United States Patent 10,706,955 (BIOINFORMATIC PROCESSES FOR DETERMINATION OF PEPTIDE BINDING) - sequence listing, part 53

SEQ ID NO: 2029145 - protein, 18 aa, Staphylococcus
LWEKLEISNDDFIRTTEK

SEQ ID NO: 2029146 - protein, 17 aa, Staphylococcus
LWENMGLSYADLIAKLI

SEQ ID NO: 2029147 - protein, 17 aa, Staphylococcus
LWENMGLSYADLITKLI

SEQ ID NO: 2029148 - protein, 20 aa, Staphylococcus
LWETLRNNFYYSAINVPKAA

SEQ ID NO: 2029149 - protein, 19 aa, Staphylococcus
LWFIQGRIDFQIKLNGYRM

SEQ ID NO: 2029150 - protein, 27 aa, Staphylococcus
LWHGSPIKRLFLDSAEPYENSNIYNYR

SEQ ID NO: 2029151 - protein, 19 aa, Staphylococcus
LWHMYRFVKGMKMFKQTLI

SEQ ID NO: 2029152 - protein, 19 aa, Staphylococcus
LWKGRLDSETDLRQFRHFQ

SEQ ID NO: 2029153 - protein, 23 aa, Staphylococcus
LWKQVVPNHMWHLYEQPQMTKEA

SEQ ID NO: 2029154 - protein, 37 aa, Staphylococcus
LWMSLVLRPNVPFAMIPKFNLFIALGIRDAIQQFSND

SEQ ID NO: 2029155 - protein, 38 aa, Staphylococcus
LWMSLVLRPNVPFSMIPKFNLFVALGIRDAIQSFTNDK

SEQ ID NO: 2029156 - protein, 25 aa, Staphylococcus
LWNQSTSLTPEWIAEYRKIYEPQTV

SEQ ID NO: 2029157 - protein, 20 aa, Staphylococcus
LWPHMSVFENVAYPLRVKKD

SEQ ID NO: 2029158 - protein, 25 aa, Staphylococcus
LWSGYRTGTIYSRPGAIMASPDEFS

SEQ ID NO: 2029159 - protein, 25 aa, Staphylococcus
LWSHIKKGIIFPAIFLNQKQIIKIK

SEQ ID NO: 2029160 - protein, 30 aa, Staphylococcus
LWSHLGWKIVFPAILPNKFQIIKISKQKMA

SEQ ID NO: 2029161 - protein, 18 aa, Staphylococcus
LWSKLEISNDDFIRTTED

SEQ ID NO: 2029162 - protein, 18 aa, Staphylococcus
LWSKLEISNDDFIRTTEQ

SEQ ID NO: 2029163 - protein, 18 aa, Staphylococcus
LWTAEVVIDLRVEYPDLK

SEQ ID NO: 2029164 - protein, 18 aa, Staphylococcus
LYAGCGIIEQSEPESELA

SEQ ID NO: 2029165 - protein, 18 aa, Staphylococcus
LYATGMRVSEVIQIEVED

SEQ ID NO: 2029166 - protein, 19 aa, Staphylococcus
LYDAPWIQWYHEQMNLKKA

SEQ ID NO: 2029167 - protein, 28 aa, Staphylococcus
LYDFAFDRFDTIEAFKYADLSQFGSHIY

SEQ ID NO: 2029168 - protein, 24 aa, Staphylococcus
LYDFTFKRFNTVADFTQEKLSHVN

SEQ ID NO: 2029169 - protein, 20 aa, Staphylococcus
LYDIGAVGMRLLTKYMNNED

SEQ ID NO: 2029170 - protein, 27 aa, Staphylococcus
LYDIIDEFKSLGGYEYDDIENRVVQFY

SEQ ID NO: 2029171 - protein, 27 aa, Staphylococcus
LYDIIDEFRSLGGYDYEEIENRVVQFY

SEQ ID NO: 2029172 - protein, 25 aa, Staphylococcus
LYDKLLPKLKEAFENIKVGDPFAED

SEQ ID NO: 2029173 - protein, 19 aa, Staphylococcus
LYDLIVEKIREAFKDKILI

SEQ ID NO: 2029174 - protein, 19 aa, Staphylococcus
LYDLIVEKIREAFKDRILI

SEQ ID NO: 2029175 - protein, 22 aa, Staphylococcus
LYDNDIRLALNRALEDDQRGLK

SEQ ID NO: 2029176 - protein, 26 aa, Staphylococcus
LYDQANCLVHPLFIDPYHLIYPSEKY

SEQ ID NO: 2029177 - protein, 25 aa, Staphylococcus
LYDSKELFKLIALESQHAGLSWLTI

SEQ ID NO: 2029178 - protein, 24 aa, Staphylococcus
LYDSLKLFKLLALESQHAGLSWLT

SEQ ID NO: 2029179 - protein, 18 aa, Staphylococcus
LYDSTGIMNLDFQPKKLV

SEQ ID NO: 2029180 - protein, 23 aa, Staphylococcus
LYDTCKTLEHIGVDLLVIRHPQN

SEQ ID NO: 2029181 - protein, 22 aa, Staphylococcus
LYDTCKTLESIGVDALVIRHPQ

SEQ ID NO: 2029182 - protein, 22 aa, Staphylococcus
LYDTCKTLESIGVDLLVIRHSQ

SEQ ID NO: 2029183 - protein, 23 aa, Staphylococcus
LYDTCKTLESIGVNLLVIRHPQN

SEQ ID NO: 2029184 - protein, 19 aa, Staphylococcus
LYDTYGFPVELTEEIATQE

SEQ ID NO: 2029185 - protein, 18 aa, Staphylococcus
LYDTYGFPVELTEELATQ

SEQ ID NO: 2029186 - protein, 23 aa, Staphylococcus
LYEAHHYKHFIYAPVGFVCEHLE

SEQ ID NO: 2029187 - protein, 33 aa, Staphylococcus
LYEALLKVGCITREFPIGVRITIGFPEQNDKMI

SEQ ID NO: 2029188 - protein, 18 aa, Staphylococcus
LYEDYSVDSFVYIPEEGY

SEQ ID NO: 2029189 - protein, 24 aa, Staphylococcus
LYEEDTRFSAYINRHRREGLNCYI

SEQ ID NO: 2029190 - protein, 18 aa, Staphylococcus
LYEEGKNCLLNFDNSYHH

SEQ ID NO: 2029191 - protein, 22 aa, Staphylococcus
LYEEMNHLLYCSSAGHEPGYVF

SEQ ID NO: 2029192 - protein, 17 aa, Staphylococcus
LYEHGFEKQYEIDYLAP

SEQ ID NO: 2029193 - protein, 18 aa, Staphylococcus
LYEIEGFNLIRSVELEIE

SEQ ID NO: 2029194 - protein, 17 aa, Staphylococcus
LYEIKHEARYGGTLFDL

SEQ ID NO: 2029195 - protein, 25 aa, Staphylococcus
LYEMVNYWIQFGVDGFRFDVINLIS

SEQ ID NO: 2029196 - protein, 26 aa, Staphylococcus
LYENEFEFVPQLKLWMATNHKPYVRG

SEQ ID NO: 2029197 - protein, 17 aa, Staphylococcus
LYEPVPHTKHIKHVKML

SEQ ID NO: 2029198 - protein, 17 aa, Staphylococcus
LYERDIDGYYLIVQQER

SEQ ID NO: 2029199 - protein, 23 aa, Staphylococcus
LYERKIPLILTFEGMDAAGKGGN

SEQ ID NO: 2029200 - protein, 25 aa, Staphylococcus
LYERKIPLILVFEGMDAAGKGGNIK

SEQ ID NO: 2029201 - protein, 17 aa, Staphylococcus
LYFDLAGKVLPYQLPNI

SEQ ID NO: 2029202 - protein, 17 aa, Staphylococcus
LYFESKNYFGYDRDHVH

SEQ ID NO: 2029203 - protein, 17 aa, Staphylococcus
LYFGEIRPVDFVVIEAG

SEQ ID NO: 2029204 - protein, 20 aa, Staphylococcus
LYFKISRHAIEMANKMKEGF

SEQ ID NO: 2029205 - protein, 17 aa, Staphylococcus
LYFKLPKDSFIFDTGGY

SEQ ID NO: 2029206 - protein, 19 aa, Staphylococcus
LYFRSMPFDSGYAVFNGLK

SEQ ID NO: 2029207 - protein, 19 aa, Staphylococcus
LYFRSMPFESGYAVFNGLK

SEQ ID NO: 2029208 - protein, 20 aa, Staphylococcus
LYFRSMPFNGGYAVFNGLKR

SEQ ID NO: 2029209 - protein, 17 aa, Staphylococcus
LYFSKGQNFIIKHINSI

SEQ ID NO: 2029210 - protein, 18 aa, Staphylococcus
LYGEVHFGVGPVIEGGFY

SEQ ID NO: 2029211 - protein, 17 aa, Staphylococcus
LYGGSELITSFIKHDLI

SEQ ID NO: 2029212 - protein, 18 aa, Staphylococcus
LYGNVQFGVGPVIEGGFY

SEQ ID NO: 2029213 - protein, 17 aa, Staphylococcus
LYGTMVFEQKSMTLDEM

SEQ ID NO: 2029214 - protein, 19 aa, Staphylococcus
LYGVSSLAALAAVMPDIKE

SEQ ID NO: 2029215 - protein, 18 aa, Staphylococcus
LYGVSSLKALAATVSEKN

SEQ ID NO: 2029216 - protein, 18 aa, Staphylococcus
LYHAYRLAIAPTQSISYV

SEQ ID NO: 2029217 - protein, 17 aa, Staphylococcus
LYHDFAKDMPIYDYHCH

SEQ ID NO: 2029218 - protein, 18 aa, Staphylococcus
LYHHFSESFQEVSSFEEL

SEQ ID NO: 2029219 - protein, 21 aa, Staphylococcus
LYHSKRPVLLITRTAEAAEQF

SEQ ID NO: 2029220 - protein, 21 aa, Staphylococcus
LYHSVPNCTLISIPTDEHDFD

SEQ ID NO: 2029221 - protein, 19 aa, Staphylococcus
LYHVSRLNIAVGGGDHLVS

SEQ ID NO: 2029222 - protein, 18 aa, Staphylococcus
LYIDGARLGYGLVSDEAD

SEQ ID NO: 2029223 - protein, 18 aa, Staphylococcus
LYIISTNLFSQVKQDVLI

SEQ ID NO: 2029224 - protein, 20 aa, Staphylococcus
LYINAYRLAERYANISTNCY

SEQ ID NO: 2029225 - protein, 19 aa, Staphylococcus
LYIPAGKYLIGKRLIIYEN

SEQ ID NO: 2029226 - protein, 18 aa, Staphylococcus
LYIYKLAVIANMKLQSLS

SEQ ID NO: 2029227 - protein, 18 aa, Staphylococcus
LYKAIIKDFHVDRLTWRD

SEQ ID NO: 2029228 - protein, 22 aa, Staphylococcus
LYKAINLDFGKFIVPKVSADML

SEQ ID NO: 2029229 - protein, 33 aa, Staphylococcus
LYKANSCKNRFCPVCAWRKARKDALGLSLMMQY

SEQ ID NO: 2029230 - protein, 25 aa, Staphylococcus
LYKAREMSVGYKFGPDTAEQNDFEI

SEQ ID NO: 2029231 - protein, 26 aa, Staphylococcus
LYKCQSCGYKYLRIRKVDVRKMRCGI

SEQ ID NO: 2029232 - protein, 21 aa, Staphylococcus
LYKEIIKQFHIDRLTWKDLFR

SEQ ID NO: 2029233 - protein, 24 aa, Staphylococcus
LYKENKKLFYAAYEFKNDKIYYKQ

SEQ ID NO: 2029234 - protein, 19 aa, Staphylococcus
LYKGCPSSFNIMRYHSLIS

SEQ ID NO: 2029235 - protein, 17 aa, Staphylococcus
LYKGKYKLAEVDSHTIN

SEQ ID NO: 2029236 - protein, 19 aa, Staphylococcus
LYKIMDKVIEEFNKDIEQN

SEQ ID NO: 2029237 - protein, 18 aa, Staphylococcus
LYKKEIVEAQILDLITPR

SEQ ID NO: 2029238 - protein, 24 aa, Staphylococcus
LYKKGHFKKLVIISTGLEDISDEE

SEQ ID NO: 2029239 - protein, 19 aa, Staphylococcus
LYKLAIESRGMFPKLSESL

SEQ ID NO: 2029240 - protein, 20 aa, Staphylococcus
LYKSICKQLEGYAWAFHTTY

SEQ ID NO: 2029241 - protein, 24 aa, Staphylococcus
LYLAALKLGIAIIPSSEMLRTKDL

SEQ ID NO: 2029242 - protein, 18 aa, Staphylococcus
LYLDESFEMGIDMDTLVH

SEQ ID NO: 2029243 - protein, 25 aa, Staphylococcus
LYLDGEFEMGIDIDTLVKFNLKKDQ

SEQ ID NO: 2029244 - protein, 19 aa, Staphylococcus
LYLEGFNFEDKKANFYPLT

SEQ ID NO: 2029245 - protein, 19 aa, Staphylococcus
LYLEGFNFENKKAKFYPLS

SEQ ID NO: 2029246 - protein, 17 aa, Staphylococcus
LYLEGSDQYRGWFNSSI

SEQ ID NO: 2029247 - protein, 18 aa, Staphylococcus
LYLEQSLLVERIKKYFHE

SEQ ID NO: 2029248 - protein, 19 aa, Staphylococcus
LYLEQSLLVERIKKYYNRQ

SEQ ID NO: 2029249 - protein, 17 aa, Staphylococcus
LYLETRHIEHIDFIDRQ

SEQ ID NO: 2029250 - protein, 17 aa, Staphylococcus
LYLISDICITDYSSVMF

SEQ ID NO: 2029251 - protein, 17 aa, Staphylococcus
LYLKGDVYSCDDDQRIK

SEQ ID NO: 2029252 - protein, 22 aa, Staphylococcus
LYLNPRASKFLDDYTEFDKTEL

SEQ ID NO: 2029253 - protein, 19 aa, Staphylococcus
LYLPYNGNLLIHGCIPVDE

SEQ ID NO: 2029254 - protein, 20 aa, Staphylococcus
LYLPYNGNLLIHGCIPVDEN

SEQ ID NO: 2029255 - protein, 18 aa, Staphylococcus
LYLVEKFNGWESRNVITY

SEQ ID NO: 2029256 - protein, 21 aa, Staphylococcus
LYMRVDPYLPYQYRNHDGEIT

SEQ ID NO: 2029257 - protein, 36 aa, Staphylococcus
LYMSDIFCLPSYREGMPRSIIEAMAMKNAILATDIR

SEQ ID NO: 2029258 - protein, 21 aa, Staphylococcus
LYMSKICSYAQGFAQMRKASE

SEQ ID NO: 2029259 - protein, 23 aa, Staphylococcus
LYMSKICSYAQGFAQMRKASEDN

SEQ ID NO: 2029260 - protein, 24 aa, Staphylococcus
LYMSKICSYAQGFAQMRKASEEHN

SEQ ID NO: 2029261 - protein, 23 aa, Staphylococcus
LYMSKICSYAQGFAQMRKASEEN

SEQ ID NO: 2029262 - protein, 21 aa, Staphylococcus
LYMSKICSYAQGFAQMRKASN

SEQ ID NO: 2029263 - protein, 21 aa, Staphylococcus
LYMSKICSYAQGFAQMRKSSE

SEQ ID NO: 2029264 - protein, 33 aa, Staphylococcus
LYMTMPAVAGMGIAIKSSVDWEQALAGVAKTTN

SEQ ID NO: 2029265 - protein, 25 aa, Staphylococcus
LYNHLKENYPNYVINYSEFTPVIAT

SEQ ID NO: 2029266 - protein, 18 aa, Staphylococcus
LYNLGGGAAKNIKIEIYI

SEQ ID NO: 2029267 - protein, 19 aa, Staphylococcus
LYNQMNIDWIKVEDIKAPS

SEQ ID NO: 2029268 - protein, 19 aa, Staphylococcus
LYNYRSFNRQDFQDVVDYL

SEQ ID NO: 2029269 - protein, 22 aa, Staphylococcus
LYPDAYVHVVGFSRGGLQGLLA

SEQ ID NO: 2029270 - protein, 24 aa, Staphylococcus
LYPDLDTWVIFPWTAGQGKVARLI

SEQ ID NO: 2029271 - protein, 17 aa, Staphylococcus
LYPDLTIYLDITAEVGR

SEQ ID NO: 2029272 - protein, 19 aa, Staphylococcus
LYPELPHSDYICFYPMNKR

SEQ ID NO: 2029273 - protein, 21 aa, Staphylococcus
LYPGQEIRISDQVLPQLRKGE

SEQ ID NO: 2029274 - protein, 22 aa, Staphylococcus
LYPGQEIRITDQILSLLQKGDA

SEQ ID NO: 2029275 - protein, 23 aa, Staphylococcus
LYPHLKGICDLIVQPFDADEIMK

SEQ ID NO: 2029276 - protein, 20 aa, Staphylococcus
LYPHSVFEISKRVILSDKVS

SEQ ID NO: 2029277 - protein, 19 aa, Staphylococcus
LYPIVKDICENVRLHGDDA

SEQ ID NO: 2029278 - protein, 22 aa, Staphylococcus
LYPLEIEKVASIKIWIDSFYVY

SEQ ID NO: 2029279 - protein, 17 aa, Staphylococcus
LYPLSYYDGDWFGKNAV

SEQ ID NO: 2029280 - protein, 28 aa, Staphylococcus
LYPMDSPGGWQIIGRTPLKVFDLNRTPM

SEQ ID NO: 2029281 - protein, 28 aa, Staphylococcus
LYPSDSPGGWQIIGRTPLKVFDINDDEM

SEQ ID NO: 2029282 - protein, 17 aa, Staphylococcus
LYQAYRYNDQLKAKIES

SEQ ID NO: 2029283 - protein, 19 aa, Staphylococcus
LYQAYRYTDKMRARIESLE

SEQ ID NO: 2029284 - protein, 21 aa, Staphylococcus
LYQAYRYTDKMRVRMESLETQ

SEQ ID NO: 2029285 - protein, 18 aa, Staphylococcus
LYQHCDIYLDINQGNEIE

SEQ ID NO: 2029286 - protein, 26 aa, Staphylococcus
LYQKDVFELVRLFGKRGRGLYNKARG

SEQ ID NO: 2029287 - protein, 25 aa, Staphylococcus
LYQKMGYEGSNIIFYFMPYLYEYGK

SEQ ID NO: 2029288 - protein, 19 aa, Staphylococcus
LYQLIVEKIREAFHDRILI

SEQ ID NO: 2029289 - protein, 22 aa, Staphylococcus
LYQQFLRKAVLKAIDTSWIEQV

SEQ ID NO: 2029290 - protein, 25 aa, Staphylococcus
LYQQKTNIIGLLFPTVANPFFGELI

SEQ ID NO: 2029291 - protein, 23 aa, Staphylococcus
LYQRGGTIYGHIMHTHLLINFVT

SEQ ID NO: 2029292 - protein, 32 aa, Staphylococcus
LYQSFLEFMNRFDIKIATTFGNRDAVSHDMKS

SEQ ID NO: 2029293 - protein, 19 aa, Staphylococcus
LYQTLPFDFLSDIVYQWER

SEQ ID NO: 2029294 - protein, 20 aa, Staphylococcus
LYRAREGACIVTGAEDILMD

SEQ ID NO: 2029295 - protein, 27 aa, Staphylococcus
LYRDTYRKLTCLHVNHGLREESIEEER

SEQ ID NO: 2029296 - protein, 18 aa, Staphylococcus
LYRECIDVNTQIKFKITI

SEQ ID NO: 2029297 - protein, 19 aa, Staphylococcus
LYRGLKLKTFNNANQLIDN

SEQ ID NO: 2029298 - protein, 24 aa, Staphylococcus
LYRHFKDKSALCTTIIEHDFTDII

SEQ ID NO: 2029299 - protein, 31 aa, Staphylococcus; identical to SEQ ID NO: 1809954

SEQ ID NO: 2029300 - protein, 23 aa, Staphylococcus
LYRLEKCKLQTGLNPKKYSDAIK

SEQ ID NO: 2029301 - protein, 23 aa, Staphylococcus
LYRNLRLWTLRGHTISEYERFRQ

SEQ ID NO: 2029302 - protein, 17 aa, Staphylococcus
LYRVRMPVKKGWHTIPL

SEQ ID NO: 2029303 - protein, 17 aa, Staphylococcus
LYSARCPQFKEAEHRKV

SEQ ID NO: 2029304 - protein, 26 aa, Staphylococcus
LYSKEWTRAVNVLKETLEEDGFTVNF

SEQ ID NO: 2029305 - protein, 17 aa, Staphylococcus
LYSKEYFAQSSLENTIS

SEQ ID NO: 2029306 - protein, 19 aa, Staphylococcus
LYSLQEMYQGFFLAPHVVS

SEQ ID NO: 2029307 - protein, 17 aa, Staphylococcus
LYSPVQFIKSTEWLIEQ

SEQ ID NO: 2029308 - protein, 17 aa, Staphylococcus
LYSRFLTLASYNLENAE

SEQ ID NO: 2029309 - protein, 18 aa, Staphylococcus
LYTKLGFKHNGDIDLYGH

SEQ ID NO: 2029310 - protein, 29 aa, Staphylococcus
LYTNWNSAVFFEWIKVFDLPMKQKVKYFS

SEQ ID NO: 2029311 - protein, 25 aa, Staphylococcus
LYTRLNFYLIDLFRKQHNTYEICEP

SEQ ID NO: 2029312 - protein, 17 aa, Staphylococcus
LYTTSILEFEPGDNVIV

SEQ ID NO: 2029313 - protein, 19 aa, Staphylococcus
LYVDDAWKERVRQTIPELP

SEQ ID NO: 2029314 - protein, 17 aa, Staphylococcus
LYVKPILDLKDKVTIMG

SEQ ID NO: 2029315 - protein, 19 aa, Staphylococcus
LYVKPILTLKEKVKIKGMN

SEQ ID NO: 2029316 - protein, 17 aa, Staphylococcus
LYVSETINIPAHTTKVV

SEQ ID NO: 2029317 - protein, 18 aa, Staphylococcus
LYVSINFKNEEINIYNKS

SEQ ID NO: 2029318 - protein, 17 aa, Staphylococcus
LYWVKKNVKPDVIVEFH

SEQ ID NO: 2029319 - protein, 18 aa, Staphylococcus
LYYAQAWCVTLSNETSEE

SEQ ID NO: 2029320 - protein, 27 aa, Staphylococcus
LYYFSIANPNPFEWLTQLVKPYQNEAQ

SEQ ID NO: 2029321 - protein, 18 aa, Staphylococcus
LYYKWLKNLSSAIESGDI

SEQ ID NO: 2029322 - protein, 18 aa, Staphylococcus
LYYLLQLLYCNNYTYETL

SEQ ID NO: 2029323 - protein, 19 aa, Staphylococcus
LYYLMSRGISQQEAERLVI

SEQ ID NO: 2029324 - protein, 18 aa, Staphylococcus
LYYQCKILANKGYSQQQI

SEQ ID NO: 2029325 - protein, 18 aa, Staphylococcus
LYYQCKILSQKGYSGQQI

SEQ ID NO: 2029326 - protein, 24 aa, Staphylococcus
LYYQCKILSRKGYSGQQIAKTINV

SEQ ID NO: 2029327 - protein, 17 aa, Staphylococcus
LYYRLFPKYTGEGLATE

SEQ ID NO: 2029328 - protein, 20 aa, Staphylococcus
LYYSELKSVQNLYRIKTHTN

SEQ ID NO: 2029329 - protein, 19 aa, Staphylococcus
LYYSELKSVQNLYRIKTYK

SEQ ID NO: 2029330 - protein, 19 aa, Staphylococcus
LYYSELKSVQNLYRILTHT

SEQ ID NO: 2029331 - protein, 19 aa, Staphylococcus
LYYSELKSVQNLYRIQANN

SEQ ID NO: 2029332 - protein, 17 aa, Staphylococcus
LYYSELKSVQNLYRNYA

SEQ ID NO: 2029333 - protein, 18 aa, Staphylococcus
LYYTHLWDGQTPVEETIQ

SEQ ID NO: 2029334 - protein, 26 aa, Staphylococcus
MAALHFDVPCLFAKKAKPSTLKDGFY

SEQ ID NO: 2029335 - protein, 20 aa, Staphylococcus
MAAVALKYPGYDFEKNVGYG

SEQ ID NO: 2029336 - protein, 20 aa, Staphylococcus
MAAYCDKESYEGFANFYIEQ

SEQ ID NO: 2029337 - protein, 27 aa, Staphylococcus
MAAYCDKESYEGFANFYIQQAKEERFH

SEQ ID NO: 2029338 - protein, 17 aa, Staphylococcus
MADHVIDNRGTLLELKQ

SEQ ID NO: 2029339 - protein, 25 aa, Staphylococcus
MADIDRFGIQEVIERSLEYLKSRNI

SEQ ID NO: 2029340 - protein, 26 aa, Staphylococcus
MADPFKSAYVASKFAQIGFTKTIALE

SEQ ID NO: 2029341 - protein, 27 aa, Staphylococcus
MAEIYGMRVAKDLVHISGDTSDYHLEG

SEQ ID NO: 2029342 - protein, 25 aa, Staphylococcus
MAEPGEYSKRAFLNGRIDLSQAEAV

SEQ ID NO: 2029343 - protein, 18 aa, Staphylococcus
MAETKLEPVPIFHKNHET

SEQ ID NO: 2029344 - protein, 25 aa, Staphylococcus
MAFDEPFYRKMAAQKWKQQDFKKAA

SEQ ID NO: 2029345 - protein, 17 aa, Staphylococcus
MAFGKVYDLLIKKVEKK

SEQ ID NO: 2029346 - protein, 25 aa, Staphylococcus
MAGDKIIIRTGANMMVHEASTMAFG

SEQ ID NO: 2029347 - protein, 24 aa, Staphylococcus
MAGKEAKGGIIYISLEPCTHFGST

SEQ ID NO: 2029348 - protein, 18 aa, Staphylococcus
MAGKGSEVGRNFEELARI

SEQ ID NO: 2029349 - protein, 19 aa, Staphylococcus
MAGKGSEVGRSFEEIAQII

SEQ ID NO: 2029350 - protein, 18 aa, Staphylococcus
MAGKGSEVGRSFEEIARI

SEQ ID NO: 2029351 - protein, 24 aa, Staphylococcus
MAGKGTEIGRSFEELARIIDGVTH

SEQ ID NO: 2029352 - protein, 23 aa, Staphylococcus
MAGLLKPKAAFELVGELKAATNL

SEQ ID NO: 2029353 - protein, 21 aa, Staphylococcus
MAGQLKSLFEQQGIDVYDGTG

SEQ ID NO: 2029354 - protein, 24 aa, Staphylococcus
MAHNVKKAIIAWGDDDYLRKLEAD

SEQ ID NO: 2029355 - protein, 24 aa, Staphylococcus
MAHNVKKAIIAWGDDEHLRKLEAD

SEQ ID NO: 2029356 - protein, 23 aa, Staphylococcus
MAHNVKKAIIAWGDDTHLRKIEA

SEQ ID NO: 2029357 - protein, 24 aa, Staphylococcus
MAHPEGYRKALRLMKQAEKFNRPI

SEQ ID NO: 2029358 - protein, 25 aa, Staphylococcus
MAIIKRDEFEMGRELLVQVRKRQLK

SEQ ID NO: 2029359 - protein, 18 aa, Staphylococcus
MAIYPCLATAGTLNLVDK

SEQ ID NO: 2029360 - protein, 19 aa, Staphylococcus
MAIYPCLFTGGTLNLVDKD

SEQ ID NO: 2029361 - protein, 17 aa, Staphylococcus
MAIYPCLVSGGTLNLVD

SEQ ID NO: 2029362 - protein, 20 aa, Staphylococcus
MAKEIVRFHSIVWPILLMAL

SEQ ID NO: 2029363 - protein, 25 aa, Staphylococcus
MAKGLQEGLLFKGIKKSFDGLDKMV

SEQ ID NO: 2029364 - protein, 18 aa, Staphylococcus
MAKIPVIHTLPAKAIIAD

SEQ ID NO: 2029365 - protein, 25 aa, Staphylococcus
MAKKDFRLILVGGDCPKVKAKPGIT

SEQ ID NO: 2029366 - protein, 18 aa, Staphylococcus
MAKSRRKKLDKIDRINKP

SEQ ID NO: 2029367 - protein, 25 aa, Staphylococcus
MAKSVKRKYTALVHDNIPHDYGTVD

SEQ ID NO: 2029368 - protein, 20 aa, Staphylococcus
MALAAKDIRIEAPIPGTSLV

SEQ ID NO: 2029369 - protein, 21 aa, Staphylococcus
MALAAKDIRIEAPIPGTSLVG

SEQ ID NO: 2029370 - protein, 19 aa, Staphylococcus
MALDVEAREPIILDDINPL

SEQ ID NO: 2029371 - protein, 17 aa, Staphylococcus
MALICPTSMIFIPCKDG

SEQ ID NO: 2029372 - protein, 19 aa, Staphylococcus
MALIGERLAKVFRIGDTVK

SEQ ID NO: 2029373 - protein, 19 aa, Staphylococcus
MAMEPKLLYVTIHPEDKEA

SEQ ID NO: 2029374 - protein, 23 aa, Staphylococcus
MAMGRLSPEKGFDILINGFKGIV

SEQ ID NO: 2029375 - protein, 28 aa, Staphylococcus
MAMPHARPEAGVIRDAFSLIILNEPVKF

SEQ ID NO: 2029376 - protein, 25 aa, Staphylococcus
MANKMKKGFIDKGYRVYFDSPTNQQ

SEQ ID NO: 2029377 - protein, 22 aa, Staphylococcus
MANKMKQGFIDKGYKVYFDSPT

SEQ ID NO: 2029378 - protein, 23 aa, Staphylococcus
MANNVKKAIIAWGDDEHLRNLKA

SEQ ID NO: 2029379 - protein, 25 aa, Staphylococcus
MAPDEIYTLVAYQLGALSAFSRIHD

SEQ ID NO: 2029380 - protein, 22 aa, Staphylococcus
MAPFSIELCGGIHVNNTAEIGL

SEQ ID NO: 2029381 - protein, 22 aa, Staphylococcus
MAPFSLELCGGIHVQNTSEIGL

SEQ ID NO: 2029382 - protein, 17 aa, Staphylococcus
MAQALYEEQVIKENNFV

SEQ ID NO: 2029383 - protein, 17 aa, Staphylococcus
MAQGVSKGNAVTDLSKK

SEQ ID NO: 2029384 - protein, 18 aa, Staphylococcus
MAQLAMRAILGEKLSDLG

SEQ ID NO: 2029385 - protein, 26 aa, Staphylococcus
MAQNADYFLDLGIKVVVITLGEQGTY

SEQ ID NO: 2029386 - protein, 21 aa, Staphylococcus
MASDASKVFKGHKMPGRMGGN

SEQ ID NO: 2029387 - protein, 20 aa, Staphylococcus
MASDASRVFKGQKAPGRMGG

SEQ ID NO: 2029388 - protein, 24 aa, Staphylococcus
MASGLPSYIYTFIGFLPRKEKDKI

SEQ ID NO: 2029389 - protein, 17 aa, Staphylococcus
MASLKVPVIAIVIGEGG

SEQ ID NO: 2029390 - protein, 18 aa, Staphylococcus
MASLKVPVIAVVIGEGGS

SEQ ID NO: 2029391 - protein, 20 aa, Staphylococcus
MASLKVPVISLVIGEGGSGG

SEQ ID NO: 2029392 - protein, 22 aa, Staphylococcus
MASRGSVIPLFIDKIKAGEPLT

SEQ ID NO: 2029393 - protein, 22 aa, Staphylococcus
MASRGSVIPLFIEKIKTGEPLT

SEQ ID NO: 2029394 - protein, 23 aa, Staphylococcus
MASSGSLPGVWPATTIESDKHFD

SEQ ID NO: 2029395 - protein, 20 aa, Staphylococcus
MASSMGRKAQINNLKATIRE

SEQ ID NO: 2029396 - protein, 22 aa, Staphylococcus
MASVLKPDIAIVTGIGSAHLST

SEQ ID NO: 2029397 - protein, 18 aa, Staphylococcus
MATIKRVREKGYSVLYMN

SEQ ID NO: 2029398 - protein, 26 aa, Staphylococcus
MATLFPNRVDLGLGRAPGTDMMTASA

SEQ ID NO: 2029399 - protein, 18 aa, Staphylococcus
MAYGHSYYDYILEIYEYV

SEQ ID NO: 2029400 - protein, 25 aa, Staphylococcus
MAYLKQRHIPMAIATSSHREDILPT

SEQ ID NO: 2029401 - protein, 23 aa, Staphylococcus
MAYNVKKGIVAWGKDEHLRKIKA

SEQ ID NO: 2029402 - protein, 18 aa, Staphylococcus
MAYSVLREDHYRVIGKTT

SEQ ID NO: 2029403 - protein, 18 aa, Staphylococcus
MAYTLAFYDNENVFFTNI

SEQ ID NO: 2029404 - protein, 20 aa, Staphylococcus
MCGGTRYRPEVLEAKVDGYS

SEQ ID NO: 2029405 - protein, 19 aa, Staphylococcus
MCGTSGLNAVERFIVGSVS

SEQ ID NO: 2029406 - protein, 26 aa, Staphylococcus
MCKQLKRAKTIYVFGYGASYVCALDI

SEQ ID NO: 2029407 - protein, 20 aa, Staphylococcus
MCMGHAKDILLYNVTIKDVV

SEQ ID NO: 2029408 - protein, 21 aa, Staphylococcus
MCRDIELHWGEPVESLRKRFQ

SEQ ID NO: 2029409 - protein, 17 aa, Staphylococcus
MDADLIVTAAFGQILPE

SEQ ID NO: 2029410 - protein, 25 aa, Staphylococcus
MDAFWPGPISFILPLKTGYLCEKVT

SEQ ID NO: 2029411 - protein, 18 aa, Staphylococcus
MDAKEKLGYFPNKNAQQL

SEQ ID NO: 2029412 - protein, 18 aa, Staphylococcus
MDAKSANIQFGFDRNTGN

SEQ ID NO: 2029413 - protein, 29 aa, Staphylococcus
MDANEFKNYILGLIFYRFLSEKNEDIAAG

SEQ ID NO: 2029414 - protein, 29 aa, Staphylococcus
MDANEFKNYILGMIFYRFLSEKIEEQAQI

SEQ ID NO: 2029415 - protein, 30 aa, Staphylococcus
MDASEFRNYILGLIFYRFLSEKAETEVAEA

SEQ ID NO: 2029416 - protein, 19 aa, Staphylococcus
MDDALKITVQYPGYSGYHV

SEQ ID NO: 2029417 - protein, 25 aa, Staphylococcus
MDDFDLKFGPILLRQKNNLFTKKWN

SEQ ID NO: 2029418 - protein, 24 aa, Staphylococcus
MDDHKVKVIAWYDNEWGYSNRVVE

SEQ ID NO: 2029419 - protein, 19 aa, Staphylococcus
MDEAIKLADKICIMSEGRV

SEQ ID NO: 2029420 - protein, 19 aa, Staphylococcus
MDEAIKLADKICIMSKGKV

SEQ ID NO: 2029421 - protein, 19 aa, Staphylococcus
MDEAIKLADKICIMSKGQI

SEQ ID NO: 2029422 - protein, 19 aa, Staphylococcus
MDEAIKLADKICIMSKGQV

SEQ ID NO: 2029423 - protein, 17 aa, Staphylococcus
MDEARIWEIGYPRNDVL

SEQ ID NO: 2029424 - protein, 19 aa, Staphylococcus
MDEFGRLLLYSSKDIVNWH

SEQ ID NO: 2029425 - protein, 23 aa, Staphylococcus
MDEIARLTPLYSGVNYDRLEGYN

SEQ ID NO: 2029426 - protein, 28 aa, Staphylococcus
MDESKLAMILVQFPPWFDCTVPNITYIR

SEQ ID NO: 2029427 - protein, 20 aa, Staphylococcus
MDFILDKLIELSAEIMPDNY

SEQ ID NO: 2029428 - protein, 25 aa, Staphylococcus
MDFRKEFNKDVVIDLVGYRRYGHNE

SEQ ID NO: 2029429 - protein, 22 aa, Staphylococcus
MDFTNLALVEFFFKKLTHYVSM

SEQ ID NO: 2029430 - protein, 24 aa, Staphylococcus
MDFVKRGAANLAILTEDPDLLSGI

SEQ ID NO: 2029431 - protein, 18 aa, Staphylococcus
MDGFLIKGTQAKILAELK

SEQ ID NO: 2029432 - protein, 19 aa, Staphylococcus
MDGPTIFNILGPMIHPYKL

SEQ ID NO: 2029433 - protein, 17 aa, Staphylococcus
MDGRDIGTVVLPNAELK

SEQ ID NO: 2029434 - protein, 20 aa, Staphylococcus
MDGRDIGTVVLPNAELKVYM

SEQ ID NO: 2029435 - protein, 18 aa, Staphylococcus
MDHFKMKPIGLIGNSGGI

SEQ ID NO: 2029436 - protein, 20 aa, Staphylococcus
MDHNCLFINVGRGTVVKEEI

SEQ ID NO: 2029437 - protein, 18 aa, Staphylococcus
MDIEWSFDYINQALNQVL

SEQ ID NO: 2029438 - protein, 17 aa, Staphylococcus
MDIIYRRLDEIPQLRTI

SEQ ID NO: 2029439 - protein, 19 aa, Staphylococcus
MDIKNMFIDIGVSSKEEAE

SEQ ID NO: 2029440 - protein, 17 aa, Staphylococcus
MDISSSLIRNRVKNKQP

SEQ ID NO: 2029441 - protein, 18 aa, Staphylococcus
MDISSSMIRERIKSKQSI

SEQ ID NO: 2029442 - protein, 18 aa, Staphylococcus
MDIVISAPFYPAYMTKER

SEQ ID NO: 2029443 - protein, 18 aa, Staphylococcus
MDKHFAPKDAFAVVMDAH

SEQ ID NO: 2029444 - protein, 24 aa, Staphylococcus
MDLKIGGIIYPTAPFNGWYMVTEI

SEQ ID NO: 2029445 - protein, 20 aa, Staphylococcus
MDLLKSDAYDDLKAIDKINS

SEQ ID NO: 2029446 - protein, 22 aa, Staphylococcus
MDLPHGIHALGYTNVPVKLDKE

SEQ ID NO: 2029447 - protein, 18 aa, Staphylococcus
MDLPNGIHALGYTNVPVK

SEQ ID NO: 2029448 - protein, 17 aa, Staphylococcus
MDLRLVDFKVEFGKTEN

SEQ ID NO: 2029449 - protein, 17 aa, Staphylococcus
MDLRLVDFKVEFGKTSD

SEQ ID NO: 2029450 - protein, 28 aa, Staphylococcus
MDMARKVAKEEGILCGISSGAAIYAAIE

SEQ ID NO: 2029451 - protein, 25 aa, Staphylococcus
MDMVDCNYMIGMAFNQLEAFKEALP

SEQ ID NO: 2029452 - protein, 21 aa, Staphylococcus
MDNGGLFGFGAMHGNHWGGQA

SEQ ID NO: 2029453 - protein, 25 aa, Staphylococcus
MDNSFEGVKRGRLVVNQDLTAPGFN

SEQ ID NO: 2029454 - protein, 28 aa, Staphylococcus
MDNYVVLRFGWLYGPGTWYGKDGMIYNQ

SEQ ID NO: 2029455 - protein, 17 aa, Staphylococcus
MDQHIPYQVLRDNIYTH

SEQ ID NO: 2029456 - protein, 27 aa, Staphylococcus
MDQYVVLRFGWLYGPGTWYGKDGMIYN

SEQ ID NO: 2029457 - protein, 19 aa, Staphylococcus
MDRFESWQLEVNKISLQEA

SEQ ID NO: 2029458 - protein, 19 aa, Staphylococcus
MDRKEAWDYNAEIKTILSK

SEQ ID NO: 2029459 - protein, 24 aa, Staphylococcus
MDRVMKPLRLMGANITGIDDNFTP

SEQ ID NO: 2029460 - protein, 23 aa, Staphylococcus
MDSGFDGFFLIAANPVDILTRYV

SEQ ID NO: 2029461 - protein, 22 aa, Staphylococcus
MDSGFDGIFLIAANPVDVLTYV

SEQ ID NO: 2029462 - protein, 22 aa, Staphylococcus
MDSTSPIDMLASWSKSEPTLKQ

SEQ ID NO: 2029463 - protein, 25 aa, Staphylococcus
MDTAFKRRFEHVYVSTKIKEEDENL

SEQ ID NO: 2029464 - protein, 18 aa, Staphylococcus
MDTLEVDGPKLLLERTED

SEQ ID NO: 2029465 - protein, 17 aa, Staphylococcus
MDTLMAIAHYRNVGMSL

SEQ ID NO: 2029466 - protein, 19 aa, Staphylococcus
MDTPSFRIGNIGDLHHKDF

SEQ ID NO: 2029467 - protein, 18 aa, Staphylococcus
MDTRKVLIAELIDQEGCS

SEQ ID NO: 2029468 - protein, 26 aa, Staphylococcus
MDVIRPKLMMKFRMLGIDHQELEDLI

SEQ ID NO: 2029469 - protein, 26 aa, Staphylococcus
MDVSKAPRVLGFDAIGVVESVGNEVT

SEQ ID NO: 2029470 - protein, 26 aa, Staphylococcus
MDWTHDEMLKVIAFFNQIERYYESSV

SEQ ID NO: 2029471 - protein, 25 aa, Staphylococcus
MDYAEYGGSVLLGLDGNVVKAHGGS

SEQ ID NO: 2029472 - protein, 19 aa, Staphylococcus
MDYDWPLTGHPAVQPRHYE

SEQ ID NO: 2029473 - protein, 18 aa, Staphylococcus
MDYEKWGAPEGMDTWDFA

SEQ ID NO: 2029474 - protein, 24 aa, Staphylococcus
MDYKHKVIDPMAGQLKSLFEQQGI

SEQ ID NO: 2029475 - protein, 24 aa, Staphylococcus
MDYLEYLGVGYLWLTPVYQSPMND

SEQ ID NO: 2029476 - protein, 24 aa, Staphylococcus
MDYVKRGAANLALITQDPDLLNGI

SEQ ID NO: 2029477 - protein, 17 aa, Staphylococcus
MDYVKSKGIECVTVHDA

SEQ ID NO: 2029478 - protein, 17 aa, Staphylococcus
MEACYQQQGVVFLLIRF

SEQ ID NO: 2029479 - protein, 21 aa, Staphylococcus
MEADLGYDLFMRTTKDIKITE

SEQ ID NO: 2029480 - protein, 19 aa, Staphylococcus
MEADLGYPLFIRTTKELKI

SEQ ID NO: 2029481 - protein, 18 aa, Staphylococcus
MEAIDRKGLIAILTSSIG

SEQ ID NO: 2029482 - protein, 24 aa, Staphylococcus
MEALKRGSGILITGGFSTAQNIID

SEQ ID NO: 2029483 - protein, 22 aa, Staphylococcus
MEALWREALHIVNDGIATTEEV

SEQ ID NO: 2029484 - protein, 21 aa, Staphylococcus
MEALWRESLHIVNEGIATTEE

SEQ ID NO: 2029485 - protein, 26 aa, Staphylococcus
MEARHPKRVDLALGRSKSYPNVFAAL

SEQ ID NO: 2029486 - protein, 35 aa, Staphylococcus
MEAVKYLIEHPEIKHGRIRIAFTPDEEIGRGPHKF

SEQ ID NO: 2029487 - protein, 18 aa, Staphylococcus
MEDARALEPVKVPIDVET

SEQ ID NO: 2029488 - protein, 23 aa, Staphylococcus
MEDFKKANPFTRFIRATATLNGK

SEQ ID NO: 2029489 - protein, 25 aa, Staphylococcus
MEDFKLYNIEGLRNFAPQQLQSKQF

SEQ ID NO: 2029490 - protein, 24 aa, Staphylococcus
MEDKKYMAALSFLTFVALDDNGKP

SEQ ID NO: 2029491 - protein, 27 aa, Staphylococcus
MEDPFTCPHGRPIIINFSNYELEKLFK

SEQ ID NO: 2029492 - protein, 27 aa, Staphylococcus
MEDPFTCPHGRPIIISFSNYELERLFK

SEQ ID NO: 2029493 - protein, 17 aa, Staphylococcus
MEECLDSKIAYSVEEVG

SEQ ID NO: 2029494 - protein, 22 aa, Staphylococcus
MEEEMFLGLRMNKGVDKVKFLS

SEQ ID NO: 2029495 - protein, 25 aa, Staphylococcus
MEEEMFLGLRMNQGVSISRFKRKFG

SEQ ID NO: 2029496 - protein, 17 aa, Staphylococcus
MEERLVLEKIDFDNNEI

SEQ ID NO: 2029497 - protein, 23 aa, Staphylococcus
MEETIKGVVLFHETLKALNVKHE

SEQ ID NO: 2029498 - protein, 24 aa, Staphylococcus
MEFEKEIIGYIGMWTVVDQAQITT

SEQ ID NO: 2029499 - protein, 17 aa, Staphylococcus
MEGKAVLFKSFAGINGV

SEQ ID NO: 2029500 - protein, 18 aa, Staphylococcus
MEGKAVLFKSFAGINGVP

SEQ ID NO: 2029501 - protein, 17 aa, Staphylococcus
MEGKAVLFKSFSGIDGV

SEQ ID NO: 2029502 - protein, 17 aa, Staphylococcus
MEGLLQLINPKIKKQSE

SEQ ID NO: 2029503 - protein, 18 aa, Staphylococcus
MEGLLQLINPTIIKVSDE

SEQ ID NO: 2029504 - protein, 36 aa, Staphylococcus
MEGSQKNAFPWVVAAFPSKAWAKRVYPNLPEEEAYS

SEQ ID NO: 2029505 - protein, 20 aa, Staphylococcus
MEHFLRFGNQEEIDYQRTHG

SEQ ID NO: 2029506 - protein, 26 aa, Staphylococcus
MEHLRLEKYQDIMLISSDDFEVGNAT

SEQ ID NO: 2029507 - protein, 18 aa, Staphylococcus
MEHPQLFIYRRNYDNQTW

SEQ ID NO: 2029508 - protein, 20 aa, Staphylococcus
MEHVLRAAMDIDDTTKQFVG

SEQ ID NO: 2029509 - protein, 19 aa, Staphylococcus
MEHYTHIGSAYCIHPNITQ

SEQ ID NO: 2029510 - protein, 20 aa, Staphylococcus
MEIDQAPSLVFFNEDVTEEG

SEQ ID NO: 2029511 - protein, 22 aa, Staphylococcus
MEIEKYDCGFSIVNENIDKFIL

SEQ ID NO: 2029512 - protein, 17 aa, Staphylococcus
MEIGIGIHGEKGLHREA

SEQ ID NO: 2029513 - protein, 17 aa, Staphylococcus
MEIPGVIAVIPLKEEGD

SEQ ID NO: 2029514 - protein, 19 aa, Staphylococcus
MEKAKEAGFKVKIHADEID

SEQ ID NO: 2029515 - protein, 18 aa, Staphylococcus
MEKAVKVVVGIAEEVAKK

SEQ ID NO: 2029516 - protein, 18 aa, Staphylococcus
MEKIGMTFLDHFEFPNLS

SEQ ID NO: 2029517 - protein, 17 aa, Staphylococcus
MEKIGMTLYDHFELPEL

SEQ ID NO: 2029518 - protein, 17 aa, Staphylococcus
MELGGLAPLIVHEDADI

SEQ ID NO: 2029519 - protein, 27 aa, Staphylococcus
MELKGENTFKVSAYRKAAQSLEVDERP

SEQ ID NO: 2029520 - protein, 17 aa, Staphylococcus
MELRLVDFKVEFGKTHD

SEQ ID NO: 2029521 - protein, 25 aa, Staphylococcus
MENNIKIGMELGYIKAPPETFIEPN

SEQ ID NO: 2029522 - protein, 24 aa, Staphylococcus
MENNIKIGMELGYIKAPPETFVEP

SEQ ID NO: 2029523 - protein, 17 aa, Staphylococcus
MEPDLIVTAAFGQILPK

SEQ ID NO: 2029524 - protein, 17 aa, Staphylococcus
MEPEEFDTCPLLLTQPS

SEQ ID NO: 2029525 - protein, 18 aa, Staphylococcus
MEQLKWKNLTLDISKYQM

SEQ ID NO: 2029526 - protein, 17 aa, Staphylococcus
MEQLYCDYQYSGIMKEM

SEQ ID NO: 2029527 - protein, 25 aa, Staphylococcus
MESARLRLGIEPEKMSVSVNKYGNT

SEQ ID NO: 2029528 - protein, 26 aa, Staphylococcus
MESFQFSVALSTVWKFISRTNKYIDE

SEQ ID NO: 2029529 - protein, 23 aa, Staphylococcus
MESIEMGCPVLSYDVRYGPNEII

SEQ ID NO: 2029530 - protein, 23 aa, Staphylococcus
MESIEVGCPVISYDVRYGPAEII

SEQ ID NO: 2029531 - protein, 23 aa, Staphylococcus
MESIEVGCPVISYDVRYGPSEII

SEQ ID NO: 2029532 - protein, 24 aa, Staphylococcus
MESLPRLLVDVDIVISSTSSENYI

SEQ ID NO: 2029533 - protein, 18 aa, Staphylococcus
MESRGMVLYINRNTRTTK

SEQ ID NO: 2029534 - protein, 20 aa, Staphylococcus
MESRLLLGTGKFDNEEIQTK

SEQ ID NO: 2029535 - protein, 27 aa, Staphylococcus
METTQWLEDYLKYFQGAIVIISHDRYF

SEQ ID NO: 2029536 - protein, 20 aa, Staphylococcus
MEVAGKLLGFPFDHNAELNK

SEQ ID NO: 2029537 - protein, 17 aa, Staphylococcus
MEVEYKPSFSNPWTYYW

SEQ ID NO: 2029538 - protein, 19 aa, Staphylococcus
MEVMKRGVTIEAIHFHSPP

SEQ ID NO: 2029539 - protein, 25 aa, Staphylococcus
MEWSEKTARLKVRMNAETPQDIKVG

SEQ ID NO: 2029540 - protein, 19 aa, Staphylococcus
MEYKESFTVAIPNYSSLAP

SEQ ID NO: 2029541 - protein, 17 aa, Staphylococcus
MFALKTAGYQSALMVPT

SEQ ID NO: 2029542 - protein, 26 aa, Staphylococcus
MFARVFRKHLEGGFIENIRQIGNDRR

SEQ ID NO: 2029543 - protein, 23 aa, Staphylococcus
MFDCVLPTRIARNGTCMTSHGRV

SEQ ID NO: 2029544 - protein, 20 aa, Staphylococcus
MFDCVLPTRIARNGTCMTSI

SEQ ID NO: 2029545 - protein, 20 aa, Staphylococcus
MFDCVLPTRIARNGTCMTSN

SEQ ID NO: 2029546 - protein, 20 aa, Staphylococcus
MFDCVLPTRIARNGTCMTSQ

SEQ ID NO: 2029547 - protein, 23 aa, Staphylococcus
MFDDWQIPIIFVTHSNYEAEQLA

SEQ ID NO: 2029548 - protein, 24 aa, Staphylococcus
MFDGELKGNIAWSNELQQKTSAFG

SEQ ID NO: 2029549 - protein, 19 aa, Staphylococcus
MFDNLKRMKAWVPIDGTYD

SEQ ID NO: 2029550 - protein, 17 aa, Staphylococcus
MFFSCNGIKDADVLTST

SEQ ID NO: 2029551 - protein, 26 aa, Staphylococcus
MFGEGCFYRKIFEDWLNYHDINIENK

SEQ ID NO: 2029552 - protein, 22 aa, Staphylococcus
MFGEGHKSFVFGPCSVESQEQV

SEQ ID NO: 2029553 - protein, 23 aa, Staphylococcus
MFGKACPTFEEIFETYYAAGQRL

SEQ ID NO: 2029554 - protein, 18 aa, Staphylococcus
MFGTCAGLIVMAKQISGE

SEQ ID NO: 2029555 - protein, 17 aa, Staphylococcus
MFHVLESLNVPYGATVN

SEQ ID NO: 2029556 - protein, 19 aa, Staphylococcus
MFIDEGFGTLDQETLETAL

SEQ ID NO: 2029557 - protein, 17 aa, Staphylococcus
MFIELNISTSATFINDV

SEQ ID NO: 2029558 - protein, 22 aa, Staphylococcus
MFMLDAGLMFPEDEMLGVDIVI

SEQ ID NO: 2029559 - protein, 22 aa, Staphylococcus
MFMLDAGLMFPEDEMLGVDVVI

SEQ ID NO: 2029560 - protein, 17 aa, Staphylococcus
MFNGVLNQSILKRAQDK

SEQ ID NO: 2029561 - protein, 18 aa, Staphylococcus
MFPDIYLHLEKEFSGQVN

SEQ ID NO: 2029562 - protein, 20 aa, Staphylococcus
MFPYPSGAGLHVGHPEGYTA

SEQ ID NO: 2029563 - protein, 18 aa, Staphylococcus
MFQYLPDFFQNESSEDNM

SEQ ID NO: 2029564 - protein, 20 aa, Staphylococcus
MFRGRKILKNISFNISEGEC

SEQ ID NO: 2029565 - protein, 21 aa, Staphylococcus
MFRHSGIFRDVYILKRSKSRV

SEQ ID NO: 2029566 - protein, 20 aa, Staphylococcus
MFTDGFELKGLNRARETYKF

SEQ ID NO: 2029567 - protein, 18 aa, Staphylococcus
MFTDGFELSGLNRATTTH

SEQ ID NO: 2029568 - protein, 18 aa, Staphylococcus
MFTLLSQWNQLYLNKDIS

SEQ ID NO: 2029569 - protein, 25 aa, Staphylococcus
MFTRVFRKHLDGGIIQDIRQIGNDR

SEQ ID NO: 2029570 - protein, 24 aa, Staphylococcus
MFVYQGAESFKIWTGEQPNIQIMK

SEQ ID NO: 2029571 - protein, 25 aa, Staphylococcus
MFVYQGAESFKIWTGKDAEIKEMKL

SEQ ID NO: 2029572 - protein, 25 aa, Staphylococcus
MFVYQGAESFKIWTGLQADIKTMKN

SEQ ID NO: 2029573 - protein, 24 aa, Staphylococcus
MFVYQGAESYRIWTGELPQIQIMK

SEQ ID NO: 2029574 - protein, 31 aa, Staphylococcus
MFYQFILRLPENIYRLKGYVRFRDTPETTYL

SEQ ID NO: 2029575 - protein, 21 aa, Staphylococcus
MGAAMLAAYGLGWFKSMEDCV

SEQ ID NO: 2029576 - protein, 24 aa, Staphylococcus
MGAGRTEMMRSLFGVDKADNEIEI

SEQ ID NO: 2029577 - protein, 20 aa, Staphylococcus
MGAKIGLVYPDFIGRNQNYR

SEQ ID NO: 2029578 - protein, 18 aa, Staphylococcus
MGAKIVAISESFGALHDS

SEQ ID NO: 2029579 - protein, 18 aa, Staphylococcus
MGALNVNMAAIWLTNSDK

SEQ ID NO: 2029580 - protein, 19 aa, Staphylococcus
MGAMLKGAQKLTVTVDGKG

SEQ ID NO: 2029581 - protein, 27 aa, Staphylococcus
MGAQHWWPAQSPIEMMLGAILVQNTNW

SEQ ID NO: 2029582 - protein, 25 aa, Staphylococcus
MGARRLKQWIDRPLIHKDNIEQRLD

SEQ ID NO: 2029583 - protein, 26 aa, Staphylococcus
MGARRLKQWIDRPLINKERIEERLSI

SEQ ID NO: 2029584 - protein, 25 aa, Staphylococcus
MGARRLKQWIDRPLIQKKQIESRLD

SEQ ID NO: 2029585 - protein, 25 aa, Staphylococcus
MGARRLKQWIDRPLIQQQEIEHRLN

SEQ ID NO: 2029586 - protein, 25 aa, Staphylococcus
MGARRLKQWIDRPLIYKQAINERLD

SEQ ID NO: 2029587 - protein, 25 aa, Staphylococcus
MGARRLKQWIDRPLIYKQQIEERLN

SEQ ID NO: 2029588 - protein, 19 aa, Staphylococcus
MGASPNGREKKLAEVIQSY

SEQ ID NO: 2029589 - protein, 17 aa, Staphylococcus
MGDFPMVAIGGINEENV

SEQ ID NO: 2029590 - protein, 18 aa, Staphylococcus
MGDIGRAFARRLKGFNTR

SEQ ID NO: 2029591 - protein, 20 aa, Staphylococcus
MGDIYPSLVASHAFTGSILP

SEQ ID NO: 2029592 - protein, 24 aa, Staphylococcus
MGDKKVKVIAWYDNEWGYSNRVVE

SEQ ID NO: 2029593 - protein, 26 aa, Staphylococcus
MGEGISELFKSMGATHIISGGQTMNP

SEQ ID NO: 2029594 - protein, 22 aa, Staphylococcus
MGEGYPVVLVHTAYENASIFQN

SEQ ID NO: 2029595 - protein, 24 aa, Staphylococcus
MGENKVKVIAWYDNEWGYSNRVVE

SEQ ID NO: 2029596 - protein, 24 aa, Staphylococcus
MGGHKAGEIASQFVTYELQKRFED

SEQ ID NO: 2029597 - protein, 21 aa, Staphylococcus
MGGHKAGEVASQFVTNQLQDY

SEQ ID NO: 2029598 - protein, 25 aa, Staphylococcus
MGGHKAGEVASQFVTYELQKRFEDE

SEQ ID NO: 2029599 - protein, 25 aa, Staphylococcus
MGGHKAGEVASQFVVNRIQEIFEEE

SEQ ID NO: 2029600 - protein, 24 aa, Staphylococcus
MGGHRAGEIASQFVTYELQKRFES

SEQ ID NO: 2029601 - protein, 26 aa, Staphylococcus
MGGLQERIWNPLQIMNDFGKDVFNPS

SEQ ID NO: 2029602 - protein, 20 aa, Staphylococcus
MGGLRYCINSAAIQFIPYDK

SEQ ID NO: 2029603 - protein, 29 aa, Staphylococcus
MGGQMIRLLEHYLRFGNQEEIDYQKEHGG

SEQ ID NO: 2029604 - protein, 30 aa, Staphylococcus
MGHSEYYPKFGFKKASNWCIQAPFEVPDEF

SEQ ID NO: 2029605 - protein, 24 aa, Staphylococcus
MGIANKRSIGFGVAKVLDELGAHL

SEQ ID NO: 2029606 - protein, 20 aa, Staphylococcus
MGIDLTSICRLDTMVTVVDA

SEQ ID NO: 2029607 - protein, 17 aa, Staphylococcus
MGIGYTVIVDKKDVSTA

SEQ ID NO: 2029608 - protein, 17 aa, Staphylococcus
MGIGYTVIVNKEDVYKT

SEQ ID NO: 2029609 - protein, 18 aa, Staphylococcus
MGIIKMKLPIEDLEKTKK

SEQ ID NO: 2029610 - protein, 21 aa, Staphylococcus
MGIKRLGAIIEQIKNYTSEDY

SEQ ID NO: 2029611 - protein, 17 aa, Staphylococcus
MGILKMKLPIEDLEKMK

SEQ ID NO: 2029612 - protein, 22 aa, Staphylococcus
MGIPKGITLIVGGGYHGKSTLL

SEQ ID NO: 2029613 - protein, 19 aa, Staphylococcus
MGIQVKRFYDVGVSGIHRL

SEQ ID NO: 2029614 - protein, 17 aa, Staphylococcus
MGKAFKKALKYMNIQAE

SEQ ID NO: 2029615 - protein, 26 aa, Staphylococcus
MGKALFAAAFVMHFSGNIPQLHFDIA

SEQ ID NO: 2029616 - protein, 19 aa, Staphylococcus
MGKCCVTGCSDVEIDTLNK

SEQ ID NO: 2029617 - protein, 23 aa, Staphylococcus
MGKCPNCGAWNQMEEIIEKKEAP

SEQ ID NO: 2029618 - protein, 23 aa, Staphylococcus
MGKCPNCGAWNQMEEIIEKTSNP

SEQ ID NO: 2029619 - protein, 23 aa, Staphylococcus
MGKCPNCGAWNQMEEIIEQKAAH

SEQ ID NO: 2029620 - protein, 19 aa, Staphylococcus
MGKCPNCGGWNQMEEIVEQ

SEQ ID NO: 2029621 - protein, 21 aa, Staphylococcus
MGKEIMLRLEKELSKLHEAFT

SEQ ID NO: 2029622 - protein, 24 aa, Staphylococcus
MGKMSGFELCKILKEDFDIPVIML

SEQ ID NO: 2029623 - protein, 19 aa, Staphylococcus
MGKPILYSLNYVKSSLVKF

SEQ ID NO: 2029624 - protein, 22 aa, Staphylococcus
MGLSSIMRAKRIILLAFGEKKI

SEQ ID NO: 2029625 - protein, 33 aa, Staphylococcus
MGMIPKLSKGSIPRFAKGSFKKKLDDYLEHPLQ

SEQ ID NO: 2029626 - protein, 19 aa, Staphylococcus
MGQKRRLSVATALSSKADI

SEQ ID NO: 2029627 - protein, 21 aa, Staphylococcus
MGQKRRLSVATALSSKADIIL

SEQ ID NO: 2029628 - protein, 18 aa, Staphylococcus
MGQKRRLSVATALSSNAD

SEQ ID NO: 2029629 - protein, 19 aa, Staphylococcus
MGQKRRLSVATALSSRADI

SEQ ID NO: 2029630 - protein, 19 aa, Staphylococcus
MGRVFLKARDIQLIPDVVL

SEQ ID NO: 2029631 - protein, 18 aa, Staphylococcus
MGSFSDKYNVRWMLHGQD

SEQ ID NO: 2029632 - protein, 18 aa, Staphylococcus
MGSTPYTLLDYFGDDWLV

SEQ ID NO: 2029633 - protein, 18 aa, Staphylococcus
MGSYDWQKTALTQGNGAT

SEQ ID NO: 2029634 - protein, 36 aa, Staphylococcus
MGTCSFDLVRHEFPILKRVAIKSMKTISDVSFYMIE

SEQ ID NO: 2029635 - protein, 22 aa, Staphylococcus
MGTSGIEYFTPILNLGETGILG

SEQ ID NO: 2029636 - protein, 22 aa, Staphylococcus
MGTSGIEYFTPILNLSETGILG

SEQ ID NO: 2029637 - protein, 22 aa, Staphylococcus
MGTTLVCAIVYDKQVVVANVGD

SEQ ID NO: 2029638 - protein, 17 aa, Staphylococcus
MGVAHGYINDQFKTSKS

SEQ ID NO: 2029639 - protein, 24 aa, Staphylococcus
MGVANKRSIGFGVAKVLDQLGAKL

SEQ ID NO: 2029640 - protein, 23 aa, Staphylococcus
MGVFTDKYGVRWMLHGQDYNAIP

SEQ ID NO: 2029641 - protein, 18 aa, Staphylococcus
MGVNFSSPFPEIKDSNDE

SEQ ID NO: 2029642 - protein, 19 aa, Staphylococcus
MGVNFSSPFPEIQNINDER

SEQ ID NO: 2029643 - protein, 24 aa, Staphylococcus
MGYLFEIIDPYSLHQQGQDIGLKY

SEQ ID NO: 2029644 - protein, 22 aa, Staphylococcus
MGYLFEIIDPYSVNKQGQDVGL

SEQ ID NO: 2029645 - protein, 20 aa, Staphylococcus
MHAKGSGAFGTFTVTNDITQ

SEQ ID NO: 2029646 - protein, 17 aa, Staphylococcus
MHAKIGIERDFTYTDLK

SEQ ID NO: 2029647 - protein, 30 aa, Staphylococcus
MHAVEMALKIKKAFVSKGYQLYIDSPTNQQ

SEQ ID NO: 2029648 - protein, 17 aa, Staphylococcus
MHEVLDLDLSKNIIESL

SEQ ID NO: 2029649 - protein, 23 aa, Staphylococcus
MHFDVPCLFAKKAKPSTLKKGVY

SEQ ID NO: 2029650 - protein, 24 aa, Staphylococcus
MHGDHIFGLPGLLTSRSFQGGEGK

SEQ ID NO: 2029651 - protein, 24 aa, Staphylococcus
MHGDHIFGLPGLLTSRSFQGGESK

SEQ ID NO: 2029652 - protein, 18 aa, Staphylococcus
MHGDHIYGLPGLLTSRSF

SEQ ID NO: 2029653 - protein, 17 aa, Staphylococcus
MHGRPLTRQGIWKMIKQ

SEQ ID NO: 2029654 - protein, 19 aa, Staphylococcus
MHGTEIYFRGKDYKLPIGT

SEQ ID NO: 2029655 - protein, 23 aa, Staphylococcus
MHHKGHLYRSSNIDMLLQQRYNN

SEQ ID NO: 2029656 - protein, 33 aa, Staphylococcus
MHHLICDNISWLILKRDFIRAINCLNNNKKITL

SEQ ID NO: 2029657 - protein, 17 aa, Staphylococcus
MHIFRKYAKDVFEEDHL

SEQ ID NO: 2029658 - protein, 22 aa, Staphylococcus
MHIGHLKSVMELLAQHDISAYI

SEQ ID NO: 2029659 - protein, 24 aa, Staphylococcus
MHKVKCYSLPIVLEISNLESVVPG

SEQ ID NO: 2029660 - protein, 20 aa, Staphylococcus
MHLDEMSIIQALETMNAEDQ

SEQ ID NO: 2029661 - protein, 18 aa, Staphylococcus
MHLITYPTQFDVIVTENL

SEQ ID NO: 2029662 - protein, 28 aa, Staphylococcus
MHMLEHILKEIGSLSCIHLISTIDNLEF

SEQ ID NO: 2029663 - protein, 20 aa, Staphylococcus
MHMVQELLNELPIFDDYVIL

SEQ ID NO: 2029664 - protein, 18 aa, Staphylococcus
MHNRMRMVTAQFLTKELF

SEQ ID NO: 2029665 - protein, 21 aa, Staphylococcus
MHNRMRMVVSQFLTKDLFIDW

SEQ ID NO: 2029666 - protein, 27 aa, Staphylococcus
MHPEYEYPFHFLCGAGVAYKLSQVLLD

SEQ ID NO: 2029667 - protein, 17 aa, Staphylococcus
MHQDLYSGRLTEVDYLN

SEQ ID NO: 2029668 - protein, 25 aa, Staphylococcus
MHQGNKSGTAWGCDLTYDYVKINAL

SEQ ID NO: 2029669 - protein, 25 aa, Staphylococcus
MHQIGDMLIQYCIEQCYGLNINQWK

SEQ ID NO: 2029670 - protein, 22 aa, Staphylococcus
MHQVEIRFLLGDTLMPLIEHGI

SEQ ID NO: 2029671 - protein, 18 aa, Staphylococcus
MHQYAIWTALATKGIGAS

SEQ ID NO: 2029672 - protein, 26 aa, Staphylococcus
MHSAKGLEFPIVFIMGMEESIFPHIR

SEQ ID NO: 2029673 - protein, 25 aa, Staphylococcus
MHSAKGLEFPIVFLMGMEESLFPHI

SEQ ID NO: 2029674 - protein, 26 aa, Staphylococcus
MHSAKGLEFPIVFLMGMEESLFPHIR

SEQ ID NO: 2029675 - protein, 17 aa, Staphylococcus
MHSLIALDSQHERLTES

SEQ ID NO: 2029676 - protein, 19 aa, Staphylococcus
MHSTLKFYQIFPRFIESLF

SEQ ID NO: 2029677 - protein, 17 aa, Staphylococcus
MHVKSFYQQPKFIQYWV

SEQ ID NO: 2029678 - protein, 21 aa, Staphylococcus
MHVLPFKTFFVPARGGLGENM

SEQ ID NO: 2029679 - protein, 17 aa, Staphylococcus
MHYDYWFTYEYEKTVYT

SEQ ID NO: 2029680 - protein, 17 aa, Staphylococcus
MIADPAIDIGMLLYNYV

SEQ ID NO: 2029681 - protein, 17 aa, Staphylococcus
MIALAISCQPDLLIADE

SEQ ID NO: 2029682 - protein, 24 aa, Staphylococcus
MIASWKIGASYVPIDITHPDKRIE

SEQ ID NO: 2029683 - protein, 21 aa, Staphylococcus
MIATGRPYRASQIYYHELNLE

SEQ ID NO: 2029684 - protein, 22 aa, Staphylococcus
MIATGRPYRASQIYYHELNMDT

SEQ ID NO: 2029685 - protein, 19 aa, Staphylococcus
MICNDAIELNEYFKDGEIS

SEQ ID NO: 2029686 - protein, 19 aa, Staphylococcus
MICNDAIELNEYFKENEVS

SEQ ID NO: 2029687 - protein, 19 aa, Staphylococcus
MICNDAIELNEYFKNGEVS

SEQ ID NO: 2029688 - protein, 18 aa, Staphylococcus
MICNDAIELNEYFNDGEI

SEQ ID NO: 2029689 - protein, 24 aa, Staphylococcus
MICTGCRISGALNLKREYINQVKS

SEQ ID NO: 2029690 - protein, 20 aa, Staphylococcus
MICTGCRISGVLNMKYEYIN

SEQ ID NO: 2029691 - protein, 18 aa, Staphylococcus
MIDACKRASAATINIVVP

SEQ ID NO: 2029692 - protein, 22 aa, Staphylococcus
MIDMEAEGLLQLINPKIKTESN

SEQ ID NO: 2029693 - protein, 20 aa, Staphylococcus
MIDNFRWAGVPFYIRTGKRM

SEQ ID NO: 2029694 - protein, 24 aa, Staphylococcus
MIDNFRWAGVPFYIRTGKRMKSKT

SEQ ID NO: 2029695 - protein, 20 aa, Staphylococcus
MIDNYKWMRNIIEAQVYDAD

SEQ ID NO: 2029696 - protein, 25 aa, Staphylococcus
MIEDLMVREQLPFGVINILLQYVML

SEQ ID NO: 2029697 - protein, 21 aa, Staphylococcus
MIEGFTVRIVNKFDADQILEI

SEQ ID NO: 2029698 - protein, 18 aa, Staphylococcus
MIEHVKTFFTQETEDNLF

SEQ ID NO: 2029699 - protein, 23 aa, Staphylococcus
MIEKFEAAHGMIVFDPNVRLPLW

SEQ ID NO: 2029700 - protein, 26 aa, Staphylococcus
MIENTDCILIGPGLGCDFKGNNAITF

SEQ ID NO: 2029701 - protein, 20 aa, Staphylococcus
MIERMSRLLKVPVLLFNPFK

SEQ ID NO: 2029702 - protein, 19 aa, Staphylococcus
MIESVLKPAFKVKKTQGNY

SEQ ID NO: 2029703 - protein, 17 aa, Staphylococcus
MIETAKIVLNWLSENDI

SEQ ID NO: 2029704 - protein, 17 aa, Staphylococcus
MIETAKIVLNWLSEQQI

SEQ ID NO: 2029705 - protein, 25 aa, Staphylococcus
MIETPRACLIAGQLAQESEFFSFGT

SEQ ID NO: 2029706 - protein, 18 aa, Staphylococcus
MIEYLRFAQSESIVTVTK

SEQ ID NO: 2029707 - protein, 19 aa, Staphylococcus
MIFDAIVFSLFGKASTEGR

SEQ ID NO: 2029708 - protein, 17 aa, Staphylococcus
MIFKIDGEFVMILIRGH

SEQ ID NO: 2029709 - protein, 17 aa, Staphylococcus
MIFWFGNLNILSANNYK

SEQ ID NO: 2029710 - protein, 24 aa, Staphylococcus
MIGGKKLKIVNYILDNVHLSNNTM

SEQ ID NO: 2029711 - protein, 17 aa, Staphylococcus
MIGKEFFEQAKPQLQII

SEQ ID NO: 2029712 - protein, 20 aa, Staphylococcus
MIHHIYRKLGKGSAYLGTNG

SEQ ID NO: 2029713 - protein, 17 aa, Staphylococcus
MIHKAYLESTAFGTKMI

SEQ ID NO: 2029714 - protein, 28 aa, Staphylococcus
MIHNHCLQCTALQFKHPILHKTISITID

SEQ ID NO: 2029715 - protein, 26 aa, Staphylococcus
MIHNLKAKGVSFVYISHRMAEIFEIS

SEQ ID NO: 2029716 - protein, 24 aa, Staphylococcus
MIIAFEKFESLPLDTLKQLYYLSK

SEQ ID NO: 2029717 - protein, 19 aa, Staphylococcus
MIIDGFVLRDPGNYKDVID

SEQ ID NO: 2029718 - protein, 18 aa, Staphylococcus
MIIELAAQVYRGILTEVR

SEQ ID NO: 2029719 - protein, 17 aa, Staphylococcus
MIIMGAGINHWFNSDTI

SEQ ID NO: 2029720 - protein, 17 aa, Staphylococcus
MIISRNKFKNCKGGIRF

SEQ ID NO: 2029721 - protein, 19 aa, Staphylococcus
MIKASKMKWIFKFEIATKD

SEQ ID NO: 2029722 - protein, 34 aa, Staphylococcus
MIKGILGKIPFFGICLGHQLFALSQGATSFKMKF

SEQ ID NO: 2029723 - protein, 20 aa, Staphylococcus
MIKNAGYTLNVWTVNKSLRA

SEQ ID NO: 2029724 - protein, 22 aa, Staphylococcus
MILDKKLKSIESYINYLSEKRV

SEQ ID NO: 2029725 - protein, 23 aa, Staphylococcus
MILYGHMSPYMIVGMLGAIKAGC

SEQ ID NO: 2029726 - protein, 18 aa, Staphylococcus
MINLEMIMDLKVLDIALK

SEQ ID NO: 2029727 - protein, 23 aa, Staphylococcus
MIPGPWEKVYLVAYMEEYASEVF

SEQ ID NO: 2029728 - protein, 17 aa, Staphylococcus
MIQYIDARDIIVVTNGM

SEQ ID NO: 2029729 - protein, 21 aa, Staphylococcus
MIREKIKPIIFVINNDGYTVE

SEQ ID NO: 2029730 - protein, 18 aa, Staphylococcus
MIRKEILVVEDIVKTVTE

SEQ ID NO: 2029731 - protein, 21 aa, Staphylococcus
MIRNQLKPIIFVINNDGYTVE

SEQ ID NO: 2029732 - protein, 20 aa, Staphylococcus
MIRQDIKPIIFVINNDGYTV

SEQ ID NO: 2029733 - protein, 20 aa, Staphylococcus
MIRQQLKPIIFVVNNDGYTV

SEQ ID NO: 2029734 - protein, 23 aa, Staphylococcus
MIRTDLEIPPFIQALTSIEEDML

SEQ ID NO: 2029735 - protein, 23 aa, Staphylococcus
MIRTDLEIPPFIQALTSIEETML

SEQ ID NO: 2029736 - protein, 20 aa, Staphylococcus
MISEARYARFNEKRQQIQDE

SEQ ID NO: 2029737 - protein, 21 aa, Staphylococcus
MISEEMRLMYVALTRAKEQLF

SEQ ID NO: 2029738 - protein, 18 aa, Staphylococcus
MISGLPHEVAQQLIQLQN

SEQ ID NO: 2029739 - protein, 18 aa, Staphylococcus
MISQEMLERFLKTHHIQY

SEQ ID NO: 2029740 - protein, 24 aa, Staphylococcus
MISYIKDRVNGMYTNQNLISSQSK

SEQ ID NO: 2029741 - protein, 22 aa, Staphylococcus
MISYIKNHVNAMYSNQNIISSK

SEQ ID NO: 2029742 - protein, 19 aa, Staphylococcus
MITKEMKFVALREGVEPEF

SEQ ID NO: 2029743 - protein, 20 aa, Staphylococcus
MITKLRAHVNHFPIVAIGGI

SEQ ID NO: 2029744 - protein, 17 aa, Staphylococcus
MITLDFGAYYHGYCSDI

SEQ ID NO: 2029745 - protein, 19 aa, Staphylococcus
MIVDGRYDPIIINKENQQF

SEQ ID NO: 2029746 - protein, 25 aa, Staphylococcus
MIVGRGGGSIEDLWNFNEEEVVRAI

SEQ ID NO: 2029747 - protein, 27 aa, Staphylococcus
MIYHRHFKLRLSYFDKSYEQLIFKQHT

SEQ ID NO: 2029748 - protein, 19 aa, Staphylococcus
MIYPSHWSNGDFGLQAPDT

SEQ ID NO: 2029749 - protein, 17 aa, Staphylococcus
MKAALAMALAHDTKLLI

SEQ ID NO: 2029750 - protein, 17 aa, Staphylococcus
MKADDTIDIIAPLGNGF

SEQ ID NO: 2029751 - protein, 18 aa, Staphylococcus
MKAELEMDVLAFNDKLDQ

SEQ ID NO: 2029752 - protein, 17 aa, Staphylococcus
MKAGMNVARLNFSHGDH

SEQ ID NO: 2029753 - protein, 17 aa, Staphylococcus
MKAGMNVARLNFSHGSH

SEQ ID NO: 2029754 - protein, 23 aa, Staphylococcus
MKAYKAQDVLNDILPTIDNIERA

SEQ ID NO: 2029755 - protein, 18 aa, Staphylococcus
MKDAVLATEDNRFYKHGA

SEQ ID NO: 2029756 - protein, 24 aa, Staphylococcus
MKDDRLELAKAFGADIVMNPSKVD

SEQ ID NO: 2029757 - protein, 22 aa, Staphylococcus
MKDESRPLFDIIKNHDDSYLRS

SEQ ID NO: 2029758 - protein, 20 aa, Staphylococcus
MKDIIGYEVDPKFYTAEQLA

SEQ ID NO: 2029759 - protein, 18 aa, Staphylococcus
MKDLIDYDMIKNGIPDES

SEQ ID NO: 2029760 - protein, 19 aa, Staphylococcus
MKDLLGGKGANLAEMKRLG

SEQ ID NO: 2029761 - protein, 17 aa, Staphylococcus
MKDLQLIVITHDPYLLN

SEQ ID NO: 2029762 - protein, 20 aa, Staphylococcus
MKDSTSYMLAEVLKGTFEAY

SEQ ID NO: 2029763 - protein, 20 aa, Staphylococcus
MKDVIGYEVEPKFFTAEQLA

SEQ ID NO: 2029764 - protein, 19 aa, Staphylococcus
MKEACYAATPAIQLAKDYL

SEQ ID NO: 2029765 - protein, 25 aa, Staphylococcus
MKEDCKSMNEGTCWCVQAYNSQRLT

SEQ ID NO: 2029766 - protein, 23 aa, Staphylococcus
MKEEPIKLLALITSNYRLFYQSK

SEQ ID NO: 2029767 - protein, 23 aa, Staphylococcus
MKEEPIKLLALITSNYRLYYQSK

SEQ ID NO: 2029768 - protein, 22 aa, Staphylococcus
MKEEPIKLLALVTSNYRLYYQC

SEQ ID NO: 2029769 - protein, 20 aa, Staphylococcus
MKEHISPILMKTEIEYKVPI

SEQ ID NO: 2029770 - protein, 23 aa, Staphylococcus
MKENIPLQLGYKALFDTTQTEVK

SEQ ID NO: 2029771 - protein, 18 aa, Staphylococcus
MKESDVIVTVYDIDTYTE

SEQ ID NO: 2029772 - protein, 19 aa, Staphylococcus
MKESIKQLRTWASQAKPPN

SEQ ID NO: 2029773 - protein, 20 aa, Staphylococcus
MKETRKMYLFNKQRTLKRLY

SEQ ID NO: 2029774 - protein, 20 aa, Staphylococcus
MKGAIQFTSPQAFETTFNLP

SEQ ID NO: 2029775 - protein, 20 aa, Staphylococcus
MKGGMSSLFYVLERLKHEGR

SEQ ID NO: 2029776 - protein, 17 aa, Staphylococcus
MKGIAFDLLEYALNYAF

SEQ ID NO: 2029777 - protein, 21 aa, Staphylococcus
MKGIWRNELLYSIDHLNICRR

SEQ ID NO: 2029778 - protein, 19 aa, Staphylococcus
MKGKRVVVRTLDIGGDKEL

SEQ ID NO: 2029779 - protein, 17 aa, Staphylococcus
MKGMIQGSDAFVFESNH

SEQ ID NO: 2029780 - protein, 17 aa, Staphylococcus
MKGMIRGSDAFMFESNH

SEQ ID NO: 2029781 - protein, 21 aa, Staphylococcus
MKGWTTDDVLAFQELTGINVT

SEQ ID NO: 2029782 - protein, 19 aa, Staphylococcus
MKGYGPSKHLMTYGEGHLE

SEQ ID NO: 2029783 - protein, 17 aa, Staphylococcus
MKHDVHLVGVKDDQNEV

SEQ ID NO: 2029784 - protein, 19 aa, Staphylococcus
MKHDVHVVGVKDDSGDVIA

SEQ ID NO: 2029785 - protein, 27 aa, Staphylococcus
MKHIKGPDFPTGGIIQGIDGIKKAYET

SEQ ID NO: 2029786 - protein, 25 aa, Staphylococcus
MKHVAMEFAQLILCNGNEQCELKLR

SEQ ID NO: 2029787 - protein, 24 aa, Staphylococcus
MKILTEFHSAPGFENDLKDYIKSE

SEQ ID NO: 2029788 - protein, 18 aa, Staphylococcus
MKKCIEFAQDIGVRNIQL

SEQ ID NO: 2029789 - protein, 20 aa, Staphylococcus
MKKGFLEKGYQLYFDSPTNQ

SEQ ID NO: 2029790 - protein, 24 aa, Staphylococcus
MKKLPGLKAMYFYKDGVSPSELGG

SEQ ID NO: 2029791 - protein, 17 aa, Staphylococcus
MKKSDVIVTVHDIDQFT

SEQ ID NO: 2029792 - protein, 18 aa, Staphylococcus
MKKWKEKEIDQRVDELLE

SEQ ID NO: 2029793 - protein, 21 aa, Staphylococcus
MKKYSEPRFNVDVLKVEVPVN

SEQ ID NO: 2029794 - protein, 18 aa, Staphylococcus
MKLDSQFYKKLGDQKFHQ

SEQ ID NO: 2029795 - protein, 20 aa, Staphylococcus
MKLEFHRNYERYQFLNWATK

SEQ ID NO: 2029796 - protein, 22 aa, Staphylococcus
MKLEQPDVIVIAGDLYDTSYPN

SEQ ID NO: 2029797 - protein, 23 aa, Staphylococcus
MKLETRPSTKIDIDGEIMFDTPV

SEQ ID NO: 2029798 - protein, 25 aa, Staphylococcus
MKLFSEPRFNVDVLKVEVPVNMKYV

SEQ ID NO: 2029799 - protein, 19 aa, Staphylococcus
MKLGQPIDITQRFHDRSFI

SEQ ID NO: 2029800 - protein, 17 aa, Staphylococcus
MKLKKNNIYICRIKARA

SEQ ID NO: 2029801 - protein, 19 aa, Staphylococcus
MKLQNPKQVLSMYPHMLSG

SEQ ID NO: 2029802 - protein, 17 aa, Staphylococcus
MKLRLVKFARTPDYNEL

SEQ ID NO: 2029803 - protein, 20 aa, Staphylococcus
MKLSATCDETLKDAEKRVNE

SEQ ID NO: 2029804 - protein, 21 aa, Staphylococcus
MKLSSACDKTLKDAENKVNQL

SEQ ID NO: 2029805 - protein, 17 aa, Staphylococcus
MKMAPEHWLCIKEDDLV

SEQ ID NO: 2029806 - protein, 17 aa, Staphylococcus
MKMKLSLALALSHHAEL

SEQ ID NO: 2029807 - protein, 24 aa, Staphylococcus
MKNEIKSGFDPALRDIKSRYVSLE

SEQ ID NO: 2029808 - protein, 25 aa, Staphylococcus
MKNIGPSTELRKWFGHDPDKFEDFK

SEQ ID NO: 2029809 - protein, 20 aa, Staphylococcus
MKPEYFIPVNGEFKMQISHA

SEQ ID NO: 2029810 - protein, 20 aa, Staphylococcus
MKPEYFIPVQGEFKMQIAHA

SEQ ID NO: 2029811 - protein, 19 aa, Staphylococcus
MKPEYFVPVQGEFKMQIAH

SEQ ID NO: 2029812 - protein, 22 aa, Staphylococcus
MKPHPLINLINVMLLEKSGADI

SEQ ID NO: 2029813 - protein, 18 aa, Staphylococcus
MKPVLEFVDGKILPLDKV

SEQ ID NO: 2029814 - protein, 19 aa, Staphylococcus
MKQAEKFGRPIFTFIDTKG

SEQ ID NO: 2029815 - protein, 19 aa, Staphylococcus
MKQAEKFNRPIFTFIDTKG

SEQ ID NO: 2029816 - protein, 23 aa, Staphylococcus
MKQANRVGAEYTIVIGEQELEDG

SEQ ID NO: 2029817 - protein, 21 aa, Staphylococcus
MKQKEVISVEWLKKYSTNFAI

SEQ ID NO: 2029818 - protein, 33 aa, Staphylococcus
MKQKTTIPLKWLQKYSYHLAIVFKDANASHQSL

SEQ ID NO: 2029819 - protein, 20 aa, Staphylococcus
MKQPIRINGINFYTLPFATV

SEQ ID NO: 2029820 - protein, 21 aa, Staphylococcus
MKQQMGCAMIFISHDLTVVNH

SEQ ID NO: 2029821 - protein, 18 aa, Staphylococcus
MKQRLVLISLLMHDPKLI

SEQ ID NO: 2029822 - protein, 17 aa, Staphylococcus
MKRGVKIEAIHFHSPPF

SEQ ID NO: 2029823 - protein, 19 aa, Staphylococcus
MKRIRNLDFQYVIASDLAS

SEQ ID NO: 2029824 - protein, 19 aa, Staphylococcus
MKRKLPKLDRLSIKETKER

SEQ ID NO: 2029825 - protein, 17 aa, Staphylococcus
MKRVISRAVPDAPHEAL

SEQ ID NO: 2029826 - protein, 22 aa, Staphylococcus
MKSGCSVCYAVLPQLDDLIQQF

SEQ ID NO: 2029827 - protein, 22 aa, Staphylococcus
MKSIAKKAVKESWSVRYLESYI

SEQ ID NO: 2029828 - protein, 21 aa, Staphylococcus
MKSISVPLQYLIAAALEVTDV

SEQ ID NO: 2029829 - protein, 18 aa, Staphylococcus
MKSLAPRDITSRALYHQQ

SEQ ID NO: 2029830 - protein, 20 aa, Staphylococcus
MKSNEFEMEPLILSLKPGAS

SEQ ID NO: 2029831 - protein, 28 aa, Staphylococcus
MKTDIYDFYALGFGEPYPISGSHGLGLG

SEQ ID NO: 2029832 - protein, 20 aa, Staphylococcus
MKTDMPNVVVFTFNDTSSWK

SEQ ID NO: 2029833 - protein, 17 aa, Staphylococcus
MKTEIEYKVPITIHDRP

SEQ ID NO: 2029834 - protein, 17 aa, Staphylococcus
MKTHIYSAFSTLKIGVD

SEQ ID NO: 2029835 - protein, 22 aa, Staphylococcus
MKTKKGPEIKIRQKVLQSLIQK

SEQ ID NO: 2029836 - protein, 17 aa, Staphylococcus
MKTVKQMSPAKHVINEK

SEQ ID NO: 2029837 - protein, 17 aa, Staphylococcus
MKVILGFSHYQSGTYEI

SEQ ID NO: 2029838 - protein, 25 aa, Staphylococcus
MKWIKENMDGWMFYPQGFQQQKALL

SEQ ID NO: 2029839 - protein, 17 aa, Staphylococcus
MKYGVATAQKGFVTKDR

SEQ ID NO: 2029840 - protein, 20 aa, Staphylococcus
MKYHIAQSYLLHGQKVEIEP

SEQ ID NO: 2029841 - protein, 27 aa, Staphylococcus
MKYIKGPDFPTGGIIQGIDGIKKAYET

SEQ ID NO: 2029842 - protein, 26 aa, Staphylococcus
MKYKQKLPCEYCNYRSVCHVDGMIDS

SEQ ID NO: 2029843 - protein, 17 aa, Staphylococcus
MKYLCKNTTFNIIFTTG

SEQ ID NO: 2029844 - protein, 21 aa, Staphylococcus
MKYSSWVQQLFHGIEYRMMQE

SEQ ID NO: 2029845 - protein, 20 aa, Staphylococcus
MKYSVQIMKTLRQLTHEVGK

SEQ ID NO: 2029846 - protein, 24 aa, Staphylococcus
MLAKLKVLYEMFGLEMVDNELSDY

SEQ ID NO: 2029847 - protein, 24 aa, Staphylococcus
MLASKFKNLCVVGDSDQSIYGWRG

SEQ ID NO: 2029848 - protein, 26 aa, Staphylococcus
MLCGCQGVNGGGWAHYVGQEKCRPIE

SEQ ID NO: 2029849 - protein, 17 aa, Staphylococcus
MLDAAVCGEIFTSPTPD

SEQ ID NO: 2029850 - protein, 19 aa, Staphylococcus
MLDALKYPFPNSNKKFELI

SEQ ID NO: 2029851 - protein, 18 aa, Staphylococcus
MLDEAGFKDAKIIASNDL

SEQ ID NO: 2029852 - protein, 19 aa, Staphylococcus
MLDEAGFKDAKIIASNDLD

SEQ ID NO: 2029853 - protein, 28 aa, Staphylococcus
MLDFRLKALKLFYKMPMPQWGGDLSELD

SEQ ID NO: 2029854 - protein, 17 aa, Staphylococcus
MLDFVGLGDKGTQYPNE

SEQ ID NO: 2029855 - protein, 22 aa, Staphylococcus
MLDGAELAELIAAHKGNFDTAI

SEQ ID NO: 2029856 - protein, 18 aa, Staphylococcus
MLDHREFTLILYVNDIVG

SEQ ID NO: 2029857 - protein, 18 aa, Staphylococcus
MLDNYKFYQNMVEADIYD

SEQ ID NO: 2029858 - protein, 18 aa, Staphylococcus
MLDPAGRKELISLIHRLK

SEQ ID NO: 2029859 - protein, 30 aa, Staphylococcus
MLDRNIPAGRGMVKWAPFATLPEQFETIHQ

SEQ ID NO: 2029860 - protein, 20 aa, Staphylococcus
MLDSKFSKIYGLRTYGYNLD

SEQ ID NO: 2029861 - protein, 24 aa, Staphylococcus
MLDYALRRRFAFFDMNPAFETIQF

SEQ ID NO: 2029862 - protein, 18 aa, Staphylococcus
MLEAIFFGHDEIKRLVEF

SEQ ID NO: 2029863 - protein, 18 aa, Staphylococcus
MLEAIFFGHEEIKRLVAF

SEQ ID NO: 2029864 - protein, 25 aa, Staphylococcus
MLEAIKILQQRSIKVVIGGMYEYGL

SEQ ID NO: 2029865 - protein, 26 aa, Staphylococcus
MLEETFPEIEFVFRKNIDEIDEADKK

SEQ ID NO: 2029866 - protein, 17 aa, Staphylococcus
MLEHREFTLILYVNDVV

SEQ ID NO: 2029867 - protein, 18 aa, Staphylococcus
MLELKRIKNVPVKLHEVP

SEQ ID NO: 2029868 - protein, 22 aa, Staphylococcus
MLEMPRIQSLWEEKYGKKATET

SEQ ID NO: 2029869 - protein, 19 aa, Staphylococcus
MLEQGLREFIICGLKSAYI

SEQ ID NO: 2029870 - protein, 17 aa, Staphylococcus
MLESIRYVDLVIPEEGW

SEQ ID NO: 2029871 - protein, 20 aa, Staphylococcus
MLEYLCKNHDDIFVTLFEKL

SEQ ID NO: 2029872 - protein, 19 aa, Staphylococcus
MLFGTLPIYPCINDENDQA

SEQ ID NO: 2029873 - protein, 24 aa, Staphylococcus
MLGDAYEFLIGRFAANAGKKAGEF

SEQ ID NO: 2029874 - protein, 25 aa, Staphylococcus
MLGDAYEFLIGRFAANAGKKAGEFY

SEQ ID NO: 2029875 - protein, 18 aa, Staphylococcus
MLGFKHKGFKEGLSKDYI

SEQ ID NO: 2029876 - protein, 18 aa, Staphylococcus
MLGGKSFIDDIFAAINQD

SEQ ID NO: 2029877 - protein, 17 aa, Staphylococcus
MLGIKYPIIQAGMAGST

SEQ ID NO: 2029878 - protein, 24 aa, Staphylococcus
MLGILKAGAGYLPIDPDYPEDRTT

SEQ ID NO: 2029879 - protein, 20 aa, Staphylococcus
MLGKYHKLFIDKKELSTDTP

SEQ ID NO: 2029880 - protein, 17 aa, Staphylococcus
MLGLLGFDIQPTADGLI

SEQ ID NO: 2029881 - protein, 22 aa, Staphylococcus
MLGMFANTLVYRGQPSNDKPWE

SEQ ID NO: 2029882 - protein, 17 aa, Staphylococcus
MLGPTGIGVLYGKRDLL

SEQ ID NO: 2029883 - protein, 17 aa, Staphylococcus
MLGPTGIGVLYGKRELL

SEQ ID NO: 2029884 - protein, 17 aa, Staphylococcus
MLGPTGIGVLYGKRQLL

SEQ ID NO: 2029885 - protein, 17 aa, Staphylococcus
MLGPTGIGVLYGKRTLL

SEQ ID NO: 2029886 - protein, 19 aa, Staphylococcus
MLGYEPSRYIQSLRGEQTK

SEQ ID NO: 2029887 - protein, 26 aa, Staphylococcus
MLIMLKRGSGVGYELIRKEKYDIALM

SEQ ID NO: 2029888 - protein, 24 aa, Staphylococcus
MLKEEPRHGYQIIKDLEEKFKGFY

SEQ ID NO: 2029889 - protein, 18 aa, Staphylococcus
MLKKDNYEIIKFFIEINE

SEQ ID NO: 2029890 - protein, 17 aa, Staphylococcus
MLKKRHLRFKITTYERD

SEQ ID NO: 2029891 - protein, 22 aa, Staphylococcus
MLKQERLLLVPLMQEQISPVEW

SEQ ID NO: 2029892 - protein, 21 aa, Staphylococcus
MLKYLYQHHWILKERKDEDQR

SEQ ID NO: 2029893 - protein, 20 aa, Staphylococcus
MLLIPEPWLYNKANDKNVRA

SEQ ID NO: 2029894 - protein, 20 aa, Staphylococcus
MLLIPEPWLYNKSNDEHVRA

SEQ ID NO: 2029895 - protein, 19 aa, Staphylococcus
MLLSHGFVMDGEGKKMSKS

SEQ ID NO: 2029896 - protein, 19 aa, Staphylococcus
MLMAICYLVTQGRIQSERS

SEQ ID NO: 2029897 - protein, 22 aa, Staphylococcus
MLMIPEPWLYNKANNANVRAFY

SEQ ID NO: 2029898 - protein, 18 aa, Staphylococcus
MLNLEAVRNHHPFELSMG

SEQ ID NO: 2029899 - protein, 28 aa, Staphylococcus
MLNTRLKGFKSGESIFIKDNDDQTFKDI

SEQ ID NO: 2029900 - protein, 21 aa, Staphylococcus
MLPDTINFFTWLQHIKDNGAT

SEQ ID NO: 2029901 - protein, 19 aa, Staphylococcus
MLPSSRLGEKQGKKLFVYG

SEQ ID NO: 2029902 - protein, 19 aa, Staphylococcus
MLPSSRLGEKQGKKLFVYS

SEQ ID NO: 2029903 - protein, 19 aa, Staphylococcus
MLPSTRLGEKQGKKLFVYG

SEQ ID NO: 2029904 - protein, 24 aa, Staphylococcus
MLQDLRKGRATEINYINGAVTKIG

SEQ ID NO: 2029905 - protein, 25 aa, Staphylococcus
MLQPGDQCPICGNTIDSPSDHLDFE

SEQ ID NO: 2029906 - protein, 17 aa, Staphylococcus
MLRCRFIDNHQQQFLKE

SEQ ID NO: 2029907 - protein, 23 aa, Staphylococcus
MLRDRHFKLKVTKLEHSYQQLLL

SEQ ID NO: 2029908 - protein, 19 aa, Staphylococcus
MLREMKDLQLIVITHDPYL

SEQ ID NO: 2029909 - protein, 25 aa, Staphylococcus
MLRIAKEICDIYSLLNRSLLYSAII

SEQ ID NO: 2029910 - protein, 18 aa, Staphylococcus
MLRLFKTDILTYQIKNSS

SEQ ID NO: 2029911 - protein, 22 aa, Staphylococcus
MLRPEAPFKKALLYAPLYPVDV

SEQ ID NO: 2029912 - protein, 21 aa, Staphylococcus
MLRPRHIQRSGYLVITSDKGL

SEQ ID NO: 2029913 - protein, 17 aa, Staphylococcus
MLRQRSGAIINLSSVVG

SEQ ID NO: 2029914 - protein, 24 aa, Staphylococcus
MLSPEGIIVLVIYPGHPEGKIESE

SEQ ID NO: 2029915 - protein, 18 aa, Staphylococcus
MLSYPEGFHILKKLNKVL

SEQ ID NO: 2029916 - protein, 19 aa, Staphylococcus
MLTALGVKFLNSDNEEIEL

SEQ ID NO: 2029917 - protein, 18 aa, Staphylococcus
MLTDCFNIRKTVFVEEQG

SEQ ID NO: 2029918 - protein, 20 aa, Staphylococcus
MLTLKPGASYKHFQPSNSDT

SEQ ID NO: 2029919 - protein, 30 aa, Staphylococcus
MLTNFFTDVKWGELDYLLLDLPPGTGDVAL

SEQ ID NO: 2029920 - protein, 17 aa, Staphylococcus
MLTNFFVEVKWGELDYL

SEQ ID NO: 2029921 - protein, 18 aa, Staphylococcus
MLTNFFVEVKWGELDYLL

SEQ ID NO: 2029922 - protein, 25 aa, Staphylococcus
MLVERPVKKRGYLVISSDRGLAGAY

SEQ ID NO: 2029923 - protein, 25 aa, Staphylococcus
MLVFEFKKHRIVYFEGGRMLIHGTT

SEQ ID NO: 2029924 - protein, 17 aa, Staphylococcus
MLVKRPLAVSGDKITLG

SEQ ID NO: 2029925 - protein, 18 aa, Staphylococcus
MLWIESIAKIQEYYIEKR

SEQ ID NO: 2029926 - protein, 18 aa, Staphylococcus
MLWMKQNEPSLWEQVSVF

SEQ ID NO: 2029927 - protein, 24 aa, Staphylococcus
MMAQEIRSLFDYQLISKDTYLKSL

SEQ ID NO: 2029928 - protein, 26 aa, Staphylococcus
MMDGVPCFLDNKWSRDTIDKLIEHFH

SEQ ID NO: 2029929 - protein, 29 aa, Staphylococcus
MMDQSEWLKRAEIYIDGFHNFSTLEYQII

SEQ ID NO: 2029930 - protein, 17 aa, Staphylococcus
MMGEVGKLGRVLGPKGL

SEQ ID NO: 2029931 - protein, 29 aa, Staphylococcus
MMIDKVIKYLCIELCSIASDIKEKQGVSL

SEQ ID NO: 2029932 - protein, 18 aa, Staphylococcus
MMLESIRYVDLVIPENDW

SEQ ID NO: 2029933 - protein, 24 aa, Staphylococcus
MMLKHLAQLYAMHWISKKRNPNDQ

SEQ ID NO: 2029934 - protein, 20 aa, Staphylococcus
MMLNALKYPYPNSNKKFEMI

SEQ ID NO: 2029935 - protein, 25 aa, Staphylococcus
MMMHIPQYVQLLFPDFNHLYLVVDT

SEQ ID NO: 2029936 - protein, 21 aa, Staphylococcus
MMMRIADKVVHEIGAHAIVNG

SEQ ID NO: 2029937 - protein, 25 aa, Staphylococcus
MMMYLPRYVQTLFPNFNHLYLVVDA

SEQ ID NO: 2029938 - protein, 19 aa, Staphylococcus
MMNALRLRESVAMGRGVHG

SEQ ID NO: 2029939 - protein, 25 aa, Staphylococcus
MMNEKDVRAVLGRFLFVQDDVKKVI

SEQ ID NO: 2029940 - protein, 19 aa, Staphylococcus
MMPRCIETYEIYLAALKLG

SEQ ID NO: 2029941 - protein, 21 aa, Staphylococcus
MMQLIKYEGTMAYKNTILKKI

SEQ ID NO: 2029942 - protein, 18 aa, Staphylococcus
MMQQWPSGLIVLSGQSGV

SEQ ID NO: 2029943 - protein, 18 aa, Staphylococcus
MMQVVSFFNAVESYYESS

SEQ ID NO: 2029944 - protein, 20 aa, Staphylococcus
MMRHIDAKTAIWVHTDMFEE

SEQ ID NO: 2029945 - protein, 24 aa, Staphylococcus
MMSKYRFSLSGGQLARVQIASVLM

SEQ ID NO: 2029946 - protein, 23 aa, Staphylococcus
MMVQLWPEFFVEGNVDIQYVIRL

SEQ ID NO: 2029947 - protein, 17 aa, Staphylococcus
MMWVSTHEPELWKKVDV

SEQ ID NO: 2029948 - protein, 23 aa, Staphylococcus
MMYRDEETWFALMNHLVSISIDY

SEQ ID NO: 2029949 - protein, 25 aa, Staphylococcus
MNAFWPGPISFILPLKQGYLCEKVT

SEQ ID NO: 2029950 - protein, 17 aa, Staphylococcus
MNANICGVEGNYTPLII

SEQ ID NO: 2029951 - protein, 25 aa, Staphylococcus
MNDGLKNVMTFTGQGLDQVWRVASL

SEQ ID NO: 2029952 - protein, 17 aa, Staphylococcus
MNDGVRNLMEFTGASLE

SEQ ID NO: 2029953 - protein, 19 aa, Staphylococcus
MNDIGCYFLDIQLEADING

SEQ ID NO: 2029954 - protein, 19 aa, Staphylococcus
MNDVGCYFLDIQLEADING

SEQ ID NO: 2029955 - protein, 20 aa, Staphylococcus
MNDVGIPVIFIINQIDKHNE

SEQ ID NO: 2029956 - protein, 25 aa, Staphylococcus
MNEFWPGPISFIVPLKKGYLCESVS

SEQ ID NO: 2029957 - protein, 17 aa, Staphylococcus
MNEIKHQLKTVVEHRER

SEQ ID NO: 2029958 - protein, 23 aa, Staphylococcus
MNEKDIRAILGRFLFVQDDVKKV

SEQ ID NO: 2029959 - protein, 25 aa, Staphylococcus
MNEKDIRAVLGRFLFVQDDVKKIIN

SEQ ID NO: 2029960 - protein, 24 aa, Staphylococcus
MNEKDVRAVLGRFLFVQEDVKKII

SEQ ID NO: 2029961 - protein, 27 aa, Staphylococcus
MNESRYCPNCGRLLHYDYIQYNQIGHY

SEQ ID NO: 2029962 - protein, 29 aa, Staphylococcus
MNESRYCPNCGRLLKYDYIHYNQIGHYHC

SEQ ID NO: 2029963 - protein, 17 aa, Staphylococcus
MNFDFYFVDIENIDTKN

SEQ ID NO: 2029964 - protein, 24 aa, Staphylococcus
MNFEERYHYMIARKYHFMGYSQMK

SEQ ID NO: 2029965 - protein, 30 aa, Staphylococcus
MNFKEYYTTLKLCRALHLLLTTRYSISAIA

SEQ ID NO: 2029966 - protein, 20 aa, Staphylococcus
MNFNMGYDMNKVVMVKNLLV

SEQ ID NO: 2029967 - protein, 21 aa, Staphylococcus
MNGEFYYRSIAYNEVEKIEYD

SEQ ID NO: 2029968 - protein, 19 aa, Staphylococcus
MNGHITLPVLLEMKKDTSF

SEQ ID NO: 2029969 - protein, 19 aa, Staphylococcus
MNGHITLPVLLEMRDNSVF

SEQ ID NO: 2029970 - protein, 19 aa, Staphylococcus
MNGHITLPVLLEMRKNKDF

SEQ ID NO: 2029971 - protein, 20 aa, Staphylococcus
MNGHITLPVLLEMRRNSQFK

SEQ ID NO: 2029972 - protein, 20 aa, Staphylococcus
MNGHLTLPVLLEARKNPQFK

SEQ ID NO: 2029973 - protein, 21 aa, Staphylococcus
MNGKLFGHVYIQDCNVRQSFE

SEQ ID NO: 2029974 - protein, 17 aa, Staphylococcus
MNGLDPKAVRDVRELIL

SEQ ID NO: 2029975 - protein, 18 aa, Staphylococcus
MNHGLPILEVDGPADKAQ

SEQ ID NO: 2029976 - protein, 26 aa, Staphylococcus
MNHLRLEKYQDLMLISQTDFEVGNSI

SEQ ID NO: 2029977 - protein, 24 aa, Staphylococcus
MNHPNQLIPLTFFVKKFKQAKSSI

SEQ ID NO: 2029978 - protein, 24 aa, Staphylococcus
MNHVLRYGDYFTVMKRGEVVETGK

SEQ ID NO: 2029979 - protein, 19 aa, Staphylococcus
MNHVYVLPQLHTLLWSNKK

SEQ ID NO: 2029980 - protein, 27 aa, Staphylococcus
MNIGGKYKFDFGTVKFVQAFHSSSYTN

SEQ ID NO: 2029981 - protein, 17 aa, Staphylococcus
MNINIDNGAAVTLTSQG

SEQ ID NO: 2029982 - protein, 19 aa, Staphylococcus
MNIPEGFTVRQYIELGRYS

SEQ ID NO: 2029983 - protein, 25 aa, Staphylococcus
MNIQIPRLMLGFKNIPPEGSKEMFM

SEQ ID NO: 2029984 - protein, 20 aa, Staphylococcus
MNLKNLFLVSLQERSVPFEL

SEQ ID NO: 2029985 - protein, 24 aa, Staphylococcus
MNLQSCLKFGALELNDTQKRALIY

SEQ ID NO: 2029986 - protein, 25 aa, Staphylococcus
MNLRLVDFKIEFGRTNEGEILLADE

SEQ ID NO: 2029987 - protein, 18 aa, Staphylococcus
MNLYDIIDEFKALGHYED

SEQ ID NO: 2029988 - protein, 17 aa, Staphylococcus
MNNIKGVQKMIRQNRKV

SEQ ID NO: 2029989 - protein, 19 aa, Staphylococcus
MNQFICAVEKELGYRLKLI

SEQ ID NO: 2029990 - protein, 25 aa, Staphylococcus
MNQIKEWYGRNLGRDYHAMISVDQV

SEQ ID NO: 2029991 - protein, 19 aa, Staphylococcus
MNQRILLPSSQLARPKLAH

SEQ ID NO: 2029992 - protein, 20 aa, Staphylococcus
MNQVGIPIIFVINQIDKHNE

SEQ ID NO: 2029993 - protein, 17 aa, Staphylococcus
MNQWSRYFMSEVGEALL

SEQ ID NO: 2029994 - protein, 22 aa, Staphylococcus
MNRIAKELNIGMGTLYRHFKDK

SEQ ID NO: 2029995 - protein, 22 aa, Staphylococcus
MNRIAQTINRFGFTIRGIYGEG

SEQ ID NO: 2029996 - protein, 22 aa, Staphylococcus
MNRIKNIWMEYVGTGLQFTHGA

SEQ ID NO: 2029997 - protein, 20 aa, Staphylococcus
MNRLEAIGLIKTYVKHGKEN

SEQ ID NO: 2029998 - protein, 17 aa, Staphylococcus
MNRQYMGQLVFNHPDKR

SEQ ID NO: 2029999 - protein, 25 aa, Staphylococcus
MNRVLKPGGMIVCLETSQPTMPVFK

SEQ ID NO: 2030000 - protein, 18 aa, Staphylococcus
MNSDIPVYAYDFDGDRYD

SEQ ID NO: 2030001 - protein, 18 aa, Staphylococcus
MNSYDWYAEHDIKLINND

SEQ ID NO: 2030002 - protein, 18 aa, Staphylococcus
MNVAIGLSGLGIDTAMVT

SEQ ID NO: 2030003 - protein, 19 aa, Staphylococcus
MNVAIGLSGLGVKTSMISA

SEQ ID NO: 2030004 - protein, 22 aa, Staphylococcus
MNVEGYKGYLFGDADTSDLKDN

SEQ ID NO: 2030005 - protein, 17 aa, Staphylococcus
MNVSYLLQESDLFDRTI

SEQ ID NO: 2030006 - protein, 21 aa, Staphylococcus
MNYEFIRVLFINMNNTRFRSL

SEQ ID NO: 2030007 - protein, 21 aa, Staphylococcus
MNYGHGPGVVTSRTISASQAA

SEQ ID NO: 2030008 - protein, 23 aa, Staphylococcus
MNYLFEIIDPYSINKQGVDEGPK

SEQ ID NO: 2030009 - protein, 17 aa, Staphylococcus
MPDMKVIMWDERLSTMA

SEQ ID NO: 2030010 - protein, 25 aa, Staphylococcus
MPDQEWRKNTGDGLSSGEKQTMYAI

SEQ ID NO: 2030011 - protein, 27 aa, Staphylococcus
MPDRMRYFCMGNALVVPLVTRIGNQIE

SEQ ID NO: 2030012 - protein, 23 aa, Staphylococcus
MPEEARPRLQLVAFSNDAPEILG

SEQ ID NO: 2030013 - protein, 19 aa, Staphylococcus
MPEEFQVPPDFTMNASFEI

SEQ ID NO: 2030014 - protein, 18 aa, Staphylococcus
MPEVKGQNILYLGGGVGF

SEQ ID NO: 2030015 - protein, 20 aa, Staphylococcus
MPEVTIRLGEWIDACPEHTR

SEQ ID NO: 2030016 - protein, 26 aa, Staphylococcus
MPFMKEIEASYSFTDYHLISTQDIGK

SEQ ID NO: 2030017 - protein, 19 aa, Staphylococcus
MPGLPKKPAALNMDVTDEG

SEQ ID NO: 2030018 - protein, 23 aa, Staphylococcus
MPISDPKTGALFTGLIVTPSNFI

SEQ ID NO: 2030019 - protein, 28 aa, Staphylococcus
MPIVLPRIKITYLYTRIEKLLQQYQLDI

SEQ ID NO: 2030020 - protein, 27 aa, Staphylococcus
MPIVLPRLRISYMYDRTKKLLKQYNLK

SEQ ID NO: 2030021 - protein, 27 aa, Staphylococcus
MPIVLPRMKITYITKRIEKLLKRYDIN

SEQ ID NO: 2030022 - protein, 25 aa, Staphylococcus
MPIVLPRMRITYLYHRTQKLLSQYH

SEQ ID NO: 2030023 - protein, 26 aa, Staphylococcus
MPKAYYRNRFSWVVSYDANDAILNEV

SEQ ID NO: 2030024 - protein, 17 aa, Staphylococcus
MPKKTGHFVRNFTKNWL

SEQ ID NO: 2030025 - protein, 22 aa, Staphylococcus
MPKTDFPMRGGLPKKEPEIQKQ

SEQ ID NO: 2030026 - protein, 22 aa, Staphylococcus
MPKTDFPMRGGLPKKEPQIQEK

SEQ ID NO: 2030027 - protein, 22 aa, Staphylococcus
MPKTEFPMRGGLPNKEPKIQEQ

SEQ ID NO: 2030028 - protein, 23 aa, Staphylococcus
MPLDDLKKVTGYIRGGCSPIGMK

SEQ ID NO: 2030029 - protein, 31 aa, Staphylococcus
MPLDEERYADMEVWLAFQYELHEVGKDSMGN

SEQ ID NO: 2030030 - protein, 19 aa, Staphylococcus
MPLHLAREYGGFKNRKVAD

SEQ ID NO: 2030031 - protein, 18 aa, Staphylococcus
MPLHLAREYGGFRNRKVA

SEQ ID NO: 2030032 - protein, 20 aa, Staphylococcus
MPNAYLKSAFEINIDKLADT

SEQ ID NO: 2030033 - protein, 20 aa, Staphylococcus
MPNQEIAKFLNINRKKVARL

SEQ ID NO: 2030034 - protein, 19 aa, Staphylococcus
MPPGESGLIATSKIVESFP

SEQ ID NO: 2030035 - protein, 21 aa, Staphylococcus
MPPHEYEAIAIELKVGQHTFT

SEQ ID NO: 2030036 - protein, 19 aa, Staphylococcus
MPPTGGLGIGIDRLVMLLT

SEQ ID NO: 2030037 - protein, 18 aa, Staphylococcus
MPRISYKANSERLANLPG

SEQ ID NO: 2030038 - protein, 25 aa, Staphylococcus
MPSHPVGRAILKAVRLPIAAPSANL

SEQ ID NO: 2030039 - protein, 17 aa, Staphylococcus
MPSQSAIKYVLEHHEQF

SEQ ID NO: 2030040 - protein, 17 aa, Staphylococcus
MPSSELLDIIHENGEDI

SEQ ID NO: 2030041 - protein, 19 aa, Staphylococcus
MPSVRKYARDNGVNIKAVA

SEQ ID NO: 2030042 - protein, 20 aa, Staphylococcus
MPSVRKYAREKGVNIKAVAG

SEQ ID NO: 2030043 - protein, 20 aa, Staphylococcus
MPSVRKYAREKGVNIKAVSG

SEQ ID NO: 2030044 - protein, 20 aa, Staphylococcus
MPSVRKYARENGVNIKAVTG

SEQ ID NO: 2030045 - protein, 24 aa, Staphylococcus
MPTHCPSCDHELVRIEGEVALRCI

SEQ ID NO: 2030046 - protein, 19 aa, Staphylococcus
MPVFFSANMSYGVHALTKI

SEQ ID NO: 2030047 - protein, 20 aa, Staphylococcus
MPVGIGSYVHYDRKLDGRIA

SEQ ID NO: 2030048 - protein, 17 aa, Staphylococcus
MPVHLKAWRKFSKKLKH

SEQ ID NO: 2030049 - protein, 25 aa, Staphylococcus
MPVKLQHIIKFSCKPVQQFYGQYDI

SEQ ID NO: 2030050 - protein, 32 aa, Staphylococcus
MPVSQLICYDLRFPEVARHSIMEGSKVIFVVA

SEQ ID NO: 2030051 - protein, 21 aa, Staphylococcus
MPVVREIAYKHCALQVPPAGY

SEQ ID NO: 2030052 - protein, 28 aa, Staphylococcus
MPYTYNNYREWFATILIRRDETQEHCDL

SEQ ID NO: 2030053 - protein, 23 aa, Staphylococcus
MQAKLHPAICFTILGHYLGVNIE

SEQ ID NO: 2030054 - protein, 23 aa, Staphylococcus
MQDEIFGPILPIITYDDFNEAVD

SEQ ID NO: 2030055 - protein, 25 aa, Staphylococcus
MQDIFIPKGQSLGVVEGHKVLVQIS

SEQ ID NO: 2030056 - protein, 18 aa, Staphylococcus
MQDSFYITEEILMRTHTS

SEQ ID NO: 2030057 - protein, 25 aa, Staphylococcus
MQEGELCFGNEPLIRVEAPLIQAQL

SEQ ID NO: 2030058 - protein, 21 aa, Staphylococcus
MQELTEYGLIPEDWGGDTIFV

SEQ ID NO: 2030059 - protein, 26 aa, Staphylococcus
MQETVEYFFKLGISTVLITLGEQGTY

SEQ ID NO: 2030060 - protein, 22 aa, Staphylococcus
MQEYDFRWEPSILSQSVSDLKV

SEQ ID NO: 2030061 - protein, 22 aa, Staphylococcus
MQFADEHTLVFGPYYRGNNGSE

SEQ ID NO: 2030062 - protein, 17 aa, Staphylococcus
MQFIKKMLESHVKYTHS

SEQ ID NO: 2030063 - protein, 24 aa, Staphylococcus
MQGAKYQLYTGMNLPMIIAYINAQ

SEQ ID NO: 2030064 - protein, 32 aa, Staphylococcus
MQGEHLCGVGVPGELCIGGAGLAKGYLNQPEL

SEQ ID NO: 2030065 - protein, 17 aa, Staphylococcus
MQGRILVYHADNPLNWQ

SEQ ID NO: 2030066 - protein, 24 aa, Staphylococcus
MQGWDHLDFVGLDALDFKHTGIEL

SEQ ID NO: 2030067 - protein, 19 aa, Staphylococcus
MQIASRFAGFSYGEADILR

SEQ ID NO: 2030068 - protein, 24 aa, Staphylococcus
MQKGKLYLPYNGNLLIHGCIPVDD

SEQ ID NO: 2030069 - protein, 24 aa, Staphylococcus
MQKLAPRVAYLAQIVKDVIEEFSK

SEQ ID NO: 2030070 - protein, 18 aa, Staphylococcus
MQKNWITPFSQRYYLATE

SEQ ID NO: 2030071 - protein, 26 aa, Staphylococcus
MQKVAINFAKLILCNNDEQCEVKVST

SEQ ID NO: 2030072 - protein, 27 aa, Staphylococcus
MQKYYPNYRYVWSFKNPKNHVVPGNAE

SEQ ID NO: 2030073 - protein, 20 aa, Staphylococcus
MQLCGIGIAGELCIAGDSLA

SEQ ID NO: 2030074 - protein, 18 aa, Staphylococcus
MQLPQFFERASFAPEGQD

SEQ ID NO: 2030075 - protein, 17 aa, Staphylococcus
MQLRDSYTLERDDESKV

SEQ ID NO: 2030076 - protein, 23 aa, Staphylococcus
MQPAVWLDFLNDIFAGDQEVIRY

SEQ ID NO: 2030077 - protein, 20 aa, Staphylococcus
MQSISIPLQYLIAAALEVTD

SEQ ID NO: 2030078 - protein, 18 aa, Staphylococcus
MQSNHLFASISVGVKKTE

SEQ ID NO: 2030079 - protein, 25 aa, Staphylococcus
MQVPLQHIIKFSCKPVQQFYGQYDI

SEQ ID NO: 2030080 - protein, 23 aa, Staphylococcus
MRAFLELREEAIILLKQGLNKYD

SEQ ID NO: 2030081 - protein, 17 aa, Staphylococcus
MRAGKAVYKNAADTVKK

SEQ ID NO: 2030082 - protein, 19 aa, Staphylococcus
MRASIMLHLPGLSIMKRMN

SEQ ID NO: 2030083 - protein, 18 aa, Staphylococcus
MRASVLVMGPLLARLGHA

SEQ ID NO: 2030084 - protein, 23 aa, Staphylococcus
MRDHCSVCHAVLPQLQDLLQEYP

SEQ ID NO: 2030085 - protein, 19 aa, Staphylococcus
MRDKISWFKEQIFKEDVNL

SEQ ID NO: 2030086 - protein, 25 aa, Staphylococcus
MRDLGRKYPGYSFENNVGYGTQQHL

SEQ ID NO: 2030087 - protein, 19 aa, Staphylococcus
MRDNPKLRGKPVIVGGKAS

SEQ ID NO: 2030088 - protein, 18 aa, Staphylococcus
MREDMSFLTRFINNSTVT

SEQ ID NO: 2030089 - protein, 18 aa, Staphylococcus
MREDMSFLTRFINRSSVS

SEQ ID NO: 2030090 - protein, 20 aa, Staphylococcus
MREDRQMLGQMMTQVHQQQQ

SEQ ID NO: 2030091 - protein, 18 aa, Staphylococcus
MREHFWTMIGKLKKENVS

SEQ ID NO: 2030092 - protein, 18 aa, Staphylococcus
MRELSYAGFGVFHDEALQ

SEQ ID NO: 2030093 - protein, 24 aa, Staphylococcus
MREPCWKIQAKYQIPDLVKRMTAS

SEQ ID NO: 2030094 - protein, 17 aa, Staphylococcus
MREPWRVIHVSKDRLGD

SEQ ID NO: 2030095 - protein, 24 aa, Staphylococcus
MREQCGVCHAVLPQLKDILDTSYP

SEQ ID NO: 2030096 - protein, 20 aa, Staphylococcus
MREQIRFYLESMSKDFKVHG

SEQ ID NO: 2030097 - protein, 22 aa, Staphylococcus
MRFKDSEYTGGHVIGEAPDFPI

SEQ ID NO: 2030098 - protein, 18 aa, Staphylococcus
MRFVDSWLVTTKFKLPKW

SEQ ID NO: 2030099 - protein, 18 aa, Staphylococcus
MRGGMTYVNMDYVGKELE

SEQ ID NO: 2030100 - protein, 17 aa, Staphylococcus
MRGYGLGQLIVKYAMSY

SEQ ID NO: 2030101 - protein, 24 aa, Staphylococcus
MRHFKRRIIITDGKITKDEELNSD

SEQ ID NO: 2030102 - protein, 26 aa, Staphylococcus
MRIARELIELIIAFMFHHQIPMRVET

SEQ ID NO: 2030103 - protein, 18 aa, Staphylococcus
MRIIKNEGKVTINELAGL

SEQ ID NO: 2030104 - protein, 20 aa, Staphylococcus
MRKEMCYLFYITSKEVVNRF

SEQ ID NO: 2030105 - protein, 21 aa, Staphylococcus
MRKGKGGFVKEFLKHPIRYTK

SEQ ID NO: 2030106 - protein, 25 aa, Staphylococcus
MRKHLEMMKVAVKFEDAEAFTQHDI

SEQ ID NO: 2030107 - protein, 18 aa, Staphylococcus
MRKIALVSILAMKPNIII

SEQ ID NO: 2030108 - protein, 23 aa, Staphylococcus
MRKIYKEKLQFILNALSPYENQL

SEQ ID NO: 2030109 - protein, 18 aa, Staphylococcus
MRKIYRDKLNYILHHLKK

SEQ ID NO: 2030110 - protein, 26 aa, Staphylococcus
MRKQLLYLKERFRQIEQSLKNHHTSF

SEQ ID NO: 2030111 - protein, 25 aa, Staphylococcus
MRKSHFKNCDFRISRNAEIAQQEMR

SEQ ID NO: 2030112 - protein, 21 aa, Staphylococcus
MRKSYYNQRHHIYDSTITGKR

SEQ ID NO: 2030113 - protein, 19 aa, Staphylococcus
MRLIKTNILTNHFKDSAYL

SEQ ID NO: 2030114 - protein, 19 aa, Staphylococcus
MRLKKLYKILNKINRYSED

SEQ ID NO: 2030115 - protein, 19 aa, Staphylococcus
MRLRQNPMRLAKALRDYGT

SEQ ID NO: 2030116 - protein, 22 aa, Staphylococcus
MRLSEVKLGVDLGYIELSDFNF

SEQ ID NO: 2030117 - protein, 19 aa, Staphylococcus
MRMKAAIAIALAHDSQLLI

SEQ ID NO: 2030118 - protein, 17 aa, Staphylococcus
MRMKAALAIALSHETKL

SEQ ID NO: 2030119 - protein, 24 aa, Staphylococcus
MRNDTRLNDGLTYLLSALTYDNQT

SEQ ID NO: 2030120 - protein, 18 aa, Staphylococcus
MRNGYAVSNDITFADYFY

SEQ ID NO: 2030121 - protein, 20 aa, Staphylococcus
MRNQMKSVRVDTILHTMPLT

SEQ ID NO: 2030122 - protein, 25 aa, Staphylococcus
MRPQLSMTFPFGFDDVYLIQAEVQL

SEQ ID NO: 2030123 - protein, 23 aa, Staphylococcus
MRQEEVSMLLAIDNKRLLKGSIT

SEQ ID NO: 2030124 - protein, 18 aa, Staphylococcus
MRQEPLDHVLLFGPPGLG

SEQ ID NO: 2030125 - protein, 17 aa, Staphylococcus
MRRAEPLLKSFRLEKEL

SEQ ID NO: 2030126 - protein, 27 aa, Staphylococcus
MRRDDCPTCGKHASFPYLYTHSTSYAT

SEQ ID NO: 2030127 - protein, 21 aa, Staphylococcus
MRRNIGMIFQHFNLVKRSTVL

SEQ ID NO: 2030128 - protein, 20 aa, Staphylococcus
MRRNIGMIFQNFNLVKRSSV

SEQ ID NO: 2030129 - protein, 18 aa, Staphylococcus
MRRSFKFDGRKIRLVSNI

SEQ ID NO: 2030130 - protein, 18 aa, Staphylococcus
MRRSHLTNTLVLFSNHKN

SEQ ID NO: 2030131 - protein, 24 aa, Staphylococcus
MRRSHNQRFLIVFSDGEPSAYNYS

SEQ ID NO: 2030132 - protein, 20 aa, Staphylococcus
MRRYKEAFDKSGIDYNISYA

SEQ ID NO: 2030133 - protein, 20 aa, Staphylococcus
MRSAALEYAKYGITVNAVQP

SEQ ID NO: 2030134 - protein, 19 aa, Staphylococcus
MRSNIASLAKVVFEVARSG

SEQ ID NO: 2030135 - protein, 22 aa, Staphylococcus
MRSQLYRMIREFGGELNNNAYL

SEQ ID NO: 2030136 - protein, 35 aa, Staphylococcus
MRTDIYDFYALGFGEPFPISGSHGLGLGDLLDEVA

SEQ ID NO: 2030137 - protein, 17 aa, Staphylococcus
MRTRIITSPAFNGEKIL

SEQ ID NO: 2030138 - protein, 19 aa, Staphylococcus
MRVEGIIILVIYHGHDEGK

SEQ ID NO: 2030139 - protein, 17 aa, Staphylococcus
MSADIEGFLFLDADDQY

SEQ ID NO: 2030140 - protein, 20 aa, Staphylococcus
MSAGLFIVGRIKGVSRPALV

SEQ ID NO: 2030141 - protein, 18 aa, Staphylococcus
MSAGVKRLQEFDIVKQQF

SEQ ID NO: 2030142 - protein, 17 aa, Staphylococcus
MSAKITGAGCLLGGIIT

SEQ ID NO: 2030143 - protein, 21 aa, Staphylococcus
MSAKLGFKVTVHMSTDARQWK

SEQ ID NO: 2030144 - protein, 17 aa, Staphylococcus
MSAQIGAEFLQKVKGGM

SEQ ID NO: 2030145 - protein, 20 aa, Staphylococcus
MSASRAYLRPAMKRKNLDVE

SEQ ID NO: 2030146 - protein, 19 aa, Staphylococcus
MSASRAYLRPAMKRKNLTV

SEQ ID NO: 2030147 - protein, 25 aa, Staphylococcus
MSASRAYLRPAMRRRNLDVETRAFV

SEQ ID NO: 2030148 - protein, 18 aa, Staphylococcus
MSCEHCRNAVESALAKLN

SEQ ID NO: 2030149 - protein, 18 aa, Staphylococcus
MSCQHCKDSVESALANLN

SEQ ID NO: 2030150 - protein, 18 aa, Staphylococcus
MSDREKFEAFKLEKINEN

SEQ ID NO: 2030151 - protein, 24 aa, Staphylococcus
MSEERTVEVPVHLVGEAVGAKEGG

SEQ ID NO: 2030152 - protein, 27 aa, Staphylococcus
MSEERTVEVPVHLVGEAVGAKEGGVVE

SEQ ID NO: 2030153 - protein, 27 aa, Staphylococcus
MSEFDIPRVLGDIIICTDVAQEQSESY

SEQ ID NO: 2030154 - protein, 24 aa, Staphylococcus
MSEIKAVLQVPIPVYAIGGITEDT

SEQ ID NO: 2030155 - protein, 18 aa, Staphylococcus
MSEKLGIELHVKYEGANP

SEQ ID NO: 2030156 - protein, 22 aa, Staphylococcus
MSELLYDVDLIFGYEPLSLPGE

SEQ ID NO: 2030157 - protein, 19 aa, Staphylococcus
MSELRAMLIERKYKDIFEF

SEQ ID NO: 2030158 - protein, 17 aa, Staphylococcus
MSELVILLYKEYAGMYF

SEQ ID NO: 2030159 - protein, 17 aa, Staphylococcus
MSESARGEGGRIWTYKD

SEQ ID NO: 2030160 - protein, 18 aa, Staphylococcus
MSFDTMVLFGDHAASPHG

SEQ ID NO: 2030161 - protein, 19 aa, Staphylococcus
MSFDTMVLFGDHAASPHGV

SEQ ID NO: 2030162 - protein, 18 aa, Staphylococcus
MSGFDKLKVMVPKNSEQE

SEQ ID NO: 2030163 - protein, 18 aa, Staphylococcus
MSGFHEIELLSSIAEPDI

SEQ ID NO: 2030164 - protein, 18 aa, Staphylococcus
MSGFHEIELLSSIAQPDI

SEQ ID NO: 2030165 - protein, 22 aa, Staphylococcus
MSGHLHVHLASYLIIDEADLMI

SEQ ID NO: 2030166 - protein, 26 aa, Staphylococcus
MSGKELRDTLHFEMLWDTSKIDVIIR

SEQ ID NO: 2030167 - protein, 21 aa, Staphylococcus
MSGKIAGLLSFVDSEILALSE

SEQ ID NO: 2030168 - protein, 17 aa, Staphylococcus
MSGLCNHWLSTSRDTAE

SEQ ID NO: 2030169 - protein, 23 aa, Staphylococcus
MSHPNKLIPLTHFVKKFKQAKSS

SEQ ID NO: 2030170 - protein, 19 aa, Staphylococcus
MSIASGVKVQGCIKDIPEL

SEQ ID NO: 2030171 - protein, 17 aa, Staphylococcus
MSIGERTAFAYKVMTDI

SEQ ID NO: 2030172 - protein, 23 aa, Staphylococcus
MSIIVLLKCMNRFGFTAFFNHSA

SEQ ID NO: 2030173 - protein, 25 aa, Staphylococcus
MSIVVLLKCMSKFGFTASFNQCVIT

SEQ ID NO: 2030174 - protein, 29 aa, Staphylococcus
MSKEEILILLNLWEKGSMTLKEMDEFVEI

SEQ ID NO: 2030175 - protein, 19 aa, Staphylococcus
MSKGSFKRAIGHLYKKKII

SEQ ID NO: 2030176 - protein, 19 aa, Staphylococcus
MSKGSFKRAIGHLYKNKII

SEQ ID NO: 2030177 - protein, 20 aa, Staphylococcus
MSKGSFKRAIGHLYKQKIIN

SEQ ID NO: 2030178 - protein, 19 aa, Staphylococcus
MSKGSFKRAIGHLYKRKII

SEQ ID NO: 2030179 - protein, 21 aa, Staphylococcus
MSKSLGNFVLVHDIIKEVDPD

SEQ ID NO: 2030180 - protein, 21 aa, Staphylococcus
MSKSLGNFVLVHDIIKQIDPD

SEQ ID NO: 2030181 - protein, 24 aa, Staphylococcus
MSLGRTSTFLDIYAERDLKNGDIT

SEQ ID NO: 2030182 - protein, 23 aa, Staphylococcus
MSLGRTSTFLDIYAERDLNNGTI

SEQ ID NO: 2030183 - protein, 23 aa, Staphylococcus
MSLGRTSTFLDIYAERDLQDGVL

SEQ ID NO: 2030184 - protein, 23 aa, Staphylococcus
MSLLKADPFWKEGLVADYTIEQW

SEQ ID NO: 2030185 - protein, 18 aa, Staphylococcus
MSMAEWQKVLDINLTGAF

SEQ ID NO: 2030186 - protein, 17 aa, Staphylococcus
MSMRKFIGILGDFHQLY

SEQ ID NO: 2030187 - protein, 18 aa, Staphylococcus
MSNAEWQKVIDINLTGAF

SEQ ID NO: 2030188 - protein, 22 aa, Staphylococcus
MSNCKIPDILQDLYKKGVGRLL

SEQ ID NO: 2030189 - protein, 23 aa, Staphylococcus
MSNIDFRLILVGGDCPKVKAKPC

SEQ ID NO: 2030190 - protein, 47 aa, Staphylococcus
MSNNSYRWLLRFDWARPEHVHFASAYHILDLVFWFGKMDILQGHSIK

SEQ ID NO: 2030191 - protein, 17 aa, Staphylococcus
MSNSEFGSIPSRVPLKS

SEQ ID NO: 2030192 - protein, 19 aa, Staphylococcus
MSPLSKIFWMKHEKPEVYN

SEQ ID NO: 2030193 - protein, 19 aa, Staphylococcus
MSPLSKIFWMKHEQPDIFN

SEQ ID NO: 2030194 - protein, 18 aa, Staphylococcus
MSPLSKIFWMKHEQQEIF

SEQ ID NO: 2030195 - protein, 18 aa, Staphylococcus
MSPLSKIFWMKHEQSDIY

SEQ ID NO: 2030196 - protein, 17 aa, Staphylococcus
MSPPVIVKEDMTVYDAI

SEQ ID NO: 2030197 - protein, 26 aa, Staphylococcus
MSPRALEEVIYFASYVVVNPGPTGLE

SEQ ID NO: 2030198 - protein, 17 aa, Staphylococcus
MSPSELMAFGDANNDKD

SEQ ID NO: 2030199 - protein, 17 aa, Staphylococcus
MSPYMIVGMLASLKAGC

SEQ ID NO: 2030200 - protein, 17 aa, Staphylococcus
MSQAYIGYHLQQSLQNE

SEQ ID NO: 2030201 - protein, 19 aa, Staphylococcus
MSQEFSKMMLGEEYEISED

SEQ ID NO: 2030202 - protein, 23 aa, Staphylococcus
MSQLRVVIDLGDEPDLYLQISAI

SEQ ID NO: 2030203 - protein, 19 aa, Staphylococcus
MSRFDNWDLKVHTLTLEEA

SEQ ID NO: 2030204 - protein, 17 aa, Staphylococcus
MSRLVKEKCDFYIKIPM

SEQ ID NO: 2030205 - protein, 22 aa, Staphylococcus
MSRRIAVDLYDEIIRLKPEWHS

SEQ ID NO: 2030206 - protein, 17 aa, Staphylococcus
MSRRKKTAAKKLLEVSN

SEQ ID NO: 2030207 - protein, 19 aa, Staphylococcus
MSRSEGFGDEVKRRIFLGT

SEQ ID NO: 2030208 - protein, 20 aa, Staphylococcus
MSRSEGFGDEVKRRIFLGTF

SEQ ID NO: 2030209 - protein, 24 aa, Staphylococcus
MSSFRDLFNKIGWLNKDKMEQALK

SEQ ID NO: 2030210 - protein, 22 aa, Staphylococcus
MSSLFKSTGMALMSNIGGASGP

SEQ ID NO: 2030211 - protein, 19 aa, Staphylococcus
MSSQFNLSVEDIKNTLGNT

SEQ ID NO: 2030212 - protein, 23 aa, Staphylococcus
MSSSGKTGFYMRVLKEGYVQQQD

SEQ ID NO: 2030213 - protein, 20 aa, Staphylococcus
MSSSSLKMYTLDDENIVTGD

SEQ ID NO: 2030214 - protein, 25 aa, Staphylococcus
MSVGGRQLVKVAAWYDNEMSYTAQL

SEQ ID NO: 2030215 - protein, 19 aa, Staphylococcus
MSVGMAMAEDHLAGKFNKP

SEQ ID NO: 2030216 - protein, 18 aa, Staphylococcus
MSVGMAMAEKHLAGKFNK

SEQ ID NO: 2030217 - protein, 17 aa, Staphylococcus
MSVGYQFGEDTAEQQAF

SEQ ID NO: 2030218 - protein, 24 aa, Staphylococcus
MSVSDFQDCLGLNNADSFRDLIKV

SEQ ID NO: 2030219 - protein, 19 aa, Staphylococcus
MSVVPIPGLDFGVDIKLMR

SEQ ID NO: 2030220 - protein, 24 aa, Staphylococcus
MSYGIKYASSFFGPFRDAAESTPQ

SEQ ID NO: 2030221 - protein, 23 aa, Staphylococcus
MSYLKVHYPHYFYANILSNVVGN

SEQ ID NO: 2030222 - protein, 18 aa, Staphylococcus
MSYNNGWGHIVADGSLAN

SEQ ID NO: 2030223 - protein, 21 aa, Staphylococcus
MTANSPFWYTIPDYPDGSQYN

SEQ ID NO: 2030224 - protein, 26 aa, Staphylococcus
MTASERLKFGEVYANCEAEEVVNGYH

SEQ ID NO: 2030225 - protein, 17 aa, Staphylococcus
MTATAMMGAMLKGDQKL

SEQ ID NO: 2030226 - protein, 30 aa, Staphylococcus
MTCLTRAALNIAEAGPFIISNEGCYDEIIN

SEQ ID NO: 2030227 - protein, 17 aa, Staphylococcus
MTDFMFFASAIMVLLHK

SEQ ID NO: 2030228 - protein, 17 aa, Staphylococcus
MTDGSCWCVRAYQNEKL

SEQ ID NO: 2030229 - protein, 25 aa, Staphylococcus
MTDNYMKFCIKPIIEKITDELNAKL

SEQ ID NO: 2030230 - protein, 18 aa, Staphylococcus
MTDVYPRFSELLSANHVD

SEQ ID NO: 2030231 - protein, 18 aa, Staphylococcus
MTDYCYRNYQAYLKDAII

SEQ ID NO: 2030232 - protein, 21 aa, Staphylococcus
MTEDISYPFVVLSRSDGRMNI

SEQ ID NO: 2030233 - protein, 26 aa, Staphylococcus
MTEERTVEVPVHLVGEAVGAKEGGVV

SEQ ID NO: 2030234 - protein, 19 aa, Staphylococcus
MTEIKFRNREYLNIIYETD

SEQ ID NO: 2030235 - protein, 21 aa, Staphylococcus
MTELMNFDALQLVGKNMTADQ

SEQ ID NO: 2030236 - protein, 19 aa, Staphylococcus
MTERVLRAETDMLKKQELI

SEQ ID NO: 2030237 - protein, 19 aa, Staphylococcus
MTERVLRSETDMLKKQELI

SEQ ID NO: 2030238 - protein, 22 aa, Staphylococcus
MTEVQKGIAYECYLNKDREFYI

SEQ ID NO: 2030239 - protein, 23 aa, Staphylococcus
MTFPHQMMRVILIEQVYRTFKIM

SEQ ID NO: 2030240 - protein, 20 aa, Staphylococcus
MTGDISMEYSDAAGTLLLNT

SEQ ID NO: 2030241 - protein, 25 aa, Staphylococcus
MTGLIGVTVPSWFLKSVTNSTVLGE

SEQ ID NO: 2030242 - protein, 29 aa, Staphylococcus
MTHIQLIGIAFNFMCFKSSAPTEEDILKI

SEQ ID NO: 2030243 - protein, 25 aa, Staphylococcus
MTHLSRFAEEIIFWSTDEAKFITLS

SEQ ID NO: 2030244 - protein, 21 aa, Staphylococcus
MTHPRYKIKKKYVAKLKGYLM

SEQ ID NO: 2030245 - protein, 22 aa, Staphylococcus
MTHPRYKIKKKYVVKLKGYLMR

SEQ ID NO: 2030246 - protein, 17 aa, Staphylococcus
MTHRAIMLSSLAKGKSI

SEQ ID NO: 2030247 - protein, 31 aa, Staphylococcus
MTIDALKLGQKRPFLLPIMHKIFNYEDPSLT

SEQ ID NO: 2030248 - protein, 27 aa, Staphylococcus
MTIHASKGLEFPFVIYSGLSKSFNRSD

SEQ ID NO: 2030249 - protein, 19 aa, Staphylococcus
MTINLTVKEYLDFIDSISI

SEQ ID NO: 2030250 - protein, 20 aa, Staphylococcus
MTIYEEFKDFAGLNILICGD

SEQ ID NO: 2030251 - protein, 22 aa, Staphylococcus
MTIYRKFIKWYGANHSTETVRK

SEQ ID NO: 2030252 - protein, 21 aa, Staphylococcus
MTKEALFPYIQYALITQSSED

SEQ ID NO: 2030253 - protein, 17 aa, Staphylococcus
MTKEAYWEHLAHGPETL

SEQ ID NO: 2030254 - protein, 29 aa, Staphylococcus
MTKEEILILLTLWQKGSMTLKEMDSFVKI

SEQ ID NO: 2030255 - protein, 36 aa, Staphylococcus
MTLDFYLKPFVKTRIKGWVRQLLWMSLYQYVFLDKI

SEQ ID NO: 2030256 - protein, 17 aa, Staphylococcus
MTLKCGIVNLPYGGGKG

SEQ ID NO: 2030257 - protein, 23 aa, Staphylococcus
MTLKRFLEVFDIGLEQLEFVMIP

SEQ ID NO: 2030258 - protein, 23 aa, Staphylococcus
MTLPRYNRDGTMIKWSRKKDSFY

SEQ ID NO: 2030259 - protein, 24 aa, Staphylococcus
MTMKLKRNIIRNLCLSIITFDKHG

SEQ ID NO: 2030260 - protein, 17 aa, Staphylococcus
MTMRALIELVKGEQLDL

SEQ ID NO: 2030261 - protein, 17 aa, Staphylococcus
MTNGSCWCVKAYNNKKL

SEQ ID NO: 2030262 - protein, 23 aa, Staphylococcus
MTNKEIIELITFTLFTTAQQHLG

SEQ ID NO: 2030263 - protein, 23 aa, Staphylococcus
MTNNRYILKRSDVVTQGYSGLEI

SEQ ID NO: 2030264 - protein, 23 aa, Staphylococcus
MTPKEWKDWIIGGQDKYLDQKEL

SEQ ID NO: 2030265 - protein, 26 aa, Staphylococcus
MTPMKLRQRVWRRLATDLKSNKLHEI

SEQ ID NO: 2030266 - protein, 18 aa, Staphylococcus
MTPTMMVFTNFFRDQMDR

SEQ ID NO: 2030267 - protein, 18 aa, Staphylococcus
MTPYFPKPDVLIYLECNY

SEQ ID NO: 2030268 - protein, 25 aa, Staphylococcus
MTPYPVQIMGGIAIHNGDISEMRTG

SEQ ID NO: 2030269 - protein, 25 aa, Staphylococcus
MTQAFPNRLYLSIDAYRRQVKINGW

SEQ ID NO: 2030270 - protein, 19 aa, Staphylococcus
MTQGQSDFVFVIGGSNGLH

SEQ ID NO: 2030271 - protein, 17 aa, Staphylococcus
MTRCTKALIQYIYEEYD

SEQ ID NO: 2030272 - protein, 19 aa, Staphylococcus
MTRGYRREEVDAFLDDIIA

SEQ ID NO: 2030273 - protein, 18 aa, Staphylococcus
MTRMAQLLRDYFGAETSE

SEQ ID NO: 2030274 - protein, 22 aa, Staphylococcus
MTRNMIKRVEILFPVEDKNIAA

SEQ ID NO: 2030275 - protein, 23 aa, Staphylococcus
MTRNMIKRVEILFPVEDKNIAKR

SEQ ID NO: 2030276 - protein, 22 aa, Staphylococcus
MTRNMIKRVEILFPVEDNDIAK

SEQ ID NO: 2030277 - protein, 22 aa, Staphylococcus
MTRNMIKRVEILFPVENKTIGK

SEQ ID NO: 2030278 - protein, 23 aa, Staphylococcus
MTRNMIKRVEILFPVHNQKIRER

SEQ ID NO: 2030279 - protein, 18 aa, Staphylococcus
MTRTVKFGTPSEEAQTIY

SEQ ID NO: 2030280 - protein, 24 aa, Staphylococcus
MTSFAEACILAYSHTKKNKIVVSK

SEQ ID NO: 2030281 - protein, 23 aa, Staphylococcus
MTSPPYPFAVDFIRYHRLSMYWL

SEQ ID NO: 2030282 - protein, 18 aa, Staphylococcus
MTTFERYFIEDKASHKEE

SEQ ID NO: 2030283 - protein, 18 aa, Staphylococcus
MTTFERYFIEDKASHKEP

SEQ ID NO: 2030284 - protein, 18 aa, Staphylococcus
MTTFERYFIEDKASHKEV

SEQ ID NO: 2030285 - protein, 19 aa, Staphylococcus
MTTFERYFIEDKVSHKEEK

SEQ ID NO: 2030286 - protein, 18 aa, Staphylococcus
MTTFKMMILPHFKDMAIK

SEQ ID NO: 2030287 - protein, 21 aa, Staphylococcus
MTTIRVARAYTKRNKIVKFAG

SEQ ID NO: 2030288 - protein, 22 aa, Staphylococcus
MTVEAFKQYLFEKYPEIDGKKF

SEQ ID NO: 2030289 - protein, 25 aa, Staphylococcus
MTVPNIEAAFKFLKDAFDAKYAYDG

SEQ ID NO: 2030290 - protein, 25 aa, Staphylococcus
MTVSGRQLVKVAAWYDNEMSYTAQL

SEQ ID NO: 2030291 - protein, 19 aa, Staphylococcus
MTVVPSRNEGFGMVILEAM

SEQ ID NO: 2030292 - protein, 29 aa, Staphylococcus
MTYFDVEKDFAFPSLASVTLRAITEKEMI

SEQ ID NO: 2030293 - protein, 17 aa, Staphylococcus
MTYKLSPLHVGISSAGV

SEQ ID NO: 2030294 - protein, 17 aa, Staphylococcus
MTYRKLGKYPPYYFLIN

SEQ ID NO: 2030295 - protein, 22 aa, Staphylococcus
MVATIKEFRDAKAMLLEEKENL

SEQ ID NO: 2030296 - protein, 22 aa, Staphylococcus
MVDSQYYYAIHFDDTVDQETIN

SEQ ID NO: 2030297 - protein, 19 aa, Staphylococcus
MVDWKDGREGVLTYDVLDY

SEQ ID NO: 2030298 - protein, 19 aa, Staphylococcus
MVDWKDGREGVLTYDVLQY

SEQ ID NO: 2030299 - protein, 19 aa, Staphylococcus
MVDWKDGREGVLTYDVVKY

SEQ ID NO: 2030300 - protein, 18 aa, Staphylococcus
MVDWNIGRNRYWGTPLNV

SEQ ID NO: 2030301 - protein, 19 aa, Staphylococcus
MVEKLDYLKDLGIDVIWLS

SEQ ID NO: 2030302 - protein, 25 aa, Staphylococcus
MVEPKKTIPTAFEFTDIAGIVKGAS

SEQ ID NO: 2030303 - protein, 25 aa, Staphylococcus
MVEPKKTIPTTFEFTDIAGIVKGAS

SEQ ID NO: 2030304 - protein, 19 aa, Staphylococcus
MVESCPRCQSHFNHRCKFH

SEQ ID NO: 2030305 - protein, 26 aa, Staphylococcus
MVESLRYGCEVLKLFPATQFSPKSIK

SEQ ID NO: 2030306 - protein, 24 aa, Staphylococcus
MVETKRLSSMIFYGPPGIGKTSIA

SEQ ID NO: 2030307 - protein, 25 aa, Staphylococcus
MVFDSKGGFYFTDFRGYSTNPLGGV

SEQ ID NO: 2030308 - protein, 19 aa, Staphylococcus
MVICGLESAYILEDTPEAF

SEQ ID NO: 2030309 - protein, 17 aa, Staphylococcus
MVIDCAKGIEPQTLKLF

SEQ ID NO: 2030310 - protein, 17 aa, Staphylococcus
MVIHEWNMLSSYTTNKQ

SEQ ID NO: 2030311 - protein, 17 aa, Staphylococcus
MVIKDAELRGVASSGMI

SEQ ID NO: 2030312 - protein, 17 aa, Staphylococcus
MVIKSVAEDKGIPFNEE

SEQ ID NO: 2030313 - protein, 24 aa, Staphylococcus
MVKRYEPKDLFAVVMDAKTGEILA

SEQ ID NO: 2030314 - protein, 19 aa, Staphylococcus
MVLNKATPKDIFFIISLSG

SEQ ID NO: 2030315 - protein, 19 aa, Staphylococcus
MVLNYSNEDDLFFVISLSG

SEQ ID NO: 2030316 - protein, 18 aa, Staphylococcus
MVLPFPIKKVLIYYFEQH

SEQ ID NO: 2030317 - protein, 23 aa, Staphylococcus
MVLRVKRRFGDDVAVLHSGLSNG

SEQ ID NO: 2030318 - protein, 19 aa, Staphylococcus
MVNNFVLDIKEYIENRSDK

SEQ ID NO: 2030319 - protein, 18 aa, Staphylococcus
MVNYCLQAADILAEDGIN

SEQ ID NO: 2030320 - protein, 18 aa, Staphylococcus
MVPSFGLKLSEHEDVYHA

SEQ ID NO: 2030321 - protein, 17 aa, Staphylococcus
MVPSFGMKLSENEALYT

SEQ ID NO: 2030322 - protein, 17 aa, Staphylococcus
MVQALGVDVIVTDHHEI

SEQ ID NO: 2030323 - protein, 17 aa, Staphylococcus
MVQEAQFRGNRKVMAHA

SEQ ID NO: 2030324 - protein, 17 aa, Staphylococcus
MVRIEAGYTQDTMAQTI

SEQ ID NO: 2030325 - protein, 25 aa, Staphylococcus
MVSMKRAGVDMIITYFAKDICRYLD

SEQ ID NO: 2030326 - protein, 23 aa, Staphylococcus
MVSSELPEVIGMSDRVMVVHEGN

SEQ ID NO: 2030327 - protein, 20 aa, Staphylococcus
MVSYAGKSSMEVCVQIIIED

SEQ ID NO: 2030328 - protein, 18 aa, Staphylococcus
MVWYCPPLSPIMSYFEGQ

SEQ ID NO: 2030329 - protein, 19 aa, Staphylococcus
MWIKAESMLKEAVDELGLD

SEQ ID NO: 2030330 - protein, 17 aa, Staphylococcus
MWNLSFPPAVKRYFDAV

SEQ ID NO: 2030331 - protein, 18 aa, Staphylococcus
MWQFPMRKASVADNLLTQ

SEQ ID NO: 2030332 - protein, 18 aa, Staphylococcus
MYALKTAGFQSALMVPTE

SEQ ID NO: 2030333 - protein, 26 aa, Staphylococcus
MYDFLKYYDLPVLIIATKEDKIAKGK

SEQ ID NO: 2030334 - protein, 20 aa, Staphylococcus
MYDIAGLRIMCQFVDDIEIV

SEQ ID NO: 2030335 - protein, 19 aa, Staphylococcus
MYDIAGLRLMCQFVDDIDI

SEQ ID NO: 2030336 - protein, 32 aa, Staphylococcus
MYDVCLLGYSMGGRVALYYALNGSVALRGLLL

SEQ ID NO: 2030337 - protein, 21 aa, Staphylococcus
MYEGIRVARQLGFNVAIVSPR

SEQ ID NO: 2030338 - protein, 18 aa, Staphylococcus
MYEVVKAMYDFGYEGPIR

SEQ ID NO: 2030339 - protein, 17 aa, Staphylococcus
MYFHSYVTGATISIIKY

SEQ ID NO: 2030340 - protein, 18 aa, Staphylococcus
MYGGISYTIHAGAPVGQR

SEQ ID NO: 2030341 - protein, 19 aa, Staphylococcus
MYGGTCINVGCIPSKTLIH

SEQ ID NO: 2030342 - protein, 22 aa, Staphylococcus
MYHDLPKFKVAYGATISGISAQ

SEQ ID NO: 2030343 - protein, 17 aa, Staphylococcus
MYHLPKQTLEDFEDSLN

SEQ ID NO: 2030344 - protein, 21 aa, Staphylococcus
MYIKQGYTYLGFRYQILKENI

SEQ ID NO: 2030345 - protein, 24 aa, Staphylococcus
MYIPEKRLYATEIEYLLEKEKITI

SEQ ID NO: 2030346 - protein, 23 aa, Staphylococcus
MYKDSYVLFGTFFKAFSESKIDR

SEQ ID NO: 2030347 - protein, 17 aa, Staphylococcus
MYKEYFGSASEFQKGEH

SEQ ID NO: 2030348 - protein, 20 aa, Staphylococcus
MYLGGGFKGERLNKLYKENI

SEQ ID NO: 2030349 - protein, 20 aa, Staphylococcus
MYLITDAMRAKGMKDGEYDL

SEQ ID NO: 2030350 - protein, 18 aa, Staphylococcus
MYLYLPNFFMNHTSEDNK

SEQ ID NO: 2030351 - protein, 18 aa, Staphylococcus
MYMVKKLDAGNIISQKAI

SEQ ID NO: 2030352 - protein, 19 aa, Staphylococcus
MYNALSFNFYYLGNKDESV

SEQ ID NO: 2030353 - protein, 19 aa, Staphylococcus
MYNIFNMGIGFTLVVDNNQ

SEQ ID NO: 2030354 - protein, 23 aa, Staphylococcus
MYNIFNMGIGFTVIVDEHDKTQT

SEQ ID NO: 2030355 - protein, 19 aa, Staphylococcus
MYNIFNMGIGYTVIVDKKD

SEQ ID NO: 2030356 - protein, 19 aa, Staphylococcus
MYNIFNMGIGYTVIVSQDD

SEQ ID NO: 2030357 - protein, 19 aa, Staphylococcus
MYNVFNMGIGYTVIVNKED

SEQ ID NO: 2030358 - protein, 18 aa, Staphylococcus
MYPEKAFNMARYVDDRQE

SEQ ID NO: 2030359 - protein, 19 aa, Staphylococcus
MYPNITFQLFENGSKKIEN

SEQ ID NO: 2030360 - protein, 22 aa, Staphylococcus
MYPVQPYYGGAMCVCGTGGDGS

SEQ ID NO: 2030361 - protein, 17 aa, Staphylococcus
MYRAEVQGFSITEVDAL

SEQ ID NO: 2030362 - protein, 21 aa, Staphylococcus
MYRDGEIEGTIDLNRYYYKNR

SEQ ID NO: 2030363 - protein, 21 aa, Staphylococcus
MYRDGEIEGTVDLNQYYYKNR

SEQ ID NO: 2030364 - protein, 17 aa, Staphylococcus
MYREVAFHGGIPDTGFF

SEQ ID NO: 2030365 - protein, 17 aa, Staphylococcus
MYREVAFHGGIPDTGFY

SEQ ID NO: 2030366 - protein, 18 aa, Staphylococcus
MYRVLKTNGHLILMTPNK

SEQ ID NO: 2030367 - protein, 17 aa, Staphylococcus
MYTALCNEEGGIIDDLV

SEQ ID NO: 2030368 - protein, 18 aa, Staphylococcus
MYYDHILLATGFENTVMS

SEQ ID NO: 2030369 - protein, 18 aa, Staphylococcus
MYYDHLLLATGFKESIMQ

SEQ ID NO: 2030370 - protein, 20 aa, Staphylococcus
MYYERSEPVAEAFGDLDPKI

SEQ ID NO: 2030371 - protein, 20 aa, Staphylococcus
MYYFSVANPNPLNWLQHLST

SEQ ID NO: 2030372 - protein, 24 aa, Staphylococcus
NAAGLKLGMIHGGLTPRERKQQMK

SEQ ID NO: 2030373 - protein, 24 aa, Staphylococcus
NAAQILKYFGVDSVNLLSNNPKKF

SEQ ID NO: 2030374 - protein, 20 aa, Staphylococcus
NAATGFAHRDPGVFGAAWLN

SEQ ID NO: 2030375 - protein, 20 aa, Staphylococcus
NAATGFGHREPGVFGAAWLN

SEQ ID NO: 2030376 - protein, 17 aa, Staphylococcus
NADALVFGSESGSIQAF

SEQ ID NO: 2030377 - protein, 21 aa, Staphylococcus
NADARFSIEFDKDTEITGNMK

SEQ ID NO: 2030378 - protein, 21 aa, Staphylococcus
NADEALNLFKLMKVSVSGIRR

SEQ ID NO: 2030379 - protein, 19 aa, Staphylococcus
NADFQLIYRHGKSVANRQF

SEQ ID NO: 2030380 - protein, 24 aa, Staphylococcus
NADGRLNTIYIRDFEGLRIDEQLL

SEQ ID NO: 2030381 - protein, 23 aa, Staphylococcus
NADVPVVAGFGIRNPEQVSTLSE

SEQ ID NO: 2030382 - protein, 18 aa, Staphylococcus
NADWRYIRVRDPLSRPIM

SEQ ID NO: 2030383 - protein, 23 aa, Staphylococcus
NAEEGKRIYGEIIPPSSPNQRIS

SEQ ID NO: 2030384 - protein, 32 aa, Staphylococcus
NAEQFRQLFILPQGEFKKFLLSNSKEKQGILR

SEQ ID NO: 2030385 - protein, 30 aa, Staphylococcus
NAEQFRQLFILPQGEFKKFLVSNSSDKQSI

SEQ ID NO: 2030386 - protein, 17 aa, Staphylococcus
NAESFAMIRGGHIDLAI

SEQ ID NO: 2030387 - protein, 21 aa, Staphylococcus
NAETLRQAFHLNFDDVGKDIE

SEQ ID NO: 2030388 - protein, 23 aa, Staphylococcus
NAFAEEKMVILFGSNAPAELEDY

SEQ ID NO: 2030389 - protein, 24 aa, Staphylococcus
NAFIKPDVFYFIPSFISPLKEHTD

SEQ ID NO: 2030390 - protein, 26 aa, Staphylococcus
NAFTSFDCTSYLFSATDNVERNILRL

SEQ ID NO: 2030391 - protein, 22 aa, Staphylococcus
NAFVPSVVGLICASYVVNDILK

SEQ ID NO: 2030392 - protein, 23 aa, Staphylococcus
NAGAKAYRLGEVGAETQYALNHF

SEQ ID NO: 2030393 - protein, 22 aa, Staphylococcus
NAGEFCGYSFAFEATKNNTKLA

SEQ ID NO: 2030394 - protein, 25 aa, Staphylococcus
NAGGKRIRPLLVFLTLDVLNQDYKK

SEQ ID NO: 2030395 - protein, 19 aa, Staphylococcus
NAGGTCLNVGCIPSKTLLE

SEQ ID NO: 2030396 - protein, 20 aa, Staphylococcus
NAGGTCLNVGCIPSKTLLEH

SEQ ID NO: 2030397 - protein, 25 aa, Staphylococcus
NAGGTCLNVGCIPSKTLLEHGEKAH

SEQ ID NO: 2030398 - protein, 17 aa, Staphylococcus
NAGKSSWFNVLANEETY

SEQ ID NO: 2030399 - protein, 17 aa, Staphylococcus
NAGKSSWFNVLANETTY

SEQ ID NO: 2030400 - protein, 17 aa, Staphylococcus
NAGKSSWFNVLSGEETF

SEQ ID NO: 2030401 - protein, 22 aa, Staphylococcus
NAGLHLLHFLGSLNLNKTAKDF

SEQ ID NO: 2030402 - protein, 27 aa, Staphylococcus
NAGRARRGELVSCFLLEVDDSLNSINF

SEQ ID NO: 2030403 - protein, 26 aa, Staphylococcus
NAHNHWYEWLGHNLTLEGYKVSLFNL

SEQ ID NO: 2030404 - protein, 29 aa, Staphylococcus
NAHNHWYQWLKHNLALEGYNVQLFNLDKE

SEQ ID NO: 2030405 - protein, 19 aa, Staphylococcus
NAHNNVIFASARPIRDLLP

SEQ ID NO: 2030406 - protein, 23 aa, Staphylococcus
NAHPEFGAKVAKFISDNTGYAFV

SEQ ID NO: 2030407 - protein, 20 aa, Staphylococcus
NAIASCGCGSSFKTAKVSGN

SEQ ID NO: 2030408 - protein, 23 aa, Staphylococcus
NAIASCGCGSSFKTAKVSGTPEE

SEQ ID NO: 2030409 - protein, 17 aa, Staphylococcus
NAIETEGLDGLYVNGSS

SEQ ID NO: 2030410 - protein, 28 aa, Staphylococcus
NAIHMAWYRYPRGFKFYRNTASFVPEPG

SEQ ID NO: 2030411 - protein, 17 aa, Staphylococcus
NAILKCVERMIELGYYR

SEQ ID NO: 2030412 - protein, 25 aa, Staphylococcus
NAILLRGWGGGFFMNGPSEDAFYGY

SEQ ID NO: 2030413 - protein, 19 aa, Staphylococcus
NAIPKEFQALYDAKQSGQD

SEQ ID NO: 2030414 - protein, 17 aa, Staphylococcus
NAIVNGRKSLYTLYDEK

SEQ ID NO: 2030415 - protein, 17 aa, Staphylococcus
NAIVNGRQSPYTLYDEK

SEQ ID NO: 2030416 - protein, 23 aa, Staphylococcus
NAIYKDKIEIIPIIADVQNGDRI

SEQ ID NO: 2030417 - protein, 21 aa, Staphylococcus
NAKASEHAMRMTAMKNASDNA

SEQ ID NO: 2030418 - protein, 22 aa, Staphylococcus
NAKDLFVRNSFVVNRQSWLNLK

SEQ ID NO: 2030419 - protein, 19 aa, Staphylococcus
NAKDVVGFARFLHTNGGVM

SEQ ID NO: 2030420 - protein, 19 aa, Staphylococcus
NAKHTKYSYTIPIKEPCLV

SEQ ID NO: 2030421 - protein, 22 aa, Staphylococcus
NAKKAIVVGGGYIGIEAAEAFT

SEQ ID NO: 2030422 - protein, 23 aa, Staphylococcus
NAKKGADWMTCICSATIPTMKAA

SEQ ID NO: 2030423 - protein, 17 aa, Staphylococcus
NAKKWFGQLPGRVSGWF

SEQ ID NO: 2030424 - protein, 23 aa, Staphylococcus
NAKLHPAICFTMLGHFLGIDIEM

SEQ ID NO: 2030425 - protein, 25 aa, Staphylococcus
NAKMIRRHPHIFGDKTVETIEDLND

SEQ ID NO: 2030426 - protein, 26 aa, Staphylococcus
NAKMIRRHPHIFGEAQADSMDDLKDI

SEQ ID NO: 2030427 - protein, 24 aa, Staphylococcus
NAKMIRRHPHIFGEQHAETIDDLN

SEQ ID NO: 2030428 - protein, 23 aa, Staphylococcus
NAKMIRRHPHIFSDESAESIEDL

SEQ ID NO: 2030429 - protein, 17 aa, Staphylococcus
NAKRFDTTPSIVLLTCY

SEQ ID NO: 2030430 - protein, 18 aa, Staphylococcus
NAKSKWIHRNEFNEPEIF

SEQ ID NO: 2030431 - protein, 18 aa, Staphylococcus
NAKVKMPTDFGTFDMYGF

SEQ ID NO: 2030432 - protein, 26 aa, Staphylococcus
NAKVKRIEKYGAFVELFAGKDALLHI

SEQ ID NO: 2030433 - protein, 26 aa, Staphylococcus
NAKVKRIEKYGAFVELFPGKDALLHI

SEQ ID NO: 2030434 - protein, 23 aa, Staphylococcus
NALDDVQAIIGFHNYPTLDIGEF

SEQ ID NO: 2030435 - protein, 24 aa, Staphylococcus
NALIADEIVCVFDAYEQSGIEREY

SEQ ID NO: 2030436 - protein, 22 aa, Staphylococcus
NALINEVIAFKVIKVKKNFAIG

SEQ ID NO: 2030437 - protein, 20 aa, Staphylococcus
NALKYQTGFSKFIPQRFETG

SEQ ID NO: 2030438 - protein, 19 aa, Staphylococcus
NALLERFKYAQSLNINAHP

SEQ ID NO: 2030439 - protein, 27 aa, Staphylococcus
NALRFGDANLSPGTRIHFVEVPKSNYQ

SEQ ID NO: 2030440 - protein, 24 aa, Staphylococcus
NALSKAYYAHGWVMQIHFGAIRNN

SEQ ID NO: 2030441 - protein, 20 aa, Staphylococcus
NALVGFKFDPTAQKAFPDMS

SEQ ID NO: 2030442 - protein, 20 aa, Staphylococcus
NAMCKPDFMLNVTLNKEKEI

SEQ ID NO: 2030443 - protein, 18 aa, Staphylococcus
NAMIEFDDSISLMSMHEK

SEQ ID NO: 2030444 - protein, 20 aa, Staphylococcus
NAMKSRGLNSNWDMLFIALS

SEQ ID NO: 2030445 - protein, 17 aa, Staphylococcus
NAMLMVHNAWTVNEGDA

SEQ ID NO: 2030446 - protein, 18 aa, Staphylococcus
NANDFGVHLFDMGSDEQG

SEQ ID NO: 2030447 - protein, 21 aa, Staphylococcus
NANLGGAIMLAARACVYSGSG

SEQ ID NO: 2030448 - protein, 25 aa, Staphylococcus
NANLIRLIFDEGFIAIRPSGTEPKI

SEQ ID NO: 2030449 - protein, 29 aa, Staphylococcus
NANVRVLFRSSPFLTSFKELYRVEFIRQR

SEQ ID NO: 2030450 - protein, 23 aa, Staphylococcus
NAPHLKVIANMAVGYDNIDVNIA

SEQ ID NO: 2030451 - protein, 23 aa, Staphylococcus
NAQCIERARKLNIPVHINQPKDF

SEQ ID NO: 2030452 - protein, 25 aa, Staphylococcus
NAQDPCMRHELTFYTSKGEPFDYSN

SEQ ID NO: 2030453 - protein, 19 aa, Staphylococcus
NAQGRIVGFSGRTYNNQEP

SEQ ID NO: 2030454 - protein, 18 aa, Staphylococcus
NAQPGCFEDKFVANLFFE

SEQ ID NO: 2030455 - protein, 26 aa, Staphylococcus
NAQPKFYPGWNDFAFNQQVKSVTFDM

SEQ ID NO: 2030456 - protein, 33 aa, Staphylococcus
NARGKGGHMRVSWKDVLQLIAAQLLYTIKKDGP

SEQ ID NO: 2030457 - protein, 21 aa, Staphylococcus
NARYKDEFMRYTNPYHIENFD

SEQ ID NO: 2030458 - protein, 25 aa, Staphylococcus
NASEEALDMVVGFVALEQLYTSALK

SEQ ID NO: 2030459 - protein, 23 aa, Staphylococcus
NASGEVLVTMFGLIGSIERQTLI

SEQ ID NO: 2030460 - protein, 23 aa, Staphylococcus
NASGEVLVTMFGLIGSIERSTLA

SEQ ID NO: 2030461 - protein, 23 aa, Staphylococcus
NASGEVLVTMFGLIGSIERSTLI

SEQ ID NO: 2030462 - protein, 17 aa, Staphylococcus
NASIPTSEPMKYRKMYG

SEQ ID NO: 2030463 - protein, 27 aa, Staphylococcus
NASVYMIGGSGLKAALLDRRLTLRRDK

SEQ ID NO: 2030464 - protein, 26 aa, Staphylococcus
NASVYMLGGNGLKTALTEAGLTVKAN

SEQ ID NO: 2030465 - protein, 19 aa, Staphylococcus
NATIAIAIGHELGLSYETI

SEQ ID NO: 2030466 - protein, 19 aa, Staphylococcus
NATIAIAVGKRLNLTYQTI

SEQ ID NO: 2030467 - protein, 33 aa, Staphylococcus; identical to SEQ ID NO: 1810274

SEQ ID NO: 2030468 - protein, 36 aa, Staphylococcus
NATIHRFTRKLGFDGYSDFKSFLKFESEKKNQLPSD

SEQ ID NO: 2030469 - protein, 33 aa, Staphylococcus
NATIHRFTRKLGFDGYSDFKSFLKFETEIQQQH

SEQ ID NO: 2030470 - protein, 32 aa, Staphylococcus
NATIHRFTRKLGFDGYSDFKSYLKFESEHLSQ

SEQ ID NO: 2030471 - protein, 32 aa, Staphylococcus
NATIHRFTRKLGFDGYSDFKSYLKFESQSLHE

SEQ ID NO: 2030472 - protein, 27 aa, Staphylococcus
NATIHRFTRKLGFDGYSDFKSYLKFET

SEQ ID NO: 2030473 - protein, 20 aa, Staphylococcus
NATIPQVVLAWLRDRPNVDS

SEQ ID NO: 2030474 - protein, 31 aa, Staphylococcus
NATLCYIYKFRARFAVLAKIIADREGLSDNQ

SEQ ID NO: 2030475 - protein, 20 aa, Staphylococcus
NATLILIKLYLYKLSKNKAR

SEQ ID NO: 2030476 - protein, 22 aa, Staphylococcus
NATLPLATLFHALFPCGSITGA

SEQ ID NO: 2030477 - protein, 25 aa, Staphylococcus
NATQFWQKFIYKLLVDNEALIIKSD

SEQ ID NO: 2030478 - protein, 18 aa, Staphylococcus
NATRFLIIKNHDNFDSNT

SEQ ID NO: 2030479 - protein, 24 aa, Staphylococcus
NATRFPNLLFGFIHVPYIPEQVES

SEQ ID NO: 2030480 - protein, 18 aa, Staphylococcus
NAVAEGIAQIQIIYDPDL

SEQ ID NO: 2030481 - protein, 32 aa, Staphylococcus
NAVAKIGIVYIRKGEFYRLYIEQQLIDLIFIM

SEQ ID NO: 2030482 - protein, 21 aa, Staphylococcus
NAVEGGEAFFAIQAPNMTSYT

SEQ ID NO: 2030483 - protein, 24 aa, Staphylococcus
NAVHLFYKYLEYVNVKHIAVVGAK

SEQ ID NO: 2030484 - protein, 20 aa, Staphylococcus
NAVLPGPVRTKLIENQLAKL

SEQ ID NO: 2030485 - protein, 22 aa, Staphylococcus
NAVQLFYPFFNSVNIKYVAAIG

SEQ ID NO: 2030486 - protein, 19 aa, Staphylococcus
NAVRLGISLYGYYPSAYVK

SEQ ID NO: 2030487 - protein, 19 aa, Staphylococcus
NAWKEGRTGYPIIDAAMHE

SEQ ID NO: 2030488 - protein, 25 aa, Staphylococcus
NAWTNRYDIWFSIYSTPSESLTDRF

SEQ ID NO: 2030489 - protein, 19 aa, Staphylococcus
NAYEAVRYGYLRNTDTIIL

SEQ ID NO: 2030490 - protein, 18 aa, Staphylococcus
NAYFKGMFNETCPSFDDI

SEQ ID NO: 2030491 - protein, 21 aa, Staphylococcus
NAYQPIDIVIAVGVINNAKNL

SEQ ID NO: 2030492 - protein, 17 aa, Staphylococcus
NCEKHWSKYGYKKTNIN

SEQ ID NO: 2030493 - protein, 19 aa, Staphylococcus
NCGLSDQLTVLKWVQYFIP

SEQ ID NO: 2030494 - protein, 17 aa, Staphylococcus
NCGYNRWNHNEPMVGQT

SEQ ID NO: 2030495 - protein, 24 aa, Staphylococcus
NCISCAACGVAAPNLFKYDVEDIA

SEQ ID NO: 2030496 - protein, 20 aa, Staphylococcus
NCIYCYNYAIWLIQNGLSKS

SEQ ID NO: 2030497 - protein, 32 aa, Staphylococcus
NCLERSDGEPCNECAICKGITRGTNSDVIEID

SEQ ID NO: 2030498 - protein, 17 aa, Staphylococcus
NCMFDALEVNKSRFKKC

SEQ ID NO: 2030499 - protein, 19 aa, Staphylococcus
NCNGGIRFLGVKDGKNAAD

SEQ ID NO: 2030500 - protein, 26 aa, Staphylococcus
NCPQAFKFHGEVAMQLFLNNQFDLPS

SEQ ID NO: 2030501 - protein, 29 aa, Staphylococcus
NCVFNHLSHLGMFIFDIHTIYKMNTAFNN

SEQ ID NO: 2030502 - protein, 20 aa, Staphylococcus
NCVYCYNYAIWLIQHGLSKK

SEQ ID NO: 2030503 - protein, 20 aa, Staphylococcus
NCVYCYNYAIWLIQHGLSTR

SEQ ID NO: 2030504 - protein, 20 aa, Staphylococcus
NCVYCYNYAIWLIQKGLSHK

SEQ ID NO: 2030505 - protein, 21 aa, Staphylococcus
NCVYCYNYAIWLIRHGLSPSY

SEQ ID NO: 2030506 - protein, 22 aa, Staphylococcus
NCVYCYNYCIWLIQHGLPKNYE

SEQ ID NO: 2030507 - protein, 22 aa, Staphylococcus
NCVYCYNYCIWLIQNGLPKSYE

SEQ ID NO: 2030508 - protein, 19 aa, Staphylococcus
NDAALKICNRCYERGVVII

SEQ ID NO: 2030509 - protein, 19 aa, Staphylococcus
NDAETTWQNALKGVNGIDT

SEQ ID NO: 2030510 - protein, 20 aa, Staphylococcus
NDAIEKARHLSFQTEDMKRQ

SEQ ID NO: 2030511 - protein, 23 aa, Staphylococcus
NDAIEKARRLAFQTEDMKRQSKV

SEQ ID NO: 2030512 - protein, 22 aa, Staphylococcus
NDAIEKARRLSFQTEDMKRQSK

SEQ ID NO: 2030513 - protein, 26 aa, Staphylococcus
NDAKACAMITFRLLKHYDDLPSMLSI

SEQ ID NO: 2030514 - protein, 25 aa, Staphylococcus
NDAKACAMITFRLLKHYDNLQSMLQ

SEQ ID NO: 2030515 - protein, 25 aa, Staphylococcus
NDAKACAMITFRLLQHYDDLATMLS

SEQ ID NO: 2030516 - protein, 25 aa, Staphylococcus
NDAKACAMITYRLLKHYDDLHSMLN

SEQ ID NO: 2030517 - protein, 19 aa, Staphylococcus
NDAKSTWDNALKGVSGIDS

SEQ ID NO: 2030518 - protein, 17 aa, Staphylococcus
NDAKTSWENALNGVNGI

SEQ ID NO: 2030519 - protein, 19 aa, Staphylococcus
NDAKTTWANALKGVNGIDK

SEQ ID NO: 2030520 - protein, 20 aa, Staphylococcus
NDALKFQVLEELPQQIKDYV

SEQ ID NO: 2030521 - protein, 20 aa, Staphylococcus
NDALKFQVLEELPSQIKDYL

SEQ ID NO: 2030522 - protein, 18 aa, Staphylococcus
NDAQTSWENALKGVNGID

SEQ ID NO: 2030523 - protein, 18 aa, Staphylococcus
NDATRFVKDVYFIQVSSL

SEQ ID NO: 2030524 - protein, 25 aa, Staphylococcus
NDAVLKLKNAMKVIPYEYEVISVFN

SEQ ID NO: 2030525 - protein, 23 aa, Staphylococcus
NDAVTRILGLKAKIHLHDKQAQQ

SEQ ID NO: 2030526 - protein, 21 aa, Staphylococcus
NDAYIKKEWLYSGYNNIQTLV

SEQ ID NO: 2030527 - protein, 18 aa, Staphylococcus
NDCFMIRKKVFVKEQHVP

SEQ ID NO: 2030528 - protein, 21 aa, Staphylococcus
NDCYAVLGLVHTLWKPMPGRF

SEQ ID NO: 2030529 - protein, 22 aa, Staphylococcus
NDDFLRGCMRQSLIDQGKLKTK

SEQ ID NO: 2030530 - protein, 24 aa, Staphylococcus
NDDFTHWRKIMGAAPISDEERENM

SEQ ID NO: 2030531 - protein, 24 aa, Staphylococcus
NDDFTHWRKIMGVAPISDEEREYM

SEQ ID NO: 2030532 - protein, 23 aa, Staphylococcus
NDDFTHWRNIMGIEPISDEERDN

SEQ ID NO: 2030533 - protein, 23 aa, Staphylococcus
NDDFTHWRNIMGVAPISEEEQEQ

SEQ ID NO: 2030534 - protein, 17 aa, Staphylococcus
NDDGFKAVAVVFGNKRV

SEQ ID NO: 2030535 - protein, 19 aa, Staphylococcus
NDDISDKLVEWVESEYPDV

SEQ ID NO: 2030536 - protein, 25 aa, Staphylococcus
NDDLFKQFKQGAVFINAARGSLVDT

SEQ ID NO: 2030537 - protein, 20 aa, Staphylococcus
NDDLIDLLILNAQENINSKG

SEQ ID NO: 2030538 - protein, 19 aa, Staphylococcus
NDDLKRYAFDLKLINEKRP

SEQ ID NO: 2030539 - protein, 21 aa, Staphylococcus
NDDSFKAVAVVVGNKKIVLEN

SEQ ID NO: 2030540 - protein, 24 aa, Staphylococcus
NDEAIERERILSALTVEVAEEADA

SEQ ID NO: 2030541 - protein, 18 aa, Staphylococcus
NDEEAYYAFHEFNSDLEI

SEQ ID NO: 2030542 - protein, 32 aa, Staphylococcus
NDEGESFFVKFHWRPVHGLESLVWDEAQTLQG

SEQ ID NO: 2030543 - protein, 17 aa, Staphylococcus
NDEGVGINLKPGVVGTI

SEQ ID NO: 2030544 - protein, 19 aa, Staphylococcus
NDEIKAIFEQLGFKTIQNA

SEQ ID NO: 2030545 - protein, 18 aa, Staphylococcus
NDEIVGAVDIRHQLNQRL

SEQ ID NO: 2030546 - protein, 18 aa, Staphylococcus
NDEKKVSSKAFLDQIHQR

SEQ ID NO: 2030547 - protein, 24 aa, Staphylococcus
NDEKLRFLQFYPVNQHSEMLSAYS

SEQ ID NO: 2030548 - protein, 18 aa, Staphylococcus
NDEMMDVIHFFNKIENYY

SEQ ID NO: 2030549 - protein, 25 aa, Staphylococcus
NDENMKEWLGEAGIEYRQDHELGGR

SEQ ID NO: 2030550 - protein, 23 aa, Staphylococcus
NDETNGMINLCFELFDDKIKIVI

SEQ ID NO: 2030551 - protein, 18 aa, Staphylococcus
NDEYAKISLIGSGMRDMS

SEQ ID NO: 2030552 - protein, 26 aa, Staphylococcus
NDFAKGLKLYDVFTVLYLLDPESYET

SEQ ID NO: 2030553 - protein, 19 aa, Staphylococcus
NDFELMITGLPKFDNEHLI

SEQ ID NO: 2030554 - protein, 24 aa, Staphylococcus
NDFFNCFFDRHLLQSNHFIKSQIL

SEQ ID NO: 2030555 - protein, 25 aa, Staphylococcus
NDFKAIFPNHNVIGISELIKDFDVE

SEQ ID NO: 2030556 - protein, 23 aa, Staphylococcus
NDFKDIREHVGIVFQNPENQFVG

SEQ ID NO: 2030557 - protein, 17 aa, Staphylococcus
NDFKENTLFIVNTLNNE

SEQ ID NO: 2030558 - protein, 18 aa, Staphylococcus
NDFKKLKALSSIKKGQLL

SEQ ID NO: 2030559 - protein, 22 aa, Staphylococcus
NDFKLLPQYQIAYDKLFEVKHH

SEQ ID NO: 2030560 - protein, 22 aa, Staphylococcus
NDFKVIFPDFNVIGIAEIIEDF

SEQ ID NO: 2030561 - protein, 17 aa, Staphylococcus
NDFMPSILTAVKIARIF

SEQ ID NO: 2030562 - protein, 21 aa, Staphylococcus
NDFWRRKYIETDKHDSIINDY

SEQ ID NO: 2030563 - protein, 19 aa, Staphylococcus
NDGDAVIFFNFRPDRAAQL

SEQ ID NO: 2030564 - protein, 24 aa, Staphylococcus
NDGKHPLQLADLVCHLTALLKYGG

SEQ ID NO: 2030565 - protein, 23 aa, Staphylococcus
NDGKPYAGFVYDVMNDVLYHAKT

SEQ ID NO: 2030566 - protein, 24 aa, Staphylococcus
NDGQFNYFAFNGMRTKGNNELHVT

SEQ ID NO: 2030567 - protein, 32 aa, Staphylococcus
NDGSGMFFKVERLKGVFAWGFRINSAESEEGL

SEQ ID NO: 2030568 - protein, 23 aa, Staphylococcus
NDHFKAAEFLQQFNDLQQLFIVS

SEQ ID NO: 2030569 - protein, 24 aa, Staphylococcus
NDHLRDLLEFKAQQSIHISEVESV

SEQ ID NO: 2030570 - protein, 19 aa, Staphylococcus
NDHLYHLYTEIKGHLNEKS

SEQ ID NO: 2030571 - protein, 22 aa, Staphylococcus
NDIAEVIAGWTGIPLTRLNETE

SEQ ID NO: 2030572 - protein, 27 aa, Staphylococcus
NDIAYQKCIPWIYGGVVQSTYAQTTFI

SEQ ID NO: 2030573 - protein, 26 aa, Staphylococcus
NDIDAFLGIRYAHLMHGRFKHSELIT

SEQ ID NO: 2030574 - protein, 17 aa, Staphylococcus
NDIDWRYVDHSSGLAPM

SEQ ID NO: 2030575 - protein, 18 aa, Staphylococcus
NDIEAVFIRAPHIEKVNS

SEQ ID NO: 2030576 - protein, 21 aa, Staphylococcus
NDIFDFYSLGFGDPYPISGSH

SEQ ID NO: 2030577 - protein, 26 aa, Staphylococcus
NDIFKKRDSMNWNEITEGIDHIPGQH

SEQ ID NO: 2030578 - protein, 26 aa, Staphylococcus
NDIFKKRDSMNWNEITEGINHIPGSH

SEQ ID NO: 2030579 - protein, 25 aa, Staphylococcus
NDIFKKRDSMNWNEITQGIDHISGK

SEQ ID NO: 2030580 - protein, 26 aa, Staphylococcus
NDIFKKRDSMNWNEITQGIDHVSGKQ

SEQ ID NO: 2030581 - protein, 23 aa, Staphylococcus
NDIFMWDYKALPAVFGGEDVVKV

SEQ ID NO: 2030582 - protein, 18 aa, Staphylococcus
NDIGCYFLDIQLEADMNG

SEQ ID NO: 2030583 - protein, 21 aa, Staphylococcus
NDIHLTPVIKCIAGDSRIIET

SEQ ID NO: 2030584 - protein, 24 aa, Staphylococcus
NDIHMWDYKALPAVFGGDNVAIHD

SEQ ID NO: 2030585 - protein, 23 aa, Staphylococcus
NDIIKKPFILITILNEPIVLKSN

SEQ ID NO: 2030586 - protein, 33 aa, Staphylococcus
NDIKAILFAFSYAKDCYKVIGPFTKGEHDLTVE

SEQ ID NO: 2030587 - protein, 24 aa, Staphylococcus
NDIKKAQGYLATFVSHNCTGMIST

SEQ ID NO: 2030588 - protein, 18 aa, Staphylococcus
NDIKLIACTMSMDVMGIK

SEQ ID NO: 2030589 - protein, 22 aa, Staphylococcus
NDIKMWDYKLLPTVFGGKDEVQ

SEQ ID NO: 2030590 - protein, 18 aa, Staphylococcus
NDILGALDVNMAAIWLTN

SEQ ID NO: 2030591 - protein, 22 aa, Staphylococcus
NDILKSNFIFKNNRVYKYVNHT

SEQ ID NO: 2030592 - protein, 17 aa, Staphylococcus
NDILRNFVRRICDCTGE

SEQ ID NO: 2030593 - protein, 20 aa, Staphylococcus
NDIMGIPSFLVYKNDELVGS

SEQ ID NO: 2030594 - protein, 26 aa, Staphylococcus
NDINLRLKGYIAIVVQHEIDHLDGIM

SEQ ID NO: 2030595 - protein, 18 aa, Staphylococcus
NDINRLRNSVAHNLDMLN

SEQ ID NO: 2030596 - protein, 17 aa, Staphylococcus
NDIPDIILLDLVMPEMN

SEQ ID NO: 2030597 - protein, 18 aa, Staphylococcus
NDIPRIVHEAFYLANSGR

SEQ ID NO: 2030598 - protein, 20 aa, Staphylococcus
NDIRADINIGLHSVTDKDPH

SEQ ID NO: 2030599 - protein, 22 aa, Staphylococcus
NDIRLKCALIDILKEHRTVEDI

SEQ ID NO: 2030600 - protein, 20 aa, Staphylococcus
NDIVGFTVAEYMPWDEINLK

SEQ ID NO: 2030601 - protein, 21 aa, Staphylococcus
NDIYDFYSLGFGDPYPISGSH

SEQ ID NO: 2030602 - protein, 21 aa, Staphylococcus
NDIYDFYSLGFGEPYPISGSH

SEQ ID NO: 2030603 - protein, 17 aa, Staphylococcus
NDKGIAQNVAQLMKDTA

SEQ ID NO: 2030604 - protein, 17 aa, Staphylococcus
NDKHVIQQFGIIIPLQI

SEQ ID NO: 2030605 - protein, 21 aa, Staphylococcus
NDKKFKISRQAGFIKEGNTSL

SEQ ID NO: 2030606 - protein, 24 aa, Staphylococcus
NDKMIRRHPHVFGEAHAENVEDLK

SEQ ID NO: 2030607 - protein, 23 aa, Staphylococcus
NDKTAEIYTDMGIITTDKGIAED

SEQ ID NO: 2030608 - protein, 18 aa, Staphylococcus
NDLEAIKIAFENYGDDIA

SEQ ID NO: 2030609 - protein, 22 aa, Staphylococcus
NDLFKIKYMVSLFIPNNDEMAQ

SEQ ID NO: 2030610 - protein, 22 aa, Staphylococcus
NDLKEIIIRTAEVLNTKIDDES

SEQ ID NO: 2030611 - protein, 19 aa, Staphylococcus
NDLKETYESFNLIDTTAVD

SEQ ID NO: 2030612 - protein, 19 aa, Staphylococcus
NDLKLVMDILKLALQNNDA

SEQ ID NO: 2030613 - protein, 20 aa, Staphylococcus
NDLKRTYVFELNYDAMMQVA

SEQ ID NO: 2030614 - protein, 17 aa, Staphylococcus
NDLKRTYVFELNYEEMM

SEQ ID NO: 2030615 - protein, 29 aa, Staphylococcus
NDLLRNFVRRVCDCIGEWSMENFIEIEIE

SEQ ID NO: 2030616 - protein, 25 aa, Staphylococcus
NDLLRNFVRRVCECTGEWTMENFID

SEQ ID NO: 2030617 - protein, 29 aa, Staphylococcus
NDLLRNFVRRVCNCIGEWTMENFIEIEIE

SEQ ID NO: 2030618 - protein, 17 aa, Staphylococcus
NDLNLILSRKLNVIKTS

SEQ ID NO: 2030619 - protein, 22 aa, Staphylococcus
NDLYFKYLISVLRLQNWIPPMQ

SEQ ID NO: 2030620 - protein, 25 aa, Staphylococcus
NDMRLKNLYFKYLILIEQSLKNNVA

SEQ ID NO: 2030621 - protein, 25 aa, Staphylococcus
NDNVFLYEIGRVFFANGEGELPDEV

SEQ ID NO: 2030622 - protein, 25 aa, Staphylococcus
NDPERLKAGLLYTIEEECIKQGHTY

SEQ ID NO: 2030623 - protein, 25 aa, Staphylococcus
NDPHVWLDPVLDRIFAEKIKDKLIQ

SEQ ID NO: 2030624 - protein, 27 aa, Staphylococcus
NDPIFQLLVNLGIPFVVIGKNYNKNDV

SEQ ID NO: 2030625 - protein, 24 aa, Staphylococcus
NDPNKAFCFGMNYVLESDDEAYRS

SEQ ID NO: 2030626 - protein, 17 aa, Staphylococcus
NDPRGLFKVVINKDTNE

SEQ ID NO: 2030627 - protein, 20 aa, Staphylococcus
NDQFEGFTFDYYISNPPFGV

SEQ ID NO: 2030628 - protein, 20 aa, Staphylococcus
NDQFEQVSVWGPRAREAQEF

SEQ ID NO: 2030629 - protein, 23 aa, Staphylococcus
NDQKIDFVNKVYLMLNKPKDYIS

SEQ ID NO: 2030630 - protein, 19 aa, Staphylococcus
NDQKLWLSGYLTANMQGGA

SEQ ID NO: 2030631 - protein, 25 aa, Staphylococcus
NDQWRYIIQDGIVFRDFVHQYDMIK

SEQ ID NO: 2030632 - protein, 22 aa, Staphylococcus
NDRAMFAFGGYSVAMKNARQEI

SEQ ID NO: 2030633 - protein, 26 aa, Staphylococcus
NDRARLKDIIELFLDSGLGKEAFSII

SEQ ID NO: 2030634 - protein, 20 aa, Staphylococcus
NDRMVWVFPLTFNNSEYYIP

SEQ ID NO: 2030635 - protein, 23 aa, Staphylococcus
NDRPLYEHVPLFMGDTGLLTQWT

SEQ ID NO: 2030636 - protein, 23 aa, Staphylococcus
NDRYKLIILRKGRGLAGNVMKTG

SEQ ID NO: 2030637 - protein, 17 aa, Staphylococcus
NDSEIIKNLSLTFSSNA

SEQ ID NO: 2030638 - protein, 25 aa, Staphylococcus
NDSERLKAGLLYTLEEECIKQGHTY

SEQ ID NO: 2030639 - protein, 26 aa, Staphylococcus
NDSEVYVCGSAKFIQSVIEVLKEIGI

SEQ ID NO: 2030640 - protein, 17 aa, Staphylococcus
NDSEYGLAGGIFTTNIN

SEQ ID NO: 2030641 - protein, 24 aa, Staphylococcus
NDSFKPLLHYARLKDMKHYQMVEE

SEQ ID NO: 2030642 - protein, 21 aa, Staphylococcus
NDSRDKFPLLTKILDANDKLS

SEQ ID NO: 2030643 - protein, 26 aa, Staphylococcus
NDSSAMPAFWFDPLINLTAISQVTQY

SEQ ID NO: 2030644 - protein, 25 aa, Staphylococcus
NDSTVCILEAMKLFNEIQAEITGEI

SEQ ID NO: 2030645 - protein, 26 aa, Staphylococcus
NDSTVCILEAMKLFNEIQAEVTGEIV

SEQ ID NO: 2030646 - protein, 25 aa, Staphylococcus
NDTERLKAGLLYVLEEECIKQGHTY

SEQ ID NO: 2030647 - protein, 20 aa, Staphylococcus
NDTFCVLNHLYVNEDKESQF

SEQ ID NO: 2030648 - protein, 30 aa, Staphylococcus
NDTILVEMMICIFHIKRFDSELFVFKDKGW

SEQ ID NO: 2030649 - protein, 18 aa, Staphylococcus
NDTISAHEGHVWLLDPID

SEQ ID NO: 2030650 - protein, 21 aa, Staphylococcus
NDTKYGLAGYVIGKDQETLRK

SEQ ID NO: 2030651 - protein, 21 aa, Staphylococcus
NDTKYGLAGYVIGNDKDTLHK

SEQ ID NO: 2030652 - protein, 20 aa, Staphylococcus
NDTKYGLAGYVYGKDLNTLR

SEQ ID NO: 2030653 - protein, 19 aa, Staphylococcus
NDTKYGLAGYVYGSDKDTL

SEQ ID NO: 2030654 - protein, 25 aa, Staphylococcus
NDTTVCILEAMKLFNEIQAETSGEI

SEQ ID NO: 2030655 - protein, 31 aa, Staphylococcus
NDTVAINILEEWSHSVAEGIAQLQIIYDPEL

SEQ ID NO: 2030656 - protein, 26 aa, Staphylococcus
NDVFKKRDSMDWNEITNGIDHIAGKH

SEQ ID NO: 2030657 - protein, 18 aa, Staphylococcus
NDVGCYFLDIQLEADING

SEQ ID NO: 2030658 - protein, 21 aa, Staphylococcus
NDVHIPYEYFVEASRKPQPNG

SEQ ID NO: 2030659 - protein, 26 aa, Staphylococcus
NDVKLRLKGYPAIIFQHEIDHLNGIM

SEQ ID NO: 2030660 - protein, 21 aa, Staphylococcus
NDVLTGFKFISDLIEHKQKDD

SEQ ID NO: 2030661 - protein, 39 aa, Staphylococcus
NDVPDWYLDSCLKIKYMFPKAHAAAYVLMAVRIAYFKVH

SEQ ID NO: 2030662 - protein, 25 aa, Staphylococcus
NDVPKEINSLLGLETGHISIGLSAV

SEQ ID NO: 2030663 - protein, 22 aa, Staphylococcus
NDVPTFAICHGPLVLIDTDDLN

SEQ ID NO: 2030664 - protein, 19 aa, Staphylococcus
NDVQSGFEIAKTAFQNSVD

SEQ ID NO: 2030665 - protein, 17 aa, Staphylococcus
NDVRIQKVIDLLRDNAK

SEQ ID NO: 2030666 - protein, 24 aa, Staphylococcus
NDVSIRDIDEWIGLLDQLEEKVKQ

SEQ ID NO: 2030667 - protein, 22 aa, Staphylococcus
NDVTFPNTFKVFGSDDSKVIFC

SEQ ID NO: 2030668 - protein, 17 aa, Staphylococcus
NDVVKNFTANGLLSIGA

SEQ ID NO: 2030669 - protein, 17 aa, Staphylococcus
NDVVKNFTANGLLSMGA

SEQ ID NO: 2030670 - protein, 22 aa, Staphylococcus
NDWVNMLGVVPVIRALREKAMT

SEQ ID NO: 2030671 - protein, 19 aa, Staphylococcus
NDYDLPVIMLTARDALSDK

SEQ ID NO: 2030672 - protein, 25 aa, Staphylococcus
NDYFKLRFFQKAILKAIDVEWINQV

SEQ ID NO: 2030673 - protein, 17 aa, Staphylococcus
NDYGDIFGRMIKSNLMT

SEQ ID NO: 2030674 - protein, 19 aa, Staphylococcus
NDYHMRNGVTLIDPTQTYI

SEQ ID NO: 2030675 - protein, 24 aa, Staphylococcus
NDYIKPFSFLPMRKGMLSRVDALY

SEQ ID NO: 2030676 - protein, 24 aa, Staphylococcus
NDYKEKLIIPGFFGVSKHNFIVTF

SEQ ID NO: 2030677 - protein, 23 aa, Staphylococcus
NDYKYNRYFSMDDVIYLEYANEK

SEQ ID NO: 2030678 - protein, 21 aa, Staphylococcus
NDYLKNMMFVLANNRHLALIN

SEQ ID NO: 2030679 - protein, 18 aa, Staphylococcus
NDYLKYSYHLTLDHIKLL

SEQ ID NO: 2030680 - protein, 18 aa, Staphylococcus
NDYPTEVERLLDIVEIKT

SEQ ID NO: 2030681 - protein, 17 aa, Staphylococcus
NDYRAIFVHPWQYDHVI

SEQ ID NO: 2030682 - protein, 17 aa, Staphylococcus
NDYSYKGDMFMRAIEDY

SEQ ID NO: 2030683 - protein, 32 aa, Staphylococcus
NDYVGRIGIGRVFRGKMHVGDNVSLIKLDGSV

SEQ ID NO: 2030684 - protein, 31 aa, Staphylococcus; identical to SEQ ID NO: 1646491

SEQ ID NO: 2030685 - protein, 17 aa, Staphylococcus
NEACGVAAFKKDENGQL

SEQ ID NO: 2030686 - protein, 19 aa, Staphylococcus
NEAEALYNCMKKIDQETQY

SEQ ID NO: 2030687 - protein, 19 aa, Staphylococcus
NEAFFKYIENYLIEHESYF

SEQ ID NO: 2030688 - protein, 20 aa, Staphylococcus
NEAIEFSYDFELLHETSHKA

SEQ ID NO: 2030689 - protein, 21 aa, Staphylococcus
NEALLPYLIPDYFDTNELLSA

SEQ ID NO: 2030690 - protein, 20 aa, Staphylococcus
NEALPGFIFLDTKQDYPNYN

SEQ ID NO: 2030691 - protein, 41 aa, Staphylococcus
NEALVRQVVFDLGKRLGNKNSRVDFGLSQWGLKQQPGESYI

SEQ ID NO: 2030692 - protein, 23 aa, Staphylococcus
NEAQYTLFLYDWRVFESEASITY

SEQ ID NO: 2030693 - protein, 27 aa, Staphylococcus
NEARVDLSLNVRRVYFSTFNREELNDS

SEQ ID NO: 2030694 - protein, 25 aa, Staphylococcus
NEASEILHRFHESIDVLITGHQHRD

SEQ ID NO: 2030695 - protein, 22 aa, Staphylococcus
NEASFGYRCIGSCGLDSIRVIK

SEQ ID NO: 2030696 - protein, 25 aa, Staphylococcus
NEAVDRACYLLEHYASGEVLKDRVA

SEQ ID NO: 2030697 - protein, 32 aa, Staphylococcus
NEAWFDLFKELGFKLGVLEFYLIEGHDLAQLN

SEQ ID NO: 2030698 - protein, 20 aa, Staphylococcus
NEAYKSWKKWSHKDRAELML

SEQ ID NO: 2030699 - protein, 25 aa, Staphylococcus
NEAYKSWKRWSHKDRAEFLIRVAAI

SEQ ID NO: 2030700 - protein, 18 aa, Staphylococcus
NEAYRMAMEHDYACILLD

SEQ ID NO: 2030701 - protein, 24 aa, Staphylococcus
NEAYTRVKGIKEWHFGMFEGESEL

SEQ ID NO: 2030702 - protein, 19 aa, Staphylococcus
NECGYRLIDRANKQFELTE

SEQ ID NO: 2030703 - protein, 18 aa, Staphylococcus
NECINRTAKFEVVNEEFV

SEQ ID NO: 2030704 - protein, 20 aa, Staphylococcus
NECLYRSGDLVRLQEDGHID

SEQ ID NO: 2030705 - protein, 34 aa, Staphylococcus
NEDAIKFPSFRPDSWRGKRYLYSGLFDNDKKLKD

SEQ ID NO: 2030706 - protein, 33 aa, Staphylococcus
NEDAIKFPSFRPDSWRGKRYLYTGLFDNDKKLK

SEQ ID NO: 2030707 - protein, 34 aa, Staphylococcus; identical to SEQ ID NO: 1810327

SEQ ID NO: 2030708 - protein, 24 aa, Staphylococcus
NEDEIRRFLPRKVRTFQLKEAQRL

SEQ ID NO: 2030709 - protein, 25 aa, Staphylococcus
NEDEIRRFLPRKVRTFQLQEAQRLV

SEQ ID NO: 2030710 - protein, 26 aa, Staphylococcus
NEDGIPIYLGMPMGVIIEAEGKTIYH

SEQ ID NO: 2030711 - protein, 25 aa, Staphylococcus
NEDGIPIYLGMPMGVIIETEGKTIY

SEQ ID NO: 2030712 - protein, 19 aa, Staphylococcus
NEDIIAFKNGIELSDGKVK

SEQ ID NO: 2030713 - protein, 20 aa, Staphylococcus
NEDIIDIYLSIKVLESSENL

SEQ ID NO: 2030714 - protein, 20 aa, Staphylococcus
NEDIKNLAIRTCQTLGITRG

SEQ ID NO: 2030715 - protein, 25 aa, Staphylococcus
NEDLNVYTDWSFVIEYSKYVNKFMR

SEQ ID NO: 2030716 - protein, 18 aa, Staphylococcus
NEDLSIYTDWSFTLEYMK

SEQ ID NO: 2030717 - protein, 19 aa, Staphylococcus
NEDVGCYFLDIQLEADING

SEQ ID NO: 2030718 - protein, 20 aa, Staphylococcus
NEDYYALVVLNTMFGGDPSS

SEQ ID NO: 2030719 - protein, 17 aa, Staphylococcus
NEENFSYYDRFRDRIMF

SEQ ID NO: 2030720 - protein, 18 aa, Staphylococcus
NEENFSYYDRFRDRIMFP

SEQ ID NO: 2030721 - protein, 17 aa, Staphylococcus
NEENFSYYDRFRNRIMF

SEQ ID NO: 2030722 - protein, 17 aa, Staphylococcus
NEETIEIDGIKAFYTHG

SEQ ID NO: 2030723 - protein, 24 aa, Staphylococcus
NEETIGFIIGPRLNAVGRLEDASL

SEQ ID NO: 2030724 - protein, 24 aa, Staphylococcus
NEETVGFIIGPRLNAVGRLEDASL

SEQ ID NO: 2030725 - protein, 22 aa, Staphylococcus
NEEVRLSVPEHVLFNHAEQAEL

SEQ ID NO: 2030726 - protein, 20 aa, Staphylococcus
NEEYVKISLIGSGMRDMSGV

SEQ ID NO: 2030727 - protein, 24 aa, Staphylococcus
NEEYVKISLIGSGMRDMSGVASKA

SEQ ID NO: 2030728 - protein, 23 aa, Staphylococcus
NEFAHYFVIEFNEKIIGYIGIWL

SEQ ID NO: 2030729 - protein, 23 aa, Staphylococcus
NEFDATYLIDGDWDYAYTGPQNH

SEQ ID NO: 2030730 - protein, 20 aa, Staphylococcus
NEFDKVIGVDRIKVVHVNDS

SEQ ID NO: 2030731 - protein, 23 aa, Staphylococcus
NEFDQEFKLGVLEGKTLVIGDDV

SEQ ID NO: 2030732 - protein, 17 aa, Staphylococcus
NEFGELVSEEIAVQTKQ

SEQ ID NO: 2030733 - protein, 29 aa, Staphylococcus
NEFGIPKTWKLVAQMPFGNVREQAGEKDI

SEQ ID NO: 2030734 - protein, 19 aa, Staphylococcus
NEFKHHRGATSYPPKMITS

SEQ ID NO: 2030735 - protein, 17 aa, Staphylococcus
NEFKQIILKTIFGENEV

SEQ ID NO: 2030736 - protein, 25 aa, Staphylococcus
NEFQLLKILSHHVGKVLTYQVLLKS

SEQ ID NO: 2030737 - protein, 24 aa, Staphylococcus
NEGDPCMRHELIFHTNKGMPFDYS

SEQ ID NO: 2030738 - protein, 23 aa, Staphylococcus
NEGEVPFKPSRVILQDFTGVPAV

SEQ ID NO: 2030739 - protein, 19 aa, Staphylococcus
NEGFIKLVIDQTYGEILGA

SEQ ID NO: 2030740 - protein, 25 aa, Staphylococcus
NEGHISTSLIQRHFQIGYNRAARII

SEQ ID NO: 2030741 - protein, 23 aa, Staphylococcus
NEGHTPLIHCANISEMLDIDLYV

SEQ ID NO: 2030742 - protein, 23 aa, Staphylococcus
NEGHTPLIHCENLSKMLDIDLYV

SEQ ID NO: 2030743 - protein, 22 aa, Staphylococcus
NEGNSILEFGNKVAAITTTRYG

SEQ ID NO: 2030744 - protein, 20 aa, Staphylococcus
NEGQTLFFGGLARIDYISGG

SEQ ID NO: 2030745 - protein, 21 aa, Staphylococcus
NEGYNLTFFAFFVKAVAEALK

SEQ ID NO: 2030746 - protein, 22 aa, Staphylococcus
NEGYRLMKEHLSSIQGDFELEA

SEQ ID NO: 2030747 - protein, 30 aa, Staphylococcus
NEHAGRFGVNLRYPLGFEFEEAIHRFEDEI

SEQ ID NO: 2030748 - protein, 19 aa, Staphylococcus
NEHFNTVGVGVDFNDERQP

SEQ ID NO: 2030749 - protein, 19 aa, Staphylococcus
NEHIGECWGISAHPNGKSE

SEQ ID NO: 2030750 - protein, 19 aa, Staphylococcus
NEHKEFIELTGDEMTPYAT

SEQ ID NO: 2030751 - protein, 23 aa, Staphylococcus
NEHKMHISGLWTHFGYADEFDVP

SEQ ID NO: 2030752 - protein, 25 aa, Staphylococcus
NEHYDYLISDSMFSFGNLIAQKLHI

SEQ ID NO: 2030753 - protein, 19 aa, Staphylococcus
NEIAEKLTFAEVIDELRAG

SEQ ID NO: 2030754 - protein, 19 aa, Staphylococcus
NEIANVFLIKLKVESSNQK

SEQ ID NO: 2030755 - protein, 20 aa, Staphylococcus
NEIAQFWIQQMLNNGLLEDV

SEQ ID NO: 2030756 - protein, 25 aa, Staphylococcus
NEIDKGFCLLVGIGKDTTEADIDAV

SEQ ID NO: 2030757 - protein, 21 aa, Staphylococcus
NEIDYLWNELATFKDDYLLKI

SEQ ID NO: 2030758 - protein, 17 aa, Staphylococcus
NEIEAYYLPQGVITTHY

SEQ ID NO: 2030759 - protein, 25 aa, Staphylococcus
NEIEIHKASLLEIMFKDNHSKEVET

SEQ ID NO: 2030760 - protein, 24 aa, Staphylococcus
NEIEIYKSSLLEVLFNKSNISEEE

SEQ ID NO: 2030761 - protein, 23 aa, Staphylococcus
NEIEVCYYLKELLQRYDIESKII

SEQ ID NO: 2030762 - protein, 18 aa, Staphylococcus
NEIFEFIANDALSFDIKV

SEQ ID NO: 2030763 - protein, 20 aa, Staphylococcus
NEIGIRLKNPVDLEYGDILY

SEQ ID NO: 2030764 - protein, 21 aa, Staphylococcus
NEIGIRLKQPIDLQYGDILYK

SEQ ID NO: 2030765 - protein, 21 aa, Staphylococcus
NEIIFIIKHLSYRNGENNQIS

SEQ ID NO: 2030766 - protein, 28 aa, Staphylococcus
NEIIRDYLEFMAFLGVLPTYYKGKNREN

SEQ ID NO: 2030767 - protein, 23 aa, Staphylococcus
NEIIWLYQYFTDIPIAPTTYTID

SEQ ID NO: 2030768 - protein, 19 aa, Staphylococcus
NEIKEAFISLDNYMINEEP

SEQ ID NO: 2030769 - protein, 31 aa, Staphylococcus
NEIKLQTGVSFAFQGCEHINRAITIERSDFN

SEQ ID NO: 2030770 - protein, 24 aa, Staphylococcus
NEIKSLKFGLSFSPYRIVITENNN

SEQ ID NO: 2030771 - protein, 21 aa, Staphylococcus
NEIKVRRIIEEDGQQYDGELD

SEQ ID NO: 2030772 - protein, 25 aa, Staphylococcus
NEILRSNFNIKHFVDYAEKLQYPTQ

SEQ ID NO: 2030773 - protein, 25 aa, Staphylococcus
NEIMQRLGHAFALLQVSGEILNDIE

SEQ ID NO: 2030774 - protein, 20 aa, Staphylococcus
NEIQIGYVFENYPKVQTNGI

SEQ ID NO: 2030775 - protein, 18 aa, Staphylococcus
NEITRCIYTRIEAASVGL

SEQ ID NO: 2030776 - protein, 17 aa, Staphylococcus
NEITVDSYLKWINDDIN

SEQ ID NO: 2030777 - protein, 20 aa, Staphylococcus
NEIYLIIDAFIKKYQLKNPH

SEQ ID NO: 2030778 - protein, 26 aa, Staphylococcus
NEKFARPFSYNFYKAIDHLKRTINAG

SEQ ID NO: 2030779 - protein, 23 aa, Staphylococcus
NEKFKSYLMEAAKKMKVFDLCLI

SEQ ID NO: 2030780 - protein, 23 aa, Staphylococcus
NEKLEECGQCSSCIQQNKTYDMT

SEQ ID NO: 2030781 - protein, 21 aa, Staphylococcus
NEKLREAARIGDLELQKYYLE

SEQ ID NO: 2030782 - protein, 21 aa, Staphylococcus
NEKQKILSILGDEVIEIHHIG

SEQ ID NO: 2030783 - protein, 26 aa, Staphylococcus
NEKQRMTIEYSIPRWIIEHWITHYGI

SEQ ID NO: 2030784 - protein, 25 aa, Staphylococcus
NEKRRGDFEKVIPLIDLYDNAQSDT

SEQ ID NO: 2030785 - protein, 17 aa, Staphylococcus
NEKSGKRGFILAPSNNV

SEQ ID NO: 2030786 - protein, 27 aa, Staphylococcus
NEKTAKILLLIYLEIMPLLSEWYEEDK

SEQ ID NO: 2030787 - protein, 26 aa, Staphylococcus
NEKVLKKKLPMSLIHEGVGEVVYDSK

SEQ ID NO: 2030788 - protein, 25 aa, Staphylococcus
NEKVYTCLKSVFGELNIISEQLKLL

SEQ ID NO: 2030789 - protein, 25 aa, Staphylococcus
NEKYKEIDIYSGIEMDILPDGQLDY

SEQ ID NO: 2030790 - protein, 20 aa, Staphylococcus
NEKYRTWDWNYGKNPKYNFE

SEQ ID NO: 2030791 - protein, 23 aa, Staphylococcus
NEKYRTWEWNYGKNPKYNFEREE

SEQ ID NO: 2030792 - protein, 24 aa, Staphylococcus
NELALDILNEWSFNVAEGLAQIQI

SEQ ID NO: 2030793 - protein, 25 aa, Staphylococcus
NELARAIRYRTRIVTLEGDIVNPGG

SEQ ID NO: 2030794 - protein, 25 aa, Staphylococcus
NELARAIRYRTRIVTLEGDVVNPGG

SEQ ID NO: 2030795 - protein, 25 aa, Staphylococcus
NELARSIRYRTRIVTLEGDVVNPGG

SEQ ID NO: 2030796 - protein, 24 aa, Staphylococcus
NELCIELDPGMAFGTGDHPTTSMC

SEQ ID NO: 2030797 - protein, 18 aa, Staphylococcus
NELCMSATTALFAQLYTI

SEQ ID NO: 2030798 - protein, 26 aa, Staphylococcus
NELDIPRVLGDIIICTDVAHEQAENY

SEQ ID NO: 2030799 - protein, 24 aa, Staphylococcus
NELDKCFYKYYGLNKLINLLIKEK

SEQ ID NO: 2030800 - protein, 17 aa, Staphylococcus
NELDQLIYAVGTRREYY

SEQ ID NO: 2030801 - protein, 23 aa, Staphylococcus
NELECKYIPIFSFYIPKEDNFDD

SEQ ID NO: 2030802 - protein, 22 aa, Staphylococcus
NELEKGWACLYVDANTCYWFHP

SEQ ID NO: 2030803 - protein, 20 aa, Staphylococcus
NELERVLCRIFEEILHVDRV

SEQ ID NO: 2030804 - protein, 23 aa, Staphylococcus
NELEVCKYLKSLLSKYDIDSKIQ

SEQ ID NO: 2030805 - protein, 17 aa, Staphylococcus
NELGEALIQAALDHQSK

SEQ ID NO: 2030806 - protein, 19 aa, Staphylococcus
NELHLRFNKSELMMIGEDF

SEQ ID NO: 2030807 - protein, 17 aa, Staphylococcus
NELIASVFWTHRPSQIE

SEQ ID NO: 2030808 - protein, 22 aa, Staphylococcus
NELIESGCEVIALDATKQKRPK

SEQ ID NO: 2030809 - protein, 24 aa, Staphylococcus
NELKARIANQYPYKEWLDNHKVDL

SEQ ID NO: 2030810 - protein, 21 aa, Staphylococcus
NELKPLCINSNFVEIDAADDY

SEQ ID NO: 2030811 - protein, 21 aa, Staphylococcus
NELKPLCMNSNFVETLQTNDY

SEQ ID NO: 2030812 - protein, 17 aa, Staphylococcus
NELKPLCQNSGFVEIEQ

SEQ ID NO: 2030813 - protein, 17 aa, Staphylococcus
NELKRPPVSNIDELVIV

SEQ ID NO: 2030814 - protein, 17 aa, Staphylococcus
NELKRPPVSNIDGLIIV

SEQ ID NO: 2030815 - protein, 23 aa, Staphylococcus
NELKRPPVSNIDHLVIVMSAVEP

SEQ ID NO: 2030816 - protein, 25 aa, Staphylococcus
NELKSRIATQYPYKAWLAKHKIDLH

SEQ ID NO: 2030817 - protein, 18 aa, Staphylococcus
NELLYSIDHLNICRRMLL

SEQ ID NO: 2030818 - protein, 22 aa, Staphylococcus
NELPSNMIWFNLDNRDNHTFPV

SEQ ID NO: 2030819 - protein, 24 aa, Staphylococcus
NELQFFKYVPFFKSFNTSAIEIKD

SEQ ID NO: 2030820 - protein, 21 aa, Staphylococcus
NELQMIFQWEHMSLDYDPIRG

SEQ ID NO: 2030821 - protein, 22 aa, Staphylococcus
NELQQLAYRFVFIEKGEIIEDI

SEQ ID NO: 2030822 - protein, 21 aa, Staphylococcus
NELQSALSIGEICPVCGNEIQ

SEQ ID NO: 2030823 - protein, 21 aa, Staphylococcus
NELRAVIGYMPMITLYSKKSI

SEQ ID NO: 2030824 - protein, 21 aa, Staphylococcus
NELRMGATTSLFAQMFTIDVL

SEQ ID NO: 2030825 - protein, 24 aa, Staphylococcus
NELSKAYYERGWVMQIHFGAIRNN

SEQ ID NO: 2030826 - protein, 23 aa, Staphylococcus
NELSQIRPLRIMSPHAVKDGKTT

SEQ ID NO: 2030827 - protein, 17 aa, Staphylococcus
NELYDSEWIQWYEAQYN

SEQ ID NO: 2030828 - protein, 20 aa, Staphylococcus
NELYFKAWNGLYHEIHNEPE

SEQ ID NO: 2030829 - protein, 32 aa, Staphylococcus
NELYRMFSKSFKRSISKRVLKETLDLYMKYAK

SEQ ID NO: 2030830 - protein, 17 aa, Staphylococcus
NEMCAHVRKTLADLSSQ

SEQ ID NO: 2030831 - protein, 17 aa, Staphylococcus
NEMLKSFLQRHQYSKKT

SEQ ID NO: 2030832 - protein, 21 aa, Staphylococcus
NEMLLAGELTPVFFGSALANF

SEQ ID NO: 2030833 - protein, 22 aa, Staphylococcus
NEMRSEARAMLKEKNIDASDEL

SEQ ID NO: 2030834 - protein, 17 aa, Staphylococcus
NEMSFDTMVLFGDHAAS

SEQ ID NO: 2030835 - protein, 21 aa, Staphylococcus
NEMSFDTMVLFGDHAASPHGT

SEQ ID NO: 2030836 - protein, 21 aa, Staphylococcus
NENCGVASFKIMQNGDLELIN

SEQ ID NO: 2030837 - protein, 17 aa, Staphylococcus
NENEGKTLLIINGAGGV

SEQ ID NO: 2030838 - protein, 24 aa, Staphylococcus
NENEIDLEHGFECTAKFRYRQKDT

SEQ ID NO: 2030839 - protein, 24 aa, Staphylococcus
NENEILKAGIAYQKKLQALTQNYE

SEQ ID NO: 2030840 - protein, 18 aa, Staphylococcus
NENKAKKPFAYKEDEDGV

SEQ ID NO: 2030841 - protein, 17 aa, Staphylococcus
NENKSTILLPVPKTIYP

SEQ ID NO: 2030842 - protein, 26 aa, Staphylococcus
NENVRIILRRGPLFASLKEMYIVNFI

SEQ ID NO: 2030843 - protein, 25 aa, Staphylococcus
NENYKEPLKLCVIAQELYFNESFIS

SEQ ID NO: 2030844 - protein, 23 aa, Staphylococcus
NENYRRLKGIKEWNYGIYEGESE

SEQ ID NO: 2030845 - protein, 26 aa, Staphylococcus
NEPALELVEGLKLVTEFVQDEKATQE

SEQ ID NO: 2030846 - protein, 23 aa, Staphylococcus
NEPDLFLQICCIGAGVPQVNYRG

SEQ ID NO: 2030847 - protein, 20 aa, Staphylococcus
NEPFMYKLVDIVADIMEPYY

SEQ ID NO: 2030848 - protein, 17 aa, Staphylococcus
NEPIFVFEIDHKVAGFA

SEQ ID NO: 2030849 - protein, 17 aa, Staphylococcus
NEPKHMLPYGLQAKIDC

SEQ ID NO: 2030850 - protein, 23 aa, Staphylococcus
NEPLKPLANYSFDIPDIKNNKDK

SEQ ID NO: 2030851 - protein, 22 aa, Staphylococcus
NEPNKAFLFGINYVILTDDTDF

SEQ ID NO: 2030852 - protein, 21 aa, Staphylococcus
NEPNKAFLFGINYVLITNDQD

SEQ ID NO: 2030853 - protein, 21 aa, Staphylococcus
NEPNKAFLFGINYVVLSNDDS

SEQ ID NO: 2030854 - protein, 27 aa, Staphylococcus
NEPSMKWELGIIWRKDIIVDSLTKNWI

SEQ ID NO: 2030855 - protein, 17 aa, Staphylococcus
NEPYILVTGTIGFGEVP

SEQ ID NO: 2030856 - protein, 18 aa, Staphylococcus
NEPYVIMSTFVVTANTLN

SEQ ID NO: 2030857 - protein, 27 aa, Staphylococcus
NEQQRKGWSQVKMKAVLHNQAIQNVVD

SEQ ID NO: 2030858 - protein, 17 aa, Staphylococcus
NEQTTPRGYAWQLEKAL

SEQ ID NO: 2030859 - protein, 19 aa, Staphylococcus
NEQVANWTVLYTKIHNFHW

SEQ ID NO: 2030860 - protein, 26 aa, Staphylococcus
NEQVFSICGMDVLKIEDYHVGEVRDM

SEQ ID NO: 2030861 - protein, 24 aa, Staphylococcus
NERAKELIDLVGLNGRENAYPSEL

SEQ ID NO: 2030862 - protein, 25 aa, Staphylococcus
NERARLKDIVDLFLDSGLGKDAFSI

SEQ ID NO: 2030863 - protein, 28 aa, Staphylococcus
NEREPSVLPARFPNLLVNGASGIAVGMA

SEQ ID NO: 2030864 - protein, 19 aa, Staphylococcus
NERFIITRGLDKCLFGYTL

SEQ ID NO: 2030865 - protein, 24 aa, Staphylococcus
NERFLEVWNLVFSEFNHNKDHTYT

SEQ ID NO: 2030866 - protein, 20 aa, Staphylococcus
NERFSCGTIDISLSIEHNCI

SEQ ID NO: 2030867 - protein, 22 aa, Staphylococcus
NERGITFDLLRLSVGLEDPDEL

SEQ ID NO: 2030868 - protein, 23 aa, Staphylococcus
NERHLAALSFLTFVALDENGKPT

SEQ ID NO: 2030869 - protein, 23 aa, Staphylococcus
NERIKIRYLKCPCKIKHDEERFN

SEQ ID NO: 2030870 - protein, 17 aa, Staphylococcus
NERIKVYVNKVEQTTKG

SEQ ID NO: 2030871 - protein, 27 aa, Staphylococcus
NERKAVWAIYAVCRMIDDSIDEYENPE

SEQ ID NO: 2030872 - protein, 19 aa, Staphylococcus
NERLGMLLGGEIASEIYKD

SEQ ID NO: 2030873 - protein, 27 aa, Staphylococcus
NERLTAKNSFKFIYSILSKHQSASLPD

SEQ ID NO: 2030874 - protein, 19 aa, Staphylococcus
NERPVILVADGEDTAKDMY

SEQ ID NO: 2030875 - protein, 33 aa, Staphylococcus; identical to SEQ ID NO: 1652563

SEQ ID NO: 2030876 - protein, 19 aa, Staphylococcus
NERYPTFILGFGGISNEDL

SEQ ID NO: 2030877 - protein, 27 aa, Staphylococcus
NESELYLTIPHRFRIMRYHSLVSEMKS

SEQ ID NO: 2030878 - protein, 24 aa, Staphylococcus
NESFGNLPTVVGFFPNIVEGDVYT

SEQ ID NO: 2030879 - protein, 17 aa, Staphylococcus
NESFVLVDHSKFKQVYF

SEQ ID NO: 2030880 - protein, 21 aa, Staphylococcus
NESHWYYRATSKGIYLSLGAV

SEQ ID NO: 2030881 - protein, 27 aa, Staphylococcus
NESKYCPNCGKLLVYDYIHYNQIGHYH

SEQ ID NO: 2030882 - protein, 27 aa, Staphylococcus
NESKYCPNCGRLLAYDYIHYNQIGHYH

SEQ ID NO: 2030883 - protein, 25 aa, Staphylococcus
NESKYCPNCGRLLTYDYTHYNQLGH

SEQ ID NO: 2030884 - protein, 20 aa, Staphylococcus
NESPIAKSLIGKHLDDEVRV

SEQ ID NO: 2030885 - protein, 21 aa, Staphylococcus
NESRHGVGILGYAVDKGVELN

SEQ ID NO: 2030886 - protein, 26 aa, Staphylococcus
NESTVCILEAMKLFNEIQAEVSGEIV

SEQ ID NO: 2030887 - protein, 26 aa, Staphylococcus
NESTVCILEAMKLFNEIQAEVTGEIA

SEQ ID NO: 2030888 - protein, 25 aa, Staphylococcus
NESVPDIADRYIKAFYEDVGALNVK

SEQ ID NO: 2030889 - protein, 22 aa, Staphylococcus
NETDIRIAFSCVEKDDIPHVFD

SEQ ID NO: 2030890 - protein, 20 aa, Staphylococcus
NETEAELLSGISITNQDNMQ

SEQ ID NO: 2030891 - protein, 20 aa, Staphylococcus
NETERLISVEWVKSKDSTQR

SEQ ID NO: 2030892 - protein, 24 aa, Staphylococcus
NETFKTNIFGMFFLTQAAVPHLSK

SEQ ID NO: 2030893 - protein, 17 aa, Staphylococcus
NETGLSPHTIRFYEKEG

SEQ ID NO: 2030894 - protein, 23 aa, Staphylococcus
NETHFKVLWVMHHLICDNISWLI

SEQ ID NO: 2030895 - protein, 24 aa, Staphylococcus
NETIKGQVTILYFYPRDNTPTCTT

SEQ ID NO: 2030896 - protein, 18 aa, Staphylococcus
NETIKWAQRKGLRRLELT

SEQ ID NO: 2030897 - protein, 18 aa, Staphylococcus
NETIRIDWDREHPRVIWD

SEQ ID NO: 2030898 - protein, 17 aa, Staphylococcus
NETISHVTIYEGKYHQV

SEQ ID NO: 2030899 - protein, 18 aa, Staphylococcus
NETISIDWNREHPRVIWD

SEQ ID NO: 2030900 - protein, 25 aa, Staphylococcus
NETMSELLLDFAYDTFKYEYERNNT

SEQ ID NO: 2030901 - protein, 24 aa, Staphylococcus
NETNAMPGFTAFSMYPNLWENMGL

SEQ ID NO: 2030902 - protein, 22 aa, Staphylococcus
NETNAMPGFTAFSMYPSLWENM

SEQ ID NO: 2030903 - protein, 23 aa, Staphylococcus
NETPKRFQFIVKIHQALTLHADY

SEQ ID NO: 2030904 - protein, 23 aa, Staphylococcus
NETVEAMQGYLMKSLKSEFAEMH

SEQ ID NO: 2030905 - protein, 23 aa, Staphylococcus
NETYVKISLIGSGMRDMSGVASK

SEQ ID NO: 2030906 - protein, 28 aa, Staphylococcus
NETYYIICAAGMRSAKVVKYLEDHDIHA

SEQ ID NO: 2030907 - protein, 25 aa, Staphylococcus
NEVCHKYEIPWVYGAAVGSKGTVYG

SEQ ID NO: 2030908 - protein, 22 aa, Staphylococcus
NEVDRYVAAHAYLYHRYYHSHM

SEQ ID NO: 2030909 - protein, 20 aa, Staphylococcus
NEVIKDFPILEQQVNGKRLA

SEQ ID NO: 2030910 - protein, 28 aa, Staphylococcus
NEVKDMYRRVNFLFGDIVKVTPSSKVVG

SEQ ID NO: 2030911 - protein, 27 aa, Staphylococcus
NEVKESKANIIIAHGLAEHLDRYDELV

SEQ ID NO: 2030912 - protein, 20 aa, Staphylococcus
NEVKKASLLDSLNAGDVIEG

SEQ ID NO: 2030913 - protein, 17 aa, Staphylococcus
NEVKLEFMIRKDQLNIA

SEQ ID NO: 2030914 - protein, 19 aa, Staphylococcus
NEVLLAMGVPDARIEGSIR

SEQ ID NO: 2030915 - protein, 19 aa, Staphylococcus
NEVLLSMGISESRIEGSIR

SEQ ID NO: 2030916 - protein, 18 aa, Staphylococcus
NEVLNIIERAFSYQLLIF

SEQ ID NO: 2030917 - protein, 33 aa, Staphylococcus
NEVLYRKILEFYHPEFKKEYVILSEEGAQSDDD

SEQ ID NO: 2030918 - protein, 21 aa, Staphylococcus
NEVMGIPSLLIFENGQKQAHL

SEQ ID NO: 2030919 - protein, 24 aa, Staphylococcus
NEVPACNEVQCGWAASHSLEGAKE

SEQ ID NO: 2030920 - protein, 23 aa, Staphylococcus
NEVPEINNALIIEVPKEDGTFEL

SEQ ID NO: 2030921 - protein, 23 aa, Staphylococcus
NEVPEINNALIIEVPKNDGTFKL

SEQ ID NO: 2030922 - protein, 21 aa, Staphylococcus
NEVPIPRFWTIEGNNNTAFIK

SEQ ID NO: 2030923 - protein, 18 aa, Staphylococcus
NEVPKVLNGLGIALVSTS

SEQ ID NO: 2030924 - protein, 24 aa, Staphylococcus
NEVSEPKANIIVVHGLAEHLKRYD

SEQ ID NO: 2030925 - protein, 18 aa, Staphylococcus
NEVSEVPVIFGILTTESI

SEQ ID NO: 2030926 - protein, 18 aa, Staphylococcus
NEVTDLFQAISLNNNNKC

SEQ ID NO: 2030927 - protein, 36 aa, Staphylococcus
NEWNLKLGDLAMIWREGCIIRAQFLQKIKDAYDNNS

SEQ ID NO: 2030928 - protein, 36 aa, Staphylococcus
NEWNLKLGELAMIWREGCIIRAQFLQKIKEAYDNDT

SEQ ID NO: 2030929 - protein, 23 aa, Staphylococcus
NEWVNMLGVVPVIRALRDKAMDI

SEQ ID NO: 2030930 - protein, 23 aa, Staphylococcus
NEWVNMLGVVPVIRALREKAMSI

SEQ ID NO: 2030931 - protein, 17 aa, Staphylococcus
NEYDKIMIKEIINSLLI

SEQ ID NO: 2030932 - protein, 25 aa, Staphylococcus
NEYEHFRLGISVSKKIGNAVTRNRI

SEQ ID NO: 2030933 - protein, 18 aa, Staphylococcus
NEYIKLRGHKNLEEIYKK

SEQ ID NO: 2030934 - protein, 17 aa, Staphylococcus
NEYLIPLVIQLDEGIKK

SEQ ID NO: 2030935 - protein, 18 aa, Staphylococcus
NEYNISLINIYVLIDIAN

SEQ ID NO: 2030936 - protein, 26 aa, Staphylococcus
NEYPKAIKPWILPNFESLVRHEKIDM

SEQ ID NO: 2030937 - protein, 17 aa, Staphylococcus
NEYRFQILVKYKREPEL

SEQ ID NO: 2030938 - protein, 19 aa, Staphylococcus
NFAEKWKVILDELRKLAKE

SEQ ID NO: 2030939 - protein, 22 aa, Staphylococcus
NFASAYKAPAIFVIQNNNYAIS

SEQ ID NO: 2030940 - protein, 20 aa, Staphylococcus
NFASAYKVPAIFVIQNNNYA

SEQ ID NO: 2030941 - protein, 22 aa, Staphylococcus
NFASGFTMMGSIIKGGKQFNSV

SEQ ID NO: 2030942 - protein, 26 aa, Staphylococcus
NFDAAKAFAKEAGFPLMIKATSGGGG

SEQ ID NO: 2030943 - protein, 20 aa, Staphylococcus
NFDFPNVIRAIQFTNNETSY

SEQ ID NO: 2030944 - protein, 25 aa, Staphylococcus
NFDFRLRHDQTWDFIYNGGISVAYL

SEQ ID NO: 2030945 - protein, 25 aa, Staphylococcus
NFDGVTFPDSFKVFGSDNSKVIFCE

SEQ ID NO: 2030946 - protein, 40 aa, Staphylococcus
NFDIRHGIRFTIDLEVYKEFIAGGILRIIYAWLKEGQERS

SEQ ID NO: 2030947 - protein, 25 aa, Staphylococcus
NFDKFAGFKSYRFLKPVQGTTYKVY

SEQ ID NO: 2030948 - protein, 29 aa, Staphylococcus
NFDKLKARLILMITRFSLYLRKATPEAKN

SEQ ID NO: 2030949 - protein, 28 aa, Staphylococcus
NFDKLKARLILMITRFSVYLRKATPEAK

SEQ ID NO: 2030950 - protein, 20 aa, Staphylococcus
NFDKSIFENVNFFKTLISKS

SEQ ID NO: 2030951 - protein, 30 aa, Staphylococcus
NFDPCVDILKNWRNTIVNTRAYGTTADTVI

SEQ ID NO: 2030952 - protein, 29 aa, Staphylococcus
NFDPCVDILKNWRNTIVNTRAYGTTAETV

SEQ ID NO: 2030953 - protein, 22 aa, Staphylococcus
NFDQHLFDGFSMGNPKIETGDI

SEQ ID NO: 2030954 - protein, 19 aa, Staphylococcus
NFDRRIDIVDGKINKDNKG

SEQ ID NO: 2030955 - protein, 25 aa, Staphylococcus
NFEAAKAFAQEAGFPLMIKATSGGG

SEQ ID NO: 2030956 - protein, 25 aa, Staphylococcus
NFEELQLKPTISFLTTSLFYSMIDN

SEQ ID NO: 2030957 - protein, 20 aa, Staphylococcus
NFEGTIIFVSHDRYFINQLA

SEQ ID NO: 2030958 - protein, 21 aa, Staphylococcus
NFEHLKESLDLIDLSEINVEG

SEQ ID NO: 2030959 - protein, 20 aa, Staphylococcus
NFESLEHAIIHFELEGTNYL

SEQ ID NO: 2030960 - protein, 18 aa, Staphylococcus
NFFAKRGYLEPAMKNLEE

SEQ ID NO: 2030961 - protein, 23 aa, Staphylococcus
NFFQNVRIQKHFDALFDALNTQL

SEQ ID NO: 2030962 - protein, 19 aa, Staphylococcus
NFFRMLQNNVRFRNEECMV

SEQ ID NO: 2030963 - protein, 18 aa, Staphylococcus
NFGCPYFIVRHINENERL

SEQ ID NO: 2030964 - protein, 18 aa, Staphylococcus
NFGCPYFVVRHIPENELV

SEQ ID NO: 2030965 - protein, 19 aa, Staphylococcus
NFGKSFKYLPNYLGSNKNS

SEQ ID NO: 2030966 - protein, 24 aa, Staphylococcus
NFINKIWNAARFSLMNIGEDFNVE

SEQ ID NO: 2030967 - protein, 24 aa, Staphylococcus
NFIRSIEMFKYLFTLPTEGENSRE

SEQ ID NO: 2030968 - protein, 22 aa, Staphylococcus
NFKDMMLRRAYVIFYETISNVY

SEQ ID NO: 2030969 - protein, 18 aa, Staphylococcus
NFKKEMKQGIHAMTLSID

SEQ ID NO: 2030970 - protein, 21 aa, Staphylococcus
NFKYIDRILLNWKKNNVKTVD

SEQ ID NO: 2030971 - protein, 24 aa, Staphylococcus
NFLDPRGQYILSVIVGSYEDIQVA

SEQ ID NO: 2030972 - protein, 17 aa, Staphylococcus
NFLEHVLEREKNYPTAI

SEQ ID NO: 2030973 - protein, 26 aa, Staphylococcus
NFLKIPNRIIPIIKIAISHYYFGYIH

SEQ ID NO: 2030974 - protein, 33 aa, Staphylococcus
NFLKLKEILMEWQIGIYQGGGWNAIFWCNHDQP

SEQ ID NO: 2030975 - protein, 31 aa, Staphylococcus
NFLNHVACFEIPSYHKMLMISDVALNILPSI

SEQ ID NO: 2030976 - protein, 18 aa, Staphylococcus
NFLQSTIHERNFFNMAYV

SEQ ID NO: 2030977 - protein, 25 aa, Staphylococcus
NFMAKEGRGLICAPISKDLALKFNL

SEQ ID NO: 2030978 - protein, 24 aa, Staphylococcus
NFMAKEGRGLICAPLDTSIAKRLE

SEQ ID NO: 2030979 - protein, 23 aa, Staphylococcus
NFMIRDGRMQKLIAPDKEPITPF

SEQ ID NO: 2030980 - protein, 19 aa, Staphylococcus
NFNIQITYNHYRPCIVNMN

SEQ ID NO: 2030981 - protein, 20 aa, Staphylococcus
NFQRRITIKDGQITNEEVLS

SEQ ID NO: 2030982 - protein, 17 aa, Staphylococcus
NFRKVKRIDTILETFAK

SEQ ID NO: 2030983 - protein, 22 aa, Staphylococcus
NFRVYLLGGEMRHLTEAFVGEM

SEQ ID NO: 2030984 - protein, 18 aa, Staphylococcus
NFSHLSPFLDFIKEDVTV

SEQ ID NO: 2030985 - protein, 22 aa, Staphylococcus
NFSKLNHKFSYLVNENDENDVT

SEQ ID NO: 2030986 - protein, 19 aa, Staphylococcus
NFSYVFPYMMQFIDQLPVV

SEQ ID NO: 2030987 - protein, 18 aa, Staphylococcus
NFTDMKARVSTLSGGNKR

SEQ ID NO: 2030988 - protein, 31 aa, Staphylococcus
NFTEIGIFSVMWSEHCSYKHSKPFLTQFPTS

SEQ ID NO: 2030989 - protein, 32 aa, Staphylococcus
NFTETGIFSVMWSEHCSYKHSKPFLKQFPTTG

SEQ ID NO: 2030990 - protein, 29 aa, Staphylococcus
NFTHYRVGILNEFAGIHFYNSNDEEAIQT

SEQ ID NO: 2030991 - protein, 24 aa, Staphylococcus
NFTPRLKTVDGYYITANVKFVEVL

SEQ ID NO: 2030992 - protein, 25 aa, Staphylococcus
NFVAHSMGNMSFAYYMNNYGNDKYL

SEQ ID NO: 2030993 - protein, 23 aa, Staphylococcus
NFVQAAFEKLDFMVVQDEFLTFT

SEQ ID NO: 2030994 - protein, 23 aa, Staphylococcus
NFVQAAFEKLDFMVVQDEFLTYT

SEQ ID NO: 2030995 - protein, 25 aa, Staphylococcus
NFVRRICDCTGEWTMENFIDLEIEK

SEQ ID NO: 2030996 - protein, 19 aa, Staphylococcus
NFVRRVCNCTGEWTMENFI

SEQ ID NO: 2030997 - protein, 25 aa, Staphylococcus
NFVSRGEIDPVIRFYTWNPATLSIG

SEQ ID NO: 2030998 - protein, 18 aa, Staphylococcus
NFVSRGEIDPVVRFYTWD

SEQ ID NO: 2030999 - protein, 23 aa, Staphylococcus
NFVYPTIFADLKYDDRVMQEEIF

SEQ ID NO: 2031000 - protein, 18 aa, Staphylococcus
NFYLDYGKDILYIEEKNA

SEQ ID NO: 2031001 - protein, 18 aa, Staphylococcus
NFYLDYGKDILYIEEKNS

SEQ ID NO: 2031002 - protein, 18 aa, Staphylococcus
NFYLDYGKDILYIEERDS

SEQ ID NO: 2031003 - protein, 19 aa, Staphylococcus
NFYLDYGKDILYIEERSSH

SEQ ID NO: 2031004 - protein, 18 aa, Staphylococcus
NFYLDYGKDILYIEKKDS

SEQ ID NO: 2031005 - protein, 18 aa, Staphylococcus
NFYLDYGKDILYIEKQDS

SEQ ID NO: 2031006 - protein, 19 aa, Staphylococcus
NFYLDYGKDILYIEQKDAH

SEQ ID NO: 2031007 - protein, 20 aa, Staphylococcus
NFYPEFDKIFVSLGKPNIKA

SEQ ID NO: 2031008 - protein, 25 aa, Staphylococcus
NFYVPRFYVDMAKLAESRQVDPNKY

SEQ ID NO: 2031009 - protein, 19 aa, Staphylococcus
NGAEYKHSFGKSAQDFVST

SEQ ID NO: 2031010 - protein, 17 aa, Staphylococcus
NGAKAIVQIHHGGAQAL

SEQ ID NO: 2031011 - protein, 17 aa, Staphylococcus
NGAKALVQIHHGGAQAL

SEQ ID NO: 2031012 - protein, 20 aa, Staphylococcus
NGALMRIAPLIKCFPPEMSL

SEQ ID NO: 2031013 - protein, 18 aa, Staphylococcus
NGATMLVTGSYFFKQDDY

SEQ ID NO: 2031014 - protein, 21 aa, Staphylococcus
NGCQYCKAKGKPTGSLTDEKL

SEQ ID NO: 2031015 - protein, 22 aa, Staphylococcus
NGDEAFDILVGFVELDHIYSSA

SEQ ID NO: 2031016 - protein, 24 aa, Staphylococcus
NGDFVIRIDDHFNYDLIADLFHHN

SEQ ID NO: 2031017 - protein, 22 aa, Staphylococcus
NGDGRIVVYVAYELDRDQLDEY

SEQ ID NO: 2031018 - protein, 24 aa, Staphylococcus
NGDIGVIQGIFWARENELNKDVLV

SEQ ID NO: 2031019 - protein, 18 aa, Staphylococcus
NGDKRKYVIISINKKTVN

SEQ ID NO: 2031020 - protein, 18 aa, Staphylococcus
NGDLLFGTIDSWLVWKLS

SEQ ID NO: 2031021 - protein, 23 aa, Staphylococcus
NGDLVHRVKHQFNELWNQSTSLT

SEQ ID NO: 2031022 - protein, 20 aa, Staphylococcus
NGDPVTAHDFVFAWRKAVDP

SEQ ID NO: 2031023 - protein, 26 aa, Staphylococcus
NGDPVTANDFVFAWRKVVDPKTGSEF

SEQ ID NO: 2031024 - protein, 23 aa, Staphylococcus
NGEEVKVVVGIAGKDGDHLDLLS

SEQ ID NO: 2031025 - protein, 24 aa, Staphylococcus
NGEEVKVVVGIAGKDGEHLDLLSK

SEQ ID NO: 2031026 - protein, 24 aa, Staphylococcus
NGEFKLQIDTDMPYVVIYTMNHPE

SEQ ID NO: 2031027 - protein, 18 aa, Staphylococcus
NGEFPLVGTLSLVPQIVD

SEQ ID NO: 2031028 - protein, 24 aa, Staphylococcus
NGEIPRLQYHINRIQQSCGRLGYA

SEQ ID NO: 2031029 - protein, 24 aa, Staphylococcus
NGELKDLDAHIAIINHGDIYEIKN

SEQ ID NO: 2031030 - protein, 17 aa, Staphylococcus
NGELTTVSILIEGQHIK

SEQ ID NO: 2031031 - protein, 20 aa, Staphylococcus
NGEPFTGQGITYMKRQGLTI

SEQ ID NO: 2031032 - protein, 18 aa, Staphylococcus
NGEQILYCPKMEVEEVKA

SEQ ID NO: 2031033 - protein, 19 aa, Staphylococcus
NGEQLRVWLYERNKRDDGK

SEQ ID NO: 2031034 - protein, 22 aa, Staphylococcus
NGESAVHMSDIFPTHAHLNPLW

SEQ ID NO: 2031035 - protein, 19 aa, Staphylococcus
NGESLPKAFSRPEVADVLI

SEQ ID NO: 2031036 - protein, 18 aa, Staphylococcus
NGESLPTQFSRPEVAEVL

SEQ ID NO: 2031037 - protein, 18 aa, Staphylococcus
NGEWKPVLFDNLSNQLVV

SEQ ID NO: 2031038 - protein, 19 aa, Staphylococcus
NGFAVIYLISQRLVKKSLE

SEQ ID NO: 2031039 - protein, 21 aa, Staphylococcus
NGFGFNPEFIRDAKYLEYTVG

SEQ ID NO: 2031040 - protein, 24 aa, Staphylococcus
NGFIKFQPIGGWWNQVMLSQKVTI

SEQ ID NO: 2031041 - protein, 26 aa, Staphylococcus
NGFIKFQPIGGWWSQVMLSQKVTITT

SEQ ID NO: 2031042 - protein, 17 aa, Staphylococcus
NGFPAVQPRGYSFKSHV

SEQ ID NO: 2031043 - protein, 20 aa, Staphylococcus
NGFSVIYLISQRLVKKSLDD

SEQ ID NO: 2031044 - protein, 25 aa, Staphylococcus
NGFVGREITMQWANRFPEADIYITS

SEQ ID NO: 2031045 - protein, 18 aa, Staphylococcus
NGFYSANGQQFFLGGLQD

SEQ ID NO: 2031046 - protein, 25 aa, Staphylococcus
NGGEQSVCMSLFFEDPEGNAYKFYV

SEQ ID NO: 2031047 - protein, 17 aa, Staphylococcus
NGGGCTGLTYGMSAEET

SEQ ID NO: 2031048 - protein, 17 aa, Staphylococcus
NGGKLKIQYELHQNDEK

SEQ ID NO: 2031049 - protein, 21 aa, Staphylococcus
NGGKSWHPLNITWPNELTEQH

SEQ ID NO: 2031050 - protein, 24 aa, Staphylococcus
NGGLYLEKFIENFRHIEFQIMGDQ

SEQ ID NO: 2031051 - protein, 24 aa, Staphylococcus
NGGLYLEKFIENFRHIEIQIIGDS

SEQ ID NO: 2031052 - protein, 24 aa, Staphylococcus
NGGLYLEKFIENFRHIEIQIVGDS

SEQ ID NO: 2031053 - protein, 25 aa, Staphylococcus
NGGLYLEKFIENFRHIEIQVIGDQF

SEQ ID NO: 2031054 - protein, 23 aa, Staphylococcus
NGGNMGVSGSVAYMFEYTAVFGI

SEQ ID NO: 2031055 - protein, 24 aa, Staphylococcus
NGGSTPLIYCEKLSEKLDIELYVK

SEQ ID NO: 2031056 - protein, 18 aa, Staphylococcus
NGGTLAIYMGIKRLGAII

SEQ ID NO: 2031057 - protein, 24 aa, Staphylococcus
NGGTPWLDQKHTVFGQLIEGDTTL

SEQ ID NO: 2031058 - protein, 25 aa, Staphylococcus
NGGYNFKSAITGYGINADAITTGTL

SEQ ID NO: 2031059 - protein, 20 aa, Staphylococcus
NGHKSAVIWFTGLSGSGKST

SEQ ID NO: 2031060 - protein, 30 aa, Staphylococcus
NGHLYIKNSITFCPHYSFNGTNVIENNTIY

SEQ ID NO: 2031061 - protein, 19 aa, Staphylococcus
NGIDKRFFDYKIEEQVGQV

SEQ ID NO: 2031062 - protein, 17 aa, Staphylococcus
NGIDWRYIDHSSGLEPM

SEQ ID NO: 2031063 - protein, 17 aa, Staphylococcus
NGIEWRYVDHSSGLEPM

SEQ ID NO: 2031064 - protein, 24 aa, Staphylococcus
NGIFIKKWERELAALEHIRNQLNP

SEQ ID NO: 2031065 - protein, 19 aa, Staphylococcus
NGIHFSLSFLKDYFNEKIK

SEQ ID NO: 2031066 - protein, 22 aa, Staphylococcus
NGIIWPKTVTPFDLHLITVNPK

SEQ ID NO: 2031067 - protein, 32 aa, Staphylococcus
NGILGKIPFFGICLGHQLFALSQGATSFKMKF

SEQ ID NO: 2031068 - protein, 20 aa, Staphylococcus
NGILNKGHIEFVPPVINKNQ

SEQ ID NO: 2031069 - protein, 25 aa, Staphylococcus
NGIPDLRSNWILSRDDVESYEGRRV

SEQ ID NO: 2031070 - protein, 17 aa, Staphylococcus
NGIREGYVMNLIRQRHP

SEQ ID NO: 2031071 - protein, 29 aa, Staphylococcus
NGISYKQLERLGGVGLHLRNQIYQIIADF

SEQ ID NO: 2031072 - protein, 18 aa, Staphylococcus
NGITEWRYHDVPQKMWKI

SEQ ID NO: 2031073 - protein, 19 aa, Staphylococcus
NGITRMVIKSVAEDKGIPF

SEQ ID NO: 2031074 - protein, 23 aa, Staphylococcus
NGITRRVIKWIAEDYGIPFKEET

SEQ ID NO: 2031075 - protein, 18 aa, Staphylococcus
NGIVWPKSVTPFDLHLIT

SEQ ID NO: 2031076 - protein, 22 aa, Staphylococcus
NGKFKMECITHYPKINVDNNHK

SEQ ID NO: 2031077 - protein, 17 aa, Staphylococcus
NGKFLYSPFSVFDNESI

SEQ ID NO: 2031078 - protein, 19 aa, Staphylococcus
NGKFPGLVEPDPSYHGISY

SEQ ID NO: 2031079 - protein, 24 aa, Staphylococcus
NGKGIYRYELDDVQGRIKFLETGY

SEQ ID NO: 2031080 - protein, 24 aa, Staphylococcus
NGKLFLRLEFEQVTELKEALESTL

SEQ ID NO: 2031081 - protein, 24 aa, Staphylococcus
NGKSVYIKLMRAFFYRQDVVSKTL

SEQ ID NO: 2031082 - protein, 22 aa, Staphylococcus
NGKTRITHQMDMLFTHFGISGP

SEQ ID NO: 2031083 - protein, 22 aa, Staphylococcus
NGLDIRNEWIFNNVHTIEDGEQ

SEQ ID NO: 2031084 - protein, 17 aa, Staphylococcus
NGLFSIEEINDFVNKLE

SEQ ID NO: 2031085 - protein, 18 aa, Staphylococcus
NGLIKTLTKFAIGAMEIE

SEQ ID NO: 2031086 - protein, 20 aa, Staphylococcus
NGLKKWLTPFELWKDHQITL

SEQ ID NO: 2031087 - protein, 24 aa, Staphylococcus
NGLKRNIVHMGHFEAGEAINTVAS

SEQ ID NO: 2031088 - protein, 25 aa, Staphylococcus
NGLKRVIDFIENFGFSDADIDYLKT

SEQ ID NO: 2031089 - protein, 23 aa, Staphylococcus
NGLKRVIQFVENFKFTDSDIAYL

SEQ ID NO: 2031090 - protein, 17 aa, Staphylococcus
NGLNTSPYFNPDYKKYM

SEQ ID NO: 2031091 - protein, 19 aa, Staphylococcus
NGLPNGCFNITIYEDQQLI

SEQ ID NO: 2031092 - protein, 26 aa, Staphylococcus
NGLPSGRFADFTTFSFHAVKNLTTAE

SEQ ID NO: 2031093 - protein, 20 aa, Staphylococcus
NGLWKDKKAIVIYTIGGSEW

SEQ ID NO: 2031094 - protein, 22 aa, Staphylococcus
NGLYADTGISFVVGEPSDPMKE

SEQ ID NO: 2031095 - protein, 23 aa, Staphylococcus
NGLYLEKFIENFRHIEIQIMGDS

SEQ ID NO: 2031096 - protein, 21 aa, Staphylococcus
NGLYPDLTIYLDIDAEVGRER

SEQ ID NO: 2031097 - protein, 21 aa, Staphylococcus
NGLYPDLTIYLDVSAEVGHQR

SEQ ID NO: 2031098 - protein, 21 aa, Staphylococcus
NGLYPDLTIYLDVSAEVGRER

SEQ ID NO: 2031099 - protein, 28 aa, Staphylococcus
NGMKYYMVGSTYRFKKSDVDDFMDHITS

SEQ ID NO: 2031100 - protein, 25 aa, Staphylococcus
NGMLVKRPLAISGDKVTVGFKEDEY

SEQ ID NO: 2031101 - protein, 18 aa, Staphylococcus
NGMNRFFKRHGEGQYDIE

SEQ ID NO: 2031102 - protein, 26 aa, Staphylococcus
NGMQTLGVALPWAIAAALVRPNTQVV

SEQ ID NO: 2031103 - protein, 17 aa, Staphylococcus
NGMSVPDYVLQKFSKQE

SEQ ID NO: 2031104 - protein, 17 aa, Staphylococcus
NGNDTLYLAQHVPNGFV

SEQ ID NO: 2031105 - protein, 17 aa, Staphylococcus
NGNEEWTTRMLMHALRN

SEQ ID NO: 2031106 - protein, 26 aa, Staphylococcus
NGNIIKMDLVLGEFRLQDRYVKAVGK

SEQ ID NO: 2031107 - protein, 21 aa, Staphylococcus
NGNMLKPWFVSSIDNPISKKN

SEQ ID NO: 2031108 - protein, 22 aa, Staphylococcus
NGNRIMELLQHIAKEHNTTLLL

SEQ ID NO: 2031109 - protein, 19 aa, Staphylococcus
NGNVFKFKDMIPGVNAPPQ

SEQ ID NO: 2031110 - protein, 21 aa, Staphylococcus
NGNVYPKWVTQKIKELGNVYT

SEQ ID NO: 2031111 - protein, 18 aa, Staphylococcus
NGPGKWTRAFNMSMALDG

SEQ ID NO: 2031112 - protein, 18 aa, Staphylococcus
NGPIGFLIVHIAGLKTEY

SEQ ID NO: 2031113 - protein, 22 aa, Staphylococcus
NGPLDLLLHLIQKFEIDIYDIP

SEQ ID NO: 2031114 - protein, 23 aa, Staphylococcus
NGPLDLTFLFGLVDHLSHKLKFL

SEQ ID NO: 2031115 - protein, 19 aa, Staphylococcus
NGQVERIAFRIPKNSRDIW

SEQ ID NO: 2031116 - protein, 19 aa, Staphylococcus
NGRAYLECHHVDWLANGGK

SEQ ID NO: 2031117 - protein, 20 aa, Staphylococcus
NGRCNLGVVTLNIPRIAIES

SEQ ID NO: 2031118 - protein, 17 aa, Staphylococcus
NGREFALGPTHEEVVTS

SEQ ID NO: 2031119 - protein, 24 aa, Staphylococcus
NGRHELLNSVFLWHSGTKYKVNVH

SEQ ID NO: 2031120 - protein, 24 aa, Staphylococcus
NGRHELMDSVFLWQSGTKYREMVH

SEQ ID NO: 2031121 - protein, 18 aa, Staphylococcus
NGRHYVRISLALDDQLLT

SEQ ID NO: 2031122 - protein, 19 aa, Staphylococcus
NGRIEFKDINIETVVGEYD

SEQ ID NO: 2031123 - protein, 24 aa, Staphylococcus
NGRINRLGSEFSEILIENITPHNE

SEQ ID NO: 2031124 - protein, 22 aa, Staphylococcus
NGRPPFGTCVIEFNHKGQKQAV

SEQ ID NO: 2031125 - protein, 22 aa, Staphylococcus
NGRSFEKFILFTSYKVDLDEEC

SEQ ID NO: 2031126 - protein, 26 aa, Staphylococcus
NGSDAFKLYDTYGFPIELTEEIATQE

SEQ ID NO: 2031127 - protein, 24 aa, Staphylococcus
NGSDEWIQKCMLTLPKGPVLALNP

SEQ ID NO: 2031128 - protein, 21 aa, Staphylococcus
NGSDLFVHFSGIVAEGYKSLE

SEQ ID NO: 2031129 - protein, 18 aa, Staphylococcus
NGSGKSSLSEWLRRLDNE

SEQ ID NO: 2031130 - protein, 27 aa, Staphylococcus
NGSHNWKSWKPMIGDILYYFLNNNHST

SEQ ID NO: 2031131 - protein, 23 aa, Staphylococcus
NGSLVKAFRKCGFDIDKVVFETD

SEQ ID NO: 2031132 - protein, 25 aa, Staphylococcus
NGTDLPGQIARRVDQNILRKLSEQV

SEQ ID NO: 2031133 - protein, 21 aa, Staphylococcus
NGTLLNRCFEKLFEKNISLAV

SEQ ID NO: 2031134 - protein, 18 aa, Staphylococcus
NGTNRLYTQLSLIGTRTH

SEQ ID NO: 2031135 - protein, 19 aa, Staphylococcus
NGTRYRPEVLEAKVDGYSI

SEQ ID NO: 2031136 - protein, 24 aa, Staphylococcus
NGTVRNVVDFGAFIDIGVKQDGLV

SEQ ID NO: 2031137 - protein, 22 aa, Staphylococcus
NGVKLGFFGVAGFDLLLDKNDD

SEQ ID NO: 2031138 - protein, 23 aa, Staphylococcus
NGVKRLKESLQEVMEQTGKEKFK

SEQ ID NO: 2031139 - protein, 17 aa, Staphylococcus
NGVLDILALNHIDVQVF

SEQ ID NO: 2031140 - protein, 26 aa, Staphylococcus
NGVMKYDLNLPIGIIPGGTFNDFTKT

SEQ ID NO: 2031141 - protein, 31 aa, Staphylococcus; identical to SEQ ID NO: 1670948

SEQ ID NO: 2031142 - protein, 17 aa, Staphylococcus
NGVSKGKIVSAIVEDGL

SEQ ID NO: 2031143 - protein, 24 aa, Staphylococcus
NGVTLFEANSWFFGEGGIKLTIDQ

SEQ ID NO: 2031144 - protein, 21 aa, Staphylococcus
NGWDNYPVCMAKTQYSFTDDK

SEQ ID NO: 2031145 - protein, 28 aa, Staphylococcus
NGWYGANLFLPFAIAIKYYSIDQLIDAY

SEQ ID NO: 2031146 - protein, 22 aa, Staphylococcus
NGYEYWVDLDWKTIQEENNIIP

SEQ ID NO: 2031147 - protein, 30 aa, Staphylococcus
NGYGLRSTLPFKHVYQAVVYISGQKKDDEV

SEQ ID NO: 2031148 - protein, 18 aa, Staphylococcus
NGYGPRIVRINDYPVDFK

SEQ ID NO: 2031149 - protein, 17 aa, Staphylococcus
NGYHFYTQLEVGDNIII

SEQ ID NO: 2031150 - protein, 17 aa, Staphylococcus
NGYHFYTQLEVGDNVII

SEQ ID NO: 2031151 - protein, 20 aa, Staphylococcus
NGYHKPLLILSDLFRQKEDY

SEQ ID NO: 2031152 - protein, 19 aa, Staphylococcus
NGYKCPNCGNSDPKTVDVV

SEQ ID NO: 2031153 - protein, 19 aa, Staphylococcus
NGYLFVFVLDYYRHSLVNE

SEQ ID NO: 2031154 - protein, 20 aa, Staphylococcus
NGYLFVFVMDYYRHSIINEE

SEQ ID NO: 2031155 - protein, 18 aa, Staphylococcus
NGYLTKEYLEKYISENTE

SEQ ID NO: 2031156 - protein, 22 aa, Staphylococcus
NGYPCSYRIVTQNGVTTNHLRI

SEQ ID NO: 2031157 - protein, 23 aa, Staphylococcus
NGYPMPSIGLGVYKIADEEMNEV

SEQ ID NO: 2031158 - protein, 20 aa, Staphylococcus
NGYPMPSIGLGVYKITDEDM

SEQ ID NO: 2031159 - protein, 28 aa, Staphylococcus
NGYRSLHIVVSIPVFLADAVEVTPVEIQ

SEQ ID NO: 2031160 - protein, 18 aa, Staphylococcus
NGYTGIELQTLFENQEIY

SEQ ID NO: 2031161 - protein, 20 aa, Staphylococcus
NGYWTYSMNDAWVGLQKSYG

SEQ ID NO: 2031162 - protein, 23 aa, Staphylococcus
NGYYADTGISFVVGEADNPLKQK

SEQ ID NO: 2031163 - protein, 23 aa, Staphylococcus
NGYYADTGISFVVGEASDPLKQK

SEQ ID NO: 2031164 - protein, 23 aa, Staphylococcus
NGYYADTGISFVVGEASDPMKQK

SEQ ID NO: 2031165 - protein, 20 aa, Staphylococcus
NHAILFYPLDIERIAHIDVW

SEQ ID NO: 2031166 - protein, 23 aa, Staphylococcus
NHAKANKVFTEFVNRHQLPVVST

SEQ ID NO: 2031167 - protein, 17 aa, Staphylococcus
NHAKKFNGAEVYNFSKE

SEQ ID NO: 2031168 - protein, 20 aa, Staphylococcus
NHALQILTLIAMEKPESRNS

SEQ ID NO: 2031169 - protein, 21 aa, Staphylococcus
NHDPLSASIGTVWPDNVSVFS

SEQ ID NO: 2031170 - protein, 19 aa, Staphylococcus
NHDQPRVVSRFGDDSTEEN

SEQ ID NO: 2031171 - protein, 19 aa, Staphylococcus
NHDYDWLIFSSKNAVKYFY

SEQ ID NO: 2031172 - protein, 25 aa, Staphylococcus
NHFIGLAHAGWRGTVGQIVNALISN

SEQ ID NO: 2031173 - protein, 24 aa, Staphylococcus
NHFKALSVGKWVRAQGRIEEDTFV

SEQ ID NO: 2031174 - protein, 17 aa, Staphylococcus
NHGEYGHDIVCAGASAV

SEQ ID NO: 2031175 - protein, 17 aa, Staphylococcus
NHGLIVLSGQSGVGKTT

SEQ ID NO: 2031176 - protein, 18 aa, Staphylococcus
NHGLRLNERTKYKLENFD

SEQ ID NO: 2031177 - protein, 17 aa, Staphylococcus
NHGMTPIICVGETDEER

SEQ ID NO: 2031178 - protein, 18 aa, Staphylococcus
NHHMQFAMMRYARDKGAT

SEQ ID NO: 2031179 - protein, 17 aa, Staphylococcus
NHHVTKIILGIGGSATN

SEQ ID NO: 2031180 - protein, 18 aa, Staphylococcus
NHHYDWIIFSSKNAVKYF

SEQ ID NO: 2031181 - protein, 17 aa, Staphylococcus
NHIEAIKTQLSRESFAP

SEQ ID NO: 2031182 - protein, 18 aa, Staphylococcus
NHIGELILTVSKFIEDEE

SEQ ID NO: 2031183 - protein, 19 aa, Staphylococcus
NHIKEPKCNVKHLVDEGKI

SEQ ID NO: 2031184 - protein, 19 aa, Staphylococcus
NHIKEPKCNVKHQLENNNL

SEQ ID NO: 2031185 - protein, 20 aa, Staphylococcus
NHILYQLGYLNATRFPNLLF

SEQ ID NO: 2031186 - protein, 19 aa, Staphylococcus
NHILYQLGYLQATRYPDIK

SEQ ID NO: 2031187 - protein, 22 aa, Staphylococcus
NHIRGLSPWPVAYTIMDDKNLK

SEQ ID NO: 2031188 - protein, 20 aa, Staphylococcus
NHIRGLSPWPVAYTTMDDKN

SEQ ID NO: 2031189 - protein, 21 aa, Staphylococcus
NHKHQCVGFFTLHEGQGVAPY

SEQ ID NO: 2031190 - protein, 26 aa, Staphylococcus
NHKVMRKQALEIFNNLNIQLDLNQMA

SEQ ID NO: 2031191 - protein, 19 aa, Staphylococcus
NHKYLPDREIVSIRDFKGR

SEQ ID NO: 2031192 - protein, 20 aa, Staphylococcus
NHLAELILTITEKVENMDFE

SEQ ID NO: 2031193 - protein, 24 aa, Staphylococcus
NHLETPLTFPLMALIVSGGHTELV

SEQ ID NO: 2031194 - protein, 18 aa, Staphylococcus
NHLGELIVSIAQASESKD

SEQ ID NO: 2031195 - protein, 18 aa, Staphylococcus
NHLGELVLTIAKSSHSSS

SEQ ID NO: 2031196 - protein, 20 aa, Staphylococcus
NHLHPAVIMNEFGKQSIDGL

SEQ ID NO: 2031197 - protein, 17 aa, Staphylococcus
NHLIQDIAYKHGFNHFP

SEQ ID NO: 2031198 - protein, 24 aa, Staphylococcus
NHLKPVIETLVLLSMRHRMEQDKA

SEQ ID NO: 2031199 - protein, 26 aa, Staphylococcus
NHLLSLPGWAGMMLWQDEHNHKVHDL

SEQ ID NO: 2031200 - protein, 31 aa, Staphylococcus
NHLPFDIYHQCISHLKAQHKAVILSHHNFQH

SEQ ID NO: 2031201 - protein, 20 aa, Staphylococcus
NHLPVAMIINQKRLGGNSRS

SEQ ID NO: 2031202 - protein, 17 aa, Staphylococcus
NHLRSGDFFATDEYDKI

SEQ ID NO: 2031203 - protein, 31 aa, Staphylococcus
NHNSVMSRYEFVGPITFRCGTNIMEVSTVEA

SEQ ID NO: 2031204 - protein, 23 aa, Staphylococcus
NHPETFGKLKGVGPYTQAAVMSI

SEQ ID NO: 2031205 - protein, 25 aa, Staphylococcus
NHPFVEHYKFLKAHTPEGIEARQTV

SEQ ID NO: 2031206 - protein, 23 aa, Staphylococcus
NHPLSAKGRREYLAQASPVNIGD

SEQ ID NO: 2031207 - protein, 33 aa, Staphylococcus
NHPYTFELNKDFNFSAAHFIPSEDAGKCMRTHG

SEQ ID NO: 2031208 - protein, 26 aa, Staphylococcus
NHQIHLSIRLRLPHSAIAFQAYCGTW

SEQ ID NO: 2031209 - protein, 24 aa, Staphylococcus
NHRIKRYIAKYTINPAITHGISDY

SEQ ID NO: 2031210 - protein, 19 aa, Staphylococcus
NHRISDKAYNDFLESEIAR

SEQ ID NO: 2031211 - protein, 18 aa, Staphylococcus
NHRKSTREFTSFEMASKE

SEQ ID NO: 2031212 - protein, 18 aa, Staphylococcus
NHRNSLNLSVNKLSKLSN

SEQ ID NO: 2031213 - protein, 23 aa, Staphylococcus
NHRRLGKELDIFSFSEYAPGMPF

SEQ ID NO: 2031214 - protein, 22 aa, Staphylococcus
NHSDFYSIKSFIPKYEEQQKLG

SEQ ID NO: 2031215 - protein, 25 aa, Staphylococcus
NHSGEYLKKMHIFIVSLLNHAMKYH

SEQ ID NO: 2031216 - protein, 22 aa, Staphylococcus
NHTEPGILFEIFNHYDEVDVAI

SEQ ID NO: 2031217 - protein, 24 aa, Staphylococcus
NHTPLKRSICIVVRKENNKPDVQQ

SEQ ID NO: 2031218 - protein, 18 aa, Staphylococcus
NHTPTPVFHKNHETGKED

SEQ ID NO: 2031219 - protein, 22 aa, Staphylococcus
NHTRSKETIAFEPKDVIIVEGI

SEQ ID NO: 2031220 - protein, 23 aa, Staphylococcus
NHTSKSGGFDWFKRKSNKNEDPD

SEQ ID NO: 2031221 - protein, 18 aa, Staphylococcus
NHTYGQREIYEFIDEAKR

SEQ ID NO: 2031222 - protein, 25 aa, Staphylococcus
NHVKEVVAGFDFTFGKFGKGNMAVL

SEQ ID NO: 2031223 - protein, 26 aa, Staphylococcus
NHVPPWIIILPHNFGLTIKWLSILKK

SEQ ID NO: 2031224 - protein, 22 aa, Staphylococcus
NHVQSAMNFQFMKRLNHAGIPV

SEQ ID NO: 2031225 - protein, 22 aa, Staphylococcus
NHYDISSALSYFANELSTESQY

SEQ ID NO: 2031226 - protein, 17 aa, Staphylococcus
NHYRLYGIFLLNQLNGK

SEQ ID NO: 2031227 - protein, 24 aa, Staphylococcus
NIAEIRLRAKIIDKYVLTRLNTMG

SEQ ID NO: 2031228 - protein, 19 aa, Staphylococcus
NIAESVYYYLTGEHFDSFK

SEQ ID NO: 2031229 - protein, 28 aa, Staphylococcus
NIAFPGVKGEVLVNAFSKLDIMVSTTSA

SEQ ID NO: 2031230 - protein, 25 aa, Staphylococcus
NIAFSLNGKQLWLTAAKKLKHIYQV

SEQ ID NO: 2031231 - protein, 23 aa, Staphylococcus
NIARNVQTGRVWVNTYNQVPEGA

SEQ ID NO: 2031232 - protein, 26 aa, Staphylococcus
NIARQHVRFGVTLTCRDTLVNFYESH

SEQ ID NO: 2031233 - protein, 20 aa, Staphylococcus
NIATNCYDTAEIIKEINDAD

SEQ ID NO: 2031234 - protein, 18 aa, Staphylococcus
NIATNCYDTAEIIQELKK

SEQ ID NO: 2031235 - protein, 18 aa, Staphylococcus
NIATNCYDTAEIISELRK

SEQ ID NO: 2031236 - protein, 18 aa, Staphylococcus
NIATNCYDTAEILSEIKK

SEQ ID NO: 2031237 - protein, 24 aa, Staphylococcus
NIAVPLDLPALFKGYYKDPERTAE

SEQ ID NO: 2031238 - protein, 24 aa, Staphylococcus
NIAVPVDLPALFKGYFKDPERTQE

SEQ ID NO: 2031239 - protein, 22 aa, Staphylococcus
NIDARIKNEFSYLIENLNNYKI

SEQ ID NO: 2031240 - protein, 19 aa, Staphylococcus
NIDDYVASIVNYVIEYTNT

SEQ ID NO: 2031241 - protein, 22 aa, Staphylococcus
NIDEAREGIDILYSEENGTVVF

SEQ ID NO: 2031242 - protein, 24 aa, Staphylococcus
NIDELKQLITFIVVNREKEVQHVE

SEQ ID NO: 2031243 - protein, 18 aa, Staphylococcus
NIDIPKIIAVNPVGSGDS

SEQ ID NO: 2031244 - protein, 17 aa, Staphylococcus
NIDKIDYIFCTFNTDLY

SEQ ID NO: 2031245 - protein, 18 aa, Staphylococcus
NIDLKDVMALGDNLNDVS

SEQ ID NO: 2031246 - protein, 22 aa, Staphylococcus
NIDLKIPIILISGNHDGKERLN

SEQ ID NO: 2031247 - protein, 19 aa, Staphylococcus
NIDPALIPFIMEKTNKSAE

SEQ ID NO: 2031248 - protein, 19 aa, Staphylococcus
NIDTGMGLERMASVSQNVR

SEQ ID NO: 2031249 - protein, 18 aa, Staphylococcus
NIDTGVFGGLISSREHFG

SEQ ID NO: 2031250 - protein, 18 aa, Staphylococcus
NIDYPRLFEHKNNIVHTL

SEQ ID NO: 2031251 - protein, 28 aa, Staphylococcus
NIEAAYKLTDWLILQGYQDILFLSEKGN

SEQ ID NO: 2031252 - protein, 25 aa, Staphylococcus
NIEARPVWKPMHLQPYFESYDYIMV

SEQ ID NO: 2031253 - protein, 17 aa, Staphylococcus
NIEGAQKIYELFKPTLE

SEQ ID NO: 2031254 - protein, 24 aa, Staphylococcus
NIEHRRWGSPFPVIEIVKQGISKA

SEQ ID NO: 2031255 - protein, 21 aa, Staphylococcus
NIELKIPMIIINGNHDSKERL

SEQ ID NO: 2031256 - protein, 22 aa, Staphylococcus
NIELPKYKLVKFTWGNVSEINR

SEQ ID NO: 2031257 - protein, 26 aa, Staphylococcus
NIEPVDCNYMIGMSFNQLNAHKEALP

SEQ ID NO: 2031258 - protein, 24 aa, Staphylococcus
NIEQRLDIVESFIDHFIERDTLRG

SEQ ID NO: 2031259 - protein, 17 aa, Staphylococcus
NIERRFHESPSEYVREV

SEQ ID NO: 2031260 - protein, 22 aa, Staphylococcus
NIESLRFGNTIFEPLWNNKYIS

SEQ ID NO: 2031261 - protein, 27 aa, Staphylococcus
NIESSGIIKKLFLLGIVANINQALDEE

SEQ ID NO: 2031262 - protein, 24 aa, Staphylococcus
NIEYKDAYFKGMFNESCPTFDDIF

SEQ ID NO: 2031263 - protein, 19 aa, Staphylococcus
NIEYKGAYFEGMFGKACPT

SEQ ID NO: 2031264 - protein, 23 aa, Staphylococcus
NIEYKNAYFKGMFNETCPTFDEI

SEQ ID NO: 2031265 - protein, 19 aa, Staphylococcus
NIFEFSRYNKISGNGHIKL

SEQ ID NO: 2031266 - protein, 20 aa, Staphylococcus
NIFLLDDWLDDILLNHEKLM

SEQ ID NO: 2031267 - protein, 27 aa, Staphylococcus
NIFNGDIGVIVGIFWAKENALNKDVLV

SEQ ID NO: 2031268 - protein, 17 aa, Staphylococcus
NIFNMGIGFTLVVDEAE

SEQ ID NO: 2031269 - protein, 17 aa, Staphylococcus
NIGELGKTFSKGLLMGA

SEQ ID NO: 2031270 - protein, 24 aa, Staphylococcus
NIGENQWGIRDWYSVDDIEEKIAP

SEQ ID NO: 2031271 - protein, 18 aa, Staphylococcus
NIGHRFDVNAGIIGDSKL

SEQ ID NO: 2031272 - protein, 18 aa, Staphylococcus
NIGIKYLTLYAFSTENWS

SEQ ID NO: 2031273 - protein, 18 aa, Staphylococcus
NIGMPGILKPVGASGSKG

SEQ ID NO: 2031274 - protein, 23 aa, Staphylococcus
NIGSCGLDSVRVIKGQFGAHINT

SEQ ID NO: 2031275 - protein, 22 aa, Staphylococcus
NIHKEILEIYLAPNTATLIDLH

SEQ ID NO: 2031276 - protein, 17 aa, Staphylococcus
NIIDHFPEFKQFYAGKE

SEQ ID NO: 2031277 - protein, 24 aa, Staphylococcus
NIIERYKSLPILGVCLGAQAITCY

SEQ ID NO: 2031278 - protein, 17 aa, Staphylococcus
NIIKEVDEETALVWLCN

SEQ ID NO: 2031279 - protein, 29 aa, Staphylococcus
NIIKRKTGVLMLNPELLMRGDDQKQKYLL

SEQ ID NO: 2031280 - protein, 25 aa, Staphylococcus
NIILAAGRLEYEKGFDLLLESIRLI

SEQ ID NO: 2031281 - protein, 17 aa, Staphylococcus
NIILEKYPKLDVKVIKD

SEQ ID NO: 2031282 - protein, 19 aa, Staphylococcus
NIILHYGEEQFIKDCEAAG

SEQ ID NO: 2031283 - protein, 17 aa, Staphylococcus
NIIQLIWNDGKYNMVEF

SEQ ID NO: 2031284 - protein, 17 aa, Staphylococcus
NIIRFKQKFDQSIYQVF

SEQ ID NO: 2031285 - protein, 23 aa, Staphylococcus
NIIRNEINDFLLYTKRATGDISN

SEQ ID NO: 2031286 - protein, 17 aa, Staphylococcus
NIIRPPFNVGRLSEYAA

SEQ ID NO: 2031287 - protein, 24 aa, Staphylococcus
NIKEALETFGGVKRRFNETFVSKQ

SEQ ID NO: 2031288 - protein, 22 aa, Staphylococcus
NIKEALETFGGVKRRFNETKLH

SEQ ID NO: 2031289 - protein, 23 aa, Staphylococcus
NIKEALETFGGVKRRFNETKVSN

SEQ ID NO: 2031290 - protein, 23 aa, Staphylococcus
NIKEALETFGGVKRRFNETKYDQ

SEQ ID NO: 2031291 - protein, 24 aa, Staphylococcus
NIKEALETFGGVKRRFNETNVANQ

SEQ ID NO: 2031292 - protein, 21 aa, Staphylococcus
NIKEGEFFVLIGPSGCGKTTT

SEQ ID NO: 2031293 - protein, 24 aa, Staphylococcus
NIKEGEFFVLIGPSGCGKTTTLKM

SEQ ID NO: 2031294 - protein, 18 aa, Staphylococcus
NIKFDYRAGQIQGLHPGR

SEQ ID NO: 2031295 - protein, 21 aa, Staphylococcus
NIKGQLFKLLDFSNMKETDVP

SEQ ID NO: 2031296 - protein, 19 aa, Staphylococcus
NIKSEIPKNKVARFFEAKS

SEQ ID NO: 2031297 - protein, 22 aa, Staphylococcus
NIKSTGRMVGIISHVSELKQRI

SEQ ID NO: 2031298 - protein, 19 aa, Staphylococcus
NIKVYEIKETISFEQLTSN

SEQ ID NO: 2031299 - protein, 25 aa, Staphylococcus
NIKYTVVPMWVFKIGSLFNKQVKEL

SEQ ID NO: 2031300 - protein, 28 aa, Staphylococcus
NILAAIKLDVFRNFYLIKHKDKYLDVNL

SEQ ID NO: 2031301 - protein, 18 aa, Staphylococcus
NILNERKIEFKINMQNIY

SEQ ID NO: 2031302 - protein, 20 aa, Staphylococcus
NILRRRSQNYALITLLNWLR

SEQ ID NO: 2031303 - protein, 23 aa, Staphylococcus
NILSEYYICLKYLVMLIDQTHHS

SEQ ID NO: 2031304 - protein, 20 aa, Staphylococcus
NILTEFKKEREGRLVAEQQV

SEQ ID NO: 2031305 - protein, 30 aa, Staphylococcus
NIMFPMVATIKEFRDAKAILLEEKDKLTSE

SEQ ID NO: 2031306 - protein, 30 aa, Staphylococcus; identical to SEQ ID NO: 1810522

SEQ ID NO: 2031307 - protein, 30 aa, Staphylococcus
NIMFPMVATINEFRDAKAILLEEKENLKND

SEQ ID NO: 2031308 - protein, 32 aa, Staphylococcus
NIMFPMVATINEFRDAKALLLEEKENLKNEGH

SEQ ID NO: 2031309 - protein, 21 aa, Staphylococcus
NIMKPEYFIPVQGEFKMQIAH

SEQ ID NO: 2031310 - protein, 22 aa, Staphylococcus
NIMKPEYFIPVQGEFKMQIAHA

SEQ ID NO: 2031311 - protein, 22 aa, Staphylococcus
NIMKRCDLFALTSHYEGQSMVL

SEQ ID NO: 2031312 - protein, 23 aa, Staphylococcus
NIMPVVKEIAYKHCALQVPPAGY

SEQ ID NO: 2031313 - protein, 24 aa, Staphylococcus
NIMREKRVDTIFVVNNHHKLLGFL

SEQ ID NO: 2031314 - protein, 20 aa, Staphylococcus
NIMRVVRTDGYWAMTIADTT

SEQ ID NO: 2031315 - protein, 20 aa, Staphylococcus
NINELFQFVFNDYFDIDLSY

SEQ ID NO: 2031316 - protein, 24 aa, Staphylococcus
NINFKKLDNAIIHFEIDGSNYLKD

SEQ ID NO: 2031317 - protein, 24 aa, Staphylococcus
NINIKINRGEFVAIVGPNGAGKST

SEQ ID NO: 2031318 - protein, 28 aa, Staphylococcus
NINLALRARYLFEVDIDYYVLKGEIVLI

SEQ ID NO: 2031319 - protein, 25 aa, Staphylococcus
NINQLKEIITFVIVNRDTSHQIVDP

SEQ ID NO: 2031320 - protein, 25 aa, Staphylococcus
NINSPELFELASLERYGALKQPVMV

SEQ ID NO: 2031321 - protein, 19 aa, Staphylococcus
NIPATEIMRHWPRHRNNPY

SEQ ID NO: 2031322 - protein, 19 aa, Staphylococcus
NIPEYSEIMRYHSLISNSK

SEQ ID NO: 2031323 - protein, 17 aa, Staphylococcus
NIPILGICRGAQILNVY

SEQ ID NO: 2031324 - protein, 22 aa, Staphylococcus
NIPIYGGPLALGLIRNKLEEHH

SEQ ID NO: 2031325 - protein, 23 aa, Staphylococcus
NIPKLNVNAGEWISITGSNGSGK

SEQ ID NO: 2031326 - protein, 23 aa, Staphylococcus
NIPNEINGLLGLETGHINIGMSA

SEQ ID NO: 2031327 - protein, 27 aa, Staphylococcus
NIPQGRGMIKWAPFAVMPEQYERINAF

SEQ ID NO: 2031328 - protein, 27 aa, Staphylococcus
NIPQGRGMVKWAPFATMPEQYQQLNDF

SEQ ID NO: 2031329 - protein, 21 aa, Staphylococcus
NIQAGEFIAVMGPSGSGKSTL

SEQ ID NO: 2031330 - protein, 18 aa, Staphylococcus
NIQIGMAHRGRLNVLTHV

SEQ ID NO: 2031331 - protein, 20 aa, Staphylococcus
NIQIVYDKFIIMGYTDTDLT

SEQ ID NO: 2031332 - protein, 24 aa, Staphylococcus
NIQKGEFFVLIGPSGCGKTTTLKM

SEQ ID NO: 2031333 - protein, 17 aa, Staphylococcus
NIQPEIKEDGYIYSDGT

SEQ ID NO: 2031334 - protein, 24 aa, Staphylococcus
NIQQLRVALNYFINNLKNWNYSFA

SEQ ID NO: 2031335 - protein, 18 aa, Staphylococcus
NIRIRPEFFEVYRDDTLL

SEQ ID NO: 2031336 - protein, 24 aa, Staphylococcus
NIRKLRLSNISAFEHDATEKYDKV

SEQ ID NO: 2031337 - protein, 25 aa, Staphylococcus
NIRKSRFLIAGGLDINHISKLKYLK

SEQ ID NO: 2031338 - protein, 24 aa, Staphylococcus
NISAAGRLEYEKGFDLLIDSINLI

SEQ ID NO: 2031339 - protein, 21 aa, Staphylococcus
NISAKVFFSSLGFENLGFEKN

SEQ ID NO: 2031340 - protein, 24 aa, Staphylococcus
NISEPKALIGFAGRRVIEQTINEK

SEQ ID NO: 2031341 - protein, 24 aa, Staphylococcus
NISESYCSNLFVRYLNMNFKDYFT

SEQ ID NO: 2031342 - protein, 23 aa, Staphylococcus
NISHRFDINVGILGDSKIALQQL

SEQ ID NO: 2031343 - protein, 20 aa, Staphylococcus
NISHSGALGYFVEMAAEKDM

SEQ ID NO: 2031344 - protein, 25 aa, Staphylococcus
NISLFAGKMSIIFECHIYTHRQVYA

SEQ ID NO: 2031345 - protein, 25 aa, Staphylococcus
NISLRQGLLNAREIILVITGHNKKE

SEQ ID NO: 2031346 - protein, 20 aa, Staphylococcus
NISNLMAAMIAVWSKGIDFK

SEQ ID NO: 2031347 - protein, 20 aa, Staphylococcus
NISNLMAAMIAVWSKGIPFE

SEQ ID NO: 2031348 - protein, 23 aa, Staphylococcus
NISPCSGVICGMGETAQDRIDMA

SEQ ID NO: 2031349 - protein, 22 aa, Staphylococcus
NISPCSGVICGMGETDEDIIDM

SEQ ID NO: 2031350 - protein, 22 aa, Staphylococcus
NISPCSGVICGMGETNEDVINM

SEQ ID NO: 2031351 - protein, 17 aa, Staphylococcus
NISPVDMLSSWSGSEPT

SEQ ID NO: 2031352 - protein, 17 aa, Staphylococcus
NISTDIIRKIVFDSIAD

SEQ ID NO: 2031353 - protein, 18 aa, Staphylococcus
NISTNCYDTAEIIKEVQQ

SEQ ID NO: 2031354 - protein, 19 aa, Staphylococcus
NITGLWLPNHKDFETQYKD

SEQ ID NO: 2031355 - protein, 24 aa, Staphylococcus
NITICGMGGPLIAKILDEGKDKLA

SEQ ID NO: 2031356 - protein, 24 aa, Staphylococcus
NITICGMGGPLIAKILKEGQEKLA

SEQ ID NO: 2031357 - protein, 23 aa, Staphylococcus
NITVESRGIFALDHQPISKLSEE

SEQ ID NO: 2031358 - protein, 19 aa, Staphylococcus
NIVALGDFNDFQWSQPLKT

SEQ ID NO: 2031359 - protein, 24 aa, Staphylococcus
NIVDLALKKEVDFIIIAGDLFDNE

SEQ ID NO: 2031360 - protein, 17 aa, Staphylococcus
NIVGFQTHLKWGAQKDV

SEQ ID NO: 2031361 - protein, 17 aa, Staphylococcus
NIVGLWTHFGYADEFDV

SEQ ID NO: 2031362 - protein, 17 aa, Staphylococcus
NIVKAFIILKEGYKPSD

SEQ ID NO: 2031363 - protein, 21 aa, Staphylococcus
NIVLVPKLLKWSKEKKDARAK

SEQ ID NO: 2031364 - protein, 21 aa, Staphylococcus
NIVLVPKLLKWSQEKKEKKAK

SEQ ID NO: 2031365 - protein, 23 aa, Staphylococcus
NIVRSKGIVWLAQYNEVACLLSQ

SEQ ID NO: 2031366 - protein, 19 aa, Staphylococcus
NIVYIRWFEDLRTIFINEY

SEQ ID NO: 2031367 - protein, 26 aa, Staphylococcus
NIWFEREAKDLLPEGFTHPGSPNGTF

SEQ ID NO: 2031368 - protein, 24 aa, Staphylococcus
NIWRSVYEHGDWDISINGLPPKKN

SEQ ID NO: 2031369 - protein, 24 aa, Staphylococcus
NIYIPSDVVSYDFKNTEDYVASIV

SEQ ID NO: 2031370 - protein, 19 aa, Staphylococcus
NIYKGETLGLVGESGCGKS

SEQ ID NO: 2031371 - protein, 22 aa, Staphylococcus
NIYKGETLGLVGESGCGKSTTG

SEQ ID NO: 2031372 - protein, 18 aa, Staphylococcus
NIYYALDLGKSYRLIDES

SEQ ID NO: 2031373 - protein, 18 aa, Staphylococcus
NKAAYGFHDTVAADPADD

SEQ ID NO: 2031374 - protein, 26 aa, Staphylococcus
NKAIKKEGYKLITPVVITNSENIEKI

SEQ ID NO: 2031375 - protein, 20 aa, Staphylococcus
NKAKIPTIITLPAKTIIPDD

SEQ ID NO: 2031376 - protein, 17 aa, Staphylococcus
NKAPFTFFGDGKQTRDF

SEQ ID NO: 2031377 - protein, 25 aa, Staphylococcus
NKAPRVIDFQAWLNGTPLSFNQFDG

SEQ ID NO: 2031378 - protein, 18 aa, Staphylococcus
NKASLPIFKQTRSWLDTY

SEQ ID NO: 2031379 - protein, 26 aa, Staphylococcus
NKATVAIQELIEFIVDFYKLKIDPKD

SEQ ID NO: 2031380 - protein, 22 aa, Staphylococcus
NKAYKSWSKWSHRDRAELLLRV

SEQ ID NO: 2031381 - protein, 25 aa, Staphylococcus
NKDEFELIRLFGKRGRGLYNKARGI

SEQ ID NO: 2031382 - protein, 19 aa, Staphylococcus
NKDGEVVGFFVLHQYYQHE

SEQ ID NO: 2031383 - protein, 24 aa, Staphylococcus
NKDHFRLGISVSKKLGNAVTRNRI

SEQ ID NO: 2031384 - protein, 21 aa, Staphylococcus
NKDIFGKLSYVGSTVKTLLNP

SEQ ID NO: 2031385 - protein, 24 aa, Staphylococcus
NKDIPKFIIGFGGIKDEALKSHTD

SEQ ID NO: 2031386 - protein, 23 aa, Staphylococcus
NKDKLKGIFLSHGHEHAIGAVSY

SEQ ID NO: 2031387 - protein, 24 aa, Staphylococcus
NKDKLKGIFLSHGHEHAIGAVSYI

SEQ ID NO: 2031388 - protein, 24 aa, Staphylococcus
NKDKLKGIFLTHGHEHAIGAVSYV

SEQ ID NO: 2031389 - protein, 26 aa, Staphylococcus
NKDPYRVGLKLKDNGWVYVQGLTHFE

SEQ ID NO: 2031390 - protein, 18 aa, Staphylococcus
NKDVTLILEIIERDKDID

SEQ ID NO: 2031391 - protein, 17 aa, Staphylococcus
NKEAGRYGVNLRYPQGF

SEQ ID NO: 2031392 - protein, 28 aa, Staphylococcus
NKEIKFKAFLDHAMKLGADYVATGHYAQ

SEQ ID NO: 2031393 - protein, 33 aa, Staphylococcus
NKEIKFKAFLEHALKLGADYVATGHYARIHRHE

SEQ ID NO: 2031394 - protein, 18 aa, Staphylococcus
NKEISWMYDLELLQETSS

SEQ ID NO: 2031395 - protein, 19 aa, Staphylococcus
NKEKFKILHKTIILPELSQ

SEQ ID NO: 2031396 - protein, 19 aa, Staphylococcus
NKEKIMGFGHRVYKDGDPR

SEQ ID NO: 2031397 - protein, 25 aa, Staphylococcus
NKELFELDCDILIPAAIENQITKEN

SEQ ID NO: 2031398 - protein, 22 aa, Staphylococcus
NKENRYLVMPALSDELNIVGIK

SEQ ID NO: 2031399 - protein, 28 aa, Staphylococcus
NKEPIHFQWKPGFVVGVMLASQGYPGTY

SEQ ID NO: 2031400 - protein, 20 aa, Staphylococcus
NKEQGCTIVMVLHDINQAIR

SEQ ID NO: 2031401 - protein, 26 aa, Staphylococcus
NKERFNLFLDEVFEMGIDIDTLVRFN

SEQ ID NO: 2031402 - protein, 18 aa, Staphylococcus
NKERIGIVHIFHGMAEHM

SEQ ID NO: 2031403 - protein, 17 aa, Staphylococcus
NKESFDYIAKVVSKQDE

SEQ ID NO: 2031404 - protein, 18 aa, Staphylococcus
NKETALGYANKFNRKLHP

SEQ ID NO: 2031405 - protein, 19 aa, Staphylococcus
NKETLRYGENPQQSAYFVR

SEQ ID NO: 2031406 - protein, 17 aa, Staphylococcus
NKEVDGFTTNPSLMAKA

SEQ ID NO: 2031407 - protein, 18 aa, Staphylococcus
NKEVDGFTTNPSLMAKAG

SEQ ID NO: 2031408 - protein, 22 aa, Staphylococcus
NKEVKVSLPREFNTNQLDAQGF

SEQ ID NO: 2031409 - protein, 27 aa, Staphylococcus
NKEWNRKAFRGVELYGKTLGVIGAGRI

SEQ ID NO: 2031410 - protein, 24 aa, Staphylococcus
NKFEPGQEIEFFGPEIDTFRQVVE

SEQ ID NO: 2031411 - protein, 17 aa, Staphylococcus
NKFIHRFPTIEALSEAK

SEQ ID NO: 2031412 - protein, 23 aa, Staphylococcus
NKFINCVGGIRFLGVKDGKNAAD

SEQ ID NO: 2031413 - protein, 18 aa, Staphylococcus
NKFISIMAGISIQYIRKE

SEQ ID NO: 2031414 - protein, 20 aa, Staphylococcus
NKFKCKKCGFRHQNNDIVAA

SEQ ID NO: 2031415 - protein, 17 aa, Staphylococcus
NKFKTIIGKDSFIGCNT

SEQ ID NO: 2031416 - protein, 19 aa, Staphylococcus
NKFMKDILLFISDNKAMVK

SEQ ID NO: 2031417 - protein, 31 aa, Staphylococcus
NKFMRIFNFPFYFRGEVYDPFETVTLSEQSF

SEQ ID NO: 2031418 - protein, 24 aa, Staphylococcus
NKGDKCKVSIRFRGRAITHKEIGQ

SEQ ID NO: 2031419 - protein, 21 aa, Staphylococcus
NKGDMTFKLFPDIAPKTVENF

SEQ ID NO: 2031420 - protein, 22 aa, Staphylococcus
NKGDMTFKLFPDIAPKTVENFV

SEQ ID NO: 2031421 - protein, 22 aa, Staphylococcus
NKGDMTFKLFPEIAPKTVENFV

SEQ ID NO: 2031422 - protein, 21 aa, Staphylococcus
NKGDMTFKLFPNIAPKTVENF

SEQ ID NO: 2031423 - protein, 25 aa, Staphylococcus
NKGGCPKCRPAINYYLNMVYPHEHE

SEQ ID NO: 2031424 - protein, 21 aa, Staphylococcus
NKGGFSRKEIIDFEKIIGKAF

SEQ ID NO: 2031425 - protein, 18 aa, Staphylococcus
NKGIKILPFSAENIKEGM

SEQ ID NO: 2031426 - protein, 26 aa, Staphylococcus
NKGIYLFKYRIGGFGFTDDIKRATLF

SEQ ID NO: 2031427 - protein, 20 aa, Staphylococcus
NKGKAIHALFQWLNQFNFDY

SEQ ID NO: 2031428 - protein, 19 aa, Staphylococcus
NKGKAIHALMNWLNQHDFN

SEQ ID NO: 2031429 - protein, 22 aa, Staphylococcus
NKGKFTYVDAFRNKKIKKNHFV

SEQ ID NO: 2031430 - protein, 23 aa, Staphylococcus
NKGKIALFAGIDKCRFKRQVTPG

SEQ ID NO: 2031431 - protein, 18 aa, Staphylococcus
NKGKLILQVLSIDESGKL

SEQ ID NO: 2031432 - protein, 18 aa, Staphylococcus
NKGKLILQVTSIDESGSL

SEQ ID NO: 2031433 - protein, 17 aa, Staphylococcus
NKGKLVLQVVSIDESGN

SEQ ID NO: 2031434 - protein, 24 aa, Staphylococcus
NKGKMAMRVYPPWEVNLNPSAQKA

SEQ ID NO: 2031435 - protein, 22 aa, Staphylococcus
NKGLIYRGEYIINWDPIARTAL

SEQ ID NO: 2031436 - protein, 18 aa, Staphylococcus
NKGLKLVGGKLMQVPQEL

SEQ ID NO: 2031437 - protein, 18 aa, Staphylococcus
NKGLKLVGGKLMQVPTEL

SEQ ID NO: 2031438 - protein, 26 aa, Staphylococcus
NKGNMLKPWFVDSIKNPISKKTFYQG

SEQ ID NO: 2031439 - protein, 22 aa, Staphylococcus
NKGNMLKPWFVNKVDNPISKKT

SEQ ID NO: 2031440 - protein, 25 aa, Staphylococcus
NKGNMLKPWFVNSIDNPVTKKNFYS

SEQ ID NO: 2031441 - protein, 25 aa, Staphylococcus
NKGNMLKPWFVQSIDNPISKKTFYK

SEQ ID NO: 2031442 - protein, 28 aa, Staphylococcus
NKGRNLIELKIPMAYFYLEDAAFFNCHF

SEQ ID NO: 2031443 - protein, 18 aa, Staphylococcus
NKGRVYKLKGYEVPELSR

SEQ ID NO: 2031444 - protein, 23 aa, Staphylococcus
NKGRYLYLPVHKLPDVKWKDLGQ

SEQ ID NO: 2031445 - protein, 30 aa, Staphylococcus
NKGVPFRSAHEVVGKIVLWSIQHNIYLLDV

SEQ ID NO: 2031446 - protein, 22 aa, Staphylococcus
NKGYIKRSYMMTAYITEFQVLN

SEQ ID NO: 2031447 - protein, 22 aa, Staphylococcus
NKHIAELCYMIWEDMELDIVNE

SEQ ID NO: 2031448 - protein, 18 aa, Staphylococcus
NKHLHFHGTTEAFKSLDE

SEQ ID NO: 2031449 - protein, 20 aa, Staphylococcus
NKHYISIFINGRYIKNFALN

SEQ ID NO: 2031450 - protein, 20 aa, Staphylococcus
NKHYISIFINGRYIKNFILN

SEQ ID NO: 2031451 - protein, 21 aa, Staphylococcus
NKHYISIFINGRYIKNFILNK

SEQ ID NO: 2031452 - protein, 20 aa, Staphylococcus
NKHYISIFINGRYIKNFLLN

SEQ ID NO: 2031453 - protein, 18 aa, Staphylococcus
NKIAMVWEEIEDFEIEDL

SEQ ID NO: 2031454 - protein, 20 aa, Staphylococcus
NKIATSYVKTARAYFEAQGI

SEQ ID NO: 2031455 - protein, 25 aa, Staphylococcus
NKIFECIHAGLPVILSPVKEHYYLN

SEQ ID NO: 2031456 - protein, 23 aa, Staphylococcus
NKIIKFEGCYHGHSDSLLIKAGS

SEQ ID NO: 2031457 - protein, 23 aa, Staphylococcus
NKIKAWCISFDVNIQITKKKGIT

SEQ ID NO: 2031458 - protein, 23 aa, Staphylococcus
NKIKGIRAALAHDYYSAERAQLS

SEQ ID NO: 2031459 - protein, 30 aa, Staphylococcus
NKIKGVGLYKALTLKAAFELGERMHSGSVD

SEQ ID NO: 2031460 - protein, 20 aa, Staphylococcus
NKIKLIKRVSFGYRNYDNLR

SEQ ID NO: 2031461 - protein, 17 aa, Staphylococcus
NKIKPDLAIAVDVAIAY

SEQ ID NO: 2031462 - protein, 17 aa, Staphylococcus
NKIKPDLAIAVDVAVAY

SEQ ID NO: 2031463 - protein, 26 aa, Staphylococcus
NKINKGYCLLVGVGKSSTEADIATLA

SEQ ID NO: 2031464 - protein, 26 aa, Staphylococcus
NKINLLESIGFTYNLIRKLSFFNENY

SEQ ID NO: 2031465 - protein, 17 aa, Staphylococcus
NKIPVEIFGVMSGGITT

SEQ ID NO: 2031466 - protein, 17 aa, Staphylococcus
NKIRIINTPGYIDTNLM

SEQ ID NO: 2031467 - protein, 22 aa, Staphylococcus
NKISMVTAYDFPSAKQAQQADI

SEQ ID NO: 2031468 - protein, 26 aa, Staphylococcus
NKISSCVKGKFGWDYVDSDERLTKPL

SEQ ID NO: 2031469 - protein, 22 aa, Staphylococcus
NKIVKFEGCYHGHSDSLLIKAG

SEQ ID NO: 2031470 - protein, 23 aa, Staphylococcus
NKIVKFEGCYHGHSDSLLIKAGS

SEQ ID NO: 2031471 - protein, 19 aa, Staphylococcus
NKIVQDVAGVFNIEANRLN

SEQ ID NO: 2031472 - protein, 18 aa, Staphylococcus
NKKARLSEFKKYKDYVAK

SEQ ID NO: 2031473 - protein, 18 aa, Staphylococcus
NKKASREVTTSEFVVEMK

SEQ ID NO: 2031474 - protein, 23 aa, Staphylococcus
NKKDIRTIIHFHLSTSPSNYMQE

SEQ ID NO: 2031475 - protein, 22 aa, Staphylococcus
NKKDIRTVIHFHLSSSPSNYLQ

SEQ ID NO: 2031476 - protein, 23 aa, Staphylococcus
NKKDIRTVIHFHLSTSPSSYLQE

SEQ ID NO: 2031477 - protein, 19 aa, Staphylococcus
NKKEFYSYYLSQLEVPKNH

SEQ ID NO: 2031478 - protein, 19 aa, Staphylococcus
NKKEYLTSELFDLTESEKQ

SEQ ID NO: 2031479 - protein, 20 aa, Staphylococcus
NKKFADKMHMLKLNYDHLPL

SEQ ID NO: 2031480 - protein, 26 aa, Staphylococcus
NKKGFAFLRPELEDMDDIFIPPTKIN

SEQ ID NO: 2031481 - protein, 17 aa, Staphylococcus
NKKGFGFLRPENDDMED

SEQ ID NO: 2031482 - protein, 24 aa, Staphylococcus
NKKIEIDGTIAWITKDGVRGFKDT

SEQ ID NO: 2031483 - protein, 26 aa, Staphylococcus
NKKKQRAICVVEGFNYDSVLNSLEKS

SEQ ID NO: 2031484 - protein, 23 aa, Staphylococcus
NKKLAKHGFIGGFDLGEASADFE

SEQ ID NO: 2031485 - protein, 17 aa, Staphylococcus
NKKLHSHGKSLKRGQFI

SEQ ID NO: 2031486 - protein, 26 aa, Staphylococcus
NKKLVIDGTIHWRKDGNKVGFKDTTK

SEQ ID NO: 2031487 - protein, 20 aa, Staphylococcus
NKKLVKLMLVFNSEYMTVNE

SEQ ID NO: 2031488 - protein, 19 aa, Staphylococcus
NKKPIKRLWISSITAKAIR

SEQ ID NO: 2031489 - protein, 26 aa, Staphylococcus
NKKPIKRLWISSVTKKAIKDGFNHLK

SEQ ID NO: 2031490 - protein, 25 aa, Staphylococcus
NKKPIKRLWISSVTKKAIQEGFKKL

SEQ ID NO: 2031491 - protein, 25 aa, Staphylococcus
NKKPIKRLWISSVTKKAIQQGFKHL

SEQ ID NO: 2031492 - protein, 24 aa, Staphylococcus
NKKPSLRWDNYYGLTHFIVPPVAK

SEQ ID NO: 2031493 - protein, 25 aa, Staphylococcus
NKKPTLRWDNYYGLTHFIVPPVAKE

SEQ ID NO: 2031494 - protein, 21 aa, Staphylococcus
NKKRYIARMKQFPDLKVDQQL

SEQ ID NO: 2031495 - protein, 18 aa, Staphylococcus
NKKSVWLGVWEKNKKAIE

SEQ ID NO: 2031496 - protein, 24 aa, Staphylococcus
NKKTILLFCRLPLALAHKSLKAMQ

SEQ ID NO: 2031497 - protein, 25 aa, Staphylococcus
NKLDCEINEKVILLIMKQQPIASDL

SEQ ID NO: 2031498 - protein, 19 aa, Staphylococcus
NKLGMSLSIAEEIVFKLKH

SEQ ID NO: 2031499 - protein, 20 aa, Staphylococcus
NKLHEIKNTIAFKDLKHSIE

SEQ ID NO: 2031500 - protein, 22 aa, Staphylococcus
NKLHLWLNKNIEIHDFDADPGW

SEQ ID NO: 2031501 - protein, 19 aa, Staphylococcus
NKLILYLIVELSHFENTDH

SEQ ID NO: 2031502 - protein, 23 aa, Staphylococcus
NKLISELKKALNYHLKNNNDKNN

SEQ ID NO: 2031503 - protein, 17 aa, Staphylococcus
NKLKELGAREVIDRISE

SEQ ID NO: 2031504 - protein, 23 aa, Staphylococcus
NKLKIYTIAFAFQSFTEQIGGKY

SEQ ID NO: 2031505 - protein, 20 aa, Staphylococcus
NKLKKFGIKKGVPVVFSDES

SEQ ID NO: 2031506 - protein, 17 aa, Staphylococcus
NKLKLLNKMYGVDVAKY

SEQ ID NO: 2031507 - protein, 25 aa, Staphylococcus
NKLKMPFIGLQWIFGRKGAAASNHF

SEQ ID NO: 2031508 - protein, 21 aa, Staphylococcus
NKLKRYWKLLLKKPHDLNRMH

SEQ ID NO: 2031509 - protein, 19 aa, Staphylococcus
NKLLNLPIFNGINEYIYNP

SEQ ID NO: 2031510 - protein, 17 aa, Staphylococcus
NKLLPYLLDGEHIIFSE

SEQ ID NO: 2031511 - protein, 18 aa, Staphylococcus
NKLLSGPDIISRGFVYMR

SEQ ID NO: 2031512 - protein, 19 aa, Staphylococcus
NKLNETFRRKGISEEKTPE

SEQ ID NO: 2031513 - protein, 17 aa, Staphylococcus
NKLPKYIPLLLQVKFDL

SEQ ID NO: 2031514 - protein, 17 aa, Staphylococcus
NKLRIADFFIQTYSYVS

SEQ ID NO: 2031515 - protein, 24 aa, Staphylococcus
NKLRLLKLAPKVLERLRESKITER

SEQ ID NO: 2031516 - protein, 24 aa, Staphylococcus
NKLSKREIEVLAEMVKGKTNKEIA

SEQ ID NO: 2031517 - protein, 23 aa, Staphylococcus
NKLSKREVEVLREMVKGKTNKEI

SEQ ID NO: 2031518 - protein, 19 aa, Staphylococcus
NKLSLDWECFVISKSEMLL

SEQ ID NO: 2031519 - protein, 17 aa, Staphylococcus
NKLVKIGVFGTFSAGKS

SEQ ID NO: 2031520 - protein, 25 aa, Staphylococcus
NKLWNIQPLREFWGINKRTEVKLNK

SEQ ID NO: 2031521 - protein, 28 aa, Staphylococcus
NKMRKVYRYKLTYIIDALSSYKDQLLIE

SEQ ID NO: 2031522 - protein, 26 aa, Staphylococcus
NKNCASIICPPDIFSKLLHTVATRNI

SEQ ID NO: 2031523 - protein, 17 aa, Staphylococcus
NKNCKKYDGQKLMMKTI

SEQ ID NO: 2031524 - protein, 24 aa, Staphylococcus
NKNFRIDYELPMNFISQSQGGKDN

SEQ ID NO: 2031525 - protein, 20 aa, Staphylococcus
NKNGFKEFYKLREEAQDHQI

SEQ ID NO: 2031526 - protein, 23 aa, Staphylococcus
NKNLKAGDTVICMIGAANRDPKA

SEQ ID NO: 2031527 - protein, 20 aa, Staphylococcus
NKNRIEMMINNAGVNCLFNG

SEQ ID NO: 2031528 - protein, 23 aa, Staphylococcus
NKNVKRLIFVAAPGIYNELPEQF

SEQ ID NO: 2031529 - protein, 23 aa, Staphylococcus
NKPDIRTVIHFHLPTSPSSYIQE

SEQ ID NO: 2031530 - protein, 23 aa, Staphylococcus
NKPEAKLFILLVGERPEEVTDIE

SEQ ID NO: 2031531 - protein, 17 aa, Staphylococcus
NKPEFSGATILITGDNF

SEQ ID NO: 2031532 - protein, 23 aa, Staphylococcus
NKPEWMILDVLPIIPPEIRPMVQ

SEQ ID NO: 2031533 - protein, 17 aa, Staphylococcus
NKPFIRILRTMPQLNEV

SEQ ID NO: 2031534 - protein, 20 aa, Staphylococcus
NKPILLKRGMSATIEEFIFA

SEQ ID NO: 2031535 - protein, 17 aa, Staphylococcus
NKPPATWVVLAKPDLGI

SEQ ID NO: 2031536 - protein, 20 aa, Staphylococcus
NKPQHQFAFQVKEATMIQHI

SEQ ID NO: 2031537 - protein, 19 aa, Staphylococcus
NKPWAQRVYPELSEEEAYE

SEQ ID NO: 2031538 - protein, 19 aa, Staphylococcus
NKQNIPWIYGAAVGSKGTV

SEQ ID NO: 2031539 - protein, 24 aa, Staphylococcus
NKQRLRIVDFYNKKGFKFAEAIYD

SEQ ID NO: 2031540 - protein, 18 aa, Staphylococcus
NKQWFKVMNKLGYQHQGF

SEQ ID NO: 2031541 - protein, 22 aa, Staphylococcus
NKRADHEIACFIQVNVSGEESK

SEQ ID NO: 2031542 - protein, 21 aa, Staphylococcus
NKRADHVVSCFLQVNVSGEES

SEQ ID NO: 2031543 - protein, 25 aa, Staphylococcus
NKRATRPVNCFVQINVSGEESKHGI

SEQ ID NO: 2031544 - protein, 24 aa, Staphylococcus
NKRGLMRHLVIRTGYHTDEIMVIF

SEQ ID NO: 2031545 - protein, 22 aa, Staphylococcus
NKRMKWYTVIQSIGMIQWYEEQ

SEQ ID NO: 2031546 - protein, 17 aa, Staphylococcus
NKRQGKQLLAYLAAPKH

SEQ ID NO: 2031547 - protein, 17 aa, Staphylococcus
NKRRAVLHFRNRNNEIL

SEQ ID NO: 2031548 - protein, 26 aa, Staphylococcus
NKRRVKDWLKKTARKYGLDADDVILI

SEQ ID NO: 2031549 - protein, 22 aa, Staphylococcus
NKRYWECPIGCYEWEDLAEYFG

SEQ ID NO: 2031550 - protein, 24 aa, Staphylococcus
NKSNELREGWLFGDKYDSTETFLF

SEQ ID NO: 2031551 - protein, 22 aa, Staphylococcus
NKSPYFKKVMTYAHYYEKNKVN

SEQ ID NO: 2031552 - protein, 25 aa, Staphylococcus
NKSRFKNCNFNEGIFKNIKAISNSK

SEQ ID NO: 2031553 - protein, 18 aa, Staphylococcus
NKSRLGLTDMTKPGGLLY

SEQ ID NO: 2031554 - protein, 17 aa, Staphylococcus
NKSSAYLGTNGFQINET

SEQ ID NO: 2031555 - protein, 18 aa, Staphylococcus
NKSTILLPVPKTIYPLLN

SEQ ID NO: 2031556 - protein, 19 aa, Staphylococcus
NKSWISVEVKIDRELAPDE

SEQ ID NO: 2031557 - protein, 19 aa, Staphylococcus
NKSYTIGIIVPRITNPYFA

SEQ ID NO: 2031558 - protein, 17 aa, Staphylococcus
NKTCIVVTHDERLTSYC

SEQ ID NO: 2031559 - protein, 22 aa, Staphylococcus
NKTEKDYAFIVGIENNEVISMA

SEQ ID NO: 2031560 - protein, 24 aa, Staphylococcus
NKTEYRGREATDFQEEDIELFKEI

SEQ ID NO: 2031561 - protein, 18 aa, Staphylococcus
NKTFKTIEDFLSKNTNKL

SEQ ID NO: 2031562 - protein, 19 aa, Staphylococcus
NKTFYLLDILQKLPIDKMN

SEQ ID NO: 2031563 - protein, 26 aa, Staphylococcus
NKTISIRWSQDWNDVTALTLYWTAIL

SEQ ID NO: 2031564 - protein, 24 aa, Staphylococcus
NKTKGRYSVVAFDIYGDVTLTEDK

SEQ ID NO: 2031565 - protein, 18 aa, Staphylococcus
NKTLEVFNGMSHKTIKTM

SEQ ID NO: 2031566 - protein, 17 aa, Staphylococcus
NKTLYLLDVLQKLPIDK

SEQ ID NO: 2031567 - protein, 26 aa, Staphylococcus
NKTMFSGKMWLSYTGFSEDEQAYKDH

SEQ ID NO: 2031568 - protein, 18 aa, Staphylococcus
NKTVIWLDCDIDIIYHRI

SEQ ID NO: 2031569 - protein, 23 aa, Staphylococcus
NKVAGELLCQYYFEKFGVDTRSV

SEQ ID NO: 2031570 - protein, 24 aa, Staphylococcus
NKVKKSQCNYDFDRYVKPYATQID

SEQ ID NO: 2031571 - protein, 18 aa, Staphylococcus
NKVKSFIQSLPFELTDAQ

SEQ ID NO: 2031572 - protein, 21 aa, Staphylococcus
NKVKVIAWYDNEWGYSNRVVE

SEQ ID NO: 2031573 - protein, 19 aa, Staphylococcus
NKVKYWLFNTLNTIRKNVK

SEQ ID NO: 2031574 - protein, 19 aa, Staphylococcus
NKVKYWLFTTLDRIRKKIK

SEQ ID NO: 2031575 - protein, 19 aa, Staphylococcus
NKVKYWLFTTLDRIRSKVK

SEQ ID NO: 2031576 - protein, 20 aa, Staphylococcus
NKVLDERGLSEILSNNQIQM

SEQ ID NO: 2031577 - protein, 18 aa, Staphylococcus
NKVMTRRPINVELTTTVA

SEQ ID NO: 2031578 - protein, 24 aa, Staphylococcus
NKVSRLSVRNSLWENQSFTDYDVI

SEQ ID NO: 2031579 - protein, 20 aa, Staphylococcus
NKVTYYWYKQIIEIMKETVN

SEQ ID NO: 2031580 - protein, 25 aa, Staphylococcus
NKWQYKTLPSINQWYSDMEKQRILH

SEQ ID NO: 2031581 - protein, 27 aa, Staphylococcus
NKWTSSWGDLFIKSRMDKLCSEIYKKR

SEQ ID NO: 2031582 - protein, 21 aa, Staphylococcus
NKYARGVAVYGDIKDSTDEDG

SEQ ID NO: 2031583 - protein, 21 aa, Staphylococcus
NKYARGVAVYGDMKDGTDENG

SEQ ID NO: 2031584 - protein, 20 aa, Staphylococcus
NKYFEDAKTIIALQHLLLNY

SEQ ID NO: 2031585 - protein, 18 aa, Staphylococcus
NKYGFYYSEEEIIITNGA

SEQ ID NO: 2031586 - protein, 17 aa, Staphylococcus
NKYGITMVMTGMRHFKH

SEQ ID NO: 2031587 - protein, 17 aa, Staphylococcus
NKYGITMVMTGRRHFKH

SEQ ID NO: 2031588 - protein, 20 aa, Staphylococcus
NKYKDAYNNYQFTKTAFTDL

SEQ ID NO: 2031589 - protein, 20 aa, Staphylococcus
NKYKEWLQDYILISTPFQVP

SEQ ID NO: 2031590 - protein, 23 aa, Staphylococcus
NKYLLPHRSIIFSSDEAFEQFLN

SEQ ID NO: 2031591 - protein, 24 aa, Staphylococcus
NKYPEYKNGPYLKVTDEQLLELNP

SEQ ID NO: 2031592 - protein, 17 aa, Staphylococcus
NKYSRKFSGRKLINKTI

SEQ ID NO: 2031593 - protein, 25 aa, Staphylococcus
NKYWPADIHLMAKEIVRFHSIIWPI

SEQ ID NO: 2031594 - protein, 17 aa, Staphylococcus
NKYYYAIHFDESVSQEM

SEQ ID NO: 2031595 - protein, 17 aa, Staphylococcus
NLAHVEGFEKYLHKNFV

SEQ ID NO: 2031596 - protein, 25 aa, Staphylococcus
NLAIMGRYVLTANIFDYLKTQKRGA

SEQ ID NO: 2031597 - protein, 25 aa, Staphylococcus
NLAIMGRYVLTPEIFDYLETQEEGA

SEQ ID NO: 2031598 - protein, 18 aa, Staphylococcus
NLAIRTCQTLGITRGVAH

SEQ ID NO: 2031599 - protein, 27 aa, Staphylococcus
NLAKEGMMLCEFLKVKPEILKFMLKVF

SEQ ID NO: 2031600 - protein, 23 aa, Staphylococcus
NLAKKHPGSIVYIPAGTYYIKRA

SEQ ID NO: 2031601 - protein, 19 aa, Staphylococcus
NLAPMVFMLGNLEVKELSQ

SEQ ID NO: 2031602 - protein, 17 aa, Staphylococcus
NLAQCPDMMQSIGPGAK

SEQ ID NO: 2031603 - protein, 25 aa, Staphylococcus
NLATEGMMLCEFLNIKANSLKFMLK

SEQ ID NO: 2031604 - protein, 17 aa, Staphylococcus
NLATSLIVSERIETTEA

SEQ ID NO: 2031605 - protein, 25 aa, Staphylococcus
NLAVKHPLFEYARTFDYVVITEKGI

SEQ ID NO: 2031606 - protein, 19 aa, Staphylococcus
NLAYSRLGKQVFELEHLTK

SEQ ID NO: 2031607 - protein, 17 aa, Staphylococcus
NLDHLGLGRFIKEAIGS

SEQ ID NO: 2031608 - protein, 18 aa, Staphylococcus
NLDIEIDEDFLLVKREIF

SEQ ID NO: 2031609 - protein, 26 aa, Staphylococcus
NLDIISVMLYLEINKAYKIMKSKYDK

SEQ ID NO: 2031610 - protein, 22 aa, Staphylococcus
NLDKGVAFGAMFEDSEDLMHQK

SEQ ID NO: 2031611 - protein, 22 aa, Staphylococcus
NLDKGVAFGAMFEDTEDLMHQK

SEQ ID NO: 2031612 - protein, 23 aa, Staphylococcus
NLDKGVAFGAMFSDSEDLMHQKN

SEQ ID NO: 2031613 - protein, 22 aa, Staphylococcus
NLDNHFPLVVWQTGSGTQSNMN

SEQ ID NO: 2031614 - protein, 17 aa, Staphylococcus
NLDNLLLQHYPQVKVID

SEQ ID NO: 2031615 - protein, 20 aa, Staphylococcus
NLDPSLLLAPWDVIEERLKA

SEQ ID NO: 2031616 - protein, 20 aa, Staphylococcus
NLDPSLLLAPWDVIESRLKD

SEQ ID NO: 2031617 - protein, 22 aa, Staphylococcus
NLDPSLLLAPWDVIQPRLDKIL

SEQ ID NO: 2031618 - protein, 21 aa, Staphylococcus
NLDPSLLLAPWDVLEQRVKAI

SEQ ID NO: 2031619 - protein, 19 aa, Staphylococcus
NLDQINWVGFYLIDNQELI

SEQ ID NO: 2031620 - protein, 25 aa, Staphylococcus
NLDSVMPGFDFYFIPSILNSNDVTY

SEQ ID NO: 2031621 - protein, 20 aa, Staphylococcus
NLDYILFGHLFKTKSKPGKA

SEQ ID NO: 2031622 - protein, 30 aa, Staphylococcus
NLEAGNALAFAHGFNIHFDVIQPPEDVDVF

SEQ ID NO: 2031623 - protein, 30 aa, Staphylococcus
NLEAGNALAFAHGFNIHFEVIKPPKDVDVF

SEQ ID NO: 2031624 - protein, 29 aa, Staphylococcus
NLEAGNALAFAHGFNIHFGVIQPPADVDV

SEQ ID NO: 2031625 - protein, 29 aa, Staphylococcus
NLEAGNALAFAHGFNIHFNVIEPPKDVDV

SEQ ID NO: 2031626 - protein, 20 aa, Staphylococcus
NLEDFKAMIDAGATRVGASA

SEQ ID NO: 2031627 - protein, 18 aa, Staphylococcus
NLEDGRLNVILMVGVNGV

SEQ ID NO: 2031628 - protein, 21 aa, Staphylococcus
NLEDYRVMIVHPWQYDHTIGG

SEQ ID NO: 2031629 - protein, 19 aa, Staphylococcus
NLEELRTQTGLNHHTLDDI

SEQ ID NO: 2031630 - protein, 22 aa, Staphylococcus
NLEFSYKAGKIEGLHPGRTAIV

SEQ ID NO: 2031631 - protein, 22 aa, Staphylococcus
NLEGLPPIVMFGAGKEIYYPDM

SEQ ID NO: 2031632 - protein, 23 aa, Staphylococcus
NLEKGEIVGLVGANGAGKTSLMK

SEQ ID NO: 2031633 - protein, 24 aa, Staphylococcus
NLEKLKIAIHYGADAVFLGGQEYG

SEQ ID NO: 2031634 - protein, 25 aa, Staphylococcus
NLEKLKIAVYYGADAVFLGGQEYGL

SEQ ID NO: 2031635 - protein, 24 aa, Staphylococcus
NLEPEEFIMWFLGMNESIADVKEN

SEQ ID NO: 2031636 - protein, 21 aa, Staphylococcus
NLEQCIYRSLLECVTVLEYTM

SEQ ID NO: 2031637 - protein, 28 aa, Staphylococcus
NLERAMSGNGRFGGHFVLGHVDDKGVIT

SEQ ID NO: 2031638 - protein, 29 aa, Staphylococcus
NLERAMSGNGRFGGHFVLGHVDELGTISK

SEQ ID NO: 2031639 - protein, 30 aa, Staphylococcus
NLERAMSGQGRFGGHFVLGHVDEVAKIKRI

SEQ ID NO: 2031640 - protein, 29 aa, Staphylococcus
NLERAMSGSGRFGGHFVLGHVDAKGTIIN

SEQ ID NO: 2031641 - protein, 24 aa, Staphylococcus
NLEYKSAYFKGMFNEEAPAFEDIF

SEQ ID NO: 2031642 - protein, 18 aa, Staphylococcus
NLFARWRKEETLYSEDEK

SEQ ID NO: 2031643 - protein, 18 aa, Staphylococcus
NLFEREYCQKEIITCHNI

SEQ ID NO: 2031644 - protein, 18 aa, Staphylococcus
NLFERHPSIKSKKFQVAV

SEQ ID NO: 2031645 - protein, 33 aa, Staphylococcus
NLFFGTPISTCILVFKKCREIDDNVLFIDASQS

SEQ ID NO: 2031646 - protein, 27 aa, Staphylococcus
NLFKPGDEILVAFDLYGGTFRLFDYYE

SEQ ID NO: 2031647 - protein, 21 aa, Staphylococcus
NLFLCEVFGGKIFKVNLPSKD

SEQ ID NO: 2031648 - protein, 22 aa, Staphylococcus
NLFVLLCIANSLNIDMTDSFNE

SEQ ID NO: 2031649 - protein, 22 aa, Staphylococcus
NLFVLMCIANSLDIDLTESFDE

SEQ ID NO: 2031650 - protein, 25 aa, Staphylococcus
NLGASRLMIEYGITNLISKCVQKFS

SEQ ID NO: 2031651 - protein, 21 aa, Staphylococcus
NLGFYKALEAEGIKSNKTKVG

SEQ ID NO: 2031652 - protein, 33 aa, Staphylococcus
NLGLDYLDLYLIHWPCEKDGLYIESYKALEKLY

SEQ ID NO: 2031653 - protein, 22 aa, Staphylococcus
NLGNEYNKEFALYRSTRRYEAI

SEQ ID NO: 2031654 - protein, 25 aa, Staphylococcus
NLGSALFIYRGLWLLKSDLDKTTIC

SEQ ID NO: 2031655 - protein, 17 aa, Staphylococcus
NLGVSWNTLKKWKTNKE

SEQ ID NO: 2031656 - protein, 21 aa, Staphylococcus
NLHGRPLTRQGIWKLIKQYGL

SEQ ID NO: 2031657 - protein, 21 aa, Staphylococcus
NLHIAFKIQSLEIMDYIERIY

SEQ ID NO: 2031658 - protein, 17 aa, Staphylococcus
NLHNDFITFYEDLHKKV

SEQ ID NO: 2031659 - protein, 22 aa, Staphylococcus
NLIEELFKLYGEMDQYNKINLL

SEQ ID NO: 2031660 - protein, 17 aa, Staphylococcus
NLIEYVDKVYIMLNKPA

SEQ ID NO: 2031661 - protein, 28 aa, Staphylococcus
NLIGAFYRPKAVIYDLNFLETLPYTEIL

SEQ ID NO: 2031662 - protein, 17 aa, Staphylococcus
NLIGGFRAKVGTTVLDG

SEQ ID NO: 2031663 - protein, 17 aa, Staphylococcus
NLIKEGYYEEKLKTLNE

SEQ ID NO: 2031664 - protein, 20 aa, Staphylococcus
NLIKELKLSTSIATNLTGRF

SEQ ID NO: 2031665 - protein, 22 aa, Staphylococcus
NLIKGGGGALFREKVIDDMAER

SEQ ID NO: 2031666 - protein, 22 aa, Staphylococcus
NLIKGGGGALFREKVIDEMARK

SEQ ID NO: 2031667 - protein, 18 aa, Staphylococcus
NLINFTGDTLDHLWRVTS

SEQ ID NO: 2031668 - protein, 17 aa, Staphylococcus
NLIRLSGFKEEDIDIEF

SEQ ID NO: 2031669 - protein, 20 aa, Staphylococcus
NLIRSHACGVGKPFSEEVAL

SEQ ID NO: 2031670 - protein, 19 aa, Staphylococcus
NLKDLRNGKAVEVPTYDYA

SEQ ID NO: 2031671 - protein, 22 aa, Staphylococcus
NLKEARILLIGAGGASKGLAAA

SEQ ID NO: 2031672 - protein, 24 aa, Staphylococcus
NLKEKRVIGQFAAKLIEDNDCIFM

SEQ ID NO: 2031673 - protein, 20 aa, Staphylococcus
NLKGRHLLKEDDFTKKEFSD

SEQ ID NO: 2031674 - protein, 20 aa, Staphylococcus
NLKGVLSLYSQFDQLVCVSD

SEQ ID NO: 2031675 - protein, 22 aa, Staphylococcus
NLKGVLYGIGAVVPKMRAQKSG

SEQ ID NO: 2031676 - protein, 22 aa, Staphylococcus
NLKKELIEYGLLEEIRVPTSNN

SEQ ID NO: 2031677 - protein, 21 aa, Staphylococcus
NLKLPIKQIDGLRERKIGYWV

SEQ ID NO: 2031678 - protein, 17 aa, Staphylococcus
NLKQRVGSMKGKIEIHA

SEQ ID NO: 2031679 - protein, 17 aa, Staphylococcus
NLKRFKEVRKEIEVGKM

SEQ ID NO: 2031680 - protein, 23 aa, Staphylococcus
NLKSILESPKFKNAESKLTVAMG

SEQ ID NO: 2031681 - protein, 20 aa, Staphylococcus
NLKSRGMILYINRNTRKTNG

SEQ ID NO: 2031682 - protein, 22 aa, Staphylococcus
NLKSSGRMVGIISHVTELKQRI

SEQ ID NO: 2031683 - protein, 24 aa, Staphylococcus
NLLAFIEQFPHYFIGSNADIPLVG

SEQ ID NO: 2031684 - protein, 25 aa, Staphylococcus
NLLAKRLKQQYGLTFDACATKHLPI

SEQ ID NO: 2031685 - protein, 17 aa, Staphylococcus
NLLDMAYTLAFYDNENV

SEQ ID NO: 2031686 - protein, 26 aa, Staphylococcus
NLLEACRKWNSNLKKFIFASSAAVYG

SEQ ID NO: 2031687 - protein, 25 aa, Staphylococcus
NLLKDLELPLARILSKMEEIGIYTD

SEQ ID NO: 2031688 - protein, 17 aa, Staphylococcus
NLLKERIVEELSQIGIE

SEQ ID NO: 2031689 - protein, 18 aa, Staphylococcus
NLLLKLQKERGITFLFIA

SEQ ID NO: 2031690 - protein, 19 aa, Staphylococcus
NLLNRCFEKLFEKNIRLAV

SEQ ID NO: 2031691 - protein, 31 aa, Staphylococcus
NLLPRYIEKTICGKKLLFIHYEIENQKLETG

SEQ ID NO: 2031692 - protein, 21 aa, Staphylococcus
NLLQLRQKYFFSVTTLKDNTL

SEQ ID NO: 2031693 - protein, 19 aa, Staphylococcus
NLLTYLGVFDRVRNFFSKE

SEQ ID NO: 2031694 - protein, 19 aa, Staphylococcus
NLLTYLGVFDSVRSFFSKE

SEQ ID NO: 2031695 - protein, 21 aa, Staphylococcus
NLMPKCIYTYPEIASIGKNLE

SEQ ID NO: 2031696 - protein, 31 aa, Staphylococcus
NLNAETSKLFSFFISYHFNKFELGVEKIFIK

SEQ ID NO: 2031697 - protein, 20 aa, Staphylococcus
NLNDIGCYFLDIQLEADING

SEQ ID NO: 2031698 - protein, 17 aa, Staphylococcus
NLNDVFKSLRQPLQQSD

SEQ ID NO: 2031699 - protein, 24 aa, Staphylococcus
NLNELRQNMGMVFQSFNLFPHKTV

SEQ ID NO: 2031700 - protein, 22 aa, Staphylococcus
NLNETFDVITIFCDSLNYLNSY

SEQ ID NO: 2031701 - protein, 26 aa, Staphylococcus
NLNHFGYMWECPDYFELDGQGVILFC

SEQ ID NO: 2031702 - protein, 20 aa, Staphylococcus
NLNHSIIIMYWHQPSKQSPS

SEQ ID NO: 2031703 - protein, 18 aa, Staphylococcus
NLNIKRLMEISSYRGIRH

SEQ ID NO: 2031704 - protein, 18 aa, Staphylococcus
NLNIPRYVDTFEEEEPID

SEQ ID NO: 2031705 - protein, 18 aa, Staphylococcus
NLNIPRYVDTFEEEEPVD

SEQ ID NO: 2031706 - protein, 18 aa, Staphylococcus
NLNIPRYVDTFEEEESID

SEQ ID NO: 2031707 - protein, 24 aa, Staphylococcus
NLNKRMKWYTVIQSIGMVQWYEEQ

SEQ ID NO: 2031708 - protein, 21 aa, Staphylococcus
NLNLLNRCFEKLFEMDIGLAM

SEQ ID NO: 2031709 - protein, 21 aa, Staphylococcus
NLNNIIWLDTDIEIIYNRIKN

SEQ ID NO: 2031710 - protein, 17 aa, Staphylococcus
NLNQPFYIKNAMIEFDD

SEQ ID NO: 2031711 - protein, 20 aa, Staphylococcus
NLNVEVLIMPDIESVMTGEL

SEQ ID NO: 2031712 - protein, 17 aa, Staphylococcus
NLNVVAINASYPSETIA

SEQ ID NO: 2031713 - protein, 21 aa, Staphylococcus
NLNYEEIYILNYIVKSKKDEI

SEQ ID NO: 2031714 - protein, 28 aa, Staphylococcus
NLPAEESYFLFYINRPSIIVGKNQNTIE

SEQ ID NO: 2031715 - protein, 24 aa, Staphylococcus
NLPESFKIMRYHSLISDPETFPEV

SEQ ID NO: 2031716 - protein, 17 aa, Staphylococcus
NLPFGGVGASGFGKYHG

SEQ ID NO: 2031717 - protein, 19 aa, Staphylococcus
NLPGAEAIRSELANNPNLD

SEQ ID NO: 2031718 - protein, 33 aa, Staphylococcus
NLPKLKIYNPWHKFKIELAYKIASIYKMMSRGR

SEQ ID NO: 2031719 - protein, 19 aa, Staphylococcus
NLPMAVSMVKSIKLTMGRL

SEQ ID NO: 2031720 - protein, 26 aa, Staphylococcus
NLPNKEFQLLFLLASNPRQVFNRDAL

SEQ ID NO: 2031721 - protein, 25 aa, Staphylococcus
NLPNKEFQLLFLLVSNPKHIFTRND

SEQ ID NO: 2031722 - protein, 19 aa, Staphylococcus
NLPPEWFEAAGAPTVEYES

SEQ ID NO: 2031723 - protein, 38 aa, Staphylococcus
NLPPSCLKGIESCVKKDIPIVLVSRSFNGIVSPVYDYE

SEQ ID NO: 2031724 - protein, 22 aa, Staphylococcus
NLPSELFGVSSKRALETKDEGI

SEQ ID NO: 2031725 - protein, 27 aa, Staphylococcus
NLPTKEFQLLFLLCGQPKHIFTRDTLI

SEQ ID NO: 2031726 - protein, 26 aa, Staphylococcus
NLPTKEFQLLFLLCTHPRQIYTRESI

SEQ ID NO: 2031727 - protein, 21 aa, Staphylococcus
NLPVKDLKASATFFENIGFTI

SEQ ID NO: 2031728 - protein, 29 aa, Staphylococcus
NLQDSRIAYVVEFFEWFNTLETFKNWKKK

SEQ ID NO: 2031729 - protein, 17 aa, Staphylococcus
NLQEIYDIISHYDYVLI

SEQ ID NO: 2031730 - protein, 33 aa, Staphylococcus
NLQLVMSIAALKLKLSPNEIWNAVTVNAAKAID

SEQ ID NO: 2031731 - protein, 26 aa, Staphylococcus
NLQQGGHIIVWFGLTWSLELYQQANA

SEQ ID NO: 2031732 - protein, 18 aa, Staphylococcus
NLQVVSFNNTRLVEMVRP

SEQ ID NO: 2031733 - protein, 21 aa, Staphylococcus
NLRALGFKHKGFKEGLSKDYI

SEQ ID NO: 2031734 - protein, 22 aa, Staphylococcus
NLRELGFDIVRFKTGTPPRVNA

SEQ ID NO: 2031735 - protein, 25 aa, Staphylococcus
NLRHCENCGGPIRPDIVLYGEMLNQ

SEQ ID NO: 2031736 - protein, 23 aa, Staphylococcus
NLRHLLLQPPMRGKQILGIDPAF

SEQ ID NO: 2031737 - protein, 24 aa, Staphylococcus
NLRIKEFELLWYLGKHENEVISKS

SEQ ID NO: 2031738 - protein, 24 aa, Staphylococcus
NLRLVDFKIEFGRTEDGDILLADE

SEQ ID NO: 2031739 - protein, 17 aa, Staphylococcus
NLRMLKNLTQEELAERT

SEQ ID NO: 2031740 - protein, 21 aa, Staphylococcus
NLRQLGFDVVRFKTGTPPRVN

SEQ ID NO: 2031741 - protein, 17 aa, Staphylococcus
NLSELKQEVRLHIIQLD

SEQ ID NO: 2031742 - protein, 24 aa, Staphylococcus
NLSHVLDFSDWIHVIKNGEMVESN

SEQ ID NO: 2031743 - protein, 18 aa, Staphylococcus
NLSIEIGDILIMIGHDND

SEQ ID NO: 2031744 - protein, 18 aa, Staphylococcus
NLSKDIKLLDGLYQQNKD

SEQ ID NO: 2031745 - protein, 23 aa, Staphylococcus
NLSLCKVKLHTGRTHQIRVHFQF

SEQ ID NO: 2031746 - protein, 19 aa, Staphylococcus
NLSLEEIKYIVNLFNKPTS

SEQ ID NO: 2031747 - protein, 20 aa, Staphylococcus
NLSLKCFKYTNNGTNPLQLS

SEQ ID NO: 2031748 - protein, 21 aa, Staphylococcus
NLSNINWLGFYLIEDGQLILG

SEQ ID NO: 2031749 - protein, 28 aa, Staphylococcus
NLSSVAGYEIFPVSLTYTATKYYVSAYT

SEQ ID NO: 2031750 - protein, 23 aa, Staphylococcus
NLSVKEFYVLYEIYKAKGKKYKI

SEQ ID NO: 2031751 - protein, 18 aa, Staphylococcus
NLTEVYNLIVYQLGALEG

SEQ ID NO: 2031752 - protein, 18 aa, Staphylococcus
NLTKDIDLLDGLYDQNKR

SEQ ID NO: 2031753 - protein, 26 aa, Staphylococcus
NLTKGRLQKDLINWFIDDQYKLFYKK

SEQ ID NO: 2031754 - protein, 27 aa, Staphylococcus
NLTKGRLQRDLINWFIDDQYKMFYKKQ

SEQ ID NO: 2031755 - protein, 26 aa, Staphylococcus
NLTKGRLQRDLTNWFIDDQYKLFYKK

SEQ ID NO: 2031756 - protein, 18 aa, Staphylococcus
NLTLDISKYQMFYKDTEI

SEQ ID NO: 2031757 - protein, 17 aa, Staphylococcus
NLTSVFVPRIEDTDLMH

SEQ ID NO: 2031758 - protein, 26 aa, Staphylococcus
NLTVLWSVRLPDNFKTYCAKMSIKTS

SEQ ID NO: 2031759 - protein, 28 aa, Staphylococcus
NLTVLWSVRLPENFKIYCAKMSIKTSSI

SEQ ID NO: 2031760 - protein, 20 aa, Staphylococcus
NLTYPQFLVLSILWDESPVN

SEQ ID NO: 2031761 - protein, 25 aa, Staphylococcus
NLVDFSFIESLAWQTLNKDDLQQMT

SEQ ID NO: 2031762 - protein, 23 aa, Staphylococcus
NLVKDYATHISIMQQGQLIESGE

SEQ ID NO: 2031763 - protein, 24 aa, Staphylococcus
NLVLLGIKTRGAFLANRIQEKIHS

SEQ ID NO: 2031764 - protein, 18 aa, Staphylococcus
NLVLLGIKTRGAYLAYRI

SEQ ID NO: 2031765 - protein, 20 aa, Staphylococcus
NLVLLGIKTRGEFLAQRIQE

SEQ ID NO: 2031766 - protein, 19 aa, Staphylococcus
NLVPEYLGELLFDDIPYLK

SEQ ID NO: 2031767 - protein, 29 aa, Staphylococcus
NLYGHIYIKDCNVRKAFELASPKHTEGLI

SEQ ID NO: 2031768 - protein, 26 aa, Staphylococcus
NLYIKANTFSLIWEEMVENYLNNYFI

SEQ ID NO: 2031769 - protein, 17 aa, Staphylococcus
NLYIKSLLFNRIHQHVS

SEQ ID NO: 2031770 - protein, 23 aa, Staphylococcus
NLYKDTWFTSSINDSWYQQSIQF

SEQ ID NO: 2031771 - protein, 21 aa, Staphylococcus
NLYLDNEFEMGIDIDTLVKFN

SEQ ID NO: 2031772 - protein, 19 aa, Staphylococcus
NLYLPVKFDGGEWVGTPYE

SEQ ID NO: 2031773 - protein, 20 aa, Staphylococcus
NLYRRWSRGGAGLLMTGNVM

SEQ ID NO: 2031774 - protein, 17 aa, Staphylococcus
NLYSRLPSVQNFIENYQ

SEQ ID NO: 2031775 - protein, 19 aa, Staphylococcus
NMAAEAFKATDCSGLLRAD

SEQ ID NO: 2031776 - protein, 18 aa, Staphylococcus
NMALEAFKATDCSGLVRA

SEQ ID NO: 2031777 - protein, 19 aa, Staphylococcus
NMALEAFKATDCSGLVRAD

SEQ ID NO: 2031778 - protein, 25 aa, Staphylococcus
NMAPEYGATCGFFPVDEEALKYMRL

SEQ ID NO: 2031779 - protein, 24 aa, Staphylococcus
NMAPEYGATCGFFPVDEESLKYLR

SEQ ID NO: 2031780 - protein, 24 aa, Staphylococcus
NMAPEYGATCGFFPVDEESLKYMK

SEQ ID NO: 2031781 - protein, 24 aa, Staphylococcus
NMAPEYGATCGFFPVDEESLKYMR

SEQ ID NO: 2031782 - protein, 25 aa, Staphylococcus
NMAPEYGATCGFFPVDEESLKYMRL

SEQ ID NO: 2031783 - protein, 23 aa, Staphylococcus
NMAPFSIELCGGIHVENTAEIGL

SEQ ID NO: 2031784 - protein, 24 aa, Staphylococcus
NMAPFSIELCGGIHVSNTAEIGLF

SEQ ID NO: 2031785 - protein, 19 aa, Staphylococcus
NMAVFSMSVVNQLTELTPR

SEQ ID NO: 2031786 - protein, 21 aa, Staphylococcus
NMCPFSRDGQMRFLDGNQGGG

SEQ ID NO: 2031787 - protein, 31 aa, Staphylococcus
NMDASEFRNYILGLIFYRFLSEKAEAEVAEA

SEQ ID NO: 2031788 - protein, 17 aa, Staphylococcus
NMFALLGKPGFEDMKKD

SEQ ID NO: 2031789 - protein, 22 aa, Staphylococcus
NMFANYVNFQFDMPVADGTDYM

SEQ ID NO: 2031790 - protein, 22 aa, Staphylococcus
NMFFNEYEHFVELQIHGQVLKL

SEQ ID NO: 2031791 - protein, 22 aa, Staphylococcus
NMFGLGRLMMKMIMKQKNVDSL

SEQ ID NO: 2031792 - protein, 25 aa, Staphylococcus
NMGCPVNKIIRCEAGARWLLDPNKI

SEQ ID NO: 2031793 - protein, 17 aa, Staphylococcus
NMGFKLKSGIFKTFCEK

SEQ ID NO: 2031794 - protein, 20 aa, Staphylococcus
NMGLSPMMRLFKTNILSNQF

SEQ ID NO: 2031795 - protein, 22 aa, Staphylococcus
NMIGFPRNEWVFPIQTHENKIA

SEQ ID NO: 2031796 - protein, 17 aa, Staphylococcus
NMIHIKPSINANGGEGK

SEQ ID NO: 2031797 - protein, 18 aa, Staphylococcus
NMIKEAADELGLSYEEAI

SEQ ID NO: 2031798 - protein, 25 aa, Staphylococcus
NMIKQFKGQVLIVTHDSYLQKHFDA

SEQ ID NO: 2031799 - protein, 18 aa, Staphylococcus
NMINEIINSFLVTKLSQE

SEQ ID NO: 2031800 - protein, 27 aa, Staphylococcus
NMIRERLGSVPLEWNEQLQVVATELET

SEQ ID NO: 2031801 - protein, 21 aa, Staphylococcus
NMKDKRNFLYLELLKVIELKK

SEQ ID NO: 2031802 - protein, 23 aa, Staphylococcus
NMKGWTKDDVLAFQELTGINVTT

SEQ ID NO: 2031803 - protein, 25 aa, Staphylococcus
NMKVKETLHYLGILSGIPKANLKIN

SEQ ID NO: 2031804 - protein, 26 aa, Staphylococcus
NMLGISYLKAIKRFAPIIKAMTIKRE

SEQ ID NO: 2031805 - protein, 23 aa, Staphylococcus
NMLKECQHLLPIHNHVFDSDFTL

SEQ ID NO: 2031806 - protein, 17 aa, Staphylococcus
NMMKLHLVGDEIAKGQG

SEQ ID NO: 2031807 - protein, 17 aa, Staphylococcus
NMMKLHLVGDELAKGQG

SEQ ID NO: 2031808 - protein, 27 aa, Staphylococcus
NMNFKDYFTSLKVIYAIKLLLSTDDSI

SEQ ID NO: 2031809 - protein, 25 aa, Staphylococcus
NMNPVELRRSIGYVIQQIGLMPHMT

SEQ ID NO: 2031810 - protein, 20 aa, Staphylococcus
NMNYCKLTYLITIYKVLNKI

SEQ ID NO: 2031811 - protein, 27 aa, Staphylococcus
NMPDKLCLYYHIGQCMGPCVYDVDQQK

SEQ ID NO: 2031812 - protein, 20 aa, Staphylococcus
NMPVGVGSYVHYDRKLDGRI

SEQ ID NO: 2031813 - protein, 18 aa, Staphylococcus
NMQPWRFLVVESDEGKDT

SEQ ID NO: 2031814 - protein, 24 aa, Staphylococcus
NMRMPALPRFGMIWKLQKEYEKIR

SEQ ID NO: 2031815 - protein, 18 aa, Staphylococcus
NMSFPALARDAHFDKEKA

SEQ ID NO: 2031816 - protein, 21 aa, Staphylococcus
NMSKGSFKRAIGHLYKKKIID

SEQ ID NO: 2031817 - protein, 21 aa, Staphylococcus
NMSKGSFKRAIGHLYKQKMIN

SEQ ID NO: 2031818 - protein, 19 aa, Staphylococcus
NMTHWKRGVATMGIGGGMG

SEQ ID NO: 2031819 - protein, 18 aa, Staphylococcus
NMTIDTWLSLSIDDQIEH

SEQ ID NO: 2031820 - protein, 19 aa, Staphylococcus
NMVIFTFNEPQNWDSDFNI

SEQ ID NO: 2031821 - protein, 18 aa, Staphylococcus
NMVKQLYSPVQFIKSTEW

SEQ ID NO: 2031822 - protein, 18 aa, Staphylococcus
NMVPDHAKAHILVEKNMT

SEQ ID NO: 2031823 - protein, 21 aa, Staphylococcus
NNAGRIISRERYVANEKSNPG

SEQ ID NO: 2031824 - protein, 17 aa, Staphylococcus
NNAKSVISPIIITNSDQ

SEQ ID NO: 2031825 - protein, 18 aa, Staphylococcus
NNAKSVISPIIITNSDQT

SEQ ID NO: 2031826 - protein, 17 aa, Staphylococcus
NNALKGVNGIDEITRIN

SEQ ID NO: 2031827 - protein, 19 aa, Staphylococcus
NNALSAFIIPKSHTTVLND

SEQ ID NO: 2031828 - protein, 20 aa, Staphylococcus
NNAYHYGLEFAVEQFLDIGI

SEQ ID NO: 2031829 - protein, 20 aa, Staphylococcus
NNAYHYGLEFAVRQFLRAGI

SEQ ID NO: 2031830 - protein, 20 aa, Staphylococcus
NNAYHYGLEFAVRTFLEAGI

SEQ ID NO: 2031831 - protein, 18 aa, Staphylococcus
NNAYHYGLEFSVKEFLKA

SEQ ID NO: 2031832 - protein, 25 aa, Staphylococcus
NNCNSKVFINLNFTQKISVFDIIKK

SEQ ID NO: 2031833 - protein, 22 aa, Staphylococcus
NNDFPWCVVVYPNKPWAQRVYP

SEQ ID NO: 2031834 - protein, 25 aa, Staphylococcus
NNDIFRSGVFNTKFLETHNIMDDQS

SEQ ID NO: 2031835 - protein, 31 aa, Staphylococcus
NNDKIFKLTVDWKNVLKYLAKVEDDNPVHPQ

SEQ ID NO: 2031836 - protein, 24 aa, Staphylococcus
NNDNFKAAEFLQQFEDLQQLFIVS

SEQ ID NO: 2031837 - protein, 18 aa, Staphylococcus
NNDQWWRNLNQPFYIKNA

SEQ ID NO: 2031838 - protein, 25 aa, Staphylococcus
NNEDPRLFEGFSMGNPKIKTGNLLN

SEQ ID NO: 2031839 - protein, 18 aa, Staphylococcus
NNEFRFWVKDNKAADNTD

SEQ ID NO: 2031840 - protein, 23 aa, Staphylococcus
NNEGGDALMILSIDQQASLDVIN

SEQ ID NO: 2031841 - protein, 26 aa, Staphylococcus
NNEGKRVWVKYHFRSQQGIENLTDEE

SEQ ID NO: 2031842 - protein, 23 aa, Staphylococcus
NNEGYNLTFFAFFVKAVAKALKA

SEQ ID NO: 2031843 - protein, 23 aa, Staphylococcus
NNEIPSPELYLLGGSENSAQFAA

SEQ ID NO: 2031844 - protein, 22 aa, Staphylococcus
NNEISFDIQLHFSNKQQRESRL

SEQ ID NO: 2031845 - protein, 30 aa, Staphylococcus
NNEKDGRQAIKFLKQRGLGRATFLPLNVIR

SEQ ID NO: 2031846 - protein, 23 aa, Staphylococcus
NNEKLANILVHFRDHDKIISSVC

SEQ ID NO: 2031847 - protein, 24 aa, Staphylococcus
NNELKPLCISSGFVETDQSDDLVI

SEQ ID NO: 2031848 - protein, 24 aa, Staphylococcus
NNELKSLCVNSGFVEIDQSDDLII

SEQ ID NO: 2031849 - protein, 25 aa, Staphylococcus
NNESFKAAEFLQEFNDLQQLFIVSQ

SEQ ID NO: 2031850 - protein, 22 aa, Staphylococcus
NNEVRIQWRVADIKIPTNEIKN

SEQ ID NO: 2031851 - protein, 22 aa, Staphylococcus
NNEVRIQWRVADIKIPTQDIKN

SEQ ID NO: 2031852 - protein, 21 aa, Staphylococcus
NNEVRIQWRVADIKIPTSEIK

SEQ ID NO: 2031853 - protein, 22 aa, Staphylococcus
NNEVRIQWRVADIKIPTSEIKN

SEQ ID NO: 2031854 - protein, 24 aa, Staphylococcus
NNEYRFQILVKYKREPALHEALKY

SEQ ID NO: 2031855 - protein, 23 aa, Staphylococcus
NNEYRFQILVKYKREPELHKALQ

SEQ ID NO: 2031856 - protein, 18 aa, Staphylococcus
NNEYRFQILVKYKSEPQL

SEQ ID NO: 2031857 - protein, 18 aa, Staphylococcus
NNFFKNDPSELFKDLGKQ

SEQ ID NO: 2031858 - protein, 17 aa, Staphylococcus
NNFGPFLNETIDFRNID

SEQ ID NO: 2031859 - protein, 26 aa, Staphylococcus
NNFLENEIARWIKIQEEIGLDVLVHG

SEQ ID NO: 2031860 - protein, 18 aa, Staphylococcus
NNFLGWVDLPIDYDKEEF

SEQ ID NO: 2031861 - protein, 18 aa, Staphylococcus
NNFNACPVVRVNINEYDI

SEQ ID NO: 2031862 - protein, 20 aa, Staphylococcus
NNFTYFFPHKIRDFLAEKTN

SEQ ID NO: 2031863 - protein, 17 aa, Staphylococcus
NNFYFNVFDKYSEEDLV

SEQ ID NO: 2031864 - protein, 26 aa, Staphylococcus
NNGFLKFTPIGGWWNQVMLSQKVTIT

SEQ ID NO: 2031865 - protein, 26 aa, Staphylococcus
NNGKKSVARDVFFEKALKVMRPVYLN

SEQ ID NO: 2031866 - protein, 17 aa, Staphylococcus
NNGRIVGLGAHLKQGEK

SEQ ID NO: 2031867 - protein, 18 aa, Staphylococcus
NNGVDIFVLQSLMRHAQI

SEQ ID NO: 2031868 - protein, 20 aa, Staphylococcus
NNGYKVAICEQMEDPKQTKG

SEQ ID NO: 2031869 - protein, 21 aa, Staphylococcus
NNGYSPLFIELLVTRKDFINR

SEQ ID NO: 2031870 - protein, 18 aa, Staphylococcus
NNHAEFDALMNFDLDMLY

SEQ ID NO: 2031871 - protein, 24 aa, Staphylococcus
NNHDPRLFEGFSMGNPKIETGNLL

SEQ ID NO: 2031872 - protein, 24 aa, Staphylococcus
NNHDPRLFEGFSMGNPKIQTGNLL

SEQ ID NO: 2031873 - protein, 25 aa, Staphylococcus
NNHDPRLFEGFSMGNPKIQTGNLLE

SEQ ID NO: 2031874 - protein, 30 aa, Staphylococcus
NNHDPRLFEGFSMGNPRIQTGNLLEQLNEA

SEQ ID NO: 2031875 - protein, 20 aa, Staphylococcus
NNHFPLILGGDHSIAIGSIS

SEQ ID NO: 2031876 - protein, 26 aa, Staphylococcus
NNHILRFAQMLSERKQPVWIRHVLVP

SEQ ID NO: 2031877 - protein, 18 aa, Staphylococcus
NNHNMAWSDFMQKLSQTV

SEQ ID NO: 2031878 - protein, 25 aa, Staphylococcus
NNHVKEVVAGFDFTYGKFGKGNMTV

SEQ ID NO: 2031879 - protein, 21 aa, Staphylococcus
NNHVYLHYYLQGFEESMYTRQ

SEQ ID NO: 2031880 - protein, 25 aa, Staphylococcus
NNIEFLKRRVESLQKNVLFGKMEIS

SEQ ID NO: 2031881 - protein, 17 aa, Staphylococcus
NNIFCLTLGTGIGGAFY

SEQ ID NO: 2031882 - protein, 20 aa, Staphylococcus
NNIHLIRANTHLVIMVIVFS

SEQ ID NO: 2031883 - protein, 17 aa, Staphylococcus
NNIKQNYIVSSTLQAIR

SEQ ID NO: 2031884 - protein, 23 aa, Staphylococcus
NNIKRILVLHSNHLEHGKIRKSY

SEQ ID NO: 2031885 - protein, 23 aa, Staphylococcus
NNIKRLLTMVEIPYFTKETVDKE

SEQ ID NO: 2031886 - protein, 23 aa, Staphylococcus
NNIKSLMLEYLRFAGYQRTIDIN

SEQ ID NO: 2031887 - protein, 17 aa, Staphylococcus
NNILPVRLDGATKEFFA

SEQ ID NO: 2031888 - protein, 22 aa, Staphylococcus
NNIRFPEMIFGEDLQFFAEVFF

SEQ ID NO: 2031889 - protein, 25 aa, Staphylococcus
NNISKFNLCLKLYSQFLLNYFNEDA

SEQ ID NO: 2031890 - protein, 19 aa, Staphylococcus
NNIWNEWAFEKFVQSKDYN

SEQ ID NO: 2031891 - protein, 20 aa, Staphylococcus
NNIWNEWAFEKYIKSSDYHG

SEQ ID NO: 2031892 - protein, 17 aa, Staphylococcus
NNIWNEWAFEKYIQSED

SEQ ID NO: 2031893 - protein, 19 aa, Staphylococcus
NNIWNEWAFENYINSEDYH

SEQ ID NO: 2031894 - protein, 28 aa, Staphylococcus
NNIYKPYVEGFVKMLAPIAPHVSEELWQ

SEQ ID NO: 2031895 - protein, 22 aa, Staphylococcus
NNKCYLHYYLHGYDEPMYTRQQ

SEQ ID NO: 2031896 - protein, 23 aa, Staphylococcus
NNKFKGIIGLITMKKVKEPLKVN

SEQ ID NO: 2031897 - protein, 23 aa, Staphylococcus
NNKKIFLQHGISLATNVFERGYF

SEQ ID NO: 2031898 - protein, 24 aa, Staphylococcus
NNKLSKREMEVLKEMVKGKTNKDI

SEQ ID NO: 2031899 - protein, 31 aa, Staphylococcus
NNKNVVLIHGFKTYVALLFFKGALIEDSKNT

SEQ ID NO: 2031900 - protein, 17 aa, Staphylococcus
NNKQLRLTKGIHVVIDQ

SEQ ID NO: 2031901 - protein, 27 aa, Staphylococcus
NNKRKFPTIRTLFLLLVGFKNSKLNDQ

SEQ ID NO: 2031902 - protein, 31 aa, Staphylococcus
NNKWEIVVILPRIGIEFEKMTPMKLGGYTGL

SEQ ID NO: 2031903 - protein, 26 aa, Staphylococcus
NNKYDPTLMLAFKLAKQFDTTVDDLF

SEQ ID NO: 2031904 - protein, 23 aa, Staphylococcus
NNLDGVVFPDTFKKYEIDLNTSK

SEQ ID NO: 2031905 - protein, 22 aa, Staphylococcus
NNLEIGEQVALYGEDGTLYGVL

SEQ ID NO: 2031906 - protein, 24 aa, Staphylococcus
NNLEIPIGIIPGGTFNDFTKTLNL

SEQ ID NO: 2031907 - protein, 17 aa, Staphylococcus
NNLIALKILNPTTGLPV

SEQ ID NO: 2031908 - protein, 19 aa, Staphylococcus
NNLNGFKLLLEKQLSHADI

SEQ ID NO: 2031909 - protein, 23 aa, Staphylococcus
NNLRPVMESLILLSMSKRMNENL

SEQ ID NO: 2031910 - protein, 23 aa, Staphylococcus
NNLRVFKKTGIVNELTYGDASSR

SEQ ID NO: 2031911 - protein, 23 aa, Staphylococcus
NNLRVFKNIGLVKELTYGDASSR

SEQ ID NO: 2031912 - protein, 18 aa, Staphylococcus
NNMDIRQYYPFAINVSNY

SEQ ID NO: 2031913 - protein, 26 aa, Staphylococcus
NNMIDLRQTIRLHIIQMDTTLFKQYI

SEQ ID NO: 2031914 - protein, 21 aa, Staphylococcus
NNMKDLARMSVGQVLNEHDID

SEQ ID NO: 2031915 - protein, 21 aa, Staphylococcus
NNMKDLARMSVGQVLNQHDID

SEQ ID NO: 2031916 - protein, 21 aa, Staphylococcus
NNMKDLARMSVSQVLNEHDID

SEQ ID NO: 2031917 - protein, 25 aa, Staphylococcus
NNNCGKTTVFKAVEFIQNGKDKSEF

SEQ ID NO: 2031918 - protein, 24 aa, Staphylococcus
NNNCKYLNNGTCWCVNAYHHKNLT

SEQ ID NO: 2031919 - protein, 22 aa, Staphylococcus
NNNEYSFLLSIIALLMNHIYYA

SEQ ID NO: 2031920 - protein, 24 aa, Staphylococcus
NNNKFKGIIGLVTMNKVREPLEVS

SEQ ID NO: 2031921 - protein, 26 aa, Staphylococcus
NNNKRIVWLFNHILFDGWSLSILINE

SEQ ID NO: 2031922 - protein, 18 aa, Staphylococcus
NNNLKKFFFASSAAIYGD

SEQ ID NO: 2031923 - protein, 18 aa, Staphylococcus
NNNNWTKKQIKEFGRGLT

SEQ ID NO: 2031924 - protein, 24 aa, Staphylococcus
NNNRFKGIIGLVTMKKVREPLEVT

SEQ ID NO: 2031925 - protein, 25 aa, Staphylococcus
NNPIIPFIIGDGIGPDIWKAASRVI

SEQ ID NO: 2031926 - protein, 25 aa, Staphylococcus
NNPIIPFIIGDGIGPDIWRASRRVL

SEQ ID NO: 2031927 - protein, 22 aa, Staphylococcus
NNPIKTFMCSDCKSRLDTPRQR

SEQ ID NO: 2031928 - protein, 25 aa, Staphylococcus
NNPKTAIKHGLAFITENRKEEGLVL

SEQ ID NO: 2031929 - protein, 22 aa, Staphylococcus
NNPLLEMLNFVSIFSSNLDEFF

SEQ ID NO: 2031930 - protein, 29 aa, Staphylococcus
NNPYKGYVGHHLWIKLGYHQTIFPTALVP

SEQ ID NO: 2031931 - protein, 25 aa, Staphylococcus
NNPYPLLAYCDAFVLSSNYEGLGLV

SEQ ID NO: 2031932 - protein, 25 aa, Staphylococcus
NNQEFKMIYQLIMIFLQNNRDYKWN

SEQ ID NO: 2031933 - protein, 17 aa, Staphylococcus
NNQEVWTTCTFILNDEG

SEQ ID NO: 2031934 - protein, 21 aa, Staphylococcus
NNQFLKLEYIFSDNKEDINEG

SEQ ID NO: 2031935 - protein, 18 aa, Staphylococcus
NNQIFKLIEQFVSTMGYV

SEQ ID NO: 2031936 - protein, 24 aa, Staphylococcus
NNQITKIGVFGTFSAGKSSLINAL

SEQ ID NO: 2031937 - protein, 21 aa, Staphylococcus
NNQRLNKLLADYNYNLSNALS

SEQ ID NO: 2031938 - protein, 23 aa, Staphylococcus
NNQYKEHIGVVFDDLRVPNKLTL

SEQ ID NO: 2031939 - protein, 18 aa, Staphylococcus
NNREGRRIAVIVNDMSEV

SEQ ID NO: 2031940 - protein, 20 aa, Staphylococcus
NNRERKLFVEKIINNLRLSD

SEQ ID NO: 2031941 - protein, 22 aa, Staphylococcus
NNRFKGIIGLVTMKKVREPLEV

SEQ ID NO: 2031942 - protein, 24 aa, Staphylococcus
NNRFKLEQARRDFMVGNLYFNRGC

SEQ ID NO: 2031943 - protein, 17 aa, Staphylococcus
NNRIHIVNRELWAKTRG

SEQ ID NO: 2031944 - protein, 23 aa, Staphylococcus
NNRIKRYIAKYTINPAITHGISD

SEQ ID NO: 2031945 - protein, 23 aa, Staphylococcus
NNRIKRYIAKYTINPAITHGISE

SEQ ID NO: 2031946 - protein, 23 aa, Staphylococcus
NNRINSILIYKHGRVEKGFSNEK

SEQ ID NO: 2031947 - protein, 17 aa, Staphylococcus
NNRKILKSIIAQHIKEE

SEQ ID NO: 2031948 - protein, 17 aa, Staphylococcus
NNRWHCVQCETDDDKYF

SEQ ID NO: 2031949 - protein, 24 aa, Staphylococcus
NNSFEVLGGTSFNEFVVKFDQPIK

SEQ ID NO: 2031950 - protein, 19 aa, Staphylococcus
NNTEYPEIVFVGNHLSSTY

SEQ ID NO: 2031951 - protein, 18 aa, Staphylococcus
NNTGLRLIFAINYGGRAE

SEQ ID NO: 2031952 - protein, 22 aa, Staphylococcus
NNTRFRSLLVEKVRENIFLPLL

SEQ ID NO: 2031953 - protein, 25 aa, Staphylococcus
NNTRLVEMVRPKLSSVIQPLYDIGA

SEQ ID NO: 2031954 - protein, 17 aa, Staphylococcus
NNTRLVEMVRPQLSSVI

SEQ ID NO: 2031955 - protein, 26 aa, Staphylococcus
NNVDYVFGIPGAKIDYLFNALEDDGP

SEQ ID NO: 2031956 - protein, 25 aa, Staphylococcus
NNVKEVIAGFDFTFGKFGKGNMTVL

SEQ ID NO: 2031957 - protein, 18 aa, Staphylococcus
NNVLKKIRIEITKGIVNG

SEQ ID NO: 2031958 - protein, 17 aa, Staphylococcus
NNVNYFGTMLVYAGHAD

SEQ ID NO: 2031959 - protein, 26 aa, Staphylococcus
NNVQFLKDRYEAMKEFPMFDNIEYTE

SEQ ID NO: 2031960 - protein, 19 aa, Staphylococcus
NNVRIALETMAGKGSEVGR

SEQ ID NO: 2031961 - protein, 17 aa, Staphylococcus
NNVSLCVTFENVEDTKR

SEQ ID NO: 2031962 - protein, 20 aa, Staphylococcus
NNWESIFNGSAWEFDELTNQ

SEQ ID NO: 2031963 - protein, 19 aa, Staphylococcus
NNWESIFNGSTWEFDEQTQ

SEQ ID NO: 2031964 - protein, 24 aa, Staphylococcus
NNYACILLDLMLPEMDGIEVASKL

SEQ ID NO: 2031965 - protein, 17 aa, Staphylococcus
NNYDFVSNIFSDFDEQE

SEQ ID NO: 2031966 - protein, 18 aa, Staphylococcus
NNYFKRYKNPYITEYISQ

SEQ ID NO: 2031967 - protein, 17 aa, Staphylococcus
NNYKWLQILPEKKRYSI

SEQ ID NO: 2031968 - protein, 19 aa, Staphylococcus
NNYLYLGFLLNRAPSQYPE

SEQ ID NO: 2031969 - protein, 17 aa, Staphylococcus
NNYPFPNTFKVLRVSGA

SEQ ID NO: 2031970 - protein, 17 aa, Staphylococcus
NNYPFPNTFNVLKLSGQ

SEQ ID NO: 2031971 - protein, 23 aa, Staphylococcus
NNYSEIDKIAAYNSAVANGVIPQ

SEQ ID NO: 2031972 - protein, 23 aa, Staphylococcus
NNYYKPTIRIFKNIKKQLIKKKE

SEQ ID NO: 2031973 - protein, 25 aa, Staphylococcus
NPAFIADKCRLWVTVHFLPNEDYHE

SEQ ID NO: 2031974 - protein, 21 aa, Staphylococcus
NPCGLYRRQFELNKLYKKKER

SEQ ID NO: 2031975 - protein, 22 aa, Staphylococcus
NPDDHFVVIVSGAFGNRFKQIA

SEQ ID NO: 2031976 - protein, 27 aa, Staphylococcus
NPDELFDAVLMTIKYIMREADIAKEDL

SEQ ID NO: 2031977 - protein, 27 aa, Staphylococcus
NPDELFDAVLMTVKYIVRESGISKKDI

SEQ ID NO: 2031978 - protein, 26 aa, Staphylococcus
NPDELFDAVLMTVKYVIREANIAKED

SEQ ID NO: 2031979 - protein, 26 aa, Staphylococcus
NPDELFDAVLMTVKYVVREADIAKED

SEQ ID NO: 2031980 - protein, 26 aa, Staphylococcus
NPDELFDAVLMTVKYVVREANIKKED

SEQ ID NO: 2031981 - protein, 25 aa, Staphylococcus
NPDFKSGEITQELQKGYKLKDRVLR

SEQ ID NO: 2031982 - protein, 25 aa, Staphylococcus
NPDILYCGTFDRGLWKSVDKGDSWL

SEQ ID NO: 2031983 - protein, 24 aa, Staphylococcus
NPDLPRPVGNEIVHYSDYFEGAQK

SEQ ID NO: 2031984 - protein, 18 aa, Staphylococcus
NPDPYLVAVQKLNYAPGH

SEQ ID NO: 2031985 - protein, 22 aa, Staphylococcus
NPEDHFVVIVSGAFGNRFKQIA

SEQ ID NO: 2031986 - protein, 27 aa, Staphylococcus
NPENLPWKDLDIDIVIEATGKFNHGDK

SEQ ID NO: 2031987 - protein, 27 aa, Staphylococcus
NPENLPWKDLEIDIVIEATGKFNHGDK

SEQ ID NO: 2031988 - protein, 27 aa, Staphylococcus
NPENLPWKDLNIDIVIEATGKFNHGDK

SEQ ID NO: 2031989 - protein, 28 aa, Staphylococcus
NPENLPWKQLDIDVAIEATGKFNHGDKA

SEQ ID NO: 2031990 - protein, 23 aa, Staphylococcus
NPERSNVFTLDYYVKLAKELERE

SEQ ID NO: 2031991 - protein, 24 aa, Staphylococcus
NPERSNVFTLEYYVKLAKELEREG

SEQ ID NO: 2031992 - protein, 23 aa, Staphylococcus
NPERSNVFTLEYYVNLAKQLERE

SEQ ID NO: 2031993 - protein, 22 aa, Staphylococcus
NPETGMINLCFEVFEDKIKIVI

SEQ ID NO: 2031994 - protein, 33 aa, Staphylococcus
NPEVRNAVFEMMNWWFDKGIDGFRVDAITHIKK

SEQ ID NO: 2031995 - protein, 33 aa, Staphylococcus
NPEVRTAIFDMMNWWFDKGIDGFRVDAITHIKK

SEQ ID NO: 2031996 - protein, 22 aa, Staphylococcus
NPEYESGVITQVLQKGYKLKDR

SEQ ID NO: 2031997 - protein, 18 aa, Staphylococcus
NPEYRPYFENPLMSDFRH

SEQ ID NO: 2031998 - protein, 20 aa, Staphylococcus
NPFAHLNKFLSANEDYRSQD

SEQ ID NO: 2031999 - protein, 30 aa, Staphylococcus
NPFDLTKVWFKDEYPLIEVGEFELNRNPDN

SEQ ID NO: 2032000 - protein, 17 aa, Staphylococcus
NPFTRGHFDWGGVHIEN

SEQ ID NO: 2032001 - protein, 24 aa, Staphylococcus
NPGDFKPPLNVYFSGYREAEGFEA

SEQ ID NO: 2032002 - protein, 22 aa, Staphylococcus
NPGDFNIAYILEKFQINPELFD

SEQ ID NO: 2032003 - protein, 20 aa, Staphylococcus
NPGESCCAIIIKDDNNHHIY

SEQ ID NO: 2032004 - protein, 19 aa, Staphylococcus
NPGGMLILVDFDKNENVQH

SEQ ID NO: 2032005 - protein, 17 aa, Staphylococcus
NPGMVFSAQRFKVYEDV

SEQ ID NO: 2032006 - protein, 17 aa, Staphylococcus
NPGRSTCGIVIKENDIK

SEQ ID NO: 2032007 - protein, 17 aa, Staphylococcus
NPHRIVAAHVVRDETYY

SEQ ID NO: 2032008 - protein, 18 aa, Staphylococcus
NPIMKKILDRMLEENEIT

SEQ ID NO: 2032009 - protein, 38 aa, Staphylococcus
NPIPIKALTAYEGFGSYELRLPLVPLEDNDRQTLEQAY

SEQ ID NO: 2032010 - protein, 26 aa, Staphylococcus
NPIPIKALTSHLGFGNYELRLPLLPL

SEQ ID NO: 2032011 - protein, 17 aa, Staphylococcus
NPKAVTHTHGWGFAHMK

SEQ ID NO: 2032012 - protein, 19 aa, Staphylococcus
NPKDTCEMMAQEIRSLFDY

SEQ ID NO: 2032013 - protein, 29 aa, Staphylococcus
NPKQCKHEFLRYPYIESFENVDEVIQVAE

SEQ ID NO: 2032014 - protein, 22 aa, Staphylococcus
NPKTLSFEFIKYIWDFPKNNEQ

SEQ ID NO: 2032015 - protein, 31 aa, Staphylococcus
NPKYNAYMGAYRLQWEMIKFAKEHDINRYNF

SEQ ID NO: 2032016 - protein, 20 aa, Staphylococcus
NPLACAVSLAALDVIVDEDL

SEQ ID NO: 2032017 - protein, 20 aa, Staphylococcus
NPLDAIKCLALGAEAVGMSR

SEQ ID NO: 2032018 - protein, 17 aa, Staphylococcus
NPLEYYFDINIKNITQK

SEQ ID NO: 2032019 - protein, 19 aa, Staphylococcus
NPLEYYFDINIKNVTQKGN

SEQ ID NO: 2032020 - protein, 17 aa, Staphylococcus
NPLHIVLWFDKMRETYG

SEQ ID NO: 2032021 - protein, 25 aa, Staphylococcus
NPLLPDEVRFILKQMGLKEKTIDIE

SEQ ID NO: 2032022 - protein, 24 aa, Staphylococcus
NPLLPDEVRFILKQMGMKEKTIDV

SEQ ID NO: 2032023 - protein, 24 aa, Staphylococcus
NPLSGEKLPIWIADYVLSSYGTGA

SEQ ID NO: 2032024 - protein, 17 aa, Staphylococcus
NPLSMRAGIALLEVLEQ

SEQ ID NO: 2032025 - protein, 19 aa, Staphylococcus
NPLSMRAGIALLEVLEQDG

SEQ ID NO: 2032026 - protein, 19 aa, Staphylococcus
NPLSMRAGIALLEVLEQNG

SEQ ID NO: 2032027 - protein, 28 aa, Staphylococcus
NPLTEMIKFKYPRLFETIHKALHMVWSD

SEQ ID NO: 2032028 - protein, 24 aa, Staphylococcus
NPLTGKKLPIWIADYVLSSYGTGA

SEQ ID NO: 2032029 - protein, 25 aa, Staphylococcus
NPNLKAFAPVREWGWSREEEIDYAI

SEQ ID NO: 2032030 - protein, 25 aa, Staphylococcus
NPNLKTFAPVREWGWSREEEIDYAI

SEQ ID NO: 2032031 - protein, 18 aa, Staphylococcus
NPNQFIVFEVYKDEYAYQ

SEQ ID NO: 2032032 - protein, 21 aa, Staphylococcus
NPNSVSLDWECFIISKTDMLL

SEQ ID NO: 2032033 - protein, 24 aa, Staphylococcus
NPNTISFEFIKYVWQFPENNNEFI

SEQ ID NO: 2032034 - protein, 17 aa, Staphylococcus
NPNWHIIGITYDDIDVI

SEQ ID NO: 2032035 - protein, 38 aa, Staphylococcus
NPPHKVIPISFFKKLIFIGVIRFRYANMQKVELAIGYD

SEQ ID NO: 2032036 - protein, 21 aa, Staphylococcus
NPPIRAGKAVVHRIFEEAYQK

SEQ ID NO: 2032037 - protein, 22 aa, Staphylococcus
NPPIRAGKDVVHRIFEEAYCKL

SEQ ID NO: 2032038 - protein, 27 aa, Staphylococcus
NPPIRAGKEVVHRIFAEAYDRLRTQGE

SEQ ID NO: 2032039 - protein, 20 aa, Staphylococcus
NPPTGCPFHTRCPIAQEACK

SEQ ID NO: 2032040 - protein, 22 aa, Staphylococcus
NPPYQQLRELKAIYQGKQIKVL

SEQ ID NO: 2032041 - protein, 29 aa, Staphylococcus
NPQDGEPCNECAICKGITQGTNGDVIEID

SEQ ID NO: 2032042 - protein, 20 aa, Staphylococcus
NPQIKIGVCGELGGDPKSIH

SEQ ID NO: 2032043 - protein, 19 aa, Staphylococcus
NPQLIKWINKNYIHKCDLN

SEQ ID NO: 2032044 - protein, 19 aa, Staphylococcus
NPQVDRLTLSCQMEIDERG

SEQ ID NO: 2032045 - protein, 26 aa, Staphylococcus
NPQYSVRVDKKWARPDYIFPGNQVND

SEQ ID NO: 2032046 - protein, 17 aa, Staphylococcus
NPSDYKLLVLGKVGIDF

SEQ ID NO: 2032047 - protein, 26 aa, Staphylococcus
NPSKMPLNKRMHAVRQRLGNVDWTGN

SEQ ID NO: 2032048 - protein, 17 aa, Staphylococcus
NPSLEWHYQNLRQHTTF

SEQ ID NO: 2032049 - protein, 17 aa, Staphylococcus
NPSLPMVAIGGITEDNC

SEQ ID NO: 2032050 - protein, 21 aa, Staphylococcus
NPSMRRYLEISLEISKIALKY

SEQ ID NO: 2032051 - protein, 22 aa, Staphylococcus
NPSNLIGYSFKFHGAISQEAAY

SEQ ID NO: 2032052 - protein, 22 aa, Staphylococcus
NPSPMTAYGIYIAMKRTALEQF

SEQ ID NO: 2032053 - protein, 21 aa, Staphylococcus
NPSRIKFVLVNPEMDDYIQNR

SEQ ID NO: 2032054 - protein, 30 aa, Staphylococcus
NPTEIDSMALPPCHTMFQFYVQDGKLSCQL

SEQ ID NO: 2032055 - protein, 30 aa, Staphylococcus
NPTEIDSMALPPCHTMFQFYVQDGRLSCQL

SEQ ID NO: 2032056 - protein, 19 aa, Staphylococcus
NPTEIETMALPPCHTMFQF

SEQ ID NO: 2032057 - protein, 24 aa, Staphylococcus
NPTGSFKDRGMVMAMAKAKEEGKK

SEQ ID NO: 2032058 - protein, 25 aa, Staphylococcus
NPTLLNRVGKLIATIYMDEQLDAVV

SEQ ID NO: 2032059 - protein, 20 aa, Staphylococcus
NPTLRELLGYLSAGGGHLTL

SEQ ID NO: 2032060 - protein, 23 aa, Staphylococcus
NPTMIWELGVIWMKDKTLSHATK

SEQ ID NO: 2032061 - protein, 24 aa, Staphylococcus
NPTYKAELHASVPAKTEEMKFINE

SEQ ID NO: 2032062 - protein, 19 aa, Staphylococcus
NPVDLGEAVSRVLKEQGAY

SEQ ID NO: 2032063 - protein, 17 aa, Staphylococcus
NPVEIVKSGDQFPRDFN

SEQ ID NO: 2032064 - protein, 24 aa, Staphylococcus
NPVELRRKIGYVIQQIGLMPHMTI

SEQ ID NO: 2032065 - protein, 20 aa, Staphylococcus
NPVIRRDLPDKVFVNDDDKN

SEQ ID NO: 2032066 - protein, 19 aa, Staphylococcus
NPVIVKFEAGWCPDCKAMD

SEQ ID NO: 2032067 - protein, 19 aa, Staphylococcus
NPVVEGFTLTKLLWVKENE

SEQ ID NO: 2032068 - protein, 19 aa, Staphylococcus
NPYDAKGLLMAAVQDDNLV

SEQ ID NO: 2032069 - protein, 20 aa, Staphylococcus
NPYDAKGLLMAAVQDDNLVV

SEQ ID NO: 2032070 - protein, 18 aa, Staphylococcus
NPYFVSFIGDAPKDDPEV

SEQ ID NO: 2032071 - protein, 17 aa, Staphylococcus
NPYHFFQCWVAKEAYLK

SEQ ID NO: 2032072 - protein, 17 aa, Staphylococcus
NPYKGYVGHHLLVKFGH

SEQ ID NO: 2032073 - protein, 17 aa, Staphylococcus
NPYKGYVGHQLFIKFGH

SEQ ID NO: 2032074 - protein, 24 aa, Staphylococcus
NPYVRHIAHPTGRIIERREGYQPN

SEQ ID NO: 2032075 - protein, 26 aa, Staphylococcus
NPYVRHIAHPTGRIIGKRPGYEPDID

SEQ ID NO: 2032076 - protein, 26 aa, Staphylococcus
NPYVRHIAHPTGRIIGKRPGYQPNIE

SEQ ID NO: 2032077 - protein, 28 aa, Staphylococcus
NPYVRHIAHPTGRIIGRREGYKPNIDRL

SEQ ID NO: 2032078 - protein, 19 aa, Staphylococcus
NQAAWNVYERAGFMHAATK

SEQ ID NO: 2032079 - protein, 18 aa, Staphylococcus
NQAAWNVYERAGFMHTAT

SEQ ID NO: 2032080 - protein, 22 aa, Staphylococcus
NQADLAPCLSLPRTLSIEQGKL

SEQ ID NO: 2032081 - protein, 19 aa, Staphylococcus
NQALNFKINATLIKSKSEY

SEQ ID NO: 2032082 - protein, 23 aa, Staphylococcus
NQALRLTLERAKTYSVPNHIIEK

SEQ ID NO: 2032083 - protein, 26 aa, Staphylococcus
NQALSYRKSKLLLLDIAVPRDIEPCH

SEQ ID NO: 2032084 - protein, 20 aa, Staphylococcus
NQANAMHQYAIWTALATKGI

SEQ ID NO: 2032085 - protein, 19 aa, Staphylococcus
NQAPFSFDLSVMAIYPCLA

SEQ ID NO: 2032086 - protein, 19 aa, Staphylococcus
NQARLGVVIHAEHFNHSNT

SEQ ID NO: 2032087 - protein, 21 aa, Staphylococcus
NQARNGVNMIVRQSVQAVESL

SEQ ID NO: 2032088 - protein, 26 aa, Staphylococcus
NQARSCRAFGSAALEIISVARGQLAA

SEQ ID NO: 2032089 - protein, 18 aa, Staphylococcus
NQDFAEVESVYELDEEEL

SEQ ID NO: 2032090 - protein, 19 aa, Staphylococcus
NQDVQIFTSLIVREDAQLL

SEQ ID NO: 2032091 - protein, 17 aa, Staphylococcus
NQEDFRIMLPIHDAIMI

SEQ ID NO: 2032092 - protein, 18 aa, Staphylococcus
NQEGRRIFVTEVVCDSVQ

SEQ ID NO: 2032093 - protein, 26 aa, Staphylococcus
NQEGRRIFVTEVVCDSVQFLEPKNAQ

SEQ ID NO: 2032094 - protein, 27 aa, Staphylococcus
NQEGRRIFVTEVVCDSVQFLEPKNQNQ

SEQ ID NO: 2032095 - protein, 26 aa, Staphylococcus
NQEGRRIFVTEVVCDSVQFLEPKNSQ

SEQ ID NO: 2032096 - protein, 27 aa, Staphylococcus
NQEGRRIFVTEVVCDSVQFLEPKNSQQ

SEQ ID NO: 2032097 - protein, 23 aa, Staphylococcus
NQELKGFVWGHYELQTKTVIIEL

SEQ ID NO: 2032098 - protein, 24 aa, Staphylococcus
NQEPWTSCEFDFTNEGKLNVSFDY

SEQ ID NO: 2032099 - protein, 24 aa, Staphylococcus
NQEYSSDVDIVFILGGDGTVNELV

SEQ ID NO: 2032100 - protein, 22 aa, Staphylococcus
NQFKYREGRTVLKQQYDFKCDN

SEQ ID NO: 2032101 - protein, 19 aa, Staphylococcus
NQFNVELELSFIFTNPTVA

SEQ ID NO: 2032102 - protein, 22 aa, Staphylococcus
NQFPAGAPFGGYKKSGIGREIY

SEQ ID NO: 2032103 - protein, 17 aa, Staphylococcus
NQFSCHQIDILVSTTVV

SEQ ID NO: 2032104 - protein, 17 aa, Staphylococcus
NQFTASFVGHFSAGKST

SEQ ID NO: 2032105 - protein, 19 aa, Staphylococcus
NQGAWSFVYPYLSDLASDK

SEQ ID NO: 2032106 - protein, 17 aa, Staphylococcus
NQGELLGLIGPSGCGKT

SEQ ID NO: 2032107 - protein, 30 aa, Staphylococcus
NQGEVCSAGSRLLVQSSLYDKLLPKLKEAF

SEQ ID NO: 2032108 - protein, 26 aa, Staphylococcus
NQGEVCSAGSRLLVQSSVYDKLLPKL

SEQ ID NO: 2032109 - protein, 30 aa, Staphylococcus
NQGEVCSAGSRLLVQTSIYDKVIPKLKEAF

SEQ ID NO: 2032110 - protein, 25 aa, Staphylococcus
NQGEVCSAGSRLVVQEDIYDELIPR

SEQ ID NO: 2032111 - protein, 25 aa, Staphylococcus
NQGGFLRKLYDTTPFKEGVGIDLAR

SEQ ID NO: 2032112 - protein, 27 aa, Staphylococcus
NQGGFLRQLYQTHEFEKGVGIDLAYNS

SEQ ID NO: 2032113 - protein, 25 aa, Staphylococcus
NQHALKFYIKNGFKAYSESQKDNQG

SEQ ID NO: 2032114 - protein, 25 aa, Staphylococcus
NQHKDHLSRDIALLDELYELNKNYF

SEQ ID NO: 2032115 - protein, 17 aa, Staphylococcus
NQHKGKHIITSKIEHHS

SEQ ID NO: 2032116 - protein, 17 aa, Staphylococcus
NQHRIIVDRAVPESLIF

SEQ ID NO: 2032117 - protein, 25 aa, Staphylococcus
NQIAHFRLGISVSKKIGNAVIRNKI

SEQ ID NO: 2032118 - protein, 22 aa, Staphylococcus
NQIDIREGCILHSDQGSVYTSY

SEQ ID NO: 2032119 - protein, 25 aa, Staphylococcus
NQIEIHKTSLLDIMFSNNSDQEGVT

SEQ ID NO: 2032120 - protein, 24 aa, Staphylococcus
NQIFQRERIKKFGAEGIRDKDTHD

SEQ ID NO: 2032121 - protein, 26 aa, Staphylococcus
NQILKEIIARLSFLNNVGLEYLTLNR

SEQ ID NO: 2032122 - protein, 25 aa, Staphylococcus
NQILKEIISRLSFLNNVGLEYLTLN

SEQ ID NO: 2032123 - protein, 18 aa, Staphylococcus
NQILSFYLNNIYFGDNQY

SEQ ID NO: 2032124 - protein, 21 aa, Staphylococcus
NQINNVLAFPGIFRGALDTEA

SEQ ID NO: 2032125 - protein, 23 aa, Staphylococcus
NQIPSSIDFNAWLKVEELTQRTF

SEQ ID NO: 2032126 - protein, 17 aa, Staphylococcus
NQIRGVLNIGSTQLSTK

SEQ ID NO: 2032127 - protein, 46 aa, Staphylococcus
NQIVKPSKDGYCIARFKMCAEDAVHLCFSCRKQIRILKPDNVRRKV

SEQ ID NO: 2032128 - protein, 36 aa, Staphylococcus
NQIYRCPYCLGEVILRHGVKVIPHFAHKVKSTRLCY

SEQ ID NO: 2032129 - protein, 25 aa, Staphylococcus
NQKCSLDAIIGWKPLFQYRNGNKQW

SEQ ID NO: 2032130 - protein, 24 aa, Staphylococcus
NQKFAQKVDHGWVRLASIDEKNSW

SEQ ID NO: 2032131 - protein, 21 aa, Staphylococcus
NQKFKFARMLVLRNVEASNLD

SEQ ID NO: 2032132 - protein, 18 aa, Staphylococcus
NQKIKVLLAQSLFGDPDV

SEQ ID NO: 2032133 - protein, 19 aa, Staphylococcus
NQKIPLVINGEEKFTKDTY

SEQ ID NO: 2032134 - protein, 19 aa, Staphylococcus
NQKLLDFMSNHFKTKAEHT

SEQ ID NO: 2032135 - protein, 29 aa, Staphylococcus
NQKSWLTYEEFFILRGFIESAIKKEDIVF

SEQ ID NO: 2032136 - protein, 20 aa, Staphylococcus
NQLEAFKEALPYLMTAAEKD

SEQ ID NO: 2032137 - protein, 25 aa, Staphylococcus
NQLEPLPSILIRSSVSQSFLNLISQ

SEQ ID NO: 2032138 - protein, 24 aa, Staphylococcus
NQLGHYHCECGFKRETPKYEVSQF

SEQ ID NO: 2032139 - protein, 21 aa, Staphylococcus
NQLKERVMAALAEVKLADQHD

SEQ ID NO: 2032140 - protein, 32 aa, Staphylococcus
NQLKSLGLNSNWDMLFIVFSIHLIDLAKQLDQ

SEQ ID NO: 2032141 - protein, 35 aa, Staphylococcus
NQLKSLGLNSNWDMLFVVFSIHFIHLLKQLDSETI

SEQ ID NO: 2032142 - protein, 18 aa, Staphylococcus
NQLLEFFNQSFSSLDEFI

SEQ ID NO: 2032143 - protein, 26 aa, Staphylococcus
NQLLGGTCLHKGCIPTKSLLKSAEVL

SEQ ID NO: 2032144 - protein, 20 aa, Staphylococcus
NQLLGRLNFDIVKAPKGAHI

SEQ ID NO: 2032145 - protein, 23 aa, Staphylococcus
NQLLIIPTWRDWLINSEQLIESD

SEQ ID NO: 2032146 - protein, 26 aa, Staphylococcus
NQLLIKRNLFLESLKKYFSDFGSWST

SEQ ID NO: 2032147 - protein, 33 aa, Staphylococcus
NQLMPKRKVEREVPVKIARKILTDDFADELIDQ

SEQ ID NO: 2032148 - protein, 20 aa, Staphylococcus
NQLMPKRKVEREVPVKTARK

SEQ ID NO: 2032149 - protein, 19 aa, Staphylococcus
NQLPIMGFYRQRSHDIIDM

SEQ ID NO: 2032150 - protein, 17 aa, Staphylococcus
NQLRFQVSRSYMKTFKQ

SEQ ID NO: 2032151 - protein, 20 aa, Staphylococcus
NQLRSAQQPLIIAGHEINSF

SEQ ID NO: 2032152 - protein, 20 aa, Staphylococcus
NQMKLLYKIFGIDISKYQPD

SEQ ID NO: 2032153 - protein, 22 aa, Staphylococcus
NQMPMLGLGTFRVENDDTCKEA

SEQ ID NO: 2032154 - protein, 17 aa, Staphylococcus
NQNCKINYGVTFPIHEK

SEQ ID NO: 2032155 - protein, 27 aa, Staphylococcus
NQNIRSNCGIGFKGFYDEVNGFNYDFF

SEQ ID NO: 2032156 - protein, 24 aa, Staphylococcus
NQNLRLVLERAKTYNVPRNIIDRA

SEQ ID NO: 2032157 - protein, 26 aa, Staphylococcus
NQNYKRLKGIKEWGFGLFEGESIELL

SEQ ID NO: 2032158 - protein, 25 aa, Staphylococcus
NQPASERRKFVGIVFGDANYYLKNM

SEQ ID NO: 2032159 - protein, 18 aa, Staphylococcus
NQPATHIRRILKRMDRYI

SEQ ID NO: 2032160 - protein, 24 aa, Staphylococcus
NQPISEHAYHEWFAQLESSAAQAV

SEQ ID NO: 2032161 - protein, 24 aa, Staphylococcus
NQPITRSDIELIRGINSDGAVRTL

SEQ ID NO: 2032162 - protein, 26 aa, Staphylococcus
NQPYLKKKIELHGTVTVKGKWNRSKQ

SEQ ID NO: 2032163 - protein, 19 aa, Staphylococcus
NQQAFKDIVYALGRMGGGK

SEQ ID NO: 2032164 - protein, 17 aa, Staphylococcus
NQQTTDQLVEWIESTYP

SEQ ID NO: 2032165 - protein, 17 aa, Staphylococcus
NQQVLALESNKKIQKLE

SEQ ID NO: 2032166 - protein, 25 aa, Staphylococcus
NQRRVKEWLKKTARKYGLEADDVVL

SEQ ID NO: 2032167 - protein, 25 aa, Staphylococcus
NQRRVKEWLKRTARKYGLEAEEVVL

SEQ ID NO: 2032168 - protein, 22 aa, Staphylococcus
NQSGTCYGIFKLLTQKLENKEK

SEQ ID NO: 2032169 - protein, 22 aa, Staphylococcus
NQSKDFFTKLGFEDVNAKNPEG

SEQ ID NO: 2032170 - protein, 22 aa, Staphylococcus
NQTKFEPVLHVFAQDGSIFTNE

SEQ ID NO: 2032171 - protein, 24 aa, Staphylococcus
NQTSLKLAAAFAAGSAVVLKPSEE

SEQ ID NO: 2032172 - protein, 30 aa, Staphylococcus
NQTSLKLAAAFAAGSPVVFKPSEETPFAAI

SEQ ID NO: 2032173 - protein, 24 aa, Staphylococcus
NQTSLKLAAAFAAGSPVVLKPSEM

SEQ ID NO: 2032174 - protein, 24 aa, Staphylococcus
NQVLEMPFYYILQILDERHLNTVD

SEQ ID NO: 2032175 - protein, 27 aa, Staphylococcus
NQVLKARPYRLLRIGTFLLTEDGYKVF

SEQ ID NO: 2032176 - protein, 23 aa, Staphylococcus
NQWIKSTHLVIAFGCNHDPFIPV

SEQ ID NO: 2032177 - protein, 25 aa, Staphylococcus
NQYAKLKSIFGVRDMFFISENGAVI

SEQ ID NO: 2032178 - protein, 18 aa, Staphylococcus
NQYFCCVIPSSLMKDAFQ

SEQ ID NO: 2032179 - protein, 25 aa, Staphylococcus
NQYIIGNCCILKFIYTHGKFEFLDM

SEQ ID NO: 2032180 - protein, 17 aa, Staphylococcus
NQYIYRMTPELQDDVGT

SEQ ID NO: 2032181 - protein, 19 aa, Staphylococcus
NQYKFLFYGELSQILEYIN

SEQ ID NO: 2032182 - protein, 21 aa, Staphylococcus
NQYRLGEAILEVSEIREPCWK

SEQ ID NO: 2032183 - protein, 21 aa, Staphylococcus
NQYRLGEAILEVSEMREPCWK

SEQ ID NO: 2032184 - protein, 22 aa, Staphylococcus
NRADIGHNWWVVNQSLVTLNQR

SEQ ID NO: 2032185 - protein, 19 aa, Staphylococcus
NRAIKFSLMVDGLLRQLGS

SEQ ID NO: 2032186 - protein, 25 aa, Staphylococcus
NRALDFKINAALIKSKTDYISLGLI

SEQ ID NO: 2032187 - protein, 17 aa, Staphylococcus
NRCKSINILSFREVMVR

SEQ ID NO: 2032188 - protein, 24 aa, Staphylococcus
NRDKGLFYAWRRLVAYDPALTKDQ

SEQ ID NO: 2032189 - protein, 24 aa, Staphylococcus
NRDLKRFVTDVAHTNQILAHKKDD

SEQ ID NO: 2032190 - protein, 25 aa, Staphylococcus
NRDLRFIEDFSIKISDVMTKDNLIT

SEQ ID NO: 2032191 - protein, 25 aa, Staphylococcus
NRDLRFIEDFSIKISDVMTKEGLIT

SEQ ID NO: 2032192 - protein, 25 aa, Staphylococcus
NRDLRFIEDFSIKISDVMTKENLIT

SEQ ID NO: 2032193 - protein, 25 aa, Staphylococcus
NRDLRFIEDFSIKISDVMTKEQLVT

SEQ ID NO: 2032194 - protein, 18 aa, Staphylococcus
NRDMPSSELLDIIHENGE

SEQ ID NO: 2032195 - protein, 17 aa, Staphylococcus
NRDNARTPMQWDDSVNG

SEQ ID NO: 2032196 - protein, 19 aa, Staphylococcus
NRDNARTPMQWNNEKNAGF

SEQ ID NO: 2032197 - protein, 18 aa, Staphylococcus
NRDTTWYSMIDKEWPILN

SEQ ID NO: 2032198 - protein, 21 aa, Staphylococcus
NRDTYWLAMIDKEWQQNKLKF

SEQ ID NO: 2032199 - protein, 18 aa, Staphylococcus
NRDVAQWFVGDYMTSLDM

SEQ ID NO: 2032200 - protein, 18 aa, Staphylococcus
NREFGNWLKKKGYQSDEI

SEQ ID NO: 2032201 - protein, 24 aa, Staphylococcus
NREFKGIELESSFISMANSRLENN

SEQ ID NO: 2032202 - protein, 18 aa, Staphylococcus
NREFVTWMDNIEAIVNRV

SEQ ID NO: 2032203 - protein, 18 aa, Staphylococcus
NREIVSIKDFKARVQDWT

SEQ ID NO: 2032204 - protein, 25 aa, Staphylococcus
NREKALKVLKARLFDMKLQEEQQKY

SEQ ID NO: 2032205 - protein, 24 aa, Staphylococcus
NREKHLELIMKWAVQELEKNFNIN

SEQ ID NO: 2032206 - protein, 18 aa, Staphylococcus
NRELIKIHILQNNMDDKK

SEQ ID NO: 2032207 - protein, 18 aa, Staphylococcus
NRELIKIHVLQNNFDDKN

SEQ ID NO: 2032208 - protein, 26 aa, Staphylococcus
NREMKIYMLIVERFLESLMPPYEYQH

SEQ ID NO: 2032209 - protein, 20 aa, Staphylococcus
NREVFSFLDEVYHMVNNFVL

SEQ ID NO: 2032210 - protein, 24 aa, Staphylococcus
NRFGCALSVDVLRNLKNEAIDINL

SEQ ID NO: 2032211 - protein, 24 aa, Staphylococcus
NRFISIMAGLPIDYIKQQLEVNQP

SEQ ID NO: 2032212 - protein, 21 aa, Staphylococcus
NRFISIMAGLSIDYIRQQLDT

SEQ ID NO: 2032213 - protein, 20 aa, Staphylococcus
NRFMHVAEFRRMNANIDVEG

SEQ ID NO: 2032214 - protein, 20 aa, Staphylococcus
NRFMHVAEFRRMNANINVEG

SEQ ID NO: 2032215 - protein, 20 aa, Staphylococcus
NRFMHVGEFKRMNAQITVEG

SEQ ID NO: 2032216 - protein, 20 aa, Staphylococcus
NRFRELARFEGEDTRVLDKN

SEQ ID NO: 2032217 - protein, 20 aa, Staphylococcus
NRGAANLALLSGDPNLLNGI

SEQ ID NO: 2032218 - protein, 19 aa, Staphylococcus
NRGINIVVGGMYEYGLSRY

SEQ ID NO: 2032219 - protein, 21 aa, Staphylococcus
NRGKYNSALEKLRNQDDTTMM

SEQ ID NO: 2032220 - protein, 29 aa, Staphylococcus
NRGYAKKAFKMAIDYAFLVLNMNKVYLYV

SEQ ID NO: 2032221 - protein, 19 aa, Staphylococcus
NRGYEEFVKAAAIQDNTKV

SEQ ID NO: 2032222 - protein, 21 aa, Staphylococcus
NRIAQTINRFGFTIRGIYGEG

SEQ ID NO: 2032223 - protein, 23 aa, Staphylococcus
NRIDLPHLAWCLDKILDGNKDNI

SEQ ID NO: 2032224 - protein, 19 aa, Staphylococcus
NRIISRLKQLQSYGHQVIF

SEQ ID NO: 2032225 - protein, 18 aa, Staphylococcus
NRILIVFGPEGGLSEEEV

SEQ ID NO: 2032226 - protein, 21 aa, Staphylococcus
NRILLRDVLKKVAKDHDTLRI

SEQ ID NO: 2032227 - protein, 20 aa, Staphylococcus
NRIMYCYNKMVGKLKKPNYN

SEQ ID NO: 2032228 - protein, 17 aa, Staphylococcus
NRITDEAYKTFLKNEIA

SEQ ID NO: 2032229 - protein, 19 aa, Staphylococcus
NRIYGGYSLLLDVDYDAMV

SEQ ID NO: 2032230 - protein, 23 aa, Staphylococcus
NRKEKFFVLMGFTSDELLNLPNK

SEQ ID NO: 2032231 - protein, 26 aa, Staphylococcus
NRKEPDIVVGYLFKIIFNGPLRLMAN

SEQ ID NO: 2032232 - protein, 22 aa, Staphylococcus
NRKKFKVVDHIGAGDVSSHQLQ

SEQ ID NO: 2032233 - protein, 26 aa, Staphylococcus
NRKKLVPFMLEDELKKRGANYSKAKL

SEQ ID NO: 2032234 - protein, 22 aa, Staphylococcus
NRKQFKVIDHIGAGSVSEKILG

SEQ ID NO: 2032235 - protein, 20 aa, Staphylococcus
NRLGIETVHVLGFRSKKDVF

SEQ ID NO: 2032236 - protein, 24 aa, Staphylococcus
NRLIPLTEGYIYFKDKPVSDFPVY

SEQ ID NO: 2032237 - protein, 23 aa, Staphylococcus
NRLIPLTEGYIYFKDSPISDYPV

SEQ ID NO: 2032238 - protein, 25 aa, Staphylococcus
NRLKGLKEWHFGILEGESNDLLNAN

SEQ ID NO: 2032239 - protein, 21 aa, Staphylococcus
NRLKKIPIRININGIRGKSTI

SEQ ID NO: 2032240 - protein, 25 aa, Staphylococcus
NRLKQPLKRRVPGIELMEECIKVAN

SEQ ID NO: 2032241 - protein, 18 aa, Staphylococcus
NRLLKGQVKSLMKTNATV

SEQ ID NO: 2032242 - protein, 19 aa, Staphylococcus
NRLNEMGIHKVLMTCNPYN

SEQ ID NO: 2032243 - protein, 24 aa, Staphylococcus
NRLNYPILCANILKDNKSLTEQGI

SEQ ID NO: 2032244 - protein, 20 aa, Staphylococcus
NRLRELIRLVKNIVLNKKSK

SEQ ID NO: 2032245 - protein, 20 aa, Staphylococcus
NRLRKKLADIDMNDAIETKI

SEQ ID NO: 2032246 - protein, 20 aa, Staphylococcus
NRLTGIIDFGDSGIIDEYCD

SEQ ID NO: 2032247 - protein, 21 aa, Staphylococcus
NRLTKKWLRKPDAKLTIEREH

SEQ ID NO: 2032248 - protein, 18 aa, Staphylococcus
NRLTRRPASFPAHYKSNI

SEQ ID NO: 2032249 - protein, 18 aa, Staphylococcus
NRLYGDWTTKTNNLYACV

SEQ ID NO: 2032250 - protein, 21 aa, Staphylococcus
NRLYTQLSLIGTRTHRITTKN

SEQ ID NO: 2032251 - protein, 21 aa, Staphylococcus
NRLYTQLSLIGTRTHRITTKR

SEQ ID NO: 2032252 - protein, 26 aa, Staphylococcus
NRMAMSHPDIRFSLVSDGKIMLQTNG

SEQ ID NO: 2032253 - protein, 26 aa, Staphylococcus
NRMAMSHPNIRFSLISDGKTMLKTNG

SEQ ID NO: 2032254 - protein, 26 aa, Staphylococcus
NRNARFACGTIDISLSVTQNRISGCS

SEQ ID NO: 2032255 - protein, 25 aa, Staphylococcus
NRNIKVICIDKCYLKDILKDIYKRG

SEQ ID NO: 2032256 - protein, 24 aa, Staphylococcus
NRNLKVGAKCLVYMNDTLEAVRIF

SEQ ID NO: 2032257 - protein, 24 aa, Staphylococcus
NRNSRRSLLWLWYDDDWKLYFHQG

SEQ ID NO: 2032258 - protein, 19 aa, Staphylococcus
NRNTIPYDEMGELDLEVFI

SEQ ID NO: 2032259 - protein, 26 aa, Staphylococcus
NRNWASSKGKGLWMSLVLRPNVPFSM

SEQ ID NO: 2032260 - protein, 26 aa, Staphylococcus
NRNWSSSKGKGLWMSLVLRPNVPFAM

SEQ ID NO: 2032261 - protein, 25 aa, Staphylococcus
NRNWSSSKGKGLWMSVVLRPNVPFD

SEQ ID NO: 2032262 - protein, 25 aa, Staphylococcus
NRNWSSSKGKGLWMSVVLRPNVSFA

SEQ ID NO: 2032263 - protein, 22 aa, Staphylococcus
NRPEDKGTFILHDREINSKNVI

SEQ ID NO: 2032264 - protein, 18 aa, Staphylococcus
NRPEVRNAFTPKTVAEMI

SEQ ID NO: 2032265 - protein, 17 aa, Staphylococcus
NRPEVRNAFTPKTVQEM

SEQ ID NO: 2032266 - protein, 28 aa, Staphylococcus
NRPLEELCALGIQIGTDIPFCILGKTAL

SEQ ID NO: 2032267 - protein, 23 aa, Staphylococcus
NRPVLQEALNFVRMGDRFIVESI

SEQ ID NO: 2032268 - protein, 17 aa, Staphylococcus
NRQCIFIRQTFIKKEVN

SEQ ID NO: 2032269 - protein, 19 aa, Staphylococcus
NRQLRRPDLTYATLDHNVP

SEQ ID NO: 2032270 - protein, 20 aa, Staphylococcus
NRQVIGIAGDGAFQMVMQDF

SEQ ID NO: 2032271 - protein, 24 aa, Staphylococcus
NRQVRRMFEHFGHEVSKLSRVELA

SEQ ID NO: 2032272 - protein, 23 aa, Staphylococcus
NRQVRRMFEHFGHQVDKLTRIEF

SEQ ID NO: 2032273 - protein, 24 aa, Staphylococcus
NRQVRRMFEHFGHQVSKLTRIQFG

SEQ ID NO: 2032274 - protein, 24 aa, Staphylococcus
NRQVRRMFEHFGHQVTKLQRIEFG

SEQ ID NO: 2032275 - protein, 22 aa, Staphylococcus
NRRIDMRLAAYIVGIKRTAEAA

SEQ ID NO: 2032276 - protein, 27 aa, Staphylococcus
NRRVNEHIIYAFAQMWGQSCTPPMNDR

SEQ ID NO: 2032277 - protein, 21 aa, Staphylococcus
NRRVTFEYGLFGGVNDQLEHA

SEQ ID NO: 2032278 - protein, 19 aa, Staphylococcus
NRSFVWLNTMRYLNKEDAD

SEQ ID NO: 2032279 - protein, 20 aa, Staphylococcus
NRSGLIDEWMLHMPVQSHKL

SEQ ID NO: 2032280 - protein, 17 aa, Staphylococcus
NRSLNNLGLEYIDLYLI

SEQ ID NO: 2032281 - protein, 17 aa, Staphylococcus
NRSMALIAIVDLLKQAK

SEQ ID NO: 2032282 - protein, 20 aa, Staphylococcus
NRSMFKRMFITFKNHKSDLN

SEQ ID NO: 2032283 - protein, 18 aa, Staphylococcus
NRSYRFALEHSENVAQYV

SEQ ID NO: 2032284 - protein, 21 aa, Staphylococcus
NRTLMPFAYIFRCIYGRAMKA

SEQ ID NO: 2032285 - protein, 22 aa, Staphylococcus
NRTSRVYLAIGGGVELEEWLDS

SEQ ID NO: 2032286 - protein, 25 aa, Staphylococcus
NRVFKDKPGGLIVDYVGIAESLKEA

SEQ ID NO: 2032287 - protein, 19 aa, Staphylococcus
NRVLKPGGMAVCLETSQPT

SEQ ID NO: 2032288 - protein, 20 aa, Staphylococcus
NRVLKPGGMIVCLETSQPTL

SEQ ID NO: 2032289 - protein, 20 aa, Staphylococcus
NRVLKPGGMIVCLETSQPTT

SEQ ID NO: 2032290 - protein, 27 aa, Staphylococcus
NRVSTCIKGKFGWDFVNSEERLTRPLV

SEQ ID NO: 2032291 - protein, 20 aa, Staphylococcus
NRVVKAMPSVRKFARDNDVN

SEQ ID NO: 2032292 - protein, 19 aa, Staphylococcus
NRYAVPYLPGCGSVTEIVQ

SEQ ID NO: 2032293 - protein, 23 aa, Staphylococcus
NRYEDMFLRLHLDNGDNVEVEVL

SEQ ID NO: 2032294 - protein, 18 aa, Staphylococcus
NRYEFLKLLLENIKNRYM

SEQ ID NO: 2032295 - protein, 20 aa, Staphylococcus
NRYQIPLFIVENGFGAVDEF

SEQ ID NO: 2032296 - protein, 21 aa, Staphylococcus
NRYSSDIFKSAFWMDEDRIWE

SEQ ID NO: 2032297 - protein, 21 aa, Staphylococcus
NRYSTDIFKSAFWMDEERIWE

SEQ ID NO: 2032298 - protein, 19 aa, Staphylococcus
NRYTLVFFNHIEAMKQAFE

SEQ ID NO: 2032299 - protein, 24 aa, Staphylococcus
NSAFKASSGAIQFDSDIGEIGGIT

SEQ ID NO: 2032300 - protein, 18 aa, Staphylococcus
NSAFLSDLVKLFEPSDIR

SEQ ID NO: 2032301 - protein, 20 aa, Staphylococcus
NSAHVTGCRLLKKPHIKHYI

SEQ ID NO: 2032302 - protein, 24 aa, Staphylococcus
NSAKVASCAVTWGTHSIEELKSEN

SEQ ID NO: 2032303 - protein, 18 aa, Staphylococcus
NSAKYGSMIERLMNQINV

SEQ ID NO: 2032304 - protein, 23 aa, Staphylococcus
NSALRKYARVRLSNNIEINAYIP

SEQ ID NO: 2032305 - protein, 24 aa, Staphylococcus
NSALRLTDIGFIFQAAYLIPYLSV

SEQ ID NO: 2032306 - protein, 20 aa, Staphylococcus
NSCGKCKGQIADILQYALGD

SEQ ID NO: 2032307 - protein, 29 aa, Staphylococcus
NSDDPKFKRWVIGSIISRTYYHNMVTHLL

SEQ ID NO: 2032308 - protein, 17 aa, Staphylococcus
NSDEYPEIVFVGNHLSS

SEQ ID NO: 2032309 - protein, 17 aa, Staphylococcus
NSDFGLAFDGDGDRIIA

SEQ ID NO: 2032310 - protein, 21 aa, Staphylococcus
NSDFSTASLLVNDFSNDPKKE

SEQ ID NO: 2032311 - protein, 26 aa, Staphylococcus
NSDKEIFKSLMFYWSDKDNRRINNLK

SEQ ID NO: 2032312 - protein, 25 aa, Staphylococcus
NSDVRLYELGSVFFANGEDELPDEV

SEQ ID NO: 2032313 - protein, 26 aa, Staphylococcus
NSEAKMGTSCIIKSDFKRDTIYTTNI

SEQ ID NO: 2032314 - protein, 29 aa, Staphylococcus
NSEDPKFKRWVIGSILSRTYYHNMVTHLL

SEQ ID NO: 2032315 - protein, 18 aa, Staphylococcus
NSEIKYKRRAVLEKSFVI

SEQ ID NO: 2032316 - protein, 22 aa, Staphylococcus
NSERYGAVYLVNLFSNIKSPEN

SEQ ID NO: 2032317 - protein, 23 aa, Staphylococcus
NSEVKPRVTITIDHYEDVSTEEV

SEQ ID NO: 2032318 - protein, 25 aa, Staphylococcus
NSFEVFTTLAYTGMRAGELLALKWS

SEQ ID NO: 2032319 - protein, 18 aa, Staphylococcus
NSFHLHKALEQFVNQTHI

SEQ ID NO: 2032320 - protein, 24 aa, Staphylococcus
NSFIKPKISVPIHYDTFELIEQDP

SEQ ID NO: 2032321 - protein, 20 aa, Staphylococcus
NSFKSSVKFRNLLFSNATEE

SEQ ID NO: 2032322 - protein, 27 aa, Staphylococcus
NSFLRKQTACNIIFRTAIVRAHDLKFN

SEQ ID NO: 2032323 - protein, 24 aa, Staphylococcus
NSFTDHRIGMMLAIASLLSNEALP

SEQ ID NO: 2032324 - protein, 18 aa, Staphylococcus
NSGDRSGTGLAFTRNPVT

SEQ ID NO: 2032325 - protein, 23 aa, Staphylococcus
NSGIKAIIQPGGSIKDQESIDMA

SEQ ID NO: 2032326 - protein, 20 aa, Staphylococcus
NSGKVPAVMYGYGQKNVSVK

SEQ ID NO: 2032327 - protein, 17 aa, Staphylococcus
NSGKVPAVVYGYGTKNT

SEQ ID NO: 2032328 - protein, 28 aa, Staphylococcus
NSGYSFNLFELELFKILLNNIEDFPVPT

SEQ ID NO: 2032329 - protein, 19 aa, Staphylococcus
NSHLVILVMVFSSGHVENI

SEQ ID NO: 2032330 - protein, 27 aa, Staphylococcus
NSHNHWYKWLQHNLELEGYDVQLFHLD

SEQ ID NO: 2032331 - protein, 26 aa, Staphylococcus
NSIFKRLRKKTGIMVHPHLLRHTHAT

SEQ ID NO: 2032332 - protein, 24 aa, Staphylococcus
NSIFKRLRKKTGINVHPHLLRHTH

SEQ ID NO: 2032333 - protein, 17 aa, Staphylococcus
NSIFYCIPTLHNPTQNT

SEQ ID NO: 2032334 - protein, 26 aa, Staphylococcus
NSIGFRGEASIHYKELILEAMPDMKV

SEQ ID NO: 2032335 - protein, 17 aa, Staphylococcus
NSIGFRGEASLKYKEEL

SEQ ID NO: 2032336 - protein, 17 aa, Staphylococcus
NSIGFRGEASLKYKELL

SEQ ID NO: 2032337 - protein, 17 aa, Staphylococcus
NSIKITLLRLSKHKFIE

SEQ ID NO: 2032338 - protein, 27 aa, Staphylococcus
NSILRKETVCNILFRNAIIKAHDIKFN

SEQ ID NO: 2032339 - protein, 18 aa, Staphylococcus
NSINDCYAVLGLVHTLWK

SEQ ID NO: 2032340 - protein, 26 aa, Staphylococcus
NSINNGRFSPVVFKIASENDIDLSQV

SEQ ID NO: 2032341 - protein, 23 aa, Staphylococcus
NSIQEVRNHIGIVFQNPDNQFVG

SEQ ID NO: 2032342 - protein, 21 aa, Staphylococcus
NSITRPSFRVPNDEALEYYEQ

SEQ ID NO: 2032343 - protein, 25 aa, Staphylococcus
NSKAIYVYEKCGFIDTNRVIGGPAG

SEQ ID NO: 2032344 - protein, 27 aa, Staphylococcus
NSKGACPNCGGKGYIKTELAFMGDFSQ

SEQ ID NO: 2032345 - protein, 23 aa, Staphylococcus
NSKIIFCEADDWKPFYEQYQSSL

SEQ ID NO: 2032346 - protein, 20 aa, Staphylococcus
NSKIKWNFTKFLVDRDGNVV

SEQ ID NO: 2032347 - protein, 24 aa, Staphylococcus
NSKNFKSEIVRYPYIETIENVDEV

SEQ ID NO: 2032348 - protein, 24 aa, Staphylococcus
NSKRELNEWYILTIERLIDLITYC

SEQ ID NO: 2032349 - protein, 19 aa, Staphylococcus
NSKYPKLLCDLYSGVLTEL

SEQ ID NO: 2032350 - protein, 27 aa, Staphylococcus
NSLDSEYQLGLLISRKKYWYKSPNFEE

SEQ ID NO: 2032351 - protein, 20 aa, Staphylococcus
NSLEQLLFGLGIRHLGVKAS

SEQ ID NO: 2032352 - protein, 23 aa, Staphylococcus
NSLERPRKILLMVKAGPATDATI

SEQ ID NO: 2032353 - protein, 24 aa, Staphylococcus
NSLGLKDNFKFIPVSPSWSEDSDI

SEQ ID NO: 2032354 - protein, 22 aa, Staphylococcus
NSLHKSRFVFLSPEFILQTQNF

SEQ ID NO: 2032355 - protein, 26 aa, Staphylococcus
NSLKFMLKVFLELGFINEDDGIITIA

SEQ ID NO: 2032356 - protein, 20 aa, Staphylococcus
NSLLDFSHVIQLGSKGNLNT

SEQ ID NO: 2032357 - protein, 20 aa, Staphylococcus
NSLVARYGELQTYYEENGGY

SEQ ID NO: 2032358 - protein, 34 aa, Staphylococcus
NSMYDELEVNKGRFKNCNFNEGIFKNINAISNSK

SEQ ID NO: 2032359 - protein, 30 aa, Staphylococcus
NSNDARFKRWVIGSIISRTYYHNMVTHLLE

SEQ ID NO: 2032360 - protein, 30 aa, Staphylococcus
NSNDGEPCNECAICKGITTGTNSDVIEIDA

SEQ ID NO: 2032361 - protein, 18 aa, Staphylococcus
NSNFDDFSILLAGEESKN

SEQ ID NO: 2032362 - protein, 35 aa, Staphylococcus
NSNFKKELFPFWKIRDFHEGFNFFINNIISESGSY

SEQ ID NO: 2032363 - protein, 22 aa, Staphylococcus
NSNFKTEHLLSSQKEEIKNIVD

SEQ ID NO: 2032364 - protein, 17 aa, Staphylococcus
NSNIKIGVCGELGGDAK

SEQ ID NO: 2032365 - protein, 22 aa, Staphylococcus
NSNIVFWYGWNKQAFDVVSELV

SEQ ID NO: 2032366 - protein, 17 aa, Staphylococcus
NSNQFKPYMDKLQNAIT

SEQ ID NO: 2032367 - protein, 28 aa, Staphylococcus
NSNRPISRSAFCYKETKSNLKFENTKLY

SEQ ID NO: 2032368 - protein, 19 aa, Staphylococcus
NSPDFGRIVNRKHFARLQH

SEQ ID NO: 2032369 - protein, 23 aa, Staphylococcus
NSQFKFAFNLAEIDSENFPMHIF

SEQ ID NO: 2032370 - protein, 25 aa, Staphylococcus
NSQFKILHIPVYYGGDRGPDIETVA

SEQ ID NO: 2032371 - protein, 29 aa, Staphylococcus
NSRAAIKKLCFKKEAIDGLIHSAGLGYFK

SEQ ID NO: 2032372 - protein, 24 aa, Staphylococcus
NSRKSALDGNVNWVDEIPETKFSK

SEQ ID NO: 2032373 - protein, 23 aa, Staphylococcus
NSSFRGLYQFIRFIDELIDRGKD

SEQ ID NO: 2032374 - protein, 23 aa, Staphylococcus
NSSFRGLYQFIRFIDELIDRGQD

SEQ ID NO: 2032375 - protein, 23 aa, Staphylococcus
NSSFRGLYQFIRFIDELIERGKD

SEQ ID NO: 2032376 - protein, 23 aa, Staphylococcus
NSSFRGLYQFIRFIDELIERNKD

SEQ ID NO: 2032377 - protein, 18 aa, Staphylococcus
NSSIIIMVIIYNSGHVEH

SEQ ID NO: 2032378 - protein, 25 aa, Staphylococcus
NSSYLIDLLENFALERGVYGKRWLD

SEQ ID NO: 2032379 - protein, 25 aa, Staphylococcus
NSSYLIDLLENFVIERGIYGKKWLD

SEQ ID NO: 2032380 - protein, 24 aa, Staphylococcus
NSSYLIDLLENFVLERGITGKRWF

SEQ ID NO: 2032381 - protein, 29 aa, Staphylococcus
NSTDGEPCNECAICKGITQGTNSDVIEID

SEQ ID NO: 2032382 - protein, 18 aa, Staphylococcus
NSTLFQRRVKSIVNKAQR

SEQ ID NO: 2032383 - protein, 19 aa, Staphylococcus
NSVDGEPCNECDICKSITQ

SEQ ID NO: 2032384 - protein, 18 aa, Staphylococcus
NSVGDAFEAWFGKIKDSD

SEQ ID NO: 2032385 - protein, 20 aa, Staphylococcus
NSVIELTKGTGIFVNVLRSF

SEQ ID NO: 2032386 - protein, 28 aa, Staphylococcus
NSVKPNWCPGCGDFSVQAAIQKAAANLG

SEQ ID NO: 2032387 - protein, 28 aa, Staphylococcus
NSVKPNWCPGCGDFSVQAAIQKAAANVG

SEQ ID NO: 2032388 - protein, 22 aa, Staphylococcus
NSVPHYTKRLFFDLQSNGYIPI

SEQ ID NO: 2032389 - protein, 21 aa, Staphylococcus
NSYEGFANFYIQQAKEERFHG

SEQ ID NO: 2032390 - protein, 18 aa, Staphylococcus
NSYGLTGFDIYKPNHSEE

SEQ ID NO: 2032391 - protein, 19 aa, Staphylococcus
NSYIIWGGVTDLHLMYEER

SEQ ID NO: 2032392 - protein, 18 aa, Staphylococcus
NSYPNWAKQFPFWSERTI

SEQ ID NO: 2032393 - protein, 25 aa, Staphylococcus
NSYVKDKLVFIGKFKMFYISEDELN

SEQ ID NO: 2032394 - protein, 23 aa, Staphylococcus
NSYWRYVETNGILGVALDDPQIV

SEQ ID NO: 2032395 - protein, 34 aa, Staphylococcus
NTADIIPMCHQLPLTGIDVTFDWQENEQSYTLNI

SEQ ID NO: 2032396 - protein, 17 aa, Staphylococcus
NTAEEFNERLNAEIRKN

SEQ ID NO: 2032397 - protein, 18 aa, Staphylococcus
NTALDWARDLAPIAKRVT

SEQ ID NO: 2032398 - protein, 18 aa, Staphylococcus
NTALRANYTLQRDVDYMV

SEQ ID NO: 2032399 - protein, 17 aa, Staphylococcus
NTAVLTFQVRREINGES

SEQ ID NO: 2032400 - protein, 23 aa, Staphylococcus
NTDCFKLSAIISKLRIEYNQYIR

SEQ ID NO: 2032401 - protein, 24 aa, Staphylococcus
NTDIRICQIWDWENGYRNVSNKNA

SEQ ID NO: 2032402 - protein, 24 aa, Staphylococcus
NTDKAYEIYQIWCANNGYHNMNKM

SEQ ID NO: 2032403 - protein, 18 aa, Staphylococcus
NTDPLFIGAMADEVYSVF

SEQ ID NO: 2032404 - protein, 24 aa, Staphylococcus
NTDPVYWKKLFKRYENWINNFNAC

SEQ ID NO: 2032405 - protein, 24 aa, Staphylococcus
NTEDCLEVLSAIIEKGEIALENTP

SEQ ID NO: 2032406 - protein, 19 aa, Staphylococcus
NTEDIYAGIEFKEGTDEVK

SEQ ID NO: 2032407 - protein, 19 aa, Staphylococcus
NTEDIYAGIEFKEGTPEAE

SEQ ID NO: 2032408 - protein, 19 aa, Staphylococcus
NTEDIYAGIEFKEGTSEVK

SEQ ID NO: 2032409 - protein, 23 aa, Staphylococcus
NTEILPDFMVEKSIAIEKAHLES

SEQ ID NO: 2032410 - protein, 25 aa, Staphylococcus
NTEIYVCGGAKFIQSVIEVLKALDV

SEQ ID NO: 2032411 - protein, 26 aa, Staphylococcus
NTELEVVEGMQFDRGYQSPYMVTDSE

SEQ ID NO: 2032412 - protein, 19 aa, Staphylococcus
NTFDSASTFGRKIQNDLLK

SEQ ID NO: 2032413 - protein, 17 aa, Staphylococcus
NTFKRALAGLTGLDTHQ

SEQ ID NO: 2032414 - protein, 18 aa, Staphylococcus
NTFKRALAGLTGLDTHQA

SEQ ID NO: 2032415 - protein, 29 aa, Staphylococcus
NTFNNFRVARTWIGFLLRETDGNFFNNIY

SEQ ID NO: 2032416 - protein, 17 aa, Staphylococcus
NTFRGNRPFTFTNLKTE

SEQ ID NO: 2032417 - protein, 18 aa, Staphylococcus
NTFVLFNINLSWIESRPL

SEQ ID NO: 2032418 - protein, 31 aa, Staphylococcus
NTFVPARNLLFLSFAGALAYQLNAKHIITGV

SEQ ID NO: 2032419 - protein, 23 aa, Staphylococcus
NTGHALLAYAGRFYGRDTVLDAV

SEQ ID NO: 2032420 - protein, 26 aa, Staphylococcus
NTGIGLAFVCAAKGYNAVFTMPETMS

SEQ ID NO: 2032421 - protein, 18 aa, Staphylococcus
NTGLKNLINFTGDTLDHL

SEQ ID NO: 2032422 - protein, 23 aa, Staphylococcus
NTGRPIYNAIVWQSRQTQDIIQS

SEQ ID NO: 2032423 - protein, 20 aa, Staphylococcus
NTGTPWLGPDVQDLTRDLYE

SEQ ID NO: 2032424 - protein, 20 aa, Staphylococcus
NTGTPWLGPDVQDLTRELYK

SEQ ID NO: 2032425 - protein, 20 aa, Staphylococcus
NTGTPWLGPDVQDLTRELYQ

SEQ ID NO: 2032426 - protein, 20 aa, Staphylococcus
NTGTPWLGPDVQDLTRTLYQ

SEQ ID NO: 2032427 - protein, 24 aa, Staphylococcus
NTHARIPVCGAISSYNHPEEDIGP

SEQ ID NO: 2032428 - protein, 23 aa, Staphylococcus
NTHEAWKEWGELMKYIADNQNVI

SEQ ID NO: 2032429 - protein, 29 aa, Staphylococcus
NTHEAWKEWSELMKWLADNKEIINQYDTI

SEQ ID NO: 2032430 - protein, 25 aa, Staphylococcus
NTHIIKWSKLYLDNFQSSWTMPKRE

SEQ ID NO: 2032431 - protein, 24 aa, Staphylococcus
NTHIIKWSKLYLDTFQSSWTMPKR

SEQ ID NO: 2032432 - protein, 27 aa, Staphylococcus
NTIAPGYMKTALTEPMFNTGGDMIDYW

SEQ ID NO: 2032433 - protein, 28 aa, Staphylococcus
NTIAPGYMKTALTEPMFNTGGEMIDYWM

SEQ ID NO: 2032434 - protein, 25 aa, Staphylococcus
NTIDMKPRLDLFLQDKSIFLNEPVD

SEQ ID NO: 2032435 - protein, 18 aa, Staphylococcus
NTIEGAGLSEAITYSLIS

SEQ ID NO: 2032436 - protein, 25 aa, Staphylococcus
NTIFSELLRFAGIGESKVETELMDL

SEQ ID NO: 2032437 - protein, 17 aa, Staphylococcus
NTIGLIFKSETNLLRQN

SEQ ID NO: 2032438 - protein, 22 aa, Staphylococcus
NTIHWQYGHVLTIFESVLSLCE

SEQ ID NO: 2032439 - protein, 17 aa, Staphylococcus
NTIKAELGDNLFVLLCI

SEQ ID NO: 2032440 - protein, 18 aa, Staphylococcus
NTINDCYAILGLVHTLWK

SEQ ID NO: 2032441 - protein, 25 aa, Staphylococcus
NTISDLRGLKVWVFAVDEGSEIRCR

SEQ ID NO: 2032442 - protein, 17 aa, Staphylococcus
NTISVAVNAGWTLEDLA

SEQ ID NO: 2032443 - protein, 19 aa, Staphylococcus
NTIYFKIIFLKRNGTEAAS

SEQ ID NO: 2032444 - protein, 20 aa, Staphylococcus
NTKEALKYYEEVFGATDINR

SEQ ID NO: 2032445 - protein, 32 aa, Staphylococcus
NTKEFKTFCNMLEHVMRSLAIQIAKDGEGATK

SEQ ID NO: 2032446 - protein, 19 aa, Staphylococcus
NTKEKFEIMNRVIKNARTY

SEQ ID NO: 2032447 - protein, 25 aa, Staphylococcus
NTKFFRTIMKYVRQGKIYPLSYYDG

SEQ ID NO: 2032448 - protein, 23 aa, Staphylococcus
NTKFKPQRFEAGFRKTPNNSEEL

SEQ ID NO: 2032449 - protein, 24 aa, Staphylococcus
NTKLKPYREALGLSTPKNSTVKEK

SEQ ID NO: 2032450 - protein, 18 aa, Staphylococcus
NTKLLPNSKVLAVTDGDI

SEQ ID NO: 2032451 - protein, 29 aa, Staphylococcus
NTKPRGLFRKKKFSPIVGDIVDFDVQNET

SEQ ID NO: 2032452 - protein, 18 aa, Staphylococcus
NTKREFYRYTNLSEDESK

SEQ ID NO: 2032453 - protein, 20 aa, Staphylococcus
NTKSGPWLKDVLRQIEVAII

SEQ ID NO: 2032454 - protein, 17 aa, Staphylococcus
NTKYRRALLLYGGAKNG

SEQ ID NO: 2032455 - protein, 23 aa, Staphylococcus
NTLDCFSEHLGLMFQIKDDLLDV

SEQ ID NO: 2032456 - protein, 17 aa, Staphylococcus
NTLIGYQHAFALPIDML

SEQ ID NO: 2032457 - protein, 27 aa, Staphylococcus
NTLIKEYRKADIFAMASLHETFGLTYL

SEQ ID NO: 2032458 - protein, 19 aa, Staphylococcus
NTLKCKLVIDNEEKTFYFP

SEQ ID NO: 2032459 - protein, 23 aa, Staphylococcus
NTLKDYGIEYEIVPGVTSASAAV

SEQ ID NO: 2032460 - protein, 35 aa, Staphylococcus
NTLLIELCRFIPNLKWKRWIYIHLLNMTIGQHTAI

SEQ ID NO: 2032461 - protein, 20 aa, Staphylococcus
NTLPRAIDYLDLNWPKDTEF

SEQ ID NO: 2032462 - protein, 25 aa, Staphylococcus
NTLREIFQSLKLPKKDLHQLNMSKD

SEQ ID NO: 2032463 - protein, 23 aa, Staphylococcus
NTLTIRPGVVVTYDRNFVSNQLL

SEQ ID NO: 2032464 - protein, 23 aa, Staphylococcus
NTLTIRPGVVVTYDRNYVSNQLL

SEQ ID NO: 2032465 - protein, 19 aa, Staphylococcus
NTLVRRAAEKAGIEGLDEF

SEQ ID NO: 2032466 - protein, 24 aa, Staphylococcus
NTMDYRMIQDLGFEIDCSNLPEDT

SEQ ID NO: 2032467 - protein, 17 aa, Staphylococcus
NTMKIVLQLSGEDYKPN

SEQ ID NO: 2032468 - protein, 18 aa, Staphylococcus
NTMSRQAFKDFVGNNKKL

SEQ ID NO: 2032469 - protein, 19 aa, Staphylococcus
NTMVRRAAEQAGIEGLNDF

SEQ ID NO: 2032470 - protein, 17 aa, Staphylococcus
NTNARIEPGAFIREGAT

SEQ ID NO: 2032471 - protein, 24 aa, Staphylococcus
NTNERYKLIILRKGRGLAGTVMKT

SEQ ID NO: 2032472 - protein, 18 aa, Staphylococcus
NTNLTVLIIGGFAQKGSN

SEQ ID NO: 2032473 - protein, 18 aa, Staphylococcus
NTPARLKYIKSLYTELGK

SEQ ID NO: 2032474 - protein, 18 aa, Staphylococcus
NTPARLKYVKSLYTELGK

SEQ ID NO: 2032475 - protein, 24 aa, Staphylococcus
NTPESWYFSKRLLYGKLNEIKEEF

SEQ ID NO: 2032476 - protein, 19 aa, Staphylococcus
NTPESWYYSKRLMYSKLTD

SEQ ID NO: 2032477 - protein, 17 aa, Staphylococcus
NTQRVLNELSFGGGAIN

SEQ ID NO: 2032478 - protein, 18 aa, Staphylococcus
NTRAFMHLDTVFTMIDYD

SEQ ID NO: 2032479 - protein, 22 aa, Staphylococcus
NTRRVLAIELIIALQAVELKGI

SEQ ID NO: 2032480 - protein, 18 aa, Staphylococcus
NTRVDIMLERGLLSEVKQ

SEQ ID NO: 2032481 - protein, 17 aa, Staphylococcus
NTSFIKNDIDVEKIIQR

SEQ ID NO: 2032482 - protein, 17 aa, Staphylococcus
NTSGIVILAKHGFIHHL

SEQ ID NO: 2032483 - protein, 18 aa, Staphylococcus
NTSGRMLLSSQYRKRKIT

SEQ ID NO: 2032484 - protein, 22 aa, Staphylococcus
NTSIPNAFVFVEQWKDRAALNA

SEQ ID NO: 2032485 - protein, 21 aa, Staphylococcus
NTSRFYQYWLDRVEADIEEAK

SEQ ID NO: 2032486 - protein, 34 aa, Staphylococcus
NTSTIIPMCHPLPLTGIDIEFSWNQANTQRHYQL

SEQ ID NO: 2032487 - protein, 34 aa, Staphylococcus
NTSTIIPMCHPLPLTGIDVNFEWDTSQTPHYILN

SEQ ID NO: 2032488 - protein, 37 aa, Staphylococcus
NTSTIIPMCHPLSLTGIDIAFEWDTTSSYTLNIEATV

SEQ ID NO: 2032489 - protein, 35 aa, Staphylococcus
NTSTMIPMCHPLPLTGIDITFSWSDLDKGQHQLNI

SEQ ID NO: 2032490 - protein, 19 aa, Staphylococcus
NTSYAPWLVVPADHKKTSR

SEQ ID NO: 2032491 - protein, 25 aa, Staphylococcus
NTTIRLRDCVMILGINVLDHIIIGD

SEQ ID NO: 2032492 - protein, 24 aa, Staphylococcus
NTVEEFKELFFIKIKGKANINTEN

SEQ ID NO: 2032493 - protein, 21 aa, Staphylococcus
NTVEPAIRFTLDNQQLINSNE

SEQ ID NO: 2032494 - protein, 27 aa, Staphylococcus
NTVIIEISRFIPFLNVKRYVYIHFLKM

SEQ ID NO: 2032495 - protein, 17 aa, Staphylococcus
NTVLKYQPLFIKPNKDE

SEQ ID NO: 2032496 - protein, 23 aa, Staphylococcus
NTWSESWSEIFVERRMDHLRDEL

SEQ ID NO: 2032497 - protein, 17 aa, Staphylococcus
NTYDFLLLVSKILFNFI

SEQ ID NO: 2032498 - protein, 18 aa, Staphylococcus
NTYDWFKEHLTSIDDIDD

SEQ ID NO: 2032499 - protein, 18 aa, Staphylococcus
NTYGLALIDFHYPESTHL

SEQ ID NO: 2032500 - protein, 19 aa, Staphylococcus
NTYGTGGFMLMNTGEEPVK

SEQ ID NO: 2032501 - protein, 23 aa, Staphylococcus
NVADLYSALLIKGVSSQLKYGLQ

SEQ ID NO: 2032502 - protein, 20 aa, Staphylococcus
NVADVIPVFAVNKETGKPVC

SEQ ID NO: 2032503 - protein, 20 aa, Staphylococcus
NVAERRLERLINPQLNGDLP

SEQ ID NO: 2032504 - protein, 25 aa, Staphylococcus
NVAGIWKDNSFFLGLNSYPIMNYHY

SEQ ID NO: 2032505 - protein, 18 aa, Staphylococcus
NVAIDWDIEFYSGDLNTL

SEQ ID NO: 2032506 - protein, 22 aa, Staphylococcus
NVALEPYGLCAKTNDEDARQLA

SEQ ID NO: 2032507 - protein, 36 aa, Staphylococcus
NVATKRQALRFGDAELNPGTRLHFVEVPNPNYRNVH

SEQ ID NO: 2032508 - protein, 19 aa, Staphylococcus
NVDAIKFAQSQGITVAIAT

SEQ ID NO: 2032509 - protein, 24 aa, Staphylococcus
NVDFLKRRVEKLNKNILFSNMEIT

SEQ ID NO: 2032510 - protein, 27 aa, Staphylococcus
NVDIKWKVPDILPEYIQAYEDVKNDVQ

SEQ ID NO: 2032511 - protein, 21 aa, Staphylococcus
NVDLFLRNAHRIPDYASNRIT

SEQ ID NO: 2032512 - protein, 21 aa, Staphylococcus
NVDLFLRNAHRIPDYASNRVT

SEQ ID NO: 2032513 - protein, 23 aa, Staphylococcus
NVDRRLRELIKIRASQINGCAYC

SEQ ID NO: 2032514 - protein, 19 aa, Staphylococcus
NVDVELRLLKYQQDMAQLI

SEQ ID NO: 2032515 - protein, 26 aa, Staphylococcus
NVEFYPVLCGTAFKNKGVQLMLDAVI

SEQ ID NO: 2032516 - protein, 21 aa, Staphylococcus
NVEGYKGYLFGDADTSDLEEH

SEQ ID NO: 2032517 - protein, 17 aa, Staphylococcus
NVEHQWLDLTKYQLNPV

SEQ ID NO: 2032518 - protein, 24 aa, Staphylococcus
NVEIKWQIPDILPEYLMQYQTVKS

SEQ ID NO: 2032519 - protein, 23 aa, Staphylococcus
NVEKGDRVFIFMPRTPELYFALF

SEQ ID NO: 2032520 - protein, 26 aa, Staphylococcus
NVELTKYLFFTGKGGVGKTTISSSIA

SEQ ID NO: 2032521 - protein, 25 aa, Staphylococcus
NVEPLGSVYIKITFYRKNDTEHSNL

SEQ ID NO: 2032522 - protein, 28 aa, Staphylococcus
NVESSGIIKKLFLLGIMANINQSLDEET

SEQ ID NO: 2032523 - protein, 27 aa, Staphylococcus
NVESSGIVKKLFLLGIVANINQSLDQE

SEQ ID NO: 2032524 - protein, 17 aa, Staphylococcus
NVFENMKQYALTPLKNK

SEQ ID NO: 2032525 - protein, 18 aa, Staphylococcus
NVFIFDIGDVLALTHDSA

SEQ ID NO: 2032526 - protein, 17 aa, Staphylococcus
NVFKELFGSDVAITNPT

SEQ ID NO: 2032527 - protein, 26 aa, Staphylococcus
NVFNHFKPSSLFMLHQIIKGHTNYNN

SEQ ID NO: 2032528 - protein, 23 aa, Staphylococcus
NVFSGKLARGIMNEFVHNMNLYS

SEQ ID NO: 2032529 - protein, 17 aa, Staphylococcus
NVFSGKYARGINNNFIQ

SEQ ID NO: 2032530 - protein, 18 aa, Staphylococcus
NVFTLEYYVNLAKELEKE

SEQ ID NO: 2032531 - protein, 23 aa, Staphylococcus
NVGAKGDVALFFGLSGTGKTTLS

SEQ ID NO: 2032532 - protein, 24 aa, Staphylococcus
NVGDPLVEFDLDFINQNAKSIISP

SEQ ID NO: 2032533 - protein, 24 aa, Staphylococcus
NVGEGLNPMRKRIAQNMRQSLGET

SEQ ID NO: 2032534 - protein, 24 aa, Staphylococcus
NVGENNWGLRDWYSVDDIEEKIAP

SEQ ID NO: 2032535 - protein, 23 aa, Staphylococcus
NVGENQWGLRDWYSVDDIEEKIA

SEQ ID NO: 2032536 - protein, 28 aa, Staphylococcus
NVGISLKGKEIYIRKFAIEKLPKILNEE

SEQ ID NO: 2032537 - protein, 18 aa, Staphylococcus
NVHLIKANDSIMILVIIY

SEQ ID NO: 2032538 - protein, 19 aa, Staphylococcus
NVHYESWLSTYNHISVNDY

SEQ ID NO: 2032539 - protein, 24 aa, Staphylococcus
NVHYKPLPMFTAYKNYGFDIKDFP

SEQ ID NO: 2032540 - protein, 27 aa, Staphylococcus
NVIEGIKLGSKRIGHGVAINQDKQSLQ

SEQ ID NO: 2032541 - protein, 27 aa, Staphylococcus
NVIFLRKWKEVGLRYGELSLVMEEVYE

SEQ ID NO: 2032542 - protein, 24 aa, Staphylococcus
NVIFTSKCIPNFRNFREIHCNYRG

SEQ ID NO: 2032543 - protein, 20 aa, Staphylococcus
NVIHKSRFIAHIKPVNSEDE

SEQ ID NO: 2032544 - protein, 17 aa, Staphylococcus
NVIKAHMIEQLYSPVQF

SEQ ID NO: 2032545 - protein, 29 aa, Staphylococcus
NVIKKVASKFSLPVLDLYHDSNLKVWIDY

SEQ ID NO: 2032546 - protein, 19 aa, Staphylococcus
NVIKRLIQIQNQYKTFYNN

SEQ ID NO: 2032547 - protein, 18 aa, Staphylococcus
NVIKRLIQVQNQFKTFYN

SEQ ID NO: 2032548 - protein, 19 aa, Staphylococcus
NVIKRLIQVQNQFKTFYNQ

SEQ ID NO: 2032549 - protein, 17 aa, Staphylococcus
NVINFKNTIVICTSNAG

SEQ ID NO: 2032550 - protein, 25 aa, Staphylococcus
NVIPEMLTENFIPRAELRETTMAIL

SEQ ID NO: 2032551 - protein, 24 aa, Staphylococcus
NVIPEMLTENFIPRTELRETTMSI

SEQ ID NO: 2032552 - protein, 18 aa, Staphylococcus
NVIPQEFQALYDAKQRGE

SEQ ID NO: 2032553 - protein, 19 aa, Staphylococcus
NVIPQEFQDLYDAKQSGEN

SEQ ID NO: 2032554 - protein, 25 aa, Staphylococcus
NVIQPRYLAADIKSTAQASDGFVNI

SEQ ID NO: 2032555 - protein, 17 aa, Staphylococcus
NVIRLLPPLTISSQEIN

SEQ ID NO: 2032556 - protein, 24 aa, Staphylococcus
NVIVKELLDNGAVVYNADIKGNDL

SEQ ID NO: 2032557 - protein, 24 aa, Staphylococcus
NVKDNLKPGGTLVYSTCTIEQLEN

SEQ ID NO: 2032558 - protein, 17 aa, Staphylococcus
NVKEGGMQFGVDPQVAA

SEQ ID NO: 2032559 - protein, 24 aa, Staphylococcus
NVKFKAHLLELGIIDENWLTEIEK

SEQ ID NO: 2032560 - protein, 29 aa, Staphylococcus
NVKFLSRLPVAGLGLDFVHDHGYNLEQIK

SEQ ID NO: 2032561 - protein, 24 aa, Staphylococcus
NVKKDIGMIFQHFNLLNSKTVYKN

SEQ ID NO: 2032562 - protein, 26 aa, Staphylococcus
NVKLMQLKELFLVSLQERAIPFELNG

SEQ ID NO: 2032563 - protein, 22 aa, Staphylococcus
NVKSEGLYTLSFKLSEQQCYAS

SEQ ID NO: 2032564 - protein, 28 aa, Staphylococcus
NVLIYRLPNLFGKWCKPNYNSVIATFCY

SEQ ID NO: 2032565 - protein, 26 aa, Staphylococcus
NVLNRWQKRLEGVGWNALFIENHDQP

SEQ ID NO: 2032566 - protein, 18 aa, Staphylococcus
NVLRRGRNAKSYTKAKNT

SEQ ID NO: 2032567 - protein, 19 aa, Staphylococcus
NVLSHYWGGDKLNIRQDLE

SEQ ID NO: 2032568 - protein, 18 aa, Staphylococcus
NVLTFAVRRMNLYDKNLP

SEQ ID NO: 2032569 - protein, 18 aa, Staphylococcus
NVLTFAVRRMNLYDRDLP

SEQ ID NO: 2032570 - protein, 18 aa, Staphylococcus
NVLVKFEEEIHCEIVNKD

SEQ ID NO: 2032571 - protein, 17 aa, Staphylococcus
NVLYGFPKFYDACIKAN

SEQ ID NO: 2032572 - protein, 18 aa, Staphylococcus
NVMRNCVGDHIIITFQNQ

SEQ ID NO: 2032573 - protein, 19 aa, Staphylococcus
NVNEVVSFVANKYLKEQGI

SEQ ID NO: 2032574 - protein, 25 aa, Staphylococcus
NVNIKCIRRIMRILGLQAQIRKKRP

SEQ ID NO: 2032575 - protein, 21 aa, Staphylococcus
NVNLFKRQGRNILLTSEGKQL

SEQ ID NO: 2032576 - protein, 23 aa, Staphylococcus
NVNLLPRRAFYIPYQLGEKDYDF

SEQ ID NO: 2032577 - protein, 18 aa, Staphylococcus
NVNSEWMIPKILEVKNKA

SEQ ID NO: 2032578 - protein, 20 aa, Staphylococcus
NVNYRLTIHSDQGWHYQNAK

SEQ ID NO: 2032579 - protein, 18 aa, Staphylococcus
NVPAAIKDKEIIAVDVSA

SEQ ID NO: 2032580 - protein, 18 aa, Staphylococcus
NVPAFAICHGPQVLIDTD

SEQ ID NO: 2032581 - protein, 21 aa, Staphylococcus
NVPDFCQLIFITTPDKLHSEE

SEQ ID NO: 2032582 - protein, 23 aa, Staphylococcus
NVPEPPMTIVPSFENTGSEDNVG

SEQ ID NO: 2032583 - protein, 17 aa, Staphylococcus
NVPIFLKLTSDLELEGF

SEQ ID NO: 2032584 - protein, 18 aa, Staphylococcus
NVQFSRDLIDTVIEKEAY

SEQ ID NO: 2032585 - protein, 23 aa, Staphylococcus
NVQKRNVIKIVYFQPQNSDKLYI

SEQ ID NO: 2032586 - protein, 18 aa, Staphylococcus
NVQTGRSYFKLIVKGEGG

SEQ ID NO: 2032587 - protein, 25 aa, Staphylococcus
NVQTGRSYFKLTIQGEGGHGSSPHT

SEQ ID NO: 2032588 - protein, 18 aa, Staphylococcus
NVQWREYIHFPKEHLLPY

SEQ ID NO: 2032589 - protein, 20 aa, Staphylococcus
NVRAGKLFGIPVSGTHAHAF

SEQ ID NO: 2032590 - protein, 20 aa, Staphylococcus
NVRAGKLFGIPVSGTHAHAL

SEQ ID NO: 2032591 - protein, 18 aa, Staphylococcus
NVRGRIFYREYFKNRIVS

SEQ ID NO: 2032592 - protein, 20 aa, Staphylococcus
NVRIILRKGPLLASTSEKYR

SEQ ID NO: 2032593 - protein, 22 aa, Staphylococcus
NVRKEAIYFLAHDYHIEEHSSQ

SEQ ID NO: 2032594 - protein, 18 aa, Staphylococcus
NVRKSKFTQISNDLLNDE

SEQ ID NO: 2032595 - protein, 26 aa, Staphylococcus
NVRQGLLKAREVVLVVTGANKREVVK

SEQ ID NO: 2032596 - protein, 21 aa, Staphylococcus
NVSFDIMLASYILDPSRSIDD

SEQ ID NO: 2032597 - protein, 27 aa, Staphylococcus
NVSQWNFIEYLLLARLGVSILPEHIAN

SEQ ID NO: 2032598 - protein, 21 aa, Staphylococcus
NVSQWNFIEYLVIARLGVSIL

SEQ ID NO: 2032599 - protein, 23 aa, Staphylococcus
NVSSTARASFYIYNTKEDVDQLV

SEQ ID NO: 2032600 - protein, 20 aa, Staphylococcus
NVSSTARASFYVYNTKEDID

SEQ ID NO: 2032601 - protein, 20 aa, Staphylococcus
NVSSTARASFYVYNTKEDVD

SEQ ID NO: 2032602 - protein, 22 aa, Staphylococcus
NVTEIIKDFPILNQQVNGKRLA

SEQ ID NO: 2032603 - protein, 20 aa, Staphylococcus
NVTFEPGCRNNWHVHTEGYQ

SEQ ID NO: 2032604 - protein, 19 aa, Staphylococcus
NVTIPQYKPGSFGPKESDQ

SEQ ID NO: 2032605 - protein, 29 aa, Staphylococcus
NVTQKAFNGMSFLNLVDFDALYGHRRDKE

SEQ ID NO: 2032606 - protein, 18 aa, Staphylococcus
NVTRALKPLEGFHIKGKR

SEQ ID NO: 2032607 - protein, 17 aa, Staphylococcus
NVTYRLIDEQGPAHHRL

SEQ ID NO: 2032608 - protein, 20 aa, Staphylococcus
NVVDISNYVLLEYGQPLHMF

SEQ ID NO: 2032609 - protein, 18 aa, Staphylococcus
NVVFLRKWEDFGIRYGDI

SEQ ID NO: 2032610 - protein, 23 aa, Staphylococcus
NVVFSNFKKGAVFVNAARGSIVD

SEQ ID NO: 2032611 - protein, 23 aa, Staphylococcus
NVVIKIDLYKPIPHQQNINEVKQ

SEQ ID NO: 2032612 - protein, 25 aa, Staphylococcus
NVVTRPIMEEWLFNTVAFIGGPSEI

SEQ ID NO: 2032613 - protein, 26 aa, Staphylococcus
NVVTRPIMEEWLFNTVAFIGGPSEIK

SEQ ID NO: 2032614 - protein, 25 aa, Staphylococcus
NVVTRPIMEEWLFNTVSFIGGPSEI

SEQ ID NO: 2032615 - protein, 26 aa, Staphylococcus
NVVTRPVMEEWLFNTVAFIGGPSEIK

SEQ ID NO: 2032616 - protein, 19 aa, Staphylococcus
NVVVFTFNDTSSWKSDMNI

SEQ ID NO: 2032617 - protein, 26 aa, Staphylococcus
NVWFEREAKDLLPEGFTHPGSPNGEF

SEQ ID NO: 2032618 - protein, 25 aa, Staphylococcus
NVYGVACPGFVPLVEQMRYNDPTIT

SEQ ID NO: 2032619 - protein, 17 aa, Staphylococcus
NVYKELYYLITELKHRI

SEQ ID NO: 2032620 - protein, 22 aa, Staphylococcus
NVYKQKGLKVFGLTASPQYIAN

SEQ ID NO: 2032621 - protein, 19 aa, Staphylococcus
NVYLAGPIQLLKRPQHNKF

SEQ ID NO: 2032622 - protein, 24 aa, Staphylococcus
NVYNRRLRFTLAHEYGHYIMEHDG

SEQ ID NO: 2032623 - protein, 26 aa, Staphylococcus
NVYRHLSQDGVFMFDVHTAYKMNTLF

SEQ ID NO: 2032624 - protein, 18 aa, Staphylococcus
NVYVLPQLHTLLWSNMKG

SEQ ID NO: 2032625 - protein, 27 aa, Staphylococcus
NWAKQFPFWSERTIKRAFGSLEKQDLL

SEQ ID NO: 2032626 - protein, 18 aa, Staphylococcus
NWGNYKLIFNTRHGAELQ

SEQ ID NO: 2032627 - protein, 18 aa, Staphylococcus
NWGNYKLIFNTRHKANIE

SEQ ID NO: 2032628 - protein, 18 aa, Staphylococcus
NWGNYKLIFNTRHQANIN

SEQ ID NO: 2032629 - protein, 18 aa, Staphylococcus
NWGNYKLIYETRHSANIE

SEQ ID NO: 2032630 - protein, 18 aa, Staphylococcus
NWGNYKLVYSTRHSADIE

SEQ ID NO: 2032631 - protein, 25 aa, Staphylococcus
NWHIEAGDNWILYGLNGAGKTTLLN

SEQ ID NO: 2032632 - protein, 36 aa, Staphylococcus
NWIYLVKNLRLAGVKIELLIEFCKLGQLPSNEDTQQ

SEQ ID NO: 2032633 - protein, 19 aa, Staphylococcus
NWLDSLKFLTKSLEESMVI

SEQ ID NO: 2032634 - protein, 25 aa, Staphylococcus
NWLKKHVFPGLTFNQILSLASNSTI

SEQ ID NO: 2032635 - protein, 17 aa, Staphylococcus
NWLKLPLDEDIRKYGTP

SEQ ID NO: 2032636 - protein, 21 aa, Staphylococcus
NWLSQKMIDFALKLRESNELS

SEQ ID NO: 2032637 - protein, 17 aa, Staphylococcus
NWNFTLFIQNGRIKDLE

SEQ ID NO: 2032638 - protein, 17 aa, Staphylococcus
NWNIAQMRIFWQYTAII

SEQ ID NO: 2032639 - protein, 26 aa, Staphylococcus
NWNMKRLAKSRFIFLSPEFILQPQNF

SEQ ID NO: 2032640 - protein, 19 aa, Staphylococcus
NWSQFAVIDGHVITGQNPQ

SEQ ID NO: 2032641 - protein, 23 aa, Staphylococcus
NWVTKPKMGPIFQDIVNDARSCR

SEQ ID NO: 2032642 - protein, 25 aa, Staphylococcus
NWVTKPKMGPIFSEIVNQARSCRAF

SEQ ID NO: 2032643 - protein, 17 aa, Staphylococcus
NYAELRLSVDTTNEAAQ

SEQ ID NO: 2032644 - protein, 17 aa, Staphylococcus
NYAELRLSVDTTNELAQ

SEQ ID NO: 2032645 - protein, 18 aa, Staphylococcus
NYAENFAVWSTQTNAMHQ

SEQ ID NO: 2032646 - protein, 26 aa, Staphylococcus
NYAKFMLNTIWGRWGMFEKEVDEGAR

SEQ ID NO: 2032647 - protein, 31 aa, Staphylococcus
NYAKQLFKHKGFEVLDGNSFNEFVVKFDEPI

SEQ ID NO: 2032648 - protein, 25 aa, Staphylococcus
NYAPCTELSMGMSNDFHLAAEEGAS

SEQ ID NO: 2032649 - protein, 19 aa, Staphylococcus
NYDAIILAAAGLKRMGWSD

SEQ ID NO: 2032650 - protein, 17 aa, Staphylococcus
NYDEFESWSALILQAKQ

SEQ ID NO: 2032651 - protein, 18 aa, Staphylococcus
NYDIFDFNLELTDIAEID

SEQ ID NO: 2032652 - protein, 19 aa, Staphylococcus
NYDTLLIGIEMSRKTLYSR

SEQ ID NO: 2032653 - protein, 19 aa, Staphylococcus
NYDTLLIGVEMSREILYQR

SEQ ID NO: 2032654 - protein, 19 aa, Staphylococcus
NYDTLLLGIEMSRDILYQR

SEQ ID NO: 2032655 - protein, 19 aa, Staphylococcus
NYDTLLVGIEMSRETLYEK

SEQ ID NO: 2032656 - protein, 20 aa, Staphylococcus
NYDVKLAKQFSHILDDFKSY

SEQ ID NO: 2032657 - protein, 23 aa, Staphylococcus
NYDYPKQAYAFFDHKKVKVVLNN

SEQ ID NO: 2032658 - protein, 18 aa, Staphylococcus
NYEALLVYYKNSFDNPVV

SEQ ID NO: 2032659 - protein, 17 aa, Staphylococcus
NYEDVYQNFDWNEVEKA

SEQ ID NO: 2032660 - protein, 18 aa, Staphylococcus
NYEEVYILNYIARSKTNE

SEQ ID NO: 2032661 - protein, 18 aa, Staphylococcus
NYEFRYSRIDSQSVFPDI

SEQ ID NO: 2032662 - protein, 17 aa, Staphylococcus
NYEGFYHLMHFNGNVEK

SEQ ID NO: 2032663 - protein, 23 aa, Staphylococcus
NYEHILLIPVFFYDGFLVNKIKK

SEQ ID NO: 2032664 - protein, 25 aa, Staphylococcus
NYEPSLQYFNEWWKQLYGESEGKDF

SEQ ID NO: 2032665 - protein, 25 aa, Staphylococcus
NYEPSMQYFNEWWKQLFGESEGKDY

SEQ ID NO: 2032666 - protein, 17 aa, Staphylococcus
NYFALPFGEQYAKESAK

SEQ ID NO: 2032667 - protein, 27 aa, Staphylococcus
NYFKVERLKGVFAWGFRIKSAEPEEGL

SEQ ID NO: 2032668 - protein, 27 aa, Staphylococcus
NYFLLLWSLTLKYLFGKNDILFGVTTS

SEQ ID NO: 2032669 - protein, 29 aa, Staphylococcus
NYFPENRARLAIYPAAMRYAGPREAILHA

SEQ ID NO: 2032670 - protein, 23 aa, Staphylococcus
NYHLKNKFGQKIFKVAIDGGFDC

SEQ ID NO: 2032671 - protein, 22 aa, Staphylococcus
NYHLKNKFGQKIFKVALDGGFD

SEQ ID NO: 2032672 - protein, 19 aa, Staphylococcus
NYIEYGIALDSNWNITFLP

SEQ ID NO: 2032673 - protein, 20 aa, Staphylococcus
NYIKARLKDRYEIPYEQYCK

SEQ ID NO: 2032674 - protein, 27 aa, Staphylococcus
NYIKTELKKRFAITIAGGQGHLKGEIL

SEQ ID NO: 2032675 - protein, 17 aa, Staphylococcus
NYINAGIVLADAGEIEK

SEQ ID NO: 2032676 - protein, 18 aa, Staphylococcus
NYINAGIVLADINEIEKA

SEQ ID NO: 2032677 - protein, 18 aa, Staphylococcus
NYINFQFDMPVADGSQEM

SEQ ID NO: 2032678 - protein, 19 aa, Staphylococcus
NYIRFSYSYIDESDIDRSL

SEQ ID NO: 2032679 - protein, 19 aa, Staphylococcus
NYIWVCARPEQTVIPGNAI

SEQ ID NO: 2032680 - protein, 24 aa, Staphylococcus
NYKAMTHAICNRCEGYSNEYDLQS

SEQ ID NO: 2032681 - protein, 23 aa, Staphylococcus
NYKDVIDILELEGVISKSTQQHV

SEQ ID NO: 2032682 - protein, 17 aa, Staphylococcus
NYKDVIDILELENVISK

SEQ ID NO: 2032683 - protein, 28 aa, Staphylococcus
NYKLLSGSIIPRPIAFVTSSDIEGNVNA

SEQ ID NO: 2032684 - protein, 27 aa, Staphylococcus
NYKLLSGSVIPRPIAFVTSEDEKGNLN

SEQ ID NO: 2032685 - protein, 26 aa, Staphylococcus
NYKNVKPRILVEPFLDMTQFNDYKFF

SEQ ID NO: 2032686 - protein, 21 aa, Staphylococcus
NYKPLNIRYAYNKNMTLPSND

SEQ ID NO: 2032687 - protein, 19 aa, Staphylococcus
NYLEQRYLLNIERENVISM

SEQ ID NO: 2032688 - protein, 22 aa, Staphylococcus
NYLFKHMMDEAVGEIVYDDAAQ

SEQ ID NO: 2032689 - protein, 18 aa, Staphylococcus
NYLKAKGLNSHFIEQISE

SEQ ID NO: 2032690 - protein, 24 aa, Staphylococcus
NYLKDGLKKLGFDIGNSESPITPV

SEQ ID NO: 2032691 - protein, 18 aa, Staphylococcus
NYLKQRGFTDELIQQRGI

SEQ ID NO: 2032692 - protein, 30 aa, Staphylococcus
NYLLGYEESYGFLAGPFVRDKDAIQIVPLI

SEQ ID NO: 2032693 - protein, 27 aa, Staphylococcus
NYLLPYEMPNYVFKVERFPITINGKTD

SEQ ID NO: 2032694 - protein, 20 aa, Staphylococcus
NYLNEKVEFINETFDDLYQN

SEQ ID NO: 2032695 - protein, 25 aa, Staphylococcus
NYMAKEARGLICAPISSQIAERLNL

SEQ ID NO: 2032696 - protein, 22 aa, Staphylococcus
NYMKPREFCLISVLEGHGQVIT

SEQ ID NO: 2032697 - protein, 18 aa, Staphylococcus
NYNPSIFDKRIKEIEKEI

SEQ ID NO: 2032698 - protein, 17 aa, Staphylococcus
NYPEERIKYILDDFNAK

SEQ ID NO: 2032699 - protein, 18 aa, Staphylococcus
NYPLLKKHIEKLSDQLSI

SEQ ID NO: 2032700 - protein, 26 aa, Staphylococcus
NYPRLKLTMHYFKDPLIFKLTKSALL

SEQ ID NO: 2032701 - protein, 20 aa, Staphylococcus
NYRNVHISSVGLRTPSNAGL

SEQ ID NO: 2032702 - protein, 27 aa, Staphylococcus
NYRPKKVMDTLELFKVAFPTDKSYQLS

SEQ ID NO: 2032703 - protein, 23 aa, Staphylococcus
NYSDIKYQLGLIGRNENEKLLKA

SEQ ID NO: 2032704 - protein, 19 aa, Staphylococcus
NYSGRVFLIGHSMGGYAVT

SEQ ID NO: 2032705 - protein, 25 aa, Staphylococcus
NYTGLFRFIQLFVISNKMETRYYAN

SEQ ID NO: 2032706 - protein, 20 aa, Staphylococcus
NYTIEEWKPLFGNLDQLTNE

SEQ ID NO: 2032707 - protein, 24 aa, Staphylococcus
NYTYFLPDIAYHFDKIKRGNDTLI

SEQ ID NO: 2032708 - protein, 24 aa, Staphylococcus
NYTYFLPDIAYHFDKVQRGNDILI

SEQ ID NO: 2032709 - protein, 19 aa, Staphylococcus
NYVDFGIALDSNWNHAFMA

SEQ ID NO: 2032710 - protein, 20 aa, Staphylococcus
NYVMKWKETEIFFDKLMDLL

SEQ ID NO: 2032711 - protein, 19 aa, Staphylococcus
NYVMKWKETEIFFDKLTDL

SEQ ID NO: 2032712 - protein, 22 aa, Staphylococcus
NYVPDIGQFFLFDTTSRIIGSE

SEQ ID NO: 2032713 - protein, 17 aa, Staphylococcus
NYVQYQFDFPIAEKNDN

SEQ ID NO: 2032714 - protein, 20 aa, Staphylococcus
NYYGECFDVASTIKYMKACQ

SEQ ID NO: 2032715 - protein, 30 aa, Staphylococcus
NYYISHQWFPLGPVHGLKYWYTYTSKDLIH

SEQ ID NO: 2032716 - protein, 19 aa, Staphylococcus
PAAQGLHYGQLVFEGLKAY

SEQ ID NO: 2032717 - protein, 18 aa, Staphylococcus
PAARSTVVMALYQMYYKL

SEQ ID NO: 2032718 - protein, 27 aa, Staphylococcus
PAAVSLKLIALCLGRRKRLKWVNQLVY

SEQ ID NO: 2032719 - protein, 20 aa, Staphylococcus
PADKVANAFVKSVEGAQTGQ

SEQ ID NO: 2032720 - protein, 17 aa, Staphylococcus
PADVVAHTVHYCYEHEL

SEQ ID NO: 2032721 - protein, 24 aa, Staphylococcus
PAEACGTWRLVYTRIVALENATLQ

SEQ ID NO: 2032722 - protein, 23 aa, Staphylococcus
PAEDLKPFILLVVDKGEGLKAAE

SEQ ID NO: 2032723 - protein, 19 aa, Staphylococcus
PAERLFKKYADKIRTWEDE

SEQ ID NO: 2032724 - protein, 19 aa, Staphylococcus
PAEYRVCKTNEGLLNIKRT

SEQ ID NO: 2032725 - protein, 19 aa, Staphylococcus
PAFACSSPELLMMHILGKT

SEQ ID NO: 2032726 - protein, 28 aa, Staphylococcus
PAFFTSAFYRKLFDQVLYQSENCMVVGS

SEQ ID NO: 2032727 - protein, 25 aa, Staphylococcus
PAFIADECRLWITVHYLPNECYEDV

SEQ ID NO: 2032728 - protein, 25 aa, Staphylococcus
PAFIADECRLWITVHYLPNERYEDV

SEQ ID NO: 2032729 - protein, 19 aa, Staphylococcus
PAFYTATGVGTEIAEGKET

SEQ ID NO: 2032730 - protein, 19 aa, Staphylococcus
PAGALSVAALEAHKDEIKG

SEQ ID NO: 2032731 - protein, 18 aa, Staphylococcus
PAGALSVAALEDYRESIK

SEQ ID NO: 2032732 - protein, 19 aa, Staphylococcus
PAGALSVSALEFYKDNIIG

SEQ ID NO: 2032733 - protein, 17 aa, Staphylococcus
PAGKDWSKFQEVRDNIK

SEQ ID NO: 2032734 - protein, 30 aa, Staphylococcus
PAGRQFYKFFGENIFRADICNADVDLGDLL

SEQ ID NO: 2032735 - protein, 25 aa, Staphylococcus
PAHIKGLTFNSAVETLKCILPDVRK

SEQ ID NO: 2032736 - protein, 24 aa, Staphylococcus
PAHLESRFLPGRHYATFNLQGEID

SEQ ID NO: 2032737 - protein, 23 aa, Staphylococcus
PAIDCSKVLILKDSEIVNFTKSI

SEQ ID NO: 2032738 - protein, 18 aa, Staphylococcus
PAIDLEKGITHFNDTLAS

SEQ ID NO: 2032739 - protein, 29 aa, Staphylococcus
PAIEGASIRFECKLDRLIELGDDESGNDL

SEQ ID NO: 2032740 - protein, 19 aa, Staphylococcus
PAIGEWLKNYEKLRDEGYT

SEQ ID NO: 2032741 - protein, 19 aa, Staphylococcus
PAIKEVRGRGLFIGIELNE

SEQ ID NO: 2032742 - protein, 25 aa, Staphylococcus
PAIKEVRGRGLFIGMELHESARPFC

SEQ ID NO: 2032743 - protein, 18 aa, Staphylococcus
PAIKEVRGRGLFIGVELH

SEQ ID NO: 2032744 - protein, 18 aa, Staphylococcus
PAILRLVKQVIEASHAEG

SEQ ID NO: 2032745 - protein, 22 aa, Staphylococcus
PAISDERFEAVVANPPYSAKWS

SEQ ID NO: 2032746 - protein, 23 aa, Staphylococcus
PAKFSRFKPLLPGGTVTVGNSCM

SEQ ID NO: 2032747 - protein, 18 aa, Staphylococcus
PAKRIKVGNKLSFGEGKI

SEQ ID NO: 2032748 - protein, 17 aa, Staphylococcus
PAKRIKVGNKLTFGEGK

SEQ ID NO: 2032749 - protein, 18 aa, Staphylococcus
PAKRIKVGNQLSFGEGKI

SEQ ID NO: 2032750 - protein, 18 aa, Staphylococcus
PAKRIKVGQKLSFGEGKI

SEQ ID NO: 2032751 - protein, 39 aa, Staphylococcus
PAKVIRYRFEAHIIERLLKLKWWQYGFADFKGVTADDSI

SEQ ID NO: 2032752 - protein, 20 aa, Staphylococcus
PALFDPAPLYGDREFDIGIT

SEQ ID NO: 2032753 - protein, 17 aa, Staphylococcus
PALIKLSRGEQVDHSSD

SEQ ID NO: 2032754 - protein, 20 aa, Staphylococcus
PALQHPSLYIDIGDHVDLSA

SEQ ID NO: 2032755 - protein, 25 aa, Staphylococcus
PANCLMARIGSRISINQLQEFDNIR

SEQ ID NO: 2032756 - protein, 27 aa, Staphylococcus
PANCLMARIGSRISLDQIKAFDDVRFM

SEQ ID NO: 2032757 - protein, 17 aa, Staphylococcus
PANDFVREFIGQNRLIQ

SEQ ID NO: 2032758 - protein, 18 aa, Staphylococcus
PANDPALFDATVKNVANF

SEQ ID NO: 2032759 - protein, 31 aa, Staphylococcus
PANEGRGYVLRRLLRRAVRFSQTLDINEPFM

SEQ ID NO: 2032760 - protein, 31 aa, Staphylococcus
PANEGRGYVLRRLLRRAVRFSQTLDIQEPFM

SEQ ID NO: 2032761 - protein, 32 aa, Staphylococcus; identical to SEQ ID NO: 1647654

SEQ ID NO: 2032762 - protein, 24 aa, Staphylococcus
PANKDIFKSSGFDTPELENAKPND

SEQ ID NO: 2032763 - protein, 28 aa, Staphylococcus
PANKVATCVKGKFSWGHINSDQRLTKPL

SEQ ID NO: 2032764 - protein, 24 aa, Staphylococcus
PAPELVEGLKIITEFIQNEKANEV

SEQ ID NO: 2032765 - protein, 24 aa, Staphylococcus
PAPELVEGLKIITEFIQNEQANEV

SEQ ID NO: 2032766 - protein, 26 aa, Staphylococcus
PAPFDRRVAPSVARNVAKAAMESGVS

SEQ ID NO: 2032767 - protein, 24 aa, Staphylococcus
PAPYSERTYYEWFHQIANDKAQFE

SEQ ID NO: 2032768 - protein, 24 aa, Staphylococcus
PAQFGGPHCGFFATTKKLMRKIPG

SEQ ID NO: 2032769 - protein, 20 aa, Staphylococcus
PAQIRLKIRNEQIINIEAAQ

SEQ ID NO: 2032770 - protein, 22 aa, Staphylococcus
PAQNLFEKFGFTKAGEAEMDYH

SEQ ID NO: 2032771 - protein, 17 aa, Staphylococcus
PAQPIVRSNTQTVTKQL

SEQ ID NO: 2032772 - protein, 25 aa, Staphylococcus
PARIKCATLAWKALEKGTVEKEGKA

SEQ ID NO: 2032773 - protein, 26 aa, Staphylococcus
PARIKCATLAWKALEKGTVEKEGKAE

SEQ ID NO: 2032774 - protein, 26 aa, Staphylococcus
PARIKCATLAWKALEKGTVEKEGKSE

SEQ ID NO: 2032775 - protein, 26 aa, Staphylococcus
PARIKCATLAWKALEKGTVEKEGNTE

SEQ ID NO: 2032776 - protein, 27 aa, Staphylococcus
PARIKCATLAWKALEKGTVEREGKADA

SEQ ID NO: 2032777 - protein, 25 aa, Staphylococcus
PARIKCATLAWKALEKGTVQKEGKA

SEQ ID NO: 2032778 - protein, 26 aa, Staphylococcus
PARIKCATLAWKALEKGTVQKEGKAE

SEQ ID NO: 2032779 - protein, 24 aa, Staphylococcus
PASDYFAFEACEYRRHFLSYHPDY

SEQ ID NO: 2032780 - protein, 19 aa, Staphylococcus
PASFPAHYKSNIQIYYDSQ

SEQ ID NO: 2032781 - protein, 23 aa, Staphylococcus
PASLYKPKNFFGAARNIEAGGSL

SEQ ID NO: 2032782 - protein, 19 aa, Staphylococcus
PATDRRLKVRGAKSNNLKD

SEQ ID NO: 2032783 - protein, 17 aa, Staphylococcus
PATIFNLNYGKLHKDSY

SEQ ID NO: 2032784 - protein, 18 aa, Staphylococcus
PATIFNLNYGKLHKDSYA

SEQ ID NO: 2032785 - protein, 25 aa, Staphylococcus
PATLTVKIKYALLQEKPKIKSVELN

SEQ ID NO: 2032786 - protein, 17 aa, Staphylococcus
PATMLVQTASKFDSDIQ

SEQ ID NO: 2032787 - protein, 22 aa, Staphylococcus
PATQCLIEKSIAGFKEIEYEVM

SEQ ID NO: 2032788 - protein, 21 aa, Staphylococcus
PATRSAIVMAVYQMYHELSSF

SEQ ID NO: 2032789 - protein, 18 aa, Staphylococcus
PAVAFRLFKQLVENKYGK

SEQ ID NO: 2032790 - protein, 19 aa, Staphylococcus
PAVAFRLFKQLVEQRYGKK

SEQ ID NO: 2032791 - protein, 17 aa, Staphylococcus
PAVFSVDPGESFRMECL

SEQ ID NO: 2032792 - protein, 19 aa, Staphylococcus
PAVHHTMGGLSINTGAQVL

SEQ ID NO: 2032793 - protein, 18 aa, Staphylococcus
PAVLGIYPHTVFELAKRI

SEQ ID NO: 2032794 - protein, 17 aa, Staphylococcus
PAVTMTTSFQLRDALKI

SEQ ID NO: 2032795 - protein, 18 aa, Staphylococcus
PAVTRFVGTGGFEDALET

SEQ ID NO: 2032796 - protein, 26 aa, Staphylococcus
PAYKLKHQFTHLTWDIEVYLADQVIN

SEQ ID NO: 2032797 - protein, 18 aa, Staphylococcus
PAYYTKKVDQIYVNTWHG

SEQ ID NO: 2032798 - protein, 20 aa, Staphylococcus
PCDTLHFLNKVLKIKEDLLV

SEQ ID NO: 2032799 - protein, 23 aa, Staphylococcus
PCEGEYAVGLFFSQKVIVNTRYQ

SEQ ID NO: 2032800 - protein, 24 aa, Staphylococcus
PCEIAHTCAYLWNPLAKSITGTVQ

SEQ ID NO: 2032801 - protein, 22 aa, Staphylococcus
PCETYKFKVIGPFIETNFTLTP

SEQ ID NO: 2032802 - protein, 23 aa, Staphylococcus
PCFNCLMPQLPVINLTCDTAGVI

SEQ ID NO: 2032803 - protein, 19 aa, Staphylococcus
PCFNCVMPQLPVINMTCDT

SEQ ID NO: 2032804 - protein, 21 aa, Staphylococcus
PCGRSLCCSTFLGDFEPVSIK

SEQ ID NO: 2032805 - protein, 24 aa, Staphylococcus
PCGSCRQVIKELCDDDMPIYLTNH

SEQ ID NO: 2032806 - protein, 20 aa, Staphylococcus
PCREGRPALCENGAESNEKG

SEQ ID NO: 2032807 - protein, 20 aa, Staphylococcus
PCSGLGVLRHKPEIKYMQTP

SEQ ID NO: 2032808 - protein, 20 aa, Staphylococcus
PCSGLGVLRHKPEIKYTQSQ

SEQ ID NO: 2032809 - protein, 20 aa, Staphylococcus
PCTELSMGMSNDYQIAVEEG

SEQ ID NO: 2032810 - protein, 18 aa, Staphylococcus
PCYQIIEDMIGQGLHFQP

SEQ ID NO: 2032811 - protein, 24 aa, Staphylococcus
PDADLKVYMIASVEERAVRRQKDN

SEQ ID NO: 2032812 - protein, 17 aa, Staphylococcus
PDAEAFEIVLIEIDYPQ

SEQ ID NO: 2032813 - protein, 24 aa, Staphylococcus
PDAELKIYMIASVEERAERRQKEN

SEQ ID NO: 2032814 - protein, 24 aa, Staphylococcus
PDAELKVYMIASVDERAERRQKEN

SEQ ID NO: 2032815 - protein, 24 aa, Staphylococcus
PDAELKVYMIASVEERAERRQKDN

SEQ ID NO: 2032816 - protein, 20 aa, Staphylococcus
PDAFPVPSDVTFEMSANDFF

SEQ ID NO: 2032817 - protein, 18 aa, Staphylococcus
PDAIFGLATGSTMVDLYP

SEQ ID NO: 2032818 - protein, 17 aa, Staphylococcus
PDAILSISDEQAIGIVH

SEQ ID NO: 2032819 - protein, 21 aa, Staphylococcus
PDAKLFILLVGERPEEVTDIE

SEQ ID NO: 2032820 - protein, 17 aa, Staphylococcus
PDATIRFLVGGTQTNQV

SEQ ID NO: 2032821 - protein, 25 aa, Staphylococcus
PDCGTGIIHSLPLAFTNIVNKGDIG

SEQ ID NO: 2032822 - protein, 17 aa, Staphylococcus
PDCKAMDMWIDPIVDKY

SEQ ID NO: 2032823 - protein, 18 aa, Staphylococcus
PDCSPEMAAMIGSSMALS

SEQ ID NO: 2032824 - protein, 20 aa, Staphylococcus
PDDFPVKIVTGAHSTGASVL

SEQ ID NO: 2032825 - protein, 20 aa, Staphylococcus
PDDHFVVIVSGAFGNRFKQI

SEQ ID NO: 2032826 - protein, 18 aa, Staphylococcus
PDDHMVKIVTGARSGDAQ

SEQ ID NO: 2032827 - protein, 17 aa, Staphylococcus
PDDYTVWIVDGARSTGA

SEQ ID NO: 2032828 - protein, 25 aa, Staphylococcus
PDEGWQWNDGFVKMDTLQVDANDLI

SEQ ID NO: 2032829 - protein, 19 aa, Staphylococcus
PDEIRLLESEVGILPRAHG

SEQ ID NO: 2032830 - protein, 19 aa, Staphylococcus
PDEKYVVAMDLGTDKVITY

SEQ ID NO: 2032831 - protein, 24 aa, Staphylococcus
PDEVWKERIALLEPYRVDQAMIEK

SEQ ID NO: 2032832 - protein, 26 aa, Staphylococcus
PDFDKVIKYESVFNFDEMVQRAADNI

SEQ ID NO: 2032833 - protein, 25 aa, Staphylococcus
PDFDKVVKYESVFNFDDLVQEAADN

SEQ ID NO: 2032834 - protein, 25 aa, Staphylococcus
PDFDYPFKYLCGAGVAYKLSQALLS

SEQ ID NO: 2032835 - protein, 20 aa, Staphylococcus
PDFLGDYYFFLIETGQIEQA

SEQ ID NO: 2032836 - protein, 18 aa, Staphylococcus
PDFSTKVLEMLIAEHDVI

SEQ ID NO: 2032837 - protein, 24 aa, Staphylococcus
PDFSTQLLDRFLVIAHSYHMRPRI

SEQ ID NO: 2032838 - protein, 19 aa, Staphylococcus
PDGKLSCGEPGQKLETFIT

SEQ ID NO: 2032839 - protein, 31 aa, Staphylococcus
PDGLYLSGALLMFCGKKAYYLYGASSNDYRD

SEQ ID NO: 2032840 - protein, 19 aa, Staphylococcus
PDGNHVLAIPLYKNQLLFT

SEQ ID NO: 2032841 - protein, 18 aa, Staphylococcus
PDGQIFFIEVKKPGGKIR

SEQ ID NO: 2032842 - protein, 19 aa, Staphylococcus
PDGRSFVLADLPGLIEGAS

SEQ ID NO: 2032843 - protein, 17 aa, Staphylococcus
PDHEKYVTERGVYDDVM

SEQ ID NO: 2032844 - protein, 18 aa, Staphylococcus
PDHKVTVFAGQDKEATQA

SEQ ID NO: 2032845 - protein, 28 aa, Staphylococcus
PDHLKDFIKVGVRVVVPFGPRTIQGYVM

SEQ ID NO: 2032846 - protein, 19 aa, Staphylococcus
PDIAQGLILTGTGQYPKYK

SEQ ID NO: 2032847 - protein, 20 aa, Staphylococcus
PDIARHLACIVRHQPYLADN

SEQ ID NO: 2032848 - protein, 18 aa, Staphylococcus
PDIEPQCMASLETLLERD

SEQ ID NO: 2032849 - protein, 17 aa, Staphylococcus
PDIILSVHGVDIHYRDP

SEQ ID NO: 2032850 - protein, 17 aa, Staphylococcus
PDIKKVIFLVDRKDLDG

SEQ ID NO: 2032851 - protein, 24 aa, Staphylococcus
PDIKTKKALKVFVYDYGISTLSYI

SEQ ID NO: 2032852 - protein, 25 aa, Staphylococcus
PDILRARPKPVVQWSNETIEETTDI

SEQ ID NO: 2032853 - protein, 19 aa, Staphylococcus
PDIPEKVLINASVSIAEGI

SEQ ID NO: 2032854 - protein, 17 aa, Staphylococcus
PDIVIDGMDHFKIRYLI

SEQ ID NO: 2032855 - protein, 25 aa, Staphylococcus
PDIYFKRINYYNYLLLCSDGLTDYI

SEQ ID NO: 2032856 - protein, 23 aa, Staphylococcus
PDKKCESCGCDLIKEGQDIPFET

SEQ ID NO: 2032857 - protein, 18 aa, Staphylococcus
PDKKCETCGSELIKEGQD

SEQ ID NO: 2032858 - protein, 20 aa, Staphylococcus
PDKKCPTCGNELIKEGQDIP

SEQ ID NO: 2032859 - protein, 17 aa, Staphylococcus
PDKKGYRKYKIKTVKGP

SEQ ID NO: 2032860 - protein, 18 aa, Staphylococcus
PDKLRQTGVKVFGPNKDA

SEQ ID NO: 2032861 - protein, 24 aa, Staphylococcus
PDKLWPIQPLRDFWGINKRTEAKL

SEQ ID NO: 2032862 - protein, 20 aa, Staphylococcus
PDKQCSTCGAELIKEGQDIP

SEQ ID NO: 2032863 - protein, 18 aa, Staphylococcus
PDKTEFDDMISLMSMHKK

SEQ ID NO: 2032864 - protein, 19 aa, Staphylococcus
PDLAIAVDVAVAFDTPGMS

SEQ ID NO: 2032865 - protein, 18 aa, Staphylococcus
PDLAIAVDVAVAYDTPGM

SEQ ID NO: 2032866 - protein, 18 aa, Staphylococcus
PDLAIAVDVGIAYDTPGM

SEQ ID NO: 2032867 - protein, 19 aa, Staphylococcus
PDLAIAVDVGVAYDVPGMT

SEQ ID NO: 2032868 - protein, 24 aa, Staphylococcus
PDLEALLKYYRLSKEEFIQLHSKS

SEQ ID NO: 2032869 - protein, 19 aa, Staphylococcus
PDLEDAYILILGAGGASKG

SEQ ID NO: 2032870 - protein, 24 aa, Staphylococcus
PDLEEYKKASGLTYDETSLYTFHE

SEQ ID NO: 2032871 - protein, 21 aa, Staphylococcus
PDLEFEFISWLVTGVKDHEVV

SEQ ID NO: 2032872 - protein, 19 aa, Staphylococcus
PDLIKSAAYPNILPSSTNP

SEQ ID NO: 2032873 - protein, 21 aa, Staphylococcus
PDLIVTAAFGQILPKSLLDAP

SEQ ID NO: 2032874 - protein, 23 aa, Staphylococcus
PDLKNGKIINQWSGIRPYCQNEQ

SEQ ID NO: 2032875 - protein, 29 aa, Staphylococcus
PDLPELLKHLKLKLSDFIQLHTGANYFVS

SEQ ID NO: 2032876 - protein, 23 aa, Staphylococcus
PDLPRPVGEDIVHYSDYFEGAQK

SEQ ID NO: 2032877 - protein, 25 aa, Staphylococcus
PDLPRPVGTDIVHFSDYFEGAQKYL

SEQ ID NO: 2032878 - protein, 21 aa, Staphylococcus
PDLSAGCSMADMANITQALHG

SEQ ID NO: 2032879 - protein, 19 aa, Staphylococcus
PDLSASAIAQFIRRDIWEK

SEQ ID NO: 2032880 - protein, 27 aa, Staphylococcus
PDLVKVLGRLNYRTSYGQNVLKHSIEV

SEQ ID NO: 2032881 - protein, 20 aa, Staphylococcus
PDLVNLLTFIVNQKLTAQDL

SEQ ID NO: 2032882 - protein, 17 aa, Staphylococcus
PDMIFPAIEEMRLPIEY

SEQ ID NO: 2032883 - protein, 22 aa, Staphylococcus
PDNFKIKPEWLIELDKCANRDT

SEQ ID NO: 2032884 - protein, 26 aa, Staphylococcus
PDNGIKFFGSDGFKLSDDQEQEIEHL

SEQ ID NO: 2032885 - protein, 24 aa, Staphylococcus
PDNILRHPANDFVRDFIGQNRLIQ

SEQ ID NO: 2032886 - protein, 24 aa, Staphylococcus
PDNPLKQKVCDVALEAFEAAMTRV

SEQ ID NO: 2032887 - protein, 24 aa, Staphylococcus
PDNSIKAAGGFIIQVMPGAKEETI

SEQ ID NO: 2032888 - protein, 24 aa, Staphylococcus
PDNSIKAAGGFIIQVMPNAKEETI

SEQ ID NO: 2032889 - protein, 24 aa, Staphylococcus
PDNSIKAAGGFVIQVMPGASNDTI

SEQ ID NO: 2032890 - protein, 24 aa, Staphylococcus
PDNSIKASGGFLIQVMPGAEDETI

SEQ ID NO: 2032891 - protein, 24 aa, Staphylococcus
PDNTIKAAGGFIIQVMPGAKEETI

SEQ ID NO: 2032892 - protein, 20 aa, Staphylococcus
PDNVIKKFVHESANAGVDVF

SEQ ID NO: 2032893 - protein, 36 aa, Staphylococcus
PDPDKRNTIRYVRNEQKLYVFNGSDWLEFEEANYDP

SEQ ID NO: 2032894 - protein, 22 aa, Staphylococcus
PDPEIFKATTTFNFETLSERLQ

SEQ ID NO: 2032895 - protein, 19 aa, Staphylococcus
PDPELYLTAVQRLNYSPAH

SEQ ID NO: 2032896 - protein, 17 aa, Staphylococcus
PDPLELIVAQSQMQIAK

SEQ ID NO: 2032897 - protein, 17 aa, Staphylococcus
PDPLVYAYCYMWNENCN

SEQ ID NO: 2032898 - protein, 19 aa, Staphylococcus
PDQIAGIGITNQRETTVVW

SEQ ID NO: 2032899 - protein, 25 aa, Staphylococcus
PDQLDKCFYKYYGLNKLMNLLLKEK

SEQ ID NO: 2032900 - protein, 24 aa, Staphylococcus
PDQLHDIKTSIAFKDLPTYLDKII

SEQ ID NO: 2032901 - protein, 25 aa, Staphylococcus
PDRDIPRFVSLYKQGRLNIDPLISE

SEQ ID NO: 2032902 - protein, 23 aa, Staphylococcus
PDRDIPRFVSLYQQERLNIDPLI

SEQ ID NO: 2032903 - protein, 19 aa, Staphylococcus
PDRIGGVKKNNFINREENN

SEQ ID NO: 2032904 - protein, 40 aa, Staphylococcus
PDSEVKCITPADIIASMSYFFNLLSGIGFTDDIDHLGNRR

SEQ ID NO: 2032905 - protein, 33 aa, Staphylococcus
PDSEVKCITPADIVASMSYFFNLLHGIGQTDDI

SEQ ID NO: 2032906 - protein, 23 aa, Staphylococcus
PDSKLPMQVSIAILEGLNQRVVE

SEQ ID NO: 2032907 - protein, 20 aa, Staphylococcus
PDSLGICIHTSYGSIVYTGE

SEQ ID NO: 2032908 - protein, 19 aa, Staphylococcus
PDSRSFVMADLPGLIEGAS

SEQ ID NO: 2032909 - protein, 24 aa, Staphylococcus
PDSVFKQKGLQVFGLTASPQYIAN

SEQ ID NO: 2032910 - protein, 19 aa, Staphylococcus
PDTFILGTVGGFRSLQQEE

SEQ ID NO: 2032911 - protein, 24 aa, Staphylococcus
PDTGELKGALGVEKIFDSYLSGTK

SEQ ID NO: 2032912 - protein, 33 aa, Staphylococcus
PDTGFYRFWYQGLVQRWPDMDIEDLIAAQQNHP

SEQ ID NO: 2032913 - protein, 18 aa, Staphylococcus
PDTLLTMCYADCVPVYFY

SEQ ID NO: 2032914 - protein, 18 aa, Staphylococcus
PDTMNFHIARSMENLLTS

SEQ ID NO: 2032915 - protein, 19 aa, Staphylococcus
PDTSIIVSDIIKLLNDYEQ

SEQ ID NO: 2032916 - protein, 18 aa, Staphylococcus
PDVLEINEVLALLETPNL

SEQ ID NO: 2032917 - protein, 31 aa, Staphylococcus
PDVREAVFKMMNWWFEKGIDGFRVDAITHIK

SEQ ID NO: 2032918 - protein, 20 aa, Staphylococcus
PDVSIPKERGFLPGNGAITS

SEQ ID NO: 2032919 - protein, 22 aa, Staphylococcus
PDVSIPKERGFLPGNGAITSVV

SEQ ID NO: 2032920 - protein, 17 aa, Staphylococcus
PDVVEKLALLKGNEFDV

SEQ ID NO: 2032921 - protein, 25 aa, Staphylococcus
PDVYSDVYLPVSYRVRKNGNNKTVQ

SEQ ID NO: 2032922 - protein, 22 aa, Staphylococcus
PDVYTNPQIMSWMMDEYSKINR

SEQ ID NO: 2032923 - protein, 19 aa, Staphylococcus
PDWLYCAKANLVLQPAYTG

SEQ ID NO: 2032924 - protein, 17 aa, Staphylococcus
PDYDRPWNYLNVLAQQA

SEQ ID NO: 2032925 - protein, 18 aa, Staphylococcus
PDYDRPWNYLNVLAQQAL

SEQ ID NO: 2032926 - protein, 19 aa, Staphylococcus
PDYETRMAILQKKIGEENL

SEQ ID NO: 2032927 - protein, 19 aa, Staphylococcus
PDYETRMAILQKKLEEEDV

SEQ ID NO: 2032928 - protein, 19 aa, Staphylococcus
PDYETRMAILQKKMEEENL

SEQ ID NO: 2032929 - protein, 26 aa, Staphylococcus
PDYIAGLSILGGEPFCNLDTVECIIQ

SEQ ID NO: 2032930 - protein, 21 aa, Staphylococcus
PDYIAGLSILGGEPFCNVDIT

SEQ ID NO: 2032931 - protein, 18 aa, Staphylococcus
PDYLKGKVKLRGMDPKVV

SEQ ID NO: 2032932 - protein, 23 aa, Staphylococcus
PDYMVRPPFFIEWNKNKVDHMQN

SEQ ID NO: 2032933 - protein, 17 aa, Staphylococcus
PDYQRLTVSSLDYKDIS

SEQ ID NO: 2032934 - protein, 19 aa, Staphylococcus
PEAAHIVFNSGLPITMVGL

SEQ ID NO: 2032935 - protein, 25 aa, Staphylococcus
PEAALKICNYCFEHGVVIIAVAGNV

SEQ ID NO: 2032936 - protein, 21 aa, Staphylococcus
PEAFIKPVPHMSFVQGIKNVD

SEQ ID NO: 2032937 - protein, 20 aa, Staphylococcus
PEAFVPHLQQFDARVSNGTG

SEQ ID NO: 2032938 - protein, 24 aa, Staphylococcus
PEAGETVMGTSFFTNPGGKGANQA

SEQ ID NO: 2032939 - protein, 24 aa, Staphylococcus
PEAHVCTIRQIFKTNLQAEQLSTS

SEQ ID NO: 2032940 - protein, 26 aa, Staphylococcus
PEALAKKLPMALFHEGIGIVEDSKHP

SEQ ID NO: 2032941 - protein, 17 aa, Staphylococcus
PEALARLRKNKMILESS

SEQ ID NO: 2032942 - protein, 22 aa, Staphylococcus
PEALLKPLFRHLTETYSEAMAH

SEQ ID NO: 2032943 - protein, 17 aa, Staphylococcus
PEALLLPLFQNLKQTFP

SEQ ID NO: 2032944 - protein, 21 aa, Staphylococcus
PEALTSPLLTAEWEEKLTRIE

SEQ ID NO: 2032945 - protein, 19 aa, Staphylococcus
PEAMCVCGTGGDKSNSFNI

SEQ ID NO: 2032946 - protein, 19 aa, Staphylococcus
PEANIGVAHGRMTERELED

SEQ ID NO: 2032947 - protein, 21 aa, Staphylococcus
PEAPLKALIFDSEYDPYRGVI

SEQ ID NO: 2032948 - protein, 19 aa, Staphylococcus
PEATVRFLIGGTQTNQVVI

SEQ ID NO: 2032949 - protein, 17 aa, Staphylococcus
PEATVRFLVGGTQTNQV

SEQ ID NO: 2032950 - protein, 19 aa, Staphylococcus
PEATVRFLVGGTQTNQVVI

SEQ ID NO: 2032951 - protein, 21 aa, Staphylococcus
PEAVKMAPLIQALKHDDALEP

SEQ ID NO: 2032952 - protein, 21 aa, Staphylococcus
PEAYPVMKYIQPVRKMIGKPT

SEQ ID NO: 2032953 - protein, 21 aa, Staphylococcus
PEDADTILALKAIKNNTKLDL

SEQ ID NO: 2032954 - protein, 19 aa, Staphylococcus
PEDEVCILYGTKNGLVALP

SEQ ID NO: 2032955 - protein, 18 aa, Staphylococcus
PEDFHVFRKLNKVLEKRR

SEQ ID NO: 2032956 - protein, 24 aa, Staphylococcus
PEDGFKTQNFVAGAPLSPDEIQEN

SEQ ID NO: 2032957 - protein, 21 aa, Staphylococcus
PEDLTELVLTLGSQMVVLAEK

SEQ ID NO: 2032958 - protein, 21 aa, Staphylococcus
PEDLTELVLTLGSQMVVLAER

SEQ ID NO: 2032959 - protein, 21 aa, Staphylococcus
PEDLTELVLTLGSQMVVLANR

SEQ ID NO: 2032960 - protein, 21 aa, Staphylococcus
PEDLTELVLTLGSQMVVLGQQ

SEQ ID NO: 2032961 - protein, 34 aa, Staphylococcus
PEDNQVLHFFVRYGGEFQLKQGFSPAFNVENKSD

SEQ ID NO: 2032962 - protein, 17 aa, Staphylococcus
PEDQVPVKIVGKMTLNR

SEQ ID NO: 2032963 - protein, 20 aa, Staphylococcus
PEDRLFPFICKIDDKEEIDK

SEQ ID NO: 2032964 - protein, 22 aa, Staphylococcus
PEDVARAVAFYASDDSDYITGS

SEQ ID NO: 2032965 - protein, 19 aa, Staphylococcus
PEDYRICLDHMKPDKPLIK

SEQ ID NO: 2032966 - protein, 20 aa, Staphylococcus
PEEAPGVGMRFIQINEIKLA

SEQ ID NO: 2032967 - protein, 27 aa, Staphylococcus
PEEELERYKKEILNDNYLVVATKDTTS

SEQ ID NO: 2032968 - protein, 26 aa, Staphylococcus
PEEEWWNWKGHRAHLDTFRNKNADAK

SEQ ID NO: 2032969 - protein, 19 aa, Staphylococcus
PEEFDTCPLLLTQPSLDRW

SEQ ID NO: 2032970 - protein, 24 aa, Staphylococcus
PEEFIRPLPHISFVRGKNNVQFLK

SEQ ID NO: 2032971 - protein, 30 aa, Staphylococcus
PEEIAFESNTSWPLALPVFKMDYAHKEYEA

SEQ ID NO: 2032972 - protein, 24 aa, Staphylococcus
PEEIKRTFDKLGIPEAEQKYLAGV

SEQ ID NO: 2032973 - protein, 18 aa, Staphylococcus
PEEIQAMGGKVTHTNHSN

SEQ ID NO: 2032974 - protein, 18 aa, Staphylococcus
PEEITFETNTSWPLALPV

SEQ ID NO: 2032975 - protein, 22 aa, Staphylococcus
PEELRSKISYMMQQSELFGTTV

SEQ ID NO: 2032976 - protein, 17 aa, Staphylococcus
PEELRTHLINEYSIGII

SEQ ID NO: 2032977 - protein, 19 aa, Staphylococcus
PEERLFRKYAHKIRNWNED

SEQ ID NO: 2032978 - protein, 22 aa, Staphylococcus
PEERLFRKYAHTIRNWDDEKQS

SEQ ID NO: 2032979 - protein, 27 aa, Staphylococcus
PEETAKAFSGEFFLTGDLAKIDEDGDV

SEQ ID NO: 2032980 - protein, 28 aa, Staphylococcus
PEEYPQLTIRVSGYAVNFIKLTREQQLD

SEQ ID NO: 2032981 - protein, 25 aa, Staphylococcus
PEFDYPFKYLCGAGVAYKLAQALLE

SEQ ID NO: 2032982 - protein, 23 aa, Staphylococcus
PEFDYPFKYLCGAGVAYKLAQNL

SEQ ID NO: 2032983 - protein, 24 aa, Staphylococcus
PEFEYPFKYLCGAGVAYKLSQCLI

SEQ ID NO: 2032984 - protein, 18 aa, Staphylococcus
PEFGQHSLMGRSGQPVEL

SEQ ID NO: 2032985 - protein, 20 aa, Staphylococcus
PEFIKAYPGIELKLIEEPSH

SEQ ID NO: 2032986 - protein, 19 aa, Staphylococcus
PEFKDFRHSFSQKAPEGES

SEQ ID NO: 2032987 - protein, 24 aa, Staphylococcus
PEFKNKDMRLAIAQSVNKKDYVNE

SEQ ID NO: 2032988 - protein, 21 aa, Staphylococcus
PEFLNRIDEFITFKPLDQQEI

SEQ ID NO: 2032989 - protein, 21 aa, Staphylococcus
PEFNYPFKYLSGAGVALKIAQ

SEQ ID NO: 2032990 - protein, 17 aa, Staphylococcus
PEFRRKSFEAFSNALRK

SEQ ID NO: 2032991 - protein, 19 aa, Staphylococcus
PEFTLDYDVDPVRQAIADT

SEQ ID NO: 2032992 - protein, 21 aa, Staphylococcus
PEFTNKLSFSDEVIEKIAGIA

SEQ ID NO: 2032993 - protein, 18 aa, Staphylococcus
PEGAAALLWKDSNLAKIA

SEQ ID NO: 2032994 - protein, 19 aa, Staphylococcus
PEGAAALLWKDSNLAKIAA

SEQ ID NO: 2032995 - protein, 17 aa, Staphylococcus
PEGAAALLWKDSNLSKI

SEQ ID NO: 2032996 - protein, 22 aa, Staphylococcus
PEGIEGRIAYKGLLQDNIYQLM

SEQ ID NO: 2032997 - protein, 26 aa, Staphylococcus
PEGIYLSGALLMFAGKKSYYLYGASS

SEQ ID NO: 2032998 - protein, 23 aa, Staphylococcus
PEGKASLMRLVRHLNEDKNVTII

SEQ ID NO: 2032999 - protein, 19 aa, Staphylococcus
PEGKGQVIGLNILDISMQV

SEQ ID NO: 2033000 - protein, 19 aa, Staphylococcus
PEGKNIWFGVREFAMGAAV

SEQ ID NO: 2033001 - protein, 22 aa, Staphylococcus
PEGLKSLIDHNDFEVVIDTELD

SEQ ID NO: 2033002 - protein, 17 aa, Staphylococcus
PEGLSIMQLNELLEDVP

SEQ ID NO: 2033003 - protein, 21 aa, Staphylococcus
PEGLVPLLKIQGLGSKKIAKL

SEQ ID NO: 2033004 - protein, 23 aa, Staphylococcus
PEGTEFIYTPYIVKAYTGTHTSS

SEQ ID NO: 2033005 - protein, 21 aa, Staphylococcus
PEGVLIRAIEPLDGIEMMKHN

SEQ ID NO: 2033006 - protein, 19 aa, Staphylococcus
PEHAFSFKNKQYFRNGLWK

SEQ ID NO: 2033007 - protein, 23 aa, Staphylococcus
PEHLKAVITRFIEKYKIATPIKV

SEQ ID NO: 2033008 - protein, 18 aa, Staphylococcus
PEHLKSIVTRFVDKHHIE

SEQ ID NO: 2033009 - protein, 20 aa, Staphylococcus
PEHRQELLNLFSTIKDIEEK

SEQ ID NO: 2033010 - protein, 21 aa, Staphylococcus
PEHYTSFKAGIQIRFYAVQAL

SEQ ID NO: 2033011 - protein, 19 aa, Staphylococcus
PEIFATRGEQHFRELEYHY

SEQ ID NO: 2033012 - protein, 17 aa, Staphylococcus
PEIGKTLTLQQFPEDIQ

SEQ ID NO: 2033013 - protein, 19 aa, Staphylococcus
PEIIRLSATIKACDKYFNQ

SEQ ID NO: 2033014 - protein, 21 aa, Staphylococcus
PEIKANVVYRDGNIEITLEDE

SEQ ID NO: 2033015 - protein, 21 aa, Staphylococcus
PEILADFYSSGVIEVLRRWVE

SEQ ID NO: 2033016 - protein, 24 aa, Staphylococcus
PEILHRFKGRLGYKVMKYPLNLSG

SEQ ID NO: 2033017 - protein, 19 aa, Staphylococcus
PEINNALVVDVERDEGTVS

SEQ ID NO: 2033018 - protein, 22 aa, Staphylococcus
PEIRMPKIGGRVMSLQEPTKKM

SEQ ID NO: 2033019 - protein, 19 aa, Staphylococcus
PEIVLMYELLDPIDYHQLP

SEQ ID NO: 2033020 - protein, 19 aa, Staphylococcus
PEIYRALDANVLFNKVAMR

SEQ ID NO: 2033021 - protein, 23 aa, Staphylococcus
PEKAKLACLTIDTSMSHLDDIAK

SEQ ID NO: 2033022 - protein, 18 aa, Staphylococcus
PEKCLSLALLSPALGGWK

SEQ ID NO: 2033023 - protein, 20 aa, Staphylococcus
PEKIGGFWFSSSSERWEQGK

SEQ ID NO: 2033024 - protein, 17 aa, Staphylococcus
PEKKGYRKYKIKTVEGP

SEQ ID NO: 2033025 - protein, 21 aa, Staphylococcus
PEKLPIAVHSWGYIAETDEDA

SEQ ID NO: 2033026 - protein, 22 aa, Staphylococcus
PEKLSNYIAKWFRENNVKVVPN

SEQ ID NO: 2033027 - protein, 22 aa, Staphylococcus
PEKLSNYIAKWFRENNVNVVPN

SEQ ID NO: 2033028 - protein, 23 aa, Staphylococcus
PEKLSNYIATWFKKHDVTVVPNS

SEQ ID NO: 2033029 - protein, 24 aa, Staphylococcus
PEKTEGYEGFFHLMNFNGTTEKAQ

SEQ ID NO: 2033030 - protein, 20 aa, Staphylococcus
PEKTTPVFVRFSTVQGSKGS

SEQ ID NO: 2033031 - protein, 22 aa, Staphylococcus
PEKVPYYSARVVKNVKIAPSPV

SEQ ID NO: 2033032 - protein, 21 aa, Staphylococcus
PEKVPYYSARVVKNVRIAPSP

SEQ ID NO: 2033033 - protein, 23 aa, Staphylococcus
PEKVPYYSARVVKNVSIEPSPIW

SEQ ID NO: 2033034 - protein, 21 aa, Staphylococcus
PEKYRSYFIGDWYISGDSAYK

SEQ ID NO: 2033035 - protein, 21 aa, Staphylococcus
PEKYYTLSIKVDGYDFQLDSN

SEQ ID NO: 2033036 - protein, 20 aa, Staphylococcus
PELFDIEPILDRGTKTLEYI

SEQ ID NO: 2033037 - protein, 17 aa, Staphylococcus
PELIVLDVMLPKKDGIE

SEQ ID NO: 2033038 - protein, 21 aa, Staphylococcus
PELKPSYTKEAPVDKTAHPNE

SEQ ID NO: 2033039 - protein, 18 aa, Staphylococcus
PELLEAFPFQEVHGTKIV

SEQ ID NO: 2033040 - protein, 21 aa, Staphylococcus
PELLEKLRVKSEMFKNEKLRG

SEQ ID NO: 2033041 - protein, 21 aa, Staphylococcus
PELLEKYYVIYKGHIEGDDAI

SEQ ID NO: 2033042 - protein, 19 aa, Staphylococcus
PELLVKWAGTDFNYPLDEE

SEQ ID NO: 2033043 - protein, 18 aa, Staphylococcus
PELMEFSSLATYGSLTEP

SEQ ID NO: 2033044 - protein, 17 aa, Staphylococcus
PELNGKLHGIALRVPTQ

SEQ ID NO: 2033045 - protein, 19 aa, Staphylococcus
PELNQVVGHTLMVTDGTSL

SEQ ID NO: 2033046 - protein, 17 aa, Staphylococcus
PELPNTIEVLGKEKVLS

SEQ ID NO: 2033047 - protein, 17 aa, Staphylococcus
PELPNTIEVLGKEKVLT

SEQ ID NO: 2033048 - protein, 17 aa, Staphylococcus
PELPRPIGEDIVHYSDY

SEQ ID NO: 2033049 - protein, 21 aa, Staphylococcus
PELRDRLAVRHGRYIEQDADD

SEQ ID NO: 2033050 - protein, 31 aa, Staphylococcus
PELRFPEFKGEWVRKKLKNIASFGKGKSLSK

SEQ ID NO: 2033051 - protein, 20 aa, Staphylococcus
PELRFPGFEDEWKNNELGKL

SEQ ID NO: 2033052 - protein, 23 aa, Staphylococcus
PELSDNFVALDFTYDMPLTTYLG

SEQ ID NO: 2033053 - protein, 23 aa, Staphylococcus
PELSGPWLSLQMFTRSFIPKSVG

SEQ ID NO: 2033054 - protein, 25 aa, Staphylococcus
PELWKHVDTFVLPKDYIRYGLTGQI

SEQ ID NO: 2033055 - protein, 19 aa, Staphylococcus
PELYFAFLGILKVGAIVGP

SEQ ID NO: 2033056 - protein, 18 aa, Staphylococcus
PEMAHATYTFYFKAPGNF

SEQ ID NO: 2033057 - protein, 19 aa, Staphylococcus
PEMFDGVLNHSILKRAQDK

SEQ ID NO: 2033058 - protein, 17 aa, Staphylococcus
PEMFKDVTDLGVHCTVV

SEQ ID NO: 2033059 - protein, 23 aa, Staphylococcus
PEMGRVACRADYVIFTPDNPAND

SEQ ID NO: 2033060 - protein, 23 aa, Staphylococcus
PEMGVSFSTPFPAIENINDERAY

SEQ ID NO: 2033061 - protein, 19 aa, Staphylococcus
PEMNGIEITEWMKKKYPNV

SEQ ID NO: 2033062 - protein, 19 aa, Staphylococcus
PEMNGIEVTEFLKKNYSDI

SEQ ID NO: 2033063 - protein, 20 aa, Staphylococcus
PEMQKRGLYRKEYEGSTFRQ

SEQ ID NO: 2033064 - protein, 21 aa, Staphylococcus
PEMTYFCSLQLARRTVNANRY

SEQ ID NO: 2033065 - protein, 19 aa, Staphylococcus
PENCLKRRKSYGSTGQDAV

SEQ ID NO: 2033066 - protein, 17 aa, Staphylococcus
PENCLKRRKSYGSTGQE

SEQ ID NO: 2033067 - protein, 18 aa, Staphylococcus
PENCLNRRKSYGSTGQDA

SEQ ID NO: 2033068 - protein, 29 aa, Staphylococcus
PENEVNYIMNLPVNFLKTFLPELIEKNVQ

SEQ ID NO: 2033069 - protein, 22 aa, Staphylococcus
PENFKIKPEWLIELDKCANRDT

SEQ ID NO: 2033070 - protein, 17 aa, Staphylococcus
PENIPVTIVKRALAVFN

SEQ ID NO: 2033071 - protein, 18 aa, Staphylococcus
PENLYGDYVVPFGGESKS

SEQ ID NO: 2033072 - protein, 26 aa, Staphylococcus
PENPYKFGATIGRYAGRIENASFNLN

SEQ ID NO: 2033073 - protein, 21 aa, Staphylococcus
PENQKYGAFHGKASFRQAIVD

SEQ ID NO: 2033074 - protein, 26 aa, Staphylococcus
PENRTRLVIYPAAMRYAGPREAILHA

SEQ ID NO: 2033075 - protein, 20 aa, Staphylococcus
PEPELYLTAVQQLNYSPTHC

SEQ ID NO: 2033076 - protein, 17 aa, Staphylococcus
PEPKEEKKGFFARLFNL

SEQ ID NO: 2033077 - protein, 18 aa, Staphylococcus
PEPTKLTGDWMNRTIEVD

SEQ ID NO: 2033078 - protein, 27 aa, Staphylococcus
PEPVIMDIALDILKLDKADVAMVGDLY

SEQ ID NO: 2033079 - protein, 17 aa, Staphylococcus
PEPYKGKGIRYQGEYVR

SEQ ID NO: 2033080 - protein, 18 aa, Staphylococcus
PEPYLMAVQNLNYNPTNC

SEQ ID NO: 2033081 - protein, 17 aa, Staphylococcus
PEPYQAIYRERLQEGKD

SEQ ID NO: 2033082 - protein, 30 aa, Staphylococcus
PEQEVNYIMNLPVNFLKTFLPELIERNVKV

SEQ ID NO: 2033083 - protein, 20 aa, Staphylococcus
PEQIKGIGITNQRETTVIWD

SEQ ID NO: 2033084 - protein, 22 aa, Staphylococcus
PEQKVWLSGYLVANQQLTSGTS

SEQ ID NO: 2033085 - protein, 22 aa, Staphylococcus
PEQKVWLSGYLVANQQLTSNGT

SEQ ID NO: 2033086 - protein, 32 aa, Staphylococcus; identical to SEQ ID NO: 1799648

SEQ ID NO: 2033087 - protein, 26 aa, Staphylococcus
PEQLFAAGYSACFNNALMHILKSDSK

SEQ ID NO: 2033088 - protein, 30 aa, Staphylococcus; identical to SEQ ID NO: 1811042

SEQ ID NO: 2033089 - protein, 31 aa, Staphylococcus
PEQLFAAGYSACFNSALSLILSRHKVNDANP

SEQ ID NO: 2033090 - protein, 28 aa, Staphylococcus
PEQLYYLMSRGISRREAERLVIHGFLDP

SEQ ID NO: 2033091 - protein, 23 aa, Staphylococcus
PEQLYYLMSRGISRTEAERLVIH

SEQ ID NO: 2033092 - protein, 22 aa, Staphylococcus
PEQMVISTMMLRSMQQARYDDV

SEQ ID NO: 2033093 - protein, 17 aa, Staphylococcus
PEREDLQAGLFFEPTVI

SEQ ID NO: 2033094 - protein, 23 aa, Staphylococcus
PERLLEISIKGMLPSSRLGEKQG

SEQ ID NO: 2033095 - protein, 20 aa, Staphylococcus
PERMASRILGMGDVLSLIEK

SEQ ID NO: 2033096 - protein, 29 aa, Staphylococcus
PERMKVKEIIKFWIKWYSIDTTIDDILYT

SEQ ID NO: 2033097 - protein, 25 aa, Staphylococcus
PERTEGYEGFYHLMKINGDVEKTTL

SEQ ID NO: 2033098 - protein, 17 aa, Staphylococcus
PERVIRAPKDIETQDLI

SEQ ID NO: 2033099 - protein, 21 aa, Staphylococcus
PERVLPGKILEELIYNNRIIG

SEQ ID NO: 2033100 - protein, 23 aa, Staphylococcus
PERVSLVQYVTWAYLRSLLDIEH

SEQ ID NO: 2033101 - protein, 28 aa, Staphylococcus
PERYEIEGNPYWPLSMPVFKMDYAHKEA

SEQ ID NO: 2033102 - protein, 20 aa, Staphylococcus
PESEIAFIVLHFGGSIKNQG

SEQ ID NO: 2033103 - protein, 21 aa, Staphylococcus
PESEVAFIVLHFGGSIKNQGH

SEQ ID NO: 2033104 - protein, 29 aa, Staphylococcus
PESEVNYIMNLPVNFLKTFLPELIEKNVK

SEQ ID NO: 2033105 - protein, 24 aa, Staphylococcus
PESHIFCLTLGTGIGGAFYTQQHG

SEQ ID NO: 2033106 - protein, 21 aa, Staphylococcus
PESIKQEFLTALKEEFSNVKV

SEQ ID NO: 2033107 - protein, 23 aa, Staphylococcus
PESLLKLPKLGAVNVHASLLPKY

SEQ ID NO: 2033108 - protein, 26 aa, Staphylococcus
PESPDSTTFYAHFPKKGMYKIWAEFK

SEQ ID NO: 2033109 - protein, 21 aa, Staphylococcus
PESRLPESHVVTMAKDYAEQT

SEQ ID NO: 2033110 - protein, 26 aa, Staphylococcus
PESSLRAGAFGLPITYAIIGGNPKRF

SEQ ID NO: 2033111 - protein, 29 aa, Staphylococcus
PESSQALGFGYRTGFLGMLHMEIIQERIE

SEQ ID NO: 2033112 - protein, 22 aa, Staphylococcus
PESVKLFGQHGFADTRYFARFG

SEQ ID NO: 2033113 - protein, 19 aa, Staphylococcus
PETARRNAISRIIEMDYLS

SEQ ID NO: 2033114 - protein, 20 aa, Staphylococcus
PETEEVLMHFIERCQQGDVV

SEQ ID NO: 2033115 - protein, 17 aa, Staphylococcus
PETEEVMLHFLEHCKDG

SEQ ID NO: 2033116 - protein, 17 aa, Staphylococcus
PETEEVMLHFLNQCHHQ

SEQ ID NO: 2033117 - protein, 18 aa, Staphylococcus
PETFAAEHLEFCKSNNLK

SEQ ID NO: 2033118 - protein, 17 aa, Staphylococcus
PETHLVPIVLQVALGQR

SEQ ID NO: 2033119 - protein, 17 aa, Staphylococcus
PETIIRAKGDVINYRGR

SEQ ID NO: 2033120 - protein, 22 aa, Staphylococcus
PETKAVVMIGEIGGTAEEEAAE

SEQ ID NO: 2033121 - protein, 18 aa, Staphylococcus
PETLCIYMGVSRLPEISR

SEQ ID NO: 2033122 - protein, 24 aa, Staphylococcus
PETLKKIRECSVAKYVYDVKKGIY

SEQ ID NO: 2033123 - protein, 20 aa, Staphylococcus
PETLMPAIIELKRAYKKAKS

SEQ ID NO: 2033124 - protein, 20 aa, Staphylococcus
PETLPILNGVLDYRRKLTNP

SEQ ID NO: 2033125 - protein, 21 aa, Staphylococcus
PETLPILNGVLDYRRKLTNPF

SEQ ID NO: 2033126 - protein, 21 aa, Staphylococcus
PETLPILNGVLDYRRQITNPY

SEQ ID NO: 2033127 - protein, 20 aa, Staphylococcus
PETLPILNGVLDYRRQLTNP

SEQ ID NO: 2033128 - protein, 21 aa, Staphylococcus
PETLPILNGVLDYRRQLTNPF

SEQ ID NO: 2033129 - protein, 21 aa, Staphylococcus
PETLPILNGVLDYRRRITNPF

SEQ ID NO: 2033130 - protein, 21 aa, Staphylococcus
PETLPILNGVLDYRRSLTNPY

SEQ ID NO: 2033131 - protein, 20 aa, Staphylococcus
PETRKAEVLYEELAHHKLTY

SEQ ID NO: 2033132 - protein, 19 aa, Staphylococcus
PEVFPELQGLEGHTLMITD

SEQ ID NO: 2033133 - protein, 21 aa, Staphylococcus
PEVHPAPTLLNVGRIDYADTF

SEQ ID NO: 2033134 - protein, 21 aa, Staphylococcus
PEVHPGPTLLNVGRIDHAQKF

SEQ ID NO: 2033135 - protein, 21 aa, Staphylococcus
PEVHPGPTLLNVGRIDYADEF

SEQ ID NO: 2033136 - protein, 20 aa, Staphylococcus
PEVHPGPTLLNVGRIDYADS

SEQ ID NO: 2033137 - protein, 21 aa, Staphylococcus
PEVHPGPTLLNVGRIDYADSF

SEQ ID NO: 2033138 - protein, 21 aa, Staphylococcus
PEVHPGPTLLNVGRIDYAENF

SEQ ID NO: 2033139 - protein, 21 aa, Staphylococcus
PEVHPGPTLLNVGRIDYSGDF

SEQ ID NO: 2033140 - protein, 22 aa, Staphylococcus
PEVQFQRTYVCEDMTKCICMYD

SEQ ID NO: 2033141 - protein, 26 aa, Staphylococcus
PEVRAKSDIVAVCYHGGFERDLESGA

SEQ ID NO: 2033142 - protein, 31 aa, Staphylococcus
PEVRESVFNMMNWWFEKGIDGFRVDAITHIK

SEQ ID NO: 2033143 - protein, 21 aa, Staphylococcus
PEVVDVATFLTGMGAKIKGAG

SEQ ID NO: 2033144 - protein, 31 aa, Staphylococcus
PEWMLDFRLKALKLFYKMPMPQWGGDLSELD

SEQ ID NO: 2033145 - protein, 32 aa, Staphylococcus
PEWMLNFRLKALKLFYKIPMPQWGGDLSELNF

SEQ ID NO: 2033146 - protein, 24 aa, Staphylococcus
PEWMLNYRLKSLKQFYKMPMPQWG

SEQ ID NO: 2033147 - protein, 25 aa, Staphylococcus
PEWNDLVYRGDFKAAYDRLSETNNF

SEQ ID NO: 2033148 - protein, 17 aa, Staphylococcus
PEWTAGKYLPKRQIVEI

SEQ ID NO: 2033149 - protein, 20 aa, Staphylococcus
PEYDGKALGSRTWQAAIDPV

SEQ ID NO: 2033150 - protein, 17 aa, Staphylococcus
PEYILKHCESLLTEFGV

SEQ ID NO: 2033151 - protein, 22 aa, Staphylococcus
PEYKSEWTPKIKKMIPSYGQSL

SEQ ID NO: 2033152 - protein, 19 aa, Staphylococcus
PEYSFYNGVGIAFSEQTND

SEQ ID NO: 2033153 - protein, 17 aa, Staphylococcus
PEYVKIAVMPKEKQDVA

SEQ ID NO: 2033154 - protein, 17 aa, Staphylococcus
PEYWEIKGDNKSAKIMD

SEQ ID NO: 2033155 - protein, 21 aa, Staphylococcus
PEYWQKLFKRYEDWINNFNAC

SEQ ID NO: 2033156 - protein, 18 aa, Staphylococcus
PFAERLANFAAEYDNAEY

SEQ ID NO: 2033157 - protein, 19 aa, Staphylococcus
PFAGHPTVGASFAVLQNGM

SEQ ID NO: 2033158 - protein, 20 aa, Staphylococcus
PFAHLHGTFGTRDFQTLSGH

SEQ ID NO: 2033159 - protein, 24 aa, Staphylococcus
PFAKQKLIFLCGMAGERDLTKTPE

SEQ ID NO: 2033160 - protein, 22 aa, Staphylococcus
PFAPIKEDRYLALATNSRRQGI

SEQ ID NO: 2033161 - protein, 23 aa, Staphylococcus
PFAQKRWCASNGLDNVITLSDHK

SEQ ID NO: 2033162 - protein, 23 aa, Staphylococcus
PFAQKRWCASNGLENVVTLSDHR

SEQ ID NO: 2033163 - protein, 25 aa, Staphylococcus
PFCNVDITLKVARAFRQKFGHRKSL

SEQ ID NO: 2033164 - protein, 23 aa, Staphylococcus
PFDADFSGFIFKIQANMDPKHRD

SEQ ID NO: 2033165 - protein, 24 aa, Staphylococcus
PFDFLSDIVYQWERFANKFKDFGT

SEQ ID NO: 2033166 - protein, 24 aa, Staphylococcus
PFDFLSDVVYQWERFAKKFEQFGT

SEQ ID NO: 2033167 - protein, 23 aa, Staphylococcus
PFDFLSDVVYQWERFARRFENFG

SEQ ID NO: 2033168 - protein, 25 aa, Staphylococcus
PFDPMELYYRVSLHLHSDACTTYHY

SEQ ID NO: 2033169 - protein, 29 aa, Staphylococcus
PFDPMELYYRVSLHLNDKGQSMYRYNDLT

SEQ ID NO: 2033170 - protein, 19 aa, Staphylococcus
PFDPPMFARVFRKHIEGGI

SEQ ID NO: 2033171 - protein, 19 aa, Staphylococcus
PFDPPMFARVFRKHLEGGI

SEQ ID NO: 2033172 - protein, 20 aa, Staphylococcus
PFDTDYGWNVSFGKNVFLNT

SEQ ID NO: 2033173 - protein, 27 aa, Staphylococcus
PFDVPSEYFMVKFLWDQLLEQPQGDVV

SEQ ID NO: 2033174 - protein, 17 aa, Staphylococcus
PFEEAGIPLEVIKNPTA

SEQ ID NO: 2033175 - protein, 25 aa, Staphylococcus
PFEIKELIFRIKAVLRRYQINAEHI

SEQ ID NO: 2033176 - protein, 17 aa, Staphylococcus
PFEKPSIIFNYLSTKED

SEQ ID NO: 2033177 - protein, 25 aa, Staphylococcus
PFELLKERITQIILPEAQKISKNKN

SEQ ID NO: 2033178 - protein, 26 aa, Staphylococcus
PFEPMKGGIFLWLKTPPNFDGESFVD

SEQ ID NO: 2033179 - protein, 19 aa, Staphylococcus
PFEPPMFARVFRKHLEGGI

SEQ ID NO: 2033180 - protein, 19 aa, Staphylococcus
PFEQFGKILIEDVNIDIEL

SEQ ID NO: 2033181 - protein, 22 aa, Staphylococcus
PFETIGIAGFFGLPIEKAELGK

SEQ ID NO: 2033182 - protein, 22 aa, Staphylococcus
PFETIGIAGFFGLPIKKEVIDA

SEQ ID NO: 2033183 - protein, 20 aa, Staphylococcus
PFEVGGGIRTLETIETYFDK

SEQ ID NO: 2033184 - protein, 26 aa, Staphylococcus
PFEVKELLFRIQAVLRRYQINSQDII

SEQ ID NO: 2033185 - protein, 18 aa, Staphylococcus
PFFGELIFELEKRLYDKG

SEQ ID NO: 2033186 - protein, 17 aa, Staphylococcus
PFFLEFMAKDVSKGNAI

SEQ ID NO: 2033187 - protein, 24 aa, Staphylococcus
PFFTNYRPQFYFRTTDVTGVVNLP

SEQ ID NO: 2033188 - protein, 18 aa, Staphylococcus
PFGFEGRKRSTQAAAGVE

SEQ ID NO: 2033189 - protein, 23 aa, Staphylococcus
PFGTKYLAWTLIDYDAIPVCGFP

SEQ ID NO: 2033190 - protein, 19 aa, Staphylococcus
PFGYPRVSYLLNYKDNQNQ

SEQ ID NO: 2033191 - protein, 24 aa, Staphylococcus
PFHKKADPSLAFFNKYKFIMIDAE

SEQ ID NO: 2033192 - protein, 25 aa, Staphylococcus
PFHMSPYFGYAERLLASSGIDYTYV

SEQ ID NO: 2033193 - protein, 22 aa, Staphylococcus
PFIARYRKERTGGLDEVEIKKI

SEQ ID NO: 2033194 - protein, 20 aa, Staphylococcus
PFISGFIGSCSFDLARHEFP

SEQ ID NO: 2033195 - protein, 19 aa, Staphylococcus
PFITDKNKFISIMAGLPIS

SEQ ID NO: 2033196 - protein, 25 aa, Staphylococcus
PFKASNRFTIVPSWETYTKENSDEL

SEQ ID NO: 2033197 - protein, 18 aa, Staphylococcus
PFKDMIQSVENWKIQGST

SEQ ID NO: 2033198 - protein, 18 aa, Staphylococcus
PFKQGVGIDLARKSLQKA

SEQ ID NO: 2033199 - protein, 25 aa, Staphylococcus
PFLEKTLERKAVWDKWMEQDMNQES

SEQ ID NO: 2033200 - protein, 19 aa, Staphylococcus
PFNFEPFRQSSIKEFEEVF

SEQ ID NO: 2033201 - protein, 19 aa, Staphylococcus
PFNPPMFARVFRKHLEGGF

SEQ ID NO: 2033202 - protein, 18 aa, Staphylococcus
PFNRKYQAVVYISGQKSG

SEQ ID NO: 2033203 - protein, 17 aa, Staphylococcus
PFNVEPLPYKVSLQQAI

SEQ ID NO: 2033204 - protein, 18 aa, Staphylococcus
PFNYSFDEIESFYENLFT

SEQ ID NO: 2033205 - protein, 18 aa, Staphylococcus
PFPDKYRGMFEQSKSNTV

SEQ ID NO: 2033206 - protein, 18 aa, Staphylococcus
PFPDNYRGMFGSNQPNTV

SEQ ID NO: 2033207 - protein, 17 aa, Staphylococcus
PFPTIVRDFQKIIGQEI

SEQ ID NO: 2033208 - protein, 20 aa, Staphylococcus
PFPTMVRDFQSVIGSEIKEQ

SEQ ID NO: 2033209 - protein, 19 aa, Staphylococcus
PFQEGRDGFIMGEGAGILV

SEQ ID NO: 2033210 - protein, 19 aa, Staphylococcus
PFQEGRDGFIMGEGAGIVV

SEQ ID NO: 2033211 - protein, 19 aa, Staphylococcus
PFQEGRDGFVMGEGAGILF

SEQ ID NO: 2033212 - protein, 19 aa, Staphylococcus
PFQEGRDGFVMGEGAGILV

SEQ ID NO: 2033213 - protein, 26 aa, Staphylococcus
PFQGHPACVHIAIGKGVCGTAVAEDK

SEQ ID NO: 2033214 - protein, 27 aa, Staphylococcus
PFQGHPACVHIAIGKGVCGTAVSEEQT

SEQ ID NO: 2033215 - protein, 17 aa, Staphylococcus
PFQGHPACVHIQIGKGV

SEQ ID NO: 2033216 - protein, 26 aa, Staphylococcus
PFRKCDTMPDKLCLYYHIGQCLGPCV

SEQ ID NO: 2033217 - protein, 19 aa, Staphylococcus
PFRLGGIDRMLEAIKILQQ

SEQ ID NO: 2033218 - protein, 26 aa, Staphylococcus
PFSKECFKLSAILSKLRIEYNQYIRV

SEQ ID NO: 2033219 - protein, 24 aa, Staphylococcus
PFSPREVVLRVKALLRRTQSANSE

SEQ ID NO: 2033220 - protein, 24 aa, Staphylococcus
PFSPREVVLRVKALLRRTQSSKPE

SEQ ID NO: 2033221 - protein, 24 aa, Staphylococcus
PFSPREVVLRVKALLRRTQSTSAE

SEQ ID NO: 2033222 - protein, 24 aa, Staphylococcus
PFSPREVVLRVKALLRRTQTSKPE

SEQ ID NO: 2033223 - protein, 24 aa, Staphylococcus
PFSPREVVLRVKALLRRTQTTTPE

SEQ ID NO: 2033224 - protein, 21 aa, Staphylococcus
PFSSAEDWDNVGLLIGDKNKD

SEQ ID NO: 2033225 - protein, 23 aa, Staphylococcus
PFTEAVKELGERVNIKVETDQSY

SEQ ID NO: 2033226 - protein, 20 aa, Staphylococcus
PFTKIQLWLPIKQEAYDFDE

SEQ ID NO: 2033227 - protein, 23 aa, Staphylococcus
PFTSCPQAGVLQAGQSIIYDTVC

SEQ ID NO: 2033228 - protein, 25 aa, Staphylococcus
PFTVESKATLSFRTMDLIHKPYHVK

SEQ ID NO: 2033229 - protein, 24 aa, Staphylococcus
PFTVESKATLSFRTMELLHHPFHI

SEQ ID NO: 2033230 - protein, 20 aa, Staphylococcus
PFVCGCRDLGEAARRIGEGA

SEQ ID NO: 2033231 - protein, 26 aa, Staphylococcus
PFVHSKGGIYCWLKTPPGYESESFEQ

SEQ ID NO: 2033232 - protein, 20 aa, Staphylococcus
PFVHSKGGIYSWLRTPPDYD

SEQ ID NO: 2033233 - protein, 23 aa, Staphylococcus
PFVKQKLIFLVGMAGERDLTKTP

SEQ ID NO: 2033234 - protein, 17 aa, Staphylococcus
PFWYAVSSYPKGEFNRI

SEQ ID NO: 2033235 - protein, 20 aa, Staphylococcus
PFYEIGWRLIPEVWGNGFAT

SEQ ID NO: 2033236 - protein, 17 aa, Staphylococcus
PFYEQILGFNIVNETMT

SEQ ID NO: 2033237 - protein, 18 aa, Staphylococcus
PFYFKGFGKHEDTFYSGR

SEQ ID NO: 2033238 - protein, 29 aa, Staphylococcus
PFYQRSMIKTVPIGAPFNQMIEFGVLHMK

SEQ ID NO: 2033239 - protein, 17 aa, Staphylococcus
PFYSKQGLSYGYQYESS

SEQ ID NO: 2033240 - protein, 24 aa, Staphylococcus
PGAAVKYIEIEGVLHEFSAVDNVV

SEQ ID NO: 2033241 - protein, 27 aa, Staphylococcus
PGAFGSYRCAYELFDKALSDKKTLNIV

SEQ ID NO: 2033242 - protein, 23 aa, Staphylococcus
PGAKLRKGMDAFETFRYSSEFTQ

SEQ ID NO: 2033243 - protein, 18 aa, Staphylococcus
PGALKEFVNDVLGPNDDI

SEQ ID NO: 2033244 - protein, 18 aa, Staphylococcus
PGALKEFVNDVLGPQDDI

SEQ ID NO: 2033245 - protein, 28 aa, Staphylococcus
PGAVTTEFKKSMPILIHGDAAYPGQGIN

SEQ ID NO: 2033246 - protein, 20 aa, Staphylococcus
PGDIKIKRAKLRGERSEGMI

SEQ ID NO: 2033247 - protein, 18 aa, Staphylococcus
PGDKINFYVQTYVHTGLH

SEQ ID NO: 2033248 - protein, 18 aa, Staphylococcus
PGDMTIKVIHTYDVEHRW

SEQ ID NO: 2033249 - protein, 25 aa, Staphylococcus
PGDPELLTIKGLRAIKEADVILYDR

SEQ ID NO: 2033250 - protein, 25 aa, Staphylococcus
PGENDEIFEFYGLKVLVDKYDKPVL

SEQ ID NO: 2033251 - protein, 24 aa, Staphylococcus
PGESFRMECLDWTDGQVGNNDDPS

SEQ ID NO: 2033252 - protein, 25 aa, Staphylococcus
PGETEGVFFHERRALSHYEKRYATR

SEQ ID NO: 2033253 - protein, 22 aa, Staphylococcus
PGEYTKRAFLNGRIDLSQAEAV

SEQ ID NO: 2033254 - protein, 19 aa, Staphylococcus
PGFYQGYYGAMFADPDGHK

SEQ ID NO: 2033255 - protein, 23 aa, Staphylococcus
PGGKAAYPSTVLMTATLAEAAGV

SEQ ID NO: 2033256 - protein, 17 aa, Staphylococcus
PGGLLYFHVHEPRIKLA

SEQ ID NO: 2033257 - protein, 18 aa, Staphylococcus
PGGMIVCLETSQPTLPVF

SEQ ID NO: 2033258 - protein, 20 aa, Staphylococcus
PGHGVSWSYSAWRLARSRCR

SEQ ID NO: 2033259 - protein, 20 aa, Staphylococcus
PGHPEFKHTDGIEVTTGPLG

SEQ ID NO: 2033260 - protein, 19 aa, Staphylococcus
PGHPEFKHTDGVEVTTGPL

SEQ ID NO: 2033261 - protein, 23 aa, Staphylococcus
PGHSPGSLTYVFDDFAVVGDTLF

SEQ ID NO: 2033262 - protein, 30 aa, Staphylococcus
PGIEIPDARYKDWFPNFALSDLISDNTATG

SEQ ID NO: 2033263 - protein, 20 aa, Staphylococcus
PGINLPIIFQDNVVGVIGIT

SEQ ID NO: 2033264 - protein, 27 aa, Staphylococcus
PGIWPHIRLNNCDWIDGGMVSPTNAML

SEQ ID NO: 2033265 - protein, 19 aa, Staphylococcus
PGKRMGHAGAIISGGKGTA

SEQ ID NO: 2033266 - protein, 27 aa, Staphylococcus
PGLANKIALKFAKKIYTTFEDTLQYLP

SEQ ID NO: 2033267 - protein, 29 aa, Staphylococcus
PGLANKISLKFAKKIYTTFEDTLKYLPKD

SEQ ID NO: 2033268 - protein, 28 aa, Staphylococcus
PGLANKISLKFAKKIYTTFEDTLNYLPK

SEQ ID NO: 2033269 - protein, 17 aa, Staphylococcus
PGLIGALLIGINAAKAL

SEQ ID NO: 2033270 - protein, 19 aa, Staphylococcus
PGLIGALLIGINAAKALAF

SEQ ID NO: 2033271 - protein, 23 aa, Staphylococcus
PGLPDLKGFGRRKMDINLTEVYN

SEQ ID NO: 2033272 - protein, 24 aa, Staphylococcus
PGLPDLKGFGRRNMDITPKEIYNL

SEQ ID NO: 2033273 - protein, 24 aa, Staphylococcus
PGLPDLQGFGRRKLDMSPEEIYNI

SEQ ID NO: 2033274 - protein, 21 aa, Staphylococcus
PGLPDLQGFGRRKMDIKPKEI

SEQ ID NO: 2033275 - protein, 21 aa, Staphylococcus
PGLPDLQGFGRRNMDLSPEEV

SEQ ID NO: 2033276 - protein, 18 aa, Staphylococcus
PGLPKKPAALNMDVTDDG

SEQ ID NO: 2033277 - protein, 18 aa, Staphylococcus
PGLVSGNMARVWSEAELA

SEQ ID NO: 2033278 - protein, 18 aa, Staphylococcus
PGMTRYFMTIPEASRLVL

SEQ ID NO: 2033279 - protein, 20 aa, Staphylococcus
PGNGKFLYSPFSVFDNESII

SEQ ID NO: 2033280 - protein, 18 aa, Staphylococcus
PGNLRKVFYSDTGSASVE

SEQ ID NO: 2033281 - protein, 19 aa, Staphylococcus
PGNMKLLLDKETLNSKVII

SEQ ID NO: 2033282 - protein, 22 aa, Staphylococcus
PGPASRLSWLGDILTTANNIHA

SEQ ID NO: 2033283 - protein, 25 aa, Staphylococcus
PGPFDKRVAPSVAREVAKAAMESGV

SEQ ID NO: 2033284 - protein, 25 aa, Staphylococcus
PGPFDKRVAPSVAREVAKAAMETGV

SEQ ID NO: 2033285 - protein, 25 aa, Staphylococcus
PGPFDKRVAPSVARSVAKAAMESGV

SEQ ID NO: 2033286 - protein, 18 aa, Staphylococcus
PGPSDSNYLFDEFITMMN

SEQ ID NO: 2033287 - protein, 19 aa, Staphylococcus
PGPSDSNYLFDEFITMMNE

SEQ ID NO: 2033288 - protein, 20 aa, Staphylococcus
PGPWYIHRMLEAAEDLPINV

SEQ ID NO: 2033289 - protein, 19 aa, Staphylococcus
PGQEIEFFGPEINSFKQVI

SEQ ID NO: 2033290 - protein, 19 aa, Staphylococcus
PGQEIEFFGPEIQSFRQVI

SEQ ID NO: 2033291 - protein, 21 aa, Staphylococcus
PGQEPPYTRLIDSARRQPEQT

SEQ ID NO: 2033292 - protein, 17 aa, Staphylococcus
PGQEVRLTEAMINEIEY

SEQ ID NO: 2033293 - protein, 18 aa, Staphylococcus
PGQKVHLVGHSMGGQTVR

SEQ ID NO: 2033294 - protein, 28 aa, Staphylococcus
PGQLVVDCVLAYFQIEWTQFNVKYRKII

SEQ ID NO: 2033295 - protein, 19 aa, Staphylococcus
PGQVFKDLIESKAFPRVNL

SEQ ID NO: 2033296 - protein, 23 aa, Staphylococcus
PGQYEKRVLFGLSGSDANDGIIK

SEQ ID NO: 2033297 - protein, 24 aa, Staphylococcus
PGRLPDLLNVWSVKRLKEAGADAV

SEQ ID NO: 2033298 - protein, 24 aa, Staphylococcus
PGSAVKYIEIEGVLHEFSAVDNVV

SEQ ID NO: 2033299 - protein, 18 aa, Staphylococcus
PGSEIYGGLSNTWDYGPL

SEQ ID NO: 2033300 - protein, 21 aa, Staphylococcus
PGSIRGDLGLTVGRNVIHGSD

SEQ ID NO: 2033301 - protein, 22 aa, Staphylococcus
PGSMGKAIPGSRVAVVDDEGNK

SEQ ID NO: 2033302 - protein, 17 aa, Staphylococcus
PGSMGKGIPGSFVTIID

SEQ ID NO: 2033303 - protein, 22 aa, Staphylococcus
PGSTFKSFGLAAAIQEGKFNPK

SEQ ID NO: 2033304 - protein, 22 aa, Staphylococcus
PGSTFKSYGLAAAIQEGKFDPD

SEQ ID NO: 2033305 - protein, 23 aa, Staphylococcus
PGSTFKSYGLAAAIQEGKFNPKE

SEQ ID NO: 2033306 - protein, 26 aa, Staphylococcus
PGTDADGNTGAWIRVYELNPDGTKGQ

SEQ ID NO: 2033307 - protein, 19 aa, Staphylococcus
PGTDLAWMSAVTKYIIDND

SEQ ID NO: 2033308 - protein, 20 aa, Staphylococcus
PGTGIAPFRAHMQEREEYGY

SEQ ID NO: 2033309 - protein, 22 aa, Staphylococcus
PGTKLRGPIHRGLPTLEAHRYQ

SEQ ID NO: 2033310 - protein, 17 aa, Staphylococcus
PGTWYGKDGMIYNSFKE

SEQ ID NO: 2033311 - protein, 18 aa, Staphylococcus
PGVAGVRIEDDILVTDSG

SEQ ID NO: 2033312 - protein, 19 aa, Staphylococcus
PGVRQGYYGAMFKDPDGHK

SEQ ID NO: 2033313 - protein, 17 aa, Staphylococcus
PGVSAPAVLGIYPHTVF

SEQ ID NO: 2033314 - protein, 20 aa, Staphylococcus
PGVSKGRVSIIGGGQAGTNA

SEQ ID NO: 2033315 - protein, 23 aa, Staphylococcus
PGWLGPKKMKAFLNHSSHEEKLQ

SEQ ID NO: 2033316 - protein, 19 aa, Staphylococcus
PGYEPDIDKLCQLVEETNT

SEQ ID NO: 2033317 - protein, 27 aa, Staphylococcus
PGYGNAGSGIRFRKAGMPTETYGDYEP

SEQ ID NO: 2033318 - protein, 21 aa, Staphylococcus
PGYNDFEIWGSVSGVNIQFIF

SEQ ID NO: 2033319 - protein, 23 aa, Staphylococcus
PGYRVKESPIHFECEYVQTVRIP

SEQ ID NO: 2033320 - protein, 25 aa, Staphylococcus
PGYTDYKAGVLLADAHPQPLVLEPP

SEQ ID NO: 2033321 - protein, 24 aa, Staphylococcus
PHADLKPPFFIQWSKSEEEREEAL

SEQ ID NO: 2033322 - protein, 17 aa, Staphylococcus
PHAIKTGMIATEETMQL

SEQ ID NO: 2033323 - protein, 27 aa, Staphylococcus
PHAISKGRIEVIGDFKFKKERYKSEKI

SEQ ID NO: 2033324 - protein, 21 aa, Staphylococcus
PHARDVIEFNHLIIDNDAHRV

SEQ ID NO: 2033325 - protein, 20 aa, Staphylococcus
PHARDVIEFNHLVIDNDAHR

SEQ ID NO: 2033326 - protein, 17 aa, Staphylococcus
PHDIFTPIFAVSRTAGW

SEQ ID NO: 2033327 - protein, 18 aa, Staphylococcus
PHEFMKMAKERGLTDEPE

SEQ ID NO: 2033328 - protein, 18 aa, Staphylococcus
PHEFMKMAKSRGLTEEPE

SEQ ID NO: 2033329 - protein, 21 aa, Staphylococcus
PHEGLMLLKVVHYDEMGKPIL

SEQ ID NO: 2033330 - protein, 18 aa, Staphylococcus
PHELRGNIVKAFIILQNG

SEQ ID NO: 2033331 - protein, 18 aa, Staphylococcus
PHELRGNIVKAFVILQDS

SEQ ID NO: 2033332 - protein, 23 aa, Staphylococcus
PHETWVPSFAMRLVLGEMSTVIL

SEQ ID NO: 2033333 - protein, 20 aa, Staphylococcus
PHEVLLCLDATTGQNALSQA

SEQ ID NO: 2033334 - protein, 21 aa, Staphylococcus
PHFDHFKFLYDRVNGRATAKV

SEQ ID NO: 2033335 - protein, 17 aa, Staphylococcus
PHFSLKNQNGVSISNKD

SEQ ID NO: 2033336 - protein, 23 aa, Staphylococcus
PHGGIALGLDRFVMLLAGRNNLR

SEQ ID NO: 2033337 - protein, 21 aa, Staphylococcus
PHGGIALGLDRLVMLLTGRTN

SEQ ID NO: 2033338 - protein, 17 aa, Staphylococcus
PHGSDTFVTVPDGVAHF

SEQ ID NO: 2033339 - protein, 20 aa, Staphylococcus
PHGTIKFMATAGEEKEQLGS

SEQ ID NO: 2033340 - protein, 25 aa, Staphylococcus
PHHHRHASDIFKMIDDSALSPRVKA

SEQ ID NO: 2033341 - protein, 24 aa, Staphylococcus
PHHTHARVGIALYGSRPYSGLNES

SEQ ID NO: 2033342 - protein, 24 aa, Staphylococcus
PHHTHARVGIALYGSRPYSKLKES

SEQ ID NO: 2033343 - protein, 22 aa, Staphylococcus
PHIAEFKAFIEIISNELERIQV

SEQ ID NO: 2033344 - protein, 23 aa, Staphylococcus
PHKDITVDFLFVILNADKASQVH

SEQ ID NO: 2033345 - protein, 26 aa, Staphylococcus
PHKFDVARFNADFAYTMDGSQLGELQ

SEQ ID NO: 2033346 - protein, 27 aa, Staphylococcus
PHKFDVKRFDADFAYTMDGSQYGELQF

SEQ ID NO: 2033347 - protein, 22 aa, Staphylococcus
PHKIPPTIISRAQRFDFKAIGL

SEQ ID NO: 2033348 - protein, 20 aa, Staphylococcus
PHKLRHTFATHMLNQGADLR

SEQ ID NO: 2033349 - protein, 19 aa, Staphylococcus
PHKPPDFFEKIFKGTGLKF

SEQ ID NO: 2033350 - protein, 19 aa, Staphylococcus
PHLKDWSLQRLLKTDRIIL

SEQ ID NO: 2033351 - protein, 19 aa, Staphylococcus
PHLKDWTLARLLKSDRIIL

SEQ ID NO: 2033352 - protein, 19 aa, Staphylococcus
PHLNVYDNIAFGLKLKKKK

SEQ ID NO: 2033353 - protein, 23 aa, Staphylococcus
PHLSRHPEMWLLSASQRSAKLAA

SEQ ID NO: 2033354 - protein, 22 aa, Staphylococcus
PHNQLKKAFGILGTDLHLHANG

SEQ ID NO: 2033355 - protein, 24 aa, Staphylococcus
PHNVTRFLVIGSQLELSETATDTM

SEQ ID NO: 2033356 - protein, 21 aa, Staphylococcus
PHPSPLSAYRGFFGSKPYSQA

SEQ ID NO: 2033357 - protein, 22 aa, Staphylococcus
PHPYLKGKNLAFLFEKPSTRTR

SEQ ID NO: 2033358 - protein, 23 aa, Staphylococcus
PHQKEWERLSGIPIEEQTYERIR

SEQ ID NO: 2033359 - protein, 24 aa, Staphylococcus
PHQKEWERLSGIPIEEQTYERNRE

SEQ ID NO: 2033360 - protein, 19 aa, Staphylococcus
PHRYLKKDFGILGTDMHLH

SEQ ID NO: 2033361 - protein, 18 aa, Staphylococcus
PHSGISLETQFLPNDINL

SEQ ID NO: 2033362 - protein, 26 aa, Staphylococcus
PHTFSRTQAFLGEFAECLSLADKTFL

SEQ ID NO: 2033363 - protein, 23 aa, Staphylococcus
PHTNPLWHMYKIIRFPKVLKQTI

SEQ ID NO: 2033364 - protein, 26 aa, Staphylococcus
PHVGSWRYKFFKEREGKYQVEQKEEN

SEQ ID NO: 2033365 - protein, 27 aa, Staphylococcus
PHVWFKDALDGYDFLKEKGYDDIVVAG

SEQ ID NO: 2033366 - protein, 25 aa, Staphylococcus
PHVWFKDALDGYDFLVEHGYDEIVV

SEQ ID NO: 2033367 - protein, 25 aa, Staphylococcus
PHWERPEYIQHLTFNSAVQTLEDIL

SEQ ID NO: 2033368 - protein, 24 aa, Staphylococcus
PHYICPECKQSEFFDDGSVGSGFD

SEQ ID NO: 2033369 - protein, 25 aa, Staphylococcus
PHYICPKCKKSEFFNDGSVGSGFDL

SEQ ID NO: 2033370 - protein, 26 aa, Staphylococcus
PHYICPNCKTSEFFDDGSVGSGFDLP

SEQ ID NO: 2033371 - protein, 18 aa, Staphylococcus
PHYIEVWGKFTPRGGISI

SEQ ID NO: 2033372 - protein, 31 aa, Staphylococcus
PHYLNLKGIISLYYKFDYLVSVSEETCKINI

SEQ ID NO: 2033373 - protein, 30 aa, Staphylococcus
PHYQNLKTLFSIYKRFDKLISVSEATMKVN

SEQ ID NO: 2033374 - protein, 35 aa, Staphylococcus
PHYYQYKGAYALQWHMIKFAIKHEIPKYNFYGITG

SEQ ID NO: 2033375 - protein, 17 aa, Staphylococcus
PIAKLAAKIAIGLTLDE

SEQ ID NO: 2033376 - protein, 18 aa, Staphylococcus
PIANFVVELLEFFKSTYK

SEQ ID NO: 2033377 - protein, 17 aa, Staphylococcus
PIARLAQELLHVDSAKE

SEQ ID NO: 2033378 - protein, 21 aa, Staphylococcus
PIDHCRKCGFVGDFKTTAKGY

SEQ ID NO: 2033379 - protein, 20 aa, Staphylococcus
PIDHCYECGFDGDFKSTPQG

SEQ ID NO: 2033380 - protein, 21 aa, Staphylococcus
PIDRKAIVDSYLEWLETEITI

SEQ ID NO: 2033381 - protein, 20 aa, Staphylococcus
PIDRQMFYQFILRLPENIYR

SEQ ID NO: 2033382 - protein, 18 aa, Staphylococcus
PIDTIRGLNGIIIDYLET

SEQ ID NO: 2033383 - protein, 27 aa, Staphylococcus
PIDVCNAESQGFIGYMLEEALKNDLNS

SEQ ID NO: 2033384 - protein, 28 aa, Staphylococcus
PIDYKKRWGQKEVQTFHGTFMKTMGFDT

SEQ ID NO: 2033385 - protein, 22 aa, Staphylococcus
PIEAIEQAFKIAKANGVTTVLN

SEQ ID NO: 2033386 - protein, 20 aa, Staphylococcus
PIEELRIISCHIGNGASIAA

SEQ ID NO: 2033387 - protein, 22 aa, Staphylococcus
PIEETDRFFKLFKMAEEKHGFS

SEQ ID NO: 2033388 - protein, 18 aa, Staphylococcus
PIEETLMSLGGKWKGIII

SEQ ID NO: 2033389 - protein, 25 aa, Staphylococcus
PIEGRYKVYIIEDFEKLTVQGENSI

SEQ ID NO: 2033390 - protein, 20 aa, Staphylococcus
PIEPGCYLMKDRNDQIIYVG

SEQ ID NO: 2033391 - protein, 19 aa, Staphylococcus
PIEQACEVFEQKLDAFEKL

SEQ ID NO: 2033392 - protein, 19 aa, Staphylococcus
PIEQACEVFEQKLDTFEKL

SEQ ID NO: 2033393 - protein, 24 aa, Staphylococcus
PIESLIKRYQLTRQFKSFEKAAYA

SEQ ID NO: 2033394 - protein, 18 aa, Staphylococcus
PIETPLLMEWLVSDEEAK

SEQ ID NO: 2033395 - protein, 24 aa, Staphylococcus
PIEWLKKYESHFVIIFKNVTESHE

SEQ ID NO: 2033396 - protein, 18 aa, Staphylococcus
PIEYGLKGLPSIEIYNED

SEQ ID NO: 2033397 - protein, 26 aa, Staphylococcus
PIFAISRTSGWLAHIFEQYRDNRIMR

SEQ ID NO: 2033398 - protein, 18 aa, Staphylococcus
PIFIPIKQLIPLIIESLD

SEQ ID NO: 2033399 - protein, 19 aa, Staphylococcus
PIFVPNALIGEVIKYKIIK

SEQ ID NO: 2033400 - protein, 24 aa, Staphylococcus
PIGRDCPKCEHYLVEKKKGRSSQV

SEQ ID NO: 2033401 - protein, 24 aa, Staphylococcus
PIGRDCPKCEHYLVEKKQGRKSQV

SEQ ID NO: 2033402 - protein, 25 aa, Staphylococcus
PIGRDCPKCNHYLMEHKKGRSSQVI

SEQ ID NO: 2033403 - protein, 17 aa, Staphylococcus
PIHFNMPFREPLTPDMD

SEQ ID NO: 2033404 - protein, 18 aa, Staphylococcus
PIHGEYRMLKAHGETGVD

SEQ ID NO: 2033405 - protein, 19 aa, Staphylococcus
PIHGEYRMLTAHGQTGVDC

SEQ ID NO: 2033406 - protein, 28 aa, Staphylococcus
PIHKLTALCEFLNISPSYIFKHNNVTEH

SEQ ID NO: 2033407 - protein, 24 aa, Staphylococcus
PIIEVFKAYTIQSLFEQWFHPPGA

SEQ ID NO: 2033408 - protein, 25 aa, Staphylococcus
PIIMDMAMDILKLPKDEVAMVGDLY

SEQ ID NO: 2033409 - protein, 24 aa, Staphylococcus
PIIPDVLKHLNFQNVSLVELQCEL

SEQ ID NO: 2033410 - protein, 20 aa, Staphylococcus
PIIQTWKKAYQEIADVFIQV

SEQ ID NO: 2033411 - protein, 19 aa, Staphylococcus
PIIQTWKNAYREIAQVFID

SEQ ID NO: 2033412 - protein, 22 aa, Staphylococcus
PIKAKRSPIQYFINALAINGLK

SEQ ID NO: 2033413 - protein, 23 aa, Staphylococcus
PIKIGLAALVDRGHRELPIRADF

SEQ ID NO: 2033414 - protein, 21 aa, Staphylococcus
PIKKIANHRVLAVNRGEKEKI

SEQ ID NO: 2033415 - protein, 19 aa, Staphylococcus
PIKKRIDIIELDNLDETQL

SEQ ID NO: 2033416 - protein, 21 aa, Staphylococcus
PIKRLGVWYMSRNVRKLMKKY

SEQ ID NO: 2033417 - protein, 22 aa, Staphylococcus
PIKSELLVDIYANVLNKEVVVI

SEQ ID NO: 2033418 - protein, 24 aa, Staphylococcus
PILDRYDIHTGQWLVLKDIAQFQP

SEQ ID NO: 2033419 - protein, 22 aa, Staphylococcus
PILEGFTLPKLLWLQENEPTHW

SEQ ID NO: 2033420 - protein, 23 aa, Staphylococcus
PILEGFTLPKMMWVSTHEPELWK

SEQ ID NO: 2033421 - protein, 27 aa, Staphylococcus
PILGICLGSQALTCYYGGKVVQGETVL

SEQ ID NO: 2033422 - protein, 18 aa, Staphylococcus
PILNSSWDGEDIIIHKDI

SEQ ID NO: 2033423 - protein, 17 aa, Staphylococcus
PIMEMIRSLIEVIQSNW

SEQ ID NO: 2033424 - protein, 18 aa, Staphylococcus
PIMKSFIDQAFWPENAFS

SEQ ID NO: 2033425 - protein, 17 aa, Staphylococcus
PINDLSFHLNDNLNEKF

SEQ ID NO: 2033426 - protein, 25 aa, Staphylococcus
PIPGADLPSVIGWRTIKDTEQMMTI

SEQ ID NO: 2033427 - protein, 26 aa, Staphylococcus
PIPGHELPSVIGWRTIEDTERMIEIA

SEQ ID NO: 2033428 - protein, 25 aa, Staphylococcus
PIPGSDLPSVIGWRTIDDTKRMMEI

SEQ ID NO: 2033429 - protein, 26 aa, Staphylococcus
PIPGSDLPSVIGWRTIEDTERMIEIA

SEQ ID NO: 2033430 - protein, 26 aa, Staphylococcus
PIPGSELPSVIGWRTIEDTERMIEIA

SEQ ID NO: 2033431 - protein, 37 aa, Staphylococcus
PIPIKALTAHLGFGNYELRLPLIPLDDAERNVLEQAY

SEQ ID NO: 2033432 - protein, 25 aa, Staphylococcus
PIPIKALTAVEGFGNYEVRLPLVTL

SEQ ID NO: 2033433 - protein, 21 aa, Staphylococcus
PIPMCGVPYHSAESYIETLIN

SEQ ID NO: 2033434 - protein, 26 aa, Staphylococcus
PIPVKALTAVEGFGNYEVRLPLVTLE

SEQ ID NO: 2033435 - protein, 18 aa, Staphylococcus
PIQGEIIGIIGPNGAGKS

SEQ ID NO: 2033436 - protein, 24 aa, Staphylococcus
PIQNPPRILGFDAVGEVVAAGPDT

SEQ ID NO: 2033437 - protein, 18 aa, Staphylococcus
PIQVGSHFHFFEANKALA

SEQ ID NO: 2033438 - protein, 18 aa, Staphylococcus
PIQVGSHFHFFEANKGLK

SEQ ID NO: 2033439 - protein, 24 aa, Staphylococcus
PIQYIVGFQSFYGYPFKVNENCLI

SEQ ID NO: 2033440 - protein, 20 aa, Staphylococcus
PIQYIVGFQSFYGYQLQVNS

SEQ ID NO: 2033441 - protein, 22 aa, Staphylococcus
PIQYIVGFQSFYGYTFEVDNNC

SEQ ID NO: 2033442 - protein, 18 aa, Staphylococcus
PIRDLLPVIPEFADYTLI

SEQ ID NO: 2033443 - protein, 19 aa, Staphylococcus
PIRFQWIDDYVVGVMLASK

SEQ ID NO: 2033444 - protein, 23 aa, Staphylococcus
PIRQIVFNFAHYRFTPIKKDSGC

SEQ ID NO: 2033445 - protein, 18 aa, Staphylococcus
PIRREAVVLASMVDDESV

SEQ ID NO: 2033446 - protein, 18 aa, Staphylococcus
PISDEGIGFYNMDINTAV

SEQ ID NO: 2033447 - protein, 18 aa, Staphylococcus
PISPYEIETLNQWIDVDK

SEQ ID NO: 2033448 - protein, 20 aa, Staphylococcus
PISSGKLRRYLSFENAKDVF

SEQ ID NO: 2033449 - protein, 21 aa, Staphylococcus
PISSGKLRRYLSFENAKDVFK

SEQ ID NO: 2033450 - protein, 18 aa, Staphylococcus
PISTDIAERLELKPMVMQ

SEQ ID NO: 2033451 - protein, 25 aa, Staphylococcus
PISVESVVLSGAFKEIGWFRRPTQR

SEQ ID NO: 2033452 - protein, 23 aa, Staphylococcus
PITAGELGRRVGLTTGSVTALVD

SEQ ID NO: 2033453 - protein, 25 aa, Staphylococcus
PITINRAGSMIGYFLNEGPVTNFEE

SEQ ID NO: 2033454 - protein, 25 aa, Staphylococcus
PITVNRAGSMIGYFLNAGPVTNFEQ

SEQ ID NO: 2033455 - protein, 25 aa, Staphylococcus
PITVNRAGSMIGYFLNDGPVTNFEQ

SEQ ID NO: 2033456 - protein, 25 aa, Staphylococcus
PITVNRAGSMIGYFLNEGPVTNFDE

SEQ ID NO: 2033457 - protein, 25 aa, Staphylococcus
PITVNRAGSMIGYFLNEGPVTNFEQ

SEQ ID NO: 2033458 - protein, 25 aa, Staphylococcus
PITVNRAGSMIGYFLNKGPVTNFEE

SEQ ID NO: 2033459 - protein, 18 aa, Staphylococcus
PITYPAIPSVLYTLPRLS

SEQ ID NO: 2033460 - protein, 26 aa, Staphylococcus
PIVEKELIARIGFVIEPQFLFSNLIN

SEQ ID NO: 2033461 - protein, 17 aa, Staphylococcus
PIVKSLVYSSRFDKKDT

SEQ ID NO: 2033462 - protein, 30 aa, Staphylococcus
PIVLPRMKITYLPIRIEKLINQYKLNAKNV

SEQ ID NO: 2033463 - protein, 25 aa, Staphylococcus
PIVLPRMKMTYMMERTQKLLKQYSL

SEQ ID NO: 2033464 - protein, 24 aa, Staphylococcus
PIVMSSRIRLARNLENHVHPLMFP

SEQ ID NO: 2033465 - protein, 24 aa, Staphylococcus
PIVNEDFKLVGIVTSREIINMNEE

SEQ ID NO: 2033466 - protein, 21 aa, Staphylococcus
PIVPAIMPVVYKHCALQVQPE

SEQ ID NO: 2033467 - protein, 25 aa, Staphylococcus
PIYCDNRITLGYPKVRQDIRDGLSE

SEQ ID NO: 2033468 - protein, 26 aa, Staphylococcus
PIYCDNRVTLGFPKVRRQIRDGLVNL

SEQ ID NO: 2033469 - protein, 19 aa, Staphylococcus
PIYGGPLALGLIRNKLEEH

SEQ ID NO: 2033470 - protein, 18 aa, Staphylococcus
PIYLDDLIIIFTDGVTEA

SEQ ID NO: 2033471 - protein, 19 aa, Staphylococcus
PIYLEDLIIIFTDGVTEAR

SEQ ID NO: 2033472 - protein, 20 aa, Staphylococcus
PIYWQLQLLYLLVKTPQNLN

SEQ ID NO: 2033473 - protein, 20 aa, Staphylococcus
PKALKTLLLLHGLSSDETSY

SEQ ID NO: 2033474 - protein, 25 aa, Staphylococcus
PKANLIRFIFEEGFIALRPSGTEPK

SEQ ID NO: 2033475 - protein, 19 aa, Staphylococcus
PKAQIQLFKQFKAIADKKK

SEQ ID NO: 2033476 - protein, 17 aa, Staphylococcus
PKAVADWVREQNDVLVT

SEQ ID NO: 2033477 - protein, 17 aa, Staphylococcus
PKCDGTGQEFEEPCPTC

SEQ ID NO: 2033478 - protein, 19 aa, Staphylococcus
PKCDICPLLEDCREGQKRM

SEQ ID NO: 2033479 - protein, 18 aa, Staphylococcus
PKCNVKHLVDEGKIAQFR

SEQ ID NO: 2033480 - protein, 17 aa, Staphylococcus
PKCQGTGQEFEEPCPTC

SEQ ID NO: 2033481 - protein, 17 aa, Staphylococcus
PKDAPGFPVRAFAIKPS

SEQ ID NO: 2033482 - protein, 18 aa, Staphylococcus
PKDEFSFPQVTLAAEERT

SEQ ID NO: 2033483 - protein, 17 aa, Staphylococcus
PKDEVAMVGDLYETDIM

SEQ ID NO: 2033484 - protein, 22 aa, Staphylococcus
PKDHPWRSLKNSGMTVEAQKRI

SEQ ID NO: 2033485 - protein, 22 aa, Staphylococcus
PKDIHLKLTYLLNTYQVDEIMI

SEQ ID NO: 2033486 - protein, 19 aa, Staphylococcus
PKDLFAVVMDAHTGEILAY

SEQ ID NO: 2033487 - protein, 18 aa, Staphylococcus
PKDLGIKALDDYTLKIDL

SEQ ID NO: 2033488 - protein, 21 aa, Staphylococcus
PKDQGGLRYCINSAAIQFIPY

SEQ ID NO: 2033489 - protein, 17 aa, Staphylococcus
PKDSFIFDTGGYKNQSR

SEQ ID NO: 2033490 - protein, 25 aa, Staphylococcus
PKDSLKVFPGLVAYVGQTYEEAYAK

SEQ ID NO: 2033491 - protein, 17 aa, Staphylococcus
PKEAYAYLEKLRSIIQY

SEQ ID NO: 2033492 - protein, 21 aa, Staphylococcus
PKEDFSYPLKMNVDHRGSFTE

SEQ ID NO: 2033493 - protein, 20 aa, Staphylococcus
PKEDLIEFAHNVVAAEGVSI

SEQ ID NO: 2033494 - protein, 23 aa, Staphylococcus
PKEDRAGLLATILNTFAIFNINL

SEQ ID NO: 2033495 - protein, 17 aa, Staphylococcus
PKEEASVLISLLEDKVF

SEQ ID NO: 2033496 - protein, 24 aa, Staphylococcus
PKEGEYAVGLFFSKERVIGSKHET

SEQ ID NO: 2033497 - protein, 17 aa, Staphylococcus
PKEKGIMVLSDEYQVGQ

SEQ ID NO: 2033498 - protein, 18 aa, Staphylococcus
PKELRKRIGDYFNKSNVQ

SEQ ID NO: 2033499 - protein, 18 aa, Staphylococcus
PKELRTRVNKYFKDETFK

SEQ ID NO: 2033500 - protein, 20 aa, Staphylococcus
PKEQACCSVEIEEKEENKKE

SEQ ID NO: 2033501 - protein, 24 aa, Staphylococcus
PKERRAGVITFNLADIHPHDVATA

SEQ ID NO: 2033502 - protein, 18 aa, Staphylococcus
PKESLEELVKYIREKAPD

SEQ ID NO: 2033503 - protein, 23 aa, Staphylococcus
PKETSVGKALRYPEKAVINELLK

SEQ ID NO: 2033504 - protein, 19 aa, Staphylococcus
PKFFKTMLVEFMDKTNYTC

SEQ ID NO: 2033505 - protein, 25 aa, Staphylococcus
PKFFNAVDVPPFWEISGDGQSAQIK

SEQ ID NO: 2033506 - protein, 28 aa, Staphylococcus
PKFKNAESKLTVAMGNRINNEPLLMDIA

SEQ ID NO: 2033507 - protein, 21 aa, Staphylococcus
PKFQQEIAYYLKDYVGRETPL

SEQ ID NO: 2033508 - protein, 19 aa, Staphylococcus
PKFYTTYADMHMDAFDTIT

SEQ ID NO: 2033509 - protein, 22 aa, Staphylococcus
PKGAPAYFSNLPVKRMTENIKQ

SEQ ID NO: 2033510 - protein, 19 aa, Staphylococcus
PKGAQAFTKHQFTTEHQGF

SEQ ID NO: 2033511 - protein, 18 aa, Staphylococcus
PKGARVGIVGAGLSGIEL

SEQ ID NO: 2033512 - protein, 18 aa, Staphylococcus
PKGAYSINRLRELIRLVK

SEQ ID NO: 2033513 - protein, 22 aa, Staphylococcus
PKGDAFARRSQYALDIDFKEAP

SEQ ID NO: 2033514 - protein, 17 aa, Staphylococcus
PKGGCAGSLMNLLQEPR

SEQ ID NO: 2033515 - protein, 20 aa, Staphylococcus
PKGIAALFQYDPSSSLEDNH

SEQ ID NO: 2033516 - protein, 18 aa, Staphylococcus
PKGIFLTHGHLDHINGAK

SEQ ID NO: 2033517 - protein, 30 aa, Staphylococcus
PKGKLDLRLEIVRYMKKRGVICDVDNICIT

SEQ ID NO: 2033518 - protein, 17 aa, Staphylococcus
PKGKVTIIGGGQAGTNA

SEQ ID NO: 2033519 - protein, 25 aa, Staphylococcus
PKGLFKADIVLLGISRTSKTPLSQY

SEQ ID NO: 2033520 - protein, 20 aa, Staphylococcus
PKGSRWLIGTEMNLVNRLKE

SEQ ID NO: 2033521 - protein, 25 aa, Staphylococcus
PKGVGIENICPFSRDGQMRILDNNQ

SEQ ID NO: 2033522 - protein, 17 aa, Staphylococcus
PKGVGIENMCPFSRDGQ

SEQ ID NO: 2033523 - protein, 17 aa, Staphylococcus
PKGVGVENLCPFSRDGQ

SEQ ID NO: 2033524 - protein, 18 aa, Staphylococcus
PKGVVNWIPGDSSDIGDY

SEQ ID NO: 2033525 - protein, 23 aa, Staphylococcus
PKGYGLMMMVDILSGSLLGLPFG

SEQ ID NO: 2033526 - protein, 17 aa, Staphylococcus
PKHAFDYSNHFPGNIVK

SEQ ID NO: 2033527 - protein, 21 aa, Staphylococcus
PKHELRVILTSLFQYIQQKDH

SEQ ID NO: 2033528 - protein, 19 aa, Staphylococcus
PKHHTCLITPVNHDTILTT

SEQ ID NO: 2033529 - protein, 19 aa, Staphylococcus
PKHHTCLITPVNHNTIRTT

SEQ ID NO: 2033530 - protein, 19 aa, Staphylococcus
PKHIIDWFIEAQKNYGLQK

SEQ ID NO: 2033531 - protein, 31 aa, Staphylococcus
PKHITKRVAIEMASSLGWHKYVGTDGKVIGI

SEQ ID NO: 2033532 - protein, 17 aa, Staphylococcus
PKHLIKEVPIFHDQYPK

SEQ ID NO: 2033533 - protein, 19 aa, Staphylococcus
PKHLKTYRTIFNHISVETM

SEQ ID NO: 2033534 - protein, 19 aa, Staphylococcus
PKHLTLRDIVKAIELGIRA

SEQ ID NO: 2033535 - protein, 19 aa, Staphylococcus
PKHQFSFPQVTLAAEERTI

SEQ ID NO: 2033536 - protein, 18 aa, Staphylococcus
PKHRRIAAGPEIQSRGFV

SEQ ID NO: 2033537 - protein, 19 aa, Staphylococcus
PKHWDELIKVPVYSMKQLE

SEQ ID NO: 2033538 - protein, 19 aa, Staphylococcus
PKIKEMIPSYGLKLNEHEE

SEQ ID NO: 2033539 - protein, 18 aa, Staphylococcus
PKIKEMVPSFGLKLSEHE

SEQ ID NO: 2033540 - protein, 21 aa, Staphylococcus
PKILLCDEATSALDPATTSSI

SEQ ID NO: 2033541 - protein, 28 aa, Staphylococcus
PKIPQGRGNIKWRAFATLPEQFEILNKM

SEQ ID NO: 2033542 - protein, 28 aa, Staphylococcus
PKIPQGRGNIKWRAFATLPEQYEILNEV

SEQ ID NO: 2033543 - protein, 17 aa, Staphylococcus
PKKAIKLVAEDRHMKTG

SEQ ID NO: 2033544 - protein, 17 aa, Staphylococcus
PKKAIKVVAEERQMKTS

SEQ ID NO: 2033545 - protein, 22 aa, Staphylococcus
PKKDRVVVEGVNIIKKHQKPTQ

SEQ ID NO: 2033546 - protein, 23 aa, Staphylococcus
PKKDRVVVEGVNIIKKHQKPTQF

SEQ ID NO: 2033547 - protein, 21 aa, Staphylococcus
PKKEFQLLYMLTSHPKQVFLR

SEQ ID NO: 2033548 - protein, 24 aa, Staphylococcus
PKKHPRVIVYAGMSLAQKNDQEAY

SEQ ID NO: 2033549 - protein, 18 aa, Staphylococcus
PKKIEIINMYGPTESTII

SEQ ID NO: 2033550 - protein, 22 aa, Staphylococcus
PKKIGLATLVDRGHRELPIRAD

SEQ ID NO: 2033551 - protein, 24 aa, Staphylococcus
PKKILSMTMKWFGFVVKTNKSRAR

SEQ ID NO: 2033552 - protein, 17 aa, Staphylococcus
PKKKRMGRYQGYTNKKR

SEQ ID NO: 2033553 - protein, 17 aa, Staphylococcus
PKKLTLRDVTKAIELGI

SEQ ID NO: 2033554 - protein, 24 aa, Staphylococcus
PKKNPRIIVYAGMKLAQKNDQEAY

SEQ ID NO: 2033555 - protein, 24 aa, Staphylococcus
PKKVYEAIEALKFEDLTRTDASNS

SEQ ID NO: 2033556 - protein, 26 aa, Staphylococcus
PKLAAKRKLSVFLYSVNDFTDFDATT

SEQ ID NO: 2033557 - protein, 27 aa, Staphylococcus
PKLAAKRKLSVFLYSVNDFTDFSATTQ

SEQ ID NO: 2033558 - protein, 18 aa, Staphylococcus
PKLDELFEKYAIEVGEEV

SEQ ID NO: 2033559 - protein, 18 aa, Staphylococcus
PKLDELFEKYALEVGEDV

SEQ ID NO: 2033560 - protein, 23 aa, Staphylococcus
PKLEEELKFLLIPKDPNDDKDVI

SEQ ID NO: 2033561 - protein, 20 aa, Staphylococcus
PKLEEMPGFNRVEVSLIEND

SEQ ID NO: 2033562 - protein, 39 aa, Staphylococcus
PKLFQKLNIEWVYRLLIDWKRIGRMMSIPKFMIKVSKQK

SEQ ID NO: 2033563 - protein, 20 aa, Staphylococcus
PKLFRKLPIQTKVKIRGLEA

SEQ ID NO: 2033564 - protein, 21 aa, Staphylococcus
PKLGAINVHASLLPKYRGGAP

SEQ ID NO: 2033565 - protein, 17 aa, Staphylococcus
PKLGIQIIEQLSHTYDE

SEQ ID NO: 2033566 - protein, 24 aa, Staphylococcus
PKLIKVKELYHLYQQLYTNPMTFN

SEQ ID NO: 2033567 - protein, 17 aa, Staphylococcus
PKLIVAGTSAYSRQLDF

SEQ ID NO: 2033568 - protein, 23 aa, Staphylococcus
PKLKPENIVLIGMRDLDKGEREY

SEQ ID NO: 2033569 - protein, 25 aa, Staphylococcus
PKLKQEYRPTVSIVNAENAAHGKGL

SEQ ID NO: 2033570 - protein, 21 aa, Staphylococcus
PKLLAHYNFIYKGHIEELKNM

SEQ ID NO: 2033571 - protein, 19 aa, Staphylococcus
PKLLNEMLMNTSINVWVST

SEQ ID NO: 2033572 - protein, 19 aa, Staphylococcus
PKLLWPIYYFVQAPLQGLI

SEQ ID NO: 2033573 - protein, 20 aa, Staphylococcus
PKLMPFQGYVLQNFQLKDDD

SEQ ID NO: 2033574 - protein, 17 aa, Staphylococcus
PKLNKKELLKAVKEGLE

SEQ ID NO: 2033575 - protein, 23 aa, Staphylococcus
PKLPHMKEAEILFFIDNIDAKMN

SEQ ID NO: 2033576 - protein, 19 aa, Staphylococcus
PKLSIEAKAIYCYLSSYAG

SEQ ID NO: 2033577 - protein, 18 aa, Staphylococcus
PKLSYIYDYAHKIIYKAI

SEQ ID NO: 2033578 - protein, 18 aa, Staphylococcus
PKLSYIYDYPHDKLYKAI

SEQ ID NO: 2033579 - protein, 18 aa, Staphylococcus
PKLSYIYDYVHQKLYKAI

SEQ ID NO: 2033580 - protein, 20 aa, Staphylococcus
PKLTFKSSILQLIKDNKVTA

SEQ ID NO: 2033581 - protein, 20 aa, Staphylococcus
PKLTFKSSILQLIKENNVTA

SEQ ID NO: 2033582 - protein, 20 aa, Staphylococcus
PKLTLQKRQSFVENVYGDAN

SEQ ID NO: 2033583 - protein, 18 aa, Staphylococcus
PKLVTRDMVKSMKTGSVL

SEQ ID NO: 2033584 - protein, 23 aa, Staphylococcus
PKLVWPVYYLFQSPFQGLMLRGF

SEQ ID NO: 2033585 - protein, 19 aa, Staphylococcus
PKMFWPVYYFVQAPLQGIM

SEQ ID NO: 2033586 - protein, 20 aa, Staphylococcus
PKMGTYGLSDLVGLDIAIAV

SEQ ID NO: 2033587 - protein, 19 aa, Staphylococcus
PKMVHDFPLYPIRQSHKVI

SEQ ID NO: 2033588 - protein, 19 aa, Staphylococcus
PKNAEGLTELELEQITKIH

SEQ ID NO: 2033589 - protein, 17 aa, Staphylococcus
PKNKAIVGQNAFSHESG

SEQ ID NO: 2033590 - protein, 18 aa, Staphylococcus
PKNLEAFIQVGVRVVVPF

SEQ ID NO: 2033591 - protein, 25 aa, Staphylococcus
PKNNGRFSPVVFKLASENQIDLSQV

SEQ ID NO: 2033592 - protein, 21 aa, Staphylococcus
PKNPLCLFCPVQDNCSAFKEG

SEQ ID NO: 2033593 - protein, 22 aa, Staphylococcus
PKNPLCLFCPVQENCEAFRKGT

SEQ ID NO: 2033594 - protein, 21 aa, Staphylococcus
PKNQGAWSFVYPYLKELTTDK

SEQ ID NO: 2033595 - protein, 25 aa, Staphylococcus
PKNRARLVIYPAAMRYAGPKEAVLH

SEQ ID NO: 2033596 - protein, 26 aa, Staphylococcus
PKPGTDLVWLGAVTKYIIDHDLHDKA

SEQ ID NO: 2033597 - protein, 26 aa, Staphylococcus
PKPGTDLVWLGAVTKYIIDNDLHDKA

SEQ ID NO: 2033598 - protein, 25 aa, Staphylococcus
PKPPKARDMIIKKGDVININTQDKT

SEQ ID NO: 2033599 - protein, 18 aa, Staphylococcus
PKPPSSMMKPNLNTLDSV

SEQ ID NO: 2033600 - protein, 20 aa, Staphylococcus
PKPWDIAAQFLFAKELGLKM

SEQ ID NO: 2033601 - protein, 20 aa, Staphylococcus
PKPWDIAAQFLFAKELGLVM

SEQ ID NO: 2033602 - protein, 20 aa, Staphylococcus
PKPWDIAAQFLFAKELNLKM

SEQ ID NO: 2033603 - protein, 22 aa, Staphylococcus
PKPWDIAAQFLFASELGLKMTT

SEQ ID NO: 2033604 - protein, 23 aa, Staphylococcus
PKPYFDENLAVWKAMEEAVEEGK

SEQ ID NO: 2033605 - protein, 22 aa, Staphylococcus
PKQADIYLYGSFMETYKGHGTD

SEQ ID NO: 2033606 - protein, 19 aa, Staphylococcus
PKQAISMGLQSIIKAKRII

SEQ ID NO: 2033607 - protein, 21 aa, Staphylococcus
PKQAISMGLQSIMRAKRIILL

SEQ ID NO: 2033608 - protein, 28 aa, Staphylococcus
PKQCKHEFLRYPYIESFEHVDEVIQVAR

SEQ ID NO: 2033609 - protein, 20 aa, Staphylococcus
PKQQLPLLIRTRHNGDKVEL

SEQ ID NO: 2033610 - protein, 27 aa, Staphylococcus
PKQTKGMVKREVVRIVTPGTVMEQGGV

SEQ ID NO: 2033611 - protein, 25 aa, Staphylococcus
PKRAEWLLMDLFDWSFTDYVMKREE

SEQ ID NO: 2033612 - protein, 18 aa, Staphylococcus
PKRDWYIWKKPKSDGSEP

SEQ ID NO: 2033613 - protein, 19 aa, Staphylococcus
PKRGEVEKVSILNDIDFEI

SEQ ID NO: 2033614 - protein, 18 aa, Staphylococcus
PKRLITVGLGNIKELTYA

SEQ ID NO: 2033615 - protein, 18 aa, Staphylococcus
PKRLITVGLGNLKTLSYA

SEQ ID NO: 2033616 - protein, 20 aa, Staphylococcus
PKRQAIAIVGDGAFQMVMQD

SEQ ID NO: 2033617 - protein, 21 aa, Staphylococcus
PKRQAISISGDGAFQMVMQDF

SEQ ID NO: 2033618 - protein, 20 aa, Staphylococcus
PKRRVMLDFLIGSALVDKDK

SEQ ID NO: 2033619 - protein, 25 aa, Staphylococcus
PKRSKAVIKEAYFRTPSTTDYNGIY

SEQ ID NO: 2033620 - protein, 24 aa, Staphylococcus
PKRTSPYEFYQFWLNQDDRDVIKY

SEQ ID NO: 2033621 - protein, 29 aa, Staphylococcus
PKSDRLTQFFDFITNFGIMVRGTGEDISP

SEQ ID NO: 2033622 - protein, 19 aa, Staphylococcus
PKSFEVMRYHSLIADKNHI

SEQ ID NO: 2033623 - protein, 25 aa, Staphylococcus
PKSIYWKPKQSLILNFDKSTLDLTG

SEQ ID NO: 2033624 - protein, 24 aa, Staphylococcus
PKSSSIEDWGKYIIKQPRFSNDIN

SEQ ID NO: 2033625 - protein, 19 aa, Staphylococcus
PKSYIFEIASNWKKKDIKT

SEQ ID NO: 2033626 - protein, 18 aa, Staphylococcus
PKSYIFEIASNWKKLGIK

SEQ ID NO: 2033627 - protein, 19 aa, Staphylococcus
PKSYKTLMLLHGLSSDATS

SEQ ID NO: 2033628 - protein, 20 aa, Staphylococcus
PKSYYIGSFMQIFKNDQSEP

SEQ ID NO: 2033629 - protein, 19 aa, Staphylococcus
PKTKGIVGDNFFKKTKPNL

SEQ ID NO: 2033630 - protein, 24 aa, Staphylococcus
PKTMSLSFLKFIWDFPKINDEQIK

SEQ ID NO: 2033631 - protein, 26 aa, Staphylococcus
PKTNLIRFIFENGFIALRPSGTEPKI

SEQ ID NO: 2033632 - protein, 19 aa, Staphylococcus
PKTVEIIKESFTIQQATEK

SEQ ID NO: 2033633 - protein, 19 aa, Staphylococcus
PKVIYKKAKSINISSFTDM

SEQ ID NO: 2033634 - protein, 19 aa, Staphylococcus
PKVIYKKAKSVNISSFTEM

SEQ ID NO: 2033635 - protein, 18 aa, Staphylococcus
PKVKAKPGITQMKYTLDF

SEQ ID NO: 2033636 - protein, 33 aa, Staphylococcus
PKVKLDIHTELPLYVTICSGLIKADKYEWMLQK

SEQ ID NO: 2033637 - protein, 21 aa, Staphylococcus
PKVQFLKENTFAFIGGTSNAK

SEQ ID NO: 2033638 - protein, 19 aa, Staphylococcus
PKVRMMSFTGSGPTGAKIM

SEQ ID NO: 2033639 - protein, 17 aa, Staphylococcus
PKVRMYYERSEPVAEAF

SEQ ID NO: 2033640 - protein, 17 aa, Staphylococcus
PKVYPETKIEKWFYEGA

SEQ ID NO: 2033641 - protein, 23 aa, Staphylococcus
PKWAEAYQSVLLQARDLVSKRLI

SEQ ID NO: 2033642 - protein, 24 aa, Staphylococcus
PKWLVDHWTTHFGIEKTETIAQSF

SEQ ID NO: 2033643 - protein, 19 aa, Staphylococcus
PKYDGFYWCRQIRHESNVP

SEQ ID NO: 2033644 - protein, 24 aa, Staphylococcus
PKYDKAGLLASILTTFALFDINLS

SEQ ID NO: 2033645 - protein, 20 aa, Staphylococcus
PKYDNIFADVEWGINKLQHN

SEQ ID NO: 2033646 - protein, 17 aa, Staphylococcus
PKYIKFQLNRNGKSIPY

SEQ ID NO: 2033647 - protein, 30 aa, Staphylococcus
PKYNAYMGAYRLQWDMIKFAKEHNVDRYNF

SEQ ID NO: 2033648 - protein, 29 aa, Staphylococcus
PKYNAYMGAYRLQWEMIKFAKEHNLDRYN

SEQ ID NO: 2033649 - protein, 25 aa, Staphylococcus
PKYNDRQAIGWSQVKMKAELHNEAI

SEQ ID NO: 2033650 - protein, 26 aa, Staphylococcus
PKYNEFMGAYCLQWDMIRYAKEKGIE

SEQ ID NO: 2033651 - protein, 24 aa, Staphylococcus
PKYVQRPTVDKIRHFQEVAKGLIK

SEQ ID NO: 2033652 - protein, 18 aa, Staphylococcus
PLACAVSIAALDVIIDED

SEQ ID NO: 2033653 - protein, 18 aa, Staphylococcus
PLACAVSIAALDVIIDEN

SEQ ID NO: 2033654 - protein, 18 aa, Staphylococcus
PLACAVSIAALDVILDED

SEQ ID NO: 2033655 - protein, 19 aa, Staphylococcus
PLACAVSMAALDVLNEEHL

SEQ ID NO: 2033656 - protein, 17 aa, Staphylococcus
PLAEAGLLDEFKALARF

SEQ ID NO: 2033657 - protein, 25 aa, Staphylococcus
PLAGPVVACAVILNADHAYYGLDDS

SEQ ID NO: 2033658 - protein, 25 aa, Staphylococcus
PLAGPVVACAVILNANHHYLGLNDS

SEQ ID NO: 2033659 - protein, 27 aa, Staphylococcus
PLAGPVVACAVILNEGHRYLGLDDSKK

SEQ ID NO: 2033660 - protein, 24 aa, Staphylococcus
PLAGPVVACAVILNKEHQYLGLDD

SEQ ID NO: 2033661 - protein, 26 aa, Staphylococcus
PLAGPVVACAVILNKGHHYLGLNDSK

SEQ ID NO: 2033662 - protein, 24 aa, Staphylococcus
PLAGPVVTCAVILNKNHHFTGLND

SEQ ID NO: 2033663 - protein, 28 aa, Staphylococcus
PLAGPVVTCAVILNPGHRYLGLNDSKKV

SEQ ID NO: 2033664 - protein, 25 aa, Staphylococcus
PLAHSLTLYALMYAHHHSVPCYMQT

SEQ ID NO: 2033665 - protein, 22 aa, Staphylococcus
PLARNELHYLLDNIPTVKHVEE

SEQ ID NO: 2033666 - protein, 28 aa, Staphylococcus
PLARNELHYLLNEISGFNVIDEAENIEE

SEQ ID NO: 2033667 - protein, 29 aa, Staphylococcus
PLARNELHYLLNEISSFEIIDEAENIEET

SEQ ID NO: 2033668 - protein, 23 aa, Staphylococcus
PLARNELHYLLNQINHFEKIDKA

SEQ ID NO: 2033669 - protein, 17 aa, Staphylococcus
PLAVSGDKITLGFNEKE

SEQ ID NO: 2033670 - protein, 20 aa, Staphylococcus
PLAYYVSLALLKPININSYF

SEQ ID NO: 2033671 - protein, 21 aa, Staphylococcus
PLDAVKCLALGASAVGMSRPF

SEQ ID NO: 2033672 - protein, 19 aa, Staphylococcus
PLDENIEPMALLAQINLSE

SEQ ID NO: 2033673 - protein, 19 aa, Staphylococcus
PLDIERIAHIDVWVEAYTN

SEQ ID NO: 2033674 - protein, 25 aa, Staphylococcus
PLDKERLADMEVWMAFRNDIHEYGQ

SEQ ID NO: 2033675 - protein, 20 aa, Staphylococcus
PLDQGLELFVGVPSERYPAH

SEQ ID NO: 2033676 - protein, 21 aa, Staphylococcus
PLDQLKQVTGYIRGGCSPIGM

SEQ ID NO: 2033677 - protein, 17 aa, Staphylococcus
PLDTMLASFGKRDDINS

SEQ ID NO: 2033678 - protein, 23 aa, Staphylococcus
PLDYEAFADINLKLFKDDNQIET

SEQ ID NO: 2033679 - protein, 23 aa, Staphylococcus
PLEDESREAYTIVIPPPNVTGKL

SEQ ID NO: 2033680 - protein, 18 aa, Staphylococcus
PLEFSYHYLREMFKEVMG

SEQ ID NO: 2033681 - protein, 19 aa, Staphylococcus
PLEPGCYLMKDRNDQVIYV

SEQ ID NO: 2033682 - protein, 18 aa, Staphylococcus
PLEQLRIFVDSSSIEIFC

SEQ ID NO: 2033683 - protein, 19 aa, Staphylococcus
PLESMEMIQFHPTLLGKPY

SEQ ID NO: 2033684 - protein, 17 aa, Staphylococcus
PLFANCLQFLDEQLTQP

SEQ ID NO: 2033685 - protein, 17 aa, Staphylococcus
PLFAWDLNMGGLMNALE

SEQ ID NO: 2033686 - protein, 19 aa, Staphylococcus
PLFMDGARLGYGLMSENTD

SEQ ID NO: 2033687 - protein, 18 aa, Staphylococcus
PLFRNIDASYARSDQYET

SEQ ID NO: 2033688 - protein, 23 aa, Staphylococcus
PLFVKIGMELFYQAGPDLIKSIK

SEQ ID NO: 2033689 - protein, 21 aa, Staphylococcus
PLGATEWSEFYGMFNDPFGIT

SEQ ID NO: 2033690 - protein, 38 aa, Staphylococcus
PLGCTATILYKMFKEQGFEIKPQIASLMLSAIISDSLL

SEQ ID NO: 2033691 - protein, 24 aa, Staphylococcus
PLGIYRFLIQQPLVYTRTLDHPVI

SEQ ID NO: 2033692 - protein, 17 aa, Staphylococcus
PLGKLSGKHAFAEKLKA

SEQ ID NO: 2033693 - protein, 17 aa, Staphylococcus
PLGKLSGKHAFAEKLKS

SEQ ID NO: 2033694 - protein, 17 aa, Staphylococcus
PLGLKDRSLGEGIKDLV

SEQ ID NO: 2033695 - protein, 18 aa, Staphylococcus
PLGPRPIDQHIKGFKALG

SEQ ID NO: 2033696 - protein, 24 aa, Staphylococcus
PLGSGKSLAYLIAALMYNIETKQH

SEQ ID NO: 2033697 - protein, 18 aa, Staphylococcus
PLGSLFEQASLVFLDSVV

SEQ ID NO: 2033698 - protein, 18 aa, Staphylococcus
PLGSRTWQAAIDPIGGNG

SEQ ID NO: 2033699 - protein, 25 aa, Staphylococcus
PLGVYRFLENKTKIYARTLDHPVIE

SEQ ID NO: 2033700 - protein, 24 aa, Staphylococcus
PLGVYRYLINTPKVYARTLDHPVI

SEQ ID NO: 2033701 - protein, 22 aa, Staphylococcus
PLHKDRIPVVIKNTNRPDDIGT

SEQ ID NO: 2033702 - protein, 22 aa, Staphylococcus
PLHKDRIPVVIKNTNRPEDKGT

SEQ ID NO: 2033703 - protein, 18 aa, Staphylococcus
PLHLQAKEGLALINGTQA

SEQ ID NO: 2033704 - protein, 19 aa, Staphylococcus
PLHPEFRTMPMVWYCPPLS

SEQ ID NO: 2033705 - protein, 18 aa, Staphylococcus
PLHYHLSDATGRTVEVTF

SEQ ID NO: 2033706 - protein, 20 aa, Staphylococcus
PLIDCLRPNDTFEFIIQTRS

SEQ ID NO: 2033707 - protein, 18 aa, Staphylococcus
PLIEQIRNSYSIKESKAI

SEQ ID NO: 2033708 - protein, 24 aa, Staphylococcus
PLIGELMSQWIISGHRPKQLYDFQ

SEQ ID NO: 2033709 - protein, 22 aa, Staphylococcus
PLIHRAKIGSILNVRELNQIKR

SEQ ID NO: 2033710 - protein, 28 aa, Staphylococcus
PLIHRWIDGRMPLIGIGSIFTADQALDA

SEQ ID NO: 2033711 - protein, 18 aa, Staphylococcus
PLIKEYTTRLTLNQMILM

SEQ ID NO: 2033712 - protein, 21 aa, Staphylococcus
PLKDEIVRYLGYFQTSSPSYL

SEQ ID NO: 2033713 - protein, 20 aa, Staphylococcus
PLKEIIHVYNIFKPPTPFCE

SEQ ID NO: 2033714 - protein, 25 aa, Staphylococcus
PLKEIRLKDGLLFRKMQIITDGGIL

SEQ ID NO: 2033715 - protein, 21 aa, Staphylococcus
PLKGHSVAVLVNGDISAETLK

SEQ ID NO: 2033716 - protein, 20 aa, Staphylococcus
PLKIKEPLNFEVRGEAYMPR

SEQ ID NO: 2033717 - protein, 17 aa, Staphylococcus
PLKKAEEDFELIVYHKG

SEQ ID NO: 2033718 - protein, 21 aa, Staphylococcus
PLKNRKCKIIFANHQTLTLNV

SEQ ID NO: 2033719 - protein, 19 aa, Staphylococcus
PLKRFKDEYSEVAYAGDMN

SEQ ID NO: 2033720 - protein, 21 aa, Staphylococcus
PLKTMLDGLALKSGFTDADKL

SEQ ID NO: 2033721 - protein, 27 aa, Staphylococcus
PLLAEDCLRTMKIFELLGVNFDIKDDK

SEQ ID NO: 2033722 - protein, 18 aa, Staphylococcus
PLLAKVTGAGCLLGGIIA

SEQ ID NO: 2033723 - protein, 23 aa, Staphylococcus
PLLDESFELPLVVATTGEKEKIT

SEQ ID NO: 2033724 - protein, 25 aa, Staphylococcus
PLLEEEFQLPLVIATTGEKEKLIEK

SEQ ID NO: 2033725 - protein, 19 aa, Staphylococcus
PLLEEIEKAIAEEDLLVTS

SEQ ID NO: 2033726 - protein, 31 aa, Staphylococcus
PLLGEDCLRTIEIFKLLGVNIELAEEKIIVD

SEQ ID NO: 2033727 - protein, 29 aa, Staphylococcus
PLLGEDCLRTLNIFKLLGVDITIKDDNVY

SEQ ID NO: 2033728 - protein, 17 aa, Staphylococcus
PLLKRMEHVDLIKRERS

SEQ ID NO: 2033729 - protein, 17 aa, Staphylococcus
PLLKRMENVDLIKRERS

SEQ ID NO: 2033730 - protein, 17 aa, Staphylococcus
PLLKRMEQVDLIKRERS

SEQ ID NO: 2033731 - protein, 28 aa, Staphylococcus
PLLKSFRLEKELDIFPSHFSKGMKQKVM

SEQ ID NO: 2033732 - protein, 19 aa, Staphylococcus
PLLNSSWDGEEIILHKDIN

SEQ ID NO: 2033733 - protein, 18 aa, Staphylococcus
PLLNSTWQGDEIIIHKDI

SEQ ID NO: 2033734 - protein, 21 aa, Staphylococcus
PLLQASWKIAPALATGCSLIM

SEQ ID NO: 2033735 - protein, 21 aa, Staphylococcus
PLLQASWKLAPALATGCSLVM

SEQ ID NO: 2033736 - protein, 20 aa, Staphylococcus
PLLQEYGLDFETFVNLHTSE

SEQ ID NO: 2033737 - protein, 18 aa, Staphylococcus
PLLQMPFLEALFKELQAN

SEQ ID NO: 2033738 - protein, 19 aa, Staphylococcus
PLLQMPFLEALFKSLKAYG

SEQ ID NO: 2033739 - protein, 18 aa, Staphylococcus
PLLQMPFLEQLFKQLKAE

SEQ ID NO: 2033740 - protein, 17 aa, Staphylococcus
PLLRLFLHRHELYEMNY

SEQ ID NO: 2033741 - protein, 18 aa, Staphylococcus
PLLSEKPLFIYISQSGET

SEQ ID NO: 2033742 - protein, 19 aa, Staphylococcus
PLLTAEWEEKLILIEKGRY

SEQ ID NO: 2033743 - protein, 18 aa, Staphylococcus
PLLTAEWEEKLLLIEKGR

SEQ ID NO: 2033744 - protein, 19 aa, Staphylococcus
PLLTAEWEEKLLLIEQGKY

SEQ ID NO: 2033745 - protein, 26 aa, Staphylococcus
PLLVAADIYRPAAIDQLETVGKQLNL

SEQ ID NO: 2033746 - protein, 17 aa, Staphylococcus
PLMKKLLDRMLEDNQIS

SEQ ID NO: 2033747 - protein, 17 aa, Staphylococcus
PLMKWLGQSSTARASFY

SEQ ID NO: 2033748 - protein, 17 aa, Staphylococcus
PLMKWLNVSSTARASFY

SEQ ID NO: 2033749 - protein, 24 aa, Staphylococcus
PLMLGEVDGAYCVASETCAFQAIG

SEQ ID NO: 2033750 - protein, 19 aa, Staphylococcus
PLMMKGRTGNEIMAASKID

SEQ ID NO: 2033751 - protein, 20 aa, Staphylococcus
PLMRRDLYKLIAALNEIEGV

SEQ ID NO: 2033752 - protein, 19 aa, Staphylococcus
PLNAQGKLDVKRAVGTEGS

SEQ ID NO: 2033753 - protein, 27 aa, Staphylococcus
PLNGLKKWLTPVDMWKSHQLTLNVGDD

SEQ ID NO: 2033754 - protein, 27 aa, Staphylococcus
PLNGLKKWLTPVEMWRNHQMTLNVGDD

SEQ ID NO: 2033755 - protein, 18 aa, Staphylococcus
PLNIERYFYLLTHTNKYI

SEQ ID NO: 2033756 - protein, 28 aa, Staphylococcus
PLNPEVIKWAKDVFGKRVLDTWWMTETG

SEQ ID NO: 2033757 - protein, 31 aa, Staphylococcus
PLNPEVIKWAKEVLGHTVLDTWWMTETGGHM

SEQ ID NO: 2033758 - protein, 21 aa, Staphylococcus
PLNPEVIKWAKSAYGKRVLDT

SEQ ID NO: 2033759 - protein, 21 aa, Staphylococcus
PLNQQCRAVLPYHLYIEINKL

SEQ ID NO: 2033760 - protein, 21 aa, Staphylococcus
PLNSMIKLFARQFKKSKIPVE

SEQ ID NO: 2033761 - protein, 27 aa, Staphylococcus
PLNSMIKLFGRHFKKNKIPVEIFGVMS

SEQ ID NO: 2033762 - protein, 19 aa, Staphylococcus
PLPDHIHFANSAVDRIVPQ

SEQ ID NO: 2033763 - protein, 28 aa, Staphylococcus
PLPMDIIYRRLDEIPHLRTLSITGGEPM

SEQ ID NO: 2033764 - protein, 24 aa, Staphylococcus
PLRDRFGVHLRLEYYKESELKDII

SEQ ID NO: 2033765 - protein, 25 aa, Staphylococcus
PLRDRFGVHLRLEYYNEADLKEIII

SEQ ID NO: 2033766 - protein, 25 aa, Staphylococcus
PLRDRFGVHLRLEYYNEHELKEIII

SEQ ID NO: 2033767 - protein, 26 aa, Staphylococcus
PLRDRFGVHLRLEYYQELELKEIIVR

SEQ ID NO: 2033768 - protein, 25 aa, Staphylococcus
PLRDRFGVHLRLEYYSESDLKEIII

SEQ ID NO: 2033769 - protein, 24 aa, Staphylococcus
PLRFLQVRIPVRMDDGTVQTFTGY

SEQ ID NO: 2033770 - protein, 19 aa, Staphylococcus
PLRRRVPGIELLEECLKIA

SEQ ID NO: 2033771 - protein, 30 aa, Staphylococcus
PLSADIFRKYGIDFCCGGNISINEAVKNKK

SEQ ID NO: 2033772 - protein, 26 aa, Staphylococcus
PLSHLRLIVRSLLGIAVPTQIATHDH

SEQ ID NO: 2033773 - protein, 26 aa, Staphylococcus
PLSHLRLIVRSLLGIAVPTQIATHDT

SEQ ID NO: 2033774 - protein, 27 aa, Staphylococcus
PLSHLRLIVRTLLGIAVPTQIATHDSD

SEQ ID NO: 2033775 - protein, 21 aa, Staphylococcus
PLSHLRVIVRSLLGIAVPTQI

SEQ ID NO: 2033776 - protein, 23 aa, Staphylococcus
PLSILYMHYDYWFTYEEDHEIET

SEQ ID NO: 2033777 - protein, 17 aa, Staphylococcus
PLSKLGYETIAIDMPTY

SEQ ID NO: 2033778 - protein, 19 aa, Staphylococcus
PLSMSVGLSSDIVFKLVYS

SEQ ID NO: 2033779 - protein, 19 aa, Staphylococcus
PLSPFEIETLNQWLDIDKH

SEQ ID NO: 2033780 - protein, 19 aa, Staphylococcus
PLSPYEIETLNQWIDVDHH

SEQ ID NO: 2033781 - protein, 19 aa, Staphylococcus
PLSPYEIETLNQWIDVDQH

SEQ ID NO: 2033782 - protein, 21 aa, Staphylococcus
PLSQPELWSAETPNLYTLYLI

SEQ ID NO: 2033783 - protein, 18 aa, Staphylococcus
PLSTMYMHYDYWFTYEYE

SEQ ID NO: 2033784 - protein, 23 aa, Staphylococcus
PLSVGIQACRRANIQPGSSVVIM

SEQ ID NO: 2033785 - protein, 27 aa, Staphylococcus
PLTDIYNRIGFDFGTLGNHEFNYGLNY

SEQ ID NO: 2033786 - protein, 19 aa, Staphylococcus
PLTLIGPKGIKAYIETTLR

SEQ ID NO: 2033787 - protein, 19 aa, Staphylococcus
PLTNCCLIDATSMLQHGFE

SEQ ID NO: 2033788 - protein, 22 aa, Staphylococcus
PLTQKRASIKYFINARKIIGIH

SEQ ID NO: 2033789 - protein, 26 aa, Staphylococcus
PLVEKGRLEGLITIKDIEKVLEFPHA

SEQ ID NO: 2033790 - protein, 18 aa, Staphylococcus
PLVEKIPISTLVQGTQAK

SEQ ID NO: 2033791 - protein, 17 aa, Staphylococcus
PLVEKISISTLVQGINA

SEQ ID NO: 2033792 - protein, 18 aa, Staphylococcus
PLVETLGGVPVYIDTTKS

SEQ ID NO: 2033793 - protein, 26 aa, Staphylococcus
PLVKEGRLEGLITIKDIEKVLEFPNS

SEQ ID NO: 2033794 - protein, 26 aa, Staphylococcus
PLVKNGRLEGLITIKDIEKVLEFPYA

SEQ ID NO: 2033795 - protein, 17 aa, Staphylococcus
PLVLPAHHYCLITPVDQ

SEQ ID NO: 2033796 - protein, 26 aa, Staphylococcus
PLVNFYNRMSFHFGTLGNHEFNYGLP

SEQ ID NO: 2033797 - protein, 18 aa, Staphylococcus
PLVNHSWFEELSIKEHVE

SEQ ID NO: 2033798 - protein, 18 aa, Staphylococcus
PLVNRITHEKAFVRYHGR

SEQ ID NO: 2033799 - protein, 20 aa, Staphylococcus
PLVQAGRVFIALPPLYKLEK

SEQ ID NO: 2033800 - protein, 32 aa, Staphylococcus
PLWEIAQEVYQEWYLGHRLYRKVENKTPRSDF

SEQ ID NO: 2033801 - protein, 26 aa, Staphylococcus
PLWSHFLRKVIVPALVPNRFQIIKIK

SEQ ID NO: 2033802 - protein, 28 aa, Staphylococcus
PLWSHLFKFVIFPAIVPNRFQVIKIAKS

SEQ ID NO: 2033803 - protein, 20 aa, Staphylococcus
PLYEIGWRLIPEVWGNGLAT

SEQ ID NO: 2033804 - protein, 22 aa, Staphylococcus
PLYKEPYVLITPKDEFPNQKTI

SEQ ID NO: 2033805 - protein, 17 aa, Staphylococcus
PLYKYFGGFNGKQLPVP

SEQ ID NO: 2033806 - protein, 23 aa, Staphylococcus
PLYQEIRRQMSLMDIIVESSKGE

SEQ ID NO: 2033807 - protein, 19 aa, Staphylococcus
PLYTIHKIFSLITLSQQLT

SEQ ID NO: 2033808 - protein, 17 aa, Staphylococcus
PMAALSRIANGTHKQIK

SEQ ID NO: 2033809 - protein, 18 aa, Staphylococcus
PMAKGAEKRLEFYRLYLF

SEQ ID NO: 2033810 - protein, 18 aa, Staphylococcus
PMAYTLWTRHLNFNPQSK

SEQ ID NO: 2033811 - protein, 18 aa, Staphylococcus
PMCGVPYHSADSYIETLI

SEQ ID NO: 2033812 - protein, 24 aa, Staphylococcus
PMDRILKPLKLMNANINGIENNYT

SEQ ID NO: 2033813 - protein, 24 aa, Staphylococcus
PMDRILKPLQLMQANISSVDNNYT

SEQ ID NO: 2033814 - protein, 25 aa, Staphylococcus
PMDRVLKPLLQMNAHISGIEGNYTP

SEQ ID NO: 2033815 - protein, 17 aa, Staphylococcus
PMGGIQIVPETNQVISP

SEQ ID NO: 2033816 - protein, 19 aa, Staphylococcus
PMHPFCRSAVAPHINPDWR

SEQ ID NO: 2033817 - protein, 18 aa, Staphylococcus
PMHPWCRSTTVPHVGNWR

SEQ ID NO: 2033818 - protein, 19 aa, Staphylococcus
PMIEYFKYKGIEIRFIEFM

SEQ ID NO: 2033819 - protein, 23 aa, Staphylococcus
PMIFDETFYRKMAIQKWQQQDYN

SEQ ID NO: 2033820 - protein, 26 aa, Staphylococcus
PMIFTEARLPLIRGINQKLIRPYKDE

SEQ ID NO: 2033821 - protein, 28 aa, Staphylococcus
PMIYITFSGHFKKAFPNLRIHHLRHSYA

SEQ ID NO: 2033822 - protein, 26 aa, Staphylococcus
PMKARGIRFAFCTGKQVERVEAVVGD

SEQ ID NO: 2033823 - protein, 20 aa, Staphylococcus
PMLDILKKLDVHNVCVVVTR

SEQ ID NO: 2033824 - protein, 26 aa, Staphylococcus
PMLDILKKLEIHNACVVVTRYFGGIK

SEQ ID NO: 2033825 - protein, 18 aa, Staphylococcus
PMLHYFKAKNIEVRFIEF

SEQ ID NO: 2033826 - protein, 26 aa, Staphylococcus
PMLMKNARFGFKMGNQALVDSMVADG

SEQ ID NO: 2033827 - protein, 24 aa, Staphylococcus
PMLRPREVHRTGYLVITSDKGLAG

SEQ ID NO: 2033828 - protein, 19 aa, Staphylococcus
PMLSDMKEAGGIEADASLA

SEQ ID NO: 2033829 - protein, 18 aa, Staphylococcus
PMNGEIKIFEAAYVATNE

SEQ ID NO: 2033830 - protein, 27 aa, Staphylococcus
PMNIGGKWEFEFGSVKYVQAFHSSSLT

SEQ ID NO: 2033831 - protein, 18 aa, Staphylococcus
PMPSQSAIKYVLENHDEF

SEQ ID NO: 2033832 - protein, 25 aa, Staphylococcus
PMRIKEFELLWYLASRENEVISKSE

SEQ ID NO: 2033833 - protein, 22 aa, Staphylococcus
PMSELKPEGIVWVIDPIDGTLN

SEQ ID NO: 2033834 - protein, 17 aa, Staphylococcus
PMSFKLNNQYMIFPNVK

SEQ ID NO: 2033835 - protein, 20 aa, Staphylococcus
PMSKAKSFISPKSFETTMHV

SEQ ID NO: 2033836 - protein, 20 aa, Staphylococcus
PMSPLSKIFWMKHEQPDIYN

SEQ ID NO: 2033837 - protein, 20 aa, Staphylococcus
PMSPLSKIFWMKHEQPDIYQ

SEQ ID NO: 2033838 - protein, 25 aa, Staphylococcus
PMTVNRAGSMIGYFLNDGPVTNFEQ

SEQ ID NO: 2033839 - protein, 30 aa, Staphylococcus
PMVIKMGRYGKFMACSNFPDCRNTKAIVKE

SEQ ID NO: 2033840 - protein, 23 aa, Staphylococcus
PMVLPARLPNLLINGSTGISAGY

SEQ ID NO: 2033841 - protein, 17 aa, Staphylococcus
PMVNRITTDTAFVRYHG

SEQ ID NO: 2033842 - protein, 19 aa, Staphylococcus
PMVYCGLFPIDNRDYNDLR

SEQ ID NO: 2033843 - protein, 24 aa, Staphylococcus
PNAELKVYMIASVEERAERRQKEN

SEQ ID NO: 2033844 - protein, 28 aa, Staphylococcus
PNAETARQCALVWGIFPVVKEGRKTTDA

SEQ ID NO: 2033845 - protein, 22 aa, Staphylococcus
PNAKASLLKLVHEVKEDNDVTI

SEQ ID NO: 2033846 - protein, 17 aa, Staphylococcus
PNAKIVFLDTDLHFQET

SEQ ID NO: 2033847 - protein, 25 aa, Staphylococcus
PNALRVGFTATPWRANSKGFTDIYD

SEQ ID NO: 2033848 - protein, 18 aa, Staphylococcus
PNAYRLEDAAGIALVGYA

SEQ ID NO: 2033849 - protein, 21 aa, Staphylococcus
PNCDCYTCRNYSRAYLRHLIK

SEQ ID NO: 2033850 - protein, 17 aa, Staphylococcus
PNCGGWNQMEEIVEQKA

SEQ ID NO: 2033851 - protein, 17 aa, Staphylococcus
PNCGSWNQMEEIVEKAS

SEQ ID NO: 2033852 - protein, 25 aa, Staphylococcus
PNDEMKGRIIGREGRNIRTLETLTG

SEQ ID NO: 2033853 - protein, 19 aa, Staphylococcus
PNDERRIDLAVTKGLPSFI

SEQ ID NO: 2033854 - protein, 18 aa, Staphylococcus
PNDFKFLYDLDQSLEEKI

SEQ ID NO: 2033855 - protein, 17 aa, Staphylococcus
PNDIYIGDKKVCGFLTE

SEQ ID NO: 2033856 - protein, 23 aa, Staphylococcus
PNEFQLLTILSHHVGKVLTYQVL

SEQ ID NO: 2033857 - protein, 22 aa, Staphylococcus
PNEGEYAVGLFFSNQKVLDTQH

SEQ ID NO: 2033858 - protein, 22 aa, Staphylococcus
PNEKRCHEMLQQVQIKYSKLSI

SEQ ID NO: 2033859 - protein, 19 aa, Staphylococcus
PNELLKACLDTEQQLHRVR

SEQ ID NO: 2033860 - protein, 26 aa, Staphylococcus
PNEPIIPFIIGDGIGPDIWKAASRVV

SEQ ID NO: 2033861 - protein, 17 aa, Staphylococcus
PNERRCNELLQQANIKI

SEQ ID NO: 2033862 - protein, 24 aa, Staphylococcus
PNETIEFQLAYGLPDFGPINQELP

SEQ ID NO: 2033863 - protein, 17 aa, Staphylococcus
PNEVIGLIAGGQQAMTE

SEQ ID NO: 2033864 - protein, 18 aa, Staphylococcus
PNEVKVYPILAPIIGETE

SEQ ID NO: 2033865 - protein, 26 aa, Staphylococcus
PNEYRSCNKYEKMIFMDYETHIDDSL

SEQ ID NO: 2033866 - protein, 24 aa, Staphylococcus
PNEYRYCDRYEKSIDMDYENIIEG

SEQ ID NO: 2033867 - protein, 19 aa, Staphylococcus
PNFDGESFVDYLLQEQSIL

SEQ ID NO: 2033868 - protein, 24 aa, Staphylococcus
PNFELAEQLMALRIRQIDNNYEMT

SEQ ID NO: 2033869 - protein, 19 aa, Staphylococcus
PNFNSFFIGDIERARKDPN

SEQ ID NO: 2033870 - protein, 25 aa, Staphylococcus
PNFSTQLLDRFLVIAHSYNLSPSIL

SEQ ID NO: 2033871 - protein, 17 aa, Staphylococcus
PNFTIVSAPHFKADPEV

SEQ ID NO: 2033872 - protein, 18 aa, Staphylococcus
PNFVKGHIPELYIENERI

SEQ ID NO: 2033873 - protein, 26 aa, Staphylococcus
PNFYQFKGAYALQWDMIQFALDHQIP

SEQ ID NO: 2033874 - protein, 23 aa, Staphylococcus
PNGCGKSTLLKALSRLIEVKNGE

SEQ ID NO: 2033875 - protein, 17 aa, Staphylococcus
PNGDLYVVFRVRPSKKF

SEQ ID NO: 2033876 - protein, 26 aa, Staphylococcus
PNGIYLSGALLMFAGSKSYYLYGASS

SEQ ID NO: 2033877 - protein, 17 aa, Staphylococcus
PNGKVIQLWHGTPIKRL

SEQ ID NO: 2033878 - protein, 17 aa, Staphylococcus
PNGLIFYNGTYYVSHQW

SEQ ID NO: 2033879 - protein, 33 aa, Staphylococcus
PNGPPPGYAFNWPHPGIDLPYIYEPVYSTISGT

SEQ ID NO: 2033880 - protein, 23 aa, Staphylococcus
PNGPRPRYISIVYRDDMYLTPVI

SEQ ID NO: 2033881 - protein, 37 aa, Staphylococcus
PNHEVYRLTNDWSEIRPEWGLAKNAAFIIGQRELTKQ

SEQ ID NO: 2033882 - protein, 19 aa, Staphylococcus
PNHFKIMRYHSLISNPKTF

SEQ ID NO: 2033883 - protein, 18 aa, Staphylococcus
PNHHMQFAMMQYAREHGA

SEQ ID NO: 2033884 - protein, 26 aa, Staphylococcus
PNHPHFEHFKFLYKKVAGRATAKVSI

SEQ ID NO: 2033885 - protein, 23 aa, Staphylococcus
PNHPYLLELKELYTTFKNNMLEH

SEQ ID NO: 2033886 - protein, 24 aa, Staphylococcus
PNIEGIEFVEFLISPNKGEPLKSL

SEQ ID NO: 2033887 - protein, 18 aa, Staphylococcus
PNIFTGCDNFHGPFEYAS

SEQ ID NO: 2033888 - protein, 17 aa, Staphylococcus
PNILPVRLDGATKEFFA

SEQ ID NO: 2033889 - protein, 20 aa, Staphylococcus
PNIMRTKIKFNMNASDITKR

SEQ ID NO: 2033890 - protein, 27 aa, Staphylococcus
PNIPQGRGMVKWAPFATLPEQFESIQQ

SEQ ID NO: 2033891 - protein, 22 aa, Staphylococcus
PNIWKNVDYFMLPKDYLRYRLT

SEQ ID NO: 2033892 - protein, 18 aa, Staphylococcus
PNKAFSFNNKQYFKRGLW

SEQ ID NO: 2033893 - protein, 18 aa, Staphylococcus
PNKEGQFPVVISADTYGK

SEQ ID NO: 2033894 - protein, 19 aa, Staphylococcus
PNKEGRFPVVMSADTYGKD

SEQ ID NO: 2033895 - protein, 20 aa, Staphylococcus
PNKLDALGFTFNYSNLKIAF

SEQ ID NO: 2033896 - protein, 20 aa, Staphylococcus
PNKLEALGFNFMYNNLKNAL

SEQ ID NO: 2033897 - protein, 20 aa, Staphylococcus
PNKLEALGFNFRYNNLKVAL

SEQ ID NO: 2033898 - protein, 21 aa, Staphylococcus
PNKLIPLTFFVDKFQQAKSSI

SEQ ID NO: 2033899 - protein, 24 aa, Staphylococcus
PNKRGYKMLPHFQIGLFKDHLFLM

SEQ ID NO: 2033900 - protein, 24 aa, Staphylococcus
PNKRGYKMLPHFQIGLFRDQLFIM

SEQ ID NO: 2033901 - protein, 24 aa, Staphylococcus
PNKRGYKMLPHFQIGLFRDQLFVM

SEQ ID NO: 2033902 - protein, 24 aa, Staphylococcus
PNKYKDVILWAYDEAMKGQSAKAI

SEQ ID NO: 2033903 - protein, 19 aa, Staphylococcus
PNLEIKWIRGNIDTRLHKL

SEQ ID NO: 2033904 - protein, 19 aa, Staphylococcus
PNLEIKWIRGNIDTRLKKL

SEQ ID NO: 2033905 - protein, 19 aa, Staphylococcus
PNLEIKWIRGNIDTRLSKL

SEQ ID NO: 2033906 - protein, 18 aa, Staphylococcus
PNLICVYSEDVYRFEKVE

SEQ ID NO: 2033907 - protein, 18 aa, Staphylococcus
PNLLYRIINKDVLEAKFY

SEQ ID NO: 2033908 - protein, 36 aa, Staphylococcus
PNLNMIIGHWGEFVPFFLERMDDILFADHLEHPISY

SEQ ID NO: 2033909 - protein, 21 aa, Staphylococcus
PNMKDYGRFDAPPVKDGSITD

SEQ ID NO: 2033910 - protein, 20 aa, Staphylococcus
PNMNGIEVTHYIKTYYPYIK

SEQ ID NO: 2033911 - protein, 17 aa, Staphylococcus
PNNCVTVEPGIYIEGLG

SEQ ID NO: 2033912 - protein, 22 aa, Staphylococcus
PNNNLLKFVVYIDCKQDSIFNQ

SEQ ID NO: 2033913 - protein, 24 aa, Staphylococcus
PNPAAGGYIAILGLVVAKDYRNQG

SEQ ID NO: 2033914 - protein, 20 aa, Staphylococcus
PNPDSPCKSVADVFITAEYD

SEQ ID NO: 2033915 - protein, 18 aa, Staphylococcus
PNPDSPCKSVAHEFITAA

SEQ ID NO: 2033916 - protein, 24 aa, Staphylococcus
PNPEIFKSTTAFNFDTLSERLQES

SEQ ID NO: 2033917 - protein, 26 aa, Staphylococcus
PNPLLPEEVRFILKQMGLKEKTIDVE

SEQ ID NO: 2033918 - protein, 27 aa, Staphylococcus
PNPLLPEEVRFILKQMGLKEKTIDVEL

SEQ ID NO: 2033919 - protein, 18 aa, Staphylococcus
PNPSELIGSAAFENILRD

SEQ ID NO: 2033920 - protein, 18 aa, Staphylococcus
PNQCPNCESEHIRQMGTG

SEQ ID NO: 2033921 - protein, 22 aa, Staphylococcus
PNQDGIEFVEFLISPNKGEPLK

SEQ ID NO: 2033922 - protein, 18 aa, Staphylococcus
PNQFVLIATGSRPQTLPF

SEQ ID NO: 2033923 - protein, 22 aa, Staphylococcus
PNQINNVLAFPGIFRGALDVEA

SEQ ID NO: 2033924 - protein, 22 aa, Staphylococcus
PNQINNVLAFPGIFRGALEVEA

SEQ ID NO: 2033925 - protein, 21 aa, Staphylococcus
PNQLIPLTFFVKKFKQAKSSI

SEQ ID NO: 2033926 - protein, 22 aa, Staphylococcus
PNRKAPKQISFRVSESEYLKLQ

SEQ ID NO: 2033927 - protein, 17 aa, Staphylococcus
PNSRYMVFYNDDLTLYT

SEQ ID NO: 2033928 - protein, 17 aa, Staphylococcus
PNSRYMVFYNDELTLYT

SEQ ID NO: 2033929 - protein, 18 aa, Staphylococcus
PNTIALSFEESILTYQQL

SEQ ID NO: 2033930 - protein, 21 aa, Staphylococcus
PNVAVLRRYWNGEWLNETVDD

SEQ ID NO: 2033931 - protein, 28 aa, Staphylococcus
PNVEGREVSRIGSTFGKTNRVIIDTDDH

SEQ ID NO: 2033932 - protein, 19 aa, Staphylococcus
PNVFRRDRLTISVSTEGAS

SEQ ID NO: 2033933 - protein, 37 aa, Staphylococcus
PNVIYEINSALKILNKFEVETIFDLALFTILKGHVAV

SEQ ID NO: 2033934 - protein, 25 aa, Staphylococcus
PNVYRTTLHPEFSYSDFIGQVMPSV

SEQ ID NO: 2033935 - protein, 25 aa, Staphylococcus
PNWLTKPRLGEMFKPIVNEARSARA

SEQ ID NO: 2033936 - protein, 22 aa, Staphylococcus
PNWTTCVSICALFRDSDVLNST

SEQ ID NO: 2033937 - protein, 21 aa, Staphylococcus
PNYLQRLLFDDIPFLKEAQAE

SEQ ID NO: 2033938 - protein, 19 aa, Staphylococcus
PNYRLGYKKDHIHIEPRVI

SEQ ID NO: 2033939 - protein, 35 aa, Staphylococcus
PPANWPRTAKFEGLIHRFRRSFLLNDNFEKKRFAK

SEQ ID NO: 2033940 - protein, 34 aa, Staphylococcus
PPEEWRKSAKYVGLIPRFSRIFLGDKEFNKKRYA

SEQ ID NO: 2033941 - protein, 21 aa, Staphylococcus
PPEYFNEGSLLKAMENPQNYI

SEQ ID NO: 2033942 - protein, 20 aa, Staphylococcus
PPFFYPLDKLVSISNMIEEA

SEQ ID NO: 2033943 - protein, 25 aa, Staphylococcus
PPFQLTEKEGWLYGRGVSDMKGGMA

SEQ ID NO: 2033944 - protein, 24 aa, Staphylococcus
PPGAERLYCSPYCENQAFIYKDCV

SEQ ID NO: 2033945 - protein, 18 aa, Staphylococcus
PPGESGLIATSKIADSFP

SEQ ID NO: 2033946 - protein, 17 aa, Staphylococcus
PPGESGLIATSKISESF

SEQ ID NO: 2033947 - protein, 18 aa, Staphylococcus
PPGESGLIATSKISESFP

SEQ ID NO: 2033948 - protein, 17 aa, Staphylococcus
PPGIIYDSIGWSDSVEK

SEQ ID NO: 2033949 - protein, 22 aa, Staphylococcus
PPGKRMGHAGAIISGGKGTADE

SEQ ID NO: 2033950 - protein, 22 aa, Staphylococcus
PPGKRMGHAGAIISGGKGTAEE

SEQ ID NO: 2033951 - protein, 22 aa, Staphylococcus
PPGKRMGHAGAIISGGKGTASE

SEQ ID NO: 2033952 - protein, 23 aa, Staphylococcus
PPHFNRYMLEFANFDSDLQYFLF

SEQ ID NO: 2033953 - protein, 21 aa, Staphylococcus
PPHRKEVLKAREDDIKDKVKN

SEQ ID NO: 2033954 - protein, 20 aa, Staphylococcus
PPHVLSVMIEYLRFAQYSKE

SEQ ID NO: 2033955 - protein, 18 aa, Staphylococcus
PPIECFEKAITAYAEKLG

SEQ ID NO: 2033956 - protein, 19 aa, Staphylococcus
PPIGKFIEKYEELIKEDVE

SEQ ID NO: 2033957 - protein, 25 aa, Staphylococcus
PPISVKDGGLFKSGFNHQLDEYLEA

SEQ ID NO: 2033958 - protein, 26 aa, Staphylococcus
PPKDRRAGVITFNIKDIHPHDVATAL

SEQ ID NO: 2033959 - protein, 26 aa, Staphylococcus
PPKDRRAGVITFNLKDVHPHDVATAV

SEQ ID NO: 2033960 - protein, 27 aa, Staphylococcus
PPKDSEHYGLWIFKKTWGTYLSEKIGE

SEQ ID NO: 2033961 - protein, 25 aa, Staphylococcus
PPKERRAGVITFNLADIHPHDVATA

SEQ ID NO: 2033962 - protein, 34 aa, Staphylococcus; identical to SEQ ID NO: 1796266

SEQ ID NO: 2033963 - protein, 18 aa, Staphylococcus
PPKIGVSSFVGYLKGKSS

SEQ ID NO: 2033964 - protein, 30 aa, Staphylococcus; identical to SEQ ID NO: 1646533

SEQ ID NO: 2033965 - protein, 29 aa, Staphylococcus
PPKLIEHLLEIRGLGVINVMTLFGAGSIL

SEQ ID NO: 2033966 - protein, 29 aa, Staphylococcus
PPKLPMLKRGYRYDIHLNITATPTQSVYV

SEQ ID NO: 2033967 - protein, 17 aa, Staphylococcus
PPLKITMRSEIPLARGL

SEQ ID NO: 2033968 - protein, 18 aa, Staphylococcus
PPLMEFIFDTTRTIIYMS

SEQ ID NO: 2033969 - protein, 34 aa, Staphylococcus
PPLNSFELFTLMAYSGCRAGEILALKWSDVDFDN

SEQ ID NO: 2033970 - protein, 18 aa, Staphylococcus
PPLSRVGLTAAQAEARHY

SEQ ID NO: 2033971 - protein, 19 aa, Staphylococcus
PPLYKKSLKKIGITMSGGY

SEQ ID NO: 2033972 - protein, 19 aa, Staphylococcus
PPNAAMFRRAKSMEKALNR

SEQ ID NO: 2033973 - protein, 22 aa, Staphylococcus
PPNKCPNCESVHIRQMGTGTQK

SEQ ID NO: 2033974 - protein, 20 aa, Staphylococcus
PPNPSELIGSVQFQKIYEEL

SEQ ID NO: 2033975 - protein, 19 aa, Staphylococcus
PPNRMGNLAIKKGWPSMMR

SEQ ID NO: 2033976 - protein, 18 aa, Staphylococcus
PPQQKCNFKFKHPSSQLV

SEQ ID NO: 2033977 - protein, 17 aa, Staphylococcus
PPREKSEIPAKVCGAED

SEQ ID NO: 2033978 - protein, 17 aa, Staphylococcus
PPSAWVVLAKPNLGISS

SEQ ID NO: 2033979 - protein, 33 aa, Staphylococcus
PPSITKRLAVEMGATLGWHKYVGLEGEVLGIDR

SEQ ID NO: 2033980 - protein, 17 aa, Staphylococcus
PPSNLYLPVKFDGGEWV

SEQ ID NO: 2033981 - protein, 35 aa, Staphylococcus; identical to SEQ ID NO: 1811273

SEQ ID NO: 2033982 - protein, 24 aa, Staphylococcus
PPSVREIGEAVGLASSSTVHGHLS

SEQ ID NO: 2033983 - protein, 17 aa, Staphylococcus
PPVDTWVAFAPNKRGYK

SEQ ID NO: 2033984 - protein, 30 aa, Staphylococcus
PPVGAVVVNRGRIVGIGAHLKKGDKHAEVQ

SEQ ID NO: 2033985 - protein, 19 aa, Staphylococcus
PPVKEVALENGIEVYQPEK

SEQ ID NO: 2033986 - protein, 17 aa, Staphylococcus
PPVMLGSHIDTVKDGGR

SEQ ID NO: 2033987 - protein, 17 aa, Staphylococcus
PPVSNIDGLIIVMSAVE

SEQ ID NO: 2033988 - protein, 24 aa, Staphylococcus
PPWFKISPTHFVKSWLLDERAPKV

SEQ ID NO: 2033989 - protein, 25 aa, Staphylococcus
PPYEYQHIKVHLAVGQFKFVLNENV

SEQ ID NO: 2033990 - protein, 22 aa, Staphylococcus
PPYKHEIEMLKSQTFDPNLKDK

SEQ ID NO: 2033991 - protein, 22 aa, Staphylococcus
PPYLHPRYKEIGGIINDIPHPL

SEQ ID NO: 2033992 - protein, 19 aa, Staphylococcus
PPYSAKWSADSKFNDDERF

SEQ ID NO: 2033993 - protein, 17 aa, Staphylococcus
PPYTRLIDSARRQPEET

SEQ ID NO: 2033994 - protein, 18 aa, Staphylococcus
PQAFVHMIGFSRGGIQGL

SEQ ID NO: 2033995 - protein, 17 aa, Staphylococcus
PQAFYFVNGEMKWNADH

SEQ ID NO: 2033996 - protein, 24 aa, Staphylococcus
PQAKKAVVVGGGYIGIEAAEAFAK

SEQ ID NO: 2033997 - protein, 20 aa, Staphylococcus
PQDAWYIRFSTLTSAINSTM

SEQ ID NO: 2033998 - protein, 26 aa, Staphylococcus
PQDDLFDDVCRFMLNEGHISTSLVQR

SEQ ID NO: 2033999 - protein, 20 aa, Staphylococcus
PQDHFEDIAPEQIKETFETN

SEQ ID NO: 2034000 - protein, 23 aa, Staphylococcus
PQDIICFRIENKILNVITAQRQY

SEQ ID NO: 2034001 - protein, 18 aa, Staphylococcus
PQDLIFLSDMKSEFEKSV

SEQ ID NO: 2034002 - protein, 18 aa, Staphylococcus
PQDLIFLSDMKTEFEKSV

SEQ ID NO: 2034003 - protein, 18 aa, Staphylococcus
PQDLIKLGDMKESFEKSV

SEQ ID NO: 2034004 - protein, 28 aa, Staphylococcus
PQDSYLLIRGIKTLGLRMEQINRNVEGI

SEQ ID NO: 2034005 - protein, 28 aa, Staphylococcus
PQDSYLLIRGIKTLGLRMEQVQRNTLAI

SEQ ID NO: 2034006 - protein, 27 aa, Staphylococcus
PQDSYLLVRGIKTLGLRMEQINRNVEG

SEQ ID NO: 2034007 - protein, 25 aa, Staphylococcus
PQEIRELIFNEIYNEAGVYSEERGK

SEQ ID NO: 2034008 - protein, 24 aa, Staphylococcus
PQEKIWLDPGIGFAKTRDEENEVM

SEQ ID NO: 2034009 - protein, 29 aa, Staphylococcus
PQELLRFLKMKRKDILENAYIMTHDMREQ

SEQ ID NO: 2034010 - protein, 21 aa, Staphylococcus
PQERTHYILKDAMPKAIITYH

SEQ ID NO: 2034011 - protein, 39 aa, Staphylococcus
PQFENKLTFSDEVVEKIAGIAAREVKGILDMKGGFTDNF

SEQ ID NO: 2034012 - protein, 44 aa, Staphylococcus
PQFENKLTFSDEVVEKIAGIAAREVKGILDMKGGFTDSFTNAFS

SEQ ID NO: 2034013 - protein, 39 aa, Staphylococcus
PQFENKLTFSDEVVEKIAGIAAREVKGILDMKGGIADSF

SEQ ID NO: 2034014 - protein, 23 aa, Staphylococcus
PQFEVFNASSLYPFIEEQEHFIS

SEQ ID NO: 2034015 - protein, 24 aa, Staphylococcus
PQFSTQLLDRFIVIAHSYQLHPSI

SEQ ID NO: 2034016 - protein, 24 aa, Staphylococcus
PQFSTQLLDRFLVIAHSYGLDTRI

SEQ ID NO: 2034017 - protein, 24 aa, Staphylococcus
PQFSTQLLDRFLVVAHSYDLEPRI

SEQ ID NO: 2034018 - protein, 20 aa, Staphylococcus
PQFTPELFMKVSAKNVMKQK

SEQ ID NO: 2034019 - protein, 17 aa, Staphylococcus
PQGEIFLEEAIEHIEMQ

SEQ ID NO: 2034020 - protein, 18 aa, Staphylococcus
PQGITLIVGGGYHGKSTL

SEQ ID NO: 2034021 - protein, 29 aa, Staphylococcus
PQGWWPADSKIEIILGAILVQNTNWRNAA

SEQ ID NO: 2034022 - protein, 25 aa, Staphylococcus
PQHWWPADSNIEMMLGAILVQNTNW

SEQ ID NO: 2034023 - protein, 18 aa, Staphylococcus
PQIKVGDQVKEGDIIGYI

SEQ ID NO: 2034024 - protein, 24 aa, Staphylococcus
PQIRIPLFTCASWSTQGLHNRGTF

SEQ ID NO: 2034025 - protein, 24 aa, Staphylococcus
PQKIVRWRAAMFIFDEGNEEQLAS

SEQ ID NO: 2034026 - protein, 24 aa, Staphylococcus
PQKIVRWRAAMFLFDEGGPEQLPS

SEQ ID NO: 2034027 - protein, 25 aa, Staphylococcus
PQKIVRWRAAMFLFEEGGKAQLASL

SEQ ID NO: 2034028 - protein, 24 aa, Staphylococcus
PQKRIIYQRVVEMLEEGTAISKIA

SEQ ID NO: 2034029 - protein, 22 aa, Staphylococcus
PQKRPVTIVTILMAQPDVCEVQ

SEQ ID NO: 2034030 - protein, 18 aa, Staphylococcus
PQLGLGVFRVENDDTAKN

SEQ ID NO: 2034031 - protein, 21 aa, Staphylococcus
PQLKLLCDIAETYGAAAKTSG

SEQ ID NO: 2034032 - protein, 24 aa, Staphylococcus
PQLKRIGFDYYFIDNHKLSSSYLN

SEQ ID NO: 2034033 - protein, 17 aa, Staphylococcus
PQLRIVANMAVGYDNID

SEQ ID NO: 2034034 - protein, 44 aa, Staphylococcus
PQLRKGEAIGLNHSRYLLIEFPSRGVPHYANRLFFELQSEGYIP

SEQ ID NO: 2034035 - protein, 26 aa, Staphylococcus
PQMVLRFKRRFGDDVAVLHSGLSTGE

SEQ ID NO: 2034036 - protein, 27 aa, Staphylococcus
PQMVLRFKRRFGDEVAVLHSGLSKGER

SEQ ID NO: 2034037 - protein, 21 aa, Staphylococcus
PQNVSLDWECFIVSKSDMLLD

SEQ ID NO: 2034038 - protein, 25 aa, Staphylococcus
PQPPRSYYKGAFLKCYLKNDKNHQL

SEQ ID NO: 2034039 - protein, 20 aa, Staphylococcus
PQPRMYRLLEDDALINRMGF

SEQ ID NO: 2034040 - protein, 17 aa, Staphylococcus
PQQLIDILNEIANEPSV

SEQ ID NO: 2034041 - protein, 24 aa, Staphylococcus
PQQTAHLAQAFGMNVEGVNTSGHS

SEQ ID NO: 2034042 - protein, 18 aa, Staphylococcus
PQQYPGIEDMLLDVLDRY

SEQ ID NO: 2034043 - protein, 21 aa, Staphylococcus
PQRMCSSCLKMWDSVKLIKND

SEQ ID NO: 2034044 - protein, 26 aa, Staphylococcus
PQSDKAIKFFVRYGGEKQLKQGFSPA

SEQ ID NO: 2034045 - protein, 24 aa, Staphylococcus
PQSDYFAFEACEYRRHFLSYRPDY

SEQ ID NO: 2034046 - protein, 21 aa, Staphylococcus
PQSLHAVDWLIINRDESETYL

SEQ ID NO: 2034047 - protein, 19 aa, Staphylococcus
PQSLLSCCLKTEQQLHRVR

SEQ ID NO: 2034048 - protein, 19 aa, Staphylococcus
PQSYYTYMHELLFNHNEWN

SEQ ID NO: 2034049 - protein, 25 aa, Staphylococcus
PQTDMDILKSLGFDHIHLDTEIYLR

SEQ ID NO: 2034050 - protein, 23 aa, Staphylococcus
PQTELLQHTALFLTHAGMNSTNE

SEQ ID NO: 2034051 - protein, 28 aa, Staphylococcus
PQTLKLFKVCRMRGIPIFTFINKLDRVG

SEQ ID NO: 2034052 - protein, 18 aa, Staphylococcus
PQTLPFLKINHRNILSSD

SEQ ID NO: 2034053 - protein, 19 aa, Staphylococcus
PQVHGASFETLNFVKKQLE

SEQ ID NO: 2034054 - protein, 19 aa, Staphylococcus
PQVKVLRGSAFGVLVNIAF

SEQ ID NO: 2034055 - protein, 17 aa, Staphylococcus
PQVLIFMLKVFNELNFI

SEQ ID NO: 2034056 - protein, 21 aa, Staphylococcus
PQWQNRFPALAGERDTLRELL

SEQ ID NO: 2034057 - protein, 17 aa, Staphylococcus
PQYSVRVQDKWKREDYT

SEQ ID NO: 2034058 - protein, 17 aa, Staphylococcus
PRAAYELVGELKAAVNL

SEQ ID NO: 2034059 - protein, 20 aa, Staphylococcus
PRAHGSGLFTRGQTQALSVL

SEQ ID NO: 2034060 - protein, 20 aa, Staphylococcus
PRAIMASIIYIEILRQIAIG

SEQ ID NO: 2034061 - protein, 20 aa, Staphylococcus
PRAKEVQSFVTNLCEDTLPS

SEQ ID NO: 2034062 - protein, 18 aa, Staphylococcus
PRARCWMIKASKMKWIFK

SEQ ID NO: 2034063 - protein, 21 aa, Staphylococcus
PRDAVKIYVAVYDFILNKTTM

SEQ ID NO: 2034064 - protein, 19 aa, Staphylococcus
PRDVANLVSFLASDDSDYI

SEQ ID NO: 2034065 - protein, 21 aa, Staphylococcus
PRDVKSQLVIMSYFRENPCPE

SEQ ID NO: 2034066 - protein, 20 aa, Staphylococcus
PRDVKSQVEVLSYFRNNPCP

SEQ ID NO: 2034067 - protein, 18 aa, Staphylococcus
PREFCLVSVIDGEGKLIT

SEQ ID NO: 2034068 - protein, 18 aa, Staphylococcus
PREFCLVSVLDGEGQMIT

SEQ ID NO: 2034069 - protein, 18 aa, Staphylococcus
PREKMKILSTSEIKELIN

SEQ ID NO: 2034070 - protein, 18 aa, Staphylococcus
PREVMGSKISDWNKVGWG

SEQ ID NO: 2034071 - protein, 35 aa, Staphylococcus
PREVSAWRPEVMQALRLAGLPANSAYANAWLRQIN

SEQ ID NO: 2034072 - protein, 20 aa, Staphylococcus
PREYKEMKVPDVLLSGNHAH

SEQ ID NO: 2034073 - protein, 17 aa, Staphylococcus
PREYLNARIPKGRGMVK

SEQ ID NO: 2034074 - protein, 25 aa, Staphylococcus
PRFNKSPYDGFAIRSKDTVGASGEQ

SEQ ID NO: 2034075 - protein, 24 aa, Staphylococcus
PRFNKSPYDGFALRSEDTVGASGD

SEQ ID NO: 2034076 - protein, 17 aa, Staphylococcus
PRFSPTRPFIMVIHIHN

SEQ ID NO: 2034077 - protein, 27 aa, Staphylococcus
PRGAQEMWRSVYYLGNIISKLSKLDTN

SEQ ID NO: 2034078 - protein, 20 aa, Staphylococcus
PRGGEYVEHILGLEKGTSII

SEQ ID NO: 2034079 - protein, 19 aa, Staphylococcus
PRGLFKAVVDKDSETILGV

SEQ ID NO: 2034080 - protein, 19 aa, Staphylococcus
PRGLFKVVINKDTNEILGA

SEQ ID NO: 2034081 - protein, 21 aa, Staphylococcus
PRGNFKHDVIQAFYDGFKHKP

SEQ ID NO: 2034082 - protein, 18 aa, Staphylococcus
PRGPLLMQDVYYLEQMSH

SEQ ID NO: 2034083 - protein, 19 aa, Staphylococcus
PRGRKATPFAYEHFKKTKE

SEQ ID NO: 2034084 - protein, 20 aa, Staphylococcus
PRGRKATPLAHEHFGNSNEM

SEQ ID NO: 2034085 - protein, 18 aa, Staphylococcus
PRGYEWETSNGRSFNLEY

SEQ ID NO: 2034086 - protein, 18 aa, Staphylococcus
PRHFYNYYSTILKKEIVY

SEQ ID NO: 2034087 - protein, 21 aa, Staphylococcus
PRIDPETFGYLVYFFELACAM

SEQ ID NO: 2034088 - protein, 19 aa, Staphylococcus
PRIEGGAFYLGSEDYENGI

SEQ ID NO: 2034089 - protein, 19 aa, Staphylococcus
PRIETMFANHNVIFDDNPM

SEQ ID NO: 2034090 - protein, 17 aa, Staphylococcus
PRIGFITITDVQVTNDL

SEQ ID NO: 2034091 - protein, 17 aa, Staphylococcus
PRILRAETAPLYALSAI

SEQ ID NO: 2034092 - protein, 18 aa, Staphylococcus
PRILRAETAPLYVLSALS

SEQ ID NO: 2034093 - protein, 24 aa, Staphylococcus
PRIMAEKLLKGEIITEFNGNIVSL

SEQ ID NO: 2034094 - protein, 18 aa, Staphylococcus
PRINYKHWTDIDDVQLEL

SEQ ID NO: 2034095 - protein, 20 aa, Staphylococcus
PRIRLYVPLSERISANEYRI

SEQ ID NO: 2034096 - protein, 22 aa, Staphylococcus
PRIRTIPVGSLDQLTMPSVQRQ

SEQ ID NO: 2034097 - protein, 17 aa, Staphylococcus
PRITDFLNEDSKAYYEQ

SEQ ID NO: 2034098 - protein, 18 aa, Staphylococcus
PRIVKYVRQPQVIGVVDA

SEQ ID NO: 2034099 - protein, 23 aa, Staphylococcus
PRIYKDAKRLSVVSYEEMMEMSA

SEQ ID NO: 2034100 - protein, 26 aa, Staphylococcus
PRKIYALPDEHRWAPQSGVTLIGDAA

SEQ ID NO: 2034101 - protein, 19 aa, Staphylococcus
PRKVIDTVELFKIAFPTDK

SEQ ID NO: 2034102 - protein, 21 aa, Staphylococcus
PRLFPELPQSEYICFYPMDKR

SEQ ID NO: 2034103 - protein, 17 aa, Staphylococcus
PRLGEKVEVRIIGHNDK

SEQ ID NO: 2034104 - protein, 17 aa, Staphylococcus
PRLKIEAGSVGIANNQT

SEQ ID NO: 2034105 - protein, 25 aa, Staphylococcus
PRLQPWDFAGGLIILNEVGGIGSNL

SEQ ID NO: 2034106 - protein, 25 aa, Staphylococcus
PRLQPWDFAGGLMILNEVGGVGSNL

SEQ ID NO: 2034107 - protein, 19 aa, Staphylococcus
PRLQRISSELLKEYDSTEL

SEQ ID NO: 2034108 - protein, 17 aa, Staphylococcus
PRLVSGPPRPGRAHVRV

SEQ ID NO: 2034109 - protein, 19 aa, Staphylococcus
PRMAERAFVLIPLQEIAPE

SEQ ID NO: 2034110 - protein, 20 aa, Staphylococcus
PRMQERAFVLIPLNDIASDK

SEQ ID NO: 2034111 - protein, 18 aa, Staphylococcus
PRMYRLVEDNALINRMGF

SEQ ID NO: 2034112 - protein, 20 aa, Staphylococcus
PRPETEEVMLHFYNQLHSGD

SEQ ID NO: 2034113 - protein, 17 aa, Staphylococcus
PRPLPMALGHEATGEVL

SEQ ID NO: 2034114 - protein, 17 aa, Staphylococcus
PRPMPMVLGHEAAGEII

SEQ ID NO: 2034115 - protein, 20 aa, Staphylococcus
PRPVGTDIVHYSDYFEGAQK

SEQ ID NO: 2034116 - protein, 19 aa, Staphylococcus
PRPYSAPCSNWSSPSRPAA

SEQ ID NO: 2034117 - protein, 19 aa, Staphylococcus
PRQFLKGAHAPSVKAQHVI

SEQ ID NO: 2034118 - protein, 27 aa, Staphylococcus
PRQTKGMVRREVVRIVTPGTVMDQGGV

SEQ ID NO: 2034119 - protein, 18 aa, Staphylococcus
PRRSEPRVKINAGSVGIA

SEQ ID NO: 2034120 - protein, 18 aa, Staphylococcus
PRRVGWFDSVVLRHSRRA

SEQ ID NO: 2034121 - protein, 18 aa, Staphylococcus
PRRVGWFDSVVLRHSRRV

SEQ ID NO: 2034122 - protein, 20 aa, Staphylococcus
PRRVSTWGDDEKYWYESATS

SEQ ID NO: 2034123 - protein, 19 aa, Staphylococcus
PRRVSTWGDDKKYWFESAT

SEQ ID NO: 2034124 - protein, 21 aa, Staphylococcus
PRSEIKYSYTHIAFTISDNDF

SEQ ID NO: 2034125 - protein, 26 aa, Staphylococcus
PRSLLDEYREGLLIGTACDEGEVFTA

SEQ ID NO: 2034126 - protein, 17 aa, Staphylococcus
PRSSRTVPFLSKITDIQ

SEQ ID NO: 2034127 - protein, 20 aa, Staphylococcus
PRTPELYFALFGILKIGAIV

SEQ ID NO: 2034128 - protein, 21 aa, Staphylococcus
PRTRIQLSNEILEEFEKIRRG

SEQ ID NO: 2034129 - protein, 17 aa, Staphylococcus
PRVDVVVEISIRIAEAF

SEQ ID NO: 2034130 - protein, 18 aa, Staphylococcus
PRVGYFYSGKSKNKIFKD

SEQ ID NO: 2034131 - protein, 18 aa, Staphylococcus
PRVGYFYSGKSTNQLLTE

SEQ ID NO: 2034132 - protein, 18 aa, Staphylococcus
PRVGYYYSGKPQNKLIAD

SEQ ID NO: 2034133 - protein, 18 aa, Staphylococcus
PRVGYYYSGKSKNKIIHE

SEQ ID NO: 2034134 - protein, 18 aa, Staphylococcus
PRVGYYYSGKSKNKIINE

SEQ ID NO: 2034135 - protein, 18 aa, Staphylococcus
PRVGYYYSGKSKNKLISD

SEQ ID NO: 2034136 - protein, 18 aa, Staphylococcus
PRVGYYYSGKSKNKLMTD

SEQ ID NO: 2034137 - protein, 17 aa, Staphylococcus
PRVKINAGSVGIANNQT

SEQ ID NO: 2034138 - protein, 20 aa, Staphylococcus
PRWIIEHWITHYGIETTHKI

SEQ ID NO: 2034139 - protein, 18 aa, Staphylococcus
PRYGKQLKAETFEKELPQ

SEQ ID NO: 2034140 - protein, 17 aa, Staphylococcus
PRYHAREIAQWRSQYHN

SEQ ID NO: 2034141 - protein, 20 aa, Staphylococcus
PRYKDDIDGFGYQWETHENE

SEQ ID NO: 2034142 - protein, 34 aa, Staphylococcus
PRYNPYMGAYRLQWEMIKFAKAHHIDRYNFYGIT

SEQ ID NO: 2034143 - protein, 17 aa, Staphylococcus
PSAASFAQRVIMLKDGN

SEQ ID NO: 2034144 - protein, 19 aa, Staphylococcus
PSAPRNLGIQLSHGHYIYF

SEQ ID NO: 2034145 - protein, 17 aa, Staphylococcus
PSDDLNAVLGREKDQNG

SEQ ID NO: 2034146 - protein, 22 aa, Staphylococcus
PSDIRAAGGVARACNPKIVQEV

SEQ ID NO: 2034147 - protein, 23 aa, Staphylococcus
PSDIRAAGGVARMANPKIVEEVM

SEQ ID NO: 2034148 - protein, 18 aa, Staphylococcus
PSDNFPDVKYSTNRRDAK

SEQ ID NO: 2034149 - protein, 19 aa, Staphylococcus
PSDPMTYHMNKWQYKTLPS

SEQ ID NO: 2034150 - protein, 23 aa, Staphylococcus
PSEADLEWGRKLIGLYQKEMSYA

SEQ ID NO: 2034151 - protein, 25 aa, Staphylococcus
PSEHTARQLALVWGAYPVIKKGRKT

SEQ ID NO: 2034152 - protein, 25 aa, Staphylococcus
PSEHTARQLALVWGAYPVVKKGRKT

SEQ ID NO: 2034153 - protein, 26 aa, Staphylococcus
PSEIKYWAELNEVFKILDVEMPIVLP

SEQ ID NO: 2034154 - protein, 25 aa, Staphylococcus
PSEIKYWAELSEVFNTLDVEMPIVL

SEQ ID NO: 2034155 - protein, 23 aa, Staphylococcus
PSEITPLTTIRVFELMEEVGFPK

SEQ ID NO: 2034156 - protein, 28 aa, Staphylococcus
PSEKTARQCAIVWGVYPVVKEGRKNTDA

SEQ ID NO: 2034157 - protein, 27 aa, Staphylococcus
PSEKTEAGIAWRLEKYGKRMNQIMRLS

SEQ ID NO: 2034158 - protein, 17 aa, Staphylococcus
PSELMAFGDANNDKDML

SEQ ID NO: 2034159 - protein, 23 aa, Staphylococcus
PSEPLKALIFDSEYDPYRGVISS

SEQ ID NO: 2034160 - protein, 21 aa, Staphylococcus
PSEVNFVRNLYEDVQRRDFTI

SEQ ID NO: 2034161 - protein, 21 aa, Staphylococcus
PSEVTFVRNLYQDVERRDFTM

SEQ ID NO: 2034162 - protein, 17 aa, Staphylococcus
PSEWFKYLCENDLMKKA

SEQ ID NO: 2034163 - protein, 27 aa, Staphylococcus
PSEYDVIYFTGGHGVMFDFPDNQDIQH

SEQ ID NO: 2034164 - protein, 17 aa, Staphylococcus
PSFGYGGYCLPKDTKQL

SEQ ID NO: 2034165 - protein, 17 aa, Staphylococcus
PSFKKHHLTIISGLAKG

SEQ ID NO: 2034166 - protein, 17 aa, Staphylococcus
PSFSLENQDGEVVTNET

SEQ ID NO: 2034167 - protein, 20 aa, Staphylococcus
PSFVQRDGYPYGLKAEDVTA

SEQ ID NO: 2034168 - protein, 23 aa, Staphylococcus
PSGCGKSTLAHIIAGLDKQYTGS

SEQ ID NO: 2034169 - protein, 18 aa, Staphylococcus
PSGCGKSTTLRMIAGLED

SEQ ID NO: 2034170 - protein, 21 aa, Staphylococcus
PSGIFYKDKLAVIGNGVVVDP

SEQ ID NO: 2034171 - protein, 21 aa, Staphylococcus
PSGIFYKEKLAVIGNGVVVDP

SEQ ID NO: 2034172 - protein, 18 aa, Staphylococcus
PSGQFKGNITVSMRPMTM

SEQ ID NO: 2034173 - protein, 21 aa, Staphylococcus
PSHIKEGRMGNFLENMVDWNI

SEQ ID NO: 2034174 - protein, 20 aa, Staphylococcus
PSHLEIVAPVVLGKTRSVQD

SEQ ID NO: 2034175 - protein, 20 aa, Staphylococcus
PSHLRKGTYPTTSFQDNYDE

SEQ ID NO: 2034176 - protein, 19 aa, Staphylococcus
PSHPIGRAILEYVDLPIAA

SEQ ID NO: 2034177 - protein, 22 aa, Staphylococcus
PSHPIGRAILKYVDLPIAAPSA

SEQ ID NO: 2034178 - protein, 18 aa, Staphylococcus
PSHPIGRAILQYIDIPIA

SEQ ID NO: 2034179 - protein, 17 aa, Staphylococcus
PSIIKAGSYEDCSDADL

SEQ ID NO: 2034180 - protein, 17 aa, Staphylococcus
PSILRLVKQVIEASHKE

SEQ ID NO: 2034181 - protein, 29 aa, Staphylococcus
PSINANLEWLPNLFVSGGLADLELGPFAR

SEQ ID NO: 2034182 - protein, 18 aa, Staphylococcus
PSISEVLMELGLKVENRA

SEQ ID NO: 2034183 - protein, 17 aa, Staphylococcus
PSISFTVLFKKSEIELL

SEQ ID NO: 2034184 - protein, 19 aa, Staphylococcus
PSITGSDLIKVDFKPLGER

SEQ ID NO: 2034185 - protein, 20 aa, Staphylococcus
PSIYEVWEKECIKPLKFKIY

SEQ ID NO: 2034186 - protein, 18 aa, Staphylococcus
PSKASVCHADLRYYTGNR

SEQ ID NO: 2034187 - protein, 20 aa, Staphylococcus
PSKDFPLLAKIVDAESPLSI

SEQ ID NO: 2034188 - protein, 23 aa, Staphylococcus
PSKDFPLLCKIVDANEPLSIHVH

SEQ ID NO: 2034189 - protein, 30 aa, Staphylococcus
PSKDFPLLCKIVDARHPLSIHVHPDDSYAY

SEQ ID NO: 2034190 - protein, 26 aa, Staphylococcus
PSKDLFWRLILSIAQIGCCPQEFLEQ

SEQ ID NO: 2034191 - protein, 17 aa, Staphylococcus
PSKKSKHDFTNSVTSES

SEQ ID NO: 2034192 - protein, 17 aa, Staphylococcus
PSKLCGLEHTIMKKLVI

SEQ ID NO: 2034193 - protein, 35 aa, Staphylococcus
PSKLKSIVGPFAYYIKGFEMLPQMKAVDIRIEYDN

SEQ ID NO: 2034194 - protein, 34 aa, Staphylococcus
PSKLKSIVGPFAYYIKGFEMLPQMNAVDIRIEYD

SEQ ID NO: 2034195 - protein, 34 aa, Staphylococcus
PSKLKSIVGSFAYYIKGFEMLPQMKAVDLRIEYD

SEQ ID NO: 2034196 - protein, 28 aa, Staphylococcus
PSLFIGKYNRFTLDGSEHGMRIDLSQNF

SEQ ID NO: 2034197 - protein, 20 aa, Staphylococcus
PSLHKPVLVLRDNTERPEGV

SEQ ID NO: 2034198 - protein, 21 aa, Staphylococcus
PSLHKPVLVLRDSTERPEGVE

SEQ ID NO: 2034199 - protein, 17 aa, Staphylococcus
PSLKLNHTVFMTNGCYI

SEQ ID NO: 2034200 - protein, 18 aa, Staphylococcus
PSLLPKYKGIDAIGQAFR

SEQ ID NO: 2034201 - protein, 36 aa, Staphylococcus
PSLSSAAYRAINRKGHISEEMRLIYVALTRAKEQLI

SEQ ID NO: 2034202 - protein, 26 aa, Staphylococcus
PSLSVEMRSDIPLARGLGSSASALVG

SEQ ID NO: 2034203 - protein, 22 aa, Staphylococcus
PSLTENLEWVPGVYVSGALADI

SEQ ID NO: 2034204 - protein, 19 aa, Staphylococcus
PSLVFDLTYFAIKQRKNES

SEQ ID NO: 2034205 - protein, 21 aa, Staphylococcus
PSLYYSELKSVQNLYRIKTYK

SEQ ID NO: 2034206 - protein, 18 aa, Staphylococcus
PSNDPALFDATIKSISEF

SEQ ID NO: 2034207 - protein, 17 aa, Staphylococcus
PSNGERYLSTPLYSFED

SEQ ID NO: 2034208 - protein, 21 aa, Staphylococcus
PSNKRYFIFIGKINSYSGNLN

SEQ ID NO: 2034209 - protein, 27 aa, Staphylococcus
PSNLAIMGRYILTPEIFDYLETQKEGA

SEQ ID NO: 2034210 - protein, 28 aa, Staphylococcus
PSNLAIMGRYILTPEIFDYLKTQKEGAG

SEQ ID NO: 2034211 - protein, 27 aa, Staphylococcus
PSNLYPPRKFDGEKWYGATANDTEQNN

SEQ ID NO: 2034212 - protein, 33 aa, Staphylococcus
PSNPCFKITDIRAVAAIAKRHHLLLAVDNTFMT

SEQ ID NO: 2034213 - protein, 26 aa, Staphylococcus
PSNPCFKITDIRAVAQISQQHQLLLA

SEQ ID NO: 2034214 - protein, 27 aa, Staphylococcus
PSNPLFKITDIRGAADIAKKHHLKLAV

SEQ ID NO: 2034215 - protein, 23 aa, Staphylococcus
PSNVLPKYAFSFLARTDGNSGKN

SEQ ID NO: 2034216 - protein, 34 aa, Staphylococcus
PSNWPRTAKFEGLIHRFRRSFLLNDNFEKKRFKE

SEQ ID NO: 2034217 - protein, 34 aa, Staphylococcus
PSNWPRTAKFEGLIHRFRRSFLLNDNFEKNKFRS

SEQ ID NO: 2034218 - protein, 19 aa, Staphylococcus
PSPANWKMDNGGLFGFGAM

SEQ ID NO: 2034219 - protein, 19 aa, Staphylococcus
PSPASWKMNNGGLFGFGGM

SEQ ID NO: 2034220 - protein, 27 aa, Staphylococcus
PSPETARQLALVWGVFPVVKKGRKTTD

SEQ ID NO: 2034221 - protein, 25 aa, Staphylococcus
PSPFHWRLLDKLALNTLHEVVLPIY

SEQ ID NO: 2034222 - protein, 19 aa, Staphylococcus
PSPHITIADVVKLRDIIEK

SEQ ID NO: 2034223 - protein, 18 aa, Staphylococcus
PSPHITLSHVIKLKDIIM

SEQ ID NO: 2034224 - protein, 18 aa, Staphylococcus
PSPMPINIVELDSIETLI

SEQ ID NO: 2034225 - protein, 19 aa, Staphylococcus
PSQETFALLLGNEGEGVND

SEQ ID NO: 2034226 - protein, 25 aa, Staphylococcus
PSQMGIRKPEFSSAISTISSSIAFD

SEQ ID NO: 2034227 - protein, 26 aa, Staphylococcus
PSQMGIRKPEFTSAISTISSSITFDE

SEQ ID NO: 2034228 - protein, 26 aa, Staphylococcus
PSQMLCSGLPRLVEYLNIDIKEEQQR

SEQ ID NO: 2034229 - protein, 18 aa, Staphylococcus
PSQTVGRTLNSGWQNESF

SEQ ID NO: 2034230 - protein, 17 aa, Staphylococcus
PSQYEVFNAQEYNQLAL

SEQ ID NO: 2034231 - protein, 18 aa, Staphylococcus
PSRIDAMIQTYENHEETD

SEQ ID NO: 2034232 - protein, 23 aa, Staphylococcus
PSRIKENFDLFNFNLELAEIAEI

SEQ ID NO: 2034233 - protein, 24 aa, Staphylococcus
PSRIYRYKHEFGDKLQPLSYQLYR

SEQ ID NO: 2034234 - protein, 35 aa, Staphylococcus
PSRLKSIVGPFAYYIKGFEMLPQMKAVDLRIEYDN

SEQ ID NO: 2034235 - protein, 24 aa, Staphylococcus
PSRNEGFGLIILEAMNQGDIVVSF

SEQ ID NO: 2034236 - protein, 24 aa, Staphylococcus
PSRTKALLDQFGFNFKKSLGQNFL

SEQ ID NO: 2034237 - protein, 29 aa, Staphylococcus
PSRTKELLTRFGFNFKKSLGQNFLVDVNI

SEQ ID NO: 2034238 - protein, 18 aa, Staphylococcus
PSSEDSVILSADYSQIEL

SEQ ID NO: 2034239 - protein, 19 aa, Staphylococcus
PSSFFEPFSYIATKAPLNS

SEQ ID NO: 2034240 - protein, 19 aa, Staphylococcus
PSSFIEYYAKVMSYHVTND

SEQ ID NO: 2034241 - protein, 20 aa, Staphylococcus
PSSFIEYYAKVMSYHVTNDH

SEQ ID NO: 2034242 - protein, 22 aa, Staphylococcus
PSSPCGACRQVMKELCDDEMPV

SEQ ID NO: 2034243 - protein, 23 aa, Staphylococcus
PSSRRYPFVKFTPEREIGNDLLF

SEQ ID NO: 2034244 - protein, 25 aa, Staphylococcus
PSTDTGWIPLPLVNGAAPDVYSDVY

SEQ ID NO: 2034245 - protein, 18 aa, Staphylococcus
PSTETWDLKDLFQNDEDF

SEQ ID NO: 2034246 - protein, 25 aa, Staphylococcus
PSTEVPLELYLSVLGMPGQTAYHGL

SEQ ID NO: 2034247 - protein, 21 aa, Staphylococcus
PSTIPKKGWIAVFTSGTYDKY

SEQ ID NO: 2034248 - protein, 18 aa, Staphylococcus
PSTLNLKVVVFDKEDYQF

SEQ ID NO: 2034249 - protein, 21 aa, Staphylococcus
PSTRAPRPFSKKDIQLVQESF

SEQ ID NO: 2034250 - protein, 18 aa, Staphylococcus
PSTVSGTITEILVDKGET

SEQ ID NO: 2034251 - protein, 17 aa, Staphylococcus
PSVKTLHPFFYPLNKLF

SEQ ID NO: 2034252 - protein, 23 aa, Staphylococcus
PSVLPIEVDERIYVLNQKEIIAL

SEQ ID NO: 2034253 - protein, 20 aa, Staphylococcus
PSVSFKLANHHIKYYIQQCR

SEQ ID NO: 2034254 - protein, 20 aa, Staphylococcus
PSYKQLISYCLLENEKNEIL

SEQ ID NO: 2034255 - protein, 20 aa, Staphylococcus
PSYKRTSCRMEILSRRGKSP

SEQ ID NO: 2034256 - protein, 21 aa, Staphylococcus
PSYMVKPPFFIQWDQGDANRH

SEQ ID NO: 2034257 - protein, 23 aa, Staphylococcus
PSYNVKPPFFIQWDESEAYKNES

SEQ ID NO: 2034258 - protein, 18 aa, Staphylococcus
PSYQDVIHKVFALPQDFT

SEQ ID NO: 2034259 - protein, 18 aa, Staphylococcus
PSYQSVIKKVFTLPQNFT

SEQ ID NO: 2034260 - protein, 17 aa, Staphylococcus
PSYQSVINKVFTLPQDF

SEQ ID NO: 2034261 - protein, 21 aa, Staphylococcus
PSYSLKPGQVITVREKSQNLN

SEQ ID NO: 2034262 - protein, 17 aa, Staphylococcus
PTAGGYGVMICYDEEDL

SEQ ID NO: 2034263 - protein, 18 aa, Staphylococcus
PTAGGYGVMICYNDHDLA

SEQ ID NO: 2034264 - protein, 18 aa, Staphylococcus
PTAGGYGVMICYSEEDLT

SEQ ID NO: 2034265 - protein, 20 aa, Staphylococcus
PTCGSRPHFPYLNQERQNYA

SEQ ID NO: 2034266 - protein, 27 aa, Staphylococcus
PTDKSEVYLNDYAKIIMSHNVASQVRR

SEQ ID NO: 2034267 - protein, 20 aa, Staphylococcus
PTDVEPYNYLSIEDYVSSIV

SEQ ID NO: 2034268 - protein, 26 aa, Staphylococcus
PTEKFKTTMITFKFMAPLDYETITAR

SEQ ID NO: 2034269 - protein, 26 aa, Staphylococcus
PTEKFKTTMITFKFMAPLEYETITAR

SEQ ID NO: 2034270 - protein, 22 aa, Staphylococcus
PTEKKGPSVLGIMDYQVQGQSQ

SEQ ID NO: 2034271 - protein, 18 aa, Staphylococcus
PTEKMISAIGNRELDNFI

SEQ ID NO: 2034272 - protein, 26 aa, Staphylococcus
PTFNEQWQRMGVLGIEMESAALYLNA

SEQ ID NO: 2034273 - protein, 22 aa, Staphylococcus
PTFYKERTVYLPNAYHPILNKD

SEQ ID NO: 2034274 - protein, 25 aa, Staphylococcus
PTGFDGLCAISFFMTSTVSDINSLK

SEQ ID NO: 2034275 - protein, 19 aa, Staphylococcus
PTGICACTELTRDQIVTQI

SEQ ID NO: 2034276 - protein, 24 aa, Staphylococcus
PTGIYWKNDQSFTVNVDSKALDLT

SEQ ID NO: 2034277 - protein, 19 aa, Staphylococcus
PTGMHFYYVYPPKGQFASI

SEQ ID NO: 2034278 - protein, 27 aa, Staphylococcus
PTGMVLSLAMCFRETFNQNEAADELEN

SEQ ID NO: 2034279 - protein, 25 aa, Staphylococcus
PTGSSLKPFLAYGPAIENMQWATNH

SEQ ID NO: 2034280 - protein, 25 aa, Staphylococcus
PTGSSLKPFLAYGPAIENMSWATNH

SEQ ID NO: 2034281 - protein, 19 aa, Staphylococcus
PTHLEFKHAALLYDFGYKY

SEQ ID NO: 2034282 - protein, 22 aa, Staphylococcus
PTIDGIEFVEFLISPNKGEPLK

SEQ ID NO: 2034283 - protein, 18 aa, Staphylococcus
PTIIEIKTVIGFGAPNKE

SEQ ID NO: 2034284 - protein, 17 aa, Staphylococcus
PTIKYIIEQGGKLVLFS

SEQ ID NO: 2034285 - protein, 17 aa, Staphylococcus
PTIKYIIEQGGKVVLFS

SEQ ID NO: 2034286 - protein, 17 aa, Staphylococcus
PTINLAMEEYVLKHLPA

SEQ ID NO: 2034287 - protein, 19 aa, Staphylococcus
PTIPNFRGTNFPKLLASLN

SEQ ID NO: 2034288 - protein, 17 aa, Staphylococcus
PTIPYKWDNSKAKYINI

SEQ ID NO: 2034289 - protein, 22 aa, Staphylococcus
PTISANVAITFAQAGHKTLLLD

SEQ ID NO: 2034290 - protein, 17 aa, Staphylococcus
PTIVRDFQKIIGQEIKA

SEQ ID NO: 2034291 - protein, 19 aa, Staphylococcus
PTKEIRIAGGREVNLQSLQ

SEQ ID NO: 2034292 - protein, 18 aa, Staphylococcus
PTKIEMLNFLLTAGAFGF

SEQ ID NO: 2034293 - protein, 27 aa, Staphylococcus
PTKKFKTTMVTFKFMAPLDYKTITARS

SEQ ID NO: 2034294 - protein, 22 aa, Staphylococcus
PTKPEGCKAQLIDLPFTSTAKE

SEQ ID NO: 2034295 - protein, 18 aa, Staphylococcus
PTKPIGMFYDKELADTIA

SEQ ID NO: 2034296 - protein, 19 aa, Staphylococcus
PTKPRAIEIVSEHNDAAID

SEQ ID NO: 2034297 - protein, 21 aa, Staphylococcus
PTKQMILNFAHYRFTDLKESG

SEQ ID NO: 2034298 - protein, 20 aa, Staphylococcus
PTKQMILNFGHYRFTDLNES

SEQ ID NO: 2034299 - protein, 22 aa, Staphylococcus
PTLCPSCDHELVRIEGEVALRC

SEQ ID NO: 2034300 - protein, 20 aa, Staphylococcus
PTLKIGEFAIKPGAMTSAVD

SEQ ID NO: 2034301 - protein, 19 aa, Staphylococcus
PTLLAPVSVIECAEELGMS

SEQ ID NO: 2034302 - protein, 18 aa, Staphylococcus
PTLNGFHWCQEIRKISNV

SEQ ID NO: 2034303 - protein, 18 aa, Staphylococcus
PTLNLAMEEYVLKNLPAE

SEQ ID NO: 2034304 - protein, 18 aa, Staphylococcus
PTLNLAMEEYVLKNLPSE

SEQ ID NO: 2034305 - protein, 18 aa, Staphylococcus
PTLNLAMEEYVLKNMPKD

SEQ ID NO: 2034306 - protein, 18 aa, Staphylococcus
PTLNLAMEEYVLKQLPSE

SEQ ID NO: 2034307 - protein, 24 aa, Staphylococcus
PTLQRDALSPIEFVVESDIEQDES

SEQ ID NO: 2034308 - protein, 19 aa, Staphylococcus
PTLTLAFKLAKLFDTTVDE

SEQ ID NO: 2034309 - protein, 22 aa, Staphylococcus
PTNIKAARILGMTNKGQQYLKY

SEQ ID NO: 2034310 - protein, 17 aa, Staphylococcus
PTNISGYIFTVDGKTIT

SEQ ID NO: 2034311 - protein, 24 aa, Staphylococcus
PTNLKTLTFHAACDEWFERYKLTS

SEQ ID NO: 2034312 - protein, 18 aa, Staphylococcus
PTPEGIELLNYIKRIFTI

SEQ ID NO: 2034313 - protein, 19 aa, Staphylococcus
PTPSYRSIKKAAKLINKSK

SEQ ID NO: 2034314 - protein, 20 aa, Staphylococcus
PTQIRYPLYLYTRGHALWYQ

SEQ ID NO: 2034315 - protein, 23 aa, Staphylococcus
PTQMKIAAVIHGKKAHASTPNKG

SEQ ID NO: 2034316 - protein, 17 aa, Staphylococcus
PTRIAVLPIGYADGYLR

SEQ ID NO: 2034317 - protein, 18 aa, Staphylococcus
PTRYESFNVSRRLNHEMH

SEQ ID NO: 2034318 - protein, 29 aa, Staphylococcus
PTSELKPETFYKLLRKLPAREYSIASSYE

SEQ ID NO: 2034319 - protein, 19 aa, Staphylococcus
PTSFEVMRYHSLMADAESV

SEQ ID NO: 2034320 - protein, 17 aa, Staphylococcus
PTSILIEADEVMIPRVK

SEQ ID NO: 2034321 - protein, 17 aa, Staphylococcus
PTSNPVIRRDLPDKVFV

SEQ ID NO: 2034322 - protein, 25 aa, Staphylococcus
PTSNQFKSCFKALMTKKETNLEQEG

SEQ ID NO: 2034323 - protein, 22 aa, Staphylococcus
PTTIAGFHLEKDHAPVLDELKK

SEQ ID NO: 2034324 - protein, 24 aa, Staphylococcus
PTTLKSLTFHAACDEWFENYKLTS

SEQ ID NO: 2034325 - protein, 23 aa, Staphylococcus
PTTLKSLTFHAASDEWFQNYIKT

SEQ ID NO: 2034326 - protein, 19 aa, Staphylococcus
PTTSQPAIGEWIENYEKLR

SEQ ID NO: 2034327 - protein, 19 aa, Staphylococcus
PTTSQPAIGEWIKNYEELR

SEQ ID NO: 2034328 - protein, 19 aa, Staphylococcus
PTTSQPAIGEWLKNYEKLR

SEQ ID NO: 2034329 - protein, 23 aa, Staphylococcus
PTTWKLAKMNLAIRGIDNDLGER

SEQ ID NO: 2034330 - protein, 21 aa, Staphylococcus
PTVALRFFNVYGPRQNPESDY

SEQ ID NO: 2034331 - protein, 23 aa, Staphylococcus
PTVGIDLKSRFDIHNLLNTMKRE

SEQ ID NO: 2034332 - protein, 19 aa, Staphylococcus
PTVRNRLNSVIERIESAKD

SEQ ID NO: 2034333 - protein, 20 aa, Staphylococcus
PTVSLRFFNVYGPKQNPYSD

SEQ ID NO: 2034334 - protein, 18 aa, Staphylococcus
PTVTEVIEGLTVDHLYEA

SEQ ID NO: 2034335 - protein, 23 aa, Staphylococcus
PTWAEAFNSILIESRDKISQRLI

SEQ ID NO: 2034336 - protein, 17 aa, Staphylococcus
PTYPFIATQVVRDKHLV

SEQ ID NO: 2034337 - protein, 19 aa, Staphylococcus
PVAALRPDASVPREMTHNQ

SEQ ID NO: 2034338 - protein, 25 aa, Staphylococcus
PVAASRKRVLIQFDEEIHCEIVNKD

SEQ ID NO: 2034339 - protein, 26 aa, Staphylococcus
PVATPYRLNDIFTRMKREGKAVFLVK

SEQ ID NO: 2034340 - protein, 26 aa, Staphylococcus
PVCDYLFCKAFGKMATNIEKYTKQGS

SEQ ID NO: 2034341 - protein, 17 aa, Staphylococcus
PVDAAIFNLGYLPKGDK

SEQ ID NO: 2034342 - protein, 17 aa, Staphylococcus
PVDEVIEAMGKIGRNLP

SEQ ID NO: 2034343 - protein, 20 aa, Staphylococcus
PVDKGDYIFMGSYSPQATYA

SEQ ID NO: 2034344 - protein, 21 aa, Staphylococcus
PVDLERGFNCTAKFRYRQQDT

SEQ ID NO: 2034345 - protein, 29 aa, Staphylococcus
PVDSIRPVLKMVDYVLVMTVNPGFGGQTF

SEQ ID NO: 2034346 - protein, 29 aa, Staphylococcus
PVEEVFRAWTKPSLFKQWFMTTEETNKVA

SEQ ID NO: 2034347 - protein, 23 aa, Staphylococcus
PVEFKPEDGITFTVEKNTTVKVE

SEQ ID NO: 2034348 - protein, 25 aa, Staphylococcus
PVEHAPRILGYDGVGIVEAVGPDVS

SEQ ID NO: 2034349 - protein, 24 aa, Staphylococcus
PVEIKADDGITFGVEKNTTVTVAG

SEQ ID NO: 2034350 - protein, 18 aa, Staphylococcus
PVEIRQILVDDFDVQDGT

SEQ ID NO: 2034351 - protein, 19 aa, Staphylococcus
PVEMLLPLHHLMEAGFDVD

SEQ ID NO: 2034352 - protein, 20 aa, Staphylococcus
PVFDVLSWKEVLNKYNITAS

SEQ ID NO: 2034353 - protein, 21 aa, Staphylococcus
PVFFGSALANFGVQNFLNAYV

SEQ ID NO: 2034354 - protein, 18 aa, Staphylococcus
PVFWGCGVTPQSVALDAK

SEQ ID NO: 2034355 - protein, 22 aa, Staphylococcus
PVGEVTLGRVFNVLGDTIDLED

SEQ ID NO: 2034356 - protein, 18 aa, Staphylococcus
PVGKMPITKLPAQPIVRS

SEQ ID NO: 2034357 - protein, 18 aa, Staphylococcus
PVGMILSLAMCLRESLNQ

SEQ ID NO: 2034358 - protein, 25 aa, Staphylococcus
PVGNAGNISAYWKGFKEYSDKNGTQ

SEQ ID NO: 2034359 - protein, 25 aa, Staphylococcus
PVGNAGNITAYWKGFKEFNDKHGTG

SEQ ID NO: 2034360 - protein, 25 aa, Staphylococcus
PVGNAGNITAYWKGFKEYNEKKGSQ

SEQ ID NO: 2034361 - protein, 24 aa, Staphylococcus
PVGNAGNITAYWQGFKEYHDKHGV

SEQ ID NO: 2034362 - protein, 25 aa, Staphylococcus
PVGPGPRKALDYMYEIAQRDGFATH

SEQ ID NO: 2034363 - protein, 25 aa, Staphylococcus
PVGPGPRQALDYMYEIAQRDGFSTH

SEQ ID NO: 2034364 - protein, 25 aa, Staphylococcus
PVGPGPRQALDYMYKIAERDGFGTH

SEQ ID NO: 2034365 - protein, 21 aa, Staphylococcus
PVGQARPGTTLSTTDEGELII

SEQ ID NO: 2034366 - protein, 31 aa, Staphylococcus
PVGRCWFMKSGRTKWIFKFEIASADRVHCVG

SEQ ID NO: 2034367 - protein, 17 aa, Staphylococcus
PVGRCWFVKAGRMKWVF

SEQ ID NO: 2034368 - protein, 25 aa, Staphylococcus
PVGRDCPKCNHYLMEHKKGRSSQVI

SEQ ID NO: 2034369 - protein, 24 aa, Staphylococcus
PVGRDCPKCNHYLVDKKKGRSSQV

SEQ ID NO: 2034370 - protein, 25 aa, Staphylococcus
PVGRECPKCNHYLVDKKKGRSSQVV

SEQ ID NO: 2034371 - protein, 24 aa, Staphylococcus
PVGVARPGTTLSITDEDELVIKGN

SEQ ID NO: 2034372 - protein, 24 aa, Staphylococcus
PVGVPRPGTILSLAENDELVITGQ

SEQ ID NO: 2034373 - protein, 20 aa, Staphylococcus
PVGVSRPGTKLTTTEDGELV

SEQ ID NO: 2034374 - protein, 19 aa, Staphylococcus
PVGYPRVDYLLQHRHDRAQ

SEQ ID NO: 2034375 - protein, 21 aa, Staphylococcus
PVHLNCAPSREHPHDSLIERV

SEQ ID NO: 2034376 - protein, 25 aa, Staphylococcus
PVHTFKMKFIKSFEAIDLHHAIFEN

SEQ ID NO: 2034377 - protein, 24 aa, Staphylococcus
PVHTYKMKFIKSFEAKDLHHTIFE

SEQ ID NO: 2034378 - protein, 25 aa, Staphylococcus
PVHTYKMKFIKSFIAKDLHHDIFID

SEQ ID NO: 2034379 - protein, 25 aa, Staphylococcus
PVIEELKETLQFESFDYIYEKNSSF

SEQ ID NO: 2034380 - protein, 17 aa, Staphylococcus
PVIHDAISHRLVVPNGT

SEQ ID NO: 2034381 - protein, 25 aa, Staphylococcus
PVILEPMMKVEILMPEEYMGDIMGD

SEQ ID NO: 2034382 - protein, 25 aa, Staphylococcus
PVIPEFKDFTLIGGNGSIISQNGQI

SEQ ID NO: 2034383 - protein, 20 aa, Staphylococcus
PVIVKEVGFGMSRELIQDLK

SEQ ID NO: 2034384 - protein, 21 aa, Staphylococcus
PVIYPTVISLKGFKYNLQNET

SEQ ID NO: 2034385 - protein, 21 aa, Staphylococcus
PVKENKGYMPPEFKEEDYEIW

SEQ ID NO: 2034386 - protein, 25 aa, Staphylococcus
PVKENNGYMPPSFKVNDYLNHTQQL

SEQ ID NO: 2034387 - protein, 22 aa, Staphylococcus
PVKGGYRLGRNTLINVLKSYER

SEQ ID NO: 2034388 - protein, 23 aa, Staphylococcus
PVKIGLATLVDRGHRELPIRADF

SEQ ID NO: 2034389 - protein, 18 aa, Staphylococcus
PVKNMTVAIIGTGRIGAA

SEQ ID NO: 2034390 - protein, 23 aa, Staphylococcus
PVKPLKMLLLLHGLSSDATSYMR

SEQ ID NO: 2034391 - protein, 21 aa, Staphylococcus
PVKRTDGFITKFNRIIERRLL

SEQ ID NO: 2034392 - protein, 22 aa, Staphylococcus
PVKRTDGFITKFNRIIERRLLN

SEQ ID NO: 2034393 - protein, 22 aa, Staphylococcus
PVKRTDGFITKFNRLIERRLLN

SEQ ID NO: 2034394 - protein, 19 aa, Staphylococcus
PVKSISELTEFEEIMDGRV

SEQ ID NO: 2034395 - protein, 18 aa, Staphylococcus
PVKTARKILTDEFADELI

SEQ ID NO: 2034396 - protein, 22 aa, Staphylococcus
PVLEGFTLPKMLWVQQHEPNIW

SEQ ID NO: 2034397 - protein, 26 aa, Staphylococcus
PVLQERGVEITSFFYNRMFTQHPELK

SEQ ID NO: 2034398 - protein, 17 aa, Staphylococcus
PVLSRHHVHLMNKAVPG

SEQ ID NO: 2034399 - protein, 19 aa, Staphylococcus
PVMESLILLSMRRRMSEDP

SEQ ID NO: 2034400 - protein, 18 aa, Staphylococcus
PVMKFFKYFYTNRGPVID

SEQ ID NO: 2034401 - protein, 20 aa, Staphylococcus
PVNIFSDYTLEEFAKRKPET

SEQ ID NO: 2034402 - protein, 24 aa, Staphylococcus
PVNNGGIILRWLRDELLASEVETA

SEQ ID NO: 2034403 - protein, 18 aa, Staphylococcus
PVNNGGVILRWLRDELLA

SEQ ID NO: 2034404 - protein, 17 aa, Staphylococcus
PVNNGGVVLRWLRDELL

SEQ ID NO: 2034405 - protein, 17 aa, Staphylococcus
PVNNGGVVLRWLRNELL

SEQ ID NO: 2034406 - protein, 18 aa, Staphylococcus
PVPEGRVAFTAEEAVEKA

SEQ ID NO: 2034407 - protein, 17 aa, Staphylococcus
PVPELPPIETFEGPTGR

SEQ ID NO: 2034408 - protein, 22 aa, Staphylococcus
PVPGGVGPLTITMVLNNTLIAE

SEQ ID NO: 2034409 - protein, 22 aa, Staphylococcus
PVPGGVGPLTITMVLNNTLLAE

SEQ ID NO: 2034410 - protein, 24 aa, Staphylococcus
PVPKEINEAIQLPMVGHRSADFEN

SEQ ID NO: 2034411 - protein, 25 aa, Staphylococcus
PVPKEINHALGLPMVGHRSPDFESI

SEQ ID NO: 2034412 - protein, 23 aa, Staphylococcus
PVQNVRHLLGSKIGYISQNYASS

SEQ ID NO: 2034413 - protein, 20 aa, Staphylococcus
PVQQQAFVDLTWEDYQQQID

SEQ ID NO: 2034414 - protein, 17 aa, Staphylococcus
PVRDAFKLLKQDQLIHL

SEQ ID NO: 2034415 - protein, 19 aa, Staphylococcus
PVRGDAWADWYANQLNVSP

SEQ ID NO: 2034416 - protein, 19 aa, Staphylococcus
PVRSFAVQIQKDLAAKKGI

SEQ ID NO: 2034417 - protein, 29 aa, Staphylococcus
PVSDFPVYEMRWDIGYVLQQIALFPHMTI

SEQ ID NO: 2034418 - protein, 18 aa, Staphylococcus
PVTMLMHLSKPIKTIKEW

SEQ ID NO: 2034419 - protein, 17 aa, Staphylococcus
PVVIDFPKDMGVLKTSA

SEQ ID NO: 2034420 - protein, 17 aa, Staphylococcus
PVVIDFPKDMGVLTSSA

SEQ ID NO: 2034421 - protein, 20 aa, Staphylococcus
PVVISSRIRLARNLENHVHP

SEQ ID NO: 2034422 - protein, 24 aa, Staphylococcus
PVVMSSRIRLARNLDNHVHPLMFT

SEQ ID NO: 2034423 - protein, 17 aa, Staphylococcus
PVVPEILSQLNFNQFNL

SEQ ID NO: 2034424 - protein, 21 aa, Staphylococcus
PVYARALYGVMTFKNDLDEIS

SEQ ID NO: 2034425 - protein, 36 aa, Staphylococcus
PWDSAKGKGLWMSAVFRPNVPFSMITTFNLFMALAI

SEQ ID NO: 2034426 - protein, 18 aa, Staphylococcus
PWFTEMGHLVPSHRYKNE

SEQ ID NO: 2034427 - protein, 19 aa, Staphylococcus
PWGSVRSISGYPFIWWFAT

SEQ ID NO: 2034428 - protein, 20 aa, Staphylococcus
PWLAEERALIIAMLKQQKPM

SEQ ID NO: 2034429 - protein, 19 aa, Staphylococcus
PWLERLGFDNVKAVLLDPE

SEQ ID NO: 2034430 - protein, 30 aa, Staphylococcus
PWRKMPRNAMTIHYSGMVIEALYRIEEGVK

SEQ ID NO: 2034431 - protein, 20 aa, Staphylococcus
PWRTMPRNGMTVHYSGMTLE

SEQ ID NO: 2034432 - protein, 27 aa, Staphylococcus
PWTLIPHCPKCDAPMEINKRKAQVGMV

SEQ ID NO: 2034433 - protein, 17 aa, Staphylococcus
PWYVNSISNPVSKDTFF

SEQ ID NO: 2034434 - protein, 17 aa, Staphylococcus
PYADGDGYIEIATTRPE

SEQ ID NO: 2034435 - protein, 25 aa, Staphylococcus
PYAEALKEEGLLCKETHDTVIRFAP

SEQ ID NO: 2034436 - protein, 25 aa, Staphylococcus
PYAPPSKIRLIIDRDIVGIPDKYLD

SEQ ID NO: 2034437 - protein, 26 aa, Staphylococcus
PYASKCFKSAFNFKKEILEIGYPRND

SEQ ID NO: 2034438 - protein, 17 aa, Staphylococcus
PYASLNPRLKVMDIVAE

SEQ ID NO: 2034439 - protein, 18 aa, Staphylococcus
PYDAKGLLISAIKSNDPV

SEQ ID NO: 2034440 - protein, 23 aa, Staphylococcus
PYDAKGLLISAIRSNDPVVYLEH

SEQ ID NO: 2034441 - protein, 19 aa, Staphylococcus
PYDAKGLLISSIRSNDPVV

SEQ ID NO: 2034442 - protein, 20 aa, Staphylococcus
PYDAKGLLISSIRSNDPVVY

SEQ ID NO: 2034443 - protein, 18 aa, Staphylococcus
PYDAKGLLLASVESNDPV

SEQ ID NO: 2034444 - protein, 19 aa, Staphylococcus
PYDAKGLLLSSIRSNDPVV

SEQ ID NO: 2034445 - protein, 20 aa, Staphylococcus
PYDAKGLLLSSIRSNDPVVY

SEQ ID NO: 2034446 - protein, 26 aa, Staphylococcus
PYDHRTIQALRRWEQWFKSLNVKDIH

SEQ ID NO: 2034447 - protein, 18 aa, Staphylococcus
PYDIDCYELGANIEPLKQ

SEQ ID NO: 2034448 - protein, 17 aa, Staphylococcus
PYDKFYFVIGSDQYDQL

SEQ ID NO: 2034449 - protein, 22 aa, Staphylococcus
PYDKWFEIVRHYSQNFNHKPNI

SEQ ID NO: 2034450 - protein, 28 aa, Staphylococcus
PYEFKALNNISLRFKQGHYYAIVGQTGS

SEQ ID NO: 2034451 - protein, 17 aa, Staphylococcus
PYEFYQFWINQSDEDVI

SEQ ID NO: 2034452 - protein, 18 aa, Staphylococcus
PYEKAWMVKVEISDQSQL

SEQ ID NO: 2034453 - protein, 21 aa, Staphylococcus
PYEKPHVYCLVSVIDGQGIVA

SEQ ID NO: 2034454 - protein, 17 aa, Staphylococcus
PYERWKKTMDVNLNSMV

SEQ ID NO: 2034455 - protein, 22 aa, Staphylococcus
PYFAGTKVKWILDHVEGAREKA

SEQ ID NO: 2034456 - protein, 21 aa, Staphylococcus
PYFAGTKVKWILDNVDGAREK

SEQ ID NO: 2034457 - protein, 17 aa, Staphylococcus
PYFCGQLNVPLTEQGTE

SEQ ID NO: 2034458 - protein, 19 aa, Staphylococcus
PYFLEFMAQGVSKGNAVTD

SEQ ID NO: 2034459 - protein, 17 aa, Staphylococcus
PYFLNDEQIQWVEETLS

SEQ ID NO: 2034460 - protein, 19 aa, Staphylococcus
PYFMHHNYWFLFYHDENYF

SEQ ID NO: 2034461 - protein, 23 aa, Staphylococcus
PYFSGSKIKWILDNVEGAREKAE

SEQ ID NO: 2034462 - protein, 23 aa, Staphylococcus
PYGPEYFVFGGLYKVEKIMPEVF

SEQ ID NO: 2034463 - protein, 37 aa, Staphylococcus
PYHMPTHCPSCGHELVRLDGEVALRCINPKCPAQLVE

SEQ ID NO: 2034464 - protein, 17 aa, Staphylococcus
PYHPLFIEEPVLPEHNE

SEQ ID NO: 2034465 - protein, 17 aa, Staphylococcus
PYIEEWSKRNNIEVDLS

SEQ ID NO: 2034466 - protein, 22 aa, Staphylococcus
PYIEIIKFDYQVGTGGYGVGIL

SEQ ID NO: 2034467 - protein, 19 aa, Staphylococcus
PYIKATKPILDRFDLHSGQ

SEQ ID NO: 2034468 - protein, 22 aa, Staphylococcus
PYIKKSDWGWAIDPVGLRYTLN

SEQ ID NO: 2034469 - protein, 18 aa, Staphylococcus
PYISFLRSEFEKYENNIL

SEQ ID NO: 2034470 - protein, 19 aa, Staphylococcus
PYKEAYKSNVIGVENIMKF

SEQ ID NO: 2034471 - protein, 20 aa, Staphylococcus
PYKKWFERMSDYGFEENIDY

SEQ ID NO: 2034472 - protein, 20 aa, Staphylococcus
PYKLEIEMLKAQQFDPQLKD

SEQ ID NO: 2034473 - protein, 18 aa, Staphylococcus
PYKVFTSFYKKWRPYLMK

SEQ ID NO: 2034474 - protein, 19 aa, Staphylococcus
PYKVFTSFYKKWRPYVMQR

SEQ ID NO: 2034475 - protein, 21 aa, Staphylococcus
PYLCRPFEHGADIVIHSATKF

SEQ ID NO: 2034476 - protein, 21 aa, Staphylococcus
PYLFRPIEHGANIVVHSATKF

SEQ ID NO: 2034477 - protein, 18 aa, Staphylococcus
PYLHYEMHQNGRPINPIK

SEQ ID NO: 2034478 - protein, 18 aa, Staphylococcus
PYLKDWSLERLLKTDRII

SEQ ID NO: 2034479 - protein, 23 aa, Staphylococcus
PYLKKKIELHGTVTVKGKWNRAK

SEQ ID NO: 2034480 - protein, 17 aa, Staphylococcus
PYLLEISYFKFLNKFLN

SEQ ID NO: 2034481 - protein, 24 aa, Staphylococcus
PYLLYELICNGALSQLTASSLLGD

SEQ ID NO: 2034482 - protein, 19 aa, Staphylococcus
PYLPELMDMHKLIYPVGEG

SEQ ID NO: 2034483 - protein, 20 aa, Staphylococcus
PYLPGCGSVTEIVQAMETGV

SEQ ID NO: 2034484 - protein, 18 aa, Staphylococcus
PYMLRFEFNGHRIVSFSG

SEQ ID NO: 2034485 - protein, 18 aa, Staphylococcus
PYMMHWYMINYCFEHGYE

SEQ ID NO: 2034486 - protein, 19 aa, Staphylococcus
PYMMHWYMMNYCFEHGYDR

SEQ ID NO: 2034487 - protein, 17 aa, Staphylococcus
PYMMQFIDKLPVVAHNA

SEQ ID NO: 2034488 - protein, 24 aa, Staphylococcus
PYMTPLKFNLLISNIQSLSVECHF

SEQ ID NO: 2034489 - protein, 26 aa, Staphylococcus
PYNDIHMWDYKALPAVFGGDNVVVHD

SEQ ID NO: 2034490 - protein, 25 aa, Staphylococcus
PYNDLPHLVAPVITDVKAATQSLKW

SEQ ID NO: 2034491 - protein, 24 aa, Staphylococcus
PYNGLPHLVSPVITDVKAATQSLK

SEQ ID NO: 2034492 - protein, 19 aa, Staphylococcus
PYNHILLATGFKPTLLQQP

SEQ ID NO: 2034493 - protein, 17 aa, Staphylococcus
PYNILAITFTNKAAKEM

SEQ ID NO: 2034494 - protein, 17 aa, Staphylococcus
PYNYLSIEDYVSSIVQY

SEQ ID NO: 2034495 - protein, 18 aa, Staphylococcus
PYPHNAFNMARYIDDSQQ

SEQ ID NO: 2034496 - protein, 19 aa, Staphylococcus
PYREFAWVQDRFGVNFQLA

SEQ ID NO: 2034497 - protein, 21 aa, Staphylococcus
PYSESLINLFKIVSTPYNTVI

SEQ ID NO: 2034498 - protein, 19 aa, Staphylococcus
PYSGVAMAEEFMFAGKDVL

SEQ ID NO: 2034499 - protein, 19 aa, Staphylococcus
PYSGVAMGEEFMFNGKDVL

SEQ ID NO: 2034500 - protein, 17 aa, Staphylococcus
PYSGVTMGEEFMFNGKH

SEQ ID NO: 2034501 - protein, 18 aa, Staphylococcus
PYSGVTMGEEFMFNGKHV

SEQ ID NO: 2034502 - protein, 19 aa, Staphylococcus
PYSGVTMGEEFMFNGKNVL

SEQ ID NO: 2034503 - protein, 18 aa, Staphylococcus
PYSGVTMGEEFMFNGKQV

SEQ ID NO: 2034504 - protein, 17 aa, Staphylococcus
PYSGYRQIDSELYKLTV

SEQ ID NO: 2034505 - protein, 19 aa, Staphylococcus
PYSKATRGNIDVDLSVEVV

SEQ ID NO: 2034506 - protein, 20 aa, Staphylococcus
PYSKKIVILNCRSDRVDRTR

SEQ ID NO: 2034507 - protein, 26 aa, Staphylococcus
PYSQALKMAHLTVRYLKNRNVHYKVE

SEQ ID NO: 2034508 - protein, 26 aa, Staphylococcus
PYTDIPEAYQILGMGPVELRLRDIQP

SEQ ID NO: 2034509 - protein, 17 aa, Staphylococcus
PYTENRVSEEFEKLSSA

SEQ ID NO: 2034510 - protein, 24 aa, Staphylococcus
PYTKSKFYSEIKVLEAIEAGLDAQ

SEQ ID NO: 2034511 - protein, 23 aa, Staphylococcus
PYTKSKFYSEIKVLEAVNDGLDA

SEQ ID NO: 2034512 - protein, 20 aa, Staphylococcus
PYTLLDYFGDDWLIMIDESH

SEQ ID NO: 2034513 - protein, 19 aa, Staphylococcus
PYTLLDYFGDDWLVMVDES

SEQ ID NO: 2034514 - protein, 20 aa, Staphylococcus
PYTQAAVMSIAFDHPLPTVD

SEQ ID NO: 2034515 - protein, 20 aa, Staphylococcus
PYTQAAVMSIAFDLPLATVD

SEQ ID NO: 2034516 - protein, 23 aa, Staphylococcus
PYTQAAVMSIAFNRPLATVDGNV

SEQ ID NO: 2034517 - protein, 20 aa, Staphylococcus
PYVGKLTFFRVYSGTLNSGS

SEQ ID NO: 2034518 - protein, 19 aa, Staphylococcus
PYVIVCLNAIVAETDEEAK

SEQ ID NO: 2034519 - protein, 24 aa, Staphylococcus
PYVMGGLKCATEIGAHTVAISCNT

SEQ ID NO: 2034520 - protein, 21 aa, Staphylococcus
PYYASGGFIHYCEYPKLNHNI

SEQ ID NO: 2034521 - protein, 22 aa, Staphylococcus
PYYASGGFIHYCEYPKLNHNIK

SEQ ID NO: 2034522 - protein, 22 aa, Staphylococcus
PYYASGGFIHYCEYPKLNHNLK

SEQ ID NO: 2034523 - protein, 23 aa, Staphylococcus
PYYHFAIDIPYNHFYDMKEHYQN

SEQ ID NO: 2034524 - protein, 19 aa, Staphylococcus
PYYSARVVKNVTIAPSPEW

SEQ ID NO: 2034525 - protein, 20 aa, Staphylococcus
QAAEALKSIANVDLESYGLE

SEQ ID NO: 2034526 - protein, 17 aa, Staphylococcus
QAAKDILDRSGYNPVDK

SEQ ID NO: 2034527 - protein, 23 aa, Staphylococcus
QAARAWLSDYAKSLLDMVIPLLV

SEQ ID NO: 2034528 - protein, 17 aa, Staphylococcus
QAASLPLTGLTASETLF

SEQ ID NO: 2034529 - protein, 20 aa, Staphylococcus
QAAVRPYKWVNTKITENSFR

SEQ ID NO: 2034530 - protein, 22 aa, Staphylococcus
QADGEPVLFCPKMEVEEVKASP

SEQ ID NO: 2034531 - protein, 20 aa, Staphylococcus
QADVGYTIVHPGILLNDSGI

SEQ ID NO: 2034532 - protein, 17 aa, Staphylococcus
QAEAIVMLQLYRLTNTD

SEQ ID NO: 2034533 - protein, 22 aa, Staphylococcus
QAEEWLRTNIKDINFDLYNYAQ

SEQ ID NO: 2034534 - protein, 20 aa, Staphylococcus
QAEVRQTFKVSKVGTIAGSY

SEQ ID NO: 2034535 - protein, 21 aa, Staphylococcus
QAFAFKDEVGYPLIVRPAFTM

SEQ ID NO: 2034536 - protein, 19 aa, Staphylococcus
QAFEDLTYFQIKLIIVGIE

SEQ ID NO: 2034537 - protein, 29 aa, Staphylococcus
QAFEFKEQVGYPLIVRPAFTMGGTGGGIC

SEQ ID NO: 2034538 - protein, 19 aa, Staphylococcus
QAFEGLRIQNRRLRRPDLT

SEQ ID NO: 2034539 - protein, 18 aa, Staphylococcus
QAFKMVINAVDLAENEDD

SEQ ID NO: 2034540 - protein, 23 aa, Staphylococcus
QAFLKEYKLRGLVNSDMDVVDAL

SEQ ID NO: 2034541 - protein, 24 aa, Staphylococcus
QAFNVQLDDGMAFLSGVVSRKKQV

SEQ ID NO: 2034542 - protein, 19 aa, Staphylococcus
QAFSFKEQVGYPLIVRPAF

SEQ ID NO: 2034543 - protein, 22 aa, Staphylococcus
QAFSRRLKEEGVYVKSIVFPTV

SEQ ID NO: 2034544 - protein, 17 aa, Staphylococcus
QAGAVMLVLEAVPSDLA

SEQ ID NO: 2034545 - protein, 18 aa, Staphylococcus
QAGDRFVIFSDEKQARRI

SEQ ID NO: 2034546 - protein, 21 aa, Staphylococcus
QAGDRFYFRLNDNASSFFGYH

SEQ ID NO: 2034547 - protein, 18 aa, Staphylococcus
QAGFKTLLIDGDMRKPTQ

SEQ ID NO: 2034548 - protein, 19 aa, Staphylococcus
QAGIYKWFIDINAGTCSYI

SEQ ID NO: 2034549 - protein, 19 aa, Staphylococcus
QAGSYPQWIKLDIVTDTQT

SEQ ID NO: 2034550 - protein, 19 aa, Staphylococcus
QAHNFKWAAPIMSTPVKNM

SEQ ID NO: 2034551 - protein, 31 aa, Staphylococcus
QAHPGHNRWHPDIPAAFSVDPGESFRMECLD

SEQ ID NO: 2034552 - protein, 25 aa, Staphylococcus
QAHPGHNRWHPDIPAVFSVDPGESF

SEQ ID NO: 2034553 - protein, 17 aa, Staphylococcus
QAIDYLMPEFLRDIFKE

SEQ ID NO: 2034554 - protein, 18 aa, Staphylococcus
QAIELGRSLGVEVLETEM

SEQ ID NO: 2034555 - protein, 18 aa, Staphylococcus
QAIHELPFDKGLNRVCTN

SEQ ID NO: 2034556 - protein, 18 aa, Staphylococcus
QAIHELPFNKGIDRVCTN

SEQ ID NO: 2034557 - protein, 18 aa, Staphylococcus
QAIHLGGKEGLSIARQLG

SEQ ID NO: 2034558 - protein, 18 aa, Staphylococcus
QAIKDTIKKASIASGVDI

SEQ ID NO: 2034559 - protein, 19 aa, Staphylococcus
QAILEWKNSDVVKEVLGEE

SEQ ID NO: 2034560 - protein, 24 aa, Staphylococcus
QAIQNLNLMYGWKENTGLLQSPVY

SEQ ID NO: 2034561 - protein, 17 aa, Staphylococcus
QAIQVFKIGEGGLGGEL

SEQ ID NO: 2034562 - protein, 22 aa, Staphylococcus
QAIRLYEKLGFKRYGREPKSIF

SEQ ID NO: 2034563 - protein, 22 aa, Staphylococcus
QAISASISYYFMKKIGDEHIQK

SEQ ID NO: 2034564 - protein, 22 aa, Staphylococcus
QAISASISYYFMKKLGDEHIQK

SEQ ID NO: 2034565 - protein, 17 aa, Staphylococcus
QAISMGLSSIMKAKRII

SEQ ID NO: 2034566 - protein, 27 aa, Staphylococcus
QAISQYFKRRYGFLYSEEEIIVTNGAS

SEQ ID NO: 2034567 - protein, 18 aa, Staphylococcus
QAIVKGNVPAAIKDKEII

SEQ ID NO: 2034568 - protein, 27 aa, Staphylococcus
QAKDIYQFGPRFGRGSEAIYEGFKLKE

SEQ ID NO: 2034569 - protein, 24 aa, Staphylococcus
QAKKRALEILNMVGLPNAKERFKA

SEQ ID NO: 2034570 - protein, 23 aa, Staphylococcus
QAKPGEISWESPFGEGRPGWHIE

SEQ ID NO: 2034571 - protein, 25 aa, Staphylococcus
QAKQLSEFIIAFILDDYKKMKTSFI

SEQ ID NO: 2034572 - protein, 20 aa, Staphylococcus
QAKSGGAVIGFRLKDETKAQ

SEQ ID NO: 2034573 - protein, 21 aa, Staphylococcus
QAKSMLGWRPIGTQEEAILEA

SEQ ID NO: 2034574 - protein, 20 aa, Staphylococcus
QAKVASLVTAFARVRDGKEP

SEQ ID NO: 2034575 - protein, 19 aa, Staphylococcus
QAKVFRIGDPVQIKVINVD

SEQ ID NO: 2034576 - protein, 24 aa, Staphylococcus
QAKWFLKEFDVYLNGERETRRGKK

SEQ ID NO: 2034577 - protein, 18 aa, Staphylococcus
QAKWFLQDFDVMINDERE

SEQ ID NO: 2034578 - protein, 17 aa, Staphylococcus
QAKWFLQDFEVLINGQR

SEQ ID NO: 2034579 - protein, 17 aa, Staphylococcus
QAKYFGFSEKLAEQIQD

SEQ ID NO: 2034580 - protein, 18 aa, Staphylococcus
QALDFFEARLNRYEIQTT

SEQ ID NO: 2034581 - protein, 18 aa, Staphylococcus
QALDFKVNATLIKSKNDY

SEQ ID NO: 2034582 - protein, 25 aa, Staphylococcus
QALEYRLPIYNSFGMTETCSQFLTA

SEQ ID NO: 2034583 - protein, 23 aa, Staphylococcus
QALFPDFNHLFLVVDAENQAAWN

SEQ ID NO: 2034584 - protein, 19 aa, Staphylococcus
QALIACFLEKLHLTDKDML

SEQ ID NO: 2034585 - protein, 17 aa, Staphylococcus
QALIKFGEPIYQSDIPK

SEQ ID NO: 2034586 - protein, 22 aa, Staphylococcus
QALKEIGYICAKVRDTMQAATK

SEQ ID NO: 2034587 - protein, 22 aa, Staphylococcus
QALKEIGYICAKVRDTMQAETK

SEQ ID NO: 2034588 - protein, 24 aa, Staphylococcus
QALKHFEGTIIFVSHDRYFINQLA

SEQ ID NO: 2034589 - protein, 18 aa, Staphylococcus
QALKRIYGDVKFGVGPVI

SEQ ID NO: 2034590 - protein, 18 aa, Staphylococcus
QALNGMRIGEMLAIQNED

SEQ ID NO: 2034591 - protein, 25 aa, Staphylococcus
QALNVFRMELLGAKVVSVTDGQGTL

SEQ ID NO: 2034592 - protein, 17 aa, Staphylococcus
QALPKDVTMHFIGSLQS

SEQ ID NO: 2034593 - protein, 24 aa, Staphylococcus
QALRFYEKRGFVVTGSHEFYTGDV

SEQ ID NO: 2034594 - protein, 23 aa, Staphylococcus
QALTRLYPQVLLTIGPVIDNGFY

SEQ ID NO: 2034595 - protein, 20 aa, Staphylococcus
QALVKRRYQLNVSNETQNSL

SEQ ID NO: 2034596 - protein, 19 aa, Staphylococcus
QAMEGEWDLPLVGSGAFEL

SEQ ID NO: 2034597 - protein, 23 aa, Staphylococcus
QAMIDASLYPKVHNISNQRLDLQ

SEQ ID NO: 2034598 - protein, 23 aa, Staphylococcus
QAMKVNFSKLVQRKQHIVSTLTG

SEQ ID NO: 2034599 - protein, 26 aa, Staphylococcus
QAMSKEGYHFFGLLYIGAILTKEGPK

SEQ ID NO: 2034600 - protein, 19 aa, Staphylococcus
QAMVLKLKALFLLLKVHMH

SEQ ID NO: 2034601 - protein, 19 aa, Staphylococcus
QANLPSRFLKEIPEELLET

SEQ ID NO: 2034602 - protein, 18 aa, Staphylococcus
QANQRLLTMSGNRYQLIR

SEQ ID NO: 2034603 - protein, 29 aa, Staphylococcus
QANVIRILFKEGFIALRPSGTEPKLKFYL

SEQ ID NO: 2034604 - protein, 30 aa, Staphylococcus
QAPHQIDLLQWLCGLPKKVYANVKYGYQRD

SEQ ID NO: 2034605 - protein, 17 aa, Staphylococcus
QAPMATLHYTPRAKKVI

SEQ ID NO: 2034606 - protein, 25 aa, Staphylococcus
QAPYKFLLSHGFVMDGEGKKMSKSL

SEQ ID NO: 2034607 - protein, 25 aa, Staphylococcus
QAQAILDMRLRRLTGLERDKIENEY

SEQ ID NO: 2034608 - protein, 24 aa, Staphylococcus
QAQAILDMRLRRLTGLERDKIESE

SEQ ID NO: 2034609 - protein, 25 aa, Staphylococcus
QAQAILDMRLRRLTGLERDKIESEY

SEQ ID NO: 2034610 - protein, 25 aa, Staphylococcus
QAQMLNERLLNMIGVHTVSIDIERN

SEQ ID NO: 2034611 - protein, 20 aa, Staphylococcus
QARGKGGHVRANWKDVTDII

SEQ ID NO: 2034612 - protein, 26 aa, Staphylococcus
QARKKVLVDHGFRLPSAMDNRPLKFE

SEQ ID NO: 2034613 - protein, 17 aa, Staphylococcus
QASEIVKKFPIPHISTG

SEQ ID NO: 2034614 - protein, 22 aa, Staphylococcus
QASHGGAVLGFRLKDETKAQDF

SEQ ID NO: 2034615 - protein, 18 aa, Staphylococcus
QASSLAMAIFFQDMNDEE

SEQ ID NO: 2034616 - protein, 18 aa, Staphylococcus
QASSLAMAIFFQDMNQEE

SEQ ID NO: 2034617 - protein, 22 aa, Staphylococcus
QATEAIPNWAAENGYPVTNYEQ

SEQ ID NO: 2034618 - protein, 17 aa, Staphylococcus
QATHEDIVWIINQLDVH

SEQ ID NO: 2034619 - protein, 20 aa, Staphylococcus
QATHFKFKYPDLKIALEDLV

SEQ ID NO: 2034620 - protein, 17 aa, Staphylococcus
QATLYRHVNAMFEEQLL

SEQ ID NO: 2034621 - protein, 32 aa, Staphylococcus
QAVGKRLAQHLVPYPPGIPSFFKGEQVTATTV

SEQ ID NO: 2034622 - protein, 19 aa, Staphylococcus
QAVISFGMVQAGSADNIIP

SEQ ID NO: 2034623 - protein, 25 aa, Staphylococcus
QAVKEGKLLFGDTVAVFGAGPIGLL

SEQ ID NO: 2034624 - protein, 20 aa, Staphylococcus
QAVRGVDFFINKGETLAIVG

SEQ ID NO: 2034625 - protein, 21 aa, Staphylococcus
QAVRGVDFFLNKGETLAIVGE

SEQ ID NO: 2034626 - protein, 19 aa, Staphylococcus
QAVSMGLNSIMRAKRIILL

SEQ ID NO: 2034627 - protein, 20 aa, Staphylococcus
QAVTHPRYGKQLKAETFEKE

SEQ ID NO: 2034628 - protein, 18 aa, Staphylococcus
QAWDWKEEYANFIRQQWA

SEQ ID NO: 2034629 - protein, 18 aa, Staphylococcus
QAWDWKEEYASFIRKQWA

SEQ ID NO: 2034630 - protein, 24 aa, Staphylococcus
QAWLARFDWCIPLHHDYGSAYHIL

SEQ ID NO: 2034631 - protein, 22 aa, Staphylococcus
QAYETRGVIVLTDPDFPGDKIR

SEQ ID NO: 2034632 - protein, 24 aa, Staphylococcus
QAYILDKFIEAMKLEQPDVIVIAG

SEQ ID NO: 2034633 - protein, 22 aa, Staphylococcus
QAYISKEPIEFVSKTYNLTEPE

SEQ ID NO: 2034634 - protein, 18 aa, Staphylococcus
QAYLYSLPFHYYKDYGIR

SEQ ID NO: 2034635 - protein, 21 aa, Staphylococcus
QCLDCQFLANRFQLMTQLYCD

SEQ ID NO: 2034636 - protein, 23 aa, Staphylococcus
QCLKLPNTRVRKLLKRMDKYIKF

SEQ ID NO: 2034637 - protein, 29 aa, Staphylococcus
QCLNYPLEIIPKLNFEDTYQFMLLDKKNN

SEQ ID NO: 2034638 - protein, 22 aa, Staphylococcus
QCLYVKLDPYWIYQIYDKDINP

SEQ ID NO: 2034639 - protein, 22 aa, Staphylococcus
QCLYVKLDPYWIYQVHDKDINP

SEQ ID NO: 2034640 - protein, 24 aa, Staphylococcus
QCMLIAIPDMHWSLEIDSSLNEDD

SEQ ID NO: 2034641 - protein, 25 aa, Staphylococcus
QCNIKHSRLEFRHCTEEIEMTDEPV

SEQ ID NO: 2034642 - protein, 20 aa, Staphylococcus
QCQTLATGSFEWENSYRNGY

SEQ ID NO: 2034643 - protein, 18 aa, Staphylococcus
QCRRKFLLEFFGESPNQP

SEQ ID NO: 2034644 - protein, 17 aa, Staphylococcus
QCRRRYLLEFFGDNPTQ

SEQ ID NO: 2034645 - protein, 19 aa, Staphylococcus
QCSAHFNNRCKFHYHLYFV

SEQ ID NO: 2034646 - protein, 22 aa, Staphylococcus
QCSEIKAYYILDKHAKHARAKV

SEQ ID NO: 2034647 - protein, 21 aa, Staphylococcus
QCVLESLNLKVVIFEDKDFEF

SEQ ID NO: 2034648 - protein, 21 aa, Staphylococcus
QCVPESLNLKVVIFDDEDYQF

SEQ ID NO: 2034649 - protein, 20 aa, Staphylococcus
QCYCGCVFAAMAQGIDFKQI

SEQ ID NO: 2034650 - protein, 19 aa, Staphylococcus
QCYCGCVFAAMRQGIDFKE

SEQ ID NO: 2034651 - protein, 19 aa, Staphylococcus
QCYCGCVFAAMRQGIDFKQ

SEQ ID NO: 2034652 - protein, 19 aa, Staphylococcus
QCYCGCVFAAQVQGIDFKE

SEQ ID NO: 2034653 - protein, 25 aa, Staphylococcus
QDAEVQFQYGLALCHLEMFNQAINQ

SEQ ID NO: 2034654 - protein, 21 aa, Staphylococcus
QDAHEFCPYSKATRGNIDVNL

SEQ ID NO: 2034655 - protein, 20 aa, Staphylococcus
QDAIMPLPFEDADVVIGDLP

SEQ ID NO: 2034656 - protein, 20 aa, Staphylococcus
QDAIMPLPFEEADVVIGDLP

SEQ ID NO: 2034657 - protein, 20 aa, Staphylococcus
QDAKSIGFVLSMPHEVDTYH

SEQ ID NO: 2034658 - protein, 22 aa, Staphylococcus
QDARELLPFATVHDLPILAGPL

SEQ ID NO: 2034659 - protein, 28 aa, Staphylococcus
QDATPIRLGQEISGWRYMLDKCDELLKE

SEQ ID NO: 2034660 - protein, 34 aa, Staphylococcus
QDATPIRLGQEISGWRYMLDKCETLLSESKAHIL

SEQ ID NO: 2034661 - protein, 29 aa, Staphylococcus
QDATPIRLGQEISGWRYMLEKCETLLAES

SEQ ID NO: 2034662 - protein, 18 aa, Staphylococcus
QDCDGYLTFDFLKNQIAA

SEQ ID NO: 2034663 - protein, 23 aa, Staphylococcus
QDDCPPCNFLKNYLTEHHINFIE

SEQ ID NO: 2034664 - protein, 25 aa, Staphylococcus
QDDCPPCSFIKNYLHEHQIPFEEKH

SEQ ID NO: 2034665 - protein, 22 aa, Staphylococcus
QDDCPPCTFVKNHLQANHVDYT

SEQ ID NO: 2034666 - protein, 26 aa, Staphylococcus
QDDKKRIAIQYSLPKWLVDHWVTHYG

SEQ ID NO: 2034667 - protein, 31 aa, Staphylococcus
QDDLELLESVALQIGSAIKRIYLTDQEKEAA

SEQ ID NO: 2034668 - protein, 24 aa, Staphylococcus
QDDLFDDVCEFMINEGHISTSLVQ

SEQ ID NO: 2034669 - protein, 24 aa, Staphylococcus
QDDLFDDVCEFMVNEGHISTSLIQ

SEQ ID NO: 2034670 - protein, 21 aa, Staphylococcus
QDDYDCFFCIVDQHAITVPQD

SEQ ID NO: 2034671 - protein, 19 aa, Staphylococcus
QDEIVIIDAGIKFPDDNLL

SEQ ID NO: 2034672 - protein, 25 aa, Staphylococcus
QDELFDDVCEFMVKEGHISTSLIQR

SEQ ID NO: 2034673 - protein, 37 aa, Staphylococcus
QDELFEDVCEFMIKEGHISTSLIQRHFQIGYNRAARI

SEQ ID NO: 2034674 - protein, 26 aa, Staphylococcus
QDEPGYAIPILLAISYLHQALIIENL

SEQ ID NO: 2034675 - protein, 19 aa, Staphylococcus
QDEVTGLKAIICIHDTTLG

SEQ ID NO: 2034676 - protein, 18 aa, Staphylococcus
QDFALWPHMTVFQNVAYP

SEQ ID NO: 2034677 - protein, 23 aa, Staphylococcus
QDFALWPHMTVFQNVAYPLKVKK

SEQ ID NO: 2034678 - protein, 27 aa, Staphylococcus
QDFDIKLKYAYCLNKLNLGRRAEHLFY

SEQ ID NO: 2034679 - protein, 19 aa, Staphylococcus
QDFDLLFVKWVPRDQNKEA

SEQ ID NO: 2034680 - protein, 26 aa, Staphylococcus
QDFERWSFHLQIYFLAERFKEQKRMF

SEQ ID NO: 2034681 - protein, 28 aa, Staphylococcus
QDFIRHLLEFKTCKPIDISKVEPASEIV

SEQ ID NO: 2034682 - protein, 26 aa, Staphylococcus
QDFPDFCQAGKDFDYILGQLGANRVA

SEQ ID NO: 2034683 - protein, 23 aa, Staphylococcus
QDFPVQIELISRFRSTKEVKETK

SEQ ID NO: 2034684 - protein, 18 aa, Staphylococcus
QDFYKKNPELYAKEQQDR

SEQ ID NO: 2034685 - protein, 23 aa, Staphylococcus
QDGKRVALMPGPPKEMQPMAENE

SEQ ID NO: 2034686 - protein, 23 aa, Staphylococcus
QDGLKGGGYYVEYRTDDARLTIE

SEQ ID NO: 2034687 - protein, 28 aa, Staphylococcus
QDIANPFGMLLSVAMCLRESLNEDKAAD

SEQ ID NO: 2034688 - protein, 18 aa, Staphylococcus
QDIANWLLSGIKPAGYSA

SEQ ID NO: 2034689 - protein, 17 aa, Staphylococcus
QDICDISYNQAQSLYES

SEQ ID NO: 2034690 - protein, 23 aa, Staphylococcus
QDIEAGYQFGAKGIGLVRTEHMF

SEQ ID NO: 2034691 - protein, 19 aa, Staphylococcus
QDIFIPKGQNLGAVDGHKV

SEQ ID NO: 2034692 - protein, 25 aa, Staphylococcus
QDIFIPKGQSLGAIDGHKVLVQITK

SEQ ID NO: 2034693 - protein, 17 aa, Staphylococcus
QDIKHQLIRTVGNPDER

SEQ ID NO: 2034694 - protein, 22 aa, Staphylococcus
QDIQAGYQFGAKGIGLVRTEHM

SEQ ID NO: 2034695 - protein, 25 aa, Staphylococcus
QDIQRIEHMLRYALIIEDNGDNNVI

SEQ ID NO: 2034696 - protein, 25 aa, Staphylococcus
QDIQRIEHMLRYALIIEDTGDNNVV

SEQ ID NO: 2034697 - protein, 26 aa, Staphylococcus
QDIQRIEHMLRYALIIEDTGDNNVVQ

SEQ ID NO: 2034698 - protein, 19 aa, Staphylococcus
QDKKVLLVMGGSLGSKKLN

SEQ ID NO: 2034699 - protein, 21 aa, Staphylococcus
QDKLQDVVKVYRKMIENKNEA

SEQ ID NO: 2034700 - protein, 24 aa, Staphylococcus
QDKRIHIILSNAIVDVCRGELFQF

SEQ ID NO: 2034701 - protein, 19 aa, Staphylococcus
QDKYLGVSFHPELTDDYRV

SEQ ID NO: 2034702 - protein, 19 aa, Staphylococcus
QDLANFLYHMSRLNQPVGG

SEQ ID NO: 2034703 - protein, 21 aa, Staphylococcus
QDLDCDFFSFSGHKMLGPTGI

SEQ ID NO: 2034704 - protein, 25 aa, Staphylococcus
QDLDLKARIVLFIHSLGSKHAKKLI

SEQ ID NO: 2034705 - protein, 27 aa, Staphylococcus
QDLFKHIPVKAGDFFFIPNGIVHAIGK

SEQ ID NO: 2034706 - protein, 25 aa, Staphylococcus
QDLGDRVNIINAFALLNEQGVTRNV

SEQ ID NO: 2034707 - protein, 23 aa, Staphylococcus
QDLIGGFRVKVGTTVMDGSVKND

SEQ ID NO: 2034708 - protein, 25 aa, Staphylococcus
QDLKDRYQFIGGLSPLAGTTNRQAE

SEQ ID NO: 2034709 - protein, 26 aa, Staphylococcus
QDLLKRLCKMNEKFDTTIIMVTHDPV

SEQ ID NO: 2034710 - protein, 24 aa, Staphylococcus
QDLLRARRTYAFTELFMFELRMQW

SEQ ID NO: 2034711 - protein, 23 aa, Staphylococcus
QDLNLKGGQKMYFDQKIETYVPV

SEQ ID NO: 2034712 - protein, 24 aa, Staphylococcus
QDLPVDSYIIWGGVSDIHLMYEER

SEQ ID NO: 2034713 - protein, 17 aa, Staphylococcus
QDLSVMATITFQNLFKL

SEQ ID NO: 2034714 - protein, 18 aa, Staphylococcus
QDLTQIAFYERGELVDAD

SEQ ID NO: 2034715 - protein, 18 aa, Staphylococcus
QDMICIYVAIGQKESTVR

SEQ ID NO: 2034716 - protein, 17 aa, Staphylococcus
QDMKAFIDLMINPQIEN

SEQ ID NO: 2034717 - protein, 17 aa, Staphylococcus
QDNALVCEVEHSENDGI

SEQ ID NO: 2034718 - protein, 24 aa, Staphylococcus
QDNRRKKISSSKFLTNYFLAIYGE

SEQ ID NO: 2034719 - protein, 17 aa, Staphylococcus
QDPEAWFQATKKAIIAL

SEQ ID NO: 2034720 - protein, 17 aa, Staphylococcus
QDPNEWFQATKRGVKRI

SEQ ID NO: 2034721 - protein, 20 aa, Staphylococcus
QDRKARSREPITAKLVANLI

SEQ ID NO: 2034722 - protein, 19 aa, Staphylococcus
QDRLDEITDRIAARIVEYF

SEQ ID NO: 2034723 - protein, 19 aa, Staphylococcus
QDRYVKAVGKAAKYVTNLK

SEQ ID NO: 2034724 - protein, 25 aa, Staphylococcus
QDSIEMMDRLGIEAGITSISDPALE

SEQ ID NO: 2034725 - protein, 17 aa, Staphylococcus
QDSINFFKRHIQIPSEL

SEQ ID NO: 2034726 - protein, 17 aa, Staphylococcus
QDSMKRIDISPLGAAAL

SEQ ID NO: 2034727 - protein, 19 aa, Staphylococcus
QDTDIANTVAFLASDKAKY

SEQ ID NO: 2034728 - protein, 28 aa, Staphylococcus
QDVKDNKIEMVLSWKLNRISRSMRDVFN

SEQ ID NO: 2034729 - protein, 17 aa, Staphylococcus
QDVKRVIEDKGGTVFLL

SEQ ID NO: 2034730 - protein, 25 aa, Staphylococcus
QDWTEVKKAGALLVIGNFSKTALET

SEQ ID NO: 2034731 - protein, 27 aa, Staphylococcus
QDYKWNKKSVRFMLVFDTKSMTIQDIH

SEQ ID NO: 2034732 - protein, 19 aa, Staphylococcus
QDYNFTWKAPIMSKPVKNM

SEQ ID NO: 2034733 - protein, 21 aa, Staphylococcus
QEADEIIRWMTGYTQSEIDRL

SEQ ID NO: 2034734 - protein, 18 aa, Staphylococcus
QEALDFDLLETMFTDEEG

SEQ ID NO: 2034735 - protein, 27 aa, Staphylococcus
QEALELAEQMGIIFIDEIDKVASNNQG

SEQ ID NO: 2034736 - protein, 18 aa, Staphylococcus
QEAMDFDLLETMFTDNEN

SEQ ID NO: 2034737 - protein, 24 aa, Staphylococcus
QEATLPGRVRILFQAAEEVGSGAQ

SEQ ID NO: 2034738 - protein, 18 aa, Staphylococcus
QEATQIGMAYAMEEGDIS

SEQ ID NO: 2034739 - protein, 24 aa, Staphylococcus
QEDLFKQWFHPEGASTEVFEFNVE

SEQ ID NO: 2034740 - protein, 26 aa, Staphylococcus
QEDLKGSWSVVCFYPADFSFVCPTEL

SEQ ID NO: 2034741 - protein, 22 aa, Staphylococcus
QEEGYPFFGVLYIGAILTDEGP

SEQ ID NO: 2034742 - protein, 19 aa, Staphylococcus
QEEIKKWSAEDEFATFVKT

SEQ ID NO: 2034743 - protein, 25 aa, Staphylococcus
QEEKRCPTCHMTLKDIAHVGKFGCS

SEQ ID NO: 2034744 - protein, 25 aa, Staphylococcus
QEEKRCPTCKMTLKDIAHVGKFGCA

SEQ ID NO: 2034745 - protein, 25 aa, Staphylococcus
QEEKRCPTCNMTLKDIAHVGKFGCA

SEQ ID NO: 2034746 - protein, 24 aa, Staphylococcus
QEEKYLRLYAEFENYKRRIQNENQ

SEQ ID NO: 2034747 - protein, 25 aa, Staphylococcus
QEELDRVGVHLEHFGGHDYIVNSYP

SEQ ID NO: 2034748 - protein, 21 aa, Staphylococcus
QEELLKSFKLNGLINSDPEVL

SEQ ID NO: 2034749 - protein, 25 aa, Staphylococcus
QEFIKSRYILADSISIINKIMQAKK

SEQ ID NO: 2034750 - protein, 23 aa, Staphylococcus
QEFKGFMTGNIIKYATRLGRKDE

SEQ ID NO: 2034751 - protein, 17 aa, Staphylococcus
QEFTKMMLGEDYNITED

SEQ ID NO: 2034752 - protein, 24 aa, Staphylococcus
QEGMKLVESFVCIFDDIEAILVKD

SEQ ID NO: 2034753 - protein, 20 aa, Staphylococcus
QEGRRFLFETVVKVEEPKYD

SEQ ID NO: 2034754 - protein, 23 aa, Staphylococcus
QEGRRFLFETVVKVNHPKHDITI

SEQ ID NO: 2034755 - protein, 23 aa, Staphylococcus
QEGRRFLFETVVKVNHPKQDITI

SEQ ID NO: 2034756 - protein, 20 aa, Staphylococcus
QEGRRPKGDIVVQSVVGEEV

SEQ ID NO: 2034757 - protein, 22 aa, Staphylococcus
QEGYAMPMLLALSHVHQLLIRE

SEQ ID NO: 2034758 - protein, 20 aa, Staphylococcus
QEGYEVAGFTTSQQGKAKLV

SEQ ID NO: 2034759 - protein, 17 aa, Staphylococcus
QEGYMTWVEDYRDEKIE

SEQ ID NO: 2034760 - protein, 23 aa, Staphylococcus
QEHEVKLVFFLAITPQDIHMNKQ

SEQ ID NO: 2034761 - protein, 17 aa, Staphylococcus
QEHGAYVLSGRGMYNLD

SEQ ID NO: 2034762 - protein, 18 aa, Staphylococcus
QEHLDLNAFEYKDARNYL

SEQ ID NO: 2034763 - protein, 17 aa, Staphylococcus
QEHLIEFEKLMSSNEKE

SEQ ID NO: 2034764 - protein, 21 aa, Staphylococcus
QEHPRNQFVREFMGDHLHKDI

SEQ ID NO: 2034765 - protein, 22 aa, Staphylococcus
QEHYPDFTLDYDVDPVREGIAK

SEQ ID NO: 2034766 - protein, 23 aa, Staphylococcus
QEIEDLFLGLGFEIVNGYEVEQD

SEQ ID NO: 2034767 - protein, 19 aa, Staphylococcus
QEIETTFTYLERVNFNLIT

SEQ ID NO: 2034768 - protein, 19 aa, Staphylococcus
QEIETTLSYLDRIDYNLIT

SEQ ID NO: 2034769 - protein, 18 aa, Staphylococcus
QEIKDLSFVEAVKELGER

SEQ ID NO: 2034770 - protein, 22 aa, Staphylococcus
QEIKENLNLPADKKVIMYAPTW

SEQ ID NO: 2034771 - protein, 23 aa, Staphylococcus
QEIQLKCVFIHNSIANVQSLSST

SEQ ID NO: 2034772 - protein, 24 aa, Staphylococcus
QEIRKTSNVPIMFISSRTDNMDQI

SEQ ID NO: 2034773 - protein, 24 aa, Staphylococcus
QEIRKVSNVPIIFISSRTDNMDQI

SEQ ID NO: 2034774 - protein, 24 aa, Staphylococcus
QEIYYRYKKFGIVPEFEDEREEIQ

SEQ ID NO: 2034775 - protein, 22 aa, Staphylococcus
QEKIDALPIVTEFREAQSDAND

SEQ ID NO: 2034776 - protein, 24 aa, Staphylococcus
QEKNGHKSVVLWFTGLSGSGKSTI

SEQ ID NO: 2034777 - protein, 17 aa, Staphylococcus
QEKRFMHHYNFPNFSVG

SEQ ID NO: 2034778 - protein, 31 aa, Staphylococcus
QEKRVTCIWRVLKRYFLHVICKQTIGKNPKT

SEQ ID NO: 2034779 - protein, 17 aa, Staphylococcus
QELALLLTTGEQQTVSY

SEQ ID NO: 2034780 - protein, 18 aa, Staphylococcus
QELAWMRAGAKARSTKQQ

SEQ ID NO: 2034781 - protein, 18 aa, Staphylococcus
QELAWMRAGAKARTTKQQ

SEQ ID NO: 2034782 - protein, 26 aa, Staphylococcus
QELDRGFDFYAPQTFIDKDGKRILIG

SEQ ID NO: 2034783 - protein, 18 aa, Staphylococcus
QELFDAFKEMLAPLQESH

SEQ ID NO: 2034784 - protein, 23 aa, Staphylococcus
QELGRLLLYKMIHRQIDQWEYIG

SEQ ID NO: 2034785 - protein, 20 aa, Staphylococcus
QELIFRIKAVLRRYQINAEN

SEQ ID NO: 2034786 - protein, 23 aa, Staphylococcus
QELIKFIQRCVGYSLSGYTSEQV

SEQ ID NO: 2034787 - protein, 17 aa, Staphylococcus
QELIKLSLTTKGLSSID

SEQ ID NO: 2034788 - protein, 21 aa, Staphylococcus
QELKAEKALNQMKEETRLMLK

SEQ ID NO: 2034789 - protein, 19 aa, Staphylococcus
QELLPQAKFKTIRAPMFEH

SEQ ID NO: 2034790 - protein, 20 aa, Staphylococcus
QELNSVFNFHHLKVDYKDGE

SEQ ID NO: 2034791 - protein, 19 aa, Staphylococcus
QELPHGQIQFIITVGEEAG

SEQ ID NO: 2034792 - protein, 25 aa, Staphylococcus
QELQRAYELKPEIIGVNNRDLKRFV

SEQ ID NO: 2034793 - protein, 25 aa, Staphylococcus
QELSEAKHIVFICGHYEGYDERIRE

SEQ ID NO: 2034794 - protein, 19 aa, Staphylococcus
QELSILVAPGIPFGQNGKH

SEQ ID NO: 2034795 - protein, 34 aa, Staphylococcus
QELTAYDVVNDWPYEALVKIFYRYGEEKFSKQIA

SEQ ID NO: 2034796 - protein, 19 aa, Staphylococcus
QELTEYGLFPEDWGGDTIF

SEQ ID NO: 2034797 - protein, 18 aa, Staphylococcus
QEMLERFLKTHHIQYKQN

SEQ ID NO: 2034798 - protein, 21 aa, Staphylococcus
QEMNGKLGLIVSGDSFIGEVS

SEQ ID NO: 2034799 - protein, 21 aa, Staphylococcus
QEMYGGTCINIGCIPSKTLVH

SEQ ID NO: 2034800 - protein, 28 aa, Staphylococcus
QENPFYFGASVGRYGGRIADGKFELDNQ

SEQ ID NO: 2034801 - protein, 18 aa, Staphylococcus
QENTKLFVVIGQLNQLIK

SEQ ID NO: 2034802 - protein, 19 aa, Staphylococcus
QEPGNTFYAHYEDVAEHNT

SEQ ID NO: 2034803 - protein, 19 aa, Staphylococcus
QEQKRRFAKLNPQATADQI

SEQ ID NO: 2034804 - protein, 19 aa, Staphylococcus
QERFSELAIDVYDNPKNMG

SEQ ID NO: 2034805 - protein, 21 aa, Staphylococcus
QERIEREFGIELIATAPSVIY

SEQ ID NO: 2034806 - protein, 18 aa, Staphylococcus
QERIKYEYFREKIGEVSN

SEQ ID NO: 2034807 - protein, 18 aa, Staphylococcus
QERIKYEYFREKIGEVTN

SEQ ID NO: 2034808 - protein, 22 aa, Staphylococcus
QERIWNPLQIMNDFGIDVFSPS

SEQ ID NO: 2034809 - protein, 19 aa, Staphylococcus
QERLAKLTGGVAVIKVGAA

SEQ ID NO: 2034810 - protein, 17 aa, Staphylococcus
QERLTIIQGKLKQLETD

SEQ ID NO: 2034811 - protein, 24 aa, Staphylococcus
QERPKLKHPSLYLDIGDHVDLSAP

SEQ ID NO: 2034812 - protein, 19 aa, Staphylococcus
QESAMKWIQRQRLYSKQNS

SEQ ID NO: 2034813 - protein, 24 aa, Staphylococcus
QESGARPVLKQAILNSKETDTVVT

SEQ ID NO: 2034814 - protein, 26 aa, Staphylococcus
QESLRKIKGGFTFAVLTKDALYGAVD

SEQ ID NO: 2034815 - protein, 25 aa, Staphylococcus
QESREIIQFIKSYVQSHSFIKSLVL

SEQ ID NO: 2034816 - protein, 22 aa, Staphylococcus
QESRNAKAWVDGMSEISKNTQS

SEQ ID NO: 2034817 - protein, 21 aa, Staphylococcus
QESSKMCLFEPRVFSDTQDIA

SEQ ID NO: 2034818 - protein, 22 aa, Staphylococcus
QESSKMCLFEPRVFSDTQDIAD

SEQ ID NO: 2034819 - protein, 18 aa, Staphylococcus
QESYRVKSIEAFLSENNI

SEQ ID NO: 2034820 - protein, 25 aa, Staphylococcus
QETFPELKKLIGHTLMITDGTSLLG

SEQ ID NO: 2034821 - protein, 20 aa, Staphylococcus
QETMKFIGIKKIEKNQTVIA

SEQ ID NO: 2034822 - protein, 22 aa, Staphylococcus
QETQVQLAFCIDVRSEPFRRHL

SEQ ID NO: 2034823 - protein, 17 aa, Staphylococcus
QETRGVIILTDPDFPGD

SEQ ID NO: 2034824 - protein, 17 aa, Staphylococcus
QETRGVIVLTDPDFPGD

SEQ ID NO: 2034825 - protein, 22 aa, Staphylococcus
QETSEIIGILWHQGESDSLNQR

SEQ ID NO: 2034826 - protein, 17 aa, Staphylococcus
QETYFKMMQDFIREEDV

SEQ ID NO: 2034827 - protein, 22 aa, Staphylococcus
QETYFKMMQDFLAPSDVILAEQ

SEQ ID NO: 2034828 - protein, 25 aa, Staphylococcus
QEVINRLTKIFGIKSISPVHKTSQE

SEQ ID NO: 2034829 - protein, 19 aa, Staphylococcus
QEVLIKLYLVIDRYDTQQD

SEQ ID NO: 2034830 - protein, 17 aa, Staphylococcus
QEVLKYIDFNQGNIARQ

SEQ ID NO: 2034831 - protein, 30 aa, Staphylococcus
QEVLLPESFYRGAHQHIFRAMMHLNEDTKE

SEQ ID NO: 2034832 - protein, 30 aa, Staphylococcus
QEVLLPESFYRGAHQHIFRAMMNLNEDAHE

SEQ ID NO: 2034833 - protein, 30 aa, Staphylococcus
QEVLLPESFYRGAHQHIFRAMMNLNEDGDE

SEQ ID NO: 2034834 - protein, 30 aa, Staphylococcus
QEVLLPESFYRGAHQHIFRAMMNLNEDNKD

SEQ ID NO: 2034835 - protein, 18 aa, Staphylococcus
QEVPEIYDGTVIVKSVAR

SEQ ID NO: 2034836 - protein, 18 aa, Staphylococcus
QEVRAWTFKQGMTAPQCA

SEQ ID NO: 2034837 - protein, 17 aa, Staphylococcus
QEVTIYTSLVVREDAQL

SEQ ID NO: 2034838 - protein, 20 aa, Staphylococcus
QEVWTTCTFILNDEGKANIS

SEQ ID NO: 2034839 - protein, 26 aa, Staphylococcus
QEYDCPLKVAGIYSFGPNEETKETED

SEQ ID NO: 2034840 - protein, 21 aa, Staphylococcus
QEYIKRLIIKLDRPIGRDVYN

SEQ ID NO: 2034841 - protein, 38 aa, Staphylococcus
QEYILPRFIAECIKFGGYGGLVIRSSKSLKHRNDLNFN

SEQ ID NO: 2034842 - protein, 20 aa, Staphylococcus
QEYYPDFKLDYDVDPVRQSI

SEQ ID NO: 2034843 - protein, 26 aa, Staphylococcus
QFAEGIEVGQVFKLGTKYSESMNATF

SEQ ID NO: 2034844 - protein, 22 aa, Staphylococcus
QFAESIINGALVNRAVSEAETG

SEQ ID NO: 2034845 - protein, 21 aa, Staphylococcus
QFAKREVYQHYALSELPFPKK

SEQ ID NO: 2034846 - protein, 20 aa, Staphylococcus
QFASGNGFHCGIWIEDQLVG

SEQ ID NO: 2034847 - protein, 30 aa, Staphylococcus
QFAYRFNEQFCRKLWLDAWEATYNQQLKAM

SEQ ID NO: 2034848 - protein, 27 aa, Staphylococcus
QFDAPERIKAGLLFTLEEECIKQGHTY

SEQ ID NO: 2034849 - protein, 24 aa, Staphylococcus
QFDEFERMILLRSIDTHWTDHIDT

SEQ ID NO: 2034850 - protein, 25 aa, Staphylococcus
QFDFGIKHGESFKNTCISTFSEVLS

SEQ ID NO: 2034851 - protein, 23 aa, Staphylococcus
QFDQIFDLLAIRIIVNSINDCYA

SEQ ID NO: 2034852 - protein, 24 aa, Staphylococcus
QFDQIFDLLAIRIIVNSINDCYAV

SEQ ID NO: 2034853 - protein, 23 aa, Staphylococcus
QFDQIFDLLAIRIIVNTINDCYA

SEQ ID NO: 2034854 - protein, 21 aa, Staphylococcus
QFEAHFGLTVRDGYGQTESTL

SEQ ID NO: 2034855 - protein, 25 aa, Staphylococcus
QFEALKRGCAVLITGGFKTSKRIIN

SEQ ID NO: 2034856 - protein, 32 aa, Staphylococcus
QFEDGKCHFNIEVKCGKGTYIRTLATDIGKQL

SEQ ID NO: 2034857 - protein, 18 aa, Staphylococcus
QFEISKQFWGHLVESGQI

SEQ ID NO: 2034858 - protein, 20 aa, Staphylococcus
QFEISKQFWGHLVKSGNIDN

SEQ ID NO: 2034859 - protein, 20 aa, Staphylococcus
QFEKHIYAIHTLTSLYTTTT

SEQ ID NO: 2034860 - protein, 21 aa, Staphylococcus
QFELLDIEWSGAINTDQYAQL

SEQ ID NO: 2034861 - protein, 24 aa, Staphylococcus
QFETRAGTLLRYYTGLLEHSKVQP

SEQ ID NO: 2034862 - protein, 26 aa, Staphylococcus
QFETRAGTLLRYYTGLLESSRKTPFG

SEQ ID NO: 2034863 - protein, 24 aa, Staphylococcus
QFEVAKEIIAAGLVPIIEPEVNIN

SEQ ID NO: 2034864 - protein, 17 aa, Staphylococcus
QFFEEKGYYPVAVDAKH

SEQ ID NO: 2034865 - protein, 26 aa, Staphylococcus
QFGAIPSRVPLNASFSKKGKDDRMKA

SEQ ID NO: 2034866 - protein, 19 aa, Staphylococcus
QFGDLSLLDTPTFLFGMRN

SEQ ID NO: 2034867 - protein, 25 aa, Staphylococcus
QFGIAWELGLLYGLNTKDINLRKMD

SEQ ID NO: 2034868 - protein, 18 aa, Staphylococcus
QFGIKHIAQRSAGFDTYD

SEQ ID NO: 2034869 - protein, 18 aa, Staphylococcus
QFGKEISKFQLIQEKLAM

SEQ ID NO: 2034870 - protein, 18 aa, Staphylococcus
QFHEVEWEEALDVITNNF

SEQ ID NO: 2034871 - protein, 26 aa, Staphylococcus
QFHKTRIEALVKRGINDFVFETVPNF

SEQ ID NO: 2034872 - protein, 18 aa, Staphylococcus
QFHQLIGMGFKRYVDTLK

SEQ ID NO: 2034873 - protein, 17 aa, Staphylococcus
QFIDTVIRATERCESDW

SEQ ID NO: 2034874 - protein, 19 aa, Staphylococcus
QFIERGSGAIVSIGTNLYQ

SEQ ID NO: 2034875 - protein, 18 aa, Staphylococcus
QFIKKLDKTMAFLDIDEN

SEQ ID NO: 2034876 - protein, 19 aa, Staphylococcus
QFIMDSGIDSTRFVYDYLS

SEQ ID NO: 2034877 - protein, 34 aa, Staphylococcus
QFINVMPQSQWLKRAEIYIDGFHNFSSLEYDIIK

SEQ ID NO: 2034878 - protein, 19 aa, Staphylococcus
QFIQCLKDEKPDVVVISGD

SEQ ID NO: 2034879 - protein, 19 aa, Staphylococcus
QFITRLNYFKSKAIASQRS

SEQ ID NO: 2034880 - protein, 27 aa, Staphylococcus
QFKERHQLKMITIESLINYRRKQESEG

SEQ ID NO: 2034881 - protein, 26 aa, Staphylococcus
QFKFDKAFLSCGAFDTSQIYEYDLEE

SEQ ID NO: 2034882 - protein, 19 aa, Staphylococcus
QFKGLRDIGDPVALAAYYN

SEQ ID NO: 2034883 - protein, 28 aa, Staphylococcus
QFKPKKVMDTLELFKIAFPTDKSYQLSE

SEQ ID NO: 2034884 - protein, 22 aa, Staphylococcus
QFKQEIANTFSYLDRIDYQLLT

SEQ ID NO: 2034885 - protein, 20 aa, Staphylococcus
QFKSGGALYYNRLMPSGTVI

SEQ ID NO: 2034886 - protein, 23 aa, Staphylococcus
QFKSLRRFFKIYVRGIKGASQLR

SEQ ID NO: 2034887 - protein, 28 aa, Staphylococcus
QFKSLRRFFKIYVRGIRGASELRHQLMS

SEQ ID NO: 2034888 - protein, 23 aa, Staphylococcus
QFKTQGIELVDYVFCTFNTDMYY

SEQ ID NO: 2034889 - protein, 27 aa, Staphylococcus
QFLDENKRLFSIYSNSDLKGMLHVSEP

SEQ ID NO: 2034890 - protein, 17 aa, Staphylococcus
QFLEHYNQLASRIRNDN

SEQ ID NO: 2034891 - protein, 20 aa, Staphylococcus
QFLEKCIESLIDLKMDKNNI

SEQ ID NO: 2034892 - protein, 23 aa, Staphylococcus
QFLIEFNQLIGGFGYPYYSDDYD

SEQ ID NO: 2034893 - protein, 18 aa, Staphylococcus
QFLKENKKGVIINTSSVH

SEQ ID NO: 2034894 - protein, 22 aa, Staphylococcus
QFLQKFNGGMGILLGGVPGVPK

SEQ ID NO: 2034895 - protein, 24 aa, Staphylococcus
QFLRKQTACNIVFKTAIARGHNLQ

SEQ ID NO: 2034896 - protein, 26 aa, Staphylococcus
QFLTKDLFIDWAWGEDYFRKKLIDYD

SEQ ID NO: 2034897 - protein, 26 aa, Staphylococcus
QFLTKDLFIDWTWGEDYFRRKLIDFD

SEQ ID NO: 2034898 - protein, 26 aa, Staphylococcus
QFLTKDLFIDWTWGEEYFRQKLIDYD

SEQ ID NO: 2034899 - protein, 31 aa, Staphylococcus
QFLTKELFIDWTWGENYFKNLLIDYDAASNV

SEQ ID NO: 2034900 - protein, 32 aa, Staphylococcus
QFLYYRMKLLEFKKYIIGSTIPHLYYKDYSKE

SEQ ID NO: 2034901 - protein, 19 aa, Staphylococcus
QFMLDSGIPTTNFVYNNLS

SEQ ID NO: 2034902 - protein, 18 aa, Staphylococcus
QFNIKFPDSEAIFITLHL

SEQ ID NO: 2034903 - protein, 17 aa, Staphylococcus
QFNKFLYERDMDGYYLI

SEQ ID NO: 2034904 - protein, 23 aa, Staphylococcus
QFNNLKWLGLDWDESVDKDKGYG

SEQ ID NO: 2034905 - protein, 24 aa, Staphylococcus
QFNPKECKHEFLRYPYIETKEDID

SEQ ID NO: 2034906 - protein, 19 aa, Staphylococcus
QFNPSQGFRAFKKAEIGDK

SEQ ID NO: 2034907 - protein, 19 aa, Staphylococcus
QFNPTQGFRAFKKAKAGDQ

SEQ ID NO: 2034908 - protein, 19 aa, Staphylococcus
QFNQLDWLKDQEIALVGVG

SEQ ID NO: 2034909 - protein, 19 aa, Staphylococcus
QFNRLPVHPNIEHVIGDFT

SEQ ID NO: 2034910 - protein, 26 aa, Staphylococcus
QFNTQKSIWVWSGFLFETLMHDSGKR

SEQ ID NO: 2034911 - protein, 24 aa, Staphylococcus
QFNYIKERVAHLVNAYNSVNDPNT

SEQ ID NO: 2034912 - protein, 29 aa, Staphylococcus
QFPKLKDLHLKWYGVPIISNMDLKIGGIT

SEQ ID NO: 2034913 - protein, 19 aa, Staphylococcus
QFRIYSLGIEHVINYLSTS

SEQ ID NO: 2034914 - protein, 21 aa, Staphylococcus
QFRLHSLGIEHVINYLSTSEM

SEQ ID NO: 2034915 - protein, 22 aa, Staphylococcus
QFRLHSLGIMHVINYLSTSETV

SEQ ID NO: 2034916 - protein, 21 aa, Staphylococcus
QFRLHSLGIMHVINYLTTSET

SEQ ID NO: 2034917 - protein, 19 aa, Staphylococcus
QFSLTRFIKQYVEQQKKQL

SEQ ID NO: 2034918 - protein, 19 aa, Staphylococcus
QFSTLDWLKDQEIALVGVG

SEQ ID NO: 2034919 - protein, 25 aa, Staphylococcus
QFTFSRKGIREGYVMNLIRQRYPEE

SEQ ID NO: 2034920 - protein, 24 aa, Staphylococcus
QFTLPMETSVLIPINDIVKTITKT

SEQ ID NO: 2034921 - protein, 18 aa, Staphylococcus
QFTNLYLAFTEATEKEDK

SEQ ID NO: 2034922 - protein, 21 aa, Staphylococcus
QFVHRFTKKWLQKPETKLSID

SEQ ID NO: 2034923 - protein, 23 aa, Staphylococcus
QFVKEHWYQLDADVLRSYIYKNV

SEQ ID NO: 2034924 - protein, 20 aa, Staphylococcus
QFVMEPTYSFSLITSSTPDP

SEQ ID NO: 2034925 - protein, 24 aa, Staphylococcus
QFVYSSLSLRCFKYTNDGKHPLQL

SEQ ID NO: 2034926 - protein, 26 aa, Staphylococcus
QFYKGEFKTATAFPLPNTNYTPLYLN

SEQ ID NO: 2034927 - protein, 29 aa, Staphylococcus
QFYVGGKLGSGFQWYSWIHIDDLTRAILF

SEQ ID NO: 2034928 - protein, 23 aa, Staphylococcus
QFYVNQRWLGGILTNYKTISKRV

SEQ ID NO: 2034929 - protein, 25 aa, Staphylococcus
QGAHTVVWNGPMGVFELSNFAKGTI

SEQ ID NO: 2034930 - protein, 17 aa, Staphylococcus
QGAILTFGVDGSVEDIA

SEQ ID NO: 2034931 - protein, 17 aa, Staphylococcus
QGAILTFGVDGSVEDIS

SEQ ID NO: 2034932 - protein, 24 aa, Staphylococcus
QGARCMDCGTPFCQTGQLVERDTV

SEQ ID NO: 2034933 - protein, 24 aa, Staphylococcus
QGASEISIMFGIHVSDADKAVKST

SEQ ID NO: 2034934 - protein, 23 aa, Staphylococcus
QGASEISMMFGIKLEDAEKAVRA

SEQ ID NO: 2034935 - protein, 25 aa, Staphylococcus
QGASEISMMFGIRVEDAEKAVLSTY

SEQ ID NO: 2034936 - protein, 23 aa, Staphylococcus
QGASEISMMFGISRENADKAVLS

SEQ ID NO: 2034937 - protein, 24 aa, Staphylococcus
QGASEISMMFGISVKDADNAVRAT

SEQ ID NO: 2034938 - protein, 25 aa, Staphylococcus
QGASEISMMFGISVKDAEKAVHATY

SEQ ID NO: 2034939 - protein, 21 aa, Staphylococcus
QGDAFARRSQYALDVDFKAEP

SEQ ID NO: 2034940 - protein, 18 aa, Staphylococcus
QGDFSIGILSEIKLLGNE

SEQ ID NO: 2034941 - protein, 17 aa, Staphylococcus
QGDIYLGEYEGWYSVPD

SEQ ID NO: 2034942 - protein, 29 aa, Staphylococcus
QGDKGDSRFYLSLQDELMVRFGSERLQKM

SEQ ID NO: 2034943 - protein, 29 aa, Staphylococcus
QGDKGDSRFYLSLQDELMVRFGSERLQNM

SEQ ID NO: 2034944 - protein, 18 aa, Staphylococcus
QGDLSHMRYILSDTNNDD

SEQ ID NO: 2034945 - protein, 18 aa, Staphylococcus
QGDMLFYIHIKQLLLHEQ

SEQ ID NO: 2034946 - protein, 17 aa, Staphylococcus
QGDMVIVDGITGDVIVD

SEQ ID NO: 2034947 - protein, 25 aa, Staphylococcus
QGDRGDSRFYLSLQDELMIRFGSER

SEQ ID NO: 2034948 - protein, 29 aa, Staphylococcus
QGDRGESRFYLSLQDELMVRFGSERLQKM

SEQ ID NO: 2034949 - protein, 21 aa, Staphylococcus
QGDSFELLTDFAHIPGKEQWF

SEQ ID NO: 2034950 - protein, 19 aa, Staphylococcus
QGDVVGFFILHRYYQHEGY

SEQ ID NO: 2034951 - protein, 21 aa, Staphylococcus
QGEHGFGYDPIFYVPEKGKTM

SEQ ID NO: 2034952 - protein, 19 aa, Staphylococcus
QGEKGFLLVEGDELKLDIT

SEQ ID NO: 2034953 - protein, 21 aa, Staphylococcus
QGESGFAFGSGMAAISAVIML

SEQ ID NO: 2034954 - protein, 24 aa, Staphylococcus
QGEYYLPDVISLIINENGRASTYH

SEQ ID NO: 2034955 - protein, 24 aa, Staphylococcus
QGEYYLPDVLSLILDDGGKAEVYH

SEQ ID NO: 2034956 - protein, 25 aa, Staphylococcus
QGEYYLPDVLSLILEEGGKAEVYHT

SEQ ID NO: 2034957 - protein, 22 aa, Staphylococcus
QGFGNAGSFIAKILHDMGAKIV

SEQ ID NO: 2034958 - protein, 25 aa, Staphylococcus
QGFGNAGSFLAKFLNDMGAKVVGIS

SEQ ID NO: 2034959 - protein, 28 aa, Staphylococcus
QGFGNAGSFLAKFLYDMGAKIVGISDAY

SEQ ID NO: 2034960 - protein, 27 aa, Staphylococcus
QGFGNAGSFLAKFLYDMGAKVVGISDA

SEQ ID NO: 2034961 - protein, 27 aa, Staphylococcus
QGFGNAGSFLAKFLYDMGATIVGISDA

SEQ ID NO: 2034962 - protein, 36 aa, Staphylococcus
QGGEFRGGDRLTLPLKEKFMKLGYADGGIGFIGLAN

SEQ ID NO: 2034963 - protein, 18 aa, Staphylococcus
QGGFLRQLYQKVPFKQGV

SEQ ID NO: 2034964 - protein, 19 aa, Staphylococcus
QGGRLVLFSHLGKVKEESD

SEQ ID NO: 2034965 - protein, 17 aa, Staphylococcus
QGHLKGEILRIGHMGQI

SEQ ID NO: 2034966 - protein, 23 aa, Staphylococcus
QGHPACVHIQIGKGVCGTAVSNN

SEQ ID NO: 2034967 - protein, 18 aa, Staphylococcus
QGHQIFPIMMDLIDQESL

SEQ ID NO: 2034968 - protein, 26 aa, Staphylococcus
QGHRIMIATGRPYRASQIYYHELNMD

SEQ ID NO: 2034969 - protein, 24 aa, Staphylococcus
QGHVPGNMKLMFEPNNFSQFSVII

SEQ ID NO: 2034970 - protein, 18 aa, Staphylococcus
QGICDLSSVIGCRDDIMV

SEQ ID NO: 2034971 - protein, 31 aa, Staphylococcus
QGIGLKIAERLFKDGFNLAIVDYNEEGAKSV

SEQ ID NO: 2034972 - protein, 18 aa, Staphylococcus
QGIIRLTLDNDFLKASTD

SEQ ID NO: 2034973 - protein, 23 aa, Staphylococcus
QGIKEGLESAGLKREDLFITSKL

SEQ ID NO: 2034974 - protein, 23 aa, Staphylococcus
QGIKEGLESTGLNREDIFVTSKL

SEQ ID NO: 2034975 - protein, 17 aa, Staphylococcus
QGIKIHLLHLLKGTPMV

SEQ ID NO: 2034976 - protein, 22 aa, Staphylococcus
QGIKIHLLHLLKGTPMVKQYDK

SEQ ID NO: 2034977 - protein, 22 aa, Staphylococcus
QGIKIHLLHLLKGTPMVKQYEK

SEQ ID NO: 2034978 - protein, 17 aa, Staphylococcus
QGIRKGPNIKLPSFDLL

SEQ ID NO: 2034979 - protein, 18 aa, Staphylococcus
QGKASAYAIIGLEDRGTN

SEQ ID NO: 2034980 - protein, 19 aa, Staphylococcus
QGKDGIDVIEFLRQQMTSQ

SEQ ID NO: 2034981 - protein, 28 aa, Staphylococcus
QGKGRLNNRITSIIFEYLNKHGIESHFI

SEQ ID NO: 2034982 - protein, 25 aa, Staphylococcus
QGKKEEIDFFIAKGVVDRIAEKLNL

SEQ ID NO: 2034983 - protein, 26 aa, Staphylococcus
QGKKEEIDFFIAKGVVDRVAEKLNLE

SEQ ID NO: 2034984 - protein, 24 aa, Staphylococcus
QGKLKGQILRIGHMGKVSPFDILS

SEQ ID NO: 2034985 - protein, 19 aa, Staphylococcus
QGKYLGVSFHPELTDDYRI

SEQ ID NO: 2034986 - protein, 23 aa, Staphylococcus
QGLEIAEAFVRSGAVDIIVVDSV

SEQ ID NO: 2034987 - protein, 18 aa, Staphylococcus
QGLFEKFGFIKVGEAEID

SEQ ID NO: 2034988 - protein, 21 aa, Staphylococcus
QGLGHNSFWFGGSKEQQAYYL

SEQ ID NO: 2034989 - protein, 24 aa, Staphylococcus
QGLKEIGYICALVRDKMQAATKPG

SEQ ID NO: 2034990 - protein, 17 aa, Staphylococcus
QGLKRGDVVGIFAPNDV

SEQ ID NO: 2034991 - protein, 17 aa, Staphylococcus
QGLLEAREIFLVVTGSN

SEQ ID NO: 2034992 - protein, 18 aa, Staphylococcus
QGLPKAWEAFNNSDKPEE

SEQ ID NO: 2034993 - protein, 18 aa, Staphylococcus
QGLQPAVIMNEFGKQSVD

SEQ ID NO: 2034994 - protein, 19 aa, Staphylococcus
QGMIGYWLETEINRVLSEI

SEQ ID NO: 2034995 - protein, 25 aa, Staphylococcus
QGNPAERLDILIVVDMFLTGFDSKK

SEQ ID NO: 2034996 - protein, 25 aa, Staphylococcus
QGNYHYTWEGNWNKDNRFNNNYSTY

SEQ ID NO: 2034997 - protein, 20 aa, Staphylococcus
QGPCLKCLLETMPSTGESCA

SEQ ID NO: 2034998 - protein, 18 aa, Staphylococcus
QGPFQFKQADQFMLDHTD

SEQ ID NO: 2034999 - protein, 18 aa, Staphylococcus
QGPFQFKRADQFMLDHTD

SEQ ID NO: 2035000 - protein, 23 aa, Staphylococcus
QGPKAVADWLLKQDDVLITDTTF

SEQ ID NO: 2035001 - protein, 26 aa, Staphylococcus
QGPPFPFPECGAMSQAYIGYQLQQSL

SEQ ID NO: 2035002 - protein, 27 aa, Staphylococcus
QGPSFPFAECGAMSQAYIGYHLQQSLQ

SEQ ID NO: 2035003 - protein, 25 aa, Staphylococcus
QGQEAAQIGMAFAMEKGDVSAPYYR

SEQ ID NO: 2035004 - protein, 17 aa, Staphylococcus
QGQPILLFYNFKHDRDR

SEQ ID NO: 2035005 - protein, 23 aa, Staphylococcus
QGQRLCGVGVPGELCIGGSGLAK

SEQ ID NO: 2035006 - protein, 19 aa, Staphylococcus
QGQVTLQLGNVCYHASKED

SEQ ID NO: 2035007 - protein, 18 aa, Staphylococcus
QGRGPVNHFAYMKKVGLD

SEQ ID NO: 2035008 - protein, 19 aa, Staphylococcus
QGRGPVNHFAYMKKVGLDD

SEQ ID NO: 2035009 - protein, 19 aa, Staphylococcus
QGRLEDARDYILRQEMKVR

SEQ ID NO: 2035010 - protein, 17 aa, Staphylococcus
QGRLSSIEAEISEIKID

SEQ ID NO: 2035011 - protein, 23 aa, Staphylococcus
QGRPACTPIQIGKGVCGTSVEKD

SEQ ID NO: 2035012 - protein, 19 aa, Staphylococcus
QGRVLVFNKRGYPIGQILM

SEQ ID NO: 2035013 - protein, 21 aa, Staphylococcus
QGRVLVFNRRGYPIGQILMPG

SEQ ID NO: 2035014 - protein, 17 aa, Staphylococcus
QGSFKVIARKEVVEESM

SEQ ID NO: 2035015 - protein, 24 aa, Staphylococcus
QGSSEISMMFGISIEDADKAVLST

SEQ ID NO: 2035016 - protein, 17 aa, Staphylococcus
QGSTEFEGAFIATNERI

SEQ ID NO: 2035017 - protein, 18 aa, Staphylococcus
QGTLIKKQAMMRGFLVAE

SEQ ID NO: 2035018 - protein, 19 aa, Staphylococcus
QGTLPVGLLPKIIVDDKEY

SEQ ID NO: 2035019 - protein, 20 aa, Staphylococcus
QGTLPVGLLPKIIVDEKEYV

SEQ ID NO: 2035020 - protein, 19 aa, Staphylococcus
QGTSDCYELYHPLERVGVY

SEQ ID NO: 2035021 - protein, 27 aa, Staphylococcus
QGTSFFGAYSLTLPKNMSFIGQPLWGS

SEQ ID NO: 2035022 - protein, 18 aa, Staphylococcus
QGVGFRHHTELIAKKLDI

SEQ ID NO: 2035023 - protein, 17 aa, Staphylococcus
QGVGIGVPGPVNFKTGV

SEQ ID NO: 2035024 - protein, 18 aa, Staphylococcus
QGVIPRVYYHTKRIRSSS

SEQ ID NO: 2035025 - protein, 18 aa, Staphylococcus
QGVLTPAEYRVCETNEGR

SEQ ID NO: 2035026 - protein, 18 aa, Staphylococcus
QGVLTPAEYRVCKTQEGL

SEQ ID NO: 2035027 - protein, 17 aa, Staphylococcus
QGVNIAFITLHVGLGTF

SEQ ID NO: 2035028 - protein, 18 aa, Staphylococcus
QGVRLKAYFNELKYNTQF

SEQ ID NO: 2035029 - protein, 21 aa, Staphylococcus
QGWHDLKIVPYGPIEISPAAQ

SEQ ID NO: 2035030 - protein, 17 aa, Staphylococcus
QGYECGITIEKFNDIKE

SEQ ID NO: 2035031 - protein, 17 aa, Staphylococcus
QGYECGITIEKYNDLKE

SEQ ID NO: 2035032 - protein, 25 aa, Staphylococcus
QGYKLDFPESVVSYFKGEIGQPVNG

SEQ ID NO: 2035033 - protein, 25 aa, Staphylococcus
QGYQLYFKFVMPIFGKLFAKSKEEY

SEQ ID NO: 2035034 - protein, 17 aa, Staphylococcus
QGYRKGVITEERLNDAV

SEQ ID NO: 2035035 - protein, 17 aa, Staphylococcus
QHACGANRFKIIRMGAD

SEQ ID NO: 2035036 - protein, 22 aa, Staphylococcus
QHAELPAGVGEYLYERLRITAH

SEQ ID NO: 2035037 - protein, 18 aa, Staphylococcus
QHAGLSWLTILKKKESYE

SEQ ID NO: 2035038 - protein, 19 aa, Staphylococcus
QHAGLSWLTILKKKESYEQ

SEQ ID NO: 2035039 - protein, 19 aa, Staphylococcus
QHAGLSWLTILKKKSAYEE

SEQ ID NO: 2035040 - protein, 19 aa, Staphylococcus
QHAGLSWLTILKKRPAYRE

SEQ ID NO: 2035041 - protein, 24 aa, Staphylococcus
QHAIKEIYSNGGIVSAVCHGLAAL

SEQ ID NO: 2035042 - protein, 17 aa, Staphylococcus
QHDEGVITLDELRELRL

SEQ ID NO: 2035043 - protein, 18 aa, Staphylococcus
QHDFKINVIEYKNLYSDS

SEQ ID NO: 2035044 - protein, 20 aa, Staphylococcus
QHDFRWKGDIMSRTVKDLTV

SEQ ID NO: 2035045 - protein, 22 aa, Staphylococcus
QHETRVRIGIREHYRSKGVGQS

SEQ ID NO: 2035046 - protein, 19 aa, Staphylococcus
QHFLKIIIKNNINDYRSLL

SEQ ID NO: 2035047 - protein, 23 aa, Staphylococcus
QHFLKVVIKRNINDYKISLDRKL

SEQ ID NO: 2035048 - protein, 19 aa, Staphylococcus
QHFSSCFIANIILEGESTE

SEQ ID NO: 2035049 - protein, 20 aa, Staphylococcus
QHFTTDFLYQTDWQEWLDKG

SEQ ID NO: 2035050 - protein, 21 aa, Staphylococcus
QHHLPDIVLLDLVMPEMNGIE

SEQ ID NO: 2035051 - protein, 26 aa, Staphylococcus
QHHLRLCGGFQFSSHKSDDEWREYGL

SEQ ID NO: 2035052 - protein, 27 aa, Staphylococcus
QHHNLFPWKNIYDNIRIGLNKRMSNEE

SEQ ID NO: 2035053 - protein, 37 aa, Staphylococcus
QHHYLWRFAKEMPRTGHIEMFDRSWYGRVLVERVEGF

SEQ ID NO: 2035054 - protein, 23 aa, Staphylococcus
QHIGHSIVGDALYGGKHESYHHQ

SEQ ID NO: 2035055 - protein, 18 aa, Staphylococcus
QHIGVDFLGVCYAVVPPL

SEQ ID NO: 2035056 - protein, 25 aa, Staphylococcus
QHIVPYPPGIPVFWKGEKVTKNMIK

SEQ ID NO: 2035057 - protein, 23 aa, Staphylococcus
QHIVPYPPGIPVMFRGEVITTHM

SEQ ID NO: 2035058 - protein, 24 aa, Staphylococcus
QHKEVKVSLAREFNPSQLDAQAFD

SEQ ID NO: 2035059 - protein, 22 aa, Staphylococcus
QHKIRVQFRLTEALKPLTADYL

SEQ ID NO: 2035060 - protein, 17 aa, Staphylococcus
QHKMRGIEFPGGKVEEG

SEQ ID NO: 2035061 - protein, 29 aa, Staphylococcus
QHKSLADFAALCFHVPFTKMGKKALDSIL

SEQ ID NO: 2035062 - protein, 23 aa, Staphylococcus
QHKVWRKRVMKEMAVKKGSTALD

SEQ ID NO: 2035063 - protein, 21 aa, Staphylococcus
QHLDEAIAIYCAYTQTDVYDA

SEQ ID NO: 2035064 - protein, 17 aa, Staphylococcus
QHLDFAKGGPFIISNKG

SEQ ID NO: 2035065 - protein, 18 aa, Staphylococcus
QHLEAIDTFGVINEHRKS

SEQ ID NO: 2035066 - protein, 42 aa, Staphylococcus
QHLEERGYQLSKTEYRGREATDFKEEDIELFKDIADKVKQTN

SEQ ID NO: 2035067 - protein, 37 aa, Staphylococcus
QHLEERGYQLSKTEYRGREATDFKEEDIELFRDIADK

SEQ ID NO: 2035068 - protein, 32 aa, Staphylococcus
QHLIIKTHCTLPYYAGLSFRTLMPKAPNEDPH

SEQ ID NO: 2035069 - protein, 17 aa, Staphylococcus
QHLILEFEKVKILSQKY

SEQ ID NO: 2035070 - protein, 18 aa, Staphylococcus
QHLIPEFQTIKGIAKQHL

SEQ ID NO: 2035071 - protein, 25 aa, Staphylococcus
QHLKKMYQSMAHKFGENWKKAQEAG

SEQ ID NO: 2035072 - protein, 17 aa, Staphylococcus
QHLTICLEDDGFLPDDV

SEQ ID NO: 2035073 - protein, 25 aa, Staphylococcus
QHMHVLLCVENAYFRKKENYITQTE

SEQ ID NO: 2035074 - protein, 23 aa, Staphylococcus
QHNCKVYGLVAPLYEQGKVLADH

SEQ ID NO: 2035075 - protein, 24 aa, Staphylococcus
QHNCLYVKMDPYWIYQIYDKDINP

SEQ ID NO: 2035076 - protein, 20 aa, Staphylococcus
QHNIHVVPLSLTIDGKSFVD

SEQ ID NO: 2035077 - protein, 18 aa, Staphylococcus
QHNIPVILFGVGASHLIN

SEQ ID NO: 2035078 - protein, 17 aa, Staphylococcus
QHNNNIWNEWAFEKYIK

SEQ ID NO: 2035079 - protein, 24 aa, Staphylococcus
QHNSCRIYKAISYFKAQYTLKNKV

SEQ ID NO: 2035080 - protein, 20 aa, Staphylococcus
QHPFFDRESLVINGLHVTTD

SEQ ID NO: 2035081 - protein, 23 aa, Staphylococcus
QHPKYVQRPSIEKIKTFQQTANQ

SEQ ID NO: 2035082 - protein, 23 aa, Staphylococcus
QHQCLYVKMDPYWIYQIYDKDIK

SEQ ID NO: 2035083 - protein, 17 aa, Staphylococcus
QHQDARELLPFATVHDL

SEQ ID NO: 2035084 - protein, 23 aa, Staphylococcus
QHQLPHNVVFIFQPAEETGGGAN

SEQ ID NO: 2035085 - protein, 24 aa, Staphylococcus
QHSRFPYENIEWLVNEGYTLLTLP

SEQ ID NO: 2035086 - protein, 25 aa, Staphylococcus
QHTIDFRFNDLIIHQLMYSPQYMAY

SEQ ID NO: 2035087 - protein, 25 aa, Staphylococcus
QHTKIKIFPGQEVRISEDLIEHIHN

SEQ ID NO: 2035088 - protein, 17 aa, Staphylococcus
QHVKPGKGSAFVRSKLR

SEQ ID NO: 2035089 - protein, 26 aa, Staphylococcus
QHVPLKTAESWDNVGLLIGDDTKEIT

SEQ ID NO: 2035090 - protein, 19 aa, Staphylococcus
QHVYFKPSDKQDFIDRLVD

SEQ ID NO: 2035091 - protein, 18 aa, Staphylococcus
QHYSPLDLPTTWDDKRLD

SEQ ID NO: 2035092 - protein, 25 aa, Staphylococcus
QIAKKELFESYGILSCDEKQFSTLD

SEQ ID NO: 2035093 - protein, 17 aa, Staphylococcus
QIAKLKGAHVVGIAGGK

SEQ ID NO: 2035094 - protein, 18 aa, Staphylococcus
QIAQRSAGFDIYDFELAE

SEQ ID NO: 2035095 - protein, 19 aa, Staphylococcus
QIAQRSAGYDGFDLELATK

SEQ ID NO: 2035096 - protein, 17 aa, Staphylococcus
QIDAEVVEVTRRLYRSG

SEQ ID NO: 2035097 - protein, 21 aa, Staphylococcus
QIDFLLPERFELTYIGSDGEN

SEQ ID NO: 2035098 - protein, 18 aa, Staphylococcus
QIDGCIFVAHNVAFDLNF

SEQ ID NO: 2035099 - protein, 25 aa, Staphylococcus
QIDLTRTWQILGEIIGESASDELID

SEQ ID NO: 2035100 - protein, 31 aa, Staphylococcus
QIDWPEVLGTICGDDTCLLICRDENASNEIK

SEQ ID NO: 2035101 - protein, 22 aa, Staphylococcus
QIDYAVAIGFQVKVNVVVQKGV

SEQ ID NO: 2035102 - protein, 22 aa, Staphylococcus
QIEDFEAIFKLSSGRPTIVRLL

SEQ ID NO: 2035103 - protein, 25 aa, Staphylococcus
QIEEQMFLGLRMNKGVSKKTFENRF

SEQ ID NO: 2035104 - protein, 22 aa, Staphylococcus
QIEGSKAFAKRIMAKYDIPTAQ

SEQ ID NO: 2035105 - protein, 18 aa, Staphylococcus
QIEGSKSFAKRIMEKYGI

SEQ ID NO: 2035106 - protein, 18 aa, Staphylococcus
QIEGSKSFAKRLMEKYDI

SEQ ID NO: 2035107 - protein, 25 aa, Staphylococcus
QIEKAHKAFKSWREVDAHERADKLY

SEQ ID NO: 2035108 - protein, 25 aa, Staphylococcus
QIESEILDVLGLIHKVYSVFGFDYS

SEQ ID NO: 2035109 - protein, 22 aa, Staphylococcus
QIESFLGRKTRLDMLDQLNKAG

SEQ ID NO: 2035110 - protein, 24 aa, Staphylococcus
QIEVLKPAVMMNLLGRDLDLLENE

SEQ ID NO: 2035111 - protein, 20 aa, Staphylococcus
QIFDLILKFADYGFPRAHAV

SEQ ID NO: 2035112 - protein, 19 aa, Staphylococcus
QIFKGEAIRLVRTNVELFE

SEQ ID NO: 2035113 - protein, 27 aa, Staphylococcus
QIFRFKRLKSNHIAILMTFPEDVMPII

SEQ ID NO: 2035114 - protein, 19 aa, Staphylococcus
QIFVYLCHGNHDPLSASIG

SEQ ID NO: 2035115 - protein, 23 aa, Staphylococcus
QIGHYHCECGFKREDTQYEVSSF

SEQ ID NO: 2035116 - protein, 23 aa, Staphylococcus
QIGHYHCECGFKREEPTYEVSNF

SEQ ID NO: 2035117 - protein, 23 aa, Staphylococcus
QIGHYHCECGFKRENPTYEVSTF

SEQ ID NO: 2035118 - protein, 23 aa, Staphylococcus
QIGHYHCECGFKREQPKYEVSSF

SEQ ID NO: 2035119 - protein, 23 aa, Staphylococcus
QIGHYHCVCGFKREKPKYEVSKF

SEQ ID NO: 2035120 - protein, 17 aa, Staphylococcus
QIGIPIVAHLGLMPQSV

SEQ ID NO: 2035121 - protein, 18 aa, Staphylococcus
QIGKRLFIDHGMGVVIGE

SEQ ID NO: 2035122 - protein, 22 aa, Staphylococcus
QIGKYPPYYFLINFTISHVNMK

SEQ ID NO: 2035123 - protein, 23 aa, Staphylococcus
QIGLVPNTAWLGNAVELNERKEI

SEQ ID NO: 2035124 - protein, 22 aa, Staphylococcus
QIGLVPNTKWIGDAVELNNRGE

SEQ ID NO: 2035125 - protein, 19 aa, Staphylococcus
QIGMRVIVPFGPRTIQGYV

SEQ ID NO: 2035126 - protein, 26 aa, Staphylococcus
QIGNNEPNCPFIINMQLTGVFDIEYE

SEQ ID NO: 2035127 - protein, 25 aa, Staphylococcus
QIGQSIPVKGVRKAIAQNMVTSVTE

SEQ ID NO: 2035128 - protein, 18 aa, Staphylococcus
QIGSRNGLDHPFDVGNQQ

SEQ ID NO: 2035129 - protein, 20 aa, Staphylococcus
QIGVRVIVPFGPRTIQGYVM

SEQ ID NO: 2035130 - protein, 17 aa, Staphylococcus
QIHGASFQVFNYVREKL

SEQ ID NO: 2035131 - protein, 18 aa, Staphylococcus
QIHGIVGFQVKVNDIEAV

SEQ ID NO: 2035132 - protein, 24 aa, Staphylococcus
QIHQRLYLEQSLITERIKKYFNSQ

SEQ ID NO: 2035133 - protein, 19 aa, Staphylococcus
QIHQYRFSLTKSIKQLIEK

SEQ ID NO: 2035134 - protein, 25 aa, Staphylococcus
QIIENCKRLGFYPKTVANISQISFI

SEQ ID NO: 2035135 - protein, 24 aa, Staphylococcus
QIIETYKNLPILGVCLGAQALTCY

SEQ ID NO: 2035136 - protein, 19 aa, Staphylococcus
QIINHLKALVTENALPTII

SEQ ID NO: 2035137 - protein, 23 aa, Staphylococcus
QIIPHRQPFLLIDRVVEYEEGKR

SEQ ID NO: 2035138 - protein, 23 aa, Staphylococcus
QIIQETPQRFAVVDATRNIDDVV

SEQ ID NO: 2035139 - protein, 23 aa, Staphylococcus
QIIVRRVDQVKGFYQYLDQENTN

SEQ ID NO: 2035140 - protein, 19 aa, Staphylococcus
QIKDCIFVAHNISFDLNFI

SEQ ID NO: 2035141 - protein, 24 aa, Staphylococcus
QIKDVRAISRFRIPENYSMEDVSK

SEQ ID NO: 2035142 - protein, 23 aa, Staphylococcus
QIKHLPVAMIINQKRLGGNSRST

SEQ ID NO: 2035143 - protein, 23 aa, Staphylococcus
QIKKLTPEIIEFSELGEFIYQPV

SEQ ID NO: 2035144 - protein, 34 aa, Staphylococcus
QIKLPKPFFFEEGKRAVLLLHGFTGNSSDVRQLG

SEQ ID NO: 2035145 - protein, 24 aa, Staphylococcus
QIKPKRKVKDLPWVEQEQTIDEIG

SEQ ID NO: 2035146 - protein, 24 aa, Staphylococcus
QIKYYREVADSFIIDTPSASYGGT

SEQ ID NO: 2035147 - protein, 26 aa, Staphylococcus
QILDKFKSLTFISGTLTFNHSFDAFK

SEQ ID NO: 2035148 - protein, 26 aa, Staphylococcus
QILDKFKSLTFISGTLTFNRSFESFK

SEQ ID NO: 2035149 - protein, 26 aa, Staphylococcus
QILEEFKARFDFSYEAYVDFLYEYRQ

SEQ ID NO: 2035150 - protein, 24 aa, Staphylococcus
QILIRCALVYLGVLKREDAKQIHI

SEQ ID NO: 2035151 - protein, 24 aa, Staphylococcus
QILKEIISRLSFLNNVGLEYLTLN

SEQ ID NO: 2035152 - protein, 24 aa, Staphylococcus
QILKSYPMVPGIDLAGTVVESEDP

SEQ ID NO: 2035153 - protein, 29 aa, Staphylococcus
QILMNYFWPGPISFILPLKRGYLCEKVTG

SEQ ID NO: 2035154 - protein, 22 aa, Staphylococcus
QILPEKKRYSITVMLDDKGNPL

SEQ ID NO: 2035155 - protein, 17 aa, Staphylococcus
QILTLLLQVMDDGNLTD

SEQ ID NO: 2035156 - protein, 24 aa, Staphylococcus
QIMKKECPDMVLVHGDTTTTFSGA

SEQ ID NO: 2035157 - protein, 23 aa, Staphylococcus
QINAQPFYKRIIDVLEGTNMFNQ

SEQ ID NO: 2035158 - protein, 17 aa, Staphylococcus
QINIPVLFVPGNHDYWS

SEQ ID NO: 2035159 - protein, 20 aa, Staphylococcus
QINLYERLKMALTEVDVTAF

SEQ ID NO: 2035160 - protein, 24 aa, Staphylococcus
QIPKHRIIQLPARFHRHPLPVPKF

SEQ ID NO: 2035161 - protein, 22 aa, Staphylococcus
QIPKLYFTSHMDTVVPGVNIRP

SEQ ID NO: 2035162 - protein, 18 aa, Staphylococcus
QIPYRFEPSPGDHDYTYW

SEQ ID NO: 2035163 - protein, 18 aa, Staphylococcus
QIQMAISRIENGDEALGS

SEQ ID NO: 2035164 - protein, 19 aa, Staphylococcus
QIQPGQWIGIFGIGGLGNL

SEQ ID NO: 2035165 - protein, 26 aa, Staphylococcus
QIRRASVENGVPCLTSLDTANALTNV

SEQ ID NO: 2035166 - protein, 27 aa, Staphylococcus
QIRRASVENGVPCLTSLDTVVALTRVI

SEQ ID NO: 2035167 - protein, 20 aa, Staphylococcus
QISMGLIFSLMDGIEYLKAH

SEQ ID NO: 2035168 - protein, 25 aa, Staphylococcus
QITEMREPYIALGTRKVILRRAAQF

SEQ ID NO: 2035169 - protein, 25 aa, Staphylococcus
QITLPHLFADILIYSSERNVMLIDF

SEQ ID NO: 2035170 - protein, 23 aa, Staphylococcus
QITLPNIFSDILIYCTERNVMLV

SEQ ID NO: 2035171 - protein, 17 aa, Staphylococcus
QITWLKRLESSTQTLLK

SEQ ID NO: 2035172 - protein, 25 aa, Staphylococcus
QIVDYILCKAYGRTATNIEKYTSQG

SEQ ID NO: 2035173 - protein, 18 aa, Staphylococcus
QIVEHPRYGKQLEAETFE

SEQ ID NO: 2035174 - protein, 17 aa, Staphylococcus
QIVIMGGSSGRGNVTPL

SEQ ID NO: 2035175 - protein, 18 aa, Staphylococcus
QIVIPLSQPELWSAETPN

SEQ ID NO: 2035176 - protein, 22 aa, Staphylococcus
QIVPDKKRYSITVMLDEQGSPL

SEQ ID NO: 2035177 - protein, 19 aa, Staphylococcus
QIVQHPRYGKQLKAETFEK

SEQ ID NO: 2035178 - protein, 21 aa, Staphylococcus
QIYEWLYQKRVNSFEEMTNLS

SEQ ID NO: 2035179 - protein, 28 aa, Staphylococcus
QIYHLNGRLKLQLLDDVKSIYNSQMTQN

SEQ ID NO: 2035180 - protein, 24 aa, Staphylococcus
QIYHLNKRLQLQLLDEVKKVYNSQ

SEQ ID NO: 2035181 - protein, 23 aa, Staphylococcus
QIYILKQFIDQMLIEKPDIIVVA

SEQ ID NO: 2035182 - protein, 25 aa, Staphylococcus
QIYPYFKFDIEKKFESYMVLIEPGG

SEQ ID NO: 2035183 - protein, 19 aa, Staphylococcus
QIYPYLVKEENLWKTNLEN

SEQ ID NO: 2035184 - protein, 26 aa, Staphylococcus
QKADYNMFLPFTVTGNVIGKATEKEW

SEQ ID NO: 2035185 - protein, 22 aa, Staphylococcus
QKAETGIAWRMERYGQRMNELQ

SEQ ID NO: 2035186 - protein, 28 aa, Staphylococcus
QKAHVQRGIVFLIMRFKVLDEVYLLPYS

SEQ ID NO: 2035187 - protein, 31 aa, Staphylococcus
QKAKIGDQMAEFERMILLRSIDTHWTDHIDT

SEQ ID NO: 2035188 - protein, 25 aa, Staphylococcus
QKAKSLNVLTIFRVFIIDSQALNRS

SEQ ID NO: 2035189 - protein, 25 aa, Staphylococcus
QKALMLPPGLSFVAYNHRAQERFKA

SEQ ID NO: 2035190 - protein, 22 aa, Staphylococcus
QKAQKISIVLSMPHEVNTYDII

SEQ ID NO: 2035191 - protein, 36 aa, Staphylococcus
QKAVAEMKLAIGLLVEKKLSHMRIHSINIKEFETNC

SEQ ID NO: 2035192 - protein, 21 aa, Staphylococcus
QKCSSFSISVAFITESGLASL

SEQ ID NO: 2035193 - protein, 26 aa, Staphylococcus
QKDFKGISFLNLVDFDALYGHRRDKE

SEQ ID NO: 2035194 - protein, 20 aa, Staphylococcus
QKDKKSFVMFKVNTHKDEIQ

SEQ ID NO: 2035195 - protein, 18 aa, Staphylococcus
QKDLMHFFDRKGSTVSNI

SEQ ID NO: 2035196 - protein, 22 aa, Staphylococcus
QKDNRPIFLYGLSAGGMETYHV

SEQ ID NO: 2035197 - protein, 22 aa, Staphylococcus
QKEHMIRAALEGVLFNLYTVYL

SEQ ID NO: 2035198 - protein, 17 aa, Staphylococcus
QKEIGWGSQIRSYVFHP

SEQ ID NO: 2035199 - protein, 19 aa, Staphylococcus
QKEMEYRKIGKYPPYYFLI

SEQ ID NO: 2035200 - protein, 18 aa, Staphylococcus
QKEMNFRKLGKYPPYYFL

SEQ ID NO: 2035201 - protein, 17 aa, Staphylococcus
QKENELRGIPSTLNQLK

SEQ ID NO: 2035202 - protein, 19 aa, Staphylococcus
QKEVIAVFQPHTFSRTQAF

SEQ ID NO: 2035203 - protein, 17 aa, Staphylococcus
QKEWERLSGTPIEEQTY

SEQ ID NO: 2035204 - protein, 18 aa, Staphylococcus
QKEYLASEIFDLTEEEKR

SEQ ID NO: 2035205 - protein, 17 aa, Staphylococcus
QKFAKLKGAERVIAIDN

SEQ ID NO: 2035206 - protein, 17 aa, Staphylococcus
QKFDLLISNIESLSVEC

SEQ ID NO: 2035207 - protein, 17 aa, Staphylococcus
QKFEFAAQGSWQKKNAD

SEQ ID NO: 2035208 - protein, 17 aa, Staphylococcus
QKFRAKQIFEWLYQKRV

SEQ ID NO: 2035209 - protein, 28 aa, Staphylococcus
QKFRAKQIFEWLYQKRVDSIDDMTNLSK

SEQ ID NO: 2035210 - protein, 28 aa, Staphylococcus
QKFRAKQIFEWLYQKRVDSIDEMTNLSK

SEQ ID NO: 2035211 - protein, 28 aa, Staphylococcus
QKFRAKQIFEWLYQKRVDTIDEMTNLSK

SEQ ID NO: 2035212 - protein, 18 aa, Staphylococcus
QKFSKFKNIEFIIKESDD

SEQ ID NO: 2035213 - protein, 24 aa, Staphylococcus
QKGEKYKAIQLIKDLIVMKEEPIK

SEQ ID NO: 2035214 - protein, 23 aa, Staphylococcus
QKGHIKIGLSPMMNVQMFTNALN

SEQ ID NO: 2035215 - protein, 24 aa, Staphylococcus
QKGHSVTIISVFRGAQSPYFKLNK

SEQ ID NO: 2035216 - protein, 26 aa, Staphylococcus
QKGNARFFLITDAMRAKGMPDGEYDL

SEQ ID NO: 2035217 - protein, 19 aa, Staphylococcus
QKGNHYAFERIAQMLIESS

SEQ ID NO: 2035218 - protein, 20 aa, Staphylococcus
QKGSLSYIHDIWGYIAPNSK

SEQ ID NO: 2035219 - protein, 20 aa, Staphylococcus
QKGTGKWTSINALELGVPLT

SEQ ID NO: 2035220 - protein, 17 aa, Staphylococcus
QKHNIIFASARPIRDLI

SEQ ID NO: 2035221 - protein, 20 aa, Staphylococcus
QKHPERLAGFATLPTIEPEL

SEQ ID NO: 2035222 - protein, 17 aa, Staphylococcus
QKHPIKVDIAGSVESIY

SEQ ID NO: 2035223 - protein, 19 aa, Staphylococcus
QKHVFDKYCVHLFDNNVFA

SEQ ID NO: 2035224 - protein, 21 aa, Staphylococcus
QKIAELCYIIWQELEVDMVKG

SEQ ID NO: 2035225 - protein, 31 aa, Staphylococcus
QKIDFFTIDSLRFLQSLGKRLVFIAWETNFD

SEQ ID NO: 2035226 - protein, 19 aa, Staphylococcus
QKIGIQFDAPERIKAGLLF

SEQ ID NO: 2035227 - protein, 22 aa, Staphylococcus
QKIMKSHMFYWSDEKNERINVL

SEQ ID NO: 2035228 - protein, 22 aa, Staphylococcus
QKIRLAIDAMIYQTAKLIGERA

SEQ ID NO: 2035229 - protein, 23 aa, Staphylococcus
QKKDYKTVLNYSVDKVKTMQLGK

SEQ ID NO: 2035230 - protein, 26 aa, Staphylococcus
QKKELFKKLAHVEGFEKYLHKNFVGA

SEQ ID NO: 2035231 - protein, 26 aa, Staphylococcus
QKKLDAVVILSDFNRRYLSEFTGTSG

SEQ ID NO: 2035232 - protein, 21 aa, Staphylococcus
QKLEPAYSFMIRVRLPGGTAT

SEQ ID NO: 2035233 - protein, 20 aa, Staphylococcus
QKLFDGFSMGNPKVETGDLL

SEQ ID NO: 2035234 - protein, 19 aa, Staphylococcus
QKLGIEGNKKIILYAPTFR

SEQ ID NO: 2035235 - protein, 22 aa, Staphylococcus
QKLIESLAFKYSKGQSHHEDLV

SEQ ID NO: 2035236 - protein, 19 aa, Staphylococcus
QKLIPEFEKVKSIAKEYKA

SEQ ID NO: 2035237 - protein, 25 aa, Staphylococcus
QKLIQRSIRIIKDICDLNDEEAKLL

SEQ ID NO: 2035238 - protein, 17 aa, Staphylococcus
QKLRYLYGMTERQFRNT

SEQ ID NO: 2035239 - protein, 18 aa, Staphylococcus
QKLSEMKQPVWIRHVLVP

SEQ ID NO: 2035240 - protein, 17 aa, Staphylococcus
QKLSRIGMNVQLVQETH

SEQ ID NO: 2035241 - protein, 18 aa, Staphylococcus
QKLVPRDIIKINEPLKHY

SEQ ID NO: 2035242 - protein, 23 aa, Staphylococcus
QKLYKAIEHRGAFENNNPLPKPP

SEQ ID NO: 2035243 - protein, 18 aa, Staphylococcus
QKNAMRTAVKNAKAAIAS

SEQ ID NO: 2035244 - protein, 17 aa, Staphylococcus
QKNELILLEGFMDVIKA

SEQ ID NO: 2035245 - protein, 23 aa, Staphylococcus
QKPMPEFFDYIFKEIGEQQRESA

SEQ ID NO: 2035246 - protein, 23 aa, Staphylococcus
QKPMPEFFDYVFDRIDAKREKTL

SEQ ID NO: 2035247 - protein, 23 aa, Staphylococcus
QKPMPEFFDYVFNKIGEDKRGYA

SEQ ID NO: 2035248 - protein, 17 aa, Staphylococcus
QKPSLGVPSEQNVNEVI

SEQ ID NO: 2035249 - protein, 17 aa, Staphylococcus
QKPSRPRRGWISRLKNS

SEQ ID NO: 2035250 - protein, 29 aa, Staphylococcus
QKPTIRKGPNIKLPSFDLLEEPEPHEVNE

SEQ ID NO: 2035251 - protein, 24 aa, Staphylococcus
QKQAKLISEIDCLQSFAEIAQKYN

SEQ ID NO: 2035252 - protein, 21 aa, Staphylococcus
QKQVKGRYSIVAFESYGSVVL

SEQ ID NO: 2035253 - protein, 18 aa, Staphylococcus
QKRIDAWKYQNNSNSAIV

SEQ ID NO: 2035254 - protein, 24 aa, Staphylococcus
QKRIIYHRVVEMLKEGTAISKIAK

SEQ ID NO: 2035255 - protein, 19 aa, Staphylococcus
QKRILDFALALIGKPQCIF

SEQ ID NO: 2035256 - protein, 20 aa, Staphylococcus
QKRILDFALTLVGRPEFLIL

SEQ ID NO: 2035257 - protein, 23 aa, Staphylococcus
QKRKHLEHVASYYKFQTPSLLYD

SEQ ID NO: 2035258 - protein, 23 aa, Staphylococcus
QKRLIMSGDVLKVMCQNDVERDH

SEQ ID NO: 2035259 - protein, 24 aa, Staphylococcus
QKRLIMSGDVLKVMVSNDVERDYF

SEQ ID NO: 2035260 - protein, 22 aa, Staphylococcus
QKRLIMSGNVLKIMTSNDIERN

SEQ ID NO: 2035261 - protein, 23 aa, Staphylococcus
QKRLIMSGNVLKVMTSNDIERNH

SEQ ID NO: 2035262 - protein, 23 aa, Staphylococcus
QKRLIMSGNVLKVMVSNDIERNH

SEQ ID NO: 2035263 - protein, 22 aa, Staphylococcus
QKRMKWYTVVQSIGMVQWYEEQ

SEQ ID NO: 2035264 - protein, 27 aa, Staphylococcus
QKRNIVYKVFFCLTKEIGIKTEKIMSN

SEQ ID NO: 2035265 - protein, 21 aa, Staphylococcus
QKRPLRRPDLTFATIDHNVPT

SEQ ID NO: 2035266 - protein, 22 aa, Staphylococcus
QKRQLRRPDLTFATLDHNVPTI

SEQ ID NO: 2035267 - protein, 19 aa, Staphylococcus
QKSGLKYNISYASKAFTCI

SEQ ID NO: 2035268 - protein, 18 aa, Staphylococcus
QKSGRITGAQAWIGTLLQ

SEQ ID NO: 2035269 - protein, 22 aa, Staphylococcus
QKSHAPVTLLFTGPLTDLAKAV

SEQ ID NO: 2035270 - protein, 17 aa, Staphylococcus
QKSIVIVGGGKVATKRA

SEQ ID NO: 2035271 - protein, 21 aa, Staphylococcus
QKSIWDFNGIYATSRHVPGVE

SEQ ID NO: 2035272 - protein, 22 aa, Staphylococcus
QKSKYYLKCFYTVLEHYTPQER

SEQ ID NO: 2035273 - protein, 26 aa, Staphylococcus
QKSLEIAKKLNFGSVIVMGHAEYYPK

SEQ ID NO: 2035274 - protein, 26 aa, Staphylococcus
QKSNIKRILVNNANKTFLHRFYFETF

SEQ ID NO: 2035275 - protein, 17 aa, Staphylococcus
QKTCKICGHDIEQKVIA

SEQ ID NO: 2035276 - protein, 19 aa, Staphylococcus
QKVELGGYIYPFTRRNQFT

SEQ ID NO: 2035277 - protein, 26 aa, Staphylococcus
QKVKDILKRLNIEALFHKNIAELSGG

SEQ ID NO: 2035278 - protein, 24 aa, Staphylococcus
QKVKRYAALIVHDGDMLFKRCNKD

SEQ ID NO: 2035279 - protein, 18 aa, Staphylococcus
QKVKSFIDSLPFELTDAQ

SEQ ID NO: 2035280 - protein, 28 aa, Staphylococcus
QKVMPQIERIDMGILFPSPNDMPHSSLA

SEQ ID NO: 2035281 - protein, 23 aa, Staphylococcus
QKVNLIQCLIKKADIYIMDEPFS

SEQ ID NO: 2035282 - protein, 20 aa, Staphylococcus
QKVRTLIRQDFERVFEDYDV

SEQ ID NO: 2035283 - protein, 29 aa, Staphylococcus
QKVVLKALMKWPIPRRMLWLRKVQSTIKD

SEQ ID NO: 2035284 - protein, 21 aa, Staphylococcus
QKWADEREFVGIDFLGVSYAA

SEQ ID NO: 2035285 - protein, 21 aa, Staphylococcus
QKYAKLLQRIHGLDKMRFEDL

SEQ ID NO: 2035286 - protein, 26 aa, Staphylococcus
QKYEHYRLGINMAIQYLSYKKRTEKE

SEQ ID NO: 2035287 - protein, 25 aa, Staphylococcus
QKYKKKAAVYPTWIKVDIVTHFNNV

SEQ ID NO: 2035288 - protein, 26 aa, Staphylococcus
QKYKNNIVFHRIWKAKATGKYDMRFF

SEQ ID NO: 2035289 - protein, 17 aa, Staphylococcus
QKYKYDLDGNIDIDKPD

SEQ ID NO: 2035290 - protein, 17 aa, Staphylococcus
QKYKYTLMMGRTHGVHA

SEQ ID NO: 2035291 - protein, 26 aa, Staphylococcus
QKYRELQDIIAILGMDELSDEDKQTV

SEQ ID NO: 2035292 - protein, 26 aa, Staphylococcus
QKYRELQDIIAILGMDELSDEDKSTV

SEQ ID NO: 2035293 - protein, 26 aa, Staphylococcus
QKYRELQDIIAILGMDELSEEDRQTV

SEQ ID NO: 2035294 - protein, 25 aa, Staphylococcus
QKYWPADVHLMAKEIVRFHSIIWPI

SEQ ID NO: 2035295 - protein, 22 aa, Staphylococcus
QKYYPNYNYVWSLKKPDKSVIP

SEQ ID NO: 2035296 - protein, 25 aa, Staphylococcus
QLAALKWVHTFIDSFGGDPNNVTLM

SEQ ID NO: 2035297 - protein, 22 aa, Staphylococcus
QLAELPEGCILHSDQGSVYTSY

SEQ ID NO: 2035298 - protein, 20 aa, Staphylococcus
QLAERGCLDIVFFADNQSFN

SEQ ID NO: 2035299 - protein, 19 aa, Staphylococcus
QLAGLRAIPNMNVIRPADG

SEQ ID NO: 2035300 - protein, 17 aa, Staphylococcus
QLAKLFKVSKRTILRDI

SEQ ID NO: 2035301 - protein, 18 aa, Staphylococcus
QLALKLKELCHNYQVPFI

SEQ ID NO: 2035302 - protein, 20 aa, Staphylococcus
QLAQHCDFFSFGTNDLTQLT

SEQ ID NO: 2035303 - protein, 26 aa, Staphylococcus
QLAQYLLKKERGVLITPQNISLDSPS

SEQ ID NO: 2035304 - protein, 24 aa, Staphylococcus
QLARKMHCEIPKGAGNKVDLVAAK

SEQ ID NO: 2035305 - protein, 24 aa, Staphylococcus
QLARVQIASVLMLNPKVIIADEPI

SEQ ID NO: 2035306 - protein, 18 aa, Staphylococcus
QLAYAIGVAEPVSIAIDT

SEQ ID NO: 2035307 - protein, 17 aa, Staphylococcus
QLCQDLEAETGIDIQFQ

SEQ ID NO: 2035308 - protein, 27 aa, Staphylococcus
QLDLFTCLRPVRWFKGVPSPVKRPQDV

SEQ ID NO: 2035309 - protein, 21 aa, Staphylococcus
QLDLKCSRCGNRYDYYKFDNG

SEQ ID NO: 2035310 - protein, 24 aa, Staphylococcus
QLDLVYRSSYVMRYLLDGRVPNLP

SEQ ID NO: 2035311 - protein, 20 aa, Staphylococcus
QLDQCRRKYLLEFFGEVPDI

SEQ ID NO: 2035312 - protein, 19 aa, Staphylococcus
QLDQRWRNETISNFKNVLS

SEQ ID NO: 2035313 - protein, 17 aa, Staphylococcus
QLDYVVIDGEFQFDAAI

SEQ ID NO: 2035314 - protein, 25 aa, Staphylococcus
QLECLKLKEQFIRSSEEKCNDLAPE

SEQ ID NO: 2035315 - protein, 19 aa, Staphylococcus
QLEDFDFGLSYDYTKRLSQ

SEQ ID NO: 2035316 - protein, 23 aa, Staphylococcus
QLEEIDGLILPGGESTTLRRLMD

SEQ ID NO: 2035317 - protein, 22 aa, Staphylococcus
QLEFPVVYASAVNGTASLDPET

SEQ ID NO: 2035318 - protein, 38 aa, Staphylococcus
QLEKKLAQLTLDFSSFGGFKSYRFLKPVGGTTYKIYFG

SEQ ID NO: 2035319 - protein, 20 aa, Staphylococcus
QLEKPLLKEMFLKHQEIDEA

SEQ ID NO: 2035320 - protein, 22 aa, Staphylococcus
QLEKRLNSLLKIADNNCMISNS

SEQ ID NO: 2035321 - protein, 25 aa, Staphylococcus
QLELDFKKAFRMSGLVNSSEEVLNA

SEQ ID NO: 2035322 - protein, 18 aa, Staphylococcus
QLEMKRNQVINLFHRKGK

SEQ ID NO: 2035323 - protein, 23 aa, Staphylococcus
QLEPDLIVTAAFGQLLPDQLLQL

SEQ ID NO: 2035324 - protein, 18 aa, Staphylococcus
QLERVYIASVLMLEPELV

SEQ ID NO: 2035325 - protein, 23 aa, Staphylococcus
QLESEFKYGILPTLTPLGIDAYH

SEQ ID NO: 2035326 - protein, 25 aa, Staphylococcus
QLETFKQSGLYPMAEEMRSFLEVVT

SEQ ID NO: 2035327 - protein, 24 aa, Staphylococcus
QLEVPVPAIIQAFKIAREAGVTTV

SEQ ID NO: 2035328 - protein, 24 aa, Staphylococcus
QLEWRKYMVNKGFNVTDVKERFYF

SEQ ID NO: 2035329 - protein, 18 aa, Staphylococcus
QLFMPIRVAVTGEMHGPE

SEQ ID NO: 2035330 - protein, 18 aa, Staphylococcus
QLFMPIRVAVTGQMHGPE

SEQ ID NO: 2035331 - protein, 19 aa, Staphylococcus
QLFNIKIGFQGGELALTDP

SEQ ID NO: 2035332 - protein, 18 aa, Staphylococcus
QLFNLHLERLQLIKLGQV

SEQ ID NO: 2035333 - protein, 27 aa, Staphylococcus
QLFVGYEVLNTFAFRITRNADLTIHED

SEQ ID NO: 2035334 - protein, 25 aa, Staphylococcus
QLFYDLNWKTVVGFQTRNPVHRAHE

SEQ ID NO: 2035335 - protein, 26 aa, Staphylococcus
QLFYSTQIPVCLWFISNNKGQNGKKE

SEQ ID NO: 2035336 - protein, 25 aa, Staphylococcus
QLGAFKEAMPFLMRASELDDKNDEE

SEQ ID NO: 2035337 - protein, 22 aa, Staphylococcus
QLGIELKDVMALGDNLNDVSML

SEQ ID NO: 2035338 - protein, 28 aa, Staphylococcus
QLGKKRLRPGGVLATNWLINKGHFSSDK

SEQ ID NO: 2035339 - protein, 23 aa, Staphylococcus
QLGQRPGAGAVYLNIFHYDVEEF

SEQ ID NO: 2035340 - protein, 23 aa, Staphylococcus
QLGVSGIRIDSGFSAQEVAKMTH

SEQ ID NO: 2035341 - protein, 17 aa, Staphylococcus
QLHARFISEMGFQSYPG

SEQ ID NO: 2035342 - protein, 21 aa, Staphylococcus
QLHEPWLLSDMTKAIERINLA

SEQ ID NO: 2035343 - protein, 25 aa, Staphylococcus
QLHSLKEPYIFIGQDAKKLSARLDG

SEQ ID NO: 2035344 - protein, 22 aa, Staphylococcus
QLIEMLVKFIPYQSRQELIHEH

SEQ ID NO: 2035345 - protein, 25 aa, Staphylococcus
QLIFTELWTRMIFEEINLYLNQEYY

SEQ ID NO: 2035346 - protein, 25 aa, Staphylococcus
QLIKEDVAMAFGFFDGMHRGHHKVF

SEQ ID NO: 2035347 - protein, 25 aa, Staphylococcus
QLIKEDVAMAFGFFDGMHRGHSKVF

SEQ ID NO: 2035348 - protein, 20 aa, Staphylococcus
QLIKGGRISKTKGFIGNIMK

SEQ ID NO: 2035349 - protein, 19 aa, Staphylococcus
QLIKGGRISKTKGLIGNIM

SEQ ID NO: 2035350 - protein, 20 aa, Staphylococcus
QLIKGGRISKTKGLIGNIMK

SEQ ID NO: 2035351 - protein, 20 aa, Staphylococcus
QLIKGGRISKTKGLIGNMMQ

SEQ ID NO: 2035352 - protein, 20 aa, Staphylococcus
QLIKGGRVSKTKGLIGNIMK

SEQ ID NO: 2035353 - protein, 17 aa, Staphylococcus
QLINQSKQAFAIQEDEN

SEQ ID NO: 2035354 - protein, 19 aa, Staphylococcus
QLISETFIKNGAKGEKGED

SEQ ID NO: 2035355 - protein, 22 aa, Staphylococcus
QLIWNDGRYNMVEFQEEMKYQR

SEQ ID NO: 2035356 - protein, 18 aa, Staphylococcus
QLKDCIFVAHNVDFDLNF

SEQ ID NO: 2035357 - protein, 21 aa, Staphylococcus
QLKDDDAFCQIKITNDVLDHY

SEQ ID NO: 2035358 - protein, 19 aa, Staphylococcus
QLKDHFTVVAVDRRDYGES

SEQ ID NO: 2035359 - protein, 22 aa, Staphylococcus
QLKHQFTHLTWNIKVYEIKETI

SEQ ID NO: 2035360 - protein, 18 aa, Staphylococcus
QLKLTVINELAWHNLFAH

SEQ ID NO: 2035361 - protein, 32 aa, Staphylococcus
QLKRRESISHGYSGLEIEVFDFHSNKSRHISS

SEQ ID NO: 2035362 - protein, 18 aa, Staphylococcus
QLKSESCETAFDLMAAIL

SEQ ID NO: 2035363 - protein, 24 aa, Staphylococcus
QLKTKRYTYTRIQRMLMNVLLNFK

SEQ ID NO: 2035364 - protein, 18 aa, Staphylococcus
QLKVTASHIPWATDDDYR

SEQ ID NO: 2035365 - protein, 18 aa, Staphylococcus
QLLAAKKSVAFGLNPDNP

SEQ ID NO: 2035366 - protein, 21 aa, Staphylococcus
QLLDEGLEWVLIQGQMGIELW

SEQ ID NO: 2035367 - protein, 24 aa, Staphylococcus
QLLDLPVCIEFRHQSWFDAVHKEQ

SEQ ID NO: 2035368 - protein, 25 aa, Staphylococcus
QLLEMRRNIGMIFQHFNLVKRSTVL

SEQ ID NO: 2035369 - protein, 17 aa, Staphylococcus
QLLISVGSIQIVLVKGS

SEQ ID NO: 2035370 - protein, 17 aa, Staphylococcus
QLLKDRYQLPVIMLTAR

SEQ ID NO: 2035371 - protein, 21 aa, Staphylococcus
QLLKRGAHVTVLARNISKFNQ

SEQ ID NO: 2035372 - protein, 39 aa, Staphylococcus; identical to SEQ ID NO: 1811640

SEQ ID NO: 2035373 - protein, 20 aa, Staphylococcus
QLLLKYVKNYASHTCEVMSL

SEQ ID NO: 2035374 - protein, 32 aa, Staphylococcus
QLLTRYLIDLGHKTFLFLAEMGDYEVVKDRIK

SEQ ID NO: 2035375 - protein, 18 aa, Staphylococcus
QLMLDLINDFGIQDKVTI

SEQ ID NO: 2035376 - protein, 18 aa, Staphylococcus
QLMLRQAMVQLIEMHEDM

SEQ ID NO: 2035377 - protein, 22 aa, Staphylococcus
QLMMLEPKFAILDEIDSGLDID

SEQ ID NO: 2035378 - protein, 25 aa, Staphylococcus
QLMSRVRRYPLPLVLEISNLESTMP

SEQ ID NO: 2035379 - protein, 22 aa, Staphylococcus
QLNDMYRLLGIAKYEDRFVVPT

SEQ ID NO: 2035380 - protein, 17 aa, Staphylococcus
QLNEIPHDIGTAVNIQE

SEQ ID NO: 2035381 - protein, 23 aa, Staphylococcus
QLNFPSQEFVEFDASSKGLEVLL

SEQ ID NO: 2035382 - protein, 20 aa, Staphylococcus
QLNGLLGVCLPKEDRTMDYA

SEQ ID NO: 2035383 - protein, 18 aa, Staphylococcus
QLNHFISNLKGFRFNVNG

SEQ ID NO: 2035384 - protein, 19 aa, Staphylococcus
QLNHVRLIGVLRKYESGDE

SEQ ID NO: 2035385 - protein, 34 aa, Staphylococcus
QLNIPEVPFIVGLLPDFLGKAAFGQSAVEYAQIN

SEQ ID NO: 2035386 - protein, 24 aa, Staphylococcus
QLPKGRKPIITSWAKHEQYEQVLA

SEQ ID NO: 2035387 - protein, 24 aa, Staphylococcus
QLPKGRKPIITSWSKHEAYESVLN

SEQ ID NO: 2035388 - protein, 19 aa, Staphylococcus
QLPKYMTWLDLSNRDDYTF

SEQ ID NO: 2035389 - protein, 24 aa, Staphylococcus
QLPLEIPSANLLPYLKPLDILFED

SEQ ID NO: 2035390 - protein, 22 aa, Staphylococcus
QLPQHFEVMRYHSLIAERQSLP

SEQ ID NO: 2035391 - protein, 29 aa, Staphylococcus
QLPRYIEKTICGKKVLFIHYEIANDKLSS

SEQ ID NO: 2035392 - protein, 18 aa, Staphylococcus
QLPSRGAIIYTISPKPKD

SEQ ID NO: 2035393 - protein, 19 aa, Staphylococcus
QLPYFITFLSFHNFTIYQI

SEQ ID NO: 2035394 - protein, 21 aa, Staphylococcus
QLPYVISFLSFHEYLIYQILP

SEQ ID NO: 2035395 - protein, 19 aa, Staphylococcus
QLQIDYYFCEARYIDHESF

SEQ ID NO: 2035396 - protein, 24 aa, Staphylococcus
QLQKRLKVGDIMKSPTVKALSQQL

SEQ ID NO: 2035397 - protein, 27 aa, Staphylococcus
QLQQFDFGIKWGEAFKGTRISKLEDIL

SEQ ID NO: 2035398 - protein, 17 aa, Staphylococcus
QLQRFNVLRTVMLQPDI

SEQ ID NO: 2035399 - protein, 22 aa, Staphylococcus
QLQVKFLWDQLTDYPHGKVKDA

SEQ ID NO: 2035400 - protein, 20 aa, Staphylococcus
QLRDAFKLLTEQSVPTKLTY

SEQ ID NO: 2035401 - protein, 25 aa, Staphylococcus
QLREAGVEYKVYKNTMVRRAAEQAG

SEQ ID NO: 2035402 - protein, 19 aa, Staphylococcus
QLREWLKEDIDVIITTGGT

SEQ ID NO: 2035403 - protein, 26 aa, Staphylococcus
QLRNIKGKIIIPGFFGVSKHGYIVTF

SEQ ID NO: 2035404 - protein, 19 aa, Staphylococcus
QLRRYLHQYPELSFEEKRT

SEQ ID NO: 2035405 - protein, 22 aa, Staphylococcus
QLSEIKKAQGLNFDIEVDGGIN

SEQ ID NO: 2035406 - protein, 22 aa, Staphylococcus
QLSELYGAYINSFVSKFKDKHV

SEQ ID NO: 2035407 - protein, 17 aa, Staphylococcus
QLSKEFHFEYELESHDF

SEQ ID NO: 2035408 - protein, 25 aa, Staphylococcus
QLSKIGGGVAINLSKLRARGEAIKG

SEQ ID NO: 2035409 - protein, 22 aa, Staphylococcus
QLSLELQILFWNMVKERDNQPH

SEQ ID NO: 2035410 - protein, 24 aa, Staphylococcus
QLSLSRKRGEGVYLKGPESKKREF

SEQ ID NO: 2035411 - protein, 24 aa, Staphylococcus
QLSLTRKRGEGVILNGTESKKREF

SEQ ID NO: 2035412 - protein, 18 aa, Staphylococcus
QLSPTPVFHKNHETGKED

SEQ ID NO: 2035413 - protein, 18 aa, Staphylococcus
QLSQFGLTFSQYLVLLTL

SEQ ID NO: 2035414 - protein, 17 aa, Staphylococcus
QLSYIYDYPHKVLYKAI

SEQ ID NO: 2035415 - protein, 23 aa, Staphylococcus
QLTDLPASIAIIGGGVIGLEFAS

SEQ ID NO: 2035416 - protein, 26 aa, Staphylococcus
QLTEAIKPVPHRSFLDKTLKRKAVWD

SEQ ID NO: 2035417 - protein, 18 aa, Staphylococcus
QLTKGIVIPSIIPNHKQI

SEQ ID NO: 2035418 - protein, 33 aa, Staphylococcus
QLTQKSKRAISIHGCTGHESVAYIGGKDDELIE

SEQ ID NO: 2035419 - protein, 18 aa, Staphylococcus
QLTRRAQISQGYSGLEID

SEQ ID NO: 2035420 - protein, 19 aa, Staphylococcus
QLTVLKWVQYFIPDFDGDK

SEQ ID NO: 2035421 - protein, 19 aa, Staphylococcus
QLTWFKNKLTVQWFNRETM

SEQ ID NO: 2035422 - protein, 19 aa, Staphylococcus
QLVDCFKAFTFKVNGTLPI

SEQ ID NO: 2035423 - protein, 17 aa, Staphylococcus
QLVEAVVNYARENNLKI

SEQ ID NO: 2035424 - protein, 21 aa, Staphylococcus
QLVGLAFNFMCFKSKAPEEND

SEQ ID NO: 2035425 - protein, 18 aa, Staphylococcus
QLVGYAFVNTETFERTQH

SEQ ID NO: 2035426 - protein, 18 aa, Staphylococcus
QLVGYGFVGTETYERTRH

SEQ ID NO: 2035427 - protein, 17 aa, Staphylococcus
QLVKAVVHLLNMASENL

SEQ ID NO: 2035428 - protein, 19 aa, Staphylococcus
QLVKVAAWYDNEMSYTSQL

SEQ ID NO: 2035429 - protein, 24 aa, Staphylococcus
QLVLLGVKTRGEFLARRIQEKIKQ

SEQ ID NO: 2035430 - protein, 25 aa, Staphylococcus
QLVQFGRFPYCKGRLNKDDMEHVES

SEQ ID NO: 2035431 - protein, 18 aa, Staphylococcus
QLWIKAILKKTDITNKQI

SEQ ID NO: 2035432 - protein, 17 aa, Staphylococcus
QLYEGMKAQIQFEIQHG

SEQ ID NO: 2035433 - protein, 26 aa, Staphylococcus
QLYFFSIANPDPFQWLNQLSAPYDDE

SEQ ID NO: 2035434 - protein, 26 aa, Staphylococcus
QLYNLIIEKIRHAFKDRILIPKNDLD

SEQ ID NO: 2035435 - protein, 24 aa, Staphylococcus
QLYPEKIIWDIGGIGPKPCYQIIE

SEQ ID NO: 2035436 - protein, 19 aa, Staphylococcus
QLYQKVPFKQGVGIDLARK

SEQ ID NO: 2035437 - protein, 23 aa, Staphylococcus
QMAADMPLAIVIGNEGHGMSRLV

SEQ ID NO: 2035438 - protein, 25 aa, Staphylococcus
QMALLKCSMLYNMQHFLELREEAII

SEQ ID NO: 2035439 - protein, 29 aa, Staphylococcus
QMDQSEWLKRSEIYIDGFHNFSTLEYEMI

SEQ ID NO: 2035440 - protein, 19 aa, Staphylococcus
QMGIIKMKLPIADLEKKKK

SEQ ID NO: 2035441 - protein, 19 aa, Staphylococcus
QMGIIKMKLPLEDLEKTKK

SEQ ID NO: 2035442 - protein, 17 aa, Staphylococcus
QMIACASVLISKPEIVV

SEQ ID NO: 2035443 - protein, 26 aa, Staphylococcus
QMIDFLFSASICGRVVANNASVAGAT

SEQ ID NO: 2035444 - protein, 23 aa, Staphylococcus
QMKDEISTLGWFSIPEADEKLIY

SEQ ID NO: 2035445 - protein, 19 aa, Staphylococcus
QMKGWDKDRIDQRVDELLK

SEQ ID NO: 2035446 - protein, 19 aa, Staphylococcus
QMKKWKDKDIDLRVNELLE

SEQ ID NO: 2035447 - protein, 20 aa, Staphylococcus
QMKRIRNLDFQFVIASDLAS

SEQ ID NO: 2035448 - protein, 20 aa, Staphylococcus
QMKSSCLIILTTHHLDEVEA

SEQ ID NO: 2035449 - protein, 17 aa, Staphylococcus
QMLDDYYQGLNFNILRN

SEQ ID NO: 2035450 - protein, 22 aa, Staphylococcus
QMLRQRGGAIINLSSIVGAMGN

SEQ ID NO: 2035451 - protein, 21 aa, Staphylococcus
QMLRQRGGAIINLSSVVGAVG

SEQ ID NO: 2035452 - protein, 21 aa, Staphylococcus
QMLSKGKRQLIIKVDKPESAV

SEQ ID NO: 2035453 - protein, 25 aa, Staphylococcus
QMMRIKIWIENKIGRELEMIELYEN

SEQ ID NO: 2035454 - protein, 24 aa, Staphylococcus
QMNEFERMILLRSIDSHWTDHIDT

SEQ ID NO: 2035455 - protein, 18 aa, Staphylococcus
QMPAHYGYKAKGMLSQSS

SEQ ID NO: 2035456 - protein, 17 aa, Staphylococcus
QMPEGVNAFSPQIIIGA

SEQ ID NO: 2035457 - protein, 23 aa, Staphylococcus
QMPGESGLIVLDWHNGNRSVLSD

SEQ ID NO: 2035458 - protein, 25 aa, Staphylococcus
QMQLFSRLKLALTEEHPSAPEFDQN

SEQ ID NO: 2035459 - protein, 31 aa, Staphylococcus
QMRIGSGGVMLQHCHPLKVIEQFHLIDKLSH

SEQ ID NO: 2035460 - protein, 30 aa, Staphylococcus
QMSKSEWLKRAEIFIDGFYNFSTLEYRIIE

SEQ ID NO: 2035461 - protein, 28 aa, Staphylococcus
QMSSEILELYFRIVIAYLKDDDGIIDSR

SEQ ID NO: 2035462 - protein, 24 aa, Staphylococcus
QMTWFKNKLDVLWLDREKMSLSLM

SEQ ID NO: 2035463 - protein, 21 aa, Staphylococcus
QMTWFKNKMDVQWFDRAQTSL

SEQ ID NO: 2035464 - protein, 17 aa, Staphylococcus
QMVKQAKAVYVLTDSSK

SEQ ID NO: 2035465 - protein, 20 aa, Staphylococcus
QMVVYELLKNGSYDKHLNNI

SEQ ID NO: 2035466 - protein, 21 aa, Staphylococcus
QMWAQDLLDEFAEEVKKGALV

SEQ ID NO: 2035467 - protein, 19 aa, Staphylococcus
QNAIKASKILSWQNESEKL

SEQ ID NO: 2035468 - protein, 19 aa, Staphylococcus
QNAVFLRYDVEVEKKNGNQ

SEQ ID NO: 2035469 - protein, 23 aa, Staphylococcus
QNDCPPCTFIKNYLADNDVAYRE

SEQ ID NO: 2035470 - protein, 21 aa, Staphylococcus
QNDCPPCTFVKNYLTEHKVDY

SEQ ID NO: 2035471 - protein, 18 aa, Staphylococcus
QNDFVYDRIKVVVATNAF

SEQ ID NO: 2035472 - protein, 17 aa, Staphylococcus
QNDGLKLIFAINYGGRA

SEQ ID NO: 2035473 - protein, 22 aa, Staphylococcus
QNDKPFIGICLGMQLMFNHSAE

SEQ ID NO: 2035474 - protein, 26 aa, Staphylococcus
QNDYFFQYLIENVLKIPYVIDLNTII

SEQ ID NO: 2035475 - protein, 23 aa, Staphylococcus
QNDYFKGGNMELFKPEATLENVL

SEQ ID NO: 2035476 - protein, 25 aa, Staphylococcus
QNEARRLRYQWFGEVIRDLNADVLL

SEQ ID NO: 2035477 - protein, 23 aa, Staphylococcus
QNECPPCQFVKNYFDEHKVAYTE

SEQ ID NO: 2035478 - protein, 22 aa, Staphylococcus
QNEGYNLTFFAFFVKAVADALK

SEQ ID NO: 2035479 - protein, 22 aa, Staphylococcus
QNELKLATDSGVFSKGKIDYGS

SEQ ID NO: 2035480 - protein, 23 aa, Staphylococcus
QNELWRKTLHIAFPKKINKNEIA

SEQ ID NO: 2035481 - protein, 27 aa, Staphylococcus
QNEMVYRPTDFFIRRTGKLYFKIDDVL

SEQ ID NO: 2035482 - protein, 22 aa, Staphylococcus
QNENGYALSYCDVSTGELKATN

SEQ ID NO: 2035483 - protein, 19 aa, Staphylococcus
QNENVDFIFGYPGGAVLPL

SEQ ID NO: 2035484 - protein, 23 aa, Staphylococcus
QNERVWVKFHFRTQQGIENYSAE

SEQ ID NO: 2035485 - protein, 18 aa, Staphylococcus
QNFKAFDVDGLDARMEAL

SEQ ID NO: 2035486 - protein, 22 aa, Staphylococcus
QNFKKAAALAHDLDDTRPVHYE

SEQ ID NO: 2035487 - protein, 17 aa, Staphylococcus
QNFKLIQNHTIFENVSI

SEQ ID NO: 2035488 - protein, 17 aa, Staphylococcus
QNGKFGTVSGIGACSSA

SEQ ID NO: 2035489 - protein, 17 aa, Staphylococcus
QNGVPMYEIITKKFKTI

SEQ ID NO: 2035490 - protein, 23 aa, Staphylococcus
QNHIRFTAVIKCVGGDNRIVETL

SEQ ID NO: 2035491 - protein, 18 aa, Staphylococcus
QNHIVCGTDVYIVGDSLA

SEQ ID NO: 2035492 - protein, 20 aa, Staphylococcus
QNHLGELILTIAQHTDNSIQ

SEQ ID NO: 2035493 - protein, 24 aa, Staphylococcus
QNHMLQMVALLAMEAPISLHSEDI

SEQ ID NO: 2035494 - protein, 24 aa, Staphylococcus
QNHMLQMVALLAMEPPISLNSADI

SEQ ID NO: 2035495 - protein, 21 aa, Staphylococcus
QNIDYCIVINFSSRFADVTAE

SEQ ID NO: 2035496 - protein, 17 aa, Staphylococcus
QNIEIEALLKAALEENE

SEQ ID NO: 2035497 - protein, 24 aa, Staphylococcus
QNIERLVWMGGTFLTKGNVEEPEH

SEQ ID NO: 2035498 - protein, 20 aa, Staphylococcus
QNIETLKKILQRQVPNADNQ

SEQ ID NO: 2035499 - protein, 17 aa, Staphylococcus
QNIKLFVVIGQLNQLIR

SEQ ID NO: 2035500 - protein, 24 aa, Staphylococcus
QNILEIGTAIGYSAMQFASVSKDV

SEQ ID NO: 2035501 - protein, 32 aa, Staphylococcus
QNINSFPFSPTWGEINYLAFDIVNVEFFNELY

SEQ ID NO: 2035502 - protein, 24 aa, Staphylococcus
QNINYRKLLSLKQHIRLMEELKHD

SEQ ID NO: 2035503 - protein, 17 aa, Staphylococcus
QNIREILNHIDLENQRI

SEQ ID NO: 2035504 - protein, 18 aa, Staphylococcus
QNISPILMHTEIDYKVPI

SEQ ID NO: 2035505 - protein, 26 aa, Staphylococcus
QNITICGMGGPLIARILNEGRIHLAN

SEQ ID NO: 2035506 - protein, 25 aa, Staphylococcus
QNIVELRIPLVYFYMKDTQFFYHYF

SEQ ID NO: 2035507 - protein, 17 aa, Staphylococcus
QNKDLIASFSRALINDL

SEQ ID NO: 2035508 - protein, 17 aa, Staphylococcus
QNKILFKDVTEIIQSGQ

SEQ ID NO: 2035509 - protein, 25 aa, Staphylococcus
QNKLSFKYIDRILLNWKKNNVKTIE

SEQ ID NO: 2035510 - protein, 26 aa, Staphylococcus
QNKLSFKYMDRILLNWKKNNVKTIDD

SEQ ID NO: 2035511 - protein, 27 aa, Staphylococcus
QNKQFGLRFGLDISCLLNETVMFKTLE

SEQ ID NO: 2035512 - protein, 17 aa, Staphylococcus
QNKRLTENITWADNRSS

SEQ ID NO: 2035513 - protein, 23 aa, Staphylococcus
QNKYKRKGFGVGEPNTHYDKPSF

SEQ ID NO: 2035514 - protein, 22 aa, Staphylococcus
QNLANPFGMILSLAMCLRESFN

SEQ ID NO: 2035515 - protein, 22 aa, Staphylococcus
QNLANPFGMVLSLAMCLRESLN

SEQ ID NO: 2035516 - protein, 24 aa, Staphylococcus
QNLFAKWRKEETLYKEDEKNATKE

SEQ ID NO: 2035517 - protein, 20 aa, Staphylococcus
QNLFARWRKEETLYSEDEKK

SEQ ID NO: 2035518 - protein, 21 aa, Staphylococcus
QNLFSAVKIHGSFKKVHVRMM

SEQ ID NO: 2035519 - protein, 20 aa, Staphylococcus
QNLGERVNLINAIALLNEQG

SEQ ID NO: 2035520 - protein, 28 aa, Staphylococcus
QNLKELRNSEGITWTFLSPAAEFDPEGV

SEQ ID NO: 2035521 - protein, 17 aa, Staphylococcus
QNLKPKKAIKVVAEERQ

SEQ ID NO: 2035522 - protein, 21 aa, Staphylococcus
QNLKVAVVMHLCDINKSEAVT

SEQ ID NO: 2035523 - protein, 18 aa, Staphylococcus
QNLLGGNVAGIWKDNSFF

SEQ ID NO: 2035524 - protein, 24 aa, Staphylococcus
QNLLKRDIASFLRQMHGLDYTDIS

SEQ ID NO: 2035525 - protein, 24 aa, Staphylococcus
QNLLLDPYFKGIVTEYQDALREVV

SEQ ID NO: 2035526 - protein, 20 aa, Staphylococcus
QNLNNCFKLLDSVSIPKGAV

SEQ ID NO: 2035527 - protein, 18 aa, Staphylococcus
QNMFALLGKPGFEDKKKE

SEQ ID NO: 2035528 - protein, 22 aa, Staphylococcus
QNMFALLGKPGFEDMKKDLEAR

SEQ ID NO: 2035529 - protein, 20 aa, Staphylococcus
QNMFALLGKQGFEDKKEALE

SEQ ID NO: 2035530 - protein, 17 aa, Staphylococcus
QNMKWYKQQFQHIPQYS

SEQ ID NO: 2035531 - protein, 25 aa, Staphylococcus
QNMLRKAMIQLIEFHDDLKVIDDFD

SEQ ID NO: 2035532 - protein, 25 aa, Staphylococcus
QNMNDLEALGKEMEQISEENDEDKY

SEQ ID NO: 2035533 - protein, 23 aa, Staphylococcus
QNMVKQLYSPVQFIKSTEWLIDQ

SEQ ID NO: 2035534 - protein, 25 aa, Staphylococcus
QNNYVAVWFKRERRDGSYQQVGLTK

SEQ ID NO: 2035535 - protein, 26 aa, Staphylococcus
QNPDVKVLHCLPAFHNTQTQVGKEVC

SEQ ID NO: 2035536 - protein, 25 aa, Staphylococcus
QNPELPRPVGQDIVHYSDYFEGAQK

SEQ ID NO: 2035537 - protein, 23 aa, Staphylococcus
QNPESMHAVFWAMSDRGIPKNFR

SEQ ID NO: 2035538 - protein, 23 aa, Staphylococcus
QNPKSGNYIIQWESETKNLEVEK

SEQ ID NO: 2035539 - protein, 23 aa, Staphylococcus
QNPSIDFYSYFRVSKIKMLNAIF

SEQ ID NO: 2035540 - protein, 26 aa, Staphylococcus
QNQLAELIFHFKRYDFIKEEELFNII

SEQ ID NO: 2035541 - protein, 24 aa, Staphylococcus
QNQLLRILNAIGIDVDNESPLNQD

SEQ ID NO: 2035542 - protein, 18 aa, Staphylococcus
QNQYLLKREDIFNYLAER

SEQ ID NO: 2035543 - protein, 25 aa, Staphylococcus
QNRISGCSIFGDFFGQGDIHDVETH

SEQ ID NO: 2035544 - protein, 23 aa, Staphylococcus
QNRKLRRPDLTFATLDHNVPTID

SEQ ID NO: 2035545 - protein, 23 aa, Staphylococcus
QNSHYKYIFIFDTEKYWKEHYQT

SEQ ID NO: 2035546 - protein, 25 aa, Staphylococcus
QNSLEHLLFGLGIRHLGAKASQILA

SEQ ID NO: 2035547 - protein, 20 aa, Staphylococcus
QNTIFLRYDVHVEKKNGDKG

SEQ ID NO: 2035548 - protein, 20 aa, Staphylococcus
QNVVEGLIIQAARMRVMLNY

SEQ ID NO: 2035549 - protein, 23 aa, Staphylococcus
QNVVELYESLKLHYGEKKVGLLH

SEQ ID NO: 2035550 - protein, 17 aa, Staphylococcus
QNYFRMYNKLAGMTGTA

SEQ ID NO: 2035551 - protein, 25 aa, Staphylococcus
QNYIKEQYKGIGIMYKNHQWYFVVA

SEQ ID NO: 2035552 - protein, 17 aa, Staphylococcus
QNYIVSSTLQAIRTDIE

SEQ ID NO: 2035553 - protein, 24 aa, Staphylococcus
QNYRLLQKHMKYFLDYIESEKANT

SEQ ID NO: 2035554 - protein, 22 aa, Staphylococcus
QNYWKTFASQWLKDLNISEENM

SEQ ID NO: 2035555 - protein, 23 aa, Staphylococcus
QNYWKTFASQWLKDLNISEENMR

SEQ ID NO: 2035556 - protein, 18 aa, Staphylococcus
QNYWKTFASQWLKDLNLS

SEQ ID NO: 2035557 - protein, 17 aa, Staphylococcus
QPAAYCGIVGLKPTYGR

SEQ ID NO: 2035558 - protein, 22 aa, Staphylococcus
QPAELAPAYVFLASYADSSYIT

SEQ ID NO: 2035559 - protein, 22 aa, Staphylococcus
QPAELAPSYVFLASYADSSYIT

SEQ ID NO: 2035560 - protein, 17 aa, Staphylococcus
QPAELAPSYVFLATPAD

SEQ ID NO: 2035561 - protein, 17 aa, Staphylococcus
QPAELAPSYVFLATQAD

SEQ ID NO: 2035562 - protein, 18 aa, Staphylococcus
QPAFDFNHFELFTQDELY

SEQ ID NO: 2035563 - protein, 20 aa, Staphylococcus
QPAIGEWIKNYEELRDKGYT

SEQ ID NO: 2035564 - protein, 19 aa, Staphylococcus
QPAIGEWIQRYEALRDQGY

SEQ ID NO: 2035565 - protein, 17 aa, Staphylococcus
QPALKRQHFKVEFKDKR

SEQ ID NO: 2035566 - protein, 18 aa, Staphylococcus
QPAPKEEKKGFFARLFNL

SEQ ID NO: 2035567 - protein, 25 aa, Staphylococcus
QPARSCVEVARLPKDVKVEIELIAK

SEQ ID NO: 2035568 - protein, 26 aa, Staphylococcus
QPARSCVEVARLPKDVKVEIELISKV

SEQ ID NO: 2035569 - protein, 25 aa, Staphylococcus
QPASERRKFAGIVFGDANYYLKNML

SEQ ID NO: 2035570 - protein, 22 aa, Staphylococcus
QPASYCGIVGMKPTYGRVSRFG

SEQ ID NO: 2035571 - protein, 19 aa, Staphylococcus
QPAVGEWIQRYEKLREDGY

SEQ ID NO: 2035572 - protein, 21 aa, Staphylococcus
QPCRNINQIIILFSLSHELRI

SEQ ID NO: 2035573 - protein, 18 aa, Staphylococcus
QPDDIGISAIRGGTIVGE

SEQ ID NO: 2035574 - protein, 34 aa, Staphylococcus
QPDIFRPQLRALLRASAYGKLNIMFPMVATINEF

SEQ ID NO: 2035575 - protein, 19 aa, Staphylococcus
QPDLIVLDVMLPKKDGIEV

SEQ ID NO: 2035576 - protein, 26 aa, Staphylococcus
QPDLPRPAGKDILHFSDYYEGAQKYL

SEQ ID NO: 2035577 - protein, 20 aa, Staphylococcus
QPDMWRRTADIVAQKQDAFE

SEQ ID NO: 2035578 - protein, 17 aa, Staphylococcus
QPDTLKCLYDMDVQIES

SEQ ID NO: 2035579 - protein, 17 aa, Staphylococcus
QPEFINALFDIEGVKSI

SEQ ID NO: 2035580 - protein, 25 aa, Staphylococcus
QPEGAFYIFPSIKAFTDDDFNFCVR

SEQ ID NO: 2035581 - protein, 22 aa, Staphylococcus
QPEGAFYIFPSIKKFTENDFDF

SEQ ID NO: 2035582 - protein, 21 aa, Staphylococcus
QPEGAFYIFPSIKRFTNNDFD

SEQ ID NO: 2035583 - protein, 24 aa, Staphylococcus
QPEGAFYIFPSIRNYTSDDFDFCV

SEQ ID NO: 2035584 - protein, 35 aa, Staphylococcus
QPEIFRPQLRALLRASVFGKLNIMFPMVATIQEFR

SEQ ID NO: 2035585 - protein, 20 aa, Staphylococcus
QPESSLAFIGDLDRVRDDIY

SEQ ID NO: 2035586 - protein, 19 aa, Staphylococcus
QPFFYPLDKLLSIGKMIEK

SEQ ID NO: 2035587 - protein, 18 aa, Staphylococcus
QPFIKAFNFLTNLLDMAY

SEQ ID NO: 2035588 - protein, 22 aa, Staphylococcus
QPFQKFIVPFIFLFEKEGNFLY

SEQ ID NO: 2035589 - protein, 18 aa, Staphylococcus
QPGEIIGLIGKNGSGKST

SEQ ID NO: 2035590 - protein, 23 aa, Staphylococcus
QPHHIEGLIFKSAIETLTQLLPN

SEQ ID NO: 2035591 - protein, 23 aa, Staphylococcus
QPIELKIVLLHHSVARVQALDAN

SEQ ID NO: 2035592 - protein, 19 aa, Staphylococcus
QPINCYIAVSIKAKGSGKV

SEQ ID NO: 2035593 - protein, 21 aa, Staphylococcus
QPINLKIILIHHQFSRVQSLA

SEQ ID NO: 2035594 - protein, 24 aa, Staphylococcus
QPINVPHLLTYVSNEKWQGIPDES

SEQ ID NO: 2035595 - protein, 26 aa, Staphylococcus
QPIQASETFWTWLADQQMNSTNYFEL

SEQ ID NO: 2035596 - protein, 24 aa, Staphylococcus
QPIRLEPMSTFPIIRDLQVDRSRM

SEQ ID NO: 2035597 - protein, 26 aa, Staphylococcus
QPKGVGIENLCPFSRDGQMRILDDNQ

SEQ ID NO: 2035598 - protein, 18 aa, Staphylococcus
QPKGYRRVLLELPHEVKS

SEQ ID NO: 2035599 - protein, 30 aa, Staphylococcus
QPKSDRLRQFFDFITNFGIMVKGTGEDIHP

SEQ ID NO: 2035600 - protein, 29 aa, Staphylococcus
QPKSERLRQFFDFVTNFGLMIKGTGEDIH

SEQ ID NO: 2035601 - protein, 21 aa, Staphylococcus
QPKWSELINRLSIPQNNTNKY

SEQ ID NO: 2035602 - protein, 21 aa, Staphylococcus
QPKWSELVNRLSIPQNNNNKY

SEQ ID NO: 2035603 - protein, 20 aa, Staphylococcus
QPLKELEVVEGQYNQVIAEE

SEQ ID NO: 2035604 - protein, 20 aa, Staphylococcus
QPLREDMSFLTRFINSSDIN

SEQ ID NO: 2035605 - protein, 21 aa, Staphylococcus
QPLREDMSFLTRFINSSEVNR

SEQ ID NO: 2035606 - protein, 17 aa, Staphylococcus
QPLSRSDIELIRGINSD

SEQ ID NO: 2035607 - protein, 19 aa, Staphylococcus
QPLTFPLMALIVSGGHTEL

SEQ ID NO: 2035608 - protein, 23 aa, Staphylococcus
QPLTNCCLIDIEGMLKNGFDIGN

SEQ ID NO: 2035609 - protein, 28 aa, Staphylococcus
QPMILFGHMSPFMIVGMIGAIKAGCGYV

SEQ ID NO: 2035610 - protein, 24 aa, Staphylococcus
QPMREDLSFITRFIHHSEVNQRIL

SEQ ID NO: 2035611 - protein, 17 aa, Staphylococcus
QPMREDMSFLTRFINNS

SEQ ID NO: 2035612 - protein, 22 aa, Staphylococcus
QPPENMEVLIGWTGSPASSHHL

SEQ ID NO: 2035613 - protein, 21 aa, Staphylococcus
QPQEFKFLYDLDQSLEEKIET

SEQ ID NO: 2035614 - protein, 21 aa, Staphylococcus
QPQEFKFLYDLNQPLEEKIET

SEQ ID NO: 2035615 - protein, 21 aa, Staphylococcus
QPSLDRWTPKFLSIPVLSGLK

SEQ ID NO: 2035616 - protein, 24 aa, Staphylococcus
QPSPFHWRFIDKLTLSTIHEVVLP

SEQ ID NO: 2035617 - protein, 19 aa, Staphylococcus
QPTHFLVAFDAGKTTFRHE

SEQ ID NO: 2035618 - protein, 21 aa, Staphylococcus
QPTISGWSFDNWLDEVACGDR

SEQ ID NO: 2035619 - protein, 18 aa, Staphylococcus
QPTNFLVAFDAGKTTFRH

SEQ ID NO: 2035620 - protein, 21 aa, Staphylococcus
QPTRCIDGIIVILPIQGDLTI

SEQ ID NO: 2035621 - protein, 18 aa, Staphylococcus
QPTVRELLGYLNAGGGHL

SEQ ID NO: 2035622 - protein, 19 aa, Staphylococcus
QPVELSGTYVLLASEDSSY

SEQ ID NO: 2035623 - protein, 17 aa, Staphylococcus
QPVELSGTYVLLASEES

SEQ ID NO: 2035624 - protein, 18 aa, Staphylococcus
QPVGRRSLSEYMDMTERV

SEQ ID NO: 2035625 - protein, 33 aa, Staphylococcus
QPVIIKFEAGWCPDCKAMDLWIDPIIEKYNAYQ

SEQ ID NO: 2035626 - protein, 25 aa, Staphylococcus
QPVIVKFEAGWCPDCKAMDMWIDPI

SEQ ID NO: 2035627 - protein, 19 aa, Staphylococcus
QPVTRSDIEIIRGINSDGA

SEQ ID NO: 2035628 - protein, 23 aa, Staphylococcus
QPYPFDIRSCGHVTIDNHLNGRY

SEQ ID NO: 2035629 - protein, 24 aa, Staphylococcus
QPYTRLKGLKEWSFGLFEGESIQL

SEQ ID NO: 2035630 - protein, 24 aa, Staphylococcus
QQADFINCVVFRKQAENVNNYLNK

SEQ ID NO: 2035631 - protein, 21 aa, Staphylococcus
QQAEIKRLETFVEKNITRAST

SEQ ID NO: 2035632 - protein, 18 aa, Staphylococcus
QQAIRYAQEQGITVVIAT

SEQ ID NO: 2035633 - protein, 24 aa, Staphylococcus
QQALRQDYLAMIRGQVLHTFSTMK

SEQ ID NO: 2035634 - protein, 24 aa, Staphylococcus
QQALSFYKKHGFEVTGQHEFITGE

SEQ ID NO: 2035635 - protein, 19 aa, Staphylococcus
QQARNVLGWTPSYTQEEAI

SEQ ID NO: 2035636 - protein, 24 aa, Staphylococcus
QQDALKLQRLVRMTTINELKQYLS

SEQ ID NO: 2035637 - protein, 24 aa, Staphylococcus
QQDCVYARTLAHPVIEALREDIHF

SEQ ID NO: 2035638 - protein, 17 aa, Staphylococcus
QQDEWHEFLAPNIRSQA

SEQ ID NO: 2035639 - protein, 22 aa, Staphylococcus
QQDIPLYLVMIGINLEDALSAS

SEQ ID NO: 2035640 - protein, 20 aa, Staphylococcus
QQDLHPIIIHGGGPFINQAL

SEQ ID NO: 2035641 - protein, 22 aa, Staphylococcus
QQDNCATCGTAANYPYLQQQPQ

SEQ ID NO: 2035642 - protein, 17 aa, Staphylococcus
QQEACRQYDYVFLTVGT

SEQ ID NO: 2035643 - protein, 21 aa, Staphylococcus
QQEAFYIMATRNGMIKKSHAG

SEQ ID NO: 2035644 - protein, 22 aa, Staphylococcus
QQEEYSYFFNGVKHILKAKNKQ

SEQ ID NO: 2035645 - protein, 21 aa, Staphylococcus
QQEFPDARIIRMDVDTTSRKG

SEQ ID NO: 2035646 - protein, 22 aa, Staphylococcus
QQELEKLMLFIGDRPTINKQDV

SEQ ID NO: 2035647 - protein, 23 aa, Staphylococcus
QQELFQYLWLQYLRTDMGRINFV

SEQ ID NO: 2035648 - protein, 18 aa, Staphylococcus
QQERITLYLKHNTKEANT

SEQ ID NO: 2035649 - protein, 18 aa, Staphylococcus
QQEYKKAASYFAKVLEMS

SEQ ID NO: 2035650 - protein, 19 aa, Staphylococcus
QQFCFTKRELLDYLERLRM

SEQ ID NO: 2035651 - protein, 23 aa, Staphylococcus
QQFKEYANVLILGYTHHMNEWMA

SEQ ID NO: 2035652 - protein, 23 aa, Staphylococcus
QQFKKELDKSVAQYKEDLTSQLN

SEQ ID NO: 2035653 - protein, 28 aa, Staphylococcus
QQFKPKDIRAAIFFGGFYNMNTVKKTEF

SEQ ID NO: 2035654 - protein, 24 aa, Staphylococcus
QQFKRLRRFFKIYVKGIKGASQLR

SEQ ID NO: 2035655 - protein, 24 aa, Staphylococcus
QQFTENYDALLLGIEMSRETLYFK

SEQ ID NO: 2035656 - protein, 20 aa, Staphylococcus
QQGKRIGKTFDHRNLPDPLY

SEQ ID NO: 2035657 - protein, 18 aa, Staphylococcus
QQGVDFFNNRGYEIESSL

SEQ ID NO: 2035658 - protein, 24 aa, Staphylococcus
QQGVDFLKTRGYEIESSLVDLPDQ

SEQ ID NO: 2035659 - protein, 19 aa, Staphylococcus
QQHGIVFLMIRFKSLDEVY

SEQ ID NO: 2035660 - protein, 19 aa, Staphylococcus
QQHKTCYQFNDFKQFMNKK

SEQ ID NO: 2035661 - protein, 19 aa, Staphylococcus
QQIDVRLGDGLAVIYDNDV

SEQ ID NO: 2035662 - protein, 17 aa, Staphylococcus
QQIETIIVTGTRAEELQ

SEQ ID NO: 2035663 - protein, 18 aa, Staphylococcus
QQIGECWGISAHPNGKNI

SEQ ID NO: 2035664 - protein, 19 aa, Staphylococcus
QQIGSSFAKKAAVASIDGE

SEQ ID NO: 2035665 - protein, 18 aa, Staphylococcus
QQIKNRFQQINWGANLHI

SEQ ID NO: 2035666 - protein, 19 aa, Staphylococcus
QQIRGAVVLPHGTGKTQRV

SEQ ID NO: 2035667 - protein, 19 aa, Staphylococcus
QQKDIWLYGGSELITSFIK

SEQ ID NO: 2035668 - protein, 29 aa, Staphylococcus
QQKFRAKQIFQWLYEKRVDSIDEMTNLSK

SEQ ID NO: 2035669 - protein, 19 aa, Staphylococcus
QQLAKRKQATLKFIPMTAE

SEQ ID NO: 2035670 - protein, 24 aa, Staphylococcus
QQLKDMYRLLGIAKYEERFVVPTS

SEQ ID NO: 2035671 - protein, 23 aa, Staphylococcus
QQLLKAIDLIGNIKGIKVTKQSS

SEQ ID NO: 2035672 - protein, 44 aa, Staphylococcus
QQLMDVFWPGPISFILPLKEGFLCKRVSGGLSSIAVRMPSHPVG

SEQ ID NO: 2035673 - protein, 23 aa, Staphylococcus
QQLNKELGCTIVMVLHDINQAIR

SEQ ID NO: 2035674 - protein, 25 aa, Staphylococcus
QQLNVFRMELLGAKVVSVEDGQGTL

SEQ ID NO: 2035675 - protein, 18 aa, Staphylococcus
QQLPYFISFLSFYQISIY

SEQ ID NO: 2035676 - protein, 21 aa, Staphylococcus
QQLPYLISFLSFHNYSIYQIL

SEQ ID NO: 2035677 - protein, 19 aa, Staphylococcus
QQMKEAIAIYKDLFEPSDV

SEQ ID NO: 2035678 - protein, 22 aa, Staphylococcus
QQMKRIRNLDFQYVIASDLASR

SEQ ID NO: 2035679 - protein, 23 aa, Staphylococcus
QQMLFDFALERGYIQKIIEMEQK

SEQ ID NO: 2035680 - protein, 17 aa, Staphylococcus
QQMLPIPVIGVIEPGSR

SEQ ID NO: 2035681 - protein, 25 aa, Staphylococcus
QQMPRQGDILTWRNLTIDKQTRKVQ

SEQ ID NO: 2035682 - protein, 17 aa, Staphylococcus
QQPECLMGHPYIINDEW

SEQ ID NO: 2035683 - protein, 18 aa, Staphylococcus
QQPLTARPGEYLDDVNFD

SEQ ID NO: 2035684 - protein, 19 aa, Staphylococcus
QQQCKKCGHKIEQQVIATR

SEQ ID NO: 2035685 - protein, 20 aa, Staphylococcus
QQQKSFFVKYVFGTEPDSET

SEQ ID NO: 2035686 - protein, 19 aa, Staphylococcus
QQRGLKLNYPEAVAIISFE

SEQ ID NO: 2035687 - protein, 27 aa, Staphylococcus
QQRILDFGLCLIGKPKLLILDEPTAAM

SEQ ID NO: 2035688 - protein, 22 aa, Staphylococcus
QQRQLRRPDLTFATLDHNVPTI

SEQ ID NO: 2035689 - protein, 19 aa, Staphylococcus
QQRQLVCELMFKNQINYFF

SEQ ID NO: 2035690 - protein, 23 aa, Staphylococcus
QQRTAAARAFVHRPSIIFADEPT

SEQ ID NO: 2035691 - protein, 19 aa, Staphylococcus
QQRVKHIYQHIKVNDLESK

SEQ ID NO: 2035692 - protein, 18 aa, Staphylococcus
QQRVKRGQTIVMVTHDPE

SEQ ID NO: 2035693 - protein, 19 aa, Staphylococcus
QQSGLKYNISYASKAFTCI

SEQ ID NO: 2035694 - protein, 24 aa, Staphylococcus
QQTIFLRYDVRVEKKDSSKGNIEV

SEQ ID NO: 2035695 - protein, 23 aa, Staphylococcus
QQTRKRIGFMIEQPTFIGRFTAF

SEQ ID NO: 2035696 - protein, 17 aa, Staphylococcus
QQTVVPIFWIAGEDHDF

SEQ ID NO: 2035697 - protein, 24 aa, Staphylococcus
QQVAIDFTKLILCNGDYQCQLKVE

SEQ ID NO: 2035698 - protein, 17 aa, Staphylococcus
QQVKALVPPGCLFNNAE

SEQ ID NO: 2035699 - protein, 18 aa, Staphylococcus
QQVLDWFKISSYRLNKTI

SEQ ID NO: 2035700 - protein, 23 aa, Staphylococcus
QQYAELLVGVGMNVQKDQPVFIR

SEQ ID NO: 2035701 - protein, 18 aa, Staphylococcus
QQYAELLVKIGMNVQPKQ

SEQ ID NO: 2035702 - protein, 17 aa, Staphylococcus
QQYGVVMEELRLLARSV

SEQ ID NO: 2035703 - protein, 25 aa, Staphylococcus
QQYPDKFKSFALIPLPFVKESIKEI

SEQ ID NO: 2035704 - protein, 18 aa, Staphylococcus
QQYPELIVGMSTHNIEMV

SEQ ID NO: 2035705 - protein, 18 aa, Staphylococcus
QQYSEIVPMLDLAQDLSN

SEQ ID NO: 2035706 - protein, 21 aa, Staphylococcus
QRAAEKWVELGVSNVIITNGL

SEQ ID NO: 2035707 - protein, 17 aa, Staphylococcus
QRAGLSISTVSRYLNHH

SEQ ID NO: 2035708 - protein, 22 aa, Staphylococcus
QRAKALGADAIMLITPYYNKTN

SEQ ID NO: 2035709 - protein, 24 aa, Staphylococcus
QRAKEWKGEYEALRKIIMENPDLV

SEQ ID NO: 2035710 - protein, 19 aa, Staphylococcus
QRALAMSLIQVYSNIVNKE

SEQ ID NO: 2035711 - protein, 20 aa, Staphylococcus
QRANDLVKFVQQQLHKFQNK

SEQ ID NO: 2035712 - protein, 20 aa, Staphylococcus
QRATISMGYIGLYEAATMFY

SEQ ID NO: 2035713 - protein, 26 aa, Staphylococcus
QRDFNGLSFLNLVDFDALYGHRRDKP

SEQ ID NO: 2035714 - protein, 21 aa, Staphylococcus
QREDLEHIVKAIAQNNIQVTT

SEQ ID NO: 2035715 - protein, 26 aa, Staphylococcus
QREEVEWIILAGYMRLIGPDLLDAYE

SEQ ID NO: 2035716 - protein, 24 aa, Staphylococcus
QREFKQYFPKSGWVEHDANEIWTS

SEQ ID NO: 2035717 - protein, 19 aa, Staphylococcus
QREGESYVKYVQRVQNSAL

SEQ ID NO: 2035718 - protein, 19 aa, Staphylococcus
QREGVLPYDIVEYINEIKL

SEQ ID NO: 2035719 - protein, 17 aa, Staphylococcus
QREIYEFIDEAKRMVRP

SEQ ID NO: 2035720 - protein, 23 aa, Staphylococcus
QRENFAISIGIYYNGEAYAGFVY

SEQ ID NO: 2035721 - protein, 30 aa, Staphylococcus
QRESLAHAFHLWLLRINYLDQPKFYPSTSY

SEQ ID NO: 2035722 - protein, 21 aa, Staphylococcus
QRFACNCGKYGCLETVASATG

SEQ ID NO: 2035723 - protein, 19 aa, Staphylococcus
QRFDCVPSQLNYVIKTRFT

SEQ ID NO: 2035724 - protein, 22 aa, Staphylococcus
QRFDCVPSQLNYVIKTRFTNEH

SEQ ID NO: 2035725 - protein, 24 aa, Staphylococcus
QRFGDPDVNFILLKSHAEDCDKEI

SEQ ID NO: 2035726 - protein, 18 aa, Staphylococcus
QRFKEGFNANVYEYIGDF

SEQ ID NO: 2035727 - protein, 17 aa, Staphylococcus
QRFKKDNQPILYIQHIN

SEQ ID NO: 2035728 - protein, 18 aa, Staphylococcus
QRFNAAIDLVLQYHVPVC

SEQ ID NO: 2035729 - protein, 22 aa, Staphylococcus
QRFTLNMLYPYIDEINISKNKS

SEQ ID NO: 2035730 - protein, 27 aa, Staphylococcus
QRGKNPFPKDWRMHAFFMDALPILNEA

SEQ ID NO: 2035731 - protein, 29 aa, Staphylococcus
QRGKVDMTYGRAFILVCEDSLLSKAKDEY

SEQ ID NO: 2035732 - protein, 25 aa, Staphylococcus
QRGMKLSATCDATLKDAEKKVNQLI

SEQ ID NO: 2035733 - protein, 22 aa, Staphylococcus
QRGYSSFVLCRDCGHVPQCPNC

SEQ ID NO: 2035734 - protein, 32 aa, Staphylococcus
QRHCKDTLLKNGWRYGQYYGYHGNSHIHIIGG

SEQ ID NO: 2035735 - protein, 23 aa, Staphylococcus
QRHMIGYALTQRALELSYPDNVT

SEQ ID NO: 2035736 - protein, 18 aa, Staphylococcus
QRIASHVVLRGRHPNEFV

SEQ ID NO: 2035737 - protein, 28 aa, Staphylococcus
QRIDKISAKRIIDFLSGTVYAIGGDIQR

SEQ ID NO: 2035738 - protein, 25 aa, Staphylococcus
QRIFEKWQIPIIFVTHSNYEATSLA

SEQ ID NO: 2035739 - protein, 17 aa, Staphylococcus
QRIGNRVLIASSSITYV

SEQ ID NO: 2035740 - protein, 21 aa, Staphylococcus
QRIIFSGSLVARSQLTIKDEQ

SEQ ID NO: 2035741 - protein, 18 aa, Staphylococcus
QRIKEAQQYISLDQICLS

SEQ ID NO: 2035742 - protein, 22 aa, Staphylococcus
QRILERLDIAPIDVFGLKMNIS

SEQ ID NO: 2035743 - protein, 25 aa, Staphylococcus
QRINENVAMAFGFFDGMHKGHDKVF

SEQ ID NO: 2035744 - protein, 24 aa, Staphylococcus
QRINEYHMRNGVTLIDPSSTYIAS

SEQ ID NO: 2035745 - protein, 21 aa, Staphylococcus
QRIRQNLDRIVKSQANQKKLS

SEQ ID NO: 2035746 - protein, 20 aa, Staphylococcus
QRIRQNLDRIVKSQSNQKKL

SEQ ID NO: 2035747 - protein, 21 aa, Staphylococcus
QRIRQNLDRVVKSQANQKKLS

SEQ ID NO: 2035748 - protein, 23 aa, Staphylococcus
QRISDLLWKELKAGQVSNLGNEY

SEQ ID NO: 2035749 - protein, 20 aa, Staphylococcus
QRIVIAIALACEPKLLIADE

SEQ ID NO: 2035750 - protein, 18 aa, Staphylococcus
QRKAAILKKQQIDEQGIF

SEQ ID NO: 2035751 - protein, 21 aa, Staphylococcus
QRKAEDVIFHLTNMVKIVPRT

SEQ ID NO: 2035752 - protein, 35 aa, Staphylococcus
QRKEGIAGSALRQLPTYVRKHFKEIRSIGITLFGE

SEQ ID NO: 2035753 - protein, 17 aa, Staphylococcus
QRKGLRRLELTVITSNK

SEQ ID NO: 2035754 - protein, 21 aa, Staphylococcus
QRKIITIPVVYGGDFGPDLDE

SEQ ID NO: 2035755 - protein, 28 aa, Staphylococcus
QRKPSLNGWILHIPSVYLGIAQAARDYA

SEQ ID NO: 2035756 - protein, 21 aa, Staphylococcus
QRKSGVLPEMVRLSIGTENAD

SEQ ID NO: 2035757 - protein, 20 aa, Staphylococcus
QRKVDVEPVFAFMKAILFPS

SEQ ID NO: 2035758 - protein, 23 aa, Staphylococcus
QRKYAKLFADEGVDVVLGTHPHV

SEQ ID NO: 2035759 - protein, 28 aa, Staphylococcus
QRKYPNIKIGICFQNRYNATFQALQEIV

SEQ ID NO: 2035760 - protein, 26 aa, Staphylococcus
QRLDVKFPPDEIGFIALHIASNTEDL

SEQ ID NO: 2035761 - protein, 21 aa, Staphylococcus
QRLERFSSYISTVFPETENNH

SEQ ID NO: 2035762 - protein, 18 aa, Staphylococcus
QRLFISPLARKMADKEDL

SEQ ID NO: 2035763 - protein, 18 aa, Staphylococcus
QRLHNFELELDRLRKSEA

SEQ ID NO: 2035764 - protein, 17 aa, Staphylococcus
QRLIPVLDYTLAPYENV

SEQ ID NO: 2035765 - protein, 22 aa, Staphylococcus
QRLKGKNIALIFEKNSTRTRCA

SEQ ID NO: 2035766 - protein, 25 aa, Staphylococcus
QRLLIKERFPQALAVEMEATAIAQT

SEQ ID NO: 2035767 - protein, 31 aa, Staphylococcus
QRLLKSYPFELSGGMAQRVALMMALISKPQC

SEQ ID NO: 2035768 - protein, 20 aa, Staphylococcus
QRLLNEIGLSHRLDVYPHLL

SEQ ID NO: 2035769 - protein, 26 aa, Staphylococcus
QRLNIKGGKDDSCMDLSGGNQQKVVL

SEQ ID NO: 2035770 - protein, 21 aa, Staphylococcus
QRLNRLRPLLANGTVTVGNSC

SEQ ID NO: 2035771 - protein, 18 aa, Staphylococcus
QRLPDAVVACIGGGSNAI

SEQ ID NO: 2035772 - protein, 21 aa, Staphylococcus
QRLSDFKSMLAYNESNYAALV

SEQ ID NO: 2035773 - protein, 20 aa, Staphylococcus
QRLSDLMAYMQLDTKLMDRL

SEQ ID NO: 2035774 - protein, 21 aa, Staphylococcus
QRLTENITWADNRASKYADQI

SEQ ID NO: 2035775 - protein, 21 aa, Staphylococcus
QRMERFEGFDFGRGFGGPRGG

SEQ ID NO: 2035776 - protein, 17 aa, Staphylococcus
QRMKEISDGLSQAFNVD

SEQ ID NO: 2035777 - protein, 17 aa, Staphylococcus
QRMLNRFAEDIKQGALV

SEQ ID NO: 2035778 - protein, 20 aa, Staphylococcus
QRNGKSYGDIAILYRTNAQS

SEQ ID NO: 2035779 - protein, 19 aa, Staphylococcus
QRNNREFIVKKNHTLVHAW

SEQ ID NO: 2035780 - protein, 29 aa, Staphylococcus
QRPFDFGDLFKTPRLDNYQTVIQTFLKNN

SEQ ID NO: 2035781 - protein, 20 aa, Staphylococcus
QRPFIMKSLYNNKKLKKYEK

SEQ ID NO: 2035782 - protein, 21 aa, Staphylococcus
QRQGFPEVIFGEGKTKEQLHD

SEQ ID NO: 2035783 - protein, 18 aa, Staphylococcus
QRQIKRYVNTEVQSVQRQ

SEQ ID NO: 2035784 - protein, 23 aa, Staphylococcus
QRQRVALGRAIVRDAQIFLMDEP

SEQ ID NO: 2035785 - protein, 18 aa, Staphylococcus
QRQSILEILAQVEVNIDY

SEQ ID NO: 2035786 - protein, 19 aa, Staphylococcus
QRRAIRMTMQTLKPLFQSD

SEQ ID NO: 2035787 - protein, 17 aa, Staphylococcus
QRRGVAGTVLIHKYAGF

SEQ ID NO: 2035788 - protein, 27 aa, Staphylococcus
QRSEYRKKEGYIRMLGYKNLTTCRREY

SEQ ID NO: 2035789 - protein, 29 aa, Staphylococcus
QRSIHIIEEICGLTFEEAQELYIKADNDI

SEQ ID NO: 2035790 - protein, 23 aa, Staphylococcus
QRSKEGWQGWPEDGIIGHLHLKT

SEQ ID NO: 2035791 - protein, 26 aa, Staphylococcus
QRSKRDLPYGRALIIYSDSSIVENAK

SEQ ID NO: 2035792 - protein, 20 aa, Staphylococcus
QRSNYALSFSKMTFPHQMMR

SEQ ID NO: 2035793 - protein, 17 aa, Staphylococcus
QRTAAARAFVHKPNIIF

SEQ ID NO: 2035794 - protein, 22 aa, Staphylococcus
QRTGFFYPELAMYFKNPARILG

SEQ ID NO: 2035795 - protein, 20 aa, Staphylococcus
QRTKWIMNWIEQQTGRFSNL

SEQ ID NO: 2035796 - protein, 32 aa, Staphylococcus
QRVANKLKLGTVWINDFHPYFAQAPWGGFKQS

SEQ ID NO: 2035797 - protein, 22 aa, Staphylococcus
QRVDELLEMVGLEPDKYKNRKP

SEQ ID NO: 2035798 - protein, 23 aa, Staphylococcus
QRVDELLEMVGLEPEKYRDRKPD

SEQ ID NO: 2035799 - protein, 23 aa, Staphylococcus
QRVDELLNMVGLEPKKFKNRKPD

SEQ ID NO: 2035800 - protein, 36 aa, Staphylococcus
QRVDFFTIDSLRFLQSLKKRLVFLAWETNFENYTPA

SEQ ID NO: 2035801 - protein, 21 aa, Staphylococcus
QRVDVPVIIKEVGFGMSKELY

SEQ ID NO: 2035802 - protein, 18 aa, Staphylococcus
QRVKLKWNADILDDVEKV

SEQ ID NO: 2035803 - protein, 17 aa, Staphylococcus
QRVLLALINKGLAREAA

SEQ ID NO: 2035804 - protein, 19 aa, Staphylococcus
QRVLLSLINKGMVREEAYD

SEQ ID NO: 2035805 - protein, 19 aa, Staphylococcus
QRVLLTLINKGMVREQAYD

SEQ ID NO: 2035806 - protein, 29 aa, Staphylococcus
QRVSEIHFKQGMCLFDIDITCGKGTYIRT

SEQ ID NO: 2035807 - protein, 21 aa, Staphylococcus
QRVSVPVIIKEVGFGMSKELL

SEQ ID NO: 2035808 - protein, 17 aa, Staphylococcus
QRYEALRDQGYTDIIVI

SEQ ID NO: 2035809 - protein, 17 aa, Staphylococcus
QRYFPTNALVTGYDIIF

SEQ ID NO: 2035810 - protein, 17 aa, Staphylococcus
QRYLLNIERENVISMKH

SEQ ID NO: 2035811 - protein, 19 aa, Staphylococcus
QRYPNVIVFVDNCYGEFVE

SEQ ID NO: 2035812 - protein, 26 aa, Staphylococcus
QRYQIQMPRFRAMLLDDEIQFEGMFV

SEQ ID NO: 2035813 - protein, 18 aa, Staphylococcus
QSAERLGLPEARIPLSQA

SEQ ID NO: 2035814 - protein, 25 aa, Staphylococcus
QSALALEMIHTYSLIHDDLPAMDDD

SEQ ID NO: 2035815 - protein, 21 aa, Staphylococcus
QSAMSRLIVRIEKPTKALVVR

SEQ ID NO: 2035816 - protein, 19 aa, Staphylococcus
QSDDLIIGLSFTVQHLVVD

SEQ ID NO: 2035817 - protein, 24 aa, Staphylococcus
QSDHLDHLVLYFAPKIIGGSGKYQ

SEQ ID NO: 2035818 - protein, 19 aa, Staphylococcus
QSDILETFAQIGLSQTQAH

SEQ ID NO: 2035819 - protein, 23 aa, Staphylococcus
QSEDCKDWNNVLVENHFNNKERL

SEQ ID NO: 2035820 - protein, 22 aa, Staphylococcus
QSEFFAFEACEYRRHFLSYHPD

SEQ ID NO: 2035821 - protein, 25 aa, Staphylococcus
QSEFGRIIVISSIWGETGASMETIY

SEQ ID NO: 2035822 - protein, 17 aa, Staphylococcus
QSEFLFVDGPFVFENAI

SEQ ID NO: 2035823 - protein, 19 aa, Staphylococcus
QSEIPRVINAALYEKRPVH

SEQ ID NO: 2035824 - protein, 26 aa, Staphylococcus
QSEKEIYEHFGVNWIEPALREDGSEF

SEQ ID NO: 2035825 - protein, 24 aa, Staphylococcus
QSEKLKRHMAFLMQKGKLYLPYNG

SEQ ID NO: 2035826 - protein, 37 aa, Staphylococcus
QSEKLKRHMSFLMKKGKLYLPYNGNLLIHGCIPVDEN

SEQ ID NO: 2035827 - protein, 24 aa, Staphylococcus
QSEKLKRHMSFLMQKGTLYLPYNG

SEQ ID NO: 2035828 - protein, 23 aa, Staphylococcus
QSELHLDIQFALYGSENATVNDI

SEQ ID NO: 2035829 - protein, 25 aa, Staphylococcus
QSEVPAHVQAGWMLTTIASIGELER

SEQ ID NO: 2035830 - protein, 23 aa, Staphylococcus
QSEYYLPDVLSLILEDRGIVEVF

SEQ ID NO: 2035831 - protein, 24 aa, Staphylococcus
QSFFKANELCIIGCSTSEVIGERI

SEQ ID NO: 2035832 - protein, 23 aa, Staphylococcus
QSFFKKDEMCVIGCSTSEVIGEK

SEQ ID NO: 2035833 - protein, 23 aa, Staphylococcus
QSFKEKYRNIDWVNDKQQFNKWK

SEQ ID NO: 2035834 - protein, 27 aa, Staphylococcus
QSFYLKKGEILGVSGLMGAGRTEMMRS

SEQ ID NO: 2035835 - protein, 20 aa, Staphylococcus
QSGKTGFYCRVIKEGFVNQH

SEQ ID NO: 2035836 - protein, 18 aa, Staphylococcus
QSGLGRSGKTFATDWDGV

SEQ ID NO: 2035837 - protein, 17 aa, Staphylococcus
QSGMVFQSYNLFPHKTA

SEQ ID NO: 2035838 - protein, 20 aa, Staphylococcus
QSGSIFGVIGFSGAGKSTLI

SEQ ID NO: 2035839 - protein, 21 aa, Staphylococcus
QSGYRSFHVIIEYPIETLNGE

SEQ ID NO: 2035840 - protein, 23 aa, Staphylococcus
QSHFSDVFKQLFGGGQAELQLTE

SEQ ID NO: 2035841 - protein, 24 aa, Staphylococcus
QSHHLDELILYLAPKLIGGSGKHQ

SEQ ID NO: 2035842 - protein, 21 aa, Staphylococcus
QSHKTRMALFPLKEYAQSQLN

SEQ ID NO: 2035843 - protein, 17 aa, Staphylococcus
QSIIGFHGVTLLSSHPK

SEQ ID NO: 2035844 - protein, 23 aa, Staphylococcus
QSIKLKFLHPMYREDQLFCKTQI

SEQ ID NO: 2035845 - protein, 24 aa, Staphylococcus
QSILEIGTAIGYSSMQFASVDSNI

SEQ ID NO: 2035846 - protein, 22 aa, Staphylococcus
QSILGWKPKHDNIHDIIDSAWR

SEQ ID NO: 2035847 - protein, 20 aa, Staphylococcus
QSILRTLFNSERFEEIQKYL

SEQ ID NO: 2035848 - protein, 26 aa, Staphylococcus
QSILRTLFNSLRFEQIQDILADEVKN

SEQ ID NO: 2035849 - protein, 20 aa, Staphylococcus
QSILVAPGIPFGEHGKNYVR

SEQ ID NO: 2035850 - protein, 17 aa, Staphylococcus
QSIRPIARLGYYDYTVV

SEQ ID NO: 2035851 - protein, 25 aa, Staphylococcus
QSISWLQQHMDGWLFYAQPFQDQKK

SEQ ID NO: 2035852 - protein, 21 aa, Staphylococcus
QSITCLHVNHGLRDASVEEER

SEQ ID NO: 2035853 - protein, 24 aa, Staphylococcus
QSIYQEWYLGSTLFKEVEGHAPYK

SEQ ID NO: 2035854 - protein, 21 aa, Staphylococcus
QSIYRVKGFIRFKEHPDTQLV

SEQ ID NO: 2035855 - protein, 24 aa, Staphylococcus
QSIYSLRYDEMQDWLVQNGQQKFR

SEQ ID NO: 2035856 - protein, 22 aa, Staphylococcus
QSIYSLRYDEMQNWLVEHGQQK

SEQ ID NO: 2035857 - protein, 18 aa, Staphylococcus
QSKGIPVINAIELDNDET

SEQ ID NO: 2035858 - protein, 18 aa, Staphylococcus
QSKGIPVINAIELENDEV

SEQ ID NO: 2035859 - protein, 18 aa, Staphylococcus
QSKGIPVVNAIELANDES

SEQ ID NO: 2035860 - protein, 18 aa, Staphylococcus
QSKGIPVVNAIELDNDES

SEQ ID NO: 2035861 - protein, 17 aa, Staphylococcus
QSKGIPVVNAIELENDE

SEQ ID NO: 2035862 - protein, 19 aa, Staphylococcus
QSLGALRVKLAHELGLIDN

SEQ ID NO: 2035863 - protein, 25 aa, Staphylococcus
QSLHFRVYLLGGEMRDLTEAFVGEM

SEQ ID NO: 2035864 - protein, 34 aa, Staphylococcus
QSLHKKRVGLFIKNDLDSVILIHACWIAQIEIAM

SEQ ID NO: 2035865 - protein, 26 aa, Staphylococcus
QSLIDWLKAQSRPFLFSTSLAPGDTK

SEQ ID NO: 2035866 - protein, 20 aa, Staphylococcus
QSLIDYLGMETSELEDEREY

SEQ ID NO: 2035867 - protein, 23 aa, Staphylococcus
QSLIGEREIGLFVVDEAHTVTTW

SEQ ID NO: 2035868 - protein, 24 aa, Staphylococcus
QSLIPHLIDAVAYNVARKNSDVRL

SEQ ID NO: 2035869 - protein, 23 aa, Staphylococcus
QSLKVANGLSVERLLRQNEEIKA

SEQ ID NO: 2035870 - protein, 27 aa, Staphylococcus
QSLLGGTCLHKGCIPTKALLKSAEVMR

SEQ ID NO: 2035871 - protein, 18 aa, Staphylococcus
QSLLNAVDAWALNHNIRR

SEQ ID NO: 2035872 - protein, 18 aa, Staphylococcus
QSLLNFLKIPNRIIPIIK

SEQ ID NO: 2035873 - protein, 19 aa, Staphylococcus
QSLLPHLIDAAAYNVARKN

SEQ ID NO: 2035874 - protein, 24 aa, Staphylococcus
QSLLPHLIEAVAYNVARKNSDVKL

SEQ ID NO: 2035875 - protein, 20 aa, Staphylococcus
QSLQCYKVTFIHPIYNREIE

SEQ ID NO: 2035876 - protein, 18 aa, Staphylococcus
QSLQGFNGIEVWQIDRDD

SEQ ID NO: 2035877 - protein, 18 aa, Staphylococcus
QSLRITENSGISFIYTLE

SEQ ID NO: 2035878 - protein, 20 aa, Staphylococcus
QSLRKTFAYHAYKAGTPITV

SEQ ID NO: 2035879 - protein, 23 aa, Staphylococcus
QSLRVANGLQVERLLRQNEEIKQ

SEQ ID NO: 2035880 - protein, 18 aa, Staphylococcus
QSLYNMFATIPGVKVVVP

SEQ ID NO: 2035881 - protein, 28 aa, Staphylococcus
QSMKHVAMEFAKLILCNGNQQCEMKVGT

SEQ ID NO: 2035882 - protein, 17 aa, Staphylococcus
QSMNRLAREKGWLDEKM

SEQ ID NO: 2035883 - protein, 25 aa, Staphylococcus
QSNELKAAISALMFKRYENDIENAR

SEQ ID NO: 2035884 - protein, 20 aa, Staphylococcus
QSNMPSRFLKEIPEDLMESH

SEQ ID NO: 2035885 - protein, 20 aa, Staphylococcus
QSNMPSRFLKEIPEELLESH

SEQ ID NO: 2035886 - protein, 18 aa, Staphylococcus
QSNMPSRFLREIPEDLLE

SEQ ID NO: 2035887 - protein, 19 aa, Staphylococcus
QSNMPSRFLREIPEDLLET

SEQ ID NO: 2035888 - protein, 19 aa, Staphylococcus
QSPIKIGIIPIGYADGYLR

SEQ ID NO: 2035889 - protein, 17 aa, Staphylococcus
QSPLFRHRVSKIVHKAQ

SEQ ID NO: 2035890 - protein, 27 aa, Staphylococcus
QSPMLLKNGRFGFKMGNQTLEDSMVSD

SEQ ID NO: 2035891 - protein, 18 aa, Staphylococcus
QSPYKEAFEFIEENEEIV

SEQ ID NO: 2035892 - protein, 17 aa, Staphylococcus
QSQLLYCHNYYPRPDTG

SEQ ID NO: 2035893 - protein, 17 aa, Staphylococcus
QSQLSFFSCEDLEKIDY

SEQ ID NO: 2035894 - protein, 22 aa, Staphylococcus
QSQVQFVGFVGEHSRYDLMHVQ

SEQ ID NO: 2035895 - protein, 23 aa, Staphylococcus
QSRFPYENIEWLVKEGYSLLTLP

SEQ ID NO: 2035896 - protein, 24 aa, Staphylococcus
QSRIYTRSRFTTNIETWEGSIYLR

SEQ ID NO: 2035897 - protein, 25 aa, Staphylococcus
QSSDFKGEEKVGPKIAIFGDTMPCE

SEQ ID NO: 2035898 - protein, 23 aa, Staphylococcus
QSSKMYGGTCINIGCIPSKTLVH

SEQ ID NO: 2035899 - protein, 20 aa, Staphylococcus
QSSYHKLALKKKIEEKKQFL

SEQ ID NO: 2035900 - protein, 27 aa, Staphylococcus
QSVKVTRPRGSVVIVSIFAHEVNFDPM

SEQ ID NO: 2035901 - protein, 23 aa, Staphylococcus
QSVLPIEVDERIYVINLDDIVAI

SEQ ID NO: 2035902 - protein, 23 aa, Staphylococcus
QSVNGRGSFKIHFRLKNEFNNEN

SEQ ID NO: 2035903 - protein, 22 aa, Staphylococcus
QSVVLPETWIKTGDYAYIKDNQ

SEQ ID NO: 2035904 - protein, 18 aa, Staphylococcus
QSVVPLKILQDAYGLKRV

SEQ ID NO: 2035905 - protein, 18 aa, Staphylococcus
QSYCPGKFDLSIDGKKFA

SEQ ID NO: 2035906 - protein, 19 aa, Staphylococcus
QSYEFFCQTGKDFDARLEE

SEQ ID NO: 2035907 - protein, 21 aa, Staphylococcus
QSYEGFANFYIQQAKEERFHG

SEQ ID NO: 2035908 - protein, 34 aa, Staphylococcus
QSYEYFCQAGKDFDFKLAELGAERLYDRVDCDID

SEQ ID NO: 2035909 - protein, 23 aa, Staphylococcus
QSYICPLSPYAIQKFSGEQYVKI

SEQ ID NO: 2035910 - protein, 20 aa, Staphylococcus
QSYSYLIFVKETWSMLHENK

SEQ ID NO: 2035911 - protein, 26 aa, Staphylococcus
QSYTVKDLFEIYKHYKYDLFKFSNSF

SEQ ID NO: 2035912 - protein, 25 aa, Staphylococcus
QTALALEMIHTYSLIHDDLPAMDND

SEQ ID NO: 2035913 - protein, 25 aa, Staphylococcus
QTALALEMVHTYSLIHDDLPAMDND

SEQ ID NO: 2035914 - protein, 24 aa, Staphylococcus
QTAMAFAKLILCNDNEICQAKVDE

SEQ ID NO: 2035915 - protein, 17 aa, Staphylococcus
QTARFIERGIIEVAPLA

SEQ ID NO: 2035916 - protein, 25 aa, Staphylococcus
QTASEGGAWGIAVLAQYLKDQRNSD

SEQ ID NO: 2035917 - protein, 21 aa, Staphylococcus
QTDELPAFFTRESDVALTSRA

SEQ ID NO: 2035918 - protein, 25 aa, Staphylococcus
QTDFPTFCEEMAQAGIYKWFIDINA

SEQ ID NO: 2035919 - protein, 24 aa, Staphylococcus
QTDKSLRDSMDFKQQFKPKDIRAA

SEQ ID NO: 2035920 - protein, 24 aa, Staphylococcus
QTDYKVCVLLDMHVGHLRSIIELL

SEQ ID NO: 2035921 - protein, 24 aa, Staphylococcus
QTEITVFFLNGFQMKGVIEDFDKY

SEQ ID NO: 2035922 - protein, 28 aa, Staphylococcus
QTFDIPASWKLVAQMPFGDIEEQAGEKE

SEQ ID NO: 2035923 - protein, 24 aa, Staphylococcus
QTFKRQIKELGFSYDWDREVNTTD

SEQ ID NO: 2035924 - protein, 26 aa, Staphylococcus
QTFLYRFESSLPWWLYMGTQALIHDI

SEQ ID NO: 2035925 - protein, 18 aa, Staphylococcus
QTFTTLLIESEHLTVKRQ

SEQ ID NO: 2035926 - protein, 21 aa, Staphylococcus
QTGTMLYHLFQHYRTENIEHG

SEQ ID NO: 2035927 - protein, 27 aa, Staphylococcus
QTHASLKRYLLEESFELFEAIDNEDDW

SEQ ID NO: 2035928 - protein, 25 aa, Staphylococcus
QTHDLGIPVMIVFEGVPASGKTRLS

SEQ ID NO: 2035929 - protein, 25 aa, Staphylococcus
QTHFSTGSWGRVPFIPFKNNSEEAS

SEQ ID NO: 2035930 - protein, 24 aa, Staphylococcus
QTHHDAKFEKGVITHQHQPSQSNS

SEQ ID NO: 2035931 - protein, 18 aa, Staphylococcus
QTHLHLLRVTPFDAQTIS

SEQ ID NO: 2035932 - protein, 24 aa, Staphylococcus
QTIEEIRYLFLYDKFEKYDFSRTD

SEQ ID NO: 2035933 - protein, 21 aa, Staphylococcus
QTIEGMGPLIYYLKSIDEKLE

SEQ ID NO: 2035934 - protein, 19 aa, Staphylococcus
QTIEWPKQLGHRIGIPHKG

SEQ ID NO: 2035935 - protein, 18 aa, Staphylococcus
QTIHAGQVIDEFSKSRAV

SEQ ID NO: 2035936 - protein, 19 aa, Staphylococcus
QTIIIEICRYMPNLKLKSH

SEQ ID NO: 2035937 - protein, 17 aa, Staphylococcus
QTIIIEISRFIPSMRLK

SEQ ID NO: 2035938 - protein, 17 aa, Staphylococcus
QTIKPDLAIAVDVCVPY

SEQ ID NO: 2035939 - protein, 25 aa, Staphylococcus
QTIKTELHLRGYRYEEAVSELDQYI

SEQ ID NO: 2035940 - protein, 18 aa, Staphylococcus
QTKDISMIGGEWDRIKKE

SEQ ID NO: 2035941 - protein, 23 aa, Staphylococcus
QTKFKMVRIEAGYTQDTMAQTIG

SEQ ID NO: 2035942 - protein, 23 aa, Staphylococcus
QTKGAYQILEWAYQIYGDAIVYS

SEQ ID NO: 2035943 - protein, 23 aa, Staphylococcus
QTKISMVTAYDFPSAKQAEQARI

SEQ ID NO: 2035944 - protein, 21 aa, Staphylococcus
QTKKRAVVIGGGLLGLECARG

SEQ ID NO: 2035945 - protein, 25 aa, Staphylococcus
QTKSDRDYLLFKLAIHTGMRLTDLL

SEQ ID NO: 2035946 - protein, 17 aa, Staphylococcus
QTKWRGGREEVGTVNGD

SEQ ID NO: 2035947 - protein, 24 aa, Staphylococcus
QTLAIEDMNLFTAKQFAYGKAKDN

SEQ ID NO: 2035948 - protein, 28 aa, Staphylococcus
QTLDLFACLRPVRWFKGVPSPVKRPEDT

SEQ ID NO: 2035949 - protein, 26 aa, Staphylococcus
QTLGQHMPVFFSANMSYGIHALTKIL

SEQ ID NO: 2035950 - protein, 17 aa, Staphylococcus
QTLIDEGFRVVSGGTDN

SEQ ID NO: 2035951 - protein, 18 aa, Staphylococcus
QTLIIEVCRYLPNVKLKH

SEQ ID NO: 2035952 - protein, 22 aa, Staphylococcus
QTLKWLMDAGLEKPYQLEKILL

SEQ ID NO: 2035953 - protein, 17 aa, Staphylococcus
QTLKWLMDAGLNKPYSI

SEQ ID NO: 2035954 - protein, 17 aa, Staphylococcus
QTLKWLMDGGLTQPFSI

SEQ ID NO: 2035955 - protein, 17 aa, Staphylococcus
QTLLSFKLDNQLITSIE

SEQ ID NO: 2035956 - protein, 17 aa, Staphylococcus
QTLQFLVDHQFIHAVCD

SEQ ID NO: 2035957 - protein, 19 aa, Staphylococcus
QTMELPYKFFVGGKLGSGF

SEQ ID NO: 2035958 - protein, 24 aa, Staphylococcus
QTMELPYRFYVGGKLGSGQQWYSW

SEQ ID NO: 2035959 - protein, 36 aa, Staphylococcus
QTMKLPYKFFVGGKLGSGFQWYSWIHINDLVRAILF

SEQ ID NO: 2035960 - protein, 22 aa, Staphylococcus
QTMWNQDMLNRFAKDIESGALV

SEQ ID NO: 2035961 - protein, 17 aa, Staphylococcus
QTNSYDLAFEELEQEKD

SEQ ID NO: 2035962 - protein, 29 aa, Staphylococcus
QTPAMPLDVCGSMTQGMIGYWLETEINRV

SEQ ID NO: 2035963 - protein, 26 aa, Staphylococcus
QTPDGRRILIGWMAMWESHMPEKEDG

SEQ ID NO: 2035964 - protein, 19 aa, Staphylococcus
QTPGVSFSFDERLTIAKQL

SEQ ID NO: 2035965 - protein, 18 aa, Staphylococcus
QTPGVSFSFEERLKIAKQ

SEQ ID NO: 2035966 - protein, 20 aa, Staphylococcus
QTPIDIWQAHQIHLHIGQDI

SEQ ID NO: 2035967 - protein, 19 aa, Staphylococcus
QTPNSYRFQKYLNQDVQIF

SEQ ID NO: 2035968 - protein, 20 aa, Staphylococcus
QTPNSYRFQKYMDHEVVVHT

SEQ ID NO: 2035969 - protein, 26 aa, Staphylococcus
QTPRHAYCGTIGLLLPEGKSIFNVPI

SEQ ID NO: 2035970 - protein, 17 aa, Staphylococcus
QTPVGRNGIKATFKGKV

SEQ ID NO: 2035971 - protein, 22 aa, Staphylococcus
QTQPKRIKLKWTGQLNDDISLL

SEQ ID NO: 2035972 - protein, 26 aa, Staphylococcus
QTRAEWLLLDLFKWSRTDYLIHREEQ

SEQ ID NO: 2035973 - protein, 25 aa, Staphylococcus
QTRAEWLLLDTFNWSRTDYLIHMND

SEQ ID NO: 2035974 - protein, 23 aa, Staphylococcus
QTREINYLISMFLPENSPASQVV

SEQ ID NO: 2035975 - protein, 22 aa, Staphylococcus
QTRFKIALTLIDKPEGLSIMQL

SEQ ID NO: 2035976 - protein, 23 aa, Staphylococcus
QTRRWNPKMKRYIFTERNGIYII

SEQ ID NO: 2035977 - protein, 29 aa, Staphylococcus
QTRVMAVGGRQLVKVAAWYDNEMSYTAQL

SEQ ID NO: 2035978 - protein, 33 aa, Staphylococcus
QTSDLIARFAGIRVPRNKAIVGQNAFSHESGIH

SEQ ID NO: 2035979 - protein, 18 aa, Staphylococcus
QTSNRFQTVFALDDHGSS

SEQ ID NO: 2035980 - protein, 19 aa, Staphylococcus
QTSTQDFVVCLKKKDLQHI

SEQ ID NO: 2035981 - protein, 21 aa, Staphylococcus
QTTPRGYAWQLEKALDTVSRD

SEQ ID NO: 2035982 - protein, 30 aa, Staphylococcus
QTVGKGGLLLTLARISAHYQLGLQAKLSVT

SEQ ID NO: 2035983 - protein, 20 aa, Staphylococcus
QTWEKFNHNVLFTGIYNSKK

SEQ ID NO: 2035984 - protein, 19 aa, Staphylococcus
QTYEFFCQTGKDFDKKLAE

SEQ ID NO: 2035985 - protein, 20 aa, Staphylococcus
QTYEFFCQTGKDFDNRLAEL

SEQ ID NO: 2035986 - protein, 21 aa, Staphylococcus
QTYEFFCQTGRDFDKKLEELG

SEQ ID NO: 2035987 - protein, 23 aa, Staphylococcus
QTYEYFCQTGRDFDRKLDELGAE

SEQ ID NO: 2035988 - protein, 23 aa, Staphylococcus
QTYGEILGAFIVGPHATDLIGEI

SEQ ID NO: 2035989 - protein, 17 aa, Staphylococcus
QVAESLKAFAKGQNIQV

SEQ ID NO: 2035990 - protein, 21 aa, Staphylococcus
QVATCKEMLLSGVGVTILPEI

SEQ ID NO: 2035991 - protein, 23 aa, Staphylococcus
QVCTAGTRILVPESIKQEFLTAL

SEQ ID NO: 2035992 - protein, 23 aa, Staphylococcus
QVCTAGTRILVPNSIKEEFLTAL

SEQ ID NO: 2035993 - protein, 20 aa, Staphylococcus
QVCTCPERIFVHEDVHDEFI

SEQ ID NO: 2035994 - protein, 21 aa, Staphylococcus
QVCTCPERIFVHQDIHDTFID

SEQ ID NO: 2035995 - protein, 28 aa, Staphylococcus
QVEHMNAWLKPYMRAFHLEEPVINIDET

SEQ ID NO: 2035996 - protein, 31 aa, Staphylococcus
QVEKDIYASMLWEGFQPFEIEKIEQLSSDIK

SEQ ID NO: 2035997 - protein, 19 aa, Staphylococcus
QVFDVNVGSIFWGIQAAVE

SEQ ID NO: 2035998 - protein, 18 aa, Staphylococcus
QVGFFLVPRDFEGVDIAD

SEQ ID NO: 2035999 - protein, 22 aa, Staphylococcus
QVGGLHNFMNWDGPILTDSGGF

SEQ ID NO: 2036000 - protein, 17 aa, Staphylococcus
QVGRITYDIAQQVVDDY

SEQ ID NO: 2036001 - protein, 25 aa, Staphylococcus
QVGRKAFKESWSVRYLEKYVNNIQE

SEQ ID NO: 2036002 - protein, 21 aa, Staphylococcus
QVGTCKEMLLSGVGVTILPEV

SEQ ID NO: 2036003 - protein, 24 aa, Staphylococcus
QVHLPGIYVDYIFEGENFEKRIEK

SEQ ID NO: 2036004 - protein, 18 aa, Staphylococcus
QVHQWRRSYDVLPPAQTE

SEQ ID NO: 2036005 - protein, 19 aa, Staphylococcus
QVIALLIHNGYFIEEVRRY

SEQ ID NO: 2036006 - protein, 19 aa, Staphylococcus
QVIDEFSKSRAVPIYQTSS

SEQ ID NO: 2036007 - protein, 19 aa, Staphylococcus
QVIGFARAMSDGVFNAAIY

SEQ ID NO: 2036008 - protein, 17 aa, Staphylococcus
QVILDEFEQKPSNQIMP

SEQ ID NO: 2036009 - protein, 19 aa, Staphylococcus
QVIQECLGHLIDLGQSSKS

SEQ ID NO: 2036010 - protein, 17 aa, Staphylococcus
QVIRRICDEVAVTENGR

SEQ ID NO: 2036011 - protein, 19 aa, Staphylococcus
QVIRRLVTFMYEQPATLVD

SEQ ID NO: 2036012 - protein, 20 aa, Staphylococcus
QVKCETCDGSGAKPGSKKKT

SEQ ID NO: 2036013 - protein, 22 aa, Staphylococcus
QVKEALRQESPKAFTTSGLTKE

SEQ ID NO: 2036014 - protein, 21 aa, Staphylococcus
QVKEGDIAPDFTVLDNSLNQI

SEQ ID NO: 2036015 - protein, 26 aa, Staphylococcus
QVKGRYSIVALDYYGTITLYDDFLEI

SEQ ID NO: 2036016 - protein, 18 aa, Staphylococcus
QVKIPKAEMDEMIKKATT

SEQ ID NO: 2036017 - protein, 18 aa, Staphylococcus
QVKMKAVLHNEAIKNVTN

SEQ ID NO: 2036018 - protein, 18 aa, Staphylococcus
QVKMKAVLHNEAIKNVTQ

SEQ ID NO: 2036019 - protein, 26 aa, Staphylococcus
QVLDKFKSLTFISGTLTFNHSFENFK

SEQ ID NO: 2036020 - protein, 18 aa, Staphylococcus
QVLDKFNALTFISGTLTF

SEQ ID NO: 2036021 - protein, 18 aa, Staphylococcus
QVLEGKVDLCLNTLPLWN

SEQ ID NO: 2036022 - protein, 27 aa, Staphylococcus
QVLEVACNMCTTSIYLAKTYQCHITAV

SEQ ID NO: 2036023 - protein, 20 aa, Staphylococcus
QVLFKVGHINFISRLLEGHY

SEQ ID NO: 2036024 - protein, 20 aa, Staphylococcus
QVLFRVGHVNFISRLLEGHY

SEQ ID NO: 2036025 - protein, 23 aa, Staphylococcus
QVLGGVGCHAYFEIIGHQVDIEK

SEQ ID NO: 2036026 - protein, 17 aa, Staphylococcus
QVLHTFSTMKVLDPLGQ

SEQ ID NO: 2036027 - protein, 20 aa, Staphylococcus
QVLHTYSKIRNDYEIVEVDL

SEQ ID NO: 2036028 - protein, 18 aa, Staphylococcus
QVLPKLAEKVGLNEAIIL

SEQ ID NO: 2036029 - protein, 18 aa, Staphylococcus
QVLPQLRKGEAIGLNHSR

SEQ ID NO: 2036030 - protein, 23 aa, Staphylococcus
QVLYHYLEFYGRYLPLQIKVAKR

SEQ ID NO: 2036031 - protein, 18 aa, Staphylococcus
QVMKEPKLSIEAKAIYCY

SEQ ID NO: 2036032 - protein, 24 aa, Staphylococcus
QVNDIRVGKLLYFTVDEATDEAVH

SEQ ID NO: 2036033 - protein, 23 aa, Staphylococcus
QVNDIRVGKVLYMSVDEATDEAV

SEQ ID NO: 2036034 - protein, 24 aa, Staphylococcus
QVNFPKILASSIIKEILTDESLKL

SEQ ID NO: 2036035 - protein, 25 aa, Staphylococcus
QVNFYKNLFKKISFENTTFDETTIN

SEQ ID NO: 2036036 - protein, 24 aa, Staphylococcus
QVNLKSDIFGVSSRQALRGNDEGI

SEQ ID NO: 2036037 - protein, 19 aa, Staphylococcus
QVQGVGFRYFTERLAQKYN

SEQ ID NO: 2036038 - protein, 18 aa, Staphylococcus
QVQKKWKRKDYIFPGNVV

SEQ ID NO: 2036039 - protein, 24 aa, Staphylococcus
QVREFCTKIAWIEGGRLKEFGELD

SEQ ID NO: 2036040 - protein, 17 aa, Staphylococcus
QVRSRMMSILLLDNEKI

SEQ ID NO: 2036041 - protein, 20 aa, Staphylococcus
QVSDLGVYCTVVGGAITRPK

SEQ ID NO: 2036042 - protein, 17 aa, Staphylococcus
QVSEFVLSFILNDYKKM

SEQ ID NO: 2036043 - protein, 25 aa, Staphylococcus
QVSELMRWVSGEAFSKKLITIDCFN

SEQ ID NO: 2036044 - protein, 18 aa, Staphylococcus
QVSGAGAYSKLKFENGAH

SEQ ID NO: 2036045 - protein, 20 aa, Staphylococcus
QVTGKWSWLAPPLSPTLTDN

SEQ ID NO: 2036046 - protein, 17 aa, Staphylococcus
QVTSLIIARDVEVHLMT

SEQ ID NO: 2036047 - protein, 19 aa, Staphylococcus
QVVAMSGSLPKGLETSYYA

SEQ ID NO: 2036048 - protein, 17 aa, Staphylococcus
QVVGTGFEGRVTKKDIE

SEQ ID NO: 2036049 - protein, 17 aa, Staphylococcus
QVVGTGFSGRVTKKDIE

SEQ ID NO: 2036050 - protein, 23 aa, Staphylococcus
QVVGVFNPDFVKAMAETLYDLKR

SEQ ID NO: 2036051 - protein, 20 aa, Staphylococcus
QVVIRCILVYLGELNKEDAL

SEQ ID NO: 2036052 - protein, 17 aa, Staphylococcus
QVVLAWLRDRPNVDSIV

SEQ ID NO: 2036053 - protein, 17 aa, Staphylococcus
QVYHLNQRLKLQLMDDI

SEQ ID NO: 2036054 - protein, 22 aa, Staphylococcus
QVYPDLSNAYILILGAGGASKG

SEQ ID NO: 2036055 - protein, 17 aa, Staphylococcus
QVYPETRVEKWFHETAP

SEQ ID NO: 2036056 - protein, 25 aa, Staphylococcus
QVYSLYFKFVMPIFGKMFAKSKEEY

SEQ ID NO: 2036057 - protein, 18 aa, Staphylococcus
QWPGTIVSIVHRIGPLKI

SEQ ID NO: 2036058 - protein, 23 aa, Staphylococcus
QWRSEYHQCPLILGSATPSLESF

SEQ ID NO: 2036059 - protein, 24 aa, Staphylococcus
QWRSRYHHCPVILGSATPSLESYA

SEQ ID NO: 2036060 - protein, 22 aa, Staphylococcus
QWSTKFLIKVEDNFRPNIEIFE

SEQ ID NO: 2036061 - protein, 19 aa, Staphylococcus
QWTDAQWKSIYANGQDVLV

SEQ ID NO: 2036062 - protein, 32 aa, Staphylococcus
QWTHLWSGQSPRLVQHMSAWALIENVVKQANE

SEQ ID NO: 2036063 - protein, 17 aa, Staphylococcus
QWYSGIVQPIVKDFDSI

SEQ ID NO: 2036064 - protein, 25 aa, Staphylococcus
QYANFPAGVGEYLFERLRLTANHMV

SEQ ID NO: 2036065 - protein, 18 aa, Staphylococcus
QYCIDASHMPSVIITSDV

SEQ ID NO: 2036066 - protein, 18 aa, Staphylococcus
QYCKAKGKPRGIFGNEKE

SEQ ID NO: 2036067 - protein, 19 aa, Staphylococcus
QYCKHEFVLSGIKQKQYGV

SEQ ID NO: 2036068 - protein, 19 aa, Staphylococcus
QYCKHEFVLSGSKQKEHGV

SEQ ID NO: 2036069 - protein, 22 aa, Staphylococcus
QYDKRWPKSLGHQIGIPKKGEA

SEQ ID NO: 2036070 - protein, 20 aa, Staphylococcus
QYDYLKKRYLLNIERENDIS

SEQ ID NO: 2036071 - protein, 21 aa, Staphylococcus
QYDYLRKRYFINIERENAISM

SEQ ID NO: 2036072 - protein, 19 aa, Staphylococcus
QYEIPIAPLSVAFDDGETF

SEQ ID NO: 2036073 - protein, 29 aa, Staphylococcus
QYFEAPYLFKLIVIHYLFEYLHPFYDGNG

SEQ ID NO: 2036074 - protein, 24 aa, Staphylococcus
QYFFDPRVKQCIEYLQSHYHKKVQ

SEQ ID NO: 2036075 - protein, 28 aa, Staphylococcus
QYFKVERLKGIFAWGFRIKSSEPEEGLP

SEQ ID NO: 2036076 - protein, 27 aa, Staphylococcus
QYFKVERLKGVFAWGFRIKSSEPEEGL

SEQ ID NO: 2036077 - protein, 27 aa, Staphylococcus
QYFKVERLKGVFAWGYRINSKIPEEGL

SEQ ID NO: 2036078 - protein, 26 aa, Staphylococcus
QYFKVERLKGVFAWGYRINSTNPEEG

SEQ ID NO: 2036079 - protein, 19 aa, Staphylococcus
QYFTTDFLYQTEWQAWLKD

SEQ ID NO: 2036080 - protein, 18 aa, Staphylococcus
QYGAVYLVNLFSNIKTPE

SEQ ID NO: 2036081 - protein, 18 aa, Staphylococcus
QYGHLKAGIYPVNPPERK

SEQ ID NO: 2036082 - protein, 17 aa, Staphylococcus
QYGIKFKYVDFLNYDDV

SEQ ID NO: 2036083 - protein, 24 aa, Staphylococcus
QYGNDIDVLFILGGDGTVNELING

SEQ ID NO: 2036084 - protein, 17 aa, Staphylococcus
QYHDHWLGYCTNELIQI

SEQ ID NO: 2036085 - protein, 28 aa, Staphylococcus
QYIGCGHNMFNLDAFEVVGNSIKIFPAT

SEQ ID NO: 2036086 - protein, 19 aa, Staphylococcus
QYIGHPLIGDALYGGNHDM

SEQ ID NO: 2036087 - protein, 25 aa, Staphylococcus
QYIKNCSNMGIPVVSHLGLTPQSVG

SEQ ID NO: 2036088 - protein, 18 aa, Staphylococcus
QYINAIFYYYMVDKQSKM

SEQ ID NO: 2036089 - protein, 18 aa, Staphylococcus
QYIQAHGFDIAYVDSTIK

SEQ ID NO: 2036090 - protein, 22 aa, Staphylococcus
QYKIIEGFKHLTPNTNQYRTVM

SEQ ID NO: 2036091 - protein, 20 aa, Staphylococcus
QYKPHIAIITNIYSAHLDYH

SEQ ID NO: 2036092 - protein, 23 aa, Staphylococcus
QYLDVLSSLSLYPLTTIDVGEFQ

SEQ ID NO: 2036093 - protein, 23 aa, Staphylococcus
QYLKDGLAKLGFNTGESETPITP

SEQ ID NO: 2036094 - protein, 23 aa, Staphylococcus
QYLKDGLSKLGFNTGESETPITP

SEQ ID NO: 2036095 - protein, 18 aa, Staphylococcus
QYLKGHFEEHDFDVEIFD

SEQ ID NO: 2036096 - protein, 26 aa, Staphylococcus
QYLLAQHRGFILAPDYQRLTVSSLDY

SEQ ID NO: 2036097 - protein, 25 aa, Staphylococcus
QYLLKQRRGHLLLPDYISLDHSSEQ

SEQ ID NO: 2036098 - protein, 18 aa, Staphylococcus
QYLLRIPLCHHVKAQKMC

SEQ ID NO: 2036099 - protein, 26 aa, Staphylococcus
QYLNHIRLKFCLIDILSTDQSIEYIA

SEQ ID NO: 2036100 - protein, 26 aa, Staphylococcus
QYLNHLRLKFCLNDILTTRRPIEEIA

SEQ ID NO: 2036101 - protein, 22 aa, Staphylococcus
QYLNRFVYQGGITQNKNNRDIE

SEQ ID NO: 2036102 - protein, 40 aa, Staphylococcus
QYLYTYKRLVNFNIPENMWLKFVVEFLLKEINSIDKEIIL

SEQ ID NO: 2036103 - protein, 21 aa, Staphylococcus
QYMLRKAMVQLIEFNDQMNVI

SEQ ID NO: 2036104 - protein, 21 aa, Staphylococcus
QYNEILGAFIVGPHATDLIGE

SEQ ID NO: 2036105 - protein, 19 aa, Staphylococcus
QYNIYRSSFGPVIAAHLGS

SEQ ID NO: 2036106 - protein, 24 aa, Staphylococcus
QYNLKTETIISYGVEQDRQKFVRE

SEQ ID NO: 2036107 - protein, 19 aa, Staphylococcus
QYNVPLLMKFEVQGSNSDV

SEQ ID NO: 2036108 - protein, 24 aa, Staphylococcus
QYPELKLAIITPFEGHTQRWNEQN

SEQ ID NO: 2036109 - protein, 18 aa, Staphylococcus
QYPERFVGFATLPINEPE

SEQ ID NO: 2036110 - protein, 25 aa, Staphylococcus
QYPGYSGYHVQEWLEKQEIYIELSD

SEQ ID NO: 2036111 - protein, 18 aa, Staphylococcus
QYPNLKFKFVRDFDTFEI

SEQ ID NO: 2036112 - protein, 28 aa, Staphylococcus
QYPPFKLTEVDGWLYGRGVSDMKGGMSS

SEQ ID NO: 2036113 - protein, 29 aa, Staphylococcus
QYQDCLLFFRLGDFYEMFFEDAKEASRVL

SEQ ID NO: 2036114 - protein, 21 aa, Staphylococcus
QYQFHPFIWEVGGKYTYPEDK

SEQ ID NO: 2036115 - protein, 17 aa, Staphylococcus
QYQIPCYVKQLDLSETV

SEQ ID NO: 2036116 - protein, 26 aa, Staphylococcus
QYQNLTWDPPMVMFAANQSVLGDHER

SEQ ID NO: 2036117 - protein, 18 aa, Staphylococcus
QYQPRLNYLKAVDKLILD

SEQ ID NO: 2036118 - protein, 18 aa, Staphylococcus
QYQPRLNYLNAVDKLILD

SEQ ID NO: 2036119 - protein, 17 aa, Staphylococcus
QYQRFIRHIQFLIYRLT

SEQ ID NO: 2036120 - protein, 18 aa, Staphylococcus
QYRGRGVATQLVKHVLNA

SEQ ID NO: 2036121 - protein, 22 aa, Staphylococcus
QYRLDSLGILSYINFLSTSEMV

SEQ ID NO: 2036122 - protein, 19 aa, Staphylococcus
QYRTFTLNEHQGAVVVFTG

SEQ ID NO: 2036123 - protein, 25 aa, Staphylococcus
QYRTVMPGFEYEAPPSQNKLNPYEI

SEQ ID NO: 2036124 - protein, 24 aa, Staphylococcus
QYRTVMPGFKYEAPPTQHKLNPFE

SEQ ID NO: 2036125 - protein, 25 aa, Staphylococcus
QYRTVMPGFKYEAPPTQHKLNPYDV

SEQ ID NO: 2036126 - protein, 24 aa, Staphylococcus
QYRTVMPGFKYEAPPTQNKLNPFN

SEQ ID NO: 2036127 - protein, 25 aa, Staphylococcus
QYRTVMPGFKYEAPPTQNKRNPYDI

SEQ ID NO: 2036128 - protein, 20 aa, Staphylococcus
QYSMYPSLWENMGLSYADLI

SEQ ID NO: 2036129 - protein, 26 aa, Staphylococcus
QYTGVDFPKLFKAFKDMGIIVNTVNI

SEQ ID NO: 2036130 - protein, 19 aa, Staphylococcus
QYTHLRFPTDHELYILKKV

SEQ ID NO: 2036131 - protein, 19 aa, Staphylococcus
QYTLCEVRLHTGRTHQIRV

SEQ ID NO: 2036132 - protein, 24 aa, Staphylococcus
QYTTRLGIRLEETFEYIDTPHKFK

SEQ ID NO: 2036133 - protein, 18 aa, Staphylococcus
QYVIRLIPFGSLEHTKDV

SEQ ID NO: 2036134 - protein, 23 aa, Staphylococcus
QYVQDLFPDFNHLYLVVDAENKG

SEQ ID NO: 2036135 - protein, 17 aa, Staphylococcus
QYYCHQHLTTSTTIDIK

SEQ ID NO: 2036136 - protein, 21 aa, Staphylococcus
QYYCNNCKVTPNLKPVYIKEK

SEQ ID NO: 2036137 - protein, 20 aa, Staphylococcus
QYYSVRIEDFSAKKRTKSIA

SEQ ID NO: 2036138 - protein, 27 aa, Staphylococcus
RAAAALGSWRLEGCTLYVTLEPCVMCA

SEQ ID NO: 2036139 - protein, 19 aa, Staphylococcus
RAAAGGDEAAIFAGDLFRM

SEQ ID NO: 2036140 - protein, 19 aa, Staphylococcus
RAAAGGDEAAIFAGDLMRM

SEQ ID NO: 2036141 - protein, 18 aa, Staphylococcus
RAAAGGDEAAIFAGDLYR

SEQ ID NO: 2036142 - protein, 26 aa, Staphylococcus
RAAATYKFAGGKGINVSRVLQTHETT

SEQ ID NO: 2036143 - protein, 23 aa, Staphylococcus
RAAEFGLPITYAIIGGNPKRFKR

SEQ ID NO: 2036144 - protein, 26 aa, Staphylococcus
RAAKEIKSDMVINLGIGMPTLVANEM

SEQ ID NO: 2036145 - protein, 24 aa, Staphylococcus
RAALARSEADWIVGINATRALTTK

SEQ ID NO: 2036146 - protein, 23 aa, Staphylococcus
RAALKALDLPLLVEDEYASPTVT

SEQ ID NO: 2036147 - protein, 25 aa, Staphylococcus
RAAMEFGKMDFNTHLDLKAYSDNIK

SEQ ID NO: 2036148 - protein, 18 aa, Staphylococcus
RAAYPIDYIDNIAKPSKA

SEQ ID NO: 2036149 - protein, 20 aa, Staphylococcus
RAAYPIEHIDNIVLPSKAAH

SEQ ID NO: 2036150 - protein, 25 aa, Staphylococcus
RACEIGPRGDLALVLDTSENQALGQ

SEQ ID NO: 2036151 - protein, 18 aa, Staphylococcus
RADEGIVEVKRRDNGESE

SEQ ID NO: 2036152 - protein, 21 aa, Staphylococcus
RADHVKLLIPLLEQNKDTLAE

SEQ ID NO: 2036153 - protein, 20 aa, Staphylococcus
RADHVVNFMHFIAHELREIL

SEQ ID NO: 2036154 - protein, 21 aa, Staphylococcus
RADLRAAKLTLEQLIDEMDQE

SEQ ID NO: 2036155 - protein, 20 aa, Staphylococcus
RADTFLPYMKDALKVRRRVM

SEQ ID NO: 2036156 - protein, 20 aa, Staphylococcus
RAEDNIQLVIMIIEDGTYTM

SEQ ID NO: 2036157 - protein, 24 aa, Staphylococcus
RAEELQLRLKLAGVTVPVILERDI

SEQ ID NO: 2036158 - protein, 21 aa, Staphylococcus
RAEFVVNGMLIRKDFYSYVRV

SEQ ID NO: 2036159 - protein, 21 aa, Staphylococcus
RAEFVVNGMLVRKDYYSYVRT

SEQ ID NO: 2036160 - protein, 20 aa, Staphylococcus
RAEHTISCFLQVNVSGESSK

SEQ ID NO: 2036161 - protein, 23 aa, Staphylococcus
RAEHVKLLIPLLEQHKDDIAHLY

SEQ ID NO: 2036162 - protein, 19 aa, Staphylococcus
RAEHVKLLIPLLEQNKDEL

SEQ ID NO: 2036163 - protein, 22 aa, Staphylococcus
RAEHVKLLIPLLEQNRDEIAQL

SEQ ID NO: 2036164 - protein, 17 aa, Staphylococcus
RAEKGVYHLLSLPERVN

SEQ ID NO: 2036165 - protein, 22 aa, Staphylococcus
RAELSALIRMNGALSLSNQQFV

SEQ ID NO: 2036166 - protein, 20 aa, Staphylococcus
RAELTMAMVHSGDEIDLSAI

SEQ ID NO: 2036167 - protein, 17 aa, Staphylococcus
RAEPLLKSFRLEKELDI

SEQ ID NO: 2036168 - protein, 20 aa, Staphylococcus
RAETAPLYALSAISYEKELM

SEQ ID NO: 2036169 - protein, 21 aa, Staphylococcus
RAEVDKLPFIEFQADPIYINQ

SEQ ID NO: 2036170 - protein, 19 aa, Staphylococcus
RAEVFLKEQFERLEKEQIF

SEQ ID NO: 2036171 - protein, 19 aa, Staphylococcus
RAEVFLKEQFERLKREQIF

SEQ ID NO: 2036172 - protein, 18 aa, Staphylococcus
RAEVFLKEQFERLRKEQV

SEQ ID NO: 2036173 - protein, 18 aa, Staphylococcus
RAEVQGFSITEVDALTGR

SEQ ID NO: 2036174 - protein, 23 aa, Staphylococcus
RAEWLMLDLFGWSRTDYLIHMYD

SEQ ID NO: 2036175 - protein, 17 aa, Staphylococcus
RAFDMDVLYTGPHRKEE

SEQ ID NO: 2036176 - protein, 19 aa, Staphylococcus
RAFEFPAFKVDESALTERY

SEQ ID NO: 2036177 - protein, 23 aa, Staphylococcus
RAFEQAGALNVFFKVGTTDGKDM

SEQ ID NO: 2036178 - protein, 19 aa, Staphylococcus
RAFINLPSIIFADEPTGAL

SEQ ID NO: 2036179 - protein, 24 aa, Staphylococcus
RAFKNDKIDFIWSHTLKTINDKDG

SEQ ID NO: 2036180 - protein, 17 aa, Staphylococcus
RAFKSVDTPAIFMDHAD

SEQ ID NO: 2036181 - protein, 17 aa, Staphylococcus
RAFKSVDTPAIFMDHAK

SEQ ID NO: 2036182 - protein, 24 aa, Staphylococcus
RAFPTLPFLKKGVTYHFKFHVTST

SEQ ID NO: 2036183 - protein, 20 aa, Staphylococcus
RAGADIRHGLFGAGIESSHA

SEQ ID NO: 2036184 - protein, 19 aa, Staphylococcus
RAGADMIITYFAKDICHYL

SEQ ID NO: 2036185 - protein, 20 aa, Staphylococcus
RAGADMIITYFAKDICRYLD

SEQ ID NO: 2036186 - protein, 19 aa, Staphylococcus
RAGIEDIIIVTGKHKRAIE

SEQ ID NO: 2036187 - protein, 19 aa, Staphylococcus
RAGKSSVIGTMGYIQANNV

SEQ ID NO: 2036188 - protein, 18 aa, Staphylococcus
RAGLDYWESVNITYYENI

SEQ ID NO: 2036189 - protein, 19 aa, Staphylococcus
RAGLGQPDAPGFEKWAENF

SEQ ID NO: 2036190 - protein, 21 aa, Staphylococcus
RAGLGYTGRNGFVINPDLGTW

SEQ ID NO: 2036191 - protein, 17 aa, Staphylococcus
RAGMSLTKETSRFYQYW

SEQ ID NO: 2036192 - protein, 17 aa, Staphylococcus
RAGNTTFLCGVDDERVD

SEQ ID NO: 2036193 - protein, 18 aa, Staphylococcus
RAGNTTFLCGVNDERVEE

SEQ ID NO: 2036194 - protein, 31 aa, Staphylococcus
RAGSNAIYEFLALRIPMLLIPLGLDQSRGDQ

SEQ ID NO: 2036195 - protein, 25 aa, Staphylococcus
RAGVSKGGLLYHFESKQALIQGLVD

SEQ ID NO: 2036196 - protein, 20 aa, Staphylococcus
RAHFPRLKDALLSCGEDFNA

SEQ ID NO: 2036197 - protein, 19 aa, Staphylococcus
RAHGSGLFTRGQTQALSVL

SEQ ID NO: 2036198 - protein, 24 aa, Staphylococcus
RAHQIPVVFMRVALEKNFADVSPH

SEQ ID NO: 2036199 - protein, 25 aa, Staphylococcus
RAIDEIPIVALLCTQANGTSIVKEA

SEQ ID NO: 2036200 - protein, 25 aa, Staphylococcus
RAIDELPVIALLCTQASGTSVIKDA

SEQ ID NO: 2036201 - protein, 31 aa, Staphylococcus
RAIQRIYESYPYKRGVYSGGVGYINYNQNLD

SEQ ID NO: 2036202 - protein, 22 aa, Staphylococcus
RAIQYKTRIVTLEGDIVNPGGS

SEQ ID NO: 2036203 - protein, 26 aa, Staphylococcus
RAIRIQAKIASLVTAFARVREGKEPL

SEQ ID NO: 2036204 - protein, 25 aa, Staphylococcus
RAIRIQAKIASLVTSYARVREGKEA

SEQ ID NO: 2036205 - protein, 28 aa, Staphylococcus
RAITHILASTMLKEGVCQLDIKLDTGRT

SEQ ID NO: 2036206 - protein, 18 aa, Staphylococcus
RAIVEVCMGELYQFQDQF

SEQ ID NO: 2036207 - protein, 19 aa, Staphylococcus
RAKAGITMHALIESTNHVP

SEQ ID NO: 2036208 - protein, 19 aa, Staphylococcus
RAKFEREYGVELSATPGRD

SEQ ID NO: 2036209 - protein, 20 aa, Staphylococcus
RAKHSVRFSFNEITTEQDIK

SEQ ID NO: 2036210 - protein, 20 aa, Staphylococcus
RAKHSVRFSFNELTTDQEIK

SEQ ID NO: 2036211 - protein, 21 aa, Staphylococcus
RAKHSVRFSFNEMTTEHEVKY

SEQ ID NO: 2036212 - protein, 20 aa, Staphylococcus
RAKHSVRFSFNEQMNEQQIK

SEQ ID NO: 2036213 - protein, 18 aa, Staphylococcus
RAKKVIELSMDEARKLHH

SEQ ID NO: 2036214 - protein, 23 aa, Staphylococcus
RAKLAKSRAESHLDNDDDNSDIN

SEQ ID NO: 2036215 - protein, 21 aa, Staphylococcus
RAKLAKSRAESHLEDDDDNSD

SEQ ID NO: 2036216 - protein, 19 aa, Staphylococcus
RAKLFKLTFDNFFKEDEVY

SEQ ID NO: 2036217 - protein, 20 aa, Staphylococcus
RAKLFPLTFDNFFKEDEVYD

SEQ ID NO: 2036218 - protein, 25 aa, Staphylococcus
RAKLKQPRSAVCFDAPSWYELVVEG

SEQ ID NO: 2036219 - protein, 19 aa, Staphylococcus
RAKLRGEHSEGMICSLQEV

SEQ ID NO: 2036220 - protein, 21 aa, Staphylococcus
RAKMALRAVDLVVELPAYASV

SEQ ID NO: 2036221 - protein, 19 aa, Staphylococcus
RAKMGLKLNELVRNGEISA

SEQ ID NO: 2036222 - protein, 19 aa, Staphylococcus
RAKQLKVAVNINEPKDFDS

SEQ ID NO: 2036223 - protein, 18 aa, Staphylococcus
RAKQLKVMVHINEPKDFE

SEQ ID NO: 2036224 - protein, 18 aa, Staphylococcus
RAKRELIYHNGAVAVCAV

SEQ ID NO: 2036225 - protein, 18 aa, Staphylococcus
RAKSFGMKIIAFDPYLTA

SEQ ID NO: 2036226 - protein, 24 aa, Staphylococcus
RAKTQELLDFAALYENSLDAVSDR

SEQ ID NO: 2036227 - protein, 20 aa, Staphylococcus
RAKTYRLAHIKERINEDILV

SEQ ID NO: 2036228 - protein, 23 aa, Staphylococcus
RAKWDRPFRLAVIQLGTYDGTIY

SEQ ID NO: 2036229 - protein, 22 aa, Staphylococcus
RALHLPSDIMGAVDVIIDDHTT

SEQ ID NO: 2036230 - protein, 18 aa, Staphylococcus
RALIDLSDLITVMPIERA

SEQ ID NO: 2036231 - protein, 17 aa, Staphylococcus
RALKALAKREIQFDIIF

SEQ ID NO: 2036232 - protein, 26 aa, Staphylococcus
RALKEEGYDYFGLLYIGAILTKEGPK

SEQ ID NO: 2036233 - protein, 22 aa, Staphylococcus
RALLLHLRPLGLKDRSLGEGIK

SEQ ID NO: 2036234 - protein, 20 aa, Staphylococcus
RALNQLIARHEILRTQYIVD

SEQ ID NO: 2036235 - protein, 19 aa, Staphylococcus
RALSDGVFNAAIYDVVVNK

SEQ ID NO: 2036236 - protein, 17 aa, Staphylococcus
RAMASASKMLNSVNRGI

SEQ ID NO: 2036237 - protein, 20 aa, Staphylococcus
RAMFKYGHVTVAMKNARPEI

SEQ ID NO: 2036238 - protein, 19 aa, Staphylococcus
RAMSDGVFNAAIYDVVVDT

SEQ ID NO: 2036239 - protein, 18 aa, Staphylococcus
RANEIGYLLYRSSDDKTF

SEQ ID NO: 2036240 - protein, 19 aa, Staphylococcus
RANESYIEYSKRIKNSPLW

SEQ ID NO: 2036241 - protein, 26 aa, Staphylococcus
RANFDLRPAGIIKMLDLKHPIYKQTA

SEQ ID NO: 2036242 - protein, 26 aa, Staphylococcus
RANFDLRPAGIIKMLDLKQPIYKQTA

SEQ ID NO: 2036243 - protein, 19 aa, Staphylococcus
RANGFCIYNDVAITAKYLA

SEQ ID NO: 2036244 - protein, 19 aa, Staphylococcus
RANGFCIYNDVAITAKYLS

SEQ ID NO: 2036245 - protein, 19 aa, Staphylococcus
RANGFCIYNDVAITAKYLV

SEQ ID NO: 2036246 - protein, 17 aa, Staphylococcus
RANHYFKPSATMNKQGE

SEQ ID NO: 2036247 - protein, 27 aa, Staphylococcus
RANKDLKNIPIHFAIYVQSSQDAITPG

SEQ ID NO: 2036248 - protein, 21 aa, Staphylococcus
RANLKTVMIERGMPGGQMANT

SEQ ID NO: 2036249 - protein, 20 aa, Staphylococcus
RANLSTVMIERGMPGGQMAN

SEQ ID NO: 2036250 - protein, 21 aa, Staphylococcus
RANQLANWGVDGIFTDHADDM

SEQ ID NO: 2036251 - protein, 22 aa, Staphylococcus
RANQLFRWGVDGIFTDVAQHLV

SEQ ID NO: 2036252 - protein, 19 aa, Staphylococcus
RAPFSSIYFLLNTGDISHF

SEQ ID NO: 2036253 - protein, 33 aa, Staphylococcus
RAPKVFRKLNIEWVYRLLIDWKRIGRLKSIPIF

SEQ ID NO: 2036254 - protein, 20 aa, Staphylococcus
RAPWKIKRPQSVYDTHLPEF

SEQ ID NO: 2036255 - protein, 20 aa, Staphylococcus
RAPWKIKRPQSVYDTNLPQF

SEQ ID NO: 2036256 - protein, 20 aa, Staphylococcus
RAPWKIKRPQSVYDTQLPEF

SEQ ID NO: 2036257 - protein, 26 aa, Staphylococcus
RAPWKIKRPQSVYEMQLPQFFERASF

SEQ ID NO: 2036258 - protein, 20 aa, Staphylococcus
RAPWKLKRPQSVYETEFPQF

SEQ ID NO: 2036259 - protein, 20 aa, Staphylococcus
RAQIALDVFAERIHKYIGSY

SEQ ID NO: 2036260 - protein, 26 aa, Staphylococcus
RAQISQGYSGLEIDVFDAHSNQSRHI

SEQ ID NO: 2036261 - protein, 29 aa, Staphylococcus
RAQLLRKCNETIKFVFLDFIKNENIQTLT

SEQ ID NO: 2036262 - protein, 20 aa, Staphylococcus
RAQRGITLLKELKKNPHRIV

SEQ ID NO: 2036263 - protein, 20 aa, Staphylococcus
RAQRGITLLKELKKNPHRVV

SEQ ID NO: 2036264 - protein, 18 aa, Staphylococcus
RAQSALVRPQIISGTHAI

SEQ ID NO: 2036265 - protein, 19 aa, Staphylococcus
RAQSFGMKILAFDPYLTED

SEQ ID NO: 2036266 - protein, 17 aa, Staphylococcus
RARDGFNQTQLAKQAGI

SEQ ID NO: 2036267 - protein, 23 aa, Staphylococcus
RAREIGDPLVVTFGRVDPVPNTV

SEQ ID NO: 2036268 - protein, 26 aa, Staphylococcus
RARKQVLIDHGFRLPSAIDNRPLTFE

SEQ ID NO: 2036269 - protein, 19 aa, Staphylococcus
RARPLLKTFRLENELKVFP

SEQ ID NO: 2036270 - protein, 19 aa, Staphylococcus
RARPLLKTFRLENELNVFP

SEQ ID NO: 2036271 - protein, 17 aa, Staphylococcus
RARSCGESIIPTSTGAA

SEQ ID NO: 2036272 - protein, 24 aa, Staphylococcus
RASFIESFPLFGYNLNDYEDLFNE

SEQ ID NO: 2036273 - protein, 23 aa, Staphylococcus
RASHYRSAGTIEYLVTDDAYYFI

SEQ ID NO: 2036274 - protein, 19 aa, Staphylococcus
RASSVSELLPFGFSGKDLE

SEQ ID NO: 2036275 - protein, 20 aa, Staphylococcus
RASTHVTFSYSLMGLNNDDK

SEQ ID NO: 2036276 - protein, 25 aa, Staphylococcus
RASYMKRSYLFTAYIVEFQVLNGMR

SEQ ID NO: 2036277 - protein, 20 aa, Staphylococcus
RASYSSIYFLLKDADVSHFH

SEQ ID NO: 2036278 - protein, 22 aa, Staphylococcus
RATELYYYIKGGRVDYGQAHAE

SEQ ID NO: 2036279 - protein, 25 aa, Staphylococcus
RATLKRLPLYYRFAQRVKSKGYDRV

SEQ ID NO: 2036280 - protein, 35 aa, Staphylococcus
RATLKRLPLYYRFVNSLKIKGIDRVSSKTISEALD

SEQ ID NO: 2036281 - protein, 28 aa, Staphylococcus
RATLKRLPLYYRFVNTLKSKGIDRVNSK

SEQ ID NO: 2036282 - protein, 29 aa, Staphylococcus
RATLKRLPLYYRFVNTLKSKGIDRVNSKA

SEQ ID NO: 2036283 - protein, 29 aa, Staphylococcus
RATLKRLPLYYRFVSNLKSKGIDRVNSKA

SEQ ID NO: 2036284 - protein, 29 aa, Staphylococcus
RATLKRLPLYYRFVSTLKSKGIDRVNSKA

SEQ ID NO: 2036285 - protein, 25 aa, Staphylococcus
RATLKRLPLYYRLVNQLHEKGIDRV

SEQ ID NO: 2036286 - protein, 23 aa, Staphylococcus
RATRSRLGMSYLTAREQYKICRP

SEQ ID NO: 2036287 - protein, 17 aa, Staphylococcus
RATSKGIYLSLGAVKGV

SEQ ID NO: 2036288 - protein, 31 aa, Staphylococcus
RATSTYKFAGGKGINVSRVLKTLGVPSTALG

SEQ ID NO: 2036289 - protein, 19 aa, Staphylococcus
RATYEFFHETGFVKIDPPI

SEQ ID NO: 2036290 - protein, 20 aa, Staphylococcus
RAVARDVGRIIGFNDKTLNE

SEQ ID NO: 2036291 - protein, 27 aa, Staphylococcus
RAVEDGVDLMGYLAWGPIDLVSMSTSE

SEQ ID NO: 2036292 - protein, 20 aa, Staphylococcus
RAVKPPVIYGDVKWTAPLTV

SEQ ID NO: 2036293 - protein, 20 aa, Staphylococcus
RAVLNLVMLCGCQGVNGGGW

SEQ ID NO: 2036294 - protein, 21 aa, Staphylococcus
RAVPESLIFYIYDSTLAGFVE

SEQ ID NO: 2036295 - protein, 20 aa, Staphylococcus
RAVRDVRELIVKKAEEGITF

SEQ ID NO: 2036296 - protein, 19 aa, Staphylococcus
RAYEMLPNVMDYKSKEVQL

SEQ ID NO: 2036297 - protein, 19 aa, Staphylococcus
RAYEMLPVVMDYKSKEVAL

SEQ ID NO: 2036298 - protein, 20 aa, Staphylococcus
RAYEMLPVVMDYKVKEVKLQ

SEQ ID NO: 2036299 - protein, 18 aa, Staphylococcus
RAYFKLKVQGSGGHGSSP

SEQ ID NO: 2036300 - protein, 24 aa, Staphylococcus
RAYLNLKGEQWLIFGNQNYHHDFL

SEQ ID NO: 2036301 - protein, 26 aa, Staphylococcus
RAYNGKPLVCIGILKGSVMFMADLIK

SEQ ID NO: 2036302 - protein, 18 aa, Staphylococcus
RAYTYIRTMGAEGLKEVS

SEQ ID NO: 2036303 - protein, 21 aa, Staphylococcus
RCFKALCKTPLSNVLIDEYAR

SEQ ID NO: 2036304 - protein, 33 aa, Staphylococcus
RCGLPSISSELEWLPQLFVSGGLADLELGPFAR

SEQ ID NO: 2036305 - protein, 21 aa, Staphylococcus
RCMDCGTPFCQTGQLYGRETI

SEQ ID NO: 2036306 - protein, 23 aa, Staphylococcus
RCNFRCDYCMPKEIFGDDFVFLP

SEQ ID NO: 2036307 - protein, 21 aa, Staphylococcus
RCPYGPRPGDEVKQFTTEIAQ

SEQ ID NO: 2036308 - protein, 20 aa, Staphylococcus
RCPYGPRSGEEVKQFTTEIA

SEQ ID NO: 2036309 - protein, 19 aa, Staphylococcus
RCQSHFNHRCKFHYHLYFE

SEQ ID NO: 2036310 - protein, 17 aa, Staphylococcus
RCRHLLTKTDKRIIEYI

SEQ ID NO: 2036311 - protein, 27 aa, Staphylococcus
RCWFVKAGRMKWVFKFEITSGDKVHCI

SEQ ID NO: 2036312 - protein, 23 aa, Staphylococcus
RCYKNEFDAWIPKIKEMIPSYGL

SEQ ID NO: 2036313 - protein, 18 aa, Staphylococcus
RDADRLDAIGAIGIARTF

SEQ ID NO: 2036314 - protein, 21 aa, Staphylococcus
RDAKDLLPEGFTHPGSPNGEF

SEQ ID NO: 2036315 - protein, 26 aa, Staphylococcus
RDAKGQQHLPGWGLDALKFLLEERQV

SEQ ID NO: 2036316 - protein, 23 aa, Staphylococcus
RDALLKNGKKFGFYHGYQGNGHI

SEQ ID NO: 2036317 - protein, 20 aa, Staphylococcus
RDAMLLNWNTYKAIQSQVKE

SEQ ID NO: 2036318 - protein, 17 aa, Staphylococcus
RDAQFVCVISMSAPNED

SEQ ID NO: 2036319 - protein, 20 aa, Staphylococcus
RDAYLNFVTREWIQFIRDLR

SEQ ID NO: 2036320 - protein, 22 aa, Staphylococcus
RDCQFIAVKLPYGVQKDAEEVE

SEQ ID NO: 2036321 - protein, 31 aa, Staphylococcus
RDDEWKDPFKFPLEVVESVVAAAEKYADKDF

SEQ ID NO: 2036322 - protein, 17 aa, Staphylococcus
RDEEIQLILNFYRNKTI

SEQ ID NO: 2036323 - protein, 20 aa, Staphylococcus
RDEFEMGRELLVQVRKRQLK

SEQ ID NO: 2036324 - protein, 18 aa, Staphylococcus
RDEIDVDRLLVVTFTNLS

SEQ ID NO: 2036325 - protein, 23 aa, Staphylococcus
RDEIKWYVEEAIRIEKSGKKVPM

SEQ ID NO: 2036326 - protein, 18 aa, Staphylococcus
RDEKIAVIMNEFGDFDVD

SEQ ID NO: 2036327 - protein, 26 aa, Staphylococcus
RDELFDDVCSFMVKEGHISTSLIQRH

SEQ ID NO: 2036328 - protein, 32 aa, Staphylococcus
RDEQYRGIATWKFDKERGRLVGTIEVPMTLAI

SEQ ID NO: 2036329 - protein, 22 aa, Staphylococcus
RDESRLAEVAKRIQDNKQAVVE

SEQ ID NO: 2036330 - protein, 21 aa, Staphylococcus
RDESRLLILGRQSGYIEHKHF

SEQ ID NO: 2036331 - protein, 29 aa, Staphylococcus
RDETDRTGLRIAIELKKDVNAEAIKNYLF

SEQ ID NO: 2036332 - protein, 28 aa, Staphylococcus
RDETDRTGLRIAIELKKDVNSDAILNFL

SEQ ID NO: 2036333 - protein, 28 aa, Staphylococcus
RDETDRTGLRIAIELKKDVNSEAIKNFL

SEQ ID NO: 2036334 - protein, 28 aa, Staphylococcus
RDETDRTGLRIAIELKKDVNSEAVLNYL

SEQ ID NO: 2036335 - protein, 28 aa, Staphylococcus
RDETDRTGLRIAIELKKEANSEAIKNYL

SEQ ID NO: 2036336 - protein, 19 aa, Staphylococcus
RDETFPGEILMLIEQAISQ

SEQ ID NO: 2036337 - protein, 24 aa, Staphylococcus
RDETSLRTGVRVVIDIRKDANANV

SEQ ID NO: 2036338 - protein, 19 aa, Staphylococcus
RDEVIGPLLHYRMVQELPT

SEQ ID NO: 2036339 - protein, 18 aa, Staphylococcus
RDFIHPLPHISFVRGKNN

SEQ ID NO: 2036340 - protein, 31 aa, Staphylococcus
RDFQEMRPLYEWLGLTASLGFVDIPDYEYAE

SEQ ID NO: 2036341 - protein, 25 aa, Staphylococcus
RDGELKMLLTYQFPLILGNDFAGEV

SEQ ID NO: 2036342 - protein, 17 aa, Staphylococcus
RDGEQTPGVSFSFDERL

SEQ ID NO: 2036343 - protein, 23 aa, Staphylococcus
RDGLVKAAALLLKYDDKADQETV

SEQ ID NO: 2036344 - protein, 24 aa, Staphylococcus
RDGQYRGIATWTYDQERQRLIGTI

SEQ ID NO: 2036345 - protein, 26 aa, Staphylococcus
RDGRARVSVGARSSIFAPFKELGLII

SEQ ID NO: 2036346 - protein, 19 aa, Staphylococcus
RDHAIEFPEDLRSAEDQLF

SEQ ID NO: 2036347 - protein, 22 aa, Staphylococcus
RDHCSVCHAVLPQIAGIVNEFP

SEQ ID NO: 2036348 - protein, 19 aa, Staphylococcus
RDHGKHVGVNYMLGKDSIQ

SEQ ID NO: 2036349 - protein, 18 aa, Staphylococcus
RDHLEEIYAHTFKAEDAI

SEQ ID NO: 2036350 - protein, 18 aa, Staphylococcus
RDHLEEIYARTFKAEDAI

SEQ ID NO: 2036351 - protein, 24 aa, Staphylococcus
RDHNLFLCEVFGGKIFKVDIDTKK

SEQ ID NO: 2036352 - protein, 20 aa, Staphylococcus
RDHYECVMCNAEGRLTINQK

SEQ ID NO: 2036353 - protein, 17 aa, Staphylococcus
RDIAFGVSEGERNSTLA

SEQ ID NO: 2036354 - protein, 18 aa, Staphylococcus
RDIANWLISGIKPPRYSS

SEQ ID NO: 2036355 - protein, 18 aa, Staphylococcus
RDIANWLLTGVKPTRYES

SEQ ID NO: 2036356 - protein, 17 aa, Staphylococcus
RDIGPRIQGTLIKKQAM

SEQ ID NO: 2036357 - protein, 19 aa, Staphylococcus
RDIIEDINKIYGLDHKQVN

SEQ ID NO: 2036358 - protein, 21 aa, Staphylococcus
RDIIKFQDLHINHVIGLDMTC

SEQ ID NO: 2036359 - protein, 19 aa, Staphylococcus
RDIIRKAREENIRFQDVAV

SEQ ID NO: 2036360 - protein, 17 aa, Staphylococcus
RDIKLAIERSAAYFDLH

SEQ ID NO: 2036361 - protein, 25 aa, Staphylococcus
RDIKRLELKYHVKIFEFKSPYLKLT

SEQ ID NO: 2036362 - protein, 17 aa, Staphylococcus
RDILKDEIDAVKNLPQY

SEQ ID NO: 2036363 - protein, 17 aa, Staphylococcus
RDILKDEVKAVKNLPQY

SEQ ID NO: 2036364 - protein, 26 aa, Staphylococcus
RDILRAPEFFRHLKVIPHAQEVVEKL

SEQ ID NO: 2036365 - protein, 19 aa, Staphylococcus
RDISCNLGSLNIVNVMESQ

SEQ ID NO: 2036366 - protein, 17 aa, Staphylococcus
RDITFSIYLPEDYTPLF

SEQ ID NO: 2036367 - protein, 17 aa, Staphylococcus
RDIVESARIGIPNKGDW

SEQ ID NO: 2036368 - protein, 23 aa, Staphylococcus
RDKLHVHNVVFARDFRGNIDDIF

SEQ ID NO: 2036369 - protein, 21 aa, Staphylococcus
RDKNHACVVMWSIANEPASNE

SEQ ID NO: 2036370 - protein, 23 aa, Staphylococcus
RDKPKIVFADAVATTKTSILVGE

SEQ ID NO: 2036371 - protein, 17 aa, Staphylococcus
RDKPYFYEMQKTYKDHA

SEQ ID NO: 2036372 - protein, 24 aa, Staphylococcus
RDKVCALEIFVECFGKDKGDGRGS

SEQ ID NO: 2036373 - protein, 19 aa, Staphylococcus
RDLATSLIVSERVETTEAR

SEQ ID NO: 2036374 - protein, 30 aa, Staphylococcus
RDLDEVWPKVTQHWLYQWRELLNEKFECKE

SEQ ID NO: 2036375 - protein, 22 aa, Staphylococcus
RDLDFDALVPWVSIEGESPVFF

SEQ ID NO: 2036376 - protein, 20 aa, Staphylococcus
RDLDKYKLYLETRHIEHIDF

SEQ ID NO: 2036377 - protein, 23 aa, Staphylococcus
RDLEADMSLAIVIGSEGQGMSRL

SEQ ID NO: 2036378 - protein, 19 aa, Staphylococcus
RDLEMTFFFEMVLGEETDF

SEQ ID NO: 2036379 - protein, 19 aa, Staphylococcus
RDLEMTFFYELILGEETEF

SEQ ID NO: 2036380 - protein, 19 aa, Staphylococcus
RDLEMTLFYEMLFGEETDF

SEQ ID NO: 2036381 - protein, 24 aa, Staphylococcus
RDLENHFFGRVGLFRNQVGDELLR

SEQ ID NO: 2036382 - protein, 24 aa, Staphylococcus
RDLENHFFGRVGLFRNQVGDQLLK

SEQ ID NO: 2036383 - protein, 23 aa, Staphylococcus
RDLFSKFKKGAVFVNAARGSIVD

SEQ ID NO: 2036384 - protein, 22 aa, Staphylococcus
RDLGVEEHVLFLGKQDNVSAFY

SEQ ID NO: 2036385 - protein, 20 aa, Staphylococcus
RDLIGKRLTYPGAPGSGGIA

SEQ ID NO: 2036386 - protein, 17 aa, Staphylococcus
RDLIKQINIARCELIEA

SEQ ID NO: 2036387 - protein, 20 aa, Staphylococcus
RDLIRLFGKRGHGLYNKARG

SEQ ID NO: 2036388 - protein, 21 aa, Staphylococcus
RDLKELKIFKVPAVSNQSYYK

SEQ ID NO: 2036389 - protein, 22 aa, Staphylococcus
RDLKRFVTDVLHTNEILENKKE

SEQ ID NO: 2036390 - protein, 27 aa, Staphylococcus
RDLLARCYRSCLALADEKGLRHLAFCC

SEQ ID NO: 2036391 - protein, 20 aa, Staphylococcus
RDLLEFKSQSSIPIEQVESV

SEQ ID NO: 2036392 - protein, 18 aa, Staphylococcus
RDLLTFKQQHPISIEEVE

SEQ ID NO: 2036393 - protein, 20 aa, Staphylococcus
RDLMLLRYGYTVNETRELDC

SEQ ID NO: 2036394 - protein, 17 aa, Staphylococcus
RDLPADAAVNVLGHIED

SEQ ID NO: 2036395 - protein, 20 aa, Staphylococcus
RDLRENEITVSKSLDDFTES

SEQ ID NO: 2036396 - protein, 18 aa, Staphylococcus
RDLVDVAVRLVKEDRKDK

SEQ ID NO: 2036397 - protein, 25 aa, Staphylococcus
RDLVSKRLIVSIYREDMINQGKNSE

SEQ ID NO: 2036398 - protein, 25 aa, Staphylococcus
RDMAADMPLAIVIGSEGQGMSRLVK

SEQ ID NO: 2036399 - protein, 19 aa, Staphylococcus
RDMLQHHFISGEIITKEAK

SEQ ID NO: 2036400 - protein, 25 aa, Staphylococcus
RDMVEELYQRCDIYLDINEGGEILN

SEQ ID NO: 2036401 - protein, 26 aa, Staphylococcus
RDNFDLRPAGIIKMLDLKRPIYKQTA

SEQ ID NO: 2036402 - protein, 25 aa, Staphylococcus
RDNHSAYAFIKRLIKQFGKPQKVIT

SEQ ID NO: 2036403 - protein, 27 aa, Staphylococcus
RDNHSAYAFIKRLIKQFGKPQMIITDQ

SEQ ID NO: 2036404 - protein, 25 aa, Staphylococcus
RDNHSAYAFIKRLITQFGKPQKVIT

SEQ ID NO: 2036405 - protein, 22 aa, Staphylococcus
RDNKLSLGDLMNGSFTITNGGI

SEQ ID NO: 2036406 - protein, 20 aa, Staphylococcus
RDNPKLKGKPVIVGGKASGR

SEQ ID NO: 2036407 - protein, 19 aa, Staphylococcus
RDNPKLKGKPVIVGGKASN

SEQ ID NO: 2036408 - protein, 19 aa, Staphylococcus
RDNQPLSLGLNVYDGKVTN

SEQ ID NO: 2036409 - protein, 23 aa, Staphylococcus
RDNSRTPMQWNQNKNAGFSDHQP

SEQ ID NO: 2036410 - protein, 23 aa, Staphylococcus
RDNYCYLHAKLPKLHQILYNNYK

SEQ ID NO: 2036411 - protein, 18 aa, Staphylococcus
RDPIHREAPAFDQLSTKV

SEQ ID NO: 2036412 - protein, 17 aa, Staphylococcus
RDPKGLYKKARSGEIKE

SEQ ID NO: 2036413 - protein, 18 aa, Staphylococcus
RDQIMKMIKKLQVEQNKT

SEQ ID NO: 2036414 - protein, 17 aa, Staphylococcus
RDQLALIQSIEELEAHV

SEQ ID NO: 2036415 - protein, 19 aa, Staphylococcus
RDQYLPMGLLLANHLIEKD

SEQ ID NO: 2036416 - protein, 26 aa, Staphylococcus
RDQYRLYKLIWDRFVASQMAPAVLDT

SEQ ID NO: 2036417 - protein, 19 aa, Staphylococcus
RDRHTFAVNVFGEVNDYLK

SEQ ID NO: 2036418 - protein, 17 aa, Staphylococcus
RDRVVVEGVNVNKKHQK

SEQ ID NO: 2036419 - protein, 26 aa, Staphylococcus
RDSDVLVCTVVGFPLGASTTATKTFE

SEQ ID NO: 2036420 - protein, 18 aa, Staphylococcus
RDSEGFDFGRGFGGFEKM

SEQ ID NO: 2036421 - protein, 24 aa, Staphylococcus
RDSEIQFQYGLVLCQLEMFEQAIQ

SEQ ID NO: 2036422 - protein, 17 aa, Staphylococcus
RDSKTQAILPLRGKILN

SEQ ID NO: 2036423 - protein, 18 aa, Staphylococcus
RDSKTQAILPLRGKILNV

SEQ ID NO: 2036424 - protein, 24 aa, Staphylococcus
RDSLPEVEHLFIICSTQGVGEPPI

SEQ ID NO: 2036425 - protein, 22 aa, Staphylococcus
RDSPRSLLHLAGAKHIRKNNHT

SEQ ID NO: 2036426 - protein, 23 aa, Staphylococcus
RDSRTQAILPLRGKILNVEKARL

SEQ ID NO: 2036427 - protein, 20 aa, Staphylococcus
RDSTLFPINHLFEQDHYEET

SEQ ID NO: 2036428 - protein, 28 aa, Staphylococcus
RDTFVPAICYNESMGPIQTCDTCTVEID

SEQ ID NO: 2036429 - protein, 30 aa, Staphylococcus
RDTFVPSICYNESMGPIQTCDTCMVEIDGK

SEQ ID NO: 2036430 - protein, 31 aa, Staphylococcus
RDTFVPSICYNESMGPIQTCDTCMVEIDGKI

SEQ ID NO: 2036431 - protein, 17 aa, Staphylococcus
RDTIIFWRLDRLGCNME

SEQ ID NO: 2036432 - protein, 19 aa, Staphylococcus
RDTLLPKLMSGEIEIPDDI

SEQ ID NO: 2036433 - protein, 26 aa, Staphylococcus
RDTMIPFHLQNEIKHRGASYHFGRVP

SEQ ID NO: 2036434 - protein, 19 aa, Staphylococcus
RDTSWIYDADFEKLRNQNI

SEQ ID NO: 2036435 - protein, 19 aa, Staphylococcus
RDTSWIYDADFEKLSEQNI

SEQ ID NO: 2036436 - protein, 19 aa, Staphylococcus
RDTSWIYDADFEKLTKQDI

SEQ ID NO: 2036437 - protein, 19 aa, Staphylococcus
RDTSWIYDADFEKLTRQQI

SEQ ID NO: 2036438 - protein, 18 aa, Staphylococcus
RDVARLHILAMTTPEANN

SEQ ID NO: 2036439 - protein, 31 aa, Staphylococcus
RDVFGYYISKGWMCIQVFFVRNGNMIQRDTT

SEQ ID NO: 2036440 - protein, 21 aa, Staphylococcus
RDVIDADGLTIVYAEPDQFAQ

SEQ ID NO: 2036441 - protein, 19 aa, Staphylococcus
RDVPQIIWHGLPLTEAFLF

SEQ ID NO: 2036442 - protein, 23 aa, Staphylococcus
RDVSKRLLAHILGVELPNPSIID

SEQ ID NO: 2036443 - protein, 19 aa, Staphylococcus
RDVSKRVLAHLLGVDLPNP

SEQ ID NO: 2036444 - protein, 20 aa, Staphylococcus
RDVSKRVLAHLLGVELPNPS

SEQ ID NO: 2036445 - protein, 17 aa, Staphylococcus
RDYCEKHQIPLAVHHLD

SEQ ID NO: 2036446 - protein, 30 aa, Staphylococcus
RDYEEMKPLYEWLGLTTSLGFVENPQGPIS

SEQ ID NO: 2036447 - protein, 30 aa, Staphylococcus
RDYEEMRPLYEWLGLTTSLGFIGDPDYEYQ

SEQ ID NO: 2036448 - protein, 17 aa, Staphylococcus
RDYEFAQKFDLPIKEVI

SEQ ID NO: 2036449 - protein, 23 aa, Staphylococcus
RDYEFASKFNLPINEVIAGGDIQ

SEQ ID NO: 2036450 - protein, 25 aa, Staphylococcus
RDYEMVPTVMAYKQMEVELQNLVDE

SEQ ID NO: 2036451 - protein, 24 aa, Staphylococcus
RDYLKKKLESLGFELTAQPEGAFY

SEQ ID NO: 2036452 - protein, 18 aa, Staphylococcus
RDYNEFVAVSGWTDIFIY

SEQ ID NO: 2036453 - protein, 24 aa, Staphylococcus
READFINCVVFRRQAENVNNYLSK

SEQ ID NO: 2036454 - protein, 23 aa, Staphylococcus
READFINVVVFRRQAENVNNYLF

SEQ ID NO: 2036455 - protein, 23 aa, Staphylococcus
READFINVVVFRRQAENVNNYLS

SEQ ID NO: 2036456 - protein, 19 aa, Staphylococcus
REAGGLLMYGIPNMKLDKE

SEQ ID NO: 2036457 - protein, 19 aa, Staphylococcus
REAGLPCYFTMDAGPNVKV

SEQ ID NO: 2036458 - protein, 20 aa, Staphylococcus
REAIHLGGKEGLSIARQLGF

SEQ ID NO: 2036459 - protein, 18 aa, Staphylococcus
REAIKATVIGKIKEFGTS

SEQ ID NO: 2036460 - protein, 20 aa, Staphylococcus
REAIPNVLFQMLLRASNAVG

SEQ ID NO: 2036461 - protein, 21 aa, Staphylococcus
REAKDYYEVIEWASQQEWSNG

SEQ ID NO: 2036462 - protein, 17 aa, Staphylococcus
REAKSFYHLGPVTQNNL

SEQ ID NO: 2036463 - protein, 20 aa, Staphylococcus
REAQKALAENVTRFIHGEDA

SEQ ID NO: 2036464 - protein, 33 aa, Staphylococcus
REAQRYASDWSEIRPEWGLARNASFIIGQRELT

SEQ ID NO: 2036465 - protein, 20 aa, Staphylococcus
REARVDRMFVVGFDTPTIER

SEQ ID NO: 2036466 - protein, 19 aa, Staphylococcus
REATDFKEEDIELFQDIAE

SEQ ID NO: 2036467 - protein, 19 aa, Staphylococcus
REAYEPGDSLVVIPQNDPV

SEQ ID NO: 2036468 - protein, 21 aa, Staphylococcus
RECEYCKSGQYNLCPHMEFMA

SEQ ID NO: 2036469 - protein, 22 aa, Staphylococcus
RECQFIAVKLPYGVQSDADEVE

SEQ ID NO: 2036470 - protein, 23 aa, Staphylococcus
RECVSDIDGVLAYIEKWTAKRES

SEQ ID NO: 2036471 - protein, 24 aa, Staphylococcus
REDAPEVMANFFIEGQKMLEAQNQ

SEQ ID NO: 2036472 - protein, 27 aa, Staphylococcus
REDAVWDLPMVFAEFGEEDFHPKTLLQ

SEQ ID NO: 2036473 - protein, 20 aa, Staphylococcus
REDAVWDLTKVFADFAEGDF

SEQ ID NO: 2036474 - protein, 21 aa, Staphylococcus
REDAVWDLTLVFADFAESDFH

SEQ ID NO: 2036475 - protein, 24 aa, Staphylococcus
REDFQVNIPERWSIAQLYQSALDQ

SEQ ID NO: 2036476 - protein, 20 aa, Staphylococcus
REDGDDVFVHFSGIATDGYK

SEQ ID NO: 2036477 - protein, 17 aa, Staphylococcus
REDGNDVFVHFSGIAGE

SEQ ID NO: 2036478 - protein, 21 aa, Staphylococcus
REDGSDVFVHFSGIAGEGYKT

SEQ ID NO: 2036479 - protein, 24 aa, Staphylococcus
REDIKGTVIGFFTPELFHGIGSAG

SEQ ID NO: 2036480 - protein, 25 aa, Staphylococcus
REDKPQIMPVWSLKKRAQKVQEEDF

SEQ ID NO: 2036481 - protein, 17 aa, Staphylococcus
REDMEMIAGNHDEAVMS

SEQ ID NO: 2036482 - protein, 19 aa, Staphylococcus
REDMQLLIQRLIKTYDMTA

SEQ ID NO: 2036483 - protein, 17 aa, Staphylococcus
REEEIDYAIKHNIPVGI

SEQ ID NO: 2036484 - protein, 17 aa, Staphylococcus
REEEIDYAIKHNIPVPI

SEQ ID NO: 2036485 - protein, 24 aa, Staphylococcus
REEKHRTAFEFHFEDLFTEEEWLN

SEQ ID NO: 2036486 - protein, 24 aa, Staphylococcus
REEKRCPNCHMTIKDIAYKGKFGC

SEQ ID NO: 2036487 - protein, 26 aa, Staphylococcus
REELQQFWYDLADDLVQTEALTSTNE

SEQ ID NO: 2036488 - protein, 17 aa, Staphylococcus
REENIRFQDVAVLYRDE

SEQ ID NO: 2036489 - protein, 17 aa, Staphylococcus
REEPLDHVLLFGPPGLG

SEQ ID NO: 2036490 - protein, 22 aa, Staphylococcus
REEQPSHFLVAFDAGKTTFRHS

SEQ ID NO: 2036491 - protein, 22 aa, Staphylococcus
REEQPTHFLVAFDAGKTTFRHS

SEQ ID NO: 2036492 - protein, 23 aa, Staphylococcus
REESLPGYQLMTLQRAITQQRNV

SEQ ID NO: 2036493 - protein, 18 aa, Staphylococcus
REESPIVMSSRIRLARNL

SEQ ID NO: 2036494 - protein, 19 aa, Staphylococcus
REEVDAFLDDIITDYQKMA

SEQ ID NO: 2036495 - protein, 21 aa, Staphylococcus
REFKDCRSELVTINETGVTTK

SEQ ID NO: 2036496 - protein, 24 aa, Staphylococcus
REFKFHPLVRQLKPFGFFDYNALQ

SEQ ID NO: 2036497 - protein, 22 aa, Staphylococcus
REFKQHFPHSGWVEHDANEIWT

SEQ ID NO: 2036498 - protein, 17 aa, Staphylococcus
REGAYVIHRLAGNPEYK

SEQ ID NO: 2036499 - protein, 21 aa, Staphylococcus
REGELVARLILDKAHNKKPTK

SEQ ID NO: 2036500 - protein, 23 aa, Staphylococcus
REGELVARLILDKVGNKKPIKRL

SEQ ID NO: 2036501 - protein, 21 aa, Staphylococcus
REGELVARLILDKVHNKKPIK

SEQ ID NO: 2036502 - protein, 22 aa, Staphylococcus
REGELVARLILDKVKNKKPIKR

SEQ ID NO: 2036503 - protein, 17 aa, Staphylococcus
REGHGAYLFDVDGNKYI

SEQ ID NO: 2036504 - protein, 34 aa, Staphylococcus
REGIARAKFEIVSGLKPGGVFIYDGDEPLLKPHV

SEQ ID NO: 2036505 - protein, 20 aa, Staphylococcus
REGIHYKNLLGTYLHGPVLP

SEQ ID NO: 2036506 - protein, 17 aa, Staphylococcus
REGKRVGLVDADIYGFS

SEQ ID NO: 2036507 - protein, 19 aa, Staphylococcus
REGLKELLEQWLYDESIDF

SEQ ID NO: 2036508 - protein, 26 aa, Staphylococcus
REGLRPKILLHSCCAPCSTYTLEYLT

SEQ ID NO: 2036509 - protein, 18 aa, Staphylococcus
REGNGWEVIDEEQAVEIA

SEQ ID NO: 2036510 - protein, 19 aa, Staphylococcus
REGRYAYSLPQSDIKTDSV

SEQ ID NO: 2036511 - protein, 17 aa, Staphylococcus
REGSWTVRQLVHHIADS

SEQ ID NO: 2036512 - protein, 17 aa, Staphylococcus
REHPRVIWDNDVPINES

SEQ ID NO: 2036513 - protein, 25 aa, Staphylococcus
REIEFGDVFFRKGDKVLQLVNRPND

SEQ ID NO: 2036514 - protein, 20 aa, Staphylococcus
REIERGVALYGPHRDDLGFK

SEQ ID NO: 2036515 - protein, 17 aa, Staphylococcus
REIHLWFDENEISNYSA

SEQ ID NO: 2036516 - protein, 17 aa, Staphylococcus
REIKRKLLSRAAYTLET

SEQ ID NO: 2036517 - protein, 21 aa, Staphylococcus
REIMDEVGIDAARYFLTMRSP

SEQ ID NO: 2036518 - protein, 23 aa, Staphylococcus
REINDFETIYGFVKSKHTAYFSP

SEQ ID NO: 2036519 - protein, 20 aa, Staphylococcus
REIYNLKEVHVIPGNCDTTE

SEQ ID NO: 2036520 - protein, 24 aa, Staphylococcus
REKALKVLKARVYDMKLQEEQEKY

SEQ ID NO: 2036521 - protein, 18 aa, Staphylococcus
REKDIIVGNVCFYGATAG

SEQ ID NO: 2036522 - protein, 22 aa, Staphylococcus
REKEGIADGLVRLSVGIEDTKD

SEQ ID NO: 2036523 - protein, 24 aa, Staphylococcus
REKGKYRPCVVLSRTSFNDKTSLV

SEQ ID NO: 2036524 - protein, 23 aa, Staphylococcus
REKGVALFGKFFADYGGETAEEV

SEQ ID NO: 2036525 - protein, 21 aa, Staphylococcus
REKHLELIMKWCAQELKNNFQ

SEQ ID NO: 2036526 - protein, 17 aa, Staphylococcus
REKIPAMRKAIAKAMVN

SEQ ID NO: 2036527 - protein, 22 aa, Staphylococcus
REKKGKVVLVTAMSPTPAGEGK

SEQ ID NO: 2036528 - protein, 26 aa, Staphylococcus
REKLKQPRSAVCFDAPSWYELVVEGR

SEQ ID NO: 2036529 - protein, 19 aa, Staphylococcus
REKLLKQQLDLMVKDSTLD

SEQ ID NO: 2036530 - protein, 25 aa, Staphylococcus
REKLNEVLLAMGIKDNRIEGSVRLS

SEQ ID NO: 2036531 - protein, 24 aa, Staphylococcus
REKLNEVLLAMGLSDKRIEGSIRI

SEQ ID NO: 2036532 - protein, 18 aa, Staphylococcus
REKLNIPKDKKIITYAPT

SEQ ID NO: 2036533 - protein, 24 aa, Staphylococcus
REKQKLRYLYGITERQFHNTFIEA

SEQ ID NO: 2036534 - protein, 18 aa, Staphylococcus
REKRIEGITDLRDETSLR

SEQ ID NO: 2036535 - protein, 18 aa, Staphylococcus
REKVDAMTPATEFETVEF

SEQ ID NO: 2036536 - protein, 18 aa, Staphylococcus
REKWGEEQVHQWRRSYDV

SEQ ID NO: 2036537 - protein, 25 aa, Staphylococcus
RELALKHKPKLIVAGTSAYSRQLDF

SEQ ID NO: 2036538 - protein, 21 aa, Staphylococcus
RELEAKTGAGFIVALTGAIMT

SEQ ID NO: 2036539 - protein, 17 aa, Staphylococcus
RELGIDGEEVMLLRHMI

SEQ ID NO: 2036540 - protein, 27 aa, Staphylococcus
RELHESLKIAGYHPFTIVLNDDGFLPD

SEQ ID NO: 2036541 - protein, 18 aa, Staphylococcus
RELIKIHVLQNNFEDKND

SEQ ID NO: 2036542 - protein, 20 aa, Staphylococcus
RELIKNARLSDVELENVISV

SEQ ID NO: 2036543 - protein, 17 aa, Staphylococcus
RELKAIYQGKQIKVLNI

SEQ ID NO: 2036544 - protein, 17 aa, Staphylococcus
RELKIKFSGQLVKEDTN

SEQ ID NO: 2036545 - protein, 19 aa, Staphylococcus
RELKIYTIIVQRFLETLMK

SEQ ID NO: 2036546 - protein, 19 aa, Staphylococcus
RELLDHYNQLGINEAELVI

SEQ ID NO: 2036547 - protein, 18 aa, Staphylococcus
RELMGMLKRDHIQAMLEM

SEQ ID NO: 2036548 - protein, 21 aa, Staphylococcus
RELRRSAFRNLYKAYGAYNNT

SEQ ID NO: 2036549 - protein, 17 aa, Staphylococcus
RELTDFSLPKIGEEFGG

SEQ ID NO: 2036550 - protein, 18 aa, Staphylococcus
RELTYCSICGHITEKDPC

SEQ ID NO: 2036551 - protein, 19 aa, Staphylococcus
RELTYCSVCGHITEEDPCY

SEQ ID NO: 2036552 - protein, 19 aa, Staphylococcus
RELTYCSVCGHITEKDPCY

SEQ ID NO: 2036553 - protein, 25 aa, Staphylococcus
RELVLRINNLLARISKYQSNHLTEQ

SEQ ID NO: 2036554 - protein, 24 aa, Staphylococcus
REMDRAVCLYGPHRDDLGFNVNDM

SEQ ID NO: 2036555 - protein, 17 aa, Staphylococcus
REMEILLLIAKGYSNQE

SEQ ID NO: 2036556 - protein, 17 aa, Staphylococcus
REMEILLLIANGYSNQE

SEQ ID NO: 2036557 - protein, 17 aa, Staphylococcus
REMGDYLIVALSSDEFN

SEQ ID NO: 2036558 - protein, 21 aa, Staphylococcus
REMIEDSSLEALDYSDNYTFQ

SEQ ID NO: 2036559 - protein, 17 aa, Staphylococcus
REMRDKKGADVKEHELI

SEQ ID NO: 2036560 - protein, 21 aa, Staphylococcus
REMTHLKSTYSKHMFRILKQY

SEQ ID NO: 2036561 - protein, 21 aa, Staphylococcus
REMVEANIAKGYQFMVITDHS

SEQ ID NO: 2036562 - protein, 20 aa, Staphylococcus
RENFKIHKEDIIARDIIVIA

SEQ ID NO: 2036563 - protein, 22 aa, Staphylococcus
RENGDDVFVHFSAIQGDGYKTL

SEQ ID NO: 2036564 - protein, 21 aa, Staphylococcus
RENGIPCYFTMDAGPNVKVIV

SEQ ID NO: 2036565 - protein, 24 aa, Staphylococcus
RENIGEPMVHIFKAVRDIVEAFED

SEQ ID NO: 2036566 - protein, 22 aa, Staphylococcus
RENPCGRYKRSFEINDYNEQSD

SEQ ID NO: 2036567 - protein, 23 aa, Staphylococcus
RENRQSIKMELDLRGYRYDEAMV

SEQ ID NO: 2036568 - protein, 17 aa, Staphylococcus
RENWIKAVNEFDVGNLY

SEQ ID NO: 2036569 - protein, 20 aa, Staphylococcus
RENYEALLIYYKESNHNPVV

SEQ ID NO: 2036570 - protein, 20 aa, Staphylococcus
RENYEALLLYYKDSVENPFI

SEQ ID NO: 2036571 - protein, 24 aa, Staphylococcus
REPIECGADLMAGSLIKNPGGGLA

SEQ ID NO: 2036572 - protein, 18 aa, Staphylococcus
REQFGFLLDAFKYGAPPH

SEQ ID NO: 2036573 - protein, 18 aa, Staphylococcus
REQFKRLEREQIFVYICH

SEQ ID NO: 2036574 - protein, 19 aa, Staphylococcus
REQFLKELEDVDACFITLS

SEQ ID NO: 2036575 - protein, 18 aa, Staphylococcus
REQHAIVATTLVSESFNA

SEQ ID NO: 2036576 - protein, 19 aa, Staphylococcus
REQLKVVVQLIDIRHNPTE

SEQ ID NO: 2036577 - protein, 24 aa, Staphylococcus
REQMEALIIIRTCHQVTVNELAEK

SEQ ID NO: 2036578 - protein, 22 aa, Staphylococcus
REQMGVFKLLNEHGSLTINEIA

SEQ ID NO: 2036579 - protein, 19 aa, Staphylococcus
RERAIELLNQVGIPRAAEV

SEQ ID NO: 2036580 - protein, 22 aa, Staphylococcus
RERERKVLQKRQFKKALQQKRH

SEQ ID NO: 2036581 - protein, 18 aa, Staphylococcus
REREWKKRIPRFDIDVNE

SEQ ID NO: 2036582 - protein, 18 aa, Staphylococcus
RERFEIGSNVVKQKRNAD

SEQ ID NO: 2036583 - protein, 23 aa, Staphylococcus
RERFKLKFGQTLDDIFGETIYDL

SEQ ID NO: 2036584 - protein, 20 aa, Staphylococcus
RERGCSNGDIVRILGGEFEF

SEQ ID NO: 2036585 - protein, 24 aa, Staphylococcus
RERHPKDRRSIMIVPQYEDKSEVQ

SEQ ID NO: 2036586 - protein, 27 aa, Staphylococcus
RERKQTRLYLFYGLVFKRYFDEALSAL

SEQ ID NO: 2036587 - protein, 22 aa, Staphylococcus
RERKRCLNMGIADLKKIYFTED

SEQ ID NO: 2036588 - protein, 23 aa, Staphylococcus
RERMYKLIEDFGADTLMHMAALL

SEQ ID NO: 2036589 - protein, 19 aa, Staphylococcus
RERTGAGMMDCKKALEATD

SEQ ID NO: 2036590 - protein, 18 aa, Staphylococcus
RERWAKYRGLIASELILE

SEQ ID NO: 2036591 - protein, 22 aa, Staphylococcus
RERWKLETEFEPKMEDEQRTKL

SEQ ID NO: 2036592 - protein, 24 aa, Staphylococcus
RESEGFKDIRDVLGQVYENAEELD

SEQ ID NO: 2036593 - protein, 27 aa, Staphylococcus
RESISQGYSGLEIDVFDLYSNKSRHIS

SEQ ID NO: 2036594 - protein, 30 aa, Staphylococcus
RESLGFNEKTKWLSVLPIYHISGLSVVLRS

SEQ ID NO: 2036595 - protein, 25 aa, Staphylococcus
RESWILSTFPEWGTWLNEEIENEVV

SEQ ID NO: 2036596 - protein, 17 aa, Staphylococcus
RESYACLSYALNELGYD

SEQ ID NO: 2036597 - protein, 17 aa, Staphylococcus
RETAVSHIGEFSLRGGI

SEQ ID NO: 2036598 - protein, 21 aa, Staphylococcus
RETEARTGFVSKTDEYFYNFF

SEQ ID NO: 2036599 - protein, 21 aa, Staphylococcus
RETEARTGFVSKTDEYFYNFI

SEQ ID NO: 2036600 - protein, 25 aa, Staphylococcus
RETEYDALMAFDLDTLYKMIDLIND

SEQ ID NO: 2036601 - protein, 26 aa, Staphylococcus
RETHKLGIPVMIVFEGVPAAGKTRLS

SEQ ID NO: 2036602 - protein, 18 aa, Staphylococcus
RETKGLEIADNWNMLGMR

SEQ ID NO: 2036603 - protein, 20 aa, Staphylococcus
RETLELFLSLFEHEYNINIS

SEQ ID NO: 2036604 - protein, 19 aa, Staphylococcus
RETSIFPTPVVGMVGLIDD

SEQ ID NO: 2036605 - protein, 18 aa, Staphylococcus
RETYEIMTPQLVGVSTTE

SEQ ID NO: 2036606 - protein, 24 aa, Staphylococcus
RETYNIFQIYAPKIWDELIGMQDV

SEQ ID NO: 2036607 - protein, 20 aa, Staphylococcus
REVDEFAFELPITQTEQQLI

SEQ ID NO: 2036608 - protein, 19 aa, Staphylococcus
REVIEDYTKLRGCQPYYIE

SEQ ID NO: 2036609 - protein, 19 aa, Staphylococcus
REVLIPWEDLPKVKDVWPV

SEQ ID NO: 2036610 - protein, 18 aa, Staphylococcus
REVLIPWEDLPKVKSLWP

SEQ ID NO: 2036611 - protein, 19 aa, Staphylococcus
REVLIPWEDLPKVKSLWPQ

SEQ ID NO: 2036612 - protein, 19 aa, Staphylococcus
REVLIPWEDLPKVKTLWPE

SEQ ID NO: 2036613 - protein, 18 aa, Staphylococcus
REVLVPWEDLPKIKELWP

SEQ ID NO: 2036614 - protein, 18 aa, Staphylococcus
REVLVPWEDLPKVKDIWP

SEQ ID NO: 2036615 - protein, 19 aa, Staphylococcus
REVMFREFYYVLMAQYPHI

SEQ ID NO: 2036616 - protein, 19 aa, Staphylococcus
REVNLPVIGIVKRDYANSD

SEQ ID NO: 2036617 - protein, 20 aa, Staphylococcus
REVPLTIVIIGEMLDTTRLK

SEQ ID NO: 2036618 - protein, 25 aa, Staphylococcus
REVSQRLNKTIAIMLDTKGPEIRTH

SEQ ID NO: 2036619 - protein, 19 aa, Staphylococcus
REWVEAIRVARNILSQPAM

SEQ ID NO: 2036620 - protein, 24 aa, Staphylococcus
REYAHALSKAGADVIIGHNSVIQK

SEQ ID NO: 2036621 - protein, 22 aa, Staphylococcus
REYIPVLMFSPKMTDYHELTID

SEQ ID NO: 2036622 - protein, 20 aa, Staphylococcus
REYLNYTYSKFFEKMKPQIA

SEQ ID NO: 2036623 - protein, 19 aa, Staphylococcus
REYNGMKVPDVLLSGNHAH

SEQ ID NO: 2036624 - protein, 20 aa, Staphylococcus
REYNKSKIWLGVWENNPSAI

SEQ ID NO: 2036625 - protein, 29 aa, Staphylococcus
RFADFDFKEVRKHWELKLNQYSEREQSLR

SEQ ID NO: 2036626 - protein, 26 aa, Staphylococcus
RFAEGIEVGQVFKLGTKYSESMNATF

SEQ ID NO: 2036627 - protein, 17 aa, Staphylococcus
RFAELVLTANPAKSEDA

SEQ ID NO: 2036628 - protein, 23 aa, Staphylococcus
RFAELWHNPQFQQIVKRLDFIYR

SEQ ID NO: 2036629 - protein, 26 aa, Staphylococcus
RFAHDFNPLYFKKLWLEAWEETHERE

SEQ ID NO: 2036630 - protein, 17 aa, Staphylococcus
RFAKEVSNQIVFIHEGK

SEQ ID NO: 2036631 - protein, 23 aa, Staphylococcus
RFAKRFESFGTRVVLGRFSMILS

SEQ ID NO: 2036632 - protein, 29 aa, Staphylococcus
RFANDWSEIRPEWGLARNAEFIIGQRNIT

SEQ ID NO: 2036633 - protein, 28 aa, Staphylococcus
RFANDWSEIRPEWGLARNAEFIIGQRSI

SEQ ID NO: 2036634 - protein, 25 aa, Staphylococcus
RFASEGKPVLGVCNGFQILTEIGLL

SEQ ID NO: 2036635 - protein, 20 aa, Staphylococcus
RFCHPSELTINVDIDIPEKA

SEQ ID NO: 2036636 - protein, 18 aa, Staphylococcus
RFCQCIQAASPINAHFSP

SEQ ID NO: 2036637 - protein, 18 aa, Staphylococcus
RFDKQNILKGILPDNDIF

SEQ ID NO: 2036638 - protein, 24 aa, Staphylococcus
RFDKSPYDGFAIRSKDSIGASGEH

SEQ ID NO: 2036639 - protein, 17 aa, Staphylococcus
RFDNWKLDINAITLQQA

SEQ ID NO: 2036640 - protein, 20 aa, Staphylococcus
RFDPDYIFVGMGFPKQEEWI

SEQ ID NO: 2036641 - protein, 18 aa, Staphylococcus
RFDVNAGIIGDSKLALQQ

SEQ ID NO: 2036642 - protein, 23 aa, Staphylococcus
RFEAATNFVHRGLGYAVIPRVYY

SEQ ID NO: 2036643 - protein, 23 aa, Staphylococcus
RFEAATTFVHRGLGYTIIPRFYY

SEQ ID NO: 2036644 - protein, 20 aa, Staphylococcus
RFEDELNHWADANATDLLNE

SEQ ID NO: 2036645 - protein, 21 aa, Staphylococcus
RFEFNGHRIVSFSGGRMLIHG

SEQ ID NO: 2036646 - protein, 25 aa, Staphylococcus
RFEQTKHNIGFEVIDYLLESNQFKL

SEQ ID NO: 2036647 - protein, 21 aa, Staphylococcus
RFESKLFMFSKEGWQKLDDSE

SEQ ID NO: 2036648 - protein, 17 aa, Staphylococcus
RFETARLSNYISGENHP

SEQ ID NO: 2036649 - protein, 25 aa, Staphylococcus
RFFPKDKSAAVLGLFTSKNGDLEDK

SEQ ID NO: 2036650 - protein, 19 aa, Staphylococcus
RFGDLIYDTLGFKPTDEHV

SEQ ID NO: 2036651 - protein, 19 aa, Staphylococcus
RFGDPEAQVLLAHLESDLM

SEQ ID NO: 2036652 - protein, 20 aa, Staphylococcus
RFGDPEAQVLLTRMESDLMQ

SEQ ID NO: 2036653 - protein, 20 aa, Staphylococcus
RFGDPEAQVLLTRMNSDLMH

SEQ ID NO: 2036654 - protein, 18 aa, Staphylococcus
RFGHYLVVIHPTIPKQQL

SEQ ID NO: 2036655 - protein, 19 aa, Staphylococcus
RFGQFVFPREVLVKQHIIS

SEQ ID NO: 2036656 - protein, 19 aa, Staphylococcus
RFGQPKAFATIDNEPFYKK

SEQ ID NO: 2036657 - protein, 26 aa, Staphylococcus
RFIEQTICGKKMLFIHYEIDNSKLNT

SEQ ID NO: 2036658 - protein, 20 aa, Staphylococcus
RFIERGIIEVAPLAYMRGRT

SEQ ID NO: 2036659 - protein, 20 aa, Staphylococcus
RFIERGTIEIAPLAYMRGRT

SEQ ID NO: 2036660 - protein, 27 aa, Staphylococcus
RFIKSCPNLKWIAWYATGVNNLPLEYI

SEQ ID NO: 2036661 - protein, 18 aa, Staphylococcus
RFILLKPNMALRHLTDQI

SEQ ID NO: 2036662 - protein, 22 aa, Staphylococcus
RFINLMGGEMLSFYDWYADLPP

SEQ ID NO: 2036663 - protein, 18 aa, Staphylococcus
RFINRSSVSNAILNQHYE

SEQ ID NO: 2036664 - protein, 21 aa, Staphylococcus
RFISIMAGLSIDYIREQLNTN

SEQ ID NO: 2036665 - protein, 25 aa, Staphylococcus
RFKDGECHFDISVNCGKGTYIRTLA

SEQ ID NO: 2036666 - protein, 18 aa, Staphylococcus
RFKETFHAVQSHFSDVFK

SEQ ID NO: 2036667 - protein, 20 aa, Staphylococcus
RFKHAQLKTSWSSPYQAMRV

SEQ ID NO: 2036668 - protein, 21 aa, Staphylococcus
RFKSSKSYKLHRLVTTIKRTI

SEQ ID NO: 2036669 - protein, 19 aa, Staphylococcus
RFKYIASLVSSGHDSIDVI

SEQ ID NO: 2036670 - protein, 27 aa, Staphylococcus
RFKYYKDRVLVPLAYLKFDEYIEELTN

SEQ ID NO: 2036671 - protein, 17 aa, Staphylococcus
RFLFFINKLPGITIKEL

SEQ ID NO: 2036672 - protein, 19 aa, Staphylococcus
RFLKERKSGSAVRLEVDGR

SEQ ID NO: 2036673 - protein, 18 aa, Staphylococcus
RFLKERKSGSAVRLEVDN

SEQ ID NO: 2036674 - protein, 19 aa, Staphylococcus
RFLSHEDYLLFTHAIEEEF

SEQ ID NO: 2036675 - protein, 20 aa, Staphylococcus
RFMNFIKNRIEQYSIEHTHI

SEQ ID NO: 2036676 - protein, 24 aa, Staphylococcus
RFNDYPVEVERLLDIVEIKVHALH

SEQ ID NO: 2036677 - protein, 21 aa, Staphylococcus
RFNDYPVEVERLLEMVEIKIH

SEQ ID NO: 2036678 - protein, 21 aa, Staphylococcus
RFNEDALRILRGLRFKSQLRF

SEQ ID NO: 2036679 - protein, 19 aa, Staphylococcus
RFNEYPIQVERLLDIVEMR

SEQ ID NO: 2036680 - protein, 21 aa, Staphylococcus
RFNIEPLVHITCRDRNLIGLQ

SEQ ID NO: 2036681 - protein, 23 aa, Staphylococcus
RFNKSPYDGFAIRSEDSAGAFSK

SEQ ID NO: 2036682 - protein, 22 aa, Staphylococcus
RFNKSPYDGFAIRSEDSAGAYH

SEQ ID NO: 2036683 - protein, 23 aa, Staphylococcus
RFNKSPYDGFAIRSEDSKDASGE

SEQ ID NO: 2036684 - protein, 24 aa, Staphylococcus
RFNKSPYDGFAIRSKDSAGAYSEN

SEQ ID NO: 2036685 - protein, 17 aa, Staphylococcus
RFNSELFVFKANGWQKI

SEQ ID NO: 2036686 - protein, 19 aa, Staphylococcus
RFPEADIYITSRGDRKEIQ

SEQ ID NO: 2036687 - protein, 24 aa, Staphylococcus
RFPEYKTKINTIFNLKRFAQSMEY

SEQ ID NO: 2036688 - protein, 26 aa, Staphylococcus
RFPVIDENWRLVGIVTSKEIIKMENQ

SEQ ID NO: 2036689 - protein, 20 aa, Staphylococcus
RFPYSKGRMKEADYEQVDYA

SEQ ID NO: 2036690 - protein, 19 aa, Staphylococcus
RFPYSKGRMKKEDHEKVAY

SEQ ID NO: 2036691 - protein, 20 aa, Staphylococcus
RFQKYLNQDVQIFTSLIVRE

SEQ ID NO: 2036692 - protein, 17 aa, Staphylococcus
RFQPGEVLTAKLNQIEK

SEQ ID NO: 2036693 - protein, 17 aa, Staphylococcus
RFQQINWGANLHITGTN

SEQ ID NO: 2036694 - protein, 20 aa, Staphylococcus
RFRDYLLELVDTFDIRSQYY

SEQ ID NO: 2036695 - protein, 21 aa, Staphylococcus
RFRPFPFWKRVHDSFIESEDD

SEQ ID NO: 2036696 - protein, 18 aa, Staphylococcus
RFSEGYGPNELAFRNAYD

SEQ ID NO: 2036697 - protein, 20 aa, Staphylococcus
RFSIEGVDALVPMLQHTITL

SEQ ID NO: 2036698 - protein, 20 aa, Staphylococcus
RFSIEGVDTLVPMLQETLRR

SEQ ID NO: 2036699 - protein, 19 aa, Staphylococcus
RFSIEGVDTLVPMLQHTLR

SEQ ID NO: 2036700 - protein, 20 aa, Staphylococcus
RFSIEGVDTLVPMLQQTLRI

SEQ ID NO: 2036701 - protein, 18 aa, Staphylococcus
RFSKETIHKVMDAKEKLG

SEQ ID NO: 2036702 - protein, 22 aa, Staphylococcus
RFSPEAWYGMIEEFKVTVWYTA

SEQ ID NO: 2036703 - protein, 19 aa, Staphylococcus
RFTNGLSVNDFLTRHSVID

SEQ ID NO: 2036704 - protein, 19 aa, Staphylococcus
RFTNGLTVNDFLTSHSVIS

SEQ ID NO: 2036705 - protein, 21 aa, Staphylococcus
RFTPDGNIEFLGRIDKQVKVN

SEQ ID NO: 2036706 - protein, 22 aa, Staphylococcus
RFTPIKKDSGCTVFLGNDYLVR

SEQ ID NO: 2036707 - protein, 17 aa, Staphylococcus
RFTRSHLGIAYTSQRVS

SEQ ID NO: 2036708 - protein, 24 aa, Staphylococcus
RFTTFEHIEMSPLIVVKKDGTREQ

SEQ ID NO: 2036709 - protein, 33 aa, Staphylococcus
RFVAKSGWTDIFIFPGFNFKAIDGLITNFHLPK

SEQ ID NO: 2036710 - protein, 21 aa, Staphylococcus
RFVDALDLFSLLANVGDSKSL

SEQ ID NO: 2036711 - protein, 21 aa, Staphylococcus
RFVDKLQLFSLLANVGDSKSL

SEQ ID NO: 2036712 - protein, 18 aa, Staphylococcus
RFVGSKMKQFLEDNFKKI

SEQ ID NO: 2036713 - protein, 19 aa, Staphylococcus
RFVKDVYFIQVSSLANRTD

SEQ ID NO: 2036714 - protein, 19 aa, Staphylococcus
RFVNYFKDYQIEVDGKQAD

SEQ ID NO: 2036715 - protein, 18 aa, Staphylococcus
RFWTIEGNNNTAFIKNLD

SEQ ID NO: 2036716 - protein, 25 aa, Staphylococcus
RFYRPAIKALHHLGATDVIQSGRND

SEQ ID NO: 2036717 - protein, 18 aa, Staphylococcus
RFYRPAIQALHNLGATDV

SEQ ID NO: 2036718 - protein, 20 aa, Staphylococcus
RFYTDEEIMCYSIHETGKFL

SEQ ID NO: 2036719 - protein, 27 aa, Staphylococcus
RGAADMKSGLAALVIAMIEIKASGQLK

SEQ ID NO: 2036720 - protein, 22 aa, Staphylococcus
RGAKNIRFMCLIAAPEGVEKLQ

SEQ ID NO: 2036721 - protein, 22 aa, Staphylococcus
RGAKNIRFMCLIAAPEGVEKMQ

SEQ ID NO: 2036722 - protein, 17 aa, Staphylococcus
RGALILVENGIEPVFSV

SEQ ID NO: 2036723 - protein, 22 aa, Staphylococcus
RGAMKRIDFKVLQLAKRAQRGI

SEQ ID NO: 2036724 - protein, 26 aa, Staphylococcus
RGDAEGRYGNFAKYFTTNNVPAFAIC

SEQ ID NO: 2036725 - protein, 20 aa, Staphylococcus
RGDDSIAIFKLSDEGAHLEL

SEQ ID NO: 2036726 - protein, 18 aa, Staphylococcus
RGDLRNILIDSLKEDTIA

SEQ ID NO: 2036727 - protein, 18 aa, Staphylococcus
RGDLRQILIDSLPNETIG

SEQ ID NO: 2036728 - protein, 18 aa, Staphylococcus
RGDVVGIFAPNDVAVIDL

SEQ ID NO: 2036729 - protein, 29 aa, Staphylococcus
RGEAKRKANELIELVGLKGRENAYPSELS

SEQ ID NO: 2036730 - protein, 40 aa, Staphylococcus
RGEDNEIWEEFGFPSQRTFLKRFKETYHMTPRDFILKTQF

SEQ ID NO: 2036731 - protein, 17 aa, Staphylococcus
RGEVASLTAFILPQQKV

SEQ ID NO: 2036732 - protein, 24 aa, Staphylococcus
RGEYRDCYVMGLLKRNWVNQQDDD

SEQ ID NO: 2036733 - protein, 17 aa, Staphylococcus
RGFKAGHTVDVILTESH

SEQ ID NO: 2036734 - protein, 17 aa, Staphylococcus
RGFKAGHTVDVILTESN

SEQ ID NO: 2036735 - protein, 19 aa, Staphylococcus
RGGADVVIDCVGMDGQVAQ

SEQ ID NO: 2036736 - protein, 17 aa, Staphylococcus
RGGEVLLNNCLKRVKQL

SEQ ID NO: 2036737 - protein, 22 aa, Staphylococcus
RGGFTTVCPMPNTRPVPDSVEH

SEQ ID NO: 2036738 - protein, 22 aa, Staphylococcus
RGGFTTVCPMPNTRPVPDSVTH

SEQ ID NO: 2036739 - protein, 22 aa, Staphylococcus
RGGFTTVCPMPNTRPVPDTVEH

SEQ ID NO: 2036740 - protein, 21 aa, Staphylococcus
RGGFTTVCPMPNTRRVPDTVE

SEQ ID NO: 2036741 - protein, 20 aa, Staphylococcus
RGGGSIEDLWNFNEEDVVKA

SEQ ID NO: 2036742 - protein, 19 aa, Staphylococcus
RGGGSIEDLWNFNEEEVVK

SEQ ID NO: 2036743 - protein, 17 aa, Staphylococcus
RGGGYQKIEIDSFPDQQ

SEQ ID NO: 2036744 - protein, 17 aa, Staphylococcus
RGGIYLNNFDTGEVAHN

SEQ ID NO: 2036745 - protein, 18 aa, Staphylococcus
RGGKTLKGEVNISGAKNS

SEQ ID NO: 2036746 - protein, 17 aa, Staphylococcus
RGGMPSEGGFGVTVAEL

SEQ ID NO: 2036747 - protein, 17 aa, Staphylococcus
RGGQTLKGDVTISGAKN

SEQ ID NO: 2036748 - protein, 18 aa, Staphylococcus
RGGSLLIRQMLRSPEMGL

SEQ ID NO: 2036749 - protein, 19 aa, Staphylococcus
RGGSLLIRQMMNTPYMGME

SEQ ID NO: 2036750 - protein, 20 aa, Staphylococcus
RGGTFLFSARCPEFKEEEVR

SEQ ID NO: 2036751 - protein, 20 aa, Staphylococcus
RGGTFLFSARCPQFKEEDVR

SEQ ID NO: 2036752 - protein, 19 aa, Staphylococcus
RGHFDWGGVHIENNHEPII

SEQ ID NO: 2036753 - protein, 19 aa, Staphylococcus
RGHLNEVLLSMGISESRIE

SEQ ID NO: 2036754 - protein, 19 aa, Staphylococcus
RGIAEPKVSLLNIGTEAAK

SEQ ID NO: 2036755 - protein, 23 aa, Staphylococcus
RGIDEHLIRLSIGIEDYKDIEAD

SEQ ID NO: 2036756 - protein, 23 aa, Staphylococcus
RGIDEHLIRLSIGIEDYNDIESD

SEQ ID NO: 2036757 - protein, 23 aa, Staphylococcus
RGIDEHLIRLSVGIEDYHDIEAD

SEQ ID NO: 2036758 - protein, 23 aa, Staphylococcus
RGIGIEEVRKLNDFAINGLYPDL

SEQ ID NO: 2036759 - protein, 19 aa, Staphylococcus
RGIGYLFQDYQLFPNMTVM

SEQ ID NO: 2036760 - protein, 19 aa, Staphylococcus
RGINDFVFETVPNFEEIKA

SEQ ID NO: 2036761 - protein, 25 aa, Staphylococcus
RGIPGERLDILIVVDMFLTGFDSKK

SEQ ID NO: 2036762 - protein, 23 aa, Staphylococcus
RGIPKGFRNMHGFGSHTYSMYND

SEQ ID NO: 2036763 - protein, 19 aa, Staphylococcus
RGIPQIEVTFDIDKNGIVN

SEQ ID NO: 2036764 - protein, 19 aa, Staphylococcus
RGISKAHAQLDEWLKDIAP

SEQ ID NO: 2036765 - protein, 20 aa, Staphylococcus
RGIVKRSALSNFSRINKNGK

SEQ ID NO: 2036766 - protein, 22 aa, Staphylococcus
RGKDESFPFLVFGPGEKPHQVD

SEQ ID NO: 2036767 - protein, 17 aa, Staphylococcus
RGKEIVVSPDPSMNIEF

SEQ ID NO: 2036768 - protein, 20 aa, Staphylococcus
RGKFEDFVRYALLKREFQSK

SEQ ID NO: 2036769 - protein, 25 aa, Staphylococcus
RGKLICPNCGYALTLNSQKRKRKND

SEQ ID NO: 2036770 - protein, 22 aa, Staphylococcus
RGKSAGEAIAILKLKNKASSPV

SEQ ID NO: 2036771 - protein, 24 aa, Staphylococcus
RGKVGRATGHLMSMLVTLKGLPLA

SEQ ID NO: 2036772 - protein, 24 aa, Staphylococcus
RGLAGIGRYLLNRVDANPKVISSL

SEQ ID NO: 2036773 - protein, 18 aa, Staphylococcus
RGLFIVPLNGLKKWLTPV

SEQ ID NO: 2036774 - protein, 25 aa, Staphylococcus
RGLIYKERNNVLALNDFSQFDIGRM

SEQ ID NO: 2036775 - protein, 22 aa, Staphylococcus
RGLKILTEVELSYLISEAPIIG

SEQ ID NO: 2036776 - protein, 19 aa, Staphylococcus
RGLNSNWDMLFIALSIHLI

SEQ ID NO: 2036777 - protein, 18 aa, Staphylococcus
RGLSATIEEFIFAAEYIA

SEQ ID NO: 2036778 - protein, 26 aa, Staphylococcus
RGLSTPRAHIIGSLIHMRCNRVFGVN

SEQ ID NO: 2036779 - protein, 17 aa, Staphylococcus
RGLWKDKDAIVIYTIGG

SEQ ID NO: 2036780 - protein, 18 aa, Staphylococcus
RGLYKFANSEWNRVDIPW

SEQ ID NO: 2036781 - protein, 28 aa, Staphylococcus
RGMATWKYDKARGRLVGTIEVPMTLAIV

SEQ ID NO: 2036782 - protein, 18 aa, Staphylococcus
RGMHGDWKVIPTHEDIHR

SEQ ID NO: 2036783 - protein, 17 aa, Staphylococcus
RGMLKRMIGHPKKNIEA

SEQ ID NO: 2036784 - protein, 18 aa, Staphylococcus
RGMLRRMVGHPKKDEEAY

SEQ ID NO: 2036785 - protein, 19 aa, Staphylococcus
RGMLRRMVGHPKKDHEAYE

SEQ ID NO: 2036786 - protein, 18 aa, Staphylococcus
RGMLRRMVGHPKKDKEAY

SEQ ID NO: 2036787 - protein, 23 aa, Staphylococcus
RGMPKGFRNMHGFGSHTYSMYND

SEQ ID NO: 2036788 - protein, 20 aa, Staphylococcus
RGNLKDSEAFELLKKQFIGE

SEQ ID NO: 2036789 - protein, 29 aa, Staphylococcus
RGNSGVILSQLFRGFCKNIENNDEINAQQ

SEQ ID NO: 2036790 - protein, 19 aa, Staphylococcus
RGNSKYLFNYFVKHNATVE

SEQ ID NO: 2036791 - protein, 23 aa, Staphylococcus
RGPNIKLPDLDILNDAQPQEIDE

SEQ ID NO: 2036792 - protein, 26 aa, Staphylococcus
RGPNIKLPSIELLEAPKQHEIDNAWI

SEQ ID NO: 2036793 - protein, 24 aa, Staphylococcus
RGPNIKLPSLDLLEDHEEHEIDES

SEQ ID NO: 2036794 - protein, 23 aa, Staphylococcus
RGQNARLAAKLTGWKIDIKSETD

SEQ ID NO: 2036795 - protein, 24 aa, Staphylococcus
RGQYAPMRLFKHSKTTLIKLLRNP

SEQ ID NO: 2036796 - protein, 25 aa, Staphylococcus
RGQYKGEAFTLFTPDEEELVGEIED

SEQ ID NO: 2036797 - protein, 31 aa, Staphylococcus
RGRIINMVATYAWRAGIGVIHSASAKAGVLS

SEQ ID NO: 2036798 - protein, 18 aa, Staphylococcus
RGRKATAFAYEHFKNFNK

SEQ ID NO: 2036799 - protein, 29 aa, Staphylococcus
RGRMRKLCRPETPAIIVTRGLEPPQELIE

SEQ ID NO: 2036800 - protein, 17 aa, Staphylococcus
RGRVLGVSQNTRYHQQE

SEQ ID NO: 2036801 - protein, 25 aa, Staphylococcus
RGSAKSVGALYPWGLSEAKDYAQVI

SEQ ID NO: 2036802 - protein, 24 aa, Staphylococcus
RGSFIESFPLFGYDLDDYDRLFVE

SEQ ID NO: 2036803 - protein, 25 aa, Staphylococcus
RGSFIESFPLFGYNLKDYEQLFNEK

SEQ ID NO: 2036804 - protein, 24 aa, Staphylococcus
RGSFIESFPLFGYNLNDYEDLFNE

SEQ ID NO: 2036805 - protein, 17 aa, Staphylococcus
RGSGHLIDYSATKGAIV

SEQ ID NO: 2036806 - protein, 20 aa, Staphylococcus
RGSGKICLNGAAARLVEVED

SEQ ID NO: 2036807 - protein, 20 aa, Staphylococcus
RGSGKICLNGAASRLVEVDD

SEQ ID NO: 2036808 - protein, 19 aa, Staphylococcus
RGSGKICLNGAASRLVEVG

SEQ ID NO: 2036809 - protein, 17 aa, Staphylococcus
RGSGRKAFIESHWGPQN

SEQ ID NO: 2036810 - protein, 17 aa, Staphylococcus
RGSGRKAFIETHWGSQH

SEQ ID NO: 2036811 - protein, 17 aa, Staphylococcus
RGSGRKSFIETHWGSQN

SEQ ID NO: 2036812 - protein, 21 aa, Staphylococcus
RGSLKRIGFKVLQTAKRAQRG

SEQ ID NO: 2036813 - protein, 17 aa, Staphylococcus
RGTGKTHFRGIDAGSDV

SEQ ID NO: 2036814 - protein, 18 aa, Staphylococcus
RGTGKTSIAKVFAKAINC

SEQ ID NO: 2036815 - protein, 21 aa, Staphylococcus
RGTSIFPTPVVGMVGLIDDVN

SEQ ID NO: 2036816 - protein, 21 aa, Staphylococcus
RGTSIFPTPVVGMVGLIEDIN

SEQ ID NO: 2036817 - protein, 27 aa, Staphylococcus
RGTTDMKGALMGMVIALIELKLSGDLS

SEQ ID NO: 2036818 - protein, 17 aa, Staphylococcus
RGTVGRIVEEILKHVDF

SEQ ID NO: 2036819 - protein, 18 aa, Staphylococcus
RGVCTRVGTMTPRKPNSA

SEQ ID NO: 2036820 - protein, 25 aa, Staphylococcus
RGVEFKIATPIVACNEKGFVVEVDG

SEQ ID NO: 2036821 - protein, 25 aa, Staphylococcus
RGVEFKIATPIVACNEKGFVVEVNG

SEQ ID NO: 2036822 - protein, 25 aa, Staphylococcus
RGVEFKIATPIVACNEKGFVVKIND

SEQ ID NO: 2036823 - protein, 20 aa, Staphylococcus
RGVRYVLNDVVKRTAGVTDI

SEQ ID NO: 2036824 - protein, 19 aa, Staphylococcus
RGVRYVLNDVVKRTAGVTE

SEQ ID NO: 2036825 - protein, 19 aa, Staphylococcus
RGVRYVLNDVVKRTSGVTN

SEQ ID NO: 2036826 - protein, 21 aa, Staphylococcus
RGYDVFLEIEVEGAKQVRKKF

SEQ ID NO: 2036827 - protein, 18 aa, Staphylococcus
RGYYPGYATKMFEREGFD

SEQ ID NO: 2036828 - protein, 17 aa, Staphylococcus
RGYYPGYATKMFGRENI

SEQ ID NO: 2036829 - protein, 18 aa, Staphylococcus
RHADAGLLYISYITNPTT

SEQ ID NO: 2036830 - protein, 23 aa, Staphylococcus
RHAKVFRIGDKVTVKVTHVDVDE

SEQ ID NO: 2036831 - protein, 23 aa, Staphylococcus
RHDLKLNTFITHVDYYFLDKYAK

SEQ ID NO: 2036832 - protein, 18 aa, Staphylococcus
RHDYFRRILSSFIGDLVE

SEQ ID NO: 2036833 - protein, 18 aa, Staphylococcus
RHDYFRRILSTFIGDLVE

SEQ ID NO: 2036834 - protein, 18 aa, Staphylococcus
RHEFMKSFVSQFFDEWHY

SEQ ID NO: 2036835 - protein, 22 aa, Staphylococcus
RHFAESLSIPFYYVPNNKEKQE

SEQ ID NO: 2036836 - protein, 19 aa, Staphylococcus
RHFDRRITIVDGQITKQEE

SEQ ID NO: 2036837 - protein, 17 aa, Staphylococcus
RHFLFSTARGYQMLDGE

SEQ ID NO: 2036838 - protein, 21 aa, Staphylococcus
RHFLWSTAHGYQLYEKDTDIW

SEQ ID NO: 2036839 - protein, 18 aa, Staphylococcus
RHFLWSTAQGYQIYEEDA

SEQ ID NO: 2036840 - protein, 26 aa, Staphylococcus
RHFNDKYHLLNHVVGILIDHFRELYL

SEQ ID NO: 2036841 - protein, 20 aa, Staphylococcus
RHFYEKYGLFSNDKYHTVAF

SEQ ID NO: 2036842 - protein, 17 aa, Staphylococcus
RHGEDCLFCLQTLEEQS

SEQ ID NO: 2036843 - protein, 19 aa, Staphylococcus
RHGEFPSVRGNMIDITLKH

SEQ ID NO: 2036844 - protein, 26 aa, Staphylococcus
RHGIDLKRANALLLNHYGVPFDNIYI

SEQ ID NO: 2036845 - protein, 25 aa, Staphylococcus
RHGLFKTEMGLLMLGKADIAFSLNK

SEQ ID NO: 2036846 - protein, 19 aa, Staphylococcus
RHGQTIFNKKCQIQGASDS

SEQ ID NO: 2036847 - protein, 20 aa, Staphylococcus
RHGQTLFNLKGRIQGSSDSP

SEQ ID NO: 2036848 - protein, 21 aa, Staphylococcus
RHGQTVFNLKGRIQGASDSPL

SEQ ID NO: 2036849 - protein, 20 aa, Staphylococcus
RHGTMPLTMFITKRGKQVKV

SEQ ID NO: 2036850 - protein, 19 aa, Staphylococcus
RHGTMPLTMYITKKGKQVK

SEQ ID NO: 2036851 - protein, 24 aa, Staphylococcus
RHHTFFEMLGNFSIGDYFKKEAIE

SEQ ID NO: 2036852 - protein, 22 aa, Staphylococcus
RHHTFFEMLGNFSIGDYFKQEA

SEQ ID NO: 2036853 - protein, 21 aa, Staphylococcus
RHHTSFNFFSLFTFSEPIEQV

SEQ ID NO: 2036854 - protein, 18 aa, Staphylococcus
RHIEVCTPKDIYNEELTE

SEQ ID NO: 2036855 - protein, 21 aa, Staphylococcus
RHIRHCYKADPDYGKGVAKAL

SEQ ID NO: 2036856 - protein, 23 aa, Staphylococcus
RHIRHCYKADPEYGKGVAKALEI

SEQ ID NO: 2036857 - protein, 19 aa, Staphylococcus
RHIRHCYKADSEYGKGVAK

SEQ ID NO: 2036858 - protein, 18 aa, Staphylococcus
RHITSLSGGETFQASLAL

SEQ ID NO: 2036859 - protein, 17 aa, Staphylococcus
RHITVDSYIEWVNGELN

SEQ ID NO: 2036860 - protein, 25 aa, Staphylococcus
RHIVPYPPGVPILFKGEKITLNMIK

SEQ ID NO: 2036861 - protein, 22 aa, Staphylococcus
RHKGSMPRELYLRLKKHIQSGR

SEQ ID NO: 2036862 - protein, 17 aa, Staphylococcus
RHKVRGIEFPGGKVECG

SEQ ID NO: 2036863 - protein, 21 aa, Staphylococcus
RHLAALSFLTFVALDDNGKPI

SEQ ID NO: 2036864 - protein, 19 aa, Staphylococcus
RHLDLFPVGRLDKDTEGLL

SEQ ID NO: 2036865 - protein, 23 aa, Staphylococcus
RHLEKKRVVIFAAGIGNPYFSTD

SEQ ID NO: 2036866 - protein, 17 aa, Staphylococcus
RHLLKGNVVFIFQYGEE

SEQ ID NO: 2036867 - protein, 20 aa, Staphylococcus
RHLSHLYGAYVNSFVSKFKD

SEQ ID NO: 2036868 - protein, 20 aa, Staphylococcus
RHLSPEFAQIIATILASHDI

SEQ ID NO: 2036869 - protein, 19 aa, Staphylococcus
RHMALDIVNLLAKRLKQQY

SEQ ID NO: 2036870 - protein, 22 aa, Staphylococcus
RHMALEIVDLLAKRLKKEYGLT

SEQ ID NO: 2036871 - protein, 35 aa, Staphylococcus
RHMALEIVDLLSKRLKSEFGLKFDKCATKHLTISG

SEQ ID NO: 2036872 - protein, 25 aa, Staphylococcus
RHMHRHCARIVGGALNLADKIMDGT

SEQ ID NO: 2036873 - protein, 22 aa, Staphylococcus
RHNEELKDCYGILPEEKVLIHV

SEQ ID NO: 2036874 - protein, 25 aa, Staphylococcus
RHPDFKKGDFVLGAMPWCLYNTVDG

SEQ ID NO: 2036875 - protein, 18 aa, Staphylococcus
RHPHLKYQSQIAIDLNNT

SEQ ID NO: 2036876 - protein, 17 aa, Staphylococcus
RHPHRVDMAIGRSPSFN

SEQ ID NO: 2036877 - protein, 23 aa, Staphylococcus
RHPLPVPRFKYFKLKCNRQQQTL

SEQ ID NO: 2036878 - protein, 21 aa, Staphylococcus
RHPNRKVSILIGGGSGHEPGF

SEQ ID NO: 2036879 - protein, 24 aa, Staphylococcus
RHPSIKSKKFQVAVNEEFVQDEDI

SEQ ID NO: 2036880 - protein, 17 aa, Staphylococcus
RHRCEVMSLEVRVDNTV

SEQ ID NO: 2036881 - protein, 21 aa, Staphylococcus
RHRLYRLSYQLHIEPLLNKYP

SEQ ID NO: 2036882 - protein, 26 aa, Staphylococcus
RHSKHPQLLCDFYSSGIIEVLKQWQK

SEQ ID NO: 2036883 - protein, 19 aa, Staphylococcus
RHTKMIGAIIPRMNSHAVD

SEQ ID NO: 2036884 - protein, 18 aa, Staphylococcus
RHWRRIIDREYTEVKVNN

SEQ ID NO: 2036885 - protein, 22 aa, Staphylococcus
RHYELGQLLNIINNCAETDYKL

SEQ ID NO: 2036886 - protein, 21 aa, Staphylococcus
RHYIIRDALRHALKALDLDVL

SEQ ID NO: 2036887 - protein, 22 aa, Staphylococcus
RHYLNQRLVNIGGHVGYGVCKS

SEQ ID NO: 2036888 - protein, 17 aa, Staphylococcus
RHYLVRSTRQGIMKREV

SEQ ID NO: 2036889 - protein, 19 aa, Staphylococcus
RHYSIRNALRTALKSLDLE

SEQ ID NO: 2036890 - protein, 28 aa, Staphylococcus
RIADEAYPSIIRRGGGYRGIDIDAFPNE

SEQ ID NO: 2036891 - protein, 19 aa, Staphylococcus
RIAGFAFADAKALEEHQAF

SEQ ID NO: 2036892 - protein, 21 aa, Staphylococcus
RIANLELNFDKFAGFKSYRFL

SEQ ID NO: 2036893 - protein, 24 aa, Staphylococcus
RIAPHPFINFLNYVLLAKSDADMA

SEQ ID NO: 2036894 - protein, 21 aa, Staphylococcus
RIAPHPFINVLLHALLQTSGA

SEQ ID NO: 2036895 - protein, 21 aa, Staphylococcus
RIAPLIKCFPPEMSLDHVIEK

SEQ ID NO: 2036896 - protein, 18 aa, Staphylococcus
RIAQGVVGINAFKGVSFG

SEQ ID NO: 2036897 - protein, 18 aa, Staphylococcus
RIARLVIKLVRKIVNSQN

SEQ ID NO: 2036898 - protein, 26 aa, Staphylococcus
RIASPEFMFPSFYGIDVSTTAELISS

SEQ ID NO: 2036899 - protein, 20 aa, Staphylococcus
RIATEVQFLLANYVFQTLGY

SEQ ID NO: 2036900 - protein, 24 aa, Staphylococcus
RICESIKYYLGLTEEIPKEFEKLK

SEQ ID NO: 2036901 - protein, 19 aa, Staphylococcus
RIDIHLIAFDEAHCISKWG

SEQ ID NO: 2036902 - protein, 17 aa, Staphylococcus
RIDILKVGHHGSKTSSS

SEQ ID NO: 2036903 - protein, 35 aa, Staphylococcus
RIDKLLSDYNHDWSRSQIQDWIKHELVIVNGKAIK

SEQ ID NO: 2036904 - protein, 32 aa, Staphylococcus
RIDKVSAKRIIDFLSGTVYAIGGDIQRVGSDI

SEQ ID NO: 2036905 - protein, 31 aa, Staphylococcus
RIDKVSAKRIIDFLSGTVYAIGGDIQRVGTD

SEQ ID NO: 2036906 - protein, 18 aa, Staphylococcus
RIDLRGMLKRMIGHPKKN

SEQ ID NO: 2036907 - protein, 32 aa, Staphylococcus
RIDNVSAKRIIDFLSGTVYAIGGDIQRVGNDI

SEQ ID NO: 2036908 - protein, 19 aa, Staphylococcus
RIDPPLPFNTRKTILRRAA

SEQ ID NO: 2036909 - protein, 17 aa, Staphylococcus
RIDQCRRKFLLEFFGES

SEQ ID NO: 2036910 - protein, 24 aa, Staphylococcus
RIDQRESFEIADLERLFKTLKDLQ

SEQ ID NO: 2036911 - protein, 20 aa, Staphylococcus
RIDSQIKLRGYRIELSEIEE

SEQ ID NO: 2036912 - protein, 22 aa, Staphylococcus
RIDTRYCDIITYSLDEALEKAQ

SEQ ID NO: 2036913 - protein, 20 aa, Staphylococcus
RIDVGLPREVLVPWEDLPKI

SEQ ID NO: 2036914 - protein, 19 aa, Staphylococcus
RIEADLTYQNKTRITLERE

SEQ ID NO: 2036915 - protein, 19 aa, Staphylococcus
RIEAEIIMLPGISNTEQDV

SEQ ID NO: 2036916 - protein, 24 aa, Staphylococcus
RIEALEPLTYLLIGGEVLNAKWVN

SEQ ID NO: 2036917 - protein, 22 aa, Staphylococcus
RIEAPIPGTSLVGIEVPNQNPT

SEQ ID NO: 2036918 - protein, 19 aa, Staphylococcus
RIEAPIPGTSLVGIEVPNV

SEQ ID NO: 2036919 - protein, 17 aa, Staphylococcus
RIEEICETIKPLDNESL

SEQ ID NO: 2036920 - protein, 18 aa, Staphylococcus
RIEFGPLNLKGLNAGEGR

SEQ ID NO: 2036921 - protein, 21 aa, Staphylococcus
RIEHGELPISIATGGTPESSL

SEQ ID NO: 2036922 - protein, 32 aa, Staphylococcus
RIEIPKKPQIIAAGRLEYEKGFDLLLQSVELI

SEQ ID NO: 2036923 - protein, 26 aa, Staphylococcus
RIEKAPNLKLAITAGVGSDHVDLDAA

SEQ ID NO: 2036924 - protein, 21 aa, Staphylococcus
RIEKVLYYLCHAIGYDQDEFY

SEQ ID NO: 2036925 - protein, 20 aa, Staphylococcus
RIEKYGTFVELFPGKDALLH

SEQ ID NO: 2036926 - protein, 17 aa, Staphylococcus
RIEPGAFIREHAVIEDG

SEQ ID NO: 2036927 - protein, 17 aa, Staphylococcus
RIEPGAFIREQAIIEDG

SEQ ID NO: 2036928 - protein, 17 aa, Staphylococcus
RIETALKQMVHGLEETF

SEQ ID NO: 2036929 - protein, 17 aa, Staphylococcus
RIETFFIDYLGAEDNHY

SEQ ID NO: 2036930 - protein, 17 aa, Staphylococcus
RIFEEAYCKLKDQGALY

SEQ ID NO: 2036931 - protein, 17 aa, Staphylococcus
RIFPSEASTGIKASTES

SEQ ID NO: 2036932 - protein, 19 aa, Staphylococcus
RIGKPFCPNHGIEIESQTV

SEQ ID NO: 2036933 - protein, 22 aa, Staphylococcus
RIGRIKSIPKFMFKVWKLQNKK

SEQ ID NO: 2036934 - protein, 23 aa, Staphylococcus
RIGRLKSIPIFMLKVAKTQYKEH

SEQ ID NO: 2036935 - protein, 27 aa, Staphylococcus
RIGSGQIGRLAFRIPKDSMTSWEMHLN

SEQ ID NO: 2036936 - protein, 19 aa, Staphylococcus
RIGSGQVGHLAFRIPKDSM

SEQ ID NO: 2036937 - protein, 26 aa, Staphylococcus
RIGSISARLFHSFGCKVVGYDPIRRP

SEQ ID NO: 2036938 - protein, 24 aa, Staphylococcus
RIHNELEDIFTIMLRNSYPQQDID

SEQ ID NO: 2036939 - protein, 21 aa, Staphylococcus
RIHQQRFLIVFSDGEPSAFNY

SEQ ID NO: 2036940 - protein, 17 aa, Staphylococcus
RIIDCLETSESRLKLLS

SEQ ID NO: 2036941 - protein, 21 aa, Staphylococcus
RIIDEFDELPYLYIKKDIVHY

SEQ ID NO: 2036942 - protein, 17 aa, Staphylococcus
RIIEKYPSLDVQIIKDI

SEQ ID NO: 2036943 - protein, 18 aa, Staphylococcus
RIIENKVWEKIKENAKRF

SEQ ID NO: 2036944 - protein, 20 aa, Staphylococcus
RIIERSCKFYGNSYLSKKSE

SEQ ID NO: 2036945 - protein, 17 aa, Staphylococcus
RIIGYTRIDQCRRKFLL

SEQ ID NO: 2036946 - protein, 18 aa, Staphylococcus
RIIHPDAKHVIDSMSSKP

SEQ ID NO: 2036947 - protein, 20 aa, Staphylococcus
RIIIATGIMFTGTLTYQTIE

SEQ ID NO: 2036948 - protein, 19 aa, Staphylococcus
RIIIDRFHIVQSLNRALNM

SEQ ID NO: 2036949 - protein, 20 aa, Staphylococcus
RIIIEKGLMASRARIAAKKA

SEQ ID NO: 2036950 - protein, 18 aa, Staphylococcus
RIILSKRGQIDYSKQIFH

SEQ ID NO: 2036951 - protein, 27 aa, Staphylococcus
RIINLSLRAKYLFDYNLDYLVSNGEIV

SEQ ID NO: 2036952 - protein, 31 aa, Staphylococcus
RIINLSLRAKYLFKYNLDYFIFDGEIVLIDR

SEQ ID NO: 2036953 - protein, 22 aa, Staphylococcus
RIIRGLRFQAQLNFKIVDNTFD

SEQ ID NO: 2036954 - protein, 25 aa, Staphylococcus
RIIRGLRFQSQFGFHLEEATFTAML

SEQ ID NO: 2036955 - protein, 18 aa, Staphylococcus
RIIVSCYASNFIRIQQVL

SEQ ID NO: 2036956 - protein, 24 aa, Staphylococcus
RIIYLAIHKKYFGKYYVKNALNTE

SEQ ID NO: 2036957 - protein, 17 aa, Staphylococcus
RIKAMPSVRKYAREKGV

SEQ ID NO: 2036958 - protein, 22 aa, Staphylococcus
RIKCEKCHRSIMMPRTEFNKKL

SEQ ID NO: 2036959 - protein, 18 aa, Staphylococcus
RIKEAIPNIALTTDIIVG

SEQ ID NO: 2036960 - protein, 20 aa, Staphylococcus
RIKEVFLKENIDVLHQSSKQ

SEQ ID NO: 2036961 - protein, 18 aa, Staphylococcus
RIKEWILNAIDDGTLQPG

SEQ ID NO: 2036962 - protein, 25 aa, Staphylococcus
RIKGIEWPSNLMITAINARKAERVA

SEQ ID NO: 2036963 - protein, 23 aa, Staphylococcus
RIKIKYLPCPCKIKHDEAQREAH

SEQ ID NO: 2036964 - protein, 31 aa, Staphylococcus
RIKKELEVFGLLRCEKGTFGKADRLYVNLPK

SEQ ID NO: 2036965 - protein, 24 aa, Staphylococcus
RIKRAQKLFGQRMHVFDIRKHEMA

SEQ ID NO: 2036966 - protein, 21 aa, Staphylococcus
RIKSKLTPFSLEISKSSGREQ

SEQ ID NO: 2036967 - protein, 21 aa, Staphylococcus
RIKYGEGLAEYAEEYVSSLDN

SEQ ID NO: 2036968 - protein, 25 aa, Staphylococcus
RILERLDIPPIDVFGLKSNISDLHE

SEQ ID NO: 2036969 - protein, 19 aa, Staphylococcus
RILFGAGLDEVILMISRAV

SEQ ID NO: 2036970 - protein, 20 aa, Staphylococcus
RILHERGILLVPDVLASAGG

SEQ ID NO: 2036971 - protein, 25 aa, Staphylococcus
RILHPSEILSCILLEAPHLDNEASM

SEQ ID NO: 2036972 - protein, 18 aa, Staphylococcus
RILKEPKLSLVKQYEALL

SEQ ID NO: 2036973 - protein, 17 aa, Staphylococcus
RILLSSLPGSAVKYIEI

SEQ ID NO: 2036974 - protein, 18 aa, Staphylococcus
RILPEIDENPQLDVSQLL

SEQ ID NO: 2036975 - protein, 18 aa, Staphylococcus
RILPEINENAQLATDQLI

SEQ ID NO: 2036976 - protein, 25 aa, Staphylococcus
RILQYRSSDIVNWEFQGEIQTNLDD

SEQ ID NO: 2036977 - protein, 17 aa, Staphylococcus
RILRNFPEKLSKYISKW

SEQ ID NO: 2036978 - protein, 23 aa, Staphylococcus
RIMAGLLSGIGIQSVLSGDESIG

SEQ ID NO: 2036979 - protein, 20 aa, Staphylococcus
RIMEKYGIPTAEYVEVDSKS

SEQ ID NO: 2036980 - protein, 35 aa, Staphylococcus
RINDLNEVNPMLGHRGCRLAITYPELYEMQVEAIM

SEQ ID NO: 2036981 - protein, 23 aa, Staphylococcus
RINEVGIPVVFIINQIDKHNDDE

SEQ ID NO: 2036982 - protein, 21 aa, Staphylococcus
RINIEPSYRQALLAKIVSDDY

SEQ ID NO: 2036983 - protein, 24 aa, Staphylococcus
RINNELEDIFSIMLENSYSDIDRD

SEQ ID NO: 2036984 - protein, 19 aa, Staphylococcus
RIPEWTNNQFLPRREVVNI

SEQ ID NO: 2036985 - protein, 18 aa, Staphylococcus
RIPFIKKMQDKGLFASIS

SEQ ID NO: 2036986 - protein, 21 aa, Staphylococcus
RIPLCHHVKAQKMCRLAIRFL

SEQ ID NO: 2036987 - protein, 23 aa, Staphylococcus
RIPNGKNPIRIVLAKSGNVDFTK

SEQ ID NO: 2036988 - protein, 20 aa, Staphylococcus
RIQIGEKLTRGLGAGANPEI

SEQ ID NO: 2036989 - protein, 18 aa, Staphylococcus
RIQLPKLGWIKLKEKSYI

SEQ ID NO: 2036990 - protein, 19 aa, Staphylococcus
RIQMIGYWLNYELHEQFKL

SEQ ID NO: 2036991 - protein, 20 aa, Staphylococcus
RIQRMLMNVLLNFKQQDKPT

SEQ ID NO: 2036992 - protein, 18 aa, Staphylococcus
RIRAVLRRQPHKDIIDIN

SEQ ID NO: 2036993 - protein, 17 aa, Staphylococcus
RIRAVLRRQPQKDIIDI

SEQ ID NO: 2036994 - protein, 21 aa, Staphylococcus
RIREVNYLTGEVLRERDHFAI

SEQ ID NO: 2036995 - protein, 22 aa, Staphylococcus
RIREVNYLTGEVLREREHFAIF

SEQ ID NO: 2036996 - protein, 25 aa, Staphylococcus
RIRKNDEVILLEGFMDVIKSDAAGL

SEQ ID NO: 2036997 - protein, 19 aa, Staphylococcus
RIRLHLPLNERISADDYRR

SEQ ID NO: 2036998 - protein, 20 aa, Staphylococcus
RIRLYIPLNERISADDYRNY

SEQ ID NO: 2036999 - protein, 18 aa, Staphylococcus
RIRPYITDRNKFISIMAG

SEQ ID NO: 2037000 - protein, 18 aa, Staphylococcus
RIRVGSGGVMLQHYSPFK

SEQ ID NO: 2037001 - protein, 30 aa, Staphylococcus
RISDWNRVGWGRIPMTQGFTYSSNTLMMQL

SEQ ID NO: 2037002 - protein, 28 aa, Staphylococcus
RISGDSCFLFKARFKTMQDVETFIDILQ

SEQ ID NO: 2037003 - protein, 20 aa, Staphylococcus
RISKTKGFIGNIMKIKPVGT

SEQ ID NO: 2037004 - protein, 19 aa, Staphylococcus
RISKTKGLIGNIMKIKPIG

SEQ ID NO: 2037005 - protein, 19 aa, Staphylococcus
RISKTKGLIGNMMQIKPIG

SEQ ID NO: 2037006 - protein, 19 aa, Staphylococcus
RISNPEMKKRILNGQKFYK

SEQ ID NO: 2037007 - protein, 20 aa, Staphylococcus
RISNTGQRAITHILASTMLK

SEQ ID NO: 2037008 - protein, 19 aa, Staphylococcus
RISNTGQRAITHILNSEMI

SEQ ID NO: 2037009 - protein, 20 aa, Staphylococcus
RISNTGQRAITHILSSKMIK

SEQ ID NO: 2037010 - protein, 20 aa, Staphylococcus
RISNTGQRAITHILTSKMIK

SEQ ID NO: 2037011 - protein, 24 aa, Staphylococcus
RISQLRIANAYIIEDINWLSQKMI

SEQ ID NO: 2037012 - protein, 26 aa, Staphylococcus
RISSTRLASYLLKKNRGYVLAPQYAL

SEQ ID NO: 2037013 - protein, 39 aa, Staphylococcus
RISVIKQPVGVCALITPWNFPGAMVARKVSPALAAGCTV

SEQ ID NO: 2037014 - protein, 21 aa, Staphylococcus
RITAELDRCLINSSEINQDWS

SEQ ID NO: 2037015 - protein, 17 aa, Staphylococcus
RITAIELREHFHNSTLN

SEQ ID NO: 2037016 - protein, 20 aa, Staphylococcus
RITDNWPNNVSVFSNRVETY

SEQ ID NO: 2037017 - protein, 17 aa, Staphylococcus
RITGWTMDKRGYNPHGV

SEQ ID NO: 2037018 - protein, 24 aa, Staphylococcus
RITHGEIDAVIAFHTLTKEFEGVK

SEQ ID NO: 2037019 - protein, 25 aa, Staphylococcus
RITHGEINAVIALADFIEEFRDIKE

SEQ ID NO: 2037020 - protein, 19 aa, Staphylococcus
RITMRDIINNYPFPNTFQV

SEQ ID NO: 2037021 - protein, 18 aa, Staphylococcus
RITRTGIEVADIIDYSKD

SEQ ID NO: 2037022 - protein, 27 aa, Staphylococcus
RITVHGFRHTHCSLLFEAGLSVQEVQD

SEQ ID NO: 2037023 - protein, 19 aa, Staphylococcus
RIVHECREAGLPCYFTMDA

SEQ ID NO: 2037024 - protein, 24 aa, Staphylococcus
RIVKETLEGAGLDQAITYSLVSKD

SEQ ID NO: 2037025 - protein, 19 aa, Staphylococcus
RIVQFYTDLNTDGRFLNVG

SEQ ID NO: 2037026 - protein, 19 aa, Staphylococcus
RIVVEKGIMASRARVAAKK

SEQ ID NO: 2037027 - protein, 17 aa, Staphylococcus
RIVYTPHQMEWERLSGI

SEQ ID NO: 2037028 - protein, 29 aa, Staphylococcus
RKAEDPFTCPHGRPIIINFSNYELEKLFK

SEQ ID NO: 2037029 - protein, 22 aa, Staphylococcus
RKAEPRLGELVEVRIIGHNEKG

SEQ ID NO: 2037030 - protein, 18 aa, Staphylococcus
RKAFELFNNPEYEIYSKL

SEQ ID NO: 2037031 - protein, 18 aa, Staphylococcus
RKAGGMLKADLERQGMNI

SEQ ID NO: 2037032 - protein, 19 aa, Staphylococcus
RKALEHWSKDIVSENKVDL

SEQ ID NO: 2037033 - protein, 24 aa, Staphylococcus
RKALGEADLILFVLNYNERLTDED

SEQ ID NO: 2037034 - protein, 19 aa, Staphylococcus
RKALSQADLILFVLNNNEA

SEQ ID NO: 2037035 - protein, 19 aa, Staphylococcus
RKALSQADLILFVLNYNEP

SEQ ID NO: 2037036 - protein, 21 aa, Staphylococcus
RKANYTFSQRVYVSKWKKNHI

SEQ ID NO: 2037037 - protein, 26 aa, Staphylococcus
RKARGLKLNYPEALALISDELLEGAR

SEQ ID NO: 2037038 - protein, 19 aa, Staphylococcus
RKAVEHWAGEEINETEINA

SEQ ID NO: 2037039 - protein, 18 aa, Staphylococcus
RKAVFDLYFRKMPFDSGY

SEQ ID NO: 2037040 - protein, 18 aa, Staphylococcus
RKAVTHWSNEIIAETSCS

SEQ ID NO: 2037041 - protein, 19 aa, Staphylococcus
RKDFIEFGRLLNASHASLK

SEQ ID NO: 2037042 - protein, 21 aa, Staphylococcus
RKDGDYHFLIFNKINDRYLSD

SEQ ID NO: 2037043 - protein, 18 aa, Staphylococcus
RKDMDALTEFVNIYGAKG

SEQ ID NO: 2037044 - protein, 24 aa, Staphylococcus
RKDSEFMLQILPYLLMVSYNSGIN

SEQ ID NO: 2037045 - protein, 24 aa, Staphylococcus
RKDSLRFNKKIQMIFQDPYASLNP

SEQ ID NO: 2037046 - protein, 22 aa, Staphylococcus
RKDTVLYLMHYHHRISEAEMKK

SEQ ID NO: 2037047 - protein, 24 aa, Staphylococcus
RKEAANKGNAQWTHLWSGQSPRLV

SEQ ID NO: 2037048 - protein, 20 aa, Staphylococcus
RKEAKIFIDDYLASFPGVKQ

SEQ ID NO: 2037049 - protein, 26 aa, Staphylococcus
RKEALDKKLPMALFHEGIGTIEDSKH

SEQ ID NO: 2037050 - protein, 21 aa, Staphylococcus
RKEALLNKKQLKMFANHNSLQ

SEQ ID NO: 2037051 - protein, 21 aa, Staphylococcus
RKEARRMDRFTQYAVVAARQA

SEQ ID NO: 2037052 - protein, 20 aa, Staphylococcus
RKECPTCGSNPSFPYLNKQH

SEQ ID NO: 2037053 - protein, 23 aa, Staphylococcus
RKEEKERELGVKYVDLDTMLEKA

SEQ ID NO: 2037054 - protein, 18 aa, Staphylococcus
RKEFLMRGYELMENHEPE

SEQ ID NO: 2037055 - protein, 17 aa, Staphylococcus
RKEGIAESALRQIPTYV

SEQ ID NO: 2037056 - protein, 22 aa, Staphylococcus
RKEIKKLMPQIIEFSELGEFIY

SEQ ID NO: 2037057 - protein, 17 aa, Staphylococcus
RKELKIKDISEYDPISS

SEQ ID NO: 2037058 - protein, 23 aa, Staphylococcus
RKEMKRLGLENEDEIKKLKQELQ

SEQ ID NO: 2037059 - protein, 18 aa, Staphylococcus
RKESAEVFKDSKDESKIE

SEQ ID NO: 2037060 - protein, 21 aa, Staphylococcus
RKEYNSLWYLLKSFKDSLHIQ

SEQ ID NO: 2037061 - protein, 21 aa, Staphylococcus
RKFIKVLLEKELITFTTGNDK

SEQ ID NO: 2037062 - protein, 19 aa, Staphylococcus
RKFKKAGIKHITVQLYANR

SEQ ID NO: 2037063 - protein, 27 aa, Staphylococcus
RKFPKEIIESGRIGIPNKGEWTDKPLR

SEQ ID NO: 2037064 - protein, 20 aa, Staphylococcus
RKFSEGIFDYTYPELGETVA

SEQ ID NO: 2037065 - protein, 19 aa, Staphylococcus
RKFVPEGIEGRTAYKGPLQ

SEQ ID NO: 2037066 - protein, 20 aa, Staphylococcus
RKFYDELARLASDETKDKSH

SEQ ID NO: 2037067 - protein, 21 aa, Staphylococcus
RKGAMLEKYFECEHLSPDETE

SEQ ID NO: 2037068 - protein, 18 aa, Staphylococcus
RKGDIIVGIVSNIPKHFR

SEQ ID NO: 2037069 - protein, 17 aa, Staphylococcus
RKGDYDAVITLGCVIRG

SEQ ID NO: 2037070 - protein, 18 aa, Staphylococcus
RKGGYVIHRLAGSPEYKG

SEQ ID NO: 2037071 - protein, 19 aa, Staphylococcus
RKGIVFDELVLFSSARSAG

SEQ ID NO: 2037072 - protein, 20 aa, Staphylococcus
RKGPNIKFQMPLFPMIDDTC

SEQ ID NO: 2037073 - protein, 26 aa, Staphylococcus
RKGPNIKLPSLELLEDPEIHQIDNSW

SEQ ID NO: 2037074 - protein, 26 aa, Staphylococcus
RKGTVHVYRPFFIETYATVYQMTSMV

SEQ ID NO: 2037075 - protein, 23 aa, Staphylococcus
RKHIEGGIVKAVRQIGNDRRVEI

SEQ ID NO: 2037076 - protein, 25 aa, Staphylococcus
RKHINVNLSYSFPYIVCAIDQHPVG

SEQ ID NO: 2037077 - protein, 23 aa, Staphylococcus
RKHIPDFVLKYDVDPVRQGIADS

SEQ ID NO: 2037078 - protein, 20 aa, Staphylococcus
RKHLEMMKVAVQFEDAEAFT

SEQ ID NO: 2037079 - protein, 22 aa, Staphylococcus
RKHLLYLNDHFRAIEQSIKDNH

SEQ ID NO: 2037080 - protein, 27 aa, Staphylococcus
RKHNYRGLFRFIQLFVVSNKKETRYYA

SEQ ID NO: 2037081 - protein, 19 aa, Staphylococcus
RKHQIPLFMDGARLGYGVM

SEQ ID NO: 2037082 - protein, 43 aa, Staphylococcus
RKIAEVIIEKGLRVAFNIDNYRVIDHLGICFNDAVLKLKNAMK

SEQ ID NO: 2037083 - protein, 19 aa, Staphylococcus
RKIDIAVIAEKGFNEGELQ

SEQ ID NO: 2037084 - protein, 17 aa, Staphylococcus
RKIFRRDALTPSEITNS

SEQ ID NO: 2037085 - protein, 17 aa, Staphylococcus
RKIGAQFVYKEQLDTYV

SEQ ID NO: 2037086 - protein, 25 aa, Staphylococcus
RKIGKYPPYFFLINFTIAHKEMKKV

SEQ ID NO: 2037087 - protein, 25 aa, Staphylococcus
RKIGKYPPYYFLINFTISHKNMKKV

SEQ ID NO: 2037088 - protein, 21 aa, Staphylococcus
RKIKADVPIYYYGLEKNEDIY

SEQ ID NO: 2037089 - protein, 25 aa, Staphylococcus
RKIKAIKVFLQHGVLGTKNLSQING

SEQ ID NO: 2037090 - protein, 24 aa, Staphylococcus
RKIKRELYDTRGFLSCTRILSTDQ

SEQ ID NO: 2037091 - protein, 18 aa, Staphylococcus
RKILGKAAAHTIIDTLPE

SEQ ID NO: 2037092 - protein, 18 aa, Staphylococcus
RKILGKAASHTIIQGIPR

SEQ ID NO: 2037093 - protein, 19 aa, Staphylococcus
RKINALPDEHRWQRRQGVT

SEQ ID NO: 2037094 - protein, 25 aa, Staphylococcus
RKIPDEFVVGYGLDYAEFYRNLPYV

SEQ ID NO: 2037095 - protein, 21 aa, Staphylococcus
RKIRQHGVLRAGFTDNKDDIQ

SEQ ID NO: 2037096 - protein, 20 aa, Staphylococcus
RKITLEYYLKPFVQTRIKGW

SEQ ID NO: 2037097 - protein, 17 aa, Staphylococcus
RKIYGFHGDVNGSIDES

SEQ ID NO: 2037098 - protein, 21 aa, Staphylococcus
RKKAIDIANAMLKDGYKEGDA

SEQ ID NO: 2037099 - protein, 19 aa, Staphylococcus
RKKAIDIGNAMLEDGYEEG

SEQ ID NO: 2037100 - protein, 23 aa, Staphylococcus
RKKAKAFIDDYLDSFPGVKQYMS

SEQ ID NO: 2037101 - protein, 21 aa, Staphylococcus
RKKARLVKSILLRRKNKNRAL

SEQ ID NO: 2037102 - protein, 23 aa, Staphylococcus
RKKFPDALFIFLAPPSLDDLRER

SEQ ID NO: 2037103 - protein, 24 aa, Staphylococcus
RKKFPDALFIFLAPPSLEHLRERL

SEQ ID NO: 2037104 - protein, 24 aa, Staphylococcus
RKKFPEALFIFLAPPSLDDLRDRL

SEQ ID NO: 2037105 - protein, 18 aa, Staphylococcus
RKKIKALTEEALELILPK

SEQ ID NO: 2037106 - protein, 20 aa, Staphylococcus
RKKILQEVSELFKVSLDSLN

SEQ ID NO: 2037107 - protein, 18 aa, Staphylococcus
RKKLSDIGMDTQIETKVG

SEQ ID NO: 2037108 - protein, 17 aa, Staphylococcus
RKKLSYIPESPIIYEEL

SEQ ID NO: 2037109 - protein, 23 aa, Staphylococcus
RKKLVPFMLEDKLKEEGADYSRA

SEQ ID NO: 2037110 - protein, 17 aa, Staphylococcus
RKKNILINDMYRYSEEW

SEQ ID NO: 2037111 - protein, 38 aa, Staphylococcus
RKKQLTICKEQWQGCASIGAFYLWEAIHQDLLQYDSIY

SEQ ID NO: 2037112 - protein, 21 aa, Staphylococcus
RKKRLKPWLYDGTPQAVKPSE

SEQ ID NO: 2037113 - protein, 44 aa, Staphylococcus
RKKRQKVSMIFQHFNLLWSRTVISNIMFPLEIAGVARTEAKKRA

SEQ ID NO: 2037114 - protein, 34 aa, Staphylococcus
RKKRQKVSMIFQHFNLLWSRTVLDNITFPLEIAG

SEQ ID NO: 2037115 - protein, 36 aa, Staphylococcus
RKKRQKVSMIFQHFNLLWSRTVLKNITFPLEIAGLS

SEQ ID NO: 2037116 - protein, 36 aa, Staphylococcus; identical to SEQ ID NO: 1812130

SEQ ID NO: 2037117 - protein, 34 aa, Staphylococcus
RKKRQKVSMIFQHFNLLWSRTVLNNITFPLEIAG

SEQ ID NO: 2037118 - protein, 20 aa, Staphylococcus
RKKSGLSYKEKLEYETIMTR

SEQ ID NO: 2037119 - protein, 28 aa, Staphylococcus
RKKTGLSYKEKREYEALMERIETTEHRL

SEQ ID NO: 2037120 - protein, 17 aa, Staphylococcus
RKKVKLTKMSIEELGPV

SEQ ID NO: 2037121 - protein, 20 aa, Staphylococcus
RKKYNGGLSSGEIQTKHAIE

SEQ ID NO: 2037122 - protein, 20 aa, Staphylococcus
RKKYPKLQMVIRNDIKDYGK

SEQ ID NO: 2037123 - protein, 18 aa, Staphylococcus
RKKYPQKEVVAVFQPHTF

SEQ ID NO: 2037124 - protein, 21 aa, Staphylococcus
RKLAKEFPVYFQKGYDYELDA

SEQ ID NO: 2037125 - protein, 19 aa, Staphylococcus
RKLESAGVIESRSLGMKGT

SEQ ID NO: 2037126 - protein, 24 aa, Staphylococcus
RKLIKSRFADAMAVEMEATAIAQV

SEQ ID NO: 2037127 - protein, 23 aa, Staphylococcus
RKLKSFCDINDWTVYDTYIDAGY

SEQ ID NO: 2037128 - protein, 21 aa, Staphylococcus
RKLLESLILVGAFDIFGKNRA

SEQ ID NO: 2037129 - protein, 19 aa, Staphylococcus
RKLLESLILVGAFDQFNEN

SEQ ID NO: 2037130 - protein, 19 aa, Staphylococcus
RKLLESLILVGAFDTFGKN

SEQ ID NO: 2037131 - protein, 19 aa, Staphylococcus
RKLLLGGLYELLEEKEFSK

SEQ ID NO: 2037132 - protein, 21 aa, Staphylococcus
RKLLLHKREIFKLGDRTREIG

SEQ ID NO: 2037133 - protein, 20 aa, Staphylococcus
RKLNEAYFKRIEAIEYSVKY

SEQ ID NO: 2037134 - protein, 19 aa, Staphylococcus
RKLPAREYSIASSYEATPD

SEQ ID NO: 2037135 - protein, 21 aa, Staphylococcus
RKLRSFCDINDWTVKDVYVDA

SEQ ID NO: 2037136 - protein, 20 aa, Staphylococcus
RKLSIGVMPQGPLTIPYVEN

SEQ ID NO: 2037137 - protein, 17 aa, Staphylococcus
RKLTSNVTLLFDGDFAG

SEQ ID NO: 2037138 - protein, 29 aa, Staphylococcus
RKMLEFYHPEFKKEYVILAEEGAQSDDDD

SEQ ID NO: 2037139 - protein, 17 aa, Staphylococcus
RKMMGEYLIYYDDVLIG

SEQ ID NO: 2037140 - protein, 22 aa, Staphylococcus
RKMNTEYFKRIEAIEYSVKYDD

SEQ ID NO: 2037141 - protein, 23 aa, Staphylococcus
RKMVEELQFLKDGRIHKINQPDN

SEQ ID NO: 2037142 - protein, 20 aa, Staphylococcus
RKNARFKYTVDRFGVDNIVK

SEQ ID NO: 2037143 - protein, 23 aa, Staphylococcus
RKNDEVMLLEGFMDVIKADYAGL

SEQ ID NO: 2037144 - protein, 18 aa, Staphylococcus
RKNEHVEIAMAQGDATIS

SEQ ID NO: 2037145 - protein, 19 aa, Staphylococcus
RKNEHVEIAMAQHDATLSD

SEQ ID NO: 2037146 - protein, 19 aa, Staphylococcus
RKNEHVEIAMAQQDVPQSD

SEQ ID NO: 2037147 - protein, 18 aa, Staphylococcus
RKNEHVEIAMAQSDAPQS

SEQ ID NO: 2037148 - protein, 18 aa, Staphylococcus
RKNEHVEIAMSQHDAPQS

SEQ ID NO: 2037149 - protein, 22 aa, Staphylococcus
RKNFELRKKKLLEIRDNINAHY

SEQ ID NO: 2037150 - protein, 23 aa, Staphylococcus
RKNIKFDELVLFSSARSAGKEVQ

SEQ ID NO: 2037151 - protein, 25 aa, Staphylococcus
RKNILKKEFNTLGVGVDFNKNRQPY

SEQ ID NO: 2037152 - protein, 23 aa, Staphylococcus
RKNIPFDELVLFSSPRSAGTKVE

SEQ ID NO: 2037153 - protein, 18 aa, Staphylococcus
RKNIPSKLILLGDGPELL

SEQ ID NO: 2037154 - protein, 19 aa, Staphylococcus
RKNNLEDIVFLQGATHQLN

SEQ ID NO: 2037155 - protein, 25 aa, Staphylococcus
RKNVILFFDEIHQIIGSGSTGGDSG

SEQ ID NO: 2037156 - protein, 20 aa, Staphylococcus
RKNYGCTHFIVGRDHAGVGD

SEQ ID NO: 2037157 - protein, 17 aa, Staphylococcus
RKPEALQDIGYTHLSFY

SEQ ID NO: 2037158 - protein, 24 aa, Staphylococcus
RKPQNFAEVKLKLDNHSKKLQIDA

SEQ ID NO: 2037159 - protein, 18 aa, Staphylococcus
RKPVRKMGHMTVLTDDVD

SEQ ID NO: 2037160 - protein, 25 aa, Staphylococcus
RKQFYFEILDYFFGNRKIRFRCIVV

SEQ ID NO: 2037161 - protein, 18 aa, Staphylococcus
RKQISALSGGQLQRVLVA

SEQ ID NO: 2037162 - protein, 24 aa, Staphylococcus
RKQKLEPAYAFMIRVRLPGGKATP

SEQ ID NO: 2037163 - protein, 24 aa, Staphylococcus
RKQKLEPAYSFMIRVRLPGGTATP

SEQ ID NO: 2037164 - protein, 27 aa, Staphylococcus
RKQKLEPLYAFMIRVRIPGGKVSTDQW

SEQ ID NO: 2037165 - protein, 19 aa, Staphylococcus
RKQLEMMKVAVQFEDAEAF

SEQ ID NO: 2037166 - protein, 21 aa, Staphylococcus
RKQLPEFYVDSMLKAQKDSDN

SEQ ID NO: 2037167 - protein, 22 aa, Staphylococcus
RKQLREAGVEYKVYKNTMMRRA

SEQ ID NO: 2037168 - protein, 22 aa, Staphylococcus
RKQLREAGVEYKVYKNTMVRRA

SEQ ID NO: 2037169 - protein, 17 aa, Staphylococcus
RKQMSINAKKMFNDLFR

SEQ ID NO: 2037170 - protein, 19 aa, Staphylococcus
RKQYLDSFREGFKQQIEST

SEQ ID NO: 2037171 - protein, 18 aa, Staphylococcus
RKRDIGFIFQDYNLLHTL

SEQ ID NO: 2037172 - protein, 19 aa, Staphylococcus
RKREFYEKPSVRRKKKSEA

SEQ ID NO: 2037173 - protein, 18 aa, Staphylococcus
RKRGYDYKNGIKEPDNEG

SEQ ID NO: 2037174 - protein, 19 aa, Staphylococcus
RKRHEAVITIGVRQLYQKH

SEQ ID NO: 2037175 - protein, 20 aa, Staphylococcus
RKRISRELHDGIVQELINVD

SEQ ID NO: 2037176 - protein, 18 aa, Staphylococcus
RKRLYSENFMVIYNDDNK

SEQ ID NO: 2037177 - protein, 18 aa, Staphylococcus
RKRRDRFTAILDEGAIPY

SEQ ID NO: 2037178 - protein, 21 aa, Staphylococcus
RKRRVYDLLETVGLSKEHANR

SEQ ID NO: 2037179 - protein, 23 aa, Staphylococcus
RKRVGDRKVLCAMSGGVDSSVVA

SEQ ID NO: 2037180 - protein, 19 aa, Staphylococcus
RKRVGFMIETPEFISNFTA

SEQ ID NO: 2037181 - protein, 21 aa, Staphylococcus
RKRVYIVELIEKLTLEIENKY

SEQ ID NO: 2037182 - protein, 30 aa, Staphylococcus
RKSALEKGYTEWTHIWSGQSTRLADTVDAA

SEQ ID NO: 2037183 - protein, 20 aa, Staphylococcus
RKSFELKKKKLLEIRDDINI

SEQ ID NO: 2037184 - protein, 18 aa, Staphylococcus
RKSGGRTKGPAAFTEEDV

SEQ ID NO: 2037185 - protein, 39 aa, Staphylococcus
RKSSLEYRKEILLKISEVYKRRMEDLINAISMDLGSPIS

SEQ ID NO: 2037186 - protein, 18 aa, Staphylococcus
RKSYQFVQEMKRRINKEV

SEQ ID NO: 2037187 - protein, 21 aa, Staphylococcus
RKTACLHPLETLPEVQTNFDE

SEQ ID NO: 2037188 - protein, 19 aa, Staphylococcus
RKTDLDLEIERELQEMMQN

SEQ ID NO: 2037189 - protein, 20 aa, Staphylococcus
RKTLINDIAMDFTKDFSSED

SEQ ID NO: 2037190 - protein, 23 aa, Staphylococcus
RKTMDYLEGIGLLKSFVRHQSDN

SEQ ID NO: 2037191 - protein, 17 aa, Staphylococcus
RKTMFVRTAGCDYHCSW

SEQ ID NO: 2037192 - protein, 18 aa, Staphylococcus
RKTMFVRTAGCDYRCSWC

SEQ ID NO: 2037193 - protein, 17 aa, Staphylococcus
RKTYEMMYDDYWPTVPS

SEQ ID NO: 2037194 - protein, 25 aa, Staphylococcus
RKVAKRLDKTVALLLDTKGPEIRTH

SEQ ID NO: 2037195 - protein, 25 aa, Staphylococcus
RKVAKRLNKTVAILLDTKGPEIRTH

SEQ ID NO: 2037196 - protein, 20 aa, Staphylococcus
RKVDSLVMIDIAVPRDIEPG

SEQ ID NO: 2037197 - protein, 23 aa, Staphylococcus
RKVGKEVKNHFYLLENQINVDKI

SEQ ID NO: 2037198 - protein, 17 aa, Staphylococcus
RKVIVHWCELLIENKPM

SEQ ID NO: 2037199 - protein, 22 aa, Staphylococcus
RKVLQKRRFKKALQEKRQQNQE

SEQ ID NO: 2037200 - protein, 20 aa, Staphylococcus
RKVLQKRRFKKALQQKRQQN

SEQ ID NO: 2037201 - protein, 20 aa, Staphylococcus
RKVRYKSPRSERVQRIDFLD

SEQ ID NO: 2037202 - protein, 19 aa, Staphylococcus
RKVTYKWYNILLETMKDTV

SEQ ID NO: 2037203 - protein, 20 aa, Staphylococcus
RKYFKALYFKEKGDIVFEIA

SEQ ID NO: 2037204 - protein, 19 aa, Staphylococcus
RKYMGELVFNNPGERIKLN

SEQ ID NO: 2037205 - protein, 18 aa, Staphylococcus
RKYNKWKHQSYVLLDSKA

SEQ ID NO: 2037206 - protein, 19 aa, Staphylococcus
RKYQAVVYISGQKSGNEVV

SEQ ID NO: 2037207 - protein, 21 aa, Staphylococcus
RKYRYEFQKSILKDRNSYSKT

SEQ ID NO: 2037208 - protein, 18 aa, Staphylococcus
RKYTGKQSIICFDQSFHG

SEQ ID NO: 2037209 - protein, 18 aa, Staphylococcus
RKYVALVHGNIPHDYGTV

SEQ ID NO: 2037210 - protein, 18 aa, Staphylococcus
RKYYKPRKMNKFLKHVED

SEQ ID NO: 2037211 - protein, 36 aa, Staphylococcus
RLAEANLRLVVSIAKRYVGRGMLFLDLIQEGNMGLI

SEQ ID NO: 2037212 - protein, 19 aa, Staphylococcus
RLAEEGAKVVLAGRNDEKL

SEQ ID NO: 2037213 - protein, 21 aa, Staphylococcus
RLAEEKGHEIIGVIEPQKNET

SEQ ID NO: 2037214 - protein, 19 aa, Staphylococcus
RLAERCRHSESIDEVLYSG

SEQ ID NO: 2037215 - protein, 25 aa, Staphylococcus
RLAKFKRSNSGTCYNQRPIVKDGDI

SEQ ID NO: 2037216 - protein, 17 aa, Staphylococcus
RLAKVFRIGDTVKVKVS

SEQ ID NO: 2037217 - protein, 18 aa, Staphylococcus
RLALLEADVNFKVVKQFI

SEQ ID NO: 2037218 - protein, 18 aa, Staphylococcus
RLALLEADVNFKVVKSFI

SEQ ID NO: 2037219 - protein, 19 aa, Staphylococcus
RLDATYRDFFAVLISETNG

SEQ ID NO: 2037220 - protein, 17 aa, Staphylococcus
RLDDGYFTLIIVQKANL

SEQ ID NO: 2037221 - protein, 20 aa, Staphylococcus
RLDDLLEDMELIPLKKRQIS

SEQ ID NO: 2037222 - protein, 30 aa, Staphylococcus
RLDEELKEAYDLGIRAVIFFGVPNEKDSVG

SEQ ID NO: 2037223 - protein, 28 aa, Staphylococcus
RLDGATKEFFAWGFRVGFITFGVEDAST

SEQ ID NO: 2037224 - protein, 29 aa, Staphylococcus
RLDGATKEFFAWGLRVGFITFGIKDEMTK

SEQ ID NO: 2037225 - protein, 30 aa, Staphylococcus
RLDGATKEFFAWGLRVGFLTFGLNNNVAKE

SEQ ID NO: 2037226 - protein, 30 aa, Staphylococcus
RLDGATKEFFAWGLRVGFLTFGLSNQKAKD

SEQ ID NO: 2037227 - protein, 27 aa, Staphylococcus
RLDGATKEFFAWGLRVGFMSFGVSNET

SEQ ID NO: 2037228 - protein, 20 aa, Staphylococcus
RLDHEFKTKILPTLTPLGID

SEQ ID NO: 2037229 - protein, 28 aa, Staphylococcus
RLDLQQFVKYLLCLQQLPHAIITSDAML

SEQ ID NO: 2037230 - protein, 20 aa, Staphylococcus
RLDNQIKLRGYRIELGDIES

SEQ ID NO: 2037231 - protein, 22 aa, Staphylococcus
RLDRYFPEWHKVYSHVDKLNQD

SEQ ID NO: 2037232 - protein, 20 aa, Staphylococcus
RLDRYFPEWHQVYSKVEALN

SEQ ID NO: 2037233 - protein, 20 aa, Staphylococcus
RLDSRLVEAFNQLKEIQNNI

SEQ ID NO: 2037234 - protein, 19 aa, Staphylococcus
RLDTEAEIAYIKASMQPPK

SEQ ID NO: 2037235 - protein, 21 aa, Staphylococcus
RLEDAAGIALVGYAQFIDSEH

SEQ ID NO: 2037236 - protein, 18 aa, Staphylococcus
RLEDLGVHAVMPLASPIG

SEQ ID NO: 2037237 - protein, 19 aa, Staphylococcus
RLEELGVKAKAYAHDLKDE

SEQ ID NO: 2037238 - protein, 24 aa, Staphylococcus
RLEHKSFDEIAHWLKETRKVDMYP

SEQ ID NO: 2037239 - protein, 17 aa, Staphylococcus
RLEKELIHSRRGFDLTY

SEQ ID NO: 2037240 - protein, 25 aa, Staphylococcus
RLEKKIASGMSYFITQPVYSKEKII

SEQ ID NO: 2037241 - protein, 24 aa, Staphylococcus
RLEKLRKAIPNVLFQMLLRASNAV

SEQ ID NO: 2037242 - protein, 34 aa, Staphylococcus
RLELKIEIPNYFKMVEAYLWFDGQEVVGFSGTND

SEQ ID NO: 2037243 - protein, 25 aa, Staphylococcus
RLEPKFKSDIVPVGLTAKGAISKAG

SEQ ID NO: 2037244 - protein, 18 aa, Staphylococcus
RLEPVYRLKEGIKQKQMR

SEQ ID NO: 2037245 - protein, 24 aa, Staphylococcus
RLERLRKAIPNVLFQMLLRASNAV

SEQ ID NO: 2037246 - protein, 25 aa, Staphylococcus
RLERLRQAIPNVLFQMLLRASNAVG

SEQ ID NO: 2037247 - protein, 17 aa, Staphylococcus
RLFEKALAEREYYYHID

SEQ ID NO: 2037248 - protein, 19 aa, Staphylococcus
RLFNKIIYIENVFNEKHFK

SEQ ID NO: 2037249 - protein, 30 aa, Staphylococcus
RLFRRTKASINEMFSRMQSVSSQIDRITIQ

SEQ ID NO: 2037250 - protein, 31 aa, Staphylococcus
RLFRRTKASINEVFSRMQSVSSQVDRITIQL

SEQ ID NO: 2037251 - protein, 19 aa, Staphylococcus
RLFYLAMNPQFFKIITQSI

SEQ ID NO: 2037252 - protein, 17 aa, Staphylococcus
RLGAKRADGQFVTGGSI

SEQ ID NO: 2037253 - protein, 18 aa, Staphylococcus
RLGAKRADGQFVTGGSIL

SEQ ID NO: 2037254 - protein, 21 aa, Staphylococcus
RLGDMSEAITPYAFPDSADKQ

SEQ ID NO: 2037255 - protein, 17 aa, Staphylococcus
RLGEIYTSIARKVIAST

SEQ ID NO: 2037256 - protein, 19 aa, Staphylococcus
RLGEVFEANGLRMHATNLG

SEQ ID NO: 2037257 - protein, 31 aa, Staphylococcus
RLGFPEARIPLSQAVIELCLSPKSNSGINAI

SEQ ID NO: 2037258 - protein, 31 aa, Staphylococcus
RLGFPEARIPLSQAVIELCLSPKSNSGISAI

SEQ ID NO: 2037259 - protein, 24 aa, Staphylococcus
RLGFPEARIPLSQAVIELSLSPKS

SEQ ID NO: 2037260 - protein, 17 aa, Staphylococcus
RLGHAIVALPGGCAIGS

SEQ ID NO: 2037261 - protein, 18 aa, Staphylococcus
RLGINATIRREQGSDIDA

SEQ ID NO: 2037262 - protein, 21 aa, Staphylococcus
RLGINTIKWELEDTALRYIDS

SEQ ID NO: 2037263 - protein, 26 aa, Staphylococcus
RLGKSRPYIANMLRLLHLPSAIMKMV

SEQ ID NO: 2037264 - protein, 25 aa, Staphylococcus
RLGKSRPYIANMLRLLNLPTDITQY

SEQ ID NO: 2037265 - protein, 24 aa, Staphylococcus
RLGLPEARIPLSQAVIELSLSPKS

SEQ ID NO: 2037266 - protein, 19 aa, Staphylococcus
RLGTLILGRVKDDFNENDL

SEQ ID NO: 2037267 - protein, 18 aa, Staphylococcus
RLGWIEGEKGVWNYTLFI

SEQ ID NO: 2037268 - protein, 20 aa, Staphylococcus
RLHRLRPILPNGTVTVGNSC

SEQ ID NO: 2037269 - protein, 26 aa, Staphylococcus
RLHTVRFATSSSRFMMTIFDQFIDQY

SEQ ID NO: 2037270 - protein, 24 aa, Staphylococcus
RLIAADLVDFDWLDGFDIECRNEE

SEQ ID NO: 2037271 - protein, 18 aa, Staphylococcus
RLIAADLVELDWAEGFDI

SEQ ID NO: 2037272 - protein, 23 aa, Staphylococcus
RLIERPCPEWSIVEMNDVLYHHS

SEQ ID NO: 2037273 - protein, 22 aa, Staphylococcus
RLIKADVKGILNFTPARIDAPN

SEQ ID NO: 2037274 - protein, 21 aa, Staphylococcus
RLINKEILEFASPSTKFFYCG

SEQ ID NO: 2037275 - protein, 23 aa, Staphylococcus
RLIPLSEGYIYFKDKPVSDYPVY

SEQ ID NO: 2037276 - protein, 19 aa, Staphylococcus
RLKADRIEFNAAGENLAYG

SEQ ID NO: 2037277 - protein, 21 aa, Staphylococcus
RLKAKGQHAVMYGKEPIDISG

SEQ ID NO: 2037278 - protein, 19 aa, Staphylococcus
RLKDALLSCGEDFNARLIA

SEQ ID NO: 2037279 - protein, 18 aa, Staphylococcus
RLKDLVIENHYDLSSTLS

SEQ ID NO: 2037280 - protein, 22 aa, Staphylococcus
RLKDVVKAFLIEQNHDVVDVTE

SEQ ID NO: 2037281 - protein, 20 aa, Staphylococcus
RLKEARFKFNNNELSLDELT

SEQ ID NO: 2037282 - protein, 26 aa, Staphylococcus
RLKEHESFNFFSLFTFHEPVEQVVTH

SEQ ID NO: 2037283 - protein, 20 aa, Staphylococcus
RLKEKLTYLSEDKMKEVDDA

SEQ ID NO: 2037284 - protein, 17 aa, Staphylococcus
RLKFEYESLDHFENNDV

SEQ ID NO: 2037285 - protein, 18 aa, Staphylococcus
RLKGFEANVMYHNRSRHR

SEQ ID NO: 2037286 - protein, 26 aa, Staphylococcus
RLKGNCPYMEAPPCLTCNSGKPCKDL

SEQ ID NO: 2037287 - protein, 26 aa, Staphylococcus
RLKHEYEIITKMGFEDYFLIVSDLIH

SEQ ID NO: 2037288 - protein, 18 aa, Staphylococcus
RLKIAKQLEKWGVDIIEA

SEQ ID NO: 2037289 - protein, 19 aa, Staphylococcus
RLKILRSIRQSGSKTLCVC

SEQ ID NO: 2037290 - protein, 19 aa, Staphylococcus
RLKLYKEEFDQLTYFQIKL

SEQ ID NO: 2037291 - protein, 22 aa, Staphylococcus
RLKNGEINYIITVDLFNEGIDI

SEQ ID NO: 2037292 - protein, 22 aa, Staphylococcus
RLKQEHGLKFEPCATKYLKISG

SEQ ID NO: 2037293 - protein, 26 aa, Staphylococcus
RLKTFSTRLGVEYSYDDAALLKGADY

SEQ ID NO: 2037294 - protein, 20 aa, Staphylococcus
RLKTVLLKRPGKELENLVPN

SEQ ID NO: 2037295 - protein, 26 aa, Staphylococcus
RLKWKDLFHDFEMHFYRYVFPYYDTL

SEQ ID NO: 2037296 - protein, 23 aa, Staphylococcus
RLLAGLLSGIGIESVLSGDVSIG

SEQ ID NO: 2037297 - protein, 19 aa, Staphylococcus
RLLAQIFKHLGLLSKGHLI

SEQ ID NO: 2037298 - protein, 21 aa, Staphylococcus
RLLDDYRWQFGVPPKGNANYA

SEQ ID NO: 2037299 - protein, 18 aa, Staphylococcus
RLLDFGVHPPTIYFPLNV

SEQ ID NO: 2037300 - protein, 21 aa, Staphylococcus
RLLDFKAEFFEQYGLNVDNPK

SEQ ID NO: 2037301 - protein, 19 aa, Staphylococcus
RLLEEGYEVAGLTTSQNGK

SEQ ID NO: 2037302 - protein, 18 aa, Staphylococcus
RLLELVEVFEEKETLLTD

SEQ ID NO: 2037303 - protein, 18 aa, Staphylococcus
RLLGIQPFARCFEMKEAC

SEQ ID NO: 2037304 - protein, 19 aa, Staphylococcus
RLLHINKLVPIYVNQQTIL

SEQ ID NO: 2037305 - protein, 18 aa, Staphylococcus
RLLKGVVRGIGGYGNCIG

SEQ ID NO: 2037306 - protein, 17 aa, Staphylococcus
RLLNINKLIPIYINRDT

SEQ ID NO: 2037307 - protein, 19 aa, Staphylococcus
RLLPDEIDRVVVLVNPTLQ

SEQ ID NO: 2037308 - protein, 17 aa, Staphylococcus
RLLPEFTGHNYAFEAIS

SEQ ID NO: 2037309 - protein, 19 aa, Staphylococcus
RLLPGGYLFLSDLMGNPTL

SEQ ID NO: 2037310 - protein, 19 aa, Staphylococcus
RLLPGGYLFLSDLVGNPTL

SEQ ID NO: 2037311 - protein, 19 aa, Staphylococcus
RLLPGTKLQSGLHQAIEAK

SEQ ID NO: 2037312 - protein, 27 aa, Staphylococcus
RLLQRPHHQRFLIIFSDGEPSAYNYDQ

SEQ ID NO: 2037313 - protein, 20 aa, Staphylococcus
RLLTEHLGADFLKVTPGIRP

SEQ ID NO: 2037314 - protein, 24 aa, Staphylococcus
RLMGKRITGDFILENDISEGTHFC

SEQ ID NO: 2037315 - protein, 22 aa, Staphylococcus
RLMKQAEKFKRPIFTFIDTKGA

SEQ ID NO: 2037316 - protein, 17 aa, Staphylococcus
RLMKQAEKFNRPIFTFI

SEQ ID NO: 2037317 - protein, 21 aa, Staphylococcus
RLMLESFAFSKIKHIDRAPIT

SEQ ID NO: 2037318 - protein, 21 aa, Staphylococcus
RLMLESFAFSKLKHMDRKKVI

SEQ ID NO: 2037319 - protein, 22 aa, Staphylococcus
RLMLESFAFSRLRSQDTQPIAK

SEQ ID NO: 2037320 - protein, 18 aa, Staphylococcus
RLNAPFILISDPRIEGGA

SEQ ID NO: 2037321 - protein, 18 aa, Staphylococcus
RLNCEGYKIIKVERRSKY

SEQ ID NO: 2037322 - protein, 35 aa, Staphylococcus
RLNDLHEVNPMLGHRGCRLAVTYPELAEMQAEAII

SEQ ID NO: 2037323 - protein, 19 aa, Staphylococcus
RLNEVGYRILATQGTARKL

SEQ ID NO: 2037324 - protein, 17 aa, Staphylococcus
RLNEVMYALQFSGIGGK

SEQ ID NO: 2037325 - protein, 21 aa, Staphylococcus
RLNGDCILFLGTGAIAQRTAK

SEQ ID NO: 2037326 - protein, 26 aa, Staphylococcus
RLNHEFKIITNMGFEDYFLIVSDLIH

SEQ ID NO: 2037327 - protein, 18 aa, Staphylococcus
RLNIAVGGGDHLVSEALY

SEQ ID NO: 2037328 - protein, 21 aa, Staphylococcus
RLNKKAIEVVIEFKKLNSKLI

SEQ ID NO: 2037329 - protein, 19 aa, Staphylococcus
RLNKYKGDVMLIVNTASQC

SEQ ID NO: 2037330 - protein, 26 aa, Staphylococcus
RLNNGYKYWVDLGWKETDKKDDMIAF

SEQ ID NO: 2037331 - protein, 26 aa, Staphylococcus
RLNNGYKYWVDLGWKETDKKDDMISF

SEQ ID NO: 2037332 - protein, 19 aa, Staphylococcus
RLNNIISFEQHKVWRKHVM

SEQ ID NO: 2037333 - protein, 25 aa, Staphylococcus
RLNPEITSKELLTFKNVIEKLTGET

SEQ ID NO: 2037334 - protein, 20 aa, Staphylococcus
RLNQKVGYYSERALKGYEGQ

SEQ ID NO: 2037335 - protein, 25 aa, Staphylococcus
RLNSLNKLNFEFGIVQTLLTIKVAK

SEQ ID NO: 2037336 - protein, 21 aa, Staphylococcus
RLNYAGFYRLHHSYKKKVVMA

SEQ ID NO: 2037337 - protein, 31 aa, Staphylococcus
RLNYHTRRLCHSCSQLGFQFSENAWYSYIEN

SEQ ID NO: 2037338 - protein, 20 aa, Staphylococcus
RLNYVGFYRLHHPYKKKVMM

SEQ ID NO: 2037339 - protein, 22 aa, Staphylococcus
RLPEICELLVKFGKDPQTPVAL

SEQ ID NO: 2037340 - protein, 20 aa, Staphylococcus
RLPEICELLVRHGKSVDTPV

SEQ ID NO: 2037341 - protein, 19 aa, Staphylococcus
RLPIKAALKQLSFFIQQDC

SEQ ID NO: 2037342 - protein, 23 aa, Staphylococcus
RLPNRIASSYIKEIDGVRILFVA

SEQ ID NO: 2037343 - protein, 18 aa, Staphylococcus
RLQFTDILGVIKNVEVPV

SEQ ID NO: 2037344 - protein, 20 aa, Staphylococcus
RLQGDLEKRESLNQNIDPLV

SEQ ID NO: 2037345 - protein, 17 aa, Staphylococcus
RLQGHGKSLSRLGGGIG

SEQ ID NO: 2037346 - protein, 19 aa, Staphylococcus
RLQLDYIDLYYIHFPDENT

SEQ ID NO: 2037347 - protein, 24 aa, Staphylococcus
RLQPWDFAGGLIILNEVGGKGSNL

SEQ ID NO: 2037348 - protein, 24 aa, Staphylococcus
RLQPWDFAGGLIILNEVGGVGSDL

SEQ ID NO: 2037349 - protein, 24 aa, Staphylococcus
RLQPWDFAGGLIILNEVGGVGTNL

SEQ ID NO: 2037350 - protein, 19 aa, Staphylococcus
RLQPWDFAGGLIVLNEVGG

SEQ ID NO: 2037351 - protein, 18 aa, Staphylococcus
RLQPWDYAGGLMILNEVG

SEQ ID NO: 2037352 - protein, 26 aa, Staphylococcus
RLQQEMYDIAGLRMMCQFVDDIDVVV

SEQ ID NO: 2037353 - protein, 25 aa, Staphylococcus
RLQQEYKLKFKPCETKELKISGGDV

SEQ ID NO: 2037354 - protein, 17 aa, Staphylococcus
RLQRLNKKVGHYSEKAM

SEQ ID NO: 2037355 - protein, 19 aa, Staphylococcus
RLQSFGMKVLAYDPYLTED

SEQ ID NO: 2037356 - protein, 20 aa, Staphylococcus
RLQYQIIDMLSKILDKHPLP

SEQ ID NO: 2037357 - protein, 26 aa, Staphylococcus
RLRDITELFLDSGLGKEAFSIISQGR

SEQ ID NO: 2037358 - protein, 18 aa, Staphylococcus
RLREEMYDIAGLRIMCQF

SEQ ID NO: 2037359 - protein, 22 aa, Staphylococcus
RLRKKLADFGLDTAIETRVGKG

SEQ ID NO: 2037360 - protein, 20 aa, Staphylococcus
RLRKKLAEIGMDDAIETKVG

SEQ ID NO: 2037361 - protein, 22 aa, Staphylococcus
RLRKLCRPDTPAIIVTRDIEPP

SEQ ID NO: 2037362 - protein, 22 aa, Staphylococcus
RLRQIIKSVYYFAVANPQPEQW

SEQ ID NO: 2037363 - protein, 26 aa, Staphylococcus
RLRQKLSRLGASISIHTVRGQGYKVN

SEQ ID NO: 2037364 - protein, 20 aa, Staphylococcus
RLRSGEVRMVLSTCRATIGQ

SEQ ID NO: 2037365 - protein, 31 aa, Staphylococcus
RLRTGMMTEEDWNRFTIAVGKLSRTKIFIDD

SEQ ID NO: 2037366 - protein, 18 aa, Staphylococcus
RLRTGTMTEEDWSRFTIA

SEQ ID NO: 2037367 - protein, 19 aa, Staphylococcus
RLSARECAILQTFPDDFVF

SEQ ID NO: 2037368 - protein, 23 aa, Staphylococcus
RLSHIEFGHLLLGSHRFVDENRE

SEQ ID NO: 2037369 - protein, 19 aa, Staphylococcus
RLSHRVFQEVGGFTEQRLS

SEQ ID NO: 2037370 - protein, 19 aa, Staphylococcus
RLSKHWNNHNMAWSDFMQK

SEQ ID NO: 2037371 - protein, 25 aa, Staphylococcus
RLSKSRPYIANMLRLLNLPQTVSNM

SEQ ID NO: 2037372 - protein, 19 aa, Staphylococcus
RLSNELLLTLDAKYSSFIA

SEQ ID NO: 2037373 - protein, 19 aa, Staphylococcus
RLSNISFSIGQGEVIGLIG

SEQ ID NO: 2037374 - protein, 30 aa, Staphylococcus
RLSNLNLDFSQFAGFKSYRFLRPEEGTTYK

SEQ ID NO: 2037375 - protein, 23 aa, Staphylococcus
RLSPDALGLIAYFMIENRNTIPY

SEQ ID NO: 2037376 - protein, 18 aa, Staphylococcus
RLSPEKGIDLLIQAIHEL

SEQ ID NO: 2037377 - protein, 17 aa, Staphylococcus
RLSQFDLTMKVGKEQSI

SEQ ID NO: 2037378 - protein, 20 aa, Staphylococcus
RLSYEAGRIPVKYTAQASSP

SEQ ID NO: 2037379 - protein, 18 aa, Staphylococcus
RLTAGTFFIKLNEKQVPE

SEQ ID NO: 2037380 - protein, 17 aa, Staphylococcus
RLTDLGHELGLISNERY

SEQ ID NO: 2037381 - protein, 24 aa, Staphylococcus
RLTEEGFATLAFDAAHQGEIAAEP

SEQ ID NO: 2037382 - protein, 22 aa, Staphylococcus
RLTEGTGIFVVLVRSYSHFSMQ

SEQ ID NO: 2037383 - protein, 21 aa, Staphylococcus
RLTEILKQRIEESGVTPNSDA

SEQ ID NO: 2037384 - protein, 18 aa, Staphylococcus
RLTGPDGIQFRFNFYKVI

SEQ ID NO: 2037385 - protein, 21 aa, Staphylococcus
RLTIQKKHHWASKNTQPPVDK

SEQ ID NO: 2037386 - protein, 18 aa, Staphylococcus
RLTKPLVRKDGEFHEVEW

SEQ ID NO: 2037387 - protein, 18 aa, Staphylococcus
RLTKPLVRKDGQFHEVEW

SEQ ID NO: 2037388 - protein, 17 aa, Staphylococcus
RLTKQYAAPSKSLAKSY

SEQ ID NO: 2037389 - protein, 28 aa, Staphylococcus
RLTWKDLFRDFEMHFYRYVFPYYDTLYT

SEQ ID NO: 2037390 - protein, 21 aa, Staphylococcus
RLTWRDLFNDFEMHFYRYVFP

SEQ ID NO: 2037391 - protein, 25 aa, Staphylococcus
RLVDDEIGCPWDKIQTHQTLKRYLL

SEQ ID NO: 2037392 - protein, 17 aa, Staphylococcus
RLVDFKVEFGKTENGDI

SEQ ID NO: 2037393 - protein, 19 aa, Staphylococcus
RLVDFKVEFGKTHDGEILL

SEQ ID NO: 2037394 - protein, 28 aa, Staphylococcus
RLVERLPGMVLPSWAYNMIAPVSINDVI

SEQ ID NO: 2037395 - protein, 19 aa, Staphylococcus
RLVGYPPYRYLLNKRLQNA

SEQ ID NO: 2037396 - protein, 21 aa, Staphylococcus
RLVKEKCDFYIKIPMVGHINS

SEQ ID NO: 2037397 - protein, 17 aa, Staphylococcus
RLVKEQKKSLVKDEATQ

SEQ ID NO: 2037398 - protein, 17 aa, Staphylococcus
RLVPYYIHQNYWFLYYH

SEQ ID NO: 2037399 - protein, 19 aa, Staphylococcus
RLVTQEGLFLTANKDFIKI

SEQ ID NO: 2037400 - protein, 24 aa, Staphylococcus
RLYDEIRLPITDLYVHLTRHAHGN

SEQ ID NO: 2037401 - protein, 32 aa, Staphylococcus
RLYDRGERILARFPEKLSHYIEKWFKKNNVTV

SEQ ID NO: 2037402 - protein, 18 aa, Staphylococcus
RLYIEEGCDIQKEYYVGF

SEQ ID NO: 2037403 - protein, 19 aa, Staphylococcus
RLYLARKQIEFYGAEQELE

SEQ ID NO: 2037404 - protein, 19 aa, Staphylococcus
RLYNGLKKEGAILMPKTEM

SEQ ID NO: 2037405 - protein, 24 aa, Staphylococcus
RLYPDVKLTIGPVIEHGFYYDIDL

SEQ ID NO: 2037406 - protein, 21 aa, Staphylococcus
RLYPELPHAEYICFYPMDKRR

SEQ ID NO: 2037407 - protein, 19 aa, Staphylococcus
RLYRLKVEIDKDGQFTHVI

SEQ ID NO: 2037408 - protein, 19 aa, Staphylococcus
RLYSDNAVDSFVYVPEDGY

SEQ ID NO: 2037409 - protein, 17 aa, Staphylococcus
RLYSMIDYFYSLVEKDE

SEQ ID NO: 2037410 - protein, 20 aa, Staphylococcus
RLYYQCKILAQKGYSGQQIA

SEQ ID NO: 2037411 - protein, 24 aa, Staphylococcus
RMAMSHPDIRISLISDGKTIMKTN

SEQ ID NO: 2037412 - protein, 23 aa, Staphylococcus
RMAMSHPDIRISLLSDGKTLIST

SEQ ID NO: 2037413 - protein, 24 aa, Staphylococcus
RMAMSHPDIRISLVSDGKTLLKTN

SEQ ID NO: 2037414 - protein, 18 aa, Staphylococcus
RMEMEPITPAIMLNKINA

SEQ ID NO: 2037415 - protein, 18 aa, Staphylococcus
RMFEYGGGFIQDRSIYED

SEQ ID NO: 2037416 - protein, 18 aa, Staphylococcus
RMGAEMIITLSGIINAFE

SEQ ID NO: 2037417 - protein, 19 aa, Staphylococcus
RMGTYYMEESFGFRSGKVI

SEQ ID NO: 2037418 - protein, 18 aa, Staphylococcus
RMGYRLVGPSVSPLKTAD

SEQ ID NO: 2037419 - protein, 21 aa, Staphylococcus
RMHAKGSGAFGTFTVTNDITE

SEQ ID NO: 2037420 - protein, 19 aa, Staphylococcus
RMHGIKAQILILGVIPIED

SEQ ID NO: 2037421 - protein, 17 aa, Staphylococcus
RMHVTLTKSKQWLDNLK

SEQ ID NO: 2037422 - protein, 17 aa, Staphylococcus
RMICSSGNVDSNRLRTG

SEQ ID NO: 2037423 - protein, 18 aa, Staphylococcus
RMICSSGNVDSNRLRTGM

SEQ ID NO: 2037424 - protein, 17 aa, Staphylococcus
RMIIPSKFRYDLNERFI

SEQ ID NO: 2037425 - protein, 20 aa, Staphylococcus
RMILEKILPILSERERQIIQ

SEQ ID NO: 2037426 - protein, 20 aa, Staphylococcus
RMINHHKMAILFQKTNFPKF

SEQ ID NO: 2037427 - protein, 20 aa, Staphylococcus
RMKGMIRGSDAFIFESNHDV

SEQ ID NO: 2037428 - protein, 20 aa, Staphylococcus
RMKLRKKQIYSFIRKSITGQ

SEQ ID NO: 2037429 - protein, 18 aa, Staphylococcus
RMKPSLPATFAVEEIESA

SEQ ID NO: 2037430 - protein, 21 aa, Staphylococcus
RMKSKSIQVVVEFKEVPMNLY

SEQ ID NO: 2037431 - protein, 25 aa, Staphylococcus
RMLNIHPSLLPKYKGLDAIGQAFDS

SEQ ID NO: 2037432 - protein, 23 aa, Staphylococcus
RMNDLRIFLPNARDEDWEVVIAG

SEQ ID NO: 2037433 - protein, 23 aa, Staphylococcus
RMNEAGLPVVFVINQIDKHQEEE

SEQ ID NO: 2037434 - protein, 19 aa, Staphylococcus
RMNEDIPFITDNGNYILDC

SEQ ID NO: 2037435 - protein, 24 aa, Staphylococcus
RMNEIKHQLKATVEHRERYRSKRR

SEQ ID NO: 2037436 - protein, 18 aa, Staphylococcus
RMNEIKHQLKTVVEHRER

SEQ ID NO: 2037437 - protein, 18 aa, Staphylococcus
RMNERSFVLIPLNDIASN

SEQ ID NO: 2037438 - protein, 22 aa, Staphylococcus
RMNQNIVKIAVFGTFSAGKSSL

SEQ ID NO: 2037439 - protein, 25 aa, Staphylococcus
RMRKLCRPDTPAIIVTRGLEPPKEL

SEQ ID NO: 2037440 - protein, 25 aa, Staphylococcus
RMRKLCRPDTPAIIVTRGLEPPNEL

SEQ ID NO: 2037441 - protein, 27 aa, Staphylococcus
RMRKLCRPETPAIIVTRGLEPPEELIS

SEQ ID NO: 2037442 - protein, 27 aa, Staphylococcus
RMRKLCRPETPAIIVTRGLEPPQELID

SEQ ID NO: 2037443 - protein, 18 aa, Staphylococcus
RMSERAFVLIPLNDIAPT

SEQ ID NO: 2037444 - protein, 18 aa, Staphylococcus
RMTERAFVLIPLNDIAST

SEQ ID NO: 2037445 - protein, 18 aa, Staphylococcus
RMVMELKNNTDYQVLVKV

SEQ ID NO: 2037446 - protein, 19 aa, Staphylococcus
RMWCDKFEVDIHIKKRKGI

SEQ ID NO: 2037447 - protein, 26 aa, Staphylococcus
RMWNLQSEYPWIVKVIIRDQQVFLNS

SEQ ID NO: 2037448 - protein, 31 aa, Staphylococcus
RMYQVLSMKSKRDYLFFKLAIHTGIRLTDLL

SEQ ID NO: 2037449 - protein, 17 aa, Staphylococcus
RNAGLELAQPITIGNNI

SEQ ID NO: 2037450 - protein, 18 aa, Staphylococcus
RNAIIVYTLVKPEMKTYM

SEQ ID NO: 2037451 - protein, 24 aa, Staphylococcus
RNAKESFLKYLIRMSTRGTPYGLL

SEQ ID NO: 2037452 - protein, 18 aa, Staphylococcus
RNAVFDLYFRSMPFESGY

SEQ ID NO: 2037453 - protein, 23 aa, Staphylococcus
RNDALRIAHLDLFETKSILENVI

SEQ ID NO: 2037454 - protein, 24 aa, Staphylococcus
RNDEWSDHMKFPTAVIDEVLKAKS

SEQ ID NO: 2037455 - protein, 20 aa, Staphylococcus
RNDIALFKPLFKNWHKYNRE

SEQ ID NO: 2037456 - protein, 17 aa, Staphylococcus
RNDIHYFNFIKRNAQNI

SEQ ID NO: 2037457 - protein, 17 aa, Staphylococcus
RNEALDFDDLIMVTIRL

SEQ ID NO: 2037458 - protein, 25 aa, Staphylococcus
RNEEASFKMAALILNKYHLPINRET

SEQ ID NO: 2037459 - protein, 19 aa, Staphylococcus
RNEEFNQAIELGRSLGVEV

SEQ ID NO: 2037460 - protein, 19 aa, Staphylococcus
RNEENFSYYDRFRDRIMFP

SEQ ID NO: 2037461 - protein, 26 aa, Staphylococcus
RNEFELRKKRLVEIKNDINSHFEDEP

SEQ ID NO: 2037462 - protein, 17 aa, Staphylococcus
RNELKLYIEDCKLEDEE

SEQ ID NO: 2037463 - protein, 23 aa, Staphylococcus
RNERGITFGLFRLSVGLEQPQEL

SEQ ID NO: 2037464 - protein, 19 aa, Staphylococcus
RNETIEWTKKMGADIVLNH

SEQ ID NO: 2037465 - protein, 27 aa, Staphylococcus
RNEVTRVHMVICCYYGLGISQLLETKL

SEQ ID NO: 2037466 - protein, 17 aa, Staphylococcus
RNFDYAVEIIDRLVDDE

SEQ ID NO: 2037467 - protein, 25 aa, Staphylococcus
RNFGVNFKTVMKWKEDHSEFMEAIK

SEQ ID NO: 2037468 - protein, 17 aa, Staphylococcus
RNFKSFLSQYLPAQSGE

SEQ ID NO: 2037469 - protein, 20 aa, Staphylococcus
RNGESLPKEFSRPEVAEVLI

SEQ ID NO: 2037470 - protein, 19 aa, Staphylococcus
RNGIKATFKGKVDGPTIAF

SEQ ID NO: 2037471 - protein, 18 aa, Staphylococcus
RNGKILAEDVERYKVVAV

SEQ ID NO: 2037472 - protein, 18 aa, Staphylococcus
RNGKVLAEDVERFKLTAV

SEQ ID NO: 2037473 - protein, 18 aa, Staphylococcus
RNGKVLAEDVERYKVVAI

SEQ ID NO: 2037474 - protein, 18 aa, Staphylococcus
RNHFMVDYFNEYRQLLRS

SEQ ID NO: 2037475 - protein, 17 aa, Staphylococcus
RNHIWQPRLEMYEVPSH

SEQ ID NO: 2037476 - protein, 24 aa, Staphylococcus
RNHRRLGKQLKLFMFSEEAPGMPF

SEQ ID NO: 2037477 - protein, 17 aa, Staphylococcus
RNIAAELGQYGITANVV

SEQ ID NO: 2037478 - protein, 19 aa, Staphylococcus
RNIAAELGQYGITANVVSG

SEQ ID NO: 2037479 - protein, 17 aa, Staphylococcus
RNIAAELGQYGVTANVV

SEQ ID NO: 2037480 - protein, 21 aa, Staphylococcus
RNIAESVYYYFTGEHFDKYDR

SEQ ID NO: 2037481 - protein, 19 aa, Staphylococcus
RNIDQNQLFLISGKTGSGK

SEQ ID NO: 2037482 - protein, 21 aa, Staphylococcus
RNIELEGGRYLVFDAKGPVPE

SEQ ID NO: 2037483 - protein, 21 aa, Staphylococcus
RNIFFEKALKVIRPVYLNFSK

SEQ ID NO: 2037484 - protein, 26 aa, Staphylococcus
RNIFFEKALKVLRPVYLNQSTIPTFY

SEQ ID NO: 2037485 - protein, 24 aa, Staphylococcus
RNIGLELALPITIGNNIWIGGNVV

SEQ ID NO: 2037486 - protein, 18 aa, Staphylococcus
RNIIKQLYFFSIANPDPF

SEQ ID NO: 2037487 - protein, 18 aa, Staphylococcus
RNIIKRLYFFSIANPNPF

SEQ ID NO: 2037488 - protein, 17 aa, Staphylococcus
RNIMTFLGVPSYETVII

SEQ ID NO: 2037489 - protein, 23 aa, Staphylococcus
RNINFIPITALDNYIMKINKPIA

SEQ ID NO: 2037490 - protein, 20 aa, Staphylococcus
RNINQIILLFSLTNELRMTI

SEQ ID NO: 2037491 - protein, 18 aa, Staphylococcus
RNIPDYVIALKEMNRVLK

SEQ ID NO: 2037492 - protein, 17 aa, Staphylococcus
RNIPYNEIESINMTDDG

SEQ ID NO: 2037493 - protein, 19 aa, Staphylococcus
RNIQYYTEIVFKHATKRKL

SEQ ID NO: 2037494 - protein, 25 aa, Staphylococcus
RNIVANLALKRRLIQTADSIANDGY

SEQ ID NO: 2037495 - protein, 25 aa, Staphylococcus
RNKALEVAQGKWILFIDSDDYITTN

SEQ ID NO: 2037496 - protein, 17 aa, Staphylococcus
RNKECGLLLAYEKTGYD

SEQ ID NO: 2037497 - protein, 20 aa, Staphylococcus
RNKEIHQVCGLDVKAIEDYQ

SEQ ID NO: 2037498 - protein, 22 aa, Staphylococcus
RNKFARYFVMEFEKEIIGYIGM

SEQ ID NO: 2037499 - protein, 24 aa, Staphylococcus
RNKIVKFEGCYHGHSDSLLIKAGS

SEQ ID NO: 2037500 - protein, 25 aa, Staphylococcus
RNKLRRLGIKKGIPVVFSDESPIVI

SEQ ID NO: 2037501 - protein, 24 aa, Staphylococcus
RNKQGIRIFNEITMDTLMAIAHYR

SEQ ID NO: 2037502 - protein, 21 aa, Staphylococcus
RNKVKIPFIDWTINLFYEHGW

SEQ ID NO: 2037503 - protein, 19 aa, Staphylococcus
RNLANGIAFASSSAADNFF

SEQ ID NO: 2037504 - protein, 23 aa, Staphylococcus
RNLDKGVAFGAMFEDSEDLMHQK

SEQ ID NO: 2037505 - protein, 24 aa, Staphylococcus
RNLDKGVAFGAMFSDSEDLMHQRN

SEQ ID NO: 2037506 - protein, 20 aa, Staphylococcus
RNLKKLKVEHFFLEVIGSDK

SEQ ID NO: 2037507 - protein, 26 aa, Staphylococcus
RNLKNALKLMKLCQKYHVHILSVHDG

SEQ ID NO: 2037508 - protein, 25 aa, Staphylococcus
RNLKNALKLMKLCQTYHVHILSVRD

SEQ ID NO: 2037509 - protein, 25 aa, Staphylococcus
RNLLFLSFAGALAYQVNAKHIITGV

SEQ ID NO: 2037510 - protein, 18 aa, Staphylococcus
RNLNCSPKEYLTYIRMYH

SEQ ID NO: 2037511 - protein, 23 aa, Staphylococcus
RNLPETRKAEVLYEELAHHKLTY

SEQ ID NO: 2037512 - protein, 18 aa, Staphylococcus
RNLPIVAIDRVMNEDIPD

SEQ ID NO: 2037513 - protein, 18 aa, Staphylococcus
RNLTFSLMEVHKSLTTLT

SEQ ID NO: 2037514 - protein, 25 aa, Staphylococcus
RNMAADMPLAIVIGSEGQGMSRLVK

SEQ ID NO: 2037515 - protein, 17 aa, Staphylococcus
RNMKLEFHRNYERYQFL

SEQ ID NO: 2037516 - protein, 25 aa, Staphylococcus
RNNFDLRPAGIIKMLDLKHPIYKQT

SEQ ID NO: 2037517 - protein, 25 aa, Staphylococcus
RNNRSNWSPAMYRFSDAIDKAVQQV

SEQ ID NO: 2037518 - protein, 20 aa, Staphylococcus
RNNTEYPEIVFVGNHLSSSY

SEQ ID NO: 2037519 - protein, 29 aa, Staphylococcus
RNPENLPWKDLDIDIVIEATGKFNHGDKA

SEQ ID NO: 2037520 - protein, 29 aa, Staphylococcus
RNPENLPWKELDIDVVIEATGKFNHGDKA

SEQ ID NO: 2037521 - protein, 29 aa, Staphylococcus
RNPENLPWNELDIDIVIEATGKFNHGDKA

SEQ ID NO: 2037522 - protein, 17 aa, Staphylococcus
RNPFKSGLETFINSDLD

SEQ ID NO: 2037523 - protein, 25 aa, Staphylococcus
RNPFYLLKRANLFALTSHYEGQSMV

SEQ ID NO: 2037524 - protein, 19 aa, Staphylococcus
RNPIVCITGSMGKSSTRLM

SEQ ID NO: 2037525 - protein, 21 aa, Staphylococcus
RNPTLIPGWNTFRSTKLMQKV

SEQ ID NO: 2037526 - protein, 30 aa, Staphylococcus
RNPYVRHIAHPTGRIIGRRPGYEPNIEKLA

SEQ ID NO: 2037527 - protein, 17 aa, Staphylococcus
RNQALVYYRAVVKHHQL

SEQ ID NO: 2037528 - protein, 18 aa, Staphylococcus
RNQFNFPASMHKILDHLE

SEQ ID NO: 2037529 - protein, 19 aa, Staphylococcus
RNQILFKTVVPARCNQTEN

SEQ ID NO: 2037530 - protein, 24 aa, Staphylococcus
RNQMDLLEAIGLMKSFVKHDEQQT

SEQ ID NO: 2037531 - protein, 20 aa, Staphylococcus
RNRFKQGRLSSIEAEISEIK

SEQ ID NO: 2037532 - protein, 28 aa, Staphylococcus
RNRYWGTPLNVWICNDCNHEYAPSSIKD

SEQ ID NO: 2037533 - protein, 18 aa, Staphylococcus
RNSDEFIPDLSLVALHKD

SEQ ID NO: 2037534 - protein, 19 aa, Staphylococcus
RNSNEYPEIVFVGNHLSST

SEQ ID NO: 2037535 - protein, 19 aa, Staphylococcus
RNSQKLTLENYVLIYYLEK

SEQ ID NO: 2037536 - protein, 26 aa, Staphylococcus
RNTEKLYDRLIYRYGSSNSAFSLEQH

SEQ ID NO: 2037537 - protein, 19 aa, Staphylococcus
RNTQLKHTFLRQVMERYIP

SEQ ID NO: 2037538 - protein, 25 aa, Staphylococcus
RNTSSIYKGVSWCKTKNKWRAYITI

SEQ ID NO: 2037539 - protein, 40 aa, Staphylococcus
RNVAPEVRADILFRAAAITRRRKHEFSALLTKEGGKPWKE

SEQ ID NO: 2037540 - protein, 26 aa, Staphylococcus
RNVDFLRRRVKALTENALFKEMTMTE

SEQ ID NO: 2037541 - protein, 20 aa, Staphylococcus
RNVHDILMGLDIGDFPGVGK

SEQ ID NO: 2037542 - protein, 21 aa, Staphylococcus
RNVHGILDFYGYSRIDIPEFR

SEQ ID NO: 2037543 - protein, 22 aa, Staphylococcus
RNVHKPSGAKPGFVTYDNQKTL

SEQ ID NO: 2037544 - protein, 24 aa, Staphylococcus
RNVHKSVFHALDLARASSKLLKTS

SEQ ID NO: 2037545 - protein, 24 aa, Staphylococcus
RNVHKSVFHGLDIVQQPADIIAMT

SEQ ID NO: 2037546 - protein, 24 aa, Staphylococcus
RNVHKSVFHGLDLAKAQATFTAMH

SEQ ID NO: 2037547 - protein, 24 aa, Staphylococcus
RNVHKSVFHGLDLAQQKAQIMPMN

SEQ ID NO: 2037548 - protein, 21 aa, Staphylococcus
RNVHKSVFHGLDLTHQSADIL

SEQ ID NO: 2037549 - protein, 24 aa, Staphylococcus
RNVKKDIGMIFQHFNLLNSATVFK

SEQ ID NO: 2037550 - protein, 18 aa, Staphylococcus
RNVLDMHAPNGIFGNKLH

SEQ ID NO: 2037551 - protein, 21 aa, Staphylococcus
RNVNMLIRRGEHVAIIGDNGT

SEQ ID NO: 2037552 - protein, 19 aa, Staphylococcus
RNVVLDKEYAAPLITNDGV

SEQ ID NO: 2037553 - protein, 19 aa, Staphylococcus
RNVVLDKEYGAPLITNDGV

SEQ ID NO: 2037554 - protein, 20 aa, Staphylococcus
RNVYKRYALSDLPFPNQTKF

SEQ ID NO: 2037555 - protein, 26 aa, Staphylococcus
RNVYPEFDILDAYSIYQIDESQLLAR

SEQ ID NO: 2037556 - protein, 23 aa, Staphylococcus
RNYDFRWEPSILSQSIRDLTVAV

SEQ ID NO: 2037557 - protein, 23 aa, Staphylococcus
RNYGEGYGHVGIVLKATLNSITI

SEQ ID NO: 2037558 - protein, 30 aa, Staphylococcus
RNYPRLKELGIKWYAVPIISNMDLKIGGIT

SEQ ID NO: 2037559 - protein, 19 aa, Staphylococcus
RNYQMVKAIVQFQVANGMR

SEQ ID NO: 2037560 - protein, 26 aa, Staphylococcus
RNYVDFGIAFDSLWNLAVLPEEINAN

SEQ ID NO: 2037561 - protein, 22 aa, Staphylococcus
RNYVDFGIAFDSQWNFAVLPEE

SEQ ID NO: 2037562 - protein, 19 aa, Staphylococcus
RPAINAGFSVSRVGGSAQI

SEQ ID NO: 2037563 - protein, 17 aa, Staphylococcus
RPAMKRKNLDVETRAFV

SEQ ID NO: 2037564 - protein, 19 aa, Staphylococcus
RPANDPALFDATIKNIKKL

SEQ ID NO: 2037565 - protein, 19 aa, Staphylococcus
RPAQFKAERIQESLTGASF

SEQ ID NO: 2037566 - protein, 19 aa, Staphylococcus
RPASEITDLGWVDKKDTEK

SEQ ID NO: 2037567 - protein, 19 aa, Staphylococcus
RPATMLVQTASKFDSDIQL

SEQ ID NO: 2037568 - protein, 25 aa, Staphylococcus
RPDKERIAVEVLPLNNYVASAEEHQ

SEQ ID NO: 2037569 - protein, 20 aa, Staphylococcus
RPDMPASRIANYIRRDIYEQ

SEQ ID NO: 2037570 - protein, 17 aa, Staphylococcus
RPDRAAQLSEVFTNKAF

SEQ ID NO: 2037571 - protein, 19 aa, Staphylococcus
RPDTIFGTTFLVLSPEHAL

SEQ ID NO: 2037572 - protein, 21 aa, Staphylococcus
RPEAIKMAPLVDQLKKEPSLE

SEQ ID NO: 2037573 - protein, 23 aa, Staphylococcus
RPEAIKMAPLVKALEKDSMLEPI

SEQ ID NO: 2037574 - protein, 23 aa, Staphylococcus
RPEAIKMAPLVKALEYDAELEPM

SEQ ID NO: 2037575 - protein, 22 aa, Staphylococcus
RPEAIKMAPLVKELQKSKNLKP

SEQ ID NO: 2037576 - protein, 21 aa, Staphylococcus
RPEDLQSYGLIPEFIGRIPIV

SEQ ID NO: 2037577 - protein, 20 aa, Staphylococcus
RPEGTLPYSMPTHCPSCDHE

SEQ ID NO: 2037578 - protein, 21 aa, Staphylococcus
RPEIIRLSATIKACDKYFNQV

SEQ ID NO: 2037579 - protein, 31 aa, Staphylococcus
RPENEVNYIMNLPVNFLKTFLPELIENNVKV

SEQ ID NO: 2037580 - protein, 25 aa, Staphylococcus
RPESIQWSLKMGADIVLNHHDDLVQ

SEQ ID NO: 2037581 - protein, 21 aa, Staphylococcus
RPESLFNYFKQLFAQVTNPPI

SEQ ID NO: 2037582 - protein, 19 aa, Staphylococcus
RPETEEVMLHFLNGCHSQG

SEQ ID NO: 2037583 - protein, 17 aa, Staphylococcus
RPFPNGVRITIGFEEQN

SEQ ID NO: 2037584 - protein, 20 aa, Staphylococcus
RPFSFEGRKRQTQAAAGVES

SEQ ID NO: 2037585 - protein, 19 aa, Staphylococcus
RPGCSFDKAKDDGFEVYPV

SEQ ID NO: 2037586 - protein, 25 aa, Staphylococcus
RPGEPEELGGIVVYLASDASSFAQG

SEQ ID NO: 2037587 - protein, 24 aa, Staphylococcus
RPGEPHELGGIVVYLASDASTFAQ

SEQ ID NO: 2037588 - protein, 19 aa, Staphylococcus
RPGEYNQYDYLPIGVSVVI

SEQ ID NO: 2037589 - protein, 20 aa, Staphylococcus
RPGFLRFQAQIMPKKLVFSG

SEQ ID NO: 2037590 - protein, 19 aa, Staphylococcus
RPGHADLIGGIKYNHRDLR

SEQ ID NO: 2037591 - protein, 18 aa, Staphylococcus
RPGKELENLVPDHLSGLL

SEQ ID NO: 2037592 - protein, 18 aa, Staphylococcus
RPGKELENLVPDYLGGLL

SEQ ID NO: 2037593 - protein, 20 aa, Staphylococcus
RPGNTDFVAVRFGNVLGSRG

SEQ ID NO: 2037594 - protein, 17 aa, Staphylococcus
RPGSMGKAIPGSHVTVI

SEQ ID NO: 2037595 - protein, 20 aa, Staphylococcus
RPIAEIQFADFILPATNQII

SEQ ID NO: 2037596 - protein, 20 aa, Staphylococcus
RPIAEIQFADFILPAVNQII

SEQ ID NO: 2037597 - protein, 20 aa, Staphylococcus
RPIAEIQFAEYILPATNQIM

SEQ ID NO: 2037598 - protein, 18 aa, Staphylococcus
RPIAPGMKYKHYAPDTPV

SEQ ID NO: 2037599 - protein, 17 aa, Staphylococcus
RPIDMIYPILAKYQSSS

SEQ ID NO: 2037600 - protein, 19 aa, Staphylococcus
RPIEEIAIDHGFHHYSRFI

SEQ ID NO: 2037601 - protein, 17 aa, Staphylococcus
RPIENGIIPDVEHDKRD

SEQ ID NO: 2037602 - protein, 19 aa, Staphylococcus
RPIKISAQEHLLKFYGSFG

SEQ ID NO: 2037603 - protein, 20 aa, Staphylococcus
RPINVPRLLKEVSNEKWQGV

SEQ ID NO: 2037604 - protein, 17 aa, Staphylococcus
RPIPGVKGGIHHVTGVE

SEQ ID NO: 2037605 - protein, 24 aa, Staphylococcus
RPIRKKVGMVFQFPESQLFEDSVE

SEQ ID NO: 2037606 - protein, 22 aa, Staphylococcus
RPIRPLFPKGYKYDVQIMNTVL

SEQ ID NO: 2037607 - protein, 18 aa, Staphylococcus
RPKALKEVLDYIHQWMNN

SEQ ID NO: 2037608 - protein, 22 aa, Staphylococcus
RPKESLEELVHYIREKAPHVEI

SEQ ID NO: 2037609 - protein, 20 aa, Staphylococcus
RPKESLSELVSYIRNKAPNV

SEQ ID NO: 2037610 - protein, 20 aa, Staphylococcus
RPKIGVIPMGTVNDFGRALH

SEQ ID NO: 2037611 - protein, 23 aa, Staphylococcus
RPKRKICAKKRVLIYPGGMKNNG

SEQ ID NO: 2037612 - protein, 19 aa, Staphylococcus
RPKRKVMIYEIERTSEPEF

SEQ ID NO: 2037613 - protein, 25 aa, Staphylococcus
RPKYMPVDFMAEFTFNTTRAAANLI

SEQ ID NO: 2037614 - protein, 20 aa, Staphylococcus
RPLGSTPFTLLDYFGDDWLV

SEQ ID NO: 2037615 - protein, 20 aa, Staphylococcus
RPLLNELIHRHQLNVNVLFS

SEQ ID NO: 2037616 - protein, 17 aa, Staphylococcus
RPLLTLDKEEIVKMARK

SEQ ID NO: 2037617 - protein, 21 aa, Staphylococcus
RPLPGHSVAVLINGDVDPETL

SEQ ID NO: 2037618 - protein, 17 aa, Staphylococcus
RPLSLQIFGGEKESLVE

SEQ ID NO: 2037619 - protein, 22 aa, Staphylococcus
RPMDRLLCGDVGYGKTEVAVRA

SEQ ID NO: 2037620 - protein, 24 aa, Staphylococcus
RPMIRATAYWAIGQIDGYNAQSFI

SEQ ID NO: 2037621 - protein, 18 aa, Staphylococcus
RPMVFRRELLDHYAELGL

SEQ ID NO: 2037622 - protein, 18 aa, Staphylococcus
RPNFEMEERLVLEKTDYD

SEQ ID NO: 2037623 - protein, 21 aa, Staphylococcus
RPNHKLDVLNKVHLIQANPLL

SEQ ID NO: 2037624 - protein, 19 aa, Staphylococcus
RPNVGKSTIFNRVVGERVS

SEQ ID NO: 2037625 - protein, 19 aa, Staphylococcus
RPPEPYKGKGIRYQGEYVR

SEQ ID NO: 2037626 - protein, 24 aa, Staphylococcus
RPPEPYKGKGIRYQGEYVRRKEGK

SEQ ID NO: 2037627 - protein, 22 aa, Staphylococcus
RPPHRKEVLKAREDDIKEKVQN

SEQ ID NO: 2037628 - protein, 18 aa, Staphylococcus
RPPVSNIDELVIVMSAVE

SEQ ID NO: 2037629 - protein, 19 aa, Staphylococcus
RPQDLIFLSDMKTEFEKSV

SEQ ID NO: 2037630 - protein, 19 aa, Staphylococcus
RPRGHIATIVAFNEKQDLN

SEQ ID NO: 2037631 - protein, 18 aa, Staphylococcus
RPRILTLEEALEFIDDDE

SEQ ID NO: 2037632 - protein, 29 aa, Staphylococcus
RPRRVGWFDSVVLRHARRVSGITDLSINS

SEQ ID NO: 2037633 - protein, 20 aa, Staphylococcus
RPSDQWQWNDDFVKMDTLEV

SEQ ID NO: 2037634 - protein, 21 aa, Staphylococcus
RPSEVIFVRDLYKDVERRDFT

SEQ ID NO: 2037635 - protein, 27 aa, Staphylococcus
RPSGTEPKLKFYLSLNVDDFEQVSHDI

SEQ ID NO: 2037636 - protein, 27 aa, Staphylococcus
RPSGTEPKLKFYLSLNVDNFEQVSQDI

SEQ ID NO: 2037637 - protein, 26 aa, Staphylococcus
RPSMKEAIEMRKHIRLNYTESQINVY

SEQ ID NO: 2037638 - protein, 26 aa, Staphylococcus
RPSSGWEWENGFIKMDTLEVDAQDLI

SEQ ID NO: 2037639 - protein, 24 aa, Staphylococcus
RPSTSGVLDVEFIDPMTGLIGVTV

SEQ ID NO: 2037640 - protein, 20 aa, Staphylococcus
RPSYISNPWLKPDEHQSNFL

SEQ ID NO: 2037641 - protein, 18 aa, Staphylococcus
RPTEGMLPTAKKLKFDTY

SEQ ID NO: 2037642 - protein, 18 aa, Staphylococcus
RPTFEMEERLVLESINYE

SEQ ID NO: 2037643 - protein, 20 aa, Staphylococcus
RPTPNHILVPLLIEELNHVP

SEQ ID NO: 2037644 - protein, 20 aa, Staphylococcus
RPVAEIQFAEYILPATNQIM

SEQ ID NO: 2037645 - protein, 22 aa, Staphylococcus
RPVFQEALNFVRMGDRLVVESI

SEQ ID NO: 2037646 - protein, 20 aa, Staphylococcus
RPVGRCWLTKISRLKWTFEF

SEQ ID NO: 2037647 - protein, 18 aa, Staphylococcus
RPVHIHLPIDVAMSDIEV

SEQ ID NO: 2037648 - protein, 18 aa, Staphylococcus
RPVHIHLPIDVAMTEIEV

SEQ ID NO: 2037649 - protein, 19 aa, Staphylococcus
RPVHLHLPIDVALAEIEVS

SEQ ID NO: 2037650 - protein, 19 aa, Staphylococcus
RPVHLHLPIDVAMTEIEVE

SEQ ID NO: 2037651 - protein, 19 aa, Staphylococcus
RPVIIRRELLDHYNQLGIN

SEQ ID NO: 2037652 - protein, 21 aa, Staphylococcus
RPVLEQEFISRIGYVIEPQYL

SEQ ID NO: 2037653 - protein, 17 aa, Staphylococcus
RPVRHVLIKNIYRTSNL

SEQ ID NO: 2037654 - protein, 26 aa, Staphylococcus
RPVVLRRELFDHYSELGMDEQDLVIL

SEQ ID NO: 2037655 - protein, 19 aa, Staphylococcus
RPYFENPLMSDFRHSFTQR

SEQ ID NO: 2037656 - protein, 18 aa, Staphylococcus
RPYLMKRTVYNYDIKDLA

SEQ ID NO: 2037657 - protein, 18 aa, Staphylococcus
RPYLQRKLSQNNKVVKID

SEQ ID NO: 2037658 - protein, 19 aa, Staphylococcus
RPYTKFFQPVFEEFDVYPA

SEQ ID NO: 2037659 - protein, 19 aa, Staphylococcus
RQAFYDWQKSSAYAQTHRK

SEQ ID NO: 2037660 - protein, 18 aa, Staphylococcus
RQAIAITGDGAFQMVMQD

SEQ ID NO: 2037661 - protein, 26 aa, Staphylococcus
RQAQAILDMRLRRLTGLERDKIEAEY

SEQ ID NO: 2037662 - protein, 26 aa, Staphylococcus
RQAQAILDMRLRRLTGLERDKIENEY

SEQ ID NO: 2037663 - protein, 24 aa, Staphylococcus
RQASHLGIKYLTLYAFSTENWSRP

SEQ ID NO: 2037664 - protein, 22 aa, Staphylococcus
RQCYCGCVFAAMKQGIDFKAIN

SEQ ID NO: 2037665 - protein, 25 aa, Staphylococcus
RQDLLRARRTYAFTELFMFELRMQW

SEQ ID NO: 2037666 - protein, 18 aa, Staphylococcus
RQEGYKIGIVTSDSEKGV

SEQ ID NO: 2037667 - protein, 20 aa, Staphylococcus
RQELSSVFNFHHLKVDYVDG

SEQ ID NO: 2037668 - protein, 19 aa, Staphylococcus
RQETIDWSKKMGADIVLNH

SEQ ID NO: 2037669 - protein, 17 aa, Staphylococcus
RQFAEFDRFPSIETARQ

SEQ ID NO: 2037670 - protein, 18 aa, Staphylococcus
RQFFPESDIIKFEDYFVD

SEQ ID NO: 2037671 - protein, 17 aa, Staphylococcus
RQFKKSKIPVEIFGIMP

SEQ ID NO: 2037672 - protein, 29 aa, Staphylococcus
RQFKPLRRFFKIYVRGIRGASELRHQLMS

SEQ ID NO: 2037673 - protein, 19 aa, Staphylococcus
RQFNHFQLGFLIEEVKCSL

SEQ ID NO: 2037674 - protein, 19 aa, Staphylococcus
RQGDGWPEPYIKNHELFYK

SEQ ID NO: 2037675 - protein, 27 aa, Staphylococcus
RQGIFKEAFINRFIMDLEHMLMNYTTS

SEQ ID NO: 2037676 - protein, 20 aa, Staphylococcus
RQGKQLLAYLAAPKHLYEKT

SEQ ID NO: 2037677 - protein, 19 aa, Staphylococcus
RQGLEFLLSTVEEFNVIES

SEQ ID NO: 2037678 - protein, 25 aa, Staphylococcus
RQGLMKAREIILVVTGAEKSEVIKR

SEQ ID NO: 2037679 - protein, 17 aa, Staphylococcus
RQGMITKEMKFVALREG

SEQ ID NO: 2037680 - protein, 18 aa, Staphylococcus
RQHCSLYIVTNGVAITQQ

SEQ ID NO: 2037681 - protein, 19 aa, Staphylococcus
RQHEIPLFMDGARLGYGLM

SEQ ID NO: 2037682 - protein, 18 aa, Staphylococcus
RQHIGEVRLNVNVQNKAK

SEQ ID NO: 2037683 - protein, 24 aa, Staphylococcus
RQHLVEVMDDLELTPLRHKQISQL

SEQ ID NO: 2037684 - protein, 20 aa, Staphylococcus
RQHPGEVCPAKWEEGSESLQ

SEQ ID NO: 2037685 - protein, 25 aa, Staphylococcus
RQHQCLYVKMDPYWIYQIYDKDVNP

SEQ ID NO: 2037686 - protein, 17 aa, Staphylococcus
RQIAKLCYIIWQDMELE

SEQ ID NO: 2037687 - protein, 19 aa, Staphylococcus
RQIIDKFGHRVNENPVLEG

SEQ ID NO: 2037688 - protein, 20 aa, Staphylococcus
RQIMKIFVYDVVNDEWIFRL

SEQ ID NO: 2037689 - protein, 19 aa, Staphylococcus
RQIPKNKYLVHGHVPNNRY

SEQ ID NO: 2037690 - protein, 19 aa, Staphylococcus
RQKFVLDYVQAHRDEAGII

SEQ ID NO: 2037691 - protein, 28 aa, Staphylococcus
RQKKALALLFERRVSGIIIISLTLEESN

SEQ ID NO: 2037692 - protein, 18 aa, Staphylococcus
RQKNNLFTKKWNRELQAL

SEQ ID NO: 2037693 - protein, 17 aa, Staphylococcus
RQLAAIYLASGIDPEKS

SEQ ID NO: 2037694 - protein, 18 aa, Staphylococcus
RQLAEQYPGYDFEHNVGY

SEQ ID NO: 2037695 - protein, 17 aa, Staphylococcus
RQLDLFEAYCARIEADI

SEQ ID NO: 2037696 - protein, 17 aa, Staphylococcus
RQLHPFPAEIVQEAVDK

SEQ ID NO: 2037697 - protein, 23 aa, Staphylococcus
RQLIEVKTMLGLDHILIKDPIQQ

SEQ ID NO: 2037698 - protein, 18 aa, Staphylococcus
RQLIKLRHHYDIITYGDI

SEQ ID NO: 2037699 - protein, 24 aa, Staphylococcus
RQLKDIKSLFGVDELMILPNVYGE

SEQ ID NO: 2037700 - protein, 22 aa, Staphylococcus
RQLKKDEFVLFDLGVIYENYCS

SEQ ID NO: 2037701 - protein, 26 aa, Staphylococcus
RQLKQCDICGATIRPDIVLYGEMLDQ

SEQ ID NO: 2037702 - protein, 26 aa, Staphylococcus
RQLLGGTCLHKGCIPTKSLLKSAEVA

SEQ ID NO: 2037703 - protein, 18 aa, Staphylococcus
RQLLKDNFAMTTLTTVVK

SEQ ID NO: 2037704 - protein, 18 aa, Staphylococcus
RQLLKDNFVMTTLTTVVK

SEQ ID NO: 2037705 - protein, 17 aa, Staphylococcus
RQLMYRPDILLLDESTS

SEQ ID NO: 2037706 - protein, 17 aa, Staphylococcus
RQLPADEHFIFGYEESY

SEQ ID NO: 2037707 - protein, 23 aa, Staphylococcus
RQLRRACPHCISELSYINETGVF

SEQ ID NO: 2037708 - protein, 20 aa, Staphylococcus
RQLSEPIPFDKMSGLTESKL

SEQ ID NO: 2037709 - protein, 21 aa, Staphylococcus
RQLSLFFKYELNNLLENYLIT

SEQ ID NO: 2037710 - protein, 19 aa, Staphylococcus
RQLSLHRMVRPVKGIRQLT

SEQ ID NO: 2037711 - protein, 25 aa, Staphylococcus
RQLTWFKNKMNVRWLDKEKMSLQMM

SEQ ID NO: 2037712 - protein, 19 aa, Staphylococcus
RQMKLYQGLMDKFHINDQQ

SEQ ID NO: 2037713 - protein, 18 aa, Staphylococcus
RQNCHSWDLDEPVPPLPP

SEQ ID NO: 2037714 - protein, 24 aa, Staphylococcus
RQNELKKQYGIEGKVAIYVPTYRE

SEQ ID NO: 2037715 - protein, 19 aa, Staphylococcus
RQPHKDIIDINGIRIDIDA

SEQ ID NO: 2037716 - protein, 22 aa, Staphylococcus
RQPILHSKAYIFGELESDNAVG

SEQ ID NO: 2037717 - protein, 23 aa, Staphylococcus
RQPLPVPHYKYLKFKPDKLQISL

SEQ ID NO: 2037718 - protein, 19 aa, Staphylococcus
RQPLPVPIFQYLKFKPKQV

SEQ ID NO: 2037719 - protein, 24 aa, Staphylococcus
RQPLPVPRFKYFKLKQHKIQYALL

SEQ ID NO: 2037720 - protein, 21 aa, Staphylococcus
RQPLREDMSFLTRFINDSEVN

SEQ ID NO: 2037721 - protein, 18 aa, Staphylococcus
RQQAYRIIHHAAKELGLL

SEQ ID NO: 2037722 - protein, 19 aa, Staphylococcus
RQQEGFGVHTFRLVNKEGQ

SEQ ID NO: 2037723 - protein, 19 aa, Staphylococcus
RQQEVLKGIEFSIEKGEFV

SEQ ID NO: 2037724 - protein, 20 aa, Staphylococcus
RQQPECLMTQPYIINDNWAI

SEQ ID NO: 2037725 - protein, 20 aa, Staphylococcus
RQQSAMVFQSYQLFKNKTVL

SEQ ID NO: 2037726 - protein, 18 aa, Staphylococcus
RQRYKLELLDYTIKTLHL

SEQ ID NO: 2037727 - protein, 24 aa, Staphylococcus
RQSDGFKDIRDVLGQVYETAEELD

SEQ ID NO: 2037728 - protein, 25 aa, Staphylococcus
RQSDGFKDIRDVLGQVYETAEELDQ

SEQ ID NO: 2037729 - protein, 20 aa, Staphylococcus
RQSEKHRRALIGKKRHPNRK

SEQ ID NO: 2037730 - protein, 26 aa, Staphylococcus
RQSLNVFRMELLGAKVESVTEGQGTL

SEQ ID NO: 2037731 - protein, 26 aa, Staphylococcus
RQSMSWLQQHMDGWLFYAQPFQGQKK

SEQ ID NO: 2037732 - protein, 21 aa, Staphylococcus
RQSPHLQDWAREGVLLLNTVL

SEQ ID NO: 2037733 - protein, 17 aa, Staphylococcus
RQSTKIYLDQIHQRLYL

SEQ ID NO: 2037734 - protein, 24 aa, Staphylococcus
RQTKDMYRLLAIAKYEDRFVIPTS

SEQ ID NO: 2037735 - protein, 24 aa, Staphylococcus
RQTKDMYRLLGLAKYEERFVIPTT

SEQ ID NO: 2037736 - protein, 21 aa, Staphylococcus
RQVCKFEPERILLLGHGENSI

SEQ ID NO: 2037737 - protein, 19 aa, Staphylococcus
RQVKDFIDVLPFDLTDAQK

SEQ ID NO: 2037738 - protein, 19 aa, Staphylococcus
RQVKSQSEILSYFRTNPCP

SEQ ID NO: 2037739 - protein, 24 aa, Staphylococcus
RQVREFCTKIAWIEGGKLKEYGDL

SEQ ID NO: 2037740 - protein, 23 aa, Staphylococcus
RQVRRMFEHFGHSVNKLTRIQFG

SEQ ID NO: 2037741 - protein, 23 aa, Staphylococcus
RQVRRMFEHFNHTVDKLIRIEFG

SEQ ID NO: 2037742 - protein, 22 aa, Staphylococcus
RQVRRMFEYFGHEVNKLTRIQF

SEQ ID NO: 2037743 - protein, 20 aa, Staphylococcus
RQWSDRELKKMSSNANRVIS

SEQ ID NO: 2037744 - protein, 20 aa, Staphylococcus
RQYAELLVKVGMNVQQNQPV

SEQ ID NO: 2037745 - protein, 20 aa, Staphylococcus
RQYAQLIVKVGMNIQPQQPV

SEQ ID NO: 2037746 - protein, 21 aa, Staphylococcus
RQYEIHNIKEFAGISEMLQLL

SEQ ID NO: 2037747 - protein, 26 aa, Staphylococcus
RQYIGCGRNMFNLKTFKVVDNDLEIF

SEQ ID NO: 2037748 - protein, 18 aa, Staphylococcus
RQYLVSLFADQGLTEEEV

SEQ ID NO: 2037749 - protein, 21 aa, Staphylococcus
RRADTFLPYMEDAMKVRQRVM

SEQ ID NO: 2037750 - protein, 24 aa, Staphylococcus
RRAIWAIYAVCRIVDDSIDVHQDV

SEQ ID NO: 2037751 - protein, 25 aa, Staphylococcus
RRAIWAIYSVCRIIDDSIDIHQDVD

SEQ ID NO: 2037752 - protein, 23 aa, Staphylococcus
RRAQNLFEKFGFKKVGEADLDYH

SEQ ID NO: 2037753 - protein, 21 aa, Staphylococcus
RRDAMFLNWNTYKAIQDKVHE

SEQ ID NO: 2037754 - protein, 17 aa, Staphylococcus
RRDELRAQNILQERAFK

SEQ ID NO: 2037755 - protein, 26 aa, Staphylococcus
RRDFMVGNLYFNRGCTGAVVGYQPFG

SEQ ID NO: 2037756 - protein, 21 aa, Staphylococcus
RRDSYEFKDFKHLMNKKQGLL

SEQ ID NO: 2037757 - protein, 24 aa, Staphylococcus
RRDYLKAKLLSLGFELEAQPEGAF

SEQ ID NO: 2037758 - protein, 29 aa, Staphylococcus
RREAISQGFSGLEIDVFDFHSNKSRHISS

SEQ ID NO: 2037759 - protein, 28 aa, Staphylococcus
RREALSQGFSGLEIDVFDFYSNKARHIS

SEQ ID NO: 2037760 - protein, 20 aa, Staphylococcus
RREGYKPNIDRLMKLAEETN

SEQ ID NO: 2037761 - protein, 17 aa, Staphylococcus
RREKIRNFSIIAHIDHG

SEQ ID NO: 2037762 - protein, 21 aa, Staphylococcus
RRELLDHYAELGLTETDLVIL

SEQ ID NO: 2037763 - protein, 17 aa, Staphylococcus
RRFDARVREKAGKVEYM

SEQ ID NO: 2037764 - protein, 17 aa, Staphylococcus
RRGAANLALISGDPDLL

SEQ ID NO: 2037765 - protein, 19 aa, Staphylococcus
RRGETLSIKEFANLFNNLK

SEQ ID NO: 2037766 - protein, 20 aa, Staphylococcus
RRGKEIKGSRIVIQGFGNAG

SEQ ID NO: 2037767 - protein, 20 aa, Staphylococcus
RRGKEIKGSRVVIQGFGNAG

SEQ ID NO: 2037768 - protein, 22 aa, Staphylococcus
RRGKHILNGIDWNIKKGDKWVL

SEQ ID NO: 2037769 - protein, 20 aa, Staphylococcus
RRGLNLKGARIVIQGFGNAG

SEQ ID NO: 2037770 - protein, 18 aa, Staphylococcus
RRGYPIGQILMPGRDEGK

SEQ ID NO: 2037771 - protein, 25 aa, Staphylococcus
RRHFLSYRPDYAIMTNIDFDHPDYF

SEQ ID NO: 2037772 - protein, 19 aa, Staphylococcus
RRHIDSLKMNNRQAQIDGQ

SEQ ID NO: 2037773 - protein, 31 aa, Staphylococcus
RRHMSFLMREGKLYLPYNGNLLIHGCIPVDE

SEQ ID NO: 2037774 - protein, 32 aa, Staphylococcus
RRHMSFLMREGKLYLPYNGNLLIHGCIPVDEN

SEQ ID NO: 2037775 - protein, 20 aa, Staphylococcus
RRIAAGPEIQSRGFVYVRES

SEQ ID NO: 2037776 - protein, 21 aa, Staphylococcus
RRIAQLEFKDILSGVYISEET

SEQ ID NO: 2037777 - protein, 20 aa, Staphylococcus
RRIDLAVTKGLPSFIDVLEN

SEQ ID NO: 2037778 - protein, 20 aa, Staphylococcus
RRIFVTEVVCDSVQFLEPKS

SEQ ID NO: 2037779 - protein, 20 aa, Staphylococcus
RRINKEVLFIPGNHDYWNVD

SEQ ID NO: 2037780 - protein, 19 aa, Staphylococcus
RRINKYDKVHLVPMLNEPE

SEQ ID NO: 2037781 - protein, 17 aa, Staphylococcus
RRITIVDGQITKQEELK

SEQ ID NO: 2037782 - protein, 18 aa, Staphylococcus
RRIYGFRGLVNGEIDEDR

SEQ ID NO: 2037783 - protein, 17 aa, Staphylococcus
RRKDLIISGGENIYPFE

SEQ ID NO: 2037784 - protein, 18 aa, Staphylococcus
RRKDLIISGGENIYPFEI

SEQ ID NO: 2037785 - protein, 17 aa, Staphylococcus
RRKDLIISGGENIYPYE

SEQ ID NO: 2037786 - protein, 18 aa, Staphylococcus
RRKDLIISGGENIYPYQI

SEQ ID NO: 2037787 - protein, 17 aa, Staphylococcus
RRKLSYIPESPVIYEEL

SEQ ID NO: 2037788 - protein, 29 aa, Staphylococcus
RRKSLSHGYSGLEIDVFDFHSNKSRHISS

SEQ ID NO: 2037789 - protein, 21 aa, Staphylococcus
RRKYLLEFFGEVPDIPSICCD

SEQ ID NO: 2037790 - protein, 20 aa, Staphylococcus
RRLAEDGFKVGVADYNIETA

SEQ ID NO: 2037791 - protein, 22 aa, Staphylococcus
RRLDAVVYALGLARTRRQARQL

SEQ ID NO: 2037792 - protein, 21 aa, Staphylococcus
RRLFFRRKHYSVVTSDIPNKK

SEQ ID NO: 2037793 - protein, 17 aa, Staphylococcus
RRLKEKFGSKVDISTSK

SEQ ID NO: 2037794 - protein, 23 aa, Staphylococcus
RRLKEKYSLFEITHQAELCAYVT

SEQ ID NO: 2037795 - protein, 17 aa, Staphylococcus
RRLKERYGTNVAITTKR

SEQ ID NO: 2037796 - protein, 21 aa, Staphylococcus
RRLKGFNTRILYHNRTQNPEA

SEQ ID NO: 2037797 - protein, 20 aa, Staphylococcus
RRLLIVPFNADFNGAKENPN

SEQ ID NO: 2037798 - protein, 20 aa, Staphylococcus
RRLLIVPFNADFNGTKENPD

SEQ ID NO: 2037799 - protein, 19 aa, Staphylococcus
RRLPFHAERFHNWLENMPD

SEQ ID NO: 2037800 - protein, 17 aa, Staphylococcus
RRLSHVFDYGSHGSTFG

SEQ ID NO: 2037801 - protein, 17 aa, Staphylococcus
RRLSVATALSSRADIIL

SEQ ID NO: 2037802 - protein, 21 aa, Staphylococcus
RRNINHVLILFSLTNELEMTI

SEQ ID NO: 2037803 - protein, 23 aa, Staphylococcus
RRNRSKVRLALKRGTKVEHSNRE

SEQ ID NO: 2037804 - protein, 24 aa, Staphylococcus
RRNRSKVRLALKRGTKVERAGRDG

SEQ ID NO: 2037805 - protein, 24 aa, Staphylococcus
RRNRSKVRLALKRGTKVERTGREG

SEQ ID NO: 2037806 - protein, 24 aa, Staphylococcus
RRNRSKVRLALKRGTTVERSNREG

SEQ ID NO: 2037807 - protein, 17 aa, Staphylococcus
RRNRSKVRLSLKRGTKV

SEQ ID NO: 2037808 - protein, 30 aa, Staphylococcus
RRNSAIPLKDLRNTNARIEPGAFIREHAVI

SEQ ID NO: 2037809 - protein, 22 aa, Staphylococcus
RRNYIDFGIAMDNYWNLTFLPE

SEQ ID NO: 2037810 - protein, 21 aa, Staphylococcus
RRPAEPHSFGKVTITEFSNNE

SEQ ID NO: 2037811 - protein, 23 aa, Staphylococcus
RRPNEVFFVRNLYDDVQRRDFTM

SEQ ID NO: 2037812 - protein, 23 aa, Staphylococcus
RRPSEVYFVRDLKEDLQRRDFTI

SEQ ID NO: 2037813 - protein, 19 aa, Staphylococcus
RRPTFEMEDRLVLEKVNYD

SEQ ID NO: 2037814 - protein, 20 aa, Staphylococcus
RRPVHIHLPIDVAMTEIEVT

SEQ ID NO: 2037815 - protein, 25 aa, Staphylococcus
RRQAKAVNFGIVYGISDYGLSQNLG

SEQ ID NO: 2037816 - protein, 26 aa, Staphylococcus
RRQFKLKEYFLRFSRKQRKNVKSISI

SEQ ID NO: 2037817 - protein, 20 aa, Staphylococcus
RRQVKINGWEEDAGLDIFDL

SEQ ID NO: 2037818 - protein, 19 aa, Staphylococcus
RRRESIFFTYILKHHPRFK

SEQ ID NO: 2037819 - protein, 20 aa, Staphylococcus
RRRGETLSIKEFANLYNELQ

SEQ ID NO: 2037820 - protein, 19 aa, Staphylococcus
RRRIEIMREAGITFKTNTN

SEQ ID NO: 2037821 - protein, 23 aa, Staphylococcus
RRRQKLEPAYSFMIRVRAPGGAS

SEQ ID NO: 2037822 - protein, 17 aa, Staphylococcus
RRSEPRLKIEAGSVGIA

SEQ ID NO: 2037823 - protein, 20 aa, Staphylococcus
RRSLQIYGFSPCHEIRDMLA

SEQ ID NO: 2037824 - protein, 20 aa, Staphylococcus
RRSLQIYGFSPCHEIRHMFA

SEQ ID NO: 2037825 - protein, 20 aa, Staphylococcus
RRSLQIYGFSPCHEISYMLA

SEQ ID NO: 2037826 - protein, 23 aa, Staphylococcus
RRTTVENGIPCLTSLDTASALTN

SEQ ID NO: 2037827 - protein, 17 aa, Staphylococcus
RRVAKEEGILAGISSGA

SEQ ID NO: 2037828 - protein, 21 aa, Staphylococcus
RRVDELLDMVRLDPNTYRDRK

SEQ ID NO: 2037829 - protein, 24 aa, Staphylococcus
RRVIAIECVIALQAVELKGVDKLS

SEQ ID NO: 2037830 - protein, 21 aa, Staphylococcus
RRVNEEIWKGIDVTIKEMPIE

SEQ ID NO: 2037831 - protein, 21 aa, Staphylococcus
RRVNEEIWRGIDVRIQEMGID

SEQ ID NO: 2037832 - protein, 21 aa, Staphylococcus
RRVNEEIWRGIDVRIQEMNID

SEQ ID NO: 2037833 - protein, 23 aa, Staphylococcus
RRVNEEIWRGISVHIQEMPIQEA

SEQ ID NO: 2037834 - protein, 24 aa, Staphylococcus
RRVNEEIWRGISVNIQEMPIAEAK

SEQ ID NO: 2037835 - protein, 24 aa, Staphylococcus
RRVNEEIWRGISVNIQEMPINEAK

SEQ ID NO: 2037836 - protein, 19 aa, Staphylococcus
RRVSIEHRLIYKIKDDSIF

SEQ ID NO: 2037837 - protein, 21 aa, Staphylococcus
RRVSPDIFTKRISYYNYILLN

SEQ ID NO: 2037838 - protein, 20 aa, Staphylococcus
RRVTFEYGLFGGVNDQLEHA

SEQ ID NO: 2037839 - protein, 21 aa, Staphylococcus
RRWGAPFPVIEIVKRGISKAR

SEQ ID NO: 2037840 - protein, 21 aa, Staphylococcus
RRYFEYKGYEVIYVSNFTDVD

SEQ ID NO: 2037841 - protein, 19 aa, Staphylococcus
RRYFEYKGYTVDYVSNFTD

SEQ ID NO: 2037842 - protein, 17 aa, Staphylococcus
RRYLHEHPELSFHETET

SEQ ID NO: 2037843 - protein, 18 aa, Staphylococcus
RRYNDISPFELFVISCPL

SEQ ID NO: 2037844 - protein, 21 aa, Staphylococcus
RRYPDLTVHRLIRKYLIDNSM

SEQ ID NO: 2037845 - protein, 21 aa, Staphylococcus
RRYPDLTVHRLIRKYLIEHSM

SEQ ID NO: 2037846 - protein, 21 aa, Staphylococcus
RRYPDLTVHRLIRKYLIENSM

SEQ ID NO: 2037847 - protein, 21 aa, Staphylococcus
RRYPDLTVHRLIRKYLVDHSM

SEQ ID NO: 2037848 - protein, 23 aa, Staphylococcus
RRYVDVNLVYGLAIAWAQQCTPA

SEQ ID NO: 2037849 - protein, 20 aa, Staphylococcus
RSAAYAARYVAKNIVAAELA

SEQ ID NO: 2037850 - protein, 20 aa, Staphylococcus
RSAAYAARYVAKNIVAAQLA

SEQ ID NO: 2037851 - protein, 20 aa, Staphylococcus
RSAENGYRIYFSEDLDVLQV

SEQ ID NO: 2037852 - protein, 23 aa, Staphylococcus
RSAFYKYRETIFPVDEKLLDHRE

SEQ ID NO: 2037853 - protein, 19 aa, Staphylococcus
RSAKEIGLELKYNVEELTE

SEQ ID NO: 2037854 - protein, 27 aa, Staphylococcus
RSAKLAGRRGLPFVIAKMGQSSSAIEE

SEQ ID NO: 2037855 - protein, 24 aa, Staphylococcus
RSALAARLEPTFTELNSGKERKQD

SEQ ID NO: 2037856 - protein, 25 aa, Staphylococcus
RSAQFEANELLQLMVSTMEQSLNNH

SEQ ID NO: 2037857 - protein, 25 aa, Staphylococcus
RSAQFNAWLEKGASIYICGDEKHMA

SEQ ID NO: 2037858 - protein, 26 aa, Staphylococcus
RSAQYEANDLLQLMISTMEDRLNEHN

SEQ ID NO: 2037859 - protein, 23 aa, Staphylococcus
RSARAYGSAALEIISVAKGQLAA

SEQ ID NO: 2037860 - protein, 25 aa, Staphylococcus
RSAYSFKRAVAIQMTKSPQINYGNG

SEQ ID NO: 2037861 - protein, 18 aa, Staphylococcus
RSDFEDMRQKHNLSTQKI

SEQ ID NO: 2037862 - protein, 18 aa, Staphylococcus
RSDIEIIRGINSDGAAKT

SEQ ID NO: 2037863 - protein, 18 aa, Staphylococcus
RSDIELIRGINSDGAVKT

SEQ ID NO: 2037864 - protein, 21 aa, Staphylococcus
RSDIFDFYSLGFGDPYPISGS

SEQ ID NO: 2037865 - protein, 19 aa, Staphylococcus
RSDMSKFGDSLLVINDDEI

SEQ ID NO: 2037866 - protein, 21 aa, Staphylococcus
RSEALGIPGIPNICEAVQIAR

SEQ ID NO: 2037867 - protein, 22 aa, Staphylococcus
RSEDIYKDEWLNIVREAIDTMN

SEQ ID NO: 2037868 - protein, 17 aa, Staphylococcus
RSEFEKYENNILKLVND

SEQ ID NO: 2037869 - protein, 28 aa, Staphylococcus
RSEIQKMRDERHMLGQMINQVHQQQQEL

SEQ ID NO: 2037870 - protein, 22 aa, Staphylococcus
RSEIQKMREERQMLGQMINQVH

SEQ ID NO: 2037871 - protein, 23 aa, Staphylococcus
RSEKSRTSFSFHFIDLYSEEEWM

SEQ ID NO: 2037872 - protein, 17 aa, Staphylococcus
RSELLRKLVDVQYTRND

SEQ ID NO: 2037873 - protein, 18 aa, Staphylococcus
RSEMKHDVHLVGVKDDQN

SEQ ID NO: 2037874 - protein, 19 aa, Staphylococcus
RSENGVIMNPFFLTPEESV

SEQ ID NO: 2037875 - protein, 23 aa, Staphylococcus
RSEQFYRDLGFEINKNPDMLDKM

SEQ ID NO: 2037876 - protein, 18 aa, Staphylococcus
RSEVDHVMHACGHDGHTT

SEQ ID NO: 2037877 - protein, 19 aa, Staphylococcus
RSFISYSRHDYFRRILSSF

SEQ ID NO: 2037878 - protein, 20 aa, Staphylococcus
RSFISYSRHDYFRRILSTFI

SEQ ID NO: 2037879 - protein, 23 aa, Staphylococcus
RSFKEVTNVTGIVLTKLDGTAKG

SEQ ID NO: 2037880 - protein, 18 aa, Staphylococcus
RSFKRLSSKLDDMTKEGI

SEQ ID NO: 2037881 - protein, 19 aa, Staphylococcus
RSGEAITGRLQGYRLSLNP

SEQ ID NO: 2037882 - protein, 20 aa, Staphylococcus
RSGEAITGRVLGYKLSLNPL

SEQ ID NO: 2037883 - protein, 24 aa, Staphylococcus
RSGHIELFDRSWYGRVLVERIEGF

SEQ ID NO: 2037884 - protein, 17 aa, Staphylococcus
RSGMSLTRETSRFYQYW

SEQ ID NO: 2037885 - protein, 29 aa, Staphylococcus
RSHFAEAKSPMWVEYEFQLNKKYFKIIRQ

SEQ ID NO: 2037886 - protein, 18 aa, Staphylococcus
RSIANFVIDTTLLKPKEL

SEQ ID NO: 2037887 - protein, 17 aa, Staphylococcus
RSIDAAFVYGNEEMVGQ

SEQ ID NO: 2037888 - protein, 17 aa, Staphylococcus
RSIHIIEDICSIDHETA

SEQ ID NO: 2037889 - protein, 20 aa, Staphylococcus
RSIIESAKFKNAESKLTVAM

SEQ ID NO: 2037890 - protein, 24 aa, Staphylococcus
RSIMGHKLAVLGYHQGIQPYSEGV

SEQ ID NO: 2037891 - protein, 17 aa, Staphylococcus
RSIRIIQDICDISYNQA

SEQ ID NO: 2037892 - protein, 25 aa, Staphylococcus
RSISGYPFIWWFATKPSYDGQGYGS

SEQ ID NO: 2037893 - protein, 20 aa, Staphylococcus
RSISTYRIYIAALKLGIAII

SEQ ID NO: 2037894 - protein, 23 aa, Staphylococcus
RSITEKTYNEWFQKLEGNLTQCT

SEQ ID NO: 2037895 - protein, 24 aa, Staphylococcus
RSIWKNGQNFFALRNDWTDQLQHY

SEQ ID NO: 2037896 - protein, 17 aa, Staphylococcus
RSKAVINEAYFRTPSTT

SEQ ID NO: 2037897 - protein, 22 aa, Staphylococcus
RSKEGRYAYSLPQSDIKTDAVS

SEQ ID NO: 2037898 - protein, 19 aa, Staphylococcus
RSKEKLIREIKQSFNSNDL

SEQ ID NO: 2037899 - protein, 20 aa, Staphylococcus
RSKHSIRFSFSELTTEHEIK

SEQ ID NO: 2037900 - protein, 24 aa, Staphylococcus
RSKIIKFEGCYHGHSDSLLIKAGS

SEQ ID NO: 2037901 - protein, 23 aa, Staphylococcus
RSKIKQYRMHALGVEDAINYLST

SEQ ID NO: 2037902 - protein, 21 aa, Staphylococcus
RSKLETWVNILSENGDYEPTV

SEQ ID NO: 2037903 - protein, 23 aa, Staphylococcus
RSKLIAKEIKCIFKNSKETFGVV

SEQ ID NO: 2037904 - protein, 22 aa, Staphylococcus
RSKLMPINRAYHVDKLMEAIKY

SEQ ID NO: 2037905 - protein, 21 aa, Staphylococcus
RSKLMPINRAYNVGKLMEAIK

SEQ ID NO: 2037906 - protein, 22 aa, Staphylococcus
RSKLMPINRAYSIDKLMEAIQY

SEQ ID NO: 2037907 - protein, 17 aa, Staphylococcus
RSKSIFEVIGHAEAKIH

SEQ ID NO: 2037908 - protein, 20 aa, Staphylococcus
RSKVRLSLKRGTKVERSNRE

SEQ ID NO: 2037909 - protein, 34 aa, Staphylococcus
RSLESSFNIARKMGYFDIPKDLLIPIDEVENYPK

SEQ ID NO: 2037910 - protein, 35 aa, Staphylococcus; identical to SEQ ID NO: 1812355

SEQ ID NO: 2037911 - protein, 35 aa, Staphylococcus
RSLESSFNIARKMGYFDIPKDLLIPINEVENYPKN

SEQ ID NO: 2037912 - protein, 36 aa, Staphylococcus
RSLESSFNIARKMGYFDIPKDLLIPINEVGNYPKNE

SEQ ID NO: 2037913 - protein, 19 aa, Staphylococcus
RSLHEIYLSAFKRVVEEAQ

SEQ ID NO: 2037914 - protein, 31 aa, Staphylococcus
RSLKEALTHDFEIAKLTPVLMKNAAELLGNP

SEQ ID NO: 2037915 - protein, 24 aa, Staphylococcus
RSLKIFPGLVTYVGKTHEEALEKK

SEQ ID NO: 2037916 - protein, 19 aa, Staphylococcus
RSLKLSGYQHLTICLEDDG

SEQ ID NO: 2037917 - protein, 19 aa, Staphylococcus
RSLLDEYREGILVGSACDE

SEQ ID NO: 2037918 - protein, 26 aa, Staphylococcus
RSLLGGTCLHKGCIPTKSLLKSAKVV

SEQ ID NO: 2037919 - protein, 20 aa, Staphylococcus
RSLLNEYREGLLVGTACDEG

SEQ ID NO: 2037920 - protein, 26 aa, Staphylococcus
RSLLYEEMKHYFILNFPQRPGALREF

SEQ ID NO: 2037921 - protein, 19 aa, Staphylococcus
RSLLYSAIILHDLGKVREL

SEQ ID NO: 2037922 - protein, 18 aa, Staphylococcus
RSLQWGNDAYTMILDRMN

SEQ ID NO: 2037923 - protein, 20 aa, Staphylococcus
RSLRRPDLTFATLDHNVPTI

SEQ ID NO: 2037924 - protein, 17 aa, Staphylococcus
RSLSEYMDLTERVLRSE

SEQ ID NO: 2037925 - protein, 25 aa, Staphylococcus
RSLTLPHLFSEILIYSNERHVMLVD

SEQ ID NO: 2037926 - protein, 24 aa, Staphylococcus
RSMDVHTLFFMFRVTVTSFATQIQ

SEQ ID NO: 2037927 - protein, 17 aa, Staphylococcus
RSMKDLIDYDMIKNGIP

SEQ ID NO: 2037928 - protein, 23 aa, Staphylococcus
RSMRKKLPFGIGQVGKSFRNEIT

SEQ ID NO: 2037929 - protein, 25 aa, Staphylococcus
RSNAFEISSKLGLSGNIIREAKSLI

SEQ ID NO: 2037930 - protein, 30 aa, Staphylococcus
RSNINLTLNAKKEWRNILLSTGESSISNMA

SEQ ID NO: 2037931 - protein, 19 aa, Staphylococcus
RSNLEEVVRSIINKNVSVV

SEQ ID NO: 2037932 - protein, 21 aa, Staphylococcus
RSNQLFVPLYKSWRLNERHYG

SEQ ID NO: 2037933 - protein, 19 aa, Staphylococcus
RSNTGTCYNQRPIVASGDV

SEQ ID NO: 2037934 - protein, 19 aa, Staphylococcus
RSPKKALICKDMSDEDQRA

SEQ ID NO: 2037935 - protein, 17 aa, Staphylococcus
RSPSIYVAFDVKDGKGV

SEQ ID NO: 2037936 - protein, 21 aa, Staphylococcus
RSQMAEGWGKNILGDEWQVYS

SEQ ID NO: 2037937 - protein, 22 aa, Staphylococcus
RSQRDLNAFYTVLGRFSTKEQK

SEQ ID NO: 2037938 - protein, 23 aa, Staphylococcus
RSQYHNCPIILGSATPCLESFAR

SEQ ID NO: 2037939 - protein, 18 aa, Staphylococcus
RSRAQIFELYALDENDIR

SEQ ID NO: 2037940 - protein, 18 aa, Staphylococcus
RSRAQIFELYPLYDNDIR

SEQ ID NO: 2037941 - protein, 17 aa, Staphylococcus
RSRAQIFELYSLDHDDV

SEQ ID NO: 2037942 - protein, 21 aa, Staphylococcus
RSRGIDGLVVIGGDGSYRGAQ

SEQ ID NO: 2037943 - protein, 25 aa, Staphylococcus
RSRKDALKGKINWVKTLPETSYSKI

SEQ ID NO: 2037944 - protein, 21 aa, Staphylococcus
RSRLMPINRAYNVEKLMEAIE

SEQ ID NO: 2037945 - protein, 21 aa, Staphylococcus
RSRLMPINRAYNVEKLMEAIH

SEQ ID NO: 2037946 - protein, 21 aa, Staphylococcus
RSRLMPINRAYNVEKLMEAIK

SEQ ID NO: 2037947 - protein, 25 aa, Staphylococcus
RSRQGNPFHYREYVEFPTIKQSAII

SEQ ID NO: 2037948 - protein, 26 aa, Staphylococcus
RSRVELKHVLGHVTHKVAKRAHTPVL

SEQ ID NO: 2037949 - protein, 17 aa, Staphylococcus
RSSEANTALAFVSLTKE

SEQ ID NO: 2037950 - protein, 19 aa, Staphylococcus
RSSEELSHIYTMSEGFEHR

SEQ ID NO: 2037951 - protein, 19 aa, Staphylococcus
RSSFARDSIVILTGINNPY

SEQ ID NO: 2037952 - protein, 38 aa, Staphylococcus
RSSQSKWHISNCLMYNNYLRYQWTIKEKSEMHIIDSKT

SEQ ID NO: 2037953 - protein, 24 aa, Staphylococcus
RSSRAYGSAALEIIAVAKGQLAAY

SEQ ID NO: 2037954 - protein, 20 aa, Staphylococcus
RSSVEALDLTHLIVEEAYKA

SEQ ID NO: 2037955 - protein, 24 aa, Staphylococcus
RSSVEALELTHLIVEEAYLLGASD

SEQ ID NO: 2037956 - protein, 23 aa, Staphylococcus
RSSVEALELTHLVVEEAYIAGAS

SEQ ID NO: 2037957 - protein, 19 aa, Staphylococcus
RSSVFAPFTNLGMIIIDEE

SEQ ID NO: 2037958 - protein, 25 aa, Staphylococcus
RSTAELTFALVLAVARRIPEGDQLS

SEQ ID NO: 2037959 - protein, 24 aa, Staphylococcus
RSTIFPNFIGITFAVYDGRKHVPV

SEQ ID NO: 2037960 - protein, 20 aa, Staphylococcus
RSTMAQAIIRQRLKERGISD

SEQ ID NO: 2037961 - protein, 22 aa, Staphylococcus
RSTRSPLGMSVQETRPGFKLVR

SEQ ID NO: 2037962 - protein, 17 aa, Staphylococcus
RSTRSSLGMAYQTTRAS

SEQ ID NO: 2037963 - protein, 21 aa, Staphylococcus
RSVALAKRLGEYLDEVFDYNV

SEQ ID NO: 2037964 - protein, 27 aa, Staphylococcus
RSVARDIFFEKALKVIRPVYLNGSNIP

SEQ ID NO: 2037965 - protein, 18 aa, Staphylococcus
RSVGNLFGTMVFEGSMTL

SEQ ID NO: 2037966 - protein, 23 aa, Staphylococcus
RSVGNLYGIMVFEGSMTLDEMRQ

SEQ ID NO: 2037967 - protein, 24 aa, Staphylococcus
RSVGNLYGIMVFEGSMTLDEMRQQ

SEQ ID NO: 2037968 - protein, 24 aa, Staphylococcus
RSVIEGFTVRLLDKFDTQRMMHII

SEQ ID NO: 2037969 - protein, 24 aa, Staphylococcus
RSVKSCVGKEFCRFGTQYTTQLGI

SEQ ID NO: 2037970 - protein, 26 aa, Staphylococcus
RSVKSCVGKEFCRFGTQYTTRLGIRL

SEQ ID NO: 2037971 - protein, 18 aa, Staphylococcus
RSVLSYVLDKIMKMLHPF

SEQ ID NO: 2037972 - protein, 18 aa, Staphylococcus
RSVLSYVLDRIMRMLHPF

SEQ ID NO: 2037973 - protein, 23 aa, Staphylococcus
RSVREFLDRDGFFDIETPVLTKS

SEQ ID NO: 2037974 - protein, 22 aa, Staphylococcus
RSVRFPGLISHIKEPGGGTTDY

SEQ ID NO: 2037975 - protein, 19 aa, Staphylococcus
RSVRFPGLISHTKEPGGGT

SEQ ID NO: 2037976 - protein, 19 aa, Staphylococcus
RSVRFPGLISHVKEPGGGT

SEQ ID NO: 2037977 - protein, 20 aa, Staphylococcus
RSVRFPGLISYVKEPGGGTT

SEQ ID NO: 2037978 - protein, 21 aa, Staphylococcus
RSVRVKQRLADVGLTGKENLL

SEQ ID NO: 2037979 - protein, 19 aa, Staphylococcus
RSWEFQITLPYFLSNEDYL

SEQ ID NO: 2037980 - protein, 17 aa, Staphylococcus
RSWKEEILPGVLVDKEA

SEQ ID NO: 2037981 - protein, 19 aa, Staphylococcus
RSWNGLIINYLSRCTDYTA

SEQ ID NO: 2037982 - protein, 24 aa, Staphylococcus
RSYAQTILASFGFDKDKIQQTIRS

SEQ ID NO: 2037983 - protein, 19 aa, Staphylococcus
RSYCPGKFDLSIDGKKFAG

SEQ ID NO: 2037984 - protein, 19 aa, Staphylococcus
RSYCPGKFDLSINGKKFAG

SEQ ID NO: 2037985 - protein, 17 aa, Staphylococcus
RSYDAVFPLLHGPNGED

SEQ ID NO: 2037986 - protein, 17 aa, Staphylococcus
RSYTHVMYGEAMDLALM

SEQ ID NO: 2037987 - protein, 21 aa, Staphylococcus
RSYVFHPYSMVKDHRTNEETA

SEQ ID NO: 2037988 - protein, 19 aa, Staphylococcus
RSYYKNVWVYEVDGKVAGC

SEQ ID NO: 2037989 - protein, 25 aa, Staphylococcus
RTADVALREKVAFKADAIRESHLDL

SEQ ID NO: 2037990 - protein, 24 aa, Staphylococcus
RTADVALREKVAFKDDAIRSANVD

SEQ ID NO: 2037991 - protein, 25 aa, Staphylococcus
RTAPWLKRLGFDHVKEVLLDEQRQK

SEQ ID NO: 2037992 - protein, 18 aa, Staphylococcus
RTDEKGRIFCYVLTEDQY

SEQ ID NO: 2037993 - protein, 18 aa, Staphylococcus
RTDKSTIMLYILLITGAR

SEQ ID NO: 2037994 - protein, 18 aa, Staphylococcus
RTDLYKGDYETLVDSIKD

SEQ ID NO: 2037995 - protein, 18 aa, Staphylococcus
RTDLYKGDYETLVDSILD

SEQ ID NO: 2037996 - protein, 18 aa, Staphylococcus
RTDRGVHAYQQFFHFDTE

SEQ ID NO: 2037997 - protein, 20 aa, Staphylococcus
RTDSRLLEYAKEAYEINMKV

SEQ ID NO: 2037998 - protein, 19 aa, Staphylococcus
RTEANFELKEENSTAYHHK

SEQ ID NO: 2037999 - protein, 24 aa, Staphylococcus
RTEDARRALPQSFGHNNAVQSSAI

SEQ ID NO: 2038000 - protein, 17 aa, Staphylococcus
RTEELYLIRSSKEDLID

SEQ ID NO: 2038001 - protein, 22 aa, Staphylococcus
RTEGDVTLEYTFRLVSLNPEEG

SEQ ID NO: 2038002 - protein, 18 aa, Staphylococcus
RTEIKYSYTHIAFSINEN

SEQ ID NO: 2038003 - protein, 21 aa, Staphylococcus
RTEIQKMREDRQMLGQMMTQV

SEQ ID NO: 2038004 - protein, 20 aa, Staphylococcus
RTELDKCLDYLREGDILVIY

SEQ ID NO: 2038005 - protein, 22 aa, Staphylococcus
RTELPIEGIILLSPLAAFQKNN

SEQ ID NO: 2038006 - protein, 25 aa, Staphylococcus
RTELSHKKLDVYRGEVASLTAFILP

SEQ ID NO: 2038007 - protein, 23 aa, Staphylococcus
RTFKEVTNVSGIVLTKLDGTAKG

SEQ ID NO: 2038008 - protein, 23 aa, Staphylococcus
RTFLKQTCQTIWEISDQTVSVFN

SEQ ID NO: 2038009 - protein, 24 aa, Staphylococcus
RTGHIEMFDRSWYGRVLVERVEGF

SEQ ID NO: 2038010 - protein, 19 aa, Staphylococcus
RTGKPMLVTYDLCRKSYSE

SEQ ID NO: 2038011 - protein, 26 aa, Staphylococcus
RTGKRMKRKSIQVVVEFKEVPMNLYY

SEQ ID NO: 2038012 - protein, 18 aa, Staphylococcus
RTGSGQLKRSRAFTSHLF

SEQ ID NO: 2038013 - protein, 18 aa, Staphylococcus
RTGTCHWQPYSATHQQPY

SEQ ID NO: 2038014 - protein, 25 aa, Staphylococcus
RTHELGIPVMILFEGVPASGKTRLS

SEQ ID NO: 2038015 - protein, 17 aa, Staphylococcus
RTHKRANVRTVIVKFDD

SEQ ID NO: 2038016 - protein, 26 aa, Staphylococcus
RTIDAPRYGLKHMMDFYNLDFHGHHD

SEQ ID NO: 2038017 - protein, 18 aa, Staphylococcus
RTIDLCLDVLVLPNGEYE

SEQ ID NO: 2038018 - protein, 19 aa, Staphylococcus
RTIEIANDYVFAMIGYHPD

SEQ ID NO: 2038019 - protein, 28 aa, Staphylococcus
RTIHAIPLKLKEPLNFEVRGEAYMPRAS

SEQ ID NO: 2038020 - protein, 20 aa, Staphylococcus
RTIHFSFGYTEGGGVHKQYT

SEQ ID NO: 2038021 - protein, 24 aa, Staphylococcus
RTIHSGNLYQIFAYVKNEAFHLKS

SEQ ID NO: 2038022 - protein, 19 aa, Staphylococcus
RTIKAIEELGERMGIQTPI

SEQ ID NO: 2038023 - protein, 19 aa, Staphylococcus
RTILELLYATGMRVTELIH

SEQ ID NO: 2038024 - protein, 20 aa, Staphylococcus
RTILPSKYKKVYTVDFKSFE

SEQ ID NO: 2038025 - protein, 20 aa, Staphylococcus
RTISAIKHNGALVVNGQTVT

SEQ ID NO: 2038026 - protein, 17 aa, Staphylococcus
RTKDFSVGGLFNKKKKT

SEQ ID NO: 2038027 - protein, 22 aa, Staphylococcus
RTKELLNQFDFNFKKSLGQNFL

SEQ ID NO: 2038028 - protein, 17 aa, Staphylococcus
RTKEVIEFTNTLETMDY

SEQ ID NO: 2038029 - protein, 25 aa, Staphylococcus
RTKGFDGWAPLFFRGREVSEKTIGI

SEQ ID NO: 2038030 - protein, 30 aa, Staphylococcus
RTKGFDGWAPLFFRGREVSGKTIGIIGLGE

SEQ ID NO: 2038031 - protein, 32 aa, Staphylococcus
RTKGFDGWAPLFFRGREVSGKVLGIVGLGAIG

SEQ ID NO: 2038032 - protein, 20 aa, Staphylococcus
RTKITGVICGVRVENMEASV

SEQ ID NO: 2038033 - protein, 23 aa, Staphylococcus
RTKLISKVMMKISTLPFVHSDME

SEQ ID NO: 2038034 - protein, 19 aa, Staphylococcus
RTKNDYVFLVGLDNDKVVS

SEQ ID NO: 2038035 - protein, 24 aa, Staphylococcus
RTKPSYPVINGIYFALDLTPQEGR

SEQ ID NO: 2038036 - protein, 37 aa, Staphylococcus
RTKSGDWLPWQSINDFKDTGWINLPLVNGAYANTEYT

SEQ ID NO: 2038037 - protein, 25 aa, Staphylococcus
RTKTEKANELWKNQLGDLLTPPNNV

SEQ ID NO: 2038038 - protein, 25 aa, Staphylococcus
RTKTEKANELWKNQLGSLLTPPHDA

SEQ ID NO: 2038039 - protein, 18 aa, Staphylococcus
RTLAVEWGSKYGINVNAI

SEQ ID NO: 2038040 - protein, 19 aa, Staphylococcus
RTLCRDLNKTIVIVLHDIN

SEQ ID NO: 2038041 - protein, 18 aa, Staphylococcus
RTLHPLDIIEILSENKDF

SEQ ID NO: 2038042 - protein, 24 aa, Staphylococcus
RTLHYYHDIELLIPHHIEDNGYRL

SEQ ID NO: 2038043 - protein, 24 aa, Staphylococcus
RTLKETLEGAGLNQAITYSLVSKD

SEQ ID NO: 2038044 - protein, 17 aa, Staphylococcus
RTLLALKDVNTMKRIGK

SEQ ID NO: 2038045 - protein, 25 aa, Staphylococcus
RTLMPKLPILTPHVKLSTNVHITGE

SEQ ID NO: 2038046 - protein, 29 aa, Staphylococcus
RTLMPKYPKLFPHIKLSTNVHITGEIRTL

SEQ ID NO: 2038047 - protein, 17 aa, Staphylococcus
RTLPKAYAIIHPMHPEF

SEQ ID NO: 2038048 - protein, 23 aa, Staphylococcus
RTLRAEIFLKEQFKRLEKEQIFV

SEQ ID NO: 2038049 - protein, 24 aa, Staphylococcus
RTLRKEVLGGLGGFGATFDLSQLQ

SEQ ID NO: 2038050 - protein, 17 aa, Staphylococcus
RTLRYYDQIGLLKPDRI

SEQ ID NO: 2038051 - protein, 30 aa, Staphylococcus
RTLSKAFGIAGLRLGVLIGTPETIQLIQSI

SEQ ID NO: 2038052 - protein, 26 aa, Staphylococcus
RTLYNFIWDEFCDWYIEMSKIPMNGE

SEQ ID NO: 2038053 - protein, 18 aa, Staphylococcus
RTMELLHHPFHIKLPVNV

SEQ ID NO: 2038054 - protein, 19 aa, Staphylococcus
RTMEPTRQALKDAGLSTSE

SEQ ID NO: 2038055 - protein, 19 aa, Staphylococcus
RTMLELLYATGMRVSELIQ

SEQ ID NO: 2038056 - protein, 24 aa, Staphylococcus
RTMRKEVLGGLGGFGATFDLSQLN

SEQ ID NO: 2038057 - protein, 23 aa, Staphylococcus
RTMRKKLPFGIGQIGKSFRNEIT

SEQ ID NO: 2038058 - protein, 19 aa, Staphylococcus
RTMYLKWYDTNQITELQLT

SEQ ID NO: 2038059 - protein, 23 aa, Staphylococcus
RTNHPKSLFIWRSNLLSSSAKGQ

SEQ ID NO: 2038060 - protein, 28 aa, Staphylococcus
RTNVPAIFCSGGPMKAGLSSEGKALTLS

SEQ ID NO: 2038061 - protein, 18 aa, Staphylococcus
RTPDEIGIHTVRGGTIVG

SEQ ID NO: 2038062 - protein, 26 aa, Staphylococcus
RTPEEMKPFLTRDQHRLYKLIWERFV

SEQ ID NO: 2038063 - protein, 17 aa, Staphylococcus
RTPELYFAFLGILKVGA

SEQ ID NO: 2038064 - protein, 19 aa, Staphylococcus
RTPELYFALFGTLKIGAIV

SEQ ID NO: 2038065 - protein, 25 aa, Staphylococcus
RTPIGRFKGKLSHYSAVELGTKTLE

SEQ ID NO: 2038066 - protein, 18 aa, Staphylococcus
RTPIQWNQNENAGFTSGT

SEQ ID NO: 2038067 - protein, 21 aa, Staphylococcus
RTPLDAVKCLALGAKAVGMSR

SEQ ID NO: 2038068 - protein, 19 aa, Staphylococcus
RTPMQWTAGENAGFTSGTP

SEQ ID NO: 2038069 - protein, 23 aa, Staphylococcus
RTPRGRKATPLAYEHFEAKNGKR

SEQ ID NO: 2038070 - protein, 31 aa, Staphylococcus
RTPRIPRSLLDEFREGLLIGTACDEGELFTA

SEQ ID NO: 2038071 - protein, 17 aa, Staphylococcus
RTPRIPRSLLNEYREGI

SEQ ID NO: 2038072 - protein, 25 aa, Staphylococcus
RTPYVIGGLKYAKAVGAKTAALACV

SEQ ID NO: 2038073 - protein, 20 aa, Staphylococcus
RTQAILPLRGKILNVEKSRL

SEQ ID NO: 2038074 - protein, 22 aa, Staphylococcus
RTQLILEIFALRAKSKEGKLQV

SEQ ID NO: 2038075 - protein, 24 aa, Staphylococcus
RTQLILEIFALRAKSREGKLQVEL

SEQ ID NO: 2038076 - protein, 24 aa, Staphylococcus
RTQLILEIFALRARSKEGKLQVEL

SEQ ID NO: 2038077 - protein, 24 aa, Staphylococcus
RTQLILEIFALRARSREGKLQVEL

SEQ ID NO: 2038078 - protein, 25 aa, Staphylococcus
RTQLILEIFALRARSREGKLQVELA

SEQ ID NO: 2038079 - protein, 24 aa, Staphylococcus
RTQLILEIFALRASSREGKLQVEL

SEQ ID NO: 2038080 - protein, 21 aa, Staphylococcus
RTQSFLKYMLLNQIEHKRFTL

SEQ ID NO: 2038081 - protein, 19 aa, Staphylococcus
RTRALLDQYGFDFKKSLGQ

SEQ ID NO: 2038082 - protein, 19 aa, Staphylococcus
RTRALLDQYGFNFKKSLGQ

SEQ ID NO: 2038083 - protein, 21 aa, Staphylococcus
RTRASLKIQEGCNNFCTFCII

SEQ ID NO: 2038084 - protein, 17 aa, Staphylococcus
RTRIKVMNEIRRKDRPN

SEQ ID NO: 2038085 - protein, 19 aa, Staphylococcus
RTRISLSKDVLAEFEKIRR

SEQ ID NO: 2038086 - protein, 21 aa, Staphylococcus
RTRISLSNDVLAEFEKIRRGN

SEQ ID NO: 2038087 - protein, 22 aa, Staphylococcus
RTRKKALKRLLIYFEQVDILDY

SEQ ID NO: 2038088 - protein, 25 aa, Staphylococcus
RTRNKRIIQIPVLYGEEYGPDLAEV

SEQ ID NO: 2038089 - protein, 24 aa, Staphylococcus
RTSFNDKTSLVWVSPITSRPVKYP

SEQ ID NO: 2038090 - protein, 17 aa, Staphylococcus
RTSGKFKGVRYHKRDKL

SEQ ID NO: 2038091 - protein, 20 aa, Staphylococcus
RTSNIPMAISYDKTGTDVNF

SEQ ID NO: 2038092 - protein, 23 aa, Staphylococcus
RTSRVYLAIGGGFKLDRWLDSTS

SEQ ID NO: 2038093 - protein, 19 aa, Staphylococcus
RTSSDIGMARGFRAPLKFY

SEQ ID NO: 2038094 - protein, 18 aa, Staphylococcus
RTSVETIDLTRLIVEVAY

SEQ ID NO: 2038095 - protein, 20 aa, Staphylococcus
RTTGHLMSMLMTLKGLPLAY

SEQ ID NO: 2038096 - protein, 18 aa, Staphylococcus
RTVDLCLDVIVLPNGKYE

SEQ ID NO: 2038097 - protein, 25 aa, Staphylococcus
RTVGIAISDLMGWTAQGLDTLRINE

SEQ ID NO: 2038098 - protein, 21 aa, Staphylococcus
RTVGLEIIGKGIARTGYEVFD

SEQ ID NO: 2038099 - protein, 22 aa, Staphylococcus
RTVGLELIDKGIARTGYTVMNL

SEQ ID NO: 2038100 - protein, 22 aa, Staphylococcus
RTVGLELLDKGIARTGYEVLDL

SEQ ID NO: 2038101 - protein, 22 aa, Staphylococcus
RTVGLELLDKGIARTGYPVLDL

SEQ ID NO: 2038102 - protein, 32 aa, Staphylococcus
RTVGLELLEKGIARTGYEVMDLDGNVIGEVTS

SEQ ID NO: 2038103 - protein, 26 aa, Staphylococcus
RTVGLEMIDKGIPRTGYEVYDLDGNQ

SEQ ID NO: 2038104 - protein, 17 aa, Staphylococcus
RTVGSPLVLPAHHYCLI

SEQ ID NO: 2038105 - protein, 17 aa, Staphylococcus
RTVILPSSDREASIKSL

SEQ ID NO: 2038106 - protein, 17 aa, Staphylococcus
RTVKETIEGAGLNQAIT

SEQ ID NO: 2038107 - protein, 17 aa, Staphylococcus
RTVKETLEGAGLDQAIT

SEQ ID NO: 2038108 - protein, 18 aa, Staphylococcus
RTVLHFHPALAPYKAAVL

SEQ ID NO: 2038109 - protein, 18 aa, Staphylococcus
RTVMMGVGGSFEIYSGTK

SEQ ID NO: 2038110 - protein, 18 aa, Staphylococcus
RTWASKKGTALLISSHQL

SEQ ID NO: 2038111 - protein, 30 aa, Staphylococcus
RTWDFQIKLPRFLSKEDYLIFTHAIVEEFK

SEQ ID NO: 2038112 - protein, 19 aa, Staphylococcus
RTYEMLPVVMEYKTKEVAL

SEQ ID NO: 2038113 - protein, 24 aa, Staphylococcus
RTYTELYKTLPFDFLSEVVYQWER

SEQ ID NO: 2038114 - protein, 22 aa, Staphylococcus
RVADFKDLLLQRHPELTHKQFQ

SEQ ID NO: 2038115 - protein, 21 aa, Staphylococcus
RVAQKLNLNFEYRATEIDGLH

SEQ ID NO: 2038116 - protein, 31 aa, Staphylococcus
RVASRIRMGTVWINDFHPYFAQAPWGGYKQS

SEQ ID NO: 2038117 - protein, 19 aa, Staphylococcus
RVATETQYLLAKYVFETLG

SEQ ID NO: 2038118 - protein, 26 aa, Staphylococcus
RVATQLKMIYVDTGAMYRALTYKYLK

SEQ ID NO: 2038119 - protein, 18 aa, Staphylococcus
RVAVTDFLTRNVAHVLKS

SEQ ID NO: 2038120 - protein, 19 aa, Staphylococcus
RVDEFLTKFEDAYNQIRQF

SEQ ID NO: 2038121 - protein, 18 aa, Staphylococcus
RVDIAGSVESIYDITKDD

SEQ ID NO: 2038122 - protein, 18 aa, Staphylococcus
RVDIAGSVESIYEITKDD

SEQ ID NO: 2038123 - protein, 17 aa, Staphylococcus
RVDLSEKQVRKIVQHLE

SEQ ID NO: 2038124 - protein, 20 aa, Staphylococcus
RVDVGLPREVLIPWEDLPKV

SEQ ID NO: 2038125 - protein, 21 aa, Staphylococcus
RVDVPVIVKEVGFGMSKETFK

SEQ ID NO: 2038126 - protein, 21 aa, Staphylococcus
RVDVPVIVKEVGFGMSKETIK

SEQ ID NO: 2038127 - protein, 26 aa, Staphylococcus
RVEDFELCCLEIDYPEKFVTLQHQHV

SEQ ID NO: 2038128 - protein, 18 aa, Staphylococcus
RVEFHLHTSMSQMDGIPN

SEQ ID NO: 2038129 - protein, 22 aa, Staphylococcus
RVEFVIEGYLVRKDFFSYTRVF

SEQ ID NO: 2038130 - protein, 17 aa, Staphylococcus
RVEIAKAVSRFVTQVKQ

SEQ ID NO: 2038131 - protein, 19 aa, Staphylococcus
RVEKADAGDTVFFVLEATP

SEQ ID NO: 2038132 - protein, 28 aa, Staphylococcus
RVEPPCIYYYKCGGCQLQHMSYQAQLNM

SEQ ID NO: 2038133 - protein, 28 aa, Staphylococcus
RVEPPCKYYWKCGGCQLQHMTYDAQLAM

SEQ ID NO: 2038134 - protein, 20 aa, Staphylococcus
RVEYKEGFSMCEVTLLTGRT

SEQ ID NO: 2038135 - protein, 19 aa, Staphylococcus
RVFCMNQCLNQIEDVSFKD

SEQ ID NO: 2038136 - protein, 26 aa, Staphylococcus
RVFKALKEQGIEFIAASGNQYAKLKS

SEQ ID NO: 2038137 - protein, 20 aa, Staphylococcus
RVFRIHHNPLLAYICNQLDT

SEQ ID NO: 2038138 - protein, 19 aa, Staphylococcus
RVFSLPQDFTIVALTATAT

SEQ ID NO: 2038139 - protein, 21 aa, Staphylococcus
RVGAAKIALERAIEINDNVVM

SEQ ID NO: 2038140 - protein, 22 aa, Staphylococcus
RVGAAKIALERAIEINDNVVMI

SEQ ID NO: 2038141 - protein, 17 aa, Staphylococcus
RVGDRKVLCAMSGGVDS

SEQ ID NO: 2038142 - protein, 20 aa, Staphylococcus
RVGEQLAIGDIYPKLINSHD

SEQ ID NO: 2038143 - protein, 19 aa, Staphylococcus
RVGEVITRTWQVAHRMKEQ

SEQ ID NO: 2038144 - protein, 18 aa, Staphylococcus
RVGFFYPEIAMYFKNPSR

SEQ ID NO: 2038145 - protein, 21 aa, Staphylococcus
RVGKPYCPHHGIEIESQTVQQ

SEQ ID NO: 2038146 - protein, 18 aa, Staphylococcus
RVGLSPSGIHALVEQGHT

SEQ ID NO: 2038147 - protein, 17 aa, Staphylococcus
RVGLSPSGVHALVEKGH

SEQ ID NO: 2038148 - protein, 20 aa, Staphylococcus
RVGRSSRIGYAYFLHPANKV

SEQ ID NO: 2038149 - protein, 23 aa, Staphylococcus
RVGRSSRIGYAYFLHPANKVLNE

SEQ ID NO: 2038150 - protein, 20 aa, Staphylococcus
RVGRSSRIGYAYFLHPTNKV

SEQ ID NO: 2038151 - protein, 22 aa, Staphylococcus
RVGRSSRIGYAYFLHPTNKVLT

SEQ ID NO: 2038152 - protein, 20 aa, Staphylococcus
RVGRSSRIGYAYFLHSANKV

SEQ ID NO: 2038153 - protein, 22 aa, Staphylococcus
RVGRSSRIGYAYFLHSTNKVLT

SEQ ID NO: 2038154 - protein, 24 aa, Staphylococcus
RVGRSSRVGYAYFLHPTNKVLSET

SEQ ID NO: 2038155 - protein, 21 aa, Staphylococcus
RVGSAKIAIERAIEINDNVAL

SEQ ID NO: 2038156 - protein, 25 aa, Staphylococcus
RVGTDKEYFVFYLLCQGKSLNEVGK

SEQ ID NO: 2038157 - protein, 18 aa, Staphylococcus
RVGYPVAMENAIPEVKEY

SEQ ID NO: 2038158 - protein, 17 aa, Staphylococcus
RVIEGNSGLFVAMPSKR

SEQ ID NO: 2038159 - protein, 21 aa, Staphylococcus
RVIEGNSGLFVAMPSKRTPDG

SEQ ID NO: 2038160 - protein, 22 aa, Staphylococcus
RVIEGNSGLFVAMPSKRTPDGE

SEQ ID NO: 2038161 - protein, 21 aa, Staphylococcus
RVIEGNTGLFVAMPSKRTPDG

SEQ ID NO: 2038162 - protein, 17 aa, Staphylococcus
RVIEYINSFHFSKSDIE

SEQ ID NO: 2038163 - protein, 24 aa, Staphylococcus
RVIFKNCRMTGTYLKQMRLGHTSF

SEQ ID NO: 2038164 - protein, 23 aa, Staphylococcus
RVIGYKNALPWHIPNDLKHVKQL

SEQ ID NO: 2038165 - protein, 19 aa, Staphylococcus
RVILGRFSMILSDDGGALQ

SEQ ID NO: 2038166 - protein, 19 aa, Staphylococcus
RVINDRKGIVFVHPSSSPK

SEQ ID NO: 2038167 - protein, 27 aa, Staphylococcus
RVINLSLRAKYLFKDNLDYFIYNGEVV

SEQ ID NO: 2038168 - protein, 19 aa, Staphylococcus
RVINTLIKFLPYITNTIRY

SEQ ID NO: 2038169 - protein, 18 aa, Staphylococcus
RVIQSGFDGVEIHGANHY

SEQ ID NO: 2038170 - protein, 31 aa, Staphylococcus
RVISEGLLEGFKLLGFDAYFAIPRSKEEREK

SEQ ID NO: 2038171 - protein, 37 aa, Staphylococcus
RVISEQIVPCWYCRFCNRGQYWMCEKHDLYGFQNNVN

SEQ ID NO: 2038172 - protein, 21 aa, Staphylococcus
RVKDADALISILSTNVDKEVI

SEQ ID NO: 2038173 - protein, 19 aa, Staphylococcus
RVKEELEDIFLTLLVQQHP

SEQ ID NO: 2038174 - protein, 19 aa, Staphylococcus
RVKGYKIGIVTSDTKKGTL

SEQ ID NO: 2038175 - protein, 17 aa, Staphylococcus
RVKLTGMRMERHETEQQ

SEQ ID NO: 2038176 - protein, 17 aa, Staphylococcus
RVKLVKFTFGTEPNSAE

SEQ ID NO: 2038177 - protein, 18 aa, Staphylococcus
RVKQRANDLVKFVQQQLH

SEQ ID NO: 2038178 - protein, 22 aa, Staphylococcus
RVKQRANDLVKFVQQQLQKNRN

SEQ ID NO: 2038179 - protein, 24 aa, Staphylococcus
RVKSIGISGMMHGYLAFDDKDDLL

SEQ ID NO: 2038180 - protein, 18 aa, Staphylococcus
RVKTIKWNIEQPIDYSKP

SEQ ID NO: 2038181 - protein, 22 aa, Staphylococcus
RVLATRLNQAFSEIGKTTQASL

SEQ ID NO: 2038182 - protein, 18 aa, Staphylococcus
RVLEDSGVFKQSTEGQKG

SEQ ID NO: 2038183 - protein, 20 aa, Staphylococcus
RVLEELSFGGGAINDTLMHL

SEQ ID NO: 2038184 - protein, 20 aa, Staphylococcus
RVLESSCKFYGSKFSILRSD

SEQ ID NO: 2038185 - protein, 25 aa, Staphylococcus
RVLGMYPKDVQVMGAIVMHQGNIAE

SEQ ID NO: 2038186 - protein, 19 aa, Staphylococcus
RVLKEQGAYEIIKKLNEEQ

SEQ ID NO: 2038187 - protein, 19 aa, Staphylococcus
RVLKEQGAYEIIRKLNEEN

SEQ ID NO: 2038188 - protein, 17 aa, Staphylococcus
RVLPLAVSGPFHSSMMS

SEQ ID NO: 2038189 - protein, 25 aa, Staphylococcus
RVLPNWTTCVSICALFRNSDVLNST

SEQ ID NO: 2038190 - protein, 19 aa, Staphylococcus
RVLRKSAFENLYKAYGAYN

SEQ ID NO: 2038191 - protein, 23 aa, Staphylococcus
RVLSEGVIKVMAKMGISTVQSYQ

SEQ ID NO: 2038192 - protein, 28 aa, Staphylococcus
RVLSEGVIKVMAKMGISTVQSYQGAQIF

SEQ ID NO: 2038193 - protein, 33 aa, Staphylococcus
RVMQELTEYGLIPEDWGGDTIFVPLSALSGDGI

SEQ ID NO: 2038194 - protein, 18 aa, Staphylococcus
RVNEEIWNSIEVDIQEMP

SEQ ID NO: 2038195 - protein, 24 aa, Staphylococcus
RVNENKKKYGFENVAQSKQKKAPD

SEQ ID NO: 2038196 - protein, 17 aa, Staphylococcus
RVPGAFNGFELGVRAIL

SEQ ID NO: 2038197 - protein, 17 aa, Staphylococcus
RVPMPHRIFNYFNAFIG

SEQ ID NO: 2038198 - protein, 21 aa, Staphylococcus
RVPRNKAIVGQNAFSHESGIH

SEQ ID NO: 2038199 - protein, 31 aa, Staphylococcus
RVPSDEALTYYMKRFEAFGIKHDGIQNVLGK

SEQ ID NO: 2038200 - protein, 26 aa, Staphylococcus
RVQDAYSLRCIPQIHGASYQVFNYVK

SEQ ID NO: 2038201 - protein, 31 aa, Staphylococcus
RVQDHNFTWAAPIMSRPVKNMTVAIIGTGRI

SEQ ID NO: 2038202 - protein, 24 aa, Staphylococcus
RVQEHNFKWAAPIMSTPVKNMTVA

SEQ ID NO: 2038203 - protein, 25 aa, Staphylococcus
RVQEHNFKWAAPIMSTPVKNMTVAI

SEQ ID NO: 2038204 - protein, 29 aa, Staphylococcus
RVQIGKLKLDSNLPKGSYRELTQEEIELV

SEQ ID NO: 2038205 - protein, 21 aa, Staphylococcus
RVQKELFEYSGHAPHIEEPDH

SEQ ID NO: 2038206 - protein, 24 aa, Staphylococcus
RVQLIEMMTAFGLEEPQRLLKSYP

SEQ ID NO: 2038207 - protein, 30 aa, Staphylococcus
RVQLLLEWMDGRMPLIGIGSIFTADQAIEA

SEQ ID NO: 2038208 - protein, 19 aa, Staphylococcus
RVQLPIIIHNREATQDCID

SEQ ID NO: 2038209 - protein, 19 aa, Staphylococcus
RVQQIKGNIPFDEDNKPVP

SEQ ID NO: 2038210 - protein, 18 aa, Staphylococcus
RVRDRTKLLIYLSSKSIS

SEQ ID NO: 2038211 - protein, 23 aa, Staphylococcus
RVREAVVVPVYRNDKVVHLIGAV

SEQ ID NO: 2038212 - protein, 27 aa, Staphylococcus
RVRMPVKKGWHTIPLHAIAPVQYSTTS

SEQ ID NO: 2038213 - protein, 23 aa, Staphylococcus
RVRYPYMRGKLWELWTTALEEHE

SEQ ID NO: 2038214 - protein, 20 aa, Staphylococcus
RVSGTSGLALFDYHFGQTGV

SEQ ID NO: 2038215 - protein, 18 aa, Staphylococcus
RVSHAEVVIWLQEKRVTC

SEQ ID NO: 2038216 - protein, 27 aa, Staphylococcus
RVSHGEIDAVISFGKFIKEFEGLKEYQ

SEQ ID NO: 2038217 - protein, 17 aa, Staphylococcus
RVSKIKLGNGFDDETEM

SEQ ID NO: 2038218 - protein, 19 aa, Staphylococcus
RVSKTKGLIGNIMKIKPIG

SEQ ID NO: 2038219 - protein, 21 aa, Staphylococcus
RVTDHRIGLTIQKLDQIVEGK

SEQ ID NO: 2038220 - protein, 22 aa, Staphylococcus
RVTDHRIGLTLQKLDQIMEGKL

SEQ ID NO: 2038221 - protein, 21 aa, Staphylococcus
RVTEAFLKMKKFDIATLEKAY

SEQ ID NO: 2038222 - protein, 17 aa, Staphylococcus
RVTENVRIHSACLTGDI

SEQ ID NO: 2038223 - protein, 23 aa, Staphylococcus
RVTIKGIDLNGSYRVTMTDYCFR

SEQ ID NO: 2038224 - protein, 25 aa, Staphylococcus
RVTKKLCAHYEIQAPLKSYHDHNKE

SEQ ID NO: 2038225 - protein, 17 aa, Staphylococcus
RVTKKLCNHYDIQTPLK

SEQ ID NO: 2038226 - protein, 17 aa, Staphylococcus
RVTKKLCNHYDITTLLK

SEQ ID NO: 2038227 - protein, 23 aa, Staphylococcus
RVTLAECPEVLQSIGPSAKLFSA

SEQ ID NO: 2038228 - protein, 19 aa, Staphylococcus
RVTLGYPEVRQHIRDGLCD

SEQ ID NO: 2038229 - protein, 27 aa, Staphylococcus
RVTLGYPLVRNAIRDGLARLIDEHFSE

SEQ ID NO: 2038230 - protein, 26 aa, Staphylococcus
RVTLGYPLVRNAIRDGLIKLINEKFE

SEQ ID NO: 2038231 - protein, 20 aa, Staphylococcus
RVTLTEFGIMCYEKYIKNKQ

SEQ ID NO: 2038232 - protein, 33 aa, Staphylococcus
RVTQIICYDLRFPELLRYPARKDAQIAFYVAQW

SEQ ID NO: 2038233 - protein, 18 aa, Staphylococcus
RVTRKLCNHYDIKTPLKS

SEQ ID NO: 2038234 - protein, 18 aa, Staphylococcus
RVTRKLCSHYAIDTPLKS

SEQ ID NO: 2038235 - protein, 22 aa, Staphylococcus
RVTRNKKKYGFEDTLTNSEKVK

SEQ ID NO: 2038236 - protein, 24 aa, Staphylococcus
RVTVYWHYFLRPEVKFSGIDPLVE

SEQ ID NO: 2038237 - protein, 20 aa, Staphylococcus
RVVHLMKHLYNRDMTEKDIK

SEQ ID NO: 2038238 - protein, 17 aa, Staphylococcus
RVVKGVQFKGLRDIGDP

SEQ ID NO: 2038239 - protein, 24 aa, Staphylococcus
RVVLRDLPLSLAHLSESMNGHQFS

SEQ ID NO: 2038240 - protein, 30 aa, Staphylococcus
RVVNKLKMGTVWINDFHPYFAQAPWGGYKQ

SEQ ID NO: 2038241 - protein, 18 aa, Staphylococcus
RVVPESVHALYHKPHASI

SEQ ID NO: 2038242 - protein, 19 aa, Staphylococcus
RVVQFYTDLNTDGRFLNIG

SEQ ID NO: 2038243 - protein, 21 aa, Staphylococcus
RVYLAIGGGFKLDSWLNSTST

SEQ ID NO: 2038244 - protein, 19 aa, Staphylococcus
RWAGVPFYIRTGKRMKRKS

SEQ ID NO: 2038245 - protein, 19 aa, Staphylococcus
RWAGVPFYIRTGKRMKSKT

SEQ ID NO: 2038246 - protein, 19 aa, Staphylococcus
RWFEDLRTIFINEYMTFSE

SEQ ID NO: 2038247 - protein, 19 aa, Staphylococcus
RWGAPFPVIEIVKRGISKA

SEQ ID NO: 2038248 - protein, 20 aa, Staphylococcus
RWGAPFPVIEIVKRGISKAR

SEQ ID NO: 2038249 - protein, 19 aa, Staphylococcus
RWHLAHNRLIIPKSKTPER

SEQ ID NO: 2038250 - protein, 20 aa, Staphylococcus
RWIKKLCQMGYITSKQSNKD

SEQ ID NO: 2038251 - protein, 22 aa, Staphylococcus
RWILLDLANVVVHIFHKDERPY

SEQ ID NO: 2038252 - protein, 18 aa, Staphylococcus
RWIYKTMNEIRFFEEKVH

SEQ ID NO: 2038253 - protein, 20 aa, Staphylococcus
RWKGTPFYIRTGKRLNKKAI

SEQ ID NO: 2038254 - protein, 19 aa, Staphylococcus
RWKKWCCSQQGFIDFAIEA

SEQ ID NO: 2038255 - protein, 24 aa, Staphylococcus
RWLPEVRRQSDFVVVSYHGGFEKD

SEQ ID NO: 2038256 - protein, 26 aa, Staphylococcus
RWNRSHHQLIFFGRYHCLARKPKCDI

SEQ ID NO: 2038257 - protein, 23 aa, Staphylococcus
RWQKQLEGIGWNALFIENHDQPR

SEQ ID NO: 2038258 - protein, 28 aa, Staphylococcus
RWSKSHHQLIFFGRYHCIARKPKCDICP

SEQ ID NO: 2038259 - protein, 26 aa, Staphylococcus
RWSRSHHQLIFFGRYHCLARKPKCDI

SEQ ID NO: 2038260 - protein, 21 aa, Staphylococcus
RWSTGHLPYLLELGAIELSKS

SEQ ID NO: 2038261 - protein, 19 aa, Staphylococcus
RYAERRAGSAGLQVTGAAY

SEQ ID NO: 2038262 - protein, 22 aa, Staphylococcus
RYAGPKGAPGMPEMLSASSILV

SEQ ID NO: 2038263 - protein, 20 aa, Staphylococcus
RYDAIPCNISPLSPQKTVVQ

SEQ ID NO: 2038264 - protein, 20 aa, Staphylococcus
RYDEITGYLNDNGFNVIRYD

SEQ ID NO: 2038265 - protein, 21 aa, Staphylococcus
RYDLLKDRAIIMHPAPVNRGV

SEQ ID NO: 2038266 - protein, 18 aa, Staphylococcus
RYDLMLVQTNRHFGKTIV

SEQ ID NO: 2038267 - protein, 21 aa, Staphylococcus
RYDPNQCILCGRCVEVCQDVQ

SEQ ID NO: 2038268 - protein, 21 aa, Staphylococcus
RYEARFQPKQIEDFEDMIQYN

SEQ ID NO: 2038269 - protein, 21 aa, Staphylococcus
RYEGFGPSGSMIIVDALTDNV

SEQ ID NO: 2038270 - protein, 21 aa, Staphylococcus
RYEGFGPSGSMIIVDALTNNV

SEQ ID NO: 2038271 - protein, 19 aa, Staphylococcus
RYEGFGPSGSMLIVDALTN

SEQ ID NO: 2038272 - protein, 27 aa, Staphylococcus
RYEMRKLKKLEVMIEILNIMYIKTVQI

SEQ ID NO: 2038273 - protein, 21 aa, Staphylococcus
RYFDDVTLYIAAAQRKKQDIQ

SEQ ID NO: 2038274 - protein, 24 aa, Staphylococcus
RYFDKEAYAVLGLITSKTPELEDK

SEQ ID NO: 2038275 - protein, 29 aa, Staphylococcus
RYFDLNFCHDWSFNFLGDMTFNDYPEFKI

SEQ ID NO: 2038276 - protein, 19 aa, Staphylococcus
RYFEMMDYVKSKGIECVTV

SEQ ID NO: 2038277 - protein, 18 aa, Staphylococcus
RYFEYKGYDVNYVSNFTD

SEQ ID NO: 2038278 - protein, 19 aa, Staphylococcus
RYFEYQGYEVVFVSNFTDV

SEQ ID NO: 2038279 - protein, 26 aa, Staphylococcus
RYFGGIKLGGGGLIRAYSGAVRDVIY

SEQ ID NO: 2038280 - protein, 18 aa, Staphylococcus
RYFGLELSAYLDQFSLYM

SEQ ID NO: 2038281 - protein, 21 aa, Staphylococcus
RYFLNKVAQEFWYVHDGQIER

SEQ ID NO: 2038282 - protein, 17 aa, Staphylococcus
RYFPILKGKSIDYIMPQ

SEQ ID NO: 2038283 - protein, 20 aa, Staphylococcus
RYGDFGSFYVGHIVTKDNLQ

SEQ ID NO: 2038284 - protein, 17 aa, Staphylococcus
RYGQSIKGTKPEFTEER

SEQ ID NO: 2038285 - protein, 20 aa, Staphylococcus
RYGRTYTGVMPEWQPGQKVH

SEQ ID NO: 2038286 - protein, 20 aa, Staphylococcus
RYGTFTKYFTQNDVPTFAIC

SEQ ID NO: 2038287 - protein, 18 aa, Staphylococcus
RYHCIARKPKCDICPLLE

SEQ ID NO: 2038288 - protein, 23 aa, Staphylococcus
RYHCLARSPKCDVCPLFNDCREG

SEQ ID NO: 2038289 - protein, 17 aa, Staphylococcus
RYHIKKKYVAKLKGYLM

SEQ ID NO: 2038290 - protein, 25 aa, Staphylococcus
RYIGACGLDSVRVIKGQFGAHFNTN

SEQ ID NO: 2038291 - protein, 28 aa, Staphylococcus
RYIIFTQGCLLRCLYCHNPDTWSLTDAP

SEQ ID NO: 2038292 - protein, 22 aa, Staphylococcus
RYIKVFPGLVTYVGHTHEEALK

SEQ ID NO: 2038293 - protein, 30 aa, Staphylococcus
RYINKPELQDMLGYFIKYVGSSSYDAPAVL

SEQ ID NO: 2038294 - protein, 25 aa, Staphylococcus
RYINLLRLFYALDVYIEQSGPITIV

SEQ ID NO: 2038295 - protein, 19 aa, Staphylococcus
RYKDDIDGFGYKWITHEEE

SEQ ID NO: 2038296 - protein, 18 aa, Staphylococcus
RYKHEYQVITYFLNIKSK

SEQ ID NO: 2038297 - protein, 20 aa, Staphylococcus
RYKTMQGFYAPYVPGWDTHG

SEQ ID NO: 2038298 - protein, 25 aa, Staphylococcus
RYLERISELCGVHISIFSVGPDREQ

SEQ ID NO: 2038299 - protein, 18 aa, Staphylococcus
RYLIARNVHKSVFHGLDL

SEQ ID NO: 2038300 - protein, 25 aa, Staphylococcus
RYLINGSNFTTGWIFFINEEGDHEL

SEQ ID NO: 2038301 - protein, 23 aa, Staphylococcus
RYLKDGLAKLGFNTGESETPITP

SEQ ID NO: 2038302 - protein, 17 aa, Staphylococcus
RYLKEFKPLKHVDHDYL

SEQ ID NO: 2038303 - protein, 17 aa, Staphylococcus
RYLKEITNDISFMQSTI

SEQ ID NO: 2038304 - protein, 17 aa, Staphylococcus
RYLKEVTQDIALMNSQI

SEQ ID NO: 2038305 - protein, 30 aa, Staphylococcus
RYLPNVKLKHWAYRKLLKMDIGAHTAFAFK

SEQ ID NO: 2038306 - protein, 19 aa, Staphylococcus
RYLSLDFSNSLDLVTQSKM

SEQ ID NO: 2038307 - protein, 20 aa, Staphylococcus
RYLTITNCYSHHPTIGKGNN

SEQ ID NO: 2038308 - protein, 20 aa, Staphylococcus
RYLTPHGKWNIHSTYQDNQH

SEQ ID NO: 2038309 - protein, 18 aa, Staphylococcus
RYMEAEPFMWPTYLEVQK

SEQ ID NO: 2038310 - protein, 18 aa, Staphylococcus
RYMNELEITRRDLPADAA

SEQ ID NO: 2038311 - protein, 17 aa, Staphylococcus
RYNCETLEVTYKGKNIA

SEQ ID NO: 2038312 - protein, 23 aa, Staphylococcus
RYNLLESIAEAFEFGTLKNNSFN

SEQ ID NO: 2038313 - protein, 17 aa, Staphylococcus
RYNMVEFQEEMKYQRSS

SEQ ID NO: 2038314 - protein, 22 aa, Staphylococcus
RYNPPINIKVATRLGHVKGYFI

SEQ ID NO: 2038315 - protein, 21 aa, Staphylococcus
RYNQIKLLWEDIEAFDDEQLI

SEQ ID NO: 2038316 - protein, 17 aa, Staphylococcus
RYPANDFVREFIGQNRL

SEQ ID NO: 2038317 - protein, 17 aa, Staphylococcus
RYPEYCSSLTLVNPTSI

SEQ ID NO: 2038318 - protein, 24 aa, Staphylococcus
RYPGESGLIALDWHNGNRSVLSDS

SEQ ID NO: 2038319 - protein, 21 aa, Staphylococcus
RYPIRALMMSHMFVEVDDDVH

SEQ ID NO: 2038320 - protein, 20 aa, Staphylococcus
RYPIRALMMSHMFVEVDEEV

SEQ ID NO: 2038321 - protein, 21 aa, Staphylococcus
RYPIRALMMSHMFVEVDEHVH

SEQ ID NO: 2038322 - protein, 20 aa, Staphylococcus
RYPIRALMMSHMFVEVDELV

SEQ ID NO: 2038323 - protein, 19 aa, Staphylococcus
RYPLVDGQGNFGSMDGDGA

SEQ ID NO: 2038324 - protein, 41 aa, Staphylococcus
RYPNIKFILGHAGGALPYLRWRIDQSYSWMIENLEDAVELN

SEQ ID NO: 2038325 - protein, 19 aa, Staphylococcus
RYPTIPFYLQVGNPYLDDD

SEQ ID NO: 2038326 - protein, 19 aa, Staphylococcus
RYQIPLFIVENGFGAVDEM

SEQ ID NO: 2038327 - protein, 17 aa, Staphylococcus
RYQITYNYDEFYQLLLI

SEQ ID NO: 2038328 - protein, 19 aa, Staphylococcus
RYQYLLTRKYHFMGYRQMK

SEQ ID NO: 2038329 - protein, 19 aa, Staphylococcus
RYRAHIPNLICVYSEDVYR

SEQ ID NO: 2038330 - protein, 25 aa, Staphylococcus
RYRHYAGSYAIQWKMINYALEHGID

SEQ ID NO: 2038331 - protein, 18 aa, Staphylococcus
RYRIKRDAQDIAELAKSL

SEQ ID NO: 2038332 - protein, 26 aa, Staphylococcus
RYRPHYKTRIVSHVRWFDDKGRLRSE

SEQ ID NO: 2038333 - protein, 20 aa, Staphylococcus
RYRQFTQFGVEAIGAEDPSI

SEQ ID NO: 2038334 - protein, 18 aa, Staphylococcus
RYRVKRDAQDIAELAKSL

SEQ ID NO: 2038335 - protein, 18 aa, Staphylococcus
RYSSEFTQPIELKIVLLH

SEQ ID NO: 2038336 - protein, 27 aa, Staphylococcus
RYSSEIFRSAFWMDEPRILEIGYPRND

SEQ ID NO: 2038337 - protein, 24 aa, Staphylococcus
RYSTEIFKSAFWMDEPRMLEIGYP

SEQ ID NO: 2038338 - protein, 24 aa, Staphylococcus
RYTDFKMGIQIRHFTVQALRLLKT

SEQ ID NO: 2038339 - protein, 24 aa, Staphylococcus
RYTIQRLALGIAYYLQDNMAQPSI

SEQ ID NO: 2038340 - protein, 17 aa, Staphylococcus
RYTKPLVAMKVKPQDEI

SEQ ID NO: 2038341 - protein, 18 aa, Staphylococcus
RYTMTSTRRMMMRVSDAL

SEQ ID NO: 2038342 - protein, 17 aa, Staphylococcus
RYVDLVIPEEGWGQKEK

SEQ ID NO: 2038343 - protein, 17 aa, Staphylococcus
RYVDLVIPESGWGQKEI

SEQ ID NO: 2038344 - protein, 25 aa, Staphylococcus
RYVKELTGLPAERVIGSGTVLDSAR

SEQ ID NO: 2038345 - protein, 19 aa, Staphylococcus
RYVLEDGKYGMLVKNEVQY

SEQ ID NO: 2038346 - protein, 18 aa, Staphylococcus
RYVPVLIVAIGKKEKEPH

SEQ ID NO: 2038347 - protein, 19 aa, Staphylococcus
RYVPVMIVAIGKKAKEAHT

SEQ ID NO: 2038348 - protein, 20 aa, Staphylococcus
RYVSNEMIYDYSIAADKLSF

SEQ ID NO: 2038349 - protein, 18 aa, Staphylococcus
RYVSNGLVHFLLPEELRE

SEQ ID NO: 2038350 - protein, 21 aa, Staphylococcus
RYVYNNGKMIIISYPLYKENK

SEQ ID NO: 2038351 - protein, 19 aa, Staphylococcus
RYYEKVGVIPPVERDKNGY

SEQ ID NO: 2038352 - protein, 28 aa, Staphylococcus
RYYFKSLYSKFYPGILVEIATDGPGFTG

SEQ ID NO: 2038353 - protein, 18 aa, Staphylococcus
RYYIQRFLARSFGFDVDD

SEQ ID NO: 2038354 - protein, 19 aa, Staphylococcus
RYYIQRFLARSFGFDVDDI

SEQ ID NO: 2038355 - protein, 18 aa, Staphylococcus
RYYIQRFLARSFGFEVDD

SEQ ID NO: 2038356 - protein, 19 aa, Staphylococcus
RYYIQRFLARSFGFEVDDI

SEQ ID NO: 2038357 - protein, 18 aa, Staphylococcus
RYYIQRFLARSFGLDVED

SEQ ID NO: 2038358 - protein, 22 aa, Staphylococcus
SAAIKPWILPNFESLVNHEKIK

SEQ ID NO: 2038359 - protein, 32 aa, Staphylococcus
SAASSCYIISLAAALERARFDNITIKNESIGT

SEQ ID NO: 2038360 - protein, 26 aa, Staphylococcus
SAASSCYIISLAAVLERSGFTDIKIA

SEQ ID NO: 2038361 - protein, 19 aa, Staphylococcus
SACYTGFQLFVKTGVLNMM

SEQ ID NO: 2038362 - protein, 19 aa, Staphylococcus
SADKRLQLLQSQYTDEKFN

SEQ ID NO: 2038363 - protein, 18 aa, Staphylococcus
SADKYVFVSPMWNLSFPP

SEQ ID NO: 2038364 - protein, 25 aa, Staphylococcus
SADLALAGVKSRIPVDEVIEAMDKV

SEQ ID NO: 2038365 - protein, 18 aa, Staphylococcus
SADLPFAQKRWCASNGLD

SEQ ID NO: 2038366 - protein, 27 aa, Staphylococcus
SADLPFAQKRWCASNGLENVITLSDHK

SEQ ID NO: 2038367 - protein, 18 aa, Staphylococcus
SADQALLQRLDLMKFQAE

SEQ ID NO: 2038368 - protein, 24 aa, Staphylococcus
SADYLCGFGQLFQYLRKEMIAEAE

SEQ ID NO: 2038369 - protein, 28 aa, Staphylococcus
SAEAFAICLKNMLGLVCDPVAGLVEVPC

SEQ ID NO: 2038370 - protein, 17 aa, Staphylococcus
SAEAGVDVFRIFDSLNW

SEQ ID NO: 2038371 - protein, 19 aa, Staphylococcus
SAEAHKIMTNRYKTDSQLW

SEQ ID NO: 2038372 - protein, 19 aa, Staphylococcus
SAEAILEFYNGHKEELSQK

SEQ ID NO: 2038373 - protein, 20 aa, Staphylococcus
SAEFADIIAHILASHHIKVY

SEQ ID NO: 2038374 - protein, 19 aa, Staphylococcus
SAEGCKRSLGYSLQSKWLS

SEQ ID NO: 2038375 - protein, 26 aa, Staphylococcus
SAEGYRPVMEIQFLGFVFEVFDSVAG

SEQ ID NO: 2038376 - protein, 21 aa, Staphylococcus
SAEHDLNHAITLYQQTNANAL

SEQ ID NO: 2038377 - protein, 25 aa, Staphylococcus
SAEHGLKFKGNENVKALKADDNNNV

SEQ ID NO: 2038378 - protein, 18 aa, Staphylococcus
SAEIKKLVVGYIESKTQH

SEQ ID NO: 2038379 - protein, 18 aa, Staphylococcus
SAELDVVILTTPGSAAQE

SEQ ID NO: 2038380 - protein, 24 aa, Staphylococcus
SAEPGETVYFILKETPFYAVSGGQ

SEQ ID NO: 2038381 - protein, 18 aa, Staphylococcus
SAFDIIGPVMMGPSSSHT

SEQ ID NO: 2038382 - protein, 19 aa, Staphylococcus
SAFDIIGPVMMGPSSSHTA

SEQ ID NO: 2038383 - protein, 26 aa, Staphylococcus
SAFDYAIEVPEIWHDPEIEPQTIEAD

SEQ ID NO: 2038384 - protein, 18 aa, Staphylococcus
SAFEVVNEWEFEKLVRIF

SEQ ID NO: 2038385 - protein, 17 aa, Staphylococcus
SAFKYAASVFLKILELE

SEQ ID NO: 2038386 - protein, 17 aa, Staphylococcus
SAFQGSSIMAFYVQTVA

SEQ ID NO: 2038387 - protein, 18 aa, Staphylococcus
SAFYALSRFMDLVVNEWN

SEQ ID NO: 2038388 - protein, 21 aa, Staphylococcus
SAFYKYRDTIFPVDDKIFEHR

SEQ ID NO: 2038389 - protein, 19 aa, Staphylococcus
SAGELRRTNPERLLETSIK

SEQ ID NO: 2038390 - protein, 23 aa, Staphylococcus
SAGETQLSLTFHKLPIDVQKDLL

SEQ ID NO: 2038391 - protein, 19 aa, Staphylococcus
SAGGQWFTPVINYPEVAIL

SEQ ID NO: 2038392 - protein, 26 aa, Staphylococcus
SAGKDLSCSVVRTWIHQHTVILGTHD

SEQ ID NO: 2038393 - protein, 19 aa, Staphylococcus
SAGLFIVGRIKGVSRPALV

SEQ ID NO: 2038394 - protein, 19 aa, Staphylococcus
SAGRLDYEKGYDLLIEAAR

SEQ ID NO: 2038395 - protein, 23 aa, Staphylococcus
SAGVLKYKKRKAASVQKLDQTEE

SEQ ID NO: 2038396 - protein, 20 aa, Staphylococcus
SAHEGHVWLLDPIDGTANLV

SEQ ID NO: 2038397 - protein, 25 aa, Staphylococcus
SAIAEACAQSGAHVIINYKSNTQAA

SEQ ID NO: 2038398 - protein, 24 aa, Staphylococcus
SAIAGRRSMLMGAYYLEAQHQGEG

SEQ ID NO: 2038399 - protein, 18 aa, Staphylococcus
SAIDAIRPGVKLKEIDKI

SEQ ID NO: 2038400 - protein, 19 aa, Staphylococcus
SAIEAVIGFLYLEQREQRL

SEQ ID NO: 2038401 - protein, 18 aa, Staphylococcus
SAIFKASPFHKLTQEQIN

SEQ ID NO: 2038402 - protein, 18 aa, Staphylococcus
SAIGRAAAIAYAKEGADV

SEQ ID NO: 2038403 - protein, 19 aa, Staphylococcus
SAIGRAAAIAYAKEGADVA

SEQ ID NO: 2038404 - protein, 19 aa, Staphylococcus
SAIGRAVAIAYAREGASVV

SEQ ID NO: 2038405 - protein, 24 aa, Staphylococcus
SAIIAEHCLFELDAPIMRLAAPDV

SEQ ID NO: 2038406 - protein, 24 aa, Staphylococcus
SAIIAEHCLFELDAPIMRLAGPDV

SEQ ID NO: 2038407 - protein, 23 aa, Staphylococcus
SAIIAENCLFDLDAPIMRLAGPN

SEQ ID NO: 2038408 - protein, 23 aa, Staphylococcus
SAIIAENCLFELDAPIMRLAGAD

SEQ ID NO: 2038409 - protein, 23 aa, Staphylococcus
SAIIAENCLFELDAPIMRLAGPD

SEQ ID NO: 2038410 - protein, 22 aa, Staphylococcus
SAIKPWILPNFESLVRHEKIDM

SEQ ID NO: 2038411 - protein, 17 aa, Staphylococcus
SAILKKLGGAWFSDSLV

SEQ ID NO: 2038412 - protein, 18 aa, Staphylococcus
SAILPVFDQIFTRIGAAD

SEQ ID NO: 2038413 - protein, 17 aa, Staphylococcus
SAIPEFGQATPLGRAGQ

SEQ ID NO: 2038414 - protein, 24 aa, Staphylococcus
SAITETLRFNSPVQLIPRQLSEPC

SEQ ID NO: 2038415 - protein, 31 aa, Staphylococcus
SAKAWDNRYGCVIAIEILELLSDVELDVDLY

SEQ ID NO: 2038416 - protein, 31 aa, Staphylococcus
SAKAWDNRYGCVLAIEILELLKDVELDVDLY

SEQ ID NO: 2038417 - protein, 20 aa, Staphylococcus
SAKENINCRCKLLYYIDEDE

SEQ ID NO: 2038418 - protein, 25 aa, Staphylococcus
SAKESLRLRTLFPYITEASENHKKR

SEQ ID NO: 2038419 - protein, 18 aa, Staphylococcus
SAKESRIQRGYLERTDED

SEQ ID NO: 2038420 - protein, 25 aa, Staphylococcus
SAKKLKEYFSDIPIDHIYVSDLKRT

SEQ ID NO: 2038421 - protein, 19 aa, Staphylococcus
SAKKVMAFEIDQRLIPVLK

SEQ ID NO: 2038422 - protein, 23 aa, Staphylococcus
SAKMIRRHPHIFGDEKAASIEEL

SEQ ID NO: 2038423 - protein, 17 aa, Staphylococcus
SAKMLAVALHLLQGTPY

SEQ ID NO: 2038424 - protein, 20 aa, Staphylococcus
SAKREISLWFNSNEIADYTS

SEQ ID NO: 2038425 - protein, 23 aa, Staphylococcus
SAKTGEGGKLFGSVSTKQIAEGL

SEQ ID NO: 2038426 - protein, 23 aa, Staphylococcus
SAKTGEGGKLFGSVSTKQITQAL

SEQ ID NO: 2038427 - protein, 24 aa, Staphylococcus
SAKTGESGKLFGSVSTKQIAQALK

SEQ ID NO: 2038428 - protein, 22 aa, Staphylococcus
SAKTILAFHPKELESVVIDGKT

SEQ ID NO: 2038429 - protein, 26 aa, Staphylococcus
SAKWIKNKIGFVYSEIYFNQQWNIKK

SEQ ID NO: 2038430 - protein, 24 aa, Staphylococcus
SALALEMIHTYSLIHDDLPAMDND

SEQ ID NO: 2038431 - protein, 24 aa, Staphylococcus
SALALEMIHTYSLIHDDLPPMDND

SEQ ID NO: 2038432 - protein, 23 aa, Staphylococcus
SALFRLALESRAMFPDLAADLFQ

SEQ ID NO: 2038433 - protein, 17 aa, Staphylococcus
SALIKGATILTRMALDL

SEQ ID NO: 2038434 - protein, 17 aa, Staphylococcus
SALKEIGLEPGPKYQDV

SEQ ID NO: 2038435 - protein, 28 aa, Staphylococcus
SALKSLMLKHGFEFETEVPKLFELAEEG

SEQ ID NO: 2038436 - protein, 29 aa, Staphylococcus
SALLAKVTGAGCLLGAVIASFLPTDETTS

SEQ ID NO: 2038437 - protein, 18 aa, Staphylococcus
SALLTKGYKAEGLHGDIT

SEQ ID NO: 2038438 - protein, 21 aa, Staphylococcus
SALQHAASVAAMFLTTEAVVA

SEQ ID NO: 2038439 - protein, 24 aa, Staphylococcus
SALQNAASVAAMFLTTEAVVAKLP

SEQ ID NO: 2038440 - protein, 30 aa, Staphylococcus
SALRHALDVADEFDVQIALHADTLNEAGFM

SEQ ID NO: 2038441 - protein, 20 aa, Staphylococcus
SALRPVWYKDEALLHEDLIE

SEQ ID NO: 2038442 - protein, 17 aa, Staphylococcus
SALRQLATYVRKNYPTI

SEQ ID NO: 2038443 - protein, 26 aa, Staphylococcus
SALRQLPTYIRKNFDNIKVLSITLYG

SEQ ID NO: 2038444 - protein, 25 aa, Staphylococcus
SALRQLPTYVRKHFNNIQTLNIMLF

SEQ ID NO: 2038445 - protein, 18 aa, Staphylococcus
SALSHVQYKLPFQKLSDL

SEQ ID NO: 2038446 - protein, 25 aa, Staphylococcus
SAMLNEFSDHLGLMFQIKDDLLDIY

SEQ ID NO: 2038447 - protein, 17 aa, Staphylococcus
SAMRIGKQMQFFGARAN

SEQ ID NO: 2038448 - protein, 21 aa, Staphylococcus
SAMSQIRWHSILDLKDKSEQQ

SEQ ID NO: 2038449 - protein, 36 aa, Staphylococcus
SANEAKPTYQAHSFKASEVPSAIFGTKKRRPIENGI

SEQ ID NO: 2038450 - protein, 18 aa, Staphylococcus
SANEIGLDLNYTVDELIE

SEQ ID NO: 2038451 - protein, 24 aa, Staphylococcus
SANKCIQGVPGFGFVIANKEILKQ

SEQ ID NO: 2038452 - protein, 22 aa, Staphylococcus
SANLGGAIMLAARACLFSGSGL

SEQ ID NO: 2038453 - protein, 22 aa, Staphylococcus
SANLGGAIMLAARACVFSGSGL

SEQ ID NO: 2038454 - protein, 21 aa, Staphylococcus
SANLGGAIMLAARACVYSGSG

SEQ ID NO: 2038455 - protein, 19 aa, Staphylococcus
SANYHIAIATGRPRTETIV

SEQ ID NO: 2038456 - protein, 17 aa, Staphylococcus
SAPHFKADPDIDGTKSE

SEQ ID NO: 2038457 - protein, 18 aa, Staphylococcus
SAPKIFRKVTDLVKEQVK

SEQ ID NO: 2038458 - protein, 21 aa, Staphylococcus
SAPKLKIIANYGAGFNNIDIQ

SEQ ID NO: 2038459 - protein, 20 aa, Staphylococcus
SAPLRVKVRLIIKETGEVKE

SEQ ID NO: 2038460 - protein, 18 aa, Staphylococcus
SAPSFAGLKLINSEGDLN

SEQ ID NO: 2038461 - protein, 18 aa, Staphylococcus
SAQARPYLQRKLSQNNKV

SEQ ID NO: 2038462 - protein, 28 aa, Staphylococcus
SAQFAADEKVGFVYAFFINSNIDVLHQS

SEQ ID NO: 2038463 - protein, 26 aa, Staphylococcus
SAQFEANEFLQLMISTMENRLNEHHT

SEQ ID NO: 2038464 - protein, 25 aa, Staphylococcus
SAQKMGFKVICLDPNPDSPCKSVAH

SEQ ID NO: 2038465 - protein, 25 aa, Staphylococcus
SAQKMGFKVICLDPNTDCPCHHIAN

SEQ ID NO: 2038466 - protein, 19 aa, Staphylococcus
SAQKMGFKVIVLDPDAEAP

SEQ ID NO: 2038467 - protein, 19 aa, Staphylococcus
SAQKMGFKVIVLDPNEDSP

SEQ ID NO: 2038468 - protein, 22 aa, Staphylococcus
SAQLPDFMEWFDLENRDDYSFP

SEQ ID NO: 2038469 - protein, 17 aa, Staphylococcus
SARETAARVAVGAVSKI

SEQ ID NO: 2038470 - protein, 17 aa, Staphylococcus
SARIGIPNKGIWTSKPL

SEQ ID NO: 2038471 - protein, 24 aa, Staphylococcus
SARIPFDHFLNRLIKTSKYDYYRK

SEQ ID NO: 2038472 - protein, 22 aa, Staphylococcus
SARIVGGALKLADMIVNDELQN

SEQ ID NO: 2038473 - protein, 19 aa, Staphylococcus
SARRHALKQGVDLAEVAGK

SEQ ID NO: 2038474 - protein, 24 aa, Staphylococcus
SASLSDIRSCVVTWGAQSAHDLLQ

SEQ ID NO: 2038475 - protein, 17 aa, Staphylococcus
SASRAYLHPAMKRKNLE

SEQ ID NO: 2038476 - protein, 31 aa, Staphylococcus
SASRLTRDRMVQLCVNNILAVLNHQPPITPV

SEQ ID NO: 2038477 - protein, 23 aa, Staphylococcus
SATGIRIGFLLGPEYLIEKLTFM

SEQ ID NO: 2038478 - protein, 19 aa, Staphylococcus
SATIRRDFSYFGELGKKGY

SEQ ID NO: 2038479 - protein, 19 aa, Staphylococcus
SATLFKDGRMNVHGIENDN

SEQ ID NO: 2038480 - protein, 31 aa, Staphylococcus
SATLQEWVRRYKAYGVDGLKPFSKRNKYSAE

SEQ ID NO: 2038481 - protein, 19 aa, Staphylococcus
SATSHAIVYFLQQGTPFIY

SEQ ID NO: 2038482 - protein, 33 aa, Staphylococcus
SATVIRCAHKLGFKGFVDLKLSLSRNLPQHEAH

SEQ ID NO: 2038483 - protein, 27 aa, Staphylococcus
SAVDYIGMPAVCFTEPELATVGYNEAQ

SEQ ID NO: 2038484 - protein, 22 aa, Staphylococcus
SAVEAYIDFLHEIKVDRIIFGD

SEQ ID NO: 2038485 - protein, 17 aa, Staphylococcus
SAVLPIFDQIFTRIGAA

SEQ ID NO: 2038486 - protein, 18 aa, Staphylococcus
SAVMSMRKFIGILGDFHQ

SEQ ID NO: 2038487 - protein, 29 aa, Staphylococcus
SAVTPFYYPFSFEEIKDYYFELIEATQNN

SEQ ID NO: 2038488 - protein, 21 aa, Staphylococcus
SAYAFIKRLIKQFGKPQKIVT

SEQ ID NO: 2038489 - protein, 18 aa, Staphylococcus
SAYDFCGLVLDYDKATKI

SEQ ID NO: 2038490 - protein, 18 aa, Staphylococcus
SAYDFKQRAEKCINDIIQ

SEQ ID NO: 2038491 - protein, 19 aa, Staphylococcus
SAYEFIKRLIKQFGKPQKV

SEQ ID NO: 2038492 - protein, 17 aa, Staphylococcus
SAYEQITVWGPRAKEVE

SEQ ID NO: 2038493 - protein, 26 aa, Staphylococcus
SAYHILDMIFWFGHLYILKANGLDVT

SEQ ID NO: 2038494 - protein, 18 aa, Staphylococcus
SAYKELHDIHGYKKARIM

SEQ ID NO: 2038495 - protein, 19 aa, Staphylococcus
SAYNVSRLFAKFYEQQLKP

SEQ ID NO: 2038496 - protein, 18 aa, Staphylococcus
SAYQIRKAFQNIIQQRFT

SEQ ID NO: 2038497 - protein, 20 aa, Staphylococcus
SAYVFIKRLIKQFGKPQKVI

SEQ ID NO: 2038498 - protein, 23 aa, Staphylococcus
SCAGVKVQLIIRGICCLKPGVPG

SEQ ID NO: 2038499 - protein, 18 aa, Staphylococcus
SCDLNFRAALWDFDTARK

SEQ ID NO: 2038500 - protein, 18 aa, Staphylococcus
SCEECFLEANHLQKSNFQ

SEQ ID NO: 2038501 - protein, 19 aa, Staphylococcus
SCEIRRPVGKNGIVATFKG

SEQ ID NO: 2038502 - protein, 27 aa, Staphylococcus
SCEVPKALEYLGFGALELGGITPKPQD

SEQ ID NO: 2038503 - protein, 25 aa, Staphylococcus
SCGDIAVSIYTGWLAYSTFDHEWVS

SEQ ID NO: 2038504 - protein, 25 aa, Staphylococcus
SCGDIAVSVFTGWLAYSTFDHDWVM

SEQ ID NO: 2038505 - protein, 25 aa, Staphylococcus
SCGDIAVSVYSGWLAYSTFDHEWVK

SEQ ID NO: 2038506 - protein, 17 aa, Staphylococcus
SCGEALIHVLNQVGQIQ

SEQ ID NO: 2038507 - protein, 20 aa, Staphylococcus
SCGELCACDLLAYFQFSQPT

SEQ ID NO: 2038508 - protein, 32 aa, Staphylococcus
SCGFPNITHELEWLPHLFVAGGLADLELGPFA

SEQ ID NO: 2038509 - protein, 22 aa, Staphylococcus
SCGKCKGQIGEILKCTLGDEFV

SEQ ID NO: 2038510 - protein, 21 aa, Staphylococcus
SCGKCKGQIGELLQCTLGDDF

SEQ ID NO: 2038511 - protein, 18 aa, Staphylococcus
SCGKCKGQISQILEYTLG

SEQ ID NO: 2038512 - protein, 19 aa, Staphylococcus
SCGKCKPQIGELLEHTLGG

SEQ ID NO: 2038513 - protein, 20 aa, Staphylococcus
SCGPELPKRYQVNGHTYNLN

SEQ ID NO: 2038514 - protein, 33 aa, Staphylococcus
SCGYPSLSDELEWLPQLFVVGGLADLELGPFAR

SEQ ID NO: 2038515 - protein, 22 aa, Staphylococcus
SCHLAIGSAYGFNIEGGTEMTT

SEQ ID NO: 2038516 - protein, 25 aa, Staphylococcus
SCHLAIGSAYGFNIKGGTEMSTEEK

SEQ ID NO: 2038517 - protein, 24 aa, Staphylococcus
SCHLAIGSAYGFNVKGGTEMSTEE

SEQ ID NO: 2038518 - protein, 20 aa, Staphylococcus
SCKAYVEAHAKYIAQDLEKV

SEQ ID NO: 2038519 - protein, 19 aa, Staphylococcus
SCLVSSMTVSRVINQAASD

SEQ ID NO: 2038520 - protein, 27 aa, Staphylococcus
SCVNAPTSKDTFDWLQALLKRKYPDIN

SEQ ID NO: 2038521 - protein, 20 aa, Staphylococcus
SCVNAPTSKDTFDWLQPLLK

SEQ ID NO: 2038522 - protein, 20 aa, Staphylococcus
SCVNAPTSKDTYEWLQPLLK

SEQ ID NO: 2038523 - protein, 25 aa, Staphylococcus
SCVNAPTSKNTYEWLKPLLERKYPN

SEQ ID NO: 2038524 - protein, 26 aa, Staphylococcus
SCVNAPTSKNTYEWLQPLLKRKYPQI

SEQ ID NO: 2038525 - protein, 25 aa, Staphylococcus
SCVNCGQCATVCPCNAMMENKMVGN

SEQ ID NO: 2038526 - protein, 19 aa, Staphylococcus
SDADMACTALFDSATGFTK

SEQ ID NO: 2038527 - protein, 31 aa, Staphylococcus
SDAEISIAIMSGNFVMRGEPAIYNKFLRTKM

SEQ ID NO: 2038528 - protein, 32 aa, Staphylococcus
SDAEISIAIMSGNFVMRGEPAIYNKFLRTQMA

SEQ ID NO: 2038529 - protein, 17 aa, Staphylococcus
SDAELAERLGFIQNSTG

SEQ ID NO: 2038530 - protein, 19 aa, Staphylococcus
SDAFLWQLLADNLQQLNLP

SEQ ID NO: 2038531 - protein, 21 aa, Staphylococcus
SDAILREVIRQEGLERDIWQY

SEQ ID NO: 2038532 - protein, 18 aa, Staphylococcus
SDAKHQAEMIGRQLRNGD

SEQ ID NO: 2038533 - protein, 18 aa, Staphylococcus
SDALEPYGHYKAKIDINQ

SEQ ID NO: 2038534 - protein, 17 aa, Staphylococcus
SDALGFSNMSTFSKMFK

SEQ ID NO: 2038535 - protein, 21 aa, Staphylococcus
SDAPIAFQEFMILPTGAESFK

SEQ ID NO: 2038536 - protein, 23 aa, Staphylococcus
SDAPIAFQEFMILPVGADSFKES

SEQ ID NO: 2038537 - protein, 21 aa, Staphylococcus
SDAPIAFQEFMILPVGAESFK

SEQ ID NO: 2038538 - protein, 23 aa, Staphylococcus
SDAPIAFQEFMVLPVGAESFKES

SEQ ID NO: 2038539 - protein, 21 aa, Staphylococcus
SDAPPYHCIPIINQHFINYIK

SEQ ID NO: 2038540 - protein, 30 aa, Staphylococcus
SDAPRIKFSILESTSSWIAMVIQQHHHEYE

SEQ ID NO: 2038541 - protein, 17 aa, Staphylococcus
SDARFLDAPLIKQTHQT

SEQ ID NO: 2038542 - protein, 18 aa, Staphylococcus
SDAVGDWAILNALINTAA

SEQ ID NO: 2038543 - protein, 18 aa, Staphylococcus
SDAVGDWAVLNALINTAA

SEQ ID NO: 2038544 - protein, 17 aa, Staphylococcus
SDAYIGVLIDDLITKGT

SEQ ID NO: 2038545 - protein, 19 aa, Staphylococcus
SDCEISQKIEDTMKVHHAK

SEQ ID NO: 2038546 - protein, 21 aa, Staphylococcus
SDDEIDAVVDFIKEQRQPEYL

SEQ ID NO: 2038547 - protein, 21 aa, Staphylococcus
SDDEIDGVVDFIKHQREPDYL

SEQ ID NO: 2038548 - protein, 22 aa, Staphylococcus
SDDFPEHLLHFINLSTPRPIVY

SEQ ID NO: 2038549 - protein, 28 aa, Staphylococcus
SDDGEPCNECAICKGITQGTNSDVIEID

SEQ ID NO: 2038550 - protein, 24 aa, Staphylococcus
SDDILKYRFNNEHPFNQMRLKLTT

SEQ ID NO: 2038551 - protein, 22 aa, Staphylococcus
SDDIRKAIATKFPRGNFKHDVI

SEQ ID NO: 2038552 - protein, 23 aa, Staphylococcus
SDDLKERILVAASIQGSQFIGRT

SEQ ID NO: 2038553 - protein, 25 aa, Staphylococcus
SDDNLAGFLRLNFNDERFGLTDNEH

SEQ ID NO: 2038554 - protein, 29 aa, Staphylococcus
SDDSKFKRWVIGSIISRTYYHNMVTHLLE

SEQ ID NO: 2038555 - protein, 19 aa, Staphylococcus
SDDVFKGEHAVIFDQSENR

SEQ ID NO: 2038556 - protein, 17 aa, Staphylococcus
SDDVIRYIVIREDEDKT

SEQ ID NO: 2038557 - protein, 28 aa, Staphylococcus
SDDYRYFPEPDIVPLYVDDAWKERVRQT

SEQ ID NO: 2038558 - protein, 33 aa, Staphylococcus
SDDYRYFPEPDIVPLYVDEAWKERVRQTIPELP

SEQ ID NO: 2038559 - protein, 37 aa, Staphylococcus
SDDYRYFPEPDIVPLYVDEEWKECVRQTIPELPDERK

SEQ ID NO: 2038560 - protein, 22 aa, Staphylococcus
SDEAFNTLIGFVELDHIYSSAL

SEQ ID NO: 2038561 - protein, 19 aa, Staphylococcus
SDEATWFALMDHLVEMSIT

SEQ ID NO: 2038562 - protein, 17 aa, Staphylococcus
SDEELLRRKSKRRNGDL

SEQ ID NO: 2038563 - protein, 23 aa, Staphylococcus
SDESRGSSGINILWPDTDNEYFK

SEQ ID NO: 2038564 - protein, 17 aa, Staphylococcus
SDETIAFEPKDVIIVEG

SEQ ID NO: 2038565 - protein, 18 aa, Staphylococcus
SDETIAFEPKDVIIVEGI

SEQ ID NO: 2038566 - protein, 24 aa, Staphylococcus
SDEVLKFVDFNAGKIAKQLLNAFE

SEQ ID NO: 2038567 - protein, 25 aa, Staphylococcus
SDFDKLRFVHHSIPSINVDQVDLTS

SEQ ID NO: 2038568 - protein, 27 aa, Staphylococcus
SDFFTMVKWEISGTLNYMKPREFCLVS

SEQ ID NO: 2038569 - protein, 24 aa, Staphylococcus
SDFHKVGDMITFKLGYQALAHSMY

SEQ ID NO: 2038570 - protein, 23 aa, Staphylococcus
SDFIKRFNYKNVFNQYVNTEHIP

SEQ ID NO: 2038571 - protein, 25 aa, Staphylococcus
SDFNRPGHLFPLIAKDNGVLERNGH

SEQ ID NO: 2038572 - protein, 29 aa, Staphylococcus
SDGEAFGKFFKLMLNQGINLAPSKFEAWF

SEQ ID NO: 2038573 - protein, 19 aa, Staphylococcus
SDGLYNFISAIRVATSDES

SEQ ID NO: 2038574 - protein, 19 aa, Staphylococcus
SDGLYNFISALRVAADNDS

SEQ ID NO: 2038575 - protein, 17 aa, Staphylococcus
SDGNGFHSGIWFDGELV

SEQ ID NO: 2038576 - protein, 19 aa, Staphylococcus
SDGRMNIGSFDTIDGQTSV

SEQ ID NO: 2038577 - protein, 22 aa, Staphylococcus
SDHAYLPIYAIKNHLCQFAVAG

SEQ ID NO: 2038578 - protein, 23 aa, Staphylococcus
SDHGHIFRYSFKIETPEYEILEV

SEQ ID NO: 2038579 - protein, 26 aa, Staphylococcus
SDHVKVEVGNPFFRTDMHGCSTGGTC

SEQ ID NO: 2038580 - protein, 23 aa, Staphylococcus
SDIAIQQVIDYCYRESYINHEDY

SEQ ID NO: 2038581 - protein, 20 aa, Staphylococcus
SDIANTVAFLASEKAKYITG

SEQ ID NO: 2038582 - protein, 17 aa, Staphylococcus
SDIDEVILVGGSTRIPA

SEQ ID NO: 2038583 - protein, 18 aa, Staphylococcus
SDIDGVLEYIKYWTAHRE

SEQ ID NO: 2038584 - protein, 20 aa, Staphylococcus
SDIDGVLKYIEKWTAEREML

SEQ ID NO: 2038585 - protein, 17 aa, Staphylococcus
SDIFSFNNPKGMCETCS

SEQ ID NO: 2038586 - protein, 18 aa, Staphylococcus
SDIFSFNNPKGMCETCSG

SEQ ID NO: 2038587 - protein, 19 aa, Staphylococcus
SDIGIKYLTLYAFSTENWT

SEQ ID NO: 2038588 - protein, 18 aa, Staphylococcus
SDIIKKLFLLGIVANINQ

SEQ ID NO: 2038589 - protein, 31 aa, Staphylococcus
SDIISRYAGIRVPRNKAIVGQNAFSHESGIH

SEQ ID NO: 2038590 - protein, 17 aa, Staphylococcus
SDIKGYEAMISVLKALN

SEQ ID NO: 2038591 - protein, 17 aa, Staphylococcus
SDIKVVLNGAGAAGIAI

SEQ ID NO: 2038592 - protein, 18 aa, Staphylococcus
SDILRYIGPQTLLIIGNR

SEQ ID NO: 2038593 - protein, 19 aa, Staphylococcus
SDILYDVDLVFGYEPIALP

SEQ ID NO: 2038594 - protein, 19 aa, Staphylococcus
SDINAWVDLFGEVFETMGV

SEQ ID NO: 2038595 - protein, 20 aa, Staphylococcus
SDINLWINLFEEVLQTMGVN

SEQ ID NO: 2038596 - protein, 19 aa, Staphylococcus
SDIPILMECFDDLIDQNNT

SEQ ID NO: 2038597 - protein, 22 aa, Staphylococcus
SDIQRKWIKKFKTIEDTFKQRA

SEQ ID NO: 2038598 - protein, 21 aa, Staphylococcus
SDIRIAFSCIEKDDIPHVFES

SEQ ID NO: 2038599 - protein, 19 aa, Staphylococcus
SDIRPKFVTLQVPIALGSV

SEQ ID NO: 2038600 - protein, 20 aa, Staphylococcus
SDIVQVIGSMIVLYKESQDN

SEQ ID NO: 2038601 - protein, 33 aa, Staphylococcus
SDIYAAVRLLWSRIGEPFVGYSDVFSFNSPNGM

SEQ ID NO: 2038602 - protein, 29 aa, Staphylococcus
SDIYASVRLLWSRIGEPFVGHSDVFSFNN

SEQ ID NO: 2038603 - protein, 34 aa, Staphylococcus
SDIYASVRLLWSRIGEPFVGYSDAFSFNSPNGMC

SEQ ID NO: 2038604 - protein, 52 aa, Staphylococcus; identical to SEQ ID NO: 1798602

SEQ ID NO: 2038605 - protein, 33 aa, Staphylococcus
SDIYASVRLLWSRIGEPFVGYSDIFSFNNPKGM

SEQ ID NO: 2038606 - protein, 31 aa, Staphylococcus
SDIYASVRLLWSRIGKPFVGYSDIFSFNNPK

SEQ ID NO: 2038607 - protein, 31 aa, Staphylococcus
SDIYASVRLLWSRIGTPFVGYSDIFSFNNPK

SEQ ID NO: 2038608 - protein, 24 aa, Staphylococcus
SDIYCFDEPFVGIDIYSEELIMKK

SEQ ID NO: 2038609 - protein, 20 aa, Staphylococcus
SDIYRLWQNAFIVGRDDATK

SEQ ID NO: 2038610 - protein, 25 aa, Staphylococcus
SDKEKRLFEQAAYVYYLGRFIDSDS

SEQ ID NO: 2038611 - protein, 33 aa, Staphylococcus
SDKERFFGMHFFNPPRIMKLVEVIPNSKTSKSV

SEQ ID NO: 2038612 - protein, 17 aa, Staphylococcus
SDKIISNYHKLWGKEAS

SEQ ID NO: 2038613 - protein, 17 aa, Staphylococcus
SDKKRLMDAKKFKKSNK

SEQ ID NO: 2038614 - protein, 22 aa, Staphylococcus
SDKRAPYQPDLHVNVDCDLEKI

SEQ ID NO: 2038615 - protein, 19 aa, Staphylococcus
SDKTAFFLNGYVNEYDDTD

SEQ ID NO: 2038616 - protein, 19 aa, Staphylococcus
SDLAILMVVGLGMSQMIGT

SEQ ID NO: 2038617 - protein, 20 aa, Staphylococcus
SDLDAAFNYKNGAKVMSLLE

SEQ ID NO: 2038618 - protein, 26 aa, Staphylococcus
SDLDYTIFRPAWLTNYDEIDYEVTQR

SEQ ID NO: 2038619 - protein, 22 aa, Staphylococcus
SDLEHKWDFPFISHELDQTLRL

SEQ ID NO: 2038620 - protein, 21 aa, Staphylococcus
SDLFLGYTVAALRLKAQLAAE

SEQ ID NO: 2038621 - protein, 18 aa, Staphylococcus
SDLGKLMYYPKGILSQSA

SEQ ID NO: 2038622 - protein, 22 aa, Staphylococcus
SDLGNGLYLFIDRKNMVGEAIN

SEQ ID NO: 2038623 - protein, 24 aa, Staphylococcus
SDLIKRIDTHLSIDFMDVSSYHGG

SEQ ID NO: 2038624 - protein, 28 aa, Staphylococcus
SDLIPELQGRFPIRVELDSLSVDDFVNI

SEQ ID NO: 2038625 - protein, 27 aa, Staphylococcus
SDLIPELQGRFPIRVELDSLSVEDFVR

SEQ ID NO: 2038626 - protein, 29 aa, Staphylococcus
SDLIPELQGRFPIRVELESLSVDDFVRIL

SEQ ID NO: 2038627 - protein, 29 aa, Staphylococcus
SDLIPELQGRFPIRVELESLSVEDFVRIL

SEQ ID NO: 2038628 - protein, 29 aa, Staphylococcus
SDLIPELQGRFPIRVELESLTVDDFYRIL

SEQ ID NO: 2038629 - protein, 17 aa, Staphylococcus
SDLKALINNAGISGNMN

SEQ ID NO: 2038630 - protein, 22 aa, Staphylococcus
SDLKEIIIRTAEVLGTKIDDES

SEQ ID NO: 2038631 - protein, 20 aa, Staphylococcus
SDLKEVIVEKIVEIYEQDDD

SEQ ID NO: 2038632 - protein, 18 aa, Staphylococcus
SDLKRTVQTYSCIFPYDI

SEQ ID NO: 2038633 - protein, 29 aa, Staphylococcus
SDLKSSLPEYMIPRKFVWMDQLPLTSNGK

SEQ ID NO: 2038634 - protein, 29 aa, Staphylococcus
SDLMGNPTLLNRVGKLIATLYMDEEIDAI

SEQ ID NO: 2038635 - protein, 20 aa, Staphylococcus
SDLQDLITLNSMITIVMQDS

SEQ ID NO: 2038636 - protein, 17 aa, Staphylococcus
SDLQISYNFNMVAISDG

SEQ ID NO: 2038637 - protein, 20 aa, Staphylococcus
SDLQSLGGIIKFIDALNVSH

SEQ ID NO: 2038638 - protein, 22 aa, Staphylococcus
SDLRAGACLITAGLIAEGVTTI

SEQ ID NO: 2038639 - protein, 23 aa, Staphylococcus
SDLRAGACLIVAGLIAEGVTTIY

SEQ ID NO: 2038640 - protein, 24 aa, Staphylococcus
SDLREGADMMIVKPALSFLDIIRD

SEQ ID NO: 2038641 - protein, 17 aa, Staphylococcus
SDLSISEAINFIKDDHP

SEQ ID NO: 2038642 - protein, 19 aa, Staphylococcus
SDLSITEAINFIKDDYPDL

SEQ ID NO: 2038643 - protein, 21 aa, Staphylococcus
SDLSPKFVVGYVETKEKHPNA

SEQ ID NO: 2038644 - protein, 17 aa, Staphylococcus
SDLTIEEAISFIKDDNP

SEQ ID NO: 2038645 - protein, 17 aa, Staphylococcus
SDLYLISDICITDYSSV

SEQ ID NO: 2038646 - protein, 25 aa, Staphylococcus
SDMIPERWENVCLNAFIGDNKRYVY

SEQ ID NO: 2038647 - protein, 20 aa, Staphylococcus
SDMMICYDARDMIKHHNITS

SEQ ID NO: 2038648 - protein, 18 aa, Staphylococcus
SDMNIYKAHSGFTLETQN

SEQ ID NO: 2038649 - protein, 17 aa, Staphylococcus
SDMTRTVPFGTPDEKAK

SEQ ID NO: 2038650 - protein, 24 aa, Staphylococcus
SDNDRAMFAFGHYTVAMKNARPEI

SEQ ID NO: 2038651 - protein, 24 aa, Staphylococcus
SDNDRSMFAFGHYTVAMKNARPEI

SEQ ID NO: 2038652 - protein, 20 aa, Staphylococcus
SDNGFYYTLYQTVFNLTTKT

SEQ ID NO: 2038653 - protein, 23 aa, Staphylococcus
SDNLPGTKWAKLIINSALSGMSA

SEQ ID NO: 2038654 - protein, 22 aa, Staphylococcus
SDNNDLEWIVGIMLPRMKEHHI

SEQ ID NO: 2038655 - protein, 20 aa, Staphylococcus
SDNNKAIFFRSFSVDARYRG

SEQ ID NO: 2038656 - protein, 22 aa, Staphylococcus
SDNQISIFEWLERHSNYSPSHT

SEQ ID NO: 2038657 - protein, 21 aa, Staphylococcus
SDNQISIFQWLKRHSNYSPSH

SEQ ID NO: 2038658 - protein, 29 aa, Staphylococcus
SDPKELIARHSLKVEAGVIAIHKSILINM

SEQ ID NO: 2038659 - protein, 25 aa, Staphylococcus
SDPKELIARHSLKVEAGVIAIQKSI

SEQ ID NO: 2038660 - protein, 26 aa, Staphylococcus
SDPKELIARHSLKVEAGVIAIQKSIL

SEQ ID NO: 2038661 - protein, 35 aa, Staphylococcus
SDPKELIARHSLRVEAGVIAIHKSILINMIKCVES

SEQ ID NO: 2038662 - protein, 23 aa, Staphylococcus
SDPMKQKVCDVATMAFENAMAKV

SEQ ID NO: 2038663 - protein, 18 aa, Staphylococcus
SDQLWIPVHKSWRLNERH

SEQ ID NO: 2038664 - protein, 20 aa, Staphylococcus
SDQRQTMLFSATMPKAIQDL

SEQ ID NO: 2038665 - protein, 20 aa, Staphylococcus
SDRALGYGIHGERVDGNDPI

SEQ ID NO: 2038666 - protein, 20 aa, Staphylococcus
SDRALGYGIYGETVDGDDPI

SEQ ID NO: 2038667 - protein, 24 aa, Staphylococcus
SDRISRLFDITGLKDLMHVNEGTE

SEQ ID NO: 2038668 - protein, 24 aa, Staphylococcus
SDRPMHHAIQFQSPEKFEIQLDLP

SEQ ID NO: 2038669 - protein, 18 aa, Staphylococcus
SDRRKVDSLVMIDIAVPR

SEQ ID NO: 2038670 - protein, 23 aa, Staphylococcus
SDSEMYRYLYLLSEKEDIFIEPS

SEQ ID NO: 2038671 - protein, 23 aa, Staphylococcus
SDSKVIFCEADDWKPFYESNQSV

SEQ ID NO: 2038672 - protein, 25 aa, Staphylococcus
SDSLKRLVMPSIEREIRSDLTNKAE

SEQ ID NO: 2038673 - protein, 20 aa, Staphylococcus
SDSVIKQMVKQGSITVDGVS

SEQ ID NO: 2038674 - protein, 18 aa, Staphylococcus
SDTARYGLHSGGEPTQGA

SEQ ID NO: 2038675 - protein, 18 aa, Staphylococcus
SDTARYGLNTGGEPTQGA

SEQ ID NO: 2038676 - protein, 17 aa, Staphylococcus
SDTARYGLQSGGEPTQG

SEQ ID NO: 2038677 - protein, 21 aa, Staphylococcus
SDTEKALALYIPHSEKPNEIK

SEQ ID NO: 2038678 - protein, 26 aa, Staphylococcus
SDTFIYCLKGCVTLTLGNSRYQANEQ

SEQ ID NO: 2038679 - protein, 32 aa, Staphylococcus
SDTIIYKVHLMRECFERGIKVISSMGAANKTD

SEQ ID NO: 2038680 - protein, 17 aa, Staphylococcus
SDTLKMHLIELNENRSL

SEQ ID NO: 2038681 - protein, 23 aa, Staphylococcus
SDTNRLRILLLLEQEESSVGHIT

SEQ ID NO: 2038682 - protein, 25 aa, Staphylococcus
SDTYRTTPDLSYAVRFLEAHAGVMI

SEQ ID NO: 2038683 - protein, 24 aa, Staphylococcus
SDTYRTTPDLSYAVRYLEADAGVM

SEQ ID NO: 2038684 - protein, 26 aa, Staphylococcus
SDVCPKLRPVIITLRRLAAFIENTMT

SEQ ID NO: 2038685 - protein, 22 aa, Staphylococcus
SDVFFRKTRRQHSKHQLNSEDS

SEQ ID NO: 2038686 - protein, 18 aa, Staphylococcus
SDVFSFNNTRGMCETCSG

SEQ ID NO: 2038687 - protein, 18 aa, Staphylococcus
SDVFSFNSPNGMCETCEG

SEQ ID NO: 2038688 - protein, 19 aa, Staphylococcus
SDVHFVRDLYEDVQRRDFT

SEQ ID NO: 2038689 - protein, 22 aa, Staphylococcus
SDVKELDNAYVVEAELPGFQKE

SEQ ID NO: 2038690 - protein, 30 aa, Staphylococcus
SDVKELMDFLYIRHAFFIGQELGASIAADF

SEQ ID NO: 2038691 - protein, 24 aa, Staphylococcus
SDVKVKILSRLAHNSGHLGMVGGQ

SEQ ID NO: 2038692 - protein, 18 aa, Staphylococcus
SDVLDCVTRIQTWCEKFD

SEQ ID NO: 2038693 - protein, 24 aa, Staphylococcus
SDVLVCTVIGFPLGATTTATKIFE

SEQ ID NO: 2038694 - protein, 29 aa, Staphylococcus
SDVPAGIMTKCPKCKKIMYTKELAENLNV

SEQ ID NO: 2038695 - protein, 17 aa, Staphylococcus
SDVTEWERLGLTKRKQG

SEQ ID NO: 2038696 - protein, 17 aa, Staphylococcus
SDVTYVASFLKTTEHKA

SEQ ID NO: 2038697 - protein, 23 aa, Staphylococcus
SDVVKKLAGFGIEAKPEEVITSA

SEQ ID NO: 2038698 - protein, 22 aa, Staphylococcus
SDWEIMKESCLMLDEFDIPYDK

SEQ ID NO: 2038699 - protein, 25 aa, Staphylococcus
SDYDLKYIIDGDFDYAANVSESHPI

SEQ ID NO: 2038700 - protein, 22 aa, Staphylococcus
SDYFAFEACEYRRHFLSYDPDY

SEQ ID NO: 2038701 - protein, 21 aa, Staphylococcus
SDYFAFEACEYRRHFLSYHPD

SEQ ID NO: 2038702 - protein, 22 aa, Staphylococcus
SDYFAFEACEYRRHFLSYHPDY

SEQ ID NO: 2038703 - protein, 18 aa, Staphylococcus
SDYIGEVWGISAHPNGKC

SEQ ID NO: 2038704 - protein, 25 aa, Staphylococcus
SDYLETRGPLLFDNINSIPLDKQSY

SEQ ID NO: 2038705 - protein, 30 aa, Staphylococcus
SDYLGRIGVGRVFRGTMRVGDNVSLIKLDG

SEQ ID NO: 2038706 - protein, 27 aa, Staphylococcus
SDYLKPALRLSAIMGLNSTFIFTHDSI

SEQ ID NO: 2038707 - protein, 20 aa, Staphylococcus
SDYYILKVLNIYSVLQNNQI

SEQ ID NO: 2038708 - protein, 19 aa, Staphylococcus
SEAAVLNANYIKARLKDHF

SEQ ID NO: 2038709 - protein, 23 aa, Staphylococcus
SEADFQKHIYAIHTLTSLYADTR

SEQ ID NO: 2038710 - protein, 21 aa, Staphylococcus
SEADLDWGRKLVSLYQKEMSY

SEQ ID NO: 2038711 - protein, 25 aa, Staphylococcus
SEADMALANILAFWCARDYSQMDSI

SEQ ID NO: 2038712 - protein, 20 aa, Staphylococcus
SEAEALCELLSLYESDKLSD

SEQ ID NO: 2038713 - protein, 22 aa, Staphylococcus
SEAEHIVFICGHYEGYDERIRE

SEQ ID NO: 2038714 - protein, 22 aa, Staphylococcus
SEAEHIVFICGHYEGYDERIRT

SEQ ID NO: 2038715 - protein, 25 aa, Staphylococcus
SEAEIYEHFGVSWIEPSMREDGSEF

SEQ ID NO: 2038716 - protein, 21 aa, Staphylococcus
SEAFEPGEIYTIYTHTYNGIK

SEQ ID NO: 2038717 - protein, 18 aa, Staphylococcus
SEAFKVAKQILKLDPNNH

SEQ ID NO: 2038718 - protein, 18 aa, Staphylococcus
SEAFKVAKQILKLDPSNH

SEQ ID NO: 2038719 - protein, 17 aa, Staphylococcus
SEAGLFHIAYLLPTDTD

SEQ ID NO: 2038720 - protein, 21 aa, Staphylococcus
SEAHAVLRQSLLPHLIDAAAY

SEQ ID NO: 2038721 - protein, 26 aa, Staphylococcus
SEAIIDIEVLFPYITLAHFGKKVDKY

SEQ ID NO: 2038722 - protein, 21 aa, Staphylococcus
SEAKAYRLGEVSAETQYALDY

SEQ ID NO: 2038723 - protein, 21 aa, Staphylococcus
SEAKEKGITCASAGNHAQGVA

SEQ ID NO: 2038724 - protein, 19 aa, Staphylococcus
SEAKPLLDDYFDMIIDYFK

SEQ ID NO: 2038725 - protein, 17 aa, Staphylococcus
SEAKQLGAMALFGEKYG

SEQ ID NO: 2038726 - protein, 24 aa, Staphylococcus
SEALARKIPMIFLDPAPGQELENA

SEQ ID NO: 2038727 - protein, 25 aa, Staphylococcus
SEALEKIKNALKWVNLDDSNIIKKY

SEQ ID NO: 2038728 - protein, 21 aa, Staphylococcus
SEALLKVVIKDVAKRAAAKQT

SEQ ID NO: 2038729 - protein, 20 aa, Staphylococcus
SEALQILDFRGKARQQILAN

SEQ ID NO: 2038730 - protein, 18 aa, Staphylococcus
SEAPGVGMRFIQINDIKL

SEQ ID NO: 2038731 - protein, 18 aa, Staphylococcus
SEAPGVGMRFIQVNDIKV

SEQ ID NO: 2038732 - protein, 23 aa, Staphylococcus
SEASHKLGRLIQIFEEQSESQVI

SEQ ID NO: 2038733 - protein, 17 aa, Staphylococcus
SEASIHFEVDEGDYLTA

SEQ ID NO: 2038734 - protein, 20 aa, Staphylococcus
SEAVSKLWRNTQLKHTFLRQ

SEQ ID NO: 2038735 - protein, 17 aa, Staphylococcus
SECWYIIDAEEDAEIIY

SEQ ID NO: 2038736 - protein, 17 aa, Staphylococcus
SEDAGKCMRTHGHTYFV

SEQ ID NO: 2038737 - protein, 18 aa, Staphylococcus
SEDAGKCMRTHGHTYFVN

SEQ ID NO: 2038738 - protein, 23 aa, Staphylococcus
SEDCGYCGQSVKMKEKQRYALVD

SEQ ID NO: 2038739 - protein, 23 aa, Staphylococcus
SEDCGYCGQSVKMKEKQRYALVE

SEQ ID NO: 2038740 - protein, 25 aa, Staphylococcus
SEDDAKKGFLLDGFPRTIEQAEALS

SEQ ID NO: 2038741 - protein, 20 aa, Staphylococcus
SEDFPQMALTLFNFQFNHNL

SEQ ID NO: 2038742 - protein, 21 aa, Staphylococcus
SEDLSLFFSYRVEKGKTGRML

SEQ ID NO: 2038743 - protein, 22 aa, Staphylococcus
SEDLSLFFSYRVEKGNTGRMLA

SEQ ID NO: 2038744 - protein, 20 aa, Staphylococcus
SEDRQTMLFSATMPKAIQTL

SEQ ID NO: 2038745 - protein, 22 aa, Staphylococcus
SEDSGALLRGYIEATRKHRDEN

SEQ ID NO: 2038746 - protein, 26 aa, Staphylococcus
SEDWCGDAMMNIAILKHISELLNLEV

SEQ ID NO: 2038747 - protein, 36 aa, Staphylococcus
SEDWCGDAMMNLPILKRISEELNWEVRVFHRDEDTD

SEQ ID NO: 2038748 - protein, 29 aa, Staphylococcus
SEDWCGDAMMNLPILKRISESLQLEVRVF

SEQ ID NO: 2038749 - protein, 31 aa, Staphylococcus
SEDYPEFGVRLKAYFNEIKFTKSLATQIKKE

SEQ ID NO: 2038750 - protein, 22 aa, Staphylococcus
SEDYPIAIVFNATCYNQKVITG

SEQ ID NO: 2038751 - protein, 18 aa, Staphylococcus
SEEAFALYEDFFKAKQHK

SEQ ID NO: 2038752 - protein, 17 aa, Staphylococcus
SEEELPIFRSFMEDTTE

SEQ ID NO: 2038753 - protein, 23 aa, Staphylococcus
SEEGFRLYVDQLLKQTSRQNKNK

SEQ ID NO: 2038754 - protein, 24 aa, Staphylococcus
SEEIPHAIGVNVDRMIKEDEDRVR

SEQ ID NO: 2038755 - protein, 25 aa, Staphylococcus
SEEKPQIMPVWSLKNRALKVRDEDF

SEQ ID NO: 2038756 - protein, 19 aa, Staphylococcus
SEELFFVVSVDTPMISQKA

SEQ ID NO: 2038757 - protein, 23 aa, Staphylococcus
SEELGAKGIRVNCVAPGPFWSPL

SEQ ID NO: 2038758 - protein, 17 aa, Staphylococcus
SEELKNQLLRNIQELAE

SEQ ID NO: 2038759 - protein, 17 aa, Staphylococcus
SEELRYGENPQQSARFV

SEQ ID NO: 2038760 - protein, 27 aa, Staphylococcus
SEEMAELYEFLGLSVGLNLNSKTTTEK

SEQ ID NO: 2038761 - protein, 26 aa, Staphylococcus
SEEMAELYEFLGLTVGLNLNSKSTEE

SEQ ID NO: 2038762 - protein, 26 aa, Staphylococcus
SEEMAELYEFLGLTVGLNLNSKSTNE

SEQ ID NO: 2038763 - protein, 25 aa, Staphylococcus
SEEMAELYNFLGLSVGLNLNSLSTE

SEQ ID NO: 2038764 - protein, 20 aa, Staphylococcus
SEEMKQMFVDIFEASVDGDF

SEQ ID NO: 2038765 - protein, 17 aa, Staphylococcus
SEEPIAITYDETGTDVN

SEQ ID NO: 2038766 - protein, 18 aa, Staphylococcus
SEERFKRVNGWKDVEAFF

SEQ ID NO: 2038767 - protein, 30 aa, Staphylococcus
SEERPKILLHSCCAPCSTYVLEFLSEYADL

SEQ ID NO: 2038768 - protein, 27 aa, Staphylococcus
SEETARQCAIVWGVNPVVKEGRKNTDA

SEQ ID NO: 2038769 - protein, 20 aa, Staphylococcus
SEEVALVMMVLRLNTLLKGH

SEQ ID NO: 2038770 - protein, 24 aa, Staphylococcus
SEEVALVMMVLRLNTLLKGHSGTT

SEQ ID NO: 2038771 - protein, 17 aa, Staphylococcus
SEEVEWIILAGYMRLVG

SEQ ID NO: 2038772 - protein, 24 aa, Staphylococcus
SEEVSLVMMILRLNTLLKGNSGVT

SEQ ID NO: 2038773 - protein, 19 aa, Staphylococcus
SEFERDLSDIITLDDINGD

SEQ ID NO: 2038774 - protein, 24 aa, Staphylococcus
SEFIVEMKLTYVWINADKPEEQFE

SEQ ID NO: 2038775 - protein, 25 aa, Staphylococcus
SEFLSEPYVIIGLNVIVADTDEEAE

SEQ ID NO: 2038776 - protein, 19 aa, Staphylococcus
SEFNACPVVRVNINEYDLH

SEQ ID NO: 2038777 - protein, 23 aa, Staphylococcus
SEFPIVIMPMVKQYFRMLQKPIL

SEQ ID NO: 2038778 - protein, 21 aa, Staphylococcus
SEFPVDTWTKMMKQVFQNYDH

SEQ ID NO: 2038779 - protein, 20 aa, Staphylococcus
SEFSCLGPNVLVKNMYYPNT

SEQ ID NO: 2038780 - protein, 17 aa, Staphylococcus
SEFVLSFILNDYKKMRT

SEQ ID NO: 2038781 - protein, 30 aa, Staphylococcus
SEGEKRLIGFLHFYYSLFMIADREMKENIE

SEQ ID NO: 2038782 - protein, 22 aa, Staphylococcus
SEGHVPRPFALKDTLLEIKQWM

SEQ ID NO: 2038783 - protein, 27 aa, Staphylococcus
SEGKDEFYRGDLNDVIQLIRLLHDKYP

SEQ ID NO: 2038784 - protein, 21 aa, Staphylococcus
SEGLLKGYLYLDVNKQQASAE

SEQ ID NO: 2038785 - protein, 21 aa, Staphylococcus
SEGLLKGYLYLQVDTERNNAE

SEQ ID NO: 2038786 - protein, 18 aa, Staphylococcus
SEGMTILYTTHYIEEVER

SEQ ID NO: 2038787 - protein, 25 aa, Staphylococcus
SEGPKVIEFNARFGDPEAQVLLAHL

SEQ ID NO: 2038788 - protein, 25 aa, Staphylococcus
SEGPKVIEFNARFGDPEAQVLLSRL

SEQ ID NO: 2038789 - protein, 26 aa, Staphylococcus
SEGRECKFIAVKLPYGVQKDADEVED

SEQ ID NO: 2038790 - protein, 24 aa, Staphylococcus
SEGRSYVTYSDFANAFLDVAEQDA

SEQ ID NO: 2038791 - protein, 25 aa, Staphylococcus
SEGSYRLKVMLQEEGNFDYLVAPLT

SEQ ID NO: 2038792 - protein, 23 aa, Staphylococcus
SEGTRILVDRVWPRGISKEDANL

SEQ ID NO: 2038793 - protein, 17 aa, Staphylococcus
SEGVGLGHQFLRHVERT

SEQ ID NO: 2038794 - protein, 20 aa, Staphylococcus
SEGVIKVMAKMGISTVQSYQ

SEQ ID NO: 2038795 - protein, 25 aa, Staphylococcus
SEHGGVQWFNLIKQFTLKNFAKQQR

SEQ ID NO: 2038796 - protein, 17 aa, Staphylococcus
SEHLDLATFEYKDARNY

SEQ ID NO: 2038797 - protein, 24 aa, Staphylococcus
SEHNRVIPTIAFYHPNCINVMDEA

SEQ ID NO: 2038798 - protein, 23 aa, Staphylococcus
SEHPVRVDIAGSVESIYNITKDD

SEQ ID NO: 2038799 - protein, 21 aa, Staphylococcus
SEIALGKAIRDKRHQMVISSK

SEQ ID NO: 2038800 - protein, 26 aa, Staphylococcus
SEIFKSELKLALGPIQRGGAGGGIAA

SEQ ID NO: 2038801 - protein, 19 aa, Staphylococcus
SEIKDKRVHEILSESIVDV

SEQ ID NO: 2038802 - protein, 25 aa, Staphylococcus
SEIKNFAGACLIISHDRTFLKQTCQ

SEQ ID NO: 2038803 - protein, 17 aa, Staphylococcus
SEIKPSYKTALLNSDKV

SEQ ID NO: 2038804 - protein, 21 aa, Staphylococcus
SEIKQLYPFIFNTLYDVIHQL

SEQ ID NO: 2038805 - protein, 17 aa, Staphylococcus
SEIKRKVHEALKLVKLE

SEQ ID NO: 2038806 - protein, 20 aa, Staphylococcus
SEIKRVIAHLPNFESDTDTF

SEQ ID NO: 2038807 - protein, 17 aa, Staphylococcus
SEIKSIIIKDSYILIKT

SEQ ID NO: 2038808 - protein, 24 aa, Staphylococcus
SEIKTLYPYAFNVLFDIVQTLSQR

SEQ ID NO: 2038809 - protein, 25 aa, Staphylococcus
SEIKYWAELHDVFQLLNIEMPIVLP

SEQ ID NO: 2038810 - protein, 26 aa, Staphylococcus
SEIKYWAELKAAFDVLDVTMPIVLPR

SEQ ID NO: 2038811 - protein, 30 aa, Staphylococcus
SEIKYWAELKEVFNLLNVEMPIVLPRLRIS

SEQ ID NO: 2038812 - protein, 25 aa, Staphylococcus
SEIKYWAELNNVFKLLNVEMPIVLP

SEQ ID NO: 2038813 - protein, 24 aa, Staphylococcus
SEIKYWTELSEVFNTLDVSMPIVL

SEQ ID NO: 2038814 - protein, 18 aa, Staphylococcus
SEILKEQGAYEIIRKLNE

SEQ ID NO: 2038815 - protein, 17 aa, Staphylococcus
SEILRLFSDDIDVLITG

SEQ ID NO: 2038816 - protein, 17 aa, Staphylococcus
SEINAKEGHVWIMDPID

SEQ ID NO: 2038817 - protein, 23 aa, Staphylococcus
SEINTGVGFLNHMLTLFTFHSGL

SEQ ID NO: 2038818 - protein, 23 aa, Staphylococcus
SEINVEGLLTVKSNEVIADMHVT

SEQ ID NO: 2038819 - protein, 25 aa, Staphylococcus
SEIPAKVCGAEDCFNVMPSSQKECD

SEQ ID NO: 2038820 - protein, 17 aa, Staphylococcus
SEIQHLLQQITFETSQL

SEQ ID NO: 2038821 - protein, 25 aa, Staphylococcus
SEIQKMREERQMLGQMISQVHHQQQ

SEQ ID NO: 2038822 - protein, 17 aa, Staphylococcus
SEIQSDVLITVDANQGK

SEQ ID NO: 2038823 - protein, 22 aa, Staphylococcus
SEIRKKDIGFIFQDYNILHTLT

SEQ ID NO: 2038824 - protein, 22 aa, Staphylococcus
SEIRKKDIGFIFQEYNLLHTLT

SEQ ID NO: 2038825 - protein, 17 aa, Staphylococcus
SEISISYVIDAKNGERA

SEQ ID NO: 2038826 - protein, 21 aa, Staphylococcus
SEITIGLKENGTFIYDGDEPL

SEQ ID NO: 2038827 - protein, 20 aa, Staphylococcus
SEITKRYGFIYVDQDDYGQG

SEQ ID NO: 2038828 - protein, 21 aa, Staphylococcus
SEIYEYIKTVVHTKGYPPSVR

SEQ ID NO: 2038829 - protein, 24 aa, Staphylococcus
SEIYGIKVAKDLVHIQGDTSDYHL

SEQ ID NO: 2038830 - protein, 24 aa, Staphylococcus
SEKDGRQAIQFLKQKGLGRATFLP

SEQ ID NO: 2038831 - protein, 23 aa, Staphylococcus
SEKEKLALAFCVDHVDQYTLTKN

SEQ ID NO: 2038832 - protein, 24 aa, Staphylococcus
SEKFKVKALHPIATAAIRQSENKD

SEQ ID NO: 2038833 - protein, 20 aa, Staphylococcus
SEKGYAMPILLAVSHVHQLL

SEQ ID NO: 2038834 - protein, 22 aa, Staphylococcus
SEKLGYARYWVAEHHQVPSVVS

SEQ ID NO: 2038835 - protein, 25 aa, Staphylococcus
SEKNPRLMPFQGYVLQNFELHSDGY

SEQ ID NO: 2038836 - protein, 20 aa, Staphylococcus
SEKPEDNWLVKLENVDEDAY

SEQ ID NO: 2038837 - protein, 24 aa, Staphylococcus
SEKVDDYFCFIGRIAKEKQLDHLI

SEQ ID NO: 2038838 - protein, 19 aa, Staphylococcus
SELADAFILAPGGAGSLEE

SEQ ID NO: 2038839 - protein, 24 aa, Staphylococcus
SELCIELDPGMAFGTGDHPTTSMC

SEQ ID NO: 2038840 - protein, 27 aa, Staphylococcus
SELDKIRIKEFVKDVAKEDQVFGLSKH

SEQ ID NO: 2038841 - protein, 27 aa, Staphylococcus
SELDKIRVKEFVRDVAKYDHVYGLTNK

SEQ ID NO: 2038842 - protein, 21 aa, Staphylococcus
SELFNAMVMTPYFPKPDVLIY

SEQ ID NO: 2038843 - protein, 30 aa, Staphylococcus
SELGEIPKNWSIKTVKEIAESFNSIRKPLS

SEQ ID NO: 2038844 - protein, 26 aa, Staphylococcus
SELHVDLIMCGTSGLNAVERFIVGSV

SEQ ID NO: 2038845 - protein, 17 aa, Staphylococcus
SELIGYFCLKIVIIKFE

SEQ ID NO: 2038846 - protein, 20 aa, Staphylococcus
SELIKELKIIVKENDKILVK

SEQ ID NO: 2038847 - protein, 17 aa, Staphylococcus
SELKDIIIRTAEVLNTE

SEQ ID NO: 2038848 - protein, 17 aa, Staphylococcus
SELKKGRLVIGVNPILA

SEQ ID NO: 2038849 - protein, 22 aa, Staphylococcus
SELKNSFVDAGLNSKLNTVITL

SEQ ID NO: 2038850 - protein, 22 aa, Staphylococcus
SELKPELVSSFVERRKGKATEE

SEQ ID NO: 2038851 - protein, 23 aa, Staphylococcus
SELKRDEDVLVFGEDVGVNGGVF

SEQ ID NO: 2038852 - protein, 24 aa, Staphylococcus
SELNLKLQIPIIMISGNHDGKARL

SEQ ID NO: 2038853 - protein, 22 aa, Staphylococcus
SELNQALPYPFIAIQDIRDDIN

SEQ ID NO: 2038854 - protein, 21 aa, Staphylococcus
SELPYQQWLETFKIDDRFDRI

SEQ ID NO: 2038855 - protein, 20 aa, Staphylococcus
SELRDALKESYENIKSFQER

SEQ ID NO: 2038856 - protein, 22 aa, Staphylococcus
SELRKGSEVNLERAMPSQGRFG

SEQ ID NO: 2038857 - protein, 19 aa, Staphylococcus
SELTYLTFVYKVAAMDFIF

SEQ ID NO: 2038858 - protein, 18 aa, Staphylococcus
SELVRGRGGPRCMSQPLF

SEQ ID NO: 2038859 - protein, 18 aa, Staphylococcus
SELVRGRGGPRCMSQPLY

SEQ ID NO: 2038860 - protein, 19 aa, Staphylococcus
SELVRGRGGPRCMSQPLYR

SEQ ID NO: 2038861 - protein, 24 aa, Staphylococcus
SEMAFKIAASLALKEAAKVADPVI

SEQ ID NO: 2038862 - protein, 24 aa, Staphylococcus
SEMAFKVAASLALKEAAKKCDPVI

SEQ ID NO: 2038863 - protein, 18 aa, Staphylococcus
SEMFFKDMPELGAEEQEV

SEQ ID NO: 2038864 - protein, 25 aa, Staphylococcus
SEMIACGYPRVRYLIDKKDDRPYVR

SEQ ID NO: 2038865 - protein, 25 aa, Staphylococcus
SEMIKEGICQLDIKLDTGRTHQIRV

SEQ ID NO: 2038866 - protein, 25 aa, Staphylococcus
SEMKFTNCCILKFDYEDGAFTFKSI

SEQ ID NO: 2038867 - protein, 25 aa, Staphylococcus
SEMKQPVWIRHVLVPGYSDDKEDLI

SEQ ID NO: 2038868 - protein, 23 aa, Staphylococcus
SEMKSEKDVILFVDEIHMLGKYK

SEQ ID NO: 2038869 - protein, 25 aa, Staphylococcus
SEMLEFQKRGAVAFDYGNNIRQVAF

SEQ ID NO: 2038870 - protein, 19 aa, Staphylococcus
SEMLKHFKKRDETFPGEIL

SEQ ID NO: 2038871 - protein, 19 aa, Staphylococcus
SENDYCRGVLLWQMNDCWP

SEQ ID NO: 2038872 - protein, 18 aa, Staphylococcus
SENGPRLYEPIHGSAPDI

SEQ ID NO: 2038873 - protein, 24 aa, Staphylococcus
SENGRIIVISSIWGETGASMETIY

SEQ ID NO: 2038874 - protein, 24 aa, Staphylococcus
SENGRIVVISSIWGETGASMETIY

SEQ ID NO: 2038875 - protein, 18 aa, Staphylococcus
SENIFSYDVDDLKGLVDA

SEQ ID NO: 2038876 - protein, 21 aa, Staphylococcus
SENLDALVILSDYNRRYISDF

SEQ ID NO: 2038877 - protein, 27 aa, Staphylococcus
SEPIFKLKHQFTHLTWHIKVYSVPEEL

SEQ ID NO: 2038878 - protein, 19 aa, Staphylococcus
SEPNLRVLAEPAPIRMLVM

SEQ ID NO: 2038879 - protein, 22 aa, Staphylococcus
SEPRFNYKNGEIIRGKKTLIQI

SEQ ID NO: 2038880 - protein, 22 aa, Staphylococcus
SEPYVIVCLNAIIADSDEEAQY

SEQ ID NO: 2038881 - protein, 22 aa, Staphylococcus
SEQCKQIRSVYGERLNGNPILE

SEQ ID NO: 2038882 - protein, 23 aa, Staphylococcus
SEQDGRHAIQYLKQRNLGRATFL

SEQ ID NO: 2038883 - protein, 18 aa, Staphylococcus
SEQLAKWVQEGKIKTQVS

SEQ ID NO: 2038884 - protein, 17 aa, Staphylococcus
SEQLAQWVKEGKIKTEV

SEQ ID NO: 2038885 - protein, 25 aa, Staphylococcus
SEQLFPEFFAAGIVQMVMVYIQDEN

SEQ ID NO: 2038886 - protein, 18 aa, Staphylococcus
SEQLIILTAVDYIYINFG

SEQ ID NO: 2038887 - protein, 17 aa, Staphylococcus
SEQLRYGENPQQSARFV

SEQ ID NO: 2038888 - protein, 25 aa, Staphylococcus
SEQMSLPLLWEFPGGKIEQGESDVD

SEQ ID NO: 2038889 - protein, 23 aa, Staphylococcus
SEQMVISTMMLRSMQQAHYDDTN

SEQ ID NO: 2038890 - protein, 22 aa, Staphylococcus
SEQMVISTMMLRSMQQAHYDGT

SEQ ID NO: 2038891 - protein, 20 aa, Staphylococcus
SEQNVVCAWTDKATAESYLN

SEQ ID NO: 2038892 - protein, 33 aa, Staphylococcus
SEQPSLNLLRWPWIGLQWIFSRKGPAASNHFEG

SEQ ID NO: 2038893 - protein, 20 aa, Staphylococcus
SEQQSYCVLIASPKTETGIE

SEQ ID NO: 2038894 - protein, 19 aa, Staphylococcus
SEQTGECWGISAHPNGKNM

SEQ ID NO: 2038895 - protein, 21 aa, Staphylococcus
SEQYGAVYLVNLFSNIKTPEN

SEQ ID NO: 2038896 - protein, 29 aa, Staphylococcus
SERAIALHGCKGEDSVAYIGGNDQQLIDI

SEQ ID NO: 2038897 - protein, 24 aa, Staphylococcus
SERFRGIRSNIMFSGVEEANSIIV

SEQ ID NO: 2038898 - protein, 17 aa, Staphylococcus
SERIFKIVLPDETNDQS

SEQ ID NO: 2038899 - protein, 23 aa, Staphylococcus
SERIGLLKIDFLGLRNLSIIHQI

SEQ ID NO: 2038900 - protein, 25 aa, Staphylococcus
SERKQPVWIRHVLVPGYTDDEADLI

SEQ ID NO: 2038901 - protein, 18 aa, Staphylococcus
SERLKSNSKLQSSTNSEL

SEQ ID NO: 2038902 - protein, 19 aa, Staphylococcus
SERLQNMMNRLGMDDSTPI

SEQ ID NO: 2038903 - protein, 17 aa, Staphylococcus
SERPRLTLVAFSNDAPE

SEQ ID NO: 2038904 - protein, 18 aa, Staphylococcus
SERQGQSKIYMLNDEHVV

SEQ ID NO: 2038905 - protein, 24 aa, Staphylococcus
SERQQIYSSLPIQVLEDALEDEDR

SEQ ID NO: 2038906 - protein, 21 aa, Staphylococcus
SERRKLEFLAGRFTTKEAFSK

SEQ ID NO: 2038907 - protein, 19 aa, Staphylococcus
SERSLVQTIGRAARNEHGE

SEQ ID NO: 2038908 - protein, 29 aa, Staphylococcus
SERTIAIHGCKGESPIVYIGGKDELLSKK

SEQ ID NO: 2038909 - protein, 19 aa, Staphylococcus
SERVQRIDFLDALQNIQKI

SEQ ID NO: 2038910 - protein, 19 aa, Staphylococcus
SESAEGLFETAFPNQHTQM

SEQ ID NO: 2038911 - protein, 22 aa, Staphylococcus
SESFNANWLNQKYIEIMQSIIY

SEQ ID NO: 2038912 - protein, 17 aa, Staphylococcus
SESGALPQGDFGTKCSV

SEQ ID NO: 2038913 - protein, 21 aa, Staphylococcus
SESGIVYAHKGSMDYQIVSRG

SEQ ID NO: 2038914 - protein, 17 aa, Staphylococcus
SESHLNYPITYIEIDNH

SEQ ID NO: 2038915 - protein, 17 aa, Staphylococcus
SESHLNYPITYIEIDNN

SEQ ID NO: 2038916 - protein, 33 aa, Staphylococcus
SESLHPMGGLQERIWNPLQIMNDFGMDVFNPST

SEQ ID NO: 2038917 - protein, 18 aa, Staphylococcus
SESLKDFVVDGTKYPDIS

SEQ ID NO: 2038918 - protein, 23 aa, Staphylococcus
SESNHFIIRIGYVECYISQVLTL

SEQ ID NO: 2038919 - protein, 19 aa, Staphylococcus
SESTGECWGISAHPNGKSM

SEQ ID NO: 2038920 - protein, 17 aa, Staphylococcus
SESWVSVEIKIDQPTNP

SEQ ID NO: 2038921 - protein, 20 aa, Staphylococcus
SETAEKLFIPLTVGGGISTI

SEQ ID NO: 2038922 - protein, 18 aa, Staphylococcus
SETCPISANAYDQFNKFL

SEQ ID NO: 2038923 - protein, 25 aa, Staphylococcus
SETDPKSKESLAFDSLDSQSENEQL

SEQ ID NO: 2038924 - protein, 24 aa, Staphylococcus
SETFGIKGMKDYAFQIENVLTARK

SEQ ID NO: 2038925 - protein, 22 aa, Staphylococcus
SETFVIISFKHKTILIGGTEYA

SEQ ID NO: 2038926 - protein, 32 aa, Staphylococcus
SETGSVVLPGRFFVDIIKKLPGKDVKLSTNAQ

SEQ ID NO: 2038927 - protein, 31 aa, Staphylococcus
SETGSVVLPGRFFVDIIKKLPGNEVKLSTNE

SEQ ID NO: 2038928 - protein, 21 aa, Staphylococcus
SETIFKFINQRLLKLIDNSKA

SEQ ID NO: 2038929 - protein, 23 aa, Staphylococcus
SETLPQYMIPVHFMKIDKIPITI

SEQ ID NO: 2038930 - protein, 19 aa, Staphylococcus
SETSGVAVWGKIFGDIKGQ

SEQ ID NO: 2038931 - protein, 17 aa, Staphylococcus
SETSSFIGIDKNTREEF

SEQ ID NO: 2038932 - protein, 19 aa, Staphylococcus
SETYFKMSQQYNEVKEQSH

SEQ ID NO: 2038933 - protein, 18 aa, Staphylococcus
SETYRQATFKDIVILERG

SEQ ID NO: 2038934 - protein, 24 aa, Staphylococcus
SEVGQPKGYRVVKFNQKNDIQDYF

SEQ ID NO: 2038935 - protein, 23 aa, Staphylococcus
SEVIRPAIEGVQRILRAADHAGV

SEQ ID NO: 2038936 - protein, 26 aa, Staphylococcus
SEVKELLNCFDYLIKHKKHSSRKRNY

SEQ ID NO: 2038937 - protein, 22 aa, Staphylococcus
SEVKIQQIIKLTWWDDKKYTDE

SEQ ID NO: 2038938 - protein, 24 aa, Staphylococcus
SEVKRLKSDPDFYGRFLEQSQSCV

SEQ ID NO: 2038939 - protein, 21 aa, Staphylococcus
SEVQEILKLIDYIYSVFGFEY

SEQ ID NO: 2038940 - protein, 18 aa, Staphylococcus
SEVQWLDAVSQFTKVIEL

SEQ ID NO: 2038941 - protein, 24 aa, Staphylococcus
SEVYLSFLDTVNWCQNKFQVTNQV

SEQ ID NO: 2038942 - protein, 23 aa, Staphylococcus
SEWNAKNLFTGWADVKLSEQGIE

SEQ ID NO: 2038943 - protein, 23 aa, Staphylococcus
SEWNAKNLFTGWADVNLSEQGIE

SEQ ID NO: 2038944 - protein, 22 aa, Staphylococcus
SEWNAKNLFTGWTDVDLSEQGI

SEQ ID NO: 2038945 - protein, 24 aa, Staphylococcus
SEYAQKIQQGWFDFDVVVATPDMM

SEQ ID NO: 2038946 - protein, 30 aa, Staphylococcus; identical to SEQ ID NO: 1796581

SEQ ID NO: 2038947 - protein, 25 aa, Staphylococcus
SEYQFFKERLILFTYLHLANEEKLT

SEQ ID NO: 2038948 - protein, 26 aa, Staphylococcus
SEYSIPYYAGLSFRTLVPELPNKAPH

SEQ ID NO: 2038949 - protein, 36 aa, Staphylococcus
SEYVMKQGLKLLLEDWLFEYKDMFPIEASNIDTDPF

SEQ ID NO: 2038950 - protein, 18 aa, Staphylococcus
SFANRFKNKIIGLSVGNV

SEQ ID NO: 2038951 - protein, 28 aa, Staphylococcus
SFASCLLFPLNIRYKYRNVLNVGDAADL

SEQ ID NO: 2038952 - protein, 17 aa, Staphylococcus
SFCPKDYSQEGFLKAFK

SEQ ID NO: 2038953 - protein, 29 aa, Staphylococcus
SFCSTCTRARLSSDGKFYGCLFATVDGFN

SEQ ID NO: 2038954 - protein, 25 aa, Staphylococcus
SFDDPFCKIQLWMPVDQEQYLDYDE

SEQ ID NO: 2038955 - protein, 23 aa, Staphylococcus
SFDLKSMMKRKDKIVNQMHQGIE

SEQ ID NO: 2038956 - protein, 19 aa, Staphylococcus
SFDNIRNAVDFGYATDPLA

SEQ ID NO: 2038957 - protein, 19 aa, Staphylococcus
SFDSFKNWFNKDIQFNTYE

SEQ ID NO: 2038958 - protein, 25 aa, Staphylococcus
SFDSKWKIGVIPSFSLTNKYKNRGF

SEQ ID NO: 2038959 - protein, 19 aa, Staphylococcus
SFDTELFVSWIDKGEALIV

SEQ ID NO: 2038960 - protein, 19 aa, Staphylococcus
SFDTMPTVVGFFPNIVEGD

SEQ ID NO: 2038961 - protein, 23 aa, Staphylococcus
SFEEIYDLPGHVFIFGGQSLFEE

SEQ ID NO: 2038962 - protein, 24 aa, Staphylococcus
SFEEKVRALLPLYKEVLQQLVDAG

SEQ ID NO: 2038963 - protein, 19 aa, Staphylococcus
SFEKCLYSTYLSYLPEDKF

SEQ ID NO: 2038964 - protein, 18 aa, Staphylococcus
SFEKVRHDTPMLSLGNAF

SEQ ID NO: 2038965 - protein, 17 aa, Staphylococcus
SFESLSVNEICESGMVH

SEQ ID NO: 2038966 - protein, 23 aa, Staphylococcus
SFEVAELNLGLKQVNFETSTSSV

SEQ ID NO: 2038967 - protein, 24 aa, Staphylococcus
SFEVAEQKLGLNLVNFETSTSSVQ

SEQ ID NO: 2038968 - protein, 24 aa, Staphylococcus
SFEVAEQKLGLSLVNFETATSSVQ

SEQ ID NO: 2038969 - protein, 25 aa, Staphylococcus
SFEYKDARNYLSFLYSKGLKRTTVS

SEQ ID NO: 2038970 - protein, 24 aa, Staphylococcus
SFFKLKGPLWFVARDLYQELYLGS

SEQ ID NO: 2038971 - protein, 19 aa, Staphylococcus
SFGAESMVLIHIISQIKPD

SEQ ID NO: 2038972 - protein, 20 aa, Staphylococcus
SFGAESMVLIHLIYQIKPDA

SEQ ID NO: 2038973 - protein, 25 aa, Staphylococcus
SFGHNEPKCILPYGVVATLDAEQLK

SEQ ID NO: 2038974 - protein, 24 aa, Staphylococcus
SFGIPKGKWTSIVGHNGSGKSTIA

SEQ ID NO: 2038975 - protein, 18 aa, Staphylococcus
SFHKPGHLFPLVSKEKGV

SEQ ID NO: 2038976 - protein, 17 aa, Staphylococcus
SFIDKSKVPARDTNIDM

SEQ ID NO: 2038977 - protein, 34 aa, Staphylococcus
SFIEACAAKVKILRDLRQSLNLNFNIEVDGGINN

SEQ ID NO: 2038978 - protein, 19 aa, Staphylococcus
SFIEYYAKVMSHFVTDKHL

SEQ ID NO: 2038979 - protein, 23 aa, Staphylococcus
SFIGCNTNLVAPVILGDDVLIAA

SEQ ID NO: 2038980 - protein, 24 aa, Staphylococcus
SFIGRLVKEKGIIDLLEAYNLLKS

SEQ ID NO: 2038981 - protein, 18 aa, Staphylococcus
SFIKNYVLSHSFIKSLVL

SEQ ID NO: 2038982 - protein, 19 aa, Staphylococcus
SFIKRELAIHGFEMSLGIK

SEQ ID NO: 2038983 - protein, 20 aa, Staphylococcus
SFISEIYSLFDAIERRNNKN

SEQ ID NO: 2038984 - protein, 21 aa, Staphylococcus
SFKLRDHRSALRIRVKQNIFE

SEQ ID NO: 2038985 - protein, 24 aa, Staphylococcus
SFKNKLAALVLKKDLAHFAKKMDY

SEQ ID NO: 2038986 - protein, 26 aa, Staphylococcus
SFKNKMAALILRKDLNGLMTKMDYAE

SEQ ID NO: 2038987 - protein, 20 aa, Staphylococcus
SFKPVNNVIYFKVAKNDELE

SEQ ID NO: 2038988 - protein, 24 aa, Staphylococcus
SFKTLVELVEYWSFEKELHKGNSF

SEQ ID NO: 2038989 - protein, 19 aa, Staphylococcus
SFKTPVHFGKKRLSDGEMT

SEQ ID NO: 2038990 - protein, 21 aa, Staphylococcus
SFKVYEDDFVYAFLDISQVTK

SEQ ID NO: 2038991 - protein, 27 aa, Staphylococcus
SFLESCPNLKWIAWYATGVNSLPLNYV

SEQ ID NO: 2038992 - protein, 17 aa, Staphylococcus
SFLIYAVEDTNIYPVQI

SEQ ID NO: 2038993 - protein, 25 aa, Staphylococcus
SFLKQCPNLNWIAWYATGVNNLPLE

SEQ ID NO: 2038994 - protein, 17 aa, Staphylococcus
SFLQSTIHERHFFNMAY

SEQ ID NO: 2038995 - protein, 18 aa, Staphylococcus
SFLQSTIHERNFFNMAYI

SEQ ID NO: 2038996 - protein, 29 aa, Staphylococcus
SFLRKHTVCNILFRTAIIKAHHIRFNESL

SEQ ID NO: 2038997 - protein, 25 aa, Staphylococcus
SFLRKNTACNIMFKTAIVQAHDLQF

SEQ ID NO: 2038998 - protein, 25 aa, Staphylococcus
SFLRKNTACNIVFKTSIVKAHHIKF

SEQ ID NO: 2038999 - protein, 25 aa, Staphylococcus
SFLTAGLCGLVRHWLDTSQLSADDF

SEQ ID NO: 2039000 - protein, 25 aa, Staphylococcus
SFLVAEQKLGLKLIDFETSTSSVQK

SEQ ID NO: 2039001 - protein, 19 aa, Staphylococcus
SFNALGHEFAREHDIPYVD

SEQ ID NO: 2039002 - protein, 18 aa, Staphylococcus
SFNALGHQFAHEHDIPYV

SEQ ID NO: 2039003 - protein, 28 aa, Staphylococcus
SFNNLKHFMAFKYIPFFKHYDITKFTLR

SEQ ID NO: 2039004 - protein, 28 aa, Staphylococcus
SFNNTRGMCETCSGLGYVEDIDLNELLD

SEQ ID NO: 2039005 - protein, 20 aa, Staphylococcus
SFNQFMEWSEKTARLKVRMN

SEQ ID NO: 2039006 - protein, 24 aa, Staphylococcus
SFNRDEIRVLTGFEPIGSEEMQKF

SEQ ID NO: 2039007 - protein, 19 aa, Staphylococcus
SFPNFKFKELIKEEWESSE

SEQ ID NO: 2039008 - protein, 19 aa, Staphylococcus
SFQDIVLGKSVKWLIEKKR

SEQ ID NO: 2039009 - protein, 19 aa, Staphylococcus
SFQEWKLEDLPIIPKQMKT

SEQ ID NO: 2039010 - protein, 25 aa, Staphylococcus
SFQTMKRLAAESDILEKKLITFFNA

SEQ ID NO: 2039011 - protein, 18 aa, Staphylococcus
SFRKALKVIEPYKEEINL

SEQ ID NO: 2039012 - protein, 24 aa, Staphylococcus
SFSADKILGAILFEQTMDREVEGK

SEQ ID NO: 2039013 - protein, 18 aa, Staphylococcus
SFSAQMHSLIALDSQHER

SEQ ID NO: 2039014 - protein, 18 aa, Staphylococcus
SFSAQMHSLIALDTQHHR

SEQ ID NO: 2039015 - protein, 25 aa, Staphylococcus
SFSDEVIEKIAGIAAREVSGILEMK

SEQ ID NO: 2039016 - protein, 22 aa, Staphylococcus
SFSELPDAISTVLNHDNFGRII

SEQ ID NO: 2039017 - protein, 20 aa, Staphylococcus
SFSGLKSAVINKLHNLRQKG

SEQ ID NO: 2039018 - protein, 20 aa, Staphylococcus
SFSGLKSAVINKLHNLRQKN

SEQ ID NO: 2039019 - protein, 23 aa, Staphylococcus
SFSGQMHGLVALNHQGEPIRNAI

SEQ ID NO: 2039020 - protein, 18 aa, Staphylococcus
SFSGQMHGLVPLDKNGCP

SEQ ID NO: 2039021 - protein, 21 aa, Staphylococcus
SFSQVRWMGVLNLEGKTPASL

SEQ ID NO: 2039022 - protein, 31 aa, Staphylococcus
SFTATIPYKGKLVVMKDEFTEFFAKEAKKRK

SEQ ID NO: 2039023 - protein, 24 aa, Staphylococcus
SFTGKAYFDLVFKGTGYKYNLHAK

SEQ ID NO: 2039024 - protein, 20 aa, Staphylococcus
SFTVLFKKSEIELLETVYNK

SEQ ID NO: 2039025 - protein, 19 aa, Staphylococcus
SFYANRLYGDWTTKTNNLY

SEQ ID NO: 2039026 - protein, 28 aa, Staphylococcus
SFYEALGFRKLKTGMAIYNNAKLKDEYT

SEQ ID NO: 2039027 - protein, 19 aa, Staphylococcus
SFYGVEVCQSIGADDKTFL

SEQ ID NO: 2039028 - protein, 20 aa, Staphylococcus
SFYYDFKGSLSICDVGAGAG

SEQ ID NO: 2039029 - protein, 21 aa, Staphylococcus
SGACGRLMCCLKYENDFYEEA

SEQ ID NO: 2039030 - protein, 20 aa, Staphylococcus
SGACGRLMCCLKYENDLYEE

SEQ ID NO: 2039031 - protein, 21 aa, Staphylococcus
SGACGRLMCCLKYENDYYEAA

SEQ ID NO: 2039032 - protein, 20 aa, Staphylococcus
SGAEHRKAQNYAEVKLKLDN

SEQ ID NO: 2039033 - protein, 19 aa, Staphylococcus
SGAEHRKAQNYAEVKLKLE

SEQ ID NO: 2039034 - protein, 20 aa, Staphylococcus
SGAEHRKAQNYAEVRLKLDN

SEQ ID NO: 2039035 - protein, 17 aa, Staphylococcus
SGAEHRKPQNFAEVKLK

SEQ ID NO: 2039036 - protein, 19 aa, Staphylococcus
SGAEHRNAQNYAEVQLKLD

SEQ ID NO: 2039037 - protein, 19 aa, Staphylococcus
SGAEHRQAQNYAEVQLKLD

SEQ ID NO: 2039038 - protein, 23 aa, Staphylococcus
SGAEVLGVVAIFTYGLAKADETF

SEQ ID NO: 2039039 - protein, 22 aa, Staphylococcus
SGAGLSLIRHWVEDENRISKEE

SEQ ID NO: 2039040 - protein, 37 aa, Staphylococcus
SGAGNAALDWACDIAPYAESVRLVYRKDKMKGYEGTQ

SEQ ID NO: 2039041 - protein, 24 aa, Staphylococcus
SGAKGGYQLSLNWQDVTIYEVITT

SEQ ID NO: 2039042 - protein, 18 aa, Staphylococcus
SGAKIFGGSYIWVEYEDT

SEQ ID NO: 2039043 - protein, 24 aa, Staphylococcus
SGAKIVEFGGWAMPVQFSSIKEEH

SEQ ID NO: 2039044 - protein, 24 aa, Staphylococcus
SGAKIVEFGGWAMPVQFTSIKDEH

SEQ ID NO: 2039045 - protein, 25 aa, Staphylococcus
SGAKPRKGKAYPHHHPKFTIDESSM

SEQ ID NO: 2039046 - protein, 22 aa, Staphylococcus
SGALKLIIRDVAKRTAAKQTKW

SEQ ID NO: 2039047 - protein, 18 aa, Staphylococcus
SGAPIKWQFVSGNTNDRY

SEQ ID NO: 2039048 - protein, 17 aa, Staphylococcus
SGATAFVYNGKFNPTRY

SEQ ID NO: 2039049 - protein, 17 aa, Staphylococcus
SGAYILSKRQLETEKSY

SEQ ID NO: 2039050 - protein, 17 aa, Staphylococcus
SGAYILSKRQLETEQSY

SEQ ID NO: 2039051 - protein, 20 aa, Staphylococcus
SGDEWREFGINHFILPEVLI

SEQ ID NO: 2039052 - protein, 24 aa, Staphylococcus
SGDRYLKTIMTFLGVPSYENVIIE

SEQ ID NO: 2039053 - protein, 22 aa, Staphylococcus
SGEELKGLIFVSRRDEAYELAE

SEQ ID NO: 2039054 - protein, 24 aa, Staphylococcus
SGELPEWIKLDIVTSTEKILFKEL

SEQ ID NO: 2039055 - protein, 19 aa, Staphylococcus
SGELVRRFEFEDINKNQIK

SEQ ID NO: 2039056 - protein, 20 aa, Staphylococcus
SGEQLPIWIADYVLSTYGTG

SEQ ID NO: 2039057 - protein, 24 aa, Staphylococcus
SGEQRISNFLIWQASYSEFIFNEK

SEQ ID NO: 2039058 - protein, 24 aa, Staphylococcus
SGEQRISNFLIWQISYSEFIFDQK

SEQ ID NO: 2039059 - protein, 23 aa, Staphylococcus
SGEQRISNFLIWQSSYSEFIFNE

SEQ ID NO: 2039060 - protein, 20 aa, Staphylococcus
SGFDGYFLIAANPVDILTRF

SEQ ID NO: 2039061 - protein, 19 aa, Staphylococcus
SGFFDYVFNHIKPTARSTA

SEQ ID NO: 2039062 - protein, 25 aa, Staphylococcus
SGFSNKYPSVFVFIGSNSEYDLHHP

SEQ ID NO: 2039063 - protein, 17 aa, Staphylococcus
SGFYRNKAKALHELFSW

SEQ ID NO: 2039064 - protein, 24 aa, Staphylococcus
SGGDSLKLSKLVFLLNEKMGLKMD

SEQ ID NO: 2039065 - protein, 17 aa, Staphylococcus
SGGEFPRDFNITESDDY

SEQ ID NO: 2039066 - protein, 26 aa, Staphylococcus
SGGEKARLQLALLMLQKDNVLILDEP

SEQ ID NO: 2039067 - protein, 18 aa, Staphylococcus
SGGELSRIMLALKSIFVK

SEQ ID NO: 2039068 - protein, 25 aa, Staphylococcus
SGGEQKRLYLLKLLVHQPNVLLLDE

SEQ ID NO: 2039069 - protein, 18 aa, Staphylococcus
SGGFKKPADLTVNDVQQV

SEQ ID NO: 2039070 - protein, 18 aa, Staphylococcus
SGGFKPIIVEDGNKEKVT

SEQ ID NO: 2039071 - protein, 20 aa, Staphylococcus
SGGIDTYWILMGMVQDEKCN

SEQ ID NO: 2039072 - protein, 19 aa, Staphylococcus
SGGIMLPHYSAYKVAEIFK

SEQ ID NO: 2039073 - protein, 24 aa, Staphylococcus
SGGIMLPNHAPLVVAEQFGTMETV

SEQ ID NO: 2039074 - protein, 21 aa, Staphylococcus
SGGKLKGKVALITGGDSGIGR

SEQ ID NO: 2039075 - protein, 25 aa, Staphylococcus
SGGMKKRLGIAQAIIHNPQVLIVDE

SEQ ID NO: 2039076 - protein, 22 aa, Staphylococcus
SGGQRQRAYIAMTIAQDTDYIL

SEQ ID NO: 2039077 - protein, 21 aa, Staphylococcus
SGGQRQRAYIAMTIAQDTEYI

SEQ ID NO: 2039078 - protein, 20 aa, Staphylococcus
SGGQRQRAYIAMTIAQNTDY

SEQ ID NO: 2039079 - protein, 21 aa, Staphylococcus
SGGQRQRAYVAMTIAQDTDYI

SEQ ID NO: 2039080 - protein, 27 aa, Staphylococcus
SGGQRQRVWIAMALAQKTDIIFLDEPT

SEQ ID NO: 2039081 - protein, 28 aa, Staphylococcus
SGGQRQRVWIAMALAQKTDIIFLDEPTT

SEQ ID NO: 2039082 - protein, 22 aa, Staphylococcus
SGGQRQRVWIAMALTQRTDIIF

SEQ ID NO: 2039083 - protein, 25 aa, Staphylococcus
SGGVFPRDFNITASDDYIVCAHQED

SEQ ID NO: 2039084 - protein, 17 aa, Staphylococcus
SGGVSLDNLEDWYNKGA

SEQ ID NO: 2039085 - protein, 17 aa, Staphylococcus
SGGVSLDNLEDWYRKGA

SEQ ID NO: 2039086 - protein, 25 aa, Staphylococcus
SGGWDFPEGIQVIGVTSVHEALDFA

SEQ ID NO: 2039087 - protein, 25 aa, Staphylococcus
SGHIQGCAGDVWYPQPAPATHPWRT

SEQ ID NO: 2039088 - protein, 20 aa, Staphylococcus
SGHLHTHLASYLIIDEADLM

SEQ ID NO: 2039089 - protein, 20 aa, Staphylococcus
SGIAEPLAVVDACLTPILAP

SEQ ID NO: 2039090 - protein, 19 aa, Staphylococcus
SGIAEPLAVVDACLTPVLA

SEQ ID NO: 2039091 - protein, 19 aa, Staphylococcus
SGIAPAIMVAYKFGVPCLF

SEQ ID NO: 2039092 - protein, 19 aa, Staphylococcus
SGIFKSIGLYKEYSDEHIK

SEQ ID NO: 2039093 - protein, 17 aa, Staphylococcus
SGIGQYHGKYTFQTFSH

SEQ ID NO: 2039094 - protein, 18 aa, Staphylococcus
SGIGRAIAVLYAKEGANV

SEQ ID NO: 2039095 - protein, 19 aa, Staphylococcus
SGIGRETYKGALRNYQQVK

SEQ ID NO: 2039096 - protein, 18 aa, Staphylococcus
SGIGRSVAILYAKEGADV

SEQ ID NO: 2039097 - protein, 19 aa, Staphylococcus
SGIGRSVAILYAKEGANVA

SEQ ID NO: 2039098 - protein, 25 aa, Staphylococcus
SGIIDRYFFKSLYYRHNKIMYEFAT

SEQ ID NO: 2039099 - protein, 22 aa, Staphylococcus
SGIIDRYFFKSLYYRHNSIMFE

SEQ ID NO: 2039100 - protein, 23 aa, Staphylococcus
SGIKAHYDVPVILFGVGASHLIN

SEQ ID NO: 2039101 - protein, 22 aa, Staphylococcus
SGIKDCINLTIGQPDFPMPDVV

SEQ ID NO: 2039102 - protein, 22 aa, Staphylococcus
SGIKVGMIHGGLTPRERKQQMK

SEQ ID NO: 2039103 - protein, 18 aa, Staphylococcus
SGIPLDYFHSYVFGATIS

SEQ ID NO: 2039104 - protein, 20 aa, Staphylococcus
SGIVTFGHLLARAVARDVGR

SEQ ID NO: 2039105 - protein, 19 aa, Staphylococcus
SGKAAWEQNYIKFRDRPKM

SEQ ID NO: 2039106 - protein, 23 aa, Staphylococcus
SGKAKAYFKKVLPIHKAKTLVQQ

SEQ ID NO: 2039107 - protein, 30 aa, Staphylococcus
SGKAWDNRYGCVLAIEILELLKDVELDVDL

SEQ ID NO: 2039108 - protein, 22 aa, Staphylococcus
SGKLHIGHAYSTVAGDVIARYK

SEQ ID NO: 2039109 - protein, 20 aa, Staphylococcus
SGKNGKIFIDHCGQEMLERT

SEQ ID NO: 2039110 - protein, 17 aa, Staphylococcus
SGKNLQSLGKWLVPQTK

SEQ ID NO: 2039111 - protein, 24 aa, Staphylococcus
SGKQGLELCAPFYIYNEDGSYSDE

SEQ ID NO: 2039112 - protein, 21 aa, Staphylococcus
SGKRYKVRLANVISLSQSNHK

SEQ ID NO: 2039113 - protein, 18 aa, Staphylococcus
SGKRYTFVGDRTVSTVSA

SEQ ID NO: 2039114 - protein, 17 aa, Staphylococcus
SGKSSLITAGFEREQEA

SEQ ID NO: 2039115 - protein, 27 aa, Staphylococcus
SGKSVAINSMLLSLLYKNHPEELKLLL

SEQ ID NO: 2039116 - protein, 20 aa, Staphylococcus
SGKTGFYFRVIQEGYVSQED

SEQ ID NO: 2039117 - protein, 22 aa, Staphylococcus
SGKTMIFDAIVFALFGEASTKD

SEQ ID NO: 2039118 - protein, 17 aa, Staphylococcus
SGKTRLSNDLLLQLDAK

SEQ ID NO: 2039119 - protein, 24 aa, Staphylococcus
SGKTRLSNELLLNFDAKYTHFIAT

SEQ ID NO: 2039120 - protein, 25 aa, Staphylococcus
SGKTRLSNELLLNFDAKYTRFITTQ

SEQ ID NO: 2039121 - protein, 18 aa, Staphylococcus
SGLEAIIGYLYLEKEDAR

SEQ ID NO: 2039122 - protein, 19 aa, Staphylococcus
SGLEAVLGFLYLENREDRL

SEQ ID NO: 2039123 - protein, 24 aa, Staphylococcus
SGLESIIYACRMVQCEAGKVFIAG

SEQ ID NO: 2039124 - protein, 31 aa, Staphylococcus
SGLESVIYACRMIQCGAGSVYLAGGVESTSR

SEQ ID NO: 2039125 - protein, 19 aa, Staphylococcus
SGLKAIVVIPEGKIALGKL

SEQ ID NO: 2039126 - protein, 26 aa, Staphylococcus
SGLLANHPGVFAFIGSNSKYDLHHPK

SEQ ID NO: 2039127 - protein, 25 aa, Staphylococcus
SGLLDERPGVFAFIGSNSDYDLHHP

SEQ ID NO: 2039128 - protein, 21 aa, Staphylococcus
SGLNVSRYALGTIPFAGSNGF

SEQ ID NO: 2039129 - protein, 17 aa, Staphylococcus
SGLNYTIVHPGRLTDDE

SEQ ID NO: 2039130 - protein, 21 aa, Staphylococcus
SGLPIEIYAELVYGIQNEMVY

SEQ ID NO: 2039131 - protein, 19 aa, Staphylococcus
SGLPKERVIGSGTILDTAR

SEQ ID NO: 2039132 - protein, 23 aa, Staphylococcus
SGLPKRPFAPFNEENRAALDELV

SEQ ID NO: 2039133 - protein, 19 aa, Staphylococcus
SGLPSFTYTFLGFLPRKEK

SEQ ID NO: 2039134 - protein, 20 aa, Staphylococcus
SGLQEYLDELGFNLVGYGCT

SEQ ID NO: 2039135 - protein, 26 aa, Staphylococcus
SGLSVILRSVMEGFTVRLLEKYNTED

SEQ ID NO: 2039136 - protein, 36 aa, Staphylococcus; identical to SEQ ID NO: 1812672

SEQ ID NO: 2039137 - protein, 22 aa, Staphylococcus
SGMAAIQLVCNLFKPGDEVLVA

SEQ ID NO: 2039138 - protein, 23 aa, Staphylococcus
SGMAKSRRKTLEKMERIDKPMLD

SEQ ID NO: 2039139 - protein, 24 aa, Staphylococcus
SGMAKSRRKVLEKIERIDKPMLDA

SEQ ID NO: 2039140 - protein, 21 aa, Staphylococcus
SGMRAKLGFSINVTINPDILV

SEQ ID NO: 2039141 - protein, 19 aa, Staphylococcus
SGMVIKDAELRGVASSGMI

SEQ ID NO: 2039142 - protein, 19 aa, Staphylococcus
SGMVIKDAKLRGVDSSGMI

SEQ ID NO: 2039143 - protein, 31 aa, Staphylococcus
SGNIPGLPLWSFISSLLVKSGSICKLPHAEP

SEQ ID NO: 2039144 - protein, 27 aa, Staphylococcus
SGNVQRFIKRTELSDVMEITEDNCQEE

SEQ ID NO: 2039145 - protein, 20 aa, Staphylococcus
SGNVRRFIKKAEITNTMEIT

SEQ ID NO: 2039146 - protein, 23 aa, Staphylococcus
SGNVRRFIKRAEIDDTLEITQDN

SEQ ID NO: 2039147 - protein, 24 aa, Staphylococcus
SGNVRRFIKRAEIENVMEITSENC

SEQ ID NO: 2039148 - protein, 27 aa, Staphylococcus
SGNVRRFIKRSEIKNVLEINKDNCKDS

SEQ ID NO: 2039149 - protein, 27 aa, Staphylococcus
SGNVRRFIKRSEISDVMEITKDNCTDP

SEQ ID NO: 2039150 - protein, 19 aa, Staphylococcus
SGPKRPQDLIFLSDMKTEF

SEQ ID NO: 2039151 - protein, 24 aa, Staphylococcus
SGQELPMNPAISLYVTVKDNAEME

SEQ ID NO: 2039152 - protein, 24 aa, Staphylococcus
SGQKCSACSRAIIHKDVHDEILEK

SEQ ID NO: 2039153 - protein, 26 aa, Staphylococcus
SGQKCSACSRAIVHSAVYDEVLEKAI

SEQ ID NO: 2039154 - protein, 19 aa, Staphylococcus
SGQQVPIWIADYVLSTYGT

SEQ ID NO: 2039155 - protein, 18 aa, Staphylococcus
SGQTPRLATNRKASKIIN

SEQ ID NO: 2039156 - protein, 27 aa, Staphylococcus
SGRAPSEQGFRLYVNQLLKQTSHQKQN

SEQ ID NO: 2039157 - protein, 20 aa, Staphylococcus
SGRCNLGVVTLNIPRIAIES

SEQ ID NO: 2039158 - protein, 19 aa, Staphylococcus
SGRELHKGLEIGTQYDKWM

SEQ ID NO: 2039159 - protein, 18 aa, Staphylococcus
SGRIGIPNKGEWTHKPLR

SEQ ID NO: 2039160 - protein, 26 aa, Staphylococcus
SGRIPSEEGFRFYVNQLLEDTSHQTF

SEQ ID NO: 2039161 - protein, 23 aa, Staphylococcus
SGRSSSVELVRLANKECKATNIW

SEQ ID NO: 2039162 - protein, 21 aa, Staphylococcus
SGRSTRSSLGMSDISNYEDYL

SEQ ID NO: 2039163 - protein, 24 aa, Staphylococcus
SGRVWSREELERFGNIMKAHDVWL

SEQ ID NO: 2039164 - protein, 24 aa, Staphylococcus
SGSAIQWLRDGLRIINSAPQSENY

SEQ ID NO: 2039165 - protein, 24 aa, Staphylococcus
SGSAIQWLRDGLRIINSAPQTENY

SEQ ID NO: 2039166 - protein, 21 aa, Staphylococcus
SGSAIQWLRDGLRMINSAPES

SEQ ID NO: 2039167 - protein, 18 aa, Staphylococcus
SGSFNISTTASFVVASAD

SEQ ID NO: 2039168 - protein, 22 aa, Staphylococcus
SGSFSDRMSKLLTGEDGEEAVL

SEQ ID NO: 2039169 - protein, 23 aa, Staphylococcus
SGSFSDRMSRLLTGEDGEEAVLN

SEQ ID NO: 2039170 - protein, 23 aa, Staphylococcus
SGSFSDRMSRLLTGEDGEEAVLS

SEQ ID NO: 2039171 - protein, 24 aa, Staphylococcus
SGSGKSLLARTVLNMRHPHLKYQS

SEQ ID NO: 2039172 - protein, 17 aa, Staphylococcus
SGSYYGGDSLKPTRIYV

SEQ ID NO: 2039173 - protein, 23 aa, Staphylococcus
SGTEPKIKLYVSLSVDHFEQTAQ

SEQ ID NO: 2039174 - protein, 19 aa, Staphylococcus
SGTEPKIKLYVSLTIDHFD

SEQ ID NO: 2039175 - protein, 17 aa, Staphylococcus
SGTGLAFTRNPVTGENK

SEQ ID NO: 2039176 - protein, 18 aa, Staphylococcus
SGTGWLLEIVISNDHYEQ

SEQ ID NO: 2039177 - protein, 17 aa, Staphylococcus
SGTIPGVLFKLEKTHDI

SEQ ID NO: 2039178 - protein, 18 aa, Staphylococcus
SGTIPGVLFKLEKTHDLT

SEQ ID NO: 2039179 - protein, 17 aa, Staphylococcus
SGTIPGVLFKLEKTHGL

SEQ ID NO: 2039180 - protein, 19 aa, Staphylococcus
SGTKILGAVLNKAQLDKSS

SEQ ID NO: 2039181 - protein, 18 aa, Staphylococcus
SGTLLKINVQAGEEAKVK

SEQ ID NO: 2039182 - protein, 30 aa, Staphylococcus
SGTLNRLTSTFLRRQFNIVTLSVTPSTTPG

SEQ ID NO: 2039183 - protein, 23 aa, Staphylococcus
SGVDFLKNRGYEIENSLVDVPDQ

SEQ ID NO: 2039184 - protein, 18 aa, Staphylococcus
SGVDFLKNRGYEVESSLV

SEQ ID NO: 2039185 - protein, 30 aa, Staphylococcus
SGVDIKEVFLKLPIIGTEVFDESNEIEFYE

SEQ ID NO: 2039186 - protein, 28 aa, Staphylococcus
SGVDIKEVFLKLPIIGTEVYDEANEIDF

SEQ ID NO: 2039187 - protein, 28 aa, Staphylococcus
SGVDIKEVFLKLPIIGTEVYDEENEIDF

SEQ ID NO: 2039188 - protein, 27 aa, Staphylococcus
SGVDIKEVFLKLPIVATEVYDETNEIE

SEQ ID NO: 2039189 - protein, 18 aa, Staphylococcus
SGVEHVRETAPFPRLLNR

SEQ ID NO: 2039190 - protein, 19 aa, Staphylococcus
SGVHTCVGASFSLIQLEMV

SEQ ID NO: 2039191 - protein, 18 aa, Staphylococcus
SGVNFSIQHLVVSNVKGR

SEQ ID NO: 2039192 - protein, 26 aa, Staphylococcus
SGVSDAPMKGAIQFTSPKKFEHTFNL

SEQ ID NO: 2039193 - protein, 20 aa, Staphylococcus
SGVVKENFLEHVLEREKNYP

SEQ ID NO: 2039194 - protein, 18 aa, Staphylococcus
SGVVYGAVNLHWTNHVNV

SEQ ID NO: 2039195 - protein, 24 aa, Staphylococcus
SGWRYMLDRCETLLNESKKHILNL

SEQ ID NO: 2039196 - protein, 19 aa, Staphylococcus
SGYPDCRDSFIKSMNVTLS

SEQ ID NO: 2039197 - protein, 17 aa, Staphylococcus
SGYRSYHVIIEYPIETL

SEQ ID NO: 2039198 - protein, 18 aa, Staphylococcus
SGYRSYHVIIEYPIETLD

SEQ ID NO: 2039199 - protein, 20 aa, Staphylococcus
SGYRSYHVIIEYPIETLEGQ

SEQ ID NO: 2039200 - protein, 18 aa, Staphylococcus
SGYRSYHVIIEYPIETLN

SEQ ID NO: 2039201 - protein, 18 aa, Staphylococcus
SGYSMFWSKILLATQSKR

SEQ ID NO: 2039202 - protein, 26 aa, Staphylococcus
SGYTKDYPGVFAIIGSNSKYDLHHPK

SEQ ID NO: 2039203 - protein, 21 aa, Staphylococcus
SHAKTLFSTHYHELTSLDQML

SEQ ID NO: 2039204 - protein, 19 aa, Staphylococcus
SHAKTLFSTHYHELTTLDQ

SEQ ID NO: 2039205 - protein, 26 aa, Staphylococcus
SHATYKAWVDHCLDNKSKHPFKYKEA

SEQ ID NO: 2039206 - protein, 25 aa, Staphylococcus
SHDKLSFKYVDRILLNWKKNNVTTL

SEQ ID NO: 2039207 - protein, 25 aa, Staphylococcus
SHDKLSFKYVDRILLNWKKNNVTTT

SEQ ID NO: 2039208 - protein, 19 aa, Staphylococcus
SHDYAHCPNFVKGHIPELY

SEQ ID NO: 2039209 - protein, 19 aa, Staphylococcus
SHEDLRCKDLYLTEEARNL

SEQ ID NO: 2039210 - protein, 21 aa, Staphylococcus
SHEPLDYIVIDQFAVRGVYQN

SEQ ID NO: 2039211 - protein, 18 aa, Staphylococcus
SHERKLLYIHGGYNTLQP

SEQ ID NO: 2039212 - protein, 18 aa, Staphylococcus
SHESWLKMDVKKETIVQN

SEQ ID NO: 2039213 - protein, 19 aa, Staphylococcus
SHFDLGIKTAQWLKQTPLL

SEQ ID NO: 2039214 - protein, 36 aa, Staphylococcus
SHFELPGALAKDNCKYMCEGTCWCVQAYQNKKLTKA

SEQ ID NO: 2039215 - protein, 20 aa, Staphylococcus
SHFHAGFKIPDVSEETIHQI

SEQ ID NO: 2039216 - protein, 17 aa, Staphylococcus
SHFHKFYNAEKVLTDDV

SEQ ID NO: 2039217 - protein, 34 aa, Staphylococcus
SHFKPEELSSIMLTYRLKSATGLLSAKTYLGHDQ

SEQ ID NO: 2039218 - protein, 19 aa, Staphylococcus
SHGFIKSLVLGISGGQDST

SEQ ID NO: 2039219 - protein, 26 aa, Staphylococcus
SHGRDRSGVCSVQFAERIQPGDTVPI

SEQ ID NO: 2039220 - protein, 20 aa, Staphylococcus
SHHMKVLVAHHFVEVRKEGN

SEQ ID NO: 2039221 - protein, 18 aa, Staphylococcus
SHHPEIIADFYSSGMIEV

SEQ ID NO: 2039222 - protein, 27 aa, Staphylococcus
SHIGEFSLRGGIIDIYPLIGAPVRIEL

SEQ ID NO: 2039223 - protein, 27 aa, Staphylococcus
SHIPESRGIVKWQAFKTLPEQYEQLEQ

SEQ ID NO: 2039224 - protein, 23 aa, Staphylococcus
SHKIAELKALIGNQEKPDLEKLF

SEQ ID NO: 2039225 - protein, 17 aa, Staphylococcus
SHKRFGGVVPEVASRHH

SEQ ID NO: 2039226 - protein, 21 aa, Staphylococcus
SHKRFGGVVPEVASRHHVEGI

SEQ ID NO: 2039227 - protein, 18 aa, Staphylococcus
SHLEIVAPVVLGKTRANQ

SEQ ID NO: 2039228 - protein, 17 aa, Staphylococcus
SHLFKQSYKALFIRKEM

SEQ ID NO: 2039229 - protein, 17 aa, Staphylococcus
SHLIRLSSGHSFIEKII

SEQ ID NO: 2039230 - protein, 17 aa, Staphylococcus
SHLKILKVFGTENIYRK

SEQ ID NO: 2039231 - protein, 28 aa, Staphylococcus
SHLLMTTDLFLNVFGMKSIEELPSTEED

SEQ ID NO: 2039232 - protein, 29 aa, Staphylococcus
SHLNIDADFIIRVGKPVISKKLNQWLTRT

SEQ ID NO: 2039233 - protein, 20 aa, Staphylococcus
SHLNKGGLLIFDVHTVEKMN

SEQ ID NO: 2039234 - protein, 19 aa, Staphylococcus
SHLYEYARIQAYLQTHRPA

SEQ ID NO: 2039235 - protein, 17 aa, Staphylococcus
SHMKRVGFKIISVQHDN

SEQ ID NO: 2039236 - protein, 20 aa, Staphylococcus
SHNEISWINSRKGLSSNERG

SEQ ID NO: 2039237 - protein, 24 aa, Staphylococcus
SHPANCLMARIGKRITLDQQHAFD

SEQ ID NO: 2039238 - protein, 25 aa, Staphylococcus
SHPANCLMARIGKRITLSQQQAFDD

SEQ ID NO: 2039239 - protein, 25 aa, Staphylococcus
SHPANCLMARIGNRITLDQQQSFDD

SEQ ID NO: 2039240 - protein, 19 aa, Staphylococcus
SHPEWSQYFIENVNIGRDK

SEQ ID NO: 2039241 - protein, 19 aa, Staphylococcus
SHPKSFYSLVTMDEGNEDE

SEQ ID NO: 2039242 - protein, 25 aa, Staphylococcus
SHPNLKYPSFERIFKDSNVYNNNVS

SEQ ID NO: 2039243 - protein, 25 aa, Staphylococcus
SHPYKRGIYSGGIGYINCNQDLDFA

SEQ ID NO: 2039244 - protein, 20 aa, Staphylococcus
SHRFIEYFNHYGIEVDGKQA

SEQ ID NO: 2039245 - protein, 21 aa, Staphylococcus
SHRKLFPSLFHLFQQNNLDEH

SEQ ID NO: 2039246 - protein, 20 aa, Staphylococcus
SHRKLFPSLFHLYQQDNLDQ

SEQ ID NO: 2039247 - protein, 20 aa, Staphylococcus
SHRKLFPSLFHLYQQENLNE

SEQ ID NO: 2039248 - protein, 17 aa, Staphylococcus
SHRPEHIEKAGLKTDVM

SEQ ID NO: 2039249 - protein, 18 aa, Staphylococcus
SHSEWTSRLDAMKDKIDW

SEQ ID NO: 2039250 - protein, 17 aa, Staphylococcus
SHSFLLPLVNEIDTEIH

SEQ ID NO: 2039251 - protein, 18 aa, Staphylococcus
SHSFPFGVVTLTRMFFEN

SEQ ID NO: 2039252 - protein, 17 aa, Staphylococcus
SHSHILKQWSGIRPYTE

SEQ ID NO: 2039253 - protein, 17 aa, Staphylococcus
SHSQCRLGIRPEDLHLI

SEQ ID NO: 2039254 - protein, 21 aa, Staphylococcus
SHTKYGSYIDHEHLILVGEYE

SEQ ID NO: 2039255 - protein, 19 aa, Staphylococcus
SHTMIDGAVFKEESKDIMA

SEQ ID NO: 2039256 - protein, 19 aa, Staphylococcus
SHTTGECWAISAHPNGPNI

SEQ ID NO: 2039257 - protein, 20 aa, Staphylococcus
SHVPVLIDEAYFEFVTADDY

SEQ ID NO: 2039258 - protein, 25 aa, Staphylococcus
SHVSELKQRIPLILEVNTNQYQSYT

SEQ ID NO: 2039259 - protein, 26 aa, Staphylococcus
SHVSELKQRIPLILEVSTNQYQSQTR

SEQ ID NO: 2039260 - protein, 26 aa, Staphylococcus
SHVSELKQRIPLILEVTSNQYQSHTR

SEQ ID NO: 2039261 - protein, 26 aa, Staphylococcus
SHVSELKQRIPLILEVTSNQYQSMTK

SEQ ID NO: 2039262 - protein, 25 aa, Staphylococcus
SHVSELKQRIPLILEVTTEQYQSTT

SEQ ID NO: 2039263 - protein, 26 aa, Staphylococcus
SHVTELKQRIPLILEVTSKQFQSATQ

SEQ ID NO: 2039264 - protein, 17 aa, Staphylococcus
SHVVIRGRHPNEFVSEF

SEQ ID NO: 2039265 - protein, 18 aa, Staphylococcus
SHVVLRGRHPNEFVSELR

SEQ ID NO: 2039266 - protein, 24 aa, Staphylococcus
SHYDLGVITALWLKQTPLLQNRER

SEQ ID NO: 2039267 - protein, 20 aa, Staphylococcus
SHYKHLFAILELAKKQGVDK

SEQ ID NO: 2039268 - protein, 24 aa, Staphylococcus
SHYKHLFALLDLAKKQGLEKVYVH

SEQ ID NO: 2039269 - protein, 20 aa, Staphylococcus
SHYRLYGIFLLNQLNGKEIL

SEQ ID NO: 2039270 - protein, 26 aa, Staphylococcus
SIAIMSGNFVMRGQPAIYNKFTRAKM

SEQ ID NO: 2039271 - protein, 18 aa, Staphylococcus
SIAKAIAGSTEYKFRQLN

SEQ ID NO: 2039272 - protein, 19 aa, Staphylococcus
SIAKAIAGSTQFKFRQLNA

SEQ ID NO: 2039273 - protein, 17 aa, Staphylococcus
SIANYVIDTTVLKPKEL

SEQ ID NO: 2039274 - protein, 21 aa, Staphylococcus
SIASNRSGIVIGTDHSAENIT

SEQ ID NO: 2039275 - protein, 20 aa, Staphylococcus
SIATQIAHHYGLQVITTASR

SEQ ID NO: 2039276 - protein, 27 aa, Staphylococcus
SIAYPRQIAMYLSRELTDFSLPKIGEE

SEQ ID NO: 2039277 - protein, 28 aa, Staphylococcus
SIAYPRQIAMYLSRELTDFSLPKIGEEF

SEQ ID NO: 2039278 - protein, 19 aa, Staphylococcus
SICTTRIVAGVGVPQITAV

SEQ ID NO: 2039279 - protein, 23 aa, Staphylococcus
SIDAIICGIGINLNHSDSDFSDD

SEQ ID NO: 2039280 - protein, 20 aa, Staphylococcus
SIDEDLFFIISLSGESHQLT

SEQ ID NO: 2039281 - protein, 23 aa, Staphylococcus
SIDELPIIALLCTQATGTSIIKD

SEQ ID NO: 2039282 - protein, 21 aa, Staphylococcus
SIDETPAFFELFRMAEEKHGF

SEQ ID NO: 2039283 - protein, 21 aa, Staphylococcus
SIDIKDMFIDIGVRSKADAEQ

SEQ ID NO: 2039284 - protein, 25 aa, Staphylococcus
SIDILKEFDNAVILFMGAGDIQKLL

SEQ ID NO: 2039285 - protein, 21 aa, Staphylococcus
SIDKLLNFDVHFALTNEEITH

SEQ ID NO: 2039286 - protein, 18 aa, Staphylococcus
SIDKSVMATITFQNLFKL

SEQ ID NO: 2039287 - protein, 24 aa, Staphylococcus
SIDNRKGQESFVFYDGPPTANGLP

SEQ ID NO: 2039288 - protein, 17 aa, Staphylococcus
SIDRKLPDLSERERKII

SEQ ID NO: 2039289 - protein, 17 aa, Staphylococcus
SIDRKLPDLSERERKVI

SEQ ID NO: 2039290 - protein, 17 aa, Staphylococcus
SIDRKLPNLSERERTVI

SEQ ID NO: 2039291 - protein, 21 aa, Staphylococcus
SIDRLTSILTQFKQVTVETDN

SEQ ID NO: 2039292 - protein, 18 aa, Staphylococcus
SIDTLTWIYVPKLTEAAR

SEQ ID NO: 2039293 - protein, 20 aa, Staphylococcus
SIDTSMGFTPLAGVTMGTRS

SEQ ID NO: 2039294 - protein, 25 aa, Staphylococcus
SIEAMVSFLNSFPMFKDDTRNTHPK

SEQ ID NO: 2039295 - protein, 17 aa, Staphylococcus
SIEATKIFLENSSFNVD

SEQ ID NO: 2039296 - protein, 17 aa, Staphylococcus
SIEEFVILYKVYEAKKM

SEQ ID NO: 2039297 - protein, 23 aa, Staphylococcus
SIEEQKVIILYALIQAKHAIKQF

SEQ ID NO: 2039298 - protein, 19 aa, Staphylococcus
SIEHRRWGAPFPVIEIVKR

SEQ ID NO: 2039299 - protein, 25 aa, Staphylococcus
SIEIPISLLPYLFFKFADHGKRLYE

SEQ ID NO: 2039300 - protein, 23 aa, Staphylococcus
SIEPGKFADLVVWDPAFFGVKPE

SEQ ID NO: 2039301 - protein, 21 aa, Staphylococcus
SIERQRLIGQIGIKEKQLNVL

SEQ ID NO: 2039302 - protein, 27 aa, Staphylococcus
SIESGKLADLVMWDPIFFGVKPELVVK

SEQ ID NO: 2039303 - protein, 29 aa, Staphylococcus
SIESRPIFQEALNFVRIGDRFVVESIDRL

SEQ ID NO: 2039304 - protein, 21 aa, Staphylococcus
SIETCESRDPKGLYQKARNGE

SEQ ID NO: 2039305 - protein, 28 aa, Staphylococcus
SIEVPLDLLPYLFFQFAKYGKRLYDDNS

SEQ ID NO: 2039306 - protein, 17 aa, Staphylococcus
SIEVSDAAKQWLGEEAY

SEQ ID NO: 2039307 - protein, 21 aa, Staphylococcus
SIFKGNRALIYGGDDGLLKEI

SEQ ID NO: 2039308 - protein, 19 aa, Staphylococcus
SIFKITKFFHLKKGNTVLF

SEQ ID NO: 2039309 - protein, 25 aa, Staphylococcus
SIFSPRPGTISVEYENGESELIPND

SEQ ID NO: 2039310 - protein, 20 aa, Staphylococcus
SIFVESRGQTAILFDEVDSG

SEQ ID NO: 2039311 - protein, 17 aa, Staphylococcus
SIFVKKLIVSKAKLYGR

SEQ ID NO: 2039312 - protein, 24 aa, Staphylococcus
SIFVKSRGQTAILFDEVDSGVSGI

SEQ ID NO: 2039313 - protein, 22 aa, Staphylococcus
SIGCAPCTSPVAAGGDSREGRW

SEQ ID NO: 2039314 - protein, 21 aa, Staphylococcus
SIGCIPCTAPVFDSEDSRAGR

SEQ ID NO: 2039315 - protein, 21 aa, Staphylococcus
SIGCIPCTAPVFDSNDSRAGR

SEQ ID NO: 2039316 - protein, 21 aa, Staphylococcus
SIGCIPCTAPVFNSDDSRAGR

SEQ ID NO: 2039317 - protein, 20 aa, Staphylococcus
SIGCIPCTSPVFDSDDSRAG

SEQ ID NO: 2039318 - protein, 18 aa, Staphylococcus
SIGEHPNCAYLIAEANGR

SEQ ID NO: 2039319 - protein, 24 aa, Staphylococcus
SIGIYSYELYNFFDVDTIIRVGSC

SEQ ID NO: 2039320 - protein, 24 aa, Staphylococcus
SIGIYSYELYNFFDVETIIRVGSC

SEQ ID NO: 2039321 - protein, 31 aa, Staphylococcus
SIGNPLYHWSQLELKMYFNIDDLLTSDNAEE

SEQ ID NO: 2039322 - protein, 17 aa, Staphylococcus
SIGRVSNLNGWKVGIPE

SEQ ID NO: 2039323 - protein, 24 aa, Staphylococcus
SIGSEICRQVCKFAPKKIVLLGHG

SEQ ID NO: 2039324 - protein, 25 aa, Staphylococcus
SIGSEICRQVCKFTPDRIMLLGHGE

SEQ ID NO: 2039325 - protein, 21 aa, Staphylococcus
SIHLLPFNVFFVPARGGLGEN

SEQ ID NO: 2039326 - protein, 25 aa, Staphylococcus
SIHPQLRICACLGLTNEKQAARLKK

SEQ ID NO: 2039327 - protein, 23 aa, Staphylococcus
SIHPRYTYDSMIQTFSCIQLLIQ

SEQ ID NO: 2039328 - protein, 19 aa, Staphylococcus
SIIAENGYRYYSESDIEKL

SEQ ID NO: 2039329 - protein, 17 aa, Staphylococcus
SIIDCAIEHGITYFDTA

SEQ ID NO: 2039330 - protein, 19 aa, Staphylococcus
SIIDHALREEVDFIVIAGD

SEQ ID NO: 2039331 - protein, 18 aa, Staphylococcus
SIIKFRYFAYYKYHKLTI

SEQ ID NO: 2039332 - protein, 17 aa, Staphylococcus
SIINRFIERSGVKEPLS

SEQ ID NO: 2039333 - protein, 19 aa, Staphylococcus
SIIPGFDFYFVPTVLNSQD

SEQ ID NO: 2039334 - protein, 17 aa, Staphylococcus
SIIPGSKPFNVVMTPSD

SEQ ID NO: 2039335 - protein, 25 aa, Staphylococcus
SIIPHEAVGVVGAVVAWNFPMLLAT

SEQ ID NO: 2039336 - protein, 19 aa, Staphylococcus
SIISRYAFVKYMDQLARKM

SEQ ID NO: 2039337 - protein, 18 aa, Staphylococcus
SIITMLKCMHKYGFSANF

SEQ ID NO: 2039338 - protein, 20 aa, Staphylococcus
SIIVLLKCMNKFGFGAFFNY

SEQ ID NO: 2039339 - protein, 19 aa, Staphylococcus
SIIVLLKCMNKFGFSALFN

SEQ ID NO: 2039340 - protein, 25 aa, Staphylococcus
SIIYIEILRQIAIGYSFKVSVENTE

SEQ ID NO: 2039341 - protein, 31 aa, Staphylococcus
SIKARGGIYEVLKLAETIAMQDGDLKETADY

SEQ ID NO: 2039342 - protein, 23 aa, Staphylococcus
SIKIRPEYFEVYKNNELLELTPK

SEQ ID NO: 2039343 - protein, 24 aa, Staphylococcus
SIKKEGYVQFEFVKDDLTDLLAIT

SEQ ID NO: 2039344 - protein, 22 aa, Staphylococcus
SIKLARKELKNWAKTKQVETPL

SEQ ID NO: 2039345 - protein, 18 aa, Staphylococcus
SIKLARKELKNWSKTKQV

SEQ ID NO: 2039346 - protein, 23 aa, Staphylococcus
SIKLSLKNGKIFKIKPEYEDLRV

SEQ ID NO: 2039347 - protein, 25 aa, Staphylococcus
SIKRKCLFNGPSVIEINGQYLSIRQ

SEQ ID NO: 2039348 - protein, 22 aa, Staphylococcus
SILDHVQKLGSLVMATTHYPEL

SEQ ID NO: 2039349 - protein, 26 aa, Staphylococcus
SILDHVRNLGALVMATTHYPELKAYS

SEQ ID NO: 2039350 - protein, 22 aa, Staphylococcus
SILGVIENMSWFESKETGNKEY

SEQ ID NO: 2039351 - protein, 17 aa, Staphylococcus
SILINMIKCVESCGVDV

SEQ ID NO: 2039352 - protein, 18 aa, Staphylococcus
SILNLVILCGCQGVNGGG

SEQ ID NO: 2039353 - protein, 19 aa, Staphylococcus
SILNLVMLCGCQGVNGGGW

SEQ ID NO: 2039354 - protein, 18 aa, Staphylococcus
SILTAVKIARIFNEPVEN

SEQ ID NO: 2039355 - protein, 27 aa, Staphylococcus
SILTEKRLRLNIHLENWHKEKLYDRVG

SEQ ID NO: 2039356 - protein, 29 aa, Staphylococcus
SILTSIPLWKNQMSIALTLMRQRNAVSAQ

SEQ ID NO: 2039357 - protein, 20 aa, Staphylococcus
SILVKDIYDNYVFLFENEFA

SEQ ID NO: 2039358 - protein, 27 aa, Staphylococcus
SIMGHLDFLIAKARYARAIKGTKPTFH

SEQ ID NO: 2039359 - protein, 19 aa, Staphylococcus
SIMKAIRLVKVLDEAKLLD

SEQ ID NO: 2039360 - protein, 23 aa, Staphylococcus
SIMRKRLDKLGAYLEEKVPGVEI

SEQ ID NO: 2039361 - protein, 17 aa, Staphylococcus
SINALELGVPLTIITES

SEQ ID NO: 2039362 - protein, 25 aa, Staphylococcus
SINDEPGFLWKIWTENESEQEAGGI

SEQ ID NO: 2039363 - protein, 18 aa, Staphylococcus
SINKILIQDGIKKQQIND

SEQ ID NO: 2039364 - protein, 25 aa, Staphylococcus
SINVPEPRLLVVSPYDKTSLSDIER

SEQ ID NO: 2039365 - protein, 17 aa, Staphylococcus
SIPFPKYKHPLADETLR

SEQ ID NO: 2039366 - protein, 24 aa, Staphylococcus
SIPMEGRATITLSLDATSTDLEID

SEQ ID NO: 2039367 - protein, 25 aa, Staphylococcus
SIPMVNRITHDIAFVRYHGRNTQGW

SEQ ID NO: 2039368 - protein, 26 aa, Staphylococcus
SIQDWDIKVDQLFYVSKFDHPNNQLH

SEQ ID NO: 2039369 - protein, 20 aa, Staphylococcus
SIQIQKLVDAIPIFQKYGSE

SEQ ID NO: 2039370 - protein, 24 aa, Staphylococcus
SIQKEGYIQYEFVKEELTDLLAIT

SEQ ID NO: 2039371 - protein, 21 aa, Staphylococcus
SIQPHVRIGIVGKNGSGKSTL

SEQ ID NO: 2039372 - protein, 22 aa, Staphylococcus
SIRDLKVAVIGTGRIGSIVAKI

SEQ ID NO: 2039373 - protein, 28 aa, Staphylococcus
SIRHLLKLKDKLGFHVVITGHEGLNSED

SEQ ID NO: 2039374 - protein, 25 aa, Staphylococcus
SIRKNDEIILLEGFMDVIKSDHAGL

SEQ ID NO: 2039375 - protein, 25 aa, Staphylococcus
SIRKNDEIILLEGFMDVIKSDQAGL

SEQ ID NO: 2039376 - protein, 20 aa, Staphylococcus
SIRNDFRFVPLTQQTYIQQR

SEQ ID NO: 2039377 - protein, 24 aa, Staphylococcus
SISAKADDGAACVAYIGPNGAGHY

SEQ ID NO: 2039378 - protein, 27 aa, Staphylococcus
SISDLELIAIGGFSPLTGFMGEADYKK

SEQ ID NO: 2039379 - protein, 27 aa, Staphylococcus
SISDLELIGIGGFSPLTGFMGVADYTK

SEQ ID NO: 2039380 - protein, 26 aa, Staphylococcus
SISERIFELILKFADYGFPRAHAVSY

SEQ ID NO: 2039381 - protein, 17 aa, Staphylococcus
SISESYCSNLFNRYLNM

SEQ ID NO: 2039382 - protein, 19 aa, Staphylococcus
SISGYPFVWWFATQPEFDG

SEQ ID NO: 2039383 - protein, 18 aa, Staphylococcus
SISKFKVVINNYIEESHG

SEQ ID NO: 2039384 - protein, 18 aa, Staphylococcus
SISLDLMYHLPKQTIDDF

SEQ ID NO: 2039385 - protein, 27 aa, Staphylococcus
SISLEAAELLELFQWKTPEEVVQKKQE

SEQ ID NO: 2039386 - protein, 17 aa, Staphylococcus
SISPELFFQKGPFDGQD

SEQ ID NO: 2039387 - protein, 26 aa, Staphylococcus
SISQMYRPRLHCVRQDFFNIGFEGAK

SEQ ID NO: 2039388 - protein, 25 aa, Staphylococcus
SITDKRADTFISYIEDARRVRQRVM

SEQ ID NO: 2039389 - protein, 18 aa, Staphylococcus
SITEGTIAEWLKNVGDSV

SEQ ID NO: 2039390 - protein, 18 aa, Staphylococcus
SITEGTIAEWLKQVGDSV

SEQ ID NO: 2039391 - protein, 19 aa, Staphylococcus
SITERRPEGTLPYSMPTHC

SEQ ID NO: 2039392 - protein, 21 aa, Staphylococcus
SITIMGGGTFGNWTPTAEFNI

SEQ ID NO: 2039393 - protein, 24 aa, Staphylococcus
SITKEPWYKSEVNSGEFKKMKAES

SEQ ID NO: 2039394 - protein, 26 aa, Staphylococcus
SITKRLGFEKGHEFETPLVEFFYKND

SEQ ID NO: 2039395 - protein, 24 aa, Staphylococcus
SITKRLGFNKGYEFEAPLVEFFYK

SEQ ID NO: 2039396 - protein, 22 aa, Staphylococcus
SITPYEGGIAFAAKPLIEEDFI

SEQ ID NO: 2039397 - protein, 22 aa, Staphylococcus
SITPYEGGIAFAAKPLIEEEFI

SEQ ID NO: 2039398 - protein, 26 aa, Staphylococcus
SITQLLERFLFPSATHGKKIYKLSGG

SEQ ID NO: 2039399 - protein, 24 aa, Staphylococcus
SITQRLGFEKGYQFDAPLVEFFYK

SEQ ID NO: 2039400 - protein, 24 aa, Staphylococcus
SITRKIRKYGVLKAGFTDNKEEIE

SEQ ID NO: 2039401 - protein, 24 aa, Staphylococcus
SITRKIRQHGVLKAGFTDNRDDID

SEQ ID NO: 2039402 - protein, 17 aa, Staphylococcus
SITTRFALEQNRDVYVL

SEQ ID NO: 2039403 - protein, 19 aa, Staphylococcus
SIVDEWNHGLIVLSGQSGV

SEQ ID NO: 2039404 - protein, 18 aa, Staphylococcus
SIVGRFLEHSRIYHFHNN

SEQ ID NO: 2039405 - protein, 23 aa, Staphylococcus
SIVGRFLEHSRIYYFHNNGDEKI

SEQ ID NO: 2039406 - protein, 24 aa, Staphylococcus
SIVGRLLEHSRIYYFYNNGDERIY

SEQ ID NO: 2039407 - protein, 24 aa, Staphylococcus
SIVGRLLEHSRIYYFYNNGDQRIY

SEQ ID NO: 2039408 - protein, 19 aa, Staphylococcus
SIVSRWIKKLCQMGYITSK

SEQ ID NO: 2039409 - protein, 31 aa, Staphylococcus
SIYFEGMPSINLFKQCYKALINKKKMNLATE

SEQ ID NO: 2039410 - protein, 18 aa, Staphylococcus
SIYGGSFEDEFSLKAFNL

SEQ ID NO: 2039411 - protein, 18 aa, Staphylococcus
SIYPPGADMHSFEPTQKE

SEQ ID NO: 2039412 - protein, 18 aa, Staphylococcus
SIYSLRYDEMQEWLVEHG

SEQ ID NO: 2039413 - protein, 23 aa, Staphylococcus
SIYSLRYDEMQNWLIEHGQQKFR

SEQ ID NO: 2039414 - protein, 20 aa, Staphylococcus
SIYTAIEMLKTIKTKPDAIF

SEQ ID NO: 2039415 - protein, 27 aa, Staphylococcus
SKACLANLLRICARYDNLDIIEDAYGI

SEQ ID NO: 2039416 - protein, 24 aa, Staphylococcus
SKAFGVNIPERWSIAQLYQSALED

SEQ ID NO: 2039417 - protein, 20 aa, Staphylococcus
SKAIPRVNLTEVYRQQDGSS

SEQ ID NO: 2039418 - protein, 23 aa, Staphylococcus
SKAISDKMYQSWFNQISNQKSQF

SEQ ID NO: 2039419 - protein, 19 aa, Staphylococcus
SKALIRHILQYAEDHQIEK

SEQ ID NO: 2039420 - protein, 17 aa, Staphylococcus
SKALKFVGEHELTQQQE

SEQ ID NO: 2039421 - protein, 27 aa, Staphylococcus
SKALRIVWPDLIFPESEVAFIVLHFGG

SEQ ID NO: 2039422 - protein, 22 aa, Staphylococcus
SKARFEFRWIDQFNLALDPDRA

SEQ ID NO: 2039423 - protein, 22 aa, Staphylococcus
SKARFEFRWIDQFNLSLDPDRA

SEQ ID NO: 2039424 - protein, 21 aa, Staphylococcus
SKAVECYGIVGMASRQQVRDG

SEQ ID NO: 2039425 - protein, 23 aa, Staphylococcus
SKAVESYGIVGMASRQQVRDGIA

SEQ ID NO: 2039426 - protein, 19 aa, Staphylococcus
SKAWAHRVYPDLSIEEAYN

SEQ ID NO: 2039427 - protein, 19 aa, Staphylococcus
SKAYLWKQLVQRLKTLQLN

SEQ ID NO: 2039428 - protein, 18 aa, Staphylococcus
SKDAISILEDLSIDIDED

SEQ ID NO: 2039429 - protein, 19 aa, Staphylococcus
SKDALRFSKVQALRNGEHA

SEQ ID NO: 2039430 - protein, 19 aa, Staphylococcus
SKDCFKISAILSKLRIEYN

SEQ ID NO: 2039431 - protein, 25 aa, Staphylococcus
SKDDLFDEVCRFMVAEDHISTSLIQ

SEQ ID NO: 2039432 - protein, 24 aa, Staphylococcus
SKDEVTELISAFGSVIEVDEEYLH

SEQ ID NO: 2039433 - protein, 27 aa, Staphylococcus
SKDFKKYGFKFMGPVTMFSFLEAAGLY

SEQ ID NO: 2039434 - protein, 25 aa, Staphylococcus
SKDGQYRGLATWKYDEERQTLVGTI

SEQ ID NO: 2039435 - protein, 19 aa, Staphylococcus
SKDGYKIFVHESERKAEPR

SEQ ID NO: 2039436 - protein, 18 aa, Staphylococcus
SKDIASWKTLTPEEQDTF

SEQ ID NO: 2039437 - protein, 22 aa, Staphylococcus
SKDLDVDFIFKARKPMGKAFKK

SEQ ID NO: 2039438 - protein, 21 aa, Staphylococcus
SKDLDVDFIFKARKPVGKAFK

SEQ ID NO: 2039439 - protein, 23 aa, Staphylococcus
SKDLEVDFIFKARKPMGKAFIKA

SEQ ID NO: 2039440 - protein, 27 aa, Staphylococcus
SKDLKAYGFKFLGPVTVFSFMEAAGLY

SEQ ID NO: 2039441 - protein, 27 aa, Staphylococcus
SKDLKKYGFKFLGPITVFSFLEAAGLY

SEQ ID NO: 2039442 - protein, 28 aa, Staphylococcus
SKDLKKYGFKFLGPVTVFSFLEAAGIYD

SEQ ID NO: 2039443 - protein, 28 aa, Staphylococcus
SKDLKKYGFKFLGPVTVFSFLEAAGLYD

SEQ ID NO: 2039444 - protein, 28 aa, Staphylococcus
SKDLKSYGFKFLGPVTVFSFLEASGMYD

SEQ ID NO: 2039445 - protein, 23 aa, Staphylococcus
SKDLKYDLYHILFEMVRQHNNVA

SEQ ID NO: 2039446 - protein, 21 aa, Staphylococcus
SKDLRKLLADHFVMTTLTTVV

SEQ ID NO: 2039447 - protein, 17 aa, Staphylococcus
SKDMASFVKEADIVVSA

SEQ ID NO: 2039448 - protein, 27 aa, Staphylococcus
SKDNDLAWLIEMMLPRMQSHQVLSEDF

SEQ ID NO: 2039449 - protein, 25 aa, Staphylococcus
SKDNPKRDWYIWADPKDDGSEPNNW

SEQ ID NO: 2039450 - protein, 25 aa, Staphylococcus
SKDNPKRDWYIWADPKPDGSEPNNW

SEQ ID NO: 2039451 - protein, 24 aa, Staphylococcus
SKDNPKREWYIWKDPKEDGSEPNN

SEQ ID NO: 2039452 - protein, 28 aa, Staphylococcus
SKDPLFAMCAIDAIGIYYTTGLNILILS

SEQ ID NO: 2039453 - protein, 19 aa, Staphylococcus
SKDPQFWIGGLKQNGVYKA

SEQ ID NO: 2039454 - protein, 26 aa, Staphylococcus
SKDSEHYGLWAFKRVWGTYLSEKIGE

SEQ ID NO: 2039455 - protein, 19 aa, Staphylococcus
SKDTYEWLQPLLKRKFPEH

SEQ ID NO: 2039456 - protein, 24 aa, Staphylococcus
SKDYLWSVLIRKLNEWNLNNEQYL

SEQ ID NO: 2039457 - protein, 23 aa, Staphylococcus
SKEAFNIYGALSMANAGPHTNGS

SEQ ID NO: 2039458 - protein, 20 aa, Staphylococcus
SKEDLVYGRTLILFSEKDTI

SEQ ID NO: 2039459 - protein, 20 aa, Staphylococcus
SKEGLPTLLDLVDHGVHVKA

SEQ ID NO: 2039460 - protein, 21 aa, Staphylococcus
SKEGRYAYSLPQSDINNKSFE

SEQ ID NO: 2039461 - protein, 18 aa, Staphylococcus
SKEIATCSEFKPYYLTKA

SEQ ID NO: 2039462 - protein, 19 aa, Staphylococcus
SKEIATCSEFKPYYLTKAL

SEQ ID NO: 2039463 - protein, 21 aa, Staphylococcus
SKEITAAFAGEVFEAHKEGCA

SEQ ID NO: 2039464 - protein, 20 aa, Staphylococcus
SKEKLRTNVGMVFQQPNPFP

SEQ ID NO: 2039465 - protein, 18 aa, Staphylococcus
SKELAQWVQEDKIKTKTS

SEQ ID NO: 2039466 - protein, 27 aa, Staphylococcus
SKELFKAALENKVDWIIAVHTTGRYSK

SEQ ID NO: 2039467 - protein, 19 aa, Staphylococcus
SKEPFIIRKTLKGLSLKDV

SEQ ID NO: 2039468 - protein, 18 aa, Staphylococcus
SKEQLKLFVYDYGMNNII

SEQ ID NO: 2039469 - protein, 17 aa, Staphylococcus
SKERLNYGSPWFQLSNL

SEQ ID NO: 2039470 - protein, 24 aa, Staphylococcus
SKETFKSLAEIGVQYVDVSGRGGT

SEQ ID NO: 2039471 - protein, 19 aa, Staphylococcus
SKETLDYFCDAMIQIANEA

SEQ ID NO: 2039472 - protein, 51 aa, Staphylococcus
SKETLEIYAPLAHRLGINTIKWELEDIALRYIDGVQYFRIVNLMKKKRSER

SEQ ID NO: 2039473 - protein, 35 aa, Staphylococcus
SKETLEIYAPLAHRLGINTIKWELEDIALRYIDSV

SEQ ID NO: 2039474 - protein, 34 aa, Staphylococcus
SKETLEIYAPLAHRLGINTIKWELEDTALRYTDS

SEQ ID NO: 2039475 - protein, 21 aa, Staphylococcus
SKETYKSLLNVGVTYVDVSGR

SEQ ID NO: 2039476 - protein, 26 aa, Staphylococcus
SKFGLSIKHGLAIQGIEKVRDTQKLN

SEQ ID NO: 2039477 - protein, 25 aa, Staphylococcus
SKFGLSIKHGLALEAINKVKASKHL

SEQ ID NO: 2039478 - protein, 19 aa, Staphylococcus
SKFGLSIRHGLAIEAVNKV

SEQ ID NO: 2039479 - protein, 20 aa, Staphylococcus
SKFGLSIRHGLAIQAVEKVK

SEQ ID NO: 2039480 - protein, 22 aa, Staphylococcus
SKFQMKREWLKIPIMTLDRELE

SEQ ID NO: 2039481 - protein, 35 aa, Staphylococcus
SKFRDEQRPRFGLLRGREFIMKDAYSFHADEASLD

SEQ ID NO: 2039482 - protein, 23 aa, Staphylococcus
SKFSALRFDEDVVFCEEHTFVTR

SEQ ID NO: 2039483 - protein, 26 aa, Staphylococcus
SKFTTCGFNNCIFESVHFYKNQYKDT

SEQ ID NO: 2039484 - protein, 17 aa, Staphylococcus
SKGGKLVDFVRYEVGEG

SEQ ID NO: 2039485 - protein, 18 aa, Staphylococcus
SKGGKLVDFVRYEVGEGM

SEQ ID NO: 2039486 - protein, 19 aa, Staphylococcus
SKGGLKLMMETMSMEYAQF

SEQ ID NO: 2039487 - protein, 25 aa, Staphylococcus
SKGHAISSFCDKSNIDLAQVICFGD

SEQ ID NO: 2039488 - protein, 18 aa, Staphylococcus
SKGIKVYLADVYKTTPQL

SEQ ID NO: 2039489 - protein, 20 aa, Staphylococcus
SKGIRRLGVVMKRNGIHHIT

SEQ ID NO: 2039490 - protein, 27 aa, Staphylococcus
SKGIYKFKFEILQAIETVIPYKSIYEK

SEQ ID NO: 2039491 - protein, 36 aa, Staphylococcus
SKGIYKFRYIIIEAIKKVFKFESVFEKMRFKDTEYT

SEQ ID NO: 2039492 - protein, 29 aa, Staphylococcus
SKGIYKFRYNVIEAIQQVFPFKSIYEKMR

SEQ ID NO: 2039493 - protein, 20 aa, Staphylococcus
SKGKMALRVYPPWETGLNNT

SEQ ID NO: 2039494 - protein, 21 aa, Staphylococcus
SKGKYLFELKIDLDNLYQELG

SEQ ID NO: 2039495 - protein, 21 aa, Staphylococcus
SKGKYLFELKIDLENLYNELG

SEQ ID NO: 2039496 - protein, 18 aa, Staphylococcus
SKGLELFYRPIFNPDTMS

SEQ ID NO: 2039497 - protein, 17 aa, Staphylococcus
SKGNHALIIIKKELLSR

SEQ ID NO: 2039498 - protein, 18 aa, Staphylococcus
SKGSFKRAIGHLYKHKII

SEQ ID NO: 2039499 - protein, 18 aa, Staphylococcus
SKGSFPQDVNFYISKHTG

SEQ ID NO: 2039500 - protein, 19 aa, Staphylococcus
SKGSFPQEVNFFISEETGI

SEQ ID NO: 2039501 - protein, 18 aa, Staphylococcus
SKGSFPQEVNFYIKDETG

SEQ ID NO: 2039502 - protein, 18 aa, Staphylococcus
SKGVSFIYISHRMEEIFN

SEQ ID NO: 2039503 - protein, 28 aa, Staphylococcus
SKGYNMSGFRVGFAVGNKDMIQALKKYQ

SEQ ID NO: 2039504 - protein, 28 aa, Staphylococcus
SKGYNMSGFRVGFAVGNKEMIQALKKYQ

SEQ ID NO: 2039505 - protein, 18 aa, Staphylococcus
SKHFTYCTKIIYQAYKEG

SEQ ID NO: 2039506 - protein, 19 aa, Staphylococcus
SKHGIALDEVNEFLKELKA

SEQ ID NO: 2039507 - protein, 18 aa, Staphylococcus
SKHGIALNDVNDFIEMLS

SEQ ID NO: 2039508 - protein, 18 aa, Staphylococcus
SKHGIALNEVNHFIEQIQ

SEQ ID NO: 2039509 - protein, 20 aa, Staphylococcus
SKHQCTWWAYKRRVQLGKPV

SEQ ID NO: 2039510 - protein, 18 aa, Staphylococcus
SKHVFDQRILPLLMDDDS

SEQ ID NO: 2039511 - protein, 34 aa, Staphylococcus
SKIDIPRVRFTTSHPWDFTDRMIQVIAQGGNIVP

SEQ ID NO: 2039512 - protein, 24 aa, Staphylococcus
SKIGKDDFSSFCELKELNAVLMDN

SEQ ID NO: 2039513 - protein, 25 aa, Staphylococcus
SKIHFSQEGYLMWIEDFENNIIQRR

SEQ ID NO: 2039514 - protein, 23 aa, Staphylococcus
SKIKAGDIIKNMAPIVGGKGGGR

SEQ ID NO: 2039515 - protein, 20 aa, Staphylococcus
SKIKNLKMGYLTQQMTLDSN

SEQ ID NO: 2039516 - protein, 20 aa, Staphylococcus
SKIKNLKMGYLTQQMTLNST

SEQ ID NO: 2039517 - protein, 23 aa, Staphylococcus
SKIKSHVVFLGFDYHYRGNSKYL

SEQ ID NO: 2039518 - protein, 20 aa, Staphylococcus
SKIKSQCELPLTGAGVVNTL

SEQ ID NO: 2039519 - protein, 22 aa, Staphylococcus
SKILTRLVKVGVISASSGAKGG

SEQ ID NO: 2039520 - protein, 19 aa, Staphylococcus
SKIQDLDLIKSYQNIEKQI

SEQ ID NO: 2039521 - protein, 25 aa, Staphylococcus
SKIQFIYKILHEIHKSSSEAFKSLI

SEQ ID NO: 2039522 - protein, 19 aa, Staphylococcus
SKISINENIIRLESKNEEL

SEQ ID NO: 2039523 - protein, 20 aa, Staphylococcus
SKISSNWPNNVSVFSNQVET

SEQ ID NO: 2039524 - protein, 21 aa, Staphylococcus
SKKAGVKHFVMVSTYDSSREA

SEQ ID NO: 2039525 - protein, 21 aa, Staphylococcus
SKKDFRLIIVGGDCPKVKAKP

SEQ ID NO: 2039526 - protein, 22 aa, Staphylococcus
SKKDLIHFLDFVIDNQVFERDV

SEQ ID NO: 2039527 - protein, 24 aa, Staphylococcus
SKKDVKRLIFVAAPGIYDELPAKF

SEQ ID NO: 2039528 - protein, 22 aa, Staphylococcus
SKKEFRLILVGGDCPKVKAKPC

SEQ ID NO: 2039529 - protein, 22 aa, Staphylococcus
SKKETIDFFVAKGIVDRIAEKL

SEQ ID NO: 2039530 - protein, 21 aa, Staphylococcus
SKKFVEFGCDGIIIFDEDETT

SEQ ID NO: 2039531 - protein, 26 aa, Staphylococcus
SKKGVKLLWASCRELFNVIQADEIGA

SEQ ID NO: 2039532 - protein, 21 aa, Staphylococcus
SKKGVKLLWASCREVINVIQA

SEQ ID NO: 2039533 - protein, 24 aa, Staphylococcus
SKKKAAEKIGMISEIVHLEETATE

SEQ ID NO: 2039534 - protein, 17 aa, Staphylococcus
SKKKYNVFFNIEKYIGR

SEQ ID NO: 2039535 - protein, 18 aa, Staphylococcus
SKKLSGDAIKVFEELSAD

SEQ ID NO: 2039536 - protein, 22 aa, Staphylococcus
SKKMCVELAKTIYKHGYLTGIY

SEQ ID NO: 2039537 - protein, 25 aa, Staphylococcus
SKKVVKEALVFYNLISNLIKEQEFL

SEQ ID NO: 2039538 - protein, 20 aa, Staphylococcus
SKKYKGAHGLMPTDFKLYQG

SEQ ID NO: 2039539 - protein, 23 aa, Staphylococcus
SKKYKVLHEIAGKTMIEHVVENV

SEQ ID NO: 2039540 - protein, 26 aa, Staphylococcus
SKLAAKRKLSIFLYSINDFTDFEATT

SEQ ID NO: 2039541 - protein, 28 aa, Staphylococcus
SKLAAKRKLSVFLYSVNDFSDFNATTQS

SEQ ID NO: 2039542 - protein, 27 aa, Staphylococcus
SKLAAKRKLSVFLYSVNDFTQFNADTQ

SEQ ID NO: 2039543 - protein, 27 aa, Staphylococcus
SKLAAKRKLSVFLYSVNDLTEFDATTQ

SEQ ID NO: 2039544 - protein, 25 aa, Staphylococcus
SKLAAKRRLSIFLYSVNDFTNFHAE

SEQ ID NO: 2039545 - protein, 26 aa, Staphylococcus
SKLAAMMEGCYVLRAIEMVEQGYKPD

SEQ ID NO: 2039546 - protein, 25 aa, Staphylococcus
SKLAELMPWNMAIQDYLFKTIQELN

SEQ ID NO: 2039547 - protein, 25 aa, Staphylococcus
SKLEALRAQLNFNYVADGMIMDDIN

SEQ ID NO: 2039548 - protein, 22 aa, Staphylococcus
SKLEPLRTFIKGVSFMHDTKTH

SEQ ID NO: 2039549 - protein, 31 aa, Staphylococcus
SKLESAKRFKRWVTSKVLPAIRKHGIYATDS

SEQ ID NO: 2039550 - protein, 20 aa, Staphylococcus
SKLFIPLTIGGGISSTDDIS

SEQ ID NO: 2039551 - protein, 19 aa, Staphylococcus
SKLFVSSQCDSLDDYLQCF

SEQ ID NO: 2039552 - protein, 21 aa, Staphylococcus
SKLIAFSFKYHGVISEQYIDR

SEQ ID NO: 2039553 - protein, 26 aa, Staphylococcus
SKLKEQRYAMPILLAISHIHQLLIRE

SEQ ID NO: 2039554 - protein, 21 aa, Staphylococcus
SKLKGNYLISRNVHKSVFHGL

SEQ ID NO: 2039555 - protein, 25 aa, Staphylococcus
SKLKLDIPKCHRIVYTPHQMEWERL

SEQ ID NO: 2039556 - protein, 19 aa, Staphylococcus
SKLKMHHMDCYRLEGMEED

SEQ ID NO: 2039557 - protein, 17 aa, Staphylococcus
SKLKRLFRRTKASINEM

SEQ ID NO: 2039558 - protein, 25 aa, Staphylococcus
SKLKSIVGPFAYYIKGFEMLPQMKA

SEQ ID NO: 2039559 - protein, 24 aa, Staphylococcus
SKLKTFVGPFAYYIKGMEMLPQMT

SEQ ID NO: 2039560 - protein, 20 aa, Staphylococcus
SKLLENQQVLALESNKKIQK

SEQ ID NO: 2039561 - protein, 22 aa, Staphylococcus
SKLLENQQVLALESNKKIQKLE

SEQ ID NO: 2039562 - protein, 25 aa, Staphylococcus
SKLLLPSLRISYMVLPISLINIYQE

SEQ ID NO: 2039563 - protein, 22 aa, Staphylococcus
SKLLNRFNFDFHFIDIEQDNVQ

SEQ ID NO: 2039564 - protein, 24 aa, Staphylococcus
SKLRKKYLDSFREGFKKQLENTKV

SEQ ID NO: 2039565 - protein, 27 aa, Staphylococcus
SKLSDRLRSRFEWGLIVDITPPDYETR

SEQ ID NO: 2039566 - protein, 22 aa, Staphylococcus
SKLSGMILGGYVIYAAERVEAG

SEQ ID NO: 2039567 - protein, 22 aa, Staphylococcus
SKLTCIHINHGLRQASIEEEAF

SEQ ID NO: 2039568 - protein, 17 aa, Staphylococcus
SKLWRQGVNEVKADYPD

SEQ ID NO: 2039569 - protein, 25 aa, Staphylococcus
SKLYFEGVSVFDMLDIIDNITLDSI

SEQ ID NO: 2039570 - protein, 20 aa, Staphylococcus
SKLYLSAYIDLYSSEIMSYS

SEQ ID NO: 2039571 - protein, 24 aa, Staphylococcus
SKMFFSCNAIKGSNVLTSTIDEAY

SEQ ID NO: 2039572 - protein, 28 aa, Staphylococcus
SKMKHYFSIKGEEIFKEDLRNKTVTIKE

SEQ ID NO: 2039573 - protein, 22 aa, Staphylococcus
SKMKMCKPVKITVKETGEILYF

SEQ ID NO: 2039574 - protein, 18 aa, Staphylococcus
SKMKWIFKFEIATKDNVH

SEQ ID NO: 2039575 - protein, 25 aa, Staphylococcus
SKMNADYEKLLGLKDVYKNKNIEVL

SEQ ID NO: 2039576 - protein, 24 aa, Staphylococcus
SKMPETINFFSWLQHMADTEQIND

SEQ ID NO: 2039577 - protein, 17 aa, Staphylococcus
SKMTGIKERHWADEDQD

SEQ ID NO: 2039578 - protein, 18 aa, Staphylococcus
SKMTGIKERHWANEDQDT

SEQ ID NO: 2039579 - protein, 20 aa, Staphylococcus
SKNDFGLPRVWLRTARYLND

SEQ ID NO: 2039580 - protein, 20 aa, Staphylococcus
SKNHYDGCVITHGTDTLEET

SEQ ID NO: 2039581 - protein, 23 aa, Staphylococcus
SKNISRIGSTFGKTNRVIIDTDD

SEQ ID NO: 2039582 - protein, 23 aa, Staphylococcus
SKNKRFIGLVSQYLFLQTKNNYN

SEQ ID NO: 2039583 - protein, 18 aa, Staphylococcus
SKNLKLGYLTQQMTLDTN

SEQ ID NO: 2039584 - protein, 18 aa, Staphylococcus
SKNLKPVVVITAQHREML

SEQ ID NO: 2039585 - protein, 21 aa, Staphylococcus
SKNLLECLGYSSSKANQKVRK

SEQ ID NO: 2039586 - protein, 18 aa, Staphylococcus
SKNQCHYMTDGSCWCVRA

SEQ ID NO: 2039587 - protein, 20 aa, Staphylococcus
SKNQKSIVVQHDWDGQHHQF

SEQ ID NO: 2039588 - protein, 23 aa, Staphylococcus
SKNTCAFNDYLDAAGVEFDHRPS

SEQ ID NO: 2039589 - protein, 26 aa, Staphylococcus
SKNVPFRTAHEIVGKIVLDCINKGIY

SEQ ID NO: 2039590 - protein, 25 aa, Staphylococcus
SKNWLHDWQHDCGYTIKYVEHSNDV

SEQ ID NO: 2039591 - protein, 22 aa, Staphylococcus
SKPFSRNIIHSMPAYINEEENY

SEQ ID NO: 2039592 - protein, 23 aa, Staphylococcus
SKPKFHNKLTFSDEVIEKIAGIA

SEQ ID NO: 2039593 - protein, 20 aa, Staphylococcus
SKPKWSKLINKLSVPIEANY

SEQ ID NO: 2039594 - protein, 19 aa, Staphylococcus
SKPMKGTMPRSDVKQQDQY

SEQ ID NO: 2039595 - protein, 18 aa, Staphylococcus
SKPNIMPVWSDYKSAEKV

SEQ ID NO: 2039596 - protein, 21 aa, Staphylococcus
SKPNLTFGIFFNQRTNPLYQK

SEQ ID NO: 2039597 - protein, 24 aa, Staphylococcus
SKPRTRIPLSDDILTEFEKIRRGH

SEQ ID NO: 2039598 - protein, 17 aa, Staphylococcus
SKQIFDLILKFADYGFP

SEQ ID NO: 2039599 - protein, 26 aa, Staphylococcus
SKQILEIGTAIGYSAMHFASVNQDIQ

SEQ ID NO: 2039600 - protein, 24 aa, Staphylococcus
SKQKRSRNLLDFADYEHFALQILT

SEQ ID NO: 2039601 - protein, 23 aa, Staphylococcus
SKQLLEELNHVFQVENKTFKTIE

SEQ ID NO: 2039602 - protein, 24 aa, Staphylococcus
SKQLSEYILTFILDDHKKMETSFI

SEQ ID NO: 2039603 - protein, 20 aa, Staphylococcus
SKQPLEYPSCGSVFQRPPGH

SEQ ID NO: 2039604 - protein, 22 aa, Staphylococcus
SKQYKGDIYIGAGTVLTVESCQ

SEQ ID NO: 2039605 - protein, 22 aa, Staphylococcus
SKQYKYAFNLAEIDAEYFPLNL

SEQ ID NO: 2039606 - protein, 23 aa, Staphylococcus
SKRDARASYRISEFSEIDYMISD

SEQ ID NO: 2039607 - protein, 21 aa, Staphylococcus
SKRFVKNPMDIVNVGDIVDVW

SEQ ID NO: 2039608 - protein, 17 aa, Staphylococcus
SKRGIEFPGGKVEINET

SEQ ID NO: 2039609 - protein, 19 aa, Staphylococcus
SKRGLEMGRVKYAPLDVAD

SEQ ID NO: 2039610 - protein, 21 aa, Staphylococcus
SKRIPRVNLTEVYRQQDGSSI

SEQ ID NO: 2039611 - protein, 18 aa, Staphylococcus
SKRLLTWDSSNKQLYMYQ

SEQ ID NO: 2039612 - protein, 31 aa, Staphylococcus
SKRLMVMKQSFKKVVIKNCENMKDSADALSN

SEQ ID NO: 2039613 - protein, 20 aa, Staphylococcus
SKRNIGMVFQDFALWPHMSV

SEQ ID NO: 2039614 - protein, 20 aa, Staphylococcus
SKRVLPIYQHAFESFDRHYT

SEQ ID NO: 2039615 - protein, 19 aa, Staphylococcus
SKRYKVLHEVAGKPMIEHV

SEQ ID NO: 2039616 - protein, 19 aa, Staphylococcus
SKRYVAAHHPFTSPKKEDI

SEQ ID NO: 2039617 - protein, 19 aa, Staphylococcus
SKSDKEFGYDAYSYDEIDN

SEQ ID NO: 2039618 - protein, 24 aa, Staphylococcus
SKSDKRFSYTYMHLLNEIYVDDAL

SEQ ID NO: 2039619 - protein, 25 aa, Staphylococcus
SKSDPKLCVIRAIPTSIKLMNSDSE

SEQ ID NO: 2039620 - protein, 23 aa, Staphylococcus
SKSEDFKVGGLFNKKKKKEEEQE

SEQ ID NO: 2039621 - protein, 23 aa, Staphylococcus
SKSESKLTLLALFEKLLSISSYH

SEQ ID NO: 2039622 - protein, 19 aa, Staphylococcus
SKSFAKRLMEKYDIPTADY

SEQ ID NO: 2039623 - protein, 20 aa, Staphylococcus
SKSHGFRFIGAGGIGALRTI

SEQ ID NO: 2039624 - protein, 26 aa, Staphylococcus
SKSHIKHYCEIEGVIDYLLIRVPMNT

SEQ ID NO: 2039625 - protein, 26 aa, Staphylococcus
SKSISFSHEFMFARPVHQTRDMIKHH

SEQ ID NO: 2039626 - protein, 19 aa, Staphylococcus
SKSLARFISTIRSFHQFAL

SEQ ID NO: 2039627 - protein, 24 aa, Staphylococcus
SKSLFPSCRIAYLVLPKKLLAQYE

SEQ ID NO: 2039628 - protein, 28 aa, Staphylococcus
SKSLKSYGFKFLGPVTVFSFLEAAGLYN

SEQ ID NO: 2039629 - protein, 24 aa, Staphylococcus
SKSLKVAHGLQVERLLRQNEEIKN

SEQ ID NO: 2039630 - protein, 22 aa, Staphylococcus
SKSLSGNIGVMFADDELIISAI

SEQ ID NO: 2039631 - protein, 21 aa, Staphylococcus
SKSMVKRGYSKRVTSPKREVK

SEQ ID NO: 2039632 - protein, 20 aa, Staphylococcus
SKSNFWLQLQADVFNAEVTP

SEQ ID NO: 2039633 - protein, 20 aa, Staphylococcus
SKSTFYGCVNEIVNVYMDAQ

SEQ ID NO: 2039634 - protein, 22 aa, Staphylococcus
SKSVDGFILLYSLKDDPIEHLL

SEQ ID NO: 2039635 - protein, 21 aa, Staphylococcus
SKSVYIKASFNTLIELQAIPN

SEQ ID NO: 2039636 - protein, 19 aa, Staphylococcus
SKSWLSSAIKAINDDNEKR

SEQ ID NO: 2039637 - protein, 18 aa, Staphylococcus
SKTEAYFDRVLLLNKTLR

SEQ ID NO: 2039638 - protein, 22 aa, Staphylococcus
SKTEYRGREATDFKEEDIELFQ

SEQ ID NO: 2039639 - protein, 20 aa, Staphylococcus
SKTIPRVNLTEVYRQQDGSS

SEQ ID NO: 2039640 - protein, 22 aa, Staphylococcus
SKTKELFGNIIGLQYSDKNENA

SEQ ID NO: 2039641 - protein, 17 aa, Staphylococcus
SKTKGLIGNIMKIKPVG

SEQ ID NO: 2039642 - protein, 23 aa, Staphylococcus
SKTLAEQGFNIIIDYNQSKEAAE

SEQ ID NO: 2039643 - protein, 23 aa, Staphylococcus
SKTLKVTPRYTFESIQQTFQVIQ

SEQ ID NO: 2039644 - protein, 27 aa, Staphylococcus
SKVALYGIVYKLGFDNALVPNVYKSFR

SEQ ID NO: 2039645 - protein, 17 aa, Staphylococcus
SKVATFCVATERNYKDE

SEQ ID NO: 2039646 - protein, 23 aa, Staphylococcus
SKVAYDEVMRFGKYHPDYQKVML

SEQ ID NO: 2039647 - protein, 29 aa, Staphylococcus
SKVCLANLLRICARYDNLDIIEDAYGINL

SEQ ID NO: 2039648 - protein, 17 aa, Staphylococcus
SKVEKWFYESAPKRVQR

SEQ ID NO: 2039649 - protein, 21 aa, Staphylococcus
SKVHYPISMLYTYLTHNNNGG

SEQ ID NO: 2039650 - protein, 17 aa, Staphylococcus
SKVIDIITAPNVSSAQK

SEQ ID NO: 2039651 - protein, 20 aa, Staphylococcus
SKVIFCEADDWKPFYESNQS

SEQ ID NO: 2039652 - protein, 19 aa, Staphylococcus
SKVIPRVNLTEVYRQQDGS

SEQ ID NO: 2039653 - protein, 20 aa, Staphylococcus
SKVQPCCFKLYNDPFDIVYV

SEQ ID NO: 2039654 - protein, 21 aa, Staphylococcus
SKWLYYGEMSIDDWASMSIED

SEQ ID NO: 2039655 - protein, 21 aa, Staphylococcus
SKWSFEPLMRLFKTQVLTKKF

SEQ ID NO: 2039656 - protein, 18 aa, Staphylococcus
SKYDRLNNIISFEQHKVW

SEQ ID NO: 2039657 - protein, 17 aa, Staphylococcus
SKYFGKECIVTGPREAA

SEQ ID NO: 2039658 - protein, 21 aa, Staphylococcus
SKYGSNVDKLFAIAQLTNEKD

SEQ ID NO: 2039659 - protein, 27 aa, Staphylococcus
SKYIADVGCGYGPIGLTIAKVSPHHQL

SEQ ID NO: 2039660 - protein, 25 aa, Staphylococcus
SKYKEILISGLRHYLVRSTRQGIMK

SEQ ID NO: 2039661 - protein, 21 aa, Staphylococcus
SKYMTELPCETCHGKRLSREA

SEQ ID NO: 2039662 - protein, 21 aa, Staphylococcus
SKYMTELPCETCYGKRLSKEV

SEQ ID NO: 2039663 - protein, 19 aa, Staphylococcus
SKYPYTFIHMIGFSRGGLQ

SEQ ID NO: 2039664 - protein, 20 aa, Staphylococcus
SKYQLFKNLFRNFVEQSQIN

SEQ ID NO: 2039665 - protein, 17 aa, Staphylococcus
SKYVALHPGDIIATGTP

SEQ ID NO: 2039666 - protein, 30 aa, Staphylococcus
SKYVKKYNCLYLRVDPYLPYQYLNHDGEII

SEQ ID NO: 2039667 - protein, 26 aa, Staphylococcus
SLADFKSLCFHVPFTKMGKKALDSIL

SEQ ID NO: 2039668 - protein, 18 aa, Staphylococcus
SLAMCLRESLNQSVAAEE

SEQ ID NO: 2039669 - protein, 18 aa, Staphylococcus
SLANEWAKHNIRVNTIAP

SEQ ID NO: 2039670 - protein, 25 aa, Staphylococcus
SLANGDRGIIMLVFDMEVIELKEIY

SEQ ID NO: 2039671 - protein, 18 aa, Staphylococcus
SLCGKTYLFRYQPTAFDY

SEQ ID NO: 2039672 - protein, 19 aa, Staphylococcus
SLCKEAKTIGMPLAEIKEI

SEQ ID NO: 2039673 - protein, 22 aa, Staphylococcus
SLDDFYFGASFRVIQNKTLEDG

SEQ ID NO: 2039674 - protein, 18 aa, Staphylococcus
SLDHKFKPLGNNEFVTVP

SEQ ID NO: 2039675 - protein, 20 aa, Staphylococcus
SLDINLSYNSFYMITIFKNE

SEQ ID NO: 2039676 - protein, 24 aa, Staphylococcus
SLDIPKHEITVFTGRSGSGKSSLV

SEQ ID NO: 2039677 - protein, 22 aa, Staphylococcus
SLDKRECLVIELITDTGDTYFG

SEQ ID NO: 2039678 - protein, 25 aa, Staphylococcus
SLDNLEDWYRKGAFAVGIGSALMKN

SEQ ID NO: 2039679 - protein, 24 aa, Staphylococcus
SLDNVKIKDCVFKNVSINNSAISE

SEQ ID NO: 2039680 - protein, 21 aa, Staphylococcus
SLDPKIFVPLIKNLKENNDLV

SEQ ID NO: 2039681 - protein, 19 aa, Staphylococcus
SLDRFLRVQLAAYKVPKKY

SEQ ID NO: 2039682 - protein, 22 aa, Staphylococcus
SLEAFKETHGLVMISIEDLEKY

SEQ ID NO: 2039683 - protein, 25 aa, Staphylococcus
SLEDFKFNELMVAIQSPFLIDEDDD

SEQ ID NO: 2039684 - protein, 17 aa, Staphylococcus
SLEDFKQSLELALEMDI

SEQ ID NO: 2039685 - protein, 19 aa, Staphylococcus
SLEEAFCQAVASGTATAFN

SEQ ID NO: 2039686 - protein, 24 aa, Staphylococcus
SLEEAREKLLLSIGNYNAAVADEI

SEQ ID NO: 2039687 - protein, 23 aa, Staphylococcus
SLEEKKKSFELLKQNQDSINHLK

SEQ ID NO: 2039688 - protein, 24 aa, Staphylococcus
SLEGFDGVLIPGGFSFGDYLRSGA

SEQ ID NO: 2039689 - protein, 29 aa, Staphylococcus
SLEIFNYKKVRLFKEWKTEKGIIDYLLTF

SEQ ID NO: 2039690 - protein, 18 aa, Staphylococcus
SLEIWVDNKYVFPSDKKT

SEQ ID NO: 2039691 - protein, 22 aa, Staphylococcus
SLEKSQAFEFIIEGDTLIPPFI

SEQ ID NO: 2039692 - protein, 23 aa, Staphylococcus
SLELEKGQILGLIGPSGSGKTTA

SEQ ID NO: 2039693 - protein, 26 aa, Staphylococcus
SLENGKLVLCDRYIDSSLAYQGYARG

SEQ ID NO: 2039694 - protein, 19 aa, Staphylococcus
SLEQNVFLLTEFIQKNQKD

SEQ ID NO: 2039695 - protein, 26 aa, Staphylococcus
SLESAKARGAKIYAEIVGYGTTGDAY

SEQ ID NO: 2039696 - protein, 24 aa, Staphylococcus
SLESAKARGAQIYAEVVGYGSTGD

SEQ ID NO: 2039697 - protein, 35 aa, Staphylococcus
SLESSFNIARKMGYFDIPKDLLIPISEVENYPKNE

SEQ ID NO: 2039698 - protein, 18 aa, Staphylococcus
SLESSFNIARKMGYFDIS

SEQ ID NO: 2039699 - protein, 24 aa, Staphylococcus
SLEWDKEALSLLGITESQLPEIVP

SEQ ID NO: 2039700 - protein, 20 aa, Staphylococcus
SLFDLLEIVESITLESVNET

SEQ ID NO: 2039701 - protein, 18 aa, Staphylococcus
SLFIPGGHAAVVGISESE

SEQ ID NO: 2039702 - protein, 27 aa, Staphylococcus
SLFKKYWPADIHIMAKEIVRFHSIIWP

SEQ ID NO: 2039703 - protein, 24 aa, Staphylococcus
SLFKRQRATISIGYIGLYEAATVF

SEQ ID NO: 2039704 - protein, 17 aa, Staphylococcus
SLFKSLNTEVIFQEMTK

SEQ ID NO: 2039705 - protein, 30 aa, Staphylococcus
SLFNEFGNALPLIHIYKMAHAFVNEPIQIS

SEQ ID NO: 2039706 - protein, 21 aa, Staphylococcus
SLFNLRKLECSYSTDEVKGNI

SEQ ID NO: 2039707 - protein, 18 aa, Staphylococcus
SLFNYFKQLFAQVTNPPI

SEQ ID NO: 2039708 - protein, 18 aa, Staphylococcus
SLFREIYRVLKNSGKAVI

SEQ ID NO: 2039709 - protein, 20 aa, Staphylococcus
SLGAEVGWYIPNRFSEGYGP

SEQ ID NO: 2039710 - protein, 22 aa, Staphylococcus
SLGGLDCFDGGIGMLQALGATF

SEQ ID NO: 2039711 - protein, 26 aa, Staphylococcus
SLGGLFTLKLAELFDVSKIAVMSAPS

SEQ ID NO: 2039712 - protein, 22 aa, Staphylococcus
SLGGLFTLRLAENVELNRIVVM

SEQ ID NO: 2039713 - protein, 23 aa, Staphylococcus
SLGLEPWKFVVVQSKTLRDKLKP

SEQ ID NO: 2039714 - protein, 25 aa, Staphylococcus
SLGLEPWRFLVIQNKTLREKLIPYS

SEQ ID NO: 2039715 - protein, 24 aa, Staphylococcus
SLGMKQRLGIAMALIKKPKLLILD

SEQ ID NO: 2039716 - protein, 25 aa, Staphylococcus
SLGMKQRLGLALALLNGPDLLVLDE

SEQ ID NO: 2039717 - protein, 18 aa, Staphylococcus
SLGRIILYRSHDLLSWDY

SEQ ID NO: 2039718 - protein, 21 aa, Staphylococcus
SLGSKGAFAKHHHKYYRVNIP

SEQ ID NO: 2039719 - protein, 17 aa, Staphylococcus
SLHDIKKVYSIAPAISQ

SEQ ID NO: 2039720 - protein, 23 aa, Staphylococcus
SLIDELHPTPALGGYPKKEAVDY

SEQ ID NO: 2039721 - protein, 28 aa, Staphylococcus
SLIEELRPSLIISFYPGYAVHPDHEATA

SEQ ID NO: 2039722 - protein, 25 aa, Staphylococcus
SLIEGSDFTTGWIFFIDDFGHHELV

SEQ ID NO: 2039723 - protein, 22 aa, Staphylococcus
SLIHLPFDYIFFTGSERVGRIV

SEQ ID NO: 2039724 - protein, 17 aa, Staphylococcus
SLIKEIMQEQGYHTPEN

SEQ ID NO: 2039725 - protein, 20 aa, Staphylococcus
SLILCATACYHFRRSNFKGA

SEQ ID NO: 2039726 - protein, 17 aa, Staphylococcus
SLIPQIVDHVSIPVVAA

SEQ ID NO: 2039727 - protein, 24 aa, Staphylococcus
SLIRFPESALRPLGRTAAGVKGIT

SEQ ID NO: 2039728 - protein, 23 aa, Staphylococcus
SLIRFPETALRPLGRTAAGVKGI

SEQ ID NO: 2039729 - protein, 23 aa, Staphylococcus
SLIRKKLGYQRMIGYTSLDQCRR

SEQ ID NO: 2039730 - protein, 19 aa, Staphylococcus
SLISTDFIEDFSVFDGQTI

SEQ ID NO: 2039731 - protein, 22 aa, Staphylococcus
SLISTDFIEDFSVFDGQTIKIK

SEQ ID NO: 2039732 - protein, 22 aa, Staphylococcus
SLISTDFIEDFSVFDGQTIRIK

SEQ ID NO: 2039733 - protein, 19 aa, Staphylococcus
SLISTDFIEDFSVFEGQTI

SEQ ID NO: 2039734 - protein, 25 aa, Staphylococcus
SLKAGEWNRKAFRGTELYKKTLGII

SEQ ID NO: 2039735 - protein, 25 aa, Staphylococcus
SLKDFNLSDTVGWYTEIYNLDIQPA

SEQ ID NO: 2039736 - protein, 19 aa, Staphylococcus
SLKDIEHFIFKGIQTKLEI

SEQ ID NO: 2039737 - protein, 23 aa, Staphylococcus
SLKDRVATLSGLVAHFNRKEKIL

SEQ ID NO: 2039738 - protein, 17 aa, Staphylococcus
SLKEMYSIDFVRQRGLK

SEQ ID NO: 2039739 - protein, 26 aa, Staphylococcus
SLKFELFYFDIFRYANSFITLQVPRK

SEQ ID NO: 2039740 - protein, 20 aa, Staphylococcus
SLKIFSLKGNEPLAHEVADD

SEQ ID NO: 2039741 - protein, 21 aa, Staphylococcus
SLKIYLALHTFNFNTNVPFEH

SEQ ID NO: 2039742 - protein, 28 aa, Staphylococcus
SLKKDWGSFFMPKFNFVINVTNENRIEN

SEQ ID NO: 2039743 - protein, 26 aa, Staphylococcus
SLKKDWGSFFMPKFQFEIDGRNNYFI

SEQ ID NO: 2039744 - protein, 25 aa, Staphylococcus
SLKKDWGSFFMPKIHFIIYGTQKYS

SEQ ID NO: 2039745 - protein, 18 aa, Staphylococcus
SLKKIGITMSGGYPIKDW

SEQ ID NO: 2039746 - protein, 26 aa, Staphylococcus
SLKKILRKLVVANLITSNASKDGGFQ

SEQ ID NO: 2039747 - protein, 19 aa, Staphylococcus
SLKKLYRLFSKMIDSREEW

SEQ ID NO: 2039748 - protein, 21 aa, Staphylococcus
SLKLEGFKTTVAYNGREALEK

SEQ ID NO: 2039749 - protein, 30 aa, Staphylococcus
SLKNKEWNRKAFKGVELYQKTLGVIGAGRI

SEQ ID NO: 2039750 - protein, 18 aa, Staphylococcus
SLKNLGVDELDLYQLHGG

SEQ ID NO: 2039751 - protein, 20 aa, Staphylococcus
SLKPLHEFHQGTILVDLQQR

SEQ ID NO: 2039752 - protein, 23 aa, Staphylococcus
SLKRYLLEETFELFEAIDNEDDW

SEQ ID NO: 2039753 - protein, 21 aa, Staphylococcus
SLKSGYMTSLLRKYILGDEKV

SEQ ID NO: 2039754 - protein, 24 aa, Staphylococcus
SLKTTLDRVVPIWTDHISQHLLDG

SEQ ID NO: 2039755 - protein, 22 aa, Staphylococcus
SLKVANGLQVERLLRQNEEIKK

SEQ ID NO: 2039756 - protein, 19 aa, Staphylococcus
SLLAGVPVKAIIDSLTTFS

SEQ ID NO: 2039757 - protein, 19 aa, Staphylococcus
SLLAPRIETMFANHNVIFD

SEQ ID NO: 2039758 - protein, 18 aa, Staphylococcus
SLLAPRVEDMFAQHHLIF

SEQ ID NO: 2039759 - protein, 17 aa, Staphylococcus
SLLHKPTLFYVYDETEY

SEQ ID NO: 2039760 - protein, 18 aa, Staphylococcus
SLLKEGYYQQKLEELEYV

SEQ ID NO: 2039761 - protein, 23 aa, Staphylococcus
SLLKEYNGSIIFVSHDRKFIEKV

SEQ ID NO: 2039762 - protein, 23 aa, Staphylococcus
SLLKFFSHETEWLRGKELDNVQS

SEQ ID NO: 2039763 - protein, 24 aa, Staphylococcus
SLLKFYVKETEWFSGKEVDTIQAL

SEQ ID NO: 2039764 - protein, 17 aa, Staphylococcus
SLLKMKPVLEFVDGKIL

SEQ ID NO: 2039765 - protein, 19 aa, Staphylococcus
SLLKQARHSIQDAIDAAES

SEQ ID NO: 2039766 - protein, 25 aa, Staphylococcus
SLLLKKARIIMHHKGFIYNENNIDI

SEQ ID NO: 2039767 - protein, 18 aa, Staphylococcus
SLLLRRPPGREAYPGDVF

SEQ ID NO: 2039768 - protein, 26 aa, Staphylococcus
SLLNEIKDHFKILVTYRTISQGGKGQ

SEQ ID NO: 2039769 - protein, 24 aa, Staphylococcus
SLLNIPADETIVFGDGYNDMPLFE

SEQ ID NO: 2039770 - protein, 18 aa, Staphylococcus
SLLPHLIEAAAYNVARKN

SEQ ID NO: 2039771 - protein, 19 aa, Staphylococcus
SLLPVLEIVDYVLVMTVNP

SEQ ID NO: 2039772 - protein, 26 aa, Staphylococcus
SLLSKLLIRATKKWSTDKAFSKHLSE

SEQ ID NO: 2039773 - protein, 26 aa, Staphylococcus
SLLSKLLVRATKKWPTDKAFNRKLSE

SEQ ID NO: 2039774 - protein, 19 aa, Staphylococcus
SLLSKVLVRATKKWPTDRS

SEQ ID NO: 2039775 - protein, 18 aa, Staphylococcus
SLLTEVGDYIIPHFPPHL

SEQ ID NO: 2039776 - protein, 18 aa, Staphylococcus
SLLVYITYFYNREEKTMA

SEQ ID NO: 2039777 - protein, 17 aa, Staphylococcus
SLLYSAIILHDIGKVRE

SEQ ID NO: 2039778 - protein, 25 aa, Staphylococcus
SLNCHCEAFNCLGPNVLVKNMYYPN

SEQ ID NO: 2039779 - protein, 24 aa, Staphylococcus
SLNESRVGLYIGNDIESIILVHAC

SEQ ID NO: 2039780 - protein, 17 aa, Staphylococcus
SLNEVLLAMGIPTKQIE

SEQ ID NO: 2039781 - protein, 18 aa, Staphylococcus
SLNFKVYLLGGEMRELTE

SEQ ID NO: 2039782 - protein, 24 aa, Staphylococcus
SLNHLRQKMGMVFQNFNLFPHKTV

SEQ ID NO: 2039783 - protein, 29 aa, Staphylococcus
SLNNLGLEYIDLYLIHWPCEKNELYIETY

SEQ ID NO: 2039784 - protein, 19 aa, Staphylococcus
SLNNLRVMGKFGDSVTTDH

SEQ ID NO: 2039785 - protein, 26 aa, Staphylococcus
SLNPTHLKAMIPWEGLNDMYREIAFH

SEQ ID NO: 2039786 - protein, 20 aa, Staphylococcus
SLNVRKLYFTSFYQDQLSDD

SEQ ID NO: 2039787 - protein, 18 aa, Staphylococcus
SLPDIEIIMWDERLSTMA

SEQ ID NO: 2039788 - protein, 21 aa, Staphylococcus
SLPFHYYKDYGIRKYGFHGTS

SEQ ID NO: 2039789 - protein, 19 aa, Staphylococcus
SLPIYKPTLPPMVFGTKDK

SEQ ID NO: 2039790 - protein, 19 aa, Staphylococcus
SLPLVVFTGQVATPGIGKD

SEQ ID NO: 2039791 - protein, 24 aa, Staphylococcus
SLPMDLIYRRLDEIPHLRTMSITG

SEQ ID NO: 2039792 - protein, 17 aa, Staphylococcus
SLPVGGLGLDFVHDNGY

SEQ ID NO: 2039793 - protein, 25 aa, Staphylococcus
SLPVMVPPAYAIREYANREALDIYN

SEQ ID NO: 2039794 - protein, 19 aa, Staphylococcus
SLPYQYYKDYGIRKYGFHG

SEQ ID NO: 2039795 - protein, 25 aa, Staphylococcus
SLPYYKEFIKEVAQFLESENVPITA

SEQ ID NO: 2039796 - protein, 18 aa, Staphylococcus
SLQDIGFTHIAFYVDNFE

SEQ ID NO: 2039797 - protein, 18 aa, Staphylococcus
SLQFIKKDLVNFLENHSL

SEQ ID NO: 2039798 - protein, 17 aa, Staphylococcus
SLQKMAMMRSYMRSQVT

SEQ ID NO: 2039799 - protein, 28 aa, Staphylococcus
SLRARRTNLIGAIIPRMNSFAVDETIKG

SEQ ID NO: 2039800 - protein, 18 aa, Staphylococcus
SLREFYVLHELYKAQDKK

SEQ ID NO: 2039801 - protein, 20 aa, Staphylococcus
SLRFRRYELRNSAGEIVVEA

SEQ ID NO: 2039802 - protein, 24 aa, Staphylococcus
SLRLSEVKLGIDLEYIELEDFKFN

SEQ ID NO: 2039803 - protein, 24 aa, Staphylococcus
SLSASCKIINRFSNLSIDVAPSYE

SEQ ID NO: 2039804 - protein, 18 aa, Staphylococcus
SLSASMKIINRFSTKNIA

SEQ ID NO: 2039805 - protein, 19 aa, Staphylococcus
SLSAYEVVNEWSYEALVKI

SEQ ID NO: 2039806 - protein, 26 aa, Staphylococcus
SLSDLELIAIGGFSPLTGFMGEADYT

SEQ ID NO: 2039807 - protein, 26 aa, Staphylococcus
SLSDLELIGIGGFSPLTGFMNEADYN

SEQ ID NO: 2039808 - protein, 26 aa, Staphylococcus
SLSDLELIGIGGFSPLTGFMNRADYE

SEQ ID NO: 2039809 - protein, 25 aa, Staphylococcus
SLSFEKGELIAIVGPSGSGKSTFLT

SEQ ID NO: 2039810 - protein, 21 aa, Staphylococcus
SLSGKELKEGFKDVPQVELST

SEQ ID NO: 2039811 - protein, 24 aa, Staphylococcus
SLSGTVTPQGFFAVIKKPDYDVTT

SEQ ID NO: 2039812 - protein, 19 aa, Staphylococcus
SLSHLPLVVLTSDRPHELR

SEQ ID NO: 2039813 - protein, 23 aa, Staphylococcus
SLSKADRVFLCDIFGSIREHDGS

SEQ ID NO: 2039814 - protein, 30 aa, Staphylococcus
SLSKGYNMSGFRVGFAVGNKDMIQALKKYH

SEQ ID NO: 2039815 - protein, 20 aa, Staphylococcus
SLSLFKLLALESQHAGLSWL

SEQ ID NO: 2039816 - protein, 24 aa, Staphylococcus
SLSNYKAVEFWKEEGLDRVVLARE

SEQ ID NO: 2039817 - protein, 17 aa, Staphylococcus
SLSQLIQRHEILRTQYI

SEQ ID NO: 2039818 - protein, 20 aa, Staphylococcus
SLSRLMQMLKTFDEFSFDKD

SEQ ID NO: 2039819 - protein, 23 aa, Staphylococcus
SLSWDYDALKLLGITKEQLPELV

SEQ ID NO: 2039820 - protein, 18 aa, Staphylococcus
SLTANYDRFMTWRSKDGE

SEQ ID NO: 2039821 - protein, 26 aa, Staphylococcus
SLTEIGLDLPFPMKINQMLGNPPEFL

SEQ ID NO: 2039822 - protein, 25 aa, Staphylococcus
SLTFKNEIALNFIIHGHLGVIERWI

SEQ ID NO: 2039823 - protein, 27 aa, Staphylococcus
SLTIYEFTNCLKLQVDYATELFTSQEI

SEQ ID NO: 2039824 - protein, 18 aa, Staphylococcus
SLTLPFDIEEDAIKLHNY

SEQ ID NO: 2039825 - protein, 24 aa, Staphylococcus
SLTLYTCMYALYSGRTFSGQDDFD

SEQ ID NO: 2039826 - protein, 18 aa, Staphylococcus
SLTNRFEQLEGYQYESKI

SEQ ID NO: 2039827 - protein, 31 aa, Staphylococcus
SLTNYKWLGILLRFVPNIIRDFGYQLFADNR

SEQ ID NO: 2039828 - protein, 25 aa, Staphylococcus
SLTPEKRPYILFERCYDYLNGYRDN

SEQ ID NO: 2039829 - protein, 19 aa, Staphylococcus
SLTPFSLEFTEEVTGISKA

SEQ ID NO: 2039830 - protein, 22 aa, Staphylococcus
SLTRTFSCIQLLIQTLSNTRED

SEQ ID NO: 2039831 - protein, 25 aa, Staphylococcus
SLTSYLKKHHCLYVLVDPYILENLR

SEQ ID NO: 2039832 - protein, 19 aa, Staphylococcus
SLTTFKWLGILLKLVPKPL

SEQ ID NO: 2039833 - protein, 17 aa, Staphylococcus
SLTVITNCFPVFQILFE

SEQ ID NO: 2039834 - protein, 21 aa, Staphylococcus
SLVDDSLKISISVDFLTTKLR

SEQ ID NO: 2039835 - protein, 18 aa, Staphylococcus
SLVKEGVHLIGGCCGTTP

SEQ ID NO: 2039836 - protein, 22 aa, Staphylococcus
SLVKKLKRKGLPVNAQNAKEHI

SEQ ID NO: 2039837 - protein, 18 aa, Staphylococcus
SLVKLFGERMNVALLTGS

SEQ ID NO: 2039838 - protein, 24 aa, Staphylococcus
SLVKSGCKIIKKAVGEDVYHKGIN

SEQ ID NO: 2039839 - protein, 23 aa, Staphylococcus
SLVPSARVGHIGLYRDPETLKAV

SEQ ID NO: 2039840 - protein, 20 aa, Staphylococcus
SLVVDYGYPIGYSYKKDTRG

SEQ ID NO: 2039841 - protein, 18 aa, Staphylococcus
SLVYAHKGSMDFRITSKG

SEQ ID NO: 2039842 - protein, 20 aa, Staphylococcus
SLYKGVAAYAELVEDEGFNN

SEQ ID NO: 2039843 - protein, 23 aa, Staphylococcus
SLYKRGGTIYGHVMHTHLLVNFV

SEQ ID NO: 2039844 - protein, 21 aa, Staphylococcus
SLYPESSFNMARYVDDNPENI

SEQ ID NO: 2039845 - protein, 23 aa, Staphylococcus
SLYTETWCFKLLIECDKNKLVKA

SEQ ID NO: 2039846 - protein, 18 aa, Staphylococcus
SLYTWQEKCCQLIRYSNI

SEQ ID NO: 2039847 - protein, 18 aa, Staphylococcus
SMAEWDVMNIIWDKKSVS

SEQ ID NO: 2039848 - protein, 17 aa, Staphylococcus
SMCKHLSIQLSENEGDI

SEQ ID NO: 2039849 - protein, 25 aa, Staphylococcus
SMDELPKRMTFIGVGIISVEFASIM

SEQ ID NO: 2039850 - protein, 21 aa, Staphylococcus
SMDFPEPVIHLSVEPKSKADQ

SEQ ID NO: 2039851 - protein, 22 aa, Staphylococcus
SMDVFYQKGWTNAAISKVTSFL

SEQ ID NO: 2039852 - protein, 20 aa, Staphylococcus
SMEHILRAAMDIDETTQQFV

SEQ ID NO: 2039853 - protein, 20 aa, Staphylococcus
SMEHLLRAAMDIDETTQQYV

SEQ ID NO: 2039854 - protein, 21 aa, Staphylococcus
SMEHLLRAAMDIDTIMQQTIE

SEQ ID NO: 2039855 - protein, 21 aa, Staphylococcus
SMEHVLRAAMDIDQTTQNFIG

SEQ ID NO: 2039856 - protein, 24 aa, Staphylococcus
SMFEREVANLLLLDYSPSEIAKRL

SEQ ID NO: 2039857 - protein, 19 aa, Staphylococcus
SMFKKARGNFFGVGIDLVK

SEQ ID NO: 2039858 - protein, 19 aa, Staphylococcus
SMGCPVISYDVRYGPNEII

SEQ ID NO: 2039859 - protein, 27 aa, Staphylococcus
SMGEKSRLQFVLLFFSNANLLILDEPT

SEQ ID NO: 2039860 - protein, 24 aa, Staphylococcus
SMGGRVALYYEIHGQYEIKQLILE

SEQ ID NO: 2039861 - protein, 18 aa, Staphylococcus
SMGGYLANELCRFIEINK

SEQ ID NO: 2039862 - protein, 19 aa, Staphylococcus
SMGSIIARKYVEMYPDTAQ

SEQ ID NO: 2039863 - protein, 24 aa, Staphylococcus
SMGTKIVYELALKIKHSGLNNPKA

SEQ ID NO: 2039864 - protein, 18 aa, Staphylococcus
SMHKRWLATKDTRTRHSH

SEQ ID NO: 2039865 - protein, 18 aa, Staphylococcus
SMIEAGILDGDKVIVRSQ

SEQ ID NO: 2039866 - protein, 25 aa, Staphylococcus
SMIEEFKVTIWYTAPTALRMLMSAG

SEQ ID NO: 2039867 - protein, 17 aa, Staphylococcus
SMIIMGAGINHWFNSDT

SEQ ID NO: 2039868 - protein, 22 aa, Staphylococcus
SMIKDSFEQAAFDLFDNSEEQS

SEQ ID NO: 2039869 - protein, 23 aa, Staphylococcus
SMIKGTVEAILFQNSDNFYTVLK

SEQ ID NO: 2039870 - protein, 21 aa, Staphylococcus
SMINCYDHMWGYFKSKATDTE

SEQ ID NO: 2039871 - protein, 19 aa, Staphylococcus
SMLERVGYPVAMANATQAV

SEQ ID NO: 2039872 - protein, 22 aa, Staphylococcus
SMLERVGYPVAMENAAPEVKAI

SEQ ID NO: 2039873 - protein, 17 aa, Staphylococcus
SMLERVGYPVAMENAIP

SEQ ID NO: 2039874 - protein, 23 aa, Staphylococcus
SMLFRGVHYEICVVDRKGYEWVI

SEQ ID NO: 2039875 - protein, 17 aa, Staphylococcus
SMLKEAVDELGLDYEEA

SEQ ID NO: 2039876 - protein, 19 aa, Staphylococcus
SMLKGEQKLTVTVDGKGPI

SEQ ID NO: 2039877 - protein, 23 aa, Staphylococcus
SMLNQLRGEIVYRNNQMVMTRYK

SEQ ID NO: 2039878 - protein, 27 aa, Staphylococcus
SMLNYVLCSNLYRFLREVSLGNTKFIQ

SEQ ID NO: 2039879 - protein, 21 aa, Staphylococcus
SMLSDCFEIRKSVFVEEQGVP

SEQ ID NO: 2039880 - protein, 25 aa, Staphylococcus
SMLYRLGALGLKKGSLVSIKRKCLF

SEQ ID NO: 2039881 - protein, 24 aa, Staphylococcus
SMMDLPLTIGEDFSGYTETYPGVF

SEQ ID NO: 2039882 - protein, 20 aa, Staphylococcus
SMMSQYATLVVRPNHNQDII

SEQ ID NO: 2039883 - protein, 23 aa, Staphylococcus
SMNRIAKELNIGMGTLYRHFKDK

SEQ ID NO: 2039884 - protein, 24 aa, Staphylococcus
SMQDKIMYCFYKIKQKAKQHKQGV

SEQ ID NO: 2039885 - protein, 23 aa, Staphylococcus
SMRHFQKRMTIIDGEIDKIEELN

SEQ ID NO: 2039886 - protein, 17 aa, Staphylococcus
SMSKTRFLELFDIGLEQ

SEQ ID NO: 2039887 - protein, 25 aa, Staphylococcus
SMSPEFYDDLQLWLKENGKIETTID

SEQ ID NO: 2039888 - protein, 21 aa, Staphylococcus
SMSPELFFQRGPFKNKADVLL

SEQ ID NO: 2039889 - protein, 29 aa, Staphylococcus
SMSRYLFQRLHFYLVDIFRKKSRQLNTCT

SEQ ID NO: 2039890 - protein, 17 aa, Staphylococcus
SMSSPLYINAMTGGSEW

SEQ ID NO: 2039891 - protein, 23 aa, Staphylococcus
SMTIEGMGPLVYYMNAIDVQVPN

SEQ ID NO: 2039892 - protein, 17 aa, Staphylococcus
SMVDTGVLSDRAVAERA

SEQ ID NO: 2039893 - protein, 18 aa, Staphylococcus
SMVKSIKLTMGRLDEASR

SEQ ID NO: 2039894 - protein, 18 aa, Staphylococcus
SMVTAYDYPSAKQAQQAN

SEQ ID NO: 2039895 - protein, 23 aa, Staphylococcus
SMYEPQSLFAWMTLGENKAPRVI

SEQ ID NO: 2039896 - protein, 17 aa, Staphylococcus
SMYKDMLDEGVKHTISQ

SEQ ID NO: 2039897 - protein, 24 aa, Staphylococcus
SMYNDKGERVWVKFHHRTQQGIEN

SEQ ID NO: 2039898 - protein, 28 aa, Staphylococcus
SMYNDKGERVWVKYHFRTQQGIENLTDE

SEQ ID NO: 2039899 - protein, 17 aa, Staphylococcus
SMYYDIINHQPLEIEAI

SEQ ID NO: 2039900 - protein, 23 aa, Staphylococcus
SNAFDISKKLGLGLNIINKAKTM

SEQ ID NO: 2039901 - protein, 24 aa, Staphylococcus
SNAFDISKKLGLGLNIINKAKTMI

SEQ ID NO: 2039902 - protein, 26 aa, Staphylococcus
SNAFDISKKLGLNLSIINKAKTMIGT

SEQ ID NO: 2039903 - protein, 27 aa, Staphylococcus
SNAFDISKKLGLNMKVIQKAKSMIGQD

SEQ ID NO: 2039904 - protein, 20 aa, Staphylococcus
SNAFDISKKLGLSLNIINKA

SEQ ID NO: 2039905 - protein, 20 aa, Staphylococcus
SNAFDISRKLGLSLGIINKA

SEQ ID NO: 2039906 - protein, 18 aa, Staphylococcus
SNAFVKLLNIEGHSATLF

SEQ ID NO: 2039907 - protein, 24 aa, Staphylococcus
SNAFVPSVVGLICAGYVINDILKD

SEQ ID NO: 2039908 - protein, 17 aa, Staphylococcus
SNAIASLIMTTTKYKWL

SEQ ID NO: 2039909 - protein, 23 aa, Staphylococcus
SNAKKAVVVGGGYIGIEAAEAFA

SEQ ID NO: 2039910 - protein, 21 aa, Staphylococcus
SNAKQFRPYMEKMQDAITAVA

SEQ ID NO: 2039911 - protein, 18 aa, Staphylococcus
SNAMKKYAQMISTDKDAM

SEQ ID NO: 2039912 - protein, 29 aa, Staphylococcus
SNAQEFEDFFKLGIKEVKDIEFRKLKKVL

SEQ ID NO: 2039913 - protein, 19 aa, Staphylococcus
SNARLPLYLNKKENQTYIQ

SEQ ID NO: 2039914 - protein, 22 aa, Staphylococcus
SNCGLGFKSFWESSTGFHYDLF

SEQ ID NO: 2039915 - protein, 19 aa, Staphylococcus
SNCYFMDGGGITIGNDVFI

SEQ ID NO: 2039916 - protein, 19 aa, Staphylococcus
SNCYFMDGGGITIGNNVFI

SEQ ID NO: 2039917 - protein, 23 aa, Staphylococcus
SNDAFCVLNHLFVNEGNEEAFEQ

SEQ ID NO: 2039918 - protein, 27 aa, Staphylococcus
SNDAKIAYALLKDRLELSIKNNWFDDN

SEQ ID NO: 2039919 - protein, 19 aa, Staphylococcus
SNDEMMQVVSFFNAVESYY

SEQ ID NO: 2039920 - protein, 25 aa, Staphylococcus
SNDRYRLGYHIMPKSGWINDPNGFS

SEQ ID NO: 2039921 - protein, 24 aa, Staphylococcus
SNDSFCVLNHLFVNEGMEDAFEKK

SEQ ID NO: 2039922 - protein, 24 aa, Staphylococcus
SNDYKMSYQFIVHLKAMIQIPTYF

SEQ ID NO: 2039923 - protein, 23 aa, Staphylococcus
SNEFKVALLRSSMIYGESAPGNF

SEQ ID NO: 2039924 - protein, 25 aa, Staphylococcus
SNEGLKSRVPYQLHFEDYSPEEVAD

SEQ ID NO: 2039925 - protein, 21 aa, Staphylococcus
SNEGYLLPINRDVFSEIEKTI

SEQ ID NO: 2039926 - protein, 18 aa, Staphylococcus
SNEIARKSIYDYLEKELH

SEQ ID NO: 2039927 - protein, 23 aa, Staphylococcus
SNEIKANLLSSFSEKEITQEELT

SEQ ID NO: 2039928 - protein, 23 aa, Staphylococcus
SNEIMSLISHDHFIILKDRYGLK

SEQ ID NO: 2039929 - protein, 18 aa, Staphylococcus
SNEISKMIEEGGLGADQY

SEQ ID NO: 2039930 - protein, 21 aa, Staphylococcus
SNEKYRTWDWNYGKNPKYNFE

SEQ ID NO: 2039931 - protein, 23 aa, Staphylococcus
SNEQARKYLGWTPIATQEEAILA

SEQ ID NO: 2039932 - protein, 24 aa, Staphylococcus
SNESIEYDALVSFELDTLYRMIDI

SEQ ID NO: 2039933 - protein, 20 aa, Staphylococcus
SNESNWTPLMQTFVDALYKS

SEQ ID NO: 2039934 - protein, 25 aa, Staphylococcus
SNESPMAKSLIGKGLNDEVRVQLPN

SEQ ID NO: 2039935 - protein, 18 aa, Staphylococcus
SNETIAFEPKDVIIVEGI

SEQ ID NO: 2039936 - protein, 18 aa, Staphylococcus
SNFDSWVKYIKNYEDGLS

SEQ ID NO: 2039937 - protein, 17 aa, Staphylococcus
SNFKKIYSLITMDEGEK

SEQ ID NO: 2039938 - protein, 17 aa, Staphylococcus
SNFKLDYPLYINAMTGG

SEQ ID NO: 2039939 - protein, 24 aa, Staphylococcus
SNFKPHHFETLLSHASVKPVIDQV

SEQ ID NO: 2039940 - protein, 25 aa, Staphylococcus
SNFNFKLLEFCLNRIKEKDSAQLMS

SEQ ID NO: 2039941 - protein, 22 aa, Staphylococcus
SNFYKNILGFSIKEQDDNHVIF

SEQ ID NO: 2039942 - protein, 26 aa, Staphylococcus
SNGDIKTYTGFILKFNVLEKSFSFFN

SEQ ID NO: 2039943 - protein, 29 aa, Staphylococcus
SNGEAFAKFFKLMLNQGINLAPSKFEAWF

SEQ ID NO: 2039944 - protein, 18 aa, Staphylococcus
SNGISVMIEEGGLGADQY

SEQ ID NO: 2039945 - protein, 27 aa, Staphylococcus
SNGMKMKLSLAIAFSHHAELFILDEPT

SEQ ID NO: 2039946 - protein, 17 aa, Staphylococcus
SNGTSFNEFVVKFNKPV

SEQ ID NO: 2039947 - protein, 20 aa, Staphylococcus
SNGYDGIGFILSKESKHICL

SEQ ID NO: 2039948 - protein, 25 aa, Staphylococcus
SNGYEKRYGLFYVDFDTQERYPKKS

SEQ ID NO: 2039949 - protein, 21 aa, Staphylococcus
SNGYHNYAWDQYYLEHVTEEC

SEQ ID NO: 2039950 - protein, 18 aa, Staphylococcus
SNGYIPIIAHPERNKVIT

SEQ ID NO: 2039951 - protein, 35 aa, Staphylococcus
SNHARATAALCAKCNVSYLVLRGEMAEYEGNLFLD

SEQ ID NO: 2039952 - protein, 35 aa, Staphylococcus
SNHDVDMLRMCRYPWKTKQRILGDMGHVSNEDAAM

SEQ ID NO: 2039953 - protein, 35 aa, Staphylococcus
SNHDVDMLRMCRYPWKTKQRILGDMGHVSNEDAGL

SEQ ID NO: 2039954 - protein, 34 aa, Staphylococcus; identical to SEQ ID NO: 1796642

SEQ ID NO: 2039955 - protein, 17 aa, Staphylococcus
SNHFKINLLEVAEHFKS

SEQ ID NO: 2039956 - protein, 25 aa, Staphylococcus
SNHLQEIFLEFKKSNIVDHYAIYNN

SEQ ID NO: 2039957 - protein, 19 aa, Staphylococcus
SNHWLIGGNGSIISKVGEI

SEQ ID NO: 2039958 - protein, 17 aa, Staphylococcus
SNICLSSYLYQRLNFYL

SEQ ID NO: 2039959 - protein, 22 aa, Staphylococcus
SNIDYTLLHLTWLYDDPSNTSY

SEQ ID NO: 2039960 - protein, 18 aa, Staphylococcus
SNIIKLKSVYVQDFEQNP

SEQ ID NO: 2039961 - protein, 19 aa, Staphylococcus
SNIINCSRINLAAQAYSDE

SEQ ID NO: 2039962 - protein, 19 aa, Staphylococcus
SNIINCSRINLANQAYKAE

SEQ ID NO: 2039963 - protein, 19 aa, Staphylococcus
SNIINCSRINLANQESQKD

SEQ ID NO: 2039964 - protein, 19 aa, Staphylococcus
SNIINCSRINLANRAHHAE

SEQ ID NO: 2039965 - protein, 19 aa, Staphylococcus
SNIINCSRINLANRAHYEE

SEQ ID NO: 2039966 - protein, 19 aa, Staphylococcus
SNIINCSRINLANRAYQEE

SEQ ID NO: 2039967 - protein, 20 aa, Staphylococcus
SNIKAGHAIIGLASSGIHSN

SEQ ID NO: 2039968 - protein, 20 aa, Staphylococcus
SNIKLVHFFFKSLTEYLKKQ

SEQ ID NO: 2039969 - protein, 18 aa, Staphylococcus
SNILKLDPFQTLDRDGVG

SEQ ID NO: 2039970 - protein, 22 aa, Staphylococcus
SNIRKKDIGFIFQDYNVLHTLT

SEQ ID NO: 2039971 - protein, 30 aa, Staphylococcus
SNITKRVAIEMASTLGWHKYVGTQGKVIGI

SEQ ID NO: 2039972 - protein, 26 aa, Staphylococcus
SNIVFIKWFEDLRTIFINQYMNYSEM

SEQ ID NO: 2039973 - protein, 24 aa, Staphylococcus
SNIVKKLFLLGIMANINQSLDDET

SEQ ID NO: 2039974 - protein, 19 aa, Staphylococcus
SNIVYIRWFEDLRTDFINQ

SEQ ID NO: 2039975 - protein, 20 aa, Staphylococcus
SNIYRAGTFVKQVRDNNQNV

SEQ ID NO: 2039976 - protein, 18 aa, Staphylococcus
SNIYRAGTYVKNIRENND

SEQ ID NO: 2039977 - protein, 24 aa, Staphylococcus
SNKAYDAWRKWSHKDRAELMLRVA

SEQ ID NO: 2039978 - protein, 18 aa, Staphylococcus
SNKDIQALLSTYLPSDLK

SEQ ID NO: 2039979 - protein, 17 aa, Staphylococcus
SNKIIKLPARFHRQPLP

SEQ ID NO: 2039980 - protein, 18 aa, Staphylococcus
SNKILKLFEDDNHSGIDV

SEQ ID NO: 2039981 - protein, 23 aa, Staphylococcus
SNKLLWSEWINRLQTPMNNGDKY

SEQ ID NO: 2039982 - protein, 24 aa, Staphylococcus
SNKPKPRYLTGFAAKPLEFLHAIL

SEQ ID NO: 2039983 - protein, 23 aa, Staphylococcus
SNKWGGKFLRSLNAFPVDRENPG

SEQ ID NO: 2039984 - protein, 17 aa, Staphylococcus
SNLEFKDNVIIKLKKTY

SEQ ID NO: 2039985 - protein, 20 aa, Staphylococcus
SNLKGCVFGMSLQTTHEELY

SEQ ID NO: 2039986 - protein, 25 aa, Staphylococcus
SNLKHFKATYGLLYEEELGLQSTIF

SEQ ID NO: 2039987 - protein, 19 aa, Staphylococcus
SNLKISFNSKYMMDALKAI

SEQ ID NO: 2039988 - protein, 22 aa, Staphylococcus
SNLKKQELDGIVIAKGPGSYTG

SEQ ID NO: 2039989 - protein, 19 aa, Staphylococcus
SNLKLHHMDCYRLEDSDED

SEQ ID NO: 2039990 - protein, 23 aa, Staphylococcus
SNLLKDLILQLALKRISQDNQEM

SEQ ID NO: 2039991 - protein, 20 aa, Staphylococcus
SNLLTYLGVFDRVRNFFSKK

SEQ ID NO: 2039992 - protein, 21 aa, Staphylococcus
SNLSLKCFKYTNNGTQSLQLS

SEQ ID NO: 2039993 - protein, 19 aa, Staphylococcus
SNLSRSYLYKTFQKHFSTS

SEQ ID NO: 2039994 - protein, 26 aa, Staphylococcus
SNLWQLAKDTYQEWYLGKDLFNKVEE

SEQ ID NO: 2039995 - protein, 25 aa, Staphylococcus
SNMEGRKILILADCLELGDNSQHMH

SEQ ID NO: 2039996 - protein, 31 aa, Staphylococcus
SNMFKALVHEVFKVYGVLFIDAQYEPLRKLE

SEQ ID NO: 2039997 - protein, 19 aa, Staphylococcus
SNMIKQLYSPVEFIDSAEW

SEQ ID NO: 2039998 - protein, 20 aa, Staphylococcus
SNMYREMAKEGVFLPPSQFE

SEQ ID NO: 2039999 - protein, 19 aa, Staphylococcus
SNNDWGCPITIRAPFGGGV

SEQ ID NO: 2040000 - protein, 24 aa, Staphylococcus
SNNGRIIVISSIWGETGASMEVVY

SEQ ID NO: 2040001 - protein, 24 aa, Staphylococcus
SNPCFKITDIKAVAHIAKKHDLLL

SEQ ID NO: 2040002 - protein, 27 aa, Staphylococcus
SNPGLASRIPHTFDFEDYKLPQLVQIG

SEQ ID NO: 2040003 - protein, 25 aa, Staphylococcus
SNPIPLHWDAGALVTNYFQCNYWGK

SEQ ID NO: 2040004 - protein, 20 aa, Staphylococcus
SNPISIVIPCHRVVGQDNHL

SEQ ID NO: 2040005 - protein, 17 aa, Staphylococcus
SNPKLEEMPGFNRVEVS

SEQ ID NO: 2040006 - protein, 18 aa, Staphylococcus
SNPKRDTVVISHDSIGYL

SEQ ID NO: 2040007 - protein, 26 aa, Staphylococcus
SNPKYLPRFIFGHYMKDYLQQFINQY

SEQ ID NO: 2040008 - protein, 17 aa, Staphylococcus
SNPLWLTSYDDYPMQSI

SEQ ID NO: 2040009 - protein, 20 aa, Staphylococcus
SNPMPPRTARLLIEEIEIGH

SEQ ID NO: 2040010 - protein, 24 aa, Staphylococcus
SNPSFKQIFEILKDFYAENDNYHI

SEQ ID NO: 2040011 - protein, 21 aa, Staphylococcus
SNPVLEGFTLTKLLWIKDNEP

SEQ ID NO: 2040012 - protein, 27 aa, Staphylococcus
SNPYNFGATVGRYGGRIANATFELDSK

SEQ ID NO: 2040013 - protein, 18 aa, Staphylococcus
SNQAIAIHGCEGNESIAY

SEQ ID NO: 2040014 - protein, 20 aa, Staphylococcus
SNQLDLILKHYIRDESEQYN

SEQ ID NO: 2040015 - protein, 25 aa, Staphylococcus
SNQLFIPIIKSWRLNERHYGGLQGL

SEQ ID NO: 2040016 - protein, 20 aa, Staphylococcus
SNQRSVIYIDDLVYHINQLI

SEQ ID NO: 2040017 - protein, 24 aa, Staphylococcus
SNQVHLFGKREGKVLYQQRDTKEE

SEQ ID NO: 2040018 - protein, 17 aa, Staphylococcus
SNRIMELLDDFANSQVD

SEQ ID NO: 2040019 - protein, 24 aa, Staphylococcus
SNRIVNHIKYYFGLISDKPNHFEK

SEQ ID NO: 2040020 - protein, 17 aa, Staphylococcus
SNSAFSLEQHRDEFQQE

SEQ ID NO: 2040021 - protein, 23 aa, Staphylococcus
SNSFNISTTVAFIVAAAGVPIIK

SEQ ID NO: 2040022 - protein, 23 aa, Staphylococcus
SNSFNISTTVAFIVASAGVPVVK

SEQ ID NO: 2040023 - protein, 20 aa, Staphylococcus
SNSFNISTTVSFIVASAGIP

SEQ ID NO: 2040024 - protein, 23 aa, Staphylococcus
SNSFNISTTVSFVIASANIPVIK

SEQ ID NO: 2040025 - protein, 20 aa, Staphylococcus
SNSFNISTTVSFVVAAANVN

SEQ ID NO: 2040026 - protein, 22 aa, Staphylococcus
SNSFNISTTVSFVVASADVPVI

SEQ ID NO: 2040027 - protein, 30 aa, Staphylococcus
SNSFVGQFLKRLGFKAAITQADSNKYPEYK

SEQ ID NO: 2040028 - protein, 25 aa, Staphylococcus
SNSLEHLLFGLGIRHLGAKASYVLA

SEQ ID NO: 2040029 - protein, 20 aa, Staphylococcus
SNTAEFGDYVSGPRVITPDV

SEQ ID NO: 2040030 - protein, 17 aa, Staphylococcus
SNTGQRAITHILSSNMV

SEQ ID NO: 2040031 - protein, 24 aa, Staphylococcus
SNTLCIRPGVVITYNRNYVSNQLL

SEQ ID NO: 2040032 - protein, 23 aa, Staphylococcus
SNTLCIRPGVVVTYDRNYVSNDL

SEQ ID NO: 2040033 - protein, 24 aa, Staphylococcus
SNTLTIRPGVVVTYDRNYVSNQLL

SEQ ID NO: 2040034 - protein, 18 aa, Staphylococcus
SNVGTIHKVYAAYIVSKN

SEQ ID NO: 2040035 - protein, 22 aa, Staphylococcus
SNVKPRVNLYVDNFEDISTETV

SEQ ID NO: 2040036 - protein, 17 aa, Staphylococcus
SNVLKRLVNDIKEKHTN

SEQ ID NO: 2040037 - protein, 17 aa, Staphylococcus
SNVLRLLSHHQGLSITE

SEQ ID NO: 2040038 - protein, 29 aa, Staphylococcus
SNVRLELGKEYLIAIIIQTFEYWAQYKDK

SEQ ID NO: 2040039 - protein, 17 aa, Staphylococcus
SNVSFDFEILKEMLRHH

SEQ ID NO: 2040040 - protein, 18 aa, Staphylococcus
SNVSRYVPDKVQMKNALQ

SEQ ID NO: 2040041 - protein, 17 aa, Staphylococcus
SNVTLLFDGDFAGQEAT

SEQ ID NO: 2040042 - protein, 26 aa, Staphylococcus
SNYDRAVELYYYIKGGTVDYGAAHAE

SEQ ID NO: 2040043 - protein, 27 aa, Staphylococcus
SNYILKYVFANGISRDIIYPLLEEMNL

SEQ ID NO: 2040044 - protein, 26 aa, Staphylococcus
SNYILKYVFANGISRDIIYPLLVKMN

SEQ ID NO: 2040045 - protein, 18 aa, Staphylococcus
SNYISKWFSKHDVTVVPN

SEQ ID NO: 2040046 - protein, 22 aa, Staphylococcus
SNYLDHLIIYYAPKIIGGIGKN

SEQ ID NO: 2040047 - protein, 20 aa, Staphylococcus
SNYLPSYRYAQISYEDDDLA

SEQ ID NO: 2040048 - protein, 21 aa, Staphylococcus
SNYLPSYRYAQIYYEDDDLAI

SEQ ID NO: 2040049 - protein, 20 aa, Staphylococcus
SNYLPSYRYAQVYYEDDDFA

SEQ ID NO: 2040050 - protein, 20 aa, Staphylococcus
SNYLPSYRYAQVYYENDDFA

SEQ ID NO: 2040051 - protein, 22 aa, Staphylococcus
SNYYRKFGLKWSESNKNVSREK

SEQ ID NO: 2040052 - protein, 19 aa, Staphylococcus
SPAFNEAKLKDPVPAKIYD

SEQ ID NO: 2040053 - protein, 18 aa, Staphylococcus
SPCGTCRQVLKELCDDDM

SEQ ID NO: 2040054 - protein, 20 aa, Staphylococcus
SPDVLKSFLQQQGFSKKTTS

SEQ ID NO: 2040055 - protein, 20 aa, Staphylococcus
SPEAWYSMIEEFKVTIWYTA

SEQ ID NO: 2040056 - protein, 18 aa, Staphylococcus
SPEERLYRRYANQIRNWD

SEQ ID NO: 2040057 - protein, 18 aa, Staphylococcus
SPEMTLRYAKLLDDTKKK

SEQ ID NO: 2040058 - protein, 25 aa, Staphylococcus
SPFDLDFSGFIFKIQANMDPKHRDR

SEQ ID NO: 2040059 - protein, 20 aa, Staphylococcus
SPFKSRSYLSQSIFDDMQKS

SEQ ID NO: 2040060 - protein, 17 aa, Staphylococcus
SPFQGLMLRGFEIDCRI

SEQ ID NO: 2040061 - protein, 21 aa, Staphylococcus
SPFSIELCGGIHVQNTSEIGL

SEQ ID NO: 2040062 - protein, 17 aa, Staphylococcus
SPGFPYLSGLNESLYVN

SEQ ID NO: 2040063 - protein, 17 aa, Staphylococcus
SPGFPYLTGMNEKLYVN

SEQ ID NO: 2040064 - protein, 18 aa, Staphylococcus
SPGFPYLTGMNERLYINH

SEQ ID NO: 2040065 - protein, 18 aa, Staphylococcus
SPGGWQIIGQTPIQVFDI

SEQ ID NO: 2040066 - protein, 25 aa, Staphylococcus
SPGKVKALHLPQGFNVRVDSLLYPN

SEQ ID NO: 2040067 - protein, 22 aa, Staphylococcus
SPGVNVPEPFALSDGTLATQII

SEQ ID NO: 2040068 - protein, 22 aa, Staphylococcus
SPHDGFKVYRHFFFNHQQLEIL

SEQ ID NO: 2040069 - protein, 22 aa, Staphylococcus
SPHPSPLSAFRGFFGSKPYSRT

SEQ ID NO: 2040070 - protein, 24 aa, Staphylococcus
SPIEAMKHGLAFITENRKEEGLIL

SEQ ID NO: 2040071 - protein, 19 aa, Staphylococcus
SPIFPRLDTEAEIAYIKAS

SEQ ID NO: 2040072 - protein, 17 aa, Staphylococcus
SPIGMKRAFPTIIDQQA

SEQ ID NO: 2040073 - protein, 19 aa, Staphylococcus
SPIIGRDIANWILTGVKPH

SEQ ID NO: 2040074 - protein, 24 aa, Staphylococcus
SPIRRYPDLTVHRLIRKYLIEHSM

SEQ ID NO: 2040075 - protein, 25 aa, Staphylococcus
SPIRRYPDLVVHRLIRKYLIDETMD

SEQ ID NO: 2040076 - protein, 21 aa, Staphylococcus
SPISETMWLSRTGFVEDEQAY

SEQ ID NO: 2040077 - protein, 21 aa, Staphylococcus
SPKFFKAMLVDFMSKTNYTCD

SEQ ID NO: 2040078 - protein, 21 aa, Staphylococcus
SPKFFKSMLVDFMEKTNYTCD

SEQ ID NO: 2040079 - protein, 19 aa, Staphylococcus
SPKLRASVEQAINAANLEV

SEQ ID NO: 2040080 - protein, 23 aa, Staphylococcus
SPKSWAGSMGRTAKINDIQRQIK

SEQ ID NO: 2040081 - protein, 23 aa, Staphylococcus
SPKYFKRMLVDFAEQTNYTCDIV

SEQ ID NO: 2040082 - protein, 22 aa, Staphylococcus
SPKYFKRMLVDFMEKTTYNCDI

SEQ ID NO: 2040083 - protein, 17 aa, Staphylococcus
SPLEYYFDINIKNITQK

SEQ ID NO: 2040084 - protein, 18 aa, Staphylococcus
SPLHNMLNYFAILEQGSI

SEQ ID NO: 2040085 - protein, 17 aa, Staphylococcus
SPLNHWKAYEGKKNVAI

SEQ ID NO: 2040086 - protein, 19 aa, Staphylococcus
SPLPDLIIVDGGKGHMSGV

SEQ ID NO: 2040087 - protein, 17 aa, Staphylococcus
SPMAEAIMRQRLIDRNI

SEQ ID NO: 2040088 - protein, 18 aa, Staphylococcus
SPMAKALIGKNLNDEVRV

SEQ ID NO: 2040089 - protein, 31 aa, Staphylococcus
SPPIREKSRMPGMWDRVLKGDINFVTSDHSP

SEQ ID NO: 2040090 - protein, 18 aa, Staphylococcus
SPPWGKDMMSRYAKIALG

SEQ ID NO: 2040091 - protein, 25 aa, Staphylococcus
SPQIFKQLLMISGFDKYYQIVKCFR

SEQ ID NO: 2040092 - protein, 26 aa, Staphylococcus
SPQLFKQLLMISGFDKYYQIVKCFRD

SEQ ID NO: 2040093 - protein, 20 aa, Staphylococcus
SPRGTRIFGPVARELRDNNY

SEQ ID NO: 2040094 - protein, 24 aa, Staphylococcus
SPRVDVVIEISMRIKKAFSSEQID

SEQ ID NO: 2040095 - protein, 25 aa, Staphylococcus
SPSIHTVRYAFDYAGEVAMEKLNQL

SEQ ID NO: 2040096 - protein, 20 aa, Staphylococcus
SPSSIIRFSKKVTEGGFHEL

SEQ ID NO: 2040097 - protein, 24 aa, Staphylococcus
SPSTDFLKAMPIIIHGDAAYPGQG

SEQ ID NO: 2040098 - protein, 20 aa, Staphylococcus
SPTDLASAFAALANGGEYNQ

SEQ ID NO: 2040099 - protein, 19 aa, Staphylococcus
SPTQLASAFAAIANGGEYN

SEQ ID NO: 2040100 - protein, 21 aa, Staphylococcus
SPYDFCGLVLDYDEATHIATI

SEQ ID NO: 2040101 - protein, 21 aa, Staphylococcus
SPYDFCGLVLDYDEATKIATI

SEQ ID NO: 2040102 - protein, 19 aa, Staphylococcus
SPYDFCGLVLEYDANTHIA

SEQ ID NO: 2040103 - protein, 24 aa, Staphylococcus
SPYFYELADKYGFYVMSEADLETH

SEQ ID NO: 2040104 - protein, 17 aa, Staphylococcus
SPYRRALNLENPVINLS

SEQ ID NO: 2040105 - protein, 23 aa, Staphylococcus
SQAETWLRTTLKQINLELYYYAQ

SEQ ID NO: 2040106 - protein, 23 aa, Staphylococcus
SQAHLEILNRLYAPLIGTHAIGL

SEQ ID NO: 2040107 - protein, 21 aa, Staphylococcus
SQAQFVGFVGEHSRYDLMLIQ

SEQ ID NO: 2040108 - protein, 24 aa, Staphylococcus
SQDDLKSDLILTMTNNHKRQLISQ

SEQ ID NO: 2040109 - protein, 19 aa, Staphylococcus
SQDGYILRFNFAGEETTEP

SEQ ID NO: 2040110 - protein, 21 aa, Staphylococcus
SQDVFPELKKLEGHTLMITDG

SEQ ID NO: 2040111 - protein, 19 aa, Staphylococcus
SQEARPIIDDYFEMILNYF

SEQ ID NO: 2040112 - protein, 27 aa, Staphylococcus
SQEDFKGSWSVVCFYPADFSFVCPTEL

SEQ ID NO: 2040113 - protein, 23 aa, Staphylococcus
SQEEQKVIILYALIQSDTPIKQY

SEQ ID NO: 2040114 - protein, 17 aa, Staphylococcus
SQEKFGLLLGNEGQGVD

SEQ ID NO: 2040115 - protein, 26 aa, Staphylococcus
SQEKLKGRYSIVVFDSYGKVTLDNKQ

SEQ ID NO: 2040116 - protein, 23 aa, Staphylococcus
SQELDKISLFLGDRTTITKNDVS

SEQ ID NO: 2040117 - protein, 24 aa, Staphylococcus
SQELLKRAFNISYYQGQKQAIEAL

SEQ ID NO: 2040118 - protein, 22 aa, Staphylococcus
SQELSKLMLYIGDRPTVNKDDV

SEQ ID NO: 2040119 - protein, 26 aa, Staphylococcus
SQEMAELYEFLGLSVGLNLNSKTTTE

SEQ ID NO: 2040120 - protein, 25 aa, Staphylococcus
SQEPFKQFVHRNHRHERWFDICKKL

SEQ ID NO: 2040121 - protein, 26 aa, Staphylococcus
SQEWLNQAPFSFDLSVMAIYPCLTSG

SEQ ID NO: 2040122 - protein, 29 aa, Staphylococcus
SQFDIPNTWKLIAQMPFGDVRESANEKEI

SEQ ID NO: 2040123 - protein, 24 aa, Staphylococcus
SQFDNLKWLGIEWDESVDKDKGYG

SEQ ID NO: 2040124 - protein, 23 aa, Staphylococcus
SQFDNLKWLGLDWDESIDKDKGF

SEQ ID NO: 2040125 - protein, 24 aa, Staphylococcus
SQFDNLKWLGLDWDESIDKDKGHG

SEQ ID NO: 2040126 - protein, 24 aa, Staphylococcus
SQFDNLKWLGLDWDESIDKDKGYG

SEQ ID NO: 2040127 - protein, 24 aa, Staphylococcus
SQFDNLKWLGLEWDESVDKDKGYG

SEQ ID NO: 2040128 - protein, 19 aa, Staphylococcus
SQFHQCPLVLGSATPSLES

SEQ ID NO: 2040129 - protein, 20 aa, Staphylococcus
SQFIDEVFEIVRVDGNDPIT

SEQ ID NO: 2040130 - protein, 24 aa, Staphylococcus
SQFLNLRHSVKMAVLDNLFEQLQI

SEQ ID NO: 2040131 - protein, 21 aa, Staphylococcus
SQFLWSYVGGHPIDLHYKHAS

SEQ ID NO: 2040132 - protein, 23 aa, Staphylococcus
SQFNRRFTIVSGLAKGADSMAHE

SEQ ID NO: 2040133 - protein, 25 aa, Staphylococcus
SQGLLEGFKNLGFDTYFAVPRSKEE

SEQ ID NO: 2040134 - protein, 25 aa, Staphylococcus
SQGLLEGFKNLGFETYFAVPRSKEE

SEQ ID NO: 2040135 - protein, 18 aa, Staphylococcus
SQGPKRLLANFAPIEKKE

SEQ ID NO: 2040136 - protein, 24 aa, Staphylococcus
SQGPKRLLAQFAPIEKRRIKSWII

SEQ ID NO: 2040137 - protein, 20 aa, Staphylococcus
SQGRAGWNLVTSMTDMEAAN

SEQ ID NO: 2040138 - protein, 21 aa, Staphylococcus
SQGYECGITIANFNDIKEGDI

SEQ ID NO: 2040139 - protein, 20 aa, Staphylococcus
SQHAGLSWLTILKKKDAYSE

SEQ ID NO: 2040140 - protein, 20 aa, Staphylococcus
SQHGRVIVISSIWGETGASM

SEQ ID NO: 2040141 - protein, 18 aa, Staphylococcus
SQHKTLIKREDIFKYLSG

SEQ ID NO: 2040142 - protein, 23 aa, Staphylococcus
SQIDFRLILVGGDVPKVKAKPCI

SEQ ID NO: 2040143 - protein, 17 aa, Staphylococcus
SQIDGKNGFLFVLSGVS

SEQ ID NO: 2040144 - protein, 31 aa, Staphylococcus
SQIKGRYAFDRVDVEGPFYILKHRNHEYERI

SEQ ID NO: 2040145 - protein, 23 aa, Staphylococcus
SQISRLPLIVLTSDRPHELRSVG

SEQ ID NO: 2040146 - protein, 17 aa, Staphylococcus
SQITVCIKKLDNWSKQA

SEQ ID NO: 2040147 - protein, 23 aa, Staphylococcus
SQKAIAFNAGFPASVREVVMSGL

SEQ ID NO: 2040148 - protein, 17 aa, Staphylococcus
SQKDILALINQIKDTHE

SEQ ID NO: 2040149 - protein, 22 aa, Staphylococcus
SQKEGRLGLYYIESGYAQRANR

SEQ ID NO: 2040150 - protein, 18 aa, Staphylococcus
SQKLLLPLYRKSKFPSPQ

SEQ ID NO: 2040151 - protein, 19 aa, Staphylococcus
SQKNAMRTAVKNAKTAINN

SEQ ID NO: 2040152 - protein, 21 aa, Staphylococcus
SQKSKRDVSFMQMARENRIIK

SEQ ID NO: 2040153 - protein, 25 aa, Staphylococcus
SQKSQIRWLSVLDMEGQKEEDVLKN

SEQ ID NO: 2040154 - protein, 20 aa, Staphylococcus
SQKSQIRWLSVLNLKDKSKE

SEQ ID NO: 2040155 - protein, 19 aa, Staphylococcus
SQLAFLKLMENMFGNQPYS

SEQ ID NO: 2040156 - protein, 20 aa, Staphylococcus
SQLATYFGVSMDYLIGLEDD

SEQ ID NO: 2040157 - protein, 20 aa, Staphylococcus
SQLFQFFMSYTIGRFDVSLI

SEQ ID NO: 2040158 - protein, 20 aa, Staphylococcus
SQLKHWLKSVHRLSIEEFVI

SEQ ID NO: 2040159 - protein, 21 aa, Staphylococcus
SQLNMKAPVLVSGTDGVGTKL

SEQ ID NO: 2040160 - protein, 19 aa, Staphylococcus
SQLNMKTPVLVSGTDGVGT

SEQ ID NO: 2040161 - protein, 19 aa, Staphylococcus
SQLSCEIRTPVGRNGIVAT

SEQ ID NO: 2040162 - protein, 19 aa, Staphylococcus
SQMAEGWGKKILGDEWQVY

SEQ ID NO: 2040163 - protein, 25 aa, Staphylococcus
SQMKRYEYDIVLAIGQAGGRYELTP

SEQ ID NO: 2040164 - protein, 17 aa, Staphylococcus
SQMLEQIPLSRFGEDKD

SEQ ID NO: 2040165 - protein, 23 aa, Staphylococcus
SQMNKELLARCYTSCLELAEQHG

SEQ ID NO: 2040166 - protein, 19 aa, Staphylococcus
SQMSKKAFAKKVDQETQKI

SEQ ID NO: 2040167 - protein, 22 aa, Staphylococcus
SQMTNAVCRRCEGYSNEYDIMS

SEQ ID NO: 2040168 - protein, 20 aa, Staphylococcus
SQMYREMAKEGVFLPPSQFE

SEQ ID NO: 2040169 - protein, 27 aa, Staphylococcus
SQNKLSFKYIDRILLNWKKNNVKTVDD

SEQ ID NO: 2040170 - protein, 24 aa, Staphylococcus
SQNNRSSLALFIMICTGCRISGVL

SEQ ID NO: 2040171 - protein, 19 aa, Staphylococcus
SQPFWEFPARPYTHHVQDL

SEQ ID NO: 2040172 - protein, 22 aa, Staphylococcus
SQPKWSELISRLSIPQNNTNKY

SEQ ID NO: 2040173 - protein, 20 aa, Staphylococcus
SQPVTLDWDTLVTDESEMEV

SEQ ID NO: 2040174 - protein, 26 aa, Staphylococcus
SQQEIREIIQFIKNYVQSHTFIESLV

SEQ ID NO: 2040175 - protein, 26 aa, Staphylococcus
SQQIVRYCPKAFVIVLTNPVDAMTYT

SEQ ID NO: 2040176 - protein, 27 aa, Staphylococcus
SQQKLKGRYSIVAFDYYGTVKLNDNEL

SEQ ID NO: 2040177 - protein, 17 aa, Staphylococcus
SQQRSSLRTIIVKFEDL

SEQ ID NO: 2040178 - protein, 21 aa, Staphylococcus
SQRAEALKGRIDEVNEQFAKA

SEQ ID NO: 2040179 - protein, 25 aa, Staphylococcus
SQREELKLVIQLVDLRHNPTEDDIL

SEQ ID NO: 2040180 - protein, 25 aa, Staphylococcus
SQREFKQYFPQSGWVEHDANEIWTS

SEQ ID NO: 2040181 - protein, 19 aa, Staphylococcus
SQRLLGMRYFAAFSRQTHI

SEQ ID NO: 2040182 - protein, 21 aa, Staphylococcus
SQRNYICFFEKSKVKPEHYYR

SEQ ID NO: 2040183 - protein, 17 aa, Staphylococcus
SQRTVETLAEFSGVPVW

SEQ ID NO: 2040184 - protein, 17 aa, Staphylococcus
SQRVHFVSRDDWAKLRG

SEQ ID NO: 2040185 - protein, 25 aa, Staphylococcus
SQSFKFHGVVAMQLFLSDDLELPSK

SEQ ID NO: 2040186 - protein, 24 aa, Staphylococcus
SQSGRIVVISSIWGETGASMESVY

SEQ ID NO: 2040187 - protein, 35 aa, Staphylococcus
SQSLEHLLFGLGIRHLGVKASRVLAEKYETMDRLL

SEQ ID NO: 2040188 - protein, 24 aa, Staphylococcus
SQSLKGALFTSLLLEKMHMHTTPK

SEQ ID NO: 2040189 - protein, 22 aa, Staphylococcus
SQSLKGALFTSLLLEKMKMKTV

SEQ ID NO: 2040190 - protein, 22 aa, Staphylococcus
SQSLKGALFTSLLLTKLNMRTV

SEQ ID NO: 2040191 - protein, 25 aa, Staphylococcus
SQTDFEVGNSIYLNILVKDIEEKSQ

SEQ ID NO: 2040192 - protein, 20 aa, Staphylococcus
SQTFLKYAVNDQFSSKLLDL

SEQ ID NO: 2040193 - protein, 18 aa, Staphylococcus
SQTLFFGGLARIDYVSGG

SEQ ID NO: 2040194 - protein, 23 aa, Staphylococcus
SQTLRFIEGYARNYIPELLPYAE

SEQ ID NO: 2040195 - protein, 20 aa, Staphylococcus
SQVIICFDGLDFFRFGRIQR

SEQ ID NO: 2040196 - protein, 23 aa, Staphylococcus
SQVKAGDIIKNMAPIVGGKGGGR

SEQ ID NO: 2040197 - protein, 19 aa, Staphylococcus
SQVKLLFNECYNTIVNHLE

SEQ ID NO: 2040198 - protein, 24 aa, Staphylococcus
SQVKTGETAPEFTLLDNDLNEVNL

SEQ ID NO: 2040199 - protein, 21 aa, Staphylococcus
SQVQFVGFVGEHSRYDLMLVQ

SEQ ID NO: 2040200 - protein, 19 aa, Staphylococcus
SQVRKNGKAIYQLKVVVNS

SEQ ID NO: 2040201 - protein, 19 aa, Staphylococcus
SQVRPLRIMSQHAVKGGNT

SEQ ID NO: 2040202 - protein, 19 aa, Staphylococcus
SQVRWMGVLDLKDQTPASI

SEQ ID NO: 2040203 - protein, 19 aa, Staphylococcus
SQVRWMGVLNLDGETPASL

SEQ ID NO: 2040204 - protein, 26 aa, Staphylococcus
SQVSDYCLFYPRFANQPNNVMTELLS

SEQ ID NO: 2040205 - protein, 25 aa, Staphylococcus
SQVYGRQLLPMYLKYKLKSKSKSVT

SEQ ID NO: 2040206 - protein, 18 aa, Staphylococcus
SQWLEKWQPYATCTLPKH

SEQ ID NO: 2040207 - protein, 24 aa, Staphylococcus
SQYENIRVVGLMTMAPFTEDEAQI

SEQ ID NO: 2040208 - protein, 18 aa, Staphylococcus
SQYNMDTCFVREKGSGTR

SEQ ID NO: 2040209 - protein, 30 aa, Staphylococcus
SQYQDCLLFFRLGDFYEMFFEDAKVASRVL

SEQ ID NO: 2040210 - protein, 26 aa, Staphylococcus
SRAEWLMLDLFEWSRTDYLMHMYDEM

SEQ ID NO: 2040211 - protein, 26 aa, Staphylococcus
SRAEWLMLDLFHWTRTDYLMHMYDEM

SEQ ID NO: 2040212 - protein, 18 aa, Staphylococcus
SRAGMSLTRNTSRFYQYW

SEQ ID NO: 2040213 - protein, 24 aa, Staphylococcus
SRAIELFKGTGFTIEGELKDKLFI

SEQ ID NO: 2040214 - protein, 23 aa, Staphylococcus
SRAIKTNMLFIPFKGENVDGHCF

SEQ ID NO: 2040215 - protein, 20 aa, Staphylococcus
SRALDSFEFEERRGDALVTK

SEQ ID NO: 2040216 - protein, 20 aa, Staphylococcus
SRAREAGVDRMFVVGFDTPT

SEQ ID NO: 2040217 - protein, 21 aa, Staphylococcus
SRAVKPPVIYGDVKWTKPITV

SEQ ID NO: 2040218 - protein, 17 aa, Staphylococcus
SRDGFLLAQDISSYSLT

SEQ ID NO: 2040219 - protein, 32 aa, Staphylococcus
SRDGQYRGIATWKYDKERGKLIGTIEVPMTLA

SEQ ID NO: 2040220 - protein, 24 aa, Staphylococcus
SREAWSVRELEHYVTTHYSDNKDK

SEQ ID NO: 2040221 - protein, 19 aa, Staphylococcus
SREEEIDYAIKHGIPVSIN

SEQ ID NO: 2040222 - protein, 17 aa, Staphylococcus
SREGFLLAQDISSYSLT

SEQ ID NO: 2040223 - protein, 18 aa, Staphylococcus
SREGFLLAQDISSYSLTL

SEQ ID NO: 2040224 - protein, 18 aa, Staphylococcus
SREKLHDLFHLFMKASKE

SEQ ID NO: 2040225 - protein, 19 aa, Staphylococcus
SRESFPQNVNFYINEQIGL

SEQ ID NO: 2040226 - protein, 27 aa, Staphylococcus
SRFAYDCYRRLLQMFGQVVYGIPMSSF

SEQ ID NO: 2040227 - protein, 24 aa, Staphylococcus
SRFEGYQACPFKHFASHGLRLNER

SEQ ID NO: 2040228 - protein, 18 aa, Staphylococcus
SRFGCIWNADSKEEVEQL

SEQ ID NO: 2040229 - protein, 18 aa, Staphylococcus
SRFGCIWTGDSKEAIEKI

SEQ ID NO: 2040230 - protein, 21 aa, Staphylococcus
SRFGHSLGVYEIVRRIIDESF

SEQ ID NO: 2040231 - protein, 22 aa, Staphylococcus
SRFGHSLGVYEIVRRLIDDSFN

SEQ ID NO: 2040232 - protein, 21 aa, Staphylococcus
SRFGHSLGVYEIVRRLIDESF

SEQ ID NO: 2040233 - protein, 21 aa, Staphylococcus
SRFGHSLGVYEIVRRMIDETF

SEQ ID NO: 2040234 - protein, 19 aa, Staphylococcus
SRFGQFYIEAIRKHDDINI

SEQ ID NO: 2040235 - protein, 17 aa, Staphylococcus
SRFIAHIKPVKTEEEAK

SEQ ID NO: 2040236 - protein, 17 aa, Staphylococcus
SRFISHIKPVASEDEAK

SEQ ID NO: 2040237 - protein, 25 aa, Staphylococcus
SRFKNTRGGQKFILEGGMPEVKGQN

SEQ ID NO: 2040238 - protein, 19 aa, Staphylococcus
SRFKPLGKEDFVTVPDGVA

SEQ ID NO: 2040239 - protein, 17 aa, Staphylococcus
SRFKPLLNQGSITVGNS

SEQ ID NO: 2040240 - protein, 17 aa, Staphylococcus
SRFLKEIPEDLMESHSG

SEQ ID NO: 2040241 - protein, 21 aa, Staphylococcus
SRFQDSLKRIDISPLGAAALS

SEQ ID NO: 2040242 - protein, 18 aa, Staphylococcus
SRFVFIGAGGASLPLLQK

SEQ ID NO: 2040243 - protein, 20 aa, Staphylococcus
SRGAHYKPEFPNRNDEEWLK

SEQ ID NO: 2040244 - protein, 22 aa, Staphylococcus
SRGEIDPVVRFYTWDPATLSVG

SEQ ID NO: 2040245 - protein, 17 aa, Staphylococcus
SRGGLQGLLTFQDLPVN

SEQ ID NO: 2040246 - protein, 18 aa, Staphylococcus
SRGMRMKAAIAIALAHDS

SEQ ID NO: 2040247 - protein, 19 aa, Staphylococcus
SRGSLKIKSKDPFEKPSII

SEQ ID NO: 2040248 - protein, 24 aa, Staphylococcus
SRGSLKIKSKDPFEKPSIVFNYLS

SEQ ID NO: 2040249 - protein, 19 aa, Staphylococcus
SRGTPRIANRLLKRVRDFQ

SEQ ID NO: 2040250 - protein, 18 aa, Staphylococcus
SRGYEYLPTVLKVTHVDA

SEQ ID NO: 2040251 - protein, 17 aa, Staphylococcus
SRHGYQIIKDLEERFKG

SEQ ID NO: 2040252 - protein, 19 aa, Staphylococcus
SRHTLKQQQLRLSEIQEQL

SEQ ID NO: 2040253 - protein, 20 aa, Staphylococcus
SRIAKTGSIIVYKLFFIETY

SEQ ID NO: 2040254 - protein, 18 aa, Staphylococcus
SRIAWHVADGTRPGSGNH

SEQ ID NO: 2040255 - protein, 18 aa, Staphylococcus
SRIDKIIYFHSPQTEKQL

SEQ ID NO: 2040256 - protein, 19 aa, Staphylococcus
SRIGLKRNDEGIINLRDSI

SEQ ID NO: 2040257 - protein, 18 aa, Staphylococcus
SRIGYAYFLHPANKVLNE

SEQ ID NO: 2040258 - protein, 17 aa, Staphylococcus
SRIGYAYFLHPTNKVLS

SEQ ID NO: 2040259 - protein, 17 aa, Staphylococcus
SRIGYAYFLHSANKVLT

SEQ ID NO: 2040260 - protein, 20 aa, Staphylococcus
SRIIDCIETALTRLQLLSKE

SEQ ID NO: 2040261 - protein, 24 aa, Staphylococcus
SRIIKATLEGAGLNQAINYSLVDK

SEQ ID NO: 2040262 - protein, 23 aa, Staphylococcus
SRIKEGKPLASVFLISPSGNNVQ

SEQ ID NO: 2040263 - protein, 17 aa, Staphylococcus
SRIKSSLAIAKDQNIEV

SEQ ID NO: 2040264 - protein, 21 aa, Staphylococcus
SRILFGAGLDEVILMISRAVL

SEQ ID NO: 2040265 - protein, 25 aa, Staphylococcus
SRITCAIASCIFDYLYENSIDNYKE

SEQ ID NO: 2040266 - protein, 20 aa, Staphylococcus
SRIYKARVKSQLPLKPQTID

SEQ ID NO: 2040267 - protein, 19 aa, Staphylococcus
SRIYRYKHHFNNQLQALSF

SEQ ID NO: 2040268 - protein, 17 aa, Staphylococcus
SRKASLVDKVDWETSIP

SEQ ID NO: 2040269 - protein, 22 aa, Staphylococcus
SRKDTVLYLMEYHNRITKKQKE

SEQ ID NO: 2040270 - protein, 21 aa, Staphylococcus
SRKEAILLLHSFTGTVRDVKP

SEQ ID NO: 2040271 - protein, 20 aa, Staphylococcus
SRKLGLSLGIINKAKTMIGT

SEQ ID NO: 2040272 - protein, 19 aa, Staphylococcus
SRKYMVIVVQNFRDSNGEY

SEQ ID NO: 2040273 - protein, 22 aa, Staphylococcus
SRLAKEKHVDWLIESVVQAHKT

SEQ ID NO: 2040274 - protein, 17 aa, Staphylococcus
SRLASEKHVDWIAKAVI

SEQ ID NO: 2040275 - protein, 23 aa, Staphylococcus
SRLASEKHVDWLIRGVVKAKAVI

SEQ ID NO: 2040276 - protein, 22 aa, Staphylococcus
SRLDSRLLEAFNQLKTIQSEVT

SEQ ID NO: 2040277 - protein, 22 aa, Staphylococcus
SRLDSRLVEAFNQLKALQSEIS

SEQ ID NO: 2040278 - protein, 21 aa, Staphylococcus
SRLDSRLVEAFNQLKDIQNSI

SEQ ID NO: 2040279 - protein, 17 aa, Staphylococcus
SRLECKDILGAYGVPVT

SEQ ID NO: 2040280 - protein, 25 aa, Staphylococcus
SRLEGEHFGDFVIRSGVIAEVHSGQ

SEQ ID NO: 2040281 - protein, 25 aa, Staphylococcus
SRLHIIQMSHPIFKQYQTIDHLLET

SEQ ID NO: 2040282 - protein, 21 aa, Staphylococcus
SRLKDGILAIDLLRRPEMTYD

SEQ ID NO: 2040283 - protein, 18 aa, Staphylococcus
SRLKFQFIDIETAEKNTV

SEQ ID NO: 2040284 - protein, 23 aa, Staphylococcus
SRLKIASDALVYYGMEAHAHEFE

SEQ ID NO: 2040285 - protein, 25 aa, Staphylococcus
SRLKSIVGPFAYYIKGFEMLPQMKA

SEQ ID NO: 2040286 - protein, 22 aa, Staphylococcus
SRLLANRLEQVFSEIERITQAS

SEQ ID NO: 2040287 - protein, 19 aa, Staphylococcus
SRLLATRLQQSFNEIEKIT

SEQ ID NO: 2040288 - protein, 21 aa, Staphylococcus
SRLLATRLQQTFSEIQKTTQA

SEQ ID NO: 2040289 - protein, 19 aa, Staphylococcus
SRLLCKMLYNVFTISTYQN

SEQ ID NO: 2040290 - protein, 22 aa, Staphylococcus
SRLLKVPVLLFNPFKRVETESW

SEQ ID NO: 2040291 - protein, 26 aa, Staphylococcus
SRLLNHGIPSYGYRIEAPTTPGTIDV

SEQ ID NO: 2040292 - protein, 19 aa, Staphylococcus
SRLNVPVGGGDHLVSEALY

SEQ ID NO: 2040293 - protein, 31 aa, Staphylococcus; identical to SEQ ID NO: 1798678

SEQ ID NO: 2040294 - protein, 27 aa, Staphylococcus
SRLPEYMIPRKFVWMDHLPLTSNGKLD

SEQ ID NO: 2040295 - protein, 26 aa, Staphylococcus
SRLPEYMIPRKFVWMKQLPLTSNGKL

SEQ ID NO: 2040296 - protein, 27 aa, Staphylococcus
SRLPEYMIPRKFVWMKQLPLTSNGKLD

SEQ ID NO: 2040297 - protein, 18 aa, Staphylococcus
SRLSESLKDFNLSDTVGW

SEQ ID NO: 2040298 - protein, 18 aa, Staphylococcus
SRLVGVQFSALFSDDLYF

SEQ ID NO: 2040299 - protein, 19 aa, Staphylococcus
SRLVKPIGIKVTRLAQGLS

SEQ ID NO: 2040300 - protein, 30 aa, Staphylococcus
SRMDEYVVLRFGWLYGPGTWYGKDGMIYNQ

SEQ ID NO: 2040301 - protein, 19 aa, Staphylococcus
SRMKLKSERLKSNSKLQSS

SEQ ID NO: 2040302 - protein, 19 aa, Staphylococcus
SRMLVKFEQTCGVIKRHPG

SEQ ID NO: 2040303 - protein, 22 aa, Staphylococcus
SRMPVSLNYFAWMQHMSTLDEM

SEQ ID NO: 2040304 - protein, 23 aa, Staphylococcus
SRNEGFGMVILEAMAQDNIVISF

SEQ ID NO: 2040305 - protein, 24 aa, Staphylococcus
SRNEGFGMVILEAMAQDNIVISFD

SEQ ID NO: 2040306 - protein, 24 aa, Staphylococcus
SRNEGFGMVILEAMAQHNIVISFK

SEQ ID NO: 2040307 - protein, 22 aa, Staphylococcus
SRNEGFGMVILEAMNQGSVVVS

SEQ ID NO: 2040308 - protein, 24 aa, Staphylococcus
SRNEGFGMVLLEAMAQDNIVISFK

SEQ ID NO: 2040309 - protein, 18 aa, Staphylococcus
SRNGKSWLAELQAKERER

SEQ ID NO: 2040310 - protein, 20 aa, Staphylococcus
SRNGLDHPFDVGNQQFFIEN

SEQ ID NO: 2040311 - protein, 26 aa, Staphylococcus
SRNKFKNCKGGIRFLGVKDGKNAADP

SEQ ID NO: 2040312 - protein, 26 aa, Staphylococcus
SRNLKEYRFELPLIIRNDYLSHGGMK

SEQ ID NO: 2040313 - protein, 35 aa, Staphylococcus
SRNLTKLLFYSGLRIGEALALQWKDYDFEKGELNI

SEQ ID NO: 2040314 - protein, 17 aa, Staphylococcus
SRNMKALVESLGDITAH

SEQ ID NO: 2040315 - protein, 19 aa, Staphylococcus
SRNPIAFTGLFRSINYRVE

SEQ ID NO: 2040316 - protein, 20 aa, Staphylococcus
SRNPLAWTGLFRSKKHQVAL

SEQ ID NO: 2040317 - protein, 32 aa, Staphylococcus
SRNTFVPSICYNESMGPIQTCDTCMVEIDGQI

SEQ ID NO: 2040318 - protein, 22 aa, Staphylococcus
SRNVGVPALVVFLNKADMVDDE

SEQ ID NO: 2040319 - protein, 24 aa, Staphylococcus
SRNVKSPGSYRVVAGYSSTGKPST

SEQ ID NO: 2040320 - protein, 31 aa, Staphylococcus
SRPESEVNYIMSLPVNFLKTFLPELIEKNVK

SEQ ID NO: 2040321 - protein, 17 aa, Staphylococcus
SRPFSLDALFSTPKLKN

SEQ ID NO: 2040322 - protein, 23 aa, Staphylococcus
SRPGLEMAGYFSHYAANRIQLLG

SEQ ID NO: 2040323 - protein, 26 aa, Staphylococcus
SRPIEIPNFKFGDRVIDSTGALNLQD

SEQ ID NO: 2040324 - protein, 22 aa, Staphylococcus
SRPIEIPNFKFGERVIDSTGAL

SEQ ID NO: 2040325 - protein, 25 aa, Staphylococcus
SRPIKIGLAALVDRGHRELPIRADF

SEQ ID NO: 2040326 - protein, 19 aa, Staphylococcus
SRPSDGLSERSHTTKDDDI

SEQ ID NO: 2040327 - protein, 19 aa, Staphylococcus
SRPSPGYLAVSCHDHSSWQ

SEQ ID NO: 2040328 - protein, 21 aa, Staphylococcus
SRPSYISNPWLKPDEHQSNFL

SEQ ID NO: 2040329 - protein, 21 aa, Staphylococcus
SRPSYVSNPWLKPEEHQSNFL

SEQ ID NO: 2040330 - protein, 19 aa, Staphylococcus
SRQAIWKMIKQNAIKANIT

SEQ ID NO: 2040331 - protein, 18 aa, Staphylococcus
SRQEALKDKIQWVETLPD

SEQ ID NO: 2040332 - protein, 25 aa, Staphylococcus
SRQGIWKLIKQYGVKANIKKKLTPH

SEQ ID NO: 2040333 - protein, 23 aa, Staphylococcus
SRQLIKRLSIEPSRKQDLLQHIL

SEQ ID NO: 2040334 - protein, 20 aa, Staphylococcus
SRQYRYEWFDYIMKQLGASV

SEQ ID NO: 2040335 - protein, 24 aa, Staphylococcus
SRRGQGIASLMLQEAKAFLKEIGV

SEQ ID NO: 2040336 - protein, 20 aa, Staphylococcus
SRRNLLLIGDGSLQLTVQEI

SEQ ID NO: 2040337 - protein, 18 aa, Staphylococcus
SRRQFLYEHQFEKQTDIR

SEQ ID NO: 2040338 - protein, 17 aa, Staphylococcus
SRSDGRMNIGSFDTIDG

SEQ ID NO: 2040339 - protein, 25 aa, Staphylococcus
SRSERPEWNTVGLIGQIYTNVEKDV

SEQ ID NO: 2040340 - protein, 19 aa, Staphylococcus
SRSHLFKLFKRNLNCSPKE

SEQ ID NO: 2040341 - protein, 20 aa, Staphylococcus
SRSIPIFVFMNSAYEQITVW

SEQ ID NO: 2040342 - protein, 20 aa, Staphylococcus
SRSIYGGFVEWEKGHDDESS

SEQ ID NO: 2040343 - protein, 18 aa, Staphylococcus
SRSMGTVSYTFVTEMPEA

SEQ ID NO: 2040344 - protein, 21 aa, Staphylococcus
SRSVEKWAVSDSLPFNVNDNK

SEQ ID NO: 2040345 - protein, 22 aa, Staphylococcus
SRSYLAEWLPFVAYTNQVEDSR

SEQ ID NO: 2040346 - protein, 32 aa, Staphylococcus
SRTKGFDGWAPLFFRGREVSGKTLGIIGFGEI

SEQ ID NO: 2040347 - protein, 17 aa, Staphylococcus
SRTPIQWTSEKQAGFTS

SEQ ID NO: 2040348 - protein, 17 aa, Staphylococcus
SRTPMQWNNEAYGGFTT

SEQ ID NO: 2040349 - protein, 19 aa, Staphylococcus
SRTPMQWNNSTNGGFTEGK

SEQ ID NO: 2040350 - protein, 19 aa, Staphylococcus
SRTPMQWTNEVNGGFTEGT

SEQ ID NO: 2040351 - protein, 22 aa, Staphylococcus
SRTSIKNIFAIGDIVPGLPLAH

SEQ ID NO: 2040352 - protein, 21 aa, Staphylococcus
SRTSIKNIYAIGDIVPGLPLA

SEQ ID NO: 2040353 - protein, 26 aa, Staphylococcus
SRVARDHVLTGLEFACGIPGSIGGAV

SEQ ID NO: 2040354 - protein, 19 aa, Staphylococcus
SRVDYQGQTLYGFVGTGSD

SEQ ID NO: 2040355 - protein, 20 aa, Staphylococcus
SRVEYKGKTQYGFIGAGSDM

SEQ ID NO: 2040356 - protein, 22 aa, Staphylococcus
SRVFLYKKRYQPIEGHEPEVIS

SEQ ID NO: 2040357 - protein, 20 aa, Staphylococcus
SRVGLYLTNSINSVILIHAC

SEQ ID NO: 2040358 - protein, 17 aa, Staphylococcus
SRVKPGAEGLIFHPYLA

SEQ ID NO: 2040359 - protein, 21 aa, Staphylococcus
SRVYLAIGGGFELDEWLGSTS

SEQ ID NO: 2040360 - protein, 22 aa, Staphylococcus
SRVYLAVGGGFQLDEWLGSSST

SEQ ID NO: 2040361 - protein, 17 aa, Staphylococcus
SRVYQLRQSRMEVEKLL

SEQ ID NO: 2040362 - protein, 17 aa, Staphylococcus
SRWDYLISPNRYSTEIF

SEQ ID NO: 2040363 - protein, 17 aa, Staphylococcus
SRWDYLVSPNRYSSKIF

SEQ ID NO: 2040364 - protein, 17 aa, Staphylococcus
SRWNYLVSPNRYSTDIF

SEQ ID NO: 2040365 - protein, 23 aa, Staphylococcus
SRYIKINVSTPMSFKLNNQYMIF

SEQ ID NO: 2040366 - protein, 19 aa, Staphylococcus
SRYMIFYDQEFDLYTKTSR

SEQ ID NO: 2040367 - protein, 17 aa, Staphylococcus
SRYMVFYNDGLELYTKT

SEQ ID NO: 2040368 - protein, 21 aa, Staphylococcus
SSAAARPFLQKELQEKNAEVV

SEQ ID NO: 2040369 - protein, 18 aa, Staphylococcus
SSAAIIAAVRKLMNSTEL

SEQ ID NO: 2040370 - protein, 17 aa, Staphylococcus
SSAAMANGGIAGFVTSA

SEQ ID NO: 2040371 - protein, 24 aa, Staphylococcus
SSAEEKYDLFVLVVTDIINSDSKI

SEQ ID NO: 2040372 - protein, 20 aa, Staphylococcus
SSALEAVIGFLYLDHQHARL

SEQ ID NO: 2040373 - protein, 18 aa, Staphylococcus
SSALPLLDYCTFGRINDL

SEQ ID NO: 2040374 - protein, 18 aa, Staphylococcus
SSARLERFLQLAAENNST

SEQ ID NO: 2040375 - protein, 19 aa, Staphylococcus
SSARLERFLQLSAENNSTV

SEQ ID NO: 2040376 - protein, 27 aa, Staphylococcus
SSASIELLTGWLIKQLFNLHLERLQLI

SEQ ID NO: 2040377 - protein, 21 aa, Staphylococcus
SSCKTGFYFRVLQEGYVHDSD

SEQ ID NO: 2040378 - protein, 24 aa, Staphylococcus
SSDKDFYCAVCKITDKEQKIKNEK

SEQ ID NO: 2040379 - protein, 24 aa, Staphylococcus
SSDLAFYNNIRVVWFKNARYLNQE

SEQ ID NO: 2040380 - protein, 18 aa, Staphylococcus
SSDLKRNNDLIITPLFED

SEQ ID NO: 2040381 - protein, 18 aa, Staphylococcus
SSDLLVMVTYADKMKSII

SEQ ID NO: 2040382 - protein, 25 aa, Staphylococcus
SSDRYLLYLYDWRVIESESSIDNFN

SEQ ID NO: 2040383 - protein, 23 aa, Staphylococcus
SSDWFAELGYAFFDYHYTAELIK

SEQ ID NO: 2040384 - protein, 18 aa, Staphylococcus
SSDWFNAAYIIMWGSNVP

SEQ ID NO: 2040385 - protein, 25 aa, Staphylococcus
SSDWKVMQESCAMLDEFEIPYEKKV

SEQ ID NO: 2040386 - protein, 20 aa, Staphylococcus
SSEAFKSLIHEKLLSNTSFS

SEQ ID NO: 2040387 - protein, 21 aa, Staphylococcus
SSEAFLQEMIDLLPEVKEYAD

SEQ ID NO: 2040388 - protein, 17 aa, Staphylococcus
SSEILIKAAKIGVGVIL

SEQ ID NO: 2040389 - protein, 21 aa, Staphylococcus
SSERLMIGQIVFDGVSDTEIL

SEQ ID NO: 2040390 - protein, 17 aa, Staphylococcus
SSETFKYSPEFAQPINL

SEQ ID NO: 2040391 - protein, 23 aa, Staphylococcus
SSETPRIAIAILDELMATGIDNG

SEQ ID NO: 2040392 - protein, 18 aa, Staphylococcus
SSEVHCVEAIKEYQNPNV

SEQ ID NO: 2040393 - protein, 17 aa, Staphylococcus
SSFIKSLIGEFKPTGSA

SEQ ID NO: 2040394 - protein, 28 aa, Staphylococcus
SSFNIARKMGYFDISKDLLIPINEVENY

SEQ ID NO: 2040395 - protein, 20 aa, Staphylococcus
SSFQILAEIDLKGETPTTYL

SEQ ID NO: 2040396 - protein, 19 aa, Staphylococcus
SSFQRFEFTQDIIYQCGNH

SEQ ID NO: 2040397 - protein, 18 aa, Staphylococcus
SSFTAGFPASVKEVVLSG

SEQ ID NO: 2040398 - protein, 28 aa, Staphylococcus
SSGDYFGEMAIKLADYLDVNTISFGSEH

SEQ ID NO: 2040399 - protein, 21 aa, Staphylococcus
SSGEWLTHEFNIIDTGGIEIG

SEQ ID NO: 2040400 - protein, 24 aa, Staphylococcus
SSGGKRVRPSFVVLSSEYGVNPRN

SEQ ID NO: 2040401 - protein, 17 aa, Staphylococcus
SSGIFAFDNQVLFETLN

SEQ ID NO: 2040402 - protein, 18 aa, Staphylococcus
SSGIFAFDNRVLFSKLEE

SEQ ID NO: 2040403 - protein, 18 aa, Staphylococcus
SSGLAGETDMLWRTYQGI

SEQ ID NO: 2040404 - protein, 22 aa, Staphylococcus
SSGLEAIIGFLYLDHRNERLDA

SEQ ID NO: 2040405 - protein, 19 aa, Staphylococcus
SSGLEAVIGYLYLDHQEER

SEQ ID NO: 2040406 - protein, 26 aa, Staphylococcus
SSGLSKRAAPNFLAHGVSKSSLNAFV

SEQ ID NO: 2040407 - protein, 22 aa, Staphylococcus
SSGMRAKLGFSINVTINPDILV

SEQ ID NO: 2040408 - protein, 18 aa, Staphylococcus
SSGYFKGNITVSMRPMTM

SEQ ID NO: 2040409 - protein, 21 aa, Staphylococcus
SSHGLALGRLSGVEFDVAIFS

SEQ ID NO: 2040410 - protein, 21 aa, Staphylococcus
SSHPSPLSAYRGFFGSKPYSR

SEQ ID NO: 2040411 - protein, 25 aa, Staphylococcus
SSHSSMPFLGENAIKPLLEFIQNID

SEQ ID NO: 2040412 - protein, 20 aa, Staphylococcus
SSIDIARIAANLFKDPAQYN

SEQ ID NO: 2040413 - protein, 20 aa, Staphylococcus
SSIEFQVKHLMVSKVKGSFT

SEQ ID NO: 2040414 - protein, 18 aa, Staphylococcus
SSIFKATTSFNFDTLSER

SEQ ID NO: 2040415 - protein, 17 aa, Staphylococcus
SSIFVNINFFKTLMSKV

SEQ ID NO: 2040416 - protein, 22 aa, Staphylococcus
SSILKFPGVLIRTSTERPEVLD

SEQ ID NO: 2040417 - protein, 23 aa, Staphylococcus
SSILKFPGVLIRTSTERPEVLDK

SEQ ID NO: 2040418 - protein, 24 aa, Staphylococcus
SSIMKAKRIILLAFGKNKQQAIKA

SEQ ID NO: 2040419 - protein, 17 aa, Staphylococcus
SSIMNKFPKGWKIVENK

SEQ ID NO: 2040420 - protein, 24 aa, Staphylococcus
SSKGLEFPFVIYSGLTREFNKKDL

SEQ ID NO: 2040421 - protein, 20 aa, Staphylococcus
SSKGYGRYTLEDELTQVGLL

SEQ ID NO: 2040422 - protein, 17 aa, Staphylococcus
SSKKMVFPINVTKEHIK

SEQ ID NO: 2040423 - protein, 23 aa, Staphylococcus
SSKLWKKIVNKVSLEYPDVTVNH

SEQ ID NO: 2040424 - protein, 23 aa, Staphylococcus
SSKLWRKTVEEVSHDYPDVEVEY

SEQ ID NO: 2040425 - protein, 24 aa, Staphylococcus
SSKQARPLLRDTLARNNNVVKIDL

SEQ ID NO: 2040426 - protein, 24 aa, Staphylococcus
SSKSEQKLSRFILNSPHKLVSMSN

SEQ ID NO: 2040427 - protein, 19 aa, Staphylococcus
SSKSLKHRNDLNFNLFDHA

SEQ ID NO: 2040428 - protein, 19 aa, Staphylococcus
SSLAPMLEQLNHSFEEVKA

SEQ ID NO: 2040429 - protein, 18 aa, Staphylococcus
SSLARMLSQTLGYYEEKE

SEQ ID NO: 2040430 - protein, 24 aa, Staphylococcus
SSLDIANELLISFNGLKELKHLSI

SEQ ID NO: 2040431 - protein, 25 aa, Staphylococcus
SSLENEIWKDMALILKDILSNITEL

SEQ ID NO: 2040432 - protein, 21 aa, Staphylococcus
SSLGLEPWHFVVVQSETLRDK

SEQ ID NO: 2040433 - protein, 27 aa, Staphylococcus
SSLKAGALGLPITYAIIGGDPKRFKRN

SEQ ID NO: 2040434 - protein, 24 aa, Staphylococcus
SSLKDLTTELGICDNVVFNTHTNQ

SEQ ID NO: 2040435 - protein, 22 aa, Staphylococcus
SSLKLSLKYNSAYLVKIYKKNN

SEQ ID NO: 2040436 - protein, 20 aa, Staphylococcus
SSLLRGVDFIQVPTTILAHD

SEQ ID NO: 2040437 - protein, 19 aa, Staphylococcus
SSLPGVWPPTTINEKLYSD

SEQ ID NO: 2040438 - protein, 24 aa, Staphylococcus
SSLQHAASVAAMFLTTEAVVANIP

SEQ ID NO: 2040439 - protein, 20 aa, Staphylococcus
SSLRRGAQILAKYPNLEIKW

SEQ ID NO: 2040440 - protein, 17 aa, Staphylococcus
SSLRRGAQILSKYPHLK

SEQ ID NO: 2040441 - protein, 21 aa, Staphylococcus
SSLSDKSWVAGMGEISKNTHP

SEQ ID NO: 2040442 - protein, 21 aa, Staphylococcus
SSLTESITWADNRASRYADII

SEQ ID NO: 2040443 - protein, 18 aa, Staphylococcus
SSLTHKISQTFNYYEENE

SEQ ID NO: 2040444 - protein, 17 aa, Staphylococcus
SSMADLGVDVTIIEVAD

SEQ ID NO: 2040445 - protein, 19 aa, Staphylococcus
SSMEGRKILILADVLELGE

SEQ ID NO: 2040446 - protein, 23 aa, Staphylococcus
SSMIPQMLYRDFGRINELRIGET

SEQ ID NO: 2040447 - protein, 27 aa, Staphylococcus
SSMPVELDHIIKFSCKPVQQFYGQYDI

SEQ ID NO: 2040448 - protein, 29 aa, Staphylococcus
SSNDPKFKRWVIGSILSRTYYHNMITHLL

SEQ ID NO: 2040449 - protein, 19 aa, Staphylococcus
SSNILPIRLDGATKEFFAW

SEQ ID NO: 2040450 - protein, 25 aa, Staphylococcus
SSNKAYKAWRQWSHKDRAELLLRVA

SEQ ID NO: 2040451 - protein, 35 aa, Staphylococcus
SSNLKLNILIGPLVKLWRIGFEDAQLPTNTEIQQR

SEQ ID NO: 2040452 - protein, 19 aa, Staphylococcus
SSPCGECRQVLKELCDDDM

SEQ ID NO: 2040453 - protein, 19 aa, Staphylococcus
SSPEFDRVLGGGIVQGSLV

SEQ ID NO: 2040454 - protein, 17 aa, Staphylococcus
SSPFLPAYITKERIEKA

SEQ ID NO: 2040455 - protein, 28 aa, Staphylococcus
SSPRSIYCGTIGMLLPEGRMIFNIPIRT

SEQ ID NO: 2040456 - protein, 18 aa, Staphylococcus
SSQGRKATSTGFGSSVNS

SEQ ID NO: 2040457 - protein, 25 aa, Staphylococcus
SSQLYNVHIGFWIYNLSRDVVEPTI

SEQ ID NO: 2040458 - protein, 28 aa, Staphylococcus
SSRDRNMYRLIKFIDKSPIFPLFGNGNN

SEQ ID NO: 2040459 - protein, 21 aa, Staphylococcus
SSRRYPYVKFTPEREIGNDLL

SEQ ID NO: 2040460 - protein, 34 aa, Staphylococcus
SSSASIEILMGWLLKALFNLEVERLELIELGRKV

SEQ ID NO: 2040461 - protein, 20 aa, Staphylococcus
SSSEWKVGDKVTHKAWGEGM

SEQ ID NO: 2040462 - protein, 17 aa, Staphylococcus
SSSGSFKSVEAIAKTLT

SEQ ID NO: 2040463 - protein, 21 aa, Staphylococcus
SSSLPGVWPPTTIDGKQYSDG

SEQ ID NO: 2040464 - protein, 25 aa, Staphylococcus
SSSLRRNSQKFGILYYKKNRLHTMN

SEQ ID NO: 2040465 - protein, 21 aa, Staphylococcus
SSTARASFYIYNTKEDIDQFV

SEQ ID NO: 2040466 - protein, 24 aa, Staphylococcus
SSTFLRKLLLELKNNLNHITLQLD

SEQ ID NO: 2040467 - protein, 25 aa, Staphylococcus
SSTLPVAAFVNWFSLVEYGNIKAGD

SEQ ID NO: 2040468 - protein, 25 aa, Staphylococcus
SSTVPKNKFNVCRNTINYSKIKRLM

SEQ ID NO: 2040469 - protein, 20 aa, Staphylococcus
SSTYEMVEYITADNIVVVTN

SEQ ID NO: 2040470 - protein, 20 aa, Staphylococcus
SSVEKGVKWIKEKEVVEGDE

SEQ ID NO: 2040471 - protein, 18 aa, Staphylococcus
SSVFAPFKNLGMIIIDEE

SEQ ID NO: 2040472 - protein, 19 aa, Staphylococcus
SSVFLETFLFYSGFYYPLY

SEQ ID NO: 2040473 - protein, 18 aa, Staphylococcus
SSVNKWLYVHGRKEWESY

SEQ ID NO: 2040474 - protein, 18 aa, Staphylococcus
SSWGDGLAVLSGQSGVGK

SEQ ID NO: 2040475 - protein, 26 aa, Staphylococcus
SSYLYSLPYNYYEDFGIRKYGFHGTS

SEQ ID NO: 2040476 - protein, 24 aa, Staphylococcus
SSYTDHRIGMTLAIASLLSDETLA

SEQ ID NO: 2040477 - protein, 19 aa, Staphylococcus
STAAPFIISNEGCYSAVLE

SEQ ID NO: 2040478 - protein, 23 aa, Staphylococcus
STAELTFGLVLAVARRIVEGDKL

SEQ ID NO: 2040479 - protein, 23 aa, Staphylococcus
STAGALDIYAYRLAQTLINNEGP

SEQ ID NO: 2040480 - protein, 23 aa, Staphylococcus
STAHGLELMFDRMNEVLDQYVED

SEQ ID NO: 2040481 - protein, 26 aa, Staphylococcus
STALGFAGGFPGDFIAQTLKDSDIHT

SEQ ID NO: 2040482 - protein, 26 aa, Staphylococcus
STALGFAGGFPGEFIAQTLEESQIKT

SEQ ID NO: 2040483 - protein, 27 aa, Staphylococcus
STALGFAGGFPGEFISSILEQSDINTE

SEQ ID NO: 2040484 - protein, 26 aa, Staphylococcus
STALGFAGGFPGKFISKTLEESKIHT

SEQ ID NO: 2040485 - protein, 26 aa, Staphylococcus
STALGFAGGFPGQFIAETLAKSDIGT

SEQ ID NO: 2040486 - protein, 19 aa, Staphylococcus
STASGFPIKDWVPEDSLKM

SEQ ID NO: 2040487 - protein, 17 aa, Staphylococcus
STASIVRFSKKITGKGF

SEQ ID NO: 2040488 - protein, 20 aa, Staphylococcus
STAYIFIKMVQQMKELGVTN

SEQ ID NO: 2040489 - protein, 19 aa, Staphylococcus
STAYPYRDVINYLNQQTDK

SEQ ID NO: 2040490 - protein, 23 aa, Staphylococcus
STDFWQKVIYKLIYDNEVLIVVT

SEQ ID NO: 2040491 - protein, 18 aa, Staphylococcus
STDLVWYLWTGKYSSLFG

SEQ ID NO: 2040492 - protein, 25 aa, Staphylococcus
STDMRYVFEKLVRKFSESYNEEAGA

SEQ ID NO: 2040493 - protein, 20 aa, Staphylococcus
STDYTLYISKLIEAINEIKY

SEQ ID NO: 2040494 - protein, 23 aa, Staphylococcus
STEFPDQTVQVFKIGDGGLGGEI

SEQ ID NO: 2040495 - protein, 20 aa, Staphylococcus
STEFPEQVIQVFQIGEGGLG

SEQ ID NO: 2040496 - protein, 22 aa, Staphylococcus
STEGRSEAGLRSHFAEAKSPMW

SEQ ID NO: 2040497 - protein, 19 aa, Staphylococcus
STEGYKIFVHESERKAEPR

SEQ ID NO: 2040498 - protein, 18 aa, Staphylococcus
STEHIVFICGHYEGYDER

SEQ ID NO: 2040499 - protein, 23 aa, Staphylococcus
STENHWFEWLATQMKSYDYHTEI

SEQ ID NO: 2040500 - protein, 22 aa, Staphylococcus
STENRGAVPYTVFIDPPLARVG

SEQ ID NO: 2040501 - protein, 19 aa, Staphylococcus
STESIRTIMEFLIGNIEKN

SEQ ID NO: 2040502 - protein, 19 aa, Staphylococcus
STFDAWLPYLNQLNAAPAA

SEQ ID NO: 2040503 - protein, 29 aa, Staphylococcus
STFKKGFIFQEILLRPEAEIQQLLHDLNA

SEQ ID NO: 2040504 - protein, 20 aa, Staphylococcus
STFKQLISYCLLENEKGEIL

SEQ ID NO: 2040505 - protein, 26 aa, Staphylococcus
STFNGVLCGRATWQGATEVLAKDGEA

SEQ ID NO: 2040506 - protein, 21 aa, Staphylococcus
STFRGLYQFIRFIDELIERKK

SEQ ID NO: 2040507 - protein, 17 aa, Staphylococcus
STFWPNKAFSFNNKQYF

SEQ ID NO: 2040508 - protein, 23 aa, Staphylococcus
STGASWRKLNVPGEDRLINKGVA

SEQ ID NO: 2040509 - protein, 23 aa, Staphylococcus
STGEALRIKHHLKNDIREAKSFY

SEQ ID NO: 2040510 - protein, 25 aa, Staphylococcus
STGEFRKRYGFIYVNRYDNFEGTFE

SEQ ID NO: 2040511 - protein, 19 aa, Staphylococcus
STGFDLSVVLVDFGKKQNI

SEQ ID NO: 2040512 - protein, 24 aa, Staphylococcus
STGHREWTHMWSGQSPRLATSQHV

SEQ ID NO: 2040513 - protein, 17 aa, Staphylococcus
STGKAKKPVIIYFYGGG

SEQ ID NO: 2040514 - protein, 26 aa, Staphylococcus
STGMKMKLSIAIAFSHHAELFILDEP

SEQ ID NO: 2040515 - protein, 18 aa, Staphylococcus
STGMKMKLSLALALSHHA

SEQ ID NO: 2040516 - protein, 20 aa, Staphylococcus
STGTACGHGLLLSDGLVHKI

SEQ ID NO: 2040517 - protein, 23 aa, Staphylococcus
STHLVKSKRQGQTMIYSLDDKHV

SEQ ID NO: 2040518 - protein, 22 aa, Staphylococcus
STHPLLKRKAQRVTEFDKSLTQ

SEQ ID NO: 2040519 - protein, 26 aa, Staphylococcus
STHPRTDLNTGVWIVGADVEPGNYTV

SEQ ID NO: 2040520 - protein, 23 aa, Staphylococcus
STHPVLFKKAKKITTFDENLKRL

SEQ ID NO: 2040521 - protein, 19 aa, Staphylococcus
STIEMIPFIKAQDIVVVTN

SEQ ID NO: 2040522 - protein, 20 aa, Staphylococcus
STIEMIPFIKAQNIVVVTNG

SEQ ID NO: 2040523 - protein, 20 aa, Staphylococcus
STIEMIPFITAKDIVVVTNG

SEQ ID NO: 2040524 - protein, 19 aa, Staphylococcus
STIEPSRKQALLQHVLSED

SEQ ID NO: 2040525 - protein, 17 aa, Staphylococcus
STIESRLQHTLKLPVNI

SEQ ID NO: 2040526 - protein, 24 aa, Staphylococcus
STIFPDFIGHTFAVYDGRKHVPVF

SEQ ID NO: 2040527 - protein, 24 aa, Staphylococcus
STIGADCYLEPSVSASCKIINRFS

SEQ ID NO: 2040528 - protein, 24 aa, Staphylococcus
STIKLLSSYLYKIFGKDISIEAIE

SEQ ID NO: 2040529 - protein, 19 aa, Staphylococcus
STIKRVMRLIDNIRQYGHL

SEQ ID NO: 2040530 - protein, 20 aa, Staphylococcus
STIMSAKRIILLAFGEKKKD

SEQ ID NO: 2040531 - protein, 22 aa, Staphylococcus
STIPREDVASVLKHVATSENKF

SEQ ID NO: 2040532 - protein, 21 aa, Staphylococcus
STIPVKGVRKAIAQNMVTSVT

SEQ ID NO: 2040533 - protein, 18 aa, Staphylococcus
STIQTKCCFKTYEMILPF

SEQ ID NO: 2040534 - protein, 17 aa, Staphylococcus
STITGERIIVFKLDKNL

SEQ ID NO: 2040535 - protein, 22 aa, Staphylococcus
STKAAAILNDFEHVADKVIKVI

SEQ ID NO: 2040536 - protein, 19 aa, Staphylococcus
STKEIVRFISTHPDEDHIH

SEQ ID NO: 2040537 - protein, 17 aa, Staphylococcus
STLANVTDIFKSLSEPN

SEQ ID NO: 2040538 - protein, 25 aa, Staphylococcus
STLEFKCQIIGLPFWKTKYSTQEIQ

SEQ ID NO: 2040539 - protein, 19 aa, Staphylococcus
STLEMIQYIDARDIIVVTN

SEQ ID NO: 2040540 - protein, 22 aa, Staphylococcus
STLEYRIIEALVQHAKSVTVLL

SEQ ID NO: 2040541 - protein, 20 aa, Staphylococcus
STLHSFCLKLIQQHYDVLDV

SEQ ID NO: 2040542 - protein, 18 aa, Staphylococcus
STLHSFCLKVIQQHYDVI

SEQ ID NO: 2040543 - protein, 24 aa, Staphylococcus
STLILSRRHIVIISNKEHFFKEII

SEQ ID NO: 2040544 - protein, 18 aa, Staphylococcus
STLLRGVDFIQVPTTILA

SEQ ID NO: 2040545 - protein, 19 aa, Staphylococcus
STLLRGVGFIQVPTTILAH

SEQ ID NO: 2040546 - protein, 17 aa, Staphylococcus
STLLSAISRLIDVDSGE

SEQ ID NO: 2040547 - protein, 18 aa, Staphylococcus
STLLSAITRLIDFEEGTI

SEQ ID NO: 2040548 - protein, 23 aa, Staphylococcus
STLNRITSAFVRLQYNINELYVK

SEQ ID NO: 2040549 - protein, 23 aa, Staphylococcus
STLNRITSAFVRLQYNISELEVK

SEQ ID NO: 2040550 - protein, 19 aa, Staphylococcus
STLPDAFAIVHPMHPEFDY

SEQ ID NO: 2040551 - protein, 31 aa, Staphylococcus
STLPLSLGIESCVIRLSPQYFYQDTDRDGPK

SEQ ID NO: 2040552 - protein, 24 aa, Staphylococcus
STLRETFAGLGFNLYDHTHLFNTL

SEQ ID NO: 2040553 - protein, 17 aa, Staphylococcus
STLSDFANELSIASQYT

SEQ ID NO: 2040554 - protein, 28 aa, Staphylococcus
STLSGGQFQRLWIAKALLVEPEVLILDE

SEQ ID NO: 2040555 - protein, 17 aa, Staphylococcus
STLSLRLAEALFKDQKR

SEQ ID NO: 2040556 - protein, 17 aa, Staphylococcus
STLVGLGPRILRAETAP

SEQ ID NO: 2040557 - protein, 19 aa, Staphylococcus
STLYGFKKMIKKGAMTPEM

SEQ ID NO: 2040558 - protein, 24 aa, Staphylococcus
STMIRQGLKPVLFVINNDGYTVER

SEQ ID NO: 2040559 - protein, 28 aa, Staphylococcus
STMRVDAIIKKRLSQMALDKDTSIKSIS

SEQ ID NO: 2040560 - protein, 22 aa, Staphylococcus
STMTNAICRQCEGYSNEFALKS

SEQ ID NO: 2040561 - protein, 25 aa, Staphylococcus
STNDARFGYEIGEMSQSFDLESFDT

SEQ ID NO: 2040562 - protein, 23 aa, Staphylococcus
STNGRIIVISSIWGETGASMETI

SEQ ID NO: 2040563 - protein, 20 aa, Staphylococcus
STNGWLFKLVWSDSQLSTIY

SEQ ID NO: 2040564 - protein, 20 aa, Staphylococcus
STNLVFKYALDMNLLKKLPN

SEQ ID NO: 2040565 - protein, 21 aa, Staphylococcus
STNQVPLTWEIRQRWANDRRY

SEQ ID NO: 2040566 - protein, 22 aa, Staphylococcus
STPKFIIGFGGIPKNQLTSHTE

SEQ ID NO: 2040567 - protein, 25 aa, Staphylococcus
STPKSHYRYAFNLAEIDAENFPLHT

SEQ ID NO: 2040568 - protein, 24 aa, Staphylococcus
STPNYRKHWHVVFHLDNGKQLVYS

SEQ ID NO: 2040569 - protein, 17 aa, Staphylococcus
STPRLVTEDGYFLTANK

SEQ ID NO: 2040570 - protein, 24 aa, Staphylococcus
STPSFIEMCLLLPNLNEKQYNSLN

SEQ ID NO: 2040571 - protein, 25 aa, Staphylococcus
STPSFIEMCLLLPTLDEKQYPSLKE

SEQ ID NO: 2040572 - protein, 25 aa, Staphylococcus
STPSFIEMCLLLPTLNEEQYGSLNH

SEQ ID NO: 2040573 - protein, 23 aa, Staphylococcus
STQKLCRDLLDLIGHSSQPEEIY

SEQ ID NO: 2040574 - protein, 20 aa, Staphylococcus
STQNLDLWYGDTHALQNINL

SEQ ID NO: 2040575 - protein, 21 aa, Staphylococcus
STQNLDLWYGENHALKNINLD

SEQ ID NO: 2040576 - protein, 19 aa, Staphylococcus
STQVIKSFESSAAKFKSLA

SEQ ID NO: 2040577 - protein, 17 aa, Staphylococcus
STRLAERDRLSVIAEIK

SEQ ID NO: 2040578 - protein, 18 aa, Staphylococcus
STRLKSGTAQKLILNMIS

SEQ ID NO: 2040579 - protein, 19 aa, Staphylococcus
STRNSLGMHECTERNHYFI

SEQ ID NO: 2040580 - protein, 26 aa, Staphylococcus
STRTLRYYHEIGLLVPSYIDDNGYRY

SEQ ID NO: 2040581 - protein, 18 aa, Staphylococcus
STRTRCAFETAAYDQGAH

SEQ ID NO: 2040582 - protein, 24 aa, Staphylococcus
STRYPNVFMIGATVRHDNATLCYI

SEQ ID NO: 2040583 - protein, 19 aa, Staphylococcus
STSEIDEVILVGGSTRIPA

SEQ ID NO: 2040584 - protein, 23 aa, Staphylococcus
STSLFKAAVVCRVNGTLVDLTYP

SEQ ID NO: 2040585 - protein, 27 aa, Staphylococcus
STSMALRYEMIISRLKYANDIILINEH

SEQ ID NO: 2040586 - protein, 19 aa, Staphylococcus
STSQWMGKVIKQHHNDYPN

SEQ ID NO: 2040587 - protein, 24 aa, Staphylococcus
STTDKSADVLLDMDAKSFTMGDYV

SEQ ID NO: 2040588 - protein, 19 aa, Staphylococcus
STTDKSAEELLNMDAKSFN

SEQ ID NO: 2040589 - protein, 24 aa, Staphylococcus
STTLRRLMNLYGFKEALQQSTLPM

SEQ ID NO: 2040590 - protein, 24 aa, Staphylococcus
STTLRRLMNLYGFKEALVNSDLPM

SEQ ID NO: 2040591 - protein, 24 aa, Staphylococcus
STVFPNFIGHTFAVYDGRKHVPVY

SEQ ID NO: 2040592 - protein, 28 aa, Staphylococcus
STVLDCTTYPFKIARPGAITQSMINAIL

SEQ ID NO: 2040593 - protein, 24 aa, Staphylococcus
STVSELLTAFGFKVVDADIAARKA

SEQ ID NO: 2040594 - protein, 24 aa, Staphylococcus
STVSELLTAFGFKVVDADTAAREA

SEQ ID NO: 2040595 - protein, 24 aa, Staphylococcus
STVSELLTAYGFKVVDADIAAREA

SEQ ID NO: 2040596 - protein, 24 aa, Staphylococcus
STVSELLTAYGFKVVDADVASRKA

SEQ ID NO: 2040597 - protein, 18 aa, Staphylococcus
STVTAFCERLKKEIYEET

SEQ ID NO: 2040598 - protein, 17 aa, Staphylococcus
STVYAFCERLKKEILEE

SEQ ID NO: 2040599 - protein, 20 aa, Staphylococcus
STYIDRFEWQNAKFPVVQNV

SEQ ID NO: 2040600 - protein, 26 aa, Staphylococcus
STYIHRAKIGGVLSVSELNVIKRLIQ

SEQ ID NO: 2040601 - protein, 18 aa, Staphylococcus
STYRLCTDLLNILDSSSQ

SEQ ID NO: 2040602 - protein, 19 aa, Staphylococcus
STYTFSIEAFREFLDINSK

SEQ ID NO: 2040603 - protein, 29 aa, Staphylococcus
SVAFDFSFLYKPVIYYQFDKERFLGKDGS

SEQ ID NO: 2040604 - protein, 25 aa, Staphylococcus
SVAKIPYEYCKDGISNTFSIVPKSL

SEQ ID NO: 2040605 - protein, 21 aa, Staphylococcus
SVALQIGSAIKRIYLTDQEKE

SEQ ID NO: 2040606 - protein, 21 aa, Staphylococcus
SVATFRLREGMPIGAKVTLRG

SEQ ID NO: 2040607 - protein, 26 aa, Staphylococcus
SVATFRLREGMPIGAKVTLRGERMYD

SEQ ID NO: 2040608 - protein, 21 aa, Staphylococcus
SVATFTLAVNRTFTNAQGERE

SEQ ID NO: 2040609 - protein, 17 aa, Staphylococcus
SVCPAPCEQSCVMNINR

SEQ ID NO: 2040610 - protein, 21 aa, Staphylococcus
SVCSRVLKFGLRFLKKTKRFS

SEQ ID NO: 2040611 - protein, 23 aa, Staphylococcus
SVDELKKIKGIGEKTFEKLKQYF

SEQ ID NO: 2040612 - protein, 23 aa, Staphylococcus
SVDEYEPLCEVITDKVTAEVPST

SEQ ID NO: 2040613 - protein, 27 aa, Staphylococcus
SVDKGDSWLPIGTRFTYNSPFKKQDIP

SEQ ID NO: 2040614 - protein, 24 aa, Staphylococcus
SVDKRIDFIQVFKDDKFLCAFKTE

SEQ ID NO: 2040615 - protein, 17 aa, Staphylococcus
SVDLPFAQKRWCASNGL

SEQ ID NO: 2040616 - protein, 18 aa, Staphylococcus
SVDLPFAQKRWCASNGLD

SEQ ID NO: 2040617 - protein, 23 aa, Staphylococcus
SVEEQKAIILYALIQSKHAVKQY

SEQ ID NO: 2040618 - protein, 23 aa, Staphylococcus
SVEEQKVIILYALIQSKHAVKQY

SEQ ID NO: 2040619 - protein, 27 aa, Staphylococcus
SVEGLDIDFNYGLPILEMDGAANKSEV

SEQ ID NO: 2040620 - protein, 20 aa, Staphylococcus
SVEHFNFIPDMITFGKSLAG

SEQ ID NO: 2040621 - protein, 30 aa, Staphylococcus
SVEKDIYSQMAWDGFQPFKIEEIKHISSDI

SEQ ID NO: 2040622 - protein, 21 aa, Staphylococcus
SVEKGEFISIMGPSGSGKTTL

SEQ ID NO: 2040623 - protein, 24 aa, Staphylococcus
SVELRPSSLDDLGIEAAFNSYFKQ

SEQ ID NO: 2040624 - protein, 25 aa, Staphylococcus
SVETIAFPCLALIASTFDKDLLRKY

SEQ ID NO: 2040625 - protein, 27 aa, Staphylococcus
SVEWLKKYSTNFAIIFKQANQSHYSIV

SEQ ID NO: 2040626 - protein, 19 aa, Staphylococcus
SVFDMLEIVENITLESVNE

SEQ ID NO: 2040627 - protein, 21 aa, Staphylococcus
SVFQHKGLKVFGLTASPNYIA

SEQ ID NO: 2040628 - protein, 24 aa, Staphylococcus
SVGDRQLVKVAAWYDNEMSYTAQL

SEQ ID NO: 2040629 - protein, 19 aa, Staphylococcus
SVGGALALKYGVKHNNDNL

SEQ ID NO: 2040630 - protein, 19 aa, Staphylococcus
SVGKAYLVEPNWLEKILND

SEQ ID NO: 2040631 - protein, 25 aa, Staphylococcus
SVGKDISCNVVRTWIHQHTVILGIH

SEQ ID NO: 2040632 - protein, 25 aa, Staphylococcus
SVGKDLSCSVVRTWVHQHTVILGIH

SEQ ID NO: 2040633 - protein, 17 aa, Staphylococcus
SVGPGQVFKDLIESKAF

SEQ ID NO: 2040634 - protein, 17 aa, Staphylococcus
SVGRIIVEKGIMASRAR

SEQ ID NO: 2040635 - protein, 22 aa, Staphylococcus
SVHPSPLSAYRGFFGSKPYSRT

SEQ ID NO: 2040636 - protein, 18 aa, Staphylococcus
SVIDACLTPALTPISTIQ

SEQ ID NO: 2040637 - protein, 25 aa, Staphylococcus
SVIEQCVPESLNLKVVIFDEDDFEF

SEQ ID NO: 2040638 - protein, 23 aa, Staphylococcus
SVIGGRWKIPIIYHLLQSEVLRL

SEQ ID NO: 2040639 - protein, 22 aa, Staphylococcus
SVIKATIFIADMNEFQNINEIY

SEQ ID NO: 2040640 - protein, 24 aa, Staphylococcus
SVIKSLNLKPGDVLVQEIVDGQII

SEQ ID NO: 2040641 - protein, 17 aa, Staphylococcus
SVILGVGYENIHTTSER

SEQ ID NO: 2040642 - protein, 34 aa, Staphylococcus
SVIPKEITKRVAIEMASPLGWHKYVGTEGKVIGI

SEQ ID NO: 2040643 - protein, 34 aa, Staphylococcus
SVIPKELTKRVAIEMASPLGWHKYVGTEGKVIGI

SEQ ID NO: 2040644 - protein, 17 aa, Staphylococcus
SVIPQFIERGSGAIVSI

SEQ ID NO: 2040645 - protein, 18 aa, Staphylococcus
SVIQKICNRVAVMEHGEV

SEQ ID NO: 2040646 - protein, 18 aa, Staphylococcus
SVIQKICNRVAVMENGEV

SEQ ID NO: 2040647 - protein, 19 aa, Staphylococcus
SVIQKICNRVAVMEQGEVI

SEQ ID NO: 2040648 - protein, 29 aa, Staphylococcus
SVIRDGHKLDFPESVVSYFKGEIGQPVNG

SEQ ID NO: 2040649 - protein, 21 aa, Staphylococcus
SVIRLNGHFEPTVTHAYINDA

SEQ ID NO: 2040650 - protein, 23 aa, Staphylococcus
SVKDRIALAMIEKAEREGKIQPG

SEQ ID NO: 2040651 - protein, 20 aa, Staphylococcus
SVKDRLGKHLIETAIRENII

SEQ ID NO: 2040652 - protein, 21 aa, Staphylococcus
SVKIDGSWLSKLIHFLESNYD

SEQ ID NO: 2040653 - protein, 20 aa, Staphylococcus
SVKLIRRGDINMNLHFVEGK

SEQ ID NO: 2040654 - protein, 27 aa, Staphylococcus
SVKQVSRIPLSLTFDHQILDGASAADF

SEQ ID NO: 2040655 - protein, 18 aa, Staphylococcus
SVKSCYILKYVFANHLSR

SEQ ID NO: 2040656 - protein, 23 aa, Staphylococcus
SVKTGEGGKLFGSISTKQIADAL

SEQ ID NO: 2040657 - protein, 20 aa, Staphylococcus
SVKTRLGYSEIDEWRDWLRH

SEQ ID NO: 2040658 - protein, 23 aa, Staphylococcus
SVKVEGLINLPSLIEENVYRIIQ

SEQ ID NO: 2040659 - protein, 25 aa, Staphylococcus
SVKYVTGKMSFIYADAISHRIVDAV

SEQ ID NO: 2040660 - protein, 20 aa, Staphylococcus
SVLDALSYYQFVILKMVVGE

SEQ ID NO: 2040661 - protein, 24 aa, Staphylococcus
SVLEEFDNVIGLDRIKVLHVNDSK

SEQ ID NO: 2040662 - protein, 26 aa, Staphylococcus
SVLEPRINQLLPYQVNKEMLINTMNP

SEQ ID NO: 2040663 - protein, 20 aa, Staphylococcus
SVLIDLGLIIGKDARRKREI

SEQ ID NO: 2040664 - protein, 18 aa, Staphylococcus
SVLKARRQIKGLSQNEME

SEQ ID NO: 2040665 - protein, 17 aa, Staphylococcus
SVLKYIADKIHGDFRNL

SEQ ID NO: 2040666 - protein, 18 aa, Staphylococcus
SVLQELGAEVGWYIPNRF

SEQ ID NO: 2040667 - protein, 19 aa, Staphylococcus
SVLRALKAIERSNVVLLVI

SEQ ID NO: 2040668 - protein, 24 aa, Staphylococcus
SVLRKVVEHFGEFNVLVNNAGLGP

SEQ ID NO: 2040669 - protein, 26 aa, Staphylococcus
SVLSELCLPLVKKGGHFIALKSSKGE

SEQ ID NO: 2040670 - protein, 18 aa, Staphylococcus
SVLSHYWGGDKLDIRQDL

SEQ ID NO: 2040671 - protein, 24 aa, Staphylococcus
SVLSKRNNFSFLPISSCRDLNLPY

SEQ ID NO: 2040672 - protein, 20 aa, Staphylococcus
SVLSKVLVRASQKWQDDKAL

SEQ ID NO: 2040673 - protein, 24 aa, Staphylococcus
SVLTGRLSGNIGYVASKVAQEVKA

SEQ ID NO: 2040674 - protein, 21 aa, Staphylococcus
SVLVPKWANWDHFHELDKKGL

SEQ ID NO: 2040675 - protein, 20 aa, Staphylococcus
SVMPGFDFYFVPTVLNSADV

SEQ ID NO: 2040676 - protein, 20 aa, Staphylococcus
SVMPGFDFYFVPTVLNSNNV

SEQ ID NO: 2040677 - protein, 22 aa, Staphylococcus
SVNEIPHAWMMVEADATNLVKT

SEQ ID NO: 2040678 - protein, 18 aa, Staphylococcus
SVNKGVAIKELLKEWDIQ

SEQ ID NO: 2040679 - protein, 19 aa, Staphylococcus
SVNLKRKASSLLLIDIAVP

SEQ ID NO: 2040680 - protein, 18 aa, Staphylococcus
SVNSEWMIPKILEVKHKA

SEQ ID NO: 2040681 - protein, 23 aa, Staphylococcus
SVPEGQVVWGPVFSEIKGQLETS

SEQ ID NO: 2040682 - protein, 19 aa, Staphylococcus
SVPEIADRYIQAFYEDVGA

SEQ ID NO: 2040683 - protein, 33 aa, Staphylococcus
SVPFEYDVLKALSRLRIVIDLNDEPDLFLQIAS

SEQ ID NO: 2040684 - protein, 21 aa, Staphylococcus
SVPGLKAKPIIDILPVVQDIN

SEQ ID NO: 2040685 - protein, 19 aa, Staphylococcus
SVQNLYRIEAHQTKLETIE

SEQ ID NO: 2040686 - protein, 24 aa, Staphylococcus
SVQPKAKFPPSLKNMYQELEDDIG

SEQ ID NO: 2040687 - protein, 21 aa, Staphylococcus
SVQPNAKFPPSLRNMYQELED

SEQ ID NO: 2040688 - protein, 17 aa, Staphylococcus
SVQRIIFSGSLVARSQL

SEQ ID NO: 2040689 - protein, 19 aa, Staphylococcus
SVQYQRFIRHVQFLIRRLK

SEQ ID NO: 2040690 - protein, 25 aa, Staphylococcus
SVRGEMPDIEFKYLTPENFNEIKEK

SEQ ID NO: 2040691 - protein, 20 aa, Staphylococcus
SVRIPEELLQFEGQTKSKLG

SEQ ID NO: 2040692 - protein, 18 aa, Staphylococcus
SVRSRVANISEFLDEPLD

SEQ ID NO: 2040693 - protein, 27 aa, Staphylococcus
SVRSYNCLKRAGINTVQELADKSEADM

SEQ ID NO: 2040694 - protein, 19 aa, Staphylococcus
SVRYPGYVSSLTFVNPTSV

SEQ ID NO: 2040695 - protein, 18 aa, Staphylococcus
SVSELTQFPEIMDGRVKT

SEQ ID NO: 2040696 - protein, 26 aa, Staphylococcus
SVSLARFPWLSANIEYNMTREPYFST

SEQ ID NO: 2040697 - protein, 18 aa, Staphylococcus
SVSLKFDKVQEFKQSVVN

SEQ ID NO: 2040698 - protein, 25 aa, Staphylococcus
SVSNKIKALELIKQYQNVEQQIHEN

SEQ ID NO: 2040699 - protein, 18 aa, Staphylococcus
SVSREKASHVVRDLSNKN

SEQ ID NO: 2040700 - protein, 25 aa, Staphylococcus
SVSWNIKQARNFRKRMDAEIAKQDD

SEQ ID NO: 2040701 - protein, 17 aa, Staphylococcus
SVTASLLTHVFGLHHFA

SEQ ID NO: 2040702 - protein, 23 aa, Staphylococcus
SVTEIPHGWMMIEADATNLVKTR

SEQ ID NO: 2040703 - protein, 23 aa, Staphylococcus
SVTEIPHGWMMVEIDASNLVQTR

SEQ ID NO: 2040704 - protein, 18 aa, Staphylococcus
SVTGISFSNNFGPKAKDE

SEQ ID NO: 2040705 - protein, 17 aa, Staphylococcus
SVTGISFSNNFGPKSKD

SEQ ID NO: 2040706 - protein, 17 aa, Staphylococcus
SVTGISFSNNFGPTAKQ

SEQ ID NO: 2040707 - protein, 17 aa, Staphylococcus
SVTGISFSSNFGPNSKD

SEQ ID NO: 2040708 - protein, 20 aa, Staphylococcus
SVTYEFKLNNQIFKIHREAP

SEQ ID NO: 2040709 - protein, 19 aa, Staphylococcus
SVVCSPEIFAQLLHTIATR

SEQ ID NO: 2040710 - protein, 24 aa, Staphylococcus
SVVESKCLILFTSYKMMHMVQELI

SEQ ID NO: 2040711 - protein, 24 aa, Staphylococcus
SVVPLKPLQEAFGLKRVAYTTYQA

SEQ ID NO: 2040712 - protein, 17 aa, Staphylococcus
SVVPLKVLQDAFGLSRV

SEQ ID NO: 2040713 - protein, 19 aa, Staphylococcus
SVVPVLLLSAGHYYKDIPA

SEQ ID NO: 2040714 - protein, 22 aa, Staphylococcus
SVVYLKNTMPFQYNVSKHLATE

SEQ ID NO: 2040715 - protein, 31 aa, Staphylococcus
SVYDPTCGSGSLLLRVGREANVRQYYGQEYN

SEQ ID NO: 2040716 - protein, 23 aa, Staphylococcus
SVYMLGGNGLRTALTDAGLTVKE

SEQ ID NO: 2040717 - protein, 17 aa, Staphylococcus
SVYPKLEGYGIKQIAQR

SEQ ID NO: 2040718 - protein, 26 aa, Staphylococcus
SVYRVKNGVCNIIFNVRMTSAKAETS

SEQ ID NO: 2040719 - protein, 30 aa, Staphylococcus
SWDDPRGSFYIWFEFSISINVKTLFNEAVK

SEQ ID NO: 2040720 - protein, 18 aa, Staphylococcus
SWDNVGLLIGDESQEVTG

SEQ ID NO: 2040721 - protein, 29 aa, Staphylococcus
SWDSPFGKGRPGWHIECSVMAYNELGETI

SEQ ID NO: 2040722 - protein, 18 aa, Staphylococcus
SWEKIGVRLVDKLLETFP

SEQ ID NO: 2040723 - protein, 29 aa, Staphylococcus
SWESPFGQGRPGWHIECSVMAYHELGKTI

SEQ ID NO: 2040724 - protein, 17 aa, Staphylococcus
SWIDCDIDDQFLDVKIK

SEQ ID NO: 2040725 - protein, 17 aa, Staphylococcus
SWIVLKFDSNISGALDD

SEQ ID NO: 2040726 - protein, 22 aa, Staphylococcus
SWKEMKLMEFLSVIDGDRGKNY

SEQ ID NO: 2040727 - protein, 18 aa, Staphylococcus
SWLKESIKNISDENEKAL

SEQ ID NO: 2040728 - protein, 18 aa, Staphylococcus
SWNGLIINYLSRCEQHSA

SEQ ID NO: 2040729 - protein, 17 aa, Staphylococcus
SWNGLIINYLSRCTEKS

SEQ ID NO: 2040730 - protein, 24 aa, Staphylococcus
SWQEALSYVKGVYVITDMHNGQLY

SEQ ID NO: 2040731 - protein, 18 aa, Staphylococcus
SWTDSWIELFVARRMDHL

SEQ ID NO: 2040732 - protein, 18 aa, Staphylococcus
SWTDSWKEIFVHRRLDHL

SEQ ID NO: 2040733 - protein, 19 aa, Staphylococcus
SWYYSKRLLYSKLEALRAQ

SEQ ID NO: 2040734 - protein, 22 aa, Staphylococcus
SYADIKYQLGLIGKTENEKLLK

SEQ ID NO: 2040735 - protein, 18 aa, Staphylococcus
SYALLWGQNACKPPLKER

SEQ ID NO: 2040736 - protein, 24 aa, Staphylococcus
SYAYQLLLDLGFDHHIMEQSPFEM

SEQ ID NO: 2040737 - protein, 25 aa, Staphylococcus
SYCGPGRRKTFAFVNNRPLAALTED

SEQ ID NO: 2040738 - protein, 19 aa, Staphylococcus
SYCSNLFGRYLHMNFKEYY

SEQ ID NO: 2040739 - protein, 22 aa, Staphylococcus
SYDKRFSPDQVVAYQKHQGDKF

SEQ ID NO: 2040740 - protein, 24 aa, Staphylococcus
SYDLEIGSGMFIPGFEEQLVGLKT

SEQ ID NO: 2040741 - protein, 18 aa, Staphylococcus
SYDLGVSHFGGFSEYARV

SEQ ID NO: 2040742 - protein, 24 aa, Staphylococcus
SYDRLEGFNSLQWPVDKDGKDSPI

SEQ ID NO: 2040743 - protein, 21 aa, Staphylococcus
SYDRLQGFDSLQWPVHEDGTD

SEQ ID NO: 2040744 - protein, 18 aa, Staphylococcus
SYDVPFIVNDDVSLAKSI

SEQ ID NO: 2040745 - protein, 18 aa, Staphylococcus
SYDYLGLPLTDKELLENA

SEQ ID NO: 2040746 - protein, 18 aa, Staphylococcus
SYEAWRKSKEVKQSSKVK

SEQ ID NO: 2040747 - protein, 21 aa, Staphylococcus
SYEGKKWLVIANFSKEAVMVP

SEQ ID NO: 2040748 - protein, 19 aa, Staphylococcus
SYEPAIFYHDIAQKKAAEL

SEQ ID NO: 2040749 - protein, 18 aa, Staphylococcus
SYEQRFTPEEVVSYQQHQ

SEQ ID NO: 2040750 - protein, 27 aa, Staphylococcus
SYEQRIPKIVIVIDELADLMMIAPQEV

SEQ ID NO: 2040751 - protein, 26 aa, Staphylococcus
SYEQRMPKIVIVIDELADLMMMAPQE

SEQ ID NO: 2040752 - protein, 22 aa, Staphylococcus
SYETKNGLHFGIQYHPESFATD

SEQ ID NO: 2040753 - protein, 17 aa, Staphylococcus
SYFKEKGFYPVAIDAKH

SEQ ID NO: 2040754 - protein, 24 aa, Staphylococcus
SYFQRINMEYCWLVKENNLEDSKK

SEQ ID NO: 2040755 - protein, 23 aa, Staphylococcus
SYGIKYASSFFGPFRDAADSAPS

SEQ ID NO: 2040756 - protein, 18 aa, Staphylococcus
SYGIKYASSFYGPFRDAA

SEQ ID NO: 2040757 - protein, 26 aa, Staphylococcus
SYGLIPEFIGRVPIVANLETLDVAAL

SEQ ID NO: 2040758 - protein, 26 aa, Staphylococcus
SYGLIPEFIGRVPIVANLETLDVEAL

SEQ ID NO: 2040759 - protein, 24 aa, Staphylococcus
SYGSIPREDVASVLKHVITSDKFS

SEQ ID NO: 2040760 - protein, 25 aa, Staphylococcus
SYHFGRVPFTSTLEVDDRIITGQNP

SEQ ID NO: 2040761 - protein, 17 aa, Staphylococcus
SYHGVSYTKDVGEAAYI

SEQ ID NO: 2040762 - protein, 18 aa, Staphylococcus
SYHPDYAIMTNIDFDHPD

SEQ ID NO: 2040763 - protein, 27 aa, Staphylococcus
SYIANKFYIYDGMKWKIDDKGSIRKLI

SEQ ID NO: 2040764 - protein, 28 aa, Staphylococcus
SYIFKSTRLESSLLFPPYKGKFKYIKTF

SEQ ID NO: 2040765 - protein, 21 aa, Staphylococcus
SYIGNAIRKHGVEHFKIEVID

SEQ ID NO: 2040766 - protein, 20 aa, Staphylococcus
SYIHDIWGYIAPNSKNEKAP

SEQ ID NO: 2040767 - protein, 35 aa, Staphylococcus
SYIKALEVNPRYIYCGTIGLLCPDDKMIFNIPIRT

SEQ ID NO: 2040768 - protein, 24 aa, Staphylococcus
SYIKKEPLGTVLIIGPFNYPVQLV

SEQ ID NO: 2040769 - protein, 25 aa, Staphylococcus
SYIKPEPYGTILIIGPFNYPVQLLF

SEQ ID NO: 2040770 - protein, 24 aa, Staphylococcus
SYIKQEPYGTVLIIGPFNYPVQLL

SEQ ID NO: 2040771 - protein, 23 aa, Staphylococcus
SYIKRLFQLLKLKRDEIKALNLN

SEQ ID NO: 2040772 - protein, 17 aa, Staphylococcus
SYILIKTSPGFAQCINY

SEQ ID NO: 2040773 - protein, 20 aa, Staphylococcus
SYINELRKKYTFPVVTFTAT

SEQ ID NO: 2040774 - protein, 19 aa, Staphylococcus
SYIPYEIKIPSKFIEKEAT

SEQ ID NO: 2040775 - protein, 18 aa, Staphylococcus
SYISYADFAIAIVDEAEN

SEQ ID NO: 2040776 - protein, 28 aa, Staphylococcus
SYIYKTTRLESGLIFPPYKGKFSYVKNL

SEQ ID NO: 2040777 - protein, 23 aa, Staphylococcus
SYKADRRMILKNINFQLNEGEAV

SEQ ID NO: 2040778 - protein, 19 aa, Staphylococcus
SYKEWKLEDLPIIPKHMKT

SEQ ID NO: 2040779 - protein, 20 aa, Staphylococcus
SYKEWKLNDLPIIPNKMKTI

SEQ ID NO: 2040780 - protein, 21 aa, Staphylococcus
SYKGTHLKLHHMDCYRLEDSE

SEQ ID NO: 2040781 - protein, 19 aa, Staphylococcus
SYKLLKKHLKDINESEATF

SEQ ID NO: 2040782 - protein, 31 aa, Staphylococcus
SYKMPKKMRRLALRSALSFKVQEKGLTVVDA

SEQ ID NO: 2040783 - protein, 31 aa, Staphylococcus
SYKMPKKMRRLALRSALSFKVQENGFTVVDA

SEQ ID NO: 2040784 - protein, 31 aa, Staphylococcus
SYKMPKKMRRLALRSALSFKVQENGFTVVDS

SEQ ID NO: 2040785 - protein, 30 aa, Staphylococcus
SYKMPKKMRRLALRSALSFKVQENNFTIVD

SEQ ID NO: 2040786 - protein, 19 aa, Staphylococcus
SYKRTSCRMEVITRRGRSP

SEQ ID NO: 2040787 - protein, 19 aa, Staphylococcus
SYKRTSCRMEVKTRRGKSP

SEQ ID NO: 2040788 - protein, 19 aa, Staphylococcus
SYKRTSCRMEVLTRKGKSP

SEQ ID NO: 2040789 - protein, 25 aa, Staphylococcus
SYLLVRGVKTLGLRMEQINRNVTSI

SEQ ID NO: 2040790 - protein, 22 aa, Staphylococcus
SYLPEDKFSYPLKMNVDNRGSF

SEQ ID NO: 2040791 - protein, 19 aa, Staphylococcus
SYLSESEYQYVLKSYHIAY

SEQ ID NO: 2040792 - protein, 17 aa, Staphylococcus
SYLSQSIFDDMQKSAYE

SEQ ID NO: 2040793 - protein, 25 aa, Staphylococcus
SYLTIPRGDTGYFFNTAYLPNGALN

SEQ ID NO: 2040794 - protein, 20 aa, Staphylococcus
SYMCMAAAMGEEVVLNNIVP

SEQ ID NO: 2040795 - protein, 19 aa, Staphylococcus
SYMDFGIPAVILANYLREN

SEQ ID NO: 2040796 - protein, 21 aa, Staphylococcus
SYMKNGHVVLKIKDHGRGISK

SEQ ID NO: 2040797 - protein, 17 aa, Staphylococcus
SYMNPKLVYQIKTMPLT

SEQ ID NO: 2040798 - protein, 18 aa, Staphylococcus
SYNFPPSRIERAKDKLKT

SEQ ID NO: 2040799 - protein, 24 aa, Staphylococcus
SYNLKSLMLEYLRFSNYDSEIKIE

SEQ ID NO: 2040800 - protein, 31 aa, Staphylococcus
SYNSAGACPECHGKGIIKTELAFMPDFTQTC

SEQ ID NO: 2040801 - protein, 19 aa, Staphylococcus
SYNYYLDLRRYGSVPHSGF

SEQ ID NO: 2040802 - protein, 23 aa, Staphylococcus
SYPDLKMVILIATPKTINNEALL

SEQ ID NO: 2040803 - protein, 19 aa, Staphylococcus
SYPEEWKTPLTVNLLDKHQ

SEQ ID NO: 2040804 - protein, 18 aa, Staphylococcus
SYPGFRRNDSETVTQYAI

SEQ ID NO: 2040805 - protein, 20 aa, Staphylococcus
SYPIMKYIQPIRKLIHEPTI

SEQ ID NO: 2040806 - protein, 18 aa, Staphylococcus
SYPIMKYIQPVRKMISTP

SEQ ID NO: 2040807 - protein, 23 aa, Staphylococcus
SYQDLKIGDYVVHVHHGVGRYLG

SEQ ID NO: 2040808 - protein, 17 aa, Staphylococcus
SYQDLKVGDYVVHVHHG

SEQ ID NO: 2040809 - protein, 25 aa, Staphylococcus
SYQGLPSRIAWLGYEERAKMGLALN

SEQ ID NO: 2040810 - protein, 24 aa, Staphylococcus
SYQGLPSRIAWLGYGERAKMGLAL

SEQ ID NO: 2040811 - protein, 19 aa, Staphylococcus
SYQIAVSVIEHLNKLLDIE

SEQ ID NO: 2040812 - protein, 17 aa, Staphylococcus
SYQRLMNDLGLTQQKVA

SEQ ID NO: 2040813 - protein, 17 aa, Staphylococcus
SYRAIMINFNNDSIDYK

SEQ ID NO: 2040814 - protein, 19 aa, Staphylococcus
SYRFLRPEEGTTYKIYFGF

SEQ ID NO: 2040815 - protein, 24 aa, Staphylococcus
SYRLSEVKLGIDLNYIKLDNFKFN

SEQ ID NO: 2040816 - protein, 25 aa, Staphylococcus
SYRMDELIVSYMLQAYVTAKPKVTQ

SEQ ID NO: 2040817 - protein, 23 aa, Staphylococcus
SYRYGEMPLTMYITKKGKQVKIN

SEQ ID NO: 2040818 - protein, 23 aa, Staphylococcus
SYSDIKYQLGLIGKTENEKLLKA

SEQ ID NO: 2040819 - protein, 25 aa, Staphylococcus
SYSILFDRYKHDVGYSEAKETIKNT

SEQ ID NO: 2040820 - protein, 23 aa, Staphylococcus
SYSKKFKHYFGYSPKEYRQLTKS

SEQ ID NO: 2040821 - protein, 22 aa, Staphylococcus
SYSPRSIAEFAVTQAVNVVRHS

SEQ ID NO: 2040822 - protein, 18 aa, Staphylococcus
SYSYYLDLRRYGSVPHSG

SEQ ID NO: 2040823 - protein, 19 aa, Staphylococcus
SYSYYLDLRRYGSVPHSGF

SEQ ID NO: 2040824 - protein, 32 aa, Staphylococcus
SYTELFKTLPFDFLSDIVYQWERFAKQFEALG

SEQ ID NO: 2040825 - protein, 27 aa, Staphylococcus
SYTFKSTRLESSLFFPPYKGKFKYIKA

SEQ ID NO: 2040826 - protein, 24 aa, Staphylococcus
SYTGVRIGVTVAKTLAYALNTKLY

SEQ ID NO: 2040827 - protein, 18 aa, Staphylococcus
SYTLKPGQVVSVREKSQK

SEQ ID NO: 2040828 - protein, 22 aa, Staphylococcus
SYTRRIYRLLGYEHTEQYDKLK

SEQ ID NO: 2040829 - protein, 25 aa, Staphylococcus
SYTSMPSFWFDPLINLTAISQVTQH

SEQ ID NO: 2040830 - protein, 20 aa, Staphylococcus
SYVFHPYSMVKDHRTNEETG

SEQ ID NO: 2040831 - protein, 21 aa, Staphylococcus
SYVKDKCVFKGTFKMYYYSEE

SEQ ID NO: 2040832 - protein, 23 aa, Staphylococcus
SYVKDTLVFKGTFKMYYTSEDEQ

SEQ ID NO: 2040833 - protein, 17 aa, Staphylococcus
SYVKSVFEIDIDKLAKS

SEQ ID NO: 2040834 - protein, 17 aa, Staphylococcus
SYVKVCTDGPVFEKGAV

SEQ ID NO: 2040835 - protein, 18 aa, Staphylococcus
SYVLYPKVFDQFIQTRQQ

SEQ ID NO: 2040836 - protein, 20 aa, Staphylococcus
SYVLYPKVYEQFIATQKQFG

SEQ ID NO: 2040837 - protein, 18 aa, Staphylococcus
SYVLYPKVYKQFITTKEQ

SEQ ID NO: 2040838 - protein, 18 aa, Staphylococcus
SYYDYILEIYEYVHQILP

SEQ ID NO: 2040839 - protein, 19 aa, Staphylococcus
SYYEGYKLGSDQLSIGEIV

SEQ ID NO: 2040840 - protein, 19 aa, Staphylococcus
SYYEGYRLGSDDLSIGEIV

SEQ ID NO: 2040841 - protein, 21 aa, Staphylococcus
SYYQFYILKLVVGKKRIEEAV

SEQ ID NO: 2040842 - protein, 26 aa, Staphylococcus
SYYYLKEMFKEIMGFDEFYIARAQGT

SEQ ID NO: 2040843 - protein, 18 aa, Staphylococcus
TAAARAFVHKPAIIFADE

SEQ ID NO: 2040844 - protein, 18 aa, Staphylococcus
TAAARAFVHKPNIIFADE

SEQ ID NO: 2040845 - protein, 18 aa, Staphylococcus
TAAARAFVHKPSIIFADE

SEQ ID NO: 2040846 - protein, 24 aa, Staphylococcus
TAALEMTLRLLGIGPGDEVITSAY

SEQ ID NO: 2040847 - protein, 26 aa, Staphylococcus
TAALLSGKIDPRWVKDKNVVALVSGG

SEQ ID NO: 2040848 - protein, 25 aa, Staphylococcus
TAARVAVGAVCKILLKQLGINVLSR

SEQ ID NO: 2040849 - protein, 26 aa, Staphylococcus
TAARVAVGAVCKLLLAQLGINMYSRV

SEQ ID NO: 2040850 - protein, 19 aa, Staphylococcus
TAARVAVGAVSKILLKQLD

SEQ ID NO: 2040851 - protein, 26 aa, Staphylococcus
TADADAKINWALGLMNEGSQIIDNTT

SEQ ID NO: 2040852 - protein, 22 aa, Staphylococcus
TADAVGIELGKALQITNILRDV

SEQ ID NO: 2040853 - protein, 22 aa, Staphylococcus
TADFKGAAVSAQPEKKEENKSA

SEQ ID NO: 2040854 - protein, 20 aa, Staphylococcus
TADIILYDRLVNPFILQLAP

SEQ ID NO: 2040855 - protein, 18 aa, Staphylococcus
TADILYLGFISTKGAIQE

SEQ ID NO: 2040856 - protein, 23 aa, Staphylococcus
TADLTIGLILSVARRIVEGDELS

SEQ ID NO: 2040857 - protein, 18 aa, Staphylococcus
TADMCYLLQLLYFNDYTY

SEQ ID NO: 2040858 - protein, 30 aa, Staphylococcus
TADSLHIGHLLPFLTLRRFQQHGHRPIVLI

SEQ ID NO: 2040859 - protein, 18 aa, Staphylococcus
TADTPVIINIGEWDEEDE

SEQ ID NO: 2040860 - protein, 19 aa, Staphylococcus
TADVALREQVAFKDDALRL

SEQ ID NO: 2040861 - protein, 19 aa, Staphylococcus
TADVALREQVAFRDDALRL

SEQ ID NO: 2040862 - protein, 20 aa, Staphylococcus
TADVALREQVAFRNDALRIA

SEQ ID NO: 2040863 - protein, 19 aa, Staphylococcus
TADVALREQVTFRDDALRL

SEQ ID NO: 2040864 - protein, 25 aa, Staphylococcus
TAEEAIEFYSRYNCVTRIHVIDLIA

SEQ ID NO: 2040865 - protein, 23 aa, Staphylococcus
TAEELKSHFTVVLPDRRGYGYSE

SEQ ID NO: 2040866 - protein, 19 aa, Staphylococcus
TAEKIKHQYGHAFYDSASE

SEQ ID NO: 2040867 - protein, 19 aa, Staphylococcus
TAEKIKHQYGHAFYDSASS

SEQ ID NO: 2040868 - protein, 18 aa, Staphylococcus
TAEKVKHQYGHAFFESAS

SEQ ID NO: 2040869 - protein, 25 aa, Staphylococcus
TAELCEALKINVDFIPNDYSQEGFL

SEQ ID NO: 2040870 - protein, 21 aa, Staphylococcus
TAELGFTLMLAVARRIVEAEK

SEQ ID NO: 2040871 - protein, 22 aa, Staphylococcus
TAELHDLAFLLLVYPLSEVEGA

SEQ ID NO: 2040872 - protein, 18 aa, Staphylococcus
TAELPRDEVQTVSTKTPY

SEQ ID NO: 2040873 - protein, 23 aa, Staphylococcus
TAELTFALVLAVARRIPEGDKLC

SEQ ID NO: 2040874 - protein, 22 aa, Staphylococcus
TAELTFGLVLAVARRIVEGDKL

SEQ ID NO: 2040875 - protein, 23 aa, Staphylococcus
TAELWNKLIELWADQTVLIVEHK

SEQ ID NO: 2040876 - protein, 23 aa, Staphylococcus
TAENIAIWIWHQFNKHLPENNSL

SEQ ID NO: 2040877 - protein, 18 aa, Staphylococcus
TAEPELVLLDINLPTFNG

SEQ ID NO: 2040878 - protein, 18 aa, Staphylococcus
TAEPWLKVSDDGLQLEGL

SEQ ID NO: 2040879 - protein, 18 aa, Staphylococcus
TAEREWLEDKGYEIDFNQ

SEQ ID NO: 2040880 - protein, 31 aa, Staphylococcus
TAESEMNRLLAIKGIGKWTAQYIGMRALGYT

SEQ ID NO: 2040881 - protein, 20 aa, Staphylococcus
TAESPTRLSVQNLNDIYYND

SEQ ID NO: 2040882 - protein, 21 aa, Staphylococcus
TAFDGRGNYTLGVKEQLIFPE

SEQ ID NO: 2040883 - protein, 31 aa, Staphylococcus
TAFDGRGNYTLGVKEQLIFPEIDYDRVNKVR

SEQ ID NO: 2040884 - protein, 21 aa, Staphylococcus
TAFIRIRINYNGSPVDLTKTD

SEQ ID NO: 2040885 - protein, 24 aa, Staphylococcus
TAFPLLYTHFVRRGNWSLQQLVDY

SEQ ID NO: 2040886 - protein, 18 aa, Staphylococcus
TAFYETMEAFDLPKYLMA

SEQ ID NO: 2040887 - protein, 23 aa, Staphylococcus
TAGDARRGQSLVVWAIKEGRGVA

SEQ ID NO: 2040888 - protein, 23 aa, Staphylococcus
TAGDCLSDLGFKEALPEMENALN

SEQ ID NO: 2040889 - protein, 23 aa, Staphylococcus
TAGDCLSDLGFKEALPEMEQALD

SEQ ID NO: 2040890 - protein, 24 aa, Staphylococcus
TAGDCLSDLGFKEALPEMVKALDD

SEQ ID NO: 2040891 - protein, 23 aa, Staphylococcus
TAGDCLSDLGFKQALPEMEKALD

SEQ ID NO: 2040892 - protein, 17 aa, Staphylococcus
TAGDLKLTLMERYPDDY

SEQ ID NO: 2040893 - protein, 19 aa, Staphylococcus
TAGFDMYDLDLAKKHNIVI

SEQ ID NO: 2040894 - protein, 18 aa, Staphylococcus
TAGFDMYDLELAKKHDII

SEQ ID NO: 2040895 - protein, 26 aa, Staphylococcus
TAGIRGQFGLGPGRLNRYTIQRLALG

SEQ ID NO: 2040896 - protein, 27 aa, Staphylococcus
TAGIVPWNAPIMVLMRKVIPAVVTGCS

SEQ ID NO: 2040897 - protein, 26 aa, Staphylococcus
TAGKGRSGFIANSFAMRLNQLGKDAY

SEQ ID NO: 2040898 - protein, 25 aa, Staphylococcus
TAGLDPKSRIQVMSLFKQLQEEQGK

SEQ ID NO: 2040899 - protein, 24 aa, Staphylococcus
TAGLDPQSRFQIMTLLKKFQLEDN

SEQ ID NO: 2040900 - protein, 18 aa, Staphylococcus
TAGPLYYRAEPVGCTATI

SEQ ID NO: 2040901 - protein, 23 aa, Staphylococcus
TAGSPRKPGMSRDDLVQINEKVM

SEQ ID NO: 2040902 - protein, 18 aa, Staphylococcus
TAGWCPDCKIIEPDLPIL

SEQ ID NO: 2040903 - protein, 23 aa, Staphylococcus
TAGWTSDVKYHLGGVKTTDTYGI

SEQ ID NO: 2040904 - protein, 24 aa, Staphylococcus
TAHYIKEIIFMGGSLGRGNVTPLV

SEQ ID NO: 2040905 - protein, 18 aa, Staphylococcus
TAIISIRIPEELLQFEGQ

SEQ ID NO: 2040906 - protein, 17 aa, Staphylococcus
TAIRIGNPASWTKATAA

SEQ ID NO: 2040907 - protein, 19 aa, Staphylococcus
TAIYNGIEVYGVYQGYLGL

SEQ ID NO: 2040908 - protein, 25 aa, Staphylococcus
TAKALNLKAVIFMPVTTPLQKVNQV

SEQ ID NO: 2040909 - protein, 17 aa, Staphylococcus
TAKDWKEAVKLSVQPLI

SEQ ID NO: 2040910 - protein, 19 aa, Staphylococcus
TAKESRIQRGYLERKDEDE

SEQ ID NO: 2040911 - protein, 23 aa, Staphylococcus
TAKLDCKVDMVMTSPPYPFAVDF

SEQ ID NO: 2040912 - protein, 25 aa, Staphylococcus
TAKLLKDLQIEYGISIEQSNVLNML

SEQ ID NO: 2040913 - protein, 17 aa, Staphylococcus
TALDWARDLANIANSIT

SEQ ID NO: 2040914 - protein, 20 aa, Staphylococcus
TALFPCGSITGAPKLNTMQY

SEQ ID NO: 2040915 - protein, 20 aa, Staphylococcus
TALIEKCWESEHFIDDNTLA

SEQ ID NO: 2040916 - protein, 20 aa, Staphylococcus
TALIEKCWESENYIDDNTLA

SEQ ID NO: 2040917 - protein, 29 aa, Staphylococcus
TALKMTKREIFDWLGVTKYKLDSAVKYLL

SEQ ID NO: 2040918 - protein, 19 aa, Staphylococcus
TALNLKVKAIVAATESGST

SEQ ID NO: 2040919 - protein, 22 aa, Staphylococcus
TALRNNLHVFMFSDNVPKDDEV

SEQ ID NO: 2040920 - protein, 21 aa, Staphylococcus
TALSNKGHRVLLATTDPTKEI

SEQ ID NO: 2040921 - protein, 20 aa, Staphylococcus
TAMYISRLVKPIGIKVTRLA

SEQ ID NO: 2040922 - protein, 24 aa, Staphylococcus
TAMYISRLVKPIGITVTRLAQGLS

SEQ ID NO: 2040923 - protein, 19 aa, Staphylococcus
TANALKLKHFFNSDVPVHR

SEQ ID NO: 2040924 - protein, 21 aa, Staphylococcus
TANALKLKSFFNSEVPIHRGA

SEQ ID NO: 2040925 - protein, 23 aa, Staphylococcus
TANGKRTSICAVGMVKVVNHQIT

SEQ ID NO: 2040926 - protein, 19 aa, Staphylococcus
TANHQPVIYCLDKIAEDYL

SEQ ID NO: 2040927 - protein, 19 aa, Staphylococcus
TANHQPVIYCLDKIAEHHL

SEQ ID NO: 2040928 - protein, 22 aa, Staphylococcus
TANKRIVEQLVFDLAKTGVGVM

SEQ ID NO: 2040929 - protein, 22 aa, Staphylococcus
TANLGDLFQIFTAHSTQGRLYT

SEQ ID NO: 2040930 - protein, 21 aa, Staphylococcus
TANQVPVVYCLDKIANHHLTC

SEQ ID NO: 2040931 - protein, 19 aa, Staphylococcus
TANVALREQVAFRDDALRL

SEQ ID NO: 2040932 - protein, 24 aa, Staphylococcus
TAPFPEQFAQAIINYYDNQQLIEW

SEQ ID NO: 2040933 - protein, 25 aa, Staphylococcus
TAPWIRRLGFENVKEVLLDKERQEE

SEQ ID NO: 2040934 - protein, 22 aa, Staphylococcus
TAPWLNRLGFENVKEVLLDPER

SEQ ID NO: 2040935 - protein, 25 aa, Staphylococcus
TAQDRLEIYYGIPYAEPPIETNRFK

SEQ ID NO: 2040936 - protein, 23 aa, Staphylococcus
TAQESGIQFFEWLQQHTNADVYY

SEQ ID NO: 2040937 - protein, 24 aa, Staphylococcus
TAQMKAMFLEKYNEAFPNGEIEEL

SEQ ID NO: 2040938 - protein, 18 aa, Staphylococcus
TAQRLAFHTLNMKEDDVV

SEQ ID NO: 2040939 - protein, 18 aa, Staphylococcus
TAQWHDYRVNIIDTPGHV

SEQ ID NO: 2040940 - protein, 23 aa, Staphylococcus
TARKIIKVLFEKDLLLVTQGTDK

SEQ ID NO: 2040941 - protein, 19 aa, Staphylococcus
TARKYGLDAEDVILISAEK

SEQ ID NO: 2040942 - protein, 19 aa, Staphylococcus
TASECGFTPQFEGLQKLYD

SEQ ID NO: 2040943 - protein, 27 aa, Staphylococcus
TASEGGAWGIAVLARYMIETKTSNLAT

SEQ ID NO: 2040944 - protein, 25 aa, Staphylococcus
TASETFVIISFKHRIILIGGTEYAG

SEQ ID NO: 2040945 - protein, 47 aa, Staphylococcus
TASEVAAWARSRIGKRLDIDGRGGAQCWDLPNYIFGRYWNFWCNGNA

SEQ ID NO: 2040946 - protein, 23 aa, Staphylococcus
TASQCGFTPQFEGLQALYEKYKD

SEQ ID NO: 2040947 - protein, 23 aa, Staphylococcus
TASTLNWPMSVIRLKSENRDELI

SEQ ID NO: 2040948 - protein, 25 aa, Staphylococcus
TATERLKFGEVYANCEAEEAVNGYH

SEQ ID NO: 2040949 - protein, 24 aa, Staphylococcus
TATERLKFGEVYANCEAEEVVNGY

SEQ ID NO: 2040950 - protein, 34 aa, Staphylococcus
TATFMILGAVCTRACRFCAVKTGLPNELDLDEPE

SEQ ID NO: 2040951 - protein, 34 aa, Staphylococcus
TATFMILGAVCTRACRFCAVKTGLPNELDLGEPE

SEQ ID NO: 2040952 - protein, 19 aa, Staphylococcus
TAVKFLPMMNALGVVNKNE

SEQ ID NO: 2040953 - protein, 19 aa, Staphylococcus
TAVQYDLPLTIFVLNNKQL

SEQ ID NO: 2040954 - protein, 21 aa, Staphylococcus
TAVQYDLPMTIFVLNNQELSF

SEQ ID NO: 2040955 - protein, 23 aa, Staphylococcus
TAYKGDIIGLVGINGSGKSTLSN

SEQ ID NO: 2040956 - protein, 18 aa, Staphylococcus
TAYMCSEHHPARCHRLIV

SEQ ID NO: 2040957 - protein, 17 aa, Staphylococcus
TAYPSILKRGGGYQKID

SEQ ID NO: 2040958 - protein, 24 aa, Staphylococcus
TAYQFTAGILKNARGFTAVCNPLV

SEQ ID NO: 2040959 - protein, 24 aa, Staphylococcus
TAYQFTAGVLKNARGFTAVCNPLV

SEQ ID NO: 2040960 - protein, 20 aa, Staphylococcus
TCDICKKRGNDLNAHHLNSW

SEQ ID NO: 2040961 - protein, 19 aa, Staphylococcus
TCELPVVIKKDGLAAGKGV

SEQ ID NO: 2040962 - protein, 17 aa, Staphylococcus
TCENIAILDKGVIAYKG

SEQ ID NO: 2040963 - protein, 22 aa, Staphylococcus
TCFNVGCIQSKLLIEHGKRVYE

SEQ ID NO: 2040964 - protein, 25 aa, Staphylococcus
TCGCAAGLARPAAVAVADQNDKKPT

SEQ ID NO: 2040965 - protein, 25 aa, Staphylococcus
TCGCAAGLARPAAVAVAEQNDKKPT

SEQ ID NO: 2040966 - protein, 25 aa, Staphylococcus
TCGCAAGLARPAAVAVAEQNEAKPT

SEQ ID NO: 2040967 - protein, 25 aa, Staphylococcus
TCGCAAGLARPAAVAVAEQNEVKPT

SEQ ID NO: 2040968 - protein, 25 aa, Staphylococcus
TCGCAAGLARPAAVTVVEQNDKKPT

SEQ ID NO: 2040969 - protein, 24 aa, Staphylococcus
TCGDRIRLTFDIEDGIIHDAKFEG

SEQ ID NO: 2040970 - protein, 24 aa, Staphylococcus
TCGDRIRLTFDIEDGIIQEAKFEG

SEQ ID NO: 2040971 - protein, 24 aa, Staphylococcus
TCGDRIRLTFDIEDGVINDAKFEG

SEQ ID NO: 2040972 - protein, 24 aa, Staphylococcus
TCGDRIRLTFDIENGIINDAKFEG

SEQ ID NO: 2040973 - protein, 24 aa, Staphylococcus
TCGDRIRLTFDIQDGIINDAKFEG

SEQ ID NO: 2040974 - protein, 24 aa, Staphylococcus
TCHQFKQPFIITRAISDLANGNAD

SEQ ID NO: 2040975 - protein, 19 aa, Staphylococcus
TCKKAAKFLDTHGVSYEPI

SEQ ID NO: 2040976 - protein, 19 aa, Staphylococcus
TCKNYSRAYIRHLIKAEET

SEQ ID NO: 2040977 - protein, 29 aa, Staphylococcus
TCPHCKSKMILKKGEIITPHFAHLKVASI

SEQ ID NO: 2040978 - protein, 17 aa, Staphylococcus
TCPKCDGTGQEFEEPCP

SEQ ID NO: 2040979 - protein, 20 aa, Staphylococcus
TCRNYSRAYIRHLIKAEETF

SEQ ID NO: 2040980 - protein, 20 aa, Staphylococcus
TCRNYSRAYLRHLIKAEETF

SEQ ID NO: 2040981 - protein, 19 aa, Staphylococcus
TCSEFKPYYLTKALQKLKE

SEQ ID NO: 2040982 - protein, 25 aa, Staphylococcus
TCTRARLSSDGKFYGCLFAEVEGFD

SEQ ID NO: 2040983 - protein, 20 aa, Staphylococcus
TCVEAAPKMLPMFSDELVNY

SEQ ID NO: 2040984 - protein, 25 aa, Staphylococcus
TCYYGGEVIQGLKIMHGKVDDLEIV

SEQ ID NO: 2040985 - protein, 19 aa, Staphylococcus
TDAAFKYDDGIRHYYTGDK

SEQ ID NO: 2040986 - protein, 22 aa, Staphylococcus
TDADFKVQVFRLGEGGLGGELH

SEQ ID NO: 2040987 - protein, 23 aa, Staphylococcus
TDADLRILRRLKRDTHERGRSMD

SEQ ID NO: 2040988 - protein, 21 aa, Staphylococcus
TDADLRILRRLTRDTQERGRS

SEQ ID NO: 2040989 - protein, 18 aa, Staphylococcus
TDAGIEQMYIRSAFTCNT

SEQ ID NO: 2040990 - protein, 21 aa, Staphylococcus
TDALKGIAWFWHTTFNHQTES

SEQ ID NO: 2040991 - protein, 24 aa, Staphylococcus
TDDARLTIEVMKRAAEKGAEVINH

SEQ ID NO: 2040992 - protein, 23 aa, Staphylococcus
TDDARLTIEVMKRAEEKGAKVIN

SEQ ID NO: 2040993 - protein, 23 aa, Staphylococcus
TDDARLTIEVMKRAEENGAEILN

SEQ ID NO: 2040994 - protein, 23 aa, Staphylococcus
TDDGKLLILDTMFESEKYKQDLI

SEQ ID NO: 2040995 - protein, 17 aa, Staphylococcus
TDDIMTLFKGQRATLSI

SEQ ID NO: 2040996 - protein, 26 aa, Staphylococcus
TDDKKRIAIEYSLPKWLVDHWTTHFG

SEQ ID NO: 2040997 - protein, 37 aa, Staphylococcus
TDDLKKDFIKKSAMVGSAFATMNLIDGHQAFAASETP

SEQ ID NO: 2040998 - protein, 25 aa, Staphylococcus
TDDMVSFLIGCSFTFEHALLEAGIP

SEQ ID NO: 2040999 - protein, 24 aa, Staphylococcus
TDDQWDAMLLGWKVIPSVKSNAVI

SEQ ID NO: 2041000 - protein, 18 aa, Staphylococcus
TDDRFKQIIIAMGSGADA

SEQ ID NO: 2041001 - protein, 24 aa, Staphylococcus
TDDRIDFFPGRFENTFNRWMEEIR

SEQ ID NO: 2041002 - protein, 27 aa, Staphylococcus
TDDTQIYICGGISFLKSIVNELYELGV

SEQ ID NO: 2041003 - protein, 20 aa, Staphylococcus
TDEAKMIVSCIARMKQQESY

SEQ ID NO: 2041004 - protein, 25 aa, Staphylococcus
TDEDLREIYKWMDLGRKLDERLWLL

SEQ ID NO: 2041005 - protein, 26 aa, Staphylococcus
TDEEGWAHCLTIPRVLTIENNQLRQR

SEQ ID NO: 2041006 - protein, 21 aa, Staphylococcus
TDEFPEWKTKAEIMQQDLKKV

SEQ ID NO: 2041007 - protein, 20 aa, Staphylococcus
TDEFPEWKTKAEIMQQDLKN

SEQ ID NO: 2041008 - protein, 19 aa, Staphylococcus
TDEGFTLDDFIKVIDNKVS

SEQ ID NO: 2041009 - protein, 23 aa, Staphylococcus
TDEGLTGPIARFFEDKDTEQLKS

SEQ ID NO: 2041010 - protein, 18 aa, Staphylococcus
TDEIMPIYDAAMKYKEDG

SEQ ID NO: 2041011 - protein, 32 aa, Staphylococcus
TDEKHGWWREIIDGGYIPRHDYQFLTFNVIGS

SEQ ID NO: 2041012 - protein, 27 aa, Staphylococcus
TDEKKRMSIAYSLPKWIVDHWVTHYGL

SEQ ID NO: 2041013 - protein, 36 aa, Staphylococcus
TDEKLKHLPFVSGFIGTCSFDLIRHEFPMLKQQSIQ

SEQ ID NO: 2041014 - protein, 24 aa, Staphylococcus
TDEKYFGGSFERLSELTVETSLPV

SEQ ID NO: 2041015 - protein, 24 aa, Staphylococcus
TDEPRGGEIVEHILGLEEGASIIH

SEQ ID NO: 2041016 - protein, 24 aa, Staphylococcus
TDEYRTASRIGIVLSMPHEVNTYT

SEQ ID NO: 2041017 - protein, 17 aa, Staphylococcus
TDFAPLVVLGGHASRSN

SEQ ID NO: 2041018 - protein, 17 aa, Staphylococcus
TDFDVLPLIYKLPHENQ

SEQ ID NO: 2041019 - protein, 18 aa, Staphylococcus
TDFIEDFSVFDGQTIRIK

SEQ ID NO: 2041020 - protein, 18 aa, Staphylococcus
TDFIEDFSVFEGQTIRLK

SEQ ID NO: 2041021 - protein, 22 aa, Staphylococcus
TDFKMGVQLRHYVVQALKLLKV

SEQ ID NO: 2041022 - protein, 23 aa, Staphylococcus
TDFNLGPEPEFFLFKLDDKGEPT

SEQ ID NO: 2041023 - protein, 25 aa, Staphylococcus
TDFQARRANIRFKRDAASKPELAHT

SEQ ID NO: 2041024 - protein, 25 aa, Staphylococcus
TDFQARRANIRFKRDASSKPELVHT

SEQ ID NO: 2041025 - protein, 25 aa, Staphylococcus
TDFQARRANIRFKRDHAAKPELAHT

SEQ ID NO: 2041026 - protein, 24 aa, Staphylococcus
TDFQARRANIRFKRDKDAKPELVH

SEQ ID NO: 2041027 - protein, 24 aa, Staphylococcus
TDFQARRANIRFKRDNAAKPELAH

SEQ ID NO: 2041028 - protein, 24 aa, Staphylococcus
TDFQARRANIRFKRDNSAKPELAH

SEQ ID NO: 2041029 - protein, 24 aa, Staphylococcus
TDFQARRSNIRFKRDKNAKPELAH

SEQ ID NO: 2041030 - protein, 24 aa, Staphylococcus
TDGEFRRSWWHFDFLENINGVEGY

SEQ ID NO: 2041031 - protein, 22 aa, Staphylococcus
TDGEFRRSWWHFDFLENLDGVE

SEQ ID NO: 2041032 - protein, 22 aa, Staphylococcus
TDGEFRRSWWHFDFLENLNGVE

SEQ ID NO: 2041033 - protein, 37 aa, Staphylococcus
TDGEFRRSWWHLDFFWGLNGVEAIKDAGGFEFENVQS

SEQ ID NO: 2041034 - protein, 21 aa, Staphylococcus
TDGQRSLTFKALYDEAHVLSQ

SEQ ID NO: 2041035 - protein, 32 aa, Staphylococcus
TDGRFLNVGENIWGLRDWYSVADIEEKIAPTI

SEQ ID NO: 2041036 - protein, 17 aa, Staphylococcus
TDHGAFEMYGFESSLTK

SEQ ID NO: 2041037 - protein, 26 aa, Staphylococcus
TDHIRHLLEFKKQKAIDISRVEPASE

SEQ ID NO: 2041038 - protein, 21 aa, Staphylococcus
TDHIRHLMTFKSSQTPVDISE

SEQ ID NO: 2041039 - protein, 17 aa, Staphylococcus
TDHLAVAVSTGIDSMCL

SEQ ID NO: 2041040 - protein, 19 aa, Staphylococcus
TDHRIGLTLQKLDQIMEGK

SEQ ID NO: 2041041 - protein, 20 aa, Staphylococcus
TDHRIGMMLAIASLLSSEPL

SEQ ID NO: 2041042 - protein, 17 aa, Staphylococcus
TDIANTVAFLASDKAKY

SEQ ID NO: 2041043 - protein, 22 aa, Staphylococcus
TDIANTVAFLASDRAKYITGQT

SEQ ID NO: 2041044 - protein, 31 aa, Staphylococcus
TDIEYKFPFGWGELWGIASRTDFDLKQHSEH

SEQ ID NO: 2041045 - protein, 31 aa, Staphylococcus
TDIEYKFPFGWGELWGIASRTDFDLQKHSEH

SEQ ID NO: 2041046 - protein, 31 aa, Staphylococcus
TDIEYKFPFGWGELWGIASRTDYDLKQHSEF

SEQ ID NO: 2041047 - protein, 23 aa, Staphylococcus
TDIGKALGYPAHMSLLTRINSGG

SEQ ID NO: 2041048 - protein, 17 aa, Staphylococcus
TDIGKQLGYPAHMSLLT

SEQ ID NO: 2041049 - protein, 24 aa, Staphylococcus
TDIKLGSGVYELGGLAVIINEHME

SEQ ID NO: 2041050 - protein, 25 aa, Staphylococcus
TDIKLKYGDIWEGYHHAIGFKNMQN

SEQ ID NO: 2041051 - protein, 17 aa, Staphylococcus
TDILKNLNIEKVDGIYY

SEQ ID NO: 2041052 - protein, 17 aa, Staphylococcus
TDILRDMIIINLQGILT

SEQ ID NO: 2041053 - protein, 18 aa, Staphylococcus
TDILRDMIIVSLHGVLTQ

SEQ ID NO: 2041054 - protein, 18 aa, Staphylococcus
TDIMKNWPTHKNNPYKGY

SEQ ID NO: 2041055 - protein, 17 aa, Staphylococcus
TDIMKNWPTHPNNPYKG

SEQ ID NO: 2041056 - protein, 19 aa, Staphylococcus
TDINSIISIVNQFPVKVVV

SEQ ID NO: 2041057 - protein, 19 aa, Staphylococcus
TDIRIAFSCVEKDDIPHVF

SEQ ID NO: 2041058 - protein, 20 aa, Staphylococcus
TDIRVAFSCIEKDDIPHVFD

SEQ ID NO: 2041059 - protein, 17 aa, Staphylococcus
TDISSANEKGIWQVLPV

SEQ ID NO: 2041060 - protein, 17 aa, Staphylococcus
TDIVFTFNIGKVPMKQI

SEQ ID NO: 2041061 - protein, 25 aa, Staphylococcus
TDIYNRLNFDFGTLGNHEFNYGLPY

SEQ ID NO: 2041062 - protein, 23 aa, Staphylococcus
TDIYNRLNFNFGTIGNHEFNYGL

SEQ ID NO: 2041063 - protein, 17 aa, Staphylococcus
TDKDSVILSADYSQIEL

SEQ ID NO: 2041064 - protein, 25 aa, Staphylococcus
TDKFIPLKPLRQLEVIEGNYEDAIQ

SEQ ID NO: 2041065 - protein, 25 aa, Staphylococcus
TDKFKTTLVTFKFMAPLDEETMTSR

SEQ ID NO: 2041066 - protein, 25 aa, Staphylococcus
TDKFKTTMITFKFMAPLEYETITAR

SEQ ID NO: 2041067 - protein, 21 aa, Staphylococcus
TDKGPGIFRQKLRDAGVEQTI

SEQ ID NO: 2041068 - protein, 17 aa, Staphylococcus
TDKGQFTERIFGMENRQ

SEQ ID NO: 2041069 - protein, 17 aa, Staphylococcus
TDKMHYLQHEWKGVHLQ

SEQ ID NO: 2041070 - protein, 25 aa, Staphylococcus
TDKMKSWYERFGFGKSTNGMFDGEA

SEQ ID NO: 2041071 - protein, 27 aa, Staphylococcus
TDKNIRSNCGIGFKGFYNETDGFNYSF

SEQ ID NO: 2041072 - protein, 17 aa, Staphylococcus
TDKPGAVTTEFKKSMPI

SEQ ID NO: 2041073 - protein, 31 aa, Staphylococcus
TDKRVSPDLFVKRTNFYDFLLLNTDGLTDYV

SEQ ID NO: 2041074 - protein, 27 aa, Staphylococcus
TDKRVTPKFSLEYIAFFPSDKPEKVKD

SEQ ID NO: 2041075 - protein, 25 aa, Staphylococcus
TDKVYRFPIMYIEYSGTFGDMEKVR

SEQ ID NO: 2041076 - protein, 30 aa, Staphylococcus
TDLAKSLNCHCEAFQCLGPNVLVKNMYYPN

SEQ ID NO: 2041077 - protein, 17 aa, Staphylococcus
TDLANIFYVRQKEQKGL

SEQ ID NO: 2041078 - protein, 26 aa, Staphylococcus
TDLDGFYIREMRRPKRLQYEFRDTTS

SEQ ID NO: 2041079 - protein, 21 aa, Staphylococcus
TDLEGSISFPDVFGTVTRSQM

SEQ ID NO: 2041080 - protein, 20 aa, Staphylococcus
TDLEGSISIPNVYGEVERSK

SEQ ID NO: 2041081 - protein, 23 aa, Staphylococcus
TDLEGSVSLPNVFGEVERSKMIV

SEQ ID NO: 2041082 - protein, 18 aa, Staphylococcus
TDLERRLDIEEVKTMIGD

SEQ ID NO: 2041083 - protein, 19 aa, Staphylococcus
TDLGLGVAEAVSRGFDEIN

SEQ ID NO: 2041084 - protein, 19 aa, Staphylococcus
TDLIIAKVIKYKDGNTTVH

SEQ ID NO: 2041085 - protein, 24 aa, Staphylococcus
TDLKLPYICLNGAEVRDESFNIMS

SEQ ID NO: 2041086 - protein, 23 aa, Staphylococcus
TDLKVPYICLNGAEVRDEAFNIM

SEQ ID NO: 2041087 - protein, 23 aa, Staphylococcus
TDLKVPYICLNGAEVRDETFNIM

SEQ ID NO: 2041088 - protein, 19 aa, Staphylococcus
TDLLEAMGINTSSVEATPS

SEQ ID NO: 2041089 - protein, 17 aa, Staphylococcus
TDLMKIANDVRWLASGP

SEQ ID NO: 2041090 - protein, 17 aa, Staphylococcus
TDLPFVHHLNNEYSIMS

SEQ ID NO: 2041091 - protein, 20 aa, Staphylococcus
TDLSVPYICLNGAEVRDESF

SEQ ID NO: 2041092 - protein, 29 aa, Staphylococcus
TDLYFDGKGSIPREDVASVLKEVALSENK

SEQ ID NO: 2041093 - protein, 31 aa, Staphylococcus
TDMFKALLNEVFKAYGLLLIDANNTELRKLE

SEQ ID NO: 2041094 - protein, 18 aa, Staphylococcus
TDMKVETMIHSFNEPFCS

SEQ ID NO: 2041095 - protein, 17 aa, Staphylococcus
TDNDLMIDTWKGMEDLY

SEQ ID NO: 2041096 - protein, 24 aa, Staphylococcus
TDNFKRIRIGIGRPTNGMSVPDYV

SEQ ID NO: 2041097 - protein, 17 aa, Staphylococcus
TDNFSIIDCCLYNDKKD

SEQ ID NO: 2041098 - protein, 21 aa, Staphylococcus
TDNGFKLAADIEVTLENVSQE

SEQ ID NO: 2041099 - protein, 17 aa, Staphylococcus
TDNGLDDVIEWIERDVL

SEQ ID NO: 2041100 - protein, 25 aa, Staphylococcus
TDNGWGQYPICMAKTQYSFSDDATA

SEQ ID NO: 2041101 - protein, 24 aa, Staphylococcus
TDNHSAEWEAFIFALECAEQQEVD

SEQ ID NO: 2041102 - protein, 18 aa, Staphylococcus
TDNISYPSLSSVVVKSLT

SEQ ID NO: 2041103 - protein, 23 aa, Staphylococcus
TDNPKAIFFRSFSVDQRYRGQGI

SEQ ID NO: 2041104 - protein, 17 aa, Staphylococcus
TDNRGLFAYSLESMSQY

SEQ ID NO: 2041105 - protein, 17 aa, Staphylococcus
TDNRGLFAYSLESMSTF

SEQ ID NO: 2041106 - protein, 21 aa, Staphylococcus
TDPKLNLAMEEYVLKYLPQDS

SEQ ID NO: 2041107 - protein, 18 aa, Staphylococcus
TDPMKFLPEDGSLELTAG

SEQ ID NO: 2041108 - protein, 19 aa, Staphylococcus
TDPMKFLPEDGSLELTSGN

SEQ ID NO: 2041109 - protein, 19 aa, Staphylococcus
TDPMKFLPEDGSLELTSGW

SEQ ID NO: 2041110 - protein, 18 aa, Staphylococcus
TDPMKFLPEDGSLKLTAG

SEQ ID NO: 2041111 - protein, 18 aa, Staphylococcus
TDQAFLIKSVQTAVDAGA

SEQ ID NO: 2041112 - protein, 24 aa, Staphylococcus
TDQEWRDVRYLYNYNENELKDLAN

SEQ ID NO: 2041113 - protein, 25 aa, Staphylococcus
TDQEWRDVRYLYNYNETELLDLAQK

SEQ ID NO: 2041114 - protein, 24 aa, Staphylococcus
TDQEWRDVRYLYNYNKEELTDLAN

SEQ ID NO: 2041115 - protein, 18 aa, Staphylococcus
TDQIPIVVEKVVNSAVNK

SEQ ID NO: 2041116 - protein, 18 aa, Staphylococcus
TDQLVEWIESTYPDVEIE

SEQ ID NO: 2041117 - protein, 19 aa, Staphylococcus
TDQPDAWIVAGRGELHLSI

SEQ ID NO: 2041118 - protein, 21 aa, Staphylococcus
TDQRADTFISYLEDARKVRRE

SEQ ID NO: 2041119 - protein, 24 aa, Staphylococcus
TDREGYSLVGCMCQPAFDFNHFEL

SEQ ID NO: 2041120 - protein, 19 aa, Staphylococcus
TDRGLLVPVVKHADRKSIF

SEQ ID NO: 2041121 - protein, 20 aa, Staphylococcus
TDRIILRMATFELLHSDTPP

SEQ ID NO: 2041122 - protein, 20 aa, Staphylococcus
TDRISRLFDITGLKDLMHVN

SEQ ID NO: 2041123 - protein, 24 aa, Staphylococcus
TDRISRLFDITGLKDLMHVNEGTE

SEQ ID NO: 2041124 - protein, 24 aa, Staphylococcus
TDRLRECGDILGIQLLDHVIIGDH

SEQ ID NO: 2041125 - protein, 17 aa, Staphylococcus
TDRRVSPDIFTKRISYY

SEQ ID NO: 2041126 - protein, 19 aa, Staphylococcus
TDSGQHWEVPQTDHAPIDI

SEQ ID NO: 2041127 - protein, 18 aa, Staphylococcus
TDSLVLFMQQAMRSMRYQ

SEQ ID NO: 2041128 - protein, 19 aa, Staphylococcus
TDSPDAWTVAGRGELHLSI

SEQ ID NO: 2041129 - protein, 24 aa, Staphylococcus
TDTFKPENMCFSLFSQRNAYIDAT

SEQ ID NO: 2041130 - protein, 18 aa, Staphylococcus
TDTLKIQWLEKERIDNYD

SEQ ID NO: 2041131 - protein, 22 aa, Staphylococcus
TDVICVFLSSGISGCYQTATQA

SEQ ID NO: 2041132 - protein, 25 aa, Staphylococcus
TDVKAATQSLKWAVDEMEKRYKLFA

SEQ ID NO: 2041133 - protein, 25 aa, Staphylococcus
TDVKAATQSLKWAVEEMEKRYKLFA

SEQ ID NO: 2041134 - protein, 25 aa, Staphylococcus
TDVKAATQSLKWAVEEMERRYKLFA

SEQ ID NO: 2041135 - protein, 24 aa, Staphylococcus
TDVKAATQSLKWAVEEMERRYKVF

SEQ ID NO: 2041136 - protein, 19 aa, Staphylococcus
TDVLFKYVATIINKNSNTL

SEQ ID NO: 2041137 - protein, 17 aa, Staphylococcus
TDVLFKYVENIMNHQKS

SEQ ID NO: 2041138 - protein, 19 aa, Staphylococcus
TDVLFKYVERMVSRNESEL

SEQ ID NO: 2041139 - protein, 28 aa, Staphylococcus
TDVLPVIYYIHGAGWVFGSPETHDKLVR

SEQ ID NO: 2041140 - protein, 19 aa, Staphylococcus
TDVPFEHYLNCIVRSMRND

SEQ ID NO: 2041141 - protein, 19 aa, Staphylococcus
TDVPLDLYLSVLGMPGQTA

SEQ ID NO: 2041142 - protein, 18 aa, Staphylococcus
TDVPLELYLSTLGMTGQT

SEQ ID NO: 2041143 - protein, 24 aa, Staphylococcus
TDYKSCVLLDMHIGHLKSVMELLA

SEQ ID NO: 2041144 - protein, 18 aa, Staphylococcus
TDYLRFADDYIRQKGYKF

SEQ ID NO: 2041145 - protein, 38 aa, Staphylococcus
TDYRKIPREYLNPRIPQGRGMVKWQPFKTMPEQYERLE

SEQ ID NO: 2041146 - protein, 22 aa, Staphylococcus
TDYRLKGIAFDLLSYAIHYAFE

SEQ ID NO: 2041147 - protein, 18 aa, Staphylococcus
TDYSSIFFDFLVTDKPII

SEQ ID NO: 2041148 - protein, 18 aa, Staphylococcus
TDYSSIFFDYLVTNKPIV

SEQ ID NO: 2041149 - protein, 36 aa, Staphylococcus
TDYSSVMFDFGILKRPQFFFAYDIEKYDKGLRGFYM

SEQ ID NO: 2041150 - protein, 22 aa, Staphylococcus
TDYSSVMFDYGILKRPQFFFAY

SEQ ID NO: 2041151 - protein, 30 aa, Staphylococcus
TEAFDIPKTWKLVAQMPFGNIRDEAGEKAF

SEQ ID NO: 2041152 - protein, 19 aa, Staphylococcus
TEAGLFYIGILLPHNSDLA

SEQ ID NO: 2041153 - protein, 17 aa, Staphylococcus
TEAIRYLSGHGFSHKLI

SEQ ID NO: 2041154 - protein, 23 aa, Staphylococcus
TEAKRKGLAPLAHFLIEGQSMNV

SEQ ID NO: 2041155 - protein, 28 aa, Staphylococcus
TEAKRKGLEPLAKWLLHKNLDKNVDEKA

SEQ ID NO: 2041156 - protein, 25 aa, Staphylococcus
TEAKRKGLESLAQWISDGQQGELSK

SEQ ID NO: 2041157 - protein, 17 aa, Staphylococcus
TEALPHIDYFVAGAGSG

SEQ ID NO: 2041158 - protein, 18 aa, Staphylococcus
TEALTEWLEAEYPDVEID

SEQ ID NO: 2041159 - protein, 23 aa, Staphylococcus
TEAQWDAMLLGWKVVASVKSNAV

SEQ ID NO: 2041160 - protein, 23 aa, Staphylococcus
TEARALKFYKYFYTHRGPVMDYS

SEQ ID NO: 2041161 - protein, 19 aa, Staphylococcus
TEASIPTNQNYGTDYNNQT

SEQ ID NO: 2041162 - protein, 23 aa, Staphylococcus
TEAYLGFTDRAAHGFGGKQTPKV

SEQ ID NO: 2041163 - protein, 18 aa, Staphylococcus
TECLKFGEVYANCEAEEA

SEQ ID NO: 2041164 - protein, 24 aa, Staphylococcus
TEDEKLGLLKIDFLGLKNLSIIHQ

SEQ ID NO: 2041165 - protein, 18 aa, Staphylococcus
TEDGRLSAKEVLGNKKAL

SEQ ID NO: 2041166 - protein, 18 aa, Staphylococcus
TEDIKIAILPIGYADGYL

SEQ ID NO: 2041167 - protein, 24 aa, Staphylococcus
TEDLWKKLIELWDEQTVLIVEHKV

SEQ ID NO: 2041168 - protein, 18 aa, Staphylococcus
TEDNCELIAKEGADGVSV

SEQ ID NO: 2041169 - protein, 26 aa, Staphylococcus
TEDPFTCPHGRPIIINFSNYELERLF

SEQ ID NO: 2041170 - protein, 22 aa, Staphylococcus
TEDSRQALPNTFSHSNAVRNSA

SEQ ID NO: 2041171 - protein, 19 aa, Staphylococcus
TEDVRFLFLPQDLPKHEKL

SEQ ID NO: 2041172 - protein, 21 aa, Staphylococcus
TEDVYDFWRPTGHAYPLVDGA

SEQ ID NO: 2041173 - protein, 23 aa, Staphylococcus
TEDYPIAVIFNASWYNETTVIGR

SEQ ID NO: 2041174 - protein, 18 aa, Staphylococcus
TEEGRVAFATKIVQDHYK

SEQ ID NO: 2041175 - protein, 24 aa, Staphylococcus
TEEIKNIFEQLGFETETQQDELTV

SEQ ID NO: 2041176 - protein, 18 aa, Staphylococcus
TEEIMPIYDAAMKYKEDG

SEQ ID NO: 2041177 - protein, 22 aa, Staphylococcus
TEEMPALGFAPDAEFPAIHGEK

SEQ ID NO: 2041178 - protein, 22 aa, Staphylococcus
TEEMPELGFAPDAEFPAIHGEK

SEQ ID NO: 2041179 - protein, 24 aa, Staphylococcus
TEERTVDVPVHLVGEAAGAKEGGV

SEQ ID NO: 2041180 - protein, 18 aa, Staphylococcus
TEESPIVMSSRIRLARNL

SEQ ID NO: 2041181 - protein, 24 aa, Staphylococcus
TEETIGFIIGPRLNAVGRLEDAAL

SEQ ID NO: 2041182 - protein, 24 aa, Staphylococcus
TEETIGFIIGPRLNAVGRLEDASL

SEQ ID NO: 2041183 - protein, 19 aa, Staphylococcus
TEEVDGYNAIQVGFADKQA

SEQ ID NO: 2041184 - protein, 19 aa, Staphylococcus
TEEVDGYNAIQVGFEDKKA

SEQ ID NO: 2041185 - protein, 19 aa, Staphylococcus
TEEVDGYNAIQVGFEDKQA

SEQ ID NO: 2041186 - protein, 17 aa, Staphylococcus
TEFDDMISLMSMHKKNG

SEQ ID NO: 2041187 - protein, 17 aa, Staphylococcus
TEFKVSKDIASWKTLTD

SEQ ID NO: 2041188 - protein, 17 aa, Staphylococcus
TEFKVSKDIASWKTLTE

SEQ ID NO: 2041189 - protein, 17 aa, Staphylococcus
TEFKVSKDIASWKTLTP

SEQ ID NO: 2041190 - protein, 19 aa, Staphylococcus
TEFPLTIMVNRDEFATVIC

SEQ ID NO: 2041191 - protein, 21 aa, Staphylococcus
TEFPYTIRIVSEVLESNGSSS

SEQ ID NO: 2041192 - protein, 22 aa, Staphylococcus
TEFRRKSFRFFSDALRKYQNTT

SEQ ID NO: 2041193 - protein, 24 aa, Staphylococcus
TEFTYMILQAIDFGHLNREYNCKV

SEQ ID NO: 2041194 - protein, 24 aa, Staphylococcus
TEFVVEMKLTYVWINADKPEEQFE

SEQ ID NO: 2041195 - protein, 23 aa, Staphylococcus
TEGALKNKGIKILPFSVDNIHEG

SEQ ID NO: 2041196 - protein, 17 aa, Staphylococcus
TEGDLSKGHFFEPTLIA

SEQ ID NO: 2041197 - protein, 24 aa, Staphylococcus
TEGERLIGFIWARYDKTLKTALIE

SEQ ID NO: 2041198 - protein, 20 aa, Staphylococcus
TEGHAGQSLAAYAPHGLTIH

SEQ ID NO: 2041199 - protein, 18 aa, Staphylococcus
TEGISFEQEYIKSFFKNS

SEQ ID NO: 2041200 - protein, 18 aa, Staphylococcus
TEGKPWFPVNPNYKDINV

SEQ ID NO: 2041201 - protein, 17 aa, Staphylococcus
TEGMLPIARSLKLNEHD

SEQ ID NO: 2041202 - protein, 19 aa, Staphylococcus
TEGPILFHLVNEIPEHQKS

SEQ ID NO: 2041203 - protein, 19 aa, Staphylococcus
TEGTAFVESFIGIFDEVEQ

SEQ ID NO: 2041204 - protein, 17 aa, Staphylococcus
TEHIPVVDMIKVKRYLE

SEQ ID NO: 2041205 - protein, 21 aa, Staphylococcus
TEHMLFIGAGAFHVSKPSDLI

SEQ ID NO: 2041206 - protein, 23 aa, Staphylococcus
TEHSMAMILAMARQIPMAHQSLK

SEQ ID NO: 2041207 - protein, 21 aa, Staphylococcus
TEHSRRYLLDEGFPKQNIFVT

SEQ ID NO: 2041208 - protein, 21 aa, Staphylococcus
TEHSRRYLLDEGFQKQNIFVT

SEQ ID NO: 2041209 - protein, 22 aa, Staphylococcus
TEHSVAMILAMARNIPQAYTSL

SEQ ID NO: 2041210 - protein, 19 aa, Staphylococcus
TEHYDVFIATAAMDVPTSF

SEQ ID NO: 2041211 - protein, 17 aa, Staphylococcus
TEIEYKVPITIHDRPVG

SEQ ID NO: 2041212 - protein, 17 aa, Staphylococcus
TEIGSGIAKFVIPKLRG

SEQ ID NO: 2041213 - protein, 20 aa, Staphylococcus
TEIPHAWMMIEADATNLVKT

SEQ ID NO: 2041214 - protein, 18 aa, Staphylococcus
TEIPMIYGGEYGPDLEDL

SEQ ID NO: 2041215 - protein, 25 aa, Staphylococcus
TEIPNDHVFAMIGYHPDYDFLESIG

SEQ ID NO: 2041216 - protein, 17 aa, Staphylococcus
TEIPYTLVSKKWQESLT

SEQ ID NO: 2041217 - protein, 20 aa, Staphylococcus
TEIQKRWIAKFKQVEDIFKQ

SEQ ID NO: 2041218 - protein, 20 aa, Staphylococcus
TEIRCRIRSKGIVINDIASD

SEQ ID NO: 2041219 - protein, 21 aa, Staphylococcus
TEIRQKLNIVNKALIDPDKFK

SEQ ID NO: 2041220 - protein, 24 aa, Staphylococcus
TEISHDWLNFGYEFVSSKSANIAH

SEQ ID NO: 2041221 - protein, 24 aa, Staphylococcus
TEISHDWLNFGYEFVSSKSASIAN

SEQ ID NO: 2041222 - protein, 23 aa, Staphylococcus
TEITHDWLNFGYEFVSSRSVSIA

SEQ ID NO: 2041223 - protein, 18 aa, Staphylococcus
TEITSYFYNRMFQQHPEL

SEQ ID NO: 2041224 - protein, 18 aa, Staphylococcus
TEIVPAVNQIECHPYLSQ

SEQ ID NO: 2041225 - protein, 24 aa, Staphylococcus
TEIVPSYRAVMIHFDQTKINAKEL

SEQ ID NO: 2041226 - protein, 20 aa, Staphylococcus
TEIYDYIRLLYARIGKPFCP

SEQ ID NO: 2041227 - protein, 20 aa, Staphylococcus
TEIYDYIRLLYARIGKPYCP

SEQ ID NO: 2041228 - protein, 34 aa, Staphylococcus
TEIYDYIRLLYARVGKAFCPYHGIEIESQTVQQM

SEQ ID NO: 2041229 - protein, 21 aa, Staphylococcus
TEIYDYIRLLYARVGKAYCPN

SEQ ID NO: 2041230 - protein, 20 aa, Staphylococcus
TEIYDYIRLLYARVGKPYCP

SEQ ID NO: 2041231 - protein, 21 aa, Staphylococcus
TEIYDYIRLLYARVGKPYCPN

SEQ ID NO: 2041232 - protein, 18 aa, Staphylococcus
TEKARYEAYVALRKDEKG

SEQ ID NO: 2041233 - protein, 17 aa, Staphylococcus
TEKDGRMIFAIPREEKA

SEQ ID NO: 2041234 - protein, 20 aa, Staphylococcus
TEKDLIVLIKLIYASETSNK

SEQ ID NO: 2041235 - protein, 24 aa, Staphylococcus
TEKDLKRTPSFSVNRPGEETGVTF

SEQ ID NO: 2041236 - protein, 22 aa, Staphylococcus
TEKEMLDAIFFGHEEIKRLVDF

SEQ ID NO: 2041237 - protein, 23 aa, Staphylococcus
TEKEMLEAIFFGHDEIKRLVAFQ

SEQ ID NO: 2041238 - protein, 17 aa, Staphylococcus
TEKGQFTERIFGLENRQ

SEQ ID NO: 2041239 - protein, 18 aa, Staphylococcus
TEKGQFTERIFGMDNRQF

SEQ ID NO: 2041240 - protein, 22 aa, Staphylococcus
TEKKGPSVLGIIEYNVQGQSEF

SEQ ID NO: 2041241 - protein, 21 aa, Staphylococcus
TEKPDLIVIAGDLYDTSYPSK

SEQ ID NO: 2041242 - protein, 21 aa, Staphylococcus
TEKRVEVALNRARYESQTNYI

SEQ ID NO: 2041243 - protein, 25 aa, Staphylococcus
TEKSLKRTPSFSVNRPGEETGITFA

SEQ ID NO: 2041244 - protein, 18 aa, Staphylococcus
TEKYPFKTISLTAVASKR

SEQ ID NO: 2041245 - protein, 23 aa, Staphylococcus
TEKYSVLRALKAIERSNVVLVII

SEQ ID NO: 2041246 - protein, 23 aa, Staphylococcus
TEKYSVLRALKAIERSNVVLVVL

SEQ ID NO: 2041247 - protein, 18 aa, Staphylococcus
TELCPKCQAHFNSRCKFH

SEQ ID NO: 2041248 - protein, 18 aa, Staphylococcus
TELDKCLDYLREGDILVI

SEQ ID NO: 2041249 - protein, 22 aa, Staphylococcus
TELDRMVQEFAQRIQQQGLDLQ

SEQ ID NO: 2041250 - protein, 21 aa, Staphylococcus
TELDRMVQEFGQRMQQQGLNL

SEQ ID NO: 2041251 - protein, 21 aa, Staphylococcus
TELEGLGILDFYTESRTERLT

SEQ ID NO: 2041252 - protein, 21 aa, Staphylococcus
TELEGLGILDFYTKSKTDRLT

SEQ ID NO: 2041253 - protein, 24 aa, Staphylococcus
TELEIKFAKKLREAIPSLKKMRFV

SEQ ID NO: 2041254 - protein, 21 aa, Staphylococcus
TELFKLKSNLWQLAKDTYQEW

SEQ ID NO: 2041255 - protein, 26 aa, Staphylococcus
TELFKYKIIFCFDGADFFSFGRIHRT

SEQ ID NO: 2041256 - protein, 21 aa, Staphylococcus
TELFLNVFGIEHLDDLPTTDE

SEQ ID NO: 2041257 - protein, 17 aa, Staphylococcus
TELFLRDVCEMGETKFI

SEQ ID NO: 2041258 - protein, 23 aa, Staphylococcus
TELGEGGLKEFFETKELIEPFNK

SEQ ID NO: 2041259 - protein, 17 aa, Staphylococcus
TELHGAPGFENDVKAYM

SEQ ID NO: 2041260 - protein, 17 aa, Staphylococcus
TELIEAYDSPGLTIQHY

SEQ ID NO: 2041261 - protein, 18 aa, Staphylococcus
TELINEVALLQFMNGSTL

SEQ ID NO: 2041262 - protein, 25 aa, Staphylococcus
TELIRPASKITLWDIYKAVETDQID

SEQ ID NO: 2041263 - protein, 17 aa, Staphylococcus
TELIVAYQRVKNRVEIN

SEQ ID NO: 2041264 - protein, 17 aa, Staphylococcus
TELIVAYQRVKNRVEYH

SEQ ID NO: 2041265 - protein, 24 aa, Staphylococcus
TELKEIRDNVAIIFVIHEFYAEWL

SEQ ID NO: 2041266 - protein, 25 aa, Staphylococcus
TELKEIRDNVAYIFVIHEFYADWLN

SEQ ID NO: 2041267 - protein, 22 aa, Staphylococcus
TELKRTICAITKYDNKKKDIDL

SEQ ID NO: 2041268 - protein, 21 aa, Staphylococcus
TELKVVSLIQVHPLNPAPDEI

SEQ ID NO: 2041269 - protein, 23 aa, Staphylococcus
TELNKRNKSAISYEITSTDIHKH

SEQ ID NO: 2041270 - protein, 23 aa, Staphylococcus
TELPIEGILLLSPMLELKKNYKT

SEQ ID NO: 2041271 - protein, 29 aa, Staphylococcus
TELPVEVTICSGLLKADKYEWLLQKCTEL

SEQ ID NO: 2041272 - protein, 19 aa, Staphylococcus
TELQILNMLFRNEGKYVSR

SEQ ID NO: 2041273 - protein, 23 aa, Staphylococcus
TELRLNDIGFIFQASHLVPYLTV

SEQ ID NO: 2041274 - protein, 17 aa, Staphylococcus
TELTINEAINFIKDDEP

SEQ ID NO: 2041275 - protein, 21 aa, Staphylococcus
TELTNAFHLFEEIKSTQIKDE

SEQ ID NO: 2041276 - protein, 24 aa, Staphylococcus
TELYRPYIKRIQPILDKYDLHTAQ

SEQ ID NO: 2041277 - protein, 21 aa, Staphylococcus
TELYVKPILELKKHVDIKAMN

SEQ ID NO: 2041278 - protein, 25 aa, Staphylococcus
TEMIKHKYPRLFESVHRALLQTWPD

SEQ ID NO: 2041279 - protein, 17 aa, Staphylococcus
TEMIKYKVPNAFVEISP

SEQ ID NO: 2041280 - protein, 17 aa, Staphylococcus
TEMIKYKVPNAFVEISQ

SEQ ID NO: 2041281 - protein, 20 aa, Staphylococcus
TEMSSKLMAYDQHQHVHLYP

SEQ ID NO: 2041282 - protein, 21 aa, Staphylococcus
TEMYDKILVDAPCSGLGVLRH

SEQ ID NO: 2041283 - protein, 25 aa, Staphylococcus
TENFGISVMAAFGYRAGEPPHGKVR

SEQ ID NO: 2041284 - protein, 18 aa, Staphylococcus
TENGKLKGLITIKDIEKV

SEQ ID NO: 2041285 - protein, 22 aa, Staphylococcus
TENRGNIPYTVFIDPPLSRVGL

SEQ ID NO: 2041286 - protein, 19 aa, Staphylococcus
TENRLPFILFSASGGARMQ

SEQ ID NO: 2041287 - protein, 21 aa, Staphylococcus
TEPAVAFRLFKQLVEEKYGKD

SEQ ID NO: 2041288 - protein, 29 aa, Staphylococcus
TEPEPSFSTCFGAPFLPLHPTKYANLLGK

SEQ ID NO: 2041289 - protein, 28 aa, Staphylococcus
TEPEPSFSTCFGAPFLPLHPTVYADLLG

SEQ ID NO: 2041290 - protein, 28 aa, Staphylococcus
TEPEPSFSTCFGAPFLPLNPNKYADLLG

SEQ ID NO: 2041291 - protein, 17 aa, Staphylococcus
TEPFKLQNPKQHDVSEY

SEQ ID NO: 2041292 - protein, 23 aa, Staphylococcus
TEPIKKIANHRVLAVNRGEKEKV

SEQ ID NO: 2041293 - protein, 23 aa, Staphylococcus
TEPKRVKLKWSDNVVDDLKKLQR

SEQ ID NO: 2041294 - protein, 26 aa, Staphylococcus
TEPMVLPARFPNLLINGSTGISAGYA

SEQ ID NO: 2041295 - protein, 32 aa, Staphylococcus
TEPQIKVGDKIEKGDVIGFIEAMKVMNEVTSD

SEQ ID NO: 2041296 - protein, 22 aa, Staphylococcus
TEQEQWNKLAYVVELANELFGT

SEQ ID NO: 2041297 - protein, 27 aa, Staphylococcus
TEQLPRLEMLEAYYLNRNTDILTGQRR

SEQ ID NO: 2041298 - protein, 21 aa, Staphylococcus
TEQPQFLNLCVEINTQLTPRE

SEQ ID NO: 2041299 - protein, 24 aa, Staphylococcus
TEQRLSKAATEMMIYHLVQQYQDD

SEQ ID NO: 2041300 - protein, 24 aa, Staphylococcus
TEQVAFHPAHIVPGIDFSNDPLLQ

SEQ ID NO: 2041301 - protein, 19 aa, Staphylococcus
TERIKVGSGGIMLPNHAPL

SEQ ID NO: 2041302 - protein, 23 aa, Staphylococcus
TERKGDYGFGYDPIFYLPEKNKT

SEQ ID NO: 2041303 - protein, 23 aa, Staphylococcus
TERRLTDIGFIFQSSHLVPYLSV

SEQ ID NO: 2041304 - protein, 22 aa, Staphylococcus
TESEMLEAIFFGHDEIKRLVAF

SEQ ID NO: 2041305 - protein, 22 aa, Staphylococcus
TESEMLEAIFFGHEEIKRLVAF

SEQ ID NO: 2041306 - protein, 23 aa, Staphylococcus
TESEMLEAIFFGHSEIQRLVNFQ

SEQ ID NO: 2041307 - protein, 19 aa, Staphylococcus
TESGFDYIVTGSGFLYNMV

SEQ ID NO: 2041308 - protein, 18 aa, Staphylococcus
TESGILYHLYEVHKDADV

SEQ ID NO: 2041309 - protein, 20 aa, Staphylococcus
TESKGPSVLGVIEYNVQGQS

SEQ ID NO: 2041310 - protein, 21 aa, Staphylococcus
TESKMAIAMARQGGLGVVHKN

SEQ ID NO: 2041311 - protein, 20 aa, Staphylococcus
TESKMAISMARQGGLGVIHK

SEQ ID NO: 2041312 - protein, 18 aa, Staphylococcus
TESLKIDLHIAREMEIEQ

SEQ ID NO: 2041313 - protein, 30 aa, Staphylococcus
TESQDWASMLLRMYQRYCEQNGFNVETVDY

SEQ ID NO: 2041314 - protein, 22 aa, Staphylococcus
TESRALKFFKYFYSQKGPILDF

SEQ ID NO: 2041315 - protein, 17 aa, Staphylococcus
TESSIIFIQQLGRGLRK

SEQ ID NO: 2041316 - protein, 17 aa, Staphylococcus
TESSLKLSLKYNSAYLV

SEQ ID NO: 2041317 - protein, 22 aa, Staphylococcus
TESSMMICYDARDMIKHYNISS

SEQ ID NO: 2041318 - protein, 25 aa, Staphylococcus
TESTLKFYYRLGFKNYDIRQNFFIS

SEQ ID NO: 2041319 - protein, 20 aa, Staphylococcus
TESWSNQVANFMSAKQRLDM

SEQ ID NO: 2041320 - protein, 32 aa, Staphylococcus
TESYGGTCINHGCIPSKVLVNDGIKHVDFSTA

SEQ ID NO: 2041321 - protein, 18 aa, Staphylococcus
TESYHFDLQNVIGVGIGV

SEQ ID NO: 2041322 - protein, 17 aa, Staphylococcus
TETCSQFLTASPEMLAQ

SEQ ID NO: 2041323 - protein, 19 aa, Staphylococcus
TETGITIMYMVKKLDAGNI

SEQ ID NO: 2041324 - protein, 22 aa, Staphylococcus
TETKGPSVLGIIEYHVQGQSEF

SEQ ID NO: 2041325 - protein, 28 aa, Staphylococcus
TETPTGLWLSELVHFYDAFKDTNVDIDL

SEQ ID NO: 2041326 - protein, 17 aa, Staphylococcus
TETQLFYGGGISNYEEA

SEQ ID NO: 2041327 - protein, 19 aa, Staphylococcus
TETRFQPGENLIVKHNNED

SEQ ID NO: 2041328 - protein, 21 aa, Staphylococcus
TETRIKEELEYFESLVEKVGC

SEQ ID NO: 2041329 - protein, 25 aa, Staphylococcus
TETRLTKAAIEMMIFNIVQQHKSEM

SEQ ID NO: 2041330 - protein, 26 aa, Staphylococcus
TETVWRQATTYGVPRIVFINKMDKLG

SEQ ID NO: 2041331 - protein, 22 aa, Staphylococcus
TEVALRAAFKAVMEGKQVAFLV

SEQ ID NO: 2041332 - protein, 17 aa, Staphylococcus
TEVDALYEIKHEARYGG

SEQ ID NO: 2041333 - protein, 17 aa, Staphylococcus
TEVIEMIKNQIKSKKMI

SEQ ID NO: 2041334 - protein, 18 aa, Staphylococcus
TEVNPLPPHYICPECKQS

SEQ ID NO: 2041335 - protein, 18 aa, Staphylococcus
TEVNPLPPHYICPHCKTS

SEQ ID NO: 2041336 - protein, 19 aa, Staphylococcus
TEVNPLPPHYICPKCKKSE

SEQ ID NO: 2041337 - protein, 18 aa, Staphylococcus
TEVNPLPPHYICPNCKTS

SEQ ID NO: 2041338 - protein, 18 aa, Staphylococcus
TEVNPLPPHYICPQCKTS

SEQ ID NO: 2041339 - protein, 17 aa, Staphylococcus
TEVNPLPPHYICSHCKT

SEQ ID NO: 2041340 - protein, 17 aa, Staphylococcus
TEVNPLPPHYICTHCKT

SEQ ID NO: 2041341 - protein, 24 aa, Staphylococcus
TEVPACNEVQCGWAASHSLEGAKA

SEQ ID NO: 2041342 - protein, 23 aa, Staphylococcus
TEVQFQYGLTLCHLEMFQEAIKQ

SEQ ID NO: 2041343 - protein, 21 aa, Staphylococcus
TEVQFQYGLVLCQLEMFDQAI

SEQ ID NO: 2041344 - protein, 21 aa, Staphylococcus
TEVSRRSIASLAVRIAKNPEL

SEQ ID NO: 2041345 - protein, 17 aa, Staphylococcus
TEVTVFFLNGFQMKGTI

SEQ ID NO: 2041346 - protein, 25 aa, Staphylococcus
TEVVDTFPIRFVVDGDNEVSDPKEL

SEQ ID NO: 2041347 - protein, 26 aa, Staphylococcus
TEWQEWLKDGVLGKMDVAFSRDTGEK

SEQ ID NO: 2041348 - protein, 25 aa, Staphylococcus
TEYARIMPHITIKPHFELKETELDS

SEQ ID NO: 2041349 - protein, 18 aa, Staphylococcus
TEYARIMPHITIKSHFEI

SEQ ID NO: 2041350 - protein, 22 aa, Staphylococcus
TEYCGVCHTDLHIKNADFGDVT

SEQ ID NO: 2041351 - protein, 22 aa, Staphylococcus
TEYDILCLFMLTPEQPISKQKI

SEQ ID NO: 2041352 - protein, 17 aa, Staphylococcus
TEYDLFYVLAENKNHVL

SEQ ID NO: 2041353 - protein, 17 aa, Staphylococcus
TEYLKKQNCLFVLVDPY

SEQ ID NO: 2041354 - protein, 19 aa, Staphylococcus
TEYYFKQPLLDWLNHYPGS

SEQ ID NO: 2041355 - protein, 23 aa, Staphylococcus
TFAKEHGFEILGIVGDYAEVGCD

SEQ ID NO: 2041356 - protein, 18 aa, Staphylococcus
TFANLPVIRQCNVMTMAT

SEQ ID NO: 2041357 - protein, 19 aa, Staphylococcus
TFAQIGLSQTQAHTFYAGD

SEQ ID NO: 2041358 - protein, 25 aa, Staphylococcus
TFARRCAEEGIIFIGPELKHLDMFG

SEQ ID NO: 2041359 - protein, 30 aa, Staphylococcus
TFARRCQEEGIKFIGPRVEHLDMFGDKVKA

SEQ ID NO: 2041360 - protein, 17 aa, Staphylococcus
TFASEHLEFCKENNLKG

SEQ ID NO: 2041361 - protein, 25 aa, Staphylococcus
TFAVTFPHVMPLLIQNYVSRHPNIK

SEQ ID NO: 2041362 - protein, 18 aa, Staphylococcus
TFDDCLKDALAYTKQHHM

SEQ ID NO: 2041363 - protein, 19 aa, Staphylococcus
TFDGKAFYIIATRNGMIKK

SEQ ID NO: 2041364 - protein, 21 aa, Staphylococcus
TFDHAFECVGGKGSQSAVNQI

SEQ ID NO: 2041365 - protein, 18 aa, Staphylococcus
TFDSRIKSSLAIAKDQNI

SEQ ID NO: 2041366 - protein, 23 aa, Staphylococcus
TFECGKAEEVIIEWKQKGIEPDV

SEQ ID NO: 2041367 - protein, 21 aa, Staphylococcus
TFEEAQKWLDIGIEQAIYHQS

SEQ ID NO: 2041368 - protein, 24 aa, Staphylococcus
TFEEFKPRVKGRIGGRRNGALVSL

SEQ ID NO: 2041369 - protein, 24 aa, Staphylococcus
TFEILRKRFRGTYGKMKRIPQNVS

SEQ ID NO: 2041370 - protein, 20 aa, Staphylococcus
TFENRFDKRLDDIYSNELND

SEQ ID NO: 2041371 - protein, 18 aa, Staphylococcus
TFESAESTLAQWLPEVRA

SEQ ID NO: 2041372 - protein, 18 aa, Staphylococcus
TFESAVTALQRWLPEVRR

SEQ ID NO: 2041373 - protein, 17 aa, Staphylococcus
TFETNVYPVFWTIQKAL

SEQ ID NO: 2041374 - protein, 24 aa, Staphylococcus
TFEVRAEQVIMFFNYNEIIDTVNE

SEQ ID NO: 2041375 - protein, 25 aa, Staphylococcus
TFEYKDARNYLSFLYSHNLKRTTVS

SEQ ID NO: 2041376 - protein, 23 aa, Staphylococcus
TFFDHQLLRRLVAFMYDQPSTII

SEQ ID NO: 2041377 - protein, 23 aa, Staphylococcus
TFFDHQLLRRLVAFMYDTPSTLI

SEQ ID NO: 2041378 - protein, 22 aa, Staphylococcus
TFGRSAGVFLAMKVAAEREVEG

SEQ ID NO: 2041379 - protein, 18 aa, Staphylococcus
TFGYLVYFFELACAMSGY

SEQ ID NO: 2041380 - protein, 17 aa, Staphylococcus
TFHAVQGHFADVFKSLF

SEQ ID NO: 2041381 - protein, 24 aa, Staphylococcus
TFIIVSFKHKVILIGGTEYAGEMK

SEQ ID NO: 2041382 - protein, 30 aa, Staphylococcus
TFIPSCGKCIPCKEGRPALCENGAKANEKG

SEQ ID NO: 2041383 - protein, 23 aa, Staphylococcus
TFIYCLEGTLTLTLGEATYIAHE

SEQ ID NO: 2041384 - protein, 20 aa, Staphylococcus
TFKATCTNVVDGDTIDIDLD

SEQ ID NO: 2041385 - protein, 24 aa, Staphylococcus
TFKQGIKVSLFIGGTDIEKDRQRT

SEQ ID NO: 2041386 - protein, 23 aa, Staphylococcus
TFKYSPEFAQPINLKIILIHHQF

SEQ ID NO: 2041387 - protein, 19 aa, Staphylococcus
TFLDPRGQYILEVIVGSYE

SEQ ID NO: 2041388 - protein, 17 aa, Staphylococcus
TFLIKTYGCQMNAHDTE

SEQ ID NO: 2041389 - protein, 21 aa, Staphylococcus
TFLKPDIAIITGIGEAHFSTF

SEQ ID NO: 2041390 - protein, 23 aa, Staphylococcus
TFLRGEIILGNLKYSSGPNHQLP

SEQ ID NO: 2041391 - protein, 19 aa, Staphylococcus
TFLRGEIILGNMKYSSGPN

SEQ ID NO: 2041392 - protein, 22 aa, Staphylococcus
TFLRGFLGRMLFSGEEVKKKAS

SEQ ID NO: 2041393 - protein, 17 aa, Staphylococcus
TFMKSNIPYTMVGGQKF

SEQ ID NO: 2041394 - protein, 24 aa, Staphylococcus
TFNAYKLPGHGNVLNGLDNLIAGM

SEQ ID NO: 2041395 - protein, 23 aa, Staphylococcus
TFNDAWKKMGILGIEMEAAGLYL

SEQ ID NO: 2041396 - protein, 20 aa, Staphylococcus
TFNDNWQKMGILGIEMESAG

SEQ ID NO: 2041397 - protein, 24 aa, Staphylococcus
TFNDQWHRMGILGIEMESAGLYLN

SEQ ID NO: 2041398 - protein, 23 aa, Staphylococcus
TFNGELLMNIFIYDVVNEEWIFR

SEQ ID NO: 2041399 - protein, 18 aa, Staphylococcus
TFNHPDFMYISSEETTIK

SEQ ID NO: 2041400 - protein, 23 aa, Staphylococcus
TFNHSFDAFKNWFTETVSFNTFE

SEQ ID NO: 2041401 - protein, 25 aa, Staphylococcus
TFNNVRFRNLISYHCVDANGVRSLT

SEQ ID NO: 2041402 - protein, 25 aa, Staphylococcus
TFNVLKEIVKGFGYSYRDYKQLVDR

SEQ ID NO: 2041403 - protein, 24 aa, Staphylococcus
TFQDRRKAFQFAYLSLLQEENIQA

SEQ ID NO: 2041404 - protein, 20 aa, Staphylococcus
TFREGCSLGEIKVTDQSVNI

SEQ ID NO: 2041405 - protein, 27 aa, Staphylococcus
TFRLTEQILNRFGIEFTTVDTTQPNNI

SEQ ID NO: 2041406 - protein, 19 aa, Staphylococcus
TFRLTEQILTRFNIQFSTI

SEQ ID NO: 2041407 - protein, 20 aa, Staphylococcus
TFRLTERILNRFNIKFTTVN

SEQ ID NO: 2041408 - protein, 18 aa, Staphylococcus
TFRNCMFDALEVNKSRFK

SEQ ID NO: 2041409 - protein, 17 aa, Staphylococcus
TFRQLGVDYEMSKLKKD

SEQ ID NO: 2041410 - protein, 24 aa, Staphylococcus
TFSEFEIYKLLSLLENDVDTMKMS

SEQ ID NO: 2041411 - protein, 20 aa, Staphylococcus
TFSGHRRFPMGSNDFNTEEK

SEQ ID NO: 2041412 - protein, 17 aa, Staphylococcus
TFSIVAHRGLSKRYPEN

SEQ ID NO: 2041413 - protein, 24 aa, Staphylococcus
TFSPAYFQKLWLYAWEETHENELV

SEQ ID NO: 2041414 - protein, 17 aa, Staphylococcus
TFSRTQAFLDEFASSLS

SEQ ID NO: 2041415 - protein, 19 aa, Staphylococcus
TFSSHMKNIVAILQQADKH

SEQ ID NO: 2041416 - protein, 32 aa, Staphylococcus
TFTAASGWTDIFIYPGFEFKAIDGLITNFHLP

SEQ ID NO: 2041417 - protein, 24 aa, Staphylococcus
TFVCGKAEEVIMQWKADGIQPDVV

SEQ ID NO: 2041418 - protein, 26 aa, Staphylococcus
TFVIGPGNRFPHAASLAVAEAPAKAY

SEQ ID NO: 2041419 - protein, 27 aa, Staphylococcus
TFVIGPGNRFPHAASLAVAEAPAKAYN

SEQ ID NO: 2041420 - protein, 25 aa, Staphylococcus
TFVIVSFKHKVILIGGTEYAGEMKK

SEQ ID NO: 2041421 - protein, 23 aa, Staphylococcus
TFVKRPDLLAKYPLTTEDEKILE

SEQ ID NO: 2041422 - protein, 30 aa, Staphylococcus
TFVPARNLLFLSFAGALAYQIKAKHIITGV

SEQ ID NO: 2041423 - protein, 26 aa, Staphylococcus
TFVPARNLLFLSFAGALAYQTNAKHI

SEQ ID NO: 2041424 - protein, 20 aa, Staphylococcus
TFVTEGKNDWAFETKDKSFV

SEQ ID NO: 2041425 - protein, 23 aa, Staphylococcus
TFVTEGKNEWAFETNDKSFVAQI

SEQ ID NO: 2041426 - protein, 23 aa, Staphylococcus
TFVTEGKNEWAFETRDKSFVAQI

SEQ ID NO: 2041427 - protein, 23 aa, Staphylococcus
TFVTEGKNEWAFETRDKSYVAQI

SEQ ID NO: 2041428 - protein, 23 aa, Staphylococcus
TFVTEGKNEWAFETSDKSFVAQI

SEQ ID NO: 2041429 - protein, 23 aa, Staphylococcus
TFVTEGKNEWAFETSDKSYVAQI

SEQ ID NO: 2041430 - protein, 19 aa, Staphylococcus
TFVYCLQGQVTLQLGNVCY

SEQ ID NO: 2041431 - protein, 24 aa, Staphylococcus
TFYEARTIYLPNAFHPLLDKETVV

SEQ ID NO: 2041432 - protein, 20 aa, Staphylococcus
TFYEGYKLGSDELSIGEIVF

SEQ ID NO: 2041433 - protein, 20 aa, Staphylococcus
TFYGGPFAERKRAMIAPSYF

SEQ ID NO: 2041434 - protein, 21 aa, Staphylococcus
TFYHPSNMVLFVVGDVDPKRI

SEQ ID NO: 2041435 - protein, 21 aa, Staphylococcus
TFYHPSNMVLFVVGDVDVANI

SEQ ID NO: 2041436 - protein, 22 aa, Staphylococcus
TFYHPSNMVLFVVGDVEPQYIV

SEQ ID NO: 2041437 - protein, 21 aa, Staphylococcus
TFYHPSNMVLFVVGDVNPEEI

SEQ ID NO: 2041438 - protein, 21 aa, Staphylococcus
TFYHPSNMVLFVVGDVNPENI

SEQ ID NO: 2041439 - protein, 26 aa, Staphylococcus
TFYPMPFLSPQTMWYYKSAFNTDQMR

SEQ ID NO: 2041440 - protein, 18 aa, Staphylococcus
TGADFGLAFDGDGDRIIA

SEQ ID NO: 2041441 - protein, 24 aa, Staphylococcus
TGADVNWNLGIIWKKESYINYVTR

SEQ ID NO: 2041442 - protein, 24 aa, Staphylococcus
TGAGNDFLGWLDLPVDYDKEEFSR

SEQ ID NO: 2041443 - protein, 20 aa, Staphylococcus
TGAKLAGLICEIMNEDGTMA

SEQ ID NO: 2041444 - protein, 18 aa, Staphylococcus
TGALLTFAVMAAVDIAQV

SEQ ID NO: 2041445 - protein, 27 aa, Staphylococcus
TGANIKDLWRVTSWNQAKALGIDQTKG

SEQ ID NO: 2041446 - protein, 20 aa, Staphylococcus
TGDFKFDFTPVGTLANIAKM

SEQ ID NO: 2041447 - protein, 26 aa, Staphylococcus
TGDFLCFEGDTWRTVILGSSDRKRSI

SEQ ID NO: 2041448 - protein, 25 aa, Staphylococcus
TGDGYRFAESMGHTITELFPTEVPI

SEQ ID NO: 2041449 - protein, 25 aa, Staphylococcus
TGDGYRFAKNLGHTITELFPTEVPI

SEQ ID NO: 2041450 - protein, 25 aa, Staphylococcus
TGDGYRFAQAMGHTITELFPTEVPI

SEQ ID NO: 2041451 - protein, 18 aa, Staphylococcus
TGDIKTPVKYASGELKKL

SEQ ID NO: 2041452 - protein, 19 aa, Staphylococcus
TGDIKTPVKYASRELKMLF

SEQ ID NO: 2041453 - protein, 31 aa, Staphylococcus
TGDKRFAYDCYRRLLQMFGEVVYSVPMQAFD

SEQ ID NO: 2041454 - protein, 23 aa, Staphylococcus
TGDLTVAFLLAKLSWHERHHLEH

SEQ ID NO: 2041455 - protein, 23 aa, Staphylococcus
TGDRPIQIGSHFHFFEANLALDF

SEQ ID NO: 2041456 - protein, 23 aa, Staphylococcus
TGDRPIQVGSHFHFYEANKALKF

SEQ ID NO: 2041457 - protein, 21 aa, Staphylococcus
TGEAEPSLSFIGDLDEIDDSV

SEQ ID NO: 2041458 - protein, 20 aa, Staphylococcus
TGEAEPSLSFIGDLDSISDR

SEQ ID NO: 2041459 - protein, 22 aa, Staphylococcus
TGEALRIKHHLKNEIREAKSFY

SEQ ID NO: 2041460 - protein, 26 aa, Staphylococcus
TGEGAKAMLYMPCVDLKQQLGTVKIT

SEQ ID NO: 2041461 - protein, 25 aa, Staphylococcus
TGEILYFLSARECSRHFGYSDRWCD

SEQ ID NO: 2041462 - protein, 23 aa, Staphylococcus
TGEMKKRYGLIYVDRDNEGHGTL

SEQ ID NO: 2041463 - protein, 19 aa, Staphylococcus
TGESCAINGVLPPIISQVA

SEQ ID NO: 2041464 - protein, 19 aa, Staphylococcus
TGESCAINGVLPPIVSIVA

SEQ ID NO: 2041465 - protein, 25 aa, Staphylococcus
TGETCPICGNEIHTLSSHVDFDEIM

SEQ ID NO: 2041466 - protein, 28 aa, Staphylococcus
TGFDGWAPLFFRGREVSGKTIGIIGLGE

SEQ ID NO: 2041467 - protein, 17 aa, Staphylococcus
TGFDYVVTGSGFLYNMV

SEQ ID NO: 2041468 - protein, 25 aa, Staphylococcus
TGFELRTGAFYNFCKQAEEDNEKDH

SEQ ID NO: 2041469 - protein, 17 aa, Staphylococcus
TGFEVLKKLNKVLEKRR

SEQ ID NO: 2041470 - protein, 19 aa, Staphylococcus
TGFGTGGWQLAAINHCSKA

SEQ ID NO: 2041471 - protein, 19 aa, Staphylococcus
TGFGTGGWQLAALNLCSKA

SEQ ID NO: 2041472 - protein, 20 aa, Staphylococcus
TGFGTGGWQLAALNLCSKAA

SEQ ID NO: 2041473 - protein, 18 aa, Staphylococcus
TGFILKFNVSENAFTFFN

SEQ ID NO: 2041474 - protein, 23 aa, Staphylococcus
TGGDMRTPVAFYKATPTDDFFPG

SEQ ID NO: 2041475 - protein, 18 aa, Staphylococcus
TGGEVIDFLLSLQKNVNH

SEQ ID NO: 2041476 - protein, 17 aa, Staphylococcus
TGGGRGGSMLILTKEEV

SEQ ID NO: 2041477 - protein, 17 aa, Staphylococcus
TGGHFVEDVAYFSDKNE

SEQ ID NO: 2041478 - protein, 19 aa, Staphylococcus
TGGLVAISGGRNFKDVVDR

SEQ ID NO: 2041479 - protein, 17 aa, Staphylococcus
TGGSILFRQRGTKIYAG

SEQ ID NO: 2041480 - protein, 25 aa, Staphylococcus
TGHFLSLPGWAGMMYYRAEQHEHEA

SEQ ID NO: 2041481 - protein, 18 aa, Staphylococcus
TGHMPNLWGDIKRIKSDC

SEQ ID NO: 2041482 - protein, 22 aa, Staphylococcus
TGHYRNGILLSPVIGRDIANWL

SEQ ID NO: 2041483 - protein, 19 aa, Staphylococcus
TGIDHNRLNLLMAVLEKKE

SEQ ID NO: 2041484 - protein, 24 aa, Staphylococcus
TGIDHNRLSLLMAVLEKKENYLLQ

SEQ ID NO: 2041485 - protein, 22 aa, Staphylococcus
TGIELFKMPSIEQVLVGELEVN

SEQ ID NO: 2041486 - protein, 26 aa, Staphylococcus
TGIEMPRVLGDIIICTDVAQEQADSY

SEQ ID NO: 2041487 - protein, 24 aa, Staphylococcus
TGIENIEFKMLCMGFKKKEIKRLM

SEQ ID NO: 2041488 - protein, 21 aa, Staphylococcus
TGIGFALSIERLLLALDEENI

SEQ ID NO: 2041489 - protein, 21 aa, Staphylococcus
TGIGFALSIERLLLALEEEDI

SEQ ID NO: 2041490 - protein, 27 aa, Staphylococcus
TGIGLAFVCAAKGYKAVFTMPETMSLE

SEQ ID NO: 2041491 - protein, 17 aa, Staphylococcus
TGIGPKSALAILATSTP

SEQ ID NO: 2041492 - protein, 17 aa, Staphylococcus
TGIGRTGKCFAFEHYDI

SEQ ID NO: 2041493 - protein, 25 aa, Staphylococcus
TGIISWKKNIKIGYLDQIPNYADNE

SEQ ID NO: 2041494 - protein, 22 aa, Staphylococcus
TGIKDIQRKSVFHALNQKAVAR

SEQ ID NO: 2041495 - protein, 17 aa, Staphylococcus
TGIKEMIDYFNIKQEET

SEQ ID NO: 2041496 - protein, 19 aa, Staphylococcus
TGIKPELVTQVAREFAQNA

SEQ ID NO: 2041497 - protein, 28 aa, Staphylococcus
TGIKQSKHVGGFPVSGLFLRCKNKDVIE

SEQ ID NO: 2041498 - protein, 23 aa, Staphylococcus
TGIKSTSILPGMVDTPMTEGYDF

SEQ ID NO: 2041499 - protein, 30 aa, Staphylococcus
TGIPESKHLGGFPISGQFLICTNPEVINEH

SEQ ID NO: 2041500 - protein, 30 aa, Staphylococcus
TGIPESKHLGGFPITGQFLICTNPDVIQAH

SEQ ID NO: 2041501 - protein, 19 aa, Staphylococcus
TGKGLLRCFSSKWRIIYLD

SEQ ID NO: 2041502 - protein, 20 aa, Staphylococcus
TGKMPNLWEAISSLHMPTLI

SEQ ID NO: 2041503 - protein, 18 aa, Staphylococcus
TGKPMLVTYDLLCKHYSK

SEQ ID NO: 2041504 - protein, 22 aa, Staphylococcus
TGKRLKDETILFLGTGAIAQDT

SEQ ID NO: 2041505 - protein, 20 aa, Staphylococcus
TGKTYDWKILDTIHDVDYLI

SEQ ID NO: 2041506 - protein, 24 aa, Staphylococcus
TGLENIEFKMLCMGFKPKEIKELT

SEQ ID NO: 2041507 - protein, 18 aa, Staphylococcus
TGLFGHPVSDRENSMTAG

SEQ ID NO: 2041508 - protein, 22 aa, Staphylococcus
TGLFRYIQMFIISNGIETRYIS

SEQ ID NO: 2041509 - protein, 24 aa, Staphylococcus
TGLISNMASLVFLLGDLNVDDLTT

SEQ ID NO: 2041510 - protein, 18 aa, Staphylococcus
TGLKNVNMGISGTGYQDR

SEQ ID NO: 2041511 - protein, 22 aa, Staphylococcus
TGLKTDVMLAAYGYQMMDEQIV

SEQ ID NO: 2041512 - protein, 17 aa, Staphylococcus
TGLPKFDNEHLIEGADK

SEQ ID NO: 2041513 - protein, 26 aa, Staphylococcus
TGLPMKRVNDIKAYINDSVPKAMGVD

SEQ ID NO: 2041514 - protein, 19 aa, Staphylococcus
TGLPQGFCDLFGFRPDGQI

SEQ ID NO: 2041515 - protein, 24 aa, Staphylococcus
TGLRNVFNKIAWLNKSEMQESLKD

SEQ ID NO: 2041516 - protein, 17 aa, Staphylococcus
TGLTISVDNAIWKVIDF

SEQ ID NO: 2041517 - protein, 18 aa, Staphylococcus
TGLTISVDNGIWKVIDFQ

SEQ ID NO: 2041518 - protein, 17 aa, Staphylococcus
TGLTISVDNGIWKVLDF

SEQ ID NO: 2041519 - protein, 31 aa, Staphylococcus
TGLYPLDSPGGWQIIGRTPLKVFDLNRDPMT

SEQ ID NO: 2041520 - protein, 20 aa, Staphylococcus
TGMAWEAGVLAGLIENDINV

SEQ ID NO: 2041521 - protein, 29 aa, Staphylococcus
TGMFPKWKGIPTLVLLKLITMILGKRRRV

SEQ ID NO: 2041522 - protein, 21 aa, Staphylococcus
TGMLPWKKYNTVTSDKVNVVP

SEQ ID NO: 2041523 - protein, 24 aa, Staphylococcus
TGMLSLRLNKAYSVAKFLENLEIC

SEQ ID NO: 2041524 - protein, 23 aa, Staphylococcus
TGMLSLRLNKDYKVDKFLEHLNV

SEQ ID NO: 2041525 - protein, 25 aa, Staphylococcus
TGMLSLRLNKHYSVAKFLENLEICI

SEQ ID NO: 2041526 - protein, 17 aa, Staphylococcus
TGMVIDLSQNFRSRQEV

SEQ ID NO: 2041527 - protein, 19 aa, Staphylococcus
TGNMKLKFDRRGNEVYFPD

SEQ ID NO: 2041528 - protein, 18 aa, Staphylococcus
TGNMKLKLWVATEEADDM

SEQ ID NO: 2041529 - protein, 26 aa, Staphylococcus
TGNPFIQYVWGKFWVSNHAHILKGKL

SEQ ID NO: 2041530 - protein, 19 aa, Staphylococcus
TGNPRAIFEHCLPSFHDTE

SEQ ID NO: 2041531 - protein, 24 aa, Staphylococcus
TGNVRRFIARSGFENTLEITNDNC

SEQ ID NO: 2041532 - protein, 22 aa, Staphylococcus
TGQALACCYLSFKHPITHEQIE

SEQ ID NO: 2041533 - protein, 19 aa, Staphylococcus
TGQEIRVSDQILSDIDDGK

SEQ ID NO: 2041534 - protein, 21 aa, Staphylococcus
TGQEWRDVRYLYDYNQQELQD

SEQ ID NO: 2041535 - protein, 23 aa, Staphylococcus
TGQFPEWIKLDIVTTTEKVQFTE

SEQ ID NO: 2041536 - protein, 21 aa, Staphylococcus
TGQMPNLWSLLSQIDISTYIM

SEQ ID NO: 2041537 - protein, 23 aa, Staphylococcus
TGQRFKYHRHFFVPDNVGHDGFL

SEQ ID NO: 2041538 - protein, 17 aa, Staphylococcus
TGQRFLAEASKIVEQSE

SEQ ID NO: 2041539 - protein, 19 aa, Staphylococcus
TGQSFDWTLLKGLDQSIPF

SEQ ID NO: 2041540 - protein, 25 aa, Staphylococcus
TGQTFNWKILESVSQDIPYLIAGGI

SEQ ID NO: 2041541 - protein, 19 aa, Staphylococcus
TGQTLLEQGLNVFVVQLPS

SEQ ID NO: 2041542 - protein, 22 aa, Staphylococcus
TGRAAKRLQESTGLEAMTIHRL

SEQ ID NO: 2041543 - protein, 22 aa, Staphylococcus
TGRETLCRNVKNAGYTVDGAKA

SEQ ID NO: 2041544 - protein, 20 aa, Staphylococcus
TGRIGSIVAKIFAQGFDAEV

SEQ ID NO: 2041545 - protein, 20 aa, Staphylococcus
TGRTGWYFRVLKEGPIQQND

SEQ ID NO: 2041546 - protein, 21 aa, Staphylococcus
TGRTLLRQVFDSFKEATESYH

SEQ ID NO: 2041547 - protein, 24 aa, Staphylococcus
TGRVCPAPCENSCVMKINRESVAI

SEQ ID NO: 2041548 - protein, 25 aa, Staphylococcus
TGRVCPAPCENSCVMKINRESVAIK

SEQ ID NO: 2041549 - protein, 26 aa, Staphylococcus
TGSAGCGKSLLAIYRIYWLSKVYPND

SEQ ID NO: 2041550 - protein, 22 aa, Staphylococcus
TGSCSWKVFVKNGVITWENQQI

SEQ ID NO: 2041551 - protein, 24 aa, Staphylococcus
TGSDLSVVLLDFGKKQNIVRELNS

SEQ ID NO: 2041552 - protein, 24 aa, Staphylococcus
TGSDLSVVLLDFGKKQNIVRELNT

SEQ ID NO: 2041553 - protein, 22 aa, Staphylococcus
TGSELKVLFNVFTDRDLELYKE

SEQ ID NO: 2041554 - protein, 17 aa, Staphylococcus
TGSGRAFLVDTTNGKII

SEQ ID NO: 2041555 - protein, 22 aa, Staphylococcus
TGSGRGGSVITLVKDYATAEKV

SEQ ID NO: 2041556 - protein, 24 aa, Staphylococcus
TGSNLSVVLLDFGKKQNIVRELNL

SEQ ID NO: 2041557 - protein, 21 aa, Staphylococcus
TGSPLLREAISQHLGVDASRI

SEQ ID NO: 2041558 - protein, 24 aa, Staphylococcus
TGSRPIEIPNFEFGNRVIDSTGAL

SEQ ID NO: 2041559 - protein, 22 aa, Staphylococcus
TGTLKIGQTVKVAYFKQTEETL

SEQ ID NO: 2041560 - protein, 27 aa, Staphylococcus
TGTMTEEDWSRFTIAVGKLSKTKIFID

SEQ ID NO: 2041561 - protein, 17 aa, Staphylococcus
TGTRVMGGLSYRESHFA

SEQ ID NO: 2041562 - protein, 18 aa, Staphylococcus
TGTYRSSTFKDIVILERN

SEQ ID NO: 2041563 - protein, 22 aa, Staphylococcus
TGVACPGFVPLVEQMRYNDPTI

SEQ ID NO: 2041564 - protein, 17 aa, Staphylococcus
TGVCGPEPDETLIKTNQ

SEQ ID NO: 2041565 - protein, 20 aa, Staphylococcus
TGVIFAFQGCEHINRAITIE

SEQ ID NO: 2041566 - protein, 25 aa, Staphylococcus
TGVISWKKDIKIGYLNQIPDYEKSE

SEQ ID NO: 2041567 - protein, 17 aa, Staphylococcus
TGVKVTSVSPGMVETPM

SEQ ID NO: 2041568 - protein, 25 aa, Staphylococcus
TGVSFAFQGCEHINRAITIERKNFN

SEQ ID NO: 2041569 - protein, 17 aa, Staphylococcus
TGVVLLKTIYSAFVQKL

SEQ ID NO: 2041570 - protein, 23 aa, Staphylococcus
TGWQFDPLMRLFKTNILTKKFKD

SEQ ID NO: 2041571 - protein, 24 aa, Staphylococcus
TGYFARPTIFINVDNDMTIAQEEI

SEQ ID NO: 2041572 - protein, 24 aa, Staphylococcus
TGYFARPTIFINVKNDMTIAQEEI

SEQ ID NO: 2041573 - protein, 26 aa, Staphylococcus
TGYFDDFDFIYGHHLWTQLELGLIDI

SEQ ID NO: 2041574 - protein, 19 aa, Staphylococcus
TGYIKKLDITVARNSFGRQ

SEQ ID NO: 2041575 - protein, 19 aa, Staphylococcus
TGYLFPINDSFKIAEYIDL

SEQ ID NO: 2041576 - protein, 25 aa, Staphylococcus
THAAGLRYAQYGPFMTFHLAGGEGG

SEQ ID NO: 2041577 - protein, 25 aa, Staphylococcus
THAAGLRYAQYGPFMTFHLAGGNGG

SEQ ID NO: 2041578 - protein, 19 aa, Staphylococcus
THALLSCLDSGQIKGAALD

SEQ ID NO: 2041579 - protein, 26 aa, Staphylococcus
THAQMKMFLTRLGFDSKMVVTGDQTQ

SEQ ID NO: 2041580 - protein, 26 aa, Staphylococcus
THAQMKMFLTRLGFGSKMVVTGDKTQ

SEQ ID NO: 2041581 - protein, 30 aa, Staphylococcus
THAQMKMFLTRLGFGSKMVVTGDMTQVDLP

SEQ ID NO: 2041582 - protein, 26 aa, Staphylococcus
THAQMKMFLTRLGFSSKMVVTGDQTQ

SEQ ID NO: 2041583 - protein, 20 aa, Staphylococcus
THARVGIALYGSRPYSALNE

SEQ ID NO: 2041584 - protein, 20 aa, Staphylococcus
THARVGIALYGSRPYSSLKP

SEQ ID NO: 2041585 - protein, 26 aa, Staphylococcus
THASLKRYLLEETFELFEAIDNKDDW

SEQ ID NO: 2041586 - protein, 17 aa, Staphylococcus
THEDGVMHPLEIIETMQ

SEQ ID NO: 2041587 - protein, 17 aa, Staphylococcus
THEDIVWIINQLDVHDN

SEQ ID NO: 2041588 - protein, 18 aa, Staphylococcus
THEKAFVRYHGRNVHGWT

SEQ ID NO: 2041589 - protein, 24 aa, Staphylococcus
THEPELWKKVDVFVLPKDYVRYCL

SEQ ID NO: 2041590 - protein, 18 aa, Staphylococcus
THERLEVVQKFRDGEIDI

SEQ ID NO: 2041591 - protein, 17 aa, Staphylococcus
THFLAILEMAKAGLINI

SEQ ID NO: 2041592 - protein, 20 aa, Staphylococcus
THFNFSFDVSDTYNNSLMKI

SEQ ID NO: 2041593 - protein, 18 aa, Staphylococcus
THFPLLTKILDAHDQLSV

SEQ ID NO: 2041594 - protein, 18 aa, Staphylococcus
THGARKGLADTALKTADS

SEQ ID NO: 2041595 - protein, 25 aa, Staphylococcus
THGEIKAVIAKSDFIEEFKGVKEYD

SEQ ID NO: 2041596 - protein, 29 aa, Staphylococcus
THGKISALLFKPLYYFKDKHTTLTYQFPF

SEQ ID NO: 2041597 - protein, 26 aa, Staphylococcus
THGLNIAHLLKAKWGDLSGGERTKVG

SEQ ID NO: 2041598 - protein, 18 aa, Staphylococcus
THGLSLLADLFVNSGDTV

SEQ ID NO: 2041599 - protein, 17 aa, Staphylococcus
THGLSLVADMFIDSGDT

SEQ ID NO: 2041600 - protein, 25 aa, Staphylococcus
THGYDFPMWFIRPFYAKETTKNKIK

SEQ ID NO: 2041601 - protein, 25 aa, Staphylococcus
THGYDFPMWFIRPFYAKSTKLNAVK

SEQ ID NO: 2041602 - protein, 18 aa, Staphylococcus
THHIEEAKDFYINQIGFQ

SEQ ID NO: 2041603 - protein, 21 aa, Staphylococcus
THHIKLSSAVTVLSSDDPVRV

SEQ ID NO: 2041604 - protein, 19 aa, Staphylococcus
THHTHVLPIGYPRVQYLLN

SEQ ID NO: 2041605 - protein, 18 aa, Staphylococcus
THIAHKYPYKDWIDQYKI

SEQ ID NO: 2041606 - protein, 24 aa, Staphylococcus
THIFKFHGEVAMQLFLNDEFKLPN

SEQ ID NO: 2041607 - protein, 20 aa, Staphylococcus
THIIKWTKLYIDQFQSSWTM

SEQ ID NO: 2041608 - protein, 25 aa, Staphylococcus
THIKSIFCSGAKLSESLFKTVSQQF

SEQ ID NO: 2041609 - protein, 17 aa, Staphylococcus
THILKFARKLSDMKQPV

SEQ ID NO: 2041610 - protein, 18 aa, Staphylococcus
THKNIRLYIIEGEKNGIY

SEQ ID NO: 2041611 - protein, 26 aa, Staphylococcus
THKTLRGPRGGMILCKEEYKKEIDKT

SEQ ID NO: 2041612 - protein, 26 aa, Staphylococcus
THKTLRGPRGGMILCKEEYKKQIDKT

SEQ ID NO: 2041613 - protein, 19 aa, Staphylococcus
THLAFTFPANHHLDNDWKQ

SEQ ID NO: 2041614 - protein, 17 aa, Staphylococcus
THLENGLVWSIPITLPV

SEQ ID NO: 2041615 - protein, 22 aa, Staphylococcus
THLHLIKPLGFSTDDKMLKRAG

SEQ ID NO: 2041616 - protein, 24 aa, Staphylococcus
THLIDLLENFAIERGIYGKKWLDD

SEQ ID NO: 2041617 - protein, 17 aa, Staphylococcus
THLIYLHSAAKITPDAS

SEQ ID NO: 2041618 - protein, 19 aa, Staphylococcus
THLKIAAIEVYKDQRKEGI

SEQ ID NO: 2041619 - protein, 27 aa, Staphylococcus
THLKIPELRKRIKLVAEQNYQHLESLE

SEQ ID NO: 2041620 - protein, 18 aa, Staphylococcus
THLSDRAIGYGIHGETVD

SEQ ID NO: 2041621 - protein, 17 aa, Staphylococcus
THMDGKVYLIGHSMGGY

SEQ ID NO: 2041622 - protein, 17 aa, Staphylococcus
THMKDAVLATEDNRFYK

SEQ ID NO: 2041623 - protein, 25 aa, Staphylococcus
THPELKLGIITPFYGHTSKWNEHNI

SEQ ID NO: 2041624 - protein, 24 aa, Staphylococcus
THPHVIQPVKWVKAKNHHHKTLVA

SEQ ID NO: 2041625 - protein, 20 aa, Staphylococcus
THPRYHIPKTYVAKLKGYLM

SEQ ID NO: 2041626 - protein, 23 aa, Staphylococcus
THPVEWQLNYLLLRRKYDRHQSC

SEQ ID NO: 2041627 - protein, 17 aa, Staphylococcus
THPYIRDYIIPNVAHKY

SEQ ID NO: 2041628 - protein, 23 aa, Staphylococcus
THQLDHIDYFLAGVGSGGTFTGV

SEQ ID NO: 2041629 - protein, 18 aa, Staphylococcus
THRLFLFVSEGLLKGYLY

SEQ ID NO: 2041630 - protein, 17 aa, Staphylococcus
THRYHFKQEGVNGMNDE

SEQ ID NO: 2041631 - protein, 23 aa, Staphylococcus
THSKEGVKLLWASCREVINVIQA

SEQ ID NO: 2041632 - protein, 19 aa, Staphylococcus
THSKIALVVKRTHGTLTSF

SEQ ID NO: 2041633 - protein, 19 aa, Staphylococcus
THSQSDCILFITNNGDQSE

SEQ ID NO: 2041634 - protein, 24 aa, Staphylococcus
THSTISQKTYDEWFQQIQNEKSQF

SEQ ID NO: 2041635 - protein, 17 aa, Staphylococcus
THTCLPLAEASEMKFTN

SEQ ID NO: 2041636 - protein, 23 aa, Staphylococcus
THVAGIVTFGHLLARAVARDVGR

SEQ ID NO: 2041637 - protein, 24 aa, Staphylococcus
THVERISKRLGICRWKDNVRQVED

SEQ ID NO: 2041638 - protein, 23 aa, Staphylococcus
THVERVSKRLGINKWKDNVKQVE

SEQ ID NO: 2041639 - protein, 23 aa, Staphylococcus
THVERVSKRLGINRWKDNVTQVE

SEQ ID NO: 2041640 - protein, 23 aa, Staphylococcus
THYPQLYSRLGFAHQYRPLGHDE

SEQ ID NO: 2041641 - protein, 26 aa, Staphylococcus
THYSKCALDYLFPHFINIPLTIVSGL

SEQ ID NO: 2041642 - protein, 26 aa, Staphylococcus
TIADVGCGYGPIGLMIAKVSPHHQIT

SEQ ID NO: 2041643 - protein, 27 aa, Staphylococcus
TIADVGCGYGPIGLMIAKVSPHHQITM

SEQ ID NO: 2041644 - protein, 25 aa, Staphylococcus
TIAELCLIGKTLLTEYEFNKDVYED

SEQ ID NO: 2041645 - protein, 32 aa, Staphylococcus
TIAENVIFIGLLCKDGQWHAVVFEIGLGSTRE

SEQ ID NO: 2041646 - protein, 31 aa, Staphylococcus
TIAENVIFIGLLCRNGEWLSIIYEIGLGRTR

SEQ ID NO: 2041647 - protein, 28 aa, Staphylococcus
TIAEYSVSIALQLVRKFPAIEKRVQEHN

SEQ ID NO: 2041648 - protein, 30 aa, Staphylococcus
TIAEYSVSIALQLVRKFPLIEKRVQAHNFK

SEQ ID NO: 2041649 - protein, 31 aa, Staphylococcus
TIAEYSVSIALQLVRRFPAIEKRVQEHNFKW

SEQ ID NO: 2041650 - protein, 28 aa, Staphylococcus
TIAEYSVSIALQLVRRFPAIERRVQDHN

SEQ ID NO: 2041651 - protein, 28 aa, Staphylococcus
TIAEYTVSIALQLVRKFPAIEKRVQDHN

SEQ ID NO: 2041652 - protein, 20 aa, Staphylococcus
TIAIKLRAAGLPADELTIID

SEQ ID NO: 2041653 - protein, 22 aa, Staphylococcus
TIAKIFSLLGMTVYGISNSGKA

SEQ ID NO: 2041654 - protein, 27 aa, Staphylococcus
TIANLKLKLSPNEVWNAVTVNAAKAID

SEQ ID NO: 2041655 - protein, 25 aa, Staphylococcus
TIARDLRELNIFRLPAESKQFEYKI

SEQ ID NO: 2041656 - protein, 19 aa, Staphylococcus
TIATMGIGGGMGNAALFER

SEQ ID NO: 2041657 - protein, 21 aa, Staphylococcus
TICGDDTCLIICRDDAASEKI

SEQ ID NO: 2041658 - protein, 20 aa, Staphylococcus
TICGDDTCLIICRNDEASEE

SEQ ID NO: 2041659 - protein, 22 aa, Staphylococcus
TIDEFKFNVIHTPGHSPGSLTY

SEQ ID NO: 2041660 - protein, 19 aa, Staphylococcus
TIDESSLCFSVFTERNKKV

SEQ ID NO: 2041661 - protein, 24 aa, Staphylococcus
TIDFCKEWLESNGLHPEIITNQGY

SEQ ID NO: 2041662 - protein, 22 aa, Staphylococcus
TIDFKQSLMGGGFQIDNPNAIA

SEQ ID NO: 2041663 - protein, 23 aa, Staphylococcus
TIDFKQSLMGGGFQIDNPNAIAA

SEQ ID NO: 2041664 - protein, 20 aa, Staphylococcus
TIDHIKHFIATYTQTLVQPL

SEQ ID NO: 2041665 - protein, 21 aa, Staphylococcus
TIDHLHLKYGRGIVSKATSYT

SEQ ID NO: 2041666 - protein, 19 aa, Staphylococcus
TIDLTRLIVEVAYQEGASD

SEQ ID NO: 2041667 - protein, 24 aa, Staphylococcus
TIDMKEMFIDIGVKSKKEAEQFGI

SEQ ID NO: 2041668 - protein, 19 aa, Staphylococcus
TIDNCIKYTNPEREELSSV

SEQ ID NO: 2041669 - protein, 24 aa, Staphylococcus
TIDNFRWAGVPFYIRTGKRMKSKC

SEQ ID NO: 2041670 - protein, 25 aa, Staphylococcus
TIDPIKFNLLFERFLNPERVTMPDI

SEQ ID NO: 2041671 - protein, 25 aa, Staphylococcus
TIDPLRYNLLFERFLNPERVTMPDI

SEQ ID NO: 2041672 - protein, 28 aa, Staphylococcus
TIDPRLRHELQIWIRLNTTTGFRLVNKT

SEQ ID NO: 2041673 - protein, 34 aa, Staphylococcus
TIEAIDIALEFRKEFHKDVVIDLVGYRRYGHNEM

SEQ ID NO: 2041674 - protein, 21 aa, Staphylococcus
TIEAIDIAMDFRKEFNKDVVI

SEQ ID NO: 2041675 - protein, 33 aa, Staphylococcus
TIEAIDIAMEFRKEFHKDFVIDLVGYRRYGHNE

SEQ ID NO: 2041676 - protein, 34 aa, Staphylococcus; identical to SEQ ID NO: 1813428

SEQ ID NO: 2041677 - protein, 17 aa, Staphylococcus
TIEALMRKGYKYDKIKS

SEQ ID NO: 2041678 - protein, 22 aa, Staphylococcus
TIEDYDKYIVCLLSQGKQHLIY

SEQ ID NO: 2041679 - protein, 25 aa, Staphylococcus
TIEEIKLLFLEGLYQKMGYEGSNII

SEQ ID NO: 2041680 - protein, 24 aa, Staphylococcus
TIEEIRLLFFQDFARPLYYEHSTL

SEQ ID NO: 2041681 - protein, 20 aa, Staphylococcus
TIEFYRKELQERSKLLENQQ

SEQ ID NO: 2041682 - protein, 22 aa, Staphylococcus
TIEGGQALMILSIDQPASQTLV

SEQ ID NO: 2041683 - protein, 19 aa, Staphylococcus
TIEIAPLAYMRGRTLDDAF

SEQ ID NO: 2041684 - protein, 19 aa, Staphylococcus
TIEIKEWFRKASEAGITIT

SEQ ID NO: 2041685 - protein, 20 aa, Staphylococcus
TIEIPALGFGVFQIPQEQTK

SEQ ID NO: 2041686 - protein, 23 aa, Staphylococcus
TIELLKPAVMMNLLGRDLDLLED

SEQ ID NO: 2041687 - protein, 22 aa, Staphylococcus
TIELSFGLKFLNIIDKEMGMEA

SEQ ID NO: 2041688 - protein, 20 aa, Staphylococcus
TIEMREYIDAHGVKAFLQEY

SEQ ID NO: 2041689 - protein, 20 aa, Staphylococcus
TIENLKLRYEHVGYLGQPLV

SEQ ID NO: 2041690 - protein, 18 aa, Staphylococcus
TIEQWLISVGDYVDEYEP

SEQ ID NO: 2041691 - protein, 21 aa, Staphylococcus
TIETLMRKGYKYDKIKSKLEE

SEQ ID NO: 2041692 - protein, 18 aa, Staphylococcus
TIETWLVSVGDSVDEYEP

SEQ ID NO: 2041693 - protein, 27 aa, Staphylococcus
TIEVNKYRGEVIDSYTNATDEEMKQFN

SEQ ID NO: 2041694 - protein, 17 aa, Staphylococcus
TIFAFIVLYRCAYNFNF

SEQ ID NO: 2041695 - protein, 22 aa, Staphylococcus
TIFDRDDMEIIAGNHDEAVMSL

SEQ ID NO: 2041696 - protein, 19 aa, Staphylococcus
TIFLMNAVYDFEKVRHYQI

SEQ ID NO: 2041697 - protein, 18 aa, Staphylococcus
TIFPDLSYFEIKLIIVGI

SEQ ID NO: 2041698 - protein, 25 aa, Staphylococcus
TIFVKARGQTAILFDEVDSGVSGKA

SEQ ID NO: 2041699 - protein, 17 aa, Staphylococcus
TIGEFGIQLLEGAPSEV

SEQ ID NO: 2041700 - protein, 22 aa, Staphylococcus
TIGKEIFEKYGLKEMEVSDEVF

SEQ ID NO: 2041701 - protein, 30 aa, Staphylococcus
TIGLEMLDKGIPRTGYDVLDLDGNKIGVVT

SEQ ID NO: 2041702 - protein, 17 aa, Staphylococcus
TIGSSYTYGEYRLAQKL

SEQ ID NO: 2041703 - protein, 23 aa, Staphylococcus
TIGVKCPTCKDGEVVERKSKKNR

SEQ ID NO: 2041704 - protein, 20 aa, Staphylococcus
TIGYILKHGVMLESASTVFN

SEQ ID NO: 2041705 - protein, 26 aa, Staphylococcus
TIHAIPLKINEPLSFEVRGEAYMPRS

SEQ ID NO: 2041706 - protein, 18 aa, Staphylococcus
TIHEADNVFTFYENNGFG

SEQ ID NO: 2041707 - protein, 18 aa, Staphylococcus
TIHFSFGYSEGGGVHKQY

SEQ ID NO: 2041708 - protein, 18 aa, Staphylococcus
TIHFSFGYTEGGGIHKQH

SEQ ID NO: 2041709 - protein, 19 aa, Staphylococcus
TIHGCLGEDEIAYIGGKDN

SEQ ID NO: 2041710 - protein, 19 aa, Staphylococcus
TIHLIKYKDFENMKESAMF

SEQ ID NO: 2041711 - protein, 27 aa, Staphylococcus
TIIDVGCGYGPIGLMIAKVSPHHKVIL

SEQ ID NO: 2041712 - protein, 19 aa, Staphylococcus
TIIGPGFMRQAHRANEYID

SEQ ID NO: 2041713 - protein, 18 aa, Staphylococcus
TIIHGFGGDLMTQIVSPI

SEQ ID NO: 2041714 - protein, 17 aa, Staphylococcus
TIIKPGLQASVVRVEGT

SEQ ID NO: 2041715 - protein, 23 aa, Staphylococcus
TIIKPSFFMDNFLRITKVSDGEI

SEQ ID NO: 2041716 - protein, 21 aa, Staphylococcus
TIIKQLVKQGSIAVDGVSLTV

SEQ ID NO: 2041717 - protein, 24 aa, Staphylococcus
TIIRGLRAVSDFEYELRLTSMNKK

SEQ ID NO: 2041718 - protein, 24 aa, Staphylococcus
TIIRRLIKHDIQLIALHTNLDVYE

SEQ ID NO: 2041719 - protein, 25 aa, Staphylococcus
TIKPLKDLRVMGKFGDSVTTDHISP

SEQ ID NO: 2041720 - protein, 19 aa, Staphylococcus
TIKPYLIKHAHIVGISSQA

SEQ ID NO: 2041721 - protein, 18 aa, Staphylococcus
TIKTHVSHIFSKLQVSDR

SEQ ID NO: 2041722 - protein, 24 aa, Staphylococcus
TIKVNVSLIKSVLKFAQKRYNISD

SEQ ID NO: 2041723 - protein, 24 aa, Staphylococcus
TIKYILEQGGKLVLFSHLGKVKEE

SEQ ID NO: 2041724 - protein, 25 aa, Staphylococcus
TILEKLRFSKMFFSSNGVKNGVVMT

SEQ ID NO: 2041725 - protein, 18 aa, Staphylococcus
TILEMLIKEHEVIAIVTQ

SEQ ID NO: 2041726 - protein, 19 aa, Staphylococcus
TILEYAFSIAYDIYKKTAL

SEQ ID NO: 2041727 - protein, 35 aa, Staphylococcus
TILIEIARFIPSLPLKRWIYRACLGMEIGQKTSFA

SEQ ID NO: 2041728 - protein, 28 aa, Staphylococcus
TILKESQHALVFCVGNIHGPGGRIAEFI

SEQ ID NO: 2041729 - protein, 24 aa, Staphylococcus
TILKKRPAYREAFYNFDPEKIASM

SEQ ID NO: 2041730 - protein, 17 aa, Staphylococcus
TILVIGSGPIIIGQAAE

SEQ ID NO: 2041731 - protein, 18 aa, Staphylococcus
TILYKMYKERNFKIKPEI

SEQ ID NO: 2041732 - protein, 18 aa, Staphylococcus
TIMKEMQLMFPGSIHYQI

SEQ ID NO: 2041733 - protein, 18 aa, Staphylococcus
TIMLYILLITGARFSEVN

SEQ ID NO: 2041734 - protein, 20 aa, Staphylococcus
TIMRKRLDQLATYIQSIVPD

SEQ ID NO: 2041735 - protein, 27 aa, Staphylococcus
TINFMAKKGRGLICTPISSSISEQLDL

SEQ ID NO: 2041736 - protein, 24 aa, Staphylococcus
TINGTDFVWILPITSREVRFPTDI

SEQ ID NO: 2041737 - protein, 20 aa, Staphylococcus
TINKKMRWLSRRFTDLFEEL

SEQ ID NO: 2041738 - protein, 20 aa, Staphylococcus
TINLFFYESDFWRFQQTKVI

SEQ ID NO: 2041739 - protein, 19 aa, Staphylococcus
TINNLKLRYEHVGYKGQPL

SEQ ID NO: 2041740 - protein, 19 aa, Staphylococcus
TINRAMCKLSTLNVRKFNV

SEQ ID NO: 2041741 - protein, 19 aa, Staphylococcus
TINVYELLTSMSKGPHPSE

SEQ ID NO: 2041742 - protein, 21 aa, Staphylococcus
TIPDFAIKLGARFNSEAQEGK

SEQ ID NO: 2041743 - protein, 23 aa, Staphylococcus
TIPLLMAGGTLVLQRYFNGESLN

SEQ ID NO: 2041744 - protein, 19 aa, Staphylococcus
TIPVRPGRNVAVIIEVAAM

SEQ ID NO: 2041745 - protein, 24 aa, Staphylococcus
TIQFLKSHLLTVATVKHHGFNQLV

SEQ ID NO: 2041746 - protein, 18 aa, Staphylococcus
TIQLLKLLHLDQVKNHHP

SEQ ID NO: 2041747 - protein, 24 aa, Staphylococcus
TIRAPQWRGGGIVFGPTPRSYSYK

SEQ ID NO: 2041748 - protein, 17 aa, Staphylococcus
TIRFEWISTEEAFKQLI

SEQ ID NO: 2041749 - protein, 20 aa, Staphylococcus
TIRGDLGLTVGRNIIHGSDS

SEQ ID NO: 2041750 - protein, 22 aa, Staphylococcus
TIRGDLGLTVGRNIIHGSDSVE

SEQ ID NO: 2041751 - protein, 25 aa, Staphylococcus
TIRIAPRKVRLVLDLIRGKNVGEAI

SEQ ID NO: 2041752 - protein, 25 aa, Staphylococcus
TIRIAPRKVRLVLDLIRGKSAGEAI

SEQ ID NO: 2041753 - protein, 22 aa, Staphylococcus
TIRLKECGDILGISLLDHIIIG

SEQ ID NO: 2041754 - protein, 23 aa, Staphylococcus
TIRLKECGQILGIELLDHIIIGD

SEQ ID NO: 2041755 - protein, 18 aa, Staphylococcus
TIRLNEVREYYLNYFGLV

SEQ ID NO: 2041756 - protein, 21 aa, Staphylococcus
TIRMNYLFDFYQALLTKKQRN

SEQ ID NO: 2041757 - protein, 20 aa, Staphylococcus
TIRMNYLFDFYQSLLTQKQK

SEQ ID NO: 2041758 - protein, 25 aa, Staphylococcus
TIRNEMKILEGMGLIEKAHASSGRS

SEQ ID NO: 2041759 - protein, 20 aa, Staphylococcus
TIRSSGFYRNKGKAIHALFQ

SEQ ID NO: 2041760 - protein, 24 aa, Staphylococcus
TISDMMASFMFDNEYFMYGLETFA

SEQ ID NO: 2041761 - protein, 21 aa, Staphylococcus
TISLIIYWSVKTIYKMIRSKI

SEQ ID NO: 2041762 - protein, 17 aa, Staphylococcus
TISRAINVISNFETAVQ

SEQ ID NO: 2041763 - protein, 23 aa, Staphylococcus
TITCKNCGYTEFYKDDKNRKSDI

SEQ ID NO: 2041764 - protein, 19 aa, Staphylococcus
TITCTNCGYTEFYKESANR

SEQ ID NO: 2041765 - protein, 27 aa, Staphylococcus
TITDSKCLVLFTSYRMMHMVQELLNEL

SEQ ID NO: 2041766 - protein, 26 aa, Staphylococcus
TITEIFYKRLFEVHPELKNVFNQTNQ

SEQ ID NO: 2041767 - protein, 24 aa, Staphylococcus
TITKFNLFMALGIRDAIQQFSKSD

SEQ ID NO: 2041768 - protein, 20 aa, Staphylococcus
TITNGGIFGSMMSTPIINGS

SEQ ID NO: 2041769 - protein, 19 aa, Staphylococcus
TITNGGVFGSMMSTPIING

SEQ ID NO: 2041770 - protein, 18 aa, Staphylococcus
TITPQGFFAVIEKPKHDI

SEQ ID NO: 2041771 - protein, 29 aa, Staphylococcus
TITRLKGGDPFIFGRGGEEAEILAEHHIP

SEQ ID NO: 2041772 - protein, 28 aa, Staphylococcus
TITRLKGGDPFVFGRGGEEAEILSDNQI

SEQ ID NO: 2041773 - protein, 25 aa, Staphylococcus
TITRRCINQVILLFSLSNHLDITLN

SEQ ID NO: 2041774 - protein, 17 aa, Staphylococcus
TIVKPGLQASVVRVEGT

SEQ ID NO: 2041775 - protein, 17 aa, Staphylococcus
TIVNLLKGFTFKVNGTL

SEQ ID NO: 2041776 - protein, 17 aa, Staphylococcus
TIYENGGLIAIPTETVY

SEQ ID NO: 2041777 - protein, 23 aa, Staphylococcus
TIYNRLNFDLGTIGNHEFNYGLP

SEQ ID NO: 2041778 - protein, 25 aa, Staphylococcus
TIYRRWKDKSSIIMDMFVEQSQKIF

SEQ ID NO: 2041779 - protein, 19 aa, Staphylococcus
TIYRWVQEYAPIFYQLWKR

SEQ ID NO: 2041780 - protein, 17 aa, Staphylococcus
TIYRWVQEYAPILYQIW

SEQ ID NO: 2041781 - protein, 20 aa, Staphylococcus
TKAAYQEWLRVLKPNGKLIN

SEQ ID NO: 2041782 - protein, 25 aa, Staphylococcus
TKAHDIRKANDWGIETQAMKVNFSK

SEQ ID NO: 2041783 - protein, 19 aa, Staphylococcus
TKAHIALVDAVRITLHNAL

SEQ ID NO: 2041784 - protein, 18 aa, Staphylococcus
TKAHPAFLVQNASDIRKE

SEQ ID NO: 2041785 - protein, 18 aa, Staphylococcus
TKAIIVYTLVKPEMRKYM

SEQ ID NO: 2041786 - protein, 18 aa, Staphylococcus
TKAKFVLEHHPYLQYHSV

SEQ ID NO: 2041787 - protein, 19 aa, Staphylococcus
TKAKLLYSLLIERQNLSKE

SEQ ID NO: 2041788 - protein, 26 aa, Staphylococcus
TKALESFIMLEFTRIKGATIKLNSIP

SEQ ID NO: 2041789 - protein, 25 aa, Staphylococcus
TKALNVRVFYCLQGKSELTINLNKY

SEQ ID NO: 2041790 - protein, 19 aa, Staphylococcus
TKALSLRLSKELIDTVHEY

SEQ ID NO: 2041791 - protein, 18 aa, Staphylococcus
TKAVKYAIENGYRSIDTA

SEQ ID NO: 2041792 - protein, 26 aa, Staphylococcus
TKDDLYLCYKTFYHPSNMVMFVVGDV

SEQ ID NO: 2041793 - protein, 24 aa, Staphylococcus
TKDEALKPFILLVVGQHDEGLKAA

SEQ ID NO: 2041794 - protein, 20 aa, Staphylococcus
TKDFAPLIVLGGHGSESHNN

SEQ ID NO: 2041795 - protein, 20 aa, Staphylococcus
TKDFAPLVVLGGHGSESHNN

SEQ ID NO: 2041796 - protein, 19 aa, Staphylococcus
TKDFLRFVTHRTRLEGGEI

SEQ ID NO: 2041797 - protein, 22 aa, Staphylococcus
TKDGYKLNGVKTFTSMSKALTH

SEQ ID NO: 2041798 - protein, 23 aa, Staphylococcus
TKDKRFITANVNFVKPTELKKKD

SEQ ID NO: 2041799 - protein, 22 aa, Staphylococcus
TKDKRIATSDFLTRTVDTQLKH

SEQ ID NO: 2041800 - protein, 17 aa, Staphylococcus
TKDLLGFASVYENSLDA

SEQ ID NO: 2041801 - protein, 17 aa, Staphylococcus
TKDPEFRTTQSGVNVAT

SEQ ID NO: 2041802 - protein, 22 aa, Staphylococcus
TKEAKMIVSCVARMRQQENYSV

SEQ ID NO: 2041803 - protein, 18 aa, Staphylococcus
TKEALKYYEEVFGATNIK

SEQ ID NO: 2041804 - protein, 17 aa, Staphylococcus
TKEEVQNIIELIKSFQH

SEQ ID NO: 2041805 - protein, 21 aa, Staphylococcus
TKEEVSGIIELIKSLQQTILT

SEQ ID NO: 2041806 - protein, 19 aa, Staphylococcus
TKEEYDLIVSLGKGEEKLP

SEQ ID NO: 2041807 - protein, 17 aa, Staphylococcus
TKEGFKYAEKVYDLSGT

SEQ ID NO: 2041808 - protein, 26 aa, Staphylococcus
TKEGIRFLSVENIRLLKSNKFISKED

SEQ ID NO: 2041809 - protein, 26 aa, Staphylococcus
TKEGKDHFLRISIDKEGGVDLNDCTL

SEQ ID NO: 2041810 - protein, 26 aa, Staphylococcus
TKEGKDHFLRISIDKEGGVNLNDCTL

SEQ ID NO: 2041811 - protein, 20 aa, Staphylococcus
TKEGLKSGFVDIVVGTHKLL

SEQ ID NO: 2041812 - protein, 24 aa, Staphylococcus
TKEIIATHIMFEFQNHYVSKDTDS

SEQ ID NO: 2041813 - protein, 18 aa, Staphylococcus
TKEIKAYGFDLELGKVQQ

SEQ ID NO: 2041814 - protein, 22 aa, Staphylococcus
TKEKYPRLLVTRTVKKGSGKYF

SEQ ID NO: 2041815 - protein, 22 aa, Staphylococcus
TKEKYPRLLVTRTVKKGTGKYF

SEQ ID NO: 2041816 - protein, 24 aa, Staphylococcus
TKELSLRICRKLVDEVTKHFNGLY

SEQ ID NO: 2041817 - protein, 23 aa, Staphylococcus
TKELSLRLSKDLIDTVHQYFNGL

SEQ ID NO: 2041818 - protein, 19 aa, Staphylococcus
TKENHVLSIPGAFTPSEIT

SEQ ID NO: 2041819 - protein, 25 aa, Staphylococcus
TKERKKRVYDLLETVGLNKEHANRY

SEQ ID NO: 2041820 - protein, 20 aa, Staphylococcus
TKEVFKFSNIKKIMSEMQLE

SEQ ID NO: 2041821 - protein, 17 aa, Staphylococcus
TKFFYCGKDPYRHSLPQ

SEQ ID NO: 2041822 - protein, 27 aa, Staphylococcus
TKFKAPRWLVNPIKNYSLRKHKEISYI

SEQ ID NO: 2041823 - protein, 18 aa, Staphylococcus
TKFNLAVQRMLLGEPIQY

SEQ ID NO: 2041824 - protein, 22 aa, Staphylococcus
TKFPGIGKKTARQIVLDLKGKV

SEQ ID NO: 2041825 - protein, 29 aa, Staphylococcus
TKGDIVIGMLPWKRFHTLPSNQVNKVPST

SEQ ID NO: 2041826 - protein, 19 aa, Staphylococcus
TKGDLPLFQKVTQWLEKYF

SEQ ID NO: 2041827 - protein, 23 aa, Staphylococcus
TKGEALKGLLTKWHIKPSELMAF

SEQ ID NO: 2041828 - protein, 23 aa, Staphylococcus
TKGESMIPLIKKLSADNVRLNVT

SEQ ID NO: 2041829 - protein, 18 aa, Staphylococcus
TKGGAYLEMELHEGENSE

SEQ ID NO: 2041830 - protein, 25 aa, Staphylococcus
TKGKRFALPNAEVMIHQPLGGAQGQ

SEQ ID NO: 2041831 - protein, 19 aa, Staphylococcus
TKGLGIKSAYITAVAINPN

SEQ ID NO: 2041832 - protein, 25 aa, Staphylococcus
TKGSLKYIHDIWGYIAPNTKSEKQP

SEQ ID NO: 2041833 - protein, 19 aa, Staphylococcus
TKHAIGLKTKNGLEILVHI

SEQ ID NO: 2041834 - protein, 19 aa, Staphylococcus
TKHDCPSCHGKRLNDKVLS

SEQ ID NO: 2041835 - protein, 24 aa, Staphylococcus
TKHDFEFHEAMILASNHQYLRTFW

SEQ ID NO: 2041836 - protein, 18 aa, Staphylococcus
TKHGTIRLLFNFRHKTKR

SEQ ID NO: 2041837 - protein, 21 aa, Staphylococcus
TKHKLQDIALVYKHLEDRING

SEQ ID NO: 2041838 - protein, 22 aa, Staphylococcus
TKIDYFFLHKFQNIINIEHELK

SEQ ID NO: 2041839 - protein, 17 aa, Staphylococcus
TKIFKSIVGQIMDSGFD

SEQ ID NO: 2041840 - protein, 20 aa, Staphylococcus
TKIGALCGEAIVFTEGYNPS

SEQ ID NO: 2041841 - protein, 17 aa, Staphylococcus
TKIKAKKAYKLSPEVEK

SEQ ID NO: 2041842 - protein, 20 aa, Staphylococcus
TKIKGDLIIIQGTDDDWVKN

SEQ ID NO: 2041843 - protein, 18 aa, Staphylococcus
TKILILGVVMPKDINKAI

SEQ ID NO: 2041844 - protein, 17 aa, Staphylococcus
TKIPRYFFISEEQEFEP

SEQ ID NO: 2041845 - protein, 17 aa, Staphylococcus
TKIQLWLPIQQETYHVD

SEQ ID NO: 2041846 - protein, 25 aa, Staphylococcus
TKISRLKWTFEFEIASGDTVHATGM

SEQ ID NO: 2041847 - protein, 17 aa, Staphylococcus
TKKCLEATLVHYFEPNE

SEQ ID NO: 2041848 - protein, 20 aa, Staphylococcus
TKKDRKALSDAVNSLGEPLS

SEQ ID NO: 2041849 - protein, 19 aa, Staphylococcus
TKKEGKGIYIFELNEDNGE

SEQ ID NO: 2041850 - protein, 22 aa, Staphylococcus
TKKEGKGIYLFELNEDSGQISS

SEQ ID NO: 2041851 - protein, 21 aa, Staphylococcus
TKKFGEEAFEVVIGAMKGDVE

SEQ ID NO: 2041852 - protein, 19 aa, Staphylococcus
TKKGKSVIVTTHVMGEAER

SEQ ID NO: 2041853 - protein, 24 aa, Staphylococcus
TKKGLLRHLVMRTGHYTNQLMIIL

SEQ ID NO: 2041854 - protein, 28 aa, Staphylococcus
TKKGNAKIMWGDLGIGNIFIKPEDLLAL

SEQ ID NO: 2041855 - protein, 36 aa, Staphylococcus
TKKGVLRHLVIRTGHYTDEIMVIFVTNGSKFKHANM

SEQ ID NO: 2041856 - protein, 23 aa, Staphylococcus
TKKIDEYVNWIAPITVYPGEKEM

SEQ ID NO: 2041857 - protein, 21 aa, Staphylococcus
TKKPLLFFTYDLEFYKNKLRG

SEQ ID NO: 2041858 - protein, 26 aa, Staphylococcus
TKKPVIFRATPQWFASIDKVREDILS

SEQ ID NO: 2041859 - protein, 26 aa, Staphylococcus
TKKPVIFRATPQWFASISKVRQDILD

SEQ ID NO: 2041860 - protein, 35 aa, Staphylococcus
TKKQIKEFGRGLTFMKQWLNIVLEIPLVNTRNIKF

SEQ ID NO: 2041861 - protein, 36 aa, Staphylococcus
TKKRAPLIFRKLNLEWFYRLITDWKRMARMQRLPRF

SEQ ID NO: 2041862 - protein, 29 aa, Staphylococcus
TKLANEHPEWTFKNSDGSVWTNGKGDSFV

SEQ ID NO: 2041863 - protein, 25 aa, Staphylococcus
TKLDFKFRLPDDMLQAHIQAVQQAI

SEQ ID NO: 2041864 - protein, 19 aa, Staphylococcus
TKLEIKRPHINVELQVSKY

SEQ ID NO: 2041865 - protein, 20 aa, Staphylococcus
TKLEPVPIFHKNHETGKEDF

SEQ ID NO: 2041866 - protein, 20 aa, Staphylococcus
TKLGFMSFFTKAAVAALKKY

SEQ ID NO: 2041867 - protein, 20 aa, Staphylococcus
TKLIFMRDGEIVLQESKEEL

SEQ ID NO: 2041868 - protein, 17 aa, Staphylococcus
TKLKLAIDHDRHDTIGI

SEQ ID NO: 2041869 - protein, 17 aa, Staphylococcus
TKLKLAIDHNKHDTIGI

SEQ ID NO: 2041870 - protein, 20 aa, Staphylococcus
TKLKNGRKFLNKGDKCKVSI

SEQ ID NO: 2041871 - protein, 26 aa, Staphylococcus
TKLKQDKPIYCRTLYGDITFKNDLNQ

SEQ ID NO: 2041872 - protein, 18 aa, Staphylococcus
TKLLDYLSRIQAWCEKFN

SEQ ID NO: 2041873 - protein, 17 aa, Staphylococcus
TKLLKFHGSYMQDDRDI

SEQ ID NO: 2041874 - protein, 28 aa, Staphylococcus
TKLLKQIHFCNSFKFTIFKKNNLYALEI

SEQ ID NO: 2041875 - protein, 19 aa, Staphylococcus
TKLNFLWVTDWPLLEYDED

SEQ ID NO: 2041876 - protein, 28 aa, Staphylococcus
TKLPYRKEIQQLIKKCLNQPATHIRRIL

SEQ ID NO: 2041877 - protein, 21 aa, Staphylococcus
TKLQAVCAVCGAPASRTQRLI

SEQ ID NO: 2041878 - protein, 21 aa, Staphylococcus
TKLQAVCAVCGASSSRTQRLI

SEQ ID NO: 2041879 - protein, 21 aa, Staphylococcus
TKLQAVCAVCGGPSSRTQRLI

SEQ ID NO: 2041880 - protein, 21 aa, Staphylococcus
TKLQAVCAVCGSPSSRTQRLI

SEQ ID NO: 2041881 - protein, 23 aa, Staphylococcus
TKLRKSLPKNYVFIIEELLYKSN

SEQ ID NO: 2041882 - protein, 17 aa, Staphylococcus
TKLRVAFGTIDKTYHKE

SEQ ID NO: 2041883 - protein, 18 aa, Staphylococcus
TKLSKEFIHSRDCLIESY

SEQ ID NO: 2041884 - protein, 17 aa, Staphylococcus
TKLSVALRIEMIEHGLR

SEQ ID NO: 2041885 - protein, 22 aa, Staphylococcus
TKLYFEGVSLFDLLEIVESITL

SEQ ID NO: 2041886 - protein, 25 aa, Staphylococcus
TKLYFEGVSLFNMLDIVDSITLDSI

SEQ ID NO: 2041887 - protein, 28 aa, Staphylococcus
TKLYFEGVSVFELLDIVERITLESINET

SEQ ID NO: 2041888 - protein, 25 aa, Staphylococcus
TKMKAREILDELGILKEGVFTHEID

SEQ ID NO: 2041889 - protein, 24 aa, Staphylococcus
TKNERIEAVHLYKSLCLAQSLYKN

SEQ ID NO: 2041890 - protein, 19 aa, Staphylococcus
TKNGMLPIVLNEQSRKYLA

SEQ ID NO: 2041891 - protein, 23 aa, Staphylococcus
TKNKEGIGYFGYAFYEQNKDKLK

SEQ ID NO: 2041892 - protein, 25 aa, Staphylococcus
TKNVPFRTAHEIVGKIVFECIQQGI

SEQ ID NO: 2041893 - protein, 23 aa, Staphylococcus
TKPEILRFTPFDTQILENLSSQL

SEQ ID NO: 2041894 - protein, 18 aa, Staphylococcus
TKPILLYAPTWHATKDST

SEQ ID NO: 2041895 - protein, 17 aa, Staphylococcus
TKPRAIEIVSEQTNDAV

SEQ ID NO: 2041896 - protein, 20 aa, Staphylococcus
TKPRPGSMGKAIPGSDTTVV

SEQ ID NO: 2041897 - protein, 26 aa, Staphylococcus
TKPTFKKERTVYLPNAFHPLLDKETV

SEQ ID NO: 2041898 - protein, 17 aa, Staphylococcus
TKQAEEWYKDASKEELE

SEQ ID NO: 2041899 - protein, 19 aa, Staphylococcus
TKQGIPINIRGQIDRIDTY

SEQ ID NO: 2041900 - protein, 19 aa, Staphylococcus
TKQQLKEMALFNVRKLENK

SEQ ID NO: 2041901 - protein, 22 aa, Staphylococcus
TKQRPNIRTVIVKFDDLEQVIS

SEQ ID NO: 2041902 - protein, 20 aa, Staphylococcus
TKQYDCRIGITQLPTHGFTV

SEQ ID NO: 2041903 - protein, 25 aa, Staphylococcus
TKRLSQWRRPALRNFNTKVEIIEQN

SEQ ID NO: 2041904 - protein, 21 aa, Staphylococcus
TKRQAGKELVDFKELALEGVF

SEQ ID NO: 2041905 - protein, 21 aa, Staphylococcus
TKRVPNFILSLGAKVNKQAKE

SEQ ID NO: 2041906 - protein, 17 aa, Staphylococcus
TKSCIRQILSASALSDI

SEQ ID NO: 2041907 - protein, 17 aa, Staphylococcus
TKSETFVIISFKHKTIL

SEQ ID NO: 2041908 - protein, 24 aa, Staphylococcus
TKSETFVIISFKHKTILIGGTEYA

SEQ ID NO: 2041909 - protein, 29 aa, Staphylococcus
TKSETFVIISFKHKVILIGGTEYAGEMKK

SEQ ID NO: 2041910 - protein, 18 aa, Staphylococcus
TKSIGIAHGCTGKGNDQV

SEQ ID NO: 2041911 - protein, 25 aa, Staphylococcus
TKSKNLPFILGEGVDSDNGILANNF

SEQ ID NO: 2041912 - protein, 19 aa, Staphylococcus
TKSLAGFDIESFNVSHDAI

SEQ ID NO: 2041913 - protein, 20 aa, Staphylococcus
TKSMIFKVDGEFIIVLVRGN

SEQ ID NO: 2041914 - protein, 21 aa, Staphylococcus
TKSNAHIISIPALSNKPSSSS

SEQ ID NO: 2041915 - protein, 17 aa, Staphylococcus
TKSRLDIINTLPATTPV

SEQ ID NO: 2041916 - protein, 21 aa, Staphylococcus
TKSSLPFDIRIHVRRGEGGNW

SEQ ID NO: 2041917 - protein, 17 aa, Staphylococcus
TKSVGALANEIKQSSEA

SEQ ID NO: 2041918 - protein, 19 aa, Staphylococcus
TKSVREMIEDSSLEALDYS

SEQ ID NO: 2041919 - protein, 28 aa, Staphylococcus
TKSVSFTHEFMFTRPIFQTEDMIKHHYY

SEQ ID NO: 2041920 - protein, 28 aa, Staphylococcus
TKTEKANELWKNHIGDLLTPPHDPSQFN

SEQ ID NO: 2041921 - protein, 22 aa, Staphylococcus
TKTEYDLLFLLVENRNHVLQRE

SEQ ID NO: 2041922 - protein, 22 aa, Staphylococcus
TKTFRGNRPFTFTNLKTDDGLD

SEQ ID NO: 2041923 - protein, 17 aa, Staphylococcus
TKTGERVIIFKLTENLE

SEQ ID NO: 2041924 - protein, 19 aa, Staphylococcus
TKTKKCLEATIVHYFEPNE

SEQ ID NO: 2041925 - protein, 25 aa, Staphylococcus
TKVACLNKHLHFHGSTEDFKKLDEV

SEQ ID NO: 2041926 - protein, 23 aa, Staphylococcus
TKVFRGDRPFAFTNLKTDEGLDE

SEQ ID NO: 2041927 - protein, 22 aa, Staphylococcus
TKVFRGNRPFTFTNLKTDEGLD

SEQ ID NO: 2041928 - protein, 17 aa, Staphylococcus
TKVGIGPGRVCITKIKT

SEQ ID NO: 2041929 - protein, 18 aa, Staphylococcus
TKVKVISRLAHDSGNLGM

SEQ ID NO: 2041930 - protein, 28 aa, Staphylococcus
TKVLGRFKEVYQIFSDVLGVPLKGKDSD

SEQ ID NO: 2041931 - protein, 26 aa, Staphylococcus
TKVRAKEILDELGILKNGIFVHDIDA

SEQ ID NO: 2041932 - protein, 26 aa, Staphylococcus
TKVRVKEILDELGILKNGIFVHDIDA

SEQ ID NO: 2041933 - protein, 20 aa, Staphylococcus
TKWNCKYHIVFAPKYRRQVI

SEQ ID NO: 2041934 - protein, 21 aa, Staphylococcus
TKWNCKYHIVFAPKYRRQVIY

SEQ ID NO: 2041935 - protein, 22 aa, Staphylococcus
TKYGLRSGVGLAAPQINISKKM

SEQ ID NO: 2041936 - protein, 18 aa, Staphylococcus
TKYGSYIDHEHLILVDEY

SEQ ID NO: 2041937 - protein, 17 aa, Staphylococcus
TKYGYYYFYNMWCQHIF

SEQ ID NO: 2041938 - protein, 30 aa, Staphylococcus
TKYPDMNRPTGLWFGEVVHFADVLYKNGYK

SEQ ID NO: 2041939 - protein, 17 aa, Staphylococcus
TKYSRLMIEPEQLAHRV

SEQ ID NO: 2041940 - protein, 24 aa, Staphylococcus
TLADRRKAFQFAYLSLMQQQEIQA

SEQ ID NO: 2041941 - protein, 20 aa, Staphylococcus
TLAIYMGIKRLGRIIDQITA

SEQ ID NO: 2041942 - protein, 17 aa, Staphylococcus
TLAIYMGVKRLGHIIQQ

SEQ ID NO: 2041943 - protein, 27 aa, Staphylococcus
TLAKNKRAGAWFDRLKFLMKSLEESMV

SEQ ID NO: 2041944 - protein, 20 aa, Staphylococcus
TLCGGGRYNGLLQLLDGPNQ

SEQ ID NO: 2041945 - protein, 20 aa, Staphylococcus
TLCGGGRYNGLLQLLDGPSE

SEQ ID NO: 2041946 - protein, 22 aa, Staphylococcus
TLDEWYELFNQTGFKLLDKKPQ

SEQ ID NO: 2041947 - protein, 35 aa, Staphylococcus
TLDFYLRPFVKTKIKSWVRQLLWMSLYQYIYLDKV

SEQ ID NO: 2041948 - protein, 19 aa, Staphylococcus
TLDILKSMKAYQLKWTEQY

SEQ ID NO: 2041949 - protein, 21 aa, Staphylococcus
TLDILREMKYYQNAWTNRYDI

SEQ ID NO: 2041950 - protein, 24 aa, Staphylococcus
TLDLEYRPSLKLSEETDEAKLYEE

SEQ ID NO: 2041951 - protein, 23 aa, Staphylococcus
TLDLTGRKIIKVESDNGSLINQM

SEQ ID NO: 2041952 - protein, 18 aa, Staphylococcus
TLDYCLKQSIDQSFNMIT

SEQ ID NO: 2041953 - protein, 30 aa, Staphylococcus
TLEAFNYRKVHLFKEWKTEKGIVNYLLDVD

SEQ ID NO: 2041954 - protein, 29 aa, Staphylococcus
TLEAFNYRKVHLFKEWKTEKGIVNYLLGV

SEQ ID NO: 2041955 - protein, 20 aa, Staphylococcus
TLEAPTPVFHKNHQSGKEDF

SEQ ID NO: 2041956 - protein, 18 aa, Staphylococcus
TLEDLALVDFFFQPDFDR

SEQ ID NO: 2041957 - protein, 27 aa, Staphylococcus
TLEDPGMRWELGVIWKKDKYLSHATKQ

SEQ ID NO: 2041958 - protein, 23 aa, Staphylococcus
TLEEDLPLFPGHGPYTTVEDEQL

SEQ ID NO: 2041959 - protein, 20 aa, Staphylococcus
TLEKLLCHTYDLVFLDINLM

SEQ ID NO: 2041960 - protein, 24 aa, Staphylococcus
TLEKLLYETYDVIFLDINLMDESG

SEQ ID NO: 2041961 - protein, 19 aa, Staphylococcus
TLELFKIAFPTEKSYQLSE

SEQ ID NO: 2041962 - protein, 19 aa, Staphylococcus
TLELFKIAYPTDKSYQLSE

SEQ ID NO: 2041963 - protein, 23 aa, Staphylococcus
TLENLPFGIAVMDSRFRMGSMGS

SEQ ID NO: 2041964 - protein, 18 aa, Staphylococcus
TLEPCVMCSGAIVMSRIP

SEQ ID NO: 2041965 - protein, 18 aa, Staphylococcus
TLFADKDADVILFGHNHT

SEQ ID NO: 2041966 - protein, 19 aa, Staphylococcus
TLFAGCGIVKESNPDSEVA

SEQ ID NO: 2041967 - protein, 19 aa, Staphylococcus
TLFCFKNDEIVGAVDIRHQ

SEQ ID NO: 2041968 - protein, 17 aa, Staphylococcus
TLFELQRQFGYTKEDIY

SEQ ID NO: 2041969 - protein, 17 aa, Staphylococcus
TLFKVQKQFGYTKEDIH

SEQ ID NO: 2041970 - protein, 27 aa, Staphylococcus
TLFNEFKPGSVFINCARGTIVKTSALI

SEQ ID NO: 2041971 - protein, 18 aa, Staphylococcus
TLFNSERFEEIEKRLNEN

SEQ ID NO: 2041972 - protein, 23 aa, Staphylococcus
TLFPIPEKFVYLAHCDTPISDLL

SEQ ID NO: 2041973 - protein, 18 aa, Staphylococcus
TLGNKFNERMYFRLHNSK

SEQ ID NO: 2041974 - protein, 17 aa, Staphylococcus
TLGRIVVEEALKVYPAN

SEQ ID NO: 2041975 - protein, 24 aa, Staphylococcus
TLHEVPGKFGKWNDENIGPYLGPF

SEQ ID NO: 2041976 - protein, 23 aa, Staphylococcus
TLHKDEEVCILYGTKNGLVALPT

SEQ ID NO: 2041977 - protein, 31 aa, Staphylococcus
TLHPMGGLQERVWNALQFMNEFGTDMFSPSI

SEQ ID NO: 2041978 - protein, 22 aa, Staphylococcus
TLHRITSAFVRLQCNIDELHVK

SEQ ID NO: 2041979 - protein, 17 aa, Staphylococcus
TLIDIGADAFVIGEQKF

SEQ ID NO: 2041980 - protein, 23 aa, Staphylococcus
TLIEIKDQFKGKVIIIHQPAEEM

SEQ ID NO: 2041981 - protein, 22 aa, Staphylococcus
TLIEMKDQFKGKVVVIHQPAEE

SEQ ID NO: 2041982 - protein, 20 aa, Staphylococcus
TLIEMKDQFNGKVIVIHQPA

SEQ ID NO: 2041983 - protein, 19 aa, Staphylococcus
TLIEMKDQFSGKVVVIHQP

SEQ ID NO: 2041984 - protein, 23 aa, Staphylococcus
TLIEMKSQFSGKVIVIHQPAEEM

SEQ ID NO: 2041985 - protein, 17 aa, Staphylococcus
TLIFKMYNDPSIELRYF

SEQ ID NO: 2041986 - protein, 18 aa, Staphylococcus
TLILFPLKHHRAPIQIYV

SEQ ID NO: 2041987 - protein, 25 aa, Staphylococcus
TLIRTILARMHFFRDDVYKPISVLS

SEQ ID NO: 2041988 - protein, 26 aa, Staphylococcus
TLKAISPRTTLPILTGIKIDAKEDEV

SEQ ID NO: 2041989 - protein, 22 aa, Staphylococcus
TLKDVEAAIKMAKNDTIHHLID

SEQ ID NO: 2041990 - protein, 21 aa, Staphylococcus
TLKDVEAAIKMAKNDTIQYLL

SEQ ID NO: 2041991 - protein, 23 aa, Staphylococcus
TLKEILKYRGIDSGLPKRPFAPF

SEQ ID NO: 2041992 - protein, 31 aa, Staphylococcus
TLKFELFYFDIFKYGTSFVTLQVHREEEFSP

SEQ ID NO: 2041993 - protein, 20 aa, Staphylococcus
TLKFELFYFDIFQYAHSFVT

SEQ ID NO: 2041994 - protein, 27 aa, Staphylococcus
TLKFELFYFDIFRYATSFITLQVERDE

SEQ ID NO: 2041995 - protein, 26 aa, Staphylococcus
TLKFELFYFDIFRYATSFVTLQVNRE

SEQ ID NO: 2041996 - protein, 24 aa, Staphylococcus
TLKFMLKVFLELGFIIDSNGIISV

SEQ ID NO: 2041997 - protein, 18 aa, Staphylococcus
TLKGERPLTYYLTDKPQE

SEQ ID NO: 2041998 - protein, 24 aa, Staphylococcus
TLKGIECIYGLYKKNRRSLQIYGF

SEQ ID NO: 2041999 - protein, 25 aa, Staphylococcus
TLKTYAYCLKRYFMYLELIDKNHND

SEQ ID NO: 2042000 - protein, 17 aa, Staphylococcus
TLLDFGVDSIQMMRIKI

SEQ ID NO: 2042001 - protein, 22 aa, Staphylococcus
TLLERFKYAQSINVNAHPVIVG

SEQ ID NO: 2042002 - protein, 24 aa, Staphylococcus
TLLIKGHNAYGYLKAEKGVHRLVR

SEQ ID NO: 2042003 - protein, 23 aa, Staphylococcus
TLLKDIFAHLVVERAKAFAALDE

SEQ ID NO: 2042004 - protein, 22 aa, Staphylococcus
TLLKLNPKRIVYISCNPSTQQR

SEQ ID NO: 2042005 - protein, 25 aa, Staphylococcus
TLLKREKPGLFGSQIKWNFTKFVID

SEQ ID NO: 2042006 - protein, 34 aa, Staphylococcus
TLLRCGKDALLKNGHRFGFYKGYQGNSHIYIKGG

SEQ ID NO: 2042007 - protein, 25 aa, Staphylococcus
TLLSLKSTGRMVGIISHVSELKQRI

SEQ ID NO: 2042008 - protein, 17 aa, Staphylococcus
TLLVPKKVSANIFETDE

SEQ ID NO: 2042009 - protein, 18 aa, Staphylococcus
TLLYEETYHLYLPKEEPL

SEQ ID NO: 2042010 - protein, 19 aa, Staphylococcus
TLMPGGVNSPVRAFKSVDT

SEQ ID NO: 2042011 - protein, 18 aa, Staphylococcus
TLMPKFPSTLPHIKLSTN

SEQ ID NO: 2042012 - protein, 28 aa, Staphylococcus
TLMTHAISFLKERNFKVASIKHHGHQGE

SEQ ID NO: 2042013 - protein, 19 aa, Staphylococcus
TLNALAIPSKGQITIDECQ

SEQ ID NO: 2042014 - protein, 32 aa, Staphylococcus
TLNDFTEIFLRPCHIAKMISRYMIINETDKVL

SEQ ID NO: 2042015 - protein, 31 aa, Staphylococcus
TLNEFTETFLRPCHIAKMISRYMILNETDNI

SEQ ID NO: 2042016 - protein, 25 aa, Staphylococcus
TLNFPKTCPHGGVIPRDHHYKELYT

SEQ ID NO: 2042017 - protein, 19 aa, Staphylococcus
TLNPGEVIGLIGKNGSGKS

SEQ ID NO: 2042018 - protein, 19 aa, Staphylococcus
TLNRMFIRDFEGLRIDEAQ

SEQ ID NO: 2042019 - protein, 24 aa, Staphylococcus
TLNSPKFKLGCRVALLNDSPIVNI

SEQ ID NO: 2042020 - protein, 19 aa, Staphylococcus
TLPHIKLSTNVHITGEIRT

SEQ ID NO: 2042021 - protein, 20 aa, Staphylococcus
TLPLRLKRATVVIWLKEPRW

SEQ ID NO: 2042022 - protein, 25 aa, Staphylococcus
TLPNGVELKNRFVLAPLTHISSNDD

SEQ ID NO: 2042023 - protein, 25 aa, Staphylococcus
TLPNKEFHLLFLLVSHPKQIFSREE

SEQ ID NO: 2042024 - protein, 22 aa, Staphylococcus
TLPNYMIPVHFMKIDKIPITIN

SEQ ID NO: 2042025 - protein, 28 aa, Staphylococcus
TLPTANVIKIYFNDGFIALRPSGTEPKI

SEQ ID NO: 2042026 - protein, 21 aa, Staphylococcus
TLPTDEIIQRFTAYGSGNLFH

SEQ ID NO: 2042027 - protein, 24 aa, Staphylococcus
TLQDRRKAFQFAYLSLLQEETIQA

SEQ ID NO: 2042028 - protein, 24 aa, Staphylococcus
TLQDRRKAFQFAYLSLMQEETIQA

SEQ ID NO: 2042029 - protein, 25 aa, Staphylococcus
TLQDRRKAFQFAYLSLMQKEDIQAN

SEQ ID NO: 2042030 - protein, 23 aa, Staphylococcus
TLQECHQDLLSIESFYQDIKAQQ

SEQ ID NO: 2042031 - protein, 18 aa, Staphylococcus
TLQFKHMHRHSARIVGGA

SEQ ID NO: 2042032 - protein, 26 aa, Staphylococcus
TLQPSAFHWRFMDKLSLSTLSEVVMP

SEQ ID NO: 2042033 - protein, 19 aa, Staphylococcus
TLQSMGFNEATPIQKESIP

SEQ ID NO: 2042034 - protein, 20 aa, Staphylococcus
TLQTPFEMIHRAYLESTAFG

SEQ ID NO: 2042035 - protein, 22 aa, Staphylococcus
TLQTPFEMVHRAYLESTAFGTK

SEQ ID NO: 2042036 - protein, 24 aa, Staphylococcus
TLRIKEFDLLWYLATHENVALSKT

SEQ ID NO: 2042037 - protein, 21 aa, Staphylococcus
TLRMNYLFDFYHSLLTEKQKN

SEQ ID NO: 2042038 - protein, 21 aa, Staphylococcus
TLRMNYLFDFYQSLLTDKQRN

SEQ ID NO: 2042039 - protein, 20 aa, Staphylococcus
TLRMNYLFDFYQTLLTEKQR

SEQ ID NO: 2042040 - protein, 30 aa, Staphylococcus
TLRRLARHLKWPILKERHGLFKTEMGLLML

SEQ ID NO: 2042041 - protein, 24 aa, Staphylococcus
TLRRLCRELNKTIVIVLHDINFAS

SEQ ID NO: 2042042 - protein, 22 aa, Staphylococcus
TLRYYDEIKLLKAHRSAENGYR

SEQ ID NO: 2042043 - protein, 18 aa, Staphylococcus
TLSCQMEIDERGDVVDHE

SEQ ID NO: 2042044 - protein, 26 aa, Staphylococcus
TLSDFESLCFHVPFTKMGKKALDSII

SEQ ID NO: 2042045 - protein, 23 aa, Staphylococcus
TLSEFTDGIVIGSEIVKRFANDS

SEQ ID NO: 2042046 - protein, 27 aa, Staphylococcus
TLSGGQFQRLWIAKALIMEPQILILDE

SEQ ID NO: 2042047 - protein, 26 aa, Staphylococcus
TLSGGQFQRLWIAKALLVEPDVLILD

SEQ ID NO: 2042048 - protein, 24 aa, Staphylococcus
TLSGGQFQRVWIAKALILEPEILI

SEQ ID NO: 2042049 - protein, 17 aa, Staphylococcus
TLSRLNPLLSEGTVTAG

SEQ ID NO: 2042050 - protein, 24 aa, Staphylococcus
TLSSEKWLGILLRVTPLPIRNLGY

SEQ ID NO: 2042051 - protein, 29 aa, Staphylococcus
TLSYPFIVKTRFGGYDGKGQILVKNDSNI

SEQ ID NO: 2042052 - protein, 19 aa, Staphylococcus
TLTANEIIEQYGMSRQHHR

SEQ ID NO: 2042053 - protein, 24 aa, Staphylococcus
TLTRKEINEFSALVYYPEEKLKII

SEQ ID NO: 2042054 - protein, 19 aa, Staphylococcus
TLTSFKASQILAQEPDIKK

SEQ ID NO: 2042055 - protein, 26 aa, Staphylococcus
TLTYEGIKQGMHFDKLAAQQNVKQNT

SEQ ID NO: 2042056 - protein, 17 aa, Staphylococcus
TLVNRAGAVKIYETSLN

SEQ ID NO: 2042057 - protein, 21 aa, Staphylococcus
TLVQMAFCIDVRSEPFRKHIE

SEQ ID NO: 2042058 - protein, 26 aa, Staphylococcus
TLVVKRLKGQLVPFVHLGTGNYNDKT

SEQ ID NO: 2042059 - protein, 22 aa, Staphylococcus
TLWDFKVSKQLPQKNSTLQLVI

SEQ ID NO: 2042060 - protein, 26 aa, Staphylococcus
TLWHFTQEVYQEWYLGQSLYEEIEQK

SEQ ID NO: 2042061 - protein, 25 aa, Staphylococcus
TLWKKAKPGEISWESPFGQGRPGWH

SEQ ID NO: 2042062 - protein, 26 aa, Staphylococcus
TLWKKAKPGEISWSSPFGEGRPGWHI

SEQ ID NO: 2042063 - protein, 18 aa, Staphylococcus
TLWPEAGDQLLVTLRIDS

SEQ ID NO: 2042064 - protein, 18 aa, Staphylococcus
TLWQSRQAFYDWQKSSAY

SEQ ID NO: 2042065 - protein, 25 aa, Staphylococcus
TLYDLKRKRAIVLHGANGMDEATLS

SEQ ID NO: 2042066 - protein, 24 aa, Staphylococcus
TLYDYFKTWCETFKKSTVTPKTYK

SEQ ID NO: 2042067 - protein, 20 aa, Staphylococcus
TLYLAEKVTNGFVYGFDIQK

SEQ ID NO: 2042068 - protein, 21 aa, Staphylococcus
TLYLAQHVPNGFVYGFDIQQL

SEQ ID NO: 2042069 - protein, 24 aa, Staphylococcus
TLYQEHGYKHFIYTPVGFVCNHLE

SEQ ID NO: 2042070 - protein, 28 aa, Staphylococcus
TLYSRINKRVDIMLGHGLFNEVKNLVEQ

SEQ ID NO: 2042071 - protein, 24 aa, Staphylococcus
TLYVPANGPVNWTTHEDLAEGMVQ

SEQ ID NO: 2042072 - protein, 21 aa, Staphylococcus
TMAGKGSEVGRTFEELAQIIE

SEQ ID NO: 2042073 - protein, 18 aa, Staphylococcus
TMAKAAALSAEMLDCDFF

SEQ ID NO: 2042074 - protein, 19 aa, Staphylococcus
TMAYRIDKGTGIKEMIEHF

SEQ ID NO: 2042075 - protein, 18 aa, Staphylococcus
TMDDGILSVILPIKQTKT

SEQ ID NO: 2042076 - protein, 20 aa, Staphylococcus
TMELGGLAPLIVHKDADIDF

SEQ ID NO: 2042077 - protein, 18 aa, Staphylococcus
TMELGGLAPLIVHNDADI

SEQ ID NO: 2042078 - protein, 17 aa, Staphylococcus
TMFEHFNIPVAVNNDII

SEQ ID NO: 2042079 - protein, 24 aa, Staphylococcus
TMGEGFPVVLIHTAYDNYSVFNDV

SEQ ID NO: 2042080 - protein, 18 aa, Staphylococcus
TMGHAGQSLGAFAPKGLL

SEQ ID NO: 2042081 - protein, 17 aa, Staphylococcus
TMHLPLRLAESTITVVP

SEQ ID NO: 2042082 - protein, 18 aa, Staphylococcus
TMICAALADIPFFVTGGI

SEQ ID NO: 2042083 - protein, 26 aa, Staphylococcus
TMIHLSRFAEEIIFWSTDEAKFITLS

SEQ ID NO: 2042084 - protein, 20 aa, Staphylococcus
TMIKELAPEWDIKLYERLDR

SEQ ID NO: 2042085 - protein, 24 aa, Staphylococcus
TMILKPIFRDYLLKLANEKEINYQ

SEQ ID NO: 2042086 - protein, 21 aa, Staphylococcus
TMILKPSFRDYLLQLCDKQNI

SEQ ID NO: 2042087 - protein, 22 aa, Staphylococcus
TMIRQDIKPVIFLINNDGYTVE

SEQ ID NO: 2042088 - protein, 21 aa, Staphylococcus
TMIRQNLKPVIFVINNDGYTV

SEQ ID NO: 2042089 - protein, 17 aa, Staphylococcus
TMIRRGPNIKLPDLDIL

SEQ ID NO: 2042090 - protein, 26 aa, Staphylococcus
TMKHVAINFAKLILCAEDSQCELKVD

SEQ ID NO: 2042091 - protein, 24 aa, Staphylococcus
TMKKSRPATQLTVISSVTQAKEFE

SEQ ID NO: 2042092 - protein, 20 aa, Staphylococcus
TMKLLKLLHLEAIKNQHPFE

SEQ ID NO: 2042093 - protein, 17 aa, Staphylococcus
TMKRLNFDYYFVDIENI

SEQ ID NO: 2042094 - protein, 22 aa, Staphylococcus
TMLKELLYKQGEHFKFVGADTE

SEQ ID NO: 2042095 - protein, 17 aa, Staphylococcus
TMLNVLKLDISRTRKKA

SEQ ID NO: 2042096 - protein, 26 aa, Staphylococcus
TMNAICPKLGLTVEARLKIMEPKTKN

SEQ ID NO: 2042097 - protein, 25 aa, Staphylococcus
TMPEKDVRAVLGRFLFVQDDVKKII

SEQ ID NO: 2042098 - protein, 28 aa, Staphylococcus
TMPEKSFLYSLPYQYYKDYGIRKYGFHG

SEQ ID NO: 2042099 - protein, 21 aa, Staphylococcus
TMPGFDFYFAPMVLNSRDVTY

SEQ ID NO: 2042100 - protein, 20 aa, Staphylococcus
TMRAGLKLVDSVKIEYKSVK

SEQ ID NO: 2042101 - protein, 23 aa, Staphylococcus
TMRKEVIGGLGGFGATFDLSQLN

SEQ ID NO: 2042102 - protein, 23 aa, Staphylococcus
TMRKEVLGGLGGFGAAFDLSQLN

SEQ ID NO: 2042103 - protein, 17 aa, Staphylococcus
TMSIERRNLLKAYGAEV

SEQ ID NO: 2042104 - protein, 18 aa, Staphylococcus
TMSLERRNLLKAYGAEVV

SEQ ID NO: 2042105 - protein, 25 aa, Staphylococcus
TMTDYCFRNYQFIIGDVIVNRDSFE

SEQ ID NO: 2042106 - protein, 18 aa, Staphylococcus
TMTEEDWNRFTVAVGKLS

SEQ ID NO: 2042107 - protein, 19 aa, Staphylococcus
TMTEVYKYLVELLEKNQLD

SEQ ID NO: 2042108 - protein, 22 aa, Staphylococcus
TMTQSKCLVLFTSYKMMHMVQD

SEQ ID NO: 2042109 - protein, 20 aa, Staphylococcus
TMTTSFQLRDAFKLLTEQSV

SEQ ID NO: 2042110 - protein, 26 aa, Staphylococcus
TMVDVYRFLVQLLRKNKLDVSEIETF

SEQ ID NO: 2042111 - protein, 26 aa, Staphylococcus
TMVHLSRFAEEIIFWSSAEANFITLS

SEQ ID NO: 2042112 - protein, 26 aa, Staphylococcus
TMVHLSRFAEEIIFWSTDEAKFITLA

SEQ ID NO: 2042113 - protein, 26 aa, Staphylococcus
TMVHLSRFAEEIIFWSTDEAKFITLS

SEQ ID NO: 2042114 - protein, 26 aa, Staphylococcus
TMVHLSRFSEEIIFWSTDEAKFITLS

SEQ ID NO: 2042115 - protein, 29 aa, Staphylococcus
TNAAVNKVLRKACANLNIKEITIHSLRHS

SEQ ID NO: 2042116 - protein, 23 aa, Staphylococcus
TNAFSGKMARGIRNDFINYLSEF

SEQ ID NO: 2042117 - protein, 20 aa, Staphylococcus
TNAGKSSWFNALAKESTYEK

SEQ ID NO: 2042118 - protein, 24 aa, Staphylococcus
TNAIHFVGTFTVEFFIDKENNLYV

SEQ ID NO: 2042119 - protein, 17 aa, Staphylococcus
TNAIIVYTLVKPEIKKY

SEQ ID NO: 2042120 - protein, 18 aa, Staphylococcus
TNALRQVGNWQVYDGNKE

SEQ ID NO: 2042121 - protein, 18 aa, Staphylococcus
TNALVLRTHITIGDGKDS

SEQ ID NO: 2042122 - protein, 21 aa, Staphylococcus
TNAMHQFAIWTALSSKGIGAS

SEQ ID NO: 2042123 - protein, 18 aa, Staphylococcus
TNAMPGFTQYSMYPSLWE

SEQ ID NO: 2042124 - protein, 19 aa, Staphylococcus
TNCYLMDGGGITFGDNVFV

SEQ ID NO: 2042125 - protein, 17 aa, Staphylococcus
TNDFFDVDNYPEVKFEI

SEQ ID NO: 2042126 - protein, 18 aa, Staphylococcus
TNDICCYFLDIQLDADIN

SEQ ID NO: 2042127 - protein, 22 aa, Staphylococcus
TNDLDLIIVPGVVFNEQGYRIG

SEQ ID NO: 2042128 - protein, 23 aa, Staphylococcus
TNDQPGWWRGIIDGGYMPINDYQ

SEQ ID NO: 2042129 - protein, 24 aa, Staphylococcus
TNDSMCVLNHLFVNEGNEPQFESK

SEQ ID NO: 2042130 - protein, 23 aa, Staphylococcus
TNEAKMIISCIARMRQQENYHVI

SEQ ID NO: 2042131 - protein, 23 aa, Staphylococcus
TNEFYFKVWEGFYHEIHNEPERD

SEQ ID NO: 2042132 - protein, 18 aa, Staphylococcus
TNEGRVSFVSKIVQDNFK

SEQ ID NO: 2042133 - protein, 22 aa, Staphylococcus
TNEIKDQFVFVGRFSEEKQISH

SEQ ID NO: 2042134 - protein, 18 aa, Staphylococcus
TNELLTLLHLDAVKQQHP

SEQ ID NO: 2042135 - protein, 19 aa, Staphylococcus
TNEPTRVGYKFVDGKKIRI

SEQ ID NO: 2042136 - protein, 25 aa, Staphylococcus
TNEPTRVGYKFVDGKKVRIVKKSGE

SEQ ID NO: 2042137 - protein, 26 aa, Staphylococcus
TNESFYAMPTVVGFLPNVVEGDVYTF

SEQ ID NO: 2042138 - protein, 23 aa, Staphylococcus
TNFLDPRGQYILEVISGSYEDME

SEQ ID NO: 2042139 - protein, 17 aa, Staphylococcus
TNFRSFNGNNELQFNDG

SEQ ID NO: 2042140 - protein, 24 aa, Staphylococcus
TNGEYFRAGIIFEQLIEMNDRIQM

SEQ ID NO: 2042141 - protein, 24 aa, Staphylococcus
TNGFRIGYGGGYYDKFLNQHDINS

SEQ ID NO: 2042142 - protein, 25 aa, Staphylococcus
TNGKYLPKREIVPIESFKDAIQNWQ

SEQ ID NO: 2042143 - protein, 18 aa, Staphylococcus
TNGNLGFDYLIDNLADTK

SEQ ID NO: 2042144 - protein, 21 aa, Staphylococcus
TNHKKRGIEFPGGKIEKNETS

SEQ ID NO: 2042145 - protein, 32 aa, Staphylococcus
TNHLDFDSIKWLINYVKQYPHTVLFVTHDRYF

SEQ ID NO: 2042146 - protein, 30 aa, Staphylococcus
TNHLDFKSIEWLTNYIKNYHGATVVVSHDR

SEQ ID NO: 2042147 - protein, 17 aa, Staphylococcus
TNHLDLETTKWLEDYLK

SEQ ID NO: 2042148 - protein, 18 aa, Staphylococcus
TNHQIEWVVIGPEQPLID

SEQ ID NO: 2042149 - protein, 24 aa, Staphylococcus
TNHSKPLYKLCVDIINEFDTWTDI

SEQ ID NO: 2042150 - protein, 30 aa, Staphylococcus
TNHYMTIFKFRGHRIVAFNGGRFLIHNMTQ

SEQ ID NO: 2042151 - protein, 26 aa, Staphylococcus
TNIERGHIRLGVSAIMDVRLFTESLN

SEQ ID NO: 2042152 - protein, 26 aa, Staphylococcus
TNIKESKHIGGFPVSGIFLVCQDPEI

SEQ ID NO: 2042153 - protein, 24 aa, Staphylococcus
TNIKNVYDKIVWLNKPVMEARLKG

SEQ ID NO: 2042154 - protein, 17 aa, Staphylococcus
TNIPFLINVIRNKHFQN

SEQ ID NO: 2042155 - protein, 24 aa, Staphylococcus
TNKAEKCTFCFPRVEAGMPTVCSE

SEQ ID NO: 2042156 - protein, 17 aa, Staphylococcus
TNKEIAETLFVSEKTIK

SEQ ID NO: 2042157 - protein, 33 aa, Staphylococcus; identical to SEQ ID NO: 1813602

SEQ ID NO: 2042158 - protein, 33 aa, Staphylococcus
TNKGRYLFIPVHKLADIRWKELGQHVSQIVPLD

SEQ ID NO: 2042159 - protein, 22 aa, Staphylococcus
TNKGRYLFIPVHKLADTRWKEL

SEQ ID NO: 2042160 - protein, 23 aa, Staphylococcus
TNKGRYLFIPVHKLAEIKWKELG

SEQ ID NO: 2042161 - protein, 24 aa, Staphylococcus
TNKGRYLFIPVHKLAEIRWKELGQ

SEQ ID NO: 2042162 - protein, 27 aa, Staphylococcus
TNKHFAQKVAHQWLRLASIDENGDIKD

SEQ ID NO: 2042163 - protein, 24 aa, Staphylococcus
TNKPLRNAILWNDTRSTHQCTTIE

SEQ ID NO: 2042164 - protein, 24 aa, Staphylococcus
TNKRGYKMLPHFQIGLFKDHLFIM

SEQ ID NO: 2042165 - protein, 23 aa, Staphylococcus
TNKRGYKMLPHFQIGLYEDQVFV

SEQ ID NO: 2042166 - protein, 17 aa, Staphylococcus
TNLCPKDDTSPIISINS

SEQ ID NO: 2042167 - protein, 25 aa, Staphylococcus
TNLFNLPKDEVWHCESIEEIADDIL

SEQ ID NO: 2042168 - protein, 17 aa, Staphylococcus
TNLIKRPIVPYHSYNVA

SEQ ID NO: 2042169 - protein, 21 aa, Staphylococcus
TNLKLYAAHIVHNKKGQPGEI

SEQ ID NO: 2042170 - protein, 21 aa, Staphylococcus
TNLLQLRQKYFISVTTMKDNS

SEQ ID NO: 2042171 - protein, 17 aa, Staphylococcus
TNLTKPFLIFVGNSNGA

SEQ ID NO: 2042172 - protein, 30 aa, Staphylococcus
TNMFKVLLHEIFKDYGVLFIDAQNHALRQL

SEQ ID NO: 2042173 - protein, 24 aa, Staphylococcus
TNMGASGIEYFTPILNLGETGILG

SEQ ID NO: 2042174 - protein, 26 aa, Staphylococcus
TNMNPLWHIYRLVKFPKVLRQTIIIE

SEQ ID NO: 2042175 - protein, 24 aa, Staphylococcus
TNNSFRISKDVLKPVEISTESKED

SEQ ID NO: 2042176 - protein, 17 aa, Staphylococcus
TNNVPAFAICHGPQVLI

SEQ ID NO: 2042177 - protein, 25 aa, Staphylococcus
TNPKGEWSLRQEIAHYLFNSRGVTC

SEQ ID NO: 2042178 - protein, 24 aa, Staphylococcus
TNPPIRAGKNVVHRIFEEAYQKLK

SEQ ID NO: 2042179 - protein, 21 aa, Staphylococcus
TNPPIRAGKQVVHSILEDAFN

SEQ ID NO: 2042180 - protein, 25 aa, Staphylococcus
TNPSALRVKFLWDQLDEYPHGIVQD

SEQ ID NO: 2042181 - protein, 26 aa, Staphylococcus
TNPSLIISFYPKFAVHPDHEATAEAV

SEQ ID NO: 2042182 - protein, 26 aa, Staphylococcus
TNPSLIISFYPKFAVHPDHEATGEAV

SEQ ID NO: 2042183 - protein, 17 aa, Staphylococcus
TNPYYIWLSEVMLQQTQ

SEQ ID NO: 2042184 - protein, 25 aa, Staphylococcus
TNQGYKMLVCTVGNGKNRLIFNGHV

SEQ ID NO: 2042185 - protein, 25 aa, Staphylococcus
TNQLLNAFHLWLIRIFYANQPKSYP

SEQ ID NO: 2042186 - protein, 18 aa, Staphylococcus
TNQSFLLDGAYPYIETKR

SEQ ID NO: 2042187 - protein, 26 aa, Staphylococcus
TNQYFKRIFNVLHEFYSENDTFNISD

SEQ ID NO: 2042188 - protein, 26 aa, Staphylococcus
TNRDLRFIEDFSIKISDVMTKENLIT

SEQ ID NO: 2042189 - protein, 25 aa, Staphylococcus
TNRFSIMMHELLKISSIGEYFGKTS

SEQ ID NO: 2042190 - protein, 19 aa, Staphylococcus
TNRLERFVVMYINEDEADQ

SEQ ID NO: 2042191 - protein, 18 aa, Staphylococcus
TNRLPKFQPGFYINGKIY

SEQ ID NO: 2042192 - protein, 22 aa, Staphylococcus
TNRRITFEYGLFGGVNDQIEHA

SEQ ID NO: 2042193 - protein, 22 aa, Staphylococcus
TNRRITFEYGLFGGVNDQLTHA

SEQ ID NO: 2042194 - protein, 21 aa, Staphylococcus
TNRSAVKMELDLRGYRYEEAI

SEQ ID NO: 2042195 - protein, 26 aa, Staphylococcus
TNSAISRSAVQLAQAILLDEHPIEPV

SEQ ID NO: 2042196 - protein, 24 aa, Staphylococcus
TNSEFEIMKLLMQYPEKAFSKQKI

SEQ ID NO: 2042197 - protein, 25 aa, Staphylococcus
TNSILPGVITKIGLNTTIDPRYKGG

SEQ ID NO: 2042198 - protein, 23 aa, Staphylococcus
TNSRRQGYVAARNMAGKEMKMPR

SEQ ID NO: 2042199 - protein, 20 aa, Staphylococcus
TNSSTFSLKAFKNVIKTTLN

SEQ ID NO: 2042200 - protein, 17 aa, Staphylococcus
TNTIMKTTGKFGGLGNT

SEQ ID NO: 2042201 - protein, 24 aa, Staphylococcus
TNTISNWYIRRSRGRFWEQGISND

SEQ ID NO: 2042202 - protein, 20 aa, Staphylococcus
TNTKLAPWHVIKADHKKTSR

SEQ ID NO: 2042203 - protein, 28 aa, Staphylococcus
TNTMPQWAGSCWYYLRYIDPDNDKMIAD

SEQ ID NO: 2042204 - protein, 27 aa, Staphylococcus
TNTMPQWAGSCWYYLRYIDPDNEQMLA

SEQ ID NO: 2042205 - protein, 28 aa, Staphylococcus
TNTMPQWAGSCWYYLRYIDPHNEQMLAD

SEQ ID NO: 2042206 - protein, 28 aa, Staphylococcus
TNTMPQWAGSCWYYLRYIDPHNSNMLAD

SEQ ID NO: 2042207 - protein, 20 aa, Staphylococcus
TNTNARIEPGAFIREQAIIE

SEQ ID NO: 2042208 - protein, 19 aa, Staphylococcus
TNTNARIEPGAFIREQAVI

SEQ ID NO: 2042209 - protein, 19 aa, Staphylococcus
TNTNARIEPGSFIREQAII

SEQ ID NO: 2042210 - protein, 24 aa, Staphylococcus
TNTNEFKAGMVITVEPGIYVPGVA

SEQ ID NO: 2042211 - protein, 25 aa, Staphylococcus
TNTTESKCLILFTSYKMMHMVQDML

SEQ ID NO: 2042212 - protein, 18 aa, Staphylococcus
TNTYRPATYKDIVILERS

SEQ ID NO: 2042213 - protein, 19 aa, Staphylococcus
TNVIPKDKYLVLGDNREVS

SEQ ID NO: 2042214 - protein, 19 aa, Staphylococcus
TNVLYGFPKFYDACVNEGI

SEQ ID NO: 2042215 - protein, 17 aa, Staphylococcus
TNYCKDNNKGLNYFIAV

SEQ ID NO: 2042216 - protein, 25 aa, Staphylococcus
TNYLKDNILKFGFYADDSHVVINAE

SEQ ID NO: 2042217 - protein, 22 aa, Staphylococcus
TNYLKHEFPEHDILMSILSNHA

SEQ ID NO: 2042218 - protein, 23 aa, Staphylococcus
TNYMIGMSFSQLEAFKEALPFLM

SEQ ID NO: 2042219 - protein, 17 aa, Staphylococcus
TPADIQAGYQFDASGIG

SEQ ID NO: 2042220 - protein, 20 aa, Staphylococcus
TPAEYRVCKTQEGLLNIKRT

SEQ ID NO: 2042221 - protein, 32 aa, Staphylococcus
TPAMPLDVCGSMTQGMIGFWIETEVNRVLAEI

SEQ ID NO: 2042222 - protein, 27 aa, Staphylococcus
TPAQIILNWHLCHGRIVIPKSQTPSRI

SEQ ID NO: 2042223 - protein, 17 aa, Staphylococcus
TPCSAWFYLPDISEKPP

SEQ ID NO: 2042224 - protein, 17 aa, Staphylococcus
TPCYNDDFLRGCMRQSL

SEQ ID NO: 2042225 - protein, 18 aa, Staphylococcus
TPDAHLVGWTREDGEQEI

SEQ ID NO: 2042226 - protein, 24 aa, Staphylococcus
TPDEIKEALSHFMLDIENANLQRI

SEQ ID NO: 2042227 - protein, 24 aa, Staphylococcus
TPDEITLLFSKFWKVLSRNIYIEK

SEQ ID NO: 2042228 - protein, 20 aa, Staphylococcus
TPDHGLEFEGVETRAHNVRI

SEQ ID NO: 2042229 - protein, 20 aa, Staphylococcus
TPDHVHVMYGGKVVTSGGPE

SEQ ID NO: 2042230 - protein, 24 aa, Staphylococcus
TPDKADEIIISFKKGLPVQIDGKD

SEQ ID NO: 2042231 - protein, 21 aa, Staphylococcus
TPEALEVILENNLPEPSVSQI

SEQ ID NO: 2042232 - protein, 29 aa, Staphylococcus
TPEDLKRDMQLLAPRVRYLSEIVKDVIHD

SEQ ID NO: 2042233 - protein, 22 aa, Staphylococcus
TPEEEFYTFIGQFYRLNQHLLP

SEQ ID NO: 2042234 - protein, 17 aa, Staphylococcus
TPEFPIVIEENFTFYNV

SEQ ID NO: 2042235 - protein, 21 aa, Staphylococcus
TPEGKNIWFGVREFAMGAAVN

SEQ ID NO: 2042236 - protein, 20 aa, Staphylococcus
TPEGKNVWFGVREFAMGAAV

SEQ ID NO: 2042237 - protein, 32 aa, Staphylococcus
TPEGSFYIWFQFKFSIDMKRLFDEAIAENILI

SEQ ID NO: 2042238 - protein, 22 aa, Staphylococcus
TPEPIYPLWHRAMNAYDKASDS

SEQ ID NO: 2042239 - protein, 22 aa, Staphylococcus
TPEQKLWLSGYLTASQQAETNE

SEQ ID NO: 2042240 - protein, 31 aa, Staphylococcus
TPEQWYKMIEAFKVTIWYTAPTALRMLMSAG

SEQ ID NO: 2042241 - protein, 17 aa, Staphylococcus
TPEREIGNDLLVVDGIS

SEQ ID NO: 2042242 - protein, 23 aa, Staphylococcus
TPESEALHFIFYKMSQFPADYLK

SEQ ID NO: 2042243 - protein, 19 aa, Staphylococcus
TPEVIEAYNPLPVGVSRPN

SEQ ID NO: 2042244 - protein, 29 aa, Staphylococcus
TPEVVYEAWTKVEILKQWFMTTPRTNKTF

SEQ ID NO: 2042245 - protein, 25 aa, Staphylococcus
TPEYFANKVAHHFKSSSVSVDIKNN

SEQ ID NO: 2042246 - protein, 18 aa, Staphylococcus
TPFAKLIHYQNYRMTLFQ

SEQ ID NO: 2042247 - protein, 26 aa, Staphylococcus
TPFEVEAKATLSFRTMQLIGKPYHIK

SEQ ID NO: 2042248 - protein, 27 aa, Staphylococcus
TPFPRISYDDAIEFLKEQGFDDIEWGE

SEQ ID NO: 2042249 - protein, 23 aa, Staphylococcus
TPFPRITYDDAIDYLKEQGFDDI

SEQ ID NO: 2042250 - protein, 23 aa, Staphylococcus
TPFPRITYDDAIEYLKEQGFDDI

SEQ ID NO: 2042251 - protein, 23 aa, Staphylococcus
TPFRTMGLYNMFLFKQKPADLYR

SEQ ID NO: 2042252 - protein, 20 aa, Staphylococcus
TPFRYGMKSLYIHQLSIESN

SEQ ID NO: 2042253 - protein, 20 aa, Staphylococcus
TPFTLLDYFGDDWLVMIDES

SEQ ID NO: 2042254 - protein, 17 aa, Staphylococcus
TPGCTTEACDFRDNMAM

SEQ ID NO: 2042255 - protein, 20 aa, Staphylococcus
TPGHPEFRHTQGVEVTTGPL

SEQ ID NO: 2042256 - protein, 24 aa, Staphylococcus
TPGHSPGSLSYVFNDFAIVGDTLF

SEQ ID NO: 2042257 - protein, 24 aa, Staphylococcus
TPGHSPGSLTYVFNDFAVVGDTLF

SEQ ID NO: 2042258 - protein, 29 aa, Staphylococcus
TPGLANKIALKFAKKIYTTFEDTLNYLPK

SEQ ID NO: 2042259 - protein, 24 aa, Staphylococcus
TPHDWKKYFKGFKKRKSKENDDIG

SEQ ID NO: 2042260 - protein, 20 aa, Staphylococcus
TPHLTYFCSYQLAKRTVQSH

SEQ ID NO: 2042261 - protein, 18 aa, Staphylococcus
TPHMFNKRMETIAKLFKI

SEQ ID NO: 2042262 - protein, 22 aa, Staphylococcus
TPHPTAAFVAARAGAMAKHTEH

SEQ ID NO: 2042263 - protein, 25 aa, Staphylococcus
TPHQMEWERLSGIPIDEQTEERNRE

SEQ ID NO: 2042264 - protein, 20 aa, Staphylococcus
TPHRIFDFFNAFIGTQDFDY

SEQ ID NO: 2042265 - protein, 20 aa, Staphylococcus
TPHRIFDFFNAFIGTSDFDQ

SEQ ID NO: 2042266 - protein, 23 aa, Staphylococcus
TPIDKCYECGFEGEFDTTVKGYT

SEQ ID NO: 2042267 - protein, 19 aa, Staphylococcus
TPIFPRLDTEAEIAYIKES

SEQ ID NO: 2042268 - protein, 25 aa, Staphylococcus
TPIKLRKLVWRRLAKDLKPKQLHDI

SEQ ID NO: 2042269 - protein, 17 aa, Staphylococcus
TPISIGRNVANCHPPKS

SEQ ID NO: 2042270 - protein, 18 aa, Staphylococcus
TPKFLSIPVLSGLKKADH

SEQ ID NO: 2042271 - protein, 28 aa, Staphylococcus
TPKHHLKVCGGFQFSSHKSDDEWRQFGL

SEQ ID NO: 2042272 - protein, 23 aa, Staphylococcus
TPKLKNIESVISMLLDNNEAMIQ

SEQ ID NO: 2042273 - protein, 25 aa, Staphylococcus
TPKNPLCLFCPIQSHCEAFEQGTIQ

SEQ ID NO: 2042274 - protein, 23 aa, Staphylococcus
TPKPRLPYDSVFHQNKYNSDKDN

SEQ ID NO: 2042275 - protein, 34 aa, Staphylococcus
TPKQLMIYDAFGWEPPRFAHMSLIVNEERKKLSK

SEQ ID NO: 2042276 - protein, 30 aa, Staphylococcus
TPKQLMIYEAFGWEAPRFAHMSLIVNEERK

SEQ ID NO: 2042277 - protein, 30 aa, Staphylococcus; identical to SEQ ID NO: 1796772

SEQ ID NO: 2042278 - protein, 34 aa, Staphylococcus
TPKQLMIYEAFGWEPPRFAHMSLIVNEQRKKLSK

SEQ ID NO: 2042279 - protein, 30 aa, Staphylococcus
TPKQLMIYEAFGWEPPRFGHISLIVNEQRK

SEQ ID NO: 2042280 - protein, 34 aa, Staphylococcus
TPKQLMIYEAFGWEPPRFGHMSLIVNEERKKLSK

SEQ ID NO: 2042281 - protein, 20 aa, Staphylococcus
TPKSLPFIEFDHERILSSDD

SEQ ID NO: 2042282 - protein, 22 aa, Staphylococcus
TPKSPLCLFCPVQDNCEAFHEG

SEQ ID NO: 2042283 - protein, 24 aa, Staphylococcus
TPKSPLCLFCPVQSHCEAFQQGTV

SEQ ID NO: 2042284 - protein, 25 aa, Staphylococcus
TPKTKGIVGKAFFEKAKPNLQIINV

SEQ ID NO: 2042285 - protein, 26 aa, Staphylococcus
TPKTRGIVGESFFNKAKPNLQIINVA

SEQ ID NO: 2042286 - protein, 20 aa, Staphylococcus
TPKTRGIVNADFFSKAKPTL

SEQ ID NO: 2042287 - protein, 19 aa, Staphylococcus
TPLDMVMSIYHMTRSYAQT

SEQ ID NO: 2042288 - protein, 20 aa, Staphylococcus
TPLDTMLSAFGKRDDINSGG

SEQ ID NO: 2042289 - protein, 17 aa, Staphylococcus
TPLERDHYLSLKYDCNV

SEQ ID NO: 2042290 - protein, 17 aa, Staphylococcus
TPLKAVINLVGGRYFGL

SEQ ID NO: 2042291 - protein, 17 aa, Staphylococcus
TPLNIYYFTGYRSEPHE

SEQ ID NO: 2042292 - protein, 24 aa, Staphylococcus
TPLRREAIVLLGMIEDKAVLPYLF

SEQ ID NO: 2042293 - protein, 19 aa, Staphylococcus
TPMFHVLGLNDTVLPSMMA

SEQ ID NO: 2042294 - protein, 18 aa, Staphylococcus
TPMKLGGYTGLWEGFIKR

SEQ ID NO: 2042295 - protein, 24 aa, Staphylococcus
TPMKVRERVWRRLATDLRPDQLHD

SEQ ID NO: 2042296 - protein, 27 aa, Staphylococcus
TPMLLRKQIWRRLATDLKPEQLHTIKN

SEQ ID NO: 2042297 - protein, 22 aa, Staphylococcus
TPNGGKLKIHYELYQNEEKMGS

SEQ ID NO: 2042298 - protein, 18 aa, Staphylococcus
TPNHILKHYEHLLSEYGV

SEQ ID NO: 2042299 - protein, 22 aa, Staphylococcus
TPNKKGYFFAMWKKDENNTNVP

SEQ ID NO: 2042300 - protein, 17 aa, Staphylococcus
TPNSYRFQQYYQQEVTI

SEQ ID NO: 2042301 - protein, 20 aa, Staphylococcus
TPNYRKHWQVIFELNNGKKL

SEQ ID NO: 2042302 - protein, 29 aa, Staphylococcus
TPQDIQAGYQFNAKGIGLVRTEHMFFGAE

SEQ ID NO: 2042303 - protein, 29 aa, Staphylococcus
TPQMVLRFKKRFGDEVAVLHSALSKGERY

SEQ ID NO: 2042304 - protein, 23 aa, Staphylococcus
TPQYFAELVVQHFKDSSVEVDIK

SEQ ID NO: 2042305 - protein, 23 aa, Staphylococcus
TPRRSEPRVKIDAGSVGIANNQT

SEQ ID NO: 2042306 - protein, 26 aa, Staphylococcus
TPSAHTARQLALVWGAYPVIKKGRKT

SEQ ID NO: 2042307 - protein, 23 aa, Staphylococcus
TPSARRHARKNGIDLNEVAGKGS

SEQ ID NO: 2042308 - protein, 25 aa, Staphylococcus
TPSELPYLLAHGERFLTQTVENIAR

SEQ ID NO: 2042309 - protein, 18 aa, Staphylococcus
TPSNPLLRVTDIKRTAEI

SEQ ID NO: 2042310 - protein, 26 aa, Staphylococcus
TPSQLFQFFMSYTIAKFDVSLATLLG

SEQ ID NO: 2042311 - protein, 17 aa, Staphylococcus
TPTGIIDCFTDALREPN

SEQ ID NO: 2042312 - protein, 25 aa, Staphylococcus
TPTIEGIEFVEFLISPNKGEPLKSL

SEQ ID NO: 2042313 - protein, 17 aa, Staphylococcus
TPTTYLFDDTLVIDIQS

SEQ ID NO: 2042314 - protein, 20 aa, Staphylococcus
TPTWIWSVVVDGKLFVRAYN

SEQ ID NO: 2042315 - protein, 23 aa, Staphylococcus
TPVDRVVPVLSMVDYVLVMTVNP

SEQ ID NO: 2042316 - protein, 18 aa, Staphylococcus
TPVFLVINKIDLVHPDQI

SEQ ID NO: 2042317 - protein, 20 aa, Staphylococcus
TPYEGGIAFAAKPLIEADFI

SEQ ID NO: 2042318 - protein, 25 aa, Staphylococcus
TPYEVINMLCTTYGMVAEYYIELGS

SEQ ID NO: 2042319 - protein, 17 aa, Staphylococcus
TPYFPKPDVLIYLDCDY

SEQ ID NO: 2042320 - protein, 23 aa, Staphylococcus
TPYFTEFALFMGRGAGKNGFISA

SEQ ID NO: 2042321 - protein, 19 aa, Staphylococcus
TPYIWTAMIDYLSKRAIPR

SEQ ID NO: 2042322 - protein, 19 aa, Staphylococcus
TPYTLLDYFGDDWLVMIDE

SEQ ID NO: 2042323 - protein, 23 aa, Staphylococcus
TQAFPTPNVFNWLQQQANIDTKE

SEQ ID NO: 2042324 - protein, 19 aa, Staphylococcus
TQAGFLLGHLDFNNFHMNH

SEQ ID NO: 2042325 - protein, 17 aa, Staphylococcus
TQAGLHFIIEVNSPYSY

SEQ ID NO: 2042326 - protein, 23 aa, Staphylococcus
TQANAMHQFAIWTALSTKGIGAS

SEQ ID NO: 2042327 - protein, 24 aa, Staphylococcus
TQANQRLAIMTGQRYQLTRRAQIS

SEQ ID NO: 2042328 - protein, 21 aa, Staphylococcus
TQATEAIPNWAAEKNYPVTNY

SEQ ID NO: 2042329 - protein, 23 aa, Staphylococcus
TQDDCPPCTFVKNYLSEQGVDFI

SEQ ID NO: 2042330 - protein, 24 aa, Staphylococcus
TQDGEGRLTVSVSGLNADTEYPKG

SEQ ID NO: 2042331 - protein, 24 aa, Staphylococcus
TQDIYFKMMQDFIGGDDILIAEQG

SEQ ID NO: 2042332 - protein, 22 aa, Staphylococcus
TQEAKMIISCIARMRQKESYSV

SEQ ID NO: 2042333 - protein, 17 aa, Staphylococcus
TQEKIVFVDKYGKVIAM

SEQ ID NO: 2042334 - protein, 18 aa, Staphylococcus
TQELLGFEYIYENSLDAV

SEQ ID NO: 2042335 - protein, 23 aa, Staphylococcus
TQESSKMCLFEPRVFSDTQDIAD

SEQ ID NO: 2042336 - protein, 26 aa, Staphylococcus
TQFTFSRKGLREGYVMHHLNEKYPDA

SEQ ID NO: 2042337 - protein, 18 aa, Staphylococcus
TQFYKEAIPLFVTGLGDI

SEQ ID NO: 2042338 - protein, 31 aa, Staphylococcus
TQGVLLPESFYRGAHQHIFRAMMHLSEENSD

SEQ ID NO: 2042339 - protein, 23 aa, Staphylococcus
TQHIPFEIVPGITSGIAAPAYAG

SEQ ID NO: 2042340 - protein, 17 aa, Staphylococcus
TQHTVRLLHAIELERIN

SEQ ID NO: 2042341 - protein, 17 aa, Staphylococcus
TQIEKGKDFIFDATVTV

SEQ ID NO: 2042342 - protein, 17 aa, Staphylococcus
TQIHLDFPSVGATQNII

SEQ ID NO: 2042343 - protein, 17 aa, Staphylococcus
TQKGRLFIYDLLKDNNI

SEQ ID NO: 2042344 - protein, 24 aa, Staphylococcus
TQKLCKDLLELLGHSSQPEEIYGK

SEQ ID NO: 2042345 - protein, 25 aa, Staphylococcus
TQKSPRWAIAYKFPAEEVVSKLLDI

SEQ ID NO: 2042346 - protein, 25 aa, Staphylococcus
TQKSPRWAIAYKFPAEEVVTELKDI

SEQ ID NO: 2042347 - protein, 25 aa, Staphylococcus
TQKSPRWAIAYKFPAEEVVTKLLDI

SEQ ID NO: 2042348 - protein, 25 aa, Staphylococcus
TQKSPRWAIAYKFPAEEVVTRLLDI

SEQ ID NO: 2042349 - protein, 25 aa, Staphylococcus
TQKSPRWAIAYKFPAEEVVTTLQDI

SEQ ID NO: 2042350 - protein, 25 aa, Staphylococcus
TQKTQSKCLILFTSYKMMHMVQELI

SEQ ID NO: 2042351 - protein, 18 aa, Staphylococcus
TQLAGMRGLMAAPSGEII

SEQ ID NO: 2042352 - protein, 17 aa, Staphylococcus
TQLEVGDNIIIYNKEKD

SEQ ID NO: 2042353 - protein, 17 aa, Staphylococcus
TQLFYGGGISNLGQAQE

SEQ ID NO: 2042354 - protein, 22 aa, Staphylococcus
TQLILEIFAMRASSKEGKLQVE

SEQ ID NO: 2042355 - protein, 25 aa, Staphylococcus
TQLKEAIRILNRFDNIKVTQISDIY

SEQ ID NO: 2042356 - protein, 18 aa, Staphylococcus
TQLLERFLFPSSTHGKKI

SEQ ID NO: 2042357 - protein, 20 aa, Staphylococcus
TQLLERFLFPSSTHGKKVYK

SEQ ID NO: 2042358 - protein, 18 aa, Staphylococcus
TQLNEIRTLNTLVQQRES

SEQ ID NO: 2042359 - protein, 24 aa, Staphylococcus
TQLPEFYERASFAPKGQDPSMIEA

SEQ ID NO: 2042360 - protein, 20 aa, Staphylococcus
TQLPNMYGFQAEGASPIVQN

SEQ ID NO: 2042361 - protein, 21 aa, Staphylococcus
TQLVKDVHAFPGHIACDANSK

SEQ ID NO: 2042362 - protein, 19 aa, Staphylococcus
TQNAMEVMEILKAQTSEKN

SEQ ID NO: 2042363 - protein, 25 aa, Staphylococcus
TQPKTERKIDEKEEHSDETMPEIEV

SEQ ID NO: 2042364 - protein, 19 aa, Staphylococcus
TQPRMKWYTDDKISNYKVT

SEQ ID NO: 2042365 - protein, 18 aa, Staphylococcus
TQPTYTFKDLNEVLNELE

SEQ ID NO: 2042366 - protein, 17 aa, Staphylococcus
TQQCLDCQFLANRFQLM

SEQ ID NO: 2042367 - protein, 25 aa, Staphylococcus
TQQIKASMVGTFFLQDSKELTEPVV

SEQ ID NO: 2042368 - protein, 17 aa, Staphylococcus
TQRAIAIKEEFNGDDVL

SEQ ID NO: 2042369 - protein, 25 aa, Staphylococcus
TQRENLRLVIQLVDLRHNPTEDDVL

SEQ ID NO: 2042370 - protein, 23 aa, Staphylococcus
TQRGAIKHIGFKVLQEAKRAQRG

SEQ ID NO: 2042371 - protein, 22 aa, Staphylococcus
TQRLISFIWGHFEAVQEKVITE

SEQ ID NO: 2042372 - protein, 23 aa, Staphylococcus
TQSFPTPKVFEWLQQQAEIETSE

SEQ ID NO: 2042373 - protein, 18 aa, Staphylococcus
TQSKHLFDLVISTETHAE

SEQ ID NO: 2042374 - protein, 24 aa, Staphylococcus
TQTGRAYFKLTIHGEGGHGSSPHT

SEQ ID NO: 2042375 - protein, 17 aa, Staphylococcus
TQTKIVHDFAYAAFGFD

SEQ ID NO: 2042376 - protein, 23 aa, Staphylococcus
TQTLIHLPFDYMFFTGSEKVGQI

SEQ ID NO: 2042377 - protein, 24 aa, Staphylococcus
TQTLINLPFDYIFFTGSDKVGQIV

SEQ ID NO: 2042378 - protein, 21 aa, Staphylococcus
TQTLINLPFDYIFFTGSENVG

SEQ ID NO: 2042379 - protein, 25 aa, Staphylococcus
TQTLLHLPFDYIFFTGSEKVGRIVY

SEQ ID NO: 2042380 - protein, 19 aa, Staphylococcus
TQTLSAYEVVNEWSYEALV

SEQ ID NO: 2042381 - protein, 23 aa, Staphylococcus
TQYPDKLKALLLTEIENNQGQLN

SEQ ID NO: 2042382 - protein, 21 aa, Staphylococcus
TRAAAELGYQPILIEDATATR

SEQ ID NO: 2042383 - protein, 20 aa, Staphylococcus
TRAAYPIHHIDNIVLPSKAA

SEQ ID NO: 2042384 - protein, 20 aa, Staphylococcus
TRAAYPIHHIDNIVTPSKAA

SEQ ID NO: 2042385 - protein, 22 aa, Staphylococcus
TRAEHVKLLIPLFEQNKDELAQ

SEQ ID NO: 2042386 - protein, 26 aa, Staphylococcus
TRAEWLMLDLFNWSKANYLMHMDDEV

SEQ ID NO: 2042387 - protein, 24 aa, Staphylococcus
TRAIKRLEVVESFRHSGNNPAWMI

SEQ ID NO: 2042388 - protein, 23 aa, Staphylococcus
TRAIKRLEVVESFRNSGNDPAWM

SEQ ID NO: 2042389 - protein, 23 aa, Staphylococcus
TRAIKRLEVVESFRNSGNDPSWM

SEQ ID NO: 2042390 - protein, 23 aa, Staphylococcus
TRAIKRLEVVESFRNSGNKPEWM

SEQ ID NO: 2042391 - protein, 23 aa, Staphylococcus
TRAIKRLEVVESFRNSGNNPAWM

SEQ ID NO: 2042392 - protein, 18 aa, Staphylococcus
TRAKRPFEKSDIELIEKN

SEQ ID NO: 2042393 - protein, 21 aa, Staphylococcus
TRAREKVTFSYSLMGNSGDEK

SEQ ID NO: 2042394 - protein, 19 aa, Staphylococcus
TRAVFKIGGVGLAFKKGKF

SEQ ID NO: 2042395 - protein, 24 aa, Staphylococcus
TRDELFEQFRLMISPLVEADKLAM

SEQ ID NO: 2042396 - protein, 18 aa, Staphylococcus
TRDGEKLLQYALKRESIE

SEQ ID NO: 2042397 - protein, 21 aa, Staphylococcus
TRDLLIRFEKINKIYDVTIIM

SEQ ID NO: 2042398 - protein, 17 aa, Staphylococcus
TRDPEYRTTPSGVSVAT

SEQ ID NO: 2042399 - protein, 23 aa, Staphylococcus
TRDQQKAFVLRQFKHLGLDQPES

SEQ ID NO: 2042400 - protein, 22 aa, Staphylococcus
TRDTIKYELERIVQGIATSFDV

SEQ ID NO: 2042401 - protein, 21 aa, Staphylococcus
TREAFFKYSRLIKKYNPNIKI

SEQ ID NO: 2042402 - protein, 22 aa, Staphylococcus
TREAKMIISCIARMKQQESYSV

SEQ ID NO: 2042403 - protein, 22 aa, Staphylococcus
TREAKMIISCVARMRQQESYSV

SEQ ID NO: 2042404 - protein, 18 aa, Staphylococcus
TREKFIFENGEWADHLVY

SEQ ID NO: 2042405 - protein, 18 aa, Staphylococcus
TRELAMQVAEQLKVFSKG

SEQ ID NO: 2042406 - protein, 17 aa, Staphylococcus
TRELAMQVAEQLRAFSR

SEQ ID NO: 2042407 - protein, 17 aa, Staphylococcus
TRELAMQVAEQLREFSK

SEQ ID NO: 2042408 - protein, 20 aa, Staphylococcus
TRELDCYFYELFQSKTSVSF

SEQ ID NO: 2042409 - protein, 25 aa, Staphylococcus
TRELSRLYVYAHHKGLKSLYYTRNK

SEQ ID NO: 2042410 - protein, 17 aa, Staphylococcus
TREQIMFILFGKGRNGK

SEQ ID NO: 2042411 - protein, 25 aa, Staphylococcus
TRESDGFKDIRDVLGDVYENAELLD

SEQ ID NO: 2042412 - protein, 25 aa, Staphylococcus
TREYIPVLMFSPKIDAYHELSGDTT

SEQ ID NO: 2042413 - protein, 26 aa, Staphylococcus
TREYIPVLMFSPKIDKYHELSGDSTF

SEQ ID NO: 2042414 - protein, 25 aa, Staphylococcus
TREYIPVLMFSPKIKQYHELPGDTT

SEQ ID NO: 2042415 - protein, 24 aa, Staphylococcus
TREYIPVLMFSPKINQYHELSQDT

SEQ ID NO: 2042416 - protein, 18 aa, Staphylococcus
TRFDMELIDVSKLGTEMD

SEQ ID NO: 2042417 - protein, 18 aa, Staphylococcus
TRFIRASATFSQSGATVV

SEQ ID NO: 2042418 - protein, 18 aa, Staphylococcus
TRFKRVEYKEGFSMCEVT

SEQ ID NO: 2042419 - protein, 25 aa, Staphylococcus
TRFLLKDIQSAYLIGQQSKFGDVSS

SEQ ID NO: 2042420 - protein, 22 aa, Staphylococcus
TRGAEFDFTFIYNVIDETQVED

SEQ ID NO: 2042421 - protein, 18 aa, Staphylococcus
TRGFKAGHTVDVILTESN

SEQ ID NO: 2042422 - protein, 22 aa, Staphylococcus
TRGFKAGHTVNVILTESNVYET

SEQ ID NO: 2042423 - protein, 19 aa, Staphylococcus
TRGISPILMKTEVDYKVPV

SEQ ID NO: 2042424 - protein, 19 aa, Staphylococcus
TRGMIKRLITSIITASPAT

SEQ ID NO: 2042425 - protein, 18 aa, Staphylococcus
TRHLIKKYQESFFTFPAA

SEQ ID NO: 2042426 - protein, 26 aa, Staphylococcus
TRHLIRKHQEAFFTFPAASTHHHNFA

SEQ ID NO: 2042427 - protein, 24 aa, Staphylococcus
TRIHLKPTQLIGGYAQISYHFNYY

SEQ ID NO: 2042428 - protein, 19 aa, Staphylococcus
TRIIDCIETAHTRLTLLSK

SEQ ID NO: 2042429 - protein, 17 aa, Staphylococcus
TRIITSPAFNGEKILGA

SEQ ID NO: 2042430 - protein, 19 aa, Staphylococcus
TRIKGGVQLELTKSLRKQF

SEQ ID NO: 2042431 - protein, 24 aa, Staphylococcus
TRILEIGTAIGYSAMQFASVSDDI

SEQ ID NO: 2042432 - protein, 23 aa, Staphylococcus
TRIMDLITPIGLGQRGLIVAPPK

SEQ ID NO: 2042433 - protein, 21 aa, Staphylococcus
TRIQLSDDVLTEFEKIRRGDH

SEQ ID NO: 2042434 - protein, 17 aa, Staphylococcus
TRIRGHSTYLKRKDSDE

SEQ ID NO: 2042435 - protein, 17 aa, Staphylococcus
TRISRIYAELGVKKIRI

SEQ ID NO: 2042436 - protein, 24 aa, Staphylococcus
TRITRHFYFPPVMADITMWSDQHH

SEQ ID NO: 2042437 - protein, 17 aa, Staphylococcus
TRKAEVLYEELAHHKLT

SEQ ID NO: 2042438 - protein, 21 aa, Staphylococcus
TRKDIDALTEFVNIYGAKGLA

SEQ ID NO: 2042439 - protein, 22 aa, Staphylococcus
TRKFTEVFNVPKKVLNQDLSNL

SEQ ID NO: 2042440 - protein, 20 aa, Staphylococcus
TRKHFTGLIIAGKMHSAGVD

SEQ ID NO: 2042441 - protein, 24 aa, Staphylococcus
TRKIREVSNTPILFLSSRDNPMDQ

SEQ ID NO: 2042442 - protein, 22 aa, Staphylococcus
TRKIRQHGVLRAGFTDNKADIE

SEQ ID NO: 2042443 - protein, 30 aa, Staphylococcus
TRKKSGLSYKEKREYEALLERIDQTETRLV

SEQ ID NO: 2042444 - protein, 25 aa, Staphylococcus
TRKLGIEVGDFISLDPRTEITENDF

SEQ ID NO: 2042445 - protein, 21 aa, Staphylococcus
TRKLKELFVAHKVEKQYDKNQ

SEQ ID NO: 2042446 - protein, 29 aa, Staphylococcus
TRKRIEQAPKLKLAITAGVGSDHVDLEAA

SEQ ID NO: 2042447 - protein, 22 aa, Staphylococcus
TRKVILRRAAQFLLEGDVISIG

SEQ ID NO: 2042448 - protein, 19 aa, Staphylococcus
TRLKCFSLGAKDYIAKPFY

SEQ ID NO: 2042449 - protein, 18 aa, Staphylococcus
TRLKTMGKLAMLMLEDLN

SEQ ID NO: 2042450 - protein, 17 aa, Staphylococcus
TRLKTMGKLAMLMLQDL

SEQ ID NO: 2042451 - protein, 24 aa, Staphylococcus
TRLLAGLLSGLGIECVLSGDTSIG

SEQ ID NO: 2042452 - protein, 24 aa, Staphylococcus
TRLLAGLLSGLGIESVLSGDVSIG

SEQ ID NO: 2042453 - protein, 20 aa, Staphylococcus
TRLLEEGKQVAIAEGITLPD

SEQ ID NO: 2042454 - protein, 20 aa, Staphylococcus
TRLSNELLLNLDAKYTQFIA

SEQ ID NO: 2042455 - protein, 24 aa, Staphylococcus
TRLVAGLLCGLGIETVLSGDESIG

SEQ ID NO: 2042456 - protein, 21 aa, Staphylococcus
TRLYVKPVLAVKEQVKLYAMT

SEQ ID NO: 2042457 - protein, 17 aa, Staphylococcus
TRMAYSVLREDHYRVIG

SEQ ID NO: 2042458 - protein, 18 aa, Staphylococcus
TRMKAWENQHEFIGNVRG

SEQ ID NO: 2042459 - protein, 19 aa, Staphylococcus
TRNALKLKSFFNSNVPVHR

SEQ ID NO: 2042460 - protein, 18 aa, Staphylococcus
TRNDVIVDIMFLEATTEK

SEQ ID NO: 2042461 - protein, 17 aa, Staphylococcus
TRNGIKYTPRGMGVIAK

SEQ ID NO: 2042462 - protein, 23 aa, Staphylococcus
TRNINRIILMFSLTNHLEITING

SEQ ID NO: 2042463 - protein, 21 aa, Staphylococcus
TRPDTIFGTSFLVLSPEHALV

SEQ ID NO: 2042464 - protein, 21 aa, Staphylococcus
TRPDTIFGTSFLVLSPEHSLV

SEQ ID NO: 2042465 - protein, 23 aa, Staphylococcus
TRPEAIKMAPLVKAIENDNQLEV

SEQ ID NO: 2042466 - protein, 23 aa, Staphylococcus
TRPEAIKMAPLVKALEKDAELEP

SEQ ID NO: 2042467 - protein, 21 aa, Staphylococcus
TRPEITEVYYPGNDEINKKQA

SEQ ID NO: 2042468 - protein, 19 aa, Staphylococcus
TRPTISLLMPMSEAHSTLR

SEQ ID NO: 2042469 - protein, 21 aa, Staphylococcus
TRPTPNHILVPLILETLSHVP

SEQ ID NO: 2042470 - protein, 22 aa, Staphylococcus
TRPTPNHILVPLLIEELNHVPR

SEQ ID NO: 2042471 - protein, 22 aa, Staphylococcus
TRQAGKELVDFQALADEGVFAF

SEQ ID NO: 2042472 - protein, 27 aa, Staphylococcus
TRQGIWKLIKQYGLRANINKTLTPHTL

SEQ ID NO: 2042473 - protein, 21 aa, Staphylococcus
TRQKLQLVIQLVDLRHNPTED

SEQ ID NO: 2042474 - protein, 26 aa, Staphylococcus
TRQLFKDLGWKTVVGFQTRNPVHRAH

SEQ ID NO: 2042475 - protein, 21 aa, Staphylococcus
TRQLVDLSGTWKFKLVQHQEE

SEQ ID NO: 2042476 - protein, 19 aa, Staphylococcus
TRQLWNMLVLARVITIGAY

SEQ ID NO: 2042477 - protein, 18 aa, Staphylococcus
TRQMILNFAHYRFTPLKN

SEQ ID NO: 2042478 - protein, 17 aa, Staphylococcus
TRQSIAKDLSMLGSNAN

SEQ ID NO: 2042479 - protein, 19 aa, Staphylococcus
TRQSIAKDLSRLGANANQI

SEQ ID NO: 2042480 - protein, 18 aa, Staphylococcus
TRRILEILEDYHISFDHM

SEQ ID NO: 2042481 - protein, 17 aa, Staphylococcus
TRRLMMRVADQLVHKIG

SEQ ID NO: 2042482 - protein, 18 aa, Staphylococcus
TRRMMMRVADKVVHDIDA

SEQ ID NO: 2042483 - protein, 17 aa, Staphylococcus
TRRRKRAYEMLPVVMDY

SEQ ID NO: 2042484 - protein, 18 aa, Staphylococcus
TRSGKIMRRVLKAWELDL

SEQ ID NO: 2042485 - protein, 18 aa, Staphylococcus
TRSGKIMRRVLKAWELNL

SEQ ID NO: 2042486 - protein, 25 aa, Staphylococcus
TRSKLRKALPEQFVYIIEELLYKNN

SEQ ID NO: 2042487 - protein, 25 aa, Staphylococcus
TRSKLRKALPEQFVYIIEELLYKSN

SEQ ID NO: 2042488 - protein, 21 aa, Staphylococcus
TRSKLRKALPKEYTYIVEELL

SEQ ID NO: 2042489 - protein, 27 aa, Staphylococcus
TRSKLRKALPKQFVFIIEELLYKNNGL

SEQ ID NO: 2042490 - protein, 25 aa, Staphylococcus
TRSKLRKALPTQYVYIVEELLYKSN

SEQ ID NO: 2042491 - protein, 19 aa, Staphylococcus
TRSSLGMAYQTTRASYQIC

SEQ ID NO: 2042492 - protein, 28 aa, Staphylococcus
TRSVALSRFPWLSANIEYIKTKEPYFST

SEQ ID NO: 2042493 - protein, 21 aa, Staphylococcus
TRSVLSYVLERTMRMLHPYMP

SEQ ID NO: 2042494 - protein, 23 aa, Staphylococcus
TRSVRFPGLISHIKEPGGGTTDY

SEQ ID NO: 2042495 - protein, 21 aa, Staphylococcus
TRSVRFPGLISHVKEPGGGTT

SEQ ID NO: 2042496 - protein, 20 aa, Staphylococcus
TRSVRFPGLISYVKEPGGGT

SEQ ID NO: 2042497 - protein, 20 aa, Staphylococcus
TRTANISSLSFAPDYLPEEL

SEQ ID NO: 2042498 - protein, 20 aa, Staphylococcus
TRTDLDFLVKCVQTAVDAGA

SEQ ID NO: 2042499 - protein, 20 aa, Staphylococcus
TRTDMDFLIKSVQTAVDAGA

SEQ ID NO: 2042500 - protein, 26 aa, Staphylococcus
TRTDTDFLIKCVQMAVDCGATIINIP

SEQ ID NO: 2042501 - protein, 22 aa, Staphylococcus
TRTEIPFLIDCVQTAIDAGATI

SEQ ID NO: 2042502 - protein, 21 aa, Staphylococcus
TRTELPFLIECVQTAVDAGAS

SEQ ID NO: 2042503 - protein, 23 aa, Staphylococcus
TRTHKGKRMRIQTDVLRANASSK

SEQ ID NO: 2042504 - protein, 22 aa, Staphylococcus
TRTKALLNQYGFNFKKSLGQNF

SEQ ID NO: 2042505 - protein, 19 aa, Staphylococcus
TRTKIQLLAPVISHRKGSH

SEQ ID NO: 2042506 - protein, 21 aa, Staphylococcus
TRTKYNGSFIYNATIDHHKGQ

SEQ ID NO: 2042507 - protein, 19 aa, Staphylococcus
TRTLIRVQIDDEVRSSKRV

SEQ ID NO: 2042508 - protein, 17 aa, Staphylococcus
TRTLIRVQIEDEMRSSK

SEQ ID NO: 2042509 - protein, 25 aa, Staphylococcus
TRTLRYYHEIGLLIPSIIAENGYRY

SEQ ID NO: 2042510 - protein, 26 aa, Staphylococcus
TRTPIRLDRHFPDWHETYQEVEKRNR

SEQ ID NO: 2042511 - protein, 19 aa, Staphylococcus
TRTQMGGFYGRTLKKKDSI

SEQ ID NO: 2042512 - protein, 23 aa, Staphylococcus
TRTYNNLVNLEWIYKERPQDDER

SEQ ID NO: 2042513 - protein, 27 aa, Staphylococcus
TRVAKLLKRFIALNAFDNVEAHGNGTY

SEQ ID NO: 2042514 - protein, 23 aa, Staphylococcus
TRVATEIQFLLAQYVFENLGYRR

SEQ ID NO: 2042515 - protein, 20 aa, Staphylococcus
TRVGHKFVDGKKVRIAKKSG

SEQ ID NO: 2042516 - protein, 20 aa, Staphylococcus
TRVGYKFVDGKKIRIAKKSG

SEQ ID NO: 2042517 - protein, 17 aa, Staphylococcus
TRVKNLDLMTAGPTPPN

SEQ ID NO: 2042518 - protein, 23 aa, Staphylococcus
TRVLDGLSYRESHFALELLHESN

SEQ ID NO: 2042519 - protein, 20 aa, Staphylococcus
TRVLDKFNSLTFISGTLTFN

SEQ ID NO: 2042520 - protein, 21 aa, Staphylococcus
TRVMGGLSYRESHFALELLNE

SEQ ID NO: 2042521 - protein, 24 aa, Staphylococcus
TRVQFRILNMDGIYINSPKDRLIT

SEQ ID NO: 2042522 - protein, 20 aa, Staphylococcus
TRVVPELNKSITTQMLPAEI

SEQ ID NO: 2042523 - protein, 18 aa, Staphylococcus
TRYLELLQNFKINVLCCT

SEQ ID NO: 2042524 - protein, 21 aa, Staphylococcus
TSADLILYVSYFNHSFTDNDK

SEQ ID NO: 2042525 - protein, 24 aa, Staphylococcus
TSANEKYDLFVLVVTDIINSDSKI

SEQ ID NO: 2042526 - protein, 25 aa, Staphylococcus
TSANEKYDLFVLVVTDIINSDSKIL

SEQ ID NO: 2042527 - protein, 22 aa, Staphylococcus
TSARLHPWLLKIYEKRGYEVYA

SEQ ID NO: 2042528 - protein, 23 aa, Staphylococcus
TSAWPEVEEAYMFEESKQAMQYV

SEQ ID NO: 2042529 - protein, 19 aa, Staphylococcus
TSDEYPEIVFAGNHLSSTY

SEQ ID NO: 2042530 - protein, 21 aa, Staphylococcus
TSDGIDCFLGIPYAHAPIGSM

SEQ ID NO: 2042531 - protein, 26 aa, Staphylococcus
TSDLIARFAGIRVPRNKAIVGQNAFS

SEQ ID NO: 2042532 - protein, 26 aa, Staphylococcus
TSDLLEPAFLVYWFQLAPEVHSQYKQ

SEQ ID NO: 2042533 - protein, 25 aa, Staphylococcus
TSDLWQRLIKLWKDQTVLIVEHKVE

SEQ ID NO: 2042534 - protein, 25 aa, Staphylococcus
TSEEIPHAIGVNVDRMIKENDERVR

SEQ ID NO: 2042535 - protein, 25 aa, Staphylococcus
TSEEIPHAIGVNVDRMIKENEDRVR

SEQ ID NO: 2042536 - protein, 25 aa, Staphylococcus
TSEEIPHAIGVNVDRMIKESEERVR

SEQ ID NO: 2042537 - protein, 23 aa, Staphylococcus
TSEINVKIGHEIDKGLSDISIIT

SEQ ID NO: 2042538 - protein, 29 aa, Staphylococcus
TSEKNAMGWYLDGRASAVVGTHTHIQTSD

SEQ ID NO: 2042539 - protein, 30 aa, Staphylococcus
TSEKNAMGWYLDGRASAVVGTHTHIQTSDE

SEQ ID NO: 2042540 - protein, 29 aa, Staphylococcus
TSEKNAMGWYLDGRVSAIVGTHTHIQTSD

SEQ ID NO: 2042541 - protein, 29 aa, Staphylococcus
TSEKNAMGWYLDGRVSAVVGTHTHIQTAD

SEQ ID NO: 2042542 - protein, 32 aa, Staphylococcus
TSELISRYAGIRVPRNKAIVGQNAFSHESGIH

SEQ ID NO: 2042543 - protein, 18 aa, Staphylococcus
TSELKSVIVGTGDQKINL

SEQ ID NO: 2042544 - protein, 24 aa, Staphylococcus
TSELRKGRQAYVICPLIESSEHLE

SEQ ID NO: 2042545 - protein, 24 aa, Staphylococcus
TSENLDLFFSYRIEKGQTGRMLAF

SEQ ID NO: 2042546 - protein, 23 aa, Staphylococcus
TSENLDLFFSYRVEKSKTGRMLA

SEQ ID NO: 2042547 - protein, 23 aa, Staphylococcus
TSENLDYFFSYRVEKGQTGRMLA

SEQ ID NO: 2042548 - protein, 23 aa, Staphylococcus
TSEPMKYRRMYGQYGGNITHTAM

SEQ ID NO: 2042549 - protein, 25 aa, Staphylococcus
TSETRPVLTGVNWLIQENELICTAT

SEQ ID NO: 2042550 - protein, 17 aa, Staphylococcus
TSFGFKHGIQMDADLVF

SEQ ID NO: 2042551 - protein, 18 aa, Staphylococcus
TSFMLRNQFYTDKVSYQI

SEQ ID NO: 2042552 - protein, 22 aa, Staphylococcus
TSFNKDRIVVELNDAVYHSFKK

SEQ ID NO: 2042553 - protein, 31 aa, Staphylococcus
TSFPRLIKVKELYKLFCQLYKDAISIDEFKK

SEQ ID NO: 2042554 - protein, 23 aa, Staphylococcus
TSFRDLGRRVVLYQHKIAEQLDV

SEQ ID NO: 2042555 - protein, 26 aa, Staphylococcus
TSFYKKWRPYVMQRHRAHYELSDISK

SEQ ID NO: 2042556 - protein, 17 aa, Staphylococcus
TSGAFGFVVANNASISG

SEQ ID NO: 2042557 - protein, 25 aa, Staphylococcus
TSGEQRLSNFLIWQASYSEFIFNEK

SEQ ID NO: 2042558 - protein, 21 aa, Staphylococcus
TSGKTGFYFRVLQEGYVDQDD

SEQ ID NO: 2042559 - protein, 25 aa, Staphylococcus
TSGMAKSRRKTLEKIQRIDKPMIDA

SEQ ID NO: 2042560 - protein, 24 aa, Staphylococcus
TSGMAKSRRKTLEKMERIDKPMID

SEQ ID NO: 2042561 - protein, 24 aa, Staphylococcus
TSGMAKSRRKTLEKMERIDKPMMD

SEQ ID NO: 2042562 - protein, 28 aa, Staphylococcus
TSGWTDIFIYPGFEFKAIDALITNFHLP

SEQ ID NO: 2042563 - protein, 27 aa, Staphylococcus
TSGWTDIFIYPGFEYKAIDGLITNFHL

SEQ ID NO: 2042564 - protein, 24 aa, Staphylococcus
TSGWTGDVKYHLGGVKTTQSYGSE

SEQ ID NO: 2042565 - protein, 20 aa, Staphylococcus
TSHAKTLFSTHYHELTTLDQ

SEQ ID NO: 2042566 - protein, 32 aa, Staphylococcus
TSHALGLKADNGLELLLHIGLDTVQLNGEGFK

SEQ ID NO: 2042567 - protein, 17 aa, Staphylococcus
TSHFRDPKVFKHHEEYY

SEQ ID NO: 2042568 - protein, 23 aa, Staphylococcus
TSHKLSPISRSFYRSNVGGKAQP

SEQ ID NO: 2042569 - protein, 19 aa, Staphylococcus
TSIAEIFGLQSRQSIYEFN

SEQ ID NO: 2042570 - protein, 18 aa, Staphylococcus
TSIATMIHHIYRKLGKGS

SEQ ID NO: 2042571 - protein, 21 aa, Staphylococcus
TSIEGIDFRSMTVIAHKGKEG

SEQ ID NO: 2042572 - protein, 17 aa, Staphylococcus
TSIEKGKEMTFEANVVV

SEQ ID NO: 2042573 - protein, 17 aa, Staphylococcus
TSIGLAMYDRLAGVKKA

SEQ ID NO: 2042574 - protein, 17 aa, Staphylococcus
TSIGLAMYDRLAGVKKS

SEQ ID NO: 2042575 - protein, 25 aa, Staphylococcus
TSIKFEVSEFNTALDYLTEHFNVLQ

SEQ ID NO: 2042576 - protein, 17 aa, Staphylococcus
TSILPGMVDTPMTERSD

SEQ ID NO: 2042577 - protein, 24 aa, Staphylococcus
TSILRRWVDQYLKYGSKGLDKKLK

SEQ ID NO: 2042578 - protein, 19 aa, Staphylococcus
TSINKFGLDISVSKTIYNK

SEQ ID NO: 2042579 - protein, 17 aa, Staphylococcus
TSINVKIGHEIESSLSD

SEQ ID NO: 2042580 - protein, 30 aa, Staphylococcus
TSKDTFDWLQPLLKRKFPHHHFEFTYIDIE

SEQ ID NO: 2042581 - protein, 17 aa, Staphylococcus
TSKEERADYLLEISRRI

SEQ ID NO: 2042582 - protein, 21 aa, Staphylococcus
TSKEIMALFGSLNKAQQTTLI

SEQ ID NO: 2042583 - protein, 17 aa, Staphylococcus
TSKEVRHVLDWKNKGGC

SEQ ID NO: 2042584 - protein, 20 aa, Staphylococcus
TSKFKQYGMPQVISQAKPEA

SEQ ID NO: 2042585 - protein, 18 aa, Staphylococcus
TSKIVAPIMRAGDSIIER

SEQ ID NO: 2042586 - protein, 26 aa, Staphylococcus
TSKKSGPWLKEVLRQIEIDVLTNKVP

SEQ ID NO: 2042587 - protein, 23 aa, Staphylococcus
TSKLWRKTINEISHEFPDVKVNH

SEQ ID NO: 2042588 - protein, 26 aa, Staphylococcus
TSKMIKEGICQLEIKLDTGRTHQIRV

SEQ ID NO: 2042589 - protein, 17 aa, Staphylococcus
TSKPLRYTVKGNPYVSR

SEQ ID NO: 2042590 - protein, 21 aa, Staphylococcus
TSKRIVKMLKDSGANEVHVRI

SEQ ID NO: 2042591 - protein, 17 aa, Staphylococcus
TSKSFIHHPRLGYIYLT

SEQ ID NO: 2042592 - protein, 19 aa, Staphylococcus
TSKSLVALIQKGHEVVISH

SEQ ID NO: 2042593 - protein, 20 aa, Staphylococcus
TSKYPIKNEDIIAFKNGIEL

SEQ ID NO: 2042594 - protein, 20 aa, Staphylococcus
TSLAPRKHVDVLLNESEITV

SEQ ID NO: 2042595 - protein, 23 aa, Staphylococcus
TSLDQMLPCLKNVHVAADEYQGE

SEQ ID NO: 2042596 - protein, 18 aa, Staphylococcus
TSLGRAYEKTAISGFKYY

SEQ ID NO: 2042597 - protein, 17 aa, Staphylococcus
TSLIARGVTFYENCALN

SEQ ID NO: 2042598 - protein, 28 aa, Staphylococcus
TSLKVGDRVSIAWLFESCGHCEYCTTGR

SEQ ID NO: 2042599 - protein, 21 aa, Staphylococcus
TSLLDADFGYAIDASVEVGTT

SEQ ID NO: 2042600 - protein, 17 aa, Staphylococcus
TSLLFNIIPERFQGRDI

SEQ ID NO: 2042601 - protein, 17 aa, Staphylococcus
TSLLFNIIPERFQGRTV

SEQ ID NO: 2042602 - protein, 17 aa, Staphylococcus
TSLLFNIIPQRFQGREV

SEQ ID NO: 2042603 - protein, 24 aa, Staphylococcus
TSLLPEYRFEKSIDNLDESLRPTV

SEQ ID NO: 2042604 - protein, 22 aa, Staphylococcus
TSLPNNKKWLGIGLRVLPKTIR

SEQ ID NO: 2042605 - protein, 21 aa, Staphylococcus
TSLQLSKLSLRQQLAYLGELC

SEQ ID NO: 2042606 - protein, 20 aa, Staphylococcus
TSLRIALSLFDLIQNDQSIY

SEQ ID NO: 2042607 - protein, 23 aa, Staphylococcus
TSLRLNDIGFIFQSSHLVPYLTV

SEQ ID NO: 2042608 - protein, 18 aa, Staphylococcus
TSLRVLDQSFLKAGLDKQ

SEQ ID NO: 2042609 - protein, 21 aa, Staphylococcus
TSLSGGETFQASLALALGLSE

SEQ ID NO: 2042610 - protein, 24 aa, Staphylococcus
TSLVRRLNLLANRNITKETHASFL

SEQ ID NO: 2042611 - protein, 19 aa, Staphylococcus
TSLYLKPDIAVITGIGAAH

SEQ ID NO: 2042612 - protein, 18 aa, Staphylococcus
TSMKRAGADMIITYFSKD

SEQ ID NO: 2042613 - protein, 19 aa, Staphylococcus
TSNGLPFHIKKGLEQVHTL

SEQ ID NO: 2042614 - protein, 22 aa, Staphylococcus
TSNLPFRIRKPLPNITFHQVEV

SEQ ID NO: 2042615 - protein, 20 aa, Staphylococcus
TSNMLYHMFNHYHGDQFGKG

SEQ ID NO: 2042616 - protein, 24 aa, Staphylococcus
TSNRKLRRGLIFYGTANNGKSVYI

SEQ ID NO: 2042617 - protein, 20 aa, Staphylococcus
TSNSKLTWDFSFITQAIDEV

SEQ ID NO: 2042618 - protein, 18 aa, Staphylococcus
TSNVKRQYPFENVDENAI

SEQ ID NO: 2042619 - protein, 19 aa, Staphylococcus
TSPDYFTLNGYDILMFTAQ

SEQ ID NO: 2042620 - protein, 17 aa, Staphylococcus
TSPEILIMYLLDHTKQM

SEQ ID NO: 2042621 - protein, 19 aa, Staphylococcus
TSPGFAQCINYFIDRMNIN

SEQ ID NO: 2042622 - protein, 26 aa, Staphylococcus
TSPIRRYPDLIVHRLIRKYIIEQSMD

SEQ ID NO: 2042623 - protein, 25 aa, Staphylococcus
TSPKQLKSLLLLHGLSSDETTYVRY

SEQ ID NO: 2042624 - protein, 17 aa, Staphylococcus
TSQEFKGFMTGNIIKYA

SEQ ID NO: 2042625 - protein, 26 aa, Staphylococcus
TSQEIKSLIDLFLIWSKEVLLKSDIC

SEQ ID NO: 2042626 - protein, 23 aa, Staphylococcus
TSQLSIALAYGFLDINEIMRQLL

SEQ ID NO: 2042627 - protein, 19 aa, Staphylococcus
TSREGFLLAQDISSYSLTI

SEQ ID NO: 2042628 - protein, 18 aa, Staphylococcus
TSRFNKPLVAMKVKDDDE

SEQ ID NO: 2042629 - protein, 19 aa, Staphylococcus
TSRFYQYWLDNVEPDLKEI

SEQ ID NO: 2042630 - protein, 19 aa, Staphylococcus
TSRFYQYWLNHVDEDIASV

SEQ ID NO: 2042631 - protein, 24 aa, Staphylococcus
TSRLLATRLEQVFSEIERITQASV

SEQ ID NO: 2042632 - protein, 22 aa, Staphylococcus
TSRSIPIFIFLNDNYEQETVWG

SEQ ID NO: 2042633 - protein, 20 aa, Staphylococcus
TSRVYLAIGGGFKLDEWLGS

SEQ ID NO: 2042634 - protein, 31 aa, Staphylococcus
TSRVYLAIGGGFKLDNWLGSNSTDLNVHIGG

SEQ ID NO: 2042635 - protein, 21 aa, Staphylococcus
TSSDLILYVSYFNHSFTENDK

SEQ ID NO: 2042636 - protein, 24 aa, Staphylococcus
TSSDWKVGDKVTHKAWGEGMVSNV

SEQ ID NO: 2042637 - protein, 24 aa, Staphylococcus
TSSFSSMLFAIYILFGGKYNASFF

SEQ ID NO: 2042638 - protein, 28 aa, Staphylococcus
TSSGRSPSELGFRYYVNQLLEQTSHQNS

SEQ ID NO: 2042639 - protein, 30 aa, Staphylococcus; identical to SEQ ID NO: 1813766

SEQ ID NO: 2042640 - protein, 20 aa, Staphylococcus
TSSLRKELFVNNKSSRKSRE

SEQ ID NO: 2042641 - protein, 35 aa, Staphylococcus
TSSLRRGAQILAKYPKLQIKWIRGNIDTRLNKLET

SEQ ID NO: 2042642 - protein, 21 aa, Staphylococcus
TSSLRRGAQILAKYPNLEIKW

SEQ ID NO: 2042643 - protein, 20 aa, Staphylococcus
TSTPVLRPLLTLDKEDIIKK

SEQ ID NO: 2042644 - protein, 20 aa, Staphylococcus
TSTPVLRPLLTLDKEEIVKM

SEQ ID NO: 2042645 - protein, 24 aa, Staphylococcus
TSTRRMMMRIADKVVHNIGADAIV

SEQ ID NO: 2042646 - protein, 25 aa, Staphylococcus
TSVSICGMGGPLIAKILNEGTEKLE

SEQ ID NO: 2042647 - protein, 25 aa, Staphylococcus
TSYDPHVWLDPILDQQFAKKIKDDL

SEQ ID NO: 2042648 - protein, 17 aa, Staphylococcus
TSYGLSKIRAEEMLDEI

SEQ ID NO: 2042649 - protein, 22 aa, Staphylococcus
TSYNYRFGIKIYGNGKDSILTR

SEQ ID NO: 2042650 - protein, 26 aa, Staphylococcus
TSYRTHKGFHMLKFEGIDNINDIEYL

SEQ ID NO: 2042651 - protein, 22 aa, Staphylococcus
TSYTHPFLKELRSMKRQISIFN

SEQ ID NO: 2042652 - protein, 18 aa, Staphylococcus
TTADMLGLLGFDIQPTAD

SEQ ID NO: 2042653 - protein, 22 aa, Staphylococcus
TTADMLGLLGFELQPTDDGLII

SEQ ID NO: 2042654 - protein, 22 aa, Staphylococcus
TTAELGFTLMLTVARRIIEAER

SEQ ID NO: 2042655 - protein, 22 aa, Staphylococcus
TTAELGFTLMLTVARRIVEAEK

SEQ ID NO: 2042656 - protein, 20 aa, Staphylococcus
TTAIKCLLGMEKLDAGEALI

SEQ ID NO: 2042657 - protein, 18 aa, Staphylococcus
TTAKKFYSLYSENQNIID

SEQ ID NO: 2042658 - protein, 17 aa, Staphylococcus
TTALRMINRMIEATDGQ

SEQ ID NO: 2042659 - protein, 17 aa, Staphylococcus
TTALRMINRMIEATSGQ

SEQ ID NO: 2042660 - protein, 17 aa, Staphylococcus
TTALRMINRMIEPTEGS

SEQ ID NO: 2042661 - protein, 27 aa, Staphylococcus
TTANALKLKRFFSSTVPVHRGSSQPLL

SEQ ID NO: 2042662 - protein, 23 aa, Staphylococcus
TTARYGDFGSFFVGHVLPEETLE

SEQ ID NO: 2042663 - protein, 17 aa, Staphylococcus
TTASWQGHRVNIIDTPG

SEQ ID NO: 2042664 - protein, 24 aa, Staphylococcus
TTCKKAAKFLDEYGVSYEPIDIVE

SEQ ID NO: 2042665 - protein, 27 aa, Staphylococcus
TTCKKAAKFLKDYGVSFEPIDIVQHTP

SEQ ID NO: 2042666 - protein, 28 aa, Staphylococcus
TTCKKAAKFLNEYGVSYEPIDIVQHTPT

SEQ ID NO: 2042667 - protein, 27 aa, Staphylococcus
TTCKKAAKFLQDYGVSFEPIDIVQHTP

SEQ ID NO: 2042668 - protein, 18 aa, Staphylococcus
TTDFLYQTEIKDWLDNGV

SEQ ID NO: 2042669 - protein, 20 aa, Staphylococcus
TTDISKPITITGAMRSSNEI

SEQ ID NO: 2042670 - protein, 17 aa, Staphylococcus
TTDKSAEELLDMDAKSF

SEQ ID NO: 2042671 - protein, 20 aa, Staphylococcus
TTDLLKCHYCGYQETPPNRC

SEQ ID NO: 2042672 - protein, 22 aa, Staphylococcus
TTDRVLLFAPFYTEAVQHDTQA

SEQ ID NO: 2042673 - protein, 19 aa, Staphylococcus
TTEACDFRDNIALFNELNA

SEQ ID NO: 2042674 - protein, 19 aa, Staphylococcus
TTEACDFRDNLAFFNDLDI

SEQ ID NO: 2042675 - protein, 22 aa, Staphylococcus
TTEIPRLINASLQERRPVHIHL

SEQ ID NO: 2042676 - protein, 21 aa, Staphylococcus
TTEIPRLIQAAINERRPVHLH

SEQ ID NO: 2042677 - protein, 18 aa, Staphylococcus
TTEIPRVINAAIHERRPV

SEQ ID NO: 2042678 - protein, 27 aa, Staphylococcus
TTELALLKCEMLLRMEQYLELREEAIV

SEQ ID NO: 2042679 - protein, 21 aa, Staphylococcus
TTELFLNVFGLETIEDLPTTE

SEQ ID NO: 2042680 - protein, 19 aa, Staphylococcus
TTFGIKMALWYTEMKRNLK

SEQ ID NO: 2042681 - protein, 20 aa, Staphylococcus
TTFYKAEAYHQDFYKKQPER

SEQ ID NO: 2042682 - protein, 18 aa, Staphylococcus
TTGHLMSMLMTLKGLPLA

SEQ ID NO: 2042683 - protein, 23 aa, Staphylococcus
TTGIPKERLIKFAHEVAKAESVA

SEQ ID NO: 2042684 - protein, 19 aa, Staphylococcus
TTHIYLLIEGNIMRENFNL

SEQ ID NO: 2042685 - protein, 25 aa, Staphylococcus
TTHSFRYTHCALLIEAGVHIKEIQE

SEQ ID NO: 2042686 - protein, 17 aa, Staphylococcus
TTICVSDPLKLLIQYQG

SEQ ID NO: 2042687 - protein, 18 aa, Staphylococcus
TTIFKLQQQFGYTKEDIN

SEQ ID NO: 2042688 - protein, 24 aa, Staphylococcus
TTIFKRAFRLENIYGGEFLEIGYP

SEQ ID NO: 2042689 - protein, 18 aa, Staphylococcus
TTIGEFAIQLLEGAPSEI

SEQ ID NO: 2042690 - protein, 19 aa, Staphylococcus
TTIHMKIIYDEDSHQILGG

SEQ ID NO: 2042691 - protein, 17 aa, Staphylococcus
TTIKCLMGMEKLDEGHA

SEQ ID NO: 2042692 - protein, 24 aa, Staphylococcus
TTILSDMLDGFVLANPENEVIADS

SEQ ID NO: 2042693 - protein, 21 aa, Staphylococcus
TTIPHAFGIKTERNKIVANDI

SEQ ID NO: 2042694 - protein, 24 aa, Staphylococcus
TTIRLKECGELLGIQVLDHIIIGD

SEQ ID NO: 2042695 - protein, 19 aa, Staphylococcus
TTIRVARAYTKRDKIIKFA

SEQ ID NO: 2042696 - protein, 17 aa, Staphylococcus
TTKATDIMKNWPTHKNN

SEQ ID NO: 2042697 - protein, 25 aa, Staphylococcus
TTKEAPVVISSRIRLARNLENHVHP

SEQ ID NO: 2042698 - protein, 25 aa, Staphylococcus
TTKGAWQKRRAEFIRYTEEIEEAKV

SEQ ID NO: 2042699 - protein, 23 aa, Staphylococcus
TTKRLSFDMSRFKEIIDYFEHAD

SEQ ID NO: 2042700 - protein, 23 aa, Staphylococcus
TTKVKEDFAFYGYLTDKNGGMIK

SEQ ID NO: 2042701 - protein, 18 aa, Staphylococcus
TTLATRENNAFIIDVHED

SEQ ID NO: 2042702 - protein, 23 aa, Staphylococcus
TTLDLKLAFGTNARLNFPSAHAK

SEQ ID NO: 2042703 - protein, 24 aa, Staphylococcus
TTLELPVTIGEDFSGLLDERPGVF

SEQ ID NO: 2042704 - protein, 17 aa, Staphylococcus
TTLKFTPMMNALGVENH

SEQ ID NO: 2042705 - protein, 21 aa, Staphylococcus
TTLKSIILPKVIEDLEDGAIH

SEQ ID NO: 2042706 - protein, 22 aa, Staphylococcus
TTLKSLTFHVACDEWLEHYKNH

SEQ ID NO: 2042707 - protein, 17 aa, Staphylococcus
TTLLRMINALELPTEGA

SEQ ID NO: 2042708 - protein, 20 aa, Staphylococcus
TTLLRTLNALAIPSKGQITI

SEQ ID NO: 2042709 - protein, 29 aa, Staphylococcus
TTLLTLKLAELFRASTIPAGLIQIVPGTG

SEQ ID NO: 2042710 - protein, 18 aa, Staphylococcus
TTLMKVILGFSHYQSGTY

SEQ ID NO: 2042711 - protein, 20 aa, Staphylococcus
TTLRRLMDLYGFKEALQQSD

SEQ ID NO: 2042712 - protein, 22 aa, Staphylococcus
TTLSGFVHWYLTGERVLGVGDA

SEQ ID NO: 2042713 - protein, 17 aa, Staphylococcus
TTLVLAPLVASVGVPVA

SEQ ID NO: 2042714 - protein, 21 aa, Staphylococcus
TTLVPRYIDRVVVLVNPDQTQ

SEQ ID NO: 2042715 - protein, 17 aa, Staphylococcus
TTPELVAAVSHQGGLGT

SEQ ID NO: 2042716 - protein, 34 aa, Staphylococcus
TTPLNIFYFTGYRSEPHERLFALLIKKNGEQILY

SEQ ID NO: 2042717 - protein, 33 aa, Staphylococcus
TTPLNIFYFTGYRSEPHERLFALLITSNGECTL

SEQ ID NO: 2042718 - protein, 33 aa, Staphylococcus
TTPLNVFYFTGYRSEPHERLFALLITANGDQTL

SEQ ID NO: 2042719 - protein, 22 aa, Staphylococcus
TTPRFYLNLNKYFDSLQQDSTP

SEQ ID NO: 2042720 - protein, 20 aa, Staphylococcus
TTPRGYAWQLEKALDAVSHD

SEQ ID NO: 2042721 - protein, 26 aa, Staphylococcus
TTQGYRPVMEIQFLGFVFEVFDEVAG

SEQ ID NO: 2042722 - protein, 26 aa, Staphylococcus
TTQGYRPVMEIQFLGFVFEVFDSVAG

SEQ ID NO: 2042723 - protein, 19 aa, Staphylococcus
TTQMLYHIFQHYRGEDFKE

SEQ ID NO: 2042724 - protein, 20 aa, Staphylococcus
TTQYIPHWERPEYIQHLTFN

SEQ ID NO: 2042725 - protein, 25 aa, Staphylococcus
TTRENLRLVIQLVDLRHNPTQDDIL

SEQ ID NO: 2042726 - protein, 18 aa, Staphylococcus
TTRLSEVEQYYKAYFGLK

SEQ ID NO: 2042727 - protein, 17 aa, Staphylococcus
TTRRNYIDFGIAMDNYW

SEQ ID NO: 2042728 - protein, 18 aa, Staphylococcus
TTRYAKYYKHNKIKDNYI

SEQ ID NO: 2042729 - protein, 17 aa, Staphylococcus
TTSEVHGVVSISYPLEK

SEQ ID NO: 2042730 - protein, 17 aa, Staphylococcus
TTTAMGRLFVTLVGAMA

SEQ ID NO: 2042731 - protein, 25 aa, Staphylococcus
TTTAVCGLARCKKSDIDAVYEATKC

SEQ ID NO: 2042732 - protein, 25 aa, Staphylococcus
TTTAVCGLARCKKSDIDAVYESTKL

SEQ ID NO: 2042733 - protein, 20 aa, Staphylococcus
TTTIGKLAYRYKMEGKKVML

SEQ ID NO: 2042734 - protein, 21 aa, Staphylococcus
TTTIGKLAYRYKMEGKKVMLA

SEQ ID NO: 2042735 - protein, 18 aa, Staphylococcus
TTTLAGFDGVLIPGGFSF

SEQ ID NO: 2042736 - protein, 24 aa, Staphylococcus
TTTLRLKECGAILGIDVLDHIIIG

SEQ ID NO: 2042737 - protein, 20 aa, Staphylococcus
TTTPVLRPLLTLDKEDIVIK

SEQ ID NO: 2042738 - protein, 25 aa, Staphylococcus
TTVCGLARCRKPDIDAVYEATKNAA

SEQ ID NO: 2042739 - protein, 24 aa, Staphylococcus
TTVGIPIQINTWFIVNDNDVYIID

SEQ ID NO: 2042740 - protein, 21 aa, Staphylococcus
TTVIIKFRVNDQLVDYEELNL

SEQ ID NO: 2042741 - protein, 19 aa, Staphylococcus
TTVIRLIMDLIQSKNGQIS

SEQ ID NO: 2042742 - protein, 17 aa, Staphylococcus
TTVKLFITYGDIEARGF

SEQ ID NO: 2042743 - protein, 17 aa, Staphylococcus
TTVKLFITYGDIESRGF

SEQ ID NO: 2042744 - protein, 18 aa, Staphylococcus
TTVNDLGVELVIDEALRE

SEQ ID NO: 2042745 - protein, 17 aa, Staphylococcus
TTVNDLGVELVIEEALR

SEQ ID NO: 2042746 - protein, 21 aa, Staphylococcus
TTVYFNIGGLWVALNEEVNVP

SEQ ID NO: 2042747 - protein, 21 aa, Staphylococcus
TTWSKRLWSNMDELRDDVQRI

SEQ ID NO: 2042748 - protein, 27 aa, Staphylococcus
TTYDLRGVAIFKEYFTREGEPLIYVNY

SEQ ID NO: 2042749 - protein, 22 aa, Staphylococcus
TTYRISIEEFVVLYKVYADTKI

SEQ ID NO: 2042750 - protein, 19 aa, Staphylococcus
TVANPFFGELIFELEKRLY

SEQ ID NO: 2042751 - protein, 27 aa, Staphylococcus
TVASCAHLLIWEGIELLPVTDNNKKAV

SEQ ID NO: 2042752 - protein, 23 aa, Staphylococcus
TVASEVMAILCLARNINDLKEKI

SEQ ID NO: 2042753 - protein, 26 aa, Staphylococcus
TVASYRMHKGFHMLTFEGIHNINDIE

SEQ ID NO: 2042754 - protein, 24 aa, Staphylococcus
TVDGNVFRVWSRINNDYSDIKLQS

SEQ ID NO: 2042755 - protein, 25 aa, Staphylococcus
TVDMSEVRTALYAIGPENDTGQRLE

SEQ ID NO: 2042756 - protein, 17 aa, Staphylococcus
TVDRKGLDWIKQELNDR

SEQ ID NO: 2042757 - protein, 21 aa, Staphylococcus
TVEAMKRMILNSITSAQTLSF

SEQ ID NO: 2042758 - protein, 20 aa, Staphylococcus
TVEDIRWLRCDIKSLNLLGN

SEQ ID NO: 2042759 - protein, 20 aa, Staphylococcus
TVEISEVFKQVHAPTLIIAG

SEQ ID NO: 2042760 - protein, 22 aa, Staphylococcus
TVEKPFEFRLANFDLDKDTNAL

SEQ ID NO: 2042761 - protein, 27 aa, Staphylococcus
TVERARRIQFFLSQNFHVAEQFTGQKG

SEQ ID NO: 2042762 - protein, 24 aa, Staphylococcus
TVERQEIYGVIGYSGAGKSTLIRM

SEQ ID NO: 2042763 - protein, 21 aa, Staphylococcus
TVEYPEVHFKPGLNGENVSVI

SEQ ID NO: 2042764 - protein, 23 aa, Staphylococcus
TVFKNVAMPLILSHKSNSEIKEK

SEQ ID NO: 2042765 - protein, 24 aa, Staphylococcus
TVFPNRVDLGLGRAPGTDMMTASA

SEQ ID NO: 2042766 - protein, 22 aa, Staphylococcus
TVFPPEHREVFINSRTTIFPIL

SEQ ID NO: 2042767 - protein, 17 aa, Staphylococcus
TVFQRYKDKVKYWMTFN

SEQ ID NO: 2042768 - protein, 17 aa, Staphylococcus
TVGFVFQNFKLIQNHTI

SEQ ID NO: 2042769 - protein, 24 aa, Staphylococcus
TVGIAISDLMGWTAQGLDTLRIDE

SEQ ID NO: 2042770 - protein, 24 aa, Staphylococcus
TVGIAISDLMGWTAQGLDTLRINE

SEQ ID NO: 2042771 - protein, 25 aa, Staphylococcus
TVGKFIRNGECSWKPYTQYDASPHI

SEQ ID NO: 2042772 - protein, 32 aa, Staphylococcus
TVGKGGLLITLARFSAFYGLGVDAKLDVTDAQ

SEQ ID NO: 2042773 - protein, 22 aa, Staphylococcus
TVGKGGLLLTLAKISAYYNLGL

SEQ ID NO: 2042774 - protein, 25 aa, Staphylococcus
TVGLMSVGLRPVWIIEDIKYRNGKL

SEQ ID NO: 2042775 - protein, 24 aa, Staphylococcus
TVGVAISDLMGWTAQGLDTLRINE

SEQ ID NO: 2042776 - protein, 23 aa, Staphylococcus
TVGVAVSDLMGWTAQGLDTLRIN

SEQ ID NO: 2042777 - protein, 24 aa, Staphylococcus
TVHKYSASFILKEYNYWKGDNNSK

SEQ ID NO: 2042778 - protein, 23 aa, Staphylococcus
TVHLWLNKDIEIHDFDADPGWLG

SEQ ID NO: 2042779 - protein, 18 aa, Staphylococcus
TVHNLKMIGHYIGMSFQI

SEQ ID NO: 2042780 - protein, 17 aa, Staphylococcus
TVIEGFGPRIIRINDFS

SEQ ID NO: 2042781 - protein, 18 aa, Staphylococcus
TVIHEWYMHTNFYTDRAF

SEQ ID NO: 2042782 - protein, 18 aa, Staphylococcus
TVIPSRNEGFGMVILEAM

SEQ ID NO: 2042783 - protein, 17 aa, Staphylococcus
TVIRFAPPLIISKEELD

SEQ ID NO: 2042784 - protein, 20 aa, Staphylococcus
TVIRLIMDLLQYDSGSISIL

SEQ ID NO: 2042785 - protein, 18 aa, Staphylococcus
TVITLEIAGKMLSSEGLA

SEQ ID NO: 2042786 - protein, 17 aa, Staphylococcus
TVIYNGKIVDLEIHDVE

SEQ ID NO: 2042787 - protein, 21 aa, Staphylococcus
TVKEGEPLLTIYSNQPDIFDV

SEQ ID NO: 2042788 - protein, 20 aa, Staphylococcus
TVKEYLDFIDSISIKNQSDI

SEQ ID NO: 2042789 - protein, 24 aa, Staphylococcus
TVKKRIGKQPMLMDFIRQNSVDPS

SEQ ID NO: 2042790 - protein, 21 aa, Staphylococcus
TVKKRLRAHLERYKVPMRWIK

SEQ ID NO: 2042791 - protein, 26 aa, Staphylococcus
TVKLVIPFERLKWFNPQTSLWQIDNG

SEQ ID NO: 2042792 - protein, 18 aa, Staphylococcus
TVKTHVSHIFSKLQVTDR

SEQ ID NO: 2042793 - protein, 26 aa, Staphylococcus
TVLDCTQFPFRIARPGSITQAMLNDV

SEQ ID NO: 2042794 - protein, 24 aa, Staphylococcus
TVLDCTQFPFRIARPGSITQTMLN

SEQ ID NO: 2042795 - protein, 17 aa, Staphylococcus
TVLGLNPHSVFNIGKRV

SEQ ID NO: 2042796 - protein, 20 aa, Staphylococcus
TVLHLADWLMEMQLDAKAGA

SEQ ID NO: 2042797 - protein, 19 aa, Staphylococcus
TVLMSTLLYELGKYNLDLN

SEQ ID NO: 2042798 - protein, 28 aa, Staphylococcus
TVLNNIKFPLEIAGVPSGLAVKRALELV

SEQ ID NO: 2042799 - protein, 17 aa, Staphylococcus
TVLPKLKKWNIGVSSIG

SEQ ID NO: 2042800 - protein, 19 aa, Staphylococcus
TVLPLALGGTFAHVLAIQY

SEQ ID NO: 2042801 - protein, 22 aa, Staphylococcus
TVLRGFKPYYIENGAFSGALGA

SEQ ID NO: 2042802 - protein, 21 aa, Staphylococcus
TVLSRKLGAQGVDSHRIQTDY

SEQ ID NO: 2042803 - protein, 35 aa, Staphylococcus
TVLYTKIHNFHWFVKGPHFFSLHVKFEELYNEASE

SEQ ID NO: 2042804 - protein, 27 aa, Staphylococcus
TVNDLKLSEIIDGLPIHEQDVKAGYPV

SEQ ID NO: 2042805 - protein, 24 aa, Staphylococcus
TVNESLRYAYHMNMQQFKILLFIK

SEQ ID NO: 2042806 - protein, 21 aa, Staphylococcus
TVPAGELIGVIGESGSGKSTL

SEQ ID NO: 2042807 - protein, 22 aa, Staphylococcus
TVPDIEAATAFFKEGLNGKIAY

SEQ ID NO: 2042808 - protein, 24 aa, Staphylococcus
TVPEEAYAEFNVRTVPEYDNRAIE

SEQ ID NO: 2042809 - protein, 25 aa, Staphylococcus
TVQDEGRFGFQHLGFSSAGAMDLYS

SEQ ID NO: 2042810 - protein, 27 aa, Staphylococcus
TVQSIPMAIKYYKIFKEMKEEGLHNLN

SEQ ID NO: 2042811 - protein, 27 aa, Staphylococcus
TVQSIPMAIKYYKIFKQLKDAGQHHLN

SEQ ID NO: 2042812 - protein, 27 aa, Staphylococcus
TVQSIPMAIQYYRVFQKLKEQGVHNFN

SEQ ID NO: 2042813 - protein, 22 aa, Staphylococcus
TVRGVVHLRDMTKFQYNVAKHI

SEQ ID NO: 2042814 - protein, 17 aa, Staphylococcus
TVRTRIAVLSFIKNKDY

SEQ ID NO: 2042815 - protein, 24 aa, Staphylococcus
TVSALKTGYVKVNFHNGNEYIAVS

SEQ ID NO: 2042816 - protein, 25 aa, Staphylococcus
TVSALRLDVVLKEMIHKSRTIAKQL

SEQ ID NO: 2042817 - protein, 23 aa, Staphylococcus
TVSELLSAHGFKIVDADIASRQA

SEQ ID NO: 2042818 - protein, 17 aa, Staphylococcus
TVSELYAPITGKVVEVN

SEQ ID NO: 2042819 - protein, 23 aa, Staphylococcus
TVSGLRLDVVLKEMVRKSRSIAK

SEQ ID NO: 2042820 - protein, 24 aa, Staphylococcus
TVSPGLRIGWIVADKNVINHLSDL

SEQ ID NO: 2042821 - protein, 24 aa, Staphylococcus
TVSPGLRIGWIVANKNVIRHLSDL

SEQ ID NO: 2042822 - protein, 17 aa, Staphylococcus
TVSRFKQLITEGDMFQV

SEQ ID NO: 2042823 - protein, 22 aa, Staphylococcus
TVSYPLEKLVFWIIQQKEELDR

SEQ ID NO: 2042824 - protein, 17 aa, Staphylococcus
TVTGERVIVFKLEDNFE

SEQ ID NO: 2042825 - protein, 22 aa, Staphylococcus
TVTKENFDLIVDYCRKNNLFIL

SEQ ID NO: 2042826 - protein, 23 aa, Staphylococcus
TVTLKRKQGIIIDASGSDLSNAV

SEQ ID NO: 2042827 - protein, 18 aa, Staphylococcus
TVTLKTLGLIIVMAQSGI

SEQ ID NO: 2042828 - protein, 18 aa, Staphylococcus
TVTLKTLGLIIVMAQSGM

SEQ ID NO: 2042829 - protein, 28 aa, Staphylococcus
TVTRLKGGDPFVFGRGGEEAEILAQHHI

SEQ ID NO: 2042830 - protein, 25 aa, Staphylococcus
TVTRLKGGDPFVFGRGGEEAEQLAT

SEQ ID NO: 2042831 - protein, 26 aa, Staphylococcus
TVTRLKGGDPFVFGRGGEEAEVLANH

SEQ ID NO: 2042832 - protein, 28 aa, Staphylococcus
TVTSYRIHKGFHMLKFEGFDNINDVESY

SEQ ID NO: 2042833 - protein, 21 aa, Staphylococcus
TVTTLCPCSKEISEYSAHNQR

SEQ ID NO: 2042834 - protein, 22 aa, Staphylococcus
TVVAGTKYRGEFEERLKKVMDE

SEQ ID NO: 2042835 - protein, 23 aa, Staphylococcus
TVVAGTKYRGEFEERLKKVMEEI

SEQ ID NO: 2042836 - protein, 19 aa, Staphylococcus
TVVLPPICKDMVEELENEF

SEQ ID NO: 2042837 - protein, 25 aa, Staphylococcus
TVVPGINVKPILKEDGYVYSDGTTV

SEQ ID NO: 2042838 - protein, 17 aa, Staphylococcus
TVVPSGFNKSGAVVAIA

SEQ ID NO: 2042839 - protein, 18 aa, Staphylococcus
TVVPSRNEGFGMVLLEAM

SEQ ID NO: 2042840 - protein, 19 aa, Staphylococcus
TVVVNCARGSIVDTDAITK

SEQ ID NO: 2042841 - protein, 17 aa, Staphylococcus
TVVYRVVQEAVFNALKY

SEQ ID NO: 2042842 - protein, 27 aa, Staphylococcus
TVYNIPFLWRLSSELNVEQLKRALNQL

SEQ ID NO: 2042843 - protein, 24 aa, Staphylococcus
TVYPDKRNFVAIIGVNNEKIFLGG

SEQ ID NO: 2042844 - protein, 17 aa, Staphylococcus
TVYRWVKEYAPILYQIW

SEQ ID NO: 2042845 - protein, 25 aa, Staphylococcus
TVYWHHYLRPEIKFDGIDPLVEQMN

SEQ ID NO: 2042846 - protein, 25 aa, Staphylococcus
TWEGSIYLRPWAGGRVGANEFSFYI

SEQ ID NO: 2042847 - protein, 24 aa, Staphylococcus
TWGRTFRVDYWFMGSYINELRKKY

SEQ ID NO: 2042848 - protein, 22 aa, Staphylococcus
TWIIYSKMIIEPKGRNMESRGM

SEQ ID NO: 2042849 - protein, 17 aa, Staphylococcus
TWKDLFNDFEMHFYRYV

SEQ ID NO: 2042850 - protein, 21 aa, Staphylococcus
TWSYLGELLVSIPFEPDDPLL

SEQ ID NO: 2042851 - protein, 23 aa, Staphylococcus
TWTNRPGAEYIWFNNVETKPGVG

SEQ ID NO: 2042852 - protein, 23 aa, Staphylococcus
TWTNRPGAEYMWFNNVETKPGVG

SEQ ID NO: 2042853 - protein, 18 aa, Staphylococcus
TWVIFPWTAGQGKVARLI

SEQ ID NO: 2042854 - protein, 17 aa, Staphylococcus
TWWDSEKDFENWKNSDA

SEQ ID NO: 2042855 - protein, 17 aa, Staphylococcus
TYAGLVQNMKWYKQQFQ

SEQ ID NO: 2042856 - protein, 19 aa, Staphylococcus
TYAHHFCIYECSVGKQIKQ

SEQ ID NO: 2042857 - protein, 24 aa, Staphylococcus
TYAPCTELSMGMSNDYPVAVEEGA

SEQ ID NO: 2042858 - protein, 18 aa, Staphylococcus
TYAPTWRDDEFIKKGQYL

SEQ ID NO: 2042859 - protein, 18 aa, Staphylococcus
TYCEEHGIEYYIKRLDLS

SEQ ID NO: 2042860 - protein, 21 aa, Staphylococcus
TYCGIGTIGLYMAEKAKHVYG

SEQ ID NO: 2042861 - protein, 17 aa, Staphylococcus
TYDFPRVWLEQDSFDFS

SEQ ID NO: 2042862 - protein, 18 aa, Staphylococcus
TYDLLGLATYFTAGVQEV

SEQ ID NO: 2042863 - protein, 32 aa, Staphylococcus
TYDLYYRAGLDIDVDFVIRVGKPVISKKLNQW

SEQ ID NO: 2042864 - protein, 31 aa, Staphylococcus
TYDYIKYPFTYLSVGAANAFTTVQNTYNSYY

SEQ ID NO: 2042865 - protein, 31 aa, Staphylococcus
TYEAVEMARKFGIEVFNVFLSQDPITEDIEE

SEQ ID NO: 2042866 - protein, 17 aa, Staphylococcus
TYEHVKIAVTRAVMNLK

SEQ ID NO: 2042867 - protein, 23 aa, Staphylococcus
TYEKVADLIIEWFEDGAADGFIF

SEQ ID NO: 2042868 - protein, 25 aa, Staphylococcus
TYERLEGFKSLQWPVAPDGTDEPIL

SEQ ID NO: 2042869 - protein, 18 aa, Staphylococcus
TYFESFVAHAIYFNDPSG

SEQ ID NO: 2042870 - protein, 24 aa, Staphylococcus
TYFGEARVASLILGAKFPIVLTSR

SEQ ID NO: 2042871 - protein, 24 aa, Staphylococcus
TYFGKSDITFNDWIENINHFPNVI

SEQ ID NO: 2042872 - protein, 17 aa, Staphylococcus
TYFKMMQDFIREEDVIL

SEQ ID NO: 2042873 - protein, 22 aa, Staphylococcus
TYFPDCDDYILLWKLEVLEKYQ

SEQ ID NO: 2042874 - protein, 19 aa, Staphylococcus
TYFSRRHIDTLKINNSEAI

SEQ ID NO: 2042875 - protein, 34 aa, Staphylococcus
TYGARMAWRNSNRCIGRLFWETLIVQDARDVESN

SEQ ID NO: 2042876 - protein, 19 aa, Staphylococcus
TYGIHRPAQFKAERIQESL

SEQ ID NO: 2042877 - protein, 17 aa, Staphylococcus
TYGLLIRPENIHVHAEE

SEQ ID NO: 2042878 - protein, 24 aa, Staphylococcus
TYGQEAQPFWNPAIDAGRETFNKY

SEQ ID NO: 2042879 - protein, 18 aa, Staphylococcus
TYGTGGFMLMNTGEEAVK

SEQ ID NO: 2042880 - protein, 17 aa, Staphylococcus
TYGTGGFMLMNTGEEPV

SEQ ID NO: 2042881 - protein, 17 aa, Staphylococcus
TYGTGGFMLMNTGEKAV

SEQ ID NO: 2042882 - protein, 18 aa, Staphylococcus
TYGTGGFMLMNTGKEAVK

SEQ ID NO: 2042883 - protein, 21 aa, Staphylococcus
TYHGESVFEPEVLVKMRNRMK

SEQ ID NO: 2042884 - protein, 23 aa, Staphylococcus
TYHIPTVILGVGYEHIHTTSERI

SEQ ID NO: 2042885 - protein, 19 aa, Staphylococcus
TYHLLERSNQLFVPLYKSW

SEQ ID NO: 2042886 - protein, 23 aa, Staphylococcus
TYHLPTEHLQVFNVIKNTSNKYI

SEQ ID NO: 2042887 - protein, 18 aa, Staphylococcus
TYHVPLLMKFEVQGTNKD

SEQ ID NO: 2042888 - protein, 24 aa, Staphylococcus
TYIEAMLNKGFRYIFTSLQIPEDD

SEQ ID NO: 2042889 - protein, 19 aa, Staphylococcus
TYIEESLCAIVHESHPLAY

SEQ ID NO: 2042890 - protein, 28 aa, Staphylococcus
TYKEWKLEDLPILPKQMHTVVIGKTSKQ

SEQ ID NO: 2042891 - protein, 27 aa, Staphylococcus
TYKKVLFMPYNRHRIYSRNMMGETTRW

SEQ ID NO: 2042892 - protein, 17 aa, Staphylococcus
TYKLCTDLLSLINHSSQ

SEQ ID NO: 2042893 - protein, 18 aa, Staphylococcus
TYKVYFGFANRQTYEDFK

SEQ ID NO: 2042894 - protein, 18 aa, Staphylococcus
TYLFQFAYGMPDYEPIQG

SEQ ID NO: 2042895 - protein, 29 aa, Staphylococcus
TYLIYMLGFMPGFPFLGGLNKQLHTPRRE

SEQ ID NO: 2042896 - protein, 18 aa, Staphylococcus
TYLKVDLEAILKNYQVLG

SEQ ID NO: 2042897 - protein, 27 aa, Staphylococcus
TYLPFGHSMLYLSSIMDIYNGEIVTYK

SEQ ID NO: 2042898 - protein, 18 aa, Staphylococcus
TYLQKGIVFLMIRFKTLD

SEQ ID NO: 2042899 - protein, 24 aa, Staphylococcus
TYLVPESYEAMRIVHECREAGLPC

SEQ ID NO: 2042900 - protein, 20 aa, Staphylococcus
TYLYIELMLEGGLKTNQYET

SEQ ID NO: 2042901 - protein, 21 aa, Staphylococcus
TYMCMAAACGQEVKINNIVPK

SEQ ID NO: 2042902 - protein, 22 aa, Staphylococcus
TYMDFTEIVPISALEGLNVDHF

SEQ ID NO: 2042903 - protein, 24 aa, Staphylococcus
TYMSDFDYATGIIDRLVDDEIGCP

SEQ ID NO: 2042904 - protein, 18 aa, Staphylococcus
TYNFAVAIDDHYMEISDV

SEQ ID NO: 2042905 - protein, 34 aa, Staphylococcus; identical to SEQ ID NO: 1813861

SEQ ID NO: 2042906 - protein, 34 aa, Staphylococcus; identical to SEQ ID NO: 1796808

SEQ ID NO: 2042907 - protein, 26 aa, Staphylococcus
TYNFKHAIIATGSRPIEIPNFKFGDR

SEQ ID NO: 2042908 - protein, 23 aa, Staphylococcus
TYNFKNAIIATGSRPIEIPNFEF

SEQ ID NO: 2042909 - protein, 24 aa, Staphylococcus
TYNFKNAIIATGSRPIEIPNFKFG

SEQ ID NO: 2042910 - protein, 25 aa, Staphylococcus
TYNYDEFYQLLLIKMWQLTLNYDEQ

SEQ ID NO: 2042911 - protein, 25 aa, Staphylococcus
TYPDLKLGIITPFYGHIDRWNEQNQ

SEQ ID NO: 2042912 - protein, 21 aa, Staphylococcus
TYPNFANGLILTGTGQYPKWK

SEQ ID NO: 2042913 - protein, 26 aa, Staphylococcus
TYQGINRLKYVFGLNVKVMPNALKGR

SEQ ID NO: 2042914 - protein, 24 aa, Staphylococcus
TYQSQRVLTDILPTIDNIERALQI

SEQ ID NO: 2042915 - protein, 19 aa, Staphylococcus
TYRGYGLGQLLLKYAMNYV

SEQ ID NO: 2042916 - protein, 23 aa, Staphylococcus
TYSELRAFLSKRLARYQIPSKLL

SEQ ID NO: 2042917 - protein, 23 aa, Staphylococcus
TYSGKFIKDGTWRTEEVGASFSY

SEQ ID NO: 2042918 - protein, 25 aa, Staphylococcus
TYSLGMKQKLGIAIAFLNDPKLIIL

SEQ ID NO: 2042919 - protein, 24 aa, Staphylococcus
TYSLGMKQKLGIAIAFLNQPQLII

SEQ ID NO: 2042920 - protein, 25 aa, Staphylococcus
TYSLGMKQKLGIAIAFLNQPQLIIL

SEQ ID NO: 2042921 - protein, 18 aa, Staphylococcus
TYSPIKWQYVSGNNNDRY

SEQ ID NO: 2042922 - protein, 18 aa, Staphylococcus
TYSSLLYKGCPSSFNIMR

SEQ ID NO: 2042923 - protein, 26 aa, Staphylococcus
TYSVLKASGFPKERVIGQSGVLDTAR

SEQ ID NO: 2042924 - protein, 18 aa, Staphylococcus
TYTDFKMGLQIRHYTVQA

SEQ ID NO: 2042925 - protein, 21 aa, Staphylococcus
TYTELDTAIDFIAERPKPLAL

SEQ ID NO: 2042926 - protein, 19 aa, Staphylococcus
TYTFYFKAPGNFTVEVYCE

SEQ ID NO: 2042927 - protein, 23 aa, Staphylococcus
TYTMPCARTLEPVEVPLDVTTSE

SEQ ID NO: 2042928 - protein, 26 aa, Staphylococcus
TYTMSCARTLVPVEVPIDIKSQEIFD

SEQ ID NO: 2042929 - protein, 17 aa, Staphylococcus
TYTQFDIRKKRKRSNIP

SEQ ID NO: 2042930 - protein, 23 aa, Staphylococcus
TYVGEFLTKLGFATALNDKVADT

SEQ ID NO: 2042931 - protein, 26 aa, Staphylococcus
TYVLYRKYYEGINMLQFEDVMTPASK

SEQ ID NO: 2042932 - protein, 23 aa, Staphylococcus
TYVSLTCQKCPDVVQALNLMSVV

SEQ ID NO: 2042933 - protein, 23 aa, Staphylococcus
TYVYKSSKSYDVFGHREAPDHFD

SEQ ID NO: 2042934 - protein, 17 aa, Staphylococcus
TYWKNEEYYGFGAGASG

SEQ ID NO: 2042935 - protein, 17 aa, Staphylococcus
TYWPTDEIMPIYDAAMK

SEQ ID NO: 2042936 - protein, 17 aa, Staphylococcus
TYWVKLDTRIDCHQLVY

SEQ ID NO: 2042937 - protein, 19 aa, Staphylococcus
TYYEGYKLGSNDLSVGEIV

SEQ ID NO: 2042938 - protein, 26 aa, Staphylococcus
TYYFICAAGVRSGRIVEYLNQHKPEV

SEQ ID NO: 2042939 - protein, 19 aa, Staphylococcus
TYYGIALALMRISKAILNN

SEQ ID NO: 2042940 - protein, 27 aa, Staphylococcus
TYYIICAAGARSARVVQYLEDSNIHAV

SEQ ID NO: 2042941 - protein, 19 aa, Staphylococcus
TYYIQSRIALIESDIEDMY

SEQ ID NO: 2042942 - protein, 24 aa, Staphylococcus
TYYKNVHIYNVEWGQSIDIKEFIT

SEQ ID NO: 2042943 - protein, 25 aa, Staphylococcus
TYYKNVHVYDVEWGKAVDIEAFETY

SEQ ID NO: 2042944 - protein, 22 aa, Staphylococcus
TYYRLLVEWNEKMNLTSITDEH

SEQ ID NO: 2042945 - protein, 23 aa, Staphylococcus
TYYRLLVEWNEKMNLTSITDEHE

SEQ ID NO: 2042946 - protein, 21 aa, Staphylococcus
TYYRNGHPLNYNLTFQSIEDS

SEQ ID NO: 2042947 - protein, 21 aa, Staphylococcus
TYYRTGDIVSFDGQRFHYIDR

SEQ ID NO: 2042948 - protein, 25 aa, Staphylococcus
TYYVSHQWFPLGAVHGLKYWFNYTS

SEQ ID NO: 2042949 - protein, 26 aa, Staphylococcus
TYYVSHQWFPLGAVHGLKYWFNYTSK

SEQ ID NO: 2042950 - protein, 21 aa, Staphylococcus
VAAARLGEQVYMVGRIGDDQL

SEQ ID NO: 2042951 - protein, 18 aa, Staphylococcus
VAAARLSNEVYMIGAVGD

SEQ ID NO: 2042952 - protein, 17 aa, Staphylococcus
VAAAVGLAQNFSACRAL

SEQ ID NO: 2042953 - protein, 19 aa, Staphylococcus
VAAEIRLQIVSGEIEVDTL

SEQ ID NO: 2042954 - protein, 17 aa, Staphylococcus
VAAELAERAILSLEAPI

SEQ ID NO: 2042955 - protein, 17 aa, Staphylococcus
VAAGGVMDGRGILASQI

SEQ ID NO: 2042956 - protein, 18 aa, Staphylococcus
VAAKAAGASKIFVFDLSE

SEQ ID NO: 2042957 - protein, 19 aa, Staphylococcus
VAAKAAGASKIFVFDLSEE

SEQ ID NO: 2042958 - protein, 20 aa, Staphylococcus
VAALKKYPAVNAEIDGDEMV

SEQ ID NO: 2042959 - protein, 21 aa, Staphylococcus
VAALKTGYVKVNFHNGNEYVA

SEQ ID NO: 2042960 - protein, 26 aa, Staphylococcus
VAAVSEFKAGFGPRHIEFNNNGKYAY

SEQ ID NO: 2042961 - protein, 19 aa, Staphylococcus
VACLNKHLHFHGTTEAFKS

SEQ ID NO: 2042962 - protein, 24 aa, Staphylococcus
VADLKVEGALAMILKDAMKPNLVQ

SEQ ID NO: 2042963 - protein, 19 aa, Staphylococcus
VADYFAYFAETVFKRYKDK

SEQ ID NO: 2042964 - protein, 24 aa, Staphylococcus
VAEAIRYISGYGFSQQLITLDAFN

SEQ ID NO: 2042965 - protein, 19 aa, Staphylococcus
VAEALDWDKNHIKLEKEFM

SEQ ID NO: 2042966 - protein, 26 aa, Staphylococcus
VAEELREILAELGLRTVDELVGRTDL

SEQ ID NO: 2042967 - protein, 30 aa, Staphylococcus
VAEGPGSYTGLRIGVTTAKTLAYALNCKLY

SEQ ID NO: 2042968 - protein, 31 aa, Staphylococcus
VAEGPGSYTGLRIGVTVAKTLAYALNTKLYG

SEQ ID NO: 2042969 - protein, 31 aa, Staphylococcus; identical to SEQ ID NO: 1813877

SEQ ID NO: 2042970 - protein, 23 aa, Staphylococcus
VAEHLAHPISYYFKNNFYITPSG

SEQ ID NO: 2042971 - protein, 22 aa, Staphylococcus
VAEHPDKLVVYGGIGKAARNWE

SEQ ID NO: 2042972 - protein, 19 aa, Staphylococcus
VAEIFKVMEARHPNRVNIG

SEQ ID NO: 2042973 - protein, 19 aa, Staphylococcus
VAELIGASPEQVFKTLLFI

SEQ ID NO: 2042974 - protein, 18 aa, Staphylococcus
VAERILPLIQTFERQYDS

SEQ ID NO: 2042975 - protein, 18 aa, Staphylococcus
VAEVLSGTVTPQGFFAVI

SEQ ID NO: 2042976 - protein, 26 aa, Staphylococcus
VAEWPTSRLNHWRSLLQARAIENDIF

SEQ ID NO: 2042977 - protein, 17 aa, Staphylococcus
VAFCYRISGDSCFLFKA

SEQ ID NO: 2042978 - protein, 19 aa, Staphylococcus
VAFDEAHCISKWGHDFRPS

SEQ ID NO: 2042979 - protein, 17 aa, Staphylococcus
VAFIKQAVNNDLPYHLA

SEQ ID NO: 2042980 - protein, 17 aa, Staphylococcus
VAFPNRQVIGIAGDGAF

SEQ ID NO: 2042981 - protein, 26 aa, Staphylococcus
VAGKGRSGFVANSFAMRLNQLGEHAY

SEQ ID NO: 2042982 - protein, 21 aa, Staphylococcus
VAGLTSGLSIQEAFKQAVAAG

SEQ ID NO: 2042983 - protein, 25 aa, Staphylococcus
VAGNVLRFQPPLVITYEQLDKALDV

SEQ ID NO: 2042984 - protein, 24 aa, Staphylococcus
VAGNVLRFQPPLVITYEQLDTALD

SEQ ID NO: 2042985 - protein, 25 aa, Staphylococcus
VAGNVLRFQPPLVITYEQLDTALNV

SEQ ID NO: 2042986 - protein, 24 aa, Staphylococcus
VAGNVLRFQPPLVITYEQLDYALN

SEQ ID NO: 2042987 - protein, 19 aa, Staphylococcus
VAGRMAAQIGAQFLQKFYG

SEQ ID NO: 2042988 - protein, 19 aa, Staphylococcus
VAGSGVYICNECIELCSEI

SEQ ID NO: 2042989 - protein, 23 aa, Staphylococcus
VAGSGVYICNECIELCSEIVEKE

SEQ ID NO: 2042990 - protein, 17 aa, Staphylococcus
VAGTVFIHKFAGFLADK

SEQ ID NO: 2042991 - protein, 17 aa, Staphylococcus
VAHDEYGCEYIIQKFKP

SEQ ID NO: 2042992 - protein, 20 aa, Staphylococcus
VAHEGIRKGPNLKLPSVELL

SEQ ID NO: 2042993 - protein, 25 aa, Staphylococcus
VAHFCSMCGPKFCSMRISHDLRQNH

SEQ ID NO: 2042994 - protein, 18 aa, Staphylococcus
VAHIKRNIDKDILVENMN

SEQ ID NO: 2042995 - protein, 23 aa, Staphylococcus
VAHPDKRIDYMIKDAQASAVITY

SEQ ID NO: 2042996 - protein, 31 aa, Staphylococcus
VAHPYSFELNKDFNFSAAHYIPSEDAGKCMR

SEQ ID NO: 2042997 - protein, 18 aa, Staphylococcus
VAHSQLLNRGPRRVSPFF

SEQ ID NO: 2042998 - protein, 18 aa, Staphylococcus
VAHTCAYLYNPMAKGVTG

SEQ ID NO: 2042999 - protein, 18 aa, Staphylococcus
VAIAEQFRGYGLGQLLLK

SEQ ID NO: 2043000 - protein, 25 aa, Staphylococcus
VAIANFWECATAYLGKNAPSRDEIE

SEQ ID NO: 2043001 - protein, 17 aa, Staphylococcus
VAIAYAREGASVVINYH

SEQ ID NO: 2043002 - protein, 18 aa, Staphylococcus
VAIEATKIFLENSNFNVN

SEQ ID NO: 2043003 - protein, 22 aa, Staphylococcus
VAIEEIRGQKICLYFNNDDLLS

SEQ ID NO: 2043004 - protein, 23 aa, Staphylococcus
VAIEPGVPCGECEYCKSGKYNLC

SEQ ID NO: 2043005 - protein, 20 aa, Staphylococcus
VAIEPPTFIVFVNDVELMHF

SEQ ID NO: 2043006 - protein, 19 aa, Staphylococcus
VAIEPPTFVVFVNDVELMH

SEQ ID NO: 2043007 - protein, 19 aa, Staphylococcus
VAIKELLKEWDIQQDELLA

SEQ ID NO: 2043008 - protein, 23 aa, Staphylococcus
VAILSPRVDVVIEISHRIKEAFK

SEQ ID NO: 2043009 - protein, 31 aa, Staphylococcus
VAIPHMKDDLILRPLILITILNESLGMQSTQ

SEQ ID NO: 2043010 - protein, 18 aa, Staphylococcus
VAIPLCYNNQVYGVLLLG

SEQ ID NO: 2043011 - protein, 25 aa, Staphylococcus
VAIPLWKNNRVYGALLLGQREGRPL

SEQ ID NO: 2043012 - protein, 17 aa, Staphylococcus
VAIVYKPKGMVVHPSPG

SEQ ID NO: 2043013 - protein, 24 aa, Staphylococcus
VAKAAKQFHCPVIAICGSLGDNYE

SEQ ID NO: 2043014 - protein, 23 aa, Staphylococcus
VAKDFKNIIIIAPLADGYGNLSS

SEQ ID NO: 2043015 - protein, 21 aa, Staphylococcus
VAKDIGYHVSMMDLPLTIGED

SEQ ID NO: 2043016 - protein, 17 aa, Staphylococcus
VAKEHFGNIDIVINNAL

SEQ ID NO: 2043017 - protein, 23 aa, Staphylococcus
VAKELGDSINFIGIRLDSGDIAY

SEQ ID NO: 2043018 - protein, 18 aa, Staphylococcus
VAKHVPFDRLLVETDAPF

SEQ ID NO: 2043019 - protein, 27 aa, Staphylococcus
VAKKLIYFVNDFFKRQHIGEVRLNVNV

SEQ ID NO: 2043020 - protein, 20 aa, Staphylococcus
VAKLKGYLMREEVKALENGI

SEQ ID NO: 2043021 - protein, 20 aa, Staphylococcus
VAKLKGYLMREEVKSLEQGI

SEQ ID NO: 2043022 - protein, 23 aa, Staphylococcus
VAKLRNAPEYNYELEVVAKNNDG

SEQ ID NO: 2043023 - protein, 21 aa, Staphylococcus
VALADLGVKYVVIGHSERREL

SEQ ID NO: 2043024 - protein, 19 aa, Staphylococcus
VALAKRLAEDLNESYDYNV

SEQ ID NO: 2043025 - protein, 18 aa, Staphylococcus
VALENGIEVYQPEKISQS

SEQ ID NO: 2043026 - protein, 18 aa, Staphylococcus
VALGDYKGILGQFTGNGR

SEQ ID NO: 2043027 - protein, 20 aa, Staphylococcus
VALGLYVRRDHYGIETNLKL

SEQ ID NO: 2043028 - protein, 31 aa, Staphylococcus
VALITGIGCSGRLSGYVNSYGMHAIHGRALP

SEQ ID NO: 2043029 - protein, 18 aa, Staphylococcus
VALKNGMIDIEMVLNTIS

SEQ ID NO: 2043030 - protein, 26 aa, Staphylococcus
VALLAELCSVSLFPINQLDEITTETS

SEQ ID NO: 2043031 - protein, 26 aa, Staphylococcus
VALLAELCSVSLFPINQLKEITTKSS

SEQ ID NO: 2043032 - protein, 19 aa, Staphylococcus
VALNKRLTAGTFFIKLNEK

SEQ ID NO: 2043033 - protein, 17 aa, Staphylococcus
VALREGVEPEFVRDEIA

SEQ ID NO: 2043034 - protein, 17 aa, Staphylococcus
VALSGGYSRDEANKILK

SEQ ID NO: 2043035 - protein, 17 aa, Staphylococcus
VALSTDERVLWVTETTT

SEQ ID NO: 2043036 - protein, 17 aa, Staphylococcus
VAMAEEFMFAGKDVLIV

SEQ ID NO: 2043037 - protein, 17 aa, Staphylococcus
VAMPLILSHKHKDEIKA

SEQ ID NO: 2043038 - protein, 20 aa, Staphylococcus
VANELGLSVTCTGIIGGKFG

SEQ ID NO: 2043039 - protein, 17 aa, Staphylococcus
VANELKLNVNIELKGTT

SEQ ID NO: 2043040 - protein, 18 aa, Staphylococcus
VANGLIKIITFAPEVEGA

SEQ ID NO: 2043041 - protein, 19 aa, Staphylococcus
VANHIAYLCSIISATSNPK

SEQ ID NO: 2043042 - protein, 20 aa, Staphylococcus
VANHIAYLCSIISATSNPKY

SEQ ID NO: 2043043 - protein, 20 aa, Staphylococcus
VANHIGYLCSIISVTSNPKY

SEQ ID NO: 2043044 - protein, 18 aa, Staphylococcus
VANIDKIIEGARNRGVPV

SEQ ID NO: 2043045 - protein, 30 aa, Staphylococcus
VANKELTPELAFKLGRYGGYVLAHNEDKKH

SEQ ID NO: 2043046 - protein, 20 aa, Staphylococcus
VANLPYYITTPILLNLMQQD

SEQ ID NO: 2043047 - protein, 19 aa, Staphylococcus
VANLPYYITTPILLNLMSK

SEQ ID NO: 2043048 - protein, 18 aa, Staphylococcus
VANLRTGKHNIITTNNTA

SEQ ID NO: 2043049 - protein, 21 aa, Staphylococcus
VANPNPLNWLQHLSTPYEDES

SEQ ID NO: 2043050 - protein, 25 aa, Staphylococcus
VANWLKMNYAEIIKAALYEAIGHEI

SEQ ID NO: 2043051 - protein, 24 aa, Staphylococcus
VAPARAMGMVSVWFKEDDEVDVEP

SEQ ID NO: 2043052 - protein, 25 aa, Staphylococcus
VAPARAMGMVSVWFKHDDAELEPLE

SEQ ID NO: 2043053 - protein, 24 aa, Staphylococcus
VAPARAMGMVSVWFNHEDEEVELA

SEQ ID NO: 2043054 - protein, 23 aa, Staphylococcus
VAPARAMGMVSVWYKQEDAELEP

SEQ ID NO: 2043055 - protein, 23 aa, Staphylococcus
VAPARAMGMVSVWYKQENAELEP

SEQ ID NO: 2043056 - protein, 28 aa, Staphylococcus
VAPERFDNVYFIRLLQQLSIHLVAFDEA

SEQ ID NO: 2043057 - protein, 23 aa, Staphylococcus
VAPEVKEGDTIVFQQYAGTEVKR

SEQ ID NO: 2043058 - protein, 18 aa, Staphylococcus
VAPGPWHIHRMLEAAEGL

SEQ ID NO: 2043059 - protein, 18 aa, Staphylococcus
VAQAVGRQMIKQGYGSII

SEQ ID NO: 2043060 - protein, 18 aa, Staphylococcus
VAQHVPMDRLLCETDAPY

SEQ ID NO: 2043061 - protein, 17 aa, Staphylococcus
VAQHVYQNLGFEYGGKR

SEQ ID NO: 2043062 - protein, 27 aa, Staphylococcus
VAQMLAAKHKAWLMYTWSDYTKEAHAG

SEQ ID NO: 2043063 - protein, 25 aa, Staphylococcus
VAQMNAWLKPYRRALQLEEPTVNIT

SEQ ID NO: 2043064 - protein, 29 aa, Staphylococcus
VAQSGRYTYKFKQIYFLRISTLPLSLGIE

SEQ ID NO: 2043065 - protein, 24 aa, Staphylococcus
VAQSLGALRIKLAKELGLIDESKL

SEQ ID NO: 2043066 - protein, 27 aa, Staphylococcus
VAQWPSARLNHWLALLKARAIENDMYV

SEQ ID NO: 2043067 - protein, 25 aa, Staphylococcus
VAQWTTKNLEHWRILLRARAVENHC

SEQ ID NO: 2043068 - protein, 18 aa, Staphylococcus
VARDDIDELYALYQEARY

SEQ ID NO: 2043069 - protein, 27 aa, Staphylococcus
VARDIFFEKALKVIRPVYLNGSDIPTF

SEQ ID NO: 2043070 - protein, 17 aa, Staphylococcus
VAREGARTVPPRENGGN

SEQ ID NO: 2043071 - protein, 23 aa, Staphylococcus
VAREIARLDLAILDNNELSNIIK

SEQ ID NO: 2043072 - protein, 24 aa, Staphylococcus
VARKKERGKACLDYIPNKDFNDFK

SEQ ID NO: 2043073 - protein, 22 aa, Staphylococcus
VARLKNELIAYGLIEVKPSKRA

SEQ ID NO: 2043074 - protein, 22 aa, Staphylococcus
VARTDYIRKLGFSYADMEKEGI

SEQ ID NO: 2043075 - protein, 20 aa, Staphylococcus
VARTDYISKLGFNYADMEKR

SEQ ID NO: 2043076 - protein, 21 aa, Staphylococcus
VARVKAILRRSKFASEIEKAD

SEQ ID NO: 2043077 - protein, 18 aa, Staphylococcus
VARVKAILRRSKFVNEIE

SEQ ID NO: 2043078 - protein, 17 aa, Staphylococcus
VARVKAILRRSQQVQSV

SEQ ID NO: 2043079 - protein, 26 aa, Staphylococcus
VASCAHIMIWEGIEILPVTTRNKKAI

SEQ ID NO: 2043080 - protein, 28 aa, Staphylococcus
VASCAHMMIWEGIELLPVTNNNKKAIGV

SEQ ID NO: 2043081 - protein, 29 aa, Staphylococcus
VASCAHMMIWEGIELLPVTTINKKLLGVV

SEQ ID NO: 2043082 - protein, 22 aa, Staphylococcus
VASEIMAILCLANDINDLKSKI

SEQ ID NO: 2043083 - protein, 22 aa, Staphylococcus
VASEIMAILCLARDIKDLKSKI

SEQ ID NO: 2043084 - protein, 22 aa, Staphylococcus
VASEIMAILCLARNINDLKEKI

SEQ ID NO: 2043085 - protein, 23 aa, Staphylococcus
VASEIMAILCLSRSIKDLKEKIS

SEQ ID NO: 2043086 - protein, 23 aa, Staphylococcus
VASEIMAILCLSRSIKDLREKIS

SEQ ID NO: 2043087 - protein, 17 aa, Staphylococcus
VASELAERAILSLDAPI

SEQ ID NO: 2043088 - protein, 18 aa, Staphylococcus
VASIKIWIDSFYVYLEKM

SEQ ID NO: 2043089 - protein, 31 aa, Staphylococcus
VASIPLQVCNVMEDFYIPKLITGGATSTPTF

SEQ ID NO: 2043090 - protein, 19 aa, Staphylococcus
VASISPELFFQKGAFNNQE

SEQ ID NO: 2043091 - protein, 18 aa, Staphylococcus
VASISPELFFQKGKFKGK

SEQ ID NO: 2043092 - protein, 24 aa, Staphylococcus
VASKEITPEWLIRGDHKKRRGKQN

SEQ ID NO: 2043093 - protein, 21 aa, Staphylococcus
VASLLRLQMRRGIPDESKHYF

SEQ ID NO: 2043094 - protein, 28 aa, Staphylococcus
VASVGGRLPGGVKIKRAKLRGEHSEGMI

SEQ ID NO: 2043095 - protein, 20 aa, Staphylococcus
VATCKEMLISGVGVTILPEI

SEQ ID NO: 2043096 - protein, 18 aa, Staphylococcus
VATFPQYRGRGVATQLVK

SEQ ID NO: 2043097 - protein, 25 aa, Staphylococcus
VATGFGRTGTMFACERADVNPDIMC

SEQ ID NO: 2043098 - protein, 19 aa, Staphylococcus
VATHFPNATLIEFFGTSEA

SEQ ID NO: 2043099 - protein, 26 aa, Staphylococcus
VATVDCNYMIGMSFNQLEAFKEALPF

SEQ ID NO: 2043100 - protein, 27 aa, Staphylococcus
VATVHQLFRFKSHFDVIFIDEVDAFPL

SEQ ID NO: 2043101 - protein, 20 aa, Staphylococcus
VAVAHGKYLFGLSGNPSACY

SEQ ID NO: 2043102 - protein, 17 aa, Staphylococcus
VAVDSIICRIETHGETN

SEQ ID NO: 2043103 - protein, 38 aa, Staphylococcus
VAVEPGVPCGTCEYCKTGKYNLCPDVVFLATPPVDGAF

SEQ ID NO: 2043104 - protein, 19 aa, Staphylococcus
VAVEPPTFVVFVNDAELMH

SEQ ID NO: 2043105 - protein, 17 aa, Staphylococcus
VAVGKRFLDAVGSSVGP

SEQ ID NO: 2043106 - protein, 17 aa, Staphylococcus
VAVGSYVHYDRKLDGRI

SEQ ID NO: 2043107 - protein, 17 aa, Staphylococcus
VAVGSYVQYDRKLDGRI

SEQ ID NO: 2043108 - protein, 20 aa, Staphylococcus
VAVGYYLRYALSYRDISEIL

SEQ ID NO: 2043109 - protein, 21 aa, Staphylococcus
VAVGYYLRYALSYRDISEILR

SEQ ID NO: 2043110 - protein, 22 aa, Staphylococcus
VAVKRFNRVGAEGMSQESVDGR

SEQ ID NO: 2043111 - protein, 19 aa, Staphylococcus
VAVNAGWTLEDLALVDFFF

SEQ ID NO: 2043112 - protein, 20 aa, Staphylococcus
VAVNWCPALGTVLSNEEVID

SEQ ID NO: 2043113 - protein, 24 aa, Staphylococcus
VAVSEIYRNLGLGQLLLKYGMTYA

SEQ ID NO: 2043114 - protein, 28 aa, Staphylococcus
VAVSGWTDIFIYPGFTYKAIDGLITNFH

SEQ ID NO: 2043115 - protein, 20 aa, Staphylococcus
VAYDNTRFIDGFEVKEVPGR

SEQ ID NO: 2043116 - protein, 17 aa, Staphylococcus
VAYNFLKENPWERLEKL

SEQ ID NO: 2043117 - protein, 17 aa, Staphylococcus
VAYNFLKENPWERLERL

SEQ ID NO: 2043118 - protein, 18 aa, Staphylococcus
VAYNHRAQERFKAVKTPR

SEQ ID NO: 2043119 - protein, 20 aa, Staphylococcus
VCAAGMSTSMLVQKMQKEAE

SEQ ID NO: 2043120 - protein, 23 aa, Staphylococcus
VCAHKRWLFISSTLIKQTVRNSL

SEQ ID NO: 2043121 - protein, 24 aa, Staphylococcus
VCAHKRWLFISSTLIKQTVRSSLI

SEQ ID NO: 2043122 - protein, 31 aa, Staphylococcus
VCASCVNAPTSINTFEWIKPLLERKYPDIQF

SEQ ID NO: 2043123 - protein, 29 aa, Staphylococcus
VCASCVNAPTSRNTFDWLQPLLKRKYPDK

SEQ ID NO: 2043124 - protein, 22 aa, Staphylococcus
VCDTLRVPIKINAVCAETNTPI

SEQ ID NO: 2043125 - protein, 26 aa, Staphylococcus
VCEGLGYSYRFMFSGAGHDAMNMALI

SEQ ID NO: 2043126 - protein, 25 aa, Staphylococcus
VCEKGEYYLAGPIQLINRPQHDAFV

SEQ ID NO: 2043127 - protein, 18 aa, Staphylococcus
VCELEIKLDTGRTHQIRV

SEQ ID NO: 2043128 - protein, 24 aa, Staphylococcus
VCELMFKNQINYFFEHNQTMPRSF

SEQ ID NO: 2043129 - protein, 18 aa, Staphylococcus
VCFYGASSGKAFINGYAG

SEQ ID NO: 2043130 - protein, 19 aa, Staphylococcus
VCGDTPLITAHTLQKLIEH

SEQ ID NO: 2043131 - protein, 20 aa, Staphylococcus
VCGKAEEVIIKWKQQGIKPD

SEQ ID NO: 2043132 - protein, 23 aa, Staphylococcus
VCGKAEEVILKWKSEGIRPDVVM

SEQ ID NO: 2043133 - protein, 20 aa, Staphylococcus
VCGSGLKAVILGKQLIQLGE

SEQ ID NO: 2043134 - protein, 25 aa, Staphylococcus
VCHGICAFLNFKGLDGRYYVDGKRL

SEQ ID NO: 2043135 - protein, 24 aa, Staphylococcus
VCHLTALLKYGGGICYHLFEDDPM

SEQ ID NO: 2043136 - protein, 26 aa, Staphylococcus
VCKSIRSDKNLVPILMLTAKDDEFDR

SEQ ID NO: 2043137 - protein, 17 aa, Staphylococcus
VCLFGPHRDDLGFNVND

SEQ ID NO: 2043138 - protein, 18 aa, Staphylococcus
VCNFNPDYIFVGMGYPKQ

SEQ ID NO: 2043139 - protein, 20 aa, Staphylococcus
VCPNCKATSNRVFVPFQTYK

SEQ ID NO: 2043140 - protein, 25 aa, Staphylococcus
VCREVRKKYDMPIIMLTAKDSEIDK

SEQ ID NO: 2043141 - protein, 19 aa, Staphylococcus
VCTAGTRILIPESKKEDFL

SEQ ID NO: 2043142 - protein, 19 aa, Staphylococcus
VCTCPERIFVHEDVHDDFV

SEQ ID NO: 2043143 - protein, 21 aa, Staphylococcus
VCTYCGVGCSFDVWTKDREIL

SEQ ID NO: 2043144 - protein, 21 aa, Staphylococcus
VCTYCGVGCSFDVWTKDREVL

SEQ ID NO: 2043145 - protein, 21 aa, Staphylococcus
VCTYCGVGCSFDVWTKNREVL

SEQ ID NO: 2043146 - protein, 21 aa, Staphylococcus
VCTYCGVGCSFEVWTKDREIL

SEQ ID NO: 2043147 - protein, 18 aa, Staphylococcus
VCVYERFATLDAVSNGRA

SEQ ID NO: 2043148 - protein, 17 aa, Staphylococcus
VDAAAVFNDARNIVKKD

SEQ ID NO: 2043149 - protein, 26 aa, Staphylococcus
VDADIFAPCALGGVLNDDTIPQLKVK

SEQ ID NO: 2043150 - protein, 17 aa, Staphylococcus
VDAHRFNSLALYKEELV

SEQ ID NO: 2043151 - protein, 26 aa, Staphylococcus
VDAHTRSQKLWAWSKLIDEHKEELAE

SEQ ID NO: 2043152 - protein, 17 aa, Staphylococcus
VDAIPIFQKYGSEQLLA

SEQ ID NO: 2043153 - protein, 18 aa, Staphylococcus
VDALRKKYNGGLSSGEIQ

SEQ ID NO: 2043154 - protein, 18 aa, Staphylococcus
VDALSFIVHKDFAYERGK

SEQ ID NO: 2043155 - protein, 18 aa, Staphylococcus
VDALSFIVHKEFAYERGK

SEQ ID NO: 2043156 - protein, 17 aa, Staphylococcus
VDARVSVLGHIQRGGSP

SEQ ID NO: 2043157 - protein, 24 aa, Staphylococcus
VDASRILFGAGLDEVILMISRAVL

SEQ ID NO: 2043158 - protein, 19 aa, Staphylococcus
VDAYFQLLIDYFKQINQIS

SEQ ID NO: 2043159 - protein, 26 aa, Staphylococcus
VDCGFIKFVLNINVNIAFQIQTDEEV

SEQ ID NO: 2043160 - protein, 18 aa, Staphylococcus
VDDAIAFIQPDKVVTVNI

SEQ ID NO: 2043161 - protein, 19 aa, Staphylococcus
VDDEGLCTVEMTLTSMGCP

SEQ ID NO: 2043162 - protein, 23 aa, Staphylococcus
VDDEKGCPWDRVQTHESLKRYLL

SEQ ID NO: 2043163 - protein, 27 aa, Staphylococcus
VDDETGCPWDRVQTHASLKRYLLEESF

SEQ ID NO: 2043164 - protein, 27 aa, Staphylococcus
VDDFTNAYFKRIFNILHDYYSNNDMYQ

SEQ ID NO: 2043165 - protein, 24 aa, Staphylococcus
VDDGLSGPIARFFEDSNVATLKDL

SEQ ID NO: 2043166 - protein, 24 aa, Staphylococcus
VDDGLSGPIARFFETTHIEKLQSL

SEQ ID NO: 2043167 - protein, 23 aa, Staphylococcus
VDDIAVDLVERFMTKLRSHKTYR

SEQ ID NO: 2043168 - protein, 20 aa, Staphylococcus
VDDIAVELVERFMTKLRSHK

SEQ ID NO: 2043169 - protein, 17 aa, Staphylococcus
VDDLRPYIERKLMTVNT

SEQ ID NO: 2043170 - protein, 25 aa, Staphylococcus
VDDSCMYIERFSYYGDVLIEYTQSI

SEQ ID NO: 2043171 - protein, 21 aa, Staphylococcus
VDDVHAFPGHIACDARSHLNC

SEQ ID NO: 2043172 - protein, 24 aa, Staphylococcus
VDDYPFGGGQGMVLKPEPIFNAME

SEQ ID NO: 2043173 - protein, 24 aa, Staphylococcus
VDDYPFGGGQGMVLKPEPVFNAME

SEQ ID NO: 2043174 - protein, 25 aa, Staphylococcus
VDDYPFGGGQGMVLKPEPVFNAMED

SEQ ID NO: 2043175 - protein, 24 aa, Staphylococcus
VDDYPFGGGQGMVLKPEPVFNAMK

SEQ ID NO: 2043176 - protein, 25 aa, Staphylococcus
VDDYPFGGGQGMVLKPEPVFNAMKD

SEQ ID NO: 2043177 - protein, 24 aa, Staphylococcus
VDEADLMIDLGLIEDVDLIASRLD

SEQ ID NO: 2043178 - protein, 26 aa, Staphylococcus
VDEAVDRACYLLERYATGTVLKDRVA

SEQ ID NO: 2043179 - protein, 22 aa, Staphylococcus
VDEAVDRACYLLQELASGEVLQ

SEQ ID NO: 2043180 - protein, 21 aa, Staphylococcus
VDEAVDRACYLLQTYADGNVL

SEQ ID NO: 2043181 - protein, 30 aa, Staphylococcus
VDEAVRFLKELPHRSSFSYILMDRKLNHAI

SEQ ID NO: 2043182 - protein, 17 aa, Staphylococcus
VDEEALLEGLKELIDVE

SEQ ID NO: 2043183 - protein, 29 aa, Staphylococcus
VDEGLRTLLDFRFQRHFKAKKGENGQSSN

SEQ ID NO: 2043184 - protein, 24 aa, Staphylococcus
VDEGLSGPIARFFEEENVNTLKEL

SEQ ID NO: 2043185 - protein, 26 aa, Staphylococcus
VDEIKKLAEEIGYPLVLKAASGGGGK

SEQ ID NO: 2043186 - protein, 20 aa, Staphylococcus
VDEIKLEFMISENEKQITEQ

SEQ ID NO: 2043187 - protein, 22 aa, Staphylococcus
VDELIPYCLHLKGHPIIESSNF

SEQ ID NO: 2043188 - protein, 18 aa, Staphylococcus
VDELLKMVNLDPDTYRDR

SEQ ID NO: 2043189 - protein, 20 aa, Staphylococcus
VDELTSALLSKGYKAEGLHG

SEQ ID NO: 2043190 - protein, 20 aa, Staphylococcus
VDELTSALLTKGYKAEGLHG

SEQ ID NO: 2043191 - protein, 28 aa, Staphylococcus
VDEMEKRYKLFAQYHVRNITAFNKKASY

SEQ ID NO: 2043192 - protein, 18 aa, Staphylococcus
VDENRRIKAMPSVRKYAR

SEQ ID NO: 2043193 - protein, 17 aa, Staphylococcus
VDEPYILVYKKWQESIL

SEQ ID NO: 2043194 - protein, 19 aa, Staphylococcus
VDEPYSLIYKKWQESTLLY

SEQ ID NO: 2043195 - protein, 23 aa, Staphylococcus
VDESINFLIKHQIGLGIELTPPR

SEQ ID NO: 2043196 - protein, 23 aa, Staphylococcus
VDESTGFLKHLKDLIPKAKSVVI

SEQ ID NO: 2043197 - protein, 23 aa, Staphylococcus
VDEVMTLPAIKVVEHPDLFVESC

SEQ ID NO: 2043198 - protein, 17 aa, Staphylococcus
VDEWKDLVSHTIEQLDK

SEQ ID NO: 2043199 - protein, 22 aa, Staphylococcus
VDEYEPLCEVITDKVTAEVPST

SEQ ID NO: 2043200 - protein, 20 aa, Staphylococcus
VDFIAPDGKLSCGEPGQKLE

SEQ ID NO: 2043201 - protein, 17 aa, Staphylococcus
VDFKGNNAITFLLQNIQ

SEQ ID NO: 2043202 - protein, 19 aa, Staphylococcus
VDFLLPIRTGDVISYEAMV

SEQ ID NO: 2043203 - protein, 17 aa, Staphylococcus
VDFTFDYIIPIRLQSMI

SEQ ID NO: 2043204 - protein, 19 aa, Staphylococcus
VDGACYILALPEIFDKVDV

SEQ ID NO: 2043205 - protein, 18 aa, Staphylococcus
VDGACYIVALPEIFNKVD

SEQ ID NO: 2043206 - protein, 23 aa, Staphylococcus
VDGEFQFDAAIVPEVAKKKAPDA

SEQ ID NO: 2043207 - protein, 17 aa, Staphylococcus
VDGFRFDVINLISKDEF

SEQ ID NO: 2043208 - protein, 18 aa, Staphylococcus
VDGFRFDVINLISKGEFR

SEQ ID NO: 2043209 - protein, 23 aa, Staphylococcus
VDGGKFSGIVPISQLSTHHIDSP

SEQ ID NO: 2043210 - protein, 17 aa, Staphylococcus
VDGHLRTNVSNIYASGD

SEQ ID NO: 2043211 - protein, 19 aa, Staphylococcus
VDGIPPSLIDMWVSKKQLI

SEQ ID NO: 2043212 - protein, 19 aa, Staphylococcus
VDGKLHGRGAADMKSGLAA

SEQ ID NO: 2043213 - protein, 17 aa, Staphylococcus
VDGKWRFTSPTHVVAAF

SEQ ID NO: 2043214 - protein, 25 aa, Staphylococcus
VDGLKVKALQMLPHKTVERIVVYLR

SEQ ID NO: 2043215 - protein, 17 aa, Staphylococcus
VDGNVFRVWSRLNNDFS

SEQ ID NO: 2043216 - protein, 24 aa, Staphylococcus
VDGRIPVIGIGSVFSADDALDAVE

SEQ ID NO: 2043217 - protein, 25 aa, Staphylococcus
VDGRIPVIGVGSVFTADDALDAIES

SEQ ID NO: 2043218 - protein, 23 aa, Staphylococcus
VDGRTAVREDIGWIMDQLEVKDD

SEQ ID NO: 2043219 - protein, 17 aa, Staphylococcus
VDGSALIDENNIDILEQ

SEQ ID NO: 2043220 - protein, 19 aa, Staphylococcus
VDGVLPVCIGNATKVSDYI

SEQ ID NO: 2043221 - protein, 17 aa, Staphylococcus
VDGYSIADILSLTVQEA

SEQ ID NO: 2043222 - protein, 20 aa, Staphylococcus
VDHCPEILSMLSNLGQSMYY

SEQ ID NO: 2043223 - protein, 17 aa, Staphylococcus
VDHDQRFKCNCGKSGCI

SEQ ID NO: 2043224 - protein, 17 aa, Staphylococcus
VDHHLFESISLNKEDLR

SEQ ID NO: 2043225 - protein, 24 aa, Staphylococcus
VDHLIKAYHRFLSYGYGTRLDVFG

SEQ ID NO: 2043226 - protein, 18 aa, Staphylococcus
VDIEKSYPGFKIEDDALV

SEQ ID NO: 2043227 - protein, 17 aa, Staphylococcus
VDIETLKATQNDIIETI

SEQ ID NO: 2043228 - protein, 21 aa, Staphylococcus
VDIFDFEGSFINALKRIVGNK

SEQ ID NO: 2043229 - protein, 19 aa, Staphylococcus
VDIGLPREVLVPWEDLPKV

SEQ ID NO: 2043230 - protein, 18 aa, Staphylococcus
VDIHLKMPSNQVLNELSQ

SEQ ID NO: 2043231 - protein, 17 aa, Staphylococcus
VDIILTIPPYELKTEDS

SEQ ID NO: 2043232 - protein, 18 aa, Staphylococcus
VDIKFEYTQLPGAVVNDE

SEQ ID NO: 2043233 - protein, 17 aa, Staphylococcus
VDIKNMYIDIGVNSKEE

SEQ ID NO: 2043234 - protein, 23 aa, Staphylococcus
VDILRNVDLIACEDTRVTKKLCA

SEQ ID NO: 2043235 - protein, 19 aa, Staphylococcus
VDIQKGRLTSLIGPNGAGK

SEQ ID NO: 2043236 - protein, 18 aa, Staphylococcus
VDISYAIEAFHLDTVNRV

SEQ ID NO: 2043237 - protein, 26 aa, Staphylococcus
VDKAQRIGIRMADLLDKETFEKLLKS

SEQ ID NO: 2043238 - protein, 24 aa, Staphylococcus
VDKAQRIGIRMGDLVEKETFERLL

SEQ ID NO: 2043239 - protein, 17 aa, Staphylococcus
VDKDLFVIAGHYRNGIL

SEQ ID NO: 2043240 - protein, 22 aa, Staphylococcus
VDKGMIIGETFLLSKTGGKSGE

SEQ ID NO: 2043241 - protein, 18 aa, Staphylococcus
VDKSFPMDTYALQRELGG

SEQ ID NO: 2043242 - protein, 24 aa, Staphylococcus
VDKYKIKMPFLDQLLINYLNQEIG

SEQ ID NO: 2043243 - protein, 23 aa, Staphylococcus
VDLDAESLLGFKTIKTNDQGDQE

SEQ ID NO: 2043244 - protein, 23 aa, Staphylococcus
VDLDAESLLGFKTIKTNEQGHQE

SEQ ID NO: 2043245 - protein, 22 aa, Staphylococcus
VDLDAESLLGFKTIKTNEQGQQ

SEQ ID NO: 2043246 - protein, 23 aa, Staphylococcus
VDLDAESLLGFKTIKTNEQGQQE

SEQ ID NO: 2043247 - protein, 23 aa, Staphylococcus
VDLDAESLLGFKTIQTNADGNQE

SEQ ID NO: 2043248 - protein, 23 aa, Staphylococcus
VDLDAESLLGFKTIQTNENGSQE

SEQ ID NO: 2043249 - protein, 24 aa, Staphylococcus
VDLDIRAHYGINIIAIKRDKDVII

SEQ ID NO: 2043250 - protein, 24 aa, Staphylococcus
VDLDRIFKIERILMDYLGQLPYTL

SEQ ID NO: 2043251 - protein, 24 aa, Staphylococcus
VDLDRIFKVERILMDYLGQLPYSL

SEQ ID NO: 2043252 - protein, 24 aa, Staphylococcus
VDLDSPWKRVHIVDAVKEATGVNF

SEQ ID NO: 2043253 - protein, 17 aa, Staphylococcus
VDLDTESLLGFKTIQTN

SEQ ID NO: 2043254 - protein, 20 aa, Staphylococcus
VDLDYLFNKFIYQHRGGFCY

SEQ ID NO: 2043255 - protein, 19 aa, Staphylococcus
VDLERYRQLFAPGSKPADW

SEQ ID NO: 2043256 - protein, 20 aa, Staphylococcus
VDLFAAKVIEKYGVSKLDSI

SEQ ID NO: 2043257 - protein, 30 aa, Staphylococcus
VDLFRPSENFKRINKSLARLDMPQVDEEVV

SEQ ID NO: 2043258 - protein, 18 aa, Staphylococcus
VDLGLTRVNGGFIVTGGS

SEQ ID NO: 2043259 - protein, 26 aa, Staphylococcus
VDLLAKRLKKEYGLTFKPCATKELKI

SEQ ID NO: 2043260 - protein, 24 aa, Staphylococcus
VDLLNIGGGFGIHYVEGDVSFPIE

SEQ ID NO: 2043261 - protein, 23 aa, Staphylococcus
VDLLNLGGGFGIKYVEGDVSFPI

SEQ ID NO: 2043262 - protein, 33 aa, Staphylococcus
VDLNEVNPMLGHRGCRLAITYPELYEMQVEAII

SEQ ID NO: 2043263 - protein, 23 aa, Staphylococcus
VDLPFGDCHFALAAKPETSSFNK

SEQ ID NO: 2043264 - protein, 19 aa, Staphylococcus
VDLPGALSKKDCHYMTNGS

SEQ ID NO: 2043265 - protein, 18 aa, Staphylococcus
VDLYRTSGHWAHYRDDMF

SEQ ID NO: 2043266 - protein, 17 aa, Staphylococcus
VDMGLGRSPSFKQVNEA

SEQ ID NO: 2043267 - protein, 22 aa, Staphylococcus
VDMKRLAYSQVQYEFESKAWYL

SEQ ID NO: 2043268 - protein, 17 aa, Staphylococcus
VDMLKADMNELKDTLPG

SEQ ID NO: 2043269 - protein, 22 aa, Staphylococcus
VDMPIGRAYEIAQLPKNLIERT

SEQ ID NO: 2043270 - protein, 19 aa, Staphylococcus
VDMQMKFLIKPEAKNSCEE

SEQ ID NO: 2043271 - protein, 21 aa, Staphylococcus
VDMYIIVSFGTKISEVASNVQ

SEQ ID NO: 2043272 - protein, 22 aa, Staphylococcus
VDNDLPYHLAIKNLKQLDEDFG

SEQ ID NO: 2043273 - protein, 23 aa, Staphylococcus
VDNGESLTAPVLNNIMRDVYEQF

SEQ ID NO: 2043274 - protein, 22 aa, Staphylococcus
VDNIEFKMLCMGFKRKEIKKLM

SEQ ID NO: 2043275 - protein, 26 aa, Staphylococcus
VDNVFPTKHAIGLKADNGLEILVHIG

SEQ ID NO: 2043276 - protein, 36 aa, Staphylococcus
VDNVFPTKHAIGLKADNGLELLVHIGLDTVQLDGEG

SEQ ID NO: 2043277 - protein, 36 aa, Staphylococcus
VDNVFPTKHAIGLKAENGLELLVHIGLDTVQLDGEG

SEQ ID NO: 2043278 - protein, 19 aa, Staphylococcus
VDNVFPTKHAIGLKTKNGL

SEQ ID NO: 2043279 - protein, 26 aa, Staphylococcus
VDNVFPTKHAVGLKADNGLELLVHIG

SEQ ID NO: 2043280 - protein, 33 aa, Staphylococcus
VDPDVLRFFMISVHYRSPINYNLELVNAAKSGL

SEQ ID NO: 2043281 - protein, 31 aa, Staphylococcus
VDPDVLRFFMISVHYRSPINYNMELVESAKS

SEQ ID NO: 2043282 - protein, 23 aa, Staphylococcus
VDPEILRKHLIDKYSIGIIALND

SEQ ID NO: 2043283 - protein, 17 aa, Staphylococcus
VDPEKIGGFWFSSSSER

SEQ ID NO: 2043284 - protein, 22 aa, Staphylococcus
VDPKSIIGIGIDFTSCTIVFLD

SEQ ID NO: 2043285 - protein, 24 aa, Staphylococcus
VDPYLRPLYDGLHTVLGPEQTARF

SEQ ID NO: 2043286 - protein, 25 aa, Staphylococcus
VDQAKLNLGYRFPTHYGKSNYYAFI

SEQ ID NO: 2043287 - protein, 24 aa, Staphylococcus
VDQAKLNLGYRFPTHYGNEDYYAL

SEQ ID NO: 2043288 - protein, 24 aa, Staphylococcus
VDQAKLNLGYRFPTYFGKENYYAF

SEQ ID NO: 2043289 - protein, 17 aa, Staphylococcus
VDQGIEVIFCLHPNMQP

SEQ ID NO: 2043290 - protein, 23 aa, Staphylococcus
VDQLYHLPIMYIEYSGIYGDVEK

SEQ ID NO: 2043291 - protein, 23 aa, Staphylococcus
VDQMNGIPFTKRAQHLLTDEEVE

SEQ ID NO: 2043292 - protein, 18 aa, Staphylococcus
VDQNFKAIKVIQANLQQL

SEQ ID NO: 2043293 - protein, 18 aa, Staphylococcus
VDQNFKAVKVIQANLKQL

SEQ ID NO: 2043294 - protein, 24 aa, Staphylococcus
VDQSRPIVYVSLGTVFNQNIGFFN

SEQ ID NO: 2043295 - protein, 17 aa, Staphylococcus
VDRAVPESLIFYIYDST

SEQ ID NO: 2043296 - protein, 24 aa, Staphylococcus
VDREVGKDLMLRLEKELSKLHDAF

SEQ ID NO: 2043297 - protein, 20 aa, Staphylococcus
VDRFCKIRNSTIGKYSYIGF

SEQ ID NO: 2043298 - protein, 17 aa, Staphylococcus
VDRIGCAVIDVSDKAIE

SEQ ID NO: 2043299 - protein, 23 aa, Staphylococcus
VDRLLKDRYEVILQYYQSDISSL

SEQ ID NO: 2043300 - protein, 19 aa, Staphylococcus
VDRSFEMIASMIASWKIGA

SEQ ID NO: 2043301 - protein, 23 aa, Staphylococcus
VDRYLLHRLREFTASTINNYENF

SEQ ID NO: 2043302 - protein, 20 aa, Staphylococcus
VDRYLLNRLREFTASTINNY

SEQ ID NO: 2043303 - protein, 17 aa, Staphylococcus
VDRYVRAQIKEAFAVAI

SEQ ID NO: 2043304 - protein, 20 aa, Staphylococcus
VDSEFALDVLVELLNEPDVD

SEQ ID NO: 2043305 - protein, 17 aa, Staphylococcus
VDSKFTLANLMKTHIFS

SEQ ID NO: 2043306 - protein, 23 aa, Staphylococcus
VDSKRLTSMIFYGPPGIGKTSIA

SEQ ID NO: 2043307 - protein, 22 aa, Staphylococcus
VDSMCLLYALTHLYRDTYRKLT

SEQ ID NO: 2043308 - protein, 18 aa, Staphylococcus
VDSNIILVQQMVKQLEQI

SEQ ID NO: 2043309 - protein, 27 aa, Staphylococcus
VDSSGIIKKLFLLGIMANINQSLDDET

SEQ ID NO: 2043310 - protein, 17 aa, Staphylococcus
VDSSGMICSMKELDLPN

SEQ ID NO: 2043311 - protein, 17 aa, Staphylococcus
VDTGDGVLLIIKNYAGD

SEQ ID NO: 2043312 - protein, 23 aa, Staphylococcus
VDTKRLSSMIFYGPPGIGKTSIA

SEQ ID NO: 2043313 - protein, 24 aa, Staphylococcus
VDTLKDRLKAIMATSLKDMAKAQM

SEQ ID NO: 2043314 - protein, 17 aa, Staphylococcus
VDTPAIFMDHADGSKIY

SEQ ID NO: 2043315 - protein, 17 aa, Staphylococcus
VDTPAIFMDHAKGSRIY

SEQ ID NO: 2043316 - protein, 17 aa, Staphylococcus
VDTPAIFMDHGEGSKIY

SEQ ID NO: 2043317 - protein, 17 aa, Staphylococcus
VDTPAIFMDHGEGSRIY

SEQ ID NO: 2043318 - protein, 17 aa, Staphylococcus
VDTWVAFAPNKRGYKML

SEQ ID NO: 2043319 - protein, 18 aa, Staphylococcus
VDVALDMIKGVLGNIPFF

SEQ ID NO: 2043320 - protein, 18 aa, Staphylococcus
VDVANFLISMGAQIKGAG

SEQ ID NO: 2043321 - protein, 18 aa, Staphylococcus
VDVAVAFDTPGMSGQTSD

SEQ ID NO: 2043322 - protein, 22 aa, Staphylococcus
VDVDELFDMFIFKNDRLKEKMK

SEQ ID NO: 2043323 - protein, 23 aa, Staphylococcus
VDVDELFDMFIFKNERLKSKMKA

SEQ ID NO: 2043324 - protein, 22 aa, Staphylococcus
VDVDGFVGVVVDFVAEVVDFAV

SEQ ID NO: 2043325 - protein, 19 aa, Staphylococcus
VDVEFPLSVMTVVTGVSGS

SEQ ID NO: 2043326 - protein, 17 aa, Staphylococcus
VDVEIKSGIGPVIQNPI

SEQ ID NO: 2043327 - protein, 17 aa, Staphylococcus
VDVESIYPPGADLHSYE

SEQ ID NO: 2043328 - protein, 25 aa, Staphylococcus
VDVGQRGFVPASLISTDFIEDFSSF

SEQ ID NO: 2043329 - protein, 22 aa, Staphylococcus
VDVIKISPLLSEKDQHQIQSLV

SEQ ID NO: 2043330 - protein, 23 aa, Staphylococcus
VDVKGKWFFDRYSPVTNIKAVGN

SEQ ID NO: 2043331 - protein, 19 aa, Staphylococcus
VDVKGSFGITGKEAEEALD

SEQ ID NO: 2043332 - protein, 21 aa, Staphylococcus
VDVKGVFFCTKQLYHSYVKMV

SEQ ID NO: 2043333 - protein, 22 aa, Staphylococcus
VDVLVDVLWLFAVLVDVLVDVL

SEQ ID NO: 2043334 - protein, 23 aa, Staphylococcus
VDVMLDILQRCFKDEFPQWESKI

SEQ ID NO: 2043335 - protein, 19 aa, Staphylococcus
VDVRKRFVHEYDQLDTEDL

SEQ ID NO: 2043336 - protein, 24 aa, Staphylococcus
VDWKDGREGILTYDIIDYINEILY

SEQ ID NO: 2043337 - protein, 19 aa, Staphylococcus
VDYAKFCFEEFSEVNFWTT

SEQ ID NO: 2043338 - protein, 19 aa, Staphylococcus
VDYANSYVSWYAEEAKRIY

SEQ ID NO: 2043339 - protein, 18 aa, Staphylococcus
VDYARSYVDWYAEEAKRI

SEQ ID NO: 2043340 - protein, 27 aa, Staphylococcus
VDYCIVINFSSRFASVTAEEFVQDYII

SEQ ID NO: 2043341 - protein, 26 aa, Staphylococcus
VDYCIVINFSSRFASVTSEEFIQEYV

SEQ ID NO: 2043342 - protein, 24 aa, Staphylococcus
VDYCTEHRLPFVLFSASGGARMQE

SEQ ID NO: 2043343 - protein, 22 aa, Staphylococcus
VDYEIVEVMGLPKDFKTHPHYK

SEQ ID NO: 2043344 - protein, 26 aa, Staphylococcus
VDYELDYFAGLSFRTLMPELPETLPH

SEQ ID NO: 2043345 - protein, 19 aa, Staphylococcus
VDYFFKTKEEFEALIKDDQ

SEQ ID NO: 2043346 - protein, 25 aa, Staphylococcus
VDYIGMPAVCFTEPELATVGYTEAQ

SEQ ID NO: 2043347 - protein, 25 aa, Staphylococcus
VDYKALEQHVQFLLDNNVKAIIVNG

SEQ ID NO: 2043348 - protein, 17 aa, Staphylococcus
VDYLIAGGINYENIQKI

SEQ ID NO: 2043349 - protein, 25 aa, Staphylococcus
VDYNHVQSALNFKFLKRMNEAGLPV

SEQ ID NO: 2043350 - protein, 40 aa, Staphylococcus
VDYNHVQSALNFKFMRRINEVGIPIVFVINQIDKHNEDEI

SEQ ID NO: 2043351 - protein, 24 aa, Staphylococcus
VDYNHVQSALNFQFMKRMNQVGIP

SEQ ID NO: 2043352 - protein, 17 aa, Staphylococcus
VDYRLKPQNVISIFMNR

SEQ ID NO: 2043353 - protein, 20 aa, Staphylococcus
VDYRPNIYSYFGIQKKPNDT

SEQ ID NO: 2043354 - protein, 18 aa, Staphylococcus
VDYVFYPSVEEMYPDQLD

SEQ ID NO: 2043355 - protein, 17 aa, Staphylococcus
VDYVLVMTVNPGFGGQS

SEQ ID NO: 2043356 - protein, 17 aa, Staphylococcus
VEAAIKMAQKGSINHLV

SEQ ID NO: 2043357 - protein, 18 aa, Staphylococcus
VEAAKIPVIHTLPAKTII

SEQ ID NO: 2043358 - protein, 18 aa, Staphylococcus
VEAAKIPVIHTLPAKTVI

SEQ ID NO: 2043359 - protein, 24 aa, Staphylococcus
VEADRLRFDFSHFGPMTQEEIDTV

SEQ ID NO: 2043360 - protein, 24 aa, Staphylococcus
VEADRLRFDFSHFGPMTQEELDQV

SEQ ID NO: 2043361 - protein, 18 aa, Staphylococcus
VEAGKRVYSTFVKGELIE

SEQ ID NO: 2043362 - protein, 25 aa, Staphylococcus
VEAIQGYIYQKARFHKLNTPYLDTV

SEQ ID NO: 2043363 - protein, 23 aa, Staphylococcus
VEAISELFIDRVLTKILQHIDDN

SEQ ID NO: 2043364 - protein, 17 aa, Staphylococcus
VEAIYGITDSGMTVIEG

SEQ ID NO: 2043365 - protein, 27 aa, Staphylococcus
VEAKLKVRVKYPVWINNRITTEEERER

SEQ ID NO: 2043366 - protein, 23 aa, Staphylococcus
VEALHLPQGFNIRVDSLLYHGYK

SEQ ID NO: 2043367 - protein, 23 aa, Staphylococcus
VEALIAKAIEYFGRVDILVNSAG

SEQ ID NO: 2043368 - protein, 17 aa, Staphylococcus
VEALIELNVQISIDTYR

SEQ ID NO: 2043369 - protein, 20 aa, Staphylococcus
VEALKALGLEPGPKYQEVKD

SEQ ID NO: 2043370 - protein, 19 aa, Staphylococcus
VEAPLILGHECAGKVAAVG

SEQ ID NO: 2043371 - protein, 21 aa, Staphylococcus
VEAVKELGERVNIKVDVGESG

SEQ ID NO: 2043372 - protein, 17 aa, Staphylococcus
VEDELRYLATLKGMASK

SEQ ID NO: 2043373 - protein, 24 aa, Staphylococcus
VEDGFSGPIARFFEDKDVEKVKEL

SEQ ID NO: 2043374 - protein, 24 aa, Staphylococcus
VEDGLSGPIARFFEDANVETLKTL

SEQ ID NO: 2043375 - protein, 20 aa, Staphylococcus
VEDIDEWIGLLDQLEEKVKT

SEQ ID NO: 2043376 - protein, 21 aa, Staphylococcus
VEDIKAPSYWYYNINSQQDLD

SEQ ID NO: 2043377 - protein, 18 aa, Staphylococcus
VEDILKLIDYIYSVFGFT

SEQ ID NO: 2043378 - protein, 18 aa, Staphylococcus
VEDIRFAGREEILTLIEK

SEQ ID NO: 2043379 - protein, 20 aa, Staphylococcus
VEDIRWLRCDIKSLNLLGNV

SEQ ID NO: 2043380 - protein, 23 aa, Staphylococcus
VEDVIDYFIEYLFQGYDIRNTFT

SEQ ID NO: 2043381 - protein, 17 aa, Staphylococcus
VEDVIRFENELFNWAKN

SEQ ID NO: 2043382 - protein, 20 aa, Staphylococcus
VEDYLKLRLDAGLSAKSTEA

SEQ ID NO: 2043383 - protein, 17 aa, Staphylococcus
VEEAIGFLGDIEIQNGK

SEQ ID NO: 2043384 - protein, 30 aa, Staphylococcus
VEEFFRALIINARLTTHIDLLRGGNTHHEI

SEQ ID NO: 2043385 - protein, 30 aa, Staphylococcus
VEEFKRCVNELGFKGALIMGRTKDGFSDQD

SEQ ID NO: 2043386 - protein, 24 aa, Staphylococcus
VEEGLSGPIARFFEDANVATLTEL

SEQ ID NO: 2043387 - protein, 23 aa, Staphylococcus
VEELAKYSGVPVWNGLTDEDHPT

SEQ ID NO: 2043388 - protein, 18 aa, Staphylococcus
VEELGGIVVGIAFIIELK

SEQ ID NO: 2043389 - protein, 17 aa, Staphylococcus
VEELGGLAVIGTERHES

SEQ ID NO: 2043390 - protein, 18 aa, Staphylococcus
VEELIEREKLSFGVINIL

SEQ ID NO: 2043391 - protein, 25 aa, Staphylococcus
VEELKDLPPAIVLNAEADVLRDEGE

SEQ ID NO: 2043392 - protein, 25 aa, Staphylococcus
VEELNTRLGWEIEEPRDFEFEHNGD

SEQ ID NO: 2043393 - protein, 17 aa, Staphylococcus
VEELQQINIYPLRNEQK

SEQ ID NO: 2043394 - protein, 19 aa, Staphylococcus
VEELVKFGRFPHSKGRLKQ

SEQ ID NO: 2043395 - protein, 25 aa, Staphylococcus
VEEMYKLPILYLEYSGTYGDKDIVK

SEQ ID NO: 2043396 - protein, 22 aa, Staphylococcus
VEEREKRLLIEFEAYKTQQKKI

SEQ ID NO: 2043397 - protein, 27 aa, Staphylococcus
VEERKANGFYKDFFDFTRRIPKRIKTR

SEQ ID NO: 2043398 - protein, 18 aa, Staphylococcus
VEEVLVKSGYRDMLDREQ

SEQ ID NO: 2043399 - protein, 25 aa, Staphylococcus
VEEVLYPAMEDFFLDIIIGKGDEAR

SEQ ID NO: 2043400 - protein, 20 aa, Staphylococcus
VEEYKLEFMIDYNQKQLAQQ

SEQ ID NO: 2043401 - protein, 18 aa, Staphylococcus
VEFEIREVMGLPKDFKTH

SEQ ID NO: 2043402 - protein, 18 aa, Staphylococcus
VEFGRKGTDLTYQQKDKI

SEQ ID NO: 2043403 - protein, 21 aa, Staphylococcus
VEFHLYPGCYHEFESIAPDAP

SEQ ID NO: 2043404 - protein, 24 aa, Staphylococcus
VEGDRLRFDFSHFGPVTEEELEQV

SEQ ID NO: 2043405 - protein, 23 aa, Staphylococcus
VEGEEALNYLVNRGFTEELIKSR

SEQ ID NO: 2043406 - protein, 25 aa, Staphylococcus
VEGEPEYFRSLGFVPLSNYSVEVPD

SEQ ID NO: 2043407 - protein, 22 aa, Staphylococcus
VEGGHLDGQYGILAALTAMKAL

SEQ ID NO: 2043408 - protein, 25 aa, Staphylococcus
VEGKQFKARFNVAILDDGNYLPSGE

SEQ ID NO: 2043409 - protein, 19 aa, Staphylococcus
VEGLMLISPLLEFKQSGKD

SEQ ID NO: 2043410 - protein, 17 aa, Staphylococcus
VEGLYPYHIYTYIINEL

SEQ ID NO: 2043411 - protein, 18 aa, Staphylococcus
VEGLYPYHIYTYIINELI

SEQ ID NO: 2043412 - protein, 24 aa, Staphylococcus
VEGTHKVYIIDGFEKLTVQGENSI

SEQ ID NO: 2043413 - protein, 20 aa, Staphylococcus
VEGYNIADILALTVDEAITF

SEQ ID NO: 2043414 - protein, 23 aa, Staphylococcus
VEGYSIADILALTVSEAISQFEG

SEQ ID NO: 2043415 - protein, 18 aa, Staphylococcus
VEHFNFTPDLITFGKSLA

SEQ ID NO: 2043416 - protein, 20 aa, Staphylococcus
VEHIWEHVDRVILLNYEGQI

SEQ ID NO: 2043417 - protein, 26 aa, Staphylococcus
VEHMNAWLKPYRKALNLEEPVVNISE

SEQ ID NO: 2043418 - protein, 23 aa, Staphylococcus
VEHPNDILEWVLIEAPELDNEAS

SEQ ID NO: 2043419 - protein, 24 aa, Staphylococcus
VEHRAKFVKQFGDFSVGIDALKQY

SEQ ID NO: 2043420 - protein, 17 aa, Staphylococcus
VEIAENWNMVGMRATES

SEQ ID NO: 2043421 - protein, 21 aa, Staphylococcus
VEIAPAVQGLVHISEIDHKHI

SEQ ID NO: 2043422 - protein, 22 aa, Staphylococcus
VEIAPGVQGLVHISEIAHEHIG

SEQ ID NO: 2043423 - protein, 23 aa, Staphylococcus
VEIAPGVQGLVHISEIAHKHIGT

SEQ ID NO: 2043424 - protein, 22 aa, Staphylococcus
VEIAPGVQGLVHISEIDHKHIG

SEQ ID NO: 2043425 - protein, 24 aa, Staphylococcus
VEICIPIRHFIKLEKHFFNSNYNF

SEQ ID NO: 2043426 - protein, 17 aa, Staphylococcus
VEIEVLAALLSLIELDS

SEQ ID NO: 2043427 - protein, 19 aa, Staphylococcus
VEIIKKIRGGNHVTSQNPE

SEQ ID NO: 2043428 - protein, 17 aa, Staphylococcus
VEIKAATIIDAEQVKKS

SEQ ID NO: 2043429 - protein, 23 aa, Staphylococcus
VEIKAEDGITFAVEKNTTVTVSG

SEQ ID NO: 2043430 - protein, 27 aa, Staphylococcus
VEILESYGIDYCIVINFSSKFAEVTAE

SEQ ID NO: 2043431 - protein, 21 aa, Staphylococcus
VEILKSLDLDGYMVVIDTGVK

SEQ ID NO: 2043432 - protein, 18 aa, Staphylococcus
VEILSEIVAIPSVNDNEL

SEQ ID NO: 2043433 - protein, 22 aa, Staphylococcus
VEINCHGGILTINRILELTMTY

SEQ ID NO: 2043434 - protein, 21 aa, Staphylococcus
VEIQFQYGLVLCQLEMFEQAI

SEQ ID NO: 2043435 - protein, 23 aa, Staphylococcus
VEISQRIKNAFIHEDIDVIHQSS

SEQ ID NO: 2043436 - protein, 23 aa, Staphylococcus
VEIVDLRTVYPLDKETIIERAKM

SEQ ID NO: 2043437 - protein, 19 aa, Staphylococcus
VEKARRLSFQTEDMKRQSK

SEQ ID NO: 2043438 - protein, 25 aa, Staphylococcus
VEKDLKRTPSFSVNRPNEETGITFA

SEQ ID NO: 2043439 - protein, 19 aa, Staphylococcus
VEKERRLTALEYKQKKKEY

SEQ ID NO: 2043440 - protein, 19 aa, Staphylococcus
VEKGDRVFVFMPRTPELYF

SEQ ID NO: 2043441 - protein, 17 aa, Staphylococcus
VEKGEFVAIMGPSGSGK

SEQ ID NO: 2043442 - protein, 18 aa, Staphylococcus
VEKGYFRPSGDKSKETYT

SEQ ID NO: 2043443 - protein, 29 aa, Staphylococcus
VEKIIKSVHFVGTFTVEFFIDDKDQLYVN

SEQ ID NO: 2043444 - protein, 28 aa, Staphylococcus
VEKIVDAQGFFKETFVFPTIDSTQLAAK

SEQ ID NO: 2043445 - protein, 18 aa, Staphylococcus
VEKLKEIIEEAAKNESYD

SEQ ID NO: 2043446 - protein, 23 aa, Staphylococcus
VEKMFHRKQFLGIYTLANAANHQ

SEQ ID NO: 2043447 - protein, 22 aa, Staphylococcus
VEKRLPRIEKMARQKDKTAEME

SEQ ID NO: 2043448 - protein, 23 aa, Staphylococcus
VEKRSKPDFERPHIAQVPQSKID

SEQ ID NO: 2043449 - protein, 17 aa, Staphylococcus
VEKSKQAQLEWEKTPEP

SEQ ID NO: 2043450 - protein, 18 aa, Staphylococcus
VEKWDINGELSFEKPSEY

SEQ ID NO: 2043451 - protein, 23 aa, Staphylococcus
VELAKERVQSIVAAEHLKRERIE

SEQ ID NO: 2043452 - protein, 27 aa, Staphylococcus
VELAKQRMENIFGLKVKVMKHALDGID

SEQ ID NO: 2043453 - protein, 28 aa, Staphylococcus
VELDDRYVLCLFDWRIIENEATNENYED

SEQ ID NO: 2043454 - protein, 25 aa, Staphylococcus
VELDNGFDFYAPQTFLDENGNRVLI

SEQ ID NO: 2043455 - protein, 23 aa, Staphylococcus
VELEIPSIISQVKFYHVPEGITI

SEQ ID NO: 2043456 - protein, 26 aa, Staphylococcus
VELEVPGVISQVRFYYVPTGITMEEL

SEQ ID NO: 2043457 - protein, 17 aa, Staphylococcus
VELFIRAYHKYYRQYEI

SEQ ID NO: 2043458 - protein, 19 aa, Staphylococcus
VELIKMGIMEVKIFRQPIL

SEQ ID NO: 2043459 - protein, 27 aa, Staphylococcus
VELKESGEWIGFVGLNYIPANSQYNFP

SEQ ID NO: 2043460 - protein, 19 aa, Staphylococcus
VELLEFFKSTYKTHFDMDG

SEQ ID NO: 2043461 - protein, 26 aa, Staphylococcus
VELLKDLELPLAKILSEMEEIGIYTD

SEQ ID NO: 2043462 - protein, 23 aa, Staphylococcus
VELLNLGGGFGIKYVEGDESFPI

SEQ ID NO: 2043463 - protein, 23 aa, Staphylococcus
VELLNLGGGFGIKYVEGDTSFPI

SEQ ID NO: 2043464 - protein, 23 aa, Staphylococcus
VELLNLGGGFGIKYVEGDVSFPI

SEQ ID NO: 2043465 - protein, 22 aa, Staphylococcus
VELMERMVWTRVLDQRSVSLNR

SEQ ID NO: 2043466 - protein, 21 aa, Staphylococcus
VELPNGAVFLFKGLDNPEKIK

SEQ ID NO: 2043467 - protein, 17 aa, Staphylococcus
VELPVEGLMLISPLLEF

SEQ ID NO: 2043468 - protein, 17 aa, Staphylococcus
VELRKAFEHDVTLSTQL

SEQ ID NO: 2043469 - protein, 17 aa, Staphylococcus
VELSGTYVLLASEESSY

SEQ ID NO: 2043470 - protein, 33 aa, Staphylococcus
VELSWHLGAIWRKDAYLNYVTRQWIDFISTLQP

SEQ ID NO: 2043471 - protein, 19 aa, Staphylococcus
VELTGSYKLLHCHHDDHKI

SEQ ID NO: 2043472 - protein, 17 aa, Staphylococcus
VELVERFMTKLRSHKTY

SEQ ID NO: 2043473 - protein, 33 aa, Staphylococcus
VEMEDRIYRSLGLLRYSRLMSVEEAAMRLSEVK

SEQ ID NO: 2043474 - protein, 20 aa, Staphylococcus
VEMGWFLNAINKFNFYEMDA

SEQ ID NO: 2043475 - protein, 19 aa, Staphylococcus
VEMIEPYKGRIYDPCCGSG

SEQ ID NO: 2043476 - protein, 19 aa, Staphylococcus
VEMKCFRYTNDLGTEIDEI

SEQ ID NO: 2043477 - protein, 23 aa, Staphylococcus
VEMRSEIPLARGLGSSASALVGA

SEQ ID NO: 2043478 - protein, 19 aa, Staphylococcus
VEMTEAFAAQSIPVSKNLG

SEQ ID NO: 2043479 - protein, 19 aa, Staphylococcus
VEMTEAFAVQSIAVKDNLN

SEQ ID NO: 2043480 - protein, 30 aa, Staphylococcus
VEMWDESLIPMPRAQFLDAIKDATACFITL

SEQ ID NO: 2043481 - protein, 17 aa, Staphylococcus
VENICPFSRDGQGRFLD

SEQ ID NO: 2043482 - protein, 22 aa, Staphylococcus
VENIEFKMLCMGFKRKEIKELM

SEQ ID NO: 2043483 - protein, 26 aa, Staphylococcus
VENIRFAAVLLRPFLTHAPKEIFKQL

SEQ ID NO: 2043484 - protein, 25 aa, Staphylococcus
VENIRFATVLLRPFITHAPKEIFKQ

SEQ ID NO: 2043485 - protein, 25 aa, Staphylococcus
VENIRFATVLLRPFITHAPRQIFEQ

SEQ ID NO: 2043486 - protein, 25 aa, Staphylococcus
VENIRFATVLLRPFLTHAPKEIFKQ

SEQ ID NO: 2043487 - protein, 25 aa, Staphylococcus
VENIRFATVLLRPFLTHAPREVFKQ

SEQ ID NO: 2043488 - protein, 26 aa, Staphylococcus
VENIRIIAVLLRPFLTHAPKQIFSQL

SEQ ID NO: 2043489 - protein, 20 aa, Staphylococcus
VENLCPFSRDGQMRVLDDNQ

SEQ ID NO: 2043490 - protein, 25 aa, Staphylococcus
VENLHLKNGLVWSIPITLPVTEDKA

SEQ ID NO: 2043491 - protein, 22 aa, Staphylococcus
VENLKVLIEHGYIDGQIEDNQI

SEQ ID NO: 2043492 - protein, 24 aa, Staphylococcus
VEPDESYHGISYAKDVGEAAYITK

SEQ ID NO: 2043493 - protein, 31 aa, Staphylococcus
VEPDVKETPFLKIDLNDMIAALPKQLTKRKI

SEQ ID NO: 2043494 - protein, 24 aa, Staphylococcus
VEPHADLILRSSITQLLKPHFGHR

SEQ ID NO: 2043495 - protein, 21 aa, Staphylococcus
VEPLLKKGFKTIIVGGDVKAN

SEQ ID NO: 2043496 - protein, 31 aa, Staphylococcus
VEPMYGKTYLPRKFKIGIALPPSNDIDVYSQ

SEQ ID NO: 2043497 - protein, 24 aa, Staphylococcus
VEPNRLRFDFSHFGQMTQDEINQV

SEQ ID NO: 2043498 - protein, 26 aa, Staphylococcus
VEPPCIYYYKCGGCQLQHMTYQAQLN

SEQ ID NO: 2043499 - protein, 18 aa, Staphylococcus
VEQAKIRMECKLNQIVTL

SEQ ID NO: 2043500 - protein, 24 aa, Staphylococcus
VEQIPGWLDQGVKIIGGCCQTTPE

SEQ ID NO: 2043501 - protein, 22 aa, Staphylococcus
VEQLVAFGRFPYSKGRLTKFDK

SEQ ID NO: 2043502 - protein, 18 aa, Staphylococcus
VEQLVKLDVQISVDTYRS

SEQ ID NO: 2043503 - protein, 21 aa, Staphylococcus
VEQQLRYLIGRGQGLTPSGDD

SEQ ID NO: 2043504 - protein, 20 aa, Staphylococcus
VEQRSSYGLGEVIIDALNNG

SEQ ID NO: 2043505 - protein, 23 aa, Staphylococcus
VEQYPEIKFEIISVDDHSVTGNV

SEQ ID NO: 2043506 - protein, 17 aa, Staphylococcus
VERCLKLLSTNVDERKA

SEQ ID NO: 2043507 - protein, 21 aa, Staphylococcus
VEREGFTFVGEQIWCQDNKKL

SEQ ID NO: 2043508 - protein, 23 aa, Staphylococcus
VEREIKRQAGILGDNVEITPQKV

SEQ ID NO: 2043509 - protein, 22 aa, Staphylococcus
VERKSFNIFDFVMLGHLHHPFS

SEQ ID NO: 2043510 - protein, 22 aa, Staphylococcus
VERLFSFNIAKTLIDSIDAETK

SEQ ID NO: 2043511 - protein, 18 aa, Staphylococcus
VERSCKFYGNSYISKKSE

SEQ ID NO: 2043512 - protein, 19 aa, Staphylococcus
VERVEGFANKDEWQRAYEE

SEQ ID NO: 2043513 - protein, 17 aa, Staphylococcus
VERWEYNEYGYLHKITN

SEQ ID NO: 2043514 - protein, 35 aa, Staphylococcus
VERYSNIKFILAHSGGTLPYINWRISEAVNTEKYI

SEQ ID NO: 2043515 - protein, 25 aa, Staphylococcus
VERYSRLRSIYKYEIYNEAGELATT

SEQ ID NO: 2043516 - protein, 17 aa, Staphylococcus
VESEGGDIHIGQKLYIL

SEQ ID NO: 2043517 - protein, 19 aa, Staphylococcus
VESIKFYRDVLKGELLVSG

SEQ ID NO: 2043518 - protein, 19 aa, Staphylococcus
VESLLEFFKSKISESDTIK

SEQ ID NO: 2043519 - protein, 21 aa, Staphylococcus
VESMMFYTCILDLIRNEETSE

SEQ ID NO: 2043520 - protein, 18 aa, Staphylococcus
VESVICAPTIQLDALITA

SEQ ID NO: 2043521 - protein, 18 aa, Staphylococcus
VESVICAPTIQLDALVTA

SEQ ID NO: 2043522 - protein, 22 aa, Staphylococcus
VESVMFYTCILDMMKEGETAEL

SEQ ID NO: 2043523 - protein, 21 aa, Staphylococcus
VETCDLPIVIKKDGLAAGKGV

SEQ ID NO: 2043524 - protein, 17 aa, Staphylococcus
VETEAYLGFTDRAAHGF

SEQ ID NO: 2043525 - protein, 25 aa, Staphylococcus
VETEPLFDLRELRITSNRICELLEG

SEQ ID NO: 2043526 - protein, 17 aa, Staphylococcus
VETESDFGLAFDGDGDR

SEQ ID NO: 2043527 - protein, 18 aa, Staphylococcus
VETLAEFSGVPVWNGLTD

SEQ ID NO: 2043528 - protein, 25 aa, Staphylococcus
VETLKALGAHVGWYIPNRFSEGYGP

SEQ ID NO: 2043529 - protein, 17 aa, Staphylococcus
VETLKCILPDVRKKSDV

SEQ ID NO: 2043530 - protein, 18 aa, Staphylococcus
VETLLEFGSPKAIIPKKI

SEQ ID NO: 2043531 - protein, 24 aa, Staphylococcus
VETPRFYLDFNKYIASAENNSTPF

SEQ ID NO: 2043532 - protein, 32 aa, Staphylococcus
VETVHLKLPIDWLKNKIIVDSLGLYSNNQRHS

SEQ ID NO: 2043533 - protein, 17 aa, Staphylococcus
VEVAEMIGEQLVEKSTV

SEQ ID NO: 2043534 - protein, 21 aa, Staphylococcus
VEVAPGVQGLVHISEIDHKHI

SEQ ID NO: 2043535 - protein, 17 aa, Staphylococcus
VEVERLLEMVEIKIHAL

SEQ ID NO: 2043536 - protein, 20 aa, Staphylococcus
VEVFKMPNIENVMSGEIEVN

SEQ ID NO: 2043537 - protein, 20 aa, Staphylococcus
VEVFLLSRVFSYVNHTNIPV

SEQ ID NO: 2043538 - protein, 18 aa, Staphylococcus
VEVGEKQAAIDLKVILEY

SEQ ID NO: 2043539 - protein, 21 aa, Staphylococcus
VEVKHAFSMSKITKVLDNANK

SEQ ID NO: 2043540 - protein, 17 aa, Staphylococcus
VEVLSYFRNNPCPENIP

SEQ ID NO: 2043541 - protein, 19 aa, Staphylococcus
VEVPCVKRNAAGASNAIVS

SEQ ID NO: 2043542 - protein, 19 aa, Staphylococcus
VEVPLDVRTSEIFDLEGYD

SEQ ID NO: 2043543 - protein, 17 aa, Staphylococcus
VEVTRRLYRSGESEYYL

SEQ ID NO: 2043544 - protein, 23 aa, Staphylococcus
VEVVDLRTIYPLDKETIIQHAKQ

SEQ ID NO: 2043545 - protein, 23 aa, Staphylococcus
VEVVDLRTVYPLDKDTIIERAKK

SEQ ID NO: 2043546 - protein, 23 aa, Staphylococcus
VEVVDLRTVYPLDKETIIERAKL

SEQ ID NO: 2043547 - protein, 23 aa, Staphylococcus
VEVVDLRTVYPLDKTTIIERAKR

SEQ ID NO: 2043548 - protein, 17 aa, Staphylococcus
VEYFKPYLSKLNYKKIA

SEQ ID NO: 2043549 - protein, 31 aa, Staphylococcus
VEYKYKIPHGHAIMIGMIYQFIVANHLLGTQ

SEQ ID NO: 2043550 - protein, 24 aa, Staphylococcus
VEYRRGEHAWPIPEEDTKKALQAF

SEQ ID NO: 2043551 - protein, 22 aa, Staphylococcus
VEYSIKNALKFYENIELSEQDK

SEQ ID NO: 2043552 - protein, 18 aa, Staphylococcus
VFAAMKQGIDFKAINKEA

SEQ ID NO: 2043553 - protein, 18 aa, Staphylococcus
VFASGLLMQELTKYGFEI

SEQ ID NO: 2043554 - protein, 19 aa, Staphylococcus
VFCYGLMVNYCLQVADILA

SEQ ID NO: 2043555 - protein, 18 aa, Staphylococcus
VFDDARLTNSLGEVANFS

SEQ ID NO: 2043556 - protein, 17 aa, Staphylococcus
VFDHAFETYDVIVVAGF

SEQ ID NO: 2043557 - protein, 26 aa, Staphylococcus
VFDPNLRFPLWDSLDDLRETVLDFIP

SEQ ID NO: 2043558 - protein, 18 aa, Staphylococcus
VFDRGGYLYHGRVKALAD

SEQ ID NO: 2043559 - protein, 20 aa, Staphylococcus
VFDRGGYLYHGRVKALADAA

SEQ ID NO: 2043560 - protein, 24 aa, Staphylococcus
VFDSKGGFYFTDFRGYSTHPQGGV

SEQ ID NO: 2043561 - protein, 20 aa, Staphylococcus
VFEDCLRAAVDRSVELSSQD

SEQ ID NO: 2043562 - protein, 20 aa, Staphylococcus
VFEINLKVAEVLSGTVTPQG

SEQ ID NO: 2043563 - protein, 24 aa, Staphylococcus
VFENEIIGYLGLWMVIDQAQITTI

SEQ ID NO: 2043564 - protein, 19 aa, Staphylococcus
VFERHVRYAYDYKEITDDL

SEQ ID NO: 2043565 - protein, 18 aa, Staphylococcus
VFEYTRRIYKLQDLEFLK

SEQ ID NO: 2043566 - protein, 20 aa, Staphylococcus
VFFGSALANFGVQNFLNAYV

SEQ ID NO: 2043567 - protein, 25 aa, Staphylococcus
VFGKLKYKQAVIIGAGEMSELSLLN

SEQ ID NO: 2043568 - protein, 20 aa, Staphylococcus
VFGSIIGGFLEWQKNEETTL

SEQ ID NO: 2043569 - protein, 19 aa, Staphylococcus
VFGVPGDFNLTFLDDIISR

SEQ ID NO: 2043570 - protein, 18 aa, Staphylococcus
VFHGLELANQKATLTNMK

SEQ ID NO: 2043571 - protein, 19 aa, Staphylococcus
VFHKDTFGTIGRVANILGD

SEQ ID NO: 2043572 - protein, 25 aa, Staphylococcus
VFHYFKEAHPYFNQNVVIIGGKNSA

SEQ ID NO: 2043573 - protein, 21 aa, Staphylococcus
VFIGPSCGFYTAHHPLTPKER

SEQ ID NO: 2043574 - protein, 19 aa, Staphylococcus
VFIPGSLVDYIYVAGDSKH

SEQ ID NO: 2043575 - protein, 18 aa, Staphylococcus
VFISWTGKMNETFVLAHE

SEQ ID NO: 2043576 - protein, 27 aa, Staphylococcus
VFKDFAVVGDTLFKQGIGRTDLYKGDY

SEQ ID NO: 2043577 - protein, 31 aa, Staphylococcus
VFKEAGFEWREPGCSMCLGMNPDQVPEGVHC

SEQ ID NO: 2043578 - protein, 17 aa, Staphylococcus
VFKEVPNALKSLMDLQK

SEQ ID NO: 2043579 - protein, 24 aa, Staphylococcus
VFKGHKMPGRMGGNTVTVQNLEVV

SEQ ID NO: 2043580 - protein, 23 aa, Staphylococcus
VFKGQKAPGRMGGNTVTVQNLEV

SEQ ID NO: 2043581 - protein, 28 aa, Staphylococcus
VFKHLNRFARIPVCGAISSYNHPERDIG

SEQ ID NO: 2043582 - protein, 17 aa, Staphylococcus
VFKKCREDDDNVLFIDA

SEQ ID NO: 2043583 - protein, 25 aa, Staphylococcus
VFKPEARSIIELAARIYKGIIDEVR

SEQ ID NO: 2043584 - protein, 27 aa, Staphylococcus
VFKQCYKLYFKFVMPIFGKIFAKSKDE

SEQ ID NO: 2043585 - protein, 18 aa, Staphylococcus
VFLADSVEIIPVEIQIRT

SEQ ID NO: 2043586 - protein, 21 aa, Staphylococcus
VFLIIRFKLLDEVYLLPFSKF

SEQ ID NO: 2043587 - protein, 18 aa, Staphylococcus
VFLMIRFKSLDEVYLLPY

SEQ ID NO: 2043588 - protein, 18 aa, Staphylococcus
VFLQHGVLGTKNLSNING

SEQ ID NO: 2043589 - protein, 17 aa, Staphylococcus
VFMKFKSGLDVSSHQSA

SEQ ID NO: 2043590 - protein, 17 aa, Staphylococcus
VFMLPKDYLRYCLTNQI

SEQ ID NO: 2043591 - protein, 19 aa, Staphylococcus
VFNDARFDSKEAFVAYFIQ

SEQ ID NO: 2043592 - protein, 25 aa, Staphylococcus
VFNIPLTAFAPHISQTFDLRDYVTL

SEQ ID NO: 2043593 - protein, 19 aa, Staphylococcus
VFNPLTIFKLQHACRENDY

SEQ ID NO: 2043594 - protein, 19 aa, Staphylococcus
VFNSGLPLTMIGLDLAREA

SEQ ID NO: 2043595 - protein, 20 aa, Staphylococcus
VFPDYELSYNKAIDELKSFS

SEQ ID NO: 2043596 - protein, 19 aa, Staphylococcus
VFPELKQVIGDTLMITDGT

SEQ ID NO: 2043597 - protein, 19 aa, Staphylococcus
VFPIKGEVSPSFEGEFEYL

SEQ ID NO: 2043598 - protein, 25 aa, Staphylococcus
VFPYSQRIGTPAARMGDQIDESIKN

SEQ ID NO: 2043599 - protein, 19 aa, Staphylococcus
VFQDLNGRIDGIINGDQSE

SEQ ID NO: 2043600 - protein, 18 aa, Staphylococcus
VFQGEALLFLLGLTNSMA

SEQ ID NO: 2043601 - protein, 23 aa, Staphylococcus
VFQGETLLFLLGLTNSMAGFEKL

SEQ ID NO: 2043602 - protein, 19 aa, Staphylococcus
VFRILRPYYTSEIIQNINS

SEQ ID NO: 2043603 - protein, 18 aa, Staphylococcus
VFRKQIALAKRVNLPIVI

SEQ ID NO: 2043604 - protein, 19 aa, Staphylococcus
VFRKQIALAKRVQLPIIIH

SEQ ID NO: 2043605 - protein, 22 aa, Staphylococcus
VFSDNFLKRVELVVDNETMLAI

SEQ ID NO: 2043606 - protein, 25 aa, Staphylococcus
VFSNIKGLFLISGFNEPLHNLPELN

SEQ ID NO: 2043607 - protein, 24 aa, Staphylococcus
VFTEGYNPSHFVSIIKQHGALLAK

SEQ ID NO: 2043608 - protein, 17 aa, Staphylococcus
VFYELGFVTEENGIIKI

SEQ ID NO: 2043609 - protein, 22 aa, Staphylococcus
VFYIPNCDKITPGMLLASVRTN

SEQ ID NO: 2043610 - protein, 26 aa, Staphylococcus
VFYIPNCDKITPGMLMAAVRTNVPAI

SEQ ID NO: 2043611 - protein, 18 aa, Staphylococcus
VGADGAWSKVRKVLTDIT

SEQ ID NO: 2043612 - protein, 28 aa, Staphylococcus
VGADSFKESLRWGAEIFHNLAKILKKRG

SEQ ID NO: 2043613 - protein, 21 aa, Staphylococcus
VGAEVKDGDILVGKVTPKGVT

SEQ ID NO: 2043614 - protein, 18 aa, Staphylococcus
VGAHPGSLGPIFDKDIKI

SEQ ID NO: 2043615 - protein, 25 aa, Staphylococcus
VGAKAEVDGGFTIGGINFDVGGSVG

SEQ ID NO: 2043616 - protein, 19 aa, Staphylococcus
VGAKLMVDMAHIAGLVAAG

SEQ ID NO: 2043617 - protein, 19 aa, Staphylococcus
VGAKLMVDMAHIAGLVAVG

SEQ ID NO: 2043618 - protein, 20 aa, Staphylococcus
VGAKLMVDMAHIAGLVAVGL

SEQ ID NO: 2043619 - protein, 17 aa, Staphylococcus
VGAKRFSIEGVDALVPM

SEQ ID NO: 2043620 - protein, 19 aa, Staphylococcus
VGASDWIGTHGYVNAYNEI

SEQ ID NO: 2043621 - protein, 26 aa, Staphylococcus
VGASQYRKDFCKTFLNTVDVVVIKGN

SEQ ID NO: 2043622 - protein, 25 aa, Staphylococcus
VGASTYRKTFCERFLAEVEVSVIKG

SEQ ID NO: 2043623 - protein, 20 aa, Staphylococcus
VGAYLKAKDGRTFYGTNVEN

SEQ ID NO: 2043624 - protein, 23 aa, Staphylococcus
VGCPIGNYIPEWNDLVYHQDYKA

SEQ ID NO: 2043625 - protein, 21 aa, Staphylococcus
VGDAFARRSQYALDIDFKEEA

SEQ ID NO: 2043626 - protein, 19 aa, Staphylococcus
VGDIKHSYADISPIQSLGF

SEQ ID NO: 2043627 - protein, 22 aa, Staphylococcus
VGDIKVSGDFTIENDPEESVVT

SEQ ID NO: 2043628 - protein, 21 aa, Staphylococcus
VGDKIQFSLGYKALAHSMYMV

SEQ ID NO: 2043629 - protein, 18 aa, Staphylococcus
VGDKQLVKVAAWYDNEMS

SEQ ID NO: 2043630 - protein, 18 aa, Staphylococcus
VGDKVTHKAWGEGMVSNV

SEQ ID NO: 2043631 - protein, 17 aa, Staphylococcus
VGDKVTHKSWGEGMVSN

SEQ ID NO: 2043632 - protein, 17 aa, Staphylococcus
VGDLVLYLPTRYEDNTV

SEQ ID NO: 2043633 - protein, 24 aa, Staphylococcus
VGDPLLKFDLEFIRNNAKSVISPI

SEQ ID NO: 2043634 - protein, 22 aa, Staphylococcus
VGDPLLKFDLEYIRNNAKDVIS

SEQ ID NO: 2043635 - protein, 19 aa, Staphylococcus
VGDRIPHEIIQLLKQNLTK

SEQ ID NO: 2043636 - protein, 22 aa, Staphylococcus
VGDVDPKRICNVIEEHENRRHK

SEQ ID NO: 2043637 - protein, 24 aa, Staphylococcus
VGDVLKHLQIRGSVALIGNTDGVE

SEQ ID NO: 2043638 - protein, 24 aa, Staphylococcus
VGEHCFKEDYGIQRKSRLMTEAEY

SEQ ID NO: 2043639 - protein, 18 aa, Staphylococcus
VGEHSRYDLMLVQTNRHF

SEQ ID NO: 2043640 - protein, 23 aa, Staphylococcus
VGEIKVLFETPANLNSIEKEVYD

SEQ ID NO: 2043641 - protein, 19 aa, Staphylococcus
VGEILKIKNIIYTKSSTPR

SEQ ID NO: 2043642 - protein, 17 aa, Staphylococcus
VGELPIVAIGGINETNI

SEQ ID NO: 2043643 - protein, 29 aa, Staphylococcus
VGENRPVFYPNYWGGDKFHIKEQFEKSGY

SEQ ID NO: 2043644 - protein, 24 aa, Staphylococcus
VGESEPSLDFMGTFDAVKDDDYKD

SEQ ID NO: 2043645 - protein, 21 aa, Staphylococcus
VGEVHLGVVFKINVNSNDVES

SEQ ID NO: 2043646 - protein, 23 aa, Staphylococcus
VGEVITRAWQTAHRMKEQRGPLE

SEQ ID NO: 2043647 - protein, 18 aa, Staphylococcus
VGEVITRTWQVAHRMKEQ

SEQ ID NO: 2043648 - protein, 17 aa, Staphylococcus
VGEVWAISAHQYGDSII

SEQ ID NO: 2043649 - protein, 18 aa, Staphylococcus
VGFFLVPREFDGVEIAEN

SEQ ID NO: 2043650 - protein, 23 aa, Staphylococcus
VGFSRGGLQGLLAFQHLPANSYI

SEQ ID NO: 2043651 - protein, 24 aa, Staphylococcus
VGGDMGVMYGHIPTVTAIHTGYVK

SEQ ID NO: 2043652 - protein, 17 aa, Staphylococcus
VGGEPMVECFKASFEAT

SEQ ID NO: 2043653 - protein, 25 aa, Staphylococcus
VGGFGRPYPYMIFKNMEDLELQSVK

SEQ ID NO: 2043654 - protein, 20 aa, Staphylococcus
VGGLGLDFVHDHGYNLEQVK

SEQ ID NO: 2043655 - protein, 18 aa, Staphylococcus
VGGMYEYGLSRYFTAMLS

SEQ ID NO: 2043656 - protein, 18 aa, Staphylococcus
VGGTCFNVGCIQSKLLIE

SEQ ID NO: 2043657 - protein, 17 aa, Staphylococcus
VGHILLMEEMIINGEDL

SEQ ID NO: 2043658 - protein, 20 aa, Staphylococcus
VGHINFISRLLEGHYPDTSR

SEQ ID NO: 2043659 - protein, 18 aa, Staphylococcus
VGHKKAREIWYLCRQYDA

SEQ ID NO: 2043660 - protein, 20 aa, Staphylococcus
VGHVNFISRLLEGHYPDTTR

SEQ ID NO: 2043661 - protein, 17 aa, Staphylococcus
VGIDLKSRYDIHQLLNQ

SEQ ID NO: 2043662 - protein, 17 aa, Staphylococcus
VGIELNEGLAKPAKLVQ

SEQ ID NO: 2043663 - protein, 18 aa, Staphylococcus
VGIGRPGYFRFQAQVMPK

SEQ ID NO: 2043664 - protein, 19 aa, Staphylococcus
VGIKDNFFELGGHSLRATL

SEQ ID NO: 2043665 - protein, 25 aa, Staphylococcus
VGIKKRKLDLGWIVSECPSSVAYVQ

SEQ ID NO: 2043666 - protein, 19 aa, Staphylococcus
VGIKSREVYETPGAEVILK

SEQ ID NO: 2043667 - protein, 18 aa, Staphylococcus
VGILPRAHGSGLFTRGQT

SEQ ID NO: 2043668 - protein, 18 aa, Staphylococcus
VGIPATFDLCQKLIGVDG

SEQ ID NO: 2043669 - protein, 18 aa, Staphylococcus
VGIVYGRDIAGKKAAFMK

SEQ ID NO: 2043670 - protein, 17 aa, Staphylococcus
VGIVYGRNIVGKKAAFM

SEQ ID NO: 2043671 - protein, 17 aa, Staphylococcus
VGKEIRNKIGILNKKEM

SEQ ID NO: 2043672 - protein, 17 aa, Staphylococcus
VGKELREMMPFVENKTI

SEQ ID NO: 2043673 - protein, 21 aa, Staphylococcus
VGKFGCAQCYATFKDDIIDIV

SEQ ID NO: 2043674 - protein, 30 aa, Staphylococcus
VGKGGLLITLARISAHYGLGLEASIDLSDA

SEQ ID NO: 2043675 - protein, 30 aa, Staphylococcus
VGKGGLLITLARISAHYSLGLKAKVNLSDA

SEQ ID NO: 2043676 - protein, 27 aa, Staphylococcus
VGKKIPDEFVVGYGLDYGEHYRNLPYI

SEQ ID NO: 2043677 - protein, 29 aa, Staphylococcus
VGKSPAQVIIRWNIEHGVVVIPKSVTPSR

SEQ ID NO: 2043678 - protein, 25 aa, Staphylococcus
VGKSPAQVIIRWNIQHDVVVIPKSV

SEQ ID NO: 2043679 - protein, 18 aa, Staphylococcus
VGKSTLFNAITKAGALAA

SEQ ID NO: 2043680 - protein, 18 aa, Staphylococcus
VGLAHDWATMGVSIADVL

SEQ ID NO: 2043681 - protein, 20 aa, Staphylococcus
VGLARCKKSDIDAVYEATKD

SEQ ID NO: 2043682 - protein, 26 aa, Staphylococcus
VGLDMPRVLGDIIICTNVAEEQADSF

SEQ ID NO: 2043683 - protein, 27 aa, Staphylococcus
VGLEPGKDVFLGFDCASSEFFEDGVYN

SEQ ID NO: 2043684 - protein, 25 aa, Staphylococcus
VGLEPGKDVYLGFDIASSEFYENGV

SEQ ID NO: 2043685 - protein, 23 aa, Staphylococcus
VGLKSEIYTVSSRIGLKRNDEGI

SEQ ID NO: 2043686 - protein, 17 aa, Staphylococcus
VGLKYGKNYSHAEANDI

SEQ ID NO: 2043687 - protein, 28 aa, Staphylococcus
VGLLLEIQNRLGIEVSIMDFDRDEWATP

SEQ ID NO: 2043688 - protein, 17 aa, Staphylococcus
VGLPREVLIPWEDLPKV

SEQ ID NO: 2043689 - protein, 18 aa, Staphylococcus
VGLTAAQAEARHYNYLEN

SEQ ID NO: 2043690 - protein, 17 aa, Staphylococcus
VGLTSFIIKSLRNDDYI

SEQ ID NO: 2043691 - protein, 18 aa, Staphylococcus
VGMEEPWRYRNKSQIPVG

SEQ ID NO: 2043692 - protein, 17 aa, Staphylococcus
VGMGFPKQDEWIVAQQH

SEQ ID NO: 2043693 - protein, 23 aa, Staphylococcus
VGMGYSLHAGMVIVADGSDRAKE

SEQ ID NO: 2043694 - protein, 18 aa, Staphylococcus
VGNADVTYGLAIEGNNIT

SEQ ID NO: 2043695 - protein, 17 aa, Staphylococcus
VGNADVTYGLAIEQDQI

SEQ ID NO: 2043696 - protein, 17 aa, Staphylococcus
VGNAIYLNLLVDDIDAV

SEQ ID NO: 2043697 - protein, 20 aa, Staphylococcus
VGNALKYLMRASRKNGLEDL

SEQ ID NO: 2043698 - protein, 19 aa, Staphylococcus
VGNDIFLCTPDNVEVAGSI

SEQ ID NO: 2043699 - protein, 18 aa, Staphylococcus
VGNDWYAIMEELASYRTG

SEQ ID NO: 2043700 - protein, 23 aa, Staphylococcus
VGNETRRSMDFPKPIQEKIKHYF

SEQ ID NO: 2043701 - protein, 19 aa, Staphylococcus
VGNGDLIIITAGVPTGEKG

SEQ ID NO: 2043702 - protein, 17 aa, Staphylococcus
VGNKLSFGEGKIIAECI

SEQ ID NO: 2043703 - protein, 18 aa, Staphylococcus
VGNKMIGAKVNGKIEPID

SEQ ID NO: 2043704 - protein, 24 aa, Staphylococcus
VGNLGRALLTYNFSIHAEMTITEA

SEQ ID NO: 2043705 - protein, 17 aa, Staphylococcus
VGNTLSFGNGKIIAECI

SEQ ID NO: 2043706 - protein, 19 aa, Staphylococcus
VGNVNFISRLLEGHYPDTT

SEQ ID NO: 2043707 - protein, 24 aa, Staphylococcus
VGPGPRQALDYMYELAERDGFSTH

SEQ ID NO: 2043708 - protein, 18 aa, Staphylococcus
VGPNCPGVITADECKIGI

SEQ ID NO: 2043709 - protein, 25 aa, Staphylococcus
VGPYTKAAVMSIAFNHPLPTVDGNV

SEQ ID NO: 2043710 - protein, 18 aa, Staphylococcus
VGQAIAIVGEGKGSTSSS

SEQ ID NO: 2043711 - protein, 20 aa, Staphylococcus
VGQNAIKPLLDFVRNIDEEY

SEQ ID NO: 2043712 - protein, 25 aa, Staphylococcus
VGQTPAQVIIRWNYQHQVVTIPKSV

SEQ ID NO: 2043713 - protein, 17 aa, Staphylococcus
VGRELRKMMPFIKAKSI

SEQ ID NO: 2043714 - protein, 17 aa, Staphylococcus
VGRGGGSIEDLWNFNEE

SEQ ID NO: 2043715 - protein, 22 aa, Staphylococcus
VGRGGGSIEDLWNFNEEEVVRA

SEQ ID NO: 2043716 - protein, 23 aa, Staphylococcus
VGRGMTINRMYWRARRRESIFMT

SEQ ID NO: 2043717 - protein, 23 aa, Staphylococcus
VGRGMTINRMYWRARRRESLFMT

SEQ ID NO: 2043718 - protein, 17 aa, Staphylococcus
VGRLDYDTSGLLLLTND

SEQ ID NO: 2043719 - protein, 20 aa, Staphylococcus
VGRQHKGLGWVITYSQEEDI

SEQ ID NO: 2043720 - protein, 22 aa, Staphylococcus
VGRQHKGLGWVLSYDENEDINT

SEQ ID NO: 2043721 - protein, 22 aa, Staphylococcus
VGRQHKGLGWVLSYDPSEDINT

SEQ ID NO: 2043722 - protein, 23 aa, Staphylococcus
VGRQHKGLGWVLSYDQNEAINTS

SEQ ID NO: 2043723 - protein, 22 aa, Staphylococcus
VGRQHKGLGWVLSYNPSEEITT

SEQ ID NO: 2043724 - protein, 23 aa, Staphylococcus
VGRSCPKCDHYLVERKKGRSSQV

SEQ ID NO: 2043725 - protein, 20 aa, Staphylococcus
VGSAKIALERAIEINDNVAL

SEQ ID NO: 2043726 - protein, 24 aa, Staphylococcus
VGSAKIALERAIEINDNVALVSDG

SEQ ID NO: 2043727 - protein, 26 aa, Staphylococcus
VGSDVPFCIYSKTAICTGHGEKVHLL

SEQ ID NO: 2043728 - protein, 26 aa, Staphylococcus
VGSECVAEGLPLFLEIVSYDANNADS

SEQ ID NO: 2043729 - protein, 24 aa, Staphylococcus
VGSGGTYAGLWYGQMINCETTQII

SEQ ID NO: 2043730 - protein, 18 aa, Staphylococcus
VGSIEFLEVVGLEGSTYK

SEQ ID NO: 2043731 - protein, 17 aa, Staphylococcus
VGSKVGLYFDPEAIHIM

SEQ ID NO: 2043732 - protein, 17 aa, Staphylococcus
VGSMAAVLGLDYEAVDA

SEQ ID NO: 2043733 - protein, 18 aa, Staphylococcus
VGSMNIFFVENGKLVTPK

SEQ ID NO: 2043734 - protein, 19 aa, Staphylococcus
VGSPDALIECSIRGMDMFD

SEQ ID NO: 2043735 - protein, 23 aa, Staphylococcus
VGSTVKFDVAFGLENHAVPHDEM

SEQ ID NO: 2043736 - protein, 25 aa, Staphylococcus
VGTFKEFNLFLLMVEGKTYKDMARI

SEQ ID NO: 2043737 - protein, 18 aa, Staphylococcus
VGTGEFISLLGASGSGKT

SEQ ID NO: 2043738 - protein, 21 aa, Staphylococcus
VGTKLKLAIDHAKHDSIGIDA

SEQ ID NO: 2043739 - protein, 22 aa, Staphylococcus
VGTKLKLAIDHGKHDTIGIDAV

SEQ ID NO: 2043740 - protein, 25 aa, Staphylococcus
VGTRREYYIFFLLCEGKSMNEIAKI

SEQ ID NO: 2043741 - protein, 23 aa, Staphylococcus
VGTSEGGLNWLLDHASARVPELK

SEQ ID NO: 2043742 - protein, 17 aa, Staphylococcus
VGVDYIFHPTVKEMYPE

SEQ ID NO: 2043743 - protein, 17 aa, Staphylococcus
VGVIRDWEAKWYAEKDF

SEQ ID NO: 2043744 - protein, 18 aa, Staphylococcus
VGVLPRAHGSGLFTRGQT

SEQ ID NO: 2043745 - protein, 20 aa, Staphylococcus
VGVQACKRANVQPGSTVVIM

SEQ ID NO: 2043746 - protein, 19 aa, Staphylococcus
VGVRVIEFADVPAGEVWMT

SEQ ID NO: 2043747 - protein, 19 aa, Staphylococcus
VGVRVVVPFGPRTVQGYVM

SEQ ID NO: 2043748 - protein, 17 aa, Staphylococcus
VGVSRPGTTLSTTDEGE

SEQ ID NO: 2043749 - protein, 17 aa, Staphylococcus
VGVVAIFTYGLAKADDM

SEQ ID NO: 2043750 - protein, 18 aa, Staphylococcus
VGVVLKLIRKSFYDAHHI

SEQ ID NO: 2043751 - protein, 25 aa, Staphylococcus
VGVVSRLITDLAVFDFIDGQMRLVE

SEQ ID NO: 2043752 - protein, 19 aa, Staphylococcus
VGYDDIDFARYMIPSLTTV

SEQ ID NO: 2043753 - protein, 25 aa, Staphylococcus
VGYDMMSQIRWLSVLDLKDKNEDQL

SEQ ID NO: 2043754 - protein, 17 aa, Staphylococcus
VGYIWFQIISLMETPFR

SEQ ID NO: 2043755 - protein, 21 aa, Staphylococcus
VGYPLIVRPAFTMGGTGGGIC

SEQ ID NO: 2043756 - protein, 18 aa, Staphylococcus
VGYSFKFDGAISQAVAYQ

SEQ ID NO: 2043757 - protein, 25 aa, Staphylococcus
VGYSTMSQIRWLSVLDLKDKSEDQL

SEQ ID NO: 2043758 - protein, 25 aa, Staphylococcus
VGYSTMSQIRWLSVLDLKNKTEDQL

SEQ ID NO: 2043759 - protein, 19 aa, Staphylococcus
VHACWLAQIEIAMINTRLT

SEQ ID NO: 2043760 - protein, 21 aa, Staphylococcus
VHAGGSLATYAYKHMDEPIVV

SEQ ID NO: 2043761 - protein, 20 aa, Staphylococcus
VHAGGSLATYAYKHMNDPIV

SEQ ID NO: 2043762 - protein, 19 aa, Staphylococcus
VHAGGSLATYAYQHMEDPI

SEQ ID NO: 2043763 - protein, 19 aa, Staphylococcus
VHAGGSLATYAYQHMNDPI

SEQ ID NO: 2043764 - protein, 24 aa, Staphylococcus
VHAGGSLATYAYRHMQDPIVVEHI

SEQ ID NO: 2043765 - protein, 19 aa, Staphylococcus
VHAGGSLSTYAYQHMDNPM

SEQ ID NO: 2043766 - protein, 18 aa, Staphylococcus
VHARGFGAHGEFQVYEDL

SEQ ID NO: 2043767 - protein, 32 aa, Staphylococcus
VHASNLSGIIGFKLSQKLKIPSFVVDPVVVDE

SEQ ID NO: 2043768 - protein, 21 aa, Staphylococcus
VHAVISRAIVEVCMGELYQFQ

SEQ ID NO: 2043769 - protein, 21 aa, Staphylococcus
VHCYTEFFNHIGYVDAKQNGI

SEQ ID NO: 2043770 - protein, 26 aa, Staphylococcus
VHDTIPWPNYVHYASSKGGLKLMMET

SEQ ID NO: 2043771 - protein, 18 aa, Staphylococcus
VHEDVDFIFGYPGGAVLP

SEQ ID NO: 2043772 - protein, 18 aa, Staphylococcus
VHELKMVLNKTVPEDLFF

SEQ ID NO: 2043773 - protein, 23 aa, Staphylococcus
VHELKMVLNRSIDEDLFFIISLS

SEQ ID NO: 2043774 - protein, 21 aa, Staphylococcus
VHEPRLKLKNWSEIDQDKIEK

SEQ ID NO: 2043775 - protein, 18 aa, Staphylococcus
VHEVPTVFTSLNFTTHLH

SEQ ID NO: 2043776 - protein, 19 aa, Staphylococcus
VHEVPTVFTSLNFTTHLHD

SEQ ID NO: 2043777 - protein, 26 aa, Staphylococcus
VHFGSSEWYLIMIIKYDQPTFAELTH

SEQ ID NO: 2043778 - protein, 22 aa, Staphylococcus
VHFPESDKYLFAKVSSTHAFGR

SEQ ID NO: 2043779 - protein, 21 aa, Staphylococcus
VHFVGTFTVEFFIDKQNQLYV

SEQ ID NO: 2043780 - protein, 21 aa, Staphylococcus
VHFVGTFTVEFFIDKSNNLYV

SEQ ID NO: 2043781 - protein, 18 aa, Staphylococcus
VHGGELFPESALVTNNVE

SEQ ID NO: 2043782 - protein, 18 aa, Staphylococcus
VHGGELFPKSALVTDEVE

SEQ ID NO: 2043783 - protein, 24 aa, Staphylococcus
VHGLELMFDKMHQILEQYVEDNNL

SEQ ID NO: 2043784 - protein, 18 aa, Staphylococcus
VHIKRLRQKLSRLGASIS

SEQ ID NO: 2043785 - protein, 26 aa, Staphylococcus
VHINLPLEWLKGKIIVDSLGLHSNNQ

SEQ ID NO: 2043786 - protein, 18 aa, Staphylococcus
VHITDMYGSPGFSNEKLS

SEQ ID NO: 2043787 - protein, 19 aa, Staphylococcus
VHKAIPSKLILLGDGPELM

SEQ ID NO: 2043788 - protein, 17 aa, Staphylococcus
VHKGFKEGLSKDYIQPR

SEQ ID NO: 2043789 - protein, 21 aa, Staphylococcus
VHKHIPSKLILLGDGPELLDM

SEQ ID NO: 2043790 - protein, 23 aa, Staphylococcus
VHKLAEIRWKELGQHVSQIVSID

SEQ ID NO: 2043791 - protein, 26 aa, Staphylococcus
VHKRWSRLDFGDFILGGHRFTDAHRN

SEQ ID NO: 2043792 - protein, 24 aa, Staphylococcus
VHKYLPLLHRYTALRKEVLGLDDM

SEQ ID NO: 2043793 - protein, 17 aa, Staphylococcus
VHLAEWLMEMQLDRQAG

SEQ ID NO: 2043794 - protein, 17 aa, Staphylococcus
VHLAKERIQSIVEAEHL

SEQ ID NO: 2043795 - protein, 18 aa, Staphylococcus
VHLEGPFISEHKVGAQNP

SEQ ID NO: 2043796 - protein, 19 aa, Staphylococcus
VHLGPKYQIQFIVRDLGGS

SEQ ID NO: 2043797 - protein, 23 aa, Staphylococcus
VHLHTRIGLHAGSLNNPTFTEEQ

SEQ ID NO: 2043798 - protein, 28 aa, Staphylococcus
VHLNLPLEWLKDKIIVDSLGLHSNNQRH

SEQ ID NO: 2043799 - protein, 27 aa, Staphylococcus
VHLNLPLEWLKGKIIVDSLGLHSNNQR

SEQ ID NO: 2043800 - protein, 18 aa, Staphylococcus
VHLTLRPLGSTPFTLLDY

SEQ ID NO: 2043801 - protein, 18 aa, Staphylococcus
VHMASLRKKLNYTQDPNT

SEQ ID NO: 2043802 - protein, 18 aa, Staphylococcus
VHMGDIFPTTAHRNPLWV

SEQ ID NO: 2043803 - protein, 19 aa, Staphylococcus
VHMIQDVYEDFGFEDYTFR

SEQ ID NO: 2043804 - protein, 20 aa, Staphylococcus
VHMIQDVYKDFGFEDYTFRL

SEQ ID NO: 2043805 - protein, 19 aa, Staphylococcus
VHMMFYKMGVVSFYGPALL

SEQ ID NO: 2043806 - protein, 22 aa, Staphylococcus
VHNRRDLGGLIFVDLRDREGYV

SEQ ID NO: 2043807 - protein, 21 aa, Staphylococcus
VHPAHNYKLLIILSPSGSYYG

SEQ ID NO: 2043808 - protein, 23 aa, Staphylococcus
VHPDELDELAIPHAAFKDIVQMM

SEQ ID NO: 2043809 - protein, 24 aa, Staphylococcus
VHPQLKICACLGLTKEEQAEKLKG

SEQ ID NO: 2043810 - protein, 26 aa, Staphylococcus
VHPREVFKAAIKWSSNAIIVVHNHPS

SEQ ID NO: 2043811 - protein, 23 aa, Staphylococcus
VHPYRVKLALGQVRHYQLEDLLN

SEQ ID NO: 2043812 - protein, 22 aa, Staphylococcus
VHPYRVKLALNQVRHYELGQLL

SEQ ID NO: 2043813 - protein, 17 aa, Staphylococcus
VHQGLGHNSFWFGGSKE

SEQ ID NO: 2043814 - protein, 21 aa, Staphylococcus
VHRKEMRSTLESILKMHAGQE

SEQ ID NO: 2043815 - protein, 19 aa, Staphylococcus
VHRLIRKYIIEQSMDRKEK

SEQ ID NO: 2043816 - protein, 17 aa, Staphylococcus
VHSHYKHLFAILELAKK

SEQ ID NO: 2043817 - protein, 27 aa, Staphylococcus
VHSRFSTNTFPSWKRAHPNRLLMHNGE

SEQ ID NO: 2043818 - protein, 33 aa, Staphylococcus; identical to SEQ ID NO: 1794158

SEQ ID NO: 2043819 - protein, 32 aa, Staphylococcus
VHSRFSTNTFPSWKRAHPNRMLMHNGEINTIQ

SEQ ID NO: 2043820 - protein, 24 aa, Staphylococcus
VHSSKGLEFPYVIYSELSKNFNKG

SEQ ID NO: 2043821 - protein, 19 aa, Staphylococcus
VHTDFFMKEFNSINQSFSE

SEQ ID NO: 2043822 - protein, 17 aa, Staphylococcus
VHTIYKMSTLFHNQCYI

SEQ ID NO: 2043823 - protein, 23 aa, Staphylococcus
VHTYKMKYIKSFDAIDLHHVIFE

SEQ ID NO: 2043824 - protein, 30 aa, Staphylococcus
VHWEELKHSWEFIDYISTEWKKSNVTIPQY

SEQ ID NO: 2043825 - protein, 25 aa, Staphylococcus
VHYDGKRAAYSYIVQVDVFVKANAD

SEQ ID NO: 2043826 - protein, 19 aa, Staphylococcus
VHYLVNMYDSWKVEDILDQ

SEQ ID NO: 2043827 - protein, 25 aa, Staphylococcus
VIAACLLTAVPVMKFFKYFYSNRGP

SEQ ID NO: 2043828 - protein, 28 aa, Staphylococcus
VIAACLLTAVPVMKIFKYFYSNRGPVID

SEQ ID NO: 2043829 - protein, 24 aa, Staphylococcus
VIAACMLTAVPVMKFFKYFYSNRG

SEQ ID NO: 2043830 - protein, 28 aa, Staphylococcus
VIAACMLTAVPVMKIFKYFYSNRGPVID

SEQ ID NO: 2043831 - protein, 18 aa, Staphylococcus
VIAAGGIMDGRGILASLI

SEQ ID NO: 2043832 - protein, 18 aa, Staphylococcus
VIAAGGIMDGRGLVASLA

SEQ ID NO: 2043833 - protein, 32 aa, Staphylococcus
VIAAKAFVASAIKNGWKMNDFVGPVDHGANRR

SEQ ID NO: 2043834 - protein, 30 aa, Staphylococcus
VIAAKGFVASAIKNGWKMNAFVGPVDHGAF

SEQ ID NO: 2043835 - protein, 17 aa, Staphylococcus
VIAIHKSILINMIKCVE

SEQ ID NO: 2043836 - protein, 18 aa, Staphylococcus
VIALRAIEDPELNKATNL

SEQ ID NO: 2043837 - protein, 17 aa, Staphylococcus
VIANMAVGFDNIDVKLA

SEQ ID NO: 2043838 - protein, 24 aa, Staphylococcus
VIAQHVYKKLGFQYGGKRKNYYGE

SEQ ID NO: 2043839 - protein, 17 aa, Staphylococcus
VIARAGVGVDNIDIDAA

SEQ ID NO: 2043840 - protein, 17 aa, Staphylococcus
VIARAGVGVDNIDIEAA

SEQ ID NO: 2043841 - protein, 20 aa, Staphylococcus
VIAYEPIWAIGTGKSSTAKD

SEQ ID NO: 2043842 - protein, 19 aa, Staphylococcus
VIDDLGFGRICLNEIERRG

SEQ ID NO: 2043843 - protein, 18 aa, Staphylococcus
VIDELAGIHFYNGNDQDP

SEQ ID NO: 2043844 - protein, 19 aa, Staphylococcus
VIDEMSRYITIEAKGEHYE

SEQ ID NO: 2043845 - protein, 17 aa, Staphylococcus
VIDEVGGKVVVLGCPAE

SEQ ID NO: 2043846 - protein, 24 aa, Staphylococcus
VIDGEFQFDAAIVPKVAAKKAPDA

SEQ ID NO: 2043847 - protein, 18 aa, Staphylococcus
VIDGVSWRIILNDFSELL

SEQ ID NO: 2043848 - protein, 18 aa, Staphylococcus
VIDILELEGVISKDTQNH

SEQ ID NO: 2043849 - protein, 20 aa, Staphylococcus
VIDIPKKVFSDLGITPNTAP

SEQ ID NO: 2043850 - protein, 25 aa, Staphylococcus
VIDIPKRVFEKLGIPANTAPIRGGT

SEQ ID NO: 2043851 - protein, 24 aa, Staphylococcus
VIDKDLPLTIVIIGEQLDVNRLKN

SEQ ID NO: 2043852 - protein, 22 aa, Staphylococcus
VIDKPLPFLFGEDFSFYGQQLA

SEQ ID NO: 2043853 - protein, 26 aa, Staphylococcus
VIDMGELRGKIFYKENYKTRVVSYVE

SEQ ID NO: 2043854 - protein, 17 aa, Staphylococcus
VIDRFEAFFNHTVNSTY

SEQ ID NO: 2043855 - protein, 23 aa, Staphylococcus
VIDRVDHRYVYVNLGRIEAVLSE

SEQ ID NO: 2043856 - protein, 19 aa, Staphylococcus
VIDSLSYYQFVILRLVVGD

SEQ ID NO: 2043857 - protein, 17 aa, Staphylococcus
VIDSWFYIENCNAVIEN

SEQ ID NO: 2043858 - protein, 17 aa, Staphylococcus
VIDTLFLEDDEEDETER

SEQ ID NO: 2043859 - protein, 20 aa, Staphylococcus
VIEAAPGFNVIAAINEGYVG

SEQ ID NO: 2043860 - protein, 21 aa, Staphylococcus
VIEALKLVKLQGYEQRQIEGM

SEQ ID NO: 2043861 - protein, 19 aa, Staphylococcus
VIEEMRLLNRAVFVLDKNN

SEQ ID NO: 2043862 - protein, 20 aa, Staphylococcus
VIEFNARFGDPEAQVLLTRM

SEQ ID NO: 2043863 - protein, 19 aa, Staphylococcus
VIEHIGSLVYLASDAINHH

SEQ ID NO: 2043864 - protein, 25 aa, Staphylococcus
VIEIAARPAGGFITSHLIRLSSGHS

SEQ ID NO: 2043865 - protein, 24 aa, Staphylococcus
VIEIPGSELVRGRGGPRCMSQPLF

SEQ ID NO: 2043866 - protein, 26 aa, Staphylococcus
VIEKAGRKAVLIPGDIRDEQFNYDLV

SEQ ID NO: 2043867 - protein, 24 aa, Staphylococcus
VIEKGDMITLDFGAYYRGYCSDIT

SEQ ID NO: 2043868 - protein, 24 aa, Staphylococcus
VIEKPLPFLFGEDFSFYGQQLAPS

SEQ ID NO: 2043869 - protein, 27 aa, Staphylococcus
VIELKKPKFFVAENVKGLLSMEKGKVI

SEQ ID NO: 2043870 - protein, 18 aa, Staphylococcus
VIEQCVPESLNLKVVIFD

SEQ ID NO: 2043871 - protein, 17 aa, Staphylococcus
VIEQFHLISNIAPGRVD

SEQ ID NO: 2043872 - protein, 26 aa, Staphylococcus
VIEQSQCKRAIILPNNKNILMASEQA

SEQ ID NO: 2043873 - protein, 27 aa, Staphylococcus
VIEQSQCKRAIILPNNKNILMASEQAA

SEQ ID NO: 2043874 - protein, 25 aa, Staphylococcus
VIEQSQCKRAIILPNNKNIRMSSDQ

SEQ ID NO: 2043875 - protein, 17 aa, Staphylococcus
VIERAQVILDQFEQKST

SEQ ID NO: 2043876 - protein, 19 aa, Staphylococcus
VIESLKVPIIAFTFGIPNQ

SEQ ID NO: 2043877 - protein, 18 aa, Staphylococcus
VIESRAFKDGLISIQDKS

SEQ ID NO: 2043878 - protein, 21 aa, Staphylococcus
VIEVPKRVFKKLGIEPNTEPI

SEQ ID NO: 2043879 - protein, 18 aa, Staphylococcus
VIEYELYDGVIINKEQSG

SEQ ID NO: 2043880 - protein, 18 aa, Staphylococcus
VIEYPLLEMIVRYNDNGY

SEQ ID NO: 2043881 - protein, 17 aa, Staphylococcus
VIFGEGKTKEQLHDIVH

SEQ ID NO: 2043882 - protein, 26 aa, Staphylococcus
VIGAGRIGLGVAKRAQSFGMKILAFD

SEQ ID NO: 2043883 - protein, 18 aa, Staphylococcus
VIGDYVAGPSHVLPTNQT

SEQ ID NO: 2043884 - protein, 19 aa, Staphylococcus
VIGFPREQWVFPIQTHENK

SEQ ID NO: 2043885 - protein, 24 aa, Staphylococcus
VIGGKWKPVILCHLKDEGTMRTSE

SEQ ID NO: 2043886 - protein, 17 aa, Staphylococcus
VIGKLIKRSIVEDYNIR

SEQ ID NO: 2043887 - protein, 37 aa, Staphylococcus
VIGLPANLFFGTSIPTCVLVFKKCRQSDDDVVFIDAS

SEQ ID NO: 2043888 - protein, 19 aa, Staphylococcus
VIGNHEFNFGLNYLKDTLA

SEQ ID NO: 2043889 - protein, 24 aa, Staphylococcus
VIGPGNRFPHAASLAVAEAPAEAY

SEQ ID NO: 2043890 - protein, 25 aa, Staphylococcus
VIGPGNRFPHAASLAVAEAPAEAYN

SEQ ID NO: 2043891 - protein, 24 aa, Staphylococcus
VIGPGNRFPHAASLAVAEAPAQAY

SEQ ID NO: 2043892 - protein, 18 aa, Staphylococcus
VIGVKGEVLLLENDELDL

SEQ ID NO: 2043893 - protein, 17 aa, Staphylococcus
VIHACRMIQAGAGHIYI

SEQ ID NO: 2043894 - protein, 18 aa, Staphylococcus
VIHLAEWLMEMQLDRKAG

SEQ ID NO: 2043895 - protein, 19 aa, Staphylococcus
VIHMKETFETTAQELGGEA

SEQ ID NO: 2043896 - protein, 22 aa, Staphylococcus
VIHPREVFKAAIRASSNAIIVL

SEQ ID NO: 2043897 - protein, 17 aa, Staphylococcus
VIHTYNVDHKWTIEYKA

SEQ ID NO: 2043898 - protein, 18 aa, Staphylococcus
VIIGRRVLMYLPDVPKAL

SEQ ID NO: 2043899 - protein, 24 aa, Staphylococcus
VIIIDHRLDYALDLADNIYYIDSG

SEQ ID NO: 2043900 - protein, 23 aa, Staphylococcus
VIIKFEAGWCPDCRAMDMWIDPI

SEQ ID NO: 2043901 - protein, 24 aa, Staphylococcus
VIINEPKLVWSFKDLQSHMQLSRN

SEQ ID NO: 2043902 - protein, 18 aa, Staphylococcus
VIIPKRRSVSLTQTVAKA

SEQ ID NO: 2043903 - protein, 25 aa, Staphylococcus
VIIPKTNIGGWTFPEDVQVVGVTTV

SEQ ID NO: 2043904 - protein, 28 aa, Staphylococcus
VIISTGARWRKLEVPGEEALINKGVAFC

SEQ ID NO: 2043905 - protein, 24 aa, Staphylococcus
VIIVDPFLSLAAREKLNHIVNTHR

SEQ ID NO: 2043906 - protein, 21 aa, Staphylococcus
VIIVTTFKRPGYFESAVANDV

SEQ ID NO: 2043907 - protein, 20 aa, Staphylococcus
VIKANGYGLGSVRIAQHLME

SEQ ID NO: 2043908 - protein, 19 aa, Staphylococcus
VIKANGYGLGSVRIAQYLV

SEQ ID NO: 2043909 - protein, 19 aa, Staphylococcus
VIKGERGSGKICLNGAASR

SEQ ID NO: 2043910 - protein, 38 aa, Staphylococcus
VIKGVSKRLGVPCLDLYHCSHLRPWIDEVNQHFFSYQE

SEQ ID NO: 2043911 - protein, 24 aa, Staphylococcus
VIKHCAGYEIAPYIKKNGQLVSRF

SEQ ID NO: 2043912 - protein, 21 aa, Staphylococcus
VILDELRKLAKEFPVYFQKGY

SEQ ID NO: 2043913 - protein, 26 aa, Staphylococcus
VILEYGESAPKIFRKVTDLVKEQVKY

SEQ ID NO: 2043914 - protein, 26 aa, Staphylococcus
VILEYGESAPKIFRKVTELVKEQVKY

SEQ ID NO: 2043915 - protein, 18 aa, Staphylococcus
VILFGVGASHLINEWNDL

SEQ ID NO: 2043916 - protein, 24 aa, Staphylococcus
VILGCTHYPLLFEPLHDYFGGSKT

SEQ ID NO: 2043917 - protein, 18 aa, Staphylococcus
VILKLNYIDDVVKEFENA

SEQ ID NO: 2043918 - protein, 19 aa, Staphylococcus
VILKPFRLGGIDRMLEAIK

SEQ ID NO: 2043919 - protein, 25 aa, Staphylococcus
VILLRMHYLIAIALNLEGYEDFAID

SEQ ID NO: 2043920 - protein, 25 aa, Staphylococcus
VILPLDYAYDFLKFCFKNPKTCPLL

SEQ ID NO: 2043921 - protein, 17 aa, Staphylococcus
VILPLEGLIDMDKEIAR

SEQ ID NO: 2043922 - protein, 23 aa, Staphylococcus
VILSGCYGDIGWFNQPRHETKIQ

SEQ ID NO: 2043923 - protein, 23 aa, Staphylococcus
VILVEGFKSAPFDKVVVYQDEKE

SEQ ID NO: 2043924 - protein, 24 aa, Staphylococcus
VILYDRLVNRELLDYATAGTKLFY

SEQ ID NO: 2043925 - protein, 23 aa, Staphylococcus
VIMSELKINLGDFREEMNRLEAI

SEQ ID NO: 2043926 - protein, 18 aa, Staphylococcus
VIMTANFGAVGFSNKDKS

SEQ ID NO: 2043927 - protein, 18 aa, Staphylococcus
VIMVCHLEGLDIENIKEA

SEQ ID NO: 2043928 - protein, 17 aa, Staphylococcus
VINEAQALCSIGTSGVV

SEQ ID NO: 2043929 - protein, 18 aa, Staphylococcus
VINEAYFRTPSTTDYNGI

SEQ ID NO: 2043930 - protein, 24 aa, Staphylococcus
VINELRRLVCRPIGVNLEPVDKTA

SEQ ID NO: 2043931 - protein, 19 aa, Staphylococcus
VINFSSRFANVTSEEFIEE

SEQ ID NO: 2043932 - protein, 21 aa, Staphylococcus
VINHYRWLFKQYHPAKQSYVI

SEQ ID NO: 2043933 - protein, 21 aa, Staphylococcus
VINIARLAYLLSRSEMSDEFS

SEQ ID NO: 2043934 - protein, 21 aa, Staphylococcus
VINILLQFVMLKNEMKLPKSY

SEQ ID NO: 2043935 - protein, 21 aa, Staphylococcus
VINILLQFVMLKNEMKLPKTY

SEQ ID NO: 2043936 - protein, 17 aa, Staphylococcus
VINKINVPVILVGQEHS

SEQ ID NO: 2043937 - protein, 18 aa, Staphylococcus
VINKLGFYISLGGPVTFK

SEQ ID NO: 2043938 - protein, 17 aa, Staphylococcus
VINKLNFHISLGGPVTF

SEQ ID NO: 2043939 - protein, 20 aa, Staphylococcus
VINSSEWLKSCVIKEINFSN

SEQ ID NO: 2043940 - protein, 25 aa, Staphylococcus
VINVKELRLSPTIEEHDFQTKLKNG

SEQ ID NO: 2043941 - protein, 18 aa, Staphylococcus
VIPDINWSAELDIKESAE

SEQ ID NO: 2043942 - protein, 20 aa, Staphylococcus
VIPDSAFCKGTVRTFDTDIQ

SEQ ID NO: 2043943 - protein, 18 aa, Staphylococcus
VIPDSAFCKGTVRTFDTK

SEQ ID NO: 2043944 - protein, 20 aa, Staphylococcus
VIPDSAFCKGTVRTFDTNLQ

SEQ ID NO: 2043945 - protein, 24 aa, Staphylococcus
VIPEMLTENFIPRSELRELTMSIL

SEQ ID NO: 2043946 - protein, 23 aa, Staphylococcus
VIPEMLTENFIPRTELRETTMTI

SEQ ID NO: 2043947 - protein, 24 aa, Staphylococcus
VIPKLKNRYLIGATSYFNDYSVGV

SEQ ID NO: 2043948 - protein, 21 aa, Staphylococcus
VIPSYRAIMINFDNIKLNFKQ

SEQ ID NO: 2043949 - protein, 19 aa, Staphylococcus
VIQAIDILKSYGILESIEK

SEQ ID NO: 2043950 - protein, 19 aa, Staphylococcus
VIQLCGALMQYYRETGIYA

SEQ ID NO: 2043951 - protein, 19 aa, Staphylococcus
VIQQFGIIIPLQIFIKTHP

SEQ ID NO: 2043952 - protein, 19 aa, Staphylococcus
VIQQMGFKPLIAKDLKTID

SEQ ID NO: 2043953 - protein, 18 aa, Staphylococcus
VIQRAQVILNDFEQKSDS

SEQ ID NO: 2043954 - protein, 19 aa, Staphylococcus
VIQSLDILKSYGILETIEK

SEQ ID NO: 2043955 - protein, 21 aa, Staphylococcus
VIRAKNILSRTVKHSSAQTLS

SEQ ID NO: 2043956 - protein, 23 aa, Staphylococcus
VIRFKKGYGAEVIEYVGDFVKPI

SEQ ID NO: 2043957 - protein, 20 aa, Staphylococcus
VIRNLLAMCYLYLSEYDIAK

SEQ ID NO: 2043958 - protein, 17 aa, Staphylococcus
VIRTLRRLAAFIENTMT

SEQ ID NO: 2043959 - protein, 17 aa, Staphylococcus
VIRVVALSGGYSRDEAN

SEQ ID NO: 2043960 - protein, 17 aa, Staphylococcus
VISAPPFGYTQHFRDPK

SEQ ID NO: 2043961 - protein, 30 aa, Staphylococcus
VISEQIVPCWNCRFCNRGEYWMCEKHDLYG

SEQ ID NO: 2043962 - protein, 17 aa, Staphylococcus
VISIGPDAVKTGMLGTQ

SEQ ID NO: 2043963 - protein, 24 aa, Staphylococcus
VISKSELLENVWGYDYYEDANTVN

SEQ ID NO: 2043964 - protein, 26 aa, Staphylococcus
VISRFKEVYQIFSDVLGVPLKGNKSD

SEQ ID NO: 2043965 - protein, 17 aa, Staphylococcus
VISSIRVIDGVVKAGDK

SEQ ID NO: 2043966 - protein, 17 aa, Staphylococcus
VISSIRVIDGVVKAGDR

SEQ ID NO: 2043967 - protein, 24 aa, Staphylococcus
VITEKTILVSIMFVNNEVGTVQQM

SEQ ID NO: 2043968 - protein, 25 aa, Staphylococcus
VITFNYRLGALGFLDWSYFNSDYNK

SEQ ID NO: 2043969 - protein, 20 aa, Staphylococcus
VITLNFYGEVYTIFYEQIYK

SEQ ID NO: 2043970 - protein, 24 aa, Staphylococcus
VITMYPHLDGVLSLDLTTVLILNQ

SEQ ID NO: 2043971 - protein, 25 aa, Staphylococcus
VITMYPHLDGVLSLDLTTVLILNQL

SEQ ID NO: 2043972 - protein, 28 aa, Staphylococcus
VITRLKGGDPFVFGRGGEEAEILAQHQI

SEQ ID NO: 2043973 - protein, 17 aa, Staphylococcus
VITRPSNDPALFDATIK

SEQ ID NO: 2043974 - protein, 22 aa, Staphylococcus
VITRSYFKNMALNFLQSTHSQH

SEQ ID NO: 2043975 - protein, 23 aa, Staphylococcus
VITSEGLVGRISKVNQFSSQVDL

SEQ ID NO: 2043976 - protein, 19 aa, Staphylococcus
VITTMAITLAREYQTENVV

SEQ ID NO: 2043977 - protein, 19 aa, Staphylococcus
VITTMAITVAREYQTKNIV

SEQ ID NO: 2043978 - protein, 18 aa, Staphylococcus
VITTMSITVAREHNTKNV

SEQ ID NO: 2043979 - protein, 19 aa, Staphylococcus
VITTMSITVAREYKTNNVV

SEQ ID NO: 2043980 - protein, 35 aa, Staphylococcus
VITTYDLLYRAGLDLDVDFVIRVGKPVISKKLNQW

SEQ ID NO: 2043981 - protein, 34 aa, Staphylococcus
VITTYDLLYRAGMDWDVDFVIRVGKPVISKKLNQ

SEQ ID NO: 2043982 - protein, 19 aa, Staphylococcus
VITTYDLLYRSHLNIDADF

SEQ ID NO: 2043983 - protein, 20 aa, Staphylococcus
VIVAGGAWSSELLEHYHLPR

SEQ ID NO: 2043984 - protein, 28 aa, Staphylococcus
VIVAHIIWIRCCLYYSGVITEEELFNKK

SEQ ID NO: 2043985 - protein, 26 aa, Staphylococcus
VIVASGAWSSQLLKNYSLPREVIGVK

SEQ ID NO: 2043986 - protein, 21 aa, Staphylococcus
VIVASGAWSSQLLKQYQLPRV

SEQ ID NO: 2043987 - protein, 17 aa, Staphylococcus
VIVGGGYIALEFASMFA

SEQ ID NO: 2043988 - protein, 20 aa, Staphylococcus
VIVHPECEFEVVQAADYAGS

SEQ ID NO: 2043989 - protein, 25 aa, Staphylococcus
VIVPDYQLSLAIGKRGQNARLAAKL

SEQ ID NO: 2043990 - protein, 26 aa, Staphylococcus
VIVPDYQLSLAIGKRGQNARLAAKLT

SEQ ID NO: 2043991 - protein, 27 aa, Staphylococcus
VIVPIWKPELEPVKEFSNETARGEKGF

SEQ ID NO: 2043992 - protein, 18 aa, Staphylococcus
VIVPNEFEAEILSGIPVT

SEQ ID NO: 2043993 - protein, 25 aa, Staphylococcus
VIVREFDQTLALEDMDLYTAKQFLY

SEQ ID NO: 2043994 - protein, 21 aa, Staphylococcus
VIVRSLLGIAVPTQIATHDSD

SEQ ID NO: 2043995 - protein, 19 aa, Staphylococcus
VIWLYQYFSDIPIAPTTYT

SEQ ID NO: 2043996 - protein, 20 aa, Staphylococcus
VIWTDAQWRSIYAKGQDTLV

SEQ ID NO: 2043997 - protein, 25 aa, Staphylococcus
VIYAKPRSGYYVSDIESLPVVPQTS

SEQ ID NO: 2043998 - protein, 17 aa, Staphylococcus
VIYDRRKDLIISGGENI

SEQ ID NO: 2043999 - protein, 17 aa, Staphylococcus
VIYEKAKSINISSYTEM

SEQ ID NO: 2044000 - protein, 20 aa, Staphylococcus
VIYGDVKWTAPLTVKETVYA

SEQ ID NO: 2044001 - protein, 17 aa, Staphylococcus
VIYIDDLVYHINQLIKY

SEQ ID NO: 2044002 - protein, 17 aa, Staphylococcus
VIYKGPFKHIEDDDDHI

SEQ ID NO: 2044003 - protein, 17 aa, Staphylococcus
VIYLGTFSKTLMPSIRM

SEQ ID NO: 2044004 - protein, 24 aa, Staphylococcus
VKADIGIKNGYIFAIGKAGNPDIM

SEQ ID NO: 2044005 - protein, 19 aa, Staphylococcus
VKADVRAFAPGRINLIGEH

SEQ ID NO: 2044006 - protein, 22 aa, Staphylococcus
VKAEGAHLISFITKASAMGIPV

SEQ ID NO: 2044007 - protein, 17 aa, Staphylococcus
VKAGAFPAEAHTYKKKV

SEQ ID NO: 2044008 - protein, 22 aa, Staphylococcus
VKAGAKLPHLSYIGDAEIGERT

SEQ ID NO: 2044009 - protein, 21 aa, Staphylococcus
VKAGDLIKNMAPVVGGKGGGR

SEQ ID NO: 2044010 - protein, 19 aa, Staphylococcus
VKAGEFYFIPAGTIHSIGA

SEQ ID NO: 2044011 - protein, 17 aa, Staphylococcus
VKAIEELGERMGIQSPI

SEQ ID NO: 2044012 - protein, 25 aa, Staphylococcus
VKAIRRLGAMVAFEVVDPETGEPDK

SEQ ID NO: 2044013 - protein, 23 aa, Staphylococcus
VKAKGTGVVHLRAIHKRWSRAEM

SEQ ID NO: 2044014 - protein, 19 aa, Staphylococcus
VKAKHAIKVTQTNIPLYLY

SEQ ID NO: 2044015 - protein, 18 aa, Staphylococcus
VKAKPCITQMKYSLDFVK

SEQ ID NO: 2044016 - protein, 23 aa, Staphylococcus
VKAKTRLAQLVVTPVMLPEPTEV

SEQ ID NO: 2044017 - protein, 23 aa, Staphylococcus
VKALFKKHIEQINNEGGQLEEDM

SEQ ID NO: 2044018 - protein, 17 aa, Staphylococcus
VKALKLANEHLLSRYEK

SEQ ID NO: 2044019 - protein, 19 aa, Staphylococcus
VKALSMWMTLKCGIVDLPY

SEQ ID NO: 2044020 - protein, 18 aa, Staphylococcus
VKALSMWMTMKCGIVDLP

SEQ ID NO: 2044021 - protein, 21 aa, Staphylococcus
VKALVPPGCLFNNAEDATSGN

SEQ ID NO: 2044022 - protein, 21 aa, Staphylococcus
VKAQKMCRLAIRFLKKRNIVY

SEQ ID NO: 2044023 - protein, 19 aa, Staphylococcus
VKASGGVRSLEDFNKMIDA

SEQ ID NO: 2044024 - protein, 25 aa, Staphylococcus
VKASKLRWEFEFEIESEDAVHCIGK

SEQ ID NO: 2044025 - protein, 34 aa, Staphylococcus
VKASQIICYDLRFPEIARHPAVNGADILFYVAEW

SEQ ID NO: 2044026 - protein, 26 aa, Staphylococcus
VKATDLRAAAALILAGLVAEGTTQVT

SEQ ID NO: 2044027 - protein, 26 aa, Staphylococcus
VKATDLRAGAALILAGLVAEGTTEVS

SEQ ID NO: 2044028 - protein, 19 aa, Staphylococcus
VKATTFATVGASALEVLRR

SEQ ID NO: 2044029 - protein, 20 aa, Staphylococcus
VKAVELLDAQALQIHVNSPQ

SEQ ID NO: 2044030 - protein, 20 aa, Staphylococcus
VKAVELLDAQALQVHVNAPQ

SEQ ID NO: 2044031 - protein, 23 aa, Staphylococcus
VKAYTLEALRQFDFGIYKDEAFK

SEQ ID NO: 2044032 - protein, 19 aa, Staphylococcus
VKCYGRDLLDHFEDYVREA

SEQ ID NO: 2044033 - protein, 18 aa, Staphylococcus
VKDALTVLVNAVKKKRHD

SEQ ID NO: 2044034 - protein, 18 aa, Staphylococcus
VKDALTVLVNTVRKKRAS

SEQ ID NO: 2044035 - protein, 18 aa, Staphylococcus
VKDALTVLVNTVRKKREE

SEQ ID NO: 2044036 - protein, 28 aa, Staphylococcus
VKDAPDFKEVFPYMLQFINQLPVVAHNA

SEQ ID NO: 2044037 - protein, 18 aa, Staphylococcus
VKDATACFITLSESVDEE

SEQ ID NO: 2044038 - protein, 26 aa, Staphylococcus
VKDDIWPEIKRQFIILDTTPSADGTI

SEQ ID NO: 2044039 - protein, 30 aa, Staphylococcus
VKDDYIVFKGFRIIHKDDLVLPGEHNLENI

SEQ ID NO: 2044040 - protein, 24 aa, Staphylococcus
VKDGEIIAAPVLALSLSFDHRQID

SEQ ID NO: 2044041 - protein, 25 aa, Staphylococcus
VKDGRIVGIGAHLRKGDKHAEVQAL

SEQ ID NO: 2044042 - protein, 22 aa, Staphylococcus
VKDGRIVGLGAHLKQGEKHAEV

SEQ ID NO: 2044043 - protein, 19 aa, Staphylococcus
VKDILTRFFNNEPFQDKDI

SEQ ID NO: 2044044 - protein, 19 aa, Staphylococcus
VKDILTRFFNNEPFQKKDI

SEQ ID NO: 2044045 - protein, 19 aa, Staphylococcus
VKDIWPVSGDYLLVTLRID

SEQ ID NO: 2044046 - protein, 20 aa, Staphylococcus
VKDKYGVYVIFDQKKPVYVG

SEQ ID NO: 2044047 - protein, 18 aa, Staphylococcus
VKDLSAVVKFQLTNSKDT

SEQ ID NO: 2044048 - protein, 25 aa, Staphylococcus
VKDLYKTEMGIAILHEKENVYLAIN

SEQ ID NO: 2044049 - protein, 25 aa, Staphylococcus
VKDNSEVFVVIGIGGSYLGARAAIE

SEQ ID NO: 2044050 - protein, 20 aa, Staphylococcus
VKDPFFKEALQIYDSKLDIS

SEQ ID NO: 2044051 - protein, 20 aa, Staphylococcus
VKDQMLPFVMDTYKNSSREV

SEQ ID NO: 2044052 - protein, 21 aa, Staphylococcus
VKDRIALAMIEEAEKAGKIKP

SEQ ID NO: 2044053 - protein, 21 aa, Staphylococcus
VKDRIALAMIEKAEKEGKIKP

SEQ ID NO: 2044054 - protein, 21 aa, Staphylococcus
VKDRIALAMIEKAEREGKIKP

SEQ ID NO: 2044055 - protein, 17 aa, Staphylococcus
VKDRKFLNEALDNLKTW

SEQ ID NO: 2044056 - protein, 26 aa, Staphylococcus
VKDSLKRLIMPSIEREIRNDLTEKAE

SEQ ID NO: 2044057 - protein, 18 aa, Staphylococcus
VKDWSKGEVEGMPGKTMP

SEQ ID NO: 2044058 - protein, 17 aa, Staphylococcus
VKEAKVRYECELVEHLS

SEQ ID NO: 2044059 - protein, 25 aa, Staphylococcus
VKEGHISTSLIQRHFQIGYNRAARI

SEQ ID NO: 2044060 - protein, 18 aa, Staphylococcus
VKEIAGAITPVPGGVGPL

SEQ ID NO: 2044061 - protein, 17 aa, Staphylococcus
VKEIIHLIHTLQETIVK

SEQ ID NO: 2044062 - protein, 22 aa, Staphylococcus
VKEKAYYSYRMDDLIVSYLIQA

SEQ ID NO: 2044063 - protein, 20 aa, Staphylococcus
VKEKEGQRLLAKIKPQSTVI

SEQ ID NO: 2044064 - protein, 20 aa, Staphylococcus
VKEKFRIIYYDGEAALALLR

SEQ ID NO: 2044065 - protein, 19 aa, Staphylococcus
VKEKFRIIYYDGEAVLALL

SEQ ID NO: 2044066 - protein, 20 aa, Staphylococcus
VKEKFRIVYYDGEAALALMR

SEQ ID NO: 2044067 - protein, 17 aa, Staphylococcus
VKEKLGLRNYERLLHIV

SEQ ID NO: 2044068 - protein, 24 aa, Staphylococcus
VKEKPKARWLFLTLSTRNAIDGET

SEQ ID NO: 2044069 - protein, 28 aa, Staphylococcus
VKELLKLPEYTFPLFGMAVGVPADDENG

SEQ ID NO: 2044070 - protein, 20 aa, Staphylococcus
VKELNRLLGKVIDAFTETKE

SEQ ID NO: 2044071 - protein, 20 aa, Staphylococcus
VKELNRRGVDVAIEAVGIPQ

SEQ ID NO: 2044072 - protein, 24 aa, Staphylococcus
VKELQKKLGKTFIFVTHDMDEAIK

SEQ ID NO: 2044073 - protein, 20 aa, Staphylococcus
VKELQRIFEYIIRKNLNISF

SEQ ID NO: 2044074 - protein, 17 aa, Staphylococcus
VKENIMLAPKLLKKNDH

SEQ ID NO: 2044075 - protein, 19 aa, Staphylococcus
VKENIMLAPQLLKKNDTAS

SEQ ID NO: 2044076 - protein, 19 aa, Staphylococcus
VKEPIKINLPFTETPETLY

SEQ ID NO: 2044077 - protein, 17 aa, Staphylococcus
VKERLAMRAAQFINNAE

SEQ ID NO: 2044078 - protein, 25 aa, Staphylococcus
VKERQRKGLSYKEKREYETVMERIE

SEQ ID NO: 2044079 - protein, 26 aa, Staphylococcus
VKESEGRIILFIDEIHMLVGAGKTDG

SEQ ID NO: 2044080 - protein, 19 aa, Staphylococcus
VKESIEFAEEMRFQNNPSG

SEQ ID NO: 2044081 - protein, 17 aa, Staphylococcus
VKESWSVRYLESYINDY

SEQ ID NO: 2044082 - protein, 18 aa, Staphylococcus
VKETHLLISNRFKTDSSF

SEQ ID NO: 2044083 - protein, 22 aa, Staphylococcus
VKETIEGAGLNQAITYSLVSKS

SEQ ID NO: 2044084 - protein, 22 aa, Staphylococcus
VKETLEGAGLDQAITYSLISKD

SEQ ID NO: 2044085 - protein, 22 aa, Staphylococcus
VKETLEGAGLNQAITYSLVSKD

SEQ ID NO: 2044086 - protein, 21 aa, Staphylococcus
VKEVKKGEFFVARTLSPNSEH

SEQ ID NO: 2044087 - protein, 20 aa, Staphylococcus
VKFAMISSIDIARIASNVFG

SEQ ID NO: 2044088 - protein, 20 aa, Staphylococcus
VKFDDLEQVISYAYHHNLST

SEQ ID NO: 2044089 - protein, 20 aa, Staphylococcus
VKFDRYPIFVPNALINEVIA

SEQ ID NO: 2044090 - protein, 20 aa, Staphylococcus
VKFEAGTPLIAQAIGLAEAI

SEQ ID NO: 2044091 - protein, 20 aa, Staphylococcus
VKFEAGWCPDCKAMDMWIDP

SEQ ID NO: 2044092 - protein, 19 aa, Staphylococcus
VKFEKVFADHFMALYDKTK

SEQ ID NO: 2044093 - protein, 20 aa, Staphylococcus
VKFGEMYAGSVDRSMQKILN

SEQ ID NO: 2044094 - protein, 17 aa, Staphylococcus
VKFIFLNNIDNVLVKVL

SEQ ID NO: 2044095 - protein, 19 aa, Staphylococcus
VKFKNCAFDNVVIKNATMS

SEQ ID NO: 2044096 - protein, 26 aa, Staphylococcus
VKFRKSQEIIQVWHAVGAFKTVGYSR

SEQ ID NO: 2044097 - protein, 17 aa, Staphylococcus
VKFSIERAKATDKTNPM

SEQ ID NO: 2044098 - protein, 19 aa, Staphylococcus
VKFSKARLIDNLIIGDEEI

SEQ ID NO: 2044099 - protein, 28 aa, Staphylococcus
VKFVGPHECARIWKEWGVSEDRIITIKP

SEQ ID NO: 2044100 - protein, 17 aa, Staphylococcus
VKFYLVEDTYVFDHYKD

SEQ ID NO: 2044101 - protein, 20 aa, Staphylococcus
VKGAELPKVQHYFKEAHPFF

SEQ ID NO: 2044102 - protein, 21 aa, Staphylococcus
VKGAYKTYAYVVSYKPTNGNE

SEQ ID NO: 2044103 - protein, 17 aa, Staphylococcus
VKGCKLILDEAKLVKDD

SEQ ID NO: 2044104 - protein, 19 aa, Staphylococcus
VKGDKEYLIPYIADVVKDI

SEQ ID NO: 2044105 - protein, 19 aa, Staphylococcus
VKGDKEYLIPYIADVVKEV

SEQ ID NO: 2044106 - protein, 18 aa, Staphylococcus
VKGDKEYMIPYIADVVKD

SEQ ID NO: 2044107 - protein, 20 aa, Staphylococcus
VKGILDMKGGFTDNFTNAFS

SEQ ID NO: 2044108 - protein, 20 aa, Staphylococcus
VKGILDMKGGIADSFSNAFS

SEQ ID NO: 2044109 - protein, 19 aa, Staphylococcus
VKGPMELRQSIAKLISYQR

SEQ ID NO: 2044110 - protein, 19 aa, Staphylococcus
VKGQNILYLGGGVGFSSKT

SEQ ID NO: 2044111 - protein, 21 aa, Staphylococcus
VKGVKEGKRHQTLLGATGTGK

SEQ ID NO: 2044112 - protein, 23 aa, Staphylococcus
VKHFPIQITHPGIYNYSHYQIDV

SEQ ID NO: 2044113 - protein, 18 aa, Staphylococcus
VKHIPKFDWLNGENLDGK

SEQ ID NO: 2044114 - protein, 25 aa, Staphylococcus
VKHKENYLHFKLKHMSHVSDPMMHL

SEQ ID NO: 2044115 - protein, 23 aa, Staphylococcus
VKHKFSELHVFPYSARIGTPAAR

SEQ ID NO: 2044116 - protein, 23 aa, Staphylococcus
VKHKFSELHVFPYSQRIGTPAAR

SEQ ID NO: 2044117 - protein, 22 aa, Staphylococcus
VKHMPNEIELEFNEPVNSKYSN

SEQ ID NO: 2044118 - protein, 23 aa, Staphylococcus
VKHNLKPGGSLIYSTCTIEQMEN

SEQ ID NO: 2044119 - protein, 17 aa, Staphylococcus
VKHQYGHAFYNSASDQD

SEQ ID NO: 2044120 - protein, 24 aa, Staphylococcus
VKHTDFHAQLLLQVHDELIFELPK

SEQ ID NO: 2044121 - protein, 20 aa, Staphylococcus
VKHWFNELNMSIYDEKNKRG

SEQ ID NO: 2044122 - protein, 22 aa, Staphylococcus
VKIDLYEPVPHYKHIDEVKSLI

SEQ ID NO: 2044123 - protein, 20 aa, Staphylococcus
VKIDRYPIFIPNVLINEEIK

SEQ ID NO: 2044124 - protein, 20 aa, Staphylococcus
VKIEAGNPFFQTGHNGCATG

SEQ ID NO: 2044125 - protein, 19 aa, Staphylococcus
VKIEIKRKKGVSISGSVNS

SEQ ID NO: 2044126 - protein, 21 aa, Staphylococcus
VKIEVGNPFFKTDSKGCASGG

SEQ ID NO: 2044127 - protein, 17 aa, Staphylococcus
VKIGATVIDGFGARIVR

SEQ ID NO: 2044128 - protein, 26 aa, Staphylococcus
VKIHGSFKKVHVRMMPKQEPPYQRLM

SEQ ID NO: 2044129 - protein, 20 aa, Staphylococcus
VKIIPLEVVVRNIAAGSITQ

SEQ ID NO: 2044130 - protein, 21 aa, Staphylococcus
VKIIPLEVVVRNVAAGSITKR

SEQ ID NO: 2044131 - protein, 23 aa, Staphylococcus
VKIKAGSYKACHNADLVVITAGA

SEQ ID NO: 2044132 - protein, 31 aa, Staphylococcus
VKILNDMKVDWKKRIHIIIGTDEESDWKCTD

SEQ ID NO: 2044133 - protein, 31 aa, Staphylococcus
VKILNDMKVDWKKRIHIIIGTDEESDWKCTE

SEQ ID NO: 2044134 - protein, 31 aa, Staphylococcus
VKILNDMNVDWKKRIHMIIGTDEESDWKCTD

SEQ ID NO: 2044135 - protein, 30 aa, Staphylococcus
VKILNDMNVDWKKRVHIIVGTDEESDWIGV

SEQ ID NO: 2044136 - protein, 31 aa, Staphylococcus
VKILNEMNVNWKKRIHIIIGTDEESDWKCTE

SEQ ID NO: 2044137 - protein, 24 aa, Staphylococcus
VKIRFLGEEDMDIFRGFMEDTAEA

SEQ ID NO: 2044138 - protein, 36 aa, Staphylococcus; identical to SEQ ID NO: 1796893

SEQ ID NO: 2044139 - protein, 27 aa, Staphylococcus
VKISGVFKKMHVRMMPGQEPPYTRLID

SEQ ID NO: 2044140 - protein, 24 aa, Staphylococcus
VKITCVEAAPKMLPMFSDELVNHA

SEQ ID NO: 2044141 - protein, 17 aa, Staphylococcus
VKIVTGAHSTGASVLEV

SEQ ID NO: 2044142 - protein, 19 aa, Staphylococcus
VKIYDFYTDVLGLRLVKKT

SEQ ID NO: 2044143 - protein, 27 aa, Staphylococcus
VKKDFNGISFLNLVDFDALYGHRRDKD

SEQ ID NO: 2044144 - protein, 20 aa, Staphylococcus
VKKEVLEIQDLIRSFQTSIL

SEQ ID NO: 2044145 - protein, 24 aa, Staphylococcus
VKKFKYKDFENEIELDFTEGNSSQ

SEQ ID NO: 2044146 - protein, 18 aa, Staphylococcus
VKKGEFFIARTLAPSDER

SEQ ID NO: 2044147 - protein, 25 aa, Staphylococcus
VKKINFGNCCILKFEYEADEFRFIE

SEQ ID NO: 2044148 - protein, 20 aa, Staphylococcus
VKKLGKFTVPLIKKRNDYAL

SEQ ID NO: 2044149 - protein, 17 aa, Staphylococcus
VKKLIHLGVDGIISDIP

SEQ ID NO: 2044150 - protein, 18 aa, Staphylococcus
VKKLKALEQEMTQNMRKS

SEQ ID NO: 2044151 - protein, 20 aa, Staphylococcus
VKKQIQLLARRELIQTVSDD

SEQ ID NO: 2044152 - protein, 20 aa, Staphylococcus
VKKRLEGFGPVDVHATKASS

SEQ ID NO: 2044153 - protein, 19 aa, Staphylococcus
VKKSRAIVEDIIKNKETIY

SEQ ID NO: 2044154 - protein, 21 aa, Staphylococcus
VKKTFPGYVLVELIMTDESWY

SEQ ID NO: 2044155 - protein, 21 aa, Staphylococcus
VKKTGIERLFGMMLPSGPENM

SEQ ID NO: 2044156 - protein, 45 aa, Staphylococcus
VKLAEALLPEYPRALIFKSAAFQGDWRTLLDFCGSNIVNIEDAKL

SEQ ID NO: 2044157 - protein, 24 aa, Staphylococcus
VKLASELYDSDWINWYHAQMKDKK

SEQ ID NO: 2044158 - protein, 23 aa, Staphylococcus
VKLAVKHQIKIGAHPGFPDLKGF

SEQ ID NO: 2044159 - protein, 19 aa, Staphylococcus
VKLEDDMAFLTGVVSRKKQ

SEQ ID NO: 2044160 - protein, 25 aa, Staphylococcus
VKLGKIAELLFQYKEIPNDKALPNT

SEQ ID NO: 2044161 - protein, 22 aa, Staphylococcus
VKLIEELEHSYPTGTHERQDHN

SEQ ID NO: 2044162 - protein, 26 aa, Staphylococcus
VKLKRDLADFNAHFDSWFSETTLYDN

SEQ ID NO: 2044163 - protein, 20 aa, Staphylococcus
VKLLDSYGVRNMIMCDSRGA

SEQ ID NO: 2044164 - protein, 23 aa, Staphylococcus
VKLMKRPTPIVDIDDENKFFKMT

SEQ ID NO: 2044165 - protein, 23 aa, Staphylococcus
VKLMKRQAPIVAVDDEDQFFKMT

SEQ ID NO: 2044166 - protein, 19 aa, Staphylococcus
VKLMRSGVIKQNLHFVEGK

SEQ ID NO: 2044167 - protein, 26 aa, Staphylococcus
VKLNRLNDAGMLFNLYDQQHFKEEKR

SEQ ID NO: 2044168 - protein, 23 aa, Staphylococcus
VKLPKYDGFYWTRKIREVSNTPI

SEQ ID NO: 2044169 - protein, 26 aa, Staphylococcus
VKLPNGVELKNRFVLAPMTHNTSNDD

SEQ ID NO: 2044170 - protein, 20 aa, Staphylococcus
VKLQLKALNPHGILLPATYG

SEQ ID NO: 2044171 - protein, 17 aa, Staphylococcus
VKLSEKFSVEQASNNYQ

SEQ ID NO: 2044172 - protein, 23 aa, Staphylococcus
VKLSPHLKFHIGALTEMSSKLMA

SEQ ID NO: 2044173 - protein, 20 aa, Staphylococcus
VKLYYNGPMFRYERKQKGRY

SEQ ID NO: 2044174 - protein, 21 aa, Staphylococcus
VKLYYNSPMFRYERKQKGRYR

SEQ ID NO: 2044175 - protein, 18 aa, Staphylococcus
VKMALWYTEMKRNLERFK

SEQ ID NO: 2044176 - protein, 19 aa, Staphylococcus
VKMALWYTEMKRNLKRFKD

SEQ ID NO: 2044177 - protein, 17 aa, Staphylococcus
VKMARKIGTYDVSIQPF

SEQ ID NO: 2044178 - protein, 24 aa, Staphylococcus
VKMARSAEESVLFYNQYQCVDRIH

SEQ ID NO: 2044179 - protein, 20 aa, Staphylococcus
VKMDGRISVITFHSLEDRLC

SEQ ID NO: 2044180 - protein, 26 aa, Staphylococcus
VKMLLMKYKLIKDIKKSNHIIVQTNY

SEQ ID NO: 2044181 - protein, 26 aa, Staphylococcus
VKMYSPEFEKVIPLKIMLIHKDCAQA

SEQ ID NO: 2044182 - protein, 19 aa, Staphylococcus
VKNAPRITDFLNEDSKAYY

SEQ ID NO: 2044183 - protein, 18 aa, Staphylococcus
VKNFPGYDYETYIDSGIS

SEQ ID NO: 2044184 - protein, 17 aa, Staphylococcus
VKNFPGYDYETYTDSGI

SEQ ID NO: 2044185 - protein, 20 aa, Staphylococcus
VKNGFLEKGYQVYFDSPTNQ

SEQ ID NO: 2044186 - protein, 17 aa, Staphylococcus
VKNIPKGKWNYLPTNKI

SEQ ID NO: 2044187 - protein, 19 aa, Staphylococcus
VKNKFLICDECQAVNLKSL

SEQ ID NO: 2044188 - protein, 21 aa, Staphylococcus
VKNKLAALILKKDLNEVMKKM

SEQ ID NO: 2044189 - protein, 31 aa, Staphylococcus
VKNKRLTVMKRSLKQVVIKNCESMTQVADRL

SEQ ID NO: 2044190 - protein, 19 aa, Staphylococcus
VKNNGFEILVTTKNDKVAL

SEQ ID NO: 2044191 - protein, 27 aa, Staphylococcus
VKNQILIIPTWRDWLTSIDRLQTSEYL

SEQ ID NO: 2044192 - protein, 24 aa, Staphylococcus
VKNRSNGYCDLCNKPAPFKDRNGR

SEQ ID NO: 2044193 - protein, 32 aa, Staphylococcus
VKNSIKAMKILALYIRKNYRNPIVCITGSMGK

SEQ ID NO: 2044194 - protein, 26 aa, Staphylococcus
VKNVKIAPSPVWMQARLMKAGIRPIN

SEQ ID NO: 2044195 - protein, 22 aa, Staphylococcus
VKNWKQKTFYHFTADTTNSNES

SEQ ID NO: 2044196 - protein, 18 aa, Staphylococcus
VKPAELIKGNDRLSYVTI

SEQ ID NO: 2044197 - protein, 19 aa, Staphylococcus
VKPELIVLDVMLPKKDGIE

SEQ ID NO: 2044198 - protein, 21 aa, Staphylococcus
VKPEMILKAGMINTAVNGDAN

SEQ ID NO: 2044199 - protein, 25 aa, Staphylococcus
VKPFVKRKLIFLVGMAGERDLTKTP

SEQ ID NO: 2044200 - protein, 17 aa, Staphylococcus
VKPGGSIIYSTCTIEQM

SEQ ID NO: 2044201 - protein, 19 aa, Staphylococcus
VKPILELKKHVSIKAMNHI

SEQ ID NO: 2044202 - protein, 18 aa, Staphylococcus
VKPLGHIATIVVFKEKQD

SEQ ID NO: 2044203 - protein, 19 aa, Staphylococcus
VKPLLKYAHQRGIYVQMNS

SEQ ID NO: 2044204 - protein, 18 aa, Staphylococcus
VKPLLKYAKDRGIYVQMN

SEQ ID NO: 2044205 - protein, 19 aa, Staphylococcus
VKPLLKYAYNRGIYTQMNS

SEQ ID NO: 2044206 - protein, 21 aa, Staphylococcus
VKPTKASVCHADLRYYTGNRR

SEQ ID NO: 2044207 - protein, 25 aa, Staphylococcus
VKQEGLKGGGYYVEYRTDDARLTIE

SEQ ID NO: 2044208 - protein, 25 aa, Staphylococcus
VKQELEKLILFLGDRSTINKQDVYQ

SEQ ID NO: 2044209 - protein, 21 aa, Staphylococcus
VKQEMGLHCEKCGRDYDYYEF

SEQ ID NO: 2044210 - protein, 21 aa, Staphylococcus
VKQIPRLTVKLNDKTMFLDPS

SEQ ID NO: 2044211 - protein, 26 aa, Staphylococcus
VKQISRIPLSLTFDHQILDGAGAADF

SEQ ID NO: 2044212 - protein, 23 aa, Staphylococcus
VKQKGADIARLWVSSTDYLADVR

SEQ ID NO: 2044213 - protein, 25 aa, Staphylococcus
VKQKGADIARLWVSSVDYLADVRIS

SEQ ID NO: 2044214 - protein, 24 aa, Staphylococcus
VKQKGADIARLWVSSVDYLSDVRI

SEQ ID NO: 2044215 - protein, 17 aa, Staphylococcus
VKQKIKAFIDYYGDIDE

SEQ ID NO: 2044216 - protein, 21 aa, Staphylococcus
VKQLILPTQFNKVFVIDFKAF

SEQ ID NO: 2044217 - protein, 25 aa, Staphylococcus
VKQQEGYCIIIGYFVNGKPKLSYIY

SEQ ID NO: 2044218 - protein, 19 aa, Staphylococcus
VKQSLKRLKMEHIDLYQLH

SEQ ID NO: 2044219 - protein, 26 aa, Staphylococcus
VKQVSRIPLSLTFDHQILDGAGAAEF

SEQ ID NO: 2044220 - protein, 25 aa, Staphylococcus
VKQYFRMLQKPILYTGLTRAKQSLV

SEQ ID NO: 2044221 - protein, 26 aa, Staphylococcus
VKRALELVELVGLKGREHAYPSELSG

SEQ ID NO: 2044222 - protein, 17 aa, Staphylococcus
VKRCKLLADKGELPHNV

SEQ ID NO: 2044223 - protein, 26 aa, Staphylococcus
VKRFTDNPLMVAMDCHHPLAAQEHLT

SEQ ID NO: 2044224 - protein, 22 aa, Staphylococcus
VKRGMAEMQKGGVIMDVVNAEQ

SEQ ID NO: 2044225 - protein, 23 aa, Staphylococcus
VKRIGGELTSFVHLGTGNYNDKT

SEQ ID NO: 2044226 - protein, 24 aa, Staphylococcus
VKRIGGELTSFVHLGTGNYNDKTA

SEQ ID NO: 2044227 - protein, 24 aa, Staphylococcus
VKRIGGKLTSFVHLGTGNYNDKTA

SEQ ID NO: 2044228 - protein, 21 aa, Staphylococcus
VKRKAEAWIDLKKEMAEMYPV

SEQ ID NO: 2044229 - protein, 25 aa, Staphylococcus
VKRLSPEYFYYLSRAKYWINNQNFP

SEQ ID NO: 2044230 - protein, 18 aa, Staphylococcus
VKRMKFYDYLLLNSDGLS

SEQ ID NO: 2044231 - protein, 20 aa, Staphylococcus
VKRPDLLERYPMTVEEKDIV

SEQ ID NO: 2044232 - protein, 26 aa, Staphylococcus
VKRPEVVEKIKVARSFGDLSENSEYD

SEQ ID NO: 2044233 - protein, 21 aa, Staphylococcus
VKRVIEDKGGTVFLLPGDITD

SEQ ID NO: 2044234 - protein, 24 aa, Staphylococcus
VKRVKCGGFKSIAIDDIHRLVFKV

SEQ ID NO: 2044235 - protein, 18 aa, Staphylococcus
VKRYLQGRKTRLVGPNCP

SEQ ID NO: 2044236 - protein, 17 aa, Staphylococcus
VKSAILFASIFSEEATT

SEQ ID NO: 2044237 - protein, 18 aa, Staphylococcus
VKSDMDIFNIPSDDLNAV

SEQ ID NO: 2044238 - protein, 21 aa, Staphylococcus
VKSDWIVKCPENLTLEEAMIY

SEQ ID NO: 2044239 - protein, 27 aa, Staphylococcus
VKSEMFKNEKLRGFIDYVLEIGKVDHN

SEQ ID NO: 2044240 - protein, 19 aa, Staphylococcus
VKSGGEFPRDFNITESDEY

SEQ ID NO: 2044241 - protein, 23 aa, Staphylococcus
VKSKREALEMAERVELDLVVVAP

SEQ ID NO: 2044242 - protein, 18 aa, Staphylococcus
VKSKRQGQSMIYSLDDQH

SEQ ID NO: 2044243 - protein, 17 aa, Staphylococcus
VKSLIPLLKQHKDDIAH

SEQ ID NO: 2044244 - protein, 18 aa, Staphylococcus
VKSLLQMLLLHAVPEPVI

SEQ ID NO: 2044245 - protein, 17 aa, Staphylococcus
VKSLPPFFYPLNELISI

SEQ ID NO: 2044246 - protein, 21 aa, Staphylococcus
VKSLWPQNGDYVLATLRIDSE

SEQ ID NO: 2044247 - protein, 26 aa, Staphylococcus
VKSMIFKIDGEFIMFLIRGHHELNDV

SEQ ID NO: 2044248 - protein, 17 aa, Staphylococcus
VKSRAGMSLTRNTSRFY

SEQ ID NO: 2044249 - protein, 18 aa, Staphylococcus
VKSRLTIKQLFIVEPERF

SEQ ID NO: 2044250 - protein, 17 aa, Staphylococcus
VKSRSRGFEQIGVAVIW

SEQ ID NO: 2044251 - protein, 18 aa, Staphylococcus
VKSVSDLTQFDEIMDGRV

SEQ ID NO: 2044252 - protein, 20 aa, Staphylococcus
VKSVSELTQFPEIMDGRVKT

SEQ ID NO: 2044253 - protein, 23 aa, Staphylococcus
VKSYLKAEMEPFVDEFVYNRMGG

SEQ ID NO: 2044254 - protein, 20 aa, Staphylococcus
VKSYPGFKIPDDALVTQIAV

SEQ ID NO: 2044255 - protein, 19 aa, Staphylococcus
VKTAPRITEFLNETSKQYY

SEQ ID NO: 2044256 - protein, 20 aa, Staphylococcus
VKTDMPYVVLYTFNQPKNWK

SEQ ID NO: 2044257 - protein, 20 aa, Staphylococcus
VKTKNGQMLVCQDPQCKTKK

SEQ ID NO: 2044258 - protein, 20 aa, Staphylococcus
VKTKNGQMLVCQDPTCHTKK

SEQ ID NO: 2044259 - protein, 17 aa, Staphylococcus
VKTKNGQMLVCQDPTCK

SEQ ID NO: 2044260 - protein, 19 aa, Staphylococcus
VKTKNGQMLVCQDPTCKTK

SEQ ID NO: 2044261 - protein, 28 aa, Staphylococcus
VKTLHPFFYPLNKLFSINDMIKEAGYHS

SEQ ID NO: 2044262 - protein, 21 aa, Staphylococcus
VKTMGGLHIKPDMTFGECKLG

SEQ ID NO: 2044263 - protein, 18 aa, Staphylococcus
VKTMIFKVDGEFIMILIR

SEQ ID NO: 2044264 - protein, 18 aa, Staphylococcus
VKTMIFKVDGEFIMVLVR

SEQ ID NO: 2044265 - protein, 18 aa, Staphylococcus
VKTMIFKVDGEFMMFLVR

SEQ ID NO: 2044266 - protein, 20 aa, Staphylococcus
VKTNIPFLINVMRNEQFRSG

SEQ ID NO: 2044267 - protein, 19 aa, Staphylococcus
VKTNVPFLINVMRNEQFKT

SEQ ID NO: 2044268 - protein, 24 aa, Staphylococcus
VKTPRFYLDLTKYHSSLIQHSTPF

SEQ ID NO: 2044269 - protein, 17 aa, Staphylococcus
VKTRGEFLAKSIQSKIQ

SEQ ID NO: 2044270 - protein, 17 aa, Staphylococcus
VKTRLGYYNIEEWKEWL

SEQ ID NO: 2044271 - protein, 17 aa, Staphylococcus
VKTSKDLKAVFDEINED

SEQ ID NO: 2044272 - protein, 24 aa, Staphylococcus
VKTTRAFFEKYFDLVCIGSAGNMF

SEQ ID NO: 2044273 - protein, 34 aa, Staphylococcus
VKVAAGIEIPDARYIDWFPNFTLADLISDDTATG

SEQ ID NO: 2044274 - protein, 23 aa, Staphylococcus
VKVAKELGLFVSCDLNFRAALWD

SEQ ID NO: 2044275 - protein, 33 aa, Staphylococcus
VKVEACGICAGDIKAYGGAPSFWGDEKQPSYIK

SEQ ID NO: 2044276 - protein, 33 aa, Staphylococcus
VKVEACGICAGDIKAYGGAPSFWGDETQPAYIK

SEQ ID NO: 2044277 - protein, 17 aa, Staphylococcus
VKVEEGQEIFVEKLDVN

SEQ ID NO: 2044278 - protein, 24 aa, Staphylococcus
VKVGDPIIKFDVEYIRNNAKSVIS

SEQ ID NO: 2044279 - protein, 26 aa, Staphylococcus
VKVGDPLIRFDLEYIKNNAKSVISPI

SEQ ID NO: 2044280 - protein, 19 aa, Staphylococcus
VKVGMELFYQSGPQFIRDI

SEQ ID NO: 2044281 - protein, 21 aa, Staphylococcus
VKVHGRISVITFHSLEDRLCK

SEQ ID NO: 2044282 - protein, 21 aa, Staphylococcus
VKVHLRPSAQLVTEIVQVKSL

SEQ ID NO: 2044283 - protein, 24 aa, Staphylococcus
VKVKFLGRDDFDQFLDLYRETEER

SEQ ID NO: 2044284 - protein, 18 aa, Staphylococcus
VKVKREDAVWDLPMVFAE

SEQ ID NO: 2044285 - protein, 18 aa, Staphylococcus
VKVKREDAVWDLTKVFAD

SEQ ID NO: 2044286 - protein, 27 aa, Staphylococcus
VKVKREEAAWDLKKVFADFAEGSFHPK

SEQ ID NO: 2044287 - protein, 27 aa, Staphylococcus
VKVKREEAAWDLRKVFADFGEGDFHPK

SEQ ID NO: 2044288 - protein, 24 aa, Staphylococcus
VKVLARGPVFKGLLTSNSIDALDH

SEQ ID NO: 2044289 - protein, 23 aa, Staphylococcus
VKVLARGPVFKGLLTSNSNQALD

SEQ ID NO: 2044290 - protein, 24 aa, Staphylococcus
VKVLARGPVFKGLLTSNSVDALDK

SEQ ID NO: 2044291 - protein, 24 aa, Staphylococcus
VKVLARGPVFKGLLTSNSVNVLDQ

SEQ ID NO: 2044292 - protein, 25 aa, Staphylococcus
VKVLQRLSKASGHIGMVGGQTLDMQ

SEQ ID NO: 2044293 - protein, 17 aa, Staphylococcus
VKVMAVGVCGSDVHYYE

SEQ ID NO: 2044294 - protein, 19 aa, Staphylococcus
VKVPRSVKVLKKCKAYNDR

SEQ ID NO: 2044295 - protein, 20 aa, Staphylococcus
VKVQRDWRNKVNFIRQIGYV

SEQ ID NO: 2044296 - protein, 20 aa, Staphylococcus
VKVRVTGIQPYGAFVETPDN

SEQ ID NO: 2044297 - protein, 27 aa, Staphylococcus
VKVSLKRLGLNHIDLYQLHGGTIDDPL

SEQ ID NO: 2044298 - protein, 22 aa, Staphylococcus
VKVSWAGICGTDLHEYLEGPIF

SEQ ID NO: 2044299 - protein, 19 aa, Staphylococcus
VKVSWTGICGTDLHEYLEG

SEQ ID NO: 2044300 - protein, 21 aa, Staphylococcus
VKVSWTGICGTDLHEYLEGPI

SEQ ID NO: 2044301 - protein, 26 aa, Staphylococcus
VKVVKACKLYDSRDFKDNTVRKLKKG

SEQ ID NO: 2044302 - protein, 22 aa, Staphylococcus
VKWGELDYLLLDLPPGTGDVAL

SEQ ID NO: 2044303 - protein, 22 aa, Staphylococcus
VKWRLVNLTTFMYGTKLHFNND

SEQ ID NO: 2044304 - protein, 23 aa, Staphylococcus
VKYAEAFGAKGMRVTNQEELENA

SEQ ID NO: 2044305 - protein, 24 aa, Staphylococcus
VKYAESFGAKGIRVTSPEELEAAI

SEQ ID NO: 2044306 - protein, 25 aa, Staphylococcus
VKYAESFGAKGLRVTNQEELEAALK

SEQ ID NO: 2044307 - protein, 17 aa, Staphylococcus
VKYAKPKLLGELFNCSY

SEQ ID NO: 2044308 - protein, 24 aa, Staphylococcus
VKYASRELKMLFSQVEEEMVNTFV

SEQ ID NO: 2044309 - protein, 22 aa, Staphylococcus
VKYDEVMRFGKYHPDYQQVTRA

SEQ ID NO: 2044310 - protein, 19 aa, Staphylococcus
VKYGKGIVSKAISYTEAGT

SEQ ID NO: 2044311 - protein, 19 aa, Staphylococcus
VKYHNGLLLEALKSYGTLI

SEQ ID NO: 2044312 - protein, 24 aa, Staphylococcus
VKYIEIRFAPLFHMDQGLTMTEVL

SEQ ID NO: 2044313 - protein, 20 aa, Staphylococcus
VKYITCFDQGYPHLLKEIYD

SEQ ID NO: 2044314 - protein, 20 aa, Staphylococcus
VKYNRKIVVFGRSMENNIKI

SEQ ID NO: 2044315 - protein, 20 aa, Staphylococcus
VKYPYIRGKLLDLWTTALEE

SEQ ID NO: 2044316 - protein, 23 aa, Staphylococcus
VKYREIMHQFTLSEIKAIYTDTF

SEQ ID NO: 2044317 - protein, 18 aa, Staphylococcus
VKYRGFAIRQEVLEELGF

SEQ ID NO: 2044318 - protein, 22 aa, Staphylococcus
VKYSPDCKIIVLTNPVDAMTYS

SEQ ID NO: 2044319 - protein, 18 aa, Staphylococcus
VLADLPGLIEGASEGVGL

SEQ ID NO: 2044320 - protein, 20 aa, Staphylococcus
VLAGFAGSVADAFTLFEKFE

SEQ ID NO: 2044321 - protein, 24 aa, Staphylococcus
VLAIPVYQGKLLFTRHKNRGIEFP

SEQ ID NO: 2044322 - protein, 21 aa, Staphylococcus
VLAKIPGDFAIYDGVTSAEIY

SEQ ID NO: 2044323 - protein, 23 aa, Staphylococcus
VLAKRLEELGVHAIMPLASPIGT

SEQ ID NO: 2044324 - protein, 24 aa, Staphylococcus
VLAPYRLAPEAAFETIISDALTVF

SEQ ID NO: 2044325 - protein, 23 aa, Staphylococcus
VLASRLGGYAVDLLMQGRSGQGV

SEQ ID NO: 2044326 - protein, 23 aa, Staphylococcus
VLASRLGGYAVELLMQGQTGFGV

SEQ ID NO: 2044327 - protein, 22 aa, Staphylococcus
VLAVESKSGYGLDKENELKQLR

SEQ ID NO: 2044328 - protein, 17 aa, Staphylococcus
VLCCTPTEYRMMAKLQN

SEQ ID NO: 2044329 - protein, 22 aa, Staphylococcus
VLCSVDVNWLFENYDVEEIEYG

SEQ ID NO: 2044330 - protein, 25 aa, Staphylococcus
VLDACSAPGGKACHIAEILNGTGHV

SEQ ID NO: 2044331 - protein, 26 aa, Staphylococcus
VLDACSAPGGKACHMAEILAPTGSVD

SEQ ID NO: 2044332 - protein, 32 aa, Staphylococcus
VLDCTQYPFRIARPGAITAEMIEQVIPGSIDT

SEQ ID NO: 2044333 - protein, 26 aa, Staphylococcus
VLDCTQYPFRIARPGSITKKMIENVL

SEQ ID NO: 2044334 - protein, 24 aa, Staphylococcus
VLDCTQYPFRIARPGSITTSMIEQ

SEQ ID NO: 2044335 - protein, 26 aa, Staphylococcus
VLDEAHCITEWGYDFRPHYALVGKIT

SEQ ID NO: 2044336 - protein, 31 aa, Staphylococcus
VLDEAHCLSEWGYDFRPHYALIGEITSHYKN

SEQ ID NO: 2044337 - protein, 26 aa, Staphylococcus
VLDEAHCLSEWGYDFRPHYALIGKIT

SEQ ID NO: 2044338 - protein, 26 aa, Staphylococcus
VLDEAHCLSEWGYDFRPHYALIGQIT

SEQ ID NO: 2044339 - protein, 27 aa, Staphylococcus
VLDEAHCLSEWGYDFRPHYALIGQITS

SEQ ID NO: 2044340 - protein, 26 aa, Staphylococcus
VLDEAHCLSEWGYDFRPHYALVGKIV

SEQ ID NO: 2044341 - protein, 21 aa, Staphylococcus
VLDEAYIEFGKTIDIPLQSHL

SEQ ID NO: 2044342 - protein, 17 aa, Staphylococcus
VLDIPYVGNGVLAASSS

SEQ ID NO: 2044343 - protein, 23 aa, Staphylococcus
VLDKERRFLAEAMEGGLLNTQKI

SEQ ID NO: 2044344 - protein, 25 aa, Staphylococcus
VLDKIMKMLHPFMPFVTETIWQSLP

SEQ ID NO: 2044345 - protein, 19 aa, Staphylococcus
VLDKLPTQRIFTGSEESHC

SEQ ID NO: 2044346 - protein, 17 aa, Staphylococcus
VLDLPYVGNGVLAASSS

SEQ ID NO: 2044347 - protein, 17 aa, Staphylococcus
VLDLPYVGNGVLAASST

SEQ ID NO: 2044348 - protein, 22 aa, Staphylococcus
VLDSARFRYLISQELNVVPSSV

SEQ ID NO: 2044349 - protein, 25 aa, Staphylococcus
VLDSARLQYLISREFDVAPASVNAS

SEQ ID NO: 2044350 - protein, 19 aa, Staphylococcus
VLDSLSYYQFVILKVVVGE

SEQ ID NO: 2044351 - protein, 43 aa, Staphylococcus
VLEAGRSDYFWDLFIQMPAALMFPSGNRFYDWIYSTNNEPHMG

SEQ ID NO: 2044352 - protein, 22 aa, Staphylococcus
VLEENKYVFVLKHSETCPISAN

SEQ ID NO: 2044353 - protein, 23 aa, Staphylococcus
VLEENKYVFVLKHSETCPISANA

SEQ ID NO: 2044354 - protein, 18 aa, Staphylococcus
VLEGYEMTLPRYNRDGTM

SEQ ID NO: 2044355 - protein, 20 aa, Staphylococcus
VLEIEFKASHKKLYAPISGK

SEQ ID NO: 2044356 - protein, 18 aa, Staphylococcus
VLEIKDTVLNGGLVALPT

SEQ ID NO: 2044357 - protein, 21 aa, Staphylococcus
VLEIPIPIYAIGGITEKTILQ

SEQ ID NO: 2044358 - protein, 19 aa, Staphylococcus
VLEITGSELVRGRGGPRCM

SEQ ID NO: 2044359 - protein, 25 aa, Staphylococcus
VLEKNWPGLHIEPLQAPENMEVLIG

SEQ ID NO: 2044360 - protein, 17 aa, Staphylococcus
VLELAGITDILSKSLGS

SEQ ID NO: 2044361 - protein, 20 aa, Staphylococcus
VLELFIKGYLSDYHLYINQT

SEQ ID NO: 2044362 - protein, 25 aa, Staphylococcus
VLELKRLKISNLTLDENLKSGEYRL

SEQ ID NO: 2044363 - protein, 24 aa, Staphylococcus
VLELKRVKIANLELDETLNSGEYR

SEQ ID NO: 2044364 - protein, 18 aa, Staphylococcus
VLESLELDPKRVIVEHNK

SEQ ID NO: 2044365 - protein, 24 aa, Staphylococcus
VLESTCKEVGLLLANPNISTTIGR

SEQ ID NO: 2044366 - protein, 17 aa, Staphylococcus
VLETGYFLNVADQAIIG

SEQ ID NO: 2044367 - protein, 18 aa, Staphylococcus
VLEYIKYWTAHREELPYD

SEQ ID NO: 2044368 - protein, 39 aa, Staphylococcus
VLFLNRRGYASFMLCRDCGHVPQCPNCDISLTYHKSTDQ

SEQ ID NO: 2044369 - protein, 40 aa, Staphylococcus
VLFLNRRGYASFMLCRDCGHVPQCPNCDISLTYHKTTDLL

SEQ ID NO: 2044370 - protein, 24 aa, Staphylococcus
VLGAMPWCLYNTVDGEELQKIEDP

SEQ ID NO: 2044371 - protein, 24 aa, Staphylococcus
VLGGKNAGIATCWFNVRNKKNNSG

SEQ ID NO: 2044372 - protein, 18 aa, Staphylococcus
VLGGNTVDPSIRRGIAEA

SEQ ID NO: 2044373 - protein, 24 aa, Staphylococcus
VLGHSMGSIIARLFVEKYPDIAQG

SEQ ID NO: 2044374 - protein, 24 aa, Staphylococcus
VLGHSMGSIIARLFVETYPNFANG

SEQ ID NO: 2044375 - protein, 25 aa, Staphylococcus
VLGHSMGSIIARLFVKQYPQFANGL

SEQ ID NO: 2044376 - protein, 24 aa, Staphylococcus
VLGHSMGSIIARLFVMRYPEFANG

SEQ ID NO: 2044377 - protein, 17 aa, Staphylococcus
VLGLDWRLSIKEASSMN

SEQ ID NO: 2044378 - protein, 18 aa, Staphylococcus
VLGLLALGEIEDFSVIED

SEQ ID NO: 2044379 - protein, 26 aa, Staphylococcus
VLGMYPKDVQVLGAIVLHEGNIAEMQ

SEQ ID NO: 2044380 - protein, 25 aa, Staphylococcus
VLGMYPKDVQVLGAIVMHQGNIAEM

SEQ ID NO: 2044381 - protein, 22 aa, Staphylococcus
VLGRVYEYFIAKFASAEGKNAG

SEQ ID NO: 2044382 - protein, 22 aa, Staphylococcus
VLGVESKSGYGLDKENELKQLR

SEQ ID NO: 2044383 - protein, 18 aa, Staphylococcus
VLHCLPAFHDVNTQVGQQ

SEQ ID NO: 2044384 - protein, 21 aa, Staphylococcus
VLHHKYDWIIFSSKNAVRIFY

SEQ ID NO: 2044385 - protein, 18 aa, Staphylococcus
VLHLAEWLMEMQLDRKAG

SEQ ID NO: 2044386 - protein, 19 aa, Staphylococcus
VLHLAEWLMEMQLDRKAGD

SEQ ID NO: 2044387 - protein, 29 aa, Staphylococcus
VLHLLYARFWHKVLFDLGVVPTKEPFQKL

SEQ ID NO: 2044388 - protein, 27 aa, Staphylococcus
VLHLLYARFWHKVLYDLGVVPTKEPFQ

SEQ ID NO: 2044389 - protein, 26 aa, Staphylococcus
VLHLLYARFWHKVLYDMGVVPTKEPF

SEQ ID NO: 2044390 - protein, 28 aa, Staphylococcus
VLHLLYSRFWHKVLYDLGVVPTKEPFQK

SEQ ID NO: 2044391 - protein, 27 aa, Staphylococcus
VLHMPGHSPGSLTFVFKDFAVVGDTLF

SEQ ID NO: 2044392 - protein, 31 aa, Staphylococcus
VLHPMGGLQERIWNPLQMMNEFGIDVFSPST

SEQ ID NO: 2044393 - protein, 25 aa, Staphylococcus
VLHRFKEVYQIFSDVLGVPLKGKNE

SEQ ID NO: 2044394 - protein, 19 aa, Staphylococcus
VLICDEITSNLDVIAEQHM

SEQ ID NO: 2044395 - protein, 18 aa, Staphylococcus
VLICGDVKNSRVAKSNYQ

SEQ ID NO: 2044396 - protein, 18 aa, Staphylococcus
VLIDRITGRMLPGTKLQS

SEQ ID NO: 2044397 - protein, 17 aa, Staphylococcus
VLIEARVSVYERQGNYQ

SEQ ID NO: 2044398 - protein, 19 aa, Staphylococcus
VLIEARVSVYERRGNYQIY

SEQ ID NO: 2044399 - protein, 17 aa, Staphylococcus
VLIENVKSDHEVTYSAH

SEQ ID NO: 2044400 - protein, 17 aa, Staphylococcus
VLIGKVIDFDDKVDNFD

SEQ ID NO: 2044401 - protein, 26 aa, Staphylococcus
VLIHGFKDYCALLFHKGVLLPDPEHK

SEQ ID NO: 2044402 - protein, 25 aa, Staphylococcus
VLIHGFKHYVALLFHKGAILEDKYH

SEQ ID NO: 2044403 - protein, 19 aa, Staphylococcus
VLKEPGFFRNLEVIQDSQE

SEQ ID NO: 2044404 - protein, 26 aa, Staphylococcus
VLKGHLKPNGIFCFQESDAINGGVGA

SEQ ID NO: 2044405 - protein, 17 aa, Staphylococcus
VLKKGAYVTLLVRNIDK

SEQ ID NO: 2044406 - protein, 24 aa, Staphylococcus
VLKKLTSHITLMFDGDFAGQEATI

SEQ ID NO: 2044407 - protein, 17 aa, Staphylococcus
VLKLDGIGLYSNYGEEF

SEQ ID NO: 2044408 - protein, 17 aa, Staphylococcus
VLKSHIIIFKNKKDIKW

SEQ ID NO: 2044409 - protein, 18 aa, Staphylococcus
VLKTFNRVRYKDADQLIN

SEQ ID NO: 2044410 - protein, 22 aa, Staphylococcus
VLKVHAFELLMIDLNHYELSDI

SEQ ID NO: 2044411 - protein, 21 aa, Staphylococcus
VLKYKKRKAESLQKLDHTEDN

SEQ ID NO: 2044412 - protein, 19 aa, Staphylococcus
VLKYKKRKATSVQKLDQTE

SEQ ID NO: 2044413 - protein, 17 aa, Staphylococcus
VLLAQSLFGDPDVLLLD

SEQ ID NO: 2044414 - protein, 26 aa, Staphylococcus
VLLCGCQGVNGGGWAHYVGQEKCRPI

SEQ ID NO: 2044415 - protein, 18 aa, Staphylococcus
VLLHPQFDKYSKYLMSEH

SEQ ID NO: 2044416 - protein, 23 aa, Staphylococcus
VLLKKMPSFGFSIDFDKCSISEE

SEQ ID NO: 2044417 - protein, 28 aa, Staphylococcus
VLLLCTNSSIFSLKAFKSVIKSTLEQAN

SEQ ID NO: 2044418 - protein, 18 aa, Staphylococcus
VLLNNCLKRAKHLYQEGY

SEQ ID NO: 2044419 - protein, 26 aa, Staphylococcus
VLLNNCLKRAKYLYNEGYTFKMYPTD

SEQ ID NO: 2044420 - protein, 19 aa, Staphylococcus
VLLVKMAELIKEGDAPVAN

SEQ ID NO: 2044421 - protein, 19 aa, Staphylococcus
VLLVYIFERVEFIPDHYTR

SEQ ID NO: 2044422 - protein, 26 aa, Staphylococcus
VLMAVRIAYFKVHHPLYYYASYFTVR

SEQ ID NO: 2044423 - protein, 26 aa, Staphylococcus
VLMAVRIAYFKVHYPLYYYASYFTVR

SEQ ID NO: 2044424 - protein, 25 aa, Staphylococcus
VLNDLKRKYGKDISELITYQSKLAN

SEQ ID NO: 2044425 - protein, 18 aa, Staphylococcus
VLNELSFGGGAINDTLMH

SEQ ID NO: 2044426 - protein, 17 aa, Staphylococcus
VLNELSFGGGAINDTML

SEQ ID NO: 2044427 - protein, 25 aa, Staphylococcus
VLNERPESLFNYFKQLFAQVTNPPI

SEQ ID NO: 2044428 - protein, 25 aa, Staphylococcus
VLNHWQKRLEGIGWNALFIENHDQP

SEQ ID NO: 2044429 - protein, 18 aa, Staphylococcus
VLNKDAYVTFEIGYNQGE

SEQ ID NO: 2044430 - protein, 20 aa, Staphylococcus
VLNLFSYTGAFSVIAANHAQ

SEQ ID NO: 2044431 - protein, 20 aa, Staphylococcus
VLNLFSYTGAFSVIAAQNAR

SEQ ID NO: 2044432 - protein, 19 aa, Staphylococcus
VLNLFSYTGAFSVVASKNA

SEQ ID NO: 2044433 - protein, 19 aa, Staphylococcus
VLNLHKIYLFVDVNNEKAI

SEQ ID NO: 2044434 - protein, 22 aa, Staphylococcus
VLNNLAPLVFMIGKLNVPNLQD

SEQ ID NO: 2044435 - protein, 19 aa, Staphylococcus
VLNNLRGTEVFPNEDAFKG

SEQ ID NO: 2044436 - protein, 18 aa, Staphylococcus
VLNQQFAQYALKVTLRRE

SEQ ID NO: 2044437 - protein, 18 aa, Staphylococcus
VLNRIKWQNEAYRYLTKK

SEQ ID NO: 2044438 - protein, 22 aa, Staphylococcus
VLNRSNYALSFSKMTFPHQMMR

SEQ ID NO: 2044439 - protein, 20 aa, Staphylococcus
VLNTFTFRITRNADLTIHED

SEQ ID NO: 2044440 - protein, 18 aa, Staphylococcus
VLPDRRGYGYSELTEPMP

SEQ ID NO: 2044441 - protein, 27 aa, Staphylococcus
VLPETKITQPSTWERISQCITTTTNQY

SEQ ID NO: 2044442 - protein, 23 aa, Staphylococcus
VLPEVEGKLHGMALRVPTKNVSL

SEQ ID NO: 2044443 - protein, 21 aa, Staphylococcus
VLPIEVDERIHVLNVEDIVAV

SEQ ID NO: 2044444 - protein, 21 aa, Staphylococcus
VLPIEVNERIHIINLDDIIAV

SEQ ID NO: 2044445 - protein, 25 aa, Staphylococcus
VLPNGVELRNRFVLAPLTHISSNDD

SEQ ID NO: 2044446 - protein, 18 aa, Staphylococcus
VLPQFDIPFHIDIKKSMT

SEQ ID NO: 2044447 - protein, 27 aa, Staphylococcus
VLQDAGFSMCYFEHGVRFGHQHYDPVH

SEQ ID NO: 2044448 - protein, 25 aa, Staphylococcus
VLQDKGVEITSFFYNRMFNEHPELR

SEQ ID NO: 2044449 - protein, 21 aa, Staphylococcus
VLQELGLTKVNGGFVVTGGSA

SEQ ID NO: 2044450 - protein, 24 aa, Staphylococcus
VLQKFCLENKIGKYTLHSIRHTHC

SEQ ID NO: 2044451 - protein, 20 aa, Staphylococcus
VLQKLKVLGGNTVDPSIRRG

SEQ ID NO: 2044452 - protein, 20 aa, Staphylococcus
VLQNRLIRHAYLDVFENEPL

SEQ ID NO: 2044453 - protein, 17 aa, Staphylococcus
VLQQFKFDKAFLSCGAF

SEQ ID NO: 2044454 - protein, 19 aa, Staphylococcus
VLQRLAYASGHLGMVGGQT

SEQ ID NO: 2044455 - protein, 17 aa, Staphylococcus
VLQRSNYALSFSKMTFP

SEQ ID NO: 2044456 - protein, 21 aa, Staphylococcus
VLQRSNYALSFSKMTFPHQMM

SEQ ID NO: 2044457 - protein, 20 aa, Staphylococcus
VLQVIMFLRKMEVPLPEIRR

SEQ ID NO: 2044458 - protein, 24 aa, Staphylococcus
VLRERDHFAIFPASHFVTREEKMK

SEQ ID NO: 2044459 - protein, 18 aa, Staphylococcus
VLRESAFRNVYKAYGSHN

SEQ ID NO: 2044460 - protein, 22 aa, Staphylococcus
VLRKTINGYYIVVGERRFRASK

SEQ ID NO: 2044461 - protein, 17 aa, Staphylococcus
VLRTVMLQPDILICDEI

SEQ ID NO: 2044462 - protein, 24 aa, Staphylococcus
VLSEALTAMVAIPLWKNNRVYGAL

SEQ ID NO: 2044463 - protein, 19 aa, Staphylococcus
VLSELCLPLVKKGGQFIAL

SEQ ID NO: 2044464 - protein, 19 aa, Staphylococcus
VLSELCLPLVKTGGHFIAM

SEQ ID NO: 2044465 - protein, 17 aa, Staphylococcus
VLSEPYVIVCLNAIIAD

SEQ ID NO: 2044466 - protein, 23 aa, Staphylococcus
VLSEPYVIVCLNVIVSDTDTHAE

SEQ ID NO: 2044467 - protein, 18 aa, Staphylococcus
VLSERYGFDLSRPAENFK

SEQ ID NO: 2044468 - protein, 30 aa, Staphylococcus
VLSGRVGYHPTWKMVLGLFPKEDKIKALEA

SEQ ID NO: 2044469 - protein, 23 aa, Staphylococcus
VLSKRELEILPLIAKGYGNKEIA

SEQ ID NO: 2044470 - protein, 22 aa, Staphylococcus
VLSQRFIKYFKHHNITVNGHEA

SEQ ID NO: 2044471 - protein, 17 aa, Staphylococcus
VLSYKEHRERLRKKQAL

SEQ ID NO: 2044472 - protein, 25 aa, Staphylococcus
VLTDERYFGGSFERLQQISETTQLP

SEQ ID NO: 2044473 - protein, 24 aa, Staphylococcus
VLTEFKSWVGDAIFVAHNASFDMG

SEQ ID NO: 2044474 - protein, 18 aa, Staphylococcus
VLTEKGFESESFVMTQKR

SEQ ID NO: 2044475 - protein, 23 aa, Staphylococcus
VLTESGAFGRALVPSGASTGEYE

SEQ ID NO: 2044476 - protein, 24 aa, Staphylococcus
VLTFCDDLMKALKQHIAKASDPLF

SEQ ID NO: 2044477 - protein, 19 aa, Staphylococcus
VLTKIAFAVSENVKIEAGN

SEQ ID NO: 2044478 - protein, 18 aa, Staphylococcus
VLTKQAQPIKAYDATLKD

SEQ ID NO: 2044479 - protein, 18 aa, Staphylococcus
VLTQRFVNYFKDYQIEVD

SEQ ID NO: 2044480 - protein, 30 aa, Staphylococcus
VLTSVKWLTDKGVHFDRSFVDMPVGALWRR

SEQ ID NO: 2044481 - protein, 18 aa, Staphylococcus
VLVEAWAPFAEGKNNLFS

SEQ ID NO: 2044482 - protein, 19 aa, Staphylococcus
VLVLVGFGGGLTWGAVTLR

SEQ ID NO: 2044483 - protein, 19 aa, Staphylococcus
VLVPGYYLLTLVNEKTEYA

SEQ ID NO: 2044484 - protein, 26 aa, Staphylococcus
VLVTHEIQFAKAIADQVLFIDDGHII

SEQ ID NO: 2044485 - protein, 18 aa, Staphylococcus
VLVYYLEMILEFANKRFM

SEQ ID NO: 2044486 - protein, 17 aa, Staphylococcus
VLYDLDFLNTLPYTEIS

SEQ ID NO: 2044487 - protein, 20 aa, Staphylococcus
VMAGILGALGYTPTEDINHA

SEQ ID NO: 2044488 - protein, 18 aa, Staphylococcus
VMAKMGISTVQSYHGAQI

SEQ ID NO: 2044489 - protein, 22 aa, Staphylococcus
VMASGFNGIFLVATNPVDVLTY

SEQ ID NO: 2044490 - protein, 18 aa, Staphylococcus
VMATITFQNLFKLFDKFA

SEQ ID NO: 2044491 - protein, 19 aa, Staphylococcus
VMCQCGKPSKAEMEECACE

SEQ ID NO: 2044492 - protein, 23 aa, Staphylococcus
VMDGRDIGTVVLPDADLKVYMIA

SEQ ID NO: 2044493 - protein, 21 aa, Staphylococcus
VMDGRDIGTVVLPDAELKVFM

SEQ ID NO: 2044494 - protein, 18 aa, Staphylococcus
VMEALRIVDHVSKVELIS

SEQ ID NO: 2044495 - protein, 26 aa, Staphylococcus
VMEAVRYLIGVGFSKQLITLDVFNVS

SEQ ID NO: 2044496 - protein, 17 aa, Staphylococcus
VMECMDTSFAIYDGVTN

SEQ ID NO: 2044497 - protein, 17 aa, Staphylococcus
VMEDYDFYHYFGDIDKD

SEQ ID NO: 2044498 - protein, 23 aa, Staphylococcus
VMEELRLLARSVFVLDESNKIVY

SEQ ID NO: 2044499 - protein, 23 aa, Staphylococcus
VMEELRLLARSVFVLDKNNKVVY

SEQ ID NO: 2044500 - protein, 24 aa, Staphylococcus
VMEELRLLARSVFVLDSNDKVVYK

SEQ ID NO: 2044501 - protein, 19 aa, Staphylococcus
VMEGKAVLFKSFAGINGVP

SEQ ID NO: 2044502 - protein, 20 aa, Staphylococcus
VMEGKAVLFKSFAGINGVPI

SEQ ID NO: 2044503 - protein, 18 aa, Staphylococcus
VMEGKAVLFKSFAGVNGV

SEQ ID NO: 2044504 - protein, 19 aa, Staphylococcus
VMEKIGMKVFDRFEFPELN

SEQ ID NO: 2044505 - protein, 18 aa, Staphylococcus
VMESLILLSMRHRMATDK

SEQ ID NO: 2044506 - protein, 26 aa, Staphylococcus
VMFDYSACKYPLGLVENQIYYFNTEN

SEQ ID NO: 2044507 - protein, 24 aa, Staphylococcus
VMFRGEVITTHMIKLLQHYSNLGI

SEQ ID NO: 2044508 - protein, 18 aa, Staphylococcus
VMGGQLCADELAKYIHVD

SEQ ID NO: 2044509 - protein, 32 aa, Staphylococcus
VMGHAEYYPKFGFKQASNWGIQAPFDVPDELL

SEQ ID NO: 2044510 - protein, 17 aa, Staphylococcus
VMGHDWEGEFDFLKDKC

SEQ ID NO: 2044511 - protein, 18 aa, Staphylococcus
VMGHDWEGEFDFLKEQCE

SEQ ID NO: 2044512 - protein, 19 aa, Staphylococcus
VMGIPSLLIFKNGEKLAHL

SEQ ID NO: 2044513 - protein, 23 aa, Staphylococcus
VMGKGAGTVKHFGLQDKIDFQIG

SEQ ID NO: 2044514 - protein, 32 aa, Staphylococcus
VMGKGPKRPNGWILHIPSVYLGIAQAAADYAK

SEQ ID NO: 2044515 - protein, 25 aa, Staphylococcus
VMGRDCGDLALWAGLAVGAETIIVP

SEQ ID NO: 2044516 - protein, 25 aa, Staphylococcus
VMGRDCGDLALWAGLSVGAETIIVP

SEQ ID NO: 2044517 - protein, 25 aa, Staphylococcus
VMGRDCGDLALWAGLSVGAETIMVP

SEQ ID NO: 2044518 - protein, 36 aa, Staphylococcus
VMGSKISDWNKVGWGKIPMSLGFTYSSNTLMMHLQD

SEQ ID NO: 2044519 - protein, 17 aa, Staphylococcus
VMHACGHDIHMASILAI

SEQ ID NO: 2044520 - protein, 23 aa, Staphylococcus
VMHKARNLLKYKIDTYDSHLAQF

SEQ ID NO: 2044521 - protein, 23 aa, Staphylococcus
VMISRDVIKYGGLETEETSSEEN

SEQ ID NO: 2044522 - protein, 24 aa, Staphylococcus
VMISRDVIKYGGLKEESSEEQSVN

SEQ ID NO: 2044523 - protein, 19 aa, Staphylococcus
VMIYDRRKDLIISGGENIY

SEQ ID NO: 2044524 - protein, 23 aa, Staphylococcus
VMKEEPIKLLALITSNYRLYYQC

SEQ ID NO: 2044525 - protein, 21 aa, Staphylococcus
VMKEGHGAYLYDVDGNKFIDY

SEQ ID NO: 2044526 - protein, 19 aa, Staphylococcus
VMKEGLCELLVDWLNNETE

SEQ ID NO: 2044527 - protein, 25 aa, Staphylococcus
VMKEGLKGLLGQWLFSNESKQLNIE

SEQ ID NO: 2044528 - protein, 21 aa, Staphylococcus
VMKEMRLLARSVFVLDENNHV

SEQ ID NO: 2044529 - protein, 23 aa, Staphylococcus
VMKRCQKFKKQAGSYPQWIKLDI

SEQ ID NO: 2044530 - protein, 24 aa, Staphylococcus
VMKVTLKKSTQWLENLKFLVKCLE

SEQ ID NO: 2044531 - protein, 19 aa, Staphylococcus
VMLQPDILICDEITASLDV

SEQ ID NO: 2044532 - protein, 21 aa, Staphylococcus
VMMGVLPLQFLDGESADSLGL

SEQ ID NO: 2044533 - protein, 23 aa, Staphylococcus
VMMKEGHGAYLYDVDGNKFIDYL

SEQ ID NO: 2044534 - protein, 19 aa, Staphylococcus
VMPGFDFYFIPTVMNSNDT

SEQ ID NO: 2044535 - protein, 17 aa, Staphylococcus
VMPIIKLDGEAVNDGKV

SEQ ID NO: 2044536 - protein, 23 aa, Staphylococcus
VMQELTEYGLIPEDWGGDTIFVP

SEQ ID NO: 2044537 - protein, 23 aa, Staphylococcus
VMQELTEYGLIPEDWGGETIFVP

SEQ ID NO: 2044538 - protein, 25 aa, Staphylococcus
VMRDHCSVCHAVLPQIEDIVASYPN

SEQ ID NO: 2044539 - protein, 18 aa, Staphylococcus
VMRFGRYHPDYQTIMLET

SEQ ID NO: 2044540 - protein, 25 aa, Staphylococcus
VMRNHCSVCHAVLPQIEDIVNDYSK

SEQ ID NO: 2044541 - protein, 25 aa, Staphylococcus
VMRYPEFANGLILTGTGMFPKWKGV

SEQ ID NO: 2044542 - protein, 17 aa, Staphylococcus
VMSEVKVGDDAVEHLLR

SEQ ID NO: 2044543 - protein, 21 aa, Staphylococcus
VMSGSEIYTALKSYAGNVNVK

SEQ ID NO: 2044544 - protein, 17 aa, Staphylococcus
VMTIANLKLKLSPNEVW

SEQ ID NO: 2044545 - protein, 22 aa, Staphylococcus
VMTPARQCYMEGSKVKRKDTDK

SEQ ID NO: 2044546 - protein, 27 aa, Staphylococcus
VMTSLKVLDFTLFKATIGDIYGSPLIT

SEQ ID NO: 2044547 - protein, 25 aa, Staphylococcus
VMVGLDLARQAMFSHEFIKKIKTMN

SEQ ID NO: 2044548 - protein, 20 aa, Staphylococcus
VMYHEFLQKCVLKAIDQGWI

SEQ ID NO: 2044549 - protein, 21 aa, Staphylococcus
VMYYAKYGLNFNMQKRKNTFQ

SEQ ID NO: 2044550 - protein, 18 aa, Staphylococcus
VNAALHYLARLIESGDLP

SEQ ID NO: 2044551 - protein, 17 aa, Staphylococcus
VNAAPGFNVIAAINVGY

SEQ ID NO: 2044552 - protein, 23 aa, Staphylococcus
VNAEGVDGIGFFFEPPYLGIDID

SEQ ID NO: 2044553 - protein, 23 aa, Staphylococcus
VNAEMREAVALAAVNQGKETADE

SEQ ID NO: 2044554 - protein, 27 aa, Staphylococcus
VNAEQFRQLFILPQGEFKKFLQSNSKE

SEQ ID NO: 2044555 - protein, 19 aa, Staphylococcus
VNAFYSWKKNANDIIEEMT

SEQ ID NO: 2044556 - protein, 22 aa, Staphylococcus
VNAILRHIFKSDLPTLETIKNE

SEQ ID NO: 2044557 - protein, 23 aa, Staphylococcus
VNAILRQIMRSDLPNVDDITDEK

SEQ ID NO: 2044558 - protein, 24 aa, Staphylococcus
VNAPATGWRTDANVNYLSFDISWN

SEQ ID NO: 2044559 - protein, 27 aa, Staphylococcus
VNAQLGLKVAVLTGVGLAEEFTQADYT

SEQ ID NO: 2044560 - protein, 32 aa, Staphylococcus
VNAYCPGVAKTEMWDRIDAEMVRYNDELQPGE

SEQ ID NO: 2044561 - protein, 18 aa, Staphylococcus
VNCEFTFSKDYPALYNDP

SEQ ID NO: 2044562 - protein, 22 aa, Staphylococcus
VNCVAPGPFWSPLQISGGQPQS

SEQ ID NO: 2044563 - protein, 22 aa, Staphylococcus
VNCVAPGPFWSPLQITGGQPQE

SEQ ID NO: 2044564 - protein, 22 aa, Staphylococcus
VNCVAPGPFWSPLQITGGQPQR

SEQ ID NO: 2044565 - protein, 18 aa, Staphylococcus
VNDDIPWLAEERALIIAM

SEQ ID NO: 2044566 - protein, 26 aa, Staphylococcus
VNDELQLVIVRDMWLTGFDVPSMHTM

SEQ ID NO: 2044567 - protein, 26 aa, Staphylococcus
VNDFAYKYNIPWIYGGVVQSTYIEAA

SEQ ID NO: 2044568 - protein, 23 aa, Staphylococcus
VNDGEIFVIMGLSGSGKSTLIRL

SEQ ID NO: 2044569 - protein, 25 aa, Staphylococcus
VNDGIEKARRLSFQTEDMKRQSKIF

SEQ ID NO: 2044570 - protein, 25 aa, Staphylococcus
VNDVEIPKIIGLVDALRFNNRMKYM

SEQ ID NO: 2044571 - protein, 20 aa, Staphylococcus
VNDWERLPLFQSQYDLEKSV

SEQ ID NO: 2044572 - protein, 18 aa, Staphylococcus
VNEAMKLFSEDRFNVDVL

SEQ ID NO: 2044573 - protein, 19 aa, Staphylococcus
VNEAMKLFSEDRFNVDVLK

SEQ ID NO: 2044574 - protein, 18 aa, Staphylococcus
VNEAMKLFSEPRFNVDVL

SEQ ID NO: 2044575 - protein, 20 aa, Staphylococcus
VNEAVDRACYLLETNASGRV

SEQ ID NO: 2044576 - protein, 18 aa, Staphylococcus
VNEAWYYIESSLQLTLPY

SEQ ID NO: 2044577 - protein, 24 aa, Staphylococcus
VNEAWYYIESSLQLTLPYEKNSLY

SEQ ID NO: 2044578 - protein, 23 aa, Staphylococcus
VNEIKIIKPVLLKAKTSFNNSID

SEQ ID NO: 2044579 - protein, 18 aa, Staphylococcus
VNELRQAIQNELEEKQEL

SEQ ID NO: 2044580 - protein, 17 aa, Staphylococcus
VNELRQTIQQELDERQT

SEQ ID NO: 2044581 - protein, 24 aa, Staphylococcus
VNEMYKLPLMYLEYSGQYGDVEKV

SEQ ID NO: 2044582 - protein, 24 aa, Staphylococcus
VNEPSYRDAIDWGSVNQPIEEEKF

SEQ ID NO: 2044583 - protein, 24 aa, Staphylococcus
VNEPSYRDNIAWGDINQPIDEDVF

SEQ ID NO: 2044584 - protein, 29 aa, Staphylococcus
VNERYLKHKDPLFDEGLALLKEIIYNPIV

SEQ ID NO: 2044585 - protein, 21 aa, Staphylococcus
VNEVKIEFMIKASQYALAEKA

SEQ ID NO: 2044586 - protein, 24 aa, Staphylococcus
VNEVLRVIKELAREGMTMVIVTHE

SEQ ID NO: 2044587 - protein, 25 aa, Staphylococcus
VNFEEARVALSLNVRKVHFSTYDKE

SEQ ID NO: 2044588 - protein, 23 aa, Staphylococcus
VNFETKMSIVLECHIYTLRQVYA

SEQ ID NO: 2044589 - protein, 23 aa, Staphylococcus
VNFRKEGKLAFYSLDDEHIRQIM

SEQ ID NO: 2044590 - protein, 17 aa, Staphylococcus
VNGACYIVALPEIFNKV

SEQ ID NO: 2044591 - protein, 17 aa, Staphylococcus
VNGAVNLYWTEPVNVRN

SEQ ID NO: 2044592 - protein, 25 aa, Staphylococcus
VNGDGRIKVYMSYKMDYDEFDQFKA

SEQ ID NO: 2044593 - protein, 25 aa, Staphylococcus
VNGDGRIKVYMSYQMDYEEFEKFKG

SEQ ID NO: 2044594 - protein, 21 aa, Staphylococcus
VNGERALLFGPFAGFSPKFLK

SEQ ID NO: 2044595 - protein, 18 aa, Staphylococcus
VNGGGCTGLTYGMSAEEE

SEQ ID NO: 2044596 - protein, 17 aa, Staphylococcus
VNGGGCTGLTYGMTAEE

SEQ ID NO: 2044597 - protein, 18 aa, Staphylococcus
VNGIEVLDMIDGETYGIK

SEQ ID NO: 2044598 - protein, 18 aa, Staphylococcus
VNGIGIDHDVLYASCKAY

SEQ ID NO: 2044599 - protein, 22 aa, Staphylococcus
VNGILRNIMRSDLPDFTEITDD

SEQ ID NO: 2044600 - protein, 23 aa, Staphylococcus
VNGILRTIMRSELPDVKDIQDDK

SEQ ID NO: 2044601 - protein, 17 aa, Staphylococcus
VNGKRLYEYARNNETVE

SEQ ID NO: 2044602 - protein, 18 aa, Staphylococcus
VNGTISIGCSSLIGQTIL

SEQ ID NO: 2044603 - protein, 19 aa, Staphylococcus
VNGTISIGCSSLIGQTLLP

SEQ ID NO: 2044604 - protein, 19 aa, Staphylococcus
VNHGRIVGLGAHLKQGERH

SEQ ID NO: 2044605 - protein, 18 aa, Staphylococcus
VNHIPKFDWLNGEKLDDK

SEQ ID NO: 2044606 - protein, 17 aa, Staphylococcus
VNHTFVFNHKKATLDKI

SEQ ID NO: 2044607 - protein, 20 aa, Staphylococcus
VNHWIQFGVDGFRFDVINLI

SEQ ID NO: 2044608 - protein, 22 aa, Staphylococcus
VNIKGVLYGIGAVLPYMRKQKS

SEQ ID NO: 2044609 - protein, 22 aa, Staphylococcus
VNILKMQLLTWIIETETGDIQD

SEQ ID NO: 2044610 - protein, 24 aa, Staphylococcus
VNILNEFDNAVILFMGAGDIQKIE

SEQ ID NO: 2044611 - protein, 20 aa, Staphylococcus
VNIMLRLQREKGITFLFIAH

SEQ ID NO: 2044612 - protein, 26 aa, Staphylococcus
VNIPGFRKGKVPRQIFEQRFGVEALY

SEQ ID NO: 2044613 - protein, 17 aa, Staphylococcus
VNIPKGYVGLLTSRSGV

SEQ ID NO: 2044614 - protein, 22 aa, Staphylococcus
VNIPKHQLTVFTGRSGSGKSSL

SEQ ID NO: 2044615 - protein, 19 aa, Staphylococcus
VNIRICTPQALSPKDAYVE

SEQ ID NO: 2044616 - protein, 25 aa, Staphylococcus
VNKANERWLRLTINSLILQYQYPIG

SEQ ID NO: 2044617 - protein, 19 aa, Staphylococcus
VNKCVSTLFGYDKALKKEQ

SEQ ID NO: 2044618 - protein, 18 aa, Staphylococcus
VNKDGLQRIFNVWTQGEA

SEQ ID NO: 2044619 - protein, 24 aa, Staphylococcus
VNKFKSANATIVFDPNVRLPLWQN

SEQ ID NO: 2044620 - protein, 18 aa, Staphylococcus
VNKIANHRILAMNRGEKE

SEQ ID NO: 2044621 - protein, 24 aa, Staphylococcus
VNKLRSNVKLALMPLQGYTVKANR

SEQ ID NO: 2044622 - protein, 21 aa, Staphylococcus
VNKQHIVVFMTFYEDMMPIIK

SEQ ID NO: 2044623 - protein, 23 aa, Staphylococcus
VNKSGGKLKIHYELYQEDEKMGT

SEQ ID NO: 2044624 - protein, 17 aa, Staphylococcus
VNKSSLVKRIDELRADK

SEQ ID NO: 2044625 - protein, 25 aa, Staphylococcus
VNKVKRLIDDMAIHCILHITPSINF

SEQ ID NO: 2044626 - protein, 22 aa, Staphylococcus
VNLAELYQQFVLARDNNQRVYT

SEQ ID NO: 2044627 - protein, 30 aa, Staphylococcus
VNLERAMPSQGRFGGHFVLGHVDEVGTIKR

SEQ ID NO: 2044628 - protein, 30 aa, Staphylococcus
VNLERAMSGNGRFGGHFVLGHVDDLGTISK

SEQ ID NO: 2044629 - protein, 21 aa, Staphylococcus
VNLGFIGVAGFDLLLDENDNV

SEQ ID NO: 2044630 - protein, 19 aa, Staphylococcus
VNLGGVFWGIQAALEQFNK

SEQ ID NO: 2044631 - protein, 25 aa, Staphylococcus
VNLKGPIWFSQSVAEHFIENNSGTI

SEQ ID NO: 2044632 - protein, 21 aa, Staphylococcus
VNLKSIMGVMSLGVGKDAEIT

SEQ ID NO: 2044633 - protein, 23 aa, Staphylococcus
VNLKSTGRMVGIISHVSELKQRI

SEQ ID NO: 2044634 - protein, 21 aa, Staphylococcus
VNLLKGFTFKVNGTLPIDKAF

SEQ ID NO: 2044635 - protein, 18 aa, Staphylococcus
VNLLPIIAKSLAPALKEK

SEQ ID NO: 2044636 - protein, 27 aa, Staphylococcus
VNLMIPCKPDHPFVYWATFSNAADLLD

SEQ ID NO: 2044637 - protein, 22 aa, Staphylococcus
VNLPEAAYLIGLVQSPYTYTPY

SEQ ID NO: 2044638 - protein, 17 aa, Staphylococcus
VNLRSIVDSEQFKNAES

SEQ ID NO: 2044639 - protein, 17 aa, Staphylococcus
VNLSFLNSLPIRGIGLD

SEQ ID NO: 2044640 - protein, 32 aa, Staphylococcus; identical to SEQ ID NO: 1802064

SEQ ID NO: 2044641 - protein, 17 aa, Staphylococcus
VNMAAIWLTNSDKDTEL

SEQ ID NO: 2044642 - protein, 24 aa, Staphylococcus
VNMFSNYVNFQFDLPIADGSEQLL

SEQ ID NO: 2044643 - protein, 23 aa, Staphylococcus
VNMFSNYVNFQFDMPIADGTTNM

SEQ ID NO: 2044644 - protein, 19 aa, Staphylococcus
VNMPTEIPMIYGGEYGPDL

SEQ ID NO: 2044645 - protein, 20 aa, Staphylococcus
VNMQPWRFVVVESDEAKAKL

SEQ ID NO: 2044646 - protein, 22 aa, Staphylococcus
VNMQPWRFVVVESDEAKAKLRP

SEQ ID NO: 2044647 - protein, 20 aa, Staphylococcus
VNMQPWRIAVVESDEAKDTL

SEQ ID NO: 2044648 - protein, 21 aa, Staphylococcus
VNMQPWRIAVVESDEGKEKIK

SEQ ID NO: 2044649 - protein, 19 aa, Staphylococcus
VNMYDSWKVEDILDQDSDV

SEQ ID NO: 2044650 - protein, 23 aa, Staphylococcus
VNNCVTIEPGIYIDGLGGVRIED

SEQ ID NO: 2044651 - protein, 22 aa, Staphylococcus
VNNDLPYHLAIKKLKQLDDDFG

SEQ ID NO: 2044652 - protein, 19 aa, Staphylococcus
VNNDLPYHLAVKKLKQLDE

SEQ ID NO: 2044653 - protein, 24 aa, Staphylococcus
VNNIYLPQYFDLVRVINLSLRAKY

SEQ ID NO: 2044654 - protein, 25 aa, Staphylococcus
VNNKRFKGIIGLVTMNKVREPLEVT

SEQ ID NO: 2044655 - protein, 19 aa, Staphylococcus
VNNSIHFKRLEIVEVDALY

SEQ ID NO: 2044656 - protein, 26 aa, Staphylococcus
VNNVRFLKNRVKALQKNVLFEKMVYT

SEQ ID NO: 2044657 - protein, 24 aa, Staphylococcus
VNNYDWLSSLTLLDFLRSYGKDFN

SEQ ID NO: 2044658 - protein, 25 aa, Staphylococcus
VNPDEVVAMGAAIQGGVISGDVKDV

SEQ ID NO: 2044659 - protein, 23 aa, Staphylococcus
VNPEEIVGIGIDFTSSTVMFTDE

SEQ ID NO: 2044660 - protein, 24 aa, Staphylococcus
VNPFPKDWRMHAFFMDALPILNEE

SEQ ID NO: 2044661 - protein, 22 aa, Staphylococcus
VNPGGAVYCATKFAVRALTEAL

SEQ ID NO: 2044662 - protein, 22 aa, Staphylococcus
VNPKIKIGVCGELGGDAKSIRR

SEQ ID NO: 2044663 - protein, 22 aa, Staphylococcus
VNPPIDTWVAFAPNKRGYKMLP

SEQ ID NO: 2044664 - protein, 29 aa, Staphylococcus
VNPQPVRWGGGIFHHIAWSVPNDEVHVQW

SEQ ID NO: 2044665 - protein, 30 aa, Staphylococcus
VNPQRVRWGTGIFHHIAWAVPNNESQLEWR

SEQ ID NO: 2044666 - protein, 17 aa, Staphylococcus
VNPRSSRTVPFLSKITD

SEQ ID NO: 2044667 - protein, 20 aa, Staphylococcus
VNPRSSRTVPFLSKITNIPM

SEQ ID NO: 2044668 - protein, 19 aa, Staphylococcus
VNPRSSRTVPFLSKITNIQ

SEQ ID NO: 2044669 - protein, 18 aa, Staphylococcus
VNQNVHFEVLLVKIAEMM

SEQ ID NO: 2044670 - protein, 18 aa, Staphylococcus
VNQNVHFEVLLVKLAEMI

SEQ ID NO: 2044671 - protein, 23 aa, Staphylococcus
VNQVKFFGSKNVKIILTGDTFDD

SEQ ID NO: 2044672 - protein, 25 aa, Staphylococcus
VNRETWAKHRGLVAAEQILEDITQF

SEQ ID NO: 2044673 - protein, 18 aa, Staphylococcus
VNRKHFARLQHLLQDSTG

SEQ ID NO: 2044674 - protein, 25 aa, Staphylococcus
VNRLMKLKYVRQIDGSPYKYLKKTY

SEQ ID NO: 2044675 - protein, 27 aa, Staphylococcus
VNRMAMSHPYIRISLISDGKTLLKTNG

SEQ ID NO: 2044676 - protein, 20 aa, Staphylococcus
VNRSMPHYVVEHVKRILSGI

SEQ ID NO: 2044677 - protein, 25 aa, Staphylococcus
VNSDLPMFGTCAGLIVLAQDIVGEE

SEQ ID NO: 2044678 - protein, 20 aa, Staphylococcus
VNSDTSLVWLCNPNNPTGTY

SEQ ID NO: 2044679 - protein, 18 aa, Staphylococcus
VNSEAIKNFLYKNSDLQI

SEQ ID NO: 2044680 - protein, 23 aa, Staphylococcus
VNSLPVKGFGLDFVHDRGVNLQQ

SEQ ID NO: 2044681 - protein, 25 aa, Staphylococcus
VNSPISFELWIAILLTVEQTNTSLS

SEQ ID NO: 2044682 - protein, 23 aa, Staphylococcus
VNSPNKLPAIIFVTESKKVFIHC

SEQ ID NO: 2044683 - protein, 21 aa, Staphylococcus
VNSSIKIGVCGELGGDAKSIR

SEQ ID NO: 2044684 - protein, 22 aa, Staphylococcus
VNSVAPGPFWSPLQISGGQPQD

SEQ ID NO: 2044685 - protein, 22 aa, Staphylococcus
VNSVAPGPFWSPLQISGGQPQS

SEQ ID NO: 2044686 - protein, 17 aa, Staphylococcus
VNTEPVWIRELRYAEEH

SEQ ID NO: 2044687 - protein, 24 aa, Staphylococcus
VNTFPTPPIFDWLQQQGQISTDEM

SEQ ID NO: 2044688 - protein, 25 aa, Staphylococcus
VNTGHAYLAYAGRFYGQPTILDAVN

SEQ ID NO: 2044689 - protein, 17 aa, Staphylococcus
VNTSSAMIIVFGDLKNY

SEQ ID NO: 2044690 - protein, 20 aa, Staphylococcus
VNTYDWFKEHLVSIDDIEDY

SEQ ID NO: 2044691 - protein, 22 aa, Staphylococcus
VNVATFTLAVNRTFTNAQGERE

SEQ ID NO: 2044692 - protein, 22 aa, Staphylococcus
VNVDELFDMFIFKNDRLKDKMK

SEQ ID NO: 2044693 - protein, 18 aa, Staphylococcus
VNVDLHYDYARLIQDELK

SEQ ID NO: 2044694 - protein, 18 aa, Staphylococcus
VNVPEDLQILSFNNTRLV

SEQ ID NO: 2044695 - protein, 18 aa, Staphylococcus
VNVPIFLKLTSDLELDGF

SEQ ID NO: 2044696 - protein, 19 aa, Staphylococcus
VNWCPELKAVLSNEEVVDG

SEQ ID NO: 2044697 - protein, 24 aa, Staphylococcus
VNYFKRGDITIGVIGLTTQFIPNW

SEQ ID NO: 2044698 - protein, 17 aa, Staphylococcus
VNYKSIYLKISLKDSYD

SEQ ID NO: 2044699 - protein, 17 aa, Staphylococcus
VNYLRYFADLKVIGNPI

SEQ ID NO: 2044700 - protein, 18 aa, Staphylococcus
VNYTKLFWSTIEDYFFGV

SEQ ID NO: 2044701 - protein, 19 aa, Staphylococcus
VPAARIGHVGLYRDPETLE

SEQ ID NO: 2044702 - protein, 18 aa, Staphylococcus
VPAARVGHIGLYRDPETL

SEQ ID NO: 2044703 - protein, 18 aa, Staphylococcus
VPAARVGHIGLYRDPNTL

SEQ ID NO: 2044704 - protein, 18 aa, Staphylococcus
VPAARVGHIGLYRDPQTL

SEQ ID NO: 2044705 - protein, 18 aa, Staphylococcus
VPAGDGWDSDPFDPVVTD

SEQ ID NO: 2044706 - protein, 18 aa, Staphylococcus
VPAGDGWDSDPFKPVVTD

SEQ ID NO: 2044707 - protein, 18 aa, Staphylococcus
VPAGDGWDSNPFEPVVTD

SEQ ID NO: 2044708 - protein, 18 aa, Staphylococcus
VPAGDGWNSDPFKPVVTD

SEQ ID NO: 2044709 - protein, 17 aa, Staphylococcus
VPAGGALAVDRHDFSGY

SEQ ID NO: 2044710 - protein, 19 aa, Staphylococcus
VPAPARLFSELTRKENLEA

SEQ ID NO: 2044711 - protein, 18 aa, Staphylococcus
VPAYDLGATVIKHIVKNT

SEQ ID NO: 2044712 - protein, 19 aa, Staphylococcus
VPCTPLGIMELLKNADIDL

SEQ ID NO: 2044713 - protein, 17 aa, Staphylococcus
VPDDIAGPVMFLASDWS

SEQ ID NO: 2044714 - protein, 24 aa, Staphylococcus
VPDEASIEYNVRPVPEYNNDFVKD

SEQ ID NO: 2044715 - protein, 17 aa, Staphylococcus
VPDEITHALNLSMIGHR

SEQ ID NO: 2044716 - protein, 18 aa, Staphylococcus
VPDIEAATEFFKKGLNGK

SEQ ID NO: 2044717 - protein, 18 aa, Staphylococcus
VPDNLSFIVEEVAVKRYN

SEQ ID NO: 2044718 - protein, 28 aa, Staphylococcus
VPDTEVIDVFPIRFIVDGDNEVSDPKEL

SEQ ID NO: 2044719 - protein, 26 aa, Staphylococcus
VPDTLRVASILAHTLFDYPSQQLTTF

SEQ ID NO: 2044720 - protein, 34 aa, Staphylococcus
VPDTLRVASLLAHELFDFPSHQLVTYGVTGTNGK

SEQ ID NO: 2044721 - protein, 32 aa, Staphylococcus; identical to SEQ ID NO: 1814351

SEQ ID NO: 2044722 - protein, 26 aa, Staphylococcus
VPDTLRVASLLAHTLYDFPSHQLTTI

SEQ ID NO: 2044723 - protein, 24 aa, Staphylococcus
VPDTLRVASLLANTLYNYPSKQLI

SEQ ID NO: 2044724 - protein, 29 aa, Staphylococcus
VPEAIKLLKEIPHRSSFSYIVMDKYLNHA

SEQ ID NO: 2044725 - protein, 24 aa, Staphylococcus
VPEAPHEVLLCLDATTGQNALSQA

SEQ ID NO: 2044726 - protein, 19 aa, Staphylococcus
VPEDMPIEKAILIEPYACS

SEQ ID NO: 2044727 - protein, 25 aa, Staphylococcus
VPEEIKRTFDRLGIPEAEQKYLAGV

SEQ ID NO: 2044728 - protein, 28 aa, Staphylococcus
VPEFKNKHLRLAISKAINKKQYVKSVFN

SEQ ID NO: 2044729 - protein, 23 aa, Staphylococcus
VPEGLIPLLKIQGLGSKKIAKLY

SEQ ID NO: 2044730 - protein, 22 aa, Staphylococcus
VPEGLVPLLKIQGLGSKKIAKL

SEQ ID NO: 2044731 - protein, 21 aa, Staphylococcus
VPEGVLIRAIEPVDGIEAMKI

SEQ ID NO: 2044732 - protein, 29 aa, Staphylococcus
VPEKNGKEISRIGSTFGKTNRVIIDTDDH

SEQ ID NO: 2044733 - protein, 25 aa, Staphylococcus
VPELKNSRVLKEWSGVRPYTNNEMP

SEQ ID NO: 2044734 - protein, 23 aa, Staphylococcus
VPELNIHPGEWITITGKNGAGKT

SEQ ID NO: 2044735 - protein, 20 aa, Staphylococcus
VPENKWPEWLNVYGTKDSMD

SEQ ID NO: 2044736 - protein, 24 aa, Staphylococcus
VPENTHAIMLLKGAGFNIEGELKN

SEQ ID NO: 2044737 - protein, 21 aa, Staphylococcus
VPEPIYPLWHRAMNSSARASD

SEQ ID NO: 2044738 - protein, 26 aa, Staphylococcus
VPETEVINVFPIRFVVDKENEVSDPK

SEQ ID NO: 2044739 - protein, 17 aa, Staphylococcus
VPEVLKEVDMYAQRNHE

SEQ ID NO: 2044740 - protein, 25 aa, Staphylococcus
VPFGEGCVEWEKFFKILKDIHYNGP

SEQ ID NO: 2044741 - protein, 18 aa, Staphylococcus
VPFGPRTVQGYVMDIQSH

SEQ ID NO: 2044742 - protein, 17 aa, Staphylococcus
VPFGTGTSVSYNYVDYR

SEQ ID NO: 2044743 - protein, 22 aa, Staphylococcus
VPFKNGVYLAVPVFNDTYYIKR

SEQ ID NO: 2044744 - protein, 18 aa, Staphylococcus
VPFKRKAKEKVNINTIEG

SEQ ID NO: 2044745 - protein, 17 aa, Staphylococcus
VPFLSKITNIPMAQLAM

SEQ ID NO: 2044746 - protein, 19 aa, Staphylococcus
VPFNGWYMVNEIAVRNFTD

SEQ ID NO: 2044747 - protein, 27 aa, Staphylococcus
VPFPRISYDDAIKFLKEEGFDDIEWGE

SEQ ID NO: 2044748 - protein, 22 aa, Staphylococcus
VPFSEDFVRAVSNLRLVVDLSN

SEQ ID NO: 2044749 - protein, 21 aa, Staphylococcus
VPGELCIGGSGLAKGYLNQPE

SEQ ID NO: 2044750 - protein, 22 aa, Staphylococcus
VPGINAPPMHPWCRSTTVPHVG

SEQ ID NO: 2044751 - protein, 23 aa, Staphylococcus
VPGVPKARVSIIGGGQAGTNAAK

SEQ ID NO: 2044752 - protein, 18 aa, Staphylococcus
VPHAICGILGRQMSGKDV

SEQ ID NO: 2044753 - protein, 18 aa, Staphylococcus
VPHAVCGILARQMSGKDI

SEQ ID NO: 2044754 - protein, 18 aa, Staphylococcus
VPHCQKVVNEWYRTYSET

SEQ ID NO: 2044755 - protein, 19 aa, Staphylococcus
VPHTYRFGDYEIEIQPDFP

SEQ ID NO: 2044756 - protein, 21 aa, Staphylococcus
VPIEPGCYLMKDRQQQVIYVG

SEQ ID NO: 2044757 - protein, 25 aa, Staphylococcus
VPIEPLRKLEIVTGDYQDVIQEKVN

SEQ ID NO: 2044758 - protein, 18 aa, Staphylococcus
VPIFQYLKFKPKQVQFKL

SEQ ID NO: 2044759 - protein, 19 aa, Staphylococcus
VPIVDRLTLDLIKQLIRIH

SEQ ID NO: 2044760 - protein, 25 aa, Staphylococcus
VPIVDRLTLEMIKQLIRLHKPQNIL

SEQ ID NO: 2044761 - protein, 17 aa, Staphylococcus
VPIWKKEIWEDGAEWQG

SEQ ID NO: 2044762 - protein, 17 aa, Staphylococcus
VPIYLKRNPNFKFPKDG

SEQ ID NO: 2044763 - protein, 17 aa, Staphylococcus
VPIYLKRNPNFKFPQES

SEQ ID NO: 2044764 - protein, 27 aa, Staphylococcus
VPKALRILKDFLKPEGIFCFQESDAIN

SEQ ID NO: 2044765 - protein, 26 aa, Staphylococcus
VPKDLKDAGVQWVDRYVRAQIKEAFA

SEQ ID NO: 2044766 - protein, 18 aa, Staphylococcus
VPKGKVSIIGGGQAGTNA

SEQ ID NO: 2044767 - protein, 18 aa, Staphylococcus
VPKGKVTIIGGGQAGTNA

SEQ ID NO: 2044768 - protein, 27 aa, Staphylococcus
VPLDEAMRLFMKDCAHYEIPVETLVHR

SEQ ID NO: 2044769 - protein, 20 aa, Staphylococcus
VPLEEGVSIITSKKAQSLKQ

SEQ ID NO: 2044770 - protein, 17 aa, Staphylococcus
VPLEHFVETRGQRRPNG

SEQ ID NO: 2044771 - protein, 21 aa, Staphylococcus
VPLEPGCYLMKDRNDQVIYVG

SEQ ID NO: 2044772 - protein, 27 aa, Staphylococcus
VPLIKKRNDYALWLKVIKKAKKVHTLE

SEQ ID NO: 2044773 - protein, 17 aa, Staphylococcus
VPLKVLQDAFGLSRVAY

SEQ ID NO: 2044774 - protein, 17 aa, Staphylococcus
VPLLIAANCDSGGNGAC

SEQ ID NO: 2044775 - protein, 24 aa, Staphylococcus
VPLVKAIAASSAFQGAYPTIQIDG

SEQ ID NO: 2044776 - protein, 20 aa, Staphylococcus
VPLYKSWRLNERHYGGLQGL

SEQ ID NO: 2044777 - protein, 20 aa, Staphylococcus
VPMFVCASWSTQGLHNRGTF

SEQ ID NO: 2044778 - protein, 27 aa, Staphylococcus
VPMLEILKKLDLHDVCVVVTRYFGGIK

SEQ ID NO: 2044779 - protein, 26 aa, Staphylococcus
VPMLEILKKLDVHNVCVVVTRYFGGI

SEQ ID NO: 2044780 - protein, 28 aa, Staphylococcus
VPMLEILKKLEIHDACVVVTRYFGGIKL

SEQ ID NO: 2044781 - protein, 17 aa, Staphylococcus
VPMSIATSSSRSNIQPT

SEQ ID NO: 2044782 - protein, 18 aa, Staphylococcus
VPMTIRRDLKELEQKSLL

SEQ ID NO: 2044783 - protein, 18 aa, Staphylococcus
VPNKLALYVPTYRENQMD

SEQ ID NO: 2044784 - protein, 17 aa, Staphylococcus
VPNKLTLTSIDKVFTNI

SEQ ID NO: 2044785 - protein, 21 aa, Staphylococcus
VPNNEKWIYDLLDMDATSPND

SEQ ID NO: 2044786 - protein, 21 aa, Staphylococcus
VPNYRKHWHVIFKLDNDKLLV

SEQ ID NO: 2044787 - protein, 17 aa, Staphylococcus
VPNYRKHWQVIFELDNG

SEQ ID NO: 2044788 - protein, 17 aa, Staphylococcus
VPQLIWHGLPLTEAFLF

SEQ ID NO: 2044789 - protein, 22 aa, Staphylococcus
VPQLLSKRIKIIDLSGDFRLTN

SEQ ID NO: 2044790 - protein, 25 aa, Staphylococcus
VPQLSIRYDLQIGVLPLPRSTNPVH

SEQ ID NO: 2044791 - protein, 23 aa, Staphylococcus
VPQRAISYPIHIVTGSINGLFDG

SEQ ID NO: 2044792 - protein, 24 aa, Staphylococcus
VPQSLPFLKFDHNVILSSDDILNM

SEQ ID NO: 2044793 - protein, 22 aa, Staphylococcus
VPRLEMADAVSLSYIIEAATAH

SEQ ID NO: 2044794 - protein, 24 aa, Staphylococcus
VPSDIRAAGGVARMANPKIVEEVM

SEQ ID NO: 2044795 - protein, 25 aa, Staphylococcus
VPSDLKAHRMVNVLLDEAAAEGLPE

SEQ ID NO: 2044796 - protein, 22 aa, Staphylococcus
VPSDQWLRVRSEYIQQRKNHNG

SEQ ID NO: 2044797 - protein, 17 aa, Staphylococcus
VPSFGLKLSEHEDVYHA

SEQ ID NO: 2044798 - protein, 23 aa, Staphylococcus
VPSICYNESLGPIQTCDTCTVEI

SEQ ID NO: 2044799 - protein, 18 aa, Staphylococcus
VPSIKLAQRLGFNRDKEW

SEQ ID NO: 2044800 - protein, 17 aa, Staphylococcus
VPSKSWLSSAIKAINDD

SEQ ID NO: 2044801 - protein, 23 aa, Staphylococcus
VPSQRIAQRVAIVGSGPAGLTAA

SEQ ID NO: 2044802 - protein, 20 aa, Staphylococcus
VPSSPSFALFKGQNLVHFMP

SEQ ID NO: 2044803 - protein, 18 aa, Staphylococcus
VPSTIVYLPEYIRILKGG

SEQ ID NO: 2044804 - protein, 19 aa, Staphylococcus
VPSTVSGTITEILVSEGET

SEQ ID NO: 2044805 - protein, 18 aa, Staphylococcus
VPSTVSGTITELTVSEGE

SEQ ID NO: 2044806 - protein, 19 aa, Staphylococcus
VPSVLRAHLEFLNEQRNLI

SEQ ID NO: 2044807 - protein, 26 aa, Staphylococcus
VPTDDQWDAMLLGWKVIPSVKSNAVI

SEQ ID NO: 2044808 - protein, 18 aa, Staphylococcus
VPTLKGSVMLTIPAGTQT

SEQ ID NO: 2044809 - protein, 24 aa, Staphylococcus
VPTSCLRFFNIYGPKQNPTSDYSG

SEQ ID NO: 2044810 - protein, 18 aa, Staphylococcus
VPTTGQFGFDIAEDEMEI

SEQ ID NO: 2044811 - protein, 25 aa, Staphylococcus
VPTTHILTGMKKRFADLMDIDENTP

SEQ ID NO: 2044812 - protein, 18 aa, Staphylococcus
VPVDLIFLDEKEMHRQAR

SEQ ID NO: 2044813 - protein, 18 aa, Staphylococcus
VPVDLIFMNGKEMHRQGR

SEQ ID NO: 2044814 - protein, 17 aa, Staphylococcus
VPVEIELLPSGTRFKQG

SEQ ID NO: 2044815 - protein, 17 aa, Staphylococcus
VPVERTKLEIKRPHINV

SEQ ID NO: 2044816 - protein, 17 aa, Staphylococcus
VPVGDELIGRVVNPLGQ

SEQ ID NO: 2044817 - protein, 21 aa, Staphylococcus
VPVGEVWPLDKIKALKQEIED

SEQ ID NO: 2044818 - protein, 21 aa, Staphylococcus
VPVGEVWPLDKIKALKQEVED

SEQ ID NO: 2044819 - protein, 18 aa, Staphylococcus
VPVGNELIGRVVNPLGQP

SEQ ID NO: 2044820 - protein, 19 aa, Staphylococcus
VPVKGVRKAIAQNMVTSAT

SEQ ID NO: 2044821 - protein, 21 aa, Staphylococcus
VPVKTARKILADDFADELIDQ

SEQ ID NO: 2044822 - protein, 20 aa, Staphylococcus
VPVKTARNILADDFADELID

SEQ ID NO: 2044823 - protein, 23 aa, Staphylococcus
VPVSELLAKLSWHERHHLEHIKI

SEQ ID NO: 2044824 - protein, 25 aa, Staphylococcus
VPVYLGMPMGLILEIEGKTIYHTGD

SEQ ID NO: 2044825 - protein, 17 aa, Staphylococcus
VPVYMHKEEFSFLTDPE

SEQ ID NO: 2044826 - protein, 21 aa, Staphylococcus
VPWHSAGRYWGHMNSETLLPS

SEQ ID NO: 2044827 - protein, 18 aa, Staphylococcus
VPYHSAESYIETLINEGY

SEQ ID NO: 2044828 - protein, 24 aa, Staphylococcus
VPYNNPLFLGMGGMHGSYASNMAL

SEQ ID NO: 2044829 - protein, 17 aa, Staphylococcus
VPYPHYIEKLIQRKSYQ

SEQ ID NO: 2044830 - protein, 21 aa, Staphylococcus
VPYYSARIVKNVTIAPSPIWM

SEQ ID NO: 2044831 - protein, 26 aa, Staphylococcus
VQAHKTRPSIKFDIYGEGAEKNNLQK

SEQ ID NO: 2044832 - protein, 20 aa, Staphylococcus
VQAIHELPFDKGLDRVCTNL

SEQ ID NO: 2044833 - protein, 19 aa, Staphylococcus
VQALLGYYYNSLVNGLEEF

SEQ ID NO: 2044834 - protein, 20 aa, Staphylococcus
VQDAIACFITLSETIDETCL

SEQ ID NO: 2044835 - protein, 29 aa, Staphylococcus
VQDAYTLRCIPQIHGASFQVFNYVKEKLE

SEQ ID NO: 2044836 - protein, 24 aa, Staphylococcus
VQDAYTLRCIPQVHGASFETLNFV

SEQ ID NO: 2044837 - protein, 19 aa, Staphylococcus
VQDEIPIWLATGGTPESSI

SEQ ID NO: 2044838 - protein, 19 aa, Staphylococcus
VQDIGIFGGFIGSGKHFGM

SEQ ID NO: 2044839 - protein, 17 aa, Staphylococcus
VQDKFGVYVIFDKKTPI

SEQ ID NO: 2044840 - protein, 19 aa, Staphylococcus
VQDKFGVYVIFDKKTPIFV

SEQ ID NO: 2044841 - protein, 24 aa, Staphylococcus
VQDKGRFGYQHLGFSGSGAMDQFS

SEQ ID NO: 2044842 - protein, 25 aa, Staphylococcus
VQDLKDRYKFIGGISPLAKITDEQA

SEQ ID NO: 2044843 - protein, 24 aa, Staphylococcus
VQDLLIPMTFHFSKDEQIIINQYQ

SEQ ID NO: 2044844 - protein, 18 aa, Staphylococcus
VQDQIALAINEEVLALES

SEQ ID NO: 2044845 - protein, 25 aa, Staphylococcus
VQEAAKLGFKRAIIPQTNIGGWTFP

SEQ ID NO: 2044846 - protein, 19 aa, Staphylococcus
VQEAAKLGFKRVIIPKTNI

SEQ ID NO: 2044847 - protein, 23 aa, Staphylococcus
VQEAAKLGFKRVIIPKTNSGGWD

SEQ ID NO: 2044848 - protein, 19 aa, Staphylococcus
VQEAAKLGFKRVIIPQTNI

SEQ ID NO: 2044849 - protein, 24 aa, Staphylococcus
VQEAAKLGFKRVILPKTNIGGWTF

SEQ ID NO: 2044850 - protein, 22 aa, Staphylococcus
VQEALRAIGVEEFKVAEFEMLP

SEQ ID NO: 2044851 - protein, 23 aa, Staphylococcus
VQEGRRFLFETVVKVNQPKHDIT

SEQ ID NO: 2044852 - protein, 32 aa, Staphylococcus
VQEIKQFVKSYVQSHSFIKSLVLGISGGQDST

SEQ ID NO: 2044853 - protein, 18 aa, Staphylococcus
VQEKYATPIEWLKKYQDN

SEQ ID NO: 2044854 - protein, 22 aa, Staphylococcus
VQELKEQYSIIMVTHNMQQAAR

SEQ ID NO: 2044855 - protein, 18 aa, Staphylococcus
VQESILNALKYASVNHID

SEQ ID NO: 2044856 - protein, 19 aa, Staphylococcus
VQEVGRLLMAEVIDHGQGF

SEQ ID NO: 2044857 - protein, 17 aa, Staphylococcus
VQFDVMLSSYIIDPSRS

SEQ ID NO: 2044858 - protein, 24 aa, Staphylococcus
VQFETFTASGLYPFVEEKDKFVDL

SEQ ID NO: 2044859 - protein, 19 aa, Staphylococcus
VQFLEKRFEVTVPPLKITM

SEQ ID NO: 2044860 - protein, 17 aa, Staphylococcus
VQFPQDHFEDIAPEQIK

SEQ ID NO: 2044861 - protein, 18 aa, Staphylococcus
VQFVGFVGEHSRYDLMLV

SEQ ID NO: 2044862 - protein, 18 aa, Staphylococcus
VQGDELFVTLRIDRDNNM

SEQ ID NO: 2044863 - protein, 18 aa, Staphylococcus
VQGEFKMQIAHAKLAAEA

SEQ ID NO: 2044864 - protein, 17 aa, Staphylococcus
VQGEFKMQIAHAKLANE

SEQ ID NO: 2044865 - protein, 18 aa, Staphylococcus
VQGEFKMQIAHAKLANES

SEQ ID NO: 2044866 - protein, 23 aa, Staphylococcus
VQGLKIHLLHLLKGTPMVKQYEK

SEQ ID NO: 2044867 - protein, 26 aa, Staphylococcus
VQGVWKPVPINGFRYYDGGSYSVENP

SEQ ID NO: 2044868 - protein, 38 aa, Staphylococcus
VQHLEERGYQLSKTEYRGREATDFKEDDIELFRDIADK

SEQ ID NO: 2044869 - protein, 36 aa, Staphylococcus
VQHLEERGYQLSKTEYRGREATDFQEEDIELFQDIA

SEQ ID NO: 2044870 - protein, 20 aa, Staphylococcus
VQHLGFKALYQIATIPEDKR

SEQ ID NO: 2044871 - protein, 35 aa, Staphylococcus
VQHPYSFELNKDFNFSAAHYIPSEDAGKCMRTHGH

SEQ ID NO: 2044872 - protein, 28 aa, Staphylococcus
VQHYFKEAHPFFNLDVTVIGGKNSAVDA

SEQ ID NO: 2044873 - protein, 17 aa, Staphylococcus
VQIHAFIAQVDRAFLSS

SEQ ID NO: 2044874 - protein, 25 aa, Staphylococcus
VQKGHIRIALSPMMNVQLFTDSLNQ

SEQ ID NO: 2044875 - protein, 17 aa, Staphylococcus
VQKKWERPDYVFPGNVV

SEQ ID NO: 2044876 - protein, 26 aa, Staphylococcus
VQLEVLKRGTAILITGGFQPTKEVIQ

SEQ ID NO: 2044877 - protein, 19 aa, Staphylococcus
VQLGYRLLMHHTIVTLTDL

SEQ ID NO: 2044878 - protein, 23 aa, Staphylococcus
VQLKALYLTVIDRIDIRKDGNHK

SEQ ID NO: 2044879 - protein, 19 aa, Staphylococcus
VQLLFGVNCEVKFEEGYPP

SEQ ID NO: 2044880 - protein, 18 aa, Staphylococcus
VQLMPEIERLFKESSISK

SEQ ID NO: 2044881 - protein, 18 aa, Staphylococcus
VQLNIPIFYFYIEDTSFF

SEQ ID NO: 2044882 - protein, 17 aa, Staphylococcus
VQLNNRFVLSPMTTNSS

SEQ ID NO: 2044883 - protein, 23 aa, Staphylococcus
VQLPKYDGFYWCRQIRQVSNVPI

SEQ ID NO: 2044884 - protein, 23 aa, Staphylococcus
VQLQHIIKFSCKPVQQFYGQYDI

SEQ ID NO: 2044885 - protein, 17 aa, Staphylococcus
VQLTGMRMERHVTEQQI

SEQ ID NO: 2044886 - protein, 20 aa, Staphylococcus
VQMAEKYQCVVRLKGGDPAI

SEQ ID NO: 2044887 - protein, 22 aa, Staphylococcus
VQMGAQCLIQAIGGEGHVYIKG

SEQ ID NO: 2044888 - protein, 23 aa, Staphylococcus
VQNEMLLHPVIPMLANSDEIDDP

SEQ ID NO: 2044889 - protein, 19 aa, Staphylococcus
VQNGWPLALTDDAMMHKVV

SEQ ID NO: 2044890 - protein, 23 aa, Staphylococcus
VQNLLIPLTFHFSKDEQMIIDQY

SEQ ID NO: 2044891 - protein, 24 aa, Staphylococcus
VQNLLIPMTFHFSKDEQFIIDQYQ

SEQ ID NO: 2044892 - protein, 24 aa, Staphylococcus
VQNLLIPMTFHFSKDEQMIINQYK

SEQ ID NO: 2044893 - protein, 17 aa, Staphylococcus
VQNLYRILTHTHKLNEL

SEQ ID NO: 2044894 - protein, 18 aa, Staphylococcus
VQPKLTIANRTMSRFDNW

SEQ ID NO: 2044895 - protein, 18 aa, Staphylococcus
VQPQMLFIPFKGEHVDGH

SEQ ID NO: 2044896 - protein, 20 aa, Staphylococcus
VQPSAKFPPSLRNMYQELED

SEQ ID NO: 2044897 - protein, 17 aa, Staphylococcus
VQQAGAVMLVLEAVPSD

SEQ ID NO: 2044898 - protein, 25 aa, Staphylococcus
VQQALDWTLDYDKFVITLCHGPAAL

SEQ ID NO: 2044899 - protein, 18 aa, Staphylococcus
VQQFNHFDKAILLGTSTF

SEQ ID NO: 2044900 - protein, 17 aa, Staphylococcus
VQQFNHFDKSILLGTST

SEQ ID NO: 2044901 - protein, 23 aa, Staphylococcus
VQQGARGYIFFGQPLDIPIVANS

SEQ ID NO: 2044902 - protein, 22 aa, Staphylococcus
VQRLIELDVDFVLVCNNPKRDD

SEQ ID NO: 2044903 - protein, 20 aa, Staphylococcus
VQRPSADQIYAFQKVANGLI

SEQ ID NO: 2044904 - protein, 19 aa, Staphylococcus
VQSCRDCFLDVAQPHHSQF

SEQ ID NO: 2044905 - protein, 17 aa, Staphylococcus
VQSFGRFKGKDVLISGG

SEQ ID NO: 2044906 - protein, 18 aa, Staphylococcus
VQSGEFVAFIGTSGSGKT

SEQ ID NO: 2044907 - protein, 19 aa, Staphylococcus
VQSLLRVLAFYTGRDKSQM

SEQ ID NO: 2044908 - protein, 24 aa, Staphylococcus
VQTFKPELLEILGRTHKTEDIYQA

SEQ ID NO: 2044909 - protein, 23 aa, Staphylococcus
VQTFKPELLEILGRTHKTNDIYS

SEQ ID NO: 2044910 - protein, 23 aa, Staphylococcus
VQTFKPELLEILGRTHNTSDIYQ

SEQ ID NO: 2044911 - protein, 25 aa, Staphylococcus
VQTFKPELLTILGRTHNTQDIYQAV

SEQ ID NO: 2044912 - protein, 28 aa, Staphylococcus
VQTKLKGWVRQLLWMSIYQYVYLDKIPE

SEQ ID NO: 2044913 - protein, 26 aa, Staphylococcus
VQTRIKGWMRHLLWMSIYQYQYLDKV

SEQ ID NO: 2044914 - protein, 19 aa, Staphylococcus
VQTRIQGLVMTNSMINGGS

SEQ ID NO: 2044915 - protein, 19 aa, Staphylococcus
VQVQKKWARPDYVFPGNQV

SEQ ID NO: 2044916 - protein, 20 aa, Staphylococcus
VQVRRYLHQYPELSFEEHHT

SEQ ID NO: 2044917 - protein, 17 aa, Staphylococcus
VQVTIQLITYITRSELP

SEQ ID NO: 2044918 - protein, 24 aa, Staphylococcus
VQVTRPRGTVVIVSIFAHAVDFDP

SEQ ID NO: 2044919 - protein, 17 aa, Staphylococcus
VQVVERLNYKKSLANGD

SEQ ID NO: 2044920 - protein, 17 aa, Staphylococcus
VQYKGRILSVAISGEAA

SEQ ID NO: 2044921 - protein, 21 aa, Staphylococcus
VQYPTEFLLAISDKLKSIGSY

SEQ ID NO: 2044922 - protein, 18 aa, Staphylococcus
VQYQRFIRHIQFLIRRLN

SEQ ID NO: 2044923 - protein, 24 aa, Staphylococcus
VRAFKSVDMPAIFMDHGKGSKIYD

SEQ ID NO: 2044924 - protein, 17 aa, Staphylococcus
VRAGKLFDIPVSGTHAH

SEQ ID NO: 2044925 - protein, 17 aa, Staphylococcus
VRAGKLFGIPVSGTHAH

SEQ ID NO: 2044926 - protein, 18 aa, Staphylococcus
VRAGKLFGIPVSGTHAHA

SEQ ID NO: 2044927 - protein, 18 aa, Staphylococcus
VRAGKLFGLPVSGTHAHA

SEQ ID NO: 2044928 - protein, 19 aa, Staphylococcus
VRAIYECHTPIISAVGHET

SEQ ID NO: 2044929 - protein, 19 aa, Staphylococcus
VRAIYNCQTPIISAVGHET

SEQ ID NO: 2044930 - protein, 23 aa, Staphylococcus
VRAKEGITDGLIRLSIGIEDTDD

SEQ ID NO: 2044931 - protein, 24 aa, Staphylococcus
VRAKEGITDGLIRLSIGIEDTDDL

SEQ ID NO: 2044932 - protein, 19 aa, Staphylococcus
VRAKGIVWFAQHNSVACLL

SEQ ID NO: 2044933 - protein, 21 aa, Staphylococcus
VRAKGIVWLAQYNHVACLMSQ

SEQ ID NO: 2044934 - protein, 21 aa, Staphylococcus
VRAKGIVWLAQYNQVACLLSQ

SEQ ID NO: 2044935 - protein, 18 aa, Staphylococcus
VRALSEFNVQLSIDTFRS

SEQ ID NO: 2044936 - protein, 19 aa, Staphylococcus
VRASHQYKLLIILSPSGAY

SEQ ID NO: 2044937 - protein, 23 aa, Staphylococcus
VRASHSYKLFIILSPSGAYYGGD

SEQ ID NO: 2044938 - protein, 19 aa, Staphylococcus
VRASKKYKLLIILSPSGAY

SEQ ID NO: 2044939 - protein, 19 aa, Staphylococcus
VRATKKWPTDRSFNQQLSE

SEQ ID NO: 2044940 - protein, 19 aa, Staphylococcus
VRDADRLDAIGAIGIARAF

SEQ ID NO: 2044941 - protein, 25 aa, Staphylococcus
VRDADRLDAIGAIGIARTFQFAGHF

SEQ ID NO: 2044942 - protein, 25 aa, Staphylococcus
VRDADRLDAIGAIGIARTFQFAGYF

SEQ ID NO: 2044943 - protein, 26 aa, Staphylococcus
VRDADRLDALGAIGIARTFQFAGYFG

SEQ ID NO: 2044944 - protein, 23 aa, Staphylococcus
VRDGHIKAWVNIMYGCDKFCTYC

SEQ ID NO: 2044945 - protein, 19 aa, Staphylococcus
VRDGLKPVQRRILFAMHSS

SEQ ID NO: 2044946 - protein, 19 aa, Staphylococcus
VRDLFNVEMGMALLHDENE

SEQ ID NO: 2044947 - protein, 19 aa, Staphylococcus
VRDNFRDMINKVNDDSDTI

SEQ ID NO: 2044948 - protein, 19 aa, Staphylococcus
VRDSFKFYHVRHEEVASLA

SEQ ID NO: 2044949 - protein, 18 aa, Staphylococcus
VRDTFKFYHVRHEEVASL

SEQ ID NO: 2044950 - protein, 23 aa, Staphylococcus
VRDYMKKEMTPFVDEVITTHLGS

SEQ ID NO: 2044951 - protein, 17 aa, Staphylococcus
VREGSIPLVNRITTETA

SEQ ID NO: 2044952 - protein, 18 aa, Staphylococcus
VRENELNYIAIRDMLTNI

SEQ ID NO: 2044953 - protein, 26 aa, Staphylococcus
VREQLKDVPVCIEFRNQTWFEGDMKE

SEQ ID NO: 2044954 - protein, 32 aa, Staphylococcus; identical to SEQ ID NO: 1814404

SEQ ID NO: 2044955 - protein, 22 aa, Staphylococcus
VREVMTLPSIKVVEHPDLFVET

SEQ ID NO: 2044956 - protein, 25 aa, Staphylococcus
VRFGDADLSPGTRIHFIEVPNYTAE

SEQ ID NO: 2044957 - protein, 17 aa, Staphylococcus
VRFGYKITDGGFQELKT

SEQ ID NO: 2044958 - protein, 22 aa, Staphylococcus
VRFKLTGKINMEYSDASSTLLL

SEQ ID NO: 2044959 - protein, 24 aa, Staphylococcus
VRFLSRDEFDLFLELYRETEERTG

SEQ ID NO: 2044960 - protein, 18 aa, Staphylococcus
VRFPWESKRRISIYPFVW

SEQ ID NO: 2044961 - protein, 17 aa, Staphylococcus
VRFSKKITGKGFQELKI

SEQ ID NO: 2044962 - protein, 17 aa, Staphylococcus
VRGRGLFIGIELNEAAR

SEQ ID NO: 2044963 - protein, 19 aa, Staphylococcus
VRGRIKAVYNDGSLSPLDK

SEQ ID NO: 2044964 - protein, 19 aa, Staphylococcus
VRGRVLGVNQQTRYSQQEI

SEQ ID NO: 2044965 - protein, 24 aa, Staphylococcus
VRGVPLRLVDTAGIRDTEDIVERI

SEQ ID NO: 2044966 - protein, 24 aa, Staphylococcus
VRGVPLRLVDTAGIRETEDIVEKI

SEQ ID NO: 2044967 - protein, 20 aa, Staphylococcus
VRGYYPSYMDRYFKENHIDI

SEQ ID NO: 2044968 - protein, 17 aa, Staphylococcus
VRHDIHYYNFIKRNAQN

SEQ ID NO: 2044969 - protein, 18 aa, Staphylococcus
VRHDMHYYNYIKRNAHHI

SEQ ID NO: 2044970 - protein, 21 aa, Staphylococcus
VRHHLKPGGTIIYSTCTIEQL

SEQ ID NO: 2044971 - protein, 26 aa, Staphylococcus
VRHYRKLIESLAYKYSKGQSHHEDLV

SEQ ID NO: 2044972 - protein, 21 aa, Staphylococcus
VRIAKVYAELGVKKLRITGGE

SEQ ID NO: 2044973 - protein, 22 aa, Staphylococcus
VRIAPSPIWMQARLIKAGIRPI

SEQ ID NO: 2044974 - protein, 27 aa, Staphylococcus
VRIASPEFMFPSFYGIDVSTTAELISA

SEQ ID NO: 2044975 - protein, 19 aa, Staphylococcus
VRIFYKYLNQLDVKYVAVI

SEQ ID NO: 2044976 - protein, 17 aa, Staphylococcus
VRIILRVPPLAASLKEM

SEQ ID NO: 2044977 - protein, 28 aa, Staphylococcus
VRILNYGSGHAWGIIGLEIESAELGTII

SEQ ID NO: 2044978 - protein, 19 aa, Staphylococcus
VRIPEELLQFEGQTKSKLG

SEQ ID NO: 2044979 - protein, 18 aa, Staphylococcus
VRIQKHFDALFDSVHSKL

SEQ ID NO: 2044980 - protein, 23 aa, Staphylococcus
VRITCVEAAPKMLPMFSDELVNY

SEQ ID NO: 2044981 - protein, 24 aa, Staphylococcus
VRKDGAFHEVEWEEALQVMADNFN

SEQ ID NO: 2044982 - protein, 18 aa, Staphylococcus
VRKDGEFHEVEWDEALDV

SEQ ID NO: 2044983 - protein, 22 aa, Staphylococcus
VRKDLSNAGAHVVDESVVVDNN

SEQ ID NO: 2044984 - protein, 23 aa, Staphylococcus
VRKEIKRQIRFCEDEIIKCNKTI

SEQ ID NO: 2044985 - protein, 26 aa, Staphylococcus
VRKHFDLRPAGIIKMLDLKHPIYKQT

SEQ ID NO: 2044986 - protein, 24 aa, Staphylococcus
VRKKCGAYSKGNRQKVALVTALSM

SEQ ID NO: 2044987 - protein, 21 aa, Staphylococcus
VRKLAEMLYMTRGAISKLTKR

SEQ ID NO: 2044988 - protein, 18 aa, Staphylococcus
VRKLCLYLDVSADIYFLN

SEQ ID NO: 2044989 - protein, 23 aa, Staphylococcus
VRKLRLKNVTAFQHDDTKPYEKM

SEQ ID NO: 2044990 - protein, 20 aa, Staphylococcus
VRKMTIKYIPSLREQQNKEV

SEQ ID NO: 2044991 - protein, 18 aa, Staphylococcus
VRKNGEFHEVEWDEALKV

SEQ ID NO: 2044992 - protein, 17 aa, Staphylococcus
VRKNGEFHEVEWEEALD

SEQ ID NO: 2044993 - protein, 24 aa, Staphylococcus
VRKNGQFEEVEWEEALSVVAENFN

SEQ ID NO: 2044994 - protein, 19 aa, Staphylococcus
VRKQERFADFDFKEVRKHW

SEQ ID NO: 2044995 - protein, 21 aa, Staphylococcus
VRKVALGLAKFIKANSNEATI

SEQ ID NO: 2044996 - protein, 17 aa, Staphylococcus
VRLANVISLSQSNHKGE

SEQ ID NO: 2044997 - protein, 28 aa, Staphylococcus
VRLDGATKEFFAWGFRVGFMTFGTKNEI

SEQ ID NO: 2044998 - protein, 29 aa, Staphylococcus
VRLDGATKEFFAWGLRVGFMTFGIHNDTA

SEQ ID NO: 2044999 - protein, 17 aa, Staphylococcus
VRLEVRRAEQLKQGQEI

SEQ ID NO: 2045000 - protein, 18 aa, Staphylococcus
VRLIQDYLRRLNYEVHLY

SEQ ID NO: 2045001 - protein, 17 aa, Staphylococcus
VRLKAYFNELTFNDELR

SEQ ID NO: 2045002 - protein, 23 aa, Staphylococcus
VRLKGSELKKVILKSQKQEYMYE

SEQ ID NO: 2045003 - protein, 25 aa, Staphylococcus
VRLLTRDEFDIFLELYRETEERTGF

SEQ ID NO: 2045004 - protein, 18 aa, Staphylococcus
VRLPLWQNAEACKEAIHE

SEQ ID NO: 2045005 - protein, 17 aa, Staphylococcus
VRLRQMFQDNVSDIMKV

SEQ ID NO: 2045006 - protein, 17 aa, Staphylococcus
VRLVKDQKKALVQDEAQ

SEQ ID NO: 2045007 - protein, 17 aa, Staphylococcus
VRLVKDQKKGLVKDEAV

SEQ ID NO: 2045008 - protein, 25 aa, Staphylococcus
VRMTQLCTFLKAYFNNDASTEEEIS

SEQ ID NO: 2045009 - protein, 32 aa, Staphylococcus
VRNAIKDSLKRLIMPSIEREIRGDLTEKAENH

SEQ ID NO: 2045010 - protein, 19 aa, Staphylococcus
VRNDIHYYNFLKRNAQNIQ

SEQ ID NO: 2045011 - protein, 30 aa, Staphylococcus
VRNEIFDMMNWWFEKGIDGFRVDAITHIKK

SEQ ID NO: 2045012 - protein, 24 aa, Staphylococcus
VRNERGITFGLFRLSVGLEQPEEL

SEQ ID NO: 2045013 - protein, 20 aa, Staphylococcus
VRNGNWSLKQLIDYLTIKPA

SEQ ID NO: 2045014 - protein, 18 aa, Staphylococcus
VRNKSCGLLLAYEKTGYD

SEQ ID NO: 2045015 - protein, 18 aa, Staphylococcus
VRNMFGYTGTYKGKEVSV

SEQ ID NO: 2045016 - protein, 24 aa, Staphylococcus
VRNQRGITFGLFRLSVGLEQPDEL

SEQ ID NO: 2045017 - protein, 21 aa, Staphylococcus
VRPDLPASKIANFIRRDILEQ

SEQ ID NO: 2045018 - protein, 21 aa, Staphylococcus
VRPDLPASQIANYIRRDIYEK

SEQ ID NO: 2045019 - protein, 22 aa, Staphylococcus
VRPGFEGGQLPLFRRLPKRGFT

SEQ ID NO: 2045020 - protein, 28 aa, Staphylococcus
VRPLLTKEIEGFGELFRYLSYTEDVGTR

SEQ ID NO: 2045021 - protein, 17 aa, Staphylococcus
VRPNGKVIQLWHGTPIK

SEQ ID NO: 2045022 - protein, 22 aa, Staphylococcus
VRPRSGKSLKTKLRVAFGTIDK

SEQ ID NO: 2045023 - protein, 19 aa, Staphylococcus
VRQGLEFLISTVEGLDIQA

SEQ ID NO: 2045024 - protein, 19 aa, Staphylococcus
VRQGLEFLLSTVDDLEVVK

SEQ ID NO: 2045025 - protein, 19 aa, Staphylococcus
VRQGLEFLLSTVEDIEVVQ

SEQ ID NO: 2045026 - protein, 23 aa, Staphylococcus
VRQHIMKVLSRYDVPSKLIKVDR

SEQ ID NO: 2045027 - protein, 24 aa, Staphylococcus
VRQHPGEVCPAKWEEGGETLEPGL

SEQ ID NO: 2045028 - protein, 21 aa, Staphylococcus
VRQKIGMVFQFPEAQLFEDNV

SEQ ID NO: 2045029 - protein, 17 aa, Staphylococcus
VRQTFKVSKVGTIAGCY

SEQ ID NO: 2045030 - protein, 17 aa, Staphylococcus
VRQTFKVSKVGTIAGSY

SEQ ID NO: 2045031 - protein, 27 aa, Staphylococcus
VRQYDFRWQPSILSRSIRDLTVAVIGT

SEQ ID NO: 2045032 - protein, 18 aa, Staphylococcus
VRRGNWSLQQLVDYFTIK

SEQ ID NO: 2045033 - protein, 19 aa, Staphylococcus
VRRLYDDKVLAGFAGSVAD

SEQ ID NO: 2045034 - protein, 19 aa, Staphylococcus
VRRLYNDKVLAGFAGSVAD

SEQ ID NO: 2045035 - protein, 24 aa, Staphylococcus
VRRNPYSVILFDEIEKANPQILTL

SEQ ID NO: 2045036 - protein, 23 aa, Staphylococcus
VRRNPYSVILLDEIEKAHSDVFN

SEQ ID NO: 2045037 - protein, 28 aa, Staphylococcus
VRRVLYDIINHWIDFGIDGFRFDVINLI

SEQ ID NO: 2045038 - protein, 17 aa, Staphylococcus
VRSGKLFGIPVSGTHAH

SEQ ID NO: 2045039 - protein, 22 aa, Staphylococcus
VRSNCGLGFKSFWEENEGFHYD

SEQ ID NO: 2045040 - protein, 18 aa, Staphylococcus
VRSYLPFESLILDINQAF

SEQ ID NO: 2045041 - protein, 17 aa, Staphylococcus
VRTAIYNGIEVYGVYQG

SEQ ID NO: 2045042 - protein, 24 aa, Staphylococcus
VRTASYFNGIGFNFKHSGNLFNAL

SEQ ID NO: 2045043 - protein, 17 aa, Staphylococcus
VRTFAVKVQQQLAAEKG

SEQ ID NO: 2045044 - protein, 19 aa, Staphylococcus
VRTGFSMILNFQDDMEVVD

SEQ ID NO: 2045045 - protein, 20 aa, Staphylococcus
VRTILKRNVRNIPVVDDDNI

SEQ ID NO: 2045046 - protein, 19 aa, Staphylococcus
VRTILKRNVRNVPVVDDDN

SEQ ID NO: 2045047 - protein, 20 aa, Staphylococcus
VRTILKRNVRNVPVVDDHHT

SEQ ID NO: 2045048 - protein, 20 aa, Staphylococcus
VRTILKRNVRNVPVVDNDNA

SEQ ID NO: 2045049 - protein, 19 aa, Staphylococcus
VRTILKRNVRNVPVVDSDE

SEQ ID NO: 2045050 - protein, 20 aa, Staphylococcus
VRTILKRNVRNVPVVGDDNE

SEQ ID NO: 2045051 - protein, 19 aa, Staphylococcus
VRTILKRNVRNVPVVNNQD

SEQ ID NO: 2045052 - protein, 17 aa, Staphylococcus
VRTLVGIITNRDLRFIE

SEQ ID NO: 2045053 - protein, 18 aa, Staphylococcus
VRTNSVVVMPDFTLSPEA

SEQ ID NO: 2045054 - protein, 18 aa, Staphylococcus
VRVEDVNLIMGFVRVFGK

SEQ ID NO: 2045055 - protein, 24 aa, Staphylococcus
VRVEIRLDAVYIFEKIIQGSGGLP

SEQ ID NO: 2045056 - protein, 19 aa, Staphylococcus
VRVEVRMDGVYVFTQIYEG

SEQ ID NO: 2045057 - protein, 24 aa, Staphylococcus
VRVKVSWTGICGTDLHEYLEGPVF

SEQ ID NO: 2045058 - protein, 20 aa, Staphylococcus
VRVPLPNGAEIKVKITNIQS

SEQ ID NO: 2045059 - protein, 19 aa, Staphylococcus
VRVQDKWKREDYTFPGSQV

SEQ ID NO: 2045060 - protein, 18 aa, Staphylococcus
VRVYERFSTLDAVSNGRS

SEQ ID NO: 2045061 - protein, 19 aa, Staphylococcus
VRYGFKRIFTNLLSVKQEE

SEQ ID NO: 2045062 - protein, 18 aa, Staphylococcus
VRYKCSKGLLGSKLFVYY

SEQ ID NO: 2045063 - protein, 19 aa, Staphylococcus
VRYLEADAGVMITASHNPK

SEQ ID NO: 2045064 - protein, 26 aa, Staphylococcus
VRYRDHYDQFGICFAQTTYDLRGVAI

SEQ ID NO: 2045065 - protein, 26 aa, Staphylococcus
VRYYFSEAFPKHFKNYYAIGQQTANS

SEQ ID NO: 2045066 - protein, 17 aa, Staphylococcus
VSAAMLLQFNHHSIKAT

SEQ ID NO: 2045067 - protein, 27 aa, Staphylococcus
VSAASSCYIISLAATLERAGYKDISIT

SEQ ID NO: 2045068 - protein, 26 aa, Staphylococcus
VSAASSCYIISLAATLERAKFTDINL

SEQ ID NO: 2045069 - protein, 19 aa, Staphylococcus
VSAELRKAGAKHFDIMTAD

SEQ ID NO: 2045070 - protein, 27 aa, Staphylococcus
VSAEMDIQFPFAFELSKILGDSITKYT

SEQ ID NO: 2045071 - protein, 24 aa, Staphylococcus
VSAKTGEGGKLFGSISTKQIAEAL

SEQ ID NO: 2045072 - protein, 24 aa, Staphylococcus
VSAKTGEGGKLFGSVSTKQIAEAL

SEQ ID NO: 2045073 - protein, 18 aa, Staphylococcus
VSALEFYKDNIIGKTVVC

SEQ ID NO: 2045074 - protein, 27 aa, Staphylococcus
VSALKIMKWLHDLHFHIPYDVQVIGYD

SEQ ID NO: 2045075 - protein, 20 aa, Staphylococcus
VSALKKYPALNSEFDEENGE

SEQ ID NO: 2045076 - protein, 18 aa, Staphylococcus
VSALRLDVVLKDMIHKSR

SEQ ID NO: 2045077 - protein, 23 aa, Staphylococcus
VSALRLDVVLKEMIRKSRSIAKQ

SEQ ID NO: 2045078 - protein, 24 aa, Staphylococcus
VSALRLDVVLKEMIRKSRSIAKQL

SEQ ID NO: 2045079 - protein, 22 aa, Staphylococcus
VSALSRPLIAKKLVEIAEKTNS

SEQ ID NO: 2045080 - protein, 22 aa, Staphylococcus
VSALSRPLIAKKLVEIAEQTKS

SEQ ID NO: 2045081 - protein, 22 aa, Staphylococcus
VSALSRPLIAKKLVEIAEQTNS

SEQ ID NO: 2045082 - protein, 22 aa, Staphylococcus
VSALSRPLIAKKLVEIAEQTQS

SEQ ID NO: 2045083 - protein, 23 aa, Staphylococcus
VSALSRPLISKKLVEIAEKTDAV

SEQ ID NO: 2045084 - protein, 23 aa, Staphylococcus
VSALSRPLISKKLVEIAEKTNSV

SEQ ID NO: 2045085 - protein, 23 aa, Staphylococcus
VSALSRPLISKKLVEIASKTNSV

SEQ ID NO: 2045086 - protein, 25 aa, Staphylococcus
VSANEKYDLFVLVVTDIINSDSKIL

SEQ ID NO: 2045087 - protein, 29 aa, Staphylococcus
VSAQMRIAQRWRDIPMLIIDNHIEDESLP

SEQ ID NO: 2045088 - protein, 17 aa, Staphylococcus
VSASCKIINRFSNKSLQ

SEQ ID NO: 2045089 - protein, 22 aa, Staphylococcus
VSASDWKIGDKVTHKSWGEGMV

SEQ ID NO: 2045090 - protein, 22 aa, Staphylococcus
VSASDWKVGDKVTHKSWGEGMV

SEQ ID NO: 2045091 - protein, 19 aa, Staphylococcus
VSASRAYLRPAMKRQNLHV

SEQ ID NO: 2045092 - protein, 17 aa, Staphylococcus
VSAYRKAAQSLEIDERP

SEQ ID NO: 2045093 - protein, 17 aa, Staphylococcus
VSAYRKAAQSLEIDERS

SEQ ID NO: 2045094 - protein, 17 aa, Staphylococcus
VSAYRKAAQSLEMDERP

SEQ ID NO: 2045095 - protein, 17 aa, Staphylococcus
VSAYRKAAQSLEMDERT

SEQ ID NO: 2045096 - protein, 20 aa, Staphylococcus
VSDEELEFITGMKDETKAIQ

SEQ ID NO: 2045097 - protein, 22 aa, Staphylococcus
VSDIKVSGDFTIENDPEESVVT

SEQ ID NO: 2045098 - protein, 22 aa, Staphylococcus
VSDIKVSGDFTIENEPEDSIVT

SEQ ID NO: 2045099 - protein, 21 aa, Staphylococcus
VSDLKVAVIGTGRIGSIVAQI

SEQ ID NO: 2045100 - protein, 24 aa, Staphylococcus
VSDMKGGMAALFYVLERLHQEGRL

SEQ ID NO: 2045101 - protein, 23 aa, Staphylococcus
VSDMKGGMASLFYVLEKLHQEGR

SEQ ID NO: 2045102 - protein, 24 aa, Staphylococcus
VSDMKGGMASLFYVLEKLHQEGRR

SEQ ID NO: 2045103 - protein, 24 aa, Staphylococcus
VSDMKGGMSSLFYVLERLHQEGHR

SEQ ID NO: 2045104 - protein, 25 aa, Staphylococcus
VSDRISRLFDITGLKDLMHVNEGTE

SEQ ID NO: 2045105 - protein, 19 aa, Staphylococcus
VSDRPNIELLMPMSEAHAV

SEQ ID NO: 2045106 - protein, 17 aa, Staphylococcus
VSDSLPFNVNDNKRKYT

SEQ ID NO: 2045107 - protein, 24 aa, Staphylococcus
VSDYVAAFVYMYFRHSEIKVTKQQ

SEQ ID NO: 2045108 - protein, 18 aa, Staphylococcus
VSEAAVLNANYIKASLKD

SEQ ID NO: 2045109 - protein, 17 aa, Staphylococcus
VSEDGGRVLFVGTKKQA

SEQ ID NO: 2045110 - protein, 25 aa, Staphylococcus
VSEDQARHILAHFMFYGKDVFKKVN

SEQ ID NO: 2045111 - protein, 21 aa, Staphylococcus
VSEETRLGVLDIIKNPKEEMK

SEQ ID NO: 2045112 - protein, 18 aa, Staphylococcus
VSEFKPDALMHMAALLSA

SEQ ID NO: 2045113 - protein, 19 aa, Staphylococcus
VSEGRLIIHQSPIKHISDH

SEQ ID NO: 2045114 - protein, 24 aa, Staphylococcus
VSEINWLQVMSKFKKVIEFKEQVE

SEQ ID NO: 2045115 - protein, 30 aa, Staphylococcus
VSESEWKSRLDAMSGKIDWKEDIPEDDYAK

SEQ ID NO: 2045116 - protein, 25 aa, Staphylococcus
VSETFGIEGMKDYAFQIENVLTSRK

SEQ ID NO: 2045117 - protein, 32 aa, Staphylococcus
VSETLRVASLLAHTLFDFPSHQLTTYGVTGTN

SEQ ID NO: 2045118 - protein, 25 aa, Staphylococcus
VSEVKRLKADPAFYGEFLDHSHQCV

SEQ ID NO: 2045119 - protein, 25 aa, Staphylococcus
VSEVKRLKSDPAFYGDFIEQSHLCV

SEQ ID NO: 2045120 - protein, 25 aa, Staphylococcus
VSEVKRLKSDPIFYGEFLDQSNTCV

SEQ ID NO: 2045121 - protein, 25 aa, Staphylococcus
VSEVKRLKSDPSFYGEFLDRSHDCV

SEQ ID NO: 2045122 - protein, 25 aa, Staphylococcus
VSEVKRLKSDPSFYGRFLDQSHTCV

SEQ ID NO: 2045123 - protein, 29 aa, Staphylococcus
VSEVKRLKSDPTFYGKFLERSHLCVEKLI

SEQ ID NO: 2045124 - protein, 17 aa, Staphylococcus
VSFDFEILKEMLRHHFI

SEQ ID NO: 2045125 - protein, 17 aa, Staphylococcus
VSFEKAGSIFGVKEARA

SEQ ID NO: 2045126 - protein, 23 aa, Staphylococcus
VSFKLLATELVWFIKGDTNIKYL

SEQ ID NO: 2045127 - protein, 27 aa, Staphylococcus
VSFPGVKGEVLVNAFSKHGVMISTTSA

SEQ ID NO: 2045128 - protein, 21 aa, Staphylococcus
VSFSGQMHGLVLLDETGRPLR

SEQ ID NO: 2045129 - protein, 17 aa, Staphylococcus
VSFSLPICGEIVGIVGP

SEQ ID NO: 2045130 - protein, 24 aa, Staphylococcus
VSGAGLSFIRHWVEDPNRIAKDEL

SEQ ID NO: 2045131 - protein, 23 aa, Staphylococcus
VSGCPFNCKGCYNHAAQNFTYGH

SEQ ID NO: 2045132 - protein, 22 aa, Staphylococcus
VSGEPVLTLAGFKYNLEKEKLV

SEQ ID NO: 2045133 - protein, 18 aa, Staphylococcus
VSGIFLVCQDPEIVEQHD

SEQ ID NO: 2045134 - protein, 21 aa, Staphylococcus
VSGILEMKGGFVDNISSSFGS

SEQ ID NO: 2045135 - protein, 26 aa, Staphylococcus
VSGKGRSGFVANSFAMRLNQLGKGAH

SEQ ID NO: 2045136 - protein, 17 aa, Staphylococcus
VSGKWFFDRYSPVTHIK

SEQ ID NO: 2045137 - protein, 17 aa, Staphylococcus
VSHFGGFSEYARVNSDW

SEQ ID NO: 2045138 - protein, 27 aa, Staphylococcus
VSHGGILFMFALKWLPIEEVKKINFGN

SEQ ID NO: 2045139 - protein, 18 aa, Staphylococcus
VSHLGMSGGFFVVDTLDD

SEQ ID NO: 2045140 - protein, 25 aa, Staphylococcus
VSHPYAFELNKDFHFAAAHYIPCED

SEQ ID NO: 2045141 - protein, 19 aa, Staphylococcus
VSIAHGFHEIPTAFKNLFT

SEQ ID NO: 2045142 - protein, 18 aa, Staphylococcus
VSIDFKTNKLLSGPDIIS

SEQ ID NO: 2045143 - protein, 18 aa, Staphylococcus
VSIEEFVVLFKVYEGKKI

SEQ ID NO: 2045144 - protein, 20 aa, Staphylococcus
VSIELTDKGEKVFQYHQALD

SEQ ID NO: 2045145 - protein, 18 aa, Staphylococcus
VSIPKERGFLPGNGAITS

SEQ ID NO: 2045146 - protein, 22 aa, Staphylococcus
VSIPKHQLTVFTGRSGSGKSSL

SEQ ID NO: 2045147 - protein, 19 aa, Staphylococcus
VSIRFSVNQNVHFEVLLVK

SEQ ID NO: 2045148 - protein, 24 aa, Staphylococcus
VSIRFSVNQNVHFEVLLVKIAEMV

SEQ ID NO: 2045149 - protein, 21 aa, Staphylococcus
VSIRFSVNQNVHFEVLLVKLA

SEQ ID NO: 2045150 - protein, 24 aa, Staphylococcus
VSIRFSVNQNVHFEVLLVKLAEMV

SEQ ID NO: 2045151 - protein, 25 aa, Staphylococcus
VSIRFSVNQSVHFEVLLVKIAEMIK

SEQ ID NO: 2045152 - protein, 25 aa, Staphylococcus
VSIRFSVNQSVHFEVLLVKLAEMIK

SEQ ID NO: 2045153 - protein, 27 aa, Staphylococcus
VSISRFKRKFGINIEEVFGQTITDLIS

SEQ ID NO: 2045154 - protein, 21 aa, Staphylococcus
VSKDSNMRCYVLTDKETGVQY

SEQ ID NO: 2045155 - protein, 25 aa, Staphylococcus
VSKFAIGAMEIRDLIKYISKQTLLI

SEQ ID NO: 2045156 - protein, 18 aa, Staphylococcus
VSKGLHYQALQVLKTYVK

SEQ ID NO: 2045157 - protein, 17 aa, Staphylococcus
VSKIKAAIPNIALTTDI

SEQ ID NO: 2045158 - protein, 25 aa, Staphylococcus
VSKIKPGQWIGIFGIGGLGNLALQY

SEQ ID NO: 2045159 - protein, 21 aa, Staphylococcus
VSKIYFTSHMDTVVPGINIKP

SEQ ID NO: 2045160 - protein, 21 aa, Staphylococcus
VSKIYFTSHMDTVVPGINVKP

SEQ ID NO: 2045161 - protein, 19 aa, Staphylococcus
VSKKLKNARGIDALIGATD

SEQ ID NO: 2045162 - protein, 28 aa, Staphylococcus
VSKLRREGLRIKFSQLIEKPTFSQWMLL

SEQ ID NO: 2045163 - protein, 30 aa, Staphylococcus
VSKSCLTTGFCLWCQLAFSTYLENADQAHL

SEQ ID NO: 2045164 - protein, 23 aa, Staphylococcus
VSKSFDGEEIFNDVHFEVKSHEK

SEQ ID NO: 2045165 - protein, 29 aa, Staphylococcus
VSKSPAQVIIRWNIQHGVVVIPKSITPSR

SEQ ID NO: 2045166 - protein, 22 aa, Staphylococcus
VSKVGTIAGCYVTDGKITRNAG

SEQ ID NO: 2045167 - protein, 17 aa, Staphylococcus
VSLDNLFEQMKQGEMKD

SEQ ID NO: 2045168 - protein, 17 aa, Staphylococcus
VSLFLLIHMDNVELVGV

SEQ ID NO: 2045169 - protein, 19 aa, Staphylococcus
VSLGIPIITGYGLTEAPLV

SEQ ID NO: 2045170 - protein, 27 aa, Staphylococcus
VSLIRLTLSGVFSRAGASYDDIEDAKI

SEQ ID NO: 2045171 - protein, 25 aa, Staphylococcus
VSLIRLTLSGVFTRAGASYDDIEDS

SEQ ID NO: 2045172 - protein, 27 aa, Staphylococcus
VSLIRLTLSGVFTRAGASYDDIEDSKI

SEQ ID NO: 2045173 - protein, 24 aa, Staphylococcus
VSLKADGQRDFSFYRKPSADMLYE

SEQ ID NO: 2045174 - protein, 17 aa, Staphylococcus
VSLKPCTIVADYTVKNQ

SEQ ID NO: 2045175 - protein, 23 aa, Staphylococcus
VSLPKKERLLSLAYSLDPENKEN

SEQ ID NO: 2045176 - protein, 17 aa, Staphylococcus
VSLRNRFVLAPLTHTSS

SEQ ID NO: 2045177 - protein, 17 aa, Staphylococcus
VSLTTLFAPLLEPEIIF

SEQ ID NO: 2045178 - protein, 24 aa, Staphylococcus
VSLVKAIHVDYVFHPSVEEMYPDE

SEQ ID NO: 2045179 - protein, 18 aa, Staphylococcus
VSLYNVFIEKDCSIVEIN

SEQ ID NO: 2045180 - protein, 36 aa, Staphylococcus
VSMPIVLPRLRISYLYPRTEKLLSQYQLKQHSIIEQ

SEQ ID NO: 2045181 - protein, 17 aa, Staphylococcus
VSMYSYLTIPRGDTGYF

SEQ ID NO: 2045182 - protein, 18 aa, Staphylococcus
VSNARLPLYLNKKPNQVY

SEQ ID NO: 2045183 - protein, 20 aa, Staphylococcus
VSNGRAEIMIGRASFIESFP

SEQ ID NO: 2045184 - protein, 21 aa, Staphylococcus
VSNIADLHFAPTIGAKHNLIQ

SEQ ID NO: 2045185 - protein, 26 aa, Staphylococcus
VSNLNGWKVGIPEYKGQDSMGTGTVI

SEQ ID NO: 2045186 - protein, 17 aa, Staphylococcus
VSNLRLVVDLSNEPDLF

SEQ ID NO: 2045187 - protein, 17 aa, Staphylococcus
VSNRDYVLWLNQNKETI

SEQ ID NO: 2045188 - protein, 17 aa, Staphylococcus
VSNRGHDSIAIYKVLEN

SEQ ID NO: 2045189 - protein, 23 aa, Staphylococcus
VSNSINFFSLFTFKENTEEIVTH

SEQ ID NO: 2045190 - protein, 22 aa, Staphylococcus
VSNYLPSYRFAQIYYEDDDIAI

SEQ ID NO: 2045191 - protein, 24 aa, Staphylococcus
VSPAERDLGMVFQDFALWPHMTVF

SEQ ID NO: 2045192 - protein, 23 aa, Staphylococcus
VSPEDFYKVMSLITEEILNSPLE

SEQ ID NO: 2045193 - protein, 21 aa, Staphylococcus
VSPFDMLSVISALEIILTDYR

SEQ ID NO: 2045194 - protein, 17 aa, Staphylococcus
VSPFIIDAHSSLLGIGS

SEQ ID NO: 2045195 - protein, 26 aa, Staphylococcus
VSPFTPDFSGFIFKIQANMDPKHRDR

SEQ ID NO: 2045196 - protein, 18 aa, Staphylococcus
VSPGKPWKNGPVPEDKAI

SEQ ID NO: 2045197 - protein, 24 aa, Staphylococcus
VSPGLRVGWIVAKPSVAAHLADLK

SEQ ID NO: 2045198 - protein, 24 aa, Staphylococcus
VSPLIHRAKIGGVLNVTELNVIKR

SEQ ID NO: 2045199 - protein, 24 aa, Staphylococcus
VSPLLHRAKIGSVLNVTELNQLKR

SEQ ID NO: 2045200 - protein, 17 aa, Staphylococcus
VSPLLKRMEQVDLIKRE

SEQ ID NO: 2045201 - protein, 20 aa, Staphylococcus
VSPRPIPGVKGGIHHITGVE

SEQ ID NO: 2045202 - protein, 20 aa, Staphylococcus
VSPRPIPGVKGGIHHVTGVE

SEQ ID NO: 2045203 - protein, 28 aa, Staphylococcus
VSPSIKHGPHWCRSRIVNPLTLEPVPNG

SEQ ID NO: 2045204 - protein, 18 aa, Staphylococcus
VSPVGRNGIKATFKGKEN

SEQ ID NO: 2045205 - protein, 18 aa, Staphylococcus
VSPYKLTFSFKMPQFSEL

SEQ ID NO: 2045206 - protein, 21 aa, Staphylococcus
VSQAVATIGHFDLLTINDAGM

SEQ ID NO: 2045207 - protein, 24 aa, Staphylococcus
VSQDIPYLIAGGININAIQQIEKL

SEQ ID NO: 2045208 - protein, 25 aa, Staphylococcus
VSQELDKLMLFLGDRPTINKDDVNQ

SEQ ID NO: 2045209 - protein, 24 aa, Staphylococcus
VSQELEKIILFLGERPTINKKDVE

SEQ ID NO: 2045210 - protein, 28 aa, Staphylococcus
VSQPRRPCWKPGRRVRWIEWGRRIQETG

SEQ ID NO: 2045211 - protein, 24 aa, Staphylococcus
VSQSLKGALFTSLLLEKLNMKTTP

SEQ ID NO: 2045212 - protein, 24 aa, Staphylococcus
VSQSLKGALFTSLLLEKLNMTTTP

SEQ ID NO: 2045213 - protein, 24 aa, Staphylococcus
VSQSLKGALFTSLLLEKMDMRTSP

SEQ ID NO: 2045214 - protein, 24 aa, Staphylococcus
VSQSLKGALFTSLLLEKMNMNTVP

SEQ ID NO: 2045215 - protein, 18 aa, Staphylococcus
VSRHKRIIENKVWEKIKE

SEQ ID NO: 2045216 - protein, 22 aa, Staphylococcus
VSRILADSGNTEWTDMPKNAKI

SEQ ID NO: 2045217 - protein, 19 aa, Staphylococcus
VSRIRLTLLEPKEGSNENK

SEQ ID NO: 2045218 - protein, 21 aa, Staphylococcus
VSRIYLNFSDPWPKNRHAKRR

SEQ ID NO: 2045219 - protein, 19 aa, Staphylococcus
VSRKSDRLIIGGKNIYPNV

SEQ ID NO: 2045220 - protein, 29 aa, Staphylococcus
VSRSHPGLLKRLFEQEVPEIYDGTVIVKS

SEQ ID NO: 2045221 - protein, 23 aa, Staphylococcus
VSRTALIEKCWESENFIDDNTLA

SEQ ID NO: 2045222 - protein, 17 aa, Staphylococcus
VSRTTIYRYLNKLNNQE

SEQ ID NO: 2045223 - protein, 26 aa, Staphylococcus
VSSEPRIKMGILESTSQWMANVIHAH

SEQ ID NO: 2045224 - protein, 26 aa, Staphylococcus
VSSHGLSLGRLRGVDFDVAIFSNLTQ

SEQ ID NO: 2045225 - protein, 17 aa, Staphylococcus
VSSKYKNIVENLLGNTI

SEQ ID NO: 2045226 - protein, 18 aa, Staphylococcus
VSSLCKVASLAGNKVTLL

SEQ ID NO: 2045227 - protein, 17 aa, Staphylococcus
VSSLCKVASLKGNKVTL

SEQ ID NO: 2045228 - protein, 21 aa, Staphylococcus
VSSLLPYASTIGWQGLPNDSK

SEQ ID NO: 2045229 - protein, 19 aa, Staphylococcus
VSSTARASFYIYNTQQDVD

SEQ ID NO: 2045230 - protein, 17 aa, Staphylococcus
VSSTGQSAITHILNSKM

SEQ ID NO: 2045231 - protein, 21 aa, Staphylococcus
VSSYPMIPGIDLAGVVEHSDT

SEQ ID NO: 2045232 - protein, 27 aa, Staphylococcus
VSSYRIHKGFHMLKFEGINNINDIEHL

SEQ ID NO: 2045233 - protein, 17 aa, Staphylococcus
VSSYVKDKCVFKGTFKM

SEQ ID NO: 2045234 - protein, 23 aa, Staphylococcus
VSTELRKMLSLELDVTNIQSTDT

SEQ ID NO: 2045235 - protein, 25 aa, Staphylococcus
VSTGELRVTNNLMYNGGDIGYKPVV

SEQ ID NO: 2045236 - protein, 19 aa, Staphylococcus
VSTHCYFEINATNIELERL

SEQ ID NO: 2045237 - protein, 25 aa, Staphylococcus
VSTLNRITSAFVRLQYNIEELHVKK

SEQ ID NO: 2045238 - protein, 24 aa, Staphylococcus
VSTLNRITSAFVRLQYNINELTVK

SEQ ID NO: 2045239 - protein, 29 aa, Staphylococcus
VSTLSGGQFQRVWIAKALIIQPKLLILDE

SEQ ID NO: 2045240 - protein, 24 aa, Staphylococcus
VSTPSFMEMCLMLPNLSENQYDSL

SEQ ID NO: 2045241 - protein, 22 aa, Staphylococcus
VSVEDIDEWIGLLDQLEEKVKQ

SEQ ID NO: 2045242 - protein, 19 aa, Staphylococcus
VSVGARSSVFAPFKNLGMI

SEQ ID NO: 2045243 - protein, 22 aa, Staphylococcus
VSVGTRLDPDFESIRSSAPQLI

SEQ ID NO: 2045244 - protein, 18 aa, Staphylococcus
VSVHLANYLEIPFDVYPQ

SEQ ID NO: 2045245 - protein, 19 aa, Staphylococcus
VSVIECAEELGMSKTSIIK

SEQ ID NO: 2045246 - protein, 18 aa, Staphylococcus
VSVIEHLNKLLDIEFPED

SEQ ID NO: 2045247 - protein, 21 aa, Staphylococcus
VSVKTRLGFYEIDEWRDWLKH

SEQ ID NO: 2045248 - protein, 20 aa, Staphylococcus
VSVLRAPKTFTREDIVEINC

SEQ ID NO: 2045249 - protein, 21 aa, Staphylococcus
VSVLRAPKTFTREDIVEINCH

SEQ ID NO: 2045250 - protein, 19 aa, Staphylococcus
VSVRFSVNQNVHFEVLLVK

SEQ ID NO: 2045251 - protein, 20 aa, Staphylococcus
VSVVPLQLISYYAALHRGLD

SEQ ID NO: 2045252 - protein, 24 aa, Staphylococcus
VSVWGPRAREAQEFVTQLRAEKLP

SEQ ID NO: 2045253 - protein, 17 aa, Staphylococcus
VSYEEIMEMSALGAGVL

SEQ ID NO: 2045254 - protein, 21 aa, Staphylococcus
VSYEEMMEMSALGAGVLETRS

SEQ ID NO: 2045255 - protein, 18 aa, Staphylococcus
VSYEPAIQPILIKNQALM

SEQ ID NO: 2045256 - protein, 17 aa, Staphylococcus
VSYHWYKEVVNVMKKTM

SEQ ID NO: 2045257 - protein, 17 aa, Staphylococcus
VSYIRDVYDKWDVMKVL

SEQ ID NO: 2045258 - protein, 23 aa, Staphylococcus
VTAARLGWLPSYPQFDTNSLRFG

SEQ ID NO: 2045259 - protein, 20 aa, Staphylococcus
VTAATFACFGYGWHVDVGIH

SEQ ID NO: 2045260 - protein, 19 aa, Staphylococcus
VTAEPWVKISDRGLQLEGL

SEQ ID NO: 2045261 - protein, 23 aa, Staphylococcus
VTAEVPSTISGTITELIATEGET

SEQ ID NO: 2045262 - protein, 22 aa, Staphylococcus
VTAGARGYIFFGHPLDIQPIAE

SEQ ID NO: 2045263 - protein, 18 aa, Staphylococcus
VTAIAKIIHQGRTTQVWN

SEQ ID NO: 2045264 - protein, 18 aa, Staphylococcus
VTAIFPKLVFSIKKGTNF

SEQ ID NO: 2045265 - protein, 25 aa, Staphylococcus
VTAKSGEGGKLFGSVSAKQIAQALQ

SEQ ID NO: 2045266 - protein, 18 aa, Staphylococcus
VTALNYYTGEEVTIPLNP

SEQ ID NO: 2045267 - protein, 18 aa, Staphylococcus
VTARAVARLSVLSELCLP

SEQ ID NO: 2045268 - protein, 23 aa, Staphylococcus
VTAYRGSAHLIDYSATKGAIVAF

SEQ ID NO: 2045269 - protein, 23 aa, Staphylococcus
VTAYRGSGHLIDYASTKGAIVSF

SEQ ID NO: 2045270 - protein, 19 aa, Staphylococcus
VTAYRGSGHLIDYSATKGA

SEQ ID NO: 2045271 - protein, 18 aa, Staphylococcus
VTCDYEFVDDYPALYNDP

SEQ ID NO: 2045272 - protein, 18 aa, Staphylococcus
VTCHKDKPGIVGQTGNLL

SEQ ID NO: 2045273 - protein, 19 aa, Staphylococcus
VTDGILFYRMKNFDNNQLL

SEQ ID NO: 2045274 - protein, 25 aa, Staphylococcus
VTDHIKEIILMGGSAGRGNVTPAAE

SEQ ID NO: 2045275 - protein, 20 aa, Staphylococcus
VTDHRIGLTLQKLDQIMEGK

SEQ ID NO: 2045276 - protein, 21 aa, Staphylococcus
VTDHRIGLTLQKLDQIMEGKL

SEQ ID NO: 2045277 - protein, 20 aa, Staphylococcus
VTDHRIGLTLQKLGQIMEGN

SEQ ID NO: 2045278 - protein, 20 aa, Staphylococcus
VTDHRIGLTLQKLSQILEGN

SEQ ID NO: 2045279 - protein, 20 aa, Staphylococcus
VTDIQLLGGASCVLMNHEHE

SEQ ID NO: 2045280 - protein, 25 aa, Staphylococcus
VTDISGRPYLSFNAEFSKEKVGTFD

SEQ ID NO: 2045281 - protein, 18 aa, Staphylococcus
VTDPKILLCDEATSALDP

SEQ ID NO: 2045282 - protein, 17 aa, Staphylococcus
VTDRKISIKGARSNNLK

SEQ ID NO: 2045283 - protein, 23 aa, Staphylococcus
VTDVPVVAGFGIRNQEHVKDIGR

SEQ ID NO: 2045284 - protein, 17 aa, Staphylococcus
VTEALGIYDLSDKYPSE

SEQ ID NO: 2045285 - protein, 17 aa, Staphylococcus
VTEDGYFLTANKDFVEI

SEQ ID NO: 2045286 - protein, 18 aa, Staphylococcus
VTEDPDVIDWIWEEQDKS

SEQ ID NO: 2045287 - protein, 25 aa, Staphylococcus
VTEEGFSAIWVHAGYQDAERQKKAL

SEQ ID NO: 2045288 - protein, 27 aa, Staphylococcus
VTEELNRRLGWEIGPAKDYEFDHNGDR

SEQ ID NO: 2045289 - protein, 19 aa, Staphylococcus
VTEELRKRGVVGKFVEFFG

SEQ ID NO: 2045290 - protein, 31 aa, Staphylococcus
VTEFPFADLTSFREVQRGLGLQHDTEVKMIE

SEQ ID NO: 2045291 - protein, 27 aa, Staphylococcus
VTEFPFSKLTSFKEVQERLGVELETEV

SEQ ID NO: 2045292 - protein, 20 aa, Staphylococcus
VTEFPLTIMVNGKEFATVIC

SEQ ID NO: 2045293 - protein, 20 aa, Staphylococcus
VTEFPLTINVNGTEFATVIC

SEQ ID NO: 2045294 - protein, 24 aa, Staphylococcus
VTEGARGYLVFGHPLKIERIAESY

SEQ ID NO: 2045295 - protein, 24 aa, Staphylococcus
VTEHGGKLKVHYDLIQDDEKMGSY

SEQ ID NO: 2045296 - protein, 19 aa, Staphylococcus
VTEIKATYYVDNEQSAATQ

SEQ ID NO: 2045297 - protein, 21 aa, Staphylococcus
VTEIPHGWMMLEVDATNLVKT

SEQ ID NO: 2045298 - protein, 24 aa, Staphylococcus
VTEKELKVIIPRNEIKQRVFQLNE

SEQ ID NO: 2045299 - protein, 18 aa, Staphylococcus
VTEMRVAYDAVPDFEKIE

SEQ ID NO: 2045300 - protein, 29 aa, Staphylococcus
VTEPEPSFSTCFGAPFLPLNPTVYADLLG

SEQ ID NO: 2045301 - protein, 30 aa, Staphylococcus
VTEPEPSFSTCFGSPFLPLNAKVYADLLGN

SEQ ID NO: 2045302 - protein, 24 aa, Staphylococcus
VTEPSYKDNIDWGDVNQPIDEETF

SEQ ID NO: 2045303 - protein, 24 aa, Staphylococcus
VTEPSYKDNIHWGDINQPIDEETF

SEQ ID NO: 2045304 - protein, 24 aa, Staphylococcus
VTEPSYRDNVDWGDINQPIDEETF

SEQ ID NO: 2045305 - protein, 24 aa, Staphylococcus
VTEPSYRDNVDWGDVNQPIDEETF

SEQ ID NO: 2045306 - protein, 17 aa, Staphylococcus
VTERAVFELTHKGLKLI

SEQ ID NO: 2045307 - protein, 17 aa, Staphylococcus
VTERAYENPRFVEDLIR

SEQ ID NO: 2045308 - protein, 26 aa, Staphylococcus
VTETEVINVFPIRFVVDKDNEVSDPK

SEQ ID NO: 2045309 - protein, 28 aa, Staphylococcus
VTETMKLQSPRLMLGFKNNPLVDEPDAS

SEQ ID NO: 2045310 - protein, 20 aa, Staphylococcus
VTFEPGCRNNWHIHHKGGQI

SEQ ID NO: 2045311 - protein, 31 aa, Staphylococcus
VTFGHLLAKAVARDVGRIMGFEESTLSEISK

SEQ ID NO: 2045312 - protein, 17 aa, Staphylococcus
VTFYDFLYGRKAPNLEG

SEQ ID NO: 2045313 - protein, 23 aa, Staphylococcus
VTGAGCLLGGIIASFLFGNIHPS

SEQ ID NO: 2045314 - protein, 19 aa, Staphylococcus
VTGELLCQYYFKKFGVDTR

SEQ ID NO: 2045315 - protein, 18 aa, Staphylococcus
VTGGGVSLKEIWPKTMMS

SEQ ID NO: 2045316 - protein, 26 aa, Staphylococcus
VTGHKFGGPKGIGALLVRENTPIQFT

SEQ ID NO: 2045317 - protein, 18 aa, Staphylococcus
VTGIGPKSALAILAASSP

SEQ ID NO: 2045318 - protein, 19 aa, Staphylococcus
VTGIGPKSALAILASSSPN

SEQ ID NO: 2045319 - protein, 18 aa, Staphylococcus
VTGIGPKSALAILATSTP

SEQ ID NO: 2045320 - protein, 19 aa, Staphylococcus
VTGIGPKSALAILATSTPN

SEQ ID NO: 2045321 - protein, 19 aa, Staphylococcus
VTGKWSWLAPPISPTLTNN

SEQ ID NO: 2045322 - protein, 19 aa, Staphylococcus
VTGKWSWLAPSLSPTLVPN

SEQ ID NO: 2045323 - protein, 21 aa, Staphylococcus
VTGMMPWATLPTVDVKNIRKV

SEQ ID NO: 2045324 - protein, 17 aa, Staphylococcus
VTGTYDFKLRSINDLSG

SEQ ID NO: 2045325 - protein, 23 aa, Staphylococcus
VTGVACPDFVPLVEQMRYHDPVP

SEQ ID NO: 2045326 - protein, 31 aa, Staphylococcus; identical to SEQ ID NO: 1796967

SEQ ID NO: 2045327 - protein, 29 aa, Staphylococcus
VTGYDIIFFWVARMIFQGLEFTGERPFDD

SEQ ID NO: 2045328 - protein, 17 aa, Staphylococcus
VTHGFGSIAALKYIEQL

SEQ ID NO: 2045329 - protein, 19 aa, Staphylococcus
VTHIFKIIYYGPLRIMAEQ

SEQ ID NO: 2045330 - protein, 26 aa, Staphylococcus
VTIALMSGNFVMRGEPAIYNKFTRAE

SEQ ID NO: 2045331 - protein, 24 aa, Staphylococcus
VTIAPSPVWMQARLMKAGIRPINN

SEQ ID NO: 2045332 - protein, 27 aa, Staphylococcus
VTIKPNEMPVFWGCGVTPQSVALDAKP

SEQ ID NO: 2045333 - protein, 17 aa, Staphylococcus
VTIKWPNDIYIDGKKVC

SEQ ID NO: 2045334 - protein, 22 aa, Staphylococcus
VTIPKHQLTVFTGRSGSGKSSL

SEQ ID NO: 2045335 - protein, 27 aa, Staphylococcus
VTIPPWNFPFAIMAGTTLAPVIAGNTV

SEQ ID NO: 2045336 - protein, 26 aa, Staphylococcus
VTIPPWNFPFAIMVGTTLAPVVAGNT

SEQ ID NO: 2045337 - protein, 23 aa, Staphylococcus
VTIRYDVILVEGFKHENYDKIVV

SEQ ID NO: 2045338 - protein, 17 aa, Staphylococcus
VTKAIKINEQFQVSKQF

SEQ ID NO: 2045339 - protein, 20 aa, Staphylococcus
VTKKDILAFINAADSHPTQT

SEQ ID NO: 2045340 - protein, 26 aa, Staphylococcus
VTKLFVLELNNLVQMMFALENDKQFP

SEQ ID NO: 2045341 - protein, 18 aa, Staphylococcus
VTKLGGLLVMIVKRDPRQ

SEQ ID NO: 2045342 - protein, 20 aa, Staphylococcus
VTKLKRFLADIQHYQDYSQR

SEQ ID NO: 2045343 - protein, 24 aa, Staphylococcus
VTKRISMLEVMLPSAIKAKYTKVF

SEQ ID NO: 2045344 - protein, 17 aa, Staphylococcus
VTLAAGYSLSWLKHTFF

SEQ ID NO: 2045345 - protein, 22 aa, Staphylococcus
VTLDCHPEVNILIGENAQGKTN

SEQ ID NO: 2045346 - protein, 21 aa, Staphylococcus
VTLDLKHHFSSGIISGLKIKM

SEQ ID NO: 2045347 - protein, 26 aa, Staphylococcus
VTLEPCVMCAGAIVMSRIPKVVYGAT

SEQ ID NO: 2045348 - protein, 24 aa, Staphylococcus
VTLEPCVMCAGAIVMSRIPRVVYG

SEQ ID NO: 2045349 - protein, 25 aa, Staphylococcus
VTLEPCVMCAGAIVMSRIPRVVYGA

SEQ ID NO: 2045350 - protein, 24 aa, Staphylococcus
VTLEPCVMCAGSIVMSRIPSVIYG

SEQ ID NO: 2045351 - protein, 21 aa, Staphylococcus
VTLEPCVMCAGTIVMSRIPYI

SEQ ID NO: 2045352 - protein, 20 aa, Staphylococcus
VTLEPCVMCAGTVVMSRIPR

SEQ ID NO: 2045353 - protein, 18 aa, Staphylococcus
VTLFKREGRNIYLTDEGK

SEQ ID NO: 2045354 - protein, 17 aa, Staphylococcus
VTLGYPAVRNEIRDGLI

SEQ ID NO: 2045355 - protein, 17 aa, Staphylococcus
VTLKHKFFDGKDHNDKG

SEQ ID NO: 2045356 - protein, 18 aa, Staphylococcus
VTLLKPAIMMNLLGRDLD

SEQ ID NO: 2045357 - protein, 17 aa, Staphylococcus
VTLSAGDSLNWLKRTMF

SEQ ID NO: 2045358 - protein, 19 aa, Staphylococcus
VTLSAGYSLSWFKREFYPD

SEQ ID NO: 2045359 - protein, 21 aa, Staphylococcus
VTMTTSFQLRDALKILIGKQI

SEQ ID NO: 2045360 - protein, 21 aa, Staphylococcus
VTNARLPLYLNKKENQMYIQT

SEQ ID NO: 2045361 - protein, 24 aa, Staphylococcus
VTNKFKVSILISTYNKEKFIENTL

SEQ ID NO: 2045362 - protein, 17 aa, Staphylococcus
VTNPKILLCDEATSALD

SEQ ID NO: 2045363 - protein, 18 aa, Staphylococcus
VTNPKILLCDEATSALDP

SEQ ID NO: 2045364 - protein, 24 aa, Staphylococcus
VTPDGGKLKVHYELFQNEEKMGSY

SEQ ID NO: 2045365 - protein, 23 aa, Staphylococcus
VTPDLTCLGKVIGGGLPVGAFGG

SEQ ID NO: 2045366 - protein, 23 aa, Staphylococcus
VTPGPWHLHRMLLAAESLPLNIG

SEQ ID NO: 2045367 - protein, 23 aa, Staphylococcus
VTPIKHGWDHVDFVGQDETDYSH

SEQ ID NO: 2045368 - protein, 21 aa, Staphylococcus
VTPLSLGIEIMGGRMNTLIER

SEQ ID NO: 2045369 - protein, 17 aa, Staphylococcus
VTQALGIHDLSHKYPSE

SEQ ID NO: 2045370 - protein, 25 aa, Staphylococcus
VTQFIKYDVNDWWACVQEAYQFLKK

SEQ ID NO: 2045371 - protein, 23 aa, Staphylococcus
VTQFPTPAIFDWLQEQGNISTDE

SEQ ID NO: 2045372 - protein, 24 aa, Staphylococcus
VTQGYSGLEIVVFDSHSNKTRHIS

SEQ ID NO: 2045373 - protein, 24 aa, Staphylococcus
VTQHLRELPPIPGRTNSTAIEVKY

SEQ ID NO: 2045374 - protein, 18 aa, Staphylococcus
VTQLKIWMKWYRNGELHR

SEQ ID NO: 2045375 - protein, 24 aa, Staphylococcus
VTQLLERFLFPSATHGKKIYKLSG

SEQ ID NO: 2045376 - protein, 19 aa, Staphylococcus
VTQLLERFLFPSSTHGKKV

SEQ ID NO: 2045377 - protein, 21 aa, Staphylococcus
VTQLLQLRQKYFISVTTMKDN

SEQ ID NO: 2045378 - protein, 23 aa, Staphylococcus
VTQSKCLVLFTSYKMMYHVQELL

SEQ ID NO: 2045379 - protein, 17 aa, Staphylococcus
VTQYFIEAIVKPTLTEK

SEQ ID NO: 2045380 - protein, 22 aa, Staphylococcus
VTRARNKLIILYSGQITPLLDN

SEQ ID NO: 2045381 - protein, 27 aa, Staphylococcus
VTRDMVKSMKTGSVLIDIAIDQGGTVE

SEQ ID NO: 2045382 - protein, 18 aa, Staphylococcus
VTRIHGGAVKYNYLNKEQ

SEQ ID NO: 2045383 - protein, 20 aa, Staphylococcus
VTRIIEFIHRTQLSYIQEHM

SEQ ID NO: 2045384 - protein, 25 aa, Staphylococcus
VTSATEIPHGWMMIEADATNLVKTR

SEQ ID NO: 2045385 - protein, 25 aa, Staphylococcus
VTSATEIPHGWMMIEVDATNLVKTR

SEQ ID NO: 2045386 - protein, 20 aa, Staphylococcus
VTSFGFKHGIQMDADLVFDV

SEQ ID NO: 2045387 - protein, 18 aa, Staphylococcus
VTSPQAFEGLRIQKRPLR

SEQ ID NO: 2045388 - protein, 18 aa, Staphylococcus
VTSPQAFEGLRIQNRRLR

SEQ ID NO: 2045389 - protein, 18 aa, Staphylococcus
VTSPQAFEGLRIQNRSLR

SEQ ID NO: 2045390 - protein, 18 aa, Staphylococcus
VTSPYRFFAENEIKDNDH

SEQ ID NO: 2045391 - protein, 17 aa, Staphylococcus
VTSYIIWGGVSDINLMY

SEQ ID NO: 2045392 - protein, 26 aa, Staphylococcus
VTSYVKEILVFKGHFKMFYISEDEYN

SEQ ID NO: 2045393 - protein, 17 aa, Staphylococcus
VTTIYNVKHIYRGYTNI

SEQ ID NO: 2045394 - protein, 26 aa, Staphylococcus
VTTKFKLPKWLYNMMHQHAVNNHKKL

SEQ ID NO: 2045395 - protein, 23 aa, Staphylococcus
VTTKFKLPKWMYNKIHQRAIQNH

SEQ ID NO: 2045396 - protein, 18 aa, Staphylococcus
VTTKLGFKAIYENKESIN

SEQ ID NO: 2045397 - protein, 24 aa, Staphylococcus
VTTLEELTPLIGKKVIVDGKEIGI

SEQ ID NO: 2045398 - protein, 18 aa, Staphylococcus
VTTLRAGLIISAKGSSYP

SEQ ID NO: 2045399 - protein, 18 aa, Staphylococcus
VTTPEVFDLIAQTTPLKK

SEQ ID NO: 2045400 - protein, 17 aa, Staphylococcus
VTTPPFWEIKGNGTMAQ

SEQ ID NO: 2045401 - protein, 22 aa, Staphylococcus
VTTPRFYLDLNKYIDSSTKHST

SEQ ID NO: 2045402 - protein, 23 aa, Staphylococcus
VTTPRFYLDLNKYLKSQAEHSTP

SEQ ID NO: 2045403 - protein, 22 aa, Staphylococcus
VTTPRFYLDLNKYLSSQEQNST

SEQ ID NO: 2045404 - protein, 29 aa, Staphylococcus
VTTRLRTQTAFNFFSLFTFHEPIEQVVTH

SEQ ID NO: 2045405 - protein, 18 aa, Staphylococcus
VTVIKRALAVFNQFTQNV

SEQ ID NO: 2045406 - protein, 17 aa, Staphylococcus
VTYELLNQLNLKVEDVG

SEQ ID NO: 2045407 - protein, 22 aa, Staphylococcus
VTYELLTVLNFDINDLGTDKLK

SEQ ID NO: 2045408 - protein, 22 aa, Staphylococcus
VTYFKQVILLSGTLKLDSADVG

SEQ ID NO: 2045409 - protein, 17 aa, Staphylococcus
VTYGLAIDGEKVTRKEL

SEQ ID NO: 2045410 - protein, 17 aa, Staphylococcus
VTYGLAIEGTKVTRKEL

SEQ ID NO: 2045411 - protein, 17 aa, Staphylococcus
VTYGLAIHKDQVTRKEL

SEQ ID NO: 2045412 - protein, 18 aa, Staphylococcus
VTYHNGILLEALKEYGHM

SEQ ID NO: 2045413 - protein, 21 aa, Staphylococcus
VTYISEFLKSFNLAYPNIQLK

SEQ ID NO: 2045414 - protein, 17 aa, Staphylococcus
VTYNGLSEWRYINQPST

SEQ ID NO: 2045415 - protein, 24 aa, Staphylococcus
VTYSEQFPYISFIPVIYPTVISLK

SEQ ID NO: 2045416 - protein, 17 aa, Staphylococcus
VTYVASFLKTTEHKAKQ

SEQ ID NO: 2045417 - protein, 25 aa, Staphylococcus
VVAAVGLAQNFAACRALVSEGIQQG

SEQ ID NO: 2045418 - protein, 19 aa, Staphylococcus
VVAAVGLAQNFSACRALVS

SEQ ID NO: 2045419 - protein, 20 aa, Staphylococcus
VVAAVGLAQNFSACRALVSE

SEQ ID NO: 2045420 - protein, 24 aa, Staphylococcus
VVAAVGLAQNFSACRALVSEGIQQ

SEQ ID NO: 2045421 - protein, 17 aa, Staphylococcus
VVADARAPRDGRIIEQI

SEQ ID NO: 2045422 - protein, 17 aa, Staphylococcus
VVADARSPRDGRIIEQI

SEQ ID NO: 2045423 - protein, 17 aa, Staphylococcus
VVADARSPRDGRIIEQV

SEQ ID NO: 2045424 - protein, 21 aa, Staphylococcus
VVAGTKYRGEFEERLKKVMEE

SEQ ID NO: 2045425 - protein, 18 aa, Staphylococcus
VVALSGGYSREHANEVLK

SEQ ID NO: 2045426 - protein, 23 aa, Staphylococcus
VVANLPYYITTPILLNLMQQDIP

SEQ ID NO: 2045427 - protein, 21 aa, Staphylococcus
VVANLPYYITTPILLNLMQQK

SEQ ID NO: 2045428 - protein, 23 aa, Staphylococcus
VVAPKLSDIILKYTDSKNIESDA

SEQ ID NO: 2045429 - protein, 19 aa, Staphylococcus
VVAPYKYPRAIEFVEDLPK

SEQ ID NO: 2045430 - protein, 17 aa, Staphylococcus
VVARAGVGVDNIDINAA

SEQ ID NO: 2045431 - protein, 17 aa, Staphylococcus
VVARGMGKCCVTGCSDV

SEQ ID NO: 2045432 - protein, 20 aa, Staphylococcus
VVARVKAILRRSQFVNEAAN

SEQ ID NO: 2045433 - protein, 20 aa, Staphylococcus
VVARVKAILRRSQFVNEVEQ

SEQ ID NO: 2045434 - protein, 18 aa, Staphylococcus
VVARVKAILRRSQIANEV

SEQ ID NO: 2045435 - protein, 20 aa, Staphylococcus
VVAVPLWLEHQMYGVLLLGQ

SEQ ID NO: 2045436 - protein, 22 aa, Staphylococcus
VVDDDWKLVGIVTSKDIIAKDS

SEQ ID NO: 2045437 - protein, 36 aa, Staphylococcus
VVDEHRGGFCYEMNYFFKHYLEYKGFKAEAMSATVM

SEQ ID NO: 2045438 - protein, 19 aa, Staphylococcus
VVDGACYIVALPEIFEKVD

SEQ ID NO: 2045439 - protein, 24 aa, Staphylococcus
VVDGEFQFDAAIVPAVAEKKAPGA

SEQ ID NO: 2045440 - protein, 18 aa, Staphylococcus
VVDIETLKQTQSDIIDTI

SEQ ID NO: 2045441 - protein, 18 aa, Staphylococcus
VVDIETLKTTQKDIIETI

SEQ ID NO: 2045442 - protein, 24 aa, Staphylococcus
VVDISGRPYLSFNATLSKEKVGTF

SEQ ID NO: 2045443 - protein, 18 aa, Staphylococcus
VVDISNYVLIEYGQPLHM

SEQ ID NO: 2045444 - protein, 20 aa, Staphylococcus
VVDKDWRLVGIVTSKEVIQM

SEQ ID NO: 2045445 - protein, 18 aa, Staphylococcus
VVDMTKLLAPILVHTAEE

SEQ ID NO: 2045446 - protein, 18 aa, Staphylococcus
VVDVFDFEGSFINAIKRI

SEQ ID NO: 2045447 - protein, 19 aa, Staphylococcus
VVDVFDFEGSFINAIKRIV

SEQ ID NO: 2045448 - protein, 20 aa, Staphylococcus
VVEEYGRIDVLYNNAGVMPE

SEQ ID NO: 2045449 - protein, 26 aa, Staphylococcus
VVEGLVSFIGSYAYKGNKGVVIHKMG

SEQ ID NO: 2045450 - protein, 24 aa, Staphylococcus
VVEKPLPFLFGEDFSFYGQQLAPA

SEQ ID NO: 2045451 - protein, 18 aa, Staphylococcus
VVELDASYYAIQPERNIL

SEQ ID NO: 2045452 - protein, 19 aa, Staphylococcus
VVELDCEIAVIVGGGNIWR

SEQ ID NO: 2045453 - protein, 22 aa, Staphylococcus
VVEPRKITVLFGSESGNAQWVA

SEQ ID NO: 2045454 - protein, 33 aa, Staphylococcus
VVERPTLKFELFYFDIFRYGTSFITLQVSREEE

SEQ ID NO: 2045455 - protein, 18 aa, Staphylococcus
VVERVINVHLNRILSQPD

SEQ ID NO: 2045456 - protein, 18 aa, Staphylococcus
VVERVINVHLNRILSQPN

SEQ ID NO: 2045457 - protein, 23 aa, Staphylococcus
VVETESDFGLAFDGDGDRLIAVD

SEQ ID NO: 2045458 - protein, 17 aa, Staphylococcus
VVETFQGAGVISRELEN

SEQ ID NO: 2045459 - protein, 17 aa, Staphylococcus
VVETFQGAGVISRELES

SEQ ID NO: 2045460 - protein, 25 aa, Staphylococcus
VVEYSIKEALDFFENIDLSEQDRKI

SEQ ID NO: 2045461 - protein, 26 aa, Staphylococcus
VVFPRETMIGSMAYYISHANNNKNFQ

SEQ ID NO: 2045462 - protein, 32 aa, Staphylococcus
VVGDSDQSIYGWRGADIQNILSFEEDYPEAKS

SEQ ID NO: 2045463 - protein, 32 aa, Staphylococcus
VVGDSDQSIYGWRGADIQNILSFEEDYPNAKT

SEQ ID NO: 2045464 - protein, 17 aa, Staphylococcus
VVGEKRIKEAILNNKKI

SEQ ID NO: 2045465 - protein, 17 aa, Staphylococcus
VVGGGYIGSELGTVFAN

SEQ ID NO: 2045466 - protein, 28 aa, Staphylococcus
VVGINAFKGVSFGEGFKAAEKPGSQIQD

SEQ ID NO: 2045467 - protein, 24 aa, Staphylococcus
VVGNTYGRIRAMVNDLGQRIKTAG

SEQ ID NO: 2045468 - protein, 27 aa, Staphylococcus
VVGQIAKIKGCRVVGIAGGDKKVNYLT

SEQ ID NO: 2045469 - protein, 26 aa, Staphylococcus
VVGQIAKIKGCRVVGIAGGPDKVNYL

SEQ ID NO: 2045470 - protein, 20 aa, Staphylococcus
VVHGGELFPTSALVTDEVEK

SEQ ID NO: 2045471 - protein, 20 aa, Staphylococcus
VVHGGELFPTSALVTDKVEE

SEQ ID NO: 2045472 - protein, 18 aa, Staphylococcus
VVHIYGLLSPYYKQPITT

SEQ ID NO: 2045473 - protein, 17 aa, Staphylococcus
VVHQCREAGLPCYFTMD

SEQ ID NO: 2045474 - protein, 19 aa, Staphylococcus
VVHRRSWLTQWQQMNYQAV

SEQ ID NO: 2045475 - protein, 24 aa, Staphylococcus
VVIERLRPFLLRDGGDCTLIDVED

SEQ ID NO: 2045476 - protein, 24 aa, Staphylococcus
VVIGEKILKVDGFLNHQIDAQLMY

SEQ ID NO: 2045477 - protein, 17 aa, Staphylococcus
VVIGIRPGNSFDKAKKD

SEQ ID NO: 2045478 - protein, 30 aa, Staphylococcus
VVILPSKCAYDFLLFCFRNPKTCPLLDVSE

SEQ ID NO: 2045479 - protein, 27 aa, Staphylococcus
VVILRSRAKWEGLFIDVCESKNIDYSL

SEQ ID NO: 2045480 - protein, 19 aa, Staphylococcus
VVIPEMWNNGYALEKLNDL

SEQ ID NO: 2045481 - protein, 27 aa, Staphylococcus
VVIPFNIGCGDCFYCNNEMESQCDNSN

SEQ ID NO: 2045482 - protein, 27 aa, Staphylococcus
VVIPFNIGCGDCFYCNNHMESQCDNSN

SEQ ID NO: 2045483 - protein, 24 aa, Staphylococcus
VVITRPANDPALFDATIKHIVNFE

SEQ ID NO: 2045484 - protein, 19 aa, Staphylococcus
VVITRPANDPALFDATIKN

SEQ ID NO: 2045485 - protein, 19 aa, Staphylococcus
VVITRPANDPALFDATVKN

SEQ ID NO: 2045486 - protein, 23 aa, Staphylococcus
VVITRPANDPALFDATVKSVTQF

SEQ ID NO: 2045487 - protein, 20 aa, Staphylococcus
VVKANGYGLGSIKVARQLMD

SEQ ID NO: 2045488 - protein, 18 aa, Staphylococcus
VVKARERGLIILTAGQNV

SEQ ID NO: 2045489 - protein, 18 aa, Staphylococcus
VVKEGESLLTIHSNRENV

SEQ ID NO: 2045490 - protein, 20 aa, Staphylococcus
VVKGDKEYLIPYIADVVKDV

SEQ ID NO: 2045491 - protein, 17 aa, Staphylococcus
VVKHHQLNIHAFEEVLT

SEQ ID NO: 2045492 - protein, 17 aa, Staphylococcus
VVKHHQLNVHAFEEVLT

SEQ ID NO: 2045493 - protein, 22 aa, Staphylococcus
VVKIDLYTPIAHRDNIHEVIKL

SEQ ID NO: 2045494 - protein, 28 aa, Staphylococcus
VVKKDFNGISFLNLVDFDALYGHRRDKE

SEQ ID NO: 2045495 - protein, 28 aa, Staphylococcus
VVKKDFNGLSFLNLVDFDALYGHRRDKP

SEQ ID NO: 2045496 - protein, 18 aa, Staphylococcus
VVKMLRQRQDFRVIEERD

SEQ ID NO: 2045497 - protein, 22 aa, Staphylococcus
VVKNADRKSMFAISDEINELAV

SEQ ID NO: 2045498 - protein, 20 aa, Staphylococcus
VVKPLLKYAYDRGIYTQMNS

SEQ ID NO: 2045499 - protein, 20 aa, Staphylococcus
VVKPLLKYAYQRGIYVQMNS

SEQ ID NO: 2045500 - protein, 21 aa, Staphylococcus
VVKWEVTGTLNYMKPREFCLV

SEQ ID NO: 2045501 - protein, 17 aa, Staphylococcus
VVLALKATYPDLKLGII

SEQ ID NO: 2045502 - protein, 20 aa, Staphylococcus
VVLEYGESAPKIFQKVTDLI

SEQ ID NO: 2045503 - protein, 20 aa, Staphylococcus
VVLEYGESAPKIFRKVTDLV

SEQ ID NO: 2045504 - protein, 18 aa, Staphylococcus
VVLFRPDQNFARINQSLD

SEQ ID NO: 2045505 - protein, 22 aa, Staphylococcus
VVLGSPRFAHYLMQLNLVDEYK

SEQ ID NO: 2045506 - protein, 27 aa, Staphylococcus
VVLIHGFKHYVALLFHKGALLEDQYGT

SEQ ID NO: 2045507 - protein, 21 aa, Staphylococcus
VVLKPFRLGGIDRVIETIDYL

SEQ ID NO: 2045508 - protein, 25 aa, Staphylococcus
VVLNEFRFHVADALINQIDADIKIR

SEQ ID NO: 2045509 - protein, 34 aa, Staphylococcus
VVLNKRLPIVDLPIIPIWVSRYWVQLISKVPKEM

SEQ ID NO: 2045510 - protein, 19 aa, Staphylococcus
VVLPEMWNNGYALPQLQAL

SEQ ID NO: 2045511 - protein, 19 aa, Staphylococcus
VVLRHSRRASGITDLSINS

SEQ ID NO: 2045512 - protein, 25 aa, Staphylococcus
VVLTPLPRLECNPMNEQQNKADYTL

SEQ ID NO: 2045513 - protein, 19 aa, Staphylococcus
VVLYIHGGGTFFGTVEGND

SEQ ID NO: 2045514 - protein, 21 aa, Staphylococcus
VVMEGMRLLARSVFVLDQDNK

SEQ ID NO: 2045515 - protein, 18 aa, Staphylococcus
VVMLTSFIEDKEVYRALD

SEQ ID NO: 2045516 - protein, 23 aa, Staphylococcus
VVMSSRIRLARNLENHVHPLMFP

SEQ ID NO: 2045517 - protein, 26 aa, Staphylococcus
VVNAILRTIFRSELPSLESIKNDKQR

SEQ ID NO: 2045518 - protein, 19 aa, Staphylococcus
VVNEAWYYIETSLQMTLPY

SEQ ID NO: 2045519 - protein, 19 aa, Staphylococcus
VVNEWPYEDLVRIFYRYGE

SEQ ID NO: 2045520 - protein, 18 aa, Staphylococcus
VVNFDYTDVIPLPTFTSL

SEQ ID NO: 2045521 - protein, 22 aa, Staphylococcus
VVNIREGMEMDRSQFLRDLVDI

SEQ ID NO: 2045522 - protein, 20 aa, Staphylococcus
VVNKDWKLVGIVTSKEVIHM

SEQ ID NO: 2045523 - protein, 23 aa, Staphylococcus
VVNKEDLVRCKVSKEQAIQFATL

SEQ ID NO: 2045524 - protein, 26 aa, Staphylococcus
VVNKRAVDWAMRASMALNMDIATNSK

SEQ ID NO: 2045525 - protein, 19 aa, Staphylococcus
VVNKRAVDWAMRASTALNM

SEQ ID NO: 2045526 - protein, 20 aa, Staphylococcus
VVNLMLKLQQERGITFLFIA

SEQ ID NO: 2045527 - protein, 20 aa, Staphylococcus
VVNMIQDVYKDFGFEDYRFR

SEQ ID NO: 2045528 - protein, 27 aa, Staphylococcus
VVNMIQEVYEDFGFKDYTFRLSYRDPE

SEQ ID NO: 2045529 - protein, 26 aa, Staphylococcus
VVNMIQEVYSDFGFEDYTFRLSYRDP

SEQ ID NO: 2045530 - protein, 17 aa, Staphylococcus
VVNQFEAHFGLTVRDGY

SEQ ID NO: 2045531 - protein, 27 aa, Staphylococcus
VVNQWPYEALVKIFYRYGEEKFSKQIA

SEQ ID NO: 2045532 - protein, 23 aa, Staphylococcus
VVNSELKDVTGFTRQVGGAPANV

SEQ ID NO: 2045533 - protein, 21 aa, Staphylococcus
VVPAGEGWDTPPFEPTVTDDA

SEQ ID NO: 2045534 - protein, 18 aa, Staphylococcus
VVPKPLWTKKYKVNDKNQ

SEQ ID NO: 2045535 - protein, 18 aa, Staphylococcus
VVPKPLWTRKYKVNDKNQ

SEQ ID NO: 2045536 - protein, 21 aa, Staphylococcus
VVPKSLVFYVFGSVLNAFIDW

SEQ ID NO: 2045537 - protein, 18 aa, Staphylococcus
VVPRDFKYDFDLEDALQL

SEQ ID NO: 2045538 - protein, 27 aa, Staphylococcus
VVPSRNEGFGMIILEAMLQDNIVISFK

SEQ ID NO: 2045539 - protein, 23 aa, Staphylococcus
VVQAHPLGGIQIVAETNQIISPR

SEQ ID NO: 2045540 - protein, 18 aa, Staphylococcus
VVQEAVFNALKYAGVSSV

SEQ ID NO: 2045541 - protein, 24 aa, Staphylococcus
VVQFFKKEFTNHGNVICTDMSELA

SEQ ID NO: 2045542 - protein, 18 aa, Staphylococcus
VVQFYTDLNTDGRFLNVG

SEQ ID NO: 2045543 - protein, 18 aa, Staphylococcus
VVQIIGSMIVLYKESEEN

SEQ ID NO: 2045544 - protein, 18 aa, Staphylococcus
VVQMRQKISWFKEQTTDL

SEQ ID NO: 2045545 - protein, 18 aa, Staphylococcus
VVQNGNFNPNDVFIPGKL

SEQ ID NO: 2045546 - protein, 18 aa, Staphylococcus
VVQPHSWIETGDYAYIQN

SEQ ID NO: 2045547 - protein, 18 aa, Staphylococcus
VVQVIGSMIVLYRESQEN

SEQ ID NO: 2045548 - protein, 25 aa, Staphylococcus
VVQYRSVASLLLLDIAVPRDIDPQV

SEQ ID NO: 2045549 - protein, 17 aa, Staphylococcus
VVRFHQLNVHPFEEVLT

SEQ ID NO: 2045550 - protein, 17 aa, Staphylococcus
VVRGLAGIGRYLLNRVD

SEQ ID NO: 2045551 - protein, 30 aa, Staphylococcus
VVRPLLDKEIEGFGELFRYLSYTEDVGTRS

SEQ ID NO: 2045552 - protein, 17 aa, Staphylococcus
VVRRLSKDMSIGVITND

SEQ ID NO: 2045553 - protein, 20 aa, Staphylococcus
VVRRRIKLMKEAGIQFKTGI

SEQ ID NO: 2045554 - protein, 23 aa, Staphylococcus
VVRRYFEYKGYEVIYVSNFTDVD

SEQ ID NO: 2045555 - protein, 23 aa, Staphylococcus
VVRRYFEYKGYEVVYVSNFTDVD

SEQ ID NO: 2045556 - protein, 17 aa, Staphylococcus
VVSEWKENLNLLNKKSL

SEQ ID NO: 2045557 - protein, 21 aa, Staphylococcus
VVSFGGAIIGKLLLFDIVDAF

SEQ ID NO: 2045558 - protein, 17 aa, Staphylococcus
VVSGIGGYGNCIGIPTT

SEQ ID NO: 2045559 - protein, 28 aa, Staphylococcus
VVSINAFKGVSFGEGFKAAEKPGSAIQD

SEQ ID NO: 2045560 - protein, 19 aa, Staphylococcus
VVSKGLHYQALQVLDTYVK

SEQ ID NO: 2045561 - protein, 19 aa, Staphylococcus
VVSKGLHYQALQVLHTYSK

SEQ ID NO: 2045562 - protein, 20 aa, Staphylococcus
VVSKGLHYQALQVLKTYIKV

SEQ ID NO: 2045563 - protein, 20 aa, Staphylococcus
VVSKGLHYQALQVLKTYVKT

SEQ ID NO: 2045564 - protein, 19 aa, Staphylococcus
VVSKGLHYQALQVLNTYAK

SEQ ID NO: 2045565 - protein, 18 aa, Staphylococcus
VVSKRGAGWVKKLRDTFK

SEQ ID NO: 2045566 - protein, 21 aa, Staphylococcus
VVSQHACPSCQGKRLNDKVLS

SEQ ID NO: 2045567 - protein, 24 aa, Staphylococcus
VVTFNYRLGALGYLDWSYFNANYD

SEQ ID NO: 2045568 - protein, 17 aa, Staphylococcus
VVTGGFRSAEGMEDALE

SEQ ID NO: 2045569 - protein, 35 aa, Staphylococcus
VVTKPTLKFELFYFDIFKYATSFITLQVPREEEFS

SEQ ID NO: 2045570 - protein, 17 aa, Staphylococcus
VVTNKVCPTCHGQRLSQ

SEQ ID NO: 2045571 - protein, 20 aa, Staphylococcus
VVTTMAITLAREFDTENVVY

SEQ ID NO: 2045572 - protein, 22 aa, Staphylococcus
VVVDRLVVKPGIETRLADSIET

SEQ ID NO: 2045573 - protein, 24 aa, Staphylococcus
VVVEEFEFMLSLLDVSKEYYIYED

SEQ ID NO: 2045574 - protein, 23 aa, Staphylococcus
VVVEISLRIKEAFNSEDIDVLHQ

SEQ ID NO: 2045575 - protein, 20 aa, Staphylococcus
VVVFNAGIALYVAEKVSSIK

SEQ ID NO: 2045576 - protein, 18 aa, Staphylococcus
VVVHTSLIVREDAQLLYG

SEQ ID NO: 2045577 - protein, 21 aa, Staphylococcus
VVVIKNAYLFTGEKGPKDLNQ

SEQ ID NO: 2045578 - protein, 21 aa, Staphylococcus
VVVLPEMWNNGYALDELNEKA

SEQ ID NO: 2045579 - protein, 21 aa, Staphylococcus
VVVLPEMWNNGYALEDLKVKA

SEQ ID NO: 2045580 - protein, 20 aa, Staphylococcus
VVVLPEMWNNGYALEELNEK

SEQ ID NO: 2045581 - protein, 19 aa, Staphylococcus
VVVMPDFTLSPEAKYPTAI

SEQ ID NO: 2045582 - protein, 24 aa, Staphylococcus
VVVRRRTEYNLKKAEDRAHILEGL

SEQ ID NO: 2045583 - protein, 24 aa, Staphylococcus
VVVRRRTEYNLKKALDRAHILEGL

SEQ ID NO: 2045584 - protein, 27 aa, Staphylococcus
VVWATAAPGWQKWVWSPFLSIMGSGAT

SEQ ID NO: 2045585 - protein, 19 aa, Staphylococcus
VVYCLDKIAKDYLTCTGYQ

SEQ ID NO: 2045586 - protein, 27 aa, Staphylococcus
VVYFRYKVFCERGGYRALSERKFCKSF

SEQ ID NO: 2045587 - protein, 20 aa, Staphylococcus
VVYHVNRYGANQSLIGETDI

SEQ ID NO: 2045588 - protein, 24 aa, Staphylococcus
VVYQLGALNGFCRIHDVKINHVKP

SEQ ID NO: 2045589 - protein, 17 aa, Staphylococcus
VVYSTQNLDLWYGENHA

SEQ ID NO: 2045590 - protein, 26 aa, Staphylococcus
VWATAAPGWQKWVWSPFLSILGTGAT

SEQ ID NO: 2045591 - protein, 26 aa, Staphylococcus
VWATAAPGWQKWVWSPFLSSLGSGAT

SEQ ID NO: 2045592 - protein, 17 aa, Staphylococcus
VWDELNFDDRETSYYDE

SEQ ID NO: 2045593 - protein, 24 aa, Staphylococcus
VWEKRIKLLEPYRVTKEMMEKTGN

SEQ ID NO: 2045594 - protein, 25 aa, Staphylococcus
VWFEREAKDLLPEGFTHPGSPNGEF

SEQ ID NO: 2045595 - protein, 17 aa, Staphylococcus
VWGERVGVEVISQSEGS

SEQ ID NO: 2045596 - protein, 17 aa, Staphylococcus
VWGNGIATEGAEAVLRF

SEQ ID NO: 2045597 - protein, 18 aa, Staphylococcus
VWGNGLATEGAQAVLSYA

SEQ ID NO: 2045598 - protein, 18 aa, Staphylococcus
VWGPRAKEVEKFVVDLRN

SEQ ID NO: 2045599 - protein, 20 aa, Staphylococcus
VWIAMALTQRTDIIFLDEPT

SEQ ID NO: 2045600 - protein, 29 aa, Staphylococcus
VWINGFTPKYSMSVWMGFNEVKQGGTNSF

SEQ ID NO: 2045601 - protein, 19 aa, Staphylococcus
VWPKSVTPFDLHLITINPK

SEQ ID NO: 2045602 - protein, 24 aa, Staphylococcus
VWQERLKLLEPYRVNKELMDKTGN

SEQ ID NO: 2045603 - protein, 25 aa, Staphylococcus
VWRDKVCSMEIWKVMMKRDDQPQQH

SEQ ID NO: 2045604 - protein, 22 aa, Staphylococcus
VWSSELNQFAWSMYLKNIKGDV

SEQ ID NO: 2045605 - protein, 19 aa, Staphylococcus
VWSYKDAAGTPWTLQISVL

SEQ ID NO: 2045606 - protein, 17 aa, Staphylococcus
VWYCPPLSPIMSYFEGK

SEQ ID NO: 2045607 - protein, 26 aa, Staphylococcus
VWYPQPAPATHPWRTMPRNGMTIHYS

SEQ ID NO: 2045608 - protein, 22 aa, Staphylococcus
VYACSFGAEGIVLIDLISQVKP

SEQ ID NO: 2045609 - protein, 17 aa, Staphylococcus
VYACSFGAESMVLIHII

SEQ ID NO: 2045610 - protein, 17 aa, Staphylococcus
VYAEFVFNEDGKVITCK

SEQ ID NO: 2045611 - protein, 18 aa, Staphylococcus
VYANGIFEGVTFPESFKV

SEQ ID NO: 2045612 - protein, 21 aa, Staphylococcus
VYCSIKHGINISKFASKIQTS

SEQ ID NO: 2045613 - protein, 21 aa, Staphylococcus
VYDAICTIFLEDAGTLFITNN

SEQ ID NO: 2045614 - protein, 18 aa, Staphylococcus
VYDFKLRAQALIEDITSR

SEQ ID NO: 2045615 - protein, 20 aa, Staphylococcus
VYDFKVTEFDTWKIDKVPKS

SEQ ID NO: 2045616 - protein, 17 aa, Staphylococcus
VYDIFSNTMLKRADENE

SEQ ID NO: 2045617 - protein, 19 aa, Staphylococcus
VYDKFKYTFFEDKEPFIQI

SEQ ID NO: 2045618 - protein, 25 aa, Staphylococcus
VYDPRKYLGPAREAIKATVKGKIKE

SEQ ID NO: 2045619 - protein, 27 aa, Staphylococcus
VYDPTCGSGSLLLRVGKETKVYRYNGQ

SEQ ID NO: 2045620 - protein, 20 aa, Staphylococcus
VYDRVRVVVATNAFGMGIDK

SEQ ID NO: 2045621 - protein, 17 aa, Staphylococcus
VYEDFGFEDYTFRLSYR

SEQ ID NO: 2045622 - protein, 24 aa, Staphylococcus
VYEHELDNGLKLFIIPKPGFQKTF

SEQ ID NO: 2045623 - protein, 18 aa, Staphylococcus
VYEHLKEDGVFLFDVHTV

SEQ ID NO: 2045624 - protein, 17 aa, Staphylococcus
VYEKLGFQYGGKRKNYY

SEQ ID NO: 2045625 - protein, 18 aa, Staphylococcus
VYENIAFGLRLKKFSKQE

SEQ ID NO: 2045626 - protein, 26 aa, Staphylococcus
VYEPEVLRSKISYLMQQSELFGQNIG

SEQ ID NO: 2045627 - protein, 17 aa, Staphylococcus
VYEPFLIQKGFLERTPR

SEQ ID NO: 2045628 - protein, 30 aa, Staphylococcus
VYERDFRKVFGNSKFDYAIDFSGYSMFWAN

SEQ ID NO: 2045629 - protein, 20 aa, Staphylococcus
VYFEVKFPKLDIERANQLWN

SEQ ID NO: 2045630 - protein, 18 aa, Staphylococcus
VYFFYTLKKEEGFFYSHD

SEQ ID NO: 2045631 - protein, 24 aa, Staphylococcus
VYFKLKDHYKWFIFAMSSAAMSKD

SEQ ID NO: 2045632 - protein, 28 aa, Staphylococcus
VYFSGYRPAEGFEAFFMMKKMGAPFLLF

SEQ ID NO: 2045633 - protein, 27 aa, Staphylococcus
VYFSGYRPAEGFEGYFMMNKMNAPFIL

SEQ ID NO: 2045634 - protein, 24 aa, Staphylococcus
VYFTLKATPFYAVSGGQVADEGTI

SEQ ID NO: 2045635 - protein, 17 aa, Staphylococcus
VYGDFAYADGYEFENLD

SEQ ID NO: 2045636 - protein, 24 aa, Staphylococcus
VYGIACPGFVPLVEQMRYNDPTIT

SEQ ID NO: 2045637 - protein, 27 aa, Staphylococcus
VYGIDFKGPCLKCLLKHIPTSAESCAI

SEQ ID NO: 2045638 - protein, 26 aa, Staphylococcus
VYGIDFKGPCLKCLLQYIPETGESCA

SEQ ID NO: 2045639 - protein, 19 aa, Staphylococcus
VYGIDFTGPCLKCLLQQVP

SEQ ID NO: 2045640 - protein, 17 aa, Staphylococcus
VYGKAFKSLTHIDNEQI

SEQ ID NO: 2045641 - protein, 23 aa, Staphylococcus
VYGKCSLSKLIIESSSPGIKDEN

SEQ ID NO: 2045642 - protein, 25 aa, Staphylococcus
VYGKRWLDEKLFSIDNFTKMGRKEH

SEQ ID NO: 2045643 - protein, 24 aa, Staphylococcus
VYGLFIYNKWRGMGTLNSVDVIDQ

SEQ ID NO: 2045644 - protein, 25 aa, Staphylococcus
VYGLFIYNKWRGMGTLNSVDVINQH

SEQ ID NO: 2045645 - protein, 17 aa, Staphylococcus
VYGPFKGGYMGIRRILK

SEQ ID NO: 2045646 - protein, 24 aa, Staphylococcus
VYGTSLYGFMEWIRDNDIQLSAHE

SEQ ID NO: 2045647 - protein, 23 aa, Staphylococcus
VYGVACPGFVPLVEQMRYDDPTI

SEQ ID NO: 2045648 - protein, 21 aa, Staphylococcus
VYHYVMKWKETEIFFEKLMDL

SEQ ID NO: 2045649 - protein, 18 aa, Staphylococcus
VYIIEDFEKLTVQGENSI

SEQ ID NO: 2045650 - protein, 18 aa, Staphylococcus
VYIVEDFEKLTVQGENSI

SEQ ID NO: 2045651 - protein, 19 aa, Staphylococcus
VYKDFGFEDYRFRLSYRDP

SEQ ID NO: 2045652 - protein, 18 aa, Staphylococcus
VYKDFGFEDYTFRLSYRD

SEQ ID NO: 2045653 - protein, 19 aa, Staphylococcus
VYKEIIKQFHIDRLKWKDL

SEQ ID NO: 2045654 - protein, 26 aa, Staphylococcus
VYKKKVCPVCGGPIQTKVIAGRNTHY

SEQ ID NO: 2045655 - protein, 20 aa, Staphylococcus
VYKKYKRVMHYVEETYKLTM

SEQ ID NO: 2045656 - protein, 24 aa, Staphylococcus
VYKLSGFPKERVLGQSGILDTARY

SEQ ID NO: 2045657 - protein, 17 aa, Staphylococcus
VYKREDVELVVLQTTAG

SEQ ID NO: 2045658 - protein, 18 aa, Staphylococcus
VYLAGPIHLVDRPKHDEF

SEQ ID NO: 2045659 - protein, 18 aa, Staphylococcus
VYLAGPIQLINRPKHDEF

SEQ ID NO: 2045660 - protein, 17 aa, Staphylococcus
VYLAGPIQLVNRPDHSE

SEQ ID NO: 2045661 - protein, 18 aa, Staphylococcus
VYLAGPIQLVNRPKHDEF

SEQ ID NO: 2045662 - protein, 19 aa, Staphylococcus
VYLDLWVKVQKDWRNKVNF

SEQ ID NO: 2045663 - protein, 24 aa, Staphylococcus
VYLEHMKLYRSFRDEVPEEEYTIE

SEQ ID NO: 2045664 - protein, 25 aa, Staphylococcus
VYLEHMKLYRSFREEVPEEEYEIEL

SEQ ID NO: 2045665 - protein, 18 aa, Staphylococcus
VYLFESFISGEHIFRGEV

SEQ ID NO: 2045666 - protein, 18 aa, Staphylococcus
VYLKGPESKKREFLSQLM

SEQ ID NO: 2045667 - protein, 26 aa, Staphylococcus
VYLKREDLQWVRSFKLRGAYNAIEAL

SEQ ID NO: 2045668 - protein, 25 aa, Staphylococcus
VYLKREDLQWVRSFKLRGAYNAISV

SEQ ID NO: 2045669 - protein, 26 aa, Staphylococcus
VYLLPYVPFEYFWKRYQQEIKKSITV

SEQ ID NO: 2045670 - protein, 18 aa, Staphylococcus
VYLNDCRYFGNDKLSFLA

SEQ ID NO: 2045671 - protein, 18 aa, Staphylococcus
VYLSFLDTRHWCQNKFQI

SEQ ID NO: 2045672 - protein, 26 aa, Staphylococcus
VYLVDRVIPMIPHRLSNGICSLNPQV

SEQ ID NO: 2045673 - protein, 20 aa, Staphylococcus
VYMQTARDSYGFIGGIHEHD

SEQ ID NO: 2045674 - protein, 18 aa, Staphylococcus
VYNIPMVAFDTYFEDYKQ

SEQ ID NO: 2045675 - protein, 25 aa, Staphylococcus
VYNKFKPYFNWTIEKLCENFNIAVD

SEQ ID NO: 2045676 - protein, 19 aa, Staphylococcus
VYNKMGGFYAVKRSENPNA

SEQ ID NO: 2045677 - protein, 19 aa, Staphylococcus
VYPDLENAYVLILGAGGAS

SEQ ID NO: 2045678 - protein, 18 aa, Staphylococcus
VYPQDAIMPLPFEDADVV

SEQ ID NO: 2045679 - protein, 18 aa, Staphylococcus
VYPQDAIMPLPFEEADVV

SEQ ID NO: 2045680 - protein, 17 aa, Staphylococcus
VYQCRFLTVATGYYGHH

SEQ ID NO: 2045681 - protein, 17 aa, Staphylococcus
VYQDYSFTQFVISEPYI

SEQ ID NO: 2045682 - protein, 18 aa, Staphylococcus
VYQHYALSELPFPKKTQF

SEQ ID NO: 2045683 - protein, 18 aa, Staphylococcus
VYQLLALPHRVNNQALPE

SEQ ID NO: 2045684 - protein, 18 aa, Staphylococcus
VYRGIKYFSGTGEAEKFG

SEQ ID NO: 2045685 - protein, 24 aa, Staphylococcus
VYRKIRNTLRFMLGNINDFNPDTD

SEQ ID NO: 2045686 - protein, 24 aa, Staphylococcus
VYRKIRNTLRFMLGNINDFNPETD

SEQ ID NO: 2045687 - protein, 23 aa, Staphylococcus
VYRKIRNTLRFMLGNINDYNPET

SEQ ID NO: 2045688 - protein, 23 aa, Staphylococcus
VYRKIRNTLRFMLGNVNDFNPDT

SEQ ID NO: 2045689 - protein, 23 aa, Staphylococcus
VYRKIRNTLRFMLGNVNDFNPET

SEQ ID NO: 2045690 - protein, 24 aa, Staphylococcus
VYRKIRNTLRFMLGNVSDFNPETD

SEQ ID NO: 2045691 - protein, 23 aa, Staphylococcus
VYRKIRNTLRFMLGNVSDYNPAT

SEQ ID NO: 2045692 - protein, 20 aa, Staphylococcus
VYRQDFKAAYQRLSETNNFP

SEQ ID NO: 2045693 - protein, 27 aa, Staphylococcus
VYSDKLLKYRFDNHHPFNQMRLKLTTE

SEQ ID NO: 2045694 - protein, 30 aa, Staphylococcus
VYSDRPSEGWTWNDGFVKMDTLEVDGPKLL

SEQ ID NO: 2045695 - protein, 19 aa, Staphylococcus
VYSGFAFGMGPDRIAMLKY

SEQ ID NO: 2045696 - protein, 28 aa, Staphylococcus
VYTARKGLRTGIVADRIGGQVNDTATIE

SEQ ID NO: 2045697 - protein, 19 aa, Staphylococcus
VYTCLAHGITEPSGVIEAP

SEQ ID NO: 2045698 - protein, 20 aa, Staphylococcus
VYTDLLFLYLEKAFLSQNFF

SEQ ID NO: 2045699 - protein, 26 aa, Staphylococcus
VYTDLLFLYLERAFLSQNFFDIPTIH

SEQ ID NO: 2045700 - protein, 23 aa, Staphylococcus
VYTDLLFLYLERAFLTQNFFEIP

SEQ ID NO: 2045701 - protein, 24 aa, Staphylococcus
VYTELPFVVNQAMVDQLPEDNQDV

SEQ ID NO: 2045702 - protein, 18 aa, Staphylococcus
VYTNLGFQFGGKRKNYYG

SEQ ID NO: 2045703 - protein, 17 aa, Staphylococcus
VYTPFIMDETLWKNSGH

SEQ ID NO: 2045704 - protein, 17 aa, Staphylococcus
VYVLPQLHTLLWSNKKG

SEQ ID NO: 2045705 - protein, 17 aa, Staphylococcus
VYVNGVLGQVTFPDSFK

SEQ ID NO: 2045706 - protein, 18 aa, Staphylococcus
VYYDGEAALALLRLYQID

SEQ ID NO: 2045707 - protein, 18 aa, Staphylococcus
VYYEWLAQLSEALETGEI

SEQ ID NO: 2045708 - protein, 17 aa, Staphylococcus
VYYREVVRFHQLNVHPF

SEQ ID NO: 2045709 - protein, 17 aa, Staphylococcus
VYYRSGEFRAEEVPSAI

SEQ ID NO: 2045710 - protein, 24 aa, Staphylococcus
VYYYCNLSSPFVCDEEALKYIDYD

SEQ ID NO: 2045711 - protein, 33 aa, Staphylococcus
WADAIKARMPKAKKAIVVGGGYIGIEAAEAFAK

SEQ ID NO: 2045712 - protein, 17 aa, Staphylococcus
WADERHFTGIDFLGVSY

SEQ ID NO: 2045713 - protein, 18 aa, Staphylococcus
WADIDAWIKNDLTWKTMK

SEQ ID NO: 2045714 - protein, 19 aa, Staphylococcus
WADIDAWVKNNLKWRTIKK

SEQ ID NO: 2045715 - protein, 21 aa, Staphylococcus
WAEDTARLSVRMNAETPQDIE

SEQ ID NO: 2045716 - protein, 20 aa, Staphylococcus
WAEGQLPYLIELGAIEVHRD

SEQ ID NO: 2045717 - protein, 24 aa, Staphylococcus
WAENLKFPMAVIDEVLKAKKDYAS

SEQ ID NO: 2045718 - protein, 32 aa, Staphylococcus
WAEPEGMDTWDFAHCLPYFKKLETTYGASPYD

SEQ ID NO: 2045719 - protein, 32 aa, Staphylococcus
WAEPEGMESWDFAHCLPYFKKLEKTFGAAPHD

SEQ ID NO: 2045720 - protein, 32 aa, Staphylococcus
WAEPEGMESWDFAHCLPYFKRLEKTYGATPFD

SEQ ID NO: 2045721 - protein, 32 aa, Staphylococcus
WAEPEGMETWDFAHCLPYFKKLEKTFGAAPYD

SEQ ID NO: 2045722 - protein, 31 aa, Staphylococcus
WAEPEGMETWDFAHCLPYFKKLETTYGSAPY

SEQ ID NO: 2045723 - protein, 25 aa, Staphylococcus
WAETKKLTGWYSRRIAVGENGEIKG

SEQ ID NO: 2045724 - protein, 24 aa, Staphylococcus
WAETKRLTGWYSKRVAVGEDGEIK

SEQ ID NO: 2045725 - protein, 24 aa, Staphylococcus
WAETKRLTGWYSKRVAVGENGEIK

SEQ ID NO: 2045726 - protein, 18 aa, Staphylococcus
WAGFKAVINYAKKYYKLL

SEQ ID NO: 2045727 - protein, 19 aa, Staphylococcus
WAGIDRGALILVEHGINPV

SEQ ID NO: 2045728 - protein, 20 aa, Staphylococcus
WAGVPTEVHVASEFVYNMPL

SEQ ID NO: 2045729 - protein, 20 aa, Staphylococcus
WAGVPTEVHVASEFVYNTPL

SEQ ID NO: 2045730 - protein, 17 aa, Staphylococcus
WAIAAALVRPNTQVVSV

SEQ ID NO: 2045731 - protein, 21 aa, Staphylococcus
WAINKRNFFSTTFMSLYNSFI

SEQ ID NO: 2045732 - protein, 17 aa, Staphylococcus
WAKRCLEAHQRPEDQAL

SEQ ID NO: 2045733 - protein, 19 aa, Staphylococcus
WALPDKAFDALWMGVLKLQ

SEQ ID NO: 2045734 - protein, 35 aa, Staphylococcus
WANEWKNYFHPFRASKRFTIVPSWEDYSKESEDEL

SEQ ID NO: 2045735 - protein, 28 aa, Staphylococcus
WAQIMLPIAPKICVEFQHDVINSSKALQ

SEQ ID NO: 2045736 - protein, 17 aa, Staphylococcus
WATLPTVDVKNIRKVPE

SEQ ID NO: 2045737 - protein, 17 aa, Staphylococcus
WATMGVSIADVLAKGVD

SEQ ID NO: 2045738 - protein, 30 aa, Staphylococcus
WAVEEMERRYKLFAKYHVRNITAFNKKASY

SEQ ID NO: 2045739 - protein, 17 aa, Staphylococcus
WAVMKYSPGMPPGANTI

SEQ ID NO: 2045740 - protein, 17 aa, Staphylococcus
WAYDVYGDSIIYSCSFG

SEQ ID NO: 2045741 - protein, 17 aa, Staphylococcus
WAYHEMPDFEQWLKDAE

SEQ ID NO: 2045742 - protein, 17 aa, Staphylococcus
WCEKFNVKIEIKRKKGV

SEQ ID NO: 2045743 - protein, 23 aa, Staphylococcus
WCGDAMMNIPILKHISEALNLEV

SEQ ID NO: 2045744 - protein, 23 aa, Staphylococcus
WCGDAMMNLPILKHIAEALELEV

SEQ ID NO: 2045745 - protein, 26 aa, Staphylococcus
WCGDAMMNLPILKRVSEVLNLEVRVF

SEQ ID NO: 2045746 - protein, 17 aa, Staphylococcus
WCQNTFQVTNQVSVNDT

SEQ ID NO: 2045747 - protein, 19 aa, Staphylococcus
WCRKMRQVSNVPILFLSSR

SEQ ID NO: 2045748 - protein, 19 aa, Staphylococcus
WCRSTTVPHVGNWRDKFFT

SEQ ID NO: 2045749 - protein, 19 aa, Staphylococcus
WCRSTTVPNVGNWRDQFFK

SEQ ID NO: 2045750 - protein, 22 aa, Staphylococcus
WDADARGAIFGLTRGTEKEHFI

SEQ ID NO: 2045751 - protein, 24 aa, Staphylococcus
WDAIKGDEPLSVYHQMSFFIEHED

SEQ ID NO: 2045752 - protein, 17 aa, Staphylococcus
WDDDVLNLLGITRQKLP

SEQ ID NO: 2045753 - protein, 18 aa, Staphylococcus
WDDIVIYMRLERVGTTFK

SEQ ID NO: 2045754 - protein, 17 aa, Staphylococcus
WDEHRELFGDFPSQEFP

SEQ ID NO: 2045755 - protein, 17 aa, Staphylococcus
WDGFQPFKVETIEQVSS

SEQ ID NO: 2045756 - protein, 18 aa, Staphylococcus
WDGNFVKMDTLAVDADDL

SEQ ID NO: 2045757 - protein, 25 aa, Staphylococcus
WDGQHFTFGFSRMFRKECPTCGSNP

SEQ ID NO: 2045758 - protein, 20 aa, Staphylococcus
WDINGELSFEKPSEYYLVSV

SEQ ID NO: 2045759 - protein, 17 aa, Staphylococcus
WDISAQFLFAKELGLKM

SEQ ID NO: 2045760 - protein, 17 aa, Staphylococcus
WDISEHLTLEKPHPYCL

SEQ ID NO: 2045761 - protein, 22 aa, Staphylococcus
WDKSIPLTSSWVEEYQETFEYK

SEQ ID NO: 2045762 - protein, 20 aa, Staphylococcus
WDLNMGGLMNALKTARTYDL

SEQ ID NO: 2045763 - protein, 25 aa, Staphylococcus
WDMLFIALSIHLIDLLKNVSPEEKE

SEQ ID NO: 2045764 - protein, 26 aa, Staphylococcus
WDNNDRPLALCAALLHDLGHGPFSHS

SEQ ID NO: 2045765 - protein, 26 aa, Staphylococcus
WDNRYGCLIGIELLELLKNTELDFDL

SEQ ID NO: 2045766 - protein, 28 aa, Staphylococcus
WDNRYGCLLAIEILKLFKDIQLDVDLYV

SEQ ID NO: 2045767 - protein, 25 aa, Staphylococcus
WDNSDRPLALCAALLHDLGHGPFSH

SEQ ID NO: 2045768 - protein, 25 aa, Staphylococcus
WDNTDRPLALCAALLHDLGHGPFSH

SEQ ID NO: 2045769 - protein, 17 aa, Staphylococcus
WDNVGLLIGDKNKDITG

SEQ ID NO: 2045770 - protein, 19 aa, Staphylococcus
WDNYPVCMAKTQYSFSDDQ

SEQ ID NO: 2045771 - protein, 19 aa, Staphylococcus
WDQVFAVDVKGVFFCTKQL

SEQ ID NO: 2045772 - protein, 25 aa, Staphylococcus
WDREEKAYNAIRNFEGPSYASAKEG

SEQ ID NO: 2045773 - protein, 24 aa, Staphylococcus
WDREEKAYNAIRNFEGPTFATAKE

SEQ ID NO: 2045774 - protein, 25 aa, Staphylococcus
WDREEKAYNAIRNFGGTTFESAKAG

SEQ ID NO: 2045775 - protein, 26 aa, Staphylococcus
WDREQKAYNAIRAFEGPQFASAEEGV

SEQ ID NO: 2045776 - protein, 25 aa, Staphylococcus
WDREQKAYNAIRNFEGPAYASAKEG

SEQ ID NO: 2045777 - protein, 24 aa, Staphylococcus
WDREQKAYNAIRNFEGPTYASAKE

SEQ ID NO: 2045778 - protein, 18 aa, Staphylococcus
WDRKTYRGTELYNKTLGV

SEQ ID NO: 2045779 - protein, 27 aa, Staphylococcus
WDSPFGKGRPGWHIECSVMAYHELGAT

SEQ ID NO: 2045780 - protein, 19 aa, Staphylococcus
WDVNLKKYIDYASDDLLLR

SEQ ID NO: 2045781 - protein, 17 aa, Staphylococcus
WDVTTAILTGNFLLALG

SEQ ID NO: 2045782 - protein, 17 aa, Staphylococcus
WDYERFDFFLEKFNLPV

SEQ ID NO: 2045783 - protein, 24 aa, Staphylococcus
WEAIKGGEPYSVYHDMSFFLKQHN

SEQ ID NO: 2045784 - protein, 23 aa, Staphylococcus
WEDEVFRVIIEYNNVPIGYGQIY

SEQ ID NO: 2045785 - protein, 27 aa, Staphylococcus
WEDLPKIKELWPQAGDYLLVTLRIDSN

SEQ ID NO: 2045786 - protein, 20 aa, Staphylococcus
WEDLPKVKDIWPVSGDYLLV

SEQ ID NO: 2045787 - protein, 21 aa, Staphylococcus
WEDRFPVIMENVIKACEETHS

SEQ ID NO: 2045788 - protein, 19 aa, Staphylococcus
WEEKICKLANKENVLPMNT

SEQ ID NO: 2045789 - protein, 18 aa, Staphylococcus
WEEKLLLIEKGRYNSRHF

SEQ ID NO: 2045790 - protein, 19 aa, Staphylococcus
WEEKLLLIEQGKYNASQFI

SEQ ID NO: 2045791 - protein, 22 aa, Staphylococcus
WEFQITLPYFLSHEDYLIFTNA

SEQ ID NO: 2045792 - protein, 19 aa, Staphylococcus
WEGLNDMYREIAFHGGIPD

SEQ ID NO: 2045793 - protein, 22 aa, Staphylococcus
WEHNPQALAFYKTCGFKVTGQH

SEQ ID NO: 2045794 - protein, 19 aa, Staphylococcus
WEKTKFPELAHKFKTEDGS

SEQ ID NO: 2045795 - protein, 34 aa, Staphylococcus
WENEWKHYFHPFRASEKFTIVPSWETYQQEDDSE

SEQ ID NO: 2045796 - protein, 25 aa, Staphylococcus
WENEWKNYFHPFKASKNFTIVPSWE

SEQ ID NO: 2045797 - protein, 34 aa, Staphylococcus
WENEWKNYFHPFRASEKFTIVPSWEQYTKEDDSE

SEQ ID NO: 2045798 - protein, 26 aa, Staphylococcus
WENEWKNYFHPFRASETFTIVPSWET

SEQ ID NO: 2045799 - protein, 17 aa, Staphylococcus
WENLGIRYGELDDIMSE

SEQ ID NO: 2045800 - protein, 17 aa, Staphylococcus
WEQIGNIQIPCFILTGE

SEQ ID NO: 2045801 - protein, 17 aa, Staphylococcus
WERAESMLKEAVDEMGL

SEQ ID NO: 2045802 - protein, 19 aa, Staphylococcus
WESLYLKKKRFTQLEEISY

SEQ ID NO: 2045803 - protein, 28 aa, Staphylococcus
WESPFGEGRPGWHIECSVMAFHELGKTI

SEQ ID NO: 2045804 - protein, 28 aa, Staphylococcus
WESPFGEGRPGWHIECSVMAFHELGPTI

SEQ ID NO: 2045805 - protein, 28 aa, Staphylococcus
WESPFGEGRPGWHIECSVMAYHELGATI

SEQ ID NO: 2045806 - protein, 20 aa, Staphylococcus
WEYNKDEFKSWCEGHTGFPI

SEQ ID NO: 2045807 - protein, 19 aa, Staphylococcus
WFDESRFQIEHFQKMGRKE

SEQ ID NO: 2045808 - protein, 23 aa, Staphylococcus
WFDEVYTNGWAFKGGSALKDKYF

SEQ ID NO: 2045809 - protein, 17 aa, Staphylococcus
WFEDLRTIFVNKHLNAS

SEQ ID NO: 2045810 - protein, 30 aa, Staphylococcus
WFEEIWNNPNAIVWEGEFIDIIGNSKVGDL

SEQ ID NO: 2045811 - protein, 18 aa, Staphylococcus
WFEKEAKDLLPEGFTHPG

SEQ ID NO: 2045812 - protein, 18 aa, Staphylococcus
WFELCKKLEGLPRHTSTH

SEQ ID NO: 2045813 - protein, 24 aa, Staphylococcus
WFEREAKELLPEGFTHPGSPNGEF

SEQ ID NO: 2045814 - protein, 25 aa, Staphylococcus
WFETHMKTIGANVLVTAHHQDDQLE

SEQ ID NO: 2045815 - protein, 18 aa, Staphylococcus
WFFKGFDLYIEYDAQKDE

SEQ ID NO: 2045816 - protein, 18 aa, Staphylococcus
WFFKGLDLLVEYNPETDE

SEQ ID NO: 2045817 - protein, 19 aa, Staphylococcus
WFFSQEFHNIHHWNQSNEF

SEQ ID NO: 2045818 - protein, 20 aa, Staphylococcus
WFGFDNFKAGQKEIIKSVLD

SEQ ID NO: 2045819 - protein, 18 aa, Staphylococcus
WFGFDSFKPGQEDIISSV

SEQ ID NO: 2045820 - protein, 18 aa, Staphylococcus
WFGFSSFNPGQKEIIESI

SEQ ID NO: 2045821 - protein, 18 aa, Staphylococcus
WFGHESFHPGQKEVIESV

SEQ ID NO: 2045822 - protein, 17 aa, Staphylococcus
WFGKKGRGLYQKVRGID

SEQ ID NO: 2045823 - protein, 23 aa, Staphylococcus
WFGQLPGRVSGWFESTKKHTDDK

SEQ ID NO: 2045824 - protein, 17 aa, Staphylococcus
WFHERGYSFFEYQYTSK

SEQ ID NO: 2045825 - protein, 19 aa, Staphylococcus
WFIENGLSFYNYMFNTQLV

SEQ ID NO: 2045826 - protein, 17 aa, Staphylococcus
WFIIGMYELSKYLTNEL

SEQ ID NO: 2045827 - protein, 18 aa, Staphylococcus
WFIIGMYELSKYLTNELI

SEQ ID NO: 2045828 - protein, 21 aa, Staphylococcus
WFINFYHLIMAQQFGRESHAR

SEQ ID NO: 2045829 - protein, 27 aa, Staphylococcus
WFINGRIDFQVKFNGYRMELEEIEFQL

SEQ ID NO: 2045830 - protein, 17 aa, Staphylococcus
WFIQGRIDFQIKMNGYR

SEQ ID NO: 2045831 - protein, 18 aa, Staphylococcus
WFIQGRIDFQIKMNGYRM

SEQ ID NO: 2045832 - protein, 26 aa, Staphylococcus
WFLNPDHMPLIIGIEKGWFADAQLDV

SEQ ID NO: 2045833 - protein, 19 aa, Staphylococcus
WFNLLNLNLGYRVLKYPLN

SEQ ID NO: 2045834 - protein, 25 aa, Staphylococcus
WFPNAKENIILFCPVEKEHTFNSQH

SEQ ID NO: 2045835 - protein, 17 aa, Staphylococcus
WFQDQRMYYRPSSEESA

SEQ ID NO: 2045836 - protein, 18 aa, Staphylococcus
WFRPESYYTDKPWRGQMA

SEQ ID NO: 2045837 - protein, 24 aa, Staphylococcus
WFTIAVYELGKWLGRELYYKLSAN

SEQ ID NO: 2045838 - protein, 17 aa, Staphylococcus
WFYSRSKGRLWKKGESS

SEQ ID NO: 2045839 - protein, 18 aa, Staphylococcus
WGAPFPVIEIVKRGISKA

SEQ ID NO: 2045840 - protein, 19 aa, Staphylococcus
WGAQKEVIQLIPGLENVDI

SEQ ID NO: 2045841 - protein, 19 aa, Staphylococcus
WGAQKEVIQLIPGLENVEI

SEQ ID NO: 2045842 - protein, 20 aa, Staphylococcus
WGELDYLILDLPPGTGDVAL

SEQ ID NO: 2045843 - protein, 20 aa, Staphylococcus
WGGTALRDKFDYDIPNELTG

SEQ ID NO: 2045844 - protein, 24 aa, Staphylococcus
WGISAHPNGKCEILNEPYRGQTLD

SEQ ID NO: 2045845 - protein, 17 aa, Staphylococcus
WGKLEISNDDFIRTTEI

SEQ ID NO: 2045846 - protein, 20 aa, Staphylococcus
WGKRRLAYEIEDFKEGFYNI

SEQ ID NO: 2045847 - protein, 21 aa, Staphylococcus
WGKRRLAYEIEDFKEGFYNIV

SEQ ID NO: 2045848 - protein, 21 aa, Staphylococcus
WGKRRLAYEIEDFKEGYYYIV

SEQ ID NO: 2045849 - protein, 25 aa, Staphylococcus
WGNVSEINRDLGIVVIKPSGVDYEK

SEQ ID NO: 2045850 - protein, 19 aa, Staphylococcus
WGQIPALYYVASETIEVKD

SEQ ID NO: 2045851 - protein, 17 aa, Staphylococcus
WGSGLAVLSGQSGVGKS

SEQ ID NO: 2045852 - protein, 20 aa, Staphylococcus
WGSSTLASFSNWVGINHGTT

SEQ ID NO: 2045853 - protein, 17 aa, Staphylococcus
WGTPREFDFEPKAHWDL

SEQ ID NO: 2045854 - protein, 17 aa, Staphylococcus
WGYFKKWATDEEKQSAQ

SEQ ID NO: 2045855 - protein, 20 aa, Staphylococcus
WHAAGALKDFGLTDHQVDLN

SEQ ID NO: 2045856 - protein, 23 aa, Staphylococcus
WHASGALKLFGLQDHQVDTANTQ

SEQ ID NO: 2045857 - protein, 18 aa, Staphylococcus
WHAVGAFKTVGYSRTGKK

SEQ ID NO: 2045858 - protein, 22 aa, Staphylococcus
WHDAKFPVVQNFNAQGETDAEV

SEQ ID NO: 2045859 - protein, 18 aa, Staphylococcus
WHDMKIVPYAPFEISPAA

SEQ ID NO: 2045860 - protein, 18 aa, Staphylococcus
WHEGVLGIVASKIVETYA

SEQ ID NO: 2045861 - protein, 37 aa, Staphylococcus
WHGLPLTDAFLFSRGHFKGNQFPEGVNAFSPQIIIGA

SEQ ID NO: 2045862 - protein, 30 aa, Staphylococcus
WHGLPLTEAFLFSRGHFKGNQMPEGVNAFS

SEQ ID NO: 2045863 - protein, 22 aa, Staphylococcus
WHGTPLKCMGLDIEDSLRGSQN

SEQ ID NO: 2045864 - protein, 25 aa, Staphylococcus
WHHDGGFNLRDLLSFVDIEQPLLSS

SEQ ID NO: 2045865 - protein, 29 aa, Staphylococcus
WHIHRMLEAAEALPINVGFTGKGQAVNHT

SEQ ID NO: 2045866 - protein, 18 aa, Staphylococcus
WHIKIAYDKFIIMAKYQQ

SEQ ID NO: 2045867 - protein, 17 aa, Staphylococcus
WHLAHDRIIIPKSKTPS

SEQ ID NO: 2045868 - protein, 17 aa, Staphylococcus
WHLGKILNGKQFLEDQH

SEQ ID NO: 2045869 - protein, 17 aa, Staphylococcus
WHLGRILNGKQLLDDQK

SEQ ID NO: 2045870 - protein, 17 aa, Staphylococcus
WHLGRILNGKQLLEDQR

SEQ ID NO: 2045871 - protein, 18 aa, Staphylococcus
WHLGRILNGKSLLEDQAY

SEQ ID NO: 2045872 - protein, 17 aa, Staphylococcus
WHPKAWNYAPRPIKLDI

SEQ ID NO: 2045873 - protein, 18 aa, Staphylococcus
WHPNAWHYAPEPKYMAPS

SEQ ID NO: 2045874 - protein, 23 aa, Staphylococcus
WHPTQMLADFMTLKEEWGTLKGK

SEQ ID NO: 2045875 - protein, 18 aa, Staphylococcus
WHRIHPLLEELPVASLDL

SEQ ID NO: 2045876 - protein, 26 aa, Staphylococcus
WHYIETRLQLTLPYEHNSLYVEIYPF

SEQ ID NO: 2045877 - protein, 21 aa, Staphylococcus
WIAEYRKIYEPQTVKDIFAES

SEQ ID NO: 2045878 - protein, 18 aa, Staphylococcus
WIATAPHVLILDEPTRGI

SEQ ID NO: 2045879 - protein, 19 aa, Staphylococcus
WIDLKKEMAEMYPVLVNDV

SEQ ID NO: 2045880 - protein, 19 aa, Staphylococcus
WIEGDKGVWNYTLFIQNGR

SEQ ID NO: 2045881 - protein, 17 aa, Staphylococcus
WIEGFDIECRNEESIHQ

SEQ ID NO: 2045882 - protein, 25 aa, Staphylococcus
WIEKLKFAKELGFDFVELSIDESDT

SEQ ID NO: 2045883 - protein, 21 aa, Staphylococcus
WIERHAHRFNKTVLMGVGGSI

SEQ ID NO: 2045884 - protein, 23 aa, Staphylococcus
WIESKYLLPTPFEVEAKATLSFR

SEQ ID NO: 2045885 - protein, 32 aa, Staphylococcus; identical to SEQ ID NO: 1814650

SEQ ID NO: 2045886 - protein, 29 aa, Staphylococcus
WIHERTKFGIKPGVKRMEWMLDRLNNPQL

SEQ ID NO: 2045887 - protein, 30 aa, Staphylococcus
WIHERTKFGIKPGVKRMEWMLERLNNPQFN

SEQ ID NO: 2045888 - protein, 29 aa, Staphylococcus
WIHERTKFGIKPGVKRMEWMLNHLNNPQL

SEQ ID NO: 2045889 - protein, 27 aa, Staphylococcus
WIHERTKFGIKPGVKRVEWMLEKLNNP

SEQ ID NO: 2045890 - protein, 26 aa, Staphylococcus
WIHPDERSAAFFALGLIKGSERPVAI

SEQ ID NO: 2045891 - protein, 27 aa, Staphylococcus
WIHPDERSAAFFALGLIKGSERPVAIL

SEQ ID NO: 2045892 - protein, 26 aa, Staphylococcus
WIHPDERSAAFFALGLIKGSKKPVAI

SEQ ID NO: 2045893 - protein, 26 aa, Staphylococcus
WIHPDERSAAFFALGLIKGSQRPVAI

SEQ ID NO: 2045894 - protein, 24 aa, Staphylococcus
WIKEPKVKCIFRVIKRYIYSLFKR

SEQ ID NO: 2045895 - protein, 23 aa, Staphylococcus
WIKETPETFKFVVKIHQALTLHA

SEQ ID NO: 2045896 - protein, 19 aa, Staphylococcus
WIKHELVIVNGKAIKANYK

SEQ ID NO: 2045897 - protein, 25 aa, Staphylococcus
WIKTVKILFEYFIANDYWKYHDHWL

SEQ ID NO: 2045898 - protein, 22 aa, Staphylococcus
WILHIPSCYLGIAQAARDYAVH

SEQ ID NO: 2045899 - protein, 17 aa, Staphylococcus
WILHIPSTYLGIAQAAR

SEQ ID NO: 2045900 - protein, 18 aa, Staphylococcus
WILIDLVNVVVHVFHKDE

SEQ ID NO: 2045901 - protein, 17 aa, Staphylococcus
WINEIARIHEHLISENE

SEQ ID NO: 2045902 - protein, 28 aa, Staphylococcus
WINGFTPKYSMSVWMGFNKVKQYGENSF

SEQ ID NO: 2045903 - protein, 24 aa, Staphylococcus
WINGRMPLIGIGSVFTADDALNAV

SEQ ID NO: 2045904 - protein, 17 aa, Staphylococcus
WINSRKGLSSNERGHNK

SEQ ID NO: 2045905 - protein, 19 aa, Staphylococcus
WIQEYATILYQIWKKKHKK

SEQ ID NO: 2045906 - protein, 18 aa, Staphylococcus
WIQNGAAIFVCGDEKQMA

SEQ ID NO: 2045907 - protein, 19 aa, Staphylococcus
WIRELRYAEEHNYKFLQPT

SEQ ID NO: 2045908 - protein, 18 aa, Staphylococcus
WITRYEARFQPKQIEDFE

SEQ ID NO: 2045909 - protein, 26 aa, Staphylococcus
WIVAGRGELHLSILIENMRREGFELQ

SEQ ID NO: 2045910 - protein, 19 aa, Staphylococcus
WIVGIMLPRMKEHHIVDET

SEQ ID NO: 2045911 - protein, 18 aa, Staphylococcus
WIYKQLPNIEEWRRDVQR

SEQ ID NO: 2045912 - protein, 33 aa, Staphylococcus
WIYLVKHLRQAGVTIELLVEFCRLGQLPKDEAV

SEQ ID NO: 2045913 - protein, 23 aa, Staphylococcus
WIYNFNACPVVRVNINEYDLHES

SEQ ID NO: 2045914 - protein, 27 aa, Staphylococcus
WKAKSFSIRGGDKMAIIGSNGTGKTTF

SEQ ID NO: 2045915 - protein, 19 aa, Staphylococcus
WKAMELGWKVVPSVKSNAI

SEQ ID NO: 2045916 - protein, 18 aa, Staphylococcus
WKAYEGKKNVAIIGMGGL

SEQ ID NO: 2045917 - protein, 18 aa, Staphylococcus
WKDEIREAIDQSKATNMD

SEQ ID NO: 2045918 - protein, 20 aa, Staphylococcus
WKDGELLPETVVDRIFEDIE

SEQ ID NO: 2045919 - protein, 19 aa, Staphylococcus
WKDIFIYRRMDHIRDELLR

SEQ ID NO: 2045920 - protein, 18 aa, Staphylococcus
WKDKVGVRELDYFNEESM

SEQ ID NO: 2045921 - protein, 18 aa, Staphylococcus
WKDLGQHISQLVPIENDE

SEQ ID NO: 2045922 - protein, 18 aa, Staphylococcus
WKDTFIAHNHFISCAGGI

SEQ ID NO: 2045923 - protein, 21 aa, Staphylococcus
WKDVTDIIAAQLLYTIKKDGP

SEQ ID NO: 2045924 - protein, 21 aa, Staphylococcus
WKDVVPCEIHKHYERPHISIE

SEQ ID NO: 2045925 - protein, 20 aa, Staphylococcus
WKEKGNWKIPIKTLNKTLTK

SEQ ID NO: 2045926 - protein, 17 aa, Staphylococcus
WKEKTFYHFSTEPENDI

SEQ ID NO: 2045927 - protein, 17 aa, Staphylococcus
WKELGQHVSQIVPLDEG

SEQ ID NO: 2045928 - protein, 20 aa, Staphylococcus
WKETEIFFDKLMDLLKFMIP

SEQ ID NO: 2045929 - protein, 18 aa, Staphylococcus
WKETEIFFDKLTDLLKYM

SEQ ID NO: 2045930 - protein, 20 aa, Staphylococcus
WKETEIFFEKLMDLLKFMIP

SEQ ID NO: 2045931 - protein, 18 aa, Staphylococcus
WKETNIFYEKLIDLLKFM

SEQ ID NO: 2045932 - protein, 22 aa, Staphylococcus
WKFNPEESWHGFNGYGKDQYFV

SEQ ID NO: 2045933 - protein, 27 aa, Staphylococcus
WKIAPALATGCSLIMKPSEITPLTTIR

SEQ ID NO: 2045934 - protein, 18 aa, Staphylococcus
WKIEEAVLYEMKKNPVDY

SEQ ID NO: 2045935 - protein, 18 aa, Staphylococcus
WKIFYHKMTLMHDALVYR

SEQ ID NO: 2045936 - protein, 18 aa, Staphylococcus
WKISRLLKTDRIILRMAA

SEQ ID NO: 2045937 - protein, 17 aa, Staphylococcus
WKITPLRDFWGINKKTE

SEQ ID NO: 2045938 - protein, 19 aa, Staphylococcus
WKKEIWEDGSEWQGHQKGS

SEQ ID NO: 2045939 - protein, 17 aa, Staphylococcus
WKKGEETDDDMARDHQE

SEQ ID NO: 2045940 - protein, 19 aa, Staphylococcus
WKKRIPRFDIDINETHSIF

SEQ ID NO: 2045941 - protein, 20 aa, Staphylococcus
WKKSRRLGISLSGTGKELEK

SEQ ID NO: 2045942 - protein, 21 aa, Staphylococcus
WKKSRRLGISLSGTGKELEKR

SEQ ID NO: 2045943 - protein, 27 aa, Staphylococcus
WKLAPALATGCSLVMKPSEITPLTTIR

SEQ ID NO: 2045944 - protein, 25 aa, Staphylococcus
WKLEDLPIIPKHMKTIVIGKTSKQF

SEQ ID NO: 2045945 - protein, 21 aa, Staphylococcus
WKNEEYYGFGAGASGYVNGKR

SEQ ID NO: 2045946 - protein, 19 aa, Staphylococcus
WKNELYVDNNFVFTDNNGY

SEQ ID NO: 2045947 - protein, 24 aa, Staphylococcus
WKNNELGKLLSIISGHSPSYYSEG

SEQ ID NO: 2045948 - protein, 18 aa, Staphylococcus
WKPVIFDCESQQLVVPNG

SEQ ID NO: 2045949 - protein, 17 aa, Staphylococcus
WKPVIHDAISHRLVVPN

SEQ ID NO: 2045950 - protein, 24 aa, Staphylococcus
WKQHDVKLVFFLAIAKKDAQMMKN

SEQ ID NO: 2045951 - protein, 20 aa, Staphylococcus
WKQKEYLASELYDLTEQEKR

SEQ ID NO: 2045952 - protein, 21 aa, Staphylococcus
WKRKNLIPDEWFIRKSTFTGQ

SEQ ID NO: 2045953 - protein, 18 aa, Staphylococcus
WKSNINFSKKDGIVSLIL

SEQ ID NO: 2045954 - protein, 19 aa, Staphylococcus
WKSWGPYLLSGKDVYGSTI

SEQ ID NO: 2045955 - protein, 18 aa, Staphylococcus
WKTEKGIIDYLLTFDSQL

SEQ ID NO: 2045956 - protein, 19 aa, Staphylococcus
WKTEKGIINYLLGVDVELF

SEQ ID NO: 2045957 - protein, 17 aa, Staphylococcus
WKTEKGIVNYLLGVDVE

SEQ ID NO: 2045958 - protein, 18 aa, Staphylococcus
WKTKAEIMQQDLKKVGIK

SEQ ID NO: 2045959 - protein, 18 aa, Staphylococcus
WKTKAEIMQQDLKNVGIH

SEQ ID NO: 2045960 - protein, 17 aa, Staphylococcus
WKTPLTVNLLDKHQTIF

SEQ ID NO: 2045961 - protein, 19 aa, Staphylococcus
WKTPLYIFEPKVRKAFGIA

SEQ ID NO: 2045962 - protein, 29 aa, Staphylococcus
WKTPPYIFEPKVRKIFGIAGDEAIAGLLY

SEQ ID NO: 2045963 - protein, 19 aa, Staphylococcus
WKTPPYIFEPKVRKVFGVH

SEQ ID NO: 2045964 - protein, 20 aa, Staphylococcus
WKVERPRYYSVNDLQAKVGH

SEQ ID NO: 2045965 - protein, 17 aa, Staphylococcus
WLAGVYINSLNVIHYMH

SEQ ID NO: 2045966 - protein, 18 aa, Staphylococcus
WLAQIEIAMINTRLTTTE

SEQ ID NO: 2045967 - protein, 20 aa, Staphylococcus
WLASGPRAGLAEIAIPENEP

SEQ ID NO: 2045968 - protein, 19 aa, Staphylococcus
WLASGPRAGLAEISIPENE

SEQ ID NO: 2045969 - protein, 18 aa, Staphylococcus
WLDDEIFNIENFRKMGRK

SEQ ID NO: 2045970 - protein, 18 aa, Staphylococcus
WLDKDLIEPFSIRNNEVN

SEQ ID NO: 2045971 - protein, 24 aa, Staphylococcus
WLDKKGFPKLVFQMSEHHSDIGFG

SEQ ID NO: 2045972 - protein, 17 aa, Staphylococcus
WLDNGVLEKADVAFSRD

SEQ ID NO: 2045973 - protein, 20 aa, Staphylococcus
WLDNLKFLVKCLEGSMELEY

SEQ ID NO: 2045974 - protein, 20 aa, Staphylococcus
WLDREIIEPFSIRDNELNFK

SEQ ID NO: 2045975 - protein, 19 aa, Staphylococcus
WLDVEIYRDGYIYEQKFNK

SEQ ID NO: 2045976 - protein, 17 aa, Staphylococcus
WLEAEMVADVWVDAYQV

SEQ ID NO: 2045977 - protein, 23 aa, Staphylococcus
WLEFKDKYLNLFINNQFDNTIQE

SEQ ID NO: 2045978 - protein, 18 aa, Staphylococcus
WLEGVSKGEMIAAEIRLR

SEQ ID NO: 2045979 - protein, 22 aa, Staphylococcus
WLESYLNYFNGAIVIISHDRYF

SEQ ID NO: 2045980 - protein, 17 aa, Staphylococcus
WLETFKIDDRFDRIDYE

SEQ ID NO: 2045981 - protein, 22 aa, Staphylococcus
WLEVYNRNGVVTARAVISHRMP

SEQ ID NO: 2045982 - protein, 25 aa, Staphylococcus
WLGTMGCALPGAIAAKRAYPNRQVV

SEQ ID NO: 2045983 - protein, 28 aa, Staphylococcus
WLGTMGCGLPGAIASKIAFPKRQAISIS

SEQ ID NO: 2045984 - protein, 27 aa, Staphylococcus
WLGTMGCGLPGAMAAKIAYPNRQAVAI

SEQ ID NO: 2045985 - protein, 19 aa, Staphylococcus
WLGYCTNELIQIAPEQKYI

SEQ ID NO: 2045986 - protein, 17 aa, Staphylococcus
WLGYCTNELVQINPQDK

SEQ ID NO: 2045987 - protein, 23 aa, Staphylococcus
WLIDEGYTLLTLPKAYGGEGGTI

SEQ ID NO: 2045988 - protein, 18 aa, Staphylococcus
WLIGTEMNLVNRLKETYT

SEQ ID NO: 2045989 - protein, 18 aa, Staphylococcus
WLKDVLRQIEVAIITQQI

SEQ ID NO: 2045990 - protein, 20 aa, Staphylococcus
WLKEDIDVIITTGGTGIAQR

SEQ ID NO: 2045991 - protein, 18 aa, Staphylococcus
WLKGKASKGSLVYQASDL

SEQ ID NO: 2045992 - protein, 18 aa, Staphylococcus
WLKGKIDLGKKGIININH

SEQ ID NO: 2045993 - protein, 17 aa, Staphylococcus
WLKRDIYNYTDVVKAME

SEQ ID NO: 2045994 - protein, 19 aa, Staphylococcus
WLKSVHRLSIEEFVILYKV

SEQ ID NO: 2045995 - protein, 25 aa, Staphylococcus
WLLNQERFELFLGRTDVNILLDNNE

SEQ ID NO: 2045996 - protein, 21 aa, Staphylococcus
WLLQHFPFLDPQHFVFCGRKN

SEQ ID NO: 2045997 - protein, 19 aa, Staphylococcus
WLMDGGLTQPFSIEKILLG

SEQ ID NO: 2045998 - protein, 17 aa, Staphylococcus
WLNCGYNRWNHNEPLVG

SEQ ID NO: 2045999 - protein, 18 aa, Staphylococcus
WLNCGYNRWNHNEPLVGQ

SEQ ID NO: 2046000 - protein, 19 aa, Staphylococcus
WLNCGYNRWNHNEPLVGQT

SEQ ID NO: 2046001 - protein, 17 aa, Staphylococcus
WLNCGYNRWNHNEPMVG

SEQ ID NO: 2046002 - protein, 19 aa, Staphylococcus
WLNCGYTRWNHNEPLIGQT

SEQ ID NO: 2046003 - protein, 19 aa, Staphylococcus
WLNCGYTRWNHNEPLVGQI

SEQ ID NO: 2046004 - protein, 19 aa, Staphylococcus
WLNCGYTRWNHNEPLVGQT

SEQ ID NO: 2046005 - protein, 19 aa, Staphylococcus
WLNKKLHSHGKRLEKGQFI

SEQ ID NO: 2046006 - protein, 18 aa, Staphylococcus
WLQILPEKKRYSITAMFD

SEQ ID NO: 2046007 - protein, 24 aa, Staphylococcus
WLQILPEKKRYSITVMFDDKGNPL

SEQ ID NO: 2046008 - protein, 19 aa, Staphylococcus
WLQQSTFDFPGKEKLKRLF

SEQ ID NO: 2046009 - protein, 18 aa, Staphylococcus
WLQQSTFNFPDKEKLKRL

SEQ ID NO: 2046010 - protein, 23 aa, Staphylococcus
WLRCDIKSLNLLGNVLAKEFAVK

SEQ ID NO: 2046011 - protein, 24 aa, Staphylococcus
WLRCDIKSLNLLGNVLAKEYAVKY

SEQ ID NO: 2046012 - protein, 20 aa, Staphylococcus
WLRDEIDQLNALLNVEEEEF

SEQ ID NO: 2046013 - protein, 18 aa, Staphylococcus
WLRNGCKESPEVIAENLL

SEQ ID NO: 2046014 - protein, 18 aa, Staphylococcus
WLRVLKPNGKLINIDANY

SEQ ID NO: 2046015 - protein, 17 aa, Staphylococcus
WLSEQQIQVELLNLGGG

SEQ ID NO: 2046016 - protein, 17 aa, Staphylococcus
WLSNFRLLTGSYYSSNT

SEQ ID NO: 2046017 - protein, 19 aa, Staphylococcus
WLSVLPIYHISGLSVILRS

SEQ ID NO: 2046018 - protein, 20 aa, Staphylococcus
WLSVLPIYHISGLSVILRSV

SEQ ID NO: 2046019 - protein, 20 aa, Staphylococcus
WLSVLPIYHISGLSVLLRSM

SEQ ID NO: 2046020 - protein, 19 aa, Staphylococcus
WLTKPIMGPIFAPIVNDAR

SEQ ID NO: 2046021 - protein, 20 aa, Staphylococcus
WLTPFELWKDHQITLRVGED

SEQ ID NO: 2046022 - protein, 20 aa, Staphylococcus
WLTSRGIKATREYFNVPDLF

SEQ ID NO: 2046023 - protein, 17 aa, Staphylococcus
WLVADLLTKQGLQVVNK

SEQ ID NO: 2046024 - protein, 18 aa, Staphylococcus
WLVDEGYTKLTLPKEYGG

SEQ ID NO: 2046025 - protein, 18 aa, Staphylococcus
WLVEEGYSVLTLPKSYGG

SEQ ID NO: 2046026 - protein, 18 aa, Staphylococcus
WLVKEGYTKLTLPKEYGG

SEQ ID NO: 2046027 - protein, 23 aa, Staphylococcus
WLVNEGYTLLTLPKAYGGEGASV

SEQ ID NO: 2046028 - protein, 17 aa, Staphylococcus
WMDPERILEIGYPRNDV

SEQ ID NO: 2046029 - protein, 25 aa, Staphylococcus
WMHRIGDLLIQYSIEHTHGLMPSQW

SEQ ID NO: 2046030 - protein, 18 aa, Staphylococcus
WMKPEQLLEIGYPRNDVL

SEQ ID NO: 2046031 - protein, 17 aa, Staphylococcus
WMKVDIQMVDEFVEKYI

SEQ ID NO: 2046032 - protein, 17 aa, Staphylococcus
WMLKALEPMGDEYLEVV

SEQ ID NO: 2046033 - protein, 22 aa, Staphylococcus
WMLKALEPMGKEYLDVVKEGLN

SEQ ID NO: 2046034 - protein, 19 aa, Staphylococcus
WMRAGAKARSTKQQARIHR

SEQ ID NO: 2046035 - protein, 19 aa, Staphylococcus
WMRAGAKARSTKQQARINR

SEQ ID NO: 2046036 - protein, 24 aa, Staphylococcus
WMSIVLRPDVPFDTITKFNLFMAL

SEQ ID NO: 2046037 - protein, 36 aa, Staphylococcus
WMSIVLRPDVPYAMIPKFNLFIALGIRDAIQQFSRH

SEQ ID NO: 2046038 - protein, 23 aa, Staphylococcus
WMSLLNGCSLLVVPDPIIDIENW

SEQ ID NO: 2046039 - protein, 37 aa, Staphylococcus
WMSVVLRPNVPFDMMPKFNLFIALGIRDAIQAFANDE

SEQ ID NO: 2046040 - protein, 37 aa, Staphylococcus
WMSVVLRPNVSFAMIPKFNLFIALGIRDAIQAFSRDK

SEQ ID NO: 2046041 - protein, 18 aa, Staphylococcus
WMTLKCGIVDLPYGGGKG

SEQ ID NO: 2046042 - protein, 18 aa, Staphylococcus
WMTLKCGIVNLPYGGGKG

SEQ ID NO: 2046043 - protein, 19 aa, Staphylococcus
WMTMKCGITNLPFGGGKGG

SEQ ID NO: 2046044 - protein, 19 aa, Staphylococcus
WMTMKCGIVDLPYGGGKGG

SEQ ID NO: 2046045 - protein, 17 aa, Staphylococcus
WMTTHFDFHSIHDNVLK

SEQ ID NO: 2046046 - protein, 22 aa, Staphylococcus
WNDRPFFSPRDVHQMATHNAVP

SEQ ID NO: 2046047 - protein, 20 aa, Staphylococcus
WNEAEQSLAHVLDDLGLDYS

SEQ ID NO: 2046048 - protein, 25 aa, Staphylococcus
WNELATFKDDYLLKIKNIESSQTEK

SEQ ID NO: 2046049 - protein, 19 aa, Staphylococcus
WNFAFAYSVQLVEAYSSEK

SEQ ID NO: 2046050 - protein, 24 aa, Staphylococcus
WNFINKIWNAARFSIMNIGEEFKF

SEQ ID NO: 2046051 - protein, 25 aa, Staphylococcus
WNFINKIWNAARFSLMNIGEEFKVE

SEQ ID NO: 2046052 - protein, 25 aa, Staphylococcus
WNFINKIWNGARFSLMNIGDEFKFE

SEQ ID NO: 2046053 - protein, 25 aa, Staphylococcus
WNFINKIWNGARFSLMNIGEDFAVE

SEQ ID NO: 2046054 - protein, 25 aa, Staphylococcus
WNFINKIWNGARFSLMNIGEDFKVE

SEQ ID NO: 2046055 - protein, 17 aa, Staphylococcus
WNFTKFLIDRDGNVVKR

SEQ ID NO: 2046056 - protein, 19 aa, Staphylococcus
WNHIKDMWQDQTVLIVEHK

SEQ ID NO: 2046057 - protein, 17 aa, Staphylococcus
WNIEHGVVTIPKSVTPH

SEQ ID NO: 2046058 - protein, 19 aa, Staphylococcus
WNIIRDGKLLYNLEVLFLA

SEQ ID NO: 2046059 - protein, 17 aa, Staphylococcus
WNIKFGKNVFINTNCYL

SEQ ID NO: 2046060 - protein, 22 aa, Staphylococcus
WNIKKLENMISPFYSKWDSHIF

SEQ ID NO: 2046061 - protein, 18 aa, Staphylococcus
WNILKDGKVLYNLEILFL

SEQ ID NO: 2046062 - protein, 21 aa, Staphylococcus
WNIPEGITMDQYLARKKKNSV

SEQ ID NO: 2046063 - protein, 18 aa, Staphylococcus
WNKAESMLKEAVDEMGLP

SEQ ID NO: 2046064 - protein, 19 aa, Staphylococcus
WNKDNRFNNNYSTYAQYNN

SEQ ID NO: 2046065 - protein, 25 aa, Staphylococcus
WNKSHHQLIFFGRYHCIARKPKCDI

SEQ ID NO: 2046066 - protein, 25 aa, Staphylococcus
WNKSHHQLIFFGRYHCLARKPKCDI

SEQ ID NO: 2046067 - protein, 25 aa, Staphylococcus
WNKTHHQLIFFGRYHCLARSPKCDV

SEQ ID NO: 2046068 - protein, 20 aa, Staphylococcus
WNLHMSEIIKRSKNGRDAHY

SEQ ID NO: 2046069 - protein, 23 aa, Staphylococcus
WNLTYKNNFKFISQQNIGEIDKL

SEQ ID NO: 2046070 - protein, 18 aa, Staphylococcus
WNMMEEINEEEDFVVEGP

SEQ ID NO: 2046071 - protein, 19 aa, Staphylococcus
WNMQHGVIVIPKSVTPQRI

SEQ ID NO: 2046072 - protein, 17 aa, Staphylococcus
WNNGYALEDLKVKADTN

SEQ ID NO: 2046073 - protein, 24 aa, Staphylococcus
WNNHDNPRCVSRFGDDRPEYRKLS

SEQ ID NO: 2046074 - protein, 19 aa, Staphylococcus
WNNHYEYVFMNAHEIDFFI

SEQ ID NO: 2046075 - protein, 25 aa, Staphylococcus
WNNKDRPLALCAALLHDLGHGPFSH

SEQ ID NO: 2046076 - protein, 18 aa, Staphylococcus
WNNLGGLYQEFYKTYSNY

SEQ ID NO: 2046077 - protein, 17 aa, Staphylococcus
WNPNYAITYARNRGWTT

SEQ ID NO: 2046078 - protein, 20 aa, Staphylococcus
WNQPMFTDHGTFIIGFSVAK

SEQ ID NO: 2046079 - protein, 25 aa, Staphylococcus
WNRSEFKGTELYHKTLGVIGTGRIG

SEQ ID NO: 2046080 - protein, 25 aa, Staphylococcus
WNSDRFFEVIQRFELPTNVQIKTFS

SEQ ID NO: 2046081 - protein, 24 aa, Staphylococcus
WNSNELQYHRGLLFLKAMELQKLI

SEQ ID NO: 2046082 - protein, 18 aa, Staphylococcus
WNSPEMIMQRALKIANNT

SEQ ID NO: 2046083 - protein, 18 aa, Staphylococcus
WNTANRFMKVSSELPNSD

SEQ ID NO: 2046084 - protein, 20 aa, Staphylococcus
WNTIETRNGFILQSNKVSNI

SEQ ID NO: 2046085 - protein, 20 aa, Staphylococcus
WNTIETRNGFMLQSNKVSNI

SEQ ID NO: 2046086 - protein, 21 aa, Staphylococcus
WNTIETRSGYILQSNKVSNIY

SEQ ID NO: 2046087 - protein, 21 aa, Staphylococcus
WNTMETRNGFILQSNKVSNIY

SEQ ID NO: 2046088 - protein, 26 aa, Staphylococcus
WNTRFKVPHFITSSVLDRSYEKHQKH

SEQ ID NO: 2046089 - protein, 17 aa, Staphylococcus
WNVKLGKNIFVNSNCYF

SEQ ID NO: 2046090 - protein, 17 aa, Staphylococcus
WPAKVSVFDKNVETYQT

SEQ ID NO: 2046091 - protein, 19 aa, Staphylococcus
WPDNVSVFSNKVETYQAIT

SEQ ID NO: 2046092 - protein, 20 aa, Staphylococcus
WPEDEIPVKVVGKMTLNRNV

SEQ ID NO: 2046093 - protein, 26 aa, Staphylococcus
WPELVFPDSEIAFIVLHFGGSLKSQS

SEQ ID NO: 2046094 - protein, 17 aa, Staphylococcus
WPGEVIKEVAFYDYKAK

SEQ ID NO: 2046095 - protein, 17 aa, Staphylococcus
WPHMTVFQNVAYPLKVN

SEQ ID NO: 2046096 - protein, 25 aa, Staphylococcus
WPHVNSQWLRAWRDLLIEKFKESEE

SEQ ID NO: 2046097 - protein, 22 aa, Staphylococcus
WPIDRKGAYVIHRLAGSSEYKG

SEQ ID NO: 2046098 - protein, 17 aa, Staphylococcus
WPIDRKGGYVIHRLAGS

SEQ ID NO: 2046099 - protein, 22 aa, Staphylococcus
WPIDRNNAYVIHRLVGSKDYKG

SEQ ID NO: 2046100 - protein, 20 aa, Staphylococcus
WPKDTEFVYSPFMVEAVISE

SEQ ID NO: 2046101 - protein, 18 aa, Staphylococcus
WPKHPSNPNKGYVGHFLM

SEQ ID NO: 2046102 - protein, 21 aa, Staphylococcus
WPKTMMSKLEPGLFLCGEVLD

SEQ ID NO: 2046103 - protein, 21 aa, Staphylococcus
WPKTMMSKLQPGLFLCGEVLD

SEQ ID NO: 2046104 - protein, 17 aa, Staphylococcus
WPLDKIKALKQEVEDAG

SEQ ID NO: 2046105 - protein, 20 aa, Staphylococcus
WPLTGHPAVQPRHYEWKSRV

SEQ ID NO: 2046106 - protein, 23 aa, Staphylococcus
WPLVRLDHWIALLKARAIENDMY

SEQ ID NO: 2046107 - protein, 19 aa, Staphylococcus
WPNDIYIADKKVCGFLTEM

SEQ ID NO: 2046108 - protein, 19 aa, Staphylococcus
WPNEHRGRVGSGQVGTIAF

SEQ ID NO: 2046109 - protein, 19 aa, Staphylococcus
WPNNVSVFSNRVETYQAIT

SEQ ID NO: 2046110 - protein, 19 aa, Staphylococcus
WPSGLIVLSGQSGVGKTTF

SEQ ID NO: 2046111 - protein, 20 aa, Staphylococcus
WPTASAALGRTMTATAMMGA

SEQ ID NO: 2046112 - protein, 19 aa, Staphylococcus
WPTASAALGRTMTATLMMG

SEQ ID NO: 2046113 - protein, 20 aa, Staphylococcus
WPTNNKEFFEGRKISWEELV

SEQ ID NO: 2046114 - protein, 19 aa, Staphylococcus
WPVKREGAYVIHRLAGNPE

SEQ ID NO: 2046115 - protein, 20 aa, Staphylococcus
WPYEDLVRIFYRYGEEKFSK

SEQ ID NO: 2046116 - protein, 27 aa, Staphylococcus
WPYNTEFFYSPYLIQAMKAHYVSKIYF

SEQ ID NO: 2046117 - protein, 25 aa, Staphylococcus
WQAPPRLQNGTSWFYFATDQWKYEE

SEQ ID NO: 2046118 - protein, 17 aa, Staphylococcus
WQEMIEYGVKNGLIKNQ

SEQ ID NO: 2046119 - protein, 23 aa, Staphylococcus
WQEWLKDGVLEKMNVAFSRDTDQ

SEQ ID NO: 2046120 - protein, 19 aa, Staphylococcus
WQEYWAFESRFVVLNYLDQ

SEQ ID NO: 2046121 - protein, 23 aa, Staphylococcus
WQGFKNGRWNKHVDVREFIQLNY

SEQ ID NO: 2046122 - protein, 32 aa, Staphylococcus
WQGLPLTEAFLFSRGHFKGNRMPEGVNALSPQ

SEQ ID NO: 2046123 - protein, 25 aa, Staphylococcus
WQGPPRLQNGTSWFYFTTDQWKYEE

SEQ ID NO: 2046124 - protein, 20 aa, Staphylococcus
WQHKWLKKPETHLTIDREAQ

SEQ ID NO: 2046125 - protein, 17 aa, Staphylococcus
WQILKSLPTDINYLIAG

SEQ ID NO: 2046126 - protein, 22 aa, Staphylococcus
WQINEGEKWMLYGLNGAGKTTL

SEQ ID NO: 2046127 - protein, 22 aa, Staphylococcus
WQKSAKIILKLGGKGTVVGLAA

SEQ ID NO: 2046128 - protein, 17 aa, Staphylococcus
WQLRFDRHHETYRMLMA

SEQ ID NO: 2046129 - protein, 24 aa, Staphylococcus
WQNFWKTFASQWLKDLNINEENMR

SEQ ID NO: 2046130 - protein, 20 aa, Staphylococcus
WQQLAKRKKASLKFIPMTDQ

SEQ ID NO: 2046131 - protein, 20 aa, Staphylococcus
WQQLAKRKKATLKFIPMTDD

SEQ ID NO: 2046132 - protein, 18 aa, Staphylococcus
WQRVRFEFNNGIIESVMD

SEQ ID NO: 2046133 - protein, 20 aa, Staphylococcus
WQSGTKYRLNVHDADMNEVE

SEQ ID NO: 2046134 - protein, 24 aa, Staphylococcus
WQVVPRAWSHIFLALINKPIQEGP

SEQ ID NO: 2046135 - protein, 34 aa, Staphylococcus
WQYKHVIAKFFESWVSENWLLPTPLTIEAKATES

SEQ ID NO: 2046136 - protein, 18 aa, Staphylococcus
WRDWLRHVFEQDIANLSI

SEQ ID NO: 2046137 - protein, 20 aa, Staphylococcus
WREAHIAFFKPYYESLEIDF

SEQ ID NO: 2046138 - protein, 21 aa, Staphylococcus
WRGPMLGKMLTNFFVEVKWGE

SEQ ID NO: 2046139 - protein, 22 aa, Staphylococcus
WRGPMLGKMLTNFFVEVKWGEL

SEQ ID NO: 2046140 - protein, 19 aa, Staphylococcus
WRHIVLKTRLDQAFMEQIP

SEQ ID NO: 2046141 - protein, 20 aa, Staphylococcus
WRIISHANLSIVNFRYENSD

SEQ ID NO: 2046142 - protein, 28 aa, Staphylococcus
WRKFIEAFPKYKGVQFEAWSFGVDEDEL

SEQ ID NO: 2046143 - protein, 19 aa, Staphylococcus
WRLIPEVWDNGIATEGAKA

SEQ ID NO: 2046144 - protein, 24 aa, Staphylococcus
WRLIPEVWGNGFATEGAAAVLKYA

SEQ ID NO: 2046145 - protein, 21 aa, Staphylococcus
WRLIPEVWGNGIATEGAEAVL

SEQ ID NO: 2046146 - protein, 24 aa, Staphylococcus
WRLIPEVWGNGIATEGAEAVLKYA

SEQ ID NO: 2046147 - protein, 25 aa, Staphylococcus
WRLIPEVWGNGIATEGAMAVLEYAK

SEQ ID NO: 2046148 - protein, 21 aa, Staphylococcus
WRLIPEVWGNGLATEGAQAVL

SEQ ID NO: 2046149 - protein, 20 aa, Staphylococcus
WRLIPEVWGNGLATEGATAV

SEQ ID NO: 2046150 - protein, 19 aa, Staphylococcus
WRMTEGIDLIVPEVNEPKL

SEQ ID NO: 2046151 - protein, 23 aa, Staphylococcus
WRNETISNFKNVLSFTNGIEDKM

SEQ ID NO: 2046152 - protein, 17 aa, Staphylococcus
WRNGYIQSIAAYIRRID

SEQ ID NO: 2046153 - protein, 20 aa, Staphylococcus
WRNSNRCIGRLFWDSLNVED

SEQ ID NO: 2046154 - protein, 19 aa, Staphylococcus
WRPTGYKYPLVAGALSKDA

SEQ ID NO: 2046155 - protein, 18 aa, Staphylococcus
WRRMFHQYPELSKYEYKT

SEQ ID NO: 2046156 - protein, 23 aa, Staphylococcus
WRSEYHNCPLILGSATPSLETYA

SEQ ID NO: 2046157 - protein, 22 aa, Staphylococcus
WRSQFHQCPLILGSATPSLESY

SEQ ID NO: 2046158 - protein, 17 aa, Staphylococcus
WRTVLDFCDTKILHLEE

SEQ ID NO: 2046159 - protein, 17 aa, Staphylococcus
WRYINQPSTDTGWIPLP

SEQ ID NO: 2046160 - protein, 17 aa, Staphylococcus
WRYMLEKCETLLAESKC

SEQ ID NO: 2046161 - protein, 30 aa, Staphylococcus
WRYQHVPEKLWPIQPLRDFWGINRKTEAKL

SEQ ID NO: 2046162 - protein, 18 aa, Staphylococcus
WSADSKFNDDERFSNYGK

SEQ ID NO: 2046163 - protein, 19 aa, Staphylococcus
WSAEGDVEGLNIFPGNIIP

SEQ ID NO: 2046164 - protein, 19 aa, Staphylococcus
WSDAQFPVVQNVHAQGETD

SEQ ID NO: 2046165 - protein, 17 aa, Staphylococcus
WSEIMGADLVLDYKEDM

SEQ ID NO: 2046166 - protein, 17 aa, Staphylococcus
WSELGYIPKEDVQKIRQ

SEQ ID NO: 2046167 - protein, 24 aa, Staphylococcus
WSGFKVVINYAKKYFGLRTDPTIS

SEQ ID NO: 2046168 - protein, 21 aa, Staphylococcus
WSHLGKSFILPAIIPTKYQLM

SEQ ID NO: 2046169 - protein, 21 aa, Staphylococcus
WSKGEIEAVPGRTMPNFTVVE

SEQ ID NO: 2046170 - protein, 17 aa, Staphylococcus
WSKGEVEGMPGKTMPNF

SEQ ID NO: 2046171 - protein, 22 aa, Staphylococcus
WSKGIPFETIVEAVKTLEPVEG

SEQ ID NO: 2046172 - protein, 17 aa, Staphylococcus
WSKRFLRKLDYLIHPTF

SEQ ID NO: 2046173 - protein, 18 aa, Staphylococcus
WSKTAFILPETLKQYAPS

SEQ ID NO: 2046174 - protein, 19 aa, Staphylococcus
WSNEEMVDVIAFFNKIENY

SEQ ID NO: 2046175 - protein, 18 aa, Staphylococcus
WSNGDFGLQAPDTEPYKT

SEQ ID NO: 2046176 - protein, 21 aa, Staphylococcus
WSNKKRLAMVGQYKRTKPDID

SEQ ID NO: 2046177 - protein, 29 aa, Staphylococcus
WSQFGEKLILPALFPSKFQTIKIPKDKMK

SEQ ID NO: 2046178 - protein, 17 aa, Staphylococcus
WSREEEIDYAIQHNIPV

SEQ ID NO: 2046179 - protein, 19 aa, Staphylococcus
WSREEEIDYALKHNIPVSI

SEQ ID NO: 2046180 - protein, 28 aa, Staphylococcus
WSSPFGEGRPGWHIECSVMAYHELGKTI

SEQ ID NO: 2046181 - protein, 19 aa, Staphylococcus
WSSQLLKQYQLPRVVVGVK

SEQ ID NO: 2046182 - protein, 20 aa, Staphylococcus
WSTGNLPYLVELGAIEVALP

SEQ ID NO: 2046183 - protein, 17 aa, Staphylococcus
WSVKRLKEAGADAVKLL

SEQ ID NO: 2046184 - protein, 25 aa, Staphylococcus
WSVNKWEVLNAIDAELARRHSAQGQ

SEQ ID NO: 2046185 - protein, 17 aa, Staphylococcus
WSVVVDGKLFVRAYNGQ

SEQ ID NO: 2046186 - protein, 17 aa, Staphylococcus
WTDAQWNSIYAKGQDIL

SEQ ID NO: 2046187 - protein, 18 aa, Staphylococcus
WTDERFLKQWFMTTERTN

SEQ ID NO: 2046188 - protein, 20 aa, Staphylococcus
WTDINLLKQWFMTSQRTNKL

SEQ ID NO: 2046189 - protein, 20 aa, Staphylococcus
WTDLPVKFEAGTPLIAQAIG

SEQ ID NO: 2046190 - protein, 20 aa, Staphylococcus
WTEFAVADGRIITGQNPQSG

SEQ ID NO: 2046191 - protein, 24 aa, Staphylococcus
WTHKPLRFTVEGNPYVSRMRKSDM

SEQ ID NO: 2046192 - protein, 19 aa, Staphylococcus
WTIKKLENIISPFYQDWDS

SEQ ID NO: 2046193 - protein, 17 aa, Staphylococcus
WTIKKLENIVAPFYNNW

SEQ ID NO: 2046194 - protein, 26 aa, Staphylococcus
WTISRQLWWGHQIPAWYHKETGEIFV

SEQ ID NO: 2046195 - protein, 26 aa, Staphylococcus
WTISRQLWWGHQIPAWYHKETGEIYV

SEQ ID NO: 2046196 - protein, 21 aa, Staphylococcus
WTKDKHIVLAVSTGVDSMVLL

SEQ ID NO: 2046197 - protein, 18 aa, Staphylococcus
WTKDYKQTLMLSRIQSTQ

SEQ ID NO: 2046198 - protein, 17 aa, Staphylococcus
WTKLGTSIVSIVENGVG

SEQ ID NO: 2046199 - protein, 25 aa, Staphylococcus
WTKSHHQLIFFGRYHCLARAPKCDI

SEQ ID NO: 2046200 - protein, 19 aa, Staphylococcus
WTLDQVVEYFFNWLNKTKG

SEQ ID NO: 2046201 - protein, 19 aa, Staphylococcus
WTLLKGLDQSIPFLIAGGI

SEQ ID NO: 2046202 - protein, 18 aa, Staphylococcus
WTLSQLVDYFMTWLGNTK

SEQ ID NO: 2046203 - protein, 17 aa, Staphylococcus
WTNMLLRMYQRYCEQKG

SEQ ID NO: 2046204 - protein, 19 aa, Staphylococcus
WTNNQFLPRREVVNIEDFE

SEQ ID NO: 2046205 - protein, 18 aa, Staphylococcus
WTPSYKQLIMTSRIQSTQ

SEQ ID NO: 2046206 - protein, 18 aa, Staphylococcus
WTQSRYGYHFPQEQLVFS

SEQ ID NO: 2046207 - protein, 26 aa, Staphylococcus
WTSRLDAMKDKIDWRDDLPDLDYSKI

SEQ ID NO: 2046208 - protein, 21 aa, Staphylococcus
WTTIEGIDFRSMTIIAHKGKE

SEQ ID NO: 2046209 - protein, 20 aa, Staphylococcus
WTTKKIDEHFGYKHTAGHWF

SEQ ID NO: 2046210 - protein, 19 aa, Staphylococcus
WTTRMLMHALRNPVTRGHY

SEQ ID NO: 2046211 - protein, 26 aa, Staphylococcus
WTVAGRGELHLSILIENMRREGYELQ

SEQ ID NO: 2046212 - protein, 17 aa, Staphylococcus
WTYGWAGHTAIVVGPSD

SEQ ID NO: 2046213 - protein, 17 aa, Staphylococcus
WVCPVCAQGENPWNQNY

SEQ ID NO: 2046214 - protein, 19 aa, Staphylococcus
WVEAIKVARNILGQKALDP

SEQ ID NO: 2046215 - protein, 19 aa, Staphylococcus
WVEAIRVARNILKQKAMDP

SEQ ID NO: 2046216 - protein, 25 aa, Staphylococcus
WVEHYSRLRSTYCYEVYNEKGELAT

SEQ ID NO: 2046217 - protein, 26 aa, Staphylococcus
WVEKYSRLRSIYSYEIYNEQGELATT

SEQ ID NO: 2046218 - protein, 27 aa, Staphylococcus
WVEKYSRLRSVYRYEIFNEQGELATTG

SEQ ID NO: 2046219 - protein, 25 aa, Staphylococcus
WVERYSRIRSLYCYEIYNENDEVTT

SEQ ID NO: 2046220 - protein, 22 aa, Staphylococcus
WVGTLLKMKPVLKFDDGKIVPE

SEQ ID NO: 2046221 - protein, 20 aa, Staphylococcus
WVGTLLKMKPVLRFEEDGKI

SEQ ID NO: 2046222 - protein, 22 aa, Staphylococcus
WVGTLLKMKPVLRFEKDGKIHP

SEQ ID NO: 2046223 - protein, 18 aa, Staphylococcus
WVKDKNVVALVSGGNVDL

SEQ ID NO: 2046224 - protein, 28 aa, Staphylococcus
WVKEELNRRLGWDIEGARDFEFEHNGDR

SEQ ID NO: 2046225 - protein, 19 aa, Staphylococcus
WVKEYAPILYQIWKKKHKK

SEQ ID NO: 2046226 - protein, 19 aa, Staphylococcus
WVKQLAETYFPGKVVTRDP

SEQ ID NO: 2046227 - protein, 18 aa, Staphylococcus
WVNCTRFDAYYIAYQLAP

SEQ ID NO: 2046228 - protein, 20 aa, Staphylococcus
WVNMLGVVPVIRALREKAMA

SEQ ID NO: 2046229 - protein, 20 aa, Staphylococcus
WVNMLGVVPVIRALREKAMH

SEQ ID NO: 2046230 - protein, 20 aa, Staphylococcus
WVNMLGVVPVIRALREKAMN

SEQ ID NO: 2046231 - protein, 22 aa, Staphylococcus
WVPGHSKGLCATKITNDYQDYV

SEQ ID NO: 2046232 - protein, 19 aa, Staphylococcus
WVQEYAPIFYQLWKRKHKK

SEQ ID NO: 2046233 - protein, 18 aa, Staphylococcus
WVQEYAPILYQIWKKKHT

SEQ ID NO: 2046234 - protein, 19 aa, Staphylococcus
WVQEYASILYQIWRKKHKK

SEQ ID NO: 2046235 - protein, 17 aa, Staphylococcus
WVSEGKIKFEVTIDEGF

SEQ ID NO: 2046236 - protein, 19 aa, Staphylococcus
WVSIKEGPVAYFVENDDEI

SEQ ID NO: 2046237 - protein, 22 aa, Staphylococcus
WVSNARLPLYLNKKENQVYIQT

SEQ ID NO: 2046238 - protein, 26 aa, Staphylococcus
WVSTPSFIEMCLLLPNLNEKDYPSLN

SEQ ID NO: 2046239 - protein, 27 aa, Staphylococcus
WVSTPSFIEMCLLLPTLNENDYPSLNH

SEQ ID NO: 2046240 - protein, 17 aa, Staphylococcus
WVTESIGGVGLDGRAMV

SEQ ID NO: 2046241 - protein, 19 aa, Staphylococcus
WVTKPIIGPIFQPVVNRAR

SEQ ID NO: 2046242 - protein, 21 aa, Staphylococcus
WVTRYKAEFISRDIHDFDKMI

SEQ ID NO: 2046243 - protein, 17 aa, Staphylococcus
WVVAAFPTKDWARRVYP

SEQ ID NO: 2046244 - protein, 26 aa, Staphylococcus
WVVAGRGELHLSILIENMRREGYELQ

SEQ ID NO: 2046245 - protein, 24 aa, Staphylococcus
WVVKGEKEYLIPYIADVVKEIDIE

SEQ ID NO: 2046246 - protein, 25 aa, Staphylococcus
WWNDVLEGYQFLKNKGFDTIFVTGI

SEQ ID NO: 2046247 - protein, 22 aa, Staphylococcus
WWNEVKDAYHFLEDEGYQHIYA

SEQ ID NO: 2046248 - protein, 17 aa, Staphylococcus
WWREIIDGGYMPINDYQ

SEQ ID NO: 2046249 - protein, 18 aa, Staphylococcus
WWREIIDGGYMPIYDYQF

SEQ ID NO: 2046250 - protein, 23 aa, Staphylococcus
WWRPQAYYDQSSWRATWSGEGGG

SEQ ID NO: 2046251 - protein, 18 aa, Staphylococcus
WYADSGHVITIDKEKEKV

SEQ ID NO: 2046252 - protein, 23 aa, Staphylococcus
WYAEEAKRIYGRTIPANTTSKKI

SEQ ID NO: 2046253 - protein, 18 aa, Staphylococcus
WYANSGHVITIDKEKELV

SEQ ID NO: 2046254 - protein, 21 aa, Staphylococcus
WYAVSSYPKGEFNRIDEINDF

SEQ ID NO: 2046255 - protein, 27 aa, Staphylococcus
WYDELEWPIDREGAYVIHRLAGSQQYK

SEQ ID NO: 2046256 - protein, 19 aa, Staphylococcus
WYDELEWPIDRKGAYVIHR

SEQ ID NO: 2046257 - protein, 20 aa, Staphylococcus
WYDKNVIWEHHQWNKGVFIE

SEQ ID NO: 2046258 - protein, 17 aa, Staphylococcus
WYGRILVERVEGFAEYH

SEQ ID NO: 2046259 - protein, 20 aa, Staphylococcus
WYINSFKYFRNMYKNFYYSR

SEQ ID NO: 2046260 - protein, 25 aa, Staphylococcus
WYINSFKYFRNMYKNFYYSRPDELD

SEQ ID NO: 2046261 - protein, 26 aa, Staphylococcus
WYINSFKYFRNMYKRFYYSRPNELDK

SEQ ID NO: 2046262 - protein, 17 aa, Staphylococcus
WYIPNRFSEGYGPNELA

SEQ ID NO: 2046263 - protein, 17 aa, Staphylococcus
WYIPNRFTEGYGPNEAA

SEQ ID NO: 2046264 - protein, 22 aa, Staphylococcus
WYITRLECIYEKDSLTPVKPTT

SEQ ID NO: 2046265 - protein, 35 aa, Staphylococcus
WYLDSCKKIKYMFPKAHAAAYVLMAMRIAYFKVHY

SEQ ID NO: 2046266 - protein, 17 aa, Staphylococcus
WYLEYEITFNRAGLLGD

SEQ ID NO: 2046267 - protein, 17 aa, Staphylococcus
WYLEYRITLNRPGLLGD

SEQ ID NO: 2046268 - protein, 18 aa, Staphylococcus
WYLGTTLYEKVEKLTPLS

SEQ ID NO: 2046269 - protein, 17 aa, Staphylococcus
WYLSYYRRFPEKLENCK

SEQ ID NO: 2046270 - protein, 17 aa, Staphylococcus
WYMMNYCFEHGYDRYNF

SEQ ID NO: 2046271 - protein, 17 aa, Staphylococcus
WYNTYLNIYAARTVNEL

SEQ ID NO: 2046272 - protein, 25 aa, Staphylococcus
WYPQPAPADHPWRKMPRNAMTIHYS

SEQ ID NO: 2046273 - protein, 24 aa, Staphylococcus
WYPQPAPADHPWRTMPRNGMTIHY

SEQ ID NO: 2046274 - protein, 24 aa, Staphylococcus
WYPQPAPADHPWRTMPRNGMTVHY

SEQ ID NO: 2046275 - protein, 26 aa, Staphylococcus
WYSKGIYKFRYNVLSALENVFEYTSI

SEQ ID NO: 2046276 - protein, 24 aa, Staphylococcus
WYSLSASMKAFFDHWSETLLDSNY

SEQ ID NO: 2046277 - protein, 19 aa, Staphylococcus
WYTNEEMLLNHLIHDTIPT

SEQ ID NO: 2046278 - protein, 23 aa, Staphylococcus
WYTYTSKDLIHFNAVGPTLKPDT

SEQ ID NO: 2046279 - protein, 19 aa, Staphylococcus
WYYIESSLQLTLPYERDSL

SEQ ID NO: 2046280 - protein, 21 aa, Staphylococcus
YAAAFYEAFEQFNLPSQLMTE

SEQ ID NO: 2046281 - protein, 18 aa, Staphylococcus
YAAALGVDIDNLYLSQPD

SEQ ID NO: 2046282 - protein, 25 aa, Staphylococcus
YAADGYARMKGIAAMVTTFGVGELS

SEQ ID NO: 2046283 - protein, 20 aa, Staphylococcus
YAAENDITFVPYFPLASGIL

SEQ ID NO: 2046284 - protein, 22 aa, Staphylococcus
YAAENNITFIPYFPLASGILAG

SEQ ID NO: 2046285 - protein, 25 aa, Staphylococcus
YAAGDVKGGLQFTYISLDDFRILKA

SEQ ID NO: 2046286 - protein, 21 aa, Staphylococcus
YAAGYTCGYYLIKYYLEKTKS

SEQ ID NO: 2046287 - protein, 24 aa, Staphylococcus
YAAHKETLVELARYLNVNLIKHQH

SEQ ID NO: 2046288 - protein, 17 aa, Staphylococcus
YAALLVPFDEHGQVKEE

SEQ ID NO: 2046289 - protein, 17 aa, Staphylococcus
YAAVGFGGVTAIQIVNK

SEQ ID NO: 2046290 - protein, 17 aa, Staphylococcus
YAAVGFGGVTALQVVNK

SEQ ID NO: 2046291 - protein, 18 aa, Staphylococcus
YADGVVIGSEIVKRLKSQ

SEQ ID NO: 2046292 - protein, 20 aa, Staphylococcus
YADGYLRSMQGAFVNVKGHQ

SEQ ID NO: 2046293 - protein, 19 aa, Staphylococcus
YADGYLRSMQGSYVNVNGQ

SEQ ID NO: 2046294 - protein, 19 aa, Staphylococcus
YADHYLRASGLNYTIVHPG

SEQ ID NO: 2046295 - protein, 17 aa, Staphylococcus
YADKGGTPWLDQKHTVF

SEQ ID NO: 2046296 - protein, 20 aa, Staphylococcus
YADNHLRDSGLFHTIVHPGA

SEQ ID NO: 2046297 - protein, 22 aa, Staphylococcus
YADPRLKRLKFEYESLDHFENN

SEQ ID NO: 2046298 - protein, 21 aa, Staphylococcus
YADRVIDLFDGKILNKEDKSE

SEQ ID NO: 2046299 - protein, 18 aa, Staphylococcus
YADSLGVDTIIVGRGGGS

SEQ ID NO: 2046300 - protein, 18 aa, Staphylococcus
YADTLGVDTIILGRGGGS

SEQ ID NO: 2046301 - protein, 17 aa, Staphylococcus
YADYLIIWGNVFQFLKQ

SEQ ID NO: 2046302 - protein, 22 aa, Staphylococcus
YAEEAKRIYGRTIPANTPNKNI

SEQ ID NO: 2046303 - protein, 22 aa, Staphylococcus
YAEERVMRPLNFAIIDEVDSIL

SEQ ID NO: 2046304 - protein, 19 aa, Staphylococcus
YAELNRLYFGDSVETDEDI

SEQ ID NO: 2046305 - protein, 18 aa, Staphylococcus
YAFDLKLINEKREHILDA

SEQ ID NO: 2046306 - protein, 17 aa, Staphylococcus
YAFERIAQMLIEASVDI

SEQ ID NO: 2046307 - protein, 18 aa, Staphylococcus
YAFNNNITCVNVPRNGEQ

SEQ ID NO: 2046308 - protein, 18 aa, Staphylococcus
YAGQEIRITDQILDDLEQ

SEQ ID NO: 2046309 - protein, 18 aa, Staphylococcus
YAGVSSVDVFVQEVGRLL

SEQ ID NO: 2046310 - protein, 17 aa, Staphylococcus
YAGVYEVEVTIQQTEEG

SEQ ID NO: 2046311 - protein, 26 aa, Staphylococcus
YAHARICSILKQAAERGITPSKDADY

SEQ ID NO: 2046312 - protein, 19 aa, Staphylococcus
YAHARICSILKQAKEKGIE

SEQ ID NO: 2046313 - protein, 19 aa, Staphylococcus
YAHARICSILKQAKEQGVE

SEQ ID NO: 2046314 - protein, 24 aa, Staphylococcus
YAHARICSILKQARAQGIDITTDA

SEQ ID NO: 2046315 - protein, 19 aa, Staphylococcus
YAHARICSILRQAKEQGVD

SEQ ID NO: 2046316 - protein, 26 aa, Staphylococcus
YAHARISSILKQAGERGITPSENADF

SEQ ID NO: 2046317 - protein, 22 aa, Staphylococcus
YAHKEYEQRFGFEPRAYGVQTM

SEQ ID NO: 2046318 - protein, 17 aa, Staphylococcus
YAHVLIKDCEVRKTFEI

SEQ ID NO: 2046319 - protein, 19 aa, Staphylococcus
YAIASAVALGLKGDTCIAG

SEQ ID NO: 2046320 - protein, 19 aa, Staphylococcus
YAIDFTGPCLRCLMQETPE

SEQ ID NO: 2046321 - protein, 19 aa, Staphylococcus
YAIEVTLDMLMDAHSSDSI

SEQ ID NO: 2046322 - protein, 17 aa, Staphylococcus
YAIGDLVKGYQLAHAAS

SEQ ID NO: 2046323 - protein, 20 aa, Staphylococcus
YAIGMGHTIHALRRNMNLTY

SEQ ID NO: 2046324 - protein, 33 aa, Staphylococcus
YAIKILNDMNVDWKKRIHMIIGTDEESDWKCTE

SEQ ID NO: 2046325 - protein, 24 aa, Staphylococcus
YAKAHGFEILGLIGDYAEVGCDPQ

SEQ ID NO: 2046326 - protein, 18 aa, Staphylococcus
YAKALPSTFIYAGAAPED

SEQ ID NO: 2046327 - protein, 19 aa, Staphylococcus
YAKDLKIKSKEIIHELKKM

SEQ ID NO: 2046328 - protein, 17 aa, Staphylococcus
YAKDVFEDNQFELLQRG

SEQ ID NO: 2046329 - protein, 19 aa, Staphylococcus
YAKEERLLYITLKLLEANT

SEQ ID NO: 2046330 - protein, 20 aa, Staphylococcus
YAKEKGIERYNFYGITGDFG

SEQ ID NO: 2046331 - protein, 18 aa, Staphylococcus
YAKELNLKSKDIIDELKS

SEQ ID NO: 2046332 - protein, 23 aa, Staphylococcus
YAKLYFEGVSVFDMLEIVENITL

SEQ ID NO: 2046333 - protein, 21 aa, Staphylococcus
YAKQFFEVVQFSPEDATRTEI

SEQ ID NO: 2046334 - protein, 19 aa, Staphylococcus
YAKYYKDIEADFIITSPPY

SEQ ID NO: 2046335 - protein, 22 aa, Staphylococcus
YALDLLQLQSIRHRNIKTLSGG

SEQ ID NO: 2046336 - protein, 22 aa, Staphylococcus
YALEKEDFILPGYRDVPQLIWH

SEQ ID NO: 2046337 - protein, 21 aa, Staphylococcus
YALEQEDFILPGYRDVPQLIW

SEQ ID NO: 2046338 - protein, 20 aa, Staphylococcus
YALGTIPFAGSNGFENAGGM

SEQ ID NO: 2046339 - protein, 22 aa, Staphylococcus
YALHEMYQGFFLAPHVVSQSLK

SEQ ID NO: 2046340 - protein, 25 aa, Staphylococcus
YALLLKMTRIYTRPLGKAVIQILLT

SEQ ID NO: 2046341 - protein, 18 aa, Staphylococcus
YALYPDIFEDVTVSDYEF

SEQ ID NO: 2046342 - protein, 17 aa, Staphylococcus
YANHVVLAYKYDKLNHL

SEQ ID NO: 2046343 - protein, 18 aa, Staphylococcus
YANMQKVELAIGYDKSLT

SEQ ID NO: 2046344 - protein, 17 aa, Staphylococcus
YANRGAANLALLSGDPN

SEQ ID NO: 2046345 - protein, 29 aa, Staphylococcus
YAPERHVLNFFSYTGAFSVIAAETAIDTT

SEQ ID NO: 2046346 - protein, 21 aa, Staphylococcus
YAPLADRLGINTIKWELEDTA

SEQ ID NO: 2046347 - protein, 21 aa, Staphylococcus
YAQALPSTFLYSGAAPQQGHA

SEQ ID NO: 2046348 - protein, 19 aa, Staphylococcus
YAQLLASKGYREAFKANHA

SEQ ID NO: 2046349 - protein, 17 aa, Staphylococcus
YAQLYRRNIFKLMKENF

SEQ ID NO: 2046350 - protein, 26 aa, Staphylococcus
YAQMANELYHFPVMYLEYSGAYGDIE

SEQ ID NO: 2046351 - protein, 18 aa, Staphylococcus
YARCFEMKEACYAATPAI

SEQ ID NO: 2046352 - protein, 25 aa, Staphylococcus
YARGQNEWMKFLGITQTTNPEFNIA

SEQ ID NO: 2046353 - protein, 25 aa, Staphylococcus
YASDLRAGACLIIAGLIAEGVTTIY

SEQ ID NO: 2046354 - protein, 26 aa, Staphylococcus
YASDWSEVRPEWGLAKNAEFIIGKRE

SEQ ID NO: 2046355 - protein, 18 aa, Staphylococcus
YASGGYIHYCEYPKLNHN

SEQ ID NO: 2046356 - protein, 22 aa, Staphylococcus
YASKAFTCIQMVKLVQEEGLDL

SEQ ID NO: 2046357 - protein, 22 aa, Staphylococcus
YASKAFTCLQMVKLVQEEGLQL

SEQ ID NO: 2046358 - protein, 21 aa, Staphylococcus
YASLIEFAEWMVSLHQEDGGQ

SEQ ID NO: 2046359 - protein, 21 aa, Staphylococcus
YASLIEFAEWMVSLNESEGSQ

SEQ ID NO: 2046360 - protein, 21 aa, Staphylococcus
YASLIEFAEWMVSLNETDNHQ

SEQ ID NO: 2046361 - protein, 18 aa, Staphylococcus
YASLVFVLSAVDGQSHLT

SEQ ID NO: 2046362 - protein, 24 aa, Staphylococcus
YASSLRVESGQEKPVYDQSNQSSE

SEQ ID NO: 2046363 - protein, 17 aa, Staphylococcus
YASTIGWQGLPNDSKIG

SEQ ID NO: 2046364 - protein, 28 aa, Staphylococcus
YASWDVPRGEFFIWLKLNGNVNIKKLFS

SEQ ID NO: 2046365 - protein, 21 aa, Staphylococcus
YATELPSTFIYSGAAPEDGDI

SEQ ID NO: 2046366 - protein, 17 aa, Staphylococcus
YATHVSIMQHGQIIESG

SEQ ID NO: 2046367 - protein, 29 aa, Staphylococcus
YATKDMSVAFPFGHGLSYTDFEYTDSNVK

SEQ ID NO: 2046368 - protein, 20 aa, Staphylococcus
YAVELPSTFIYSGAAPEDGE

SEQ ID NO: 2046369 - protein, 17 aa, Staphylococcus
YAVKILNEMNVNWKKRI

SEQ ID NO: 2046370 - protein, 23 aa, Staphylococcus
YAVKLLNDLRRNGVKADKDYLQR

SEQ ID NO: 2046371 - protein, 17 aa, Staphylococcus
YAVKVPETLDPAAASSI

SEQ ID NO: 2046372 - protein, 21 aa, Staphylococcus
YAVMGTLYFARQVPLIRQRVH

SEQ ID NO: 2046373 - protein, 20 aa, Staphylococcus
YAVNEAWHFIETSLQLTLPY

SEQ ID NO: 2046374 - protein, 24 aa, Staphylococcus
YAVRFLEAHAGVMITASHNPKDYN

SEQ ID NO: 2046375 - protein, 18 aa, Staphylococcus
YAVSIGFHVKVNVVIQKG

SEQ ID NO: 2046376 - protein, 18 aa, Staphylococcus
YAVSIGFKVKINVVVQKG

SEQ ID NO: 2046377 - protein, 20 aa, Staphylococcus
YAYCLKRYFVYLEFKNKGHK

SEQ ID NO: 2046378 - protein, 17 aa, Staphylococcus
YAYPHLKSITPEQINLS

SEQ ID NO: 2046379 - protein, 24 aa, Staphylococcus
YCASPYFTHSYVFISWTGKMAETF

SEQ ID NO: 2046380 - protein, 19 aa, Staphylococcus
YCDDPYCGFLVSNQVIYET

SEQ ID NO: 2046381 - protein, 18 aa, Staphylococcus
YCDNRVTLGYPEVRQHIR

SEQ ID NO: 2046382 - protein, 29 aa, Staphylococcus
YCDNRVTLGYPEVRRAIRDGLSQMIIEQF

SEQ ID NO: 2046383 - protein, 19 aa, Staphylococcus
YCGIVGLKPTYGRVSRFGL

SEQ ID NO: 2046384 - protein, 19 aa, Staphylococcus
YCGVGCTFDVWTKGREILK

SEQ ID NO: 2046385 - protein, 18 aa, Staphylococcus
YCNHKVLMFGGGGYNIWR

SEQ ID NO: 2046386 - protein, 20 aa, Staphylococcus
YCNVCENMATAKTCPHDASE

SEQ ID NO: 2046387 - protein, 23 aa, Staphylococcus
YCPRIRYKNVILKPATWKLNKDM

SEQ ID NO: 2046388 - protein, 22 aa, Staphylococcus
YDAEKLREAFHLNFDDVGKNIE

SEQ ID NO: 2046389 - protein, 23 aa, Staphylococcus
YDAFYERFCRFETGHAAEAIVKR

SEQ ID NO: 2046390 - protein, 20 aa, Staphylococcus
YDAIILAAAGLRRMGWSDDI

SEQ ID NO: 2046391 - protein, 20 aa, Staphylococcus
YDAIITLGCVIRGATSHYDY

SEQ ID NO: 2046392 - protein, 17 aa, Staphylococcus
YDAKRLHVFMTLSDEAN

SEQ ID NO: 2046393 - protein, 20 aa, Staphylococcus
YDAKRVHLFLTMYNSNDERN

SEQ ID NO: 2046394 - protein, 17 aa, Staphylococcus
YDAMRIVHECREAGLPC

SEQ ID NO: 2046395 - protein, 28 aa, Staphylococcus
YDAMVRLSQGWKLCHVLIEMQGNNGSID

SEQ ID NO: 2046396 - protein, 25 aa, Staphylococcus
YDAPEHLKSLIGHFVENKKVEEPLL

SEQ ID NO: 2046397 - protein, 18 aa, Staphylococcus
YDASWADLPTKFEAGTPL

SEQ ID NO: 2046398 - protein, 19 aa, Staphylococcus
YDAVITLGCVIRGATSHYD

SEQ ID NO: 2046399 - protein, 20 aa, Staphylococcus
YDAVITLGCVIRGATSHYDY

SEQ ID NO: 2046400 - protein, 19 aa, Staphylococcus
YDAVITLGCVIRGSTSHYD

SEQ ID NO: 2046401 - protein, 22 aa, Staphylococcus
YDDELVGVIGLHYLDLVNKRTS

SEQ ID NO: 2046402 - protein, 22 aa, Staphylococcus
YDDIIQIGITFVRQNKIIGTYH

SEQ ID NO: 2046403 - protein, 27 aa, Staphylococcus
YDDISKWSFQTEMFFLCNRYKQAQDIA

SEQ ID NO: 2046404 - protein, 27 aa, Staphylococcus
YDDISKWSFQTEMFFLCNRYKQFKDIE

SEQ ID NO: 2046405 - protein, 22 aa, Staphylococcus
YDDKRIHFFLKLIKENGTLAAT

SEQ ID NO: 2046406 - protein, 18 aa, Staphylococcus
YDDLKFYEEFILHSHEKL

SEQ ID NO: 2046407 - protein, 26 aa, Staphylococcus
YDDVEFKLYIGLKHIHPFIEDAVQSM

SEQ ID NO: 2046408 - protein, 25 aa, Staphylococcus
YDDVEFKLYLGLKHISPYIEEAVEK

SEQ ID NO: 2046409 - protein, 28 aa, Staphylococcus
YDDVRTAMKMVLPKKWTLDQVVEYFFNW

SEQ ID NO: 2046410 - protein, 19 aa, Staphylococcus
YDEHLYVSINFKNEEINIY

SEQ ID NO: 2046411 - protein, 22 aa, Staphylococcus
YDEIDIYSGIEMDILPDGSLDY

SEQ ID NO: 2046412 - protein, 17 aa, Staphylococcus
YDEIIQIGITFVSNNKI

SEQ ID NO: 2046413 - protein, 23 aa, Staphylococcus
YDEIIRLKPEWHSDDDDKGVIKV

SEQ ID NO: 2046414 - protein, 18 aa, Staphylococcus
YDELEWPIDRKGAYVIHR

SEQ ID NO: 2046415 - protein, 24 aa, Staphylococcus
YDELLPKLKEAFENITVGDPFDEN

SEQ ID NO: 2046416 - protein, 26 aa, Staphylococcus
YDELMKRLKDVFSHLKVGDPTDENVQ

SEQ ID NO: 2046417 - protein, 20 aa, Staphylococcus
YDELNKALGDMNRKLDDGQR

SEQ ID NO: 2046418 - protein, 17 aa, Staphylococcus
YDELVAFLNEHHYNVVR

SEQ ID NO: 2046419 - protein, 21 aa, Staphylococcus
YDELYHFLIRIMNIYQTHLGR

SEQ ID NO: 2046420 - protein, 18 aa, Staphylococcus
YDESIDFPIDASNINTDP

SEQ ID NO: 2046421 - protein, 19 aa, Staphylococcus
YDETGEWLPQATLDTIEEY

SEQ ID NO: 2046422 - protein, 21 aa, Staphylococcus
YDEVMRFGRYHPDYQNVMLDT

SEQ ID NO: 2046423 - protein, 17 aa, Staphylococcus
YDFIKCIQLEQNSGSPA

SEQ ID NO: 2046424 - protein, 34 aa, Staphylococcus
YDFLKLKKILMEWQVGIYNGGGWNAIFWCNHDQP

SEQ ID NO: 2046425 - protein, 17 aa, Staphylococcus
YDFLKTLLYEINKRYKQ

SEQ ID NO: 2046426 - protein, 17 aa, Staphylococcus
YDFLYAIIGWHPVDAID

SEQ ID NO: 2046427 - protein, 17 aa, Staphylococcus
YDFPRVWLEKESYDFSF

SEQ ID NO: 2046428 - protein, 19 aa, Staphylococcus
YDFRPHYALIGKITTSFKS

SEQ ID NO: 2046429 - protein, 17 aa, Staphylococcus
YDFRPHYALIGQITHHF

SEQ ID NO: 2046430 - protein, 19 aa, Staphylococcus
YDFRPHYALIGQITSHFKN

SEQ ID NO: 2046431 - protein, 17 aa, Staphylococcus
YDFRPHYALISKITNYY

SEQ ID NO: 2046432 - protein, 20 aa, Staphylococcus
YDFRPHYALVGKITKRFPNA

SEQ ID NO: 2046433 - protein, 20 aa, Staphylococcus
YDFRPHYALVGKIVNHFHNA

SEQ ID NO: 2046434 - protein, 17 aa, Staphylococcus
YDGEPLLAYTYEFYQQK

SEQ ID NO: 2046435 - protein, 23 aa, Staphylococcus
YDGHFLIQWYSKGIYKFRYNVLS

SEQ ID NO: 2046436 - protein, 23 aa, Staphylococcus
YDGHLLIQWYSKGIYAFRDTILN

SEQ ID NO: 2046437 - protein, 24 aa, Staphylococcus
YDGINKFRTVIGRDAFIGCNTNLI

SEQ ID NO: 2046438 - protein, 19 aa, Staphylococcus
YDGKIKHILARHEQGATHA

SEQ ID NO: 2046439 - protein, 24 aa, Staphylococcus
YDHSLKGAIKFGIEESDIVTSVSH

SEQ ID NO: 2046440 - protein, 24 aa, Staphylococcus
YDHSLKGAIKFGIEQSDIVTSVSH

SEQ ID NO: 2046441 - protein, 25 aa, Staphylococcus
YDHSLKGAIKFGIEQSDLVTSVSHS

SEQ ID NO: 2046442 - protein, 24 aa, Staphylococcus
YDHSLKNAIKFGIEGSDVVTSVSQ

SEQ ID NO: 2046443 - protein, 24 aa, Staphylococcus
YDHSLKNAIKFGIEQSDIVTSVSH

SEQ ID NO: 2046444 - protein, 18 aa, Staphylococcus
YDIACHNVDDFVQVDEGA

SEQ ID NO: 2046445 - protein, 18 aa, Staphylococcus
YDIDKGWHDLKIVPYAPL

SEQ ID NO: 2046446 - protein, 20 aa, Staphylococcus
YDIDNRWSIEYYAESDQTTL

SEQ ID NO: 2046447 - protein, 19 aa, Staphylococcus
YDIDQGWHDLKIVPYGPIE

SEQ ID NO: 2046448 - protein, 21 aa, Staphylococcus
YDIEIAKRIEVIVPETTHNHD

SEQ ID NO: 2046449 - protein, 19 aa, Staphylococcus
YDIELAYEAGLLSRNEENF

SEQ ID NO: 2046450 - protein, 18 aa, Staphylococcus
YDIELAYESGLLSRNEEN

SEQ ID NO: 2046451 - protein, 20 aa, Staphylococcus
YDIGAVGMRLLTKFMNEEDI

SEQ ID NO: 2046452 - protein, 17 aa, Staphylococcus
YDIGAVGMRLLTKYMND

SEQ ID NO: 2046453 - protein, 17 aa, Staphylococcus
YDIGAVGMRLLTKYMNE

SEQ ID NO: 2046454 - protein, 20 aa, Staphylococcus
YDIGNAIKYLSRATHKNGKE

SEQ ID NO: 2046455 - protein, 26 aa, Staphylococcus
YDIGRVELRAAIPTTVTLNYDQTGKF

SEQ ID NO: 2046456 - protein, 26 aa, Staphylococcus
YDIGRVELREAVPVTVTISYDLTGKF

SEQ ID NO: 2046457 - protein, 20 aa, Staphylococcus
YDIIDEFKALGHYEDDEHLE

SEQ ID NO: 2046458 - protein, 20 aa, Staphylococcus
YDIIDEFKALGHYEDDEIEN

SEQ ID NO: 2046459 - protein, 26 aa, Staphylococcus
YDIIDEFKDLGGYEFEEIENRVVQFY

SEQ ID NO: 2046460 - protein, 17 aa, Staphylococcus
YDILPEFIKAYPGIELK

SEQ ID NO: 2046461 - protein, 20 aa, Staphylococcus
YDIMGIPSFLVFCDGNQIGS

SEQ ID NO: 2046462 - protein, 20 aa, Staphylococcus
YDIMGIPSFLVFKDGDMLGS

SEQ ID NO: 2046463 - protein, 22 aa, Staphylococcus
YDIMKRLNFDYYFIDIENLETK

SEQ ID NO: 2046464 - protein, 17 aa, Staphylococcus
YDIPEYVNQVLPKLESF

SEQ ID NO: 2046465 - protein, 19 aa, Staphylococcus
YDIPFNFNLNFEESKGHLG

SEQ ID NO: 2046466 - protein, 17 aa, Staphylococcus
YDIQETFYLSSNIAVSV

SEQ ID NO: 2046467 - protein, 21 aa, Staphylococcus
YDIVEGISDVKVIFRAKLNAS

SEQ ID NO: 2046468 - protein, 25 aa, Staphylococcus
YDKEARFIIELAARVYKSILDETRK

SEQ ID NO: 2046469 - protein, 18 aa, Staphylococcus
YDKFPGKFTAKMGAEGIK

SEQ ID NO: 2046470 - protein, 18 aa, Staphylococcus
YDKGELFTKLFERALKGD

SEQ ID NO: 2046471 - protein, 19 aa, Staphylococcus
YDKGHFEPIFILAKNNKAK

SEQ ID NO: 2046472 - protein, 22 aa, Staphylococcus
YDKGLRVYDTLLLQIDSTKKGN

SEQ ID NO: 2046473 - protein, 22 aa, Staphylococcus
YDKIKIVGLMTMAPYTEDTAYI

SEQ ID NO: 2046474 - protein, 26 aa, Staphylococcus
YDKIMIKEIINSLLINKIKQEDIYLS

SEQ ID NO: 2046475 - protein, 18 aa, Staphylococcus
YDKIRGLNQFYKAIPQQY

SEQ ID NO: 2046476 - protein, 19 aa, Staphylococcus
YDKKEALAFTKEDREKVKD

SEQ ID NO: 2046477 - protein, 24 aa, Staphylococcus
YDKLLPKLKEAFENIKVGDPFADD

SEQ ID NO: 2046478 - protein, 23 aa, Staphylococcus
YDKMPDRLVSVFAGQDKEATQQA

SEQ ID NO: 2046479 - protein, 20 aa, Staphylococcus
YDKMPKCIYTHPEVASIGYN

SEQ ID NO: 2046480 - protein, 24 aa, Staphylococcus
YDKNAKWFKNVLVALQKEYQFKQF

SEQ ID NO: 2046481 - protein, 17 aa, Staphylococcus
YDKNLIIIFKDIDNTHK

SEQ ID NO: 2046482 - protein, 25 aa, Staphylococcus
YDKTPAQIVLRWHLAHDRIIIPKSK

SEQ ID NO: 2046483 - protein, 24 aa, Staphylococcus
YDKTPAQIVLRWHVAHNRVVIPKS

SEQ ID NO: 2046484 - protein, 24 aa, Staphylococcus
YDLALKRDVFFHHPYESFEPIVDF

SEQ ID NO: 2046485 - protein, 17 aa, Staphylococcus
YDLDILHMHYAVPHAIC

SEQ ID NO: 2046486 - protein, 19 aa, Staphylococcus
YDLDLAKKHGIVISNIPSY

SEQ ID NO: 2046487 - protein, 19 aa, Staphylococcus
YDLDLAKKHGIVISNVPSY

SEQ ID NO: 2046488 - protein, 19 aa, Staphylococcus
YDLDLAKKHNIVISNVPSY

SEQ ID NO: 2046489 - protein, 17 aa, Staphylococcus
YDLDVLHMHYAVPHAVC

SEQ ID NO: 2046490 - protein, 23 aa, Staphylococcus
YDLEKNLYCKKYFEETNDNKLNS

SEQ ID NO: 2046491 - protein, 18 aa, Staphylococcus
YDLFNILFEMVREHHNHD

SEQ ID NO: 2046492 - protein, 18 aa, Staphylococcus
YDLFNVLFEMVRQHENSP

SEQ ID NO: 2046493 - protein, 18 aa, Staphylococcus
YDLFYVLAENKNHVLQRE

SEQ ID NO: 2046494 - protein, 27 aa, Staphylococcus
YDLGSAEMNLDMAIEMYDGEYRVEKVE

SEQ ID NO: 2046495 - protein, 26 aa, Staphylococcus
YDLGSSEMNLDLAIEMYEGSHHIKKI

SEQ ID NO: 2046496 - protein, 17 aa, Staphylococcus
YDLINFFNKKRGPWIKT

SEQ ID NO: 2046497 - protein, 21 aa, Staphylococcus
YDLKEGVTITLEKEIPVSAGL

SEQ ID NO: 2046498 - protein, 17 aa, Staphylococcus
YDLKLNDLLFLKHLLAC

SEQ ID NO: 2046499 - protein, 25 aa, Staphylococcus
YDLKRTYVFELNFDKLMSVSVGYIN

SEQ ID NO: 2046500 - protein, 17 aa, Staphylococcus
YDLLEKVAEAFEFDTLK

SEQ ID NO: 2046501 - protein, 30 aa, Staphylococcus
YDLLLRSGLELEADFVIRVGKPVISKKLNQ

SEQ ID NO: 2046502 - protein, 18 aa, Staphylococcus
YDLLYVLAENRNHVLQRE

SEQ ID NO: 2046503 - protein, 19 aa, Staphylococcus
YDLLYVLAENRNHVMQREQ

SEQ ID NO: 2046504 - protein, 24 aa, Staphylococcus
YDLRLMLESFAFSRLKDHDTQAIA

SEQ ID NO: 2046505 - protein, 19 aa, Staphylococcus
YDLTALRKSVIRWCELILS

SEQ ID NO: 2046506 - protein, 17 aa, Staphylococcus
YDLVKLVNGKTMYDGGQ

SEQ ID NO: 2046507 - protein, 19 aa, Staphylococcus
YDLYFWKQHDEGIITLDEL

SEQ ID NO: 2046508 - protein, 19 aa, Staphylococcus
YDLYFWKQHDEGVITLDEL

SEQ ID NO: 2046509 - protein, 25 aa, Staphylococcus
YDNKHGKPYFCGQLDVPLTEKGMQS

SEQ ID NO: 2046510 - protein, 22 aa, Staphylococcus
YDNSLEFLALFEKLSLEMNDVV

SEQ ID NO: 2046511 - protein, 25 aa, Staphylococcus
YDNVEFKLYLGLKHISPYIEEAVEK

SEQ ID NO: 2046512 - protein, 18 aa, Staphylococcus
YDPCCGSGGMFVQSERFV

SEQ ID NO: 2046513 - protein, 18 aa, Staphylococcus
YDPFVFLTYLSAFTSKIA

SEQ ID NO: 2046514 - protein, 23 aa, Staphylococcus
YDPQHPYTWGLLSSMPDLETGTD

SEQ ID NO: 2046515 - protein, 25 aa, Staphylococcus
YDPTCGSGSLLLRVGAEAKVRQYYG

SEQ ID NO: 2046516 - protein, 26 aa, Staphylococcus
YDPTCGSGSLLLRVGKETTVYRYNGQ

SEQ ID NO: 2046517 - protein, 23 aa, Staphylococcus
YDQEAAKNFWIEKLNFVEVSDVS

SEQ ID NO: 2046518 - protein, 17 aa, Staphylococcus
YDQIGLLKPDRINSSGY

SEQ ID NO: 2046519 - protein, 17 aa, Staphylococcus
YDQKLFDGFSMGNPKVE

SEQ ID NO: 2046520 - protein, 20 aa, Staphylococcus
YDQLRLKGFYKDSNKKAEIS

SEQ ID NO: 2046521 - protein, 20 aa, Staphylococcus
YDQLRLKGFYKDTNKKAEIS

SEQ ID NO: 2046522 - protein, 18 aa, Staphylococcus
YDQLRLKGFYNDNNKKTE

SEQ ID NO: 2046523 - protein, 23 aa, Staphylococcus
YDQWSPSAIKHFYEKLLKLKSLM

SEQ ID NO: 2046524 - protein, 25 aa, Staphylococcus
YDREIRPDHLISGLSCDKGFTVINI

SEQ ID NO: 2046525 - protein, 18 aa, Staphylococcus
YDRGEAFGKNDPAEEMYP

SEQ ID NO: 2046526 - protein, 17 aa, Staphylococcus
YDRGPRILRNFPEKLSK

SEQ ID NO: 2046527 - protein, 17 aa, Staphylococcus
YDRGPRILRNFPEKLSN

SEQ ID NO: 2046528 - protein, 18 aa, Staphylococcus
YDRGPRILRNFPEKLSNY

SEQ ID NO: 2046529 - protein, 19 aa, Staphylococcus
YDRIKVVVATNAFGMGIDK

SEQ ID NO: 2046530 - protein, 23 aa, Staphylococcus
YDRLEGYNSLQWPVAEDGTDEPI

SEQ ID NO: 2046531 - protein, 20 aa, Staphylococcus
YDRSVRLVAEIVRSLNDHTY

SEQ ID NO: 2046532 - protein, 28 aa, Staphylococcus
YDRYKHFKDRVLVPLAYIYFDEYLEELN

SEQ ID NO: 2046533 - protein, 17 aa, Staphylococcus
YDRYNFYGLSGDFTENS

SEQ ID NO: 2046534 - protein, 24 aa, Staphylococcus
YDSDRYVPVLAIAIGKKAQEAHGS

SEQ ID NO: 2046535 - protein, 25 aa, Staphylococcus
YDSKDLFKLLALESQHAGLSWLTIL

SEQ ID NO: 2046536 - protein, 18 aa, Staphylococcus
YDSLNQFTQWMVDLNQLG

SEQ ID NO: 2046537 - protein, 25 aa, Staphylococcus
YDSNNWWDSAVVPFYIKRKTTEFDD

SEQ ID NO: 2046538 - protein, 20 aa, Staphylococcus
YDSPWIKWYHQQMKDKRAKL

SEQ ID NO: 2046539 - protein, 26 aa, Staphylococcus
YDSTETFLFIWGWNEGKEIFSNNINK

SEQ ID NO: 2046540 - protein, 24 aa, Staphylococcus
YDSTLAGFVEWARCENPNMDADKM

SEQ ID NO: 2046541 - protein, 21 aa, Staphylococcus
YDTCKTLEQIGANVLVIRHSQ

SEQ ID NO: 2046542 - protein, 25 aa, Staphylococcus
YDTDNRLIASIGYRNARASQAIGSI

SEQ ID NO: 2046543 - protein, 19 aa, Staphylococcus
YDTEPILDILIGVDNLHDI

SEQ ID NO: 2046544 - protein, 24 aa, Staphylococcus
YDTVCKQDGYIWVSYTANNGKDVW

SEQ ID NO: 2046545 - protein, 26 aa, Staphylococcus
YDVDIEPFFKCIKQYPDLVINQRHAI

SEQ ID NO: 2046546 - protein, 18 aa, Staphylococcus
YDVDVFVMGHDWEGKFDF

SEQ ID NO: 2046547 - protein, 17 aa, Staphylococcus
YDVEDIAYACLDNNRGC

SEQ ID NO: 2046548 - protein, 19 aa, Staphylococcus
YDVEHRWTIEYKATSNEDT

SEQ ID NO: 2046549 - protein, 17 aa, Staphylococcus
YDVFLEIEVEGAKQVRK

SEQ ID NO: 2046550 - protein, 19 aa, Staphylococcus
YDVGNLYLNRGCTSAVVGY

SEQ ID NO: 2046551 - protein, 17 aa, Staphylococcus
YDVKSEFTVDEIEQYEK

SEQ ID NO: 2046552 - protein, 21 aa, Staphylococcus
YDVLSRMKVGSYLVNTARGKI

SEQ ID NO: 2046553 - protein, 21 aa, Staphylococcus
YDVMDAFKLLDSVSIPKGAVL

SEQ ID NO: 2046554 - protein, 18 aa, Staphylococcus
YDVPFQLRLIFAESNGKI

SEQ ID NO: 2046555 - protein, 21 aa, Staphylococcus
YDVRVGIRPGDSFNKAKEDGL

SEQ ID NO: 2046556 - protein, 19 aa, Staphylococcus
YDVVACCLDVGEGKDLDLV

SEQ ID NO: 2046557 - protein, 19 aa, Staphylococcus
YDVVACCLDVGEGKDLDTV

SEQ ID NO: 2046558 - protein, 20 aa, Staphylococcus
YDWRVFESEASITYFGDTEV

SEQ ID NO: 2046559 - protein, 19 aa, Staphylococcus
YDWYKEHHIELIVDDPVEK

SEQ ID NO: 2046560 - protein, 26 aa, Staphylococcus
YDYAEPIKKIANHRVLAVNRGEKEKI

SEQ ID NO: 2046561 - protein, 22 aa, Staphylococcus
YDYDILVVALGFESETFGINGM

SEQ ID NO: 2046562 - protein, 18 aa, Staphylococcus
YDYDILVVALGFVSETFG

SEQ ID NO: 2046563 - protein, 24 aa, Staphylococcus
YDYDYKRVHFFLMLYTDEDELAAT

SEQ ID NO: 2046564 - protein, 18 aa, Staphylococcus
YDYFADVGLGEKLVIQTY

SEQ ID NO: 2046565 - protein, 22 aa, Staphylococcus
YDYIKHVVQIKGYPPSVREIGE

SEQ ID NO: 2046566 - protein, 25 aa, Staphylococcus
YDYIPRLFWPIYYVIQAPLQGLIMR

SEQ ID NO: 2046567 - protein, 18 aa, Staphylococcus
YDYLAHDGLGKKLVIQTY

SEQ ID NO: 2046568 - protein, 17 aa, Staphylococcus
YDYLIFVQETWSMLHEN

SEQ ID NO: 2046569 - protein, 20 aa, Staphylococcus
YDYLKPANCLQRRQSYGSTG

SEQ ID NO: 2046570 - protein, 18 aa, Staphylococcus
YEAALPIRIIVEAHHYGV

SEQ ID NO: 2046571 - protein, 19 aa, Staphylococcus
YEAALPLRIIVEAHHYGVS

SEQ ID NO: 2046572 - protein, 21 aa, Staphylococcus
YEAALPLRIIVEAHHYGVSNL

SEQ ID NO: 2046573 - protein, 17 aa, Staphylococcus
YEAAPAFNSDMEVNFSK

SEQ ID NO: 2046574 - protein, 17 aa, Staphylococcus
YEACKVLLDKGYIVCPY

SEQ ID NO: 2046575 - protein, 28 aa, Staphylococcus
YEADVIPCFEYRNYLSFGNSEEDREYIP

SEQ ID NO: 2046576 - protein, 23 aa, Staphylococcus
YEAEALMGKYRISGVPIVDNKED

SEQ ID NO: 2046577 - protein, 21 aa, Staphylococcus
YEAICTIFLEDVSTLFVVNQN

SEQ ID NO: 2046578 - protein, 24 aa, Staphylococcus
YEAIFPYNIPTTFTDLLKERSLGV

SEQ ID NO: 2046579 - protein, 17 aa, Staphylococcus
YEAIIALLSYVDEDDLD

SEQ ID NO: 2046580 - protein, 17 aa, Staphylococcus
YEAIISLLSYVDEEDLD

SEQ ID NO: 2046581 - protein, 17 aa, Staphylococcus
YEALGYKSIGDIFMEEN

SEQ ID NO: 2046582 - protein, 30 aa, Staphylococcus
YEAVEMSRKMGIEVFNVFLSQEPITEDIEQ

SEQ ID NO: 2046583 - protein, 30 aa, Staphylococcus
YEAVEMSRKYGIEVFNVFLSQDPITEEIEQ

SEQ ID NO: 2046584 - protein, 22 aa, Staphylococcus
YEAYYVGGAVRDYLMDRPIHDI

SEQ ID NO: 2046585 - protein, 17 aa, Staphylococcus
YEDADWEEEEVLDTDFS

SEQ ID NO: 2046586 - protein, 18 aa, Staphylococcus
YEDAEFFAEKSLKPYDVD

SEQ ID NO: 2046587 - protein, 18 aa, Staphylococcus
YEDEKFMLIDPIEEIQPE

SEQ ID NO: 2046588 - protein, 20 aa, Staphylococcus
YEDEKFMLVDSIEAIQPEHR

SEQ ID NO: 2046589 - protein, 18 aa, Staphylococcus
YEDFKTSELFQQHFSKSA

SEQ ID NO: 2046590 - protein, 28 aa, Staphylococcus
YEDISKWSFQTEMFFLCNRYKQFQDLAL

SEQ ID NO: 2046591 - protein, 27 aa, Staphylococcus
YEDISKWSFQTEMFFLCNRYKQLNDLK

SEQ ID NO: 2046592 - protein, 26 aa, Staphylococcus
YEDISTWSFQTEMFFLCNRYKQVQDL

SEQ ID NO: 2046593 - protein, 23 aa, Staphylococcus
YEDLKALFFEEMVKNGLFEKFHG

SEQ ID NO: 2046594 - protein, 18 aa, Staphylococcus
YEDLKFYEAFVLNSNEKL

SEQ ID NO: 2046595 - protein, 25 aa, Staphylococcus
YEDRMPKIVIVIDELADLMMMAPQE

SEQ ID NO: 2046596 - protein, 25 aa, Staphylococcus
YEDTIKIFLQHGVLGRKNVEYHKKY

SEQ ID NO: 2046597 - protein, 25 aa, Staphylococcus
YEDVEFKLYLGLKHISPYIEEAVEK

SEQ ID NO: 2046598 - protein, 18 aa, Staphylococcus
YEEIMEMSALGAGVLETR

SEQ ID NO: 2046599 - protein, 21 aa, Staphylococcus
YEEKSAIFNRIFQEHPNVDGI

SEQ ID NO: 2046600 - protein, 23 aa, Staphylococcus
YEELKAEYLSDIKFLSETDTEVI

SEQ ID NO: 2046601 - protein, 18 aa, Staphylococcus
YEESHGYLAAPFSRDKDA

SEQ ID NO: 2046602 - protein, 17 aa, Staphylococcus
YEESYGYLADDFVRDKD

SEQ ID NO: 2046603 - protein, 17 aa, Staphylococcus
YEETYHLYLPKEEPLAL

SEQ ID NO: 2046604 - protein, 20 aa, Staphylococcus
YEFAQKFDLPIKEVIEGGDV

SEQ ID NO: 2046605 - protein, 22 aa, Staphylococcus
YEFEAPYFTFDWTNKKIEDDTL

SEQ ID NO: 2046606 - protein, 18 aa, Staphylococcus
YEFFEGIAKITINRPEVR

SEQ ID NO: 2046607 - protein, 17 aa, Staphylococcus
YEFKDSIANIIHYYQIP

SEQ ID NO: 2046608 - protein, 21 aa, Staphylococcus
YEFQFSMGLPTYGITDREVPL

SEQ ID NO: 2046609 - protein, 21 aa, Staphylococcus
YEFQYAYGMPDYGVIDKDLPL

SEQ ID NO: 2046610 - protein, 17 aa, Staphylococcus
YEFYASWLNQKYSAIFE

SEQ ID NO: 2046611 - protein, 19 aa, Staphylococcus
YEGEICAIIGRNGAGKSTL

SEQ ID NO: 2046612 - protein, 19 aa, Staphylococcus
YEGELGVVIGKAGEKIPKG

SEQ ID NO: 2046613 - protein, 18 aa, Staphylococcus
YEGFGPNGSMLIVDALTN

SEQ ID NO: 2046614 - protein, 17 aa, Staphylococcus
YEGGKIVVAEAYRNLIS

SEQ ID NO: 2046615 - protein, 24 aa, Staphylococcus
YEGIFPYNIPTTFTKSLRERSLGV

SEQ ID NO: 2046616 - protein, 19 aa, Staphylococcus
YEGLLITPLVEKFKYSLKK

SEQ ID NO: 2046617 - protein, 20 aa, Staphylococcus
YEGRAGKPRGAQEMWRSVYY

SEQ ID NO: 2046618 - protein, 30 aa, Staphylococcus
YEGVEMARKYGIEVFNVFLSQDVITEDIEQ

SEQ ID NO: 2046619 - protein, 20 aa, Staphylococcus
YEGWWLFSDWPERVIETLNF

SEQ ID NO: 2046620 - protein, 21 aa, Staphylococcus
YEHFIYTPVGFVCEHLEVLYD

SEQ ID NO: 2046621 - protein, 19 aa, Staphylococcus
YEHLLKKRVKTIKWNIEQP

SEQ ID NO: 2046622 - protein, 34 aa, Staphylococcus; identical to SEQ ID NO: 1674113

SEQ ID NO: 2046623 - protein, 25 aa, Staphylococcus
YEHPLKVAGVFSYAANEERNEGEVD

SEQ ID NO: 2046624 - protein, 17 aa, Staphylococcus
YEIKGSFNNKVSFEGLG

SEQ ID NO: 2046625 - protein, 17 aa, Staphylococcus
YEIQFIFNLNDKDIRSI

SEQ ID NO: 2046626 - protein, 17 aa, Staphylococcus
YEISKRTVLFLIQKDIT

SEQ ID NO: 2046627 - protein, 20 aa, Staphylococcus
YEKDMALNWGKKNNIEVTTS

SEQ ID NO: 2046628 - protein, 19 aa, Staphylococcus
YEKEMALNWGKKNNIEVTT

SEQ ID NO: 2046629 - protein, 17 aa, Staphylococcus
YEKEYKEALYIDQTGYG

SEQ ID NO: 2046630 - protein, 19 aa, Staphylococcus
YEKGFDLLLESIRLIQDDL

SEQ ID NO: 2046631 - protein, 19 aa, Staphylococcus
YEKGFDLLLESVRLIQDYL

SEQ ID NO: 2046632 - protein, 18 aa, Staphylococcus
YEKGHFEPIFILGKNNKQ

SEQ ID NO: 2046633 - protein, 23 aa, Staphylococcus
YEKKLPKQLFIKIHRATIINKQY

SEQ ID NO: 2046634 - protein, 19 aa, Staphylococcus
YEKLAIATLAVRKGAKFIS

SEQ ID NO: 2046635 - protein, 19 aa, Staphylococcus
YEKLAIATLAVRNGATFIS

SEQ ID NO: 2046636 - protein, 23 aa, Staphylococcus
YEKLKLLGYKAIIFDIDSTLVPH

SEQ ID NO: 2046637 - protein, 20 aa, Staphylococcus
YEKMIELVKPLGHIATIVVF

SEQ ID NO: 2046638 - protein, 18 aa, Staphylococcus
YEKMRFKDSEYTGGHVIG

SEQ ID NO: 2046639 - protein, 24 aa, Staphylococcus
YEKRGVAVVVCPNDLLTQKIKDTT

SEQ ID NO: 2046640 - protein, 17 aa, Staphylococcus
YEKRLSLSDCTRTQANQ

SEQ ID NO: 2046641 - protein, 25 aa, Staphylococcus
YEKTLGFKSVFKFRNDKNEVLMNHL

SEQ ID NO: 2046642 - protein, 25 aa, Staphylococcus
YEKTPAQIVLRWHLAHNRLIIPKSK

SEQ ID NO: 2046643 - protein, 17 aa, Staphylococcus
YELADYLFKNFANRKKY

SEQ ID NO: 2046644 - protein, 25 aa, Staphylococcus
YELEEILPHYFIRISKSEILNIRNI

SEQ ID NO: 2046645 - protein, 19 aa, Staphylococcus
YELEIEYRYPILSQCIIKP

SEQ ID NO: 2046646 - protein, 17 aa, Staphylococcus
YELEKGKSFILTSEDLD

SEQ ID NO: 2046647 - protein, 19 aa, Staphylococcus
YELEMNRLKELVAGKKLDN

SEQ ID NO: 2046648 - protein, 26 aa, Staphylococcus
YELIPHCPKCDAPMEINKRKAQVGMV

SEQ ID NO: 2046649 - protein, 18 aa, Staphylococcus
YELIQPPTAYQFFNDPML

SEQ ID NO: 2046650 - protein, 20 aa, Staphylococcus
YELIQPPTAYQFFNDPMLSI

SEQ ID NO: 2046651 - protein, 21 aa, Staphylococcus
YELKLDMHKSYIMSYNGGQTI

SEQ ID NO: 2046652 - protein, 17 aa, Staphylococcus
YELKLNFSSVGPKLGNK

SEQ ID NO: 2046653 - protein, 20 aa, Staphylococcus
YELLLSCADEILHLENGHVK

SEQ ID NO: 2046654 - protein, 24 aa, Staphylococcus
YELLSFKSGQRYNMVPDFAEAKVF

SEQ ID NO: 2046655 - protein, 26 aa, Staphylococcus
YELREIQSRLGITFIFVTHDQEEALA

SEQ ID NO: 2046656 - protein, 26 aa, Staphylococcus
YELRELQSRLGITFIFVTHDQEEALA

SEQ ID NO: 2046657 - protein, 25 aa, Staphylococcus
YELSKCMTCGVCLEVCPNVTKKNDF

SEQ ID NO: 2046658 - protein, 25 aa, Staphylococcus
YELSKCMTCGVCLEVCPNVTKNNGF

SEQ ID NO: 2046659 - protein, 25 aa, Staphylococcus
YELSKCMTCGVCLEVCPNVTQKNDF

SEQ ID NO: 2046660 - protein, 25 aa, Staphylococcus
YELSKCMTCGVCLEVCPNVTQNNKF

SEQ ID NO: 2046661 - protein, 25 aa, Staphylococcus
YELSKCMTCGVCLEVCPNVTRNNKF

SEQ ID NO: 2046662 - protein, 25 aa, Staphylococcus
YELVGELKAAVNLPIHLHTHDTSGN

SEQ ID NO: 2046663 - protein, 18 aa, Staphylococcus
YELYALPPHIKQTLANVV

SEQ ID NO: 2046664 - protein, 19 aa, Staphylococcus
YEMFMKFLSDIKEINGIIT

SEQ ID NO: 2046665 - protein, 17 aa, Staphylococcus
YEMPLYLVEKFNGWESR

SEQ ID NO: 2046666 - protein, 21 aa, Staphylococcus
YEMSNVIGVGIGVPGPVDFET

SEQ ID NO: 2046667 - protein, 33 aa, Staphylococcus
YENDIGKLLGLKRKLRPVHNIRKLSKKDMKNNN

SEQ ID NO: 2046668 - protein, 23 aa, Staphylococcus
YENELNCRLGITQLPTHGLAIRI

SEQ ID NO: 2046669 - protein, 17 aa, Staphylococcus
YENGRFVQGLTRGDGTT

SEQ ID NO: 2046670 - protein, 20 aa, Staphylococcus
YENIEIYKAAWEKIIDKYET

SEQ ID NO: 2046671 - protein, 18 aa, Staphylococcus
YENIPLWHERDISHSSAE

SEQ ID NO: 2046672 - protein, 18 aa, Staphylococcus
YENLKHFMHVTPYNIDNT

SEQ ID NO: 2046673 - protein, 24 aa, Staphylococcus
YENPRFVEDLIRLIAADLVDFDWL

SEQ ID NO: 2046674 - protein, 35 aa, Staphylococcus
YENPRFVEDLIRLIAADLVEFDWIDGFDIECRNEE

SEQ ID NO: 2046675 - protein, 36 aa, Staphylococcus
YENPRFVEDLIRLIAADLVEFDWIDGFDIECRNEES

SEQ ID NO: 2046676 - protein, 24 aa, Staphylococcus
YENPRFVEDLIRLIAADLVELDWA

SEQ ID NO: 2046677 - protein, 18 aa, Staphylococcus
YENRLLKKIKDAAQNMYL

SEQ ID NO: 2046678 - protein, 22 aa, Staphylococcus
YENSKMCLFEPRVFSDTQDIAD

SEQ ID NO: 2046679 - protein, 17 aa, Staphylococcus
YENVPLWHERDISHSSA

SEQ ID NO: 2046680 - protein, 25 aa, Staphylococcus
YEPADLKAHRMVNVILDKEAAAGLP

SEQ ID NO: 2046681 - protein, 30 aa, Staphylococcus
YEPDLLLTMCYADCVPVYFYSKKHHFVALA

SEQ ID NO: 2046682 - protein, 21 aa, Staphylococcus
YEPKSIVPLNDWTLEVANQLN

SEQ ID NO: 2046683 - protein, 31 aa, Staphylococcus
YEPNLLLTMCYADCVPIYFYSEKNHFIGLAH

SEQ ID NO: 2046684 - protein, 18 aa, Staphylococcus
YEPNLTLYDYFKTWCETF

SEQ ID NO: 2046685 - protein, 19 aa, Staphylococcus
YEPTLPWSVYKFTQANIHK

SEQ ID NO: 2046686 - protein, 22 aa, Staphylococcus
YEQLEYPMGNWESINIIDNIVN

SEQ ID NO: 2046687 - protein, 30 aa, Staphylococcus
YEQLMPILGVCLGFQLIVEYYGGRIIHSPK

SEQ ID NO: 2046688 - protein, 25 aa, Staphylococcus
YEQRMPKIVIVIDELADLMMMAPQE

SEQ ID NO: 2046689 - protein, 26 aa, Staphylococcus
YEQVPLPRPERWGLLVSEDSPFRGQS

SEQ ID NO: 2046690 - protein, 27 aa, Staphylococcus
YEREFRKIFGDSDFDYVVDFSGYSMFW

SEQ ID NO: 2046691 - protein, 18 aa, Staphylococcus
YERGELLDAASIKLAGRD

SEQ ID NO: 2046692 - protein, 17 aa, Staphylococcus
YERLDRPGIESSNERNN

SEQ ID NO: 2046693 - protein, 23 aa, Staphylococcus
YERLEGFNSLQWPVAPDGIDQPT

SEQ ID NO: 2046694 - protein, 28 aa, Staphylococcus
YERPKGKFRFPMRVLEEANDSLKTDDEL

SEQ ID NO: 2046695 - protein, 19 aa, Staphylococcus
YERVEPIWASYMEHPFIKG

SEQ ID NO: 2046696 - protein, 17 aa, Staphylococcus
YERYILAVVDWIENTLI

SEQ ID NO: 2046697 - protein, 22 aa, Staphylococcus
YESSKMCLFEPRVFSDTQDIAD

SEQ ID NO: 2046698 - protein, 26 aa, Staphylococcus
YETDFITCVAFGKTAEIIANNFKKGN

SEQ ID NO: 2046699 - protein, 21 aa, Staphylococcus
YETDNIPSLFSFEKNESVIYL

SEQ ID NO: 2046700 - protein, 26 aa, Staphylococcus
YETGLRIGELLSLYIDDIKYDLTNGH

SEQ ID NO: 2046701 - protein, 17 aa, Staphylococcus
YETLGEILSLPPFLEPK

SEQ ID NO: 2046702 - protein, 18 aa, Staphylococcus
YETLRYNEETALGYANKF

SEQ ID NO: 2046703 - protein, 23 aa, Staphylococcus
YETMEAFDLPKYLMAHRDELDLK

SEQ ID NO: 2046704 - protein, 38 aa, Staphylococcus
YEVARKYFLERTFRKPSEFYNPLTLYRGLKLKTFNNAN

SEQ ID NO: 2046705 - protein, 21 aa, Staphylococcus
YEVIKYPLIDITVNYNDEKNP

SEQ ID NO: 2046706 - protein, 25 aa, Staphylococcus
YEVLCNLGRRLPRIYKFDNKEYIIN

SEQ ID NO: 2046707 - protein, 21 aa, Staphylococcus
YEVLCNLGRRLPRIYQVDDEM

SEQ ID NO: 2046708 - protein, 19 aa, Staphylococcus
YEVLCRIGRRVPRIYEPEK

SEQ ID NO: 2046709 - protein, 20 aa, Staphylococcus
YEVLCRLSRRLPRVYHSSKD

SEQ ID NO: 2046710 - protein, 18 aa, Staphylococcus
YEVNKSALVKKIDELRAD

SEQ ID NO: 2046711 - protein, 20 aa, Staphylococcus
YEVPKIAVLGTCFSRNGLNT

SEQ ID NO: 2046712 - protein, 20 aa, Staphylococcus
YEVQHSCFALDDLIQRFHIE

SEQ ID NO: 2046713 - protein, 26 aa, Staphylococcus
YEVSILKMKLLIWLTETETGDIQELN

SEQ ID NO: 2046714 - protein, 28 aa, Staphylococcus
YEVSYLPLRFCEGLERFDFNNVSLYETL

SEQ ID NO: 2046715 - protein, 24 aa, Staphylococcus
YEVTYEILEQLGLGANDIGTDQLK

SEQ ID NO: 2046716 - protein, 29 aa, Staphylococcus
YEVVNEWPYEALVKIFYRYGEEKFSKQIA

SEQ ID NO: 2046717 - protein, 17 aa, Staphylococcus
YEWLQQSTFNFPDKEKL

SEQ ID NO: 2046718 - protein, 20 aa, Staphylococcus
YEWLQQSTFNFPDKEKLKRL

SEQ ID NO: 2046719 - protein, 20 aa, Staphylococcus
YEWLQQSTFNFPDKTKLKRL

SEQ ID NO: 2046720 - protein, 23 aa, Staphylococcus
YEWPEKMLLKELKKLALQQKIEK

SEQ ID NO: 2046721 - protein, 18 aa, Staphylococcus
YEYDLEYGTNILTMHNDA

SEQ ID NO: 2046722 - protein, 17 aa, Staphylococcus
YEYLKDYINQFNIQITD

SEQ ID NO: 2046723 - protein, 24 aa, Staphylococcus
YEYPRMVHDFPLYPIRESHKVIKQ

SEQ ID NO: 2046724 - protein, 22 aa, Staphylococcus
YEYSPLRVKYPYIRGKLLDLWT

SEQ ID NO: 2046725 - protein, 21 aa, Staphylococcus
YEYSPLRVKYPYIRGQLLELW

SEQ ID NO: 2046726 - protein, 25 aa, Staphylococcus
YEYYGGTIIHGLKPVHGHTTTLTHR

SEQ ID NO: 2046727 - protein, 25 aa, Staphylococcus
YFAEGFKGICLRTTSIEETAQRLCD

SEQ ID NO: 2046728 - protein, 17 aa, Staphylococcus
YFAHAKVASLILGATFP

SEQ ID NO: 2046729 - protein, 18 aa, Staphylococcus
YFAKYGILLADYLGIDTI

SEQ ID NO: 2046730 - protein, 19 aa, Staphylococcus
YFAQIAVQVARYLDVDTIA

SEQ ID NO: 2046731 - protein, 25 aa, Staphylococcus
YFATAVDVASAWTLMENMLASYEKH

SEQ ID NO: 2046732 - protein, 18 aa, Staphylococcus
YFCEARYIDHESFLFQIH

SEQ ID NO: 2046733 - protein, 23 aa, Staphylococcus
YFCPHCSSQLLLKCGTKNIPHFA

SEQ ID NO: 2046734 - protein, 19 aa, Staphylococcus
YFCSYQLAKRTVQSHRYGL

SEQ ID NO: 2046735 - protein, 19 aa, Staphylococcus
YFDDTTMINLEMIMDLKVL

SEQ ID NO: 2046736 - protein, 22 aa, Staphylococcus
YFDFYKSQEFVPQFEKVKELFA

SEQ ID NO: 2046737 - protein, 19 aa, Staphylococcus
YFDKLFLSFIQYVSRHKGE

SEQ ID NO: 2046738 - protein, 17 aa, Staphylococcus
YFDKSYEQLIFKQHTSR

SEQ ID NO: 2046739 - protein, 17 aa, Staphylococcus
YFEIKLIIVGIERGDLH

SEQ ID NO: 2046740 - protein, 25 aa, Staphylococcus
YFENEGFKVIGYRDVPVNTNAIAKH

SEQ ID NO: 2046741 - protein, 25 aa, Staphylococcus
YFESEGLKVIGYRDVPVEVSAVPPH

SEQ ID NO: 2046742 - protein, 25 aa, Staphylococcus
YFGGIKLGGGGLIRAYSGAVRDVIF

SEQ ID NO: 2046743 - protein, 19 aa, Staphylococcus
YFGGIKLGTGGLIRAYSGA

SEQ ID NO: 2046744 - protein, 19 aa, Staphylococcus
YFGGSYERLQDLTLQTTLP

SEQ ID NO: 2046745 - protein, 17 aa, Staphylococcus
YFGLRTDPTISIKPIPR

SEQ ID NO: 2046746 - protein, 23 aa, Staphylococcus
YFGNDKLSFLAWMNNINHYPNII

SEQ ID NO: 2046747 - protein, 19 aa, Staphylococcus
YFKHFEQTYGLAISYQANI

SEQ ID NO: 2046748 - protein, 26 aa, Staphylococcus
YFKKPGRILNSFFIKHHGYRVRIDDI

SEQ ID NO: 2046749 - protein, 19 aa, Staphylococcus
YFKNDVIKTLQYAFGSSNV

SEQ ID NO: 2046750 - protein, 19 aa, Staphylococcus
YFKPEIKATEIYNLISGQT

SEQ ID NO: 2046751 - protein, 26 aa, Staphylococcus
YFKQEAIEFAWEFLTSEKWMAMEPKL

SEQ ID NO: 2046752 - protein, 19 aa, Staphylococcus
YFKYLISVLRLQNWIPPMQ

SEQ ID NO: 2046753 - protein, 19 aa, Staphylococcus
YFLAPALHFLKHFSTTNQA

SEQ ID NO: 2046754 - protein, 19 aa, Staphylococcus
YFLCHDILEDAWKEQPSYS

SEQ ID NO: 2046755 - protein, 18 aa, Staphylococcus
YFLCHDILEDAWKKQPFF

SEQ ID NO: 2046756 - protein, 19 aa, Staphylococcus
YFLCHDILEEAWKENENFS

SEQ ID NO: 2046757 - protein, 19 aa, Staphylococcus
YFLCHDILEEAWKENKSFS

SEQ ID NO: 2046758 - protein, 19 aa, Staphylococcus
YFLCHDILEEAWKLNPSFS

SEQ ID NO: 2046759 - protein, 26 aa, Staphylococcus
YFLCHDILEEAWKSNINFSKKDGIVS

SEQ ID NO: 2046760 - protein, 21 aa, Staphylococcus
YFLSNEDYLIFTHAIKEEFKD

SEQ ID NO: 2046761 - protein, 19 aa, Staphylococcus
YFLYKGIETKLNIIVQDEK

SEQ ID NO: 2046762 - protein, 20 aa, Staphylococcus
YFMRLKQFYDDSVIYSSLDE

SEQ ID NO: 2046763 - protein, 26 aa, Staphylococcus
YFMTIPEAARLVLQAGALATGGEIFV

SEQ ID NO: 2046764 - protein, 17 aa, Staphylococcus
YFMYGLETFAESNNSDM

SEQ ID NO: 2046765 - protein, 18 aa, Staphylococcus
YFNGLYLITPFQKVDYTL

SEQ ID NO: 2046766 - protein, 18 aa, Staphylococcus
YFNGLYLITPFQRIDYSL

SEQ ID NO: 2046767 - protein, 22 aa, Staphylococcus
YFNPKVPIAPDFIVTNSEVEQN

SEQ ID NO: 2046768 - protein, 19 aa, Staphylococcus
YFNRDRFVLSAGHGSALLY

SEQ ID NO: 2046769 - protein, 20 aa, Staphylococcus
YFNRDRFVLSAGHGSALLYS

SEQ ID NO: 2046770 - protein, 17 aa, Staphylococcus
YFNRSLNNLGLEYIDLY

SEQ ID NO: 2046771 - protein, 18 aa, Staphylococcus
YFQGAIVIISHDRYFLDK

SEQ ID NO: 2046772 - protein, 25 aa, Staphylococcus
YFQSEGLKVIGYRDVPVDVNAVAPH

SEQ ID NO: 2046773 - protein, 22 aa, Staphylococcus
YFQVKCIRLFDDLGNVSGHIIM

SEQ ID NO: 2046774 - protein, 19 aa, Staphylococcus
YFRNMPFGSGYAVFNGLKR

SEQ ID NO: 2046775 - protein, 23 aa, Staphylococcus
YFRRDHLGFVFQDFNILPTMTNK

SEQ ID NO: 2046776 - protein, 20 aa, Staphylococcus
YFSERIYELAGWHTELYLNA

SEQ ID NO: 2046777 - protein, 24 aa, Staphylococcus
YFSGNRPQIDFSLKPEGTDFQKSV

SEQ ID NO: 2046778 - protein, 21 aa, Staphylococcus
YFSGTKVRWILDNVKGAREKA

SEQ ID NO: 2046779 - protein, 26 aa, Staphylococcus
YFSKSIKDEVLWKDAYFYINGGDKIG

SEQ ID NO: 2046780 - protein, 24 aa, Staphylococcus
YFSSDRLEQEITYLQELTDLPYAV

SEQ ID NO: 2046781 - protein, 23 aa, Staphylococcus
YFSTRKSNVFLFGVKILFIAITP

SEQ ID NO: 2046782 - protein, 18 aa, Staphylococcus
YFTSLKLCHSINLLMTSH

SEQ ID NO: 2046783 - protein, 20 aa, Staphylococcus
YFTSLSHRTIVYKGWLRSDQ

SEQ ID NO: 2046784 - protein, 25 aa, Staphylococcus
YFTSLSKRTIVYKGWLRSDQIKELY

SEQ ID NO: 2046785 - protein, 18 aa, Staphylococcus
YFVKCFIAKMLSQLHYHV

SEQ ID NO: 2046786 - protein, 17 aa, Staphylococcus
YFVLRRIPERELKNIRE

SEQ ID NO: 2046787 - protein, 19 aa, Staphylococcus
YFWMLERDYSRFVDSMKRI

SEQ ID NO: 2046788 - protein, 17 aa, Staphylococcus
YFYDIKCYTNDDIKTYV

SEQ ID NO: 2046789 - protein, 19 aa, Staphylococcus
YFYKNEIALGNALKKADIP

SEQ ID NO: 2046790 - protein, 25 aa, Staphylococcus
YFYNMWCQHIFNFLSSGVRSSLTAN

SEQ ID NO: 2046791 - protein, 21 aa, Staphylococcus
YFYQIELVRMYTFEDFAKSVN

SEQ ID NO: 2046792 - protein, 19 aa, Staphylococcus
YGADSLRWALISDSAPWNN

SEQ ID NO: 2046793 - protein, 20 aa, Staphylococcus
YGADSLRYFLATGSSPGNDL

SEQ ID NO: 2046794 - protein, 25 aa, Staphylococcus
YGAILRKLIKHDINVIALHTNLDVY

SEQ ID NO: 2046795 - protein, 17 aa, Staphylococcus
YGAINVHASLLPKYRGG

SEQ ID NO: 2046796 - protein, 19 aa, Staphylococcus
YGATGRFGGFLNEDLGIKH

SEQ ID NO: 2046797 - protein, 20 aa, Staphylococcus
YGAVNLHWTNHVNVREIFSK

SEQ ID NO: 2046798 - protein, 29 aa, Staphylococcus
YGAYKRIKNVYDFNDFQLAIDHIQVDPYA

SEQ ID NO: 2046799 - protein, 26 aa, Staphylococcus
YGAYKRTKGIYAFDQFHLAIDHVQVD

SEQ ID NO: 2046800 - protein, 30 aa, Staphylococcus
YGAYKRTKGVYEFDQFRLAIDHVQVDPFAP

SEQ ID NO: 2046801 - protein, 22 aa, Staphylococcus
YGDAAYFTMVVFNVMFGGDPSS

SEQ ID NO: 2046802 - protein, 21 aa, Staphylococcus
YGDEARFIFNIGQNEVPTAQH

SEQ ID NO: 2046803 - protein, 18 aa, Staphylococcus
YGDERKTEIQLGGLDDIE

SEQ ID NO: 2046804 - protein, 19 aa, Staphylococcus
YGDEVDYIITLTYGSQDAV

SEQ ID NO: 2046805 - protein, 18 aa, Staphylococcus
YGDFGSFYVGHILNTDDF

SEQ ID NO: 2046806 - protein, 18 aa, Staphylococcus
YGDLSLLDTPTFLFGMRN

SEQ ID NO: 2046807 - protein, 29 aa, Staphylococcus
YGDLWEGTHFSFGFSKLYRTNCPTCGQNP

SEQ ID NO: 2046808 - protein, 18 aa, Staphylococcus
YGDREFDLGATRVFGGFS

SEQ ID NO: 2046809 - protein, 18 aa, Staphylococcus
YGDWTFEEAQKWLDIGIE

SEQ ID NO: 2046810 - protein, 25 aa, Staphylococcus
YGDYFPHRLGHGLGLEEHEYQDVSS

SEQ ID NO: 2046811 - protein, 19 aa, Staphylococcus
YGEFGGFYIGHILKTDDFE

SEQ ID NO: 2046812 - protein, 19 aa, Staphylococcus
YGEFGSFYVGHILKSEDFT

SEQ ID NO: 2046813 - protein, 17 aa, Staphylococcus
YGEGLALKTRDELRKLE

SEQ ID NO: 2046814 - protein, 26 aa, Staphylococcus
YGELHVSGIVTFGHLLARAVGRDVGR

SEQ ID NO: 2046815 - protein, 18 aa, Staphylococcus
YGELIKLKVENMREQHRE

SEQ ID NO: 2046816 - protein, 20 aa, Staphylococcus
YGENVWLDAFENYGVSIHVT

SEQ ID NO: 2046817 - protein, 24 aa, Staphylococcus
YGEPKYYSSSAWGKECTYKIGNKD

SEQ ID NO: 2046818 - protein, 30 aa, Staphylococcus
YGERVVVFWHHYLRPEIKFDGIDPLVEQMN

SEQ ID NO: 2046819 - protein, 26 aa, Staphylococcus
YGERVVVYWHHFLRPEIKFDGIDPLV

SEQ ID NO: 2046820 - protein, 27 aa, Staphylococcus
YGEVIGVKGLVTWFRPESYYTDKPWRG

SEQ ID NO: 2046821 - protein, 25 aa, Staphylococcus
YGEYFPHRLGHGLGLEEHEYQDVSS

SEQ ID NO: 2046822 - protein, 19 aa, Staphylococcus
YGFDFKKSLGQNFLVDVNI

SEQ ID NO: 2046823 - protein, 25 aa, Staphylococcus
YGFYEEMNHLLYCSSAGHEPGYVYR

SEQ ID NO: 2046824 - protein, 19 aa, Staphylococcus
YGGAEMNVAIGLSGLGVKT

SEQ ID NO: 2046825 - protein, 21 aa, Staphylococcus
YGGEIKDCIDYALCVNEEGDL

SEQ ID NO: 2046826 - protein, 21 aa, Staphylococcus
YGGEIKDCIDYALCVNEHGDL

SEQ ID NO: 2046827 - protein, 21 aa, Staphylococcus
YGGEVKDCIDYALCVNEDGDL

SEQ ID NO: 2046828 - protein, 20 aa, Staphylococcus
YGGEVKDCIDYALCVNEQGD

SEQ ID NO: 2046829 - protein, 25 aa, Staphylococcus
YGGFARHGGGCFSGKDPTKVDRSAA

SEQ ID NO: 2046830 - protein, 25 aa, Staphylococcus
YGGYARHGGGCFSGKDPTKVDRSAA

SEQ ID NO: 2046831 - protein, 17 aa, Staphylococcus
YGGYCLPKDTKQLKANY

SEQ ID NO: 2046832 - protein, 19 aa, Staphylococcus
YGHARICSILKQAKEQGID

SEQ ID NO: 2046833 - protein, 26 aa, Staphylococcus
YGHFGRTDILLPWEKLDKVNVLKDTI

SEQ ID NO: 2046834 - protein, 25 aa, Staphylococcus
YGHFGRTDVLLPWEKLDKVNILKDA

SEQ ID NO: 2046835 - protein, 26 aa, Staphylococcus
YGHFGRTDVLLPWEKLDKVNLLKDSV

SEQ ID NO: 2046836 - protein, 23 aa, Staphylococcus
YGHMSPFMVVGMIAGIKAGCGYV

SEQ ID NO: 2046837 - protein, 22 aa, Staphylococcus
YGHMSPYMLVGMIGAIKAGCGY

SEQ ID NO: 2046838 - protein, 17 aa, Staphylococcus
YGIDFKGPCLKCLLKQM

SEQ ID NO: 2046839 - protein, 29 aa, Staphylococcus
YGIGSFVYRRRLPFHAQRLEQWLMQLPQN

SEQ ID NO: 2046840 - protein, 17 aa, Staphylococcus
YGIMKGVQAVRVHNVKL

SEQ ID NO: 2046841 - protein, 23 aa, Staphylococcus
YGINLRPLLTLAEAYYDGNNPAF

SEQ ID NO: 2046842 - protein, 21 aa, Staphylococcus
YGINLRPLLTLAEEHYNGENP

SEQ ID NO: 2046843 - protein, 22 aa, Staphylococcus
YGINLRPLLTLAEKHYDGDNPA

SEQ ID NO: 2046844 - protein, 22 aa, Staphylococcus
YGINLRPLLTLAEKHYDGKNKA

SEQ ID NO: 2046845 - protein, 23 aa, Staphylococcus
YGINLRPLLTLAEKYYDAENPAF

SEQ ID NO: 2046846 - protein, 23 aa, Staphylococcus
YGINLRPLLTLAEKYYSGDNPAF

SEQ ID NO: 2046847 - protein, 21 aa, Staphylococcus
YGIQIIIAGSFSDIFYMNCTK

SEQ ID NO: 2046848 - protein, 33 aa, Staphylococcus
YGIVQGVGFRFYTQRIAHKFKITGTVQNIEDYV

SEQ ID NO: 2046849 - protein, 23 aa, Staphylococcus
YGKEIQASPDFGRIVNQTHFDRL

SEQ ID NO: 2046850 - protein, 17 aa, Staphylococcus
YGKFKGDLAEIVKDFLI

SEQ ID NO: 2046851 - protein, 17 aa, Staphylococcus
YGKFKGDLAEIVKSFLV

SEQ ID NO: 2046852 - protein, 17 aa, Staphylococcus
YGKFKTDLSEIVKDFLI

SEQ ID NO: 2046853 - protein, 17 aa, Staphylococcus
YGKHVGVNYMLGKDSIQ

SEQ ID NO: 2046854 - protein, 20 aa, Staphylococcus
YGKKDILEVLSYLDELKRNR

SEQ ID NO: 2046855 - protein, 24 aa, Staphylococcus
YGKTECWYIISAKEGAEIIYGVHA

SEQ ID NO: 2046856 - protein, 23 aa, Staphylococcus
YGKTECWYILDAKENAEIIYGVN

SEQ ID NO: 2046857 - protein, 19 aa, Staphylococcus
YGLDIKIVLINNGTLGMVK

SEQ ID NO: 2046858 - protein, 18 aa, Staphylococcus
YGLDKGFNLTLHAGECGC

SEQ ID NO: 2046859 - protein, 18 aa, Staphylococcus
YGLEPVIALNSFIHDTEA

SEQ ID NO: 2046860 - protein, 17 aa, Staphylococcus
YGLFIYNKWKGMGTLSS

SEQ ID NO: 2046861 - protein, 19 aa, Staphylococcus
YGLGVSTLLAERIKKLSPS

SEQ ID NO: 2046862 - protein, 26 aa, Staphylococcus
YGLIPEFIGRIPIVANLETLDIAALK

SEQ ID NO: 2046863 - protein, 17 aa, Staphylococcus
YGLKHMMDFYQLDFHGH

SEQ ID NO: 2046864 - protein, 19 aa, Staphylococcus
YGLNIKIVLINNGTLGMVK

SEQ ID NO: 2046865 - protein, 17 aa, Staphylococcus
YGLVLWSSIGRVIDVPT

SEQ ID NO: 2046866 - protein, 17 aa, Staphylococcus
YGLVLWSSLGRVIDVPT

SEQ ID NO: 2046867 - protein, 20 aa, Staphylococcus
YGLYHAYRLAIAPTQSISYV

SEQ ID NO: 2046868 - protein, 17 aa, Staphylococcus
YGMAPGMLVEYEDKKVI

SEQ ID NO: 2046869 - protein, 18 aa, Staphylococcus
YGNDSIFWQGDITPEIMK

SEQ ID NO: 2046870 - protein, 17 aa, Staphylococcus
YGNKEIAEKLFVSVKTV

SEQ ID NO: 2046871 - protein, 18 aa, Staphylococcus
YGNLSLLDTPTFFFGMRH

SEQ ID NO: 2046872 - protein, 17 aa, Staphylococcus
YGNPVFTMVAGEVAFKE

SEQ ID NO: 2046873 - protein, 30 aa, Staphylococcus
YGPDLDALLAHYKLDFEKFVKLHTQPTYFV

SEQ ID NO: 2046874 - protein, 17 aa, Staphylococcus
YGPGELIIPDYNGSLVE

SEQ ID NO: 2046875 - protein, 20 aa, Staphylococcus
YGPHWERLSKAKAFTLDILK

SEQ ID NO: 2046876 - protein, 21 aa, Staphylococcus
YGPQFKRGRYNDIINSALNYG

SEQ ID NO: 2046877 - protein, 25 aa, Staphylococcus
YGPTESTVMCLIKLMTKKVKTSNLG

SEQ ID NO: 2046878 - protein, 23 aa, Staphylococcus
YGRKLSIGVMPQGPLTIPYVEDE

SEQ ID NO: 2046879 - protein, 19 aa, Staphylococcus
YGRVRAMVNDAGKRVKSAG

SEQ ID NO: 2046880 - protein, 17 aa, Staphylococcus
YGRVRAMVNDLGQRIKT

SEQ ID NO: 2046881 - protein, 20 aa, Staphylococcus
YGSDLLLRTFLKEHPPGPSK

SEQ ID NO: 2046882 - protein, 17 aa, Staphylococcus
YGSIAALKFIEQVDLKR

SEQ ID NO: 2046883 - protein, 25 aa, Staphylococcus
YGSPWFQLSNLHIKTSLEDLTCPIT

SEQ ID NO: 2046884 - protein, 20 aa, Staphylococcus
YGTASGRVFLVDTTNGEIIS

SEQ ID NO: 2046885 - protein, 19 aa, Staphylococcus
YGTASGRVILVNTSDGKIV

SEQ ID NO: 2046886 - protein, 22 aa, Staphylococcus
YGTDEHPGWWREIIDGGYMPIN

SEQ ID NO: 2046887 - protein, 36 aa, Staphylococcus
YGTIKYALLEGHRFAKACPLSAAFNAQGLIDYDWYD

SEQ ID NO: 2046888 - protein, 18 aa, Staphylococcus
YGTKMMMFLPQYVQELFP

SEQ ID NO: 2046889 - protein, 24 aa, Staphylococcus
YGTMKFALTQGRLFSKASPLSSVF

SEQ ID NO: 2046890 - protein, 22 aa, Staphylococcus
YGTRIIGLRAGELVFDGPASEA

SEQ ID NO: 2046891 - protein, 21 aa, Staphylococcus
YGTRIIGLRAGELVYDGPASE

SEQ ID NO: 2046892 - protein, 17 aa, Staphylococcus
YGTRLDVFGADEDKQKQ

SEQ ID NO: 2046893 - protein, 28 aa, Staphylococcus
YGTSIPTCVLVFKKCREADQDVLFIDAS

SEQ ID NO: 2046894 - protein, 17 aa, Staphylococcus
YGTTMMMHIPQYVQLLF

SEQ ID NO: 2046895 - protein, 23 aa, Staphylococcus
YGVDFGTGYALEFGGSTMRNLSM

SEQ ID NO: 2046896 - protein, 23 aa, Staphylococcus
YGVDFGTGYALEFTGEAIRQLSM

SEQ ID NO: 2046897 - protein, 23 aa, Staphylococcus
YGVDFGTGYALEFTGETIKSLSM

SEQ ID NO: 2046898 - protein, 22 aa, Staphylococcus
YGVDFGTGYALEFTGETIQSLS

SEQ ID NO: 2046899 - protein, 19 aa, Staphylococcus
YGVKDSYELALNDWLGSAQ

SEQ ID NO: 2046900 - protein, 18 aa, Staphylococcus
YGVMICYSEEDLTKAKTR

SEQ ID NO: 2046901 - protein, 25 aa, Staphylococcus
YGVPSRELEKSFELQNYDLVNSERK

SEQ ID NO: 2046902 - protein, 21 aa, Staphylococcus
YGVWHPKAWHSAPKALNFSDS

SEQ ID NO: 2046903 - protein, 17 aa, Staphylococcus
YGVYNYFGIGAYDNNPN

SEQ ID NO: 2046904 - protein, 19 aa, Staphylococcus
YGYCTEMMVRFGKDKKEFN

SEQ ID NO: 2046905 - protein, 19 aa, Staphylococcus
YGYCTEMMVRFGKDKRAFD

SEQ ID NO: 2046906 - protein, 19 aa, Staphylococcus
YGYEGRGNIHFEGGTLDSN

SEQ ID NO: 2046907 - protein, 26 aa, Staphylococcus
YGYGSSYVCALEFYQKLSRIGLNIQL

SEQ ID NO: 2046908 - protein, 19 aa, Staphylococcus
YGYNIDGLLEFFKSELSDS

SEQ ID NO: 2046909 - protein, 17 aa, Staphylococcus
YGYRGNSKYLFSYFVKR

SEQ ID NO: 2046910 - protein, 17 aa, Staphylococcus
YGYYLGEVNLTIENKTV

SEQ ID NO: 2046911 - protein, 18 aa, Staphylococcus
YHAGESLTIHMIMPDGKY

SEQ ID NO: 2046912 - protein, 18 aa, Staphylococcus
YHALCEEILEIGNQRDDR

SEQ ID NO: 2046913 - protein, 17 aa, Staphylococcus
YHCLARAPKCDICPLFD

SEQ ID NO: 2046914 - protein, 17 aa, Staphylococcus
YHCSLALDEVERSFLRE

SEQ ID NO: 2046915 - protein, 29 aa, Staphylococcus
YHDIPDKLWRISPLKSFWGINKKTEIKLN

SEQ ID NO: 2046916 - protein, 19 aa, Staphylococcus
YHDSLLKFYELGARYIQLD

SEQ ID NO: 2046917 - protein, 17 aa, Staphylococcus
YHDSTVHGFELMFDKMN

SEQ ID NO: 2046918 - protein, 23 aa, Staphylococcus
YHFKSVCINPTYVKHAAEALKDS

SEQ ID NO: 2046919 - protein, 17 aa, Staphylococcus
YHFPRVWLEKDSYDFSF

SEQ ID NO: 2046920 - protein, 23 aa, Staphylococcus
YHFRRSNFKGAYKSFSKAKQVIK

SEQ ID NO: 2046921 - protein, 18 aa, Staphylococcus
YHGKYSFDTFSHMKSYIF

SEQ ID NO: 2046922 - protein, 17 aa, Staphylococcus
YHGPNQAHGLAFSVQPD

SEQ ID NO: 2046923 - protein, 25 aa, Staphylococcus
YHIEALKELVTFVVVNRGKAEQEIE

SEQ ID NO: 2046924 - protein, 22 aa, Staphylococcus
YHILDVIFWFGKMDILAAHQVS

SEQ ID NO: 2046925 - protein, 17 aa, Staphylococcus
YHIPCKVYKELQEQTFE

SEQ ID NO: 2046926 - protein, 22 aa, Staphylococcus
YHIQTDLGLIIKVKTDASLSEY

SEQ ID NO: 2046927 - protein, 25 aa, Staphylococcus
YHISKRISVLEAMLPSAIKAKYTKV

SEQ ID NO: 2046928 - protein, 17 aa, Staphylococcus
YHKAVEMEYRFFSFGDA

SEQ ID NO: 2046929 - protein, 19 aa, Staphylococcus
YHKDVQVLGAIMMHQGNIS

SEQ ID NO: 2046930 - protein, 18 aa, Staphylococcus
YHKLKLYLQVGLVKITKK

SEQ ID NO: 2046931 - protein, 22 aa, Staphylococcus
YHKNQALECLNNISSQYQTSEL

SEQ ID NO: 2046932 - protein, 21 aa, Staphylococcus
YHKRPDLLDRYPLTEDDEKFI

SEQ ID NO: 2046933 - protein, 17 aa, Staphylococcus
YHKVIFLDTTTNFKFLS

SEQ ID NO: 2046934 - protein, 17 aa, Staphylococcus
YHLAELYGIDPTIENLN

SEQ ID NO: 2046935 - protein, 19 aa, Staphylococcus
YHLEGFVAKPEHSRSNKHY

SEQ ID NO: 2046936 - protein, 25 aa, Staphylococcus
YHLLYRCFDKLFERHIGLAMTIKSK

SEQ ID NO: 2046937 - protein, 19 aa, Staphylococcus
YHLMPKCVYTYPEVASIGL

SEQ ID NO: 2046938 - protein, 26 aa, Staphylococcus
YHLNQRLKLQLMDDIKSVYNSQMTQN

SEQ ID NO: 2046939 - protein, 19 aa, Staphylococcus
YHLNVKIVLINNGTLGMVK

SEQ ID NO: 2046940 - protein, 19 aa, Staphylococcus
YHLQRRKSLSHGYSGLEID

SEQ ID NO: 2046941 - protein, 25 aa, Staphylococcus
YHLTKRISVLEVMLPNAIKAKYQKA

SEQ ID NO: 2046942 - protein, 17 aa, Staphylococcus
YHMNKWQYKTLPSINQW

SEQ ID NO: 2046943 - protein, 30 aa, Staphylococcus; identical to SEQ ID NO: 1794209

SEQ ID NO: 2046944 - protein, 31 aa, Staphylococcus
YHMPTHCPSCGHKLVRIEGEVALRCINPKCQ

SEQ ID NO: 2046945 - protein, 17 aa, Staphylococcus
YHMRPRILVTKKDLTSL

SEQ ID NO: 2046946 - protein, 24 aa, Staphylococcus
YHNGSFKILAEINLNQTSNEAQLN

SEQ ID NO: 2046947 - protein, 29 aa, Staphylococcus
YHNVSRKKQEIFLKGHIDAFNNYEDKNIY

SEQ ID NO: 2046948 - protein, 17 aa, Staphylococcus
YHPDYAIMTNIDFDHPD

SEQ ID NO: 2046949 - protein, 24 aa, Staphylococcus
YHPDYEFLQNIGIDIKTNEYGTAP

SEQ ID NO: 2046950 - protein, 19 aa, Staphylococcus
YHPEARPGPSDSNYLFDDF

SEQ ID NO: 2046951 - protein, 25 aa, Staphylococcus
YHPNYEFLESIGIEINTNEYGTAPV

SEQ ID NO: 2046952 - protein, 24 aa, Staphylococcus
YHQGDLFMDPGFVIGHEPMGIVEE

SEQ ID NO: 2046953 - protein, 18 aa, Staphylococcus
YHQHHWLAKLNFKEISTS

SEQ ID NO: 2046954 - protein, 22 aa, Staphylococcus
YHQKHRPVLLITRTAEAAEYFS

SEQ ID NO: 2046955 - protein, 23 aa, Staphylococcus
YHQKVCKIRGLPHISKIQTEDIL

SEQ ID NO: 2046956 - protein, 18 aa, Staphylococcus
YHQLEEIDSFNVLPDDDY

SEQ ID NO: 2046957 - protein, 24 aa, Staphylococcus
YHQLKPDKFYFLPSYMAPLKTHDD

SEQ ID NO: 2046958 - protein, 19 aa, Staphylococcus
YHQRMEKYYSEELAISQRI

SEQ ID NO: 2046959 - protein, 27 aa, Staphylococcus
YHRLKHYKDRVLVPMAYIDFDEYLKEL

SEQ ID NO: 2046960 - protein, 17 aa, Staphylococcus
YHRQRQKLIGTIEVPMT

SEQ ID NO: 2046961 - protein, 28 aa, Staphylococcus
YHRSSFKTSEVPSAIFGTKKRRPIENGV

SEQ ID NO: 2046962 - protein, 17 aa, Staphylococcus
YHSAFKQSGLTYNISYA

SEQ ID NO: 2046963 - protein, 25 aa, Staphylococcus
YHSEWSRTQIQDWIKASLVKVNDQV

SEQ ID NO: 2046964 - protein, 22 aa, Staphylococcus
YHTHARVGIALYGSRPYSKLGE

SEQ ID NO: 2046965 - protein, 26 aa, Staphylococcus
YHTLKPDRFLFLPSYMSPLKAHRSEL

SEQ ID NO: 2046966 - protein, 29 aa, Staphylococcus
YHTLLTIGRYPICYINIQMDPILVDVNVH

SEQ ID NO: 2046967 - protein, 28 aa, Staphylococcus
YHTLLTIGRYPICYLNIEMDPILVDVNV

SEQ ID NO: 2046968 - protein, 17 aa, Staphylococcus
YHTLPILGICLGAQALT

SEQ ID NO: 2046969 - protein, 18 aa, Staphylococcus
YHTSRFMTFTGYTIGGSE

SEQ ID NO: 2046970 - protein, 20 aa, Staphylococcus
YHVGDLILINSYQNFLILED

SEQ ID NO: 2046971 - protein, 20 aa, Staphylococcus
YHVSGIVTFGHLLARAVARD

SEQ ID NO: 2046972 - protein, 25 aa, Staphylococcus
YHVTKRISILEAMLPSAIKAKYTKA

SEQ ID NO: 2046973 - protein, 19 aa, Staphylococcus
YHVTKRISVLEAMLPSAIK

SEQ ID NO: 2046974 - protein, 29 aa, Staphylococcus
YHYLEFEGGHMWKSWKPLLGDLLKYFLSD

SEQ ID NO: 2046975 - protein, 29 aa, Staphylococcus
YHYLEFEGGHNWKSWKPLLSDILKYYLSD

SEQ ID NO: 2046976 - protein, 26 aa, Staphylococcus
YHYLREMFKEVMGFDEFYIARAQGTS

SEQ ID NO: 2046977 - protein, 26 aa, Staphylococcus
YHYQIDPKLVPYIGSIELHSYDFYGV

SEQ ID NO: 2046978 - protein, 19 aa, Staphylococcus
YHYVFDFDSTRILKDLHTI

SEQ ID NO: 2046979 - protein, 24 aa, Staphylococcus
YIAASFVRRPSDVLDIREILEREN

SEQ ID NO: 2046980 - protein, 19 aa, Staphylococcus
YIAEIQMKLEEFKKQGKID

SEQ ID NO: 2046981 - protein, 18 aa, Staphylococcus
YIALEFASMFANFGSKVT

SEQ ID NO: 2046982 - protein, 18 aa, Staphylococcus
YIALEFASMFANFGTQVT

SEQ ID NO: 2046983 - protein, 19 aa, Staphylococcus
YIALEFASMFQSFGTNVTV

SEQ ID NO: 2046984 - protein, 17 aa, Staphylococcus
YIAMSRATSKVTFSYSL

SEQ ID NO: 2046985 - protein, 18 aa, Staphylococcus
YIDCISGFSVVNQGHCHP

SEQ ID NO: 2046986 - protein, 19 aa, Staphylococcus
YIDEHGGMIIYLPQEGRGI

SEQ ID NO: 2046987 - protein, 18 aa, Staphylococcus
YIDFNAGKIAKQLLNTFE

SEQ ID NO: 2046988 - protein, 17 aa, Staphylococcus
YIDFNSGKISKQLLNSF

SEQ ID NO: 2046989 - protein, 18 aa, Staphylococcus
YIDIKGYILYQLYGKYVM

SEQ ID NO: 2046990 - protein, 20 aa, Staphylococcus
YIDIYCALKHGVNISKTANN

SEQ ID NO: 2046991 - protein, 24 aa, Staphylococcus
YIDKFCHPSELIIDTDITIPEKAM

SEQ ID NO: 2046992 - protein, 23 aa, Staphylococcus
YIDLPFGECHFSVAAKPNVTNIQ

SEQ ID NO: 2046993 - protein, 24 aa, Staphylococcus
YIDNGGSTKLVLYGGIKGEERTKI

SEQ ID NO: 2046994 - protein, 18 aa, Staphylococcus
YIDNSVRYGFKRIFTNLL

SEQ ID NO: 2046995 - protein, 17 aa, Staphylococcus
YIDRVVVLVNPDQTQIQ

SEQ ID NO: 2046996 - protein, 19 aa, Staphylococcus
YIDSIKEIVEESGQFDLVF

SEQ ID NO: 2046997 - protein, 18 aa, Staphylococcus
YIDTAVFDFESGYLQAVE

SEQ ID NO: 2046998 - protein, 20 aa, Staphylococcus
YIDYVLSWGPLILGHENPQV

SEQ ID NO: 2046999 - protein, 21 aa, Staphylococcus
YIDYVLSWGPLILGHKNKQVI

SEQ ID NO: 2047000 - protein, 22 aa, Staphylococcus
YIDYVLSWGPLILGHKNKQVIE

SEQ ID NO: 2047001 - protein, 19 aa, Staphylococcus
YIEALTEYYSVRFGLDIIC

SEQ ID NO: 2047002 - protein, 17 aa, Staphylococcus
YIEAMKVLNEVTSDVSG

SEQ ID NO: 2047003 - protein, 25 aa, Staphylococcus
YIEDFPRQCIFIGTTNKVDFLRDET

SEQ ID NO: 2047004 - protein, 18 aa, Staphylococcus
YIEDSTIPKAEIRHFSRS

SEQ ID NO: 2047005 - protein, 19 aa, Staphylococcus
YIEIGSGMGQFITTLAAQH

SEQ ID NO: 2047006 - protein, 19 aa, Staphylococcus
YIEIGSGMGQFITTLAEQH

SEQ ID NO: 2047007 - protein, 17 aa, Staphylococcus
YIEKLGFDAIHEHEKAL

SEQ ID NO: 2047008 - protein, 17 aa, Staphylococcus
YIERCLISLKKQRFQDF

SEQ ID NO: 2047009 - protein, 19 aa, Staphylococcus
YIESGSTFQWRKQGQRHAF

SEQ ID NO: 2047010 - protein, 19 aa, Staphylococcus
YIEVGSGMGQFITELAAQH

SEQ ID NO: 2047011 - protein, 19 aa, Staphylococcus
YIEVIKFDYTMGSGGQGVG

SEQ ID NO: 2047012 - protein, 25 aa, Staphylococcus
YIEYKPEYWIKAGVNANNIKIQEDA

SEQ ID NO: 2047013 - protein, 17 aa, Staphylococcus
YIGHPLIGDTLYGGKHG

SEQ ID NO: 2047014 - protein, 24 aa, Staphylococcus
YIGIYNPRFNQIYKYDMTQADSEM

SEQ ID NO: 2047015 - protein, 18 aa, Staphylococcus
YIGNVSINGFPNVEKRPK

SEQ ID NO: 2047016 - protein, 18 aa, Staphylococcus
YIGNVTINGFPNVEQRPK

SEQ ID NO: 2047017 - protein, 18 aa, Staphylococcus
YIGNVTINGFPNVQQRPK

SEQ ID NO: 2047018 - protein, 18 aa, Staphylococcus
YIGNVTINGFPSVEKRSK

SEQ ID NO: 2047019 - protein, 20 aa, Staphylococcus
YIGSELGTAFANFGSDVTIL

SEQ ID NO: 2047020 - protein, 20 aa, Staphylococcus
YIGSELGTAFANFGSEVTIL

SEQ ID NO: 2047021 - protein, 23 aa, Staphylococcus
YIGSELGTAFANFGTEVTILEGA

SEQ ID NO: 2047022 - protein, 19 aa, Staphylococcus
YIHDIWGYIAPNTKKEQTP

SEQ ID NO: 2047023 - protein, 19 aa, Staphylococcus
YIHEIEEPDFLIVIYHGGL

SEQ ID NO: 2047024 - protein, 26 aa, Staphylococcus
YIHESEHPDFLIVIYHGGLYKINQTN

SEQ ID NO: 2047025 - protein, 17 aa, Staphylococcus
YIHIPTFVIPNIINETR

SEQ ID NO: 2047026 - protein, 29 aa, Staphylococcus
YIHIPVGVLLPFKSQCFVRHYSKGQVIYF

SEQ ID NO: 2047027 - protein, 26 aa, Staphylococcus
YIHKIKYAGAMFLGPYAPEALGDYNA

SEQ ID NO: 2047028 - protein, 33 aa, Staphylococcus
YIHKKAKSYSLGMKQKLGIAIAFLNNPKLIILD

SEQ ID NO: 2047029 - protein, 24 aa, Staphylococcus
YIHVKQMMRCCRFFIDKLRQSQHG

SEQ ID NO: 2047030 - protein, 26 aa, Staphylococcus
YIILTTEYYWHWDLKNSKLDVYEYKK

SEQ ID NO: 2047031 - protein, 26 aa, Staphylococcus
YIIRQGLKRFDMIVLTGGLGPTKDDL

SEQ ID NO: 2047032 - protein, 18 aa, Staphylococcus
YIKDNFIIYKGVRIINID

SEQ ID NO: 2047033 - protein, 26 aa, Staphylococcus
YIKESVKSSLKRLGLEQLDLYQLHGG

SEQ ID NO: 2047034 - protein, 20 aa, Staphylococcus
YIKESVKVSLKRLGLNHIDL

SEQ ID NO: 2047035 - protein, 18 aa, Staphylococcus
YIKHFYPHINEIVLTVNI

SEQ ID NO: 2047036 - protein, 23 aa, Staphylococcus
YIKNEPYGTVLIIGPFNYPVQLV

SEQ ID NO: 2047037 - protein, 21 aa, Staphylococcus
YIKPEIVLMYDFLDNQNYHQS

SEQ ID NO: 2047038 - protein, 23 aa, Staphylococcus
YIKRHPSYHLVILTKNSATQLQQ

SEQ ID NO: 2047039 - protein, 23 aa, Staphylococcus
YIKRLPVSTYRAQHRGGRGVQGM

SEQ ID NO: 2047040 - protein, 22 aa, Staphylococcus
YIKRLPVSTYRAQNRGGRGVQG

SEQ ID NO: 2047041 - protein, 23 aa, Staphylococcus
YIKRLPVSTYRSQHRGGRGVQGM

SEQ ID NO: 2047042 - protein, 27 aa, Staphylococcus
YIKRLRFLDNQLLCIETSYFNKRIVPT

SEQ ID NO: 2047043 - protein, 19 aa, Staphylococcus
YILALPEIFDKVDVFESDL

SEQ ID NO: 2047044 - protein, 19 aa, Staphylococcus
YILALPEIFNKVDVFESDL

SEQ ID NO: 2047045 - protein, 18 aa, Staphylococcus
YILGVSDRIGRLFDITGL

SEQ ID NO: 2047046 - protein, 18 aa, Staphylococcus
YILNWLVTKSNEFEMEPL

SEQ ID NO: 2047047 - protein, 18 aa, Staphylococcus
YILPYSKFEFFWERYTQE

SEQ ID NO: 2047048 - protein, 20 aa, Staphylococcus
YILSEGMTAVILPHMFTYGY

SEQ ID NO: 2047049 - protein, 19 aa, Staphylococcus
YILVYKKWQESILLAYLIN

SEQ ID NO: 2047050 - protein, 17 aa, Staphylococcus
YILWNNHYEYVFMNAHE

SEQ ID NO: 2047051 - protein, 24 aa, Staphylococcus
YILWNNYYEYVFAQAPYIDFYITA

SEQ ID NO: 2047052 - protein, 23 aa, Staphylococcus
YIMKEPYGTVLIIGPFNYPVQLV

SEQ ID NO: 2047053 - protein, 19 aa, Staphylococcus
YINAYRLAEKYSNIATNCY

SEQ ID NO: 2047054 - protein, 19 aa, Staphylococcus
YINAYRLAERYANIATNCY

SEQ ID NO: 2047055 - protein, 24 aa, Staphylococcus
YINAYRLAERYANLSSNAFDTCEV

SEQ ID NO: 2047056 - protein, 18 aa, Staphylococcus
YINCNHNLDFALSIRTML

SEQ ID NO: 2047057 - protein, 25 aa, Staphylococcus
YINCNQDLDFALAIRTMLIDDKEVH

SEQ ID NO: 2047058 - protein, 17 aa, Staphylococcus
YINDCTYFGKSDITFND

SEQ ID NO: 2047059 - protein, 19 aa, Staphylococcus
YINDHGGLIIYLPQEGRGI

SEQ ID NO: 2047060 - protein, 19 aa, Staphylococcus
YINEHGGMIIYLPQEGRGI

SEQ ID NO: 2047061 - protein, 18 aa, Staphylococcus
YINEHGGMVIYLPQEGRG

SEQ ID NO: 2047062 - protein, 25 aa, Staphylococcus
YINEPLEFEQWLAILLIKNNNLPSL

SEQ ID NO: 2047063 - protein, 18 aa, Staphylococcus
YINFEFATQLSYPVAEIL

SEQ ID NO: 2047064 - protein, 23 aa, Staphylococcus
YINHKRFNNAYMQYASTSPFYPM

SEQ ID NO: 2047065 - protein, 26 aa, Staphylococcus
YINISQTEVLTWVLGYNKTIEELIEQ

SEQ ID NO: 2047066 - protein, 25 aa, Staphylococcus
YINISQTEVLVWALGYNRTIEELIE

SEQ ID NO: 2047067 - protein, 19 aa, Staphylococcus
YINISWFKGNGSEFVASSK

SEQ ID NO: 2047068 - protein, 18 aa, Staphylococcus
YINLSSNNYLGLATNEDL

SEQ ID NO: 2047069 - protein, 23 aa, Staphylococcus
YINNRIVPVIPQQGSLGASGDLA

SEQ ID NO: 2047070 - protein, 19 aa, Staphylococcus
YINQCKFLGFNDPDGTRFF

SEQ ID NO: 2047071 - protein, 17 aa, Staphylococcus
YINQTFYSSFKSFYQNN

SEQ ID NO: 2047072 - protein, 23 aa, Staphylococcus
YIPYKTPILIAAEKKGNPIYNGL

SEQ ID NO: 2047073 - protein, 19 aa, Staphylococcus
YIQDIWGYIAPNTKKEQTP

SEQ ID NO: 2047074 - protein, 17 aa, Staphylococcus
YIQEIKENLNLPADKKV

SEQ ID NO: 2047075 - protein, 19 aa, Staphylococcus
YIQNINLKGMFFVTQAVLK

SEQ ID NO: 2047076 - protein, 26 aa, Staphylococcus
YIQPIRKLIHEPTIFNIVGPLINPFK

SEQ ID NO: 2047077 - protein, 18 aa, Staphylococcus
YIQSEMQDILSILDIEEA

SEQ ID NO: 2047078 - protein, 17 aa, Staphylococcus
YIQSLFRKLRTKRDEIK

SEQ ID NO: 2047079 - protein, 17 aa, Staphylococcus
YIRDYAVEQNATPIELD

SEQ ID NO: 2047080 - protein, 24 aa, Staphylococcus
YIRGGCSPIGMKHLFPTTIDESAL

SEQ ID NO: 2047081 - protein, 23 aa, Staphylococcus
YIRGGCSPIGMKHLFPTVIDQSA

SEQ ID NO: 2047082 - protein, 20 aa, Staphylococcus
YIRGGCSPIGMKRAFPTIID

SEQ ID NO: 2047083 - protein, 23 aa, Staphylococcus
YIRGGCSPVGMKHLFPTTIDQSA

SEQ ID NO: 2047084 - protein, 21 aa, Staphylococcus
YIRGGCSPVGMKHLYPTVIDA

SEQ ID NO: 2047085 - protein, 20 aa, Staphylococcus
YIRISYAYEMDMLKEGMRRL

SEQ ID NO: 2047086 - protein, 22 aa, Staphylococcus
YIRKGLEIIDSVNIDYTMVSDW

SEQ ID NO: 2047087 - protein, 30 aa, Staphylococcus
YIRKNVRVVIVPIVNPWGFANRERENVNNV

SEQ ID NO: 2047088 - protein, 20 aa, Staphylococcus
YIRTCYGHIAGKIGVKFTEA

SEQ ID NO: 2047089 - protein, 24 aa, Staphylococcus
YIRYLRNKLKPFGKDKVIETVRGV

SEQ ID NO: 2047090 - protein, 19 aa, Staphylococcus
YISDRIAVMYFGKIVELGP

SEQ ID NO: 2047091 - protein, 25 aa, Staphylococcus
YISGGKRPLVCYFSNDLNIHRTKTE

SEQ ID NO: 2047092 - protein, 18 aa, Staphylococcus
YISGLSILGGEPFCNLDV

SEQ ID NO: 2047093 - protein, 18 aa, Staphylococcus
YISGLSILGGEPFCNVDI

SEQ ID NO: 2047094 - protein, 25 aa, Staphylococcus
YISIEMIDALPIDNCYKHILYQHKG

SEQ ID NO: 2047095 - protein, 24 aa, Staphylococcus
YISLDDFRILKAKLFGNKDRTTEN

SEQ ID NO: 2047096 - protein, 24 aa, Staphylococcus
YISNRGHDSLAIFKVGDEGATISL

SEQ ID NO: 2047097 - protein, 20 aa, Staphylococcus
YITDRNKFISIMAGISIQYI

SEQ ID NO: 2047098 - protein, 20 aa, Staphylococcus
YITFSELYFYVVGVNEKEQV

SEQ ID NO: 2047099 - protein, 24 aa, Staphylococcus
YITPDKVHVMYGGKVVKSGGPELA

SEQ ID NO: 2047100 - protein, 24 aa, Staphylococcus
YITSLKIALSLSELVQNKQTIYQV

SEQ ID NO: 2047101 - protein, 20 aa, Staphylococcus
YIVALPEIFEKVDVFESELP

SEQ ID NO: 2047102 - protein, 20 aa, Staphylococcus
YIVALPEIFNKVDIFESELP

SEQ ID NO: 2047103 - protein, 19 aa, Staphylococcus
YIVEWLKIKCQDYGIELRQ

SEQ ID NO: 2047104 - protein, 21 aa, Staphylococcus
YIVKEPTGYLAGRDKRNVVNF

SEQ ID NO: 2047105 - protein, 23 aa, Staphylococcus
YIVKEPYGTVLIIGPFNYPFQLL

SEQ ID NO: 2047106 - protein, 18 aa, Staphylococcus
YIVKEYTYEILLVKSDGI

SEQ ID NO: 2047107 - protein, 19 aa, Staphylococcus
YIVKEYTYEILLVKSDGIK

SEQ ID NO: 2047108 - protein, 25 aa, Staphylococcus
YIVKYGKEEFLNFVATEKKSFIVFK

SEQ ID NO: 2047109 - protein, 25 aa, Staphylococcus
YIVLTTEYYWHWDLDQAQLDVFEYK

SEQ ID NO: 2047110 - protein, 27 aa, Staphylococcus
YIVLTTEYYWHWDLKSAKLDVFEYKKM

SEQ ID NO: 2047111 - protein, 18 aa, Staphylococcus
YIVNCARGKIVNKDEIVQ

SEQ ID NO: 2047112 - protein, 25 aa, Staphylococcus
YIVNSYPVWFPKAEAEEIIKDMIEL

SEQ ID NO: 2047113 - protein, 21 aa, Staphylococcus
YIVNSYPVWFPKEEAQEIIQD

SEQ ID NO: 2047114 - protein, 25 aa, Staphylococcus
YIVNSYPVWLPKADVEDIIKDMIEL

SEQ ID NO: 2047115 - protein, 24 aa, Staphylococcus
YIVPKYPNRFLIGATSEFDNYSVG

SEQ ID NO: 2047116 - protein, 19 aa, Staphylococcus
YIVTWALGHLVTNAQPEHY

SEQ ID NO: 2047117 - protein, 17 aa, Staphylococcus
YIVTWALGHLVTNATPE

SEQ ID NO: 2047118 - protein, 18 aa, Staphylococcus
YIVTWALGHLVTNATPEQ

SEQ ID NO: 2047119 - protein, 19 aa, Staphylococcus
YIVTWALGHLVTNATPEQY

SEQ ID NO: 2047120 - protein, 17 aa, Staphylococcus
YIYKCLGCGETFKRIRK

SEQ ID NO: 2047121 - protein, 18 aa, Staphylococcus
YIYSHALVNLFYQYLLTC

SEQ ID NO: 2047122 - protein, 18 aa, Staphylococcus
YKAAELMTKVYDLKQGVT

SEQ ID NO: 2047123 - protein, 24 aa, Staphylococcus
YKAAELQGRLRAERFIHLMQNEII

SEQ ID NO: 2047124 - protein, 19 aa, Staphylococcus
YKAGGKLKGKVALITGGDS

SEQ ID NO: 2047125 - protein, 20 aa, Staphylococcus
YKAHSGFTLETQCIPNDINL

SEQ ID NO: 2047126 - protein, 20 aa, Staphylococcus
YKAHSGLTIEAQYLPNDINL

SEQ ID NO: 2047127 - protein, 23 aa, Staphylococcus
YKAKRNFSKKIVFGAYKDVDKIV

SEQ ID NO: 2047128 - protein, 19 aa, Staphylococcus
YKAKSSGVVSELIANEIGV

SEQ ID NO: 2047129 - protein, 19 aa, Staphylococcus
YKANLERLGELPSIDEHHK

SEQ ID NO: 2047130 - protein, 20 aa, Staphylococcus
YKAQCTQKSFQIILPIHDAI

SEQ ID NO: 2047131 - protein, 17 aa, Staphylococcus
YKARYDVTLLINGLPLV

SEQ ID NO: 2047132 - protein, 21 aa, Staphylococcus
YKATEKNIYLSLGAIKGVGYQ

SEQ ID NO: 2047133 - protein, 24 aa, Staphylococcus
YKAVLDIETLFPFITISHFTDIEI

SEQ ID NO: 2047134 - protein, 17 aa, Staphylococcus
YKAYEAILDLPFAKESD

SEQ ID NO: 2047135 - protein, 17 aa, Staphylococcus
YKDASILITGENFGCGS

SEQ ID NO: 2047136 - protein, 20 aa, Staphylococcus
YKDEIVLIDAGIKFPDDNLL

SEQ ID NO: 2047137 - protein, 19 aa, Staphylococcus
YKDELYVIASNQFSKASNA

SEQ ID NO: 2047138 - protein, 17 aa, Staphylococcus
YKDKIGYEPSFYHVDIG

SEQ ID NO: 2047139 - protein, 23 aa, Staphylococcus
YKDKPLVCVGILKGSVMFMADLI

SEQ ID NO: 2047140 - protein, 18 aa, Staphylococcus
YKDLKDYDIALSKEETEV

SEQ ID NO: 2047141 - protein, 20 aa, Staphylococcus
YKDLLREGVDFMTMGNHTYG

SEQ ID NO: 2047142 - protein, 27 aa, Staphylococcus
YKDLVVSVRVGMEMERSELLRKLVDVQ

SEQ ID NO: 2047143 - protein, 27 aa, Staphylococcus
YKDLVVSVRVGMEMERTELLRKLVDVQ

SEQ ID NO: 2047144 - protein, 20 aa, Staphylococcus
YKDLYFAGASTHPGAGVPIV

SEQ ID NO: 2047145 - protein, 20 aa, Staphylococcus
YKDMLKQICQSWFIVTKDNV

SEQ ID NO: 2047146 - protein, 28 aa, Staphylococcus
YKDNPGLFKRLIASTFFLKMNEKQQPEF

SEQ ID NO: 2047147 - protein, 17 aa, Staphylococcus
YKDNVYLIGHSMGGYTV

SEQ ID NO: 2047148 - protein, 18 aa, Staphylococcus
YKDRISRNIHMFTNTPDM

SEQ ID NO: 2047149 - protein, 19 aa, Staphylococcus
YKEAIAINFDLVAKNEHVR

SEQ ID NO: 2047150 - protein, 18 aa, Staphylococcus
YKEALYIDQTGYGIDALV

SEQ ID NO: 2047151 - protein, 24 aa, Staphylococcus
YKEAMKHWGDEVAAVLVEPIVGNF

SEQ ID NO: 2047152 - protein, 24 aa, Staphylococcus
YKEAMKHWGNEVAAVLVEPIVGNF

SEQ ID NO: 2047153 - protein, 22 aa, Staphylococcus
YKEATVSLGKWMANQNYGLVFG

SEQ ID NO: 2047154 - protein, 19 aa, Staphylococcus
YKEGTYIGVVIHEVGEDHR

SEQ ID NO: 2047155 - protein, 24 aa, Staphylococcus
YKEIKLKAFEAHKSQTGPFLKQLA

SEQ ID NO: 2047156 - protein, 26 aa, Staphylococcus
YKEISFSVSGNGAFSKLKYENGAHRV

SEQ ID NO: 2047157 - protein, 20 aa, Staphylococcus
YKELDEFSSKLAHQLQGSQQ

SEQ ID NO: 2047158 - protein, 25 aa, Staphylococcus
YKELKLKAFEAHASQTGPFLKQLAS

SEQ ID NO: 2047159 - protein, 19 aa, Staphylococcus
YKELLREGVDFMTMGNHTY

SEQ ID NO: 2047160 - protein, 18 aa, Staphylococcus
YKEMSCQPTSKLGLATGG

SEQ ID NO: 2047161 - protein, 25 aa, Staphylococcus
YKERFNLFLDEAFEMGIDIDTLVKF

SEQ ID NO: 2047162 - protein, 27 aa, Staphylococcus
YKERNFKIKPEIAGLMISAIISDSLLF

SEQ ID NO: 2047163 - protein, 22 aa, Staphylococcus
YKEYIDKCHIIYQKIESHRKAM

SEQ ID NO: 2047164 - protein, 22 aa, Staphylococcus
YKFAEHLGHSITELFPTEVPIT

SEQ ID NO: 2047165 - protein, 17 aa, Staphylococcus
YKFFLLVASYIKRREAF

SEQ ID NO: 2047166 - protein, 31 aa, Staphylococcus
YKFFVGGKLGSGFQWYSWIHIDDLVRAILFT

SEQ ID NO: 2047167 - protein, 20 aa, Staphylococcus
YKFLKQHPFVYTRTLDHPVI

SEQ ID NO: 2047168 - protein, 20 aa, Staphylococcus
YKFNIEILSSIDAYGLAMDF

SEQ ID NO: 2047169 - protein, 19 aa, Staphylococcus
YKFPSIERKQLEPFILNLL

SEQ ID NO: 2047170 - protein, 21 aa, Staphylococcus
YKFSKIESFYNLYKLNNEVFK

SEQ ID NO: 2047171 - protein, 22 aa, Staphylococcus
YKGAATELFKFAVNLATDHGIH

SEQ ID NO: 2047172 - protein, 20 aa, Staphylococcus
YKGAFQFKQADRFMLEHSDL

SEQ ID NO: 2047173 - protein, 19 aa, Staphylococcus
YKGDMFMRAIEDYADTDNE

SEQ ID NO: 2047174 - protein, 17 aa, Staphylococcus
YKGGWVLNKKGQLELKS

SEQ ID NO: 2047175 - protein, 18 aa, Staphylococcus
YKGHGLMLDELMAFDVDD

SEQ ID NO: 2047176 - protein, 17 aa, Staphylococcus
YKGKDAIGQAFNSGDKE

SEQ ID NO: 2047177 - protein, 17 aa, Staphylococcus
YKGKYYISHEWYPFYSK

SEQ ID NO: 2047178 - protein, 25 aa, Staphylococcus
YKGMGTTCVCALVFDKQLVVANIGD

SEQ ID NO: 2047179 - protein, 18 aa, Staphylococcus
YKGNKFVGQPLWGSIGYT

SEQ ID NO: 2047180 - protein, 24 aa, Staphylococcus
YKGYSSDITRTFAIGEPDPQLKEI

SEQ ID NO: 2047181 - protein, 18 aa, Staphylococcus
YKHLISFITSAPVFAMVV

SEQ ID NO: 2047182 - protein, 20 aa, Staphylococcus
YKHRIVERVEWLNKRGHTQY

SEQ ID NO: 2047183 - protein, 24 aa, Staphylococcus
YKIEKLKQLITFVIVNRDVNYQEV

SEQ ID NO: 2047184 - protein, 19 aa, Staphylococcus
YKILKMIQRQFDVIINESE

SEQ ID NO: 2047185 - protein, 17 aa, Staphylococcus
YKIMFNTLRAMYHHHPI

SEQ ID NO: 2047186 - protein, 25 aa, Staphylococcus
YKIMTMFEPYFREYKMIFVNCPSRG

SEQ ID NO: 2047187 - protein, 27 aa, Staphylococcus
YKIMTMFEPYMREYKLIFINCPSRGKS

SEQ ID NO: 2047188 - protein, 18 aa, Staphylococcus
YKIPDLIKRMSSSCKTGF

SEQ ID NO: 2047189 - protein, 19 aa, Staphylococcus
YKITQHFTRLVGYPPYRYL

SEQ ID NO: 2047190 - protein, 26 aa, Staphylococcus
YKIVSEHRGGYCYEQNRLFHSWITSK

SEQ ID NO: 2047191 - protein, 17 aa, Staphylococcus
YKKAASYFAKVLEMSPQ

SEQ ID NO: 2047192 - protein, 23 aa, Staphylococcus
YKKARSGEIPEFTGISAPYEAPD

SEQ ID NO: 2047193 - protein, 19 aa, Staphylococcus
YKKDETFGLNIPVEIKDVP

SEQ ID NO: 2047194 - protein, 17 aa, Staphylococcus
YKKHWHVNFKLSNGKQL

SEQ ID NO: 2047195 - protein, 22 aa, Staphylococcus
YKKIFLKEERVVGAVLYGDTDD

SEQ ID NO: 2047196 - protein, 21 aa, Staphylococcus
YKKKLLHFIEEEFKKKVPTTV

SEQ ID NO: 2047197 - protein, 19 aa, Staphylococcus
YKKLLEIGGTTQSELAKSL

SEQ ID NO: 2047198 - protein, 18 aa, Staphylococcus
YKKMRTSYENQRAHKYDS

SEQ ID NO: 2047199 - protein, 24 aa, Staphylococcus
YKKRYPKGRFIVSIPAVVTTDGNQ

SEQ ID NO: 2047200 - protein, 19 aa, Staphylococcus
YKKSAPCMYVGTEKATVIN

SEQ ID NO: 2047201 - protein, 21 aa, Staphylococcus
YKKWIKIITKPAVNQASFTTV

SEQ ID NO: 2047202 - protein, 19 aa, Staphylococcus
YKKWRPYLMKRTVYNYDIK

SEQ ID NO: 2047203 - protein, 22 aa, Staphylococcus
YKKYKGIYGYRRIYIYIRLYLQ

SEQ ID NO: 2047204 - protein, 31 aa, Staphylococcus; identical to SEQ ID NO: 1649842

SEQ ID NO: 2047205 - protein, 19 aa, Staphylococcus
YKLDAYKNKVMLIVNTASE

SEQ ID NO: 2047206 - protein, 22 aa, Staphylococcus
YKLDFPESVVSFFKGDIGQPVN

SEQ ID NO: 2047207 - protein, 22 aa, Staphylococcus
YKLDFPESVVSFFKGEIGQPVN

SEQ ID NO: 2047208 - protein, 22 aa, Staphylococcus
YKLEEMGVQLAFDEEGVRVTAP

SEQ ID NO: 2047209 - protein, 17 aa, Staphylococcus
YKLELIDAIPEDENVTL

SEQ ID NO: 2047210 - protein, 20 aa, Staphylococcus
YKLHRIKVIVENDAICALAS

SEQ ID NO: 2047211 - protein, 19 aa, Staphylococcus
YKLKIIELIESDITGYQVF

SEQ ID NO: 2047212 - protein, 27 aa, Staphylococcus
YKLLSGSVIPRPVAFVTTQDKDGNLNA

SEQ ID NO: 2047213 - protein, 26 aa, Staphylococcus
YKLLSGSVLPRPIAFVTSQDKEGNIN

SEQ ID NO: 2047214 - protein, 19 aa, Staphylococcus
YKLLVLGKVGIDFFKNRSI

SEQ ID NO: 2047215 - protein, 17 aa, Staphylococcus
YKLMFNTLRAMYEKHPI

SEQ ID NO: 2047216 - protein, 22 aa, Staphylococcus
YKLMFNTLRAMYHHHPIRVDIA

SEQ ID NO: 2047217 - protein, 25 aa, Staphylococcus
YKLNTRPRKRFDWKTPAELFNDKVL

SEQ ID NO: 2047218 - protein, 22 aa, Staphylococcus
YKLNYEEIFILNYIYNCEDNEI

SEQ ID NO: 2047219 - protein, 19 aa, Staphylococcus
YKLRQAIAHYLFNSRGVNC

SEQ ID NO: 2047220 - protein, 17 aa, Staphylococcus
YKLSPLHVGISSAGVID

SEQ ID NO: 2047221 - protein, 19 aa, Staphylococcus
YKLTFSFKMPQFSELEDII

SEQ ID NO: 2047222 - protein, 20 aa, Staphylococcus
YKLYYPKEMILNIKDSEVKG

SEQ ID NO: 2047223 - protein, 18 aa, Staphylococcus
YKMAHAFVNEPIQISNNY

SEQ ID NO: 2047224 - protein, 17 aa, Staphylococcus
YKMGLFPLEKVKQSVTV

SEQ ID NO: 2047225 - protein, 18 aa, Staphylococcus
YKMPHAFVEISPELAKDR

SEQ ID NO: 2047226 - protein, 30 aa, Staphylococcus
YKMPKKMRRLALRSALSFKVKENGFTVVDA

SEQ ID NO: 2047227 - protein, 30 aa, Staphylococcus
YKMPKKMRRLALRSALSFKVKENGFTVVDS

SEQ ID NO: 2047228 - protein, 29 aa, Staphylococcus
YKMPKKMRRLALRSALSFKVKENNFTIVD

SEQ ID NO: 2047229 - protein, 24 aa, Staphylococcus
YKMSQFPADYLKLAVMPENQSDVL

SEQ ID NO: 2047230 - protein, 20 aa, Staphylococcus
YKMTVARITLWDEINKKEQE

SEQ ID NO: 2047231 - protein, 23 aa, Staphylococcus
YKNAKRIGIVLSMTHEVDTYPII

SEQ ID NO: 2047232 - protein, 17 aa, Staphylococcus
YKNEIKKSITVEEIRKN

SEQ ID NO: 2047233 - protein, 19 aa, Staphylococcus
YKNFKFETIEQAFQVINEY

SEQ ID NO: 2047234 - protein, 24 aa, Staphylococcus
YKNIESQDIFALLLGNEGEGVNKE

SEQ ID NO: 2047235 - protein, 19 aa, Staphylococcus
YKNIHVYDVSWGEAVNVNS

SEQ ID NO: 2047236 - protein, 24 aa, Staphylococcus
YKNIKAHLLKGVVTVSPIIKKLYA

SEQ ID NO: 2047237 - protein, 17 aa, Staphylococcus
YKNKEVDGFTTNPSLMA

SEQ ID NO: 2047238 - protein, 19 aa, Staphylococcus
YKNKVKYWITFNEINMILH

SEQ ID NO: 2047239 - protein, 24 aa, Staphylococcus
YKNLEPQETFALLLGNEGDGVNNA

SEQ ID NO: 2047240 - protein, 25 aa, Staphylococcus
YKNQDPIILVHGFNGFTDDINPNVL

SEQ ID NO: 2047241 - protein, 23 aa, Staphylococcus
YKNQFTISFVGHFSAGKSTLINL

SEQ ID NO: 2047242 - protein, 20 aa, Staphylococcus
YKNQHVVSISLEIVNERYLK

SEQ ID NO: 2047243 - protein, 22 aa, Staphylococcus
YKNRIFQSGYVYRFVKENRHSN

SEQ ID NO: 2047244 - protein, 18 aa, Staphylococcus
YKNSVALVTEIVKSLNND

SEQ ID NO: 2047245 - protein, 22 aa, Staphylococcus
YKNTDLQVAYNFNMVAISEGRP

SEQ ID NO: 2047246 - protein, 21 aa, Staphylococcus
YKNVALGLIFLKYVSDSFEEK

SEQ ID NO: 2047247 - protein, 18 aa, Staphylococcus
YKPDIAILDIEMPGKTGI

SEQ ID NO: 2047248 - protein, 19 aa, Staphylococcus
YKPDILLSVHGVDIHYLDP

SEQ ID NO: 2047249 - protein, 26 aa, Staphylococcus
YKPLEIARILKLQRKAVYNSIQRCKM

SEQ ID NO: 2047250 - protein, 23 aa, Staphylococcus
YKPPIVLCGGLFSNLEFKDNVII

SEQ ID NO: 2047251 - protein, 19 aa, Staphylococcus
YKPQYKRYKNLYIGNESGT

SEQ ID NO: 2047252 - protein, 27 aa, Staphylococcus
YKPSFSNPWTYYWVGINGKQILTYLSR

SEQ ID NO: 2047253 - protein, 19 aa, Staphylococcus
YKQKYCKVCGHSIETKVIA

SEQ ID NO: 2047254 - protein, 25 aa, Staphylococcus
YKQLDHLASYYKFKQPSLLYDQQIQ

SEQ ID NO: 2047255 - protein, 22 aa, Staphylococcus
YKQLICWSKLKYDNFVKGKYNI

SEQ ID NO: 2047256 - protein, 24 aa, Staphylococcus
YKQLTCLHVNHGLREASHKEEAFI

SEQ ID NO: 2047257 - protein, 19 aa, Staphylococcus
YKQMGFQITSVLPKALFLS

SEQ ID NO: 2047258 - protein, 34 aa, Staphylococcus
YKQNPYMIVFSFNGYRIVAFNGGRLLIHGMNNPN

SEQ ID NO: 2047259 - protein, 19 aa, Staphylococcus
YKQRIVSSVEWLDPQGFVR

SEQ ID NO: 2047260 - protein, 18 aa, Staphylococcus
YKQSFGLNIINTITENDL

SEQ ID NO: 2047261 - protein, 21 aa, Staphylococcus
YKQYISIRHILNPSLRVLTKC

SEQ ID NO: 2047262 - protein, 22 aa, Staphylococcus
YKRFWLTEHHDVPAFASGSPEL

SEQ ID NO: 2047263 - protein, 21 aa, Staphylococcus
YKRISEDYILTSLYDASVKFI

SEQ ID NO: 2047264 - protein, 20 aa, Staphylococcus
YKRKVRRHHIAAVFQDYSSS

SEQ ID NO: 2047265 - protein, 21 aa, Staphylococcus
YKRLIADIHMKDVYQNTKAWL

SEQ ID NO: 2047266 - protein, 26 aa, Staphylococcus
YKRMIHAFPLLPIRESHKVVKQIVET

SEQ ID NO: 2047267 - protein, 27 aa, Staphylococcus
YKRMQGYNVLHPMGWDAFGLPAEQYAL

SEQ ID NO: 2047268 - protein, 20 aa, Staphylococcus
YKRQGIETIDGFKEMFVTKT

SEQ ID NO: 2047269 - protein, 23 aa, Staphylococcus
YKRYLENQIRDAFGFEGTPIHII

SEQ ID NO: 2047270 - protein, 23 aa, Staphylococcus
YKRYLENQIRDAFGFEGTPIRII

SEQ ID NO: 2047271 - protein, 27 aa, Staphylococcus
YKRYLENQIRHAFGFEGTPIHIIPRRR

SEQ ID NO: 2047272 - protein, 26 aa, Staphylococcus
YKRYLENQIRHAFGFEGTPVHIIPRK

SEQ ID NO: 2047273 - protein, 26 aa, Staphylococcus
YKRYLENQIRNAFGFEGTPIHIIPRK

SEQ ID NO: 2047274 - protein, 17 aa, Staphylococcus
YKSDPRNTFVIYDNTIE

SEQ ID NO: 2047275 - protein, 20 aa, Staphylococcus
YKSEPELLKALQYLDDYYHE

SEQ ID NO: 2047276 - protein, 19 aa, Staphylococcus
YKSGISIAIIQKYLGHQTT

SEQ ID NO: 2047277 - protein, 22 aa, Staphylococcus
YKSIYLKISLKDSYDPDIQLTD

SEQ ID NO: 2047278 - protein, 21 aa, Staphylococcus
YKSRHEGFMHACGHDGHTAIL

SEQ ID NO: 2047279 - protein, 20 aa, Staphylococcus
YKSSEVHCIEAIHELDNPNV

SEQ ID NO: 2047280 - protein, 19 aa, Staphylococcus
YKSSFLKENQIVFPENIVY

SEQ ID NO: 2047281 - protein, 20 aa, Staphylococcus
YKSVKNWKQHLADYLVSQHI

SEQ ID NO: 2047282 - protein, 23 aa, Staphylococcus
YKTAEYLAVQGIIVYGASRRIES

SEQ ID NO: 2047283 - protein, 21 aa, Staphylococcus
YKTDSTFWKAVYNSIIDQMLY

SEQ ID NO: 2047284 - protein, 18 aa, Staphylococcus
YKTEANKLILYLIVELSH

SEQ ID NO: 2047285 - protein, 18 aa, Staphylococcus
YKTINRHYALLMKENLLK

SEQ ID NO: 2047286 - protein, 21 aa, Staphylococcus
YKTITARSILSKVLVRATQQW

SEQ ID NO: 2047287 - protein, 20 aa, Staphylococcus
YKTKIIELIESNITGYQIHK

SEQ ID NO: 2047288 - protein, 20 aa, Staphylococcus
YKTKTVYTDLLFLYLEKAFL

SEQ ID NO: 2047289 - protein, 20 aa, Staphylococcus
YKTLISLRHHHDIITYGNIE

SEQ ID NO: 2047290 - protein, 18 aa, Staphylococcus
YKTMQGFYSPYVPGWDTH

SEQ ID NO: 2047291 - protein, 19 aa, Staphylococcus
YKTRVVSYVEWLDKHQRLR

SEQ ID NO: 2047292 - protein, 26 aa, Staphylococcus
YKTSKRGGLRIGSSHAPIYGMLPEAL

SEQ ID NO: 2047293 - protein, 20 aa, Staphylococcus
YKTSNSRWVNIRTTFEDYKM

SEQ ID NO: 2047294 - protein, 20 aa, Staphylococcus
YKTYRGMGSLGAMESGSNDR

SEQ ID NO: 2047295 - protein, 22 aa, Staphylococcus
YKVIDIPFGKQMVFEYKNETEA

SEQ ID NO: 2047296 - protein, 17 aa, Staphylococcus
YKVILNYNVEPLGSVYI

SEQ ID NO: 2047297 - protein, 19 aa, Staphylococcus
YKVKGQIVGYLKLNIDAAQ

SEQ ID NO: 2047298 - protein, 17 aa, Staphylococcus
YKVNLQQLFDLARETGT

SEQ ID NO: 2047299 - protein, 17 aa, Staphylococcus
YKVPAIFVIQNNNYAIS

SEQ ID NO: 2047300 - protein, 18 aa, Staphylococcus
YKVPDFLEDLILDGKIKD

SEQ ID NO: 2047301 - protein, 22 aa, Staphylococcus
YKVQVMGGIAIHKGDIAEMRTG

SEQ ID NO: 2047302 - protein, 22 aa, Staphylococcus
YKVYENDYVYAFLDISQVTKGH

SEQ ID NO: 2047303 - protein, 26 aa, Staphylococcus
YKWLQILPEKKRYSLTVMFDDKGNPL

SEQ ID NO: 2047304 - protein, 18 aa, Staphylococcus
YKWNAHITSNIQWQNYIE

SEQ ID NO: 2047305 - protein, 35 aa, Staphylococcus
YKYDLFKFSNSFVLGLKYKSGFIRGKEETIIFTSY

SEQ ID NO: 2047306 - protein, 17 aa, Staphylococcus
YKYDNIFNSNKFKQRFP

SEQ ID NO: 2047307 - protein, 17 aa, Staphylococcus
YKYDVIWFSHYHTNGVS

SEQ ID NO: 2047308 - protein, 24 aa, Staphylococcus
YKYFKEGLILFTYLHLANEEKLTQ

SEQ ID NO: 2047309 - protein, 17 aa, Staphylococcus
YKYLSRRIGSIVETTLN

SEQ ID NO: 2047310 - protein, 19 aa, Staphylococcus
YKYLVELLEKNQLDVSHVE

SEQ ID NO: 2047311 - protein, 21 aa, Staphylococcus
YKYLYPLFRILPKNKKKVIYY

SEQ ID NO: 2047312 - protein, 22 aa, Staphylococcus
YKYNAYFDFCIDANPLSYEEIK

SEQ ID NO: 2047313 - protein, 19 aa, Staphylococcus
YKYQVSSYFNLVKENPKIT

SEQ ID NO: 2047314 - protein, 19 aa, Staphylococcus
YKYRDTIFPVDEKMLEHRE

SEQ ID NO: 2047315 - protein, 19 aa, Staphylococcus
YKYTLMMGRTHGVHAEPTT

SEQ ID NO: 2047316 - protein, 24 aa, Staphylococcus
YLADKSYPGLLFGFIHVPFIPEQV

SEQ ID NO: 2047317 - protein, 19 aa, Staphylococcus
YLAERICYQLDELLDEDML

SEQ ID NO: 2047318 - protein, 18 aa, Staphylococcus
YLAGLAVGFWDSKDEIAN

SEQ ID NO: 2047319 - protein, 24 aa, Staphylococcus
YLALPDWNTLKVIPWMSRTAMVFA

SEQ ID NO: 2047320 - protein, 20 aa, Staphylococcus
YLALPPDYALLLSQQSEEKN

SEQ ID NO: 2047321 - protein, 18 aa, Staphylococcus
YLALRSRQGNPFHYREYV

SEQ ID NO: 2047322 - protein, 20 aa, Staphylococcus
YLAMAPQFFGVISDFLKSSG

SEQ ID NO: 2047323 - protein, 17 aa, Staphylococcus
YLATLKGLSSRDIQQRI

SEQ ID NO: 2047324 - protein, 18 aa, Staphylococcus
YLCHGNHDPLSASIGTVW

SEQ ID NO: 2047325 - protein, 20 aa, Staphylococcus
YLCRPFEFGADIVIHSATKF

SEQ ID NO: 2047326 - protein, 25 aa, Staphylococcus
YLDEIKHVYEQGGLIALPTETVYGL

SEQ ID NO: 2047327 - protein, 17 aa, Staphylococcus
YLDEIYRTTNACVIHIV

SEQ ID NO: 2047328 - protein, 19 aa, Staphylococcus
YLDELGFNLVGYGCTTCIG

SEQ ID NO: 2047329 - protein, 29 aa, Staphylococcus
YLDEMIAGIKRLWAKLEISNDDFIRTTEE

SEQ ID NO: 2047330 - protein, 25 aa, Staphylococcus
YLDESRRTVAKCLGAKPSEVIFTSG

SEQ ID NO: 2047331 - protein, 24 aa, Staphylococcus
YLDEWKPKIKKMIPSYGESLIHDV

SEQ ID NO: 2047332 - protein, 22 aa, Staphylococcus
YLDHERKAFVLYKVNLHKDEIE

SEQ ID NO: 2047333 - protein, 18 aa, Staphylococcus
YLDHLKLSNYELFSSTQE

SEQ ID NO: 2047334 - protein, 20 aa, Staphylococcus
YLDKDLETIVGVQTDKPFKR

SEQ ID NO: 2047335 - protein, 19 aa, Staphylococcus
YLDKLGIDVIWLNPIYESP

SEQ ID NO: 2047336 - protein, 20 aa, Staphylococcus
YLDKSWKVERPRYYSVNDLQ

SEQ ID NO: 2047337 - protein, 34 aa, Staphylococcus
YLDLPEEMNPFLGYRAIRLCLAQPDIFRPQLRAL

SEQ ID NO: 2047338 - protein, 32 aa, Staphylococcus
YLDLPEEMNPFLGYRAIRLCLDQPEIFRPQLR

SEQ ID NO: 2047339 - protein, 23 aa, Staphylococcus
YLDLRRPELAQTFKMRHQTTRAI

SEQ ID NO: 2047340 - protein, 23 aa, Staphylococcus
YLDLRRPELAQTFKMRHQTTRSI

SEQ ID NO: 2047341 - protein, 17 aa, Staphylococcus
YLDPILFTFESGYEEAI

SEQ ID NO: 2047342 - protein, 27 aa, Staphylococcus
YLDSAPIRVTNAWNVMHLIFPVVSTTF

SEQ ID NO: 2047343 - protein, 18 aa, Staphylococcus
YLDSLILEMERRTLNDNT

SEQ ID NO: 2047344 - protein, 22 aa, Staphylococcus
YLDSRVKGGVLLATAGEGGDKL

SEQ ID NO: 2047345 - protein, 19 aa, Staphylococcus
YLEGEYGFSDICLGVPTIL

SEQ ID NO: 2047346 - protein, 17 aa, Staphylococcus
YLEGPIFISTDKPDPFL

SEQ ID NO: 2047347 - protein, 25 aa, Staphylococcus
YLEILKKYWDYESFRDLDIYEDIHT

SEQ ID NO: 2047348 - protein, 17 aa, Staphylococcus
YLEKAFLSQNFFDIPMM

SEQ ID NO: 2047349 - protein, 18 aa, Staphylococcus
YLEKEGFELGLMEMYAIE

SEQ ID NO: 2047350 - protein, 24 aa, Staphylococcus
YLEKELVIYTSLIVREDAQLLYGF

SEQ ID NO: 2047351 - protein, 17 aa, Staphylococcus
YLEKGQLLSLADSGKYY

SEQ ID NO: 2047352 - protein, 24 aa, Staphylococcus
YLEKYCQCFDYLVVDFVYQKDEFF

SEQ ID NO: 2047353 - protein, 19 aa, Staphylococcus
YLELMARMEIEYGVLSISS

SEQ ID NO: 2047354 - protein, 22 aa, Staphylococcus
YLEQECRVQIDVNLAKYLTKKE

SEQ ID NO: 2047355 - protein, 24 aa, Staphylococcus
YLERISELCGVHISIFSVGPDREQ

SEQ ID NO: 2047356 - protein, 24 aa, Staphylococcus
YLESFPSKYLILYMDNQAEISVEG

SEQ ID NO: 2047357 - protein, 26 aa, Staphylococcus
YLESMSDDFKVGGLLNKKKKKQEEQE

SEQ ID NO: 2047358 - protein, 25 aa, Staphylococcus
YLESMSKDFKVHGFLNKKKKKEEEQ

SEQ ID NO: 2047359 - protein, 23 aa, Staphylococcus
YLETDGPCLFTSIKDIPYSERSF

SEQ ID NO: 2047360 - protein, 25 aa, Staphylococcus
YLETTRNAFFIGRTIDYNVSLEGAL

SEQ ID NO: 2047361 - protein, 17 aa, Staphylococcus
YLEYDISDFESRYKQIK

SEQ ID NO: 2047362 - protein, 17 aa, Staphylococcus
YLFKHMMDESVGEIIYD

SEQ ID NO: 2047363 - protein, 18 aa, Staphylococcus
YLFSEPIHDYGIFSEYIK

SEQ ID NO: 2047364 - protein, 22 aa, Staphylococcus
YLFTRLKYHLIDHFRKENNRSN

SEQ ID NO: 2047365 - protein, 17 aa, Staphylococcus
YLFVFVLDYYRHNLINE

SEQ ID NO: 2047366 - protein, 24 aa, Staphylococcus
YLGDFVICGEPTQLGIGYKAKGIL

SEQ ID NO: 2047367 - protein, 17 aa, Staphylococcus
YLGFKDKAAHGFGGKQT

SEQ ID NO: 2047368 - protein, 22 aa, Staphylococcus
YLGKPCIDYSGFRVHVSITHTE

SEQ ID NO: 2047369 - protein, 19 aa, Staphylococcus
YLHKFCNPSELTIDTEVEI

SEQ ID NO: 2047370 - protein, 17 aa, Staphylococcus
YLHKNFVGAKRFSIEGV

SEQ ID NO: 2047371 - protein, 19 aa, Staphylococcus
YLHPAMKRKNLEVQTRAFV

SEQ ID NO: 2047372 - protein, 17 aa, Staphylococcus
YLIAGGINYENIQKIEN

SEQ ID NO: 2047373 - protein, 17 aa, Staphylococcus
YLIANALDLHGYDDFAI

SEQ ID NO: 2047374 - protein, 17 aa, Staphylococcus
YLIEFCINQQLDKVVMA

SEQ ID NO: 2047375 - protein, 18 aa, Staphylococcus
YLIGTMIETPRACLVADE

SEQ ID NO: 2047376 - protein, 24 aa, Staphylococcus
YLINGSNFTTGWIFFIDNNGHHEM

SEQ ID NO: 2047377 - protein, 25 aa, Staphylococcus
YLINGSNFTTGWIFFINKKGEQELV

SEQ ID NO: 2047378 - protein, 17 aa, Staphylococcus
YLIPIALSGDHSHNKDN

SEQ ID NO: 2047379 - protein, 18 aa, Staphylococcus
YLIPLVIQLDEGIKKEDV

SEQ ID NO: 2047380 - protein, 17 aa, Staphylococcus
YLISNELNVAPASVHAA

SEQ ID NO: 2047381 - protein, 18 aa, Staphylococcus
YLITDAMRAKGMEDGEYD

SEQ ID NO: 2047382 - protein, 18 aa, Staphylococcus
YLITDAMRAKGMPDGEYD

SEQ ID NO: 2047383 - protein, 21 aa, Staphylococcus
YLKAILNNGGATSFVTNKKLS

SEQ ID NO: 2047384 - protein, 18 aa, Staphylococcus
YLKAILTHDGDHSFVSNK

SEQ ID NO: 2047385 - protein, 19 aa, Staphylococcus
YLKAILTNGGDSAFVSNKI

SEQ ID NO: 2047386 - protein, 22 aa, Staphylococcus
YLKDGLKKLGYDIGDSETPITP

SEQ ID NO: 2047387 - protein, 18 aa, Staphylococcus
YLKEIGRVNLLNAQEEIE

SEQ ID NO: 2047388 - protein, 17 aa, Staphylococcus
YLKELHFEESFSVRVRI

SEQ ID NO: 2047389 - protein, 28 aa, Staphylococcus
YLKELKILAEIYMKAAFDSLLEAENILS

SEQ ID NO: 2047390 - protein, 20 aa, Staphylococcus
YLKGAIKIEIEVNGERCNYQ

SEQ ID NO: 2047391 - protein, 20 aa, Staphylococcus
YLKKHNCLYVLVDPYILENL

SEQ ID NO: 2047392 - protein, 25 aa, Staphylococcus
YLKKNRISHVSLLFDTFQAHELPRE

SEQ ID NO: 2047393 - protein, 20 aa, Staphylococcus
YLKKQFPNRLYVTNINKESA

SEQ ID NO: 2047394 - protein, 19 aa, Staphylococcus
YLKNADIIVSAVGRPGLVT

SEQ ID NO: 2047395 - protein, 17 aa, Staphylococcus
YLKNLKFTGHIHSMQEG

SEQ ID NO: 2047396 - protein, 25 aa, Staphylococcus
YLKPALRLSSIMGLNSTFIFTHDSI

SEQ ID NO: 2047397 - protein, 29 aa, Staphylococcus
YLKQAALNTCIEFLARTLSQSEFRFLDAD

SEQ ID NO: 2047398 - protein, 26 aa, Staphylococcus
YLKQRHIPMAIATSSYREEIMPTINA

SEQ ID NO: 2047399 - protein, 17 aa, Staphylococcus
YLLDILQKLPIDKMNHF

SEQ ID NO: 2047400 - protein, 20 aa, Staphylococcus
YLLEKACERKGIAFEPKQVD

SEQ ID NO: 2047401 - protein, 19 aa, Staphylococcus
YLLEKACERKGIPFEPKEL

SEQ ID NO: 2047402 - protein, 20 aa, Staphylococcus
YLLEKACERKGIPFEPKQLD

SEQ ID NO: 2047403 - protein, 20 aa, Staphylococcus
YLLEKACERKGIPFTPKQLD

SEQ ID NO: 2047404 - protein, 24 aa, Staphylococcus
YLLEYCNFGCPYFVVKHLSKNEVK

SEQ ID NO: 2047405 - protein, 24 aa, Staphylococcus
YLLKELKKNFEVFKDTGASIDEMH

SEQ ID NO: 2047406 - protein, 20 aa, Staphylococcus
YLLKREDIFNYLAERKENVT

SEQ ID NO: 2047407 - protein, 17 aa, Staphylococcus
YLLKSFKDSLHIQDSVW

SEQ ID NO: 2047408 - protein, 18 aa, Staphylococcus
YLLNNATIAQHCTGRIRA

SEQ ID NO: 2047409 - protein, 18 aa, Staphylococcus
YLLPENAQFIPLCDDEQD

SEQ ID NO: 2047410 - protein, 22 aa, Staphylococcus
YLLPFSKFEPFWERYKKEIKKS

SEQ ID NO: 2047411 - protein, 17 aa, Staphylococcus
YLLPTRTDLANFLFHAS

SEQ ID NO: 2047412 - protein, 17 aa, Staphylococcus
YLLPYANFKKFWERHIQ

SEQ ID NO: 2047413 - protein, 19 aa, Staphylococcus
YLLPYSKFEFFWDRYQKDI

SEQ ID NO: 2047414 - protein, 24 aa, Staphylococcus
YLLQGSQFTTGWIFFIDDSGHHEL

SEQ ID NO: 2047415 - protein, 17 aa, Staphylococcus
YLLVEPDLSFTNEKITD

SEQ ID NO: 2047416 - protein, 17 aa, Staphylococcus
YLLVEPDLSFTNEKVTD

SEQ ID NO: 2047417 - protein, 17 aa, Staphylococcus
YLLVEPDLSFTNENITD

SEQ ID NO: 2047418 - protein, 25 aa, Staphylococcus
YLMEPWDGPTMIAFCNGDKIGALTD

SEQ ID NO: 2047419 - protein, 25 aa, Staphylococcus
YLMEPWDGPTMISFCNGDKIGALTD

SEQ ID NO: 2047420 - protein, 23 aa, Staphylococcus
YLMLKDIFPQNAVDLKMFRANGL

SEQ ID NO: 2047421 - protein, 22 aa, Staphylococcus
YLMSYLKFRQFYLQDINKEEIT

SEQ ID NO: 2047422 - protein, 19 aa, Staphylococcus
YLNALSGHGAFLVTTNDYL

SEQ ID NO: 2047423 - protein, 25 aa, Staphylococcus
YLNDRLKLQLLDDVKSVFNSQLTQH

SEQ ID NO: 2047424 - protein, 20 aa, Staphylococcus
YLNDYAKIIMSHNVTSQVRR

SEQ ID NO: 2047425 - protein, 24 aa, Staphylococcus
YLNEYKWQIFLQMVKELSVECHYY

SEQ ID NO: 2047426 - protein, 32 aa, Staphylococcus
YLNIKPNILKFILKVFLDLSFIYEENGIIKIN

SEQ ID NO: 2047427 - protein, 17 aa, Staphylococcus
YLNIWRRHHSQNKHRPV

SEQ ID NO: 2047428 - protein, 17 aa, Staphylococcus
YLNLLARMYPLPKNVVS

SEQ ID NO: 2047429 - protein, 33 aa, Staphylococcus; identical to SEQ ID NO: 1815082

SEQ ID NO: 2047430 - protein, 28 aa, Staphylococcus
YLNLPEEMNPFLGYRAIRLCLDQPDIFR

SEQ ID NO: 2047431 - protein, 32 aa, Staphylococcus
YLNLPKEMNPFLGYRAIRLCLDQPDIFRPQLR

SEQ ID NO: 2047432 - protein, 20 aa, Staphylococcus
YLNMNFKDYFTSLKLCHSIN

SEQ ID NO: 2047433 - protein, 18 aa, Staphylococcus
YLNNKEVLEYVLYKAINL

SEQ ID NO: 2047434 - protein, 17 aa, Staphylococcus
YLNRGCTAAVVGYHPFG

SEQ ID NO: 2047435 - protein, 18 aa, Staphylococcus
YLNRGCTSAVVGYHPFGG

SEQ ID NO: 2047436 - protein, 23 aa, Staphylococcus
YLNRVAEADIWLRENPLKFEWGG

SEQ ID NO: 2047437 - protein, 26 aa, Staphylococcus
YLNYCDEFKFLNSLLGILANNILYCE

SEQ ID NO: 2047438 - protein, 26 aa, Staphylococcus
YLPDRERRAVWAIYAVCRVIDDSIDV

SEQ ID NO: 2047439 - protein, 25 aa, Staphylococcus
YLPEALFNFITLLGWSPEGEDEIFS

SEQ ID NO: 2047440 - protein, 25 aa, Staphylococcus
YLPEALFNFITLLGWSPEGEEEIYS

SEQ ID NO: 2047441 - protein, 25 aa, Staphylococcus
YLPEALFNFITLLGWSPEGENEIYS

SEQ ID NO: 2047442 - protein, 22 aa, Staphylococcus
YLPEIYKAIDAKVLFNKVAMRP

SEQ ID NO: 2047443 - protein, 23 aa, Staphylococcus
YLPEIYKAIDANVLFNKVAQRPG

SEQ ID NO: 2047444 - protein, 31 aa, Staphylococcus
YLPENERKAVWAIYAVCRIIDDSIDVYEDPQ

SEQ ID NO: 2047445 - protein, 22 aa, Staphylococcus
YLPGKLKWLVADLLTKQGLQVV

SEQ ID NO: 2047446 - protein, 20 aa, Staphylococcus
YLPHGYGGARLQTTRTKNHA

SEQ ID NO: 2047447 - protein, 17 aa, Staphylococcus
YLPKQSKESILKEIQSV

SEQ ID NO: 2047448 - protein, 22 aa, Staphylococcus
YLPKYMIPNTFTAIDEIPLTSN

SEQ ID NO: 2047449 - protein, 17 aa, Staphylococcus
YLPLLHRYTKLRKELLA

SEQ ID NO: 2047450 - protein, 17 aa, Staphylococcus
YLPLLHRYTKLRKELLG

SEQ ID NO: 2047451 - protein, 17 aa, Staphylococcus
YLPQTGKPSFDIEDNEM

SEQ ID NO: 2047452 - protein, 17 aa, Staphylococcus
YLPTVLKVTHVDANSKV

SEQ ID NO: 2047453 - protein, 17 aa, Staphylococcus
YLQAIDFEALREELQAK

SEQ ID NO: 2047454 - protein, 17 aa, Staphylococcus
YLQEHFNVIHSYKQNGE

SEQ ID NO: 2047455 - protein, 19 aa, Staphylococcus
YLQLFKFYSEILGNNKSTT

SEQ ID NO: 2047456 - protein, 26 aa, Staphylococcus
YLQNVPGFKALRFLRPQVAGRHYIIL

SEQ ID NO: 2047457 - protein, 18 aa, Staphylococcus
YLRHLIKAEETFGIRLTT

SEQ ID NO: 2047458 - protein, 26 aa, Staphylococcus
YLRNKLKPFGKDKCIETVRGVGYVVR

SEQ ID NO: 2047459 - protein, 21 aa, Staphylococcus
YLRPLYDGLNTVLGREQTERF

SEQ ID NO: 2047460 - protein, 19 aa, Staphylococcus
YLRRINRKTALLIQLATEV

SEQ ID NO: 2047461 - protein, 21 aa, Staphylococcus
YLRRINRKTALLIQLSTEVGA

SEQ ID NO: 2047462 - protein, 19 aa, Staphylococcus
YLRSLAHNIDPIFQIGKAG

SEQ ID NO: 2047463 - protein, 20 aa, Staphylococcus
YLRSLAHNIDPIFQIGKAGI

SEQ ID NO: 2047464 - protein, 17 aa, Staphylococcus
YLRSLAHNTDPTFQIGK

SEQ ID NO: 2047465 - protein, 25 aa, Staphylococcus
YLRSLSVKKRKAYKEKPVSVKKELL

SEQ ID NO: 2047466 - protein, 24 aa, Staphylococcus
YLSEIDLPILIIASQHGERTTIVE

SEQ ID NO: 2047467 - protein, 17 aa, Staphylococcus
YLSGKRFSGKLITVEPF

SEQ ID NO: 2047468 - protein, 20 aa, Staphylococcus
YLSHKGIESHFIKQLSETEQ

SEQ ID NO: 2047469 - protein, 20 aa, Staphylococcus
YLSKTEMIILEMLVKKQNQI

SEQ ID NO: 2047470 - protein, 23 aa, Staphylococcus
YLSLKCFKYTNNGTHPLQLADLV

SEQ ID NO: 2047471 - protein, 27 aa, Staphylococcus
YLSNFEIREIRIIKSVLLKGKKSFNNT

SEQ ID NO: 2047472 - protein, 18 aa, Staphylococcus
YLSPSRREKLSRLYHRAC

SEQ ID NO: 2047473 - protein, 26 aa, Staphylococcus
YLSQILAGIVMRYSVEHFRSENDYCR

SEQ ID NO: 2047474 - protein, 17 aa, Staphylococcus
YLSQVAISTEKLMLEAD

SEQ ID NO: 2047475 - protein, 17 aa, Staphylococcus
YLSTFSIQLERANKKGI

SEQ ID NO: 2047476 - protein, 19 aa, Staphylococcus
YLSVEGIIVLVIYHGHAEG

SEQ ID NO: 2047477 - protein, 26 aa, Staphylococcus
YLTAVQRLNYSPAHCLAIEDSANGAT

SEQ ID NO: 2047478 - protein, 17 aa, Staphylococcus
YLTGMNKKLFVNHTSKE

SEQ ID NO: 2047479 - protein, 25 aa, Staphylococcus
YLTKFPGIGKKTARQIILDLKGKVN

SEQ ID NO: 2047480 - protein, 17 aa, Staphylococcus
YLTLTVHIVLSIERIQH

SEQ ID NO: 2047481 - protein, 17 aa, Staphylococcus
YLTLYAFSTENWTRPEN

SEQ ID NO: 2047482 - protein, 19 aa, Staphylococcus
YLTMKAFNLAEEYQCPVII

SEQ ID NO: 2047483 - protein, 23 aa, Staphylococcus
YLTRLRTGALSGIASKYMSKPDA

SEQ ID NO: 2047484 - protein, 25 aa, Staphylococcus
YLTVPSVWNLYGFDQIQYLNTQYPI

SEQ ID NO: 2047485 - protein, 25 aa, Staphylococcus
YLVDRVIPMIPHRLSNGICSLNPDV

SEQ ID NO: 2047486 - protein, 25 aa, Staphylococcus
YLVDRVIPMIPHRLSNGICSLNPNV

SEQ ID NO: 2047487 - protein, 20 aa, Staphylococcus
YLVEEFKKENGIDLSQDKMA

SEQ ID NO: 2047488 - protein, 25 aa, Staphylococcus
YLVEIGLDLPFAMKMNQKLGFKDEF

SEQ ID NO: 2047489 - protein, 24 aa, Staphylococcus
YLVFPDNVAIVLGIAEAVGVDYET

SEQ ID NO: 2047490 - protein, 17 aa, Staphylococcus
YLVGLMRSVIYQFTEDE

SEQ ID NO: 2047491 - protein, 19 aa, Staphylococcus
YLVKPPFFIQWNETETERK

SEQ ID NO: 2047492 - protein, 21 aa, Staphylococcus
YLVKQDLPFIVEIVPTESDMM

SEQ ID NO: 2047493 - protein, 33 aa, Staphylococcus
YLVMFHFNKYRIVCFHDGRFLIHGMTNITQATK

SEQ ID NO: 2047494 - protein, 18 aa, Staphylococcus
YLVPESYDAMRIVHECRE

SEQ ID NO: 2047495 - protein, 23 aa, Staphylococcus
YLVPESYLAMEIVHQCRENGIPC

SEQ ID NO: 2047496 - protein, 24 aa, Staphylococcus
YLVQESYDAMAIVHECRKMGVPCY

SEQ ID NO: 2047497 - protein, 27 aa, Staphylococcus
YLVREVKKLKGLCLKWVSPGTRGVPDR

SEQ ID NO: 2047498 - protein, 19 aa, Staphylococcus
YLVTWNIPEGITMDQYLAR

SEQ ID NO: 2047499 - protein, 20 aa, Staphylococcus
YLWDVVHWLKDGNWKVNCRN

SEQ ID NO: 2047500 - protein, 22 aa, Staphylococcus
YLYGGAIKGFSKWIENSSAKIT

SEQ ID NO: 2047501 - protein, 18 aa, Staphylococcus
YLYHLGHRHILFLQESGH

SEQ ID NO: 2047502 - protein, 18 aa, Staphylococcus
YLYIKKDIVHYINVNHIE

SEQ ID NO: 2047503 - protein, 17 aa, Staphylococcus
YLYKGLRDKNPAVRRTA

SEQ ID NO: 2047504 - protein, 25 aa, Staphylococcus
YLYPDLDTWVIFPWTAGQGKVARLI

SEQ ID NO: 2047505 - protein, 17 aa, Staphylococcus
YLYSGLFDNDKKLKDYT

SEQ ID NO: 2047506 - protein, 17 aa, Staphylococcus
YLYYRYHKKHITKKKII

SEQ ID NO: 2047507 - protein, 23 aa, Staphylococcus
YMAEKAKHVYGVEVVPAAIEDAK

SEQ ID NO: 2047508 - protein, 18 aa, Staphylococcus
YMCIAAAVGEEITINNIV

SEQ ID NO: 2047509 - protein, 27 aa, Staphylococcus
YMEESFGFRSGKVIYDREHSTFILDEA

SEQ ID NO: 2047510 - protein, 27 aa, Staphylococcus
YMELKGENAFKVSAYRKAAQSLETDER

SEQ ID NO: 2047511 - protein, 21 aa, Staphylococcus
YMESRGIFLYINHNTRTTKGY

SEQ ID NO: 2047512 - protein, 23 aa, Staphylococcus
YMFTPDLEKITAFREHLIDEKET

SEQ ID NO: 2047513 - protein, 24 aa, Staphylococcus
YMGIKRLHTIITQIYKQVGKDYPI

SEQ ID NO: 2047514 - protein, 18 aa, Staphylococcus
YMHVVNFKKIAVVGEKTA

SEQ ID NO: 2047515 - protein, 23 aa, Staphylococcus
YMIPAHIYFLNVFPLNKNGKIDQ

SEQ ID NO: 2047516 - protein, 17 aa, Staphylococcus
YMIPKTVTAIDVIPLTR

SEQ ID NO: 2047517 - protein, 19 aa, Staphylococcus
YMKCSFFNDNIESFGEITA

SEQ ID NO: 2047518 - protein, 17 aa, Staphylococcus
YMKKSVVSPKFSGLFSL

SEQ ID NO: 2047519 - protein, 18 aa, Staphylococcus
YMKPREFCLVSVIDGEGK

SEQ ID NO: 2047520 - protein, 18 aa, Staphylococcus
YMKPREFCLVSVLDGEGQ

SEQ ID NO: 2047521 - protein, 17 aa, Staphylococcus
YMKTIHASYNFTDYYLE

SEQ ID NO: 2047522 - protein, 17 aa, Staphylococcus
YMLEKCETLLAESKCHI

SEQ ID NO: 2047523 - protein, 18 aa, Staphylococcus
YMMHWYMMNYCFDHGYGR

SEQ ID NO: 2047524 - protein, 25 aa, Staphylococcus
YMRVDRMKGIFAWGKILHSSQKEEG

SEQ ID NO: 2047525 - protein, 18 aa, Staphylococcus
YMTDDFLFIHAGFIADVP

SEQ ID NO: 2047526 - protein, 19 aa, Staphylococcus
YMVEAHMINLIGVNKVMNI

SEQ ID NO: 2047527 - protein, 20 aa, Staphylococcus
YNAYSRIFKRVGINARPVVA

SEQ ID NO: 2047528 - protein, 17 aa, Staphylococcus
YNCKVCDLNFEKEYGEI

SEQ ID NO: 2047529 - protein, 18 aa, Staphylococcus
YNDARWVLIDLANVVVHI

SEQ ID NO: 2047530 - protein, 18 aa, Staphylococcus
YNDINMWDYKALPNVFGG

SEQ ID NO: 2047531 - protein, 32 aa, Staphylococcus
YNDYLGRIGIGRVFRGTIKVGDQVSLLKLDGS

SEQ ID NO: 2047532 - protein, 17 aa, Staphylococcus
YNEALIRHFEPVIDTFC

SEQ ID NO: 2047533 - protein, 18 aa, Staphylococcus
YNEETALGYANKFMRQLH

SEQ ID NO: 2047534 - protein, 17 aa, Staphylococcus
YNEGNWWRDKAVPFYET

SEQ ID NO: 2047535 - protein, 20 aa, Staphylococcus
YNEKSVHFFSIMTNEHGSKV

SEQ ID NO: 2047536 - protein, 28 aa, Staphylococcus
YNERQKMGWSQVKMKAVLHNEAIKNVVQ

SEQ ID NO: 2047537 - protein, 28 aa, Staphylococcus
YNEYMGAYRLQWEMIKFAKEHNIDRYNF

SEQ ID NO: 2047538 - protein, 25 aa, Staphylococcus
YNFKGKPYLKVRVGSELVVIDDKYE

SEQ ID NO: 2047539 - protein, 24 aa, Staphylococcus
YNGEAYAGFVYDVMKDALYHAKVH

SEQ ID NO: 2047540 - protein, 25 aa, Staphylococcus
YNGHLLIQWYSKGIYKFRYIIIEAI

SEQ ID NO: 2047541 - protein, 28 aa, Staphylococcus
YNGIIGDGCGKCPACKLRQRGLHQYLEQ

SEQ ID NO: 2047542 - protein, 17 aa, Staphylococcus
YNGIIPISQLSTHHIEK

SEQ ID NO: 2047543 - protein, 17 aa, Staphylococcus
YNGKFNPSRYLSLLQKF

SEQ ID NO: 2047544 - protein, 21 aa, Staphylococcus
YNGKRKNVFFNFKNKNLNLEF

SEQ ID NO: 2047545 - protein, 21 aa, Staphylococcus
YNGLSEWRYINQPSTDTGWIP

SEQ ID NO: 2047546 - protein, 24 aa, Staphylococcus
YNGYDYWIDLGWKEADKKEIHDIS

SEQ ID NO: 2047547 - protein, 18 aa, Staphylococcus
YNHAQLRKQGGRHKGPTP

SEQ ID NO: 2047548 - protein, 24 aa, Staphylococcus
YNHEAAFQKWGFIDWKQGNYSYKV

SEQ ID NO: 2047549 - protein, 19 aa, Staphylococcus
YNHRFEVDKAVILAATDKT

SEQ ID NO: 2047550 - protein, 21 aa, Staphylococcus
YNHYRPCIVNMNLPSVSKQPA

SEQ ID NO: 2047551 - protein, 26 aa, Staphylococcus
YNIAAQILKYFAIEKVNLLSNNPKKF

SEQ ID NO: 2047552 - protein, 20 aa, Staphylococcus
YNIEPLVHITCRDRNLIGLQ

SEQ ID NO: 2047553 - protein, 22 aa, Staphylococcus
YNIIRPPFNVGRLSEYAAVAAF

SEQ ID NO: 2047554 - protein, 23 aa, Staphylococcus
YNIKATEIMKHWPKHPNNPYKGY

SEQ ID NO: 2047555 - protein, 17 aa, Staphylococcus
YNIVCHYGETLFFKACE

SEQ ID NO: 2047556 - protein, 23 aa, Staphylococcus
YNKAGFDRTKWYSVKYETLNQLV

SEQ ID NO: 2047557 - protein, 24 aa, Staphylococcus
YNKDGFKFAETVYDLNKKPILKTY

SEQ ID NO: 2047558 - protein, 17 aa, Staphylococcus
YNKDGNMITWSREKDSF

SEQ ID NO: 2047559 - protein, 18 aa, Staphylococcus
YNKDGQMIIWSRQKDSFY

SEQ ID NO: 2047560 - protein, 18 aa, Staphylococcus
YNKDGTMVKWSRKKDSFY

SEQ ID NO: 2047561 - protein, 24 aa, Staphylococcus
YNKEIHLKCVLIHQSIARTQSLSF

SEQ ID NO: 2047562 - protein, 19 aa, Staphylococcus
YNKEILKENIMVINIYDWL

SEQ ID NO: 2047563 - protein, 19 aa, Staphylococcus
YNKETALGYANKFTTKLHP

SEQ ID NO: 2047564 - protein, 18 aa, Staphylococcus
YNKGEVVSGFTLDGRYFV

SEQ ID NO: 2047565 - protein, 24 aa, Staphylococcus
YNKNIKISGVFTWSDKDVELVSFL

SEQ ID NO: 2047566 - protein, 29 aa, Staphylococcus
YNKTIPQIILKWHVQNGVVPIPKSTSIAR

SEQ ID NO: 2047567 - protein, 20 aa, Staphylococcus
YNLDIKFIIVNEAGASVYSA

SEQ ID NO: 2047568 - protein, 19 aa, Staphylococcus
YNLDIKIVIINNGTLGMVK

SEQ ID NO: 2047569 - protein, 23 aa, Staphylococcus
YNLKSGVGTTKFKKGLAQKKGVN

SEQ ID NO: 2047570 - protein, 23 aa, Staphylococcus
YNLKSGVGTTKFKKGLAQQKGLN

SEQ ID NO: 2047571 - protein, 20 aa, Staphylococcus
YNLLYTWYVEFNKSNFDFIF

SEQ ID NO: 2047572 - protein, 24 aa, Staphylococcus
YNLNHGVPSFGYRIEAPTTSGKID

SEQ ID NO: 2047573 - protein, 20 aa, Staphylococcus
YNLNIPRYVDTFEEEEPIDL

SEQ ID NO: 2047574 - protein, 21 aa, Staphylococcus
YNLTYPQFLVLSILWDESPVN

SEQ ID NO: 2047575 - protein, 21 aa, Staphylococcus
YNLTYPQFLVLSILWEESPVN

SEQ ID NO: 2047576 - protein, 34 aa, Staphylococcus
YNMIRDRGEWVISRQRVWGVPLPVFYAENGDIIM

SEQ ID NO: 2047577 - protein, 26 aa, Staphylococcus
YNMSGYRVGFALGNKDVIQALKKYHT

SEQ ID NO: 2047578 - protein, 18 aa, Staphylococcus
YNMVRVLVAFLVEVGKGK

SEQ ID NO: 2047579 - protein, 22 aa, Staphylococcus
YNMYLGGGFKGERLNKLYKENI

SEQ ID NO: 2047580 - protein, 19 aa, Staphylococcus
YNNEFKVSGLVGATDAAEL

SEQ ID NO: 2047581 - protein, 17 aa, Staphylococcus
YNNKPQHQFAFQVKEAT

SEQ ID NO: 2047582 - protein, 24 aa, Staphylococcus
YNNLRVFKDIGIVKELPYGDSSSR

SEQ ID NO: 2047583 - protein, 24 aa, Staphylococcus
YNNLRVFKKIGIVKELTYGDASSR

SEQ ID NO: 2047584 - protein, 24 aa, Staphylococcus
YNNLRVFKSIGIVKELTYGDASSR

SEQ ID NO: 2047585 - protein, 17 aa, Staphylococcus
YNNNIWNEWAFEKFVQS

SEQ ID NO: 2047586 - protein, 25 aa, Staphylococcus
YNPFSNTLITSWFWSHRPHHIEQAG

SEQ ID NO: 2047587 - protein, 24 aa, Staphylococcus
YNPFSNTLITSWFWSHRPKAVEAA

SEQ ID NO: 2047588 - protein, 25 aa, Staphylococcus
YNQFLRDEIARWIQIQEDISLDVFV

SEQ ID NO: 2047589 - protein, 24 aa, Staphylococcus
YNQIKRTHGGVVLNDSEVWDELNF

SEQ ID NO: 2047590 - protein, 26 aa, Staphylococcus
YNQKSLRLISLLIKIKSLTPTLHKEI

SEQ ID NO: 2047591 - protein, 23 aa, Staphylococcus
YNQLEIGDNLIFYNKYEDQSVVG

SEQ ID NO: 2047592 - protein, 22 aa, Staphylococcus
YNQLEVGDNLIFYDKNSNQSVV

SEQ ID NO: 2047593 - protein, 23 aa, Staphylococcus
YNQLEVGDNLVFYNRNKNQAVIG

SEQ ID NO: 2047594 - protein, 19 aa, Staphylococcus
YNQQGFRFAQLLYDEFKMK

SEQ ID NO: 2047595 - protein, 17 aa, Staphylococcus
YNQSFRVPITTPKVHLT

SEQ ID NO: 2047596 - protein, 25 aa, Staphylococcus
YNQTLPCDFCNYKSVCHVDGMIDSK

SEQ ID NO: 2047597 - protein, 28 aa, Staphylococcus
YNQYMGAYRLQWDMICFAKSHHIHRYNF

SEQ ID NO: 2047598 - protein, 25 aa, Staphylococcus
YNRKANEIVLAMKLERIMSKEEIMY

SEQ ID NO: 2047599 - protein, 28 aa, Staphylococcus
YNRLRYYKDRVLVPLAYMDFDEYITELK

SEQ ID NO: 2047600 - protein, 24 aa, Staphylococcus
YNRPKGNFRFPLHVDNPENSEDEA

SEQ ID NO: 2047601 - protein, 22 aa, Staphylococcus
YNRQVKWAYSFTYESIKKALLD

SEQ ID NO: 2047602 - protein, 22 aa, Staphylococcus
YNSDIKKLEFFLPKEISEQEKI

SEQ ID NO: 2047603 - protein, 28 aa, Staphylococcus
YNSKGACPNCGGKGYIKTELAFMGDFSQ

SEQ ID NO: 2047604 - protein, 21 aa, Staphylococcus
YNSRPSYALNPWLTTEEHQSN

SEQ ID NO: 2047605 - protein, 31 aa, Staphylococcus
YNSYPEWQKQFPFWSERTIKRTFSSLEKQDL

SEQ ID NO: 2047606 - protein, 31 aa, Staphylococcus
YNTKPRGLFRKKKFSPVVGDIVDFDIQNEDE

SEQ ID NO: 2047607 - protein, 17 aa, Staphylococcus
YNTLPITHLIYLHSAAK

SEQ ID NO: 2047608 - protein, 19 aa, Staphylococcus
YNTMIELVKPLGKIATIVA

SEQ ID NO: 2047609 - protein, 23 aa, Staphylococcus
YNTYRRRFGITFPIHSKTIVNGD

SEQ ID NO: 2047610 - protein, 20 aa, Staphylococcus
YNVDHKWTIEYKAKSTEKTL

SEQ ID NO: 2047611 - protein, 25 aa, Staphylococcus
YNVEGLPGICIIGDIINYSLPQNKA

SEQ ID NO: 2047612 - protein, 17 aa, Staphylococcus
YNVESLLEFFKSKISES

SEQ ID NO: 2047613 - protein, 24 aa, Staphylococcus
YNVGDPFPREGLTVSKERLTELST

SEQ ID NO: 2047614 - protein, 18 aa, Staphylococcus
YNVIGIGELIEGFDVEET

SEQ ID NO: 2047615 - protein, 24 aa, Staphylococcus
YNVIWKLEVLRDFQGRGYGTSLLD

SEQ ID NO: 2047616 - protein, 22 aa, Staphylococcus
YNVPDFCQLIFITTPNKLKEDK

SEQ ID NO: 2047617 - protein, 22 aa, Staphylococcus
YNVPDFCQLILITSPQHLKIQH

SEQ ID NO: 2047618 - protein, 23 aa, Staphylococcus
YNYDYKRVHFFLMMYDESDNLVA

SEQ ID NO: 2047619 - protein, 17 aa, Staphylococcus
YNYKLKNTNIFTDRISE

SEQ ID NO: 2047620 - protein, 19 aa, Staphylococcus
YNYNVPLGYGTRIISKSSA

SEQ ID NO: 2047621 - protein, 20 aa, Staphylococcus
YNYVMKWKETKTFFEKLMDL

SEQ ID NO: 2047622 - protein, 21 aa, Staphylococcus
YPARFRHVDELKNMGADISAD

SEQ ID NO: 2047623 - protein, 21 aa, Staphylococcus
YPARFRHVDELKNMGANIEAD

SEQ ID NO: 2047624 - protein, 21 aa, Staphylococcus
YPARFRHVEELKNMGASIEAD

SEQ ID NO: 2047625 - protein, 17 aa, Staphylococcus
YPDCDFISWDKPVGREC

SEQ ID NO: 2047626 - protein, 19 aa, Staphylococcus
YPDEELFFVVSVDTPMINE

SEQ ID NO: 2047627 - protein, 22 aa, Staphylococcus
YPDIFSNLTSVFIKRVENDATY

SEQ ID NO: 2047628 - protein, 17 aa, Staphylococcus
YPDINFDFHHGFFDLTD

SEQ ID NO: 2047629 - protein, 17 aa, Staphylococcus
YPDIPYVIDPVMLAKSG

SEQ ID NO: 2047630 - protein, 20 aa, Staphylococcus
YPDLEFYFFKKAVDIPTELK

SEQ ID NO: 2047631 - protein, 24 aa, Staphylococcus
YPDLERPTGAWLGEVVHFADEFYK

SEQ ID NO: 2047632 - protein, 18 aa, Staphylococcus
YPDMLVIADTCLCEYTDH

SEQ ID NO: 2047633 - protein, 17 aa, Staphylococcus
YPEIVFVGNHLSSSYTQ

SEQ ID NO: 2047634 - protein, 17 aa, Staphylococcus
YPEIVFVGNHLSSTYTQ

SEQ ID NO: 2047635 - protein, 17 aa, Staphylococcus
YPEKIIWDIGGLAPKPC

SEQ ID NO: 2047636 - protein, 17 aa, Staphylococcus
YPELIKWLENETTEKIV

SEQ ID NO: 2047637 - protein, 25 aa, Staphylococcus
YPELKSELASPFAAIYDTKAKSKVT

SEQ ID NO: 2047638 - protein, 17 aa, Staphylococcus
YPELPTIELKAGRLASV

SEQ ID NO: 2047639 - protein, 20 aa, Staphylococcus
YPENTRIALEAALTSNIDML

SEQ ID NO: 2047640 - protein, 31 aa, Staphylococcus
YPETDKHHLRICGGFQFSSHKSDDEWREFSI

SEQ ID NO: 2047641 - protein, 17 aa, Staphylococcus
YPEYTWDLTTIFESDEA

SEQ ID NO: 2047642 - protein, 33 aa, Staphylococcus
YPFFKIDFARFARYCRENNAIVLFKMHPFVKNK

SEQ ID NO: 2047643 - protein, 26 aa, Staphylococcus
YPFIVKTRFGGYDGKGQILVQSDEDI

SEQ ID NO: 2047644 - protein, 25 aa, Staphylococcus
YPFIVKTRFGGYDGKGQVLVKNEES

SEQ ID NO: 2047645 - protein, 25 aa, Staphylococcus
YPFKELPLYEIGWRLIPEVWGNGIA

SEQ ID NO: 2047646 - protein, 21 aa, Staphylococcus
YPFPEDEIKAIFDTLPHIESV

SEQ ID NO: 2047647 - protein, 30 aa, Staphylococcus
YPFQLSGGMAQRIALVMSIVREAKLLIVDE

SEQ ID NO: 2047648 - protein, 27 aa, Staphylococcus
YPGDIKLKIIHTYDIDNRWSIEYYAES

SEQ ID NO: 2047649 - protein, 26 aa, Staphylococcus
YPGDLALKVIHHYDIEHRWTITYEAE

SEQ ID NO: 2047650 - protein, 19 aa, Staphylococcus
YPGKYMVHGHVPTFREGCS

SEQ ID NO: 2047651 - protein, 21 aa, Staphylococcus
YPGRFKSFALLPMPHVKESLK

SEQ ID NO: 2047652 - protein, 21 aa, Staphylococcus
YPGRRYYGGCDYVDVTETIAI

SEQ ID NO: 2047653 - protein, 21 aa, Staphylococcus
YPGRRYYGGCEFVDVTESVAI

SEQ ID NO: 2047654 - protein, 21 aa, Staphylococcus
YPGRRYYGGCEYVDVSETVAI

SEQ ID NO: 2047655 - protein, 23 aa, Staphylococcus
YPHEGLMLLKVVHYDEMGKPILY

SEQ ID NO: 2047656 - protein, 21 aa, Staphylococcus
YPHLEIKWIRGNIDTRLKKLE

SEQ ID NO: 2047657 - protein, 21 aa, Staphylococcus
YPHLEIKWIRGNIDTRLQKLE

SEQ ID NO: 2047658 - protein, 28 aa, Staphylococcus
YPHMLSGGMLQRLMIALALSLQPKLIIA

SEQ ID NO: 2047659 - protein, 17 aa, Staphylococcus
YPHVTYFMSGGRNDEFE

SEQ ID NO: 2047660 - protein, 19 aa, Staphylococcus
YPIDQMRGLNEQIVAYIKT

SEQ ID NO: 2047661 - protein, 19 aa, Staphylococcus
YPIFIPNVLINEEIKYKVI

SEQ ID NO: 2047662 - protein, 18 aa, Staphylococcus
YPILLATSRKRFIKEMIG

SEQ ID NO: 2047663 - protein, 20 aa, Staphylococcus
YPITCPHGGIIPRDNQYKEL

SEQ ID NO: 2047664 - protein, 17 aa, Staphylococcus
YPKLEAYGIKQIAQRTA

SEQ ID NO: 2047665 - protein, 28 aa, Staphylococcus
YPKLKALNLKWYAVPIISNMNLVIGGIT

SEQ ID NO: 2047666 - protein, 27 aa, Staphylococcus
YPKLKDLNLKWYGVPIISNMDLKIGGI

SEQ ID NO: 2047667 - protein, 22 aa, Staphylococcus
YPKLTFKSSILPLIKDNKVTAK

SEQ ID NO: 2047668 - protein, 22 aa, Staphylococcus
YPKLTFKSSILPLIKENKVTAK

SEQ ID NO: 2047669 - protein, 21 aa, Staphylococcus
YPKLTFKSSILQLIKDNKVTA

SEQ ID NO: 2047670 - protein, 22 aa, Staphylococcus
YPKLTFKSSILSLIKENKVTAK

SEQ ID NO: 2047671 - protein, 28 aa, Staphylococcus
YPKYKGIPAIIVLKLITLIFGKRSRLEW

SEQ ID NO: 2047672 - protein, 38 aa, Staphylococcus
YPLAKGAYERLEFYRLYLLMIHLLKFGGMYASSVNRSM

SEQ ID NO: 2047673 - protein, 36 aa, Staphylococcus
YPLDIFSLFNEEDWIIAYDVYFKSMIGIEVSEANQE

SEQ ID NO: 2047674 - protein, 19 aa, Staphylococcus
YPLEKLVCWIVEKKDELDR

SEQ ID NO: 2047675 - protein, 17 aa, Staphylococcus
YPLGEVVSISRMIEDQG

SEQ ID NO: 2047676 - protein, 18 aa, Staphylococcus
YPLIEVGEFELNRNPENY

SEQ ID NO: 2047677 - protein, 17 aa, Staphylococcus
YPLIEVGEWELNRNPDN

SEQ ID NO: 2047678 - protein, 18 aa, Staphylococcus
YPLIGAPVRIELFDTEVD

SEQ ID NO: 2047679 - protein, 24 aa, Staphylococcus
YPLLNQLIILPALLHKTTLTYEGI

SEQ ID NO: 2047680 - protein, 33 aa, Staphylococcus
YPLNIESLFPIEDWIVAYDVYFKSMLGIDDNVV

SEQ ID NO: 2047681 - protein, 18 aa, Staphylococcus
YPLPDNRLLTQLFTALDE

SEQ ID NO: 2047682 - protein, 18 aa, Staphylococcus
YPLPDNRLLTQLFTALEE

SEQ ID NO: 2047683 - protein, 19 aa, Staphylococcus
YPLPDNRLLTQLFTELEEG

SEQ ID NO: 2047684 - protein, 27 aa, Staphylococcus
YPLQIFVSAYCRYAPFIEQMESISMST

SEQ ID NO: 2047685 - protein, 17 aa, Staphylococcus
YPLRGHNNVQGCSDAGS

SEQ ID NO: 2047686 - protein, 18 aa, Staphylococcus
YPLRGHNNVQGCSDMGSM

SEQ ID NO: 2047687 - protein, 18 aa, Staphylococcus
YPLVDGQGNFGSMDGDGA

SEQ ID NO: 2047688 - protein, 18 aa, Staphylococcus
YPLVEQIHISTLVQGTQA

SEQ ID NO: 2047689 - protein, 26 aa, Staphylococcus
YPMKNCTRIIPFGAISYLDLLEKNDQ

SEQ ID NO: 2047690 - protein, 25 aa, Staphylococcus
YPMNWPIGMGQNFFGIIDRDSKSIE

SEQ ID NO: 2047691 - protein, 25 aa, Staphylococcus
YPMNWPIGMGQNFFGIIDRETKTIE

SEQ ID NO: 2047692 - protein, 25 aa, Staphylococcus
YPMNWPIGMGQNFFGIIDRKTKTIE

SEQ ID NO: 2047693 - protein, 25 aa, Staphylococcus
YPMNWPVGMGQNFFGIIDRATKTIE

SEQ ID NO: 2047694 - protein, 25 aa, Staphylococcus
YPMNWPVGMGQNFFGIIDREQRTIE

SEQ ID NO: 2047695 - protein, 25 aa, Staphylococcus
YPMNWPVGMGQNFFGIIDRESHTIE

SEQ ID NO: 2047696 - protein, 25 aa, Staphylococcus
YPMNWPVGMGQNFFGIIDRKSKSIE

SEQ ID NO: 2047697 - protein, 18 aa, Staphylococcus
YPMVPGIDLAGTVVESDD

SEQ ID NO: 2047698 - protein, 18 aa, Staphylococcus
YPNCVLAGEGAKGSTLSI

SEQ ID NO: 2047699 - protein, 18 aa, Staphylococcus
YPNCVLLGEGAKGSTLSI

SEQ ID NO: 2047700 - protein, 17 aa, Staphylococcus
YPNDTWDLTTIFKNDEA

SEQ ID NO: 2047701 - protein, 17 aa, Staphylococcus
YPNFFGSIEDLEKIQSF

SEQ ID NO: 2047702 - protein, 18 aa, Staphylococcus
YPNIKILVLTSYVDDEHV

SEQ ID NO: 2047703 - protein, 19 aa, Staphylococcus
YPNRFGAFATLPLPDVEGA

SEQ ID NO: 2047704 - protein, 22 aa, Staphylococcus
YPNRRYYGGCEYVDVSETLAID

SEQ ID NO: 2047705 - protein, 22 aa, Staphylococcus
YPNVHVSYGRPLGVQPRLTEIL

SEQ ID NO: 2047706 - protein, 17 aa, Staphylococcus
YPNYNRIMLSNILQNKM

SEQ ID NO: 2047707 - protein, 25 aa, Staphylococcus
YPPEELRMKISYLMQQSQLFGETIG

SEQ ID NO: 2047708 - protein, 25 aa, Staphylococcus
YPQDSPGGWQIIGRTPLDVFDLNRE

SEQ ID NO: 2047709 - protein, 18 aa, Staphylococcus
YPQIKDKQFQIAVNEEFV

SEQ ID NO: 2047710 - protein, 26 aa, Staphylococcus
YPQLLREIYDPPLILFYRGKLTLMQS

SEQ ID NO: 2047711 - protein, 22 aa, Staphylococcus
YPRAEHRPLPITIATGGTPESS

SEQ ID NO: 2047712 - protein, 19 aa, Staphylococcus
YPRCLLKHFANDNKKFHVY

SEQ ID NO: 2047713 - protein, 17 aa, Staphylococcus
YPRDIVESARIGIPNKG

SEQ ID NO: 2047714 - protein, 17 aa, Staphylococcus
YPSATWHNFLLETRFLF

SEQ ID NO: 2047715 - protein, 19 aa, Staphylococcus
YPSESGIRYYVNQLLQETS

SEQ ID NO: 2047716 - protein, 18 aa, Staphylococcus
YPSFERYSNNFNIETAQY

SEQ ID NO: 2047717 - protein, 20 aa, Staphylococcus
YPSILKRGGGYQKIDVDTFS

SEQ ID NO: 2047718 - protein, 28 aa, Staphylococcus
YPSNPYHFGATIGRYAGRIGNAKFHLND

SEQ ID NO: 2047719 - protein, 17 aa, Staphylococcus
YPSTVLMTVTLAKVAGV

SEQ ID NO: 2047720 - protein, 26 aa, Staphylococcus
YPTDDEGWAHCLTLPRVLTVEQGKLI

SEQ ID NO: 2047721 - protein, 17 aa, Staphylococcus
YPTDFVPFFEESMTIEQ

SEQ ID NO: 2047722 - protein, 20 aa, Staphylococcus
YPTTCPHGGVIPRNGKFEEI

SEQ ID NO: 2047723 - protein, 18 aa, Staphylococcus
YPTVPFYLQVGNPYLDGE

SEQ ID NO: 2047724 - protein, 26 aa, Staphylococcus
YPVAEILCKLLPAFVNEPLPEKLNND

SEQ ID NO: 2047725 - protein, 21 aa, Staphylococcus
YPVDLSAKCWENKHKRIFEVA

SEQ ID NO: 2047726 - protein, 21 aa, Staphylococcus
YPVDLSTLCWENKHKRIFEVA

SEQ ID NO: 2047727 - protein, 19 aa, Staphylococcus
YPVQLVFEPLIGAIAAGNT

SEQ ID NO: 2047728 - protein, 25 aa, Staphylococcus
YPVYEMRWDIGYVLQQIALFPHMSV

SEQ ID NO: 2047729 - protein, 21 aa, Staphylococcus
YPVYRRPMRQWVLKITEYADR

SEQ ID NO: 2047730 - protein, 21 aa, Staphylococcus
YPWGSVRSISGYPFVWWFATQ

SEQ ID NO: 2047731 - protein, 18 aa, Staphylococcus
YPYADGDGYIEIATTRPE

SEQ ID NO: 2047732 - protein, 18 aa, Staphylococcus
YPYADGEGYIEIATTRPE

SEQ ID NO: 2047733 - protein, 19 aa, Staphylococcus
YPYADGEGYIEIATTRPET

SEQ ID NO: 2047734 - protein, 26 aa, Staphylococcus
YPYAPEWGPMHWGHARSKDLVHWETL

SEQ ID NO: 2047735 - protein, 22 aa, Staphylococcus
YPYKKKIIILNCRSDRIDRTQL

SEQ ID NO: 2047736 - protein, 19 aa, Staphylococcus
YPYMLKFINELPVVAHNAA

SEQ ID NO: 2047737 - protein, 24 aa, Staphylococcus
YPYQYLRRDFGILGVDMHLHANGI

SEQ ID NO: 2047738 - protein, 25 aa, Staphylococcus
YPYRFLKRDFGVLGIDMHLHANGID

SEQ ID NO: 2047739 - protein, 25 aa, Staphylococcus
YPYRYLKRDFGILGVDMHLHANGID

SEQ ID NO: 2047740 - protein, 19 aa, Staphylococcus
YQAASLAMAIFFQDMTEQE

SEQ ID NO: 2047741 - protein, 18 aa, Staphylococcus
YQAFSSWSKLTAAERAEY

SEQ ID NO: 2047742 - protein, 23 aa, Staphylococcus
YQALERHVDFLLINNVKAIIVNG

SEQ ID NO: 2047743 - protein, 20 aa, Staphylococcus
YQASSLAMAIYFQDMNDDER

SEQ ID NO: 2047744 - protein, 22 aa, Staphylococcus
YQAYFVGGSVRDYLMQRPIHDI

SEQ ID NO: 2047745 - protein, 24 aa, Staphylococcus
YQDAEFPMFLVVNVIDGQRFGQFV

SEQ ID NO: 2047746 - protein, 18 aa, Staphylococcus
YQDARWILLDLANVVVHI

SEQ ID NO: 2047747 - protein, 17 aa, Staphylococcus
YQDRPSDQWQWNDDFVK

SEQ ID NO: 2047748 - protein, 17 aa, Staphylococcus
YQDRPYESWQWDGNFVK

SEQ ID NO: 2047749 - protein, 19 aa, Staphylococcus
YQDSLGYIAMQLCFPEKKT

SEQ ID NO: 2047750 - protein, 29 aa, Staphylococcus
YQDVPKKLWPIQPLREFWGISRKIEAKLN

SEQ ID NO: 2047751 - protein, 23 aa, Staphylococcus
YQDYPVRYSIMGHVHFRKELTEN

SEQ ID NO: 2047752 - protein, 35 aa, Staphylococcus
YQELFKLMFYTGLRIGEAMALVWTDYNKYKKEISI

SEQ ID NO: 2047753 - protein, 24 aa, Staphylococcus
YQELKRKHIEFIAASGNQYAKLKS

SEQ ID NO: 2047754 - protein, 17 aa, Staphylococcus
YQEQVIKNAKTLAETLQ

SEQ ID NO: 2047755 - protein, 17 aa, Staphylococcus
YQFDAPLVEFFYKNDEL

SEQ ID NO: 2047756 - protein, 24 aa, Staphylococcus
YQFKMYPKEFIPFFEGTITIDQYV

SEQ ID NO: 2047757 - protein, 17 aa, Staphylococcus
YQFKSYKLFNEIIRLII

SEQ ID NO: 2047758 - protein, 26 aa, Staphylococcus
YQFLDEAYLLLDFHSMIFNDNQLQIF

SEQ ID NO: 2047759 - protein, 17 aa, Staphylococcus
YQFPRVWLEKESYDFSF

SEQ ID NO: 2047760 - protein, 24 aa, Staphylococcus
YQFVLEPSYSFSIITSATQQPDEL

SEQ ID NO: 2047761 - protein, 23 aa, Staphylococcus
YQFVLEPSYSFSVITSATQQPDK

SEQ ID NO: 2047762 - protein, 25 aa, Staphylococcus
YQFVLEPTYSFSIITSATHKPDQLK

SEQ ID NO: 2047763 - protein, 24 aa, Staphylococcus
YQFVLEPTYSFSIITSATNHPDQL

SEQ ID NO: 2047764 - protein, 24 aa, Staphylococcus
YQFVLEPTYSFSVITSATQYPDKL

SEQ ID NO: 2047765 - protein, 17 aa, Staphylococcus
YQGASILITGDNFGCGS

SEQ ID NO: 2047766 - protein, 24 aa, Staphylococcus
YQGKPLVCVGILKGSVMFMADLIK

SEQ ID NO: 2047767 - protein, 18 aa, Staphylococcus
YQGLDRFECRKQLVEDLK

SEQ ID NO: 2047768 - protein, 20 aa, Staphylococcus
YQGNQFLGFQIQQQGRTVQQ

SEQ ID NO: 2047769 - protein, 21 aa, Staphylococcus
YQGNQFLGFQIQQQGRTVQQQ

SEQ ID NO: 2047770 - protein, 22 aa, Staphylococcus
YQGPCLKCLMQTIPETGESCAI

SEQ ID NO: 2047771 - protein, 22 aa, Staphylococcus
YQGQICALIGRNGAGKSTFFKL

SEQ ID NO: 2047772 - protein, 17 aa, Staphylococcus
YQGSNFLGFQIQNQGRT

SEQ ID NO: 2047773 - protein, 24 aa, Staphylococcus
YQHFGKEWIAPALREDGSEFDKDL

SEQ ID NO: 2047774 - protein, 24 aa, Staphylococcus
YQHFGRHWIAPAIREDGSEFDRDL

SEQ ID NO: 2047775 - protein, 24 aa, Staphylococcus
YQHGSFDLAVPIFIPIKQLIPLII

SEQ ID NO: 2047776 - protein, 17 aa, Staphylococcus
YQHVYQAVVYISGQKRN

SEQ ID NO: 2047777 - protein, 17 aa, Staphylococcus
YQIEIMKKIQPILESVN

SEQ ID NO: 2047778 - protein, 17 aa, Staphylococcus
YQIKPKIIGVNNRDLKT

SEQ ID NO: 2047779 - protein, 20 aa, Staphylococcus
YQILLVTGGEGWYQEEGKPS

SEQ ID NO: 2047780 - protein, 19 aa, Staphylococcus
YQILSSLIKLLKKYPLPTT

SEQ ID NO: 2047781 - protein, 17 aa, Staphylococcus
YQIPWVYGAAVGSKGTV

SEQ ID NO: 2047782 - protein, 24 aa, Staphylococcus
YQIVNYWIDFGVDGFRFDVINLIS

SEQ ID NO: 2047783 - protein, 26 aa, Staphylococcus
YQKAGFKKLKTGMVIYQDKRLTDTYT

SEQ ID NO: 2047784 - protein, 24 aa, Staphylococcus
YQKETGYYFNIFDYGSFTIGSKNE

SEQ ID NO: 2047785 - protein, 17 aa, Staphylococcus
YQLAQRGINVNLIEMRP

SEQ ID NO: 2047786 - protein, 19 aa, Staphylococcus
YQLGALNGFCQIHDVKMNH

SEQ ID NO: 2047787 - protein, 18 aa, Staphylococcus
YQLHDVIFEMVRQRGTEP

SEQ ID NO: 2047788 - protein, 17 aa, Staphylococcus
YQLKHQFTHLTWNIQVY

SEQ ID NO: 2047789 - protein, 24 aa, Staphylococcus
YQLKLPKDGPVNWTTHEDLAEGMV

SEQ ID NO: 2047790 - protein, 19 aa, Staphylococcus
YQLMDEFIVNEVLDNTEFV

SEQ ID NO: 2047791 - protein, 23 aa, Staphylococcus
YQLPKYLFEDIYFKKMSAEAKIM

SEQ ID NO: 2047792 - protein, 19 aa, Staphylococcus
YQLSFKSVESITNEDLDWA

SEQ ID NO: 2047793 - protein, 17 aa, Staphylococcus
YQLTDGRHYSGLRRNSM

SEQ ID NO: 2047794 - protein, 19 aa, Staphylococcus
YQMKFIFRDINGISIHMPS

SEQ ID NO: 2047795 - protein, 20 aa, Staphylococcus
YQMSSMAMAIYFQDMNNDER

SEQ ID NO: 2047796 - protein, 17 aa, Staphylococcus
YQMTIVFITHDINLVKD

SEQ ID NO: 2047797 - protein, 19 aa, Staphylococcus
YQMYVKLLFDKWQHDKIPP

SEQ ID NO: 2047798 - protein, 23 aa, Staphylococcus
YQMYYKLKAFKVEYGATVSGWSD

SEQ ID NO: 2047799 - protein, 20 aa, Staphylococcus
YQNDCRYFGNTSLTFDEWMN

SEQ ID NO: 2047800 - protein, 25 aa, Staphylococcus
YQNEQRLPNQLLFTTEQHTNNEVED

SEQ ID NO: 2047801 - protein, 17 aa, Staphylococcus
YQNGRFVQGLTRGDGTT

SEQ ID NO: 2047802 - protein, 24 aa, Staphylococcus
YQNKPLVCVGILKGSVMFMADLIK

SEQ ID NO: 2047803 - protein, 26 aa, Staphylococcus
YQNKRPDYIDAFWNVVNWNKVDELYE

SEQ ID NO: 2047804 - protein, 24 aa, Staphylococcus
YQNKRPDYISAFWNVINWEKVDEL

SEQ ID NO: 2047805 - protein, 17 aa, Staphylococcus
YQNLEMRSNIASLAKVV

SEQ ID NO: 2047806 - protein, 24 aa, Staphylococcus
YQNLTWDPPMVMFAANQSVLGNHE

SEQ ID NO: 2047807 - protein, 22 aa, Staphylococcus
YQNSKDWSHGMGLISNSEAYNY

SEQ ID NO: 2047808 - protein, 25 aa, Staphylococcus
YQNVKNRIGSIPTLMDFIEQNSIDP

SEQ ID NO: 2047809 - protein, 17 aa, Staphylococcus
YQNVSFNSLEEFMNSNI

SEQ ID NO: 2047810 - protein, 17 aa, Staphylococcus
YQPDVIHANDFDVLLMV

SEQ ID NO: 2047811 - protein, 19 aa, Staphylococcus
YQPGIKYDSMIILYGGQGV

SEQ ID NO: 2047812 - protein, 23 aa, Staphylococcus
YQPKELVIIGGGYIALEFASMFQ

SEQ ID NO: 2047813 - protein, 17 aa, Staphylococcus
YQPKPGTDLVWLGAATK

SEQ ID NO: 2047814 - protein, 19 aa, Staphylococcus
YQPWPSYDEALLVDDEIEI

SEQ ID NO: 2047815 - protein, 18 aa, Staphylococcus
YQPWPTFDESLLVDDEVE

SEQ ID NO: 2047816 - protein, 17 aa, Staphylococcus
YQPWPTYDESLLVDSEV

SEQ ID NO: 2047817 - protein, 17 aa, Staphylococcus
YQPWPTYNESLLVDDEV

SEQ ID NO: 2047818 - protein, 25 aa, Staphylococcus
YQPYAEGFVKMLAPIAPHIGEELWD

SEQ ID NO: 2047819 - protein, 25 aa, Staphylococcus
YQPYAEGFVKMLAPIAPHIGEELWQ

SEQ ID NO: 2047820 - protein, 19 aa, Staphylococcus
YQQCPFKHYTSHGLRLNER

SEQ ID NO: 2047821 - protein, 19 aa, Staphylococcus
YQQHIPWIYGGVVQSTYVE

SEQ ID NO: 2047822 - protein, 25 aa, Staphylococcus
YQQIFRLLEDMRVFNHIRNERPSTS

SEQ ID NO: 2047823 - protein, 19 aa, Staphylococcus
YQQNIPWIYGGVVQSTYIE

SEQ ID NO: 2047824 - protein, 22 aa, Staphylococcus
YQQPKFLQYWTEKINETLANIP

SEQ ID NO: 2047825 - protein, 19 aa, Staphylococcus
YQREVYRLVDQGESLTAST

SEQ ID NO: 2047826 - protein, 22 aa, Staphylococcus
YQRGIHCHPEQIVIGSGTNALL

SEQ ID NO: 2047827 - protein, 19 aa, Staphylococcus
YQRGMKLSSACDKTLKDAE

SEQ ID NO: 2047828 - protein, 25 aa, Staphylococcus
YQRGMKLSTACDSTLKDAEKKVNKL

SEQ ID NO: 2047829 - protein, 25 aa, Staphylococcus
YQRGMKLSTACDTTLKDAEKKVNKL

SEQ ID NO: 2047830 - protein, 29 aa, Staphylococcus
YQRIQKDWGKLKWRSLLESFDKYYMTDDF

SEQ ID NO: 2047831 - protein, 25 aa, Staphylococcus
YQRNQFHLAKTGAMFYTDILTPGYS

SEQ ID NO: 2047832 - protein, 24 aa, Staphylococcus
YQRSADIFLGVPFNIASYALLTHL

SEQ ID NO: 2047833 - protein, 25 aa, Staphylococcus
YQRSADIFLGVPFNIASYALLTHLV

SEQ ID NO: 2047834 - protein, 20 aa, Staphylococcus
YQRVMFWSEYEIRQYTHSDI

SEQ ID NO: 2047835 - protein, 17 aa, Staphylococcus
YQRYWIAEHHQVLSVAS

SEQ ID NO: 2047836 - protein, 23 aa, Staphylococcus
YQSGIEIKQLFVIEPDRTDEDLI

SEQ ID NO: 2047837 - protein, 17 aa, Staphylococcus
YQSGLVIEQLFVVDPSR

SEQ ID NO: 2047838 - protein, 20 aa, Staphylococcus
YQSLTALGAHVMFSSPDEWK

SEQ ID NO: 2047839 - protein, 26 aa, Staphylococcus
YQSNGIKCVMIAKLPFMNKYNTKHWL

SEQ ID NO: 2047840 - protein, 21 aa, Staphylococcus
YQTAKLIGERAVTLKGSIDQI

SEQ ID NO: 2047841 - protein, 21 aa, Staphylococcus
YQTEIKDWLDNGVLEKADVAF

SEQ ID NO: 2047842 - protein, 20 aa, Staphylococcus
YQTEIQAIIKQCLGLPQTRL

SEQ ID NO: 2047843 - protein, 20 aa, Staphylococcus
YQTGHAAGIPKDFLSFKYIL

SEQ ID NO: 2047844 - protein, 18 aa, Staphylococcus
YQTLKIIIEQDVATVFKL

SEQ ID NO: 2047845 - protein, 18 aa, Staphylococcus
YQVASSLAQQLSTIYQVS

SEQ ID NO: 2047846 - protein, 26 aa, Staphylococcus
YQVEDFKEIFKLSGEHPTIVRLLDPP

SEQ ID NO: 2047847 - protein, 25 aa, Staphylococcus
YQVIICFDGLDFLRFGRIQREYEKL

SEQ ID NO: 2047848 - protein, 26 aa, Staphylococcus
YQVIICFDGLDFLRFGRIQRVYERLR

SEQ ID NO: 2047849 - protein, 22 aa, Staphylococcus
YQVLLKSIFGYVNKCEMASLRV

SEQ ID NO: 2047850 - protein, 17 aa, Staphylococcus
YQVPGLMMGGVTVVISP

SEQ ID NO: 2047851 - protein, 24 aa, Staphylococcus
YQVPPRWLFLKIITDEGLEGWGEP

SEQ ID NO: 2047852 - protein, 19 aa, Staphylococcus
YQYDHILLATGFKNNIMQM

SEQ ID NO: 2047853 - protein, 23 aa, Staphylococcus
YQYFREDLILFTYLHLANDKELT

SEQ ID NO: 2047854 - protein, 24 aa, Staphylococcus
YQYMLKRKYHFMGYSQMKTLKNEL

SEQ ID NO: 2047855 - protein, 32 aa, Staphylococcus
YQYPFELSGGMAQRVALVMAIVREAQFLIADE

SEQ ID NO: 2047856 - protein, 19 aa, Staphylococcus
YQYQPRLDYLKAVDKLILD

SEQ ID NO: 2047857 - protein, 19 aa, Staphylococcus
YQYQPRLNYLKAVNKLILD

SEQ ID NO: 2047858 - protein, 18 aa, Staphylococcus
YQYVMKWQETAIFYDKLL

SEQ ID NO: 2047859 - protein, 19 aa, Staphylococcus
YRAIRLCLDQPDIFRPQLR

SEQ ID NO: 2047860 - protein, 21 aa, Staphylococcus
YRAVLNLVLLCGCQGVNGGGW

SEQ ID NO: 2047861 - protein, 20 aa, Staphylococcus
YRDGEIEGTIDLNQYYYKNR

SEQ ID NO: 2047862 - protein, 20 aa, Staphylococcus
YRDGEVEGTIDLNQYYYKNR

SEQ ID NO: 2047863 - protein, 19 aa, Staphylococcus
YRDKLNYILHHLKKYKDQL

SEQ ID NO: 2047864 - protein, 18 aa, Staphylococcus
YRDMRAGLHNPPMEDMAY

SEQ ID NO: 2047865 - protein, 19 aa, Staphylococcus
YRDSPKYIYEYMQKKYPYY

SEQ ID NO: 2047866 - protein, 17 aa, Staphylococcus
YRDTIFPIDEKIESTRE

SEQ ID NO: 2047867 - protein, 25 aa, Staphylococcus
YRDVLKGELLVSGKTTVYFNIGGLW

SEQ ID NO: 2047868 - protein, 24 aa, Staphylococcus
YREAEGFEAYFLMNQLGAPFLLIS

SEQ ID NO: 2047869 - protein, 17 aa, Staphylococcus
YREFFLLCFLSISNKVS

SEQ ID NO: 2047870 - protein, 25 aa, Staphylococcus
YREGFHICKGELFGKHRHGEDCLLC

SEQ ID NO: 2047871 - protein, 19 aa, Staphylococcus
YREYSGIFFKSQKLINQLK

SEQ ID NO: 2047872 - protein, 20 aa, Staphylococcus
YRFQILVKYKREPELLTALQ

SEQ ID NO: 2047873 - protein, 19 aa, Staphylococcus
YRGIVKFGRKAKGARANIE

SEQ ID NO: 2047874 - protein, 23 aa, Staphylococcus
YRGKDLVCIGILKGSAMFMSDLI

SEQ ID NO: 2047875 - protein, 17 aa, Staphylococcus
YRGKGYASTLLGQALDY

SEQ ID NO: 2047876 - protein, 20 aa, Staphylococcus
YRGLGLGLKLLTFIETIARE

SEQ ID NO: 2047877 - protein, 23 aa, Staphylococcus
YRGMGTTCVCALIFDNKIVVANI

SEQ ID NO: 2047878 - protein, 24 aa, Staphylococcus
YRGMGTTCVCALIFEKKVVIANIG

SEQ ID NO: 2047879 - protein, 19 aa, Staphylococcus
YRGMLLSDIVNWLEFELSC

SEQ ID NO: 2047880 - protein, 26 aa, Staphylococcus
YRGNSKYLFNHFIKRNPMVDTYFITD

SEQ ID NO: 2047881 - protein, 23 aa, Staphylococcus
YRGNSKYLFNYFVKRNPTTEAYF

SEQ ID NO: 2047882 - protein, 23 aa, Staphylococcus
YRGNSKYLFNYFVKRNPTTEAYY

SEQ ID NO: 2047883 - protein, 25 aa, Staphylococcus
YRGNSKYLFSYFVKRNPTIETYFVT

SEQ ID NO: 2047884 - protein, 17 aa, Staphylococcus
YRGQGIATQLMTYLLEM

SEQ ID NO: 2047885 - protein, 35 aa, Staphylococcus
YRGVTEFPFSDLISFKEIKEQLGLTHHTEMLLNET

SEQ ID NO: 2047886 - protein, 17 aa, Staphylococcus
YRHLIVVPMFLYDGRLV

SEQ ID NO: 2047887 - protein, 20 aa, Staphylococcus
YRHMALDIVDLLAKRLKQEH

SEQ ID NO: 2047888 - protein, 34 aa, Staphylococcus
YRHMALEIVDLLAKRLKQEYGLKFADSKTKNTPI

SEQ ID NO: 2047889 - protein, 24 aa, Staphylococcus
YRHMALEIVDLLAKRLKQEYKLTF

SEQ ID NO: 2047890 - protein, 20 aa, Staphylococcus
YRIHGYRIGGKTGTAQVADP

SEQ ID NO: 2047891 - protein, 19 aa, Staphylococcus
YRIKRLKDAIPNNAPILYK

SEQ ID NO: 2047892 - protein, 21 aa, Staphylococcus
YRILTEPKLSLIKQYEALLKT

SEQ ID NO: 2047893 - protein, 21 aa, Staphylococcus
YRILTEPKLSLIKQYEALLQT

SEQ ID NO: 2047894 - protein, 21 aa, Staphylococcus
YRILTEPKLSLVKQYEALLKT

SEQ ID NO: 2047895 - protein, 19 aa, Staphylococcus
YRILYKHMGPQGWWPADSK

SEQ ID NO: 2047896 - protein, 26 aa, Staphylococcus
YRIYIAALKLGIAIIPSSEMLRTKDL

SEQ ID NO: 2047897 - protein, 21 aa, Staphylococcus
YRKADIKGYEVMKEKLEQLNV

SEQ ID NO: 2047898 - protein, 20 aa, Staphylococcus
YRKHIPDLIYVHSEDALRFD

SEQ ID NO: 2047899 - protein, 18 aa, Staphylococcus
YRKHPYTLIIISHDLSVI

SEQ ID NO: 2047900 - protein, 17 aa, Staphylococcus
YRKHWHVIFHLNNGKKL

SEQ ID NO: 2047901 - protein, 17 aa, Staphylococcus
YRKHWQVIFELDNGKKL

SEQ ID NO: 2047902 - protein, 24 aa, Staphylococcus
YRKKRGQTIIQTWHASGALKLFGL

SEQ ID NO: 2047903 - protein, 30 aa, Staphylococcus
YRKMLEFYHPEFKKEYVILAEEGAQSDDDD

SEQ ID NO: 2047904 - protein, 30 aa, Staphylococcus
YRKMLEFYHPEFKKEYVVLAEEGAQTDEDV

SEQ ID NO: 2047905 - protein, 26 aa, Staphylococcus
YRKNVKFGVDITHLFNQPEAFKNMEP

SEQ ID NO: 2047906 - protein, 18 aa, Staphylococcus
YRKPCVICETCFEKWNQV

SEQ ID NO: 2047907 - protein, 17 aa, Staphylococcus
YRKPGCGAYPLRGHNNV

SEQ ID NO: 2047908 - protein, 20 aa, Staphylococcus
YRKRGEGVYLDGPESKKREF

SEQ ID NO: 2047909 - protein, 20 aa, Staphylococcus
YRLASKYGSNVDDLFNIAQT

SEQ ID NO: 2047910 - protein, 23 aa, Staphylococcus
YRLEVKNPLQLIYAILAKYQANH

SEQ ID NO: 2047911 - protein, 18 aa, Staphylococcus
YRLHHAYHKKVMMAQFNN

SEQ ID NO: 2047912 - protein, 26 aa, Staphylococcus
YRLIGSCGLDSVRVIKGQFGAHINTN

SEQ ID NO: 2047913 - protein, 23 aa, Staphylococcus
YRLKPQNVISIFMNRLNKYTPLI

SEQ ID NO: 2047914 - protein, 24 aa, Staphylococcus
YRLKPTHFNAILANRIRKYTPLLK

SEQ ID NO: 2047915 - protein, 25 aa, Staphylococcus
YRLRLLELGFSMKQFSLYERYTSDT

SEQ ID NO: 2047916 - protein, 25 aa, Staphylococcus
YRMDDLRASLGISQFKNMKRNKIHR

SEQ ID NO: 2047917 - protein, 17 aa, Staphylococcus
YRMMAKLDNLDKYNLDH

SEQ ID NO: 2047918 - protein, 17 aa, Staphylococcus
YRMRWNPRHPGNHQYAT

SEQ ID NO: 2047919 - protein, 25 aa, Staphylococcus
YRNACLNAIEFLKTRGFTGEQAYML

SEQ ID NO: 2047920 - protein, 20 aa, Staphylococcus
YRNAKEMIFIPNISDIEDIE

SEQ ID NO: 2047921 - protein, 19 aa, Staphylococcus
YRNEPSWLASYKENEKLLR

SEQ ID NO: 2047922 - protein, 18 aa, Staphylococcus
YRNFLPNHHMQFAMMQYA

SEQ ID NO: 2047923 - protein, 17 aa, Staphylococcus
YRNIRFFPENFETYEFL

SEQ ID NO: 2047924 - protein, 26 aa, Staphylococcus
YRNKAKALHELFSWLHMYHYDYEHIA

SEQ ID NO: 2047925 - protein, 21 aa, Staphylococcus
YRNLHLFKDLAIIESTELDGE

SEQ ID NO: 2047926 - protein, 20 aa, Staphylococcus
YRNLHLFKDLGIIESTELDG

SEQ ID NO: 2047927 - protein, 20 aa, Staphylococcus
YRNLHLFKDLGIIESTELEG

SEQ ID NO: 2047928 - protein, 21 aa, Staphylococcus
YRNLHLFKDLGIVEGTELDGE

SEQ ID NO: 2047929 - protein, 22 aa, Staphylococcus
YRNLHLFKDLKIIESTELDGEM

SEQ ID NO: 2047930 - protein, 20 aa, Staphylococcus
YRNLHLFKDLNIVESTELDG

SEQ ID NO: 2047931 - protein, 30 aa, Staphylococcus
YRPYIKRTQPILDQFGLHTGQWLVLKDIAT

SEQ ID NO: 2047932 - protein, 18 aa, Staphylococcus
YRQFTQFGVEAIGAENPG

SEQ ID NO: 2047933 - protein, 18 aa, Staphylococcus
YRQFTQFGVEAIGAENPS

SEQ ID NO: 2047934 - protein, 24 aa, Staphylococcus
YRQIKGLEFDTVIMPFLSKKTFLE

SEQ ID NO: 2047935 - protein, 18 aa, Staphylococcus
YRQLEEIDTFQPLPNDEY

SEQ ID NO: 2047936 - protein, 17 aa, Staphylococcus
YRQNVVFILWGKPAQQK

SEQ ID NO: 2047937 - protein, 19 aa, Staphylococcus
YRRKLSYIPEAPVIYEELT

SEQ ID NO: 2047938 - protein, 18 aa, Staphylococcus
YRRNIFKLMKENFKFIYL

SEQ ID NO: 2047939 - protein, 18 aa, Staphylococcus
YRRVVPSPMPINIVELDS

SEQ ID NO: 2047940 - protein, 19 aa, Staphylococcus
YRSSNIMGFLGYNQENLII

SEQ ID NO: 2047941 - protein, 17 aa, Staphylococcus
YRTAIFYTNEDQRETAE

SEQ ID NO: 2047942 - protein, 18 aa, Staphylococcus
YRTIILEIMGKHSNLILV

SEQ ID NO: 2047943 - protein, 18 aa, Staphylococcus
YRTLELLAEIKVVDKINF

SEQ ID NO: 2047944 - protein, 18 aa, Staphylococcus
YRTMPMVWYCPPLSPIMS

SEQ ID NO: 2047945 - protein, 21 aa, Staphylococcus
YRTSGHWAHYRDDMFPPMKLD

SEQ ID NO: 2047946 - protein, 24 aa, Staphylococcus
YRTVMPGFQYEAPPTQNKLNPYEV

SEQ ID NO: 2047947 - protein, 21 aa, Staphylococcus
YRTVMPGFQYETPPTQNKINP

SEQ ID NO: 2047948 - protein, 26 aa, Staphylococcus
YRTYTNALMPYNFLNARFKQDGSRPG

SEQ ID NO: 2047949 - protein, 22 aa, Staphylococcus
YRVGLKLRDGGWVYVQGLTHFE

SEQ ID NO: 2047950 - protein, 31 aa, Staphylococcus
YRVISEGLLEGFKHLGFDASFAIPRSKEERA

SEQ ID NO: 2047951 - protein, 32 aa, Staphylococcus
YRVISEGLLEGFKLLGFEAYFAIPRSKEEREK

SEQ ID NO: 2047952 - protein, 18 aa, Staphylococcus
YRVKGFVRFTDSKLIHLV

SEQ ID NO: 2047953 - protein, 17 aa, Staphylococcus
YRVKSIEAFLSENNISL

SEQ ID NO: 2047954 - protein, 24 aa, Staphylococcus
YRVNEAWYYIETSLQLTLPYERNS

SEQ ID NO: 2047955 - protein, 22 aa, Staphylococcus
YRYDPDQCILCGRCVEACQDVE

SEQ ID NO: 2047956 - protein, 22 aa, Staphylococcus
YRYDPNQCILCGRCVEVCQDVQ

SEQ ID NO: 2047957 - protein, 20 aa, Staphylococcus
YRYIFPYDIPSTVTSLLRER

SEQ ID NO: 2047958 - protein, 17 aa, Staphylococcus
YRYKSYELETIILNMLG

SEQ ID NO: 2047959 - protein, 20 aa, Staphylococcus
YRYPLVDGQGNFGSMDGDGA

SEQ ID NO: 2047960 - protein, 17 aa, Staphylococcus
YSARTGTPAARMDDQID

SEQ ID NO: 2047961 - protein, 19 aa, Staphylococcus
YSCSAFLIYAGINRQLRDK

SEQ ID NO: 2047962 - protein, 24 aa, Staphylococcus
YSDDYRAFVMVSYIDDRVNALYSN

SEQ ID NO: 2047963 - protein, 22 aa, Staphylococcus
YSDFDRRALIEHAEELLKSDMR

SEQ ID NO: 2047964 - protein, 21 aa, Staphylococcus
YSDIKYQLGLIGKNENEKLLK

SEQ ID NO: 2047965 - protein, 25 aa, Staphylococcus
YSDIPENLQILGMGPVELRLRDIRP

SEQ ID NO: 2047966 - protein, 24 aa, Staphylococcus
YSDKNLACHLGWFNTTVDENFRPH

SEQ ID NO: 2047967 - protein, 24 aa, Staphylococcus
YSDLKLKAFEAHASQTGPFLKQIA

SEQ ID NO: 2047968 - protein, 17 aa, Staphylococcus
YSDLVVNIREGMEMDRS

SEQ ID NO: 2047969 - protein, 23 aa, Staphylococcus
YSDMSQIRWHSVLNLQQKSEDQL

SEQ ID NO: 2047970 - protein, 19 aa, Staphylococcus
YSDNSFNVSSSFKASKSQN

SEQ ID NO: 2047971 - protein, 32 aa, Staphylococcus
YSDSFSFNSPNGMCKTCEGLGYIEDINLNELL

SEQ ID NO: 2047972 - protein, 18 aa, Staphylococcus
YSEALRLYHSVPNCTLIS

SEQ ID NO: 2047973 - protein, 31 aa, Staphylococcus
YSELFKYQVIICFDGLDFLRFGRLQREYERL

SEQ ID NO: 2047974 - protein, 22 aa, Staphylococcus
YSELTYLTFVYKVAAMDFIFKD

SEQ ID NO: 2047975 - protein, 23 aa, Staphylococcus
YSGDTLKGLIFVSRKNEAVELAE

SEQ ID NO: 2047976 - protein, 20 aa, Staphylococcus
YSGEALFRIVQAVEQSATHW

SEQ ID NO: 2047977 - protein, 22 aa, Staphylococcus
YSGLKLLRLIHHHHHIEVSSIH

SEQ ID NO: 2047978 - protein, 19 aa, Staphylococcus
YSGMIKGTGPRYCPSIEDK

SEQ ID NO: 2047979 - protein, 19 aa, Staphylococcus
YSGVPVWNGLTDAWHPTQM

SEQ ID NO: 2047980 - protein, 18 aa, Staphylococcus
YSHDKWWESTSVPFYQKR

SEQ ID NO: 2047981 - protein, 17 aa, Staphylococcus
YSHFLLIEQTVYALKQS

SEQ ID NO: 2047982 - protein, 18 aa, Staphylococcus
YSHFSRTYLRLTKNIYLN

SEQ ID NO: 2047983 - protein, 18 aa, Staphylococcus
YSHFTQMEGNYELKVAEG

SEQ ID NO: 2047984 - protein, 18 aa, Staphylococcus
YSHFTQMVGNYELKVAEG

SEQ ID NO: 2047985 - protein, 30 aa, Staphylococcus
YSIIPLKLYLKHGVCKVLIGVARGKKKYDK

SEQ ID NO: 2047986 - protein, 24 aa, Staphylococcus
YSIVAFESYGSVVLNNDLLTIKTK

SEQ ID NO: 2047987 - protein, 18 aa, Staphylococcus
YSKATRGNIDVNLNVKVE

SEQ ID NO: 2047988 - protein, 25 aa, Staphylococcus
YSKHGFKFAETIYDLAGKAILKKYV

SEQ ID NO: 2047989 - protein, 20 aa, Staphylococcus
YSKHLYRLFTEYQDESTYTF

SEQ ID NO: 2047990 - protein, 17 aa, Staphylococcus
YSKLKFENGAHRVQRVP

SEQ ID NO: 2047991 - protein, 25 aa, Staphylococcus
YSKLTDFKDVLGFNYVLDGMIMDDL

SEQ ID NO: 2047992 - protein, 17 aa, Staphylococcus
YSKTFKSYMGMTPNEYR

SEQ ID NO: 2047993 - protein, 17 aa, Staphylococcus
YSKWKGMGTLSSVDVID

SEQ ID NO: 2047994 - protein, 18 aa, Staphylococcus
YSLEFLGASLGGYIIGTA

SEQ ID NO: 2047995 - protein, 25 aa, Staphylococcus
YSLGMKQRLGIALALLTGPDILVLD

SEQ ID NO: 2047996 - protein, 18 aa, Staphylococcus
YSLIKRIFNVEVEILVRK

SEQ ID NO: 2047997 - protein, 18 aa, Staphylococcus
YSLIKRVFDVEVEILVRK

SEQ ID NO: 2047998 - protein, 25 aa, Staphylococcus
YSLKDRAYVSKWKKHKIYRNLKKKY

SEQ ID NO: 2047999 - protein, 25 aa, Staphylococcus
YSLPYRYYEDYGIRKYGFHGTSHKY

SEQ ID NO: 2048000 - protein, 25 aa, Staphylococcus
YSLRHVYKNVITCFLDTKEVQPLKN

SEQ ID NO: 2048001 - protein, 21 aa, Staphylococcus
YSLRYDEMQQWLIDHGQQKFR

SEQ ID NO: 2048002 - protein, 24 aa, Staphylococcus
YSMGGRIGLYYALYGQAQLTGLIL

SEQ ID NO: 2048003 - protein, 34 aa, Staphylococcus
YSMGGRVALYYALYGQCRLSGLILESTSPGIHQA

SEQ ID NO: 2048004 - protein, 25 aa, Staphylococcus
YSMGGRVALYYAVYGKCSLSKLIIE

SEQ ID NO: 2048005 - protein, 18 aa, Staphylococcus
YSMIKGTVDAILFQNNDN

SEQ ID NO: 2048006 - protein, 20 aa, Staphylococcus
YSMMRLNKNILLKGPTGSGK

SEQ ID NO: 2048007 - protein, 23 aa, Staphylococcus
YSMVKGTVEAILFQNKENFYTVL

SEQ ID NO: 2048008 - protein, 27 aa, Staphylococcus
YSNALYRIAKDLDIGFISLYRALGDFN

SEQ ID NO: 2048009 - protein, 21 aa, Staphylococcus
YSNDIDIVFILGGDGTVNELI

SEQ ID NO: 2048010 - protein, 21 aa, Staphylococcus
YSNEDDLFFVISLSGETHQLT

SEQ ID NO: 2048011 - protein, 24 aa, Staphylococcus
YSNEYNIGAPLGMPTFDSTVNPLH

SEQ ID NO: 2048012 - protein, 22 aa, Staphylococcus
YSNIELVHFFFKSLTSYLKKHN

SEQ ID NO: 2048013 - protein, 18 aa, Staphylococcus
YSNIELVHYFFKSLTNFL

SEQ ID NO: 2048014 - protein, 21 aa, Staphylococcus
YSNRYKLIFEYNNFIYEGDFI

SEQ ID NO: 2048015 - protein, 17 aa, Staphylococcus
YSNSIFYYYMIDKQARM

SEQ ID NO: 2048016 - protein, 20 aa, Staphylococcus
YSPDSKLGLATGGTMTDVYQ

SEQ ID NO: 2048017 - protein, 19 aa, Staphylococcus
YSPNCLPIIARALESDDYS

SEQ ID NO: 2048018 - protein, 17 aa, Staphylococcus
YSPSEFKKALEDDETII

SEQ ID NO: 2048019 - protein, 17 aa, Staphylococcus
YSPYLKKYDLTYTGYIV

SEQ ID NO: 2048020 - protein, 17 aa, Staphylococcus
YSQLIAKSVQLDFLRSD

SEQ ID NO: 2048021 - protein, 24 aa, Staphylococcus
YSQLLKLLAQRHVYPTFIESRKNS

SEQ ID NO: 2048022 - protein, 20 aa, Staphylococcus
YSRAFLPFRPYVVEDGHLVT

SEQ ID NO: 2048023 - protein, 25 aa, Staphylococcus
YSRITIKGVKDIAGYSRNKVNEVIK

SEQ ID NO: 2048024 - protein, 19 aa, Staphylococcus
YSRTGKKGGPFFNSVNHRN

SEQ ID NO: 2048025 - protein, 17 aa, Staphylococcus
YSSFISYHIFFETLLRK

SEQ ID NO: 2048026 - protein, 23 aa, Staphylococcus
YSSGMRAKLGFSINITTNPDILV

SEQ ID NO: 2048027 - protein, 23 aa, Staphylococcus
YSSGMRAKLGFSINITVNPDILV

SEQ ID NO: 2048028 - protein, 24 aa, Staphylococcus
YSSGMRAKLGFSINVTIDPDILVI

SEQ ID NO: 2048029 - protein, 32 aa, Staphylococcus
YSSVMFDYAYLKRPMLFFAYDLEKYLYSERGT

SEQ ID NO: 2048030 - protein, 19 aa, Staphylococcus
YSTDLANIFYVRQKEQKGL

SEQ ID NO: 2048031 - protein, 24 aa, Staphylococcus
YSTEIFESAFWMDPERILEIGYPR

SEQ ID NO: 2048032 - protein, 28 aa, Staphylococcus
YSTEIFESAFWMDRERILEVGYPRNDIL

SEQ ID NO: 2048033 - protein, 33 aa, Staphylococcus
YSTEKVESIWNFINKIWNAARFSIMNIGEDFTV

SEQ ID NO: 2048034 - protein, 17 aa, Staphylococcus
YSTEMRPLIEVFDNLLD

SEQ ID NO: 2048035 - protein, 19 aa, Staphylococcus
YSTHRLCIDLLNMLNHSSQ

SEQ ID NO: 2048036 - protein, 24 aa, Staphylococcus
YSTLKKDGPRIMALEPQDDNRDGV

SEQ ID NO: 2048037 - protein, 17 aa, Staphylococcus
YSTNIFKTAFWMDEARI

SEQ ID NO: 2048038 - protein, 21 aa, Staphylococcus
YSTNPKAIFFRSFTVDARYRG

SEQ ID NO: 2048039 - protein, 17 aa, Staphylococcus
YSTYLSYLPEDKFSYPL

SEQ ID NO: 2048040 - protein, 25 aa, Staphylococcus
YSVFAFKVVPDLFYPELITVGNNSV

SEQ ID NO: 2048041 - protein, 20 aa, Staphylococcus
YSVLRALKAIERSNVILIVI

SEQ ID NO: 2048042 - protein, 30 aa, Staphylococcus
YSVRFGLDIICLRFSHLFGANEKNNYMINY

SEQ ID NO: 2048043 - protein, 23 aa, Staphylococcus
YSYPNEYGRIFKTLIENINSKQD

SEQ ID NO: 2048044 - protein, 22 aa, Staphylococcus
YTAEGIGGAGYNDGTPCKEVSI

SEQ ID NO: 2048045 - protein, 34 aa, Staphylococcus
YTAGQCTYYAFDRAGGKVGSTWGNANNWASAAAA

SEQ ID NO: 2048046 - protein, 26 aa, Staphylococcus
YTAKQLKLKAVIFMPVTTPLQKINQV

SEQ ID NO: 2048047 - protein, 19 aa, Staphylococcus
YTAPNFFLLERLRKAYPDK

SEQ ID NO: 2048048 - protein, 17 aa, Staphylococcus
YTAVFGIEDKSADDILE

SEQ ID NO: 2048049 - protein, 17 aa, Staphylococcus
YTAWQFGVDPNKLADLV

SEQ ID NO: 2048050 - protein, 24 aa, Staphylococcus
YTDKLKSRIDSLAIQEEDYTYFFN

SEQ ID NO: 2048051 - protein, 17 aa, Staphylococcus
YTDKMRVRMESLETQAE

SEQ ID NO: 2048052 - protein, 19 aa, Staphylococcus
YTDLIFLYLEKSFLTEDFY

SEQ ID NO: 2048053 - protein, 19 aa, Staphylococcus
YTDLLFLYLEHAFIEQNFY

SEQ ID NO: 2048054 - protein, 24 aa, Staphylococcus
YTEDMVSFLIGCSFTFEHALLEAG

SEQ ID NO: 2048055 - protein, 30 aa, Staphylococcus
YTEDVYDFWRPSGEIYPLVAGKLSKDAYIK

SEQ ID NO: 2048056 - protein, 27 aa, Staphylococcus
YTEDVYDFWRPSGHHYPLVDGALSKDA

SEQ ID NO: 2048057 - protein, 32 aa, Staphylococcus
YTELFKYQVIICFDGLDFLRFGRIQRTYEQLR

SEQ ID NO: 2048058 - protein, 17 aa, Staphylococcus
YTFHKIFSIITLSNQLT

SEQ ID NO: 2048059 - protein, 17 aa, Staphylococcus
YTFHKIFSLITLSNELR

SEQ ID NO: 2048060 - protein, 20 aa, Staphylococcus
YTFKMYPTDFVPFFEESMTI

SEQ ID NO: 2048061 - protein, 18 aa, Staphylococcus
YTFPLFGMAVGEPAEDED

SEQ ID NO: 2048062 - protein, 17 aa, Staphylococcus
YTGALVVVDDLKNLQKS

SEQ ID NO: 2048063 - protein, 17 aa, Staphylococcus
YTGEFKFDQSLHGNYAP

SEQ ID NO: 2048064 - protein, 23 aa, Staphylococcus
YTGLFRFIQMFVVSNKMETRYYA

SEQ ID NO: 2048065 - protein, 25 aa, Staphylococcus
YTGLTRAKQSLVFLGDPQAFDIGLK

SEQ ID NO: 2048066 - protein, 24 aa, Staphylococcus
YTGLTRAKQSLVLLGDPQAFDIGL

SEQ ID NO: 2048067 - protein, 27 aa, Staphylococcus
YTGMRAGELLALKWSDIDFENNTISIT

SEQ ID NO: 2048068 - protein, 19 aa, Staphylococcus
YTGRQAVVSFVRGFHGRTN

SEQ ID NO: 2048069 - protein, 22 aa, Staphylococcus
YTGVRIGVTVAKTLAYALNVRL

SEQ ID NO: 2048070 - protein, 19 aa, Staphylococcus
YTHDGQIEFMGRIDNQVKV

SEQ ID NO: 2048071 - protein, 25 aa, Staphylococcus
YTHIQRLLMNILLNFKKHDEPASIN

SEQ ID NO: 2048072 - protein, 24 aa, Staphylococcus
YTHLGSCYFIHPSVNQKFIEQVYE

SEQ ID NO: 2048073 - protein, 19 aa, Staphylococcus
YTIDIIFYRFIARNYHDSL

SEQ ID NO: 2048074 - protein, 18 aa, Staphylococcus
YTIHVGRALGERVSDLFV

SEQ ID NO: 2048075 - protein, 17 aa, Staphylococcus
YTILQAIDFGHLNQNLN

SEQ ID NO: 2048076 - protein, 17 aa, Staphylococcus
YTILQAIDFGHLNRTYN

SEQ ID NO: 2048077 - protein, 18 aa, Staphylococcus
YTIRLAKGLNIVGLINIQ

SEQ ID NO: 2048078 - protein, 18 aa, Staphylococcus
YTKIKMPVSDKVKQPFGY

SEQ ID NO: 2048079 - protein, 18 aa, Staphylococcus
YTKLRGCQPYYIEHGAFS

SEQ ID NO: 2048080 - protein, 18 aa, Staphylococcus
YTKMLALDNVELEFTEEA

SEQ ID NO: 2048081 - protein, 19 aa, Staphylococcus
YTKSYVMGHKLRYCENCGD

SEQ ID NO: 2048082 - protein, 25 aa, Staphylococcus
YTKYELKFGPILLRNKSDIFFSKWH

SEQ ID NO: 2048083 - protein, 18 aa, Staphylococcus
YTLARVSHRPHHTWVPSL

SEQ ID NO: 2048084 - protein, 20 aa, Staphylococcus
YTLELNNLVTLGSEIENKQR

SEQ ID NO: 2048085 - protein, 17 aa, Staphylococcus
YTLMMGRTHGVHAEPTT

SEQ ID NO: 2048086 - protein, 17 aa, Staphylococcus
YTLNVPLFVNEGDVLVI

SEQ ID NO: 2048087 - protein, 20 aa, Staphylococcus
YTLRQLLPIHRIQKCQQHMQ

SEQ ID NO: 2048088 - protein, 23 aa, Staphylococcus
YTLSHGYPGVILFLNEFQNLYHV

SEQ ID NO: 2048089 - protein, 19 aa, Staphylococcus
YTMTLEFDEAVFGTKKEIS

SEQ ID NO: 2048090 - protein, 18 aa, Staphylococcus
YTMTLEFEEAVFGTKKEI

SEQ ID NO: 2048091 - protein, 17 aa, Staphylococcus
YTMTSTRRLMMRVADQL

SEQ ID NO: 2048092 - protein, 23 aa, Staphylococcus
YTNALMPYNFLNARFKQDGDKPG

SEQ ID NO: 2048093 - protein, 23 aa, Staphylococcus
YTNEKLKSILNISSPNKLSKIKK

SEQ ID NO: 2048094 - protein, 21 aa, Staphylococcus
YTNSPMFYKWDDIVIYMRLER

SEQ ID NO: 2048095 - protein, 21 aa, Staphylococcus
YTPDHGLEFEGLETRAHNVRV

SEQ ID NO: 2048096 - protein, 19 aa, Staphylococcus
YTPKFKIWVSTNHKPIIRG

SEQ ID NO: 2048097 - protein, 17 aa, Staphylococcus
YTPKLSVILVGNDGASQ

SEQ ID NO: 2048098 - protein, 20 aa, Staphylococcus
YTPLEFSYYYLKEMFKEIMG

SEQ ID NO: 2048099 - protein, 29 aa, Staphylococcus
YTPLFKYKVIFCFDGLDFFRYGRIHRTYE

SEQ ID NO: 2048100 - protein, 26 aa, Staphylococcus
YTPRYNKDFLRGCMRESLLENHKLKV

SEQ ID NO: 2048101 - protein, 17 aa, Staphylococcus
YTQEIKKSITVEEIRKN

SEQ ID NO: 2048102 - protein, 23 aa, Staphylococcus
YTQLEIGDKIVFYSREQDHSVVG

SEQ ID NO: 2048103 - protein, 22 aa, Staphylococcus
YTQLEIGDQLVFYNKKREQSVI

SEQ ID NO: 2048104 - protein, 20 aa, Staphylococcus
YTQRHMKLFDNLKHTHKTNW

SEQ ID NO: 2048105 - protein, 23 aa, Staphylococcus
YTQRLGGAKIYLKREDLNHTGAH

SEQ ID NO: 2048106 - protein, 17 aa, Staphylococcus
YTQYELFASASQSEGFG

SEQ ID NO: 2048107 - protein, 17 aa, Staphylococcus
YTRIDQCRRKFLLEFFG

SEQ ID NO: 2048108 - protein, 20 aa, Staphylococcus
YTSCQSMQAIGYKELIPAVN

SEQ ID NO: 2048109 - protein, 18 aa, Staphylococcus
YTSDELQQFLELVKDNVL

SEQ ID NO: 2048110 - protein, 25 aa, Staphylococcus
YTSEHGITFIPYFPLVSGLLAGKYN

SEQ ID NO: 2048111 - protein, 25 aa, Staphylococcus
YTSQRVSYQLVRPMLDISKATIKSY

SEQ ID NO: 2048112 - protein, 26 aa, Staphylococcus
YTSYDYPIAIVFRASLFDEKILTGNI

SEQ ID NO: 2048113 - protein, 20 aa, Staphylococcus
YTTADIDWSTLVPSQEITDL

SEQ ID NO: 2048114 - protein, 17 aa, Staphylococcus
YTTAKAGLIGFSRNLAA

SEQ ID NO: 2048115 - protein, 17 aa, Staphylococcus
YTTKSFRWEYVEGGHMF

SEQ ID NO: 2048116 - protein, 23 aa, Staphylococcus
YTTNGRLGFDYLFDNLADHINAK

SEQ ID NO: 2048117 - protein, 22 aa, Staphylococcus
YTTNGRLGFDYLIDNLADDIQA

SEQ ID NO: 2048118 - protein, 22 aa, Staphylococcus
YTTNGRLGFDYLIDNLADSLEG

SEQ ID NO: 2048119 - protein, 18 aa, Staphylococcus
YTTPDHFETIALNFDTYV

SEQ ID NO: 2048120 - protein, 24 aa, Staphylococcus
YTTQLGIRLEKTFEYIDTPHKFKM

SEQ ID NO: 2048121 - protein, 24 aa, Staphylococcus
YTTYWPTDEVMPIYDAAMKYKEDG

SEQ ID NO: 2048122 - protein, 17 aa, Staphylococcus
YTVDRLGVDWIRNEINN

SEQ ID NO: 2048123 - protein, 18 aa, Staphylococcus
YTVIRFWEKHEVFKDMDG

SEQ ID NO: 2048124 - protein, 17 aa, Staphylococcus
YTVSQALNLVRNYNDIQ

SEQ ID NO: 2048125 - protein, 20 aa, Staphylococcus
YTYGDQGLKEYAVSQFKEAD

SEQ ID NO: 2048126 - protein, 25 aa, Staphylococcus
YTYGEYRLAQKLADLAHQYPRLHIH

SEQ ID NO: 2048127 - protein, 25 aa, Staphylococcus
YTYRLETSDAYTLVGHARFINTEDL

SEQ ID NO: 2048128 - protein, 17 aa, Staphylococcus
YVAGSKQLIDWLKAQSR

SEQ ID NO: 2048129 - protein, 18 aa, Staphylococcus
YVAIRLATEYVLLTTTKD

SEQ ID NO: 2048130 - protein, 29 aa, Staphylococcus
YVASDFKIVTGFIEPHFFAGFSGGPKGIM

SEQ ID NO: 2048131 - protein, 19 aa, Staphylococcus
YVCALDIYQKFSRIGLNVQ

SEQ ID NO: 2048132 - protein, 19 aa, Staphylococcus
YVDCTLGGAGHALYLLNQL

SEQ ID NO: 2048133 - protein, 20 aa, Staphylococcus
YVDCTLGGAGHALYLLNQLN

SEQ ID NO: 2048134 - protein, 17 aa, Staphylococcus
YVDFNSGKIAKQLLNTF

SEQ ID NO: 2048135 - protein, 27 aa, Staphylococcus
YVDFYKSDCWYHAKAYKCSSIGKMTKC

SEQ ID NO: 2048136 - protein, 20 aa, Staphylococcus
YVDVSGRGGTNFVNIENERR

SEQ ID NO: 2048137 - protein, 29 aa, Staphylococcus
YVEADFKIVTGFIEPHFFAGFSGGPKGIM

SEQ ID NO: 2048138 - protein, 19 aa, Staphylococcus
YVEDCKIPVVLKKDGLAAG

SEQ ID NO: 2048139 - protein, 21 aa, Staphylococcus
YVEFLYQCRQTLKRINIEPSY

SEQ ID NO: 2048140 - protein, 17 aa, Staphylococcus
YVEGRFVQGLTRGDGTT

SEQ ID NO: 2048141 - protein, 17 aa, Staphylococcus
YVELGCLTKEDYARITK

SEQ ID NO: 2048142 - protein, 29 aa, Staphylococcus
YVESDFKIVTGFIEPHFFAGFSGGPKGIM

SEQ ID NO: 2048143 - protein, 20 aa, Staphylococcus
YVETVYLMLNKPKGYISATE

SEQ ID NO: 2048144 - protein, 32 aa, Staphylococcus
YVFDDARLYSKEEFIAYFIRKLHLESDDIVII

SEQ ID NO: 2048145 - protein, 26 aa, Staphylococcus
YVFEDARLYSKQEFVAYFMKKLHLTE

SEQ ID NO: 2048146 - protein, 22 aa, Staphylococcus
YVFISWTGKMTETFVLAHELGH

SEQ ID NO: 2048147 - protein, 18 aa, Staphylococcus
YVFTEVALRNKGIKILPF

SEQ ID NO: 2048148 - protein, 19 aa, Staphylococcus
YVFVSPMWNLSFPPVLKAY

SEQ ID NO: 2048149 - protein, 23 aa, Staphylococcus
YVGAHKLYSAFTIAPSQLEENTQ

SEQ ID NO: 2048150 - protein, 17 aa, Staphylococcus
YVGGHPIDLHYKHASDR

SEQ ID NO: 2048151 - protein, 19 aa, Staphylococcus
YVGLKTGRDGIHGATFASE

SEQ ID NO: 2048152 - protein, 29 aa, Staphylococcus
YVGRIGVGRVFRGKMRVGDNVSLIKLDGT

SEQ ID NO: 2048153 - protein, 24 aa, Staphylococcus
YVGRQHKGLGWVLSYDSEQTIDTS

SEQ ID NO: 2048154 - protein, 17 aa, Staphylococcus
YVHIKFRVNDTLTPYET

SEQ ID NO: 2048155 - protein, 23 aa, Staphylococcus
YVHLLEVEREFLLILMKNNKLDL

SEQ ID NO: 2048156 - protein, 23 aa, Staphylococcus
YVIEPQYLFGHLVKKIEKQAFEM

SEQ ID NO: 2048157 - protein, 21 aa, Staphylococcus
YVIGCNGCGDDGQTEYAGNSI

SEQ ID NO: 2048158 - protein, 20 aa, Staphylococcus
YVIGEGGIRTALLDAGLTLI

SEQ ID NO: 2048159 - protein, 28 aa, Staphylococcus
YVKDLKEICRIFKIKGFSKGNEDYIINL

SEQ ID NO: 2048160 - protein, 21 aa, Staphylococcus
YVKEAYELGKYMAEKGYELVF

SEQ ID NO: 2048161 - protein, 18 aa, Staphylococcus
YVKEAYELGKYMAEQGYE

SEQ ID NO: 2048162 - protein, 21 aa, Staphylococcus
YVKEAYQLGKYMAEQGYELIF

SEQ ID NO: 2048163 - protein, 24 aa, Staphylococcus
YVKEVFGLDCKINLVKAYTNSYGF

SEQ ID NO: 2048164 - protein, 25 aa, Staphylococcus
YVLDRIMRMLHPFMPFVTEKIWQSL

SEQ ID NO: 2048165 - protein, 27 aa, Staphylococcus
YVLMAMRIAYFKVHYPLYYYASYFTVR

SEQ ID NO: 2048166 - protein, 27 aa, Staphylococcus
YVLMAVRIAYFKVHHPLYYYASYFTIR

SEQ ID NO: 2048167 - protein, 18 aa, Staphylococcus
YVLMTYYNIVCHYGETLF

SEQ ID NO: 2048168 - protein, 19 aa, Staphylococcus
YVLNDGKFGKLVSHDIKDI

SEQ ID NO: 2048169 - protein, 19 aa, Staphylococcus
YVLNWKNKTHFFKSQEAFV

SEQ ID NO: 2048170 - protein, 19 aa, Staphylococcus
YVMLGHLHHPFSVNEKNIK

SEQ ID NO: 2048171 - protein, 17 aa, Staphylococcus
YVMVSTYDSRREAFDAS

SEQ ID NO: 2048172 - protein, 24 aa, Staphylococcus
YVNPSKVSLDWECFVVSKSDMELD

SEQ ID NO: 2048173 - protein, 18 aa, Staphylococcus
YVNQAAKWGHKAIAVTDH

SEQ ID NO: 2048174 - protein, 18 aa, Staphylococcus
YVNQSVVLPETWIKTGDY

SEQ ID NO: 2048175 - protein, 29 aa, Staphylococcus
YVNRFVRIFDFPFYFRGEVYHPFETETLS

SEQ ID NO: 2048176 - protein, 24 aa, Staphylococcus
YVNRTAIIEKCWESENFIDDNTLA

SEQ ID NO: 2048177 - protein, 17 aa, Staphylococcus
YVNTEVQSVQRQNGYYD

SEQ ID NO: 2048178 - protein, 24 aa, Staphylococcus
YVNVEGNIVFVFKDGTTCICKCEP

SEQ ID NO: 2048179 - protein, 17 aa, Staphylococcus
YVPTAMMFVPSINGISH

SEQ ID NO: 2048180 - protein, 18 aa, Staphylococcus
YVPYSNFKVGAYLKTKDG

SEQ ID NO: 2048181 - protein, 21 aa, Staphylococcus
YVQELFPDFNHLYLVVDAENK

SEQ ID NO: 2048182 - protein, 19 aa, Staphylococcus
YVQRPSASKIQHFQEVANQ

SEQ ID NO: 2048183 - protein, 20 aa, Staphylococcus
YVQRPTIDAIQHFQEVGQGN

SEQ ID NO: 2048184 - protein, 25 aa, Staphylococcus
YVQTGRAYFKLTIHGQGGHGSSPHA

SEQ ID NO: 2048185 - protein, 17 aa, Staphylococcus
YVRDYALEQNAKPIELD

SEQ ID NO: 2048186 - protein, 27 aa, Staphylococcus
YVREQLKDFPICVEFRHQSWFNDQFKE

SEQ ID NO: 2048187 - protein, 24 aa, Staphylococcus
YVRGGCSPIGMKHLFPTTIDVSAK

SEQ ID NO: 2048188 - protein, 25 aa, Staphylococcus
YVSGAGLSFLRHWVEDGNRIPKEDL

SEQ ID NO: 2048189 - protein, 25 aa, Staphylococcus
YVSGGKRPLVCFFSNELNIHRTKTE

SEQ ID NO: 2048190 - protein, 24 aa, Staphylococcus
YVSGGKRPLVCYFSNNLNIHRTKT

SEQ ID NO: 2048191 - protein, 24 aa, Staphylococcus
YVSGGKRSLVCFFSNDLNIHRTKT

SEQ ID NO: 2048192 - protein, 18 aa, Staphylococcus
YVSKWKKNHIYRELMKEY

SEQ ID NO: 2048193 - protein, 24 aa, Staphylococcus
YVSKYYKGCLEFQENQPLSSFMIE

SEQ ID NO: 2048194 - protein, 19 aa, Staphylococcus
YVSLCGRDTVQYENPNISQ

SEQ ID NO: 2048195 - protein, 33 aa, Staphylococcus; identical to SEQ ID NO: 1815320

SEQ ID NO: 2048196 - protein, 30 aa, Staphylococcus
YVSRSHPGLLKRLFEQEVPEIYDGTVVIKS

SEQ ID NO: 2048197 - protein, 24 aa, Staphylococcus
YVSRTALIEKCWESENFIDDNTLA

SEQ ID NO: 2048198 - protein, 17 aa, Staphylococcus
YVSRYKWNAHITSNIQW

SEQ ID NO: 2048199 - protein, 17 aa, Staphylococcus
YVSYAIKGNLMYENTYP

SEQ ID NO: 2048200 - protein, 22 aa, Staphylococcus
YVTEFPLTIMVNGEEFATIICS

SEQ ID NO: 2048201 - protein, 17 aa, Staphylococcus
YVTFAWDSVKYVEREGF

SEQ ID NO: 2048202 - protein, 23 aa, Staphylococcus
YVVEHVKRILSGINHAKIAVFGL

SEQ ID NO: 2048203 - protein, 19 aa, Staphylococcus
YVVIYTMNHPETWESQLNI

SEQ ID NO: 2048204 - protein, 19 aa, Staphylococcus
YVVLYTFNQPKNWKSDANI

SEQ ID NO: 2048205 - protein, 19 aa, Staphylococcus
YVVTWALGHLVTNAQPEHY

SEQ ID NO: 2048206 - protein, 19 aa, Staphylococcus
YVYLEKMLNLSFSPTENIN

SEQ ID NO: 2048207 - protein, 25 aa, Staphylococcus
YVYPPKGQFASIIGMNKDKIFMCGT

SEQ ID NO: 2048208 - protein, 19 aa, Staphylococcus
YWAEQWAKAYVKFATYEKE

SEQ ID NO: 2048209 - protein, 24 aa, Staphylococcus
YWDSEARGAIFGLSRGTEKEHFIR

SEQ ID NO: 2048210 - protein, 17 aa, Staphylococcus
YWFDDLSKVDSWKVRLR

SEQ ID NO: 2048211 - protein, 18 aa, Staphylococcus
YWFNYTSKDLVTFEPNGP

SEQ ID NO: 2048212 - protein, 17 aa, Staphylococcus
YWGKADESYIIPMNNSL

SEQ ID NO: 2048213 - protein, 21 aa, Staphylococcus
YWGKRGAKRALLARELNLDEI

SEQ ID NO: 2048214 - protein, 35 aa, Staphylococcus
YWIHERTKFGIKPGVKRMEWMLAQFNNPQHNIRGI

SEQ ID NO: 2048215 - protein, 24 aa, Staphylococcus
YWISNARLPLYLNKKENQVYIQTW

SEQ ID NO: 2048216 - protein, 23 aa, Staphylococcus
YWKARQVPLPQIRIPLFTCASWS

SEQ ID NO: 2048217 - protein, 21 aa, Staphylococcus
YWKRTSSQIIARVKEDGSVEK

SEQ ID NO: 2048218 - protein, 19 aa, Staphylococcus
YWLTHSFIRREFLETTHLE

SEQ ID NO: 2048219 - protein, 18 aa, Staphylococcus
YWQKLFERYDHWINNFNA

SEQ ID NO: 2048220 - protein, 21 aa, Staphylococcus
YWRDIAFGVGEGERNQTLASL

SEQ ID NO: 2048221 - protein, 18 aa, Staphylococcus
YWSLSSLFNSGAVHINKI

SEQ ID NO: 2048222 - protein, 25 aa, Staphylococcus
YWYEHSLDLFLKHFGEDIKIKDITR

SEQ ID NO: 2048223 - protein, 17 aa, Staphylococcus
YYADTGISFVVGEADNP

SEQ ID NO: 2048224 - protein, 18 aa, Staphylococcus
YYAFHEFNSDLEIEELAL

SEQ ID NO: 2048225 - protein, 24 aa, Staphylococcus
YYAKELPSAFIFAGAEPEEGDVYP

SEQ ID NO: 2048226 - protein, 18 aa, Staphylococcus
YYALLDFSKCNSLKNIIV

SEQ ID NO: 2048227 - protein, 18 aa, Staphylococcus
YYAMGVTLAAGYSLNWLK

SEQ ID NO: 2048228 - protein, 17 aa, Staphylococcus
YYATRLQPAAVIVGKPL

SEQ ID NO: 2048229 - protein, 34 aa, Staphylococcus
YYAVKILNEMNVDWKKRIHIIIGTDEESDWKCTE

SEQ ID NO: 2048230 - protein, 23 aa, Staphylococcus
YYCNNCKITKGMKPHHITETETL

SEQ ID NO: 2048231 - protein, 32 aa, Staphylococcus
YYCPHCRTKVILKNGAKVIAHFAHMDPCKIWR

SEQ ID NO: 2048232 - protein, 20 aa, Staphylococcus
YYCQIDFLLEFTFNTTRAAA

SEQ ID NO: 2048233 - protein, 18 aa, Staphylococcus
YYEEKGLINISRNQNNYR

SEQ ID NO: 2048234 - protein, 21 aa, Staphylococcus
YYEKCGGCQLQHMSYESQLKM

SEQ ID NO: 2048235 - protein, 19 aa, Staphylococcus
YYEKHGLLMNIERNTHNQR

SEQ ID NO: 2048236 - protein, 20 aa, Staphylococcus
YYELHTSNIGKWRYKVDNGE

SEQ ID NO: 2048237 - protein, 18 aa, Staphylococcus
YYEPRVEDFELCCLEIDY

SEQ ID NO: 2048238 - protein, 21 aa, Staphylococcus
YYEVFPFGAQRIVLKEDYQWM

SEQ ID NO: 2048239 - protein, 17 aa, Staphylococcus
YYFDINIKNITQKGNAR

SEQ ID NO: 2048240 - protein, 17 aa, Staphylococcus
YYFDINIKNVTQKGNAR

SEQ ID NO: 2048241 - protein, 23 aa, Staphylococcus
YYFDQRIKECINFIQRNYTYKIK

SEQ ID NO: 2048242 - protein, 19 aa, Staphylococcus
YYFKILISSVNEFKFTKEV

SEQ ID NO: 2048243 - protein, 18 aa, Staphylococcus
YYGDISIPLISRGHGYDV

SEQ ID NO: 2048244 - protein, 24 aa, Staphylococcus
YYGGEIIHGPKPVHGHTTPIIHTG

SEQ ID NO: 2048245 - protein, 17 aa, Staphylococcus
YYGGKVIQGEKVMHGKV

SEQ ID NO: 2048246 - protein, 18 aa, Staphylococcus
YYGGKVVQGETVLHGKID

SEQ ID NO: 2048247 - protein, 18 aa, Staphylococcus
YYGGRVIQSDTVMHGKVD

SEQ ID NO: 2048248 - protein, 17 aa, Staphylococcus
YYHLPKKVYEAIEALKF

SEQ ID NO: 2048249 - protein, 23 aa, Staphylococcus
YYHLPRKVYEAIHEMSYEDIKRM

SEQ ID NO: 2048250 - protein, 19 aa, Staphylococcus
YYHQPKFIEYWTNKINETL

SEQ ID NO: 2048251 - protein, 18 aa, Staphylococcus
YYIESSLQLTLPYERNSL

SEQ ID NO: 2048252 - protein, 24 aa, Staphylococcus
YYIICAAGARSAKVVEYLEDKGIH

SEQ ID NO: 2048253 - protein, 22 aa, Staphylococcus
YYIKGFEMLPQMKAVDIRIEYD

SEQ ID NO: 2048254 - protein, 22 aa, Staphylococcus
YYIKGFEMLPQMKAVDLRIEYD

SEQ ID NO: 2048255 - protein, 17 aa, Staphylococcus
YYIKRSDFEDMRQKHNL

SEQ ID NO: 2048256 - protein, 21 aa, Staphylococcus
YYISVLCAGTSDLPVSEEAAI

SEQ ID NO: 2048257 - protein, 20 aa, Staphylococcus
YYIVCAAGVRSEKVANYLEN

SEQ ID NO: 2048258 - protein, 19 aa, Staphylococcus
YYKDYGIRKYGFHGTSHKY

SEQ ID NO: 2048259 - protein, 20 aa, Staphylococcus
YYKKEFPQLKVTASHIPWAT

SEQ ID NO: 2048260 - protein, 19 aa, Staphylococcus
YYKMHQFEADYLKVAVMPN

SEQ ID NO: 2048261 - protein, 22 aa, Staphylococcus
YYKNVHVYDVTWGEAVDVNDFI

SEQ ID NO: 2048262 - protein, 25 aa, Staphylococcus
YYLKEIPGTFYIVGCKPEQVTSPYM

SEQ ID NO: 2048263 - protein, 17 aa, Staphylococcus
YYLKTKKLLSYRKKVQQ

SEQ ID NO: 2048264 - protein, 20 aa, Staphylococcus
YYLPIREWNGVAPPNQGLGD

SEQ ID NO: 2048265 - protein, 18 aa, Staphylococcus
YYLQRKFPEKSIYAVGQP

SEQ ID NO: 2048266 - protein, 34 aa, Staphylococcus
YYLRPFVQTKIKGWVRQLLWMSIYQYVYLDKVPN

SEQ ID NO: 2048267 - protein, 25 aa, Staphylococcus
YYNEQKERIELFMKYNVKGYRTIHF

SEQ ID NO: 2048268 - protein, 19 aa, Staphylococcus
YYNVRIEDFSAKKRTKSIA

SEQ ID NO: 2048269 - protein, 18 aa, Staphylococcus
YYNVRLEDFAAKKRTKSI

SEQ ID NO: 2048270 - protein, 32 aa, Staphylococcus
YYPFELSGGMAQRVAFILSLIRNPQCLILDEP

SEQ ID NO: 2048271 - protein, 24 aa, Staphylococcus
YYPGNWRELRLPGILSSKKQEKRS

SEQ ID NO: 2048272 - protein, 17 aa, Staphylococcus
YYQCKILSQKGYSAQQI

SEQ ID NO: 2048273 - protein, 17 aa, Staphylococcus
YYQESFGYIAQQLNFPE

SEQ ID NO: 2048274 - protein, 20 aa, Staphylococcus
YYQNVHVFNVAWGEAVNIDA

SEQ ID NO: 2048275 - protein, 18 aa, Staphylococcus
YYREGFITHLMPKNDKSY

SEQ ID NO: 2048276 - protein, 17 aa, Staphylococcus
YYRHTALKMTKREIFDW

SEQ ID NO: 2048277 - protein, 35 aa, Staphylococcus
YYRMLQRPIIYTGLTRAKQSLVFLGDSQAFDIGMQ

SEQ ID NO: 2048278 - protein, 22 aa, Staphylococcus
YYRNEPSWIASYKMNETLISQN

SEQ ID NO: 2048279 - protein, 19 aa, Staphylococcus
YYRYLSQRIGAIIETTLGA

SEQ ID NO: 2048280 - protein, 19 aa, Staphylococcus
YYRYLSQRIGAIVETTLTA

SEQ ID NO: 2048281 - protein, 20 aa, Staphylococcus
YYRYLSRRIGAIVETTLNAL

SEQ ID NO: 2048282 - protein, 18 aa, Staphylococcus
YYSARIVHDVTIAPSPVW

SEQ ID NO: 2048283 - protein, 24 aa, Staphylococcus
YYSFREIVKKMQLKEYRFYPAGKG

SEQ ID NO: 2048284 - protein, 17 aa, Staphylococcus
YYSKSFNLSSFEKDKLN

SEQ ID NO: 2048285 - protein, 19 aa, Staphylococcus
YYTHSYVFISWTGKMTETF

SEQ ID NO: 2048286 - protein, 17 aa, Staphylococcus
YYTQRLANKYNILGTVQ

SEQ ID NO: 2048287 - protein, 20 aa, Staphylococcus
YYVEELRPLTGLDDLVYNYV

SEQ ID NO: 2048288 - protein, 19 aa, Staphylococcus
YYWVSTYVMKGIWRNELLY

SEQ ID NO: 2048289 - protein, 23 aa, Staphylococcus
FNYHKVHLFKEWKTEKGIINYLL

SEQ ID NO: 2048290 - protein, 21 aa, Staphylococcus
SQRKIDVEPVFGFMKAILGFT

SEQ ID NO: 2048291 - protein, 26 aa, Staphylococcus
LEAFNYRKVHLFKEWKTEKGIVNYLL

SEQ ID NO: 2048292 - protein, 17 aa, Staphylococcus
APIGRPSPMSPWGKPTL

SEQ ID NO: 2048293 - protein, 25 aa, Staphylococcus
ENHACPICGFSIGELEPRMFSFNSP

SEQ ID NO: 2048294 - protein, 17 aa, Staphylococcus
ENPRFVEDLIRLIAADL

SEQ ID NO: 2048295 - protein, 17 aa, Staphylococcus
GDTIVVWRLDRLGRNME

SEQ ID NO: 2048296 - protein, 26 aa, Staphylococcus
GHIELAAPVSHIWYFKGIPSRMGLLL

SEQ ID NO: 2048297 - protein, 19 aa, Staphylococcus
IPEHLVWRQPFPGPGLGIR

SEQ ID NO: 2048298 - protein, 24 aa, Staphylococcus
KMGRYGKFMACSNFPDCRNTKAIV

SEQ ID NO: 2048299 - protein, 24 aa, Staphylococcus
NALSWSSAGALGFKGSKKSTPFAA

SEQ ID NO: 2048300 - protein, 18 aa, Staphylococcus
PSVQIGDPFVGKKLMEAT

SEQ ID NO: 2048301 - protein, 20 aa, Staphylococcus
RKPYSVILFDEIEKAHPDVF

SEQ ID NO: 2048302 - protein, 20 aa, Staphylococcus
RTIRIPVHMVETINKLIRVQ

SEQ ID NO: 2048303 - protein, 21 aa, Staphylococcus
SEPKALIGFAGRRVIEQTINE

SEQ ID NO: 2048304 - protein, 19 aa, Staphylococcus
YDIIFFWVARMIFQGLEFT

SEQ ID NO: 2048305 - protein, 18 aa, Staphylococcus
CINSILMSLLYKNHPEEL

SEQ ID NO: 2048306 - protein, 21 aa, Staphylococcus
CPEFTSLCPITGQPDFATIYI

SEQ ID NO: 2048307 - protein, 23 aa, Staphylococcus
EDPRFTDRFELFIVGREHANAFT

SEQ ID NO: 2048308 - protein, 20 aa, Staphylococcus
EIRRFLPRKVRTFQLQEAQR

SEQ ID NO: 2048309 - protein, 17 aa, Staphylococcus
ELACAMSGYQLGVNPFN

SEQ ID NO: 2048310 - protein, 19 aa, Staphylococcus
ETLEIYAPLAHRLGINTIK

SEQ ID NO: 2048311 - protein, 22 aa, Staphylococcus
FFPENRVEYFVSYYDYYQPEAY

SEQ ID NO: 2048312 - protein, 17 aa, Staphylococcus
FGEMEVWALEAYGAAYT

SEQ ID NO: 2048313 - protein, 21 aa, Staphylococcus
FKAFLEHALKLGADYVATGHY

SEQ ID NO: 2048314 - protein, 23 aa, Staphylococcus
KELPMEYAVEMNRLIKFEMEGSI

SEQ ID NO: 2048315 - protein, 18 aa, Staphylococcus
KHWLPVDLYIGGVEHAVL

SEQ ID NO: 2048316 - protein, 18 aa, Staphylococcus
LKYIKSLYTELGKITDIV

SEQ ID NO: 2048317 - protein, 18 aa, Staphylococcus
LRFANAMFEPLWNNKYIS

SEQ ID NO: 2048318 - protein, 17 aa, Staphylococcus
NANRYTFVWKKSIQNHE

SEQ ID NO: 2048319 - protein, 24 aa, Staphylococcus
NHPEELRLLLIDPKMVELAPYNDL

SEQ ID NO: 2048320 - protein, 17 aa, Staphylococcus
NRYTFVWKKSIQNHESK

SEQ ID NO: 2048321 - protein, 18 aa, Staphylococcus
PDVLRFFMISVHYRSPIN

SEQ ID NO: 2048322 - protein, 23 aa, Staphylococcus
PQLFKQLLMISGFDKYYQIVKCF

SEQ ID NO: 2048323 - protein, 17 aa, Staphylococcus
PSVREIGEAVGLASSST

SEQ ID NO: 2048324 - protein, 18 aa, Staphylococcus
QHRLYKLIWERFVASQMA

SEQ ID NO: 2048325 - protein, 23 aa, Staphylococcus
RNGPTGTVKLHFMKQYNKFTDID

SEQ ID NO: 2048326 - protein, 23 aa, Staphylococcus
RSYNCLKRAGINSVQELADKSEA

SEQ ID NO: 2048327 - protein, 26 aa, Staphylococcus
TLKLFKVCKMRGIPIFTFINKLDRVG

SEQ ID NO: 2048328 - protein, 17 aa, Staphylococcus
WDGPTMISFCNGDKIGA

SEQ ID NO: 2048329 - protein, 17 aa, Staphylococcus
WREGCIIRAQFLQKIKD

SEQ ID NO: 2048330 - protein, 19 aa, Staphylococcus
YARHGGGCFSGKDPTKVDR

SEQ ID NO: 2048331 - protein, 17 aa, Staphylococcus
YECDDCSECPLKNQCMN

SEQ ID NO: 2048332 - protein, 19 aa, Staphylococcus
ALYNFIWDEFCDWYIEMSK

SEQ ID NO: 2048333 - protein, 21 aa, Staphylococcus
ANLRLVVSIAKRYVGRGMLFL

SEQ ID NO: 2048334 - protein, 20 aa, Staphylococcus
CGDIAVSVYSGWLAYSTFDH

SEQ ID NO: 2048335 - protein, 17 aa, Staphylococcus
CGIPEKFYTDHGSDFTS

SEQ ID NO: 2048336 - protein, 22 aa, Staphylococcus
DACIKYQYIGICYGQPGVGKTL

SEQ ID NO: 2048337 - protein, 18 aa, Staphylococcus
DERAKAGLFLAMQYPSEI

SEQ ID NO: 2048338 - protein, 23 aa, Staphylococcus
DGDTRGGAALSIRSVTQKPIKFV

SEQ ID NO: 2048339 - protein, 19 aa, Staphylococcus
EALHKLGFDDGMYDLIKEP

SEQ ID NO: 2048340 - protein, 17 aa, Staphylococcus
EGIAAKVLESFNITEDK

SEQ ID NO: 2048341 - protein, 18 aa, Staphylococcus
EHMIRAALEGVLYNLYTV

SEQ ID NO: 2048342 - protein, 20 aa, Staphylococcus
EMTVELIAPIAIEDGTRFSI

SEQ ID NO: 2048343 - protein, 20 aa, Staphylococcus
EPIIPFIIGDGIGPDIWKAA

SEQ ID NO: 2048344 - protein, 19 aa, Staphylococcus
EYGATCGFFPVDEESLKYM

SEQ ID NO: 2048345 - protein, 19 aa, Staphylococcus
FAKFFKLMLNQGINLAPSK

SEQ ID NO: 2048346 - protein, 18 aa, Staphylococcus
GDCTICVDRCPTGALVGN

SEQ ID NO: 2048347 - protein, 21 aa, Staphylococcus
GEPKLGFKEMEEIGASTGLPL

SEQ ID NO: 2048348 - protein, 18 aa, Staphylococcus
GNVLRFQPPLVITYEQLD

SEQ ID NO: 2048349 - protein, 19 aa, Staphylococcus
IAPALATGCSLVMKPSEIT

SEQ ID NO: 2048350 - protein, 19 aa, Staphylococcus
IKFLFELQDGYTIETVLMR

SEQ ID NO: 2048351 - protein, 24 aa, Staphylococcus
INAFKGVSFGEGFKAAEKPGSEIQ

SEQ ID NO: 2048352 - protein, 20 aa, Staphylococcus
IPRTLAISVFGEMDVSSIKQ

SEQ ID NO: 2048353 - protein, 17 aa, Staphylococcus
IRLEPMSTFPVIRDLQV

SEQ ID NO: 2048354 - protein, 26 aa, Staphylococcus
IRTLLLTFFYRFMRPLIEAGYVYIAQ

SEQ ID NO: 2048355 - protein, 20 aa, Staphylococcus
KELRDTLHFEMLWDTSKIDV

SEQ ID NO: 2048356 - protein, 17 aa, Staphylococcus
KKLPFGIGQIGKSFRNE

SEQ ID NO: 2048357 - protein, 22 aa, Staphylococcus
KLSRYPQLYSRIGFAHEFDNLS

SEQ ID NO: 2048358 - protein, 24 aa, Staphylococcus
LEDRLRSRFEWGLIVDITPPDYET

SEQ ID NO: 2048359 - protein, 17 aa, Staphylococcus
LRKPDWLKIKLNTNENY

SEQ ID NO: 2048360 - protein, 17 aa, Staphylococcus
MDHRHLWLRSKKQHAVM

SEQ ID NO: 2048361 - protein, 18 aa, Staphylococcus
MISRSEFYTAYTPYQPEI

SEQ ID NO: 2048362 - protein, 19 aa, Staphylococcus
NIEVLRFANAMFEPLWNNK

SEQ ID NO: 2048363 - protein, 26 aa, Staphylococcus
NNVKPNWCPGCGDFSVQAAIQKAAAN

SEQ ID NO: 2048364 - protein, 17 aa, Staphylococcus
NQAPFSFDLSVMAIYPC

SEQ ID NO: 2048365 - protein, 17 aa, Staphylococcus
NVGVPALVVFLNKVDMV

SEQ ID NO: 2048366 - protein, 18 aa, Staphylococcus
PIGSFLFLGPTGVGKTEL

SEQ ID NO: 2048367 - protein, 21 aa, Staphylococcus
PRVRFTTSHPWDFTDRMIEVI

SEQ ID NO: 2048368 - protein, 18 aa, Staphylococcus
RATPQWFASINKVRQDIL

SEQ ID NO: 2048369 - protein, 24 aa, Staphylococcus
RMQGYNVLHPMGWDAFGLPAEQYA

SEQ ID NO: 2048370 - protein, 18 aa, Staphylococcus
SVVLLDFGKKQNIVRELN

SEQ ID NO: 2048371 - protein, 19 aa, Staphylococcus
TMPQTRFVLKKALEQNLKP

SEQ ID NO: 2048372 - protein, 18 aa, Staphylococcus
VATFTLAVNRTFTNAQGE

SEQ ID NO: 2048373 - protein, 18 aa, Staphylococcus
VELTLPLVVRLEGTNVER

SEQ ID NO: 2048374 - protein, 19 aa, Staphylococcus
VEVAFRLGIDTRKNDQQIR

SEQ ID NO: 2048375 - protein, 17 aa, Staphylococcus
VNFGIVYGISDYGLSQS

SEQ ID NO: 2048376 - protein, 18 aa, Staphylococcus
YGAVPIDFAYAIHSEVGN

SEQ ID NO: 2048377 - protein, 22 aa, Staphylococcus
YMRIAIELHLKRLIVGGLEKVY

SEQ ID NO: 2048378 - protein, 19 aa, Staphylococcus
AKRIIDFLSGTVYAIGGDI

SEQ ID NO: 2048379 - protein, 19 aa, Staphylococcus
ALLRASAYGKLNIMFPMVA

SEQ ID NO: 2048380 - protein, 19 aa, Staphylococcus
ANLLRICARYDNLDIIEDA

SEQ ID NO: 2048381 - protein, 20 aa, Staphylococcus
ARRGELVSCFLLEVDDSLNS

SEQ ID NO: 2048382 - protein, 23 aa, Staphylococcus
AVAEMKLAVGLLVDKKLSHMRIH

SEQ ID NO: 2048383 - protein, 19 aa, Staphylococcus
CDKFCTYCIVPFTRGKERS

SEQ ID NO: 2048384 - protein, 17 aa, Staphylococcus
DTLRLEAGLPLHGQDLT

SEQ ID NO: 2048385 - protein, 19 aa, Staphylococcus
EALFNFITLLGWSPEGEEE

SEQ ID NO: 2048386 - protein, 19 aa, Staphylococcus
EDWNRFTIAVGKLSRTKIF

SEQ ID NO: 2048387 - protein, 19 aa, Staphylococcus
EFTELGSGFKIAMRDLNIR

SEQ ID NO: 2048388 - protein, 19 aa, Staphylococcus
EGCMPFEVMAERGRKTLLF

SEQ ID NO: 2048389 - protein, 18 aa, Staphylococcus
EPKLSLPTARSIIAIAVG

SEQ ID NO: 2048390 - protein, 20 aa, Staphylococcus
ETDRTGLRIAIELKKDVNSE

SEQ ID NO: 2048391 - protein, 18 aa, Staphylococcus
FGRIGRLAFRRIQDVEGI

SEQ ID NO: 2048392 - protein, 18 aa, Staphylococcus
FIIGDGIGPDIWKAASRV

SEQ ID NO: 2048393 - protein, 19 aa, Staphylococcus
FNIARKMGYFDIPKDLLIP

SEQ ID NO: 2048394 - protein, 19 aa, Staphylococcus
FPTAGLILGKSGIRRAYET

SEQ ID NO: 2048395 - protein, 27 aa, Staphylococcus
FRDEKRPRFGLLRGREFIMKDAYSFHA

SEQ ID NO: 2048396 - protein, 20 aa, Staphylococcus
GASWRKLNIPGEDRLINKGV

SEQ ID NO: 2048397 - protein, 18 aa, Staphylococcus
GIKKRGKKAVAITYTGDG

SEQ ID NO: 2048398 - protein, 23 aa, Staphylococcus
GKSNITDAIKWVLGEQSAKSLRG

SEQ ID NO: 2048399 - protein, 18 aa, Staphylococcus
HHTFFEMLGNFSIGDYFK

SEQ ID NO: 2048400 - protein, 19 aa, Staphylococcus
HPGLLKRLFEQEVPEIYDG

SEQ ID NO: 2048401 - protein, 18 aa, Staphylococcus
IGLLKIDFLGLRNLSIIH

SEQ ID NO: 2048402 - protein, 17 aa, Staphylococcus
IPMIPHRLSNGICSLNP

SEQ ID NO: 2048403 - protein, 17 aa, Staphylococcus
IQKEYYVGFVIDRATDR

SEQ ID NO: 2048404 - protein, 17 aa, Staphylococcus
ISDLMGWTAQGLDTLRI

SEQ ID NO: 2048405 - protein, 19 aa, Staphylococcus
KGLEFPIVFIMGMEESLFP

SEQ ID NO: 2048406 - protein, 22 aa, Staphylococcus
KVKMYVCGPTVYNYIHIGNARP

SEQ ID NO: 2048407 - protein, 17 aa, Staphylococcus
LEIAEAFVRSGAVDIVV

SEQ ID NO: 2048408 - protein, 19 aa, Staphylococcus
LLLTFFFKYMKPLVQAGRV

SEQ ID NO: 2048409 - protein, 17 aa, Staphylococcus
LLSKIAITFSEEENVDR

SEQ ID NO: 2048410 - protein, 20 aa, Staphylococcus
LTGGCPMGPYIVTKDELPTP

SEQ ID NO: 2048411 - protein, 24 aa, Staphylococcus
PGYEAPCYIAWSGKNRSPLVRVPS

SEQ ID NO: 2048412 - protein, 17 aa, Staphylococcus
QNKRPDYISAFWNVVNW

SEQ ID NO: 2048413 - protein, 20 aa, Staphylococcus
RALEEVIYFASYVVVDPGPT

SEQ ID NO: 2048414 - protein, 19 aa, Staphylococcus
REHFAIFPASHFVTREEKM

SEQ ID NO: 2048415 - protein, 18 aa, Staphylococcus
REWGDYGIEEFLEVKSIA

SEQ ID NO: 2048416 - protein, 19 aa, Staphylococcus
RKGLRTGIVADRIGGQVND

SEQ ID NO: 2048417 - protein, 19 aa, Staphylococcus
RKLSERRIFPAIDIGRSST

SEQ ID NO: 2048418 - protein, 18 aa, Staphylococcus
RKVAIALRNRYRRSLLDE

SEQ ID NO: 2048419 - protein, 20 aa, Staphylococcus
RMLQRPILYTGLTRAKQSLV

SEQ ID NO: 2048420 - protein, 20 aa, Staphylococcus
RPVMEEWLFNTVAFIGGPSE

SEQ ID NO: 2048421 - protein, 18 aa, Staphylococcus
SFSLEMWGGATFDVAYNF

SEQ ID NO: 2048422 - protein, 20 aa, Staphylococcus
SGPAALRCSQFVYKEQKNQK

SEQ ID NO: 2048423 - protein, 19 aa, Staphylococcus
SRIYAKFGKEIYVAAKSGE

SEQ ID NO: 2048424 - protein, 26 aa, Staphylococcus
TAMNRKGYYLYGYRHFSSRIKGGHTN

SEQ ID NO: 2048425 - protein, 24 aa, Staphylococcus
TTLGLRWLVNYARLRGEKTMEDRL

SEQ ID NO: 2048426 - protein, 19 aa, Staphylococcus
VAGRGELHLSILIENMRRE

SEQ ID NO: 2048427 - protein, 23 aa, Staphylococcus
VEFYPVLCGTAFKNKGVQLMLNA

SEQ ID NO: 2048428 - protein, 24 aa, Staphylococcus
VKDMYRRVNFLFGDIVKVTPSSKV

SEQ ID NO: 2048429 - protein, 21 aa, Staphylococcus
VRLSQDWKLRHVLIEMHGNNG

SEQ ID NO: 2048430 - protein, 19 aa, Staphylococcus
WGGATFDVAYNFLKENPWE

SEQ ID NO: 2048431 - protein, 24 aa, Staphylococcus
WNLKLGELAMIWREGCIIRAQFLQ

SEQ ID NO: 2048432 - protein, 21 aa, Staphylococcus
YASCFNGAFDLILKQNKVRDA

SEQ ID NO: 2048433 - protein, 23 aa, Staphylococcus
YDPRKYLGPAREAIKETVKGKIR

SEQ ID NO: 2048434 - protein, 18 aa, Staphylococcus
YIPYCIEPSLGADRVTLA

SEQ ID NO: 2048435 - protein, 19 aa, Staphylococcus
YQLSLAIGKRGQNARLAAK

SEQ ID NO: 2048436 - protein, 17 aa, Staphylococcus
YRSSGGFGVRLDAGDGF

SEQ ID NO: 2048437 - protein, 20 aa, Staphylococcus
ACLLTAVPVMKFFKYFYSNR

SEQ ID NO: 2048438 - protein, 24 aa, Staphylococcus
AESFKEALRWGAEIFHNLKSILSE

SEQ ID NO: 2048439 - protein, 24 aa, Staphylococcus
AFNYHKVHLFKEWKTEKGIINYLL

SEQ ID NO: 2048440 - protein, 20 aa, Staphylococcus
AGNITAYWKGFKEYHEKKGS

SEQ ID NO: 2048441 - protein, 23 aa, Staphylococcus
AGYKPGEDVFLGFDCASSEFYEN

SEQ ID NO: 2048442 - protein, 18 aa, Staphylococcus
AHTVVWNGPMGVFEFSNF

SEQ ID NO: 2048443 - protein, 27 aa, Staphylococcus
AIALLFAILKVRSAPFVILDEVEAALD

SEQ ID NO: 2048444 - protein, 24 aa, Staphylococcus
AIPYEHPLFLGMGGMHGSYASNMA

SEQ ID NO: 2048445 - protein, 24 aa, Staphylococcus
AKGRLPDCLVEWSAKRLKEQGANA

SEQ ID NO: 2048446 - protein, 18 aa, Staphylococcus
AKYRGEFEERLKAVLKEV

SEQ ID NO: 2048447 - protein, 22 aa, Staphylococcus
ANIPTRIAFMVSSSVDSRTILD

SEQ ID NO: 2048448 - protein, 17 aa, Staphylococcus
ARLQLALLMLQRDNVLI

SEQ ID NO: 2048449 - protein, 18 aa, Staphylococcus
ARRIQFFLSQNFHVAEQF

SEQ ID NO: 2048450 - protein, 20 aa, Staphylococcus
ASKFKNLCVVGDSDQSIYGW

SEQ ID NO: 2048451 - protein, 19 aa, Staphylococcus
ASPEFMFPSFYGIDVSTTA

SEQ ID NO: 2048452 - protein, 22 aa, Staphylococcus
ATAPLVVLGCIMMRVCHNDTCP

SEQ ID NO: 2048453 - protein, 18 aa, Staphylococcus
ATQSLKWAVEEMERRYKL

SEQ ID NO: 2048454 - protein, 18 aa, Staphylococcus
CDKFCTYCIVPFTRGKER

SEQ ID NO: 2048455 - protein, 17 aa, Staphylococcus
CFGCKKGGNVFQFTQEI

SEQ ID NO: 2048456 - protein, 21 aa, Staphylococcus
DFESLCFHVPFTKMGKKALDS

SEQ ID NO: 2048457 - protein, 19 aa, Staphylococcus
DGLKGGGYYVEYRTDDARL

SEQ ID NO: 2048458 - protein, 23 aa, Staphylococcus
DLFTCLRPVRWFKGVPSPVKRPQ

SEQ ID NO: 2048459 - protein, 18 aa, Staphylococcus
DPFTCPHGRPIIINFSNY

SEQ ID NO: 2048460 - protein, 24 aa, Staphylococcus
DVDMLRMCRYPWKTKQRILSDMGH

SEQ ID NO: 2048461 - protein, 24 aa, Staphylococcus
DVLALAEFERLVLVDSLNDVLVLV

SEQ ID NO: 2048462 - protein, 19 aa, Staphylococcus
EEAKSWMLKALEPMGEEYL

SEQ ID NO: 2048463 - protein, 18 aa, Staphylococcus
EFTELGSGFKIAMRDLNI

SEQ ID NO: 2048464 - protein, 17 aa, Staphylococcus
EGCIIRAQFLQKIKDAY

SEQ ID NO: 2048465 - protein, 20 aa, Staphylococcus
EIPHAIGVNVDRMIKEDEDR

SEQ ID NO: 2048466 - protein, 22 aa, Staphylococcus
EKIKELQDFIARFSANASKSKQ

SEQ ID NO: 2048467 - protein, 18 aa, Staphylococcus
ELECPVIALSQLSRGVEQ

SEQ ID NO: 2048468 - protein, 22 aa, Staphylococcus
EMKRLGLPVPDGFTITTEACIE

SEQ ID NO: 2048469 - protein, 25 aa, Staphylococcus
EWNLKLGDLAMIWREGCIIRAQFLQ

SEQ ID NO: 2048470 - protein, 22 aa, Staphylococcus
EWREPGCSMCLGMNPDQVPEGV

SEQ ID NO: 2048471 - protein, 20 aa, Staphylococcus
FAEACILAFNHTKKNKIVVS

SEQ ID NO: 2048472 - protein, 17 aa, Staphylococcus
FDGRGNYTLGIKEQLIF

SEQ ID NO: 2048473 - protein, 22 aa, Staphylococcus
FGAEVKRRIFLGTFALSSGYYD

SEQ ID NO: 2048474 - protein, 18 aa, Staphylococcus
FHKDVVIDLVGYRRYGHN

SEQ ID NO: 2048475 - protein, 18 aa, Staphylococcus
FLLSHGFVMDGEGKKMSK

SEQ ID NO: 2048476 - protein, 19 aa, Staphylococcus
FTRKLGFDGYSDFKSFLKF

SEQ ID NO: 2048477 - protein, 17 aa, Staphylococcus
GAQKEVIRLIPGLENVD

SEQ ID NO: 2048478 - protein, 17 aa, Staphylococcus
GELHLSILIENMRREGF

SEQ ID NO: 2048479 - protein, 20 aa, Staphylococcus
GFLALHGFLHLLGYDHMNEE

SEQ ID NO: 2048480 - protein, 17 aa, Staphylococcus
GFPEARIPLSQAVIELC

SEQ ID NO: 2048481 - protein, 18 aa, Staphylococcus
GHISTSLIQRHFQIGYNR

SEQ ID NO: 2048482 - protein, 20 aa, Staphylococcus
GKLGVKVWIYRGEVLPTKNT

SEQ ID NO: 2048483 - protein, 22 aa, Staphylococcus
GKRFALPNAEVMIHQPLGGAQG

SEQ ID NO: 2048484 - protein, 23 aa, Staphylococcus
GKVARLTNFGAFVDIGGVDGLVH

SEQ ID NO: 2048485 - protein, 17 aa, Staphylococcus
GSSREHAAWALKDYGFN

SEQ ID NO: 2048486 - protein, 22 aa, Staphylococcus
GVIGLKVHEDWGATPSALSHAL

SEQ ID NO: 2048487 - protein, 17 aa, Staphylococcus
GVYRFKRGFNVQIEELI

SEQ ID NO: 2048488 - protein, 21 aa, Staphylococcus
HAQMKMFLTRLGFGSKMVVTG

SEQ ID NO: 2048489 - protein, 17 aa, Staphylococcus
IAEAFVRSGAVDIVVVD

SEQ ID NO: 2048490 - protein, 17 aa, Staphylococcus
IAISDLMGWTAQGLDTL

SEQ ID NO: 2048491 - protein, 22 aa, Staphylococcus
IEPLKDLRVMGKFGDSVTTDHI

SEQ ID NO: 2048492 - protein, 21 aa, Staphylococcus
IKEAAMLAGYFSKAGNSGQIP

SEQ ID NO: 2048493 - protein, 19 aa, Staphylococcus
IKYMFPKAHAAAYVLMAVR

SEQ ID NO: 2048494 - protein, 19 aa, Staphylococcus
IPAKARRKGGHPAKRVFQA

SEQ ID NO: 2048495 - protein, 25 aa, Staphylococcus
IVEKSLRGAAIWDELKDRLHTNAYG

SEQ ID NO: 2048496 - protein, 24 aa, Staphylococcus
KAAARFGSGWAWLVVNNGQLEIVT

SEQ ID NO: 2048497 - protein, 19 aa, Staphylococcus
KARACGIHMLVATQRPSVN

SEQ ID NO: 2048498 - protein, 23 aa, Staphylococcus
KATDLRAAAALILAGLVADGTTQ

SEQ ID NO: 2048499 - protein, 20 aa, Staphylococcus
KCATLAWKALEKGTVEKEGK

SEQ ID NO: 2048500 - protein, 24 aa, Staphylococcus
KDPKRPIGSFIFLGPTGVGKTELA

SEQ ID NO: 2048501 - protein, 22 aa, Staphylococcus
KGVAFCPHCDGPLFENKDVAVI

SEQ ID NO: 2048502 - protein, 23 aa, Staphylococcus
KHFDLRPAGIIKMLDLKHPIYKQ

SEQ ID NO: 2048503 - protein, 20 aa, Staphylococcus
KKGPFAPDFIKVWKERYKKI

SEQ ID NO: 2048504 - protein, 18 aa, Staphylococcus
KLGTVWINDFHPYFAQAP

SEQ ID NO: 2048505 - protein, 21 aa, Staphylococcus
KRPDYISAFWNVVNWEKVDEL

SEQ ID NO: 2048506 - protein, 23 aa, Staphylococcus
LAVSRTSFDWGVRVPSNPKHVVY

SEQ ID NO: 2048507 - protein, 19 aa, Staphylococcus
LDSCRKIKYMFPKAHAAAY

SEQ ID NO: 2048508 - protein, 17 aa, Staphylococcus
LKALKLFYKMPMPQWGG

SEQ ID NO: 2048509 - protein, 25 aa, Staphylococcus
LKDPKRPIGSFIFLGPTGVGKTELA

SEQ ID NO: 2048510 - protein, 21 aa, Staphylococcus
LKIKYMFPKAHAAAYVLMAVR

SEQ ID NO: 2048511 - protein, 21 aa, Staphylococcus
LKREDLQWVRSFKLRGAYNAI

SEQ ID NO: 2048512 - protein, 17 aa, Staphylococcus
LKVLKARLYDMKLQEEQ

SEQ ID NO: 2048513 - protein, 17 aa, Staphylococcus
LLSHGFVMDGEGKKMSK

SEQ ID NO: 2048514 - protein, 21 aa, Staphylococcus
LPESFYRGAHQHIFRAMMNLN

SEQ ID NO: 2048515 - protein, 20 aa, Staphylococcus
LPYRRVILCTGDIGFSASKT

SEQ ID NO: 2048516 - protein, 21 aa, Staphylococcus
LRTLLDFRYQRHFKAKKGENG

SEQ ID NO: 2048517 - protein, 17 aa, Staphylococcus
LTLSGVFSRAGASYDDI

SEQ ID NO: 2048518 - protein, 23 aa, Staphylococcus
MILGAVCTRACRFCAVKTGLPNE

SEQ ID NO: 2048519 - protein, 17 aa, Staphylococcus
MKLYRSFREEVPEEEYT

SEQ ID NO: 2048520 - protein, 18 aa, Staphylococcus
MRYMFGGKAKIPLVVRTV

SEQ ID NO: 2048521 - protein, 22 aa, Staphylococcus
NKAEKCTFCFPRIEAGMPTVCS

SEQ ID NO: 2048522 - protein, 19 aa, Staphylococcus
NMSGFRVGFAVGNKDMIQA

SEQ ID NO: 2048523 - protein, 19 aa, Staphylococcus
NPVELRRSIGYVIQQIGLM

SEQ ID NO: 2048524 - protein, 18 aa, Staphylococcus
NYTLGIKEQLIFPEIDYD

SEQ ID NO: 2048525 - protein, 19 aa, Staphylococcus
PGDEVLVAFDLYGGTFRLF

SEQ ID NO: 2048526 - protein, 20 aa, Staphylococcus
PILLASWKLGPALAAGNTVV

SEQ ID NO: 2048527 - protein, 20 aa, Staphylococcus
PLTEAFLFSRGHFKGNQFPE

SEQ ID NO: 2048528 - protein, 20 aa, Staphylococcus
QAPYKFLLSHGFVMDGEGKK

SEQ ID NO: 2048529 - protein, 17 aa, Staphylococcus
QQRVCIARCLAIEPDVI

SEQ ID NO: 2048530 - protein, 18 aa, Staphylococcus
QTHLKWGAQKEVIRLIPG

SEQ ID NO: 2048531 - protein, 17 aa, Staphylococcus
RDLRFIEDFSIKISDVM

SEQ ID NO: 2048532 - protein, 17 aa, Staphylococcus
RELGFLALHGFLHLLGY

SEQ ID NO: 2048533 - protein, 21 aa, Staphylococcus
RELQSRLGITFIFVTHDQEEA

SEQ ID NO: 2048534 - protein, 21 aa, Staphylococcus
RIAPRKVRLVLDLIRGKNAGE

SEQ ID NO: 2048535 - protein, 18 aa, Staphylococcus
RIGCTFCASTLGGLKRNL

SEQ ID NO: 2048536 - protein, 17 aa, Staphylococcus
RPELSFPADLYFEGSDQ

SEQ ID NO: 2048537 - protein, 26 aa, Staphylococcus
RQSKIFRSRFRMLVEAQLDLLKNDDW

SEQ ID NO: 2048538 - protein, 17 aa, Staphylococcus
RTYNNLVNLEWIYKERP

SEQ ID NO: 2048539 - protein, 17 aa, Staphylococcus
SDYPWDLFIQMPAALMF

SEQ ID NO: 2048540 - protein, 19 aa, Staphylococcus
SEVPAHVQAGWMLTTISSV

SEQ ID NO: 2048541 - protein, 17 aa, Staphylococcus
SGGFGVRLDAGDGFQGA

SEQ ID NO: 2048542 - protein, 20 aa, Staphylococcus
SHGLSLGRLRGVEFDVAIFS

SEQ ID NO: 2048543 - protein, 17 aa, Staphylococcus
SINWALGLMNEGSQIID

SEQ ID NO: 2048544 - protein, 21 aa, Staphylococcus
SRLLKDRIIMLGSQIDDNVAN

SEQ ID NO: 2048545 - protein, 17 aa, Staphylococcus
TDGRMKALVSITLDEAF

SEQ ID NO: 2048546 - protein, 19 aa, Staphylococcus
TEAIPNWAAEQGYPVTNYE

SEQ ID NO: 2048547 - protein, 17 aa, Staphylococcus
TIHRFTRKLGFDGYSDF

SEQ ID NO: 2048548 - protein, 19 aa, Staphylococcus
TSLYRPGPMEEIPTYITRR

SEQ ID NO: 2048549 - protein, 20 aa, Staphylococcus
TSRIYAKFGKEIYVAAKSGE

SEQ ID NO: 2048550 - protein, 18 aa, Staphylococcus
TYMPLPIFLSHQLAKRLS

SEQ ID NO: 2048551 - protein, 23 aa, Staphylococcus
VGKDLSCNVVRTWIHQHTVILGI

SEQ ID NO: 2048552 - protein, 23 aa, Staphylococcus
VKRMPWIGLQWIFARKGAAASNH

SEQ ID NO: 2048553 - protein, 18 aa, Staphylococcus
VKRTCGYLGNPVQRPVIE

SEQ ID NO: 2048554 - protein, 19 aa, Staphylococcus
VRVGMEMDRSELLRKLVDV

SEQ ID NO: 2048555 - protein, 18 aa, Staphylococcus
VYEMRWDIGYVLQQIALF

SEQ ID NO: 2048556 - protein, 19 aa, Staphylococcus
VYEMRWDIGYVLQQIALFP

SEQ ID NO: 2048557 - protein, 18 aa, Staphylococcus
WFNVICMFREDGVYYYCN

SEQ ID NO: 2048558 - protein, 21 aa, Staphylococcus
WSVHVPRRIKEIGPRIKKVSD

SEQ ID NO: 2048559 - protein, 21 aa, Staphylococcus
WYLDSCLKIKYMFPKAHAAAY

SEQ ID NO: 2048560 - protein, 25 aa, Staphylococcus
YGILKRPQFFFAYDIDKYDKGLRGF

SEQ ID NO: 2048561 - protein, 26 aa, Staphylococcus
YGILKRPQFFFAYDIEKYDKGLRGFY

SEQ ID NO: 2048562 - protein, 19 aa, Staphylococcus
YKIAQRLGGFDAVGPVLQG

SEQ ID NO: 2048563 - protein, 17 aa, Staphylococcus
YYYCNLSSPFVCDEEAL

SEQ ID NO: 2048564 - protein, 20 aa, Staphylococcus
AALMFPSGNPFYDWRYQTEE

SEQ ID NO: 2048565 - protein, 22 aa, Staphylococcus
AELLLRVAAIIRRRKEEISAVM

SEQ ID NO: 2048566 - protein, 17 aa, Staphylococcus
AEVDIMYGQGISKEGEL

SEQ ID NO: 2048567 - protein, 19 aa, Staphylococcus
AGELFIFDIVDAFIKAEYK

SEQ ID NO: 2048568 - protein, 17 aa, Staphylococcus
AHPEGYRKALRLMKQAE

SEQ ID NO: 2048569 - protein, 18 aa, Staphylococcus
AHPEGYRKALRLMKQAEK

SEQ ID NO: 2048570 - protein, 23 aa, Staphylococcus
AIKFPSFRPDSWRGKRYLYTGLF

SEQ ID NO: 2048571 - protein, 18 aa, Staphylococcus
AIKNGWKMNDFVGPVDHG

SEQ ID NO: 2048572 - protein, 24 aa, Staphylococcus
AKGRLPDCLVEWSAKRLKEQGADA

SEQ ID NO: 2048573 - protein, 18 aa, Staphylococcus
AKPGEISWESPFGEGRPG

SEQ ID NO: 2048574 - protein, 18 aa, Staphylococcus
ALKLKLSPNEVWNAVTVN

SEQ ID NO: 2048575 - protein, 22 aa, Staphylococcus
ANIPTRIAFMVSSSVDSRTIID

SEQ ID NO: 2048576 - protein, 20 aa, Staphylococcus
ANLLRICARYDNLDIIEDAY

SEQ ID NO: 2048577 - protein, 18 aa, Staphylococcus
APLAHRLGINTIKWELED

SEQ ID NO: 2048578 - protein, 19 aa, Staphylococcus
APLVVLGCVMMRVCHKDTC

SEQ ID NO: 2048579 - protein, 17 aa, Staphylococcus
AQDGASCVTYIGPNGAG

SEQ ID NO: 2048580 - protein, 18 aa, Staphylococcus
ARGAIFGLTRGTEKEHFI

SEQ ID NO: 2048581 - protein, 19 aa, Staphylococcus
ARIPLSQAVIELCLSPKSN

SEQ ID NO: 2048582 - protein, 20 aa, Staphylococcus
ARIPLSQAVIELCLSPKSNS

SEQ ID NO: 2048583 - protein, 18 aa, Staphylococcus
ARLKNVFMVFQDVHRQLF

SEQ ID NO: 2048584 - protein, 19 aa, Staphylococcus
ARRGELVSCFLLEVDDSLN

SEQ ID NO: 2048585 - protein, 19 aa, Staphylococcus
ARRIQFFLSQNFHVAEQFT

SEQ ID NO: 2048586 - protein, 17 aa, Staphylococcus
ASINEVFSRMQSVSSQI

SEQ ID NO: 2048587 - protein, 22 aa, Staphylococcus
ATDLRAAAALILAGLVAEGTTQ

SEQ ID NO: 2048588 - protein, 24 aa, Staphylococcus
ATGLRPIAELMFNDFIGFGLDPIL

SEQ ID NO: 2048589 - protein, 18 aa, Staphylococcus
AVARDVGRIMGFEEITLN

SEQ ID NO: 2048590 - protein, 19 aa, Staphylococcus
CESSYKLPFAFKIYNDPFN

SEQ ID NO: 2048591 - protein, 17 aa, Staphylococcus
CLHKGCIPTKALLKSAE

SEQ ID NO: 2048592 - protein, 24 aa, Staphylococcus
DAEGRYGTFAKYFTKNDVPAFAIC

SEQ ID NO: 2048593 - protein, 24 aa, Staphylococcus
DAEGRYGTFAKYFTKNDVPTFAIC

SEQ ID NO: 2048594 - protein, 18 aa, Staphylococcus
DAELRGVASSGMICSMKE

SEQ ID NO: 2048595 - protein, 19 aa, Staphylococcus
DASINWALGLMNEGSQIID

SEQ ID NO: 2048596 - protein, 23 aa, Staphylococcus
DDLKGSWSVVCFYPADFSFVCPT

SEQ ID NO: 2048597 - protein, 20 aa, Staphylococcus
DERAKAGLFLAMQYPSEITG

SEQ ID NO: 2048598 - protein, 27 aa, Staphylococcus
DIEYKFPFGWGELWGIASRTDFDLKKH

SEQ ID NO: 2048599 - protein, 18 aa, Staphylococcus
DIFGRCLHTYLIKDAIHD

SEQ ID NO: 2048600 - protein, 19 aa, Staphylococcus
DKGDSRFYLSLQDELMVRF

SEQ ID NO: 2048601 - protein, 17 aa, Staphylococcus
DKLSFKYVDRILLNWKK

SEQ ID NO: 2048602 - protein, 17 aa, Staphylococcus
DKTWSVHVPRRIKEIGP

SEQ ID NO: 2048603 - protein, 17 aa, Staphylococcus
DKVSAKRIIDFLSGTVY

SEQ ID NO: 2048604 - protein, 23 aa, Staphylococcus
DLFTCLRPVRWFQGVPSPVKRPE

SEQ ID NO: 2048605 - protein, 21 aa, Staphylococcus
DLKKYGFKFLGPVTVFSFLEA

SEQ ID NO: 2048606 - protein, 25 aa, Staphylococcus
DMKVDWKKRIHIIIGTDEESDWKCT

SEQ ID NO: 2048607 - protein, 23 aa, Staphylococcus
DSLHIGHLLPFMTLRRFQEHGHR

SEQ ID NO: 2048608 - protein, 17 aa, Staphylococcus
DTLRLEAGLPLHGQDLS

SEQ ID NO: 2048609 - protein, 23 aa, Staphylococcus
DTTVCILEAMKLFNEIQAEISGE

SEQ ID NO: 2048610 - protein, 17 aa, Staphylococcus
DVARFNADFAYTMDGSQ

SEQ ID NO: 2048611 - protein, 23 aa, Staphylococcus
DVDVPRTDWDWMIYPKGLYDQIM

SEQ ID NO: 2048612 - protein, 21 aa, Staphylococcus
DVSCFKCKGQGCNVCKHTGWI

SEQ ID NO: 2048613 - protein, 19 aa, Staphylococcus
EALHKLGFDDGMYDLVKEP

SEQ ID NO: 2048614 - protein, 22 aa, Staphylococcus
EEGKRAVLLLHGFTGNSSDVRQ

SEQ ID NO: 2048615 - protein, 21 aa, Staphylococcus
EEKYLRLYAEFENYKRRIQKE

SEQ ID NO: 2048616 - protein, 19 aa, Staphylococcus
EEMKHYFILNFPQRPGALK

SEQ ID NO: 2048617 - protein, 17 aa, Staphylococcus
EEMRFILKQMGLKEKTI

SEQ ID NO: 2048618 - protein, 20 aa, Staphylococcus
EFKQYFPKSGWVEHDANEIW

SEQ ID NO: 2048619 - protein, 21 aa, Staphylococcus
EFYHPEFKKEYVILAEEGAQS

SEQ ID NO: 2048620 - protein, 18 aa, Staphylococcus
EGELCFGNEPLLRVEAPL

SEQ ID NO: 2048621 - protein, 20 aa, Staphylococcus
EGKRAVLLLHGFTGNSSDVR

SEQ ID NO: 2048622 - protein, 18 aa, Staphylococcus
EIRPGIVHRIDKDTSGLL

SEQ ID NO: 2048623 - protein, 21 aa, Staphylococcus
EKIKELQDFVARFSANASKSK

SEQ ID NO: 2048624 - protein, 25 aa, Staphylococcus
EKNAMGWYLDGRVSAIVGTHTHIQT

SEQ ID NO: 2048625 - protein, 25 aa, Staphylococcus
EKNAMGWYLDGRVSAVVGTHTHIQT

SEQ ID NO: 2048626 - protein, 17 aa, Staphylococcus
EKRCPTCHMTLKDIAHV

SEQ ID NO: 2048627 - protein, 19 aa, Staphylococcus
EKYDLFVLVVTDIINSDSK

SEQ ID NO: 2048628 - protein, 22 aa, Staphylococcus
EMAELYEFLGLTVGLNLNSKST

SEQ ID NO: 2048629 - protein, 22 aa, Staphylococcus
EMKRLGLPVPDGFTITTEACID

SEQ ID NO: 2048630 - protein, 20 aa, Staphylococcus
ENGKHGFAFGSGMAAISAVI

SEQ ID NO: 2048631 - protein, 20 aa, Staphylococcus
ENRARLVIYPAAMRYAGPRE

SEQ ID NO: 2048632 - protein, 22 aa, Staphylococcus
EPCNECAICKGITQGTNGDVIE

SEQ ID NO: 2048633 - protein, 20 aa, Staphylococcus
EQRISNFLIWQVSYSEFIFN

SEQ ID NO: 2048634 - protein, 17 aa, Staphylococcus
EQSQCKRAIILPNNKNI

SEQ ID NO: 2048635 - protein, 22 aa, Staphylococcus
EQTEVRLVLSFLRTIDNPLQDI

SEQ ID NO: 2048636 - protein, 18 aa, Staphylococcus
ERGYQLSKTEYRGREATD

SEQ ID NO: 2048637 - protein, 24 aa, Staphylococcus
ESKYCPNCGRLLQYDYIHYNQIGH

SEQ ID NO: 2048638 - protein, 25 aa, Staphylococcus
ETGSVVLPGRFFVDIIKKLPGKDVK

SEQ ID NO: 2048639 - protein, 20 aa, Staphylococcus
ETYMPLPIFLSHQLAKRLSD

SEQ ID NO: 2048640 - protein, 21 aa, Staphylococcus
EVFKYLNRFARVPVCGAISAY

SEQ ID NO: 2048641 - protein, 25 aa, Staphylococcus
EVKDMYRRVNFLFGDIVKVTPSSKV

SEQ ID NO: 2048642 - protein, 18 aa, Staphylococcus
EVMSIPTLIVFKDGEPVD

SEQ ID NO: 2048643 - protein, 18 aa, Staphylococcus
FAKVKGRLIVSCYASNFI

SEQ ID NO: 2048644 - protein, 18 aa, Staphylococcus
FDEKRLSKSPAFFDKQKL

SEQ ID NO: 2048645 - protein, 21 aa, Staphylococcus
FDLRPAGIIKMLDLKHPIYKQ

SEQ ID NO: 2048646 - protein, 18 aa, Staphylococcus
FDNLKWLGLDWDESIDKD

SEQ ID NO: 2048647 - protein, 18 aa, Staphylococcus
FEGTILFVSHDRYFINQL

SEQ ID NO: 2048648 - protein, 21 aa, Staphylococcus
FETRAATLLRYFTGLCESSYK

SEQ ID NO: 2048649 - protein, 20 aa, Staphylococcus
FFGICLGHQLFALSQGATSF

SEQ ID NO: 2048650 - protein, 18 aa, Staphylococcus
FGTIDTWLVWKLSGGEAH

SEQ ID NO: 2048651 - protein, 19 aa, Staphylococcus
FIEDFSIKISDVMTKEDLI

SEQ ID NO: 2048652 - protein, 19 aa, Staphylococcus
FIEDFSIKISDVMTKENLI

SEQ ID NO: 2048653 - protein, 17 aa, Staphylococcus
FIIGDGIGPDIWKAASR

SEQ ID NO: 2048654 - protein, 19 aa, Staphylococcus
FKGSIIFTSYDFEFINTIA

SEQ ID NO: 2048655 - protein, 19 aa, Staphylococcus
FKLYLGLKHISPYIEEAVE

SEQ ID NO: 2048656 - protein, 17 aa, Staphylococcus
FLFELQDGYTIETVLMR

SEQ ID NO: 2048657 - protein, 24 aa, Staphylococcus
FNGDIGVIVGIFWAKENALNKDVL

SEQ ID NO: 2048658 - protein, 17 aa, Staphylococcus
FNYHKVHLFKEWKTEKG

SEQ ID NO: 2048659 - protein, 17 aa, Staphylococcus
FPGFEMITGPDLSTKMF

SEQ ID NO: 2048660 - protein, 23 aa, Staphylococcus
FPGVKGEVLVNAFSKLDIMVSTT

SEQ ID NO: 2048661 - protein, 23 aa, Staphylococcus
FQHFNLLWSRTVLKNITFPLEIA

SEQ ID NO: 2048662 - protein, 17 aa, Staphylococcus
FRLGISVSKKLGNAVTR

SEQ ID NO: 2048663 - protein, 17 aa, Staphylococcus
FSFNVKGGRCEACKGDG

SEQ ID NO: 2048664 - protein, 24 aa, Staphylococcus
FTGYEVLNTFTFRITRNADLTIHE

SEQ ID NO: 2048665 - protein, 19 aa, Staphylococcus
FTRKLGFDGYSDFKSYLKF

SEQ ID NO: 2048666 - protein, 24 aa, Staphylococcus
FVVEGPLWIQVHAFEKGVEVTISK

SEQ ID NO: 2048667 - protein, 18 aa, Staphylococcus
FWATWCGPCKMIAPVLEE

SEQ ID NO: 2048668 - protein, 24 aa, Staphylococcus
FYDRKEIKDLLSYLRIVANSNDDI

SEQ ID NO: 2048669 - protein, 24 aa, Staphylococcus
FYDRKEIKDLLSYLRVIANSNDDI

SEQ ID NO: 2048670 - protein, 17 aa, Staphylococcus
GASAVLFGSVNAIMGLT

SEQ ID NO: 2048671 - protein, 19 aa, Staphylococcus
GCFWCMVKPFTSYPGIEDV

SEQ ID NO: 2048672 - protein, 18 aa, Staphylococcus
GDCTICVDRCPTGALVGD

SEQ ID NO: 2048673 - protein, 18 aa, Staphylococcus
GEIDPVIRFYTWDPATLS

SEQ ID NO: 2048674 - protein, 18 aa, Staphylococcus
GEIDPVIRFYTWNPATLS

SEQ ID NO: 2048675 - protein, 20 aa, Staphylococcus
GEIRPGIVHRIDKDTSGLLM

SEQ ID NO: 2048676 - protein, 17 aa, Staphylococcus
GEVPFKPSRVILQDFTG

SEQ ID NO: 2048677 - protein, 20 aa, Staphylococcus
GFRGEALASISSVAKVTLKT

SEQ ID NO: 2048678 - protein, 23 aa, Staphylococcus
GGEKARLQLALLMLERNNVLILD

SEQ ID NO: 2048679 - protein, 19 aa, Staphylococcus
GGEKARLQLALLMLQRDNV

SEQ ID NO: 2048680 - protein, 18 aa, Staphylococcus
GGIARPAASHALHYDKLP

SEQ ID NO: 2048681 - protein, 19 aa, Staphylococcus
GGLYLEKFIENFRHIEIQI

SEQ ID NO: 2048682 - protein, 20 aa, Staphylococcus
GGLYLEKFIENFRHIEIQII

SEQ ID NO: 2048683 - protein, 17 aa, Staphylococcus
GGSVLLGLDGTVVKAHG

SEQ ID NO: 2048684 - protein, 18 aa, Staphylococcus
GICCLKPGIPGVSENIEV

SEQ ID NO: 2048685 - protein, 17 aa, Staphylococcus
GILPWKKINTVNGDDVT

SEQ ID NO: 2048686 - protein, 24 aa, Staphylococcus
GIVSRGGSIIAQWCLAHHEESFLY

SEQ ID NO: 2048687 - protein, 23 aa, Staphylococcus
GKGCNVCKHTGWIEILGAGMVHP

SEQ ID NO: 2048688 - protein, 20 aa, Staphylococcus
GKRRLAYEINDFKEGFYNIV

SEQ ID NO: 2048689 - protein, 17 aa, Staphylococcus
GKSNITDAIKWVLGEQS

SEQ ID NO: 2048690 - protein, 20 aa, Staphylococcus
GMCETCSGLGYVEDIDLNEL

SEQ ID NO: 2048691 - protein, 18 aa, Staphylococcus
GNELPISAGYFFINPFEV

SEQ ID NO: 2048692 - protein, 17 aa, Staphylococcus
GNIGRGFIGYILADNNI

SEQ ID NO: 2048693 - protein, 23 aa, Staphylococcus
GQGCNVCKHTGWIEILGAGMVHP

SEQ ID NO: 2048694 - protein, 17 aa, Staphylococcus
GQIPGFVHLYVGEEAVA

SEQ ID NO: 2048695 - protein, 19 aa, Staphylococcus
GRSDYFWDLFIQMPAALMF

SEQ ID NO: 2048696 - protein, 19 aa, Staphylococcus
GTFKKMHVRMMPKQEPPYT

SEQ ID NO: 2048697 - protein, 17 aa, Staphylococcus
GVALPWAIAAALVRPNT

SEQ ID NO: 2048698 - protein, 19 aa, Staphylococcus
GVDVFRIFDSLNWVDQMKV

SEQ ID NO: 2048699 - protein, 19 aa, Staphylococcus
GVIMLTKSLAMEWSKYGIK

SEQ ID NO: 2048700 - protein, 21 aa, Staphylococcus
GVLCGRATWSGAVKVYIEQGE

SEQ ID NO: 2048701 - protein, 25 aa, Staphylococcus
GVNGIRISIAWSRIFPKGYGEVNPK

SEQ ID NO: 2048702 - protein, 19 aa, Staphylococcus
GYFIWSLMDVFSWSNGYEK

SEQ ID NO: 2048703 - protein, 21 aa, Staphylococcus
HAAGLRYAQYGPFMTFHLAGG

SEQ ID NO: 2048704 - protein, 18 aa, Staphylococcus
HCFGCKKGGNVFQFTQEI

SEQ ID NO: 2048705 - protein, 22 aa, Staphylococcus
HFNKLEVPFIYRVHEQPKSDRL

SEQ ID NO: 2048706 - protein, 21 aa, Staphylococcus
HLQMAPKHWLCIKEDDLVWAT

SEQ ID NO: 2048707 - protein, 19 aa, Staphylococcus
HPYSFELNKDFNFSAAHYI

SEQ ID NO: 2048708 - protein, 17 aa, Staphylococcus
HRLGHGLGLEEHEYQDV

SEQ ID NO: 2048709 - protein, 17 aa, Staphylococcus
HTFFEMLGNFSIGDYFK

SEQ ID NO: 2048710 - protein, 18 aa, Staphylococcus
HVPQCPNCDISLTYHKTT

SEQ ID NO: 2048711 - protein, 17 aa, Staphylococcus
HWLCIKEDDLVWATAAP

SEQ ID NO: 2048712 - protein, 22 aa, Staphylococcus
HYRMVQELPTFFSSNLSFEELE

SEQ ID NO: 2048713 - protein, 17 aa, Staphylococcus
IAACLLTAVPVMKFFKY

SEQ ID NO: 2048714 - protein, 17 aa, Staphylococcus
IALFAGIDKCRFKRQVT

SEQ ID NO: 2048715 - protein, 18 aa, Staphylococcus
IAYFKVHYPLYYYASYFT

SEQ ID NO: 2048716 - protein, 17 aa, Staphylococcus
ICNYCFEHGVVIIAVAG

SEQ ID NO: 2048717 - protein, 19 aa, Staphylococcus
IDKVSAKRIIDFLSGTVYA

SEQ ID NO: 2048718 - protein, 17 aa, Staphylococcus
IELHLKRLIVGGLEKVY

SEQ ID NO: 2048719 - protein, 20 aa, Staphylococcus
IEQFPKLLFISGEDDEIIPY

SEQ ID NO: 2048720 - protein, 19 aa, Staphylococcus
IEQSQCKRAIILPNNKNIL

SEQ ID NO: 2048721 - protein, 17 aa, Staphylococcus
IFLGVPFNIASYALLTH

SEQ ID NO: 2048722 - protein, 17 aa, Staphylococcus
IGCTFCASTLGGLKRNL

SEQ ID NO: 2048723 - protein, 17 aa, Staphylococcus
IGEAVGLASSSTVHGHL

SEQ ID NO: 2048724 - protein, 18 aa, Staphylococcus
IGHLYAYQFEKIALIGGN

SEQ ID NO: 2048725 - protein, 17 aa, Staphylococcus
IGYKIAQRLGGFDAVGP

SEQ ID NO: 2048726 - protein, 19 aa, Staphylococcus
IKAAGGFIIQVMPGAKDET

SEQ ID NO: 2048727 - protein, 21 aa, Staphylococcus
ILGAVCTRACRFCAVKTGLPN

SEQ ID NO: 2048728 - protein, 17 aa, Staphylococcus
ILGETLYNFGLTPQGLE

SEQ ID NO: 2048729 - protein, 19 aa, Staphylococcus
ILIGGGMAYTFLKAQGKEI

SEQ ID NO: 2048730 - protein, 17 aa, Staphylococcus
ILKPRLVPLLQMSNKEF

SEQ ID NO: 2048731 - protein, 17 aa, Staphylococcus
INLMFSKVGVPRGRGKI

SEQ ID NO: 2048732 - protein, 18 aa, Staphylococcus
IPAKARRKGGHPAKRIFQ

SEQ ID NO: 2048733 - protein, 18 aa, Staphylococcus
IPAKARRKGGHPAKRVFQ

SEQ ID NO: 2048734 - protein, 19 aa, Staphylococcus
IPDEFVVGYGLDYAEHYRN

SEQ ID NO: 2048735 - protein, 23 aa, Staphylococcus
IPELQGRFPIRVELESLTVNDFY

SEQ ID NO: 2048736 - protein, 17 aa, Staphylococcus
IQKEYYVGFVIDRATDK

SEQ ID NO: 2048737 - protein, 21 aa, Staphylococcus
IQRIEHMLRYALIIEDTGDNN

SEQ ID NO: 2048738 - protein, 17 aa, Staphylococcus
IRPGIVHRIDKDTSGLL

SEQ ID NO: 2048739 - protein, 17 aa, Staphylococcus
IRWSTAMSNEIPWYVHE

SEQ ID NO: 2048740 - protein, 22 aa, Staphylococcus
ISKTGFGPFAFDEWRYLPDGSD

SEQ ID NO: 2048741 - protein, 18 aa, Staphylococcus
IVEKELIQRIGFVIEPEN

SEQ ID NO: 2048742 - protein, 25 aa, Staphylococcus
IVEKSLRGAAIWDELKDRLHMNAYG

SEQ ID NO: 2048743 - protein, 18 aa, Staphylococcus
IVGPFAYYIKGFEMLPQM

SEQ ID NO: 2048744 - protein, 19 aa, Staphylococcus
KAFAPVREWAWSREEEIDY

SEQ ID NO: 2048745 - protein, 23 aa, Staphylococcus
KANIPTRIAFMVSSSVDSRTILD

SEQ ID NO: 2048746 - protein, 21 aa, Staphylococcus
KARACGIHMLVATQRPSVNVI

SEQ ID NO: 2048747 - protein, 20 aa, Staphylococcus
KCATLAWKALEKGTVQKEGK

SEQ ID NO: 2048748 - protein, 18 aa, Staphylococcus
KERIELLKPYQVNQEMIE

SEQ ID NO: 2048749 - protein, 20 aa, Staphylococcus
KERRAGVITFNLADIHPHDV

SEQ ID NO: 2048750 - protein, 19 aa, Staphylococcus
KFAEGIEVGQVFKLGTKYS

SEQ ID NO: 2048751 - protein, 19 aa, Staphylococcus
KGLEFPIVFLMGMEESLFP

SEQ ID NO: 2048752 - protein, 19 aa, Staphylococcus
KGLLCVYEGFLKGLKGEKV

SEQ ID NO: 2048753 - protein, 22 aa, Staphylococcus
KGPEVPRGLPIIPEEYTPKLKR

SEQ ID NO: 2048754 - protein, 22 aa, Staphylococcus
KGVAFCPHCDGPLFENKNVAVI

SEQ ID NO: 2048755 - protein, 20 aa, Staphylococcus
KGYFLWSLMDVFSWSNGYEK

SEQ ID NO: 2048756 - protein, 18 aa, Staphylococcus
KHAQLEWEKVPAPTRAEH

SEQ ID NO: 2048757 - protein, 18 aa, Staphylococcus
KHLEGGIIKAIRQIGNDR

SEQ ID NO: 2048758 - protein, 19 aa, Staphylococcus
KIALFAGIDKCRFKKQVTP

SEQ ID NO: 2048759 - protein, 19 aa, Staphylococcus
KKAIDIGNAMLKDGYKEGD

SEQ ID NO: 2048760 - protein, 19 aa, Staphylococcus
KKGFLLDGFPRTIDQAEAL

SEQ ID NO: 2048761 - protein, 17 aa, Staphylococcus
KKGFLLDGFPRTIEQAE

SEQ ID NO: 2048762 - protein, 17 aa, Staphylococcus
KKGTLLWLMDETKTPMG

SEQ ID NO: 2048763 - protein, 21 aa, Staphylococcus
KKRALEILNLVGLPNAEKRFK

SEQ ID NO: 2048764 - protein, 18 aa, Staphylococcus
KKTFPGYVLVELVMTDES

SEQ ID NO: 2048765 - protein, 19 aa, Staphylococcus
KLKVLYEMFGLKMVDNELS

SEQ ID NO: 2048766 - protein, 17 aa, Staphylococcus
KPALRLSAIMGLNSTFI

SEQ ID NO: 2048767 - protein, 18 aa, Staphylococcus
KPDLILLTFPTPVMSVLT

SEQ ID NO: 2048768 - protein, 23 aa, Staphylococcus
KQKIKCPYCHSTLTNMTVRKPDH

SEQ ID NO: 2048769 - protein, 18 aa, Staphylococcus
KRIHMIIGTDEESDWKCT

SEQ ID NO: 2048770 - protein, 18 aa, Staphylococcus
KRIIDFLSGTVYAIGGDI

SEQ ID NO: 2048771 - protein, 19 aa, Staphylococcus
KRIRYYSCSNFRNKGSKVC

SEQ ID NO: 2048772 - protein, 22 aa, Staphylococcus
KRMPFIGLQWIFARKGAAASNH

SEQ ID NO: 2048773 - protein, 17 aa, Staphylococcus
KRVVISLTYVYGIGTST

SEQ ID NO: 2048774 - protein, 19 aa, Staphylococcus
KRYYICSLFNRSGSSACHS

SEQ ID NO: 2048775 - protein, 17 aa, Staphylococcus
KSERLRQFFDFITNFGI

SEQ ID NO: 2048776 - protein, 20 aa, Staphylococcus
KSIVGPFAYYIKGFEMLPQM

SEQ ID NO: 2048777 - protein, 17 aa, Staphylococcus
KSPRWAIAYKFPAEEVV

SEQ ID NO: 2048778 - protein, 18 aa, Staphylococcus
KSTGRMVGIISHVSELKQ

SEQ ID NO: 2048779 - protein, 19 aa, Staphylococcus
KVHLFKEWKTEKGIINYLL

SEQ ID NO: 2048780 - protein, 22 aa, Staphylococcus
LAEEYQCPVIILSDLQLSLGKQ

SEQ ID NO: 2048781 - protein, 21 aa, Staphylococcus
LDPSLPIDLIIDYAHTADGMN

SEQ ID NO: 2048782 - protein, 19 aa, Staphylococcus
LDQLPCWLTYTNGETHKVI

SEQ ID NO: 2048783 - protein, 19 aa, Staphylococcus
LDVADEFDVQIALHADTLN

SEQ ID NO: 2048784 - protein, 18 aa, Staphylococcus
LEAFNLYGALSMANAGPN

SEQ ID NO: 2048785 - protein, 21 aa, Staphylococcus
LELAEQMGIIFIDEIDKVATN

SEQ ID NO: 2048786 - protein, 20 aa, Staphylococcus
LESEIARWIKIQEDIGLDVL

SEQ ID NO: 2048787 - protein, 18 aa, Staphylococcus
LGFPEARIPLSQAVIELC

SEQ ID NO: 2048788 - protein, 17 aa, Staphylococcus
LGFRGDIFGGYILYNLG

SEQ ID NO: 2048789 - protein, 18 aa, Staphylococcus
LGLLKIDFLGLRNLSIIH

SEQ ID NO: 2048790 - protein, 18 aa, Staphylococcus
LGVALPWAISAALVRPNT

SEQ ID NO: 2048791 - protein, 24 aa, Staphylococcus
LHIGHLLPFLTLRRFQEHGHRPIV

SEQ ID NO: 2048792 - protein, 18 aa, Staphylococcus
LHPDLDTWVIFPWTAGQG

SEQ ID NO: 2048793 - protein, 18 aa, Staphylococcus
LKIAELFRDSTIPAGLIQ

SEQ ID NO: 2048794 - protein, 21 aa, Staphylococcus
LKRLIMPSIEREIRSDLTEKA

SEQ ID NO: 2048795 - protein, 18 aa, Staphylococcus
LKSKKGTLLWLMDETKTP

SEQ ID NO: 2048796 - protein, 20 aa, Staphylococcus
LKSKKGTLLWLMDETKTPMG

SEQ ID NO: 2048797 - protein, 19 aa, Staphylococcus
LKVAIVVSRFNDFITNRLL

SEQ ID NO: 2048798 - protein, 17 aa, Staphylococcus
LKVYMIASVEERAERRQ

SEQ ID NO: 2048799 - protein, 23 aa, Staphylococcus
LLFAILKVRSAPFVILDEVEAAL

SEQ ID NO: 2048800 - protein, 18 aa, Staphylococcus
LLGGTCLHKGCIPTKALL

SEQ ID NO: 2048801 - protein, 18 aa, Staphylococcus
LLGGTCLHKGCIPTKSLL

SEQ ID NO: 2048802 - protein, 19 aa, Staphylococcus
LLMFCGKKAYYLYGASSND

SEQ ID NO: 2048803 - protein, 19 aa, Staphylococcus
LLRKADLVVAIGYDPIEYE

SEQ ID NO: 2048804 - protein, 17 aa, Staphylococcus
LNVFRMELLGAKVEAVD

SEQ ID NO: 2048805 - protein, 21 aa, Staphylococcus
LPESFYRGAHQHIFRAMMHLN

SEQ ID NO: 2048806 - protein, 17 aa, Staphylococcus
LPRPFFILAPMEDVTDI

SEQ ID NO: 2048807 - protein, 17 aa, Staphylococcus
LQERIWNPLQIMNDFGK

SEQ ID NO: 2048808 - protein, 18 aa, Staphylococcus
LRAQKILQDRAFKNEKID

SEQ ID NO: 2048809 - protein, 20 aa, Staphylococcus
LRDITELFLDSGLGKEAFSI

SEQ ID NO: 2048810 - protein, 19 aa, Staphylococcus
LRKALPEQFVYIIEELLYK

SEQ ID NO: 2048811 - protein, 20 aa, Staphylococcus
LRQFFDFITNFGIMIKGTGE

SEQ ID NO: 2048812 - protein, 18 aa, Staphylococcus
LSDMIKRQRQSILEILAQ

SEQ ID NO: 2048813 - protein, 20 aa, Staphylococcus
LSKDELKEIVTMMVNKLTQR

SEQ ID NO: 2048814 - protein, 21 aa, Staphylococcus
LTKSLAMEWSKYGIKVNTIAP

SEQ ID NO: 2048815 - protein, 23 aa, Staphylococcus
LTPELAFKLGRYGGYVLAHNEGE

SEQ ID NO: 2048816 - protein, 18 aa, Staphylococcus
LTQYIGHLNVVLFAPEDL

SEQ ID NO: 2048817 - protein, 19 aa, Staphylococcus
LVEMVRPKLSSVIQPLYDI

SEQ ID NO: 2048818 - protein, 19 aa, Staphylococcus
LYARFWHKVLYDLGVVPTK

SEQ ID NO: 2048819 - protein, 20 aa, Staphylococcus
LYARFWHKVLYDLGVVPTKE

SEQ ID NO: 2048820 - protein, 19 aa, Staphylococcus
LYGDVKFGVGPVIDGGFYY

SEQ ID NO: 2048821 - protein, 21 aa, Staphylococcus
MAADMPLAIVIGSEGQGMSRL

SEQ ID NO: 2048822 - protein, 17 aa, Staphylococcus
MALPPCHTMFQFYVQDG

SEQ ID NO: 2048823 - protein, 24 aa, Staphylococcus
MEFRKEFHKDFVIDLVGYRRYGHN

SEQ ID NO: 2048824 - protein, 22 aa, Staphylococcus
MILGAVCTRACRFCAVKTGLPN

SEQ ID NO: 2048825 - protein, 18 aa, Staphylococcus
MLFRGVHYEICCIDRKGY

SEQ ID NO: 2048826 - protein, 19 aa, Staphylococcus
MMMAALKISTDFERMGDNA

SEQ ID NO: 2048827 - protein, 19 aa, Staphylococcus
MPIEVVYGFAQLKRGAALA

SEQ ID NO: 2048828 - protein, 17 aa, Staphylococcus
MVLPARFPNLLVNGSTG

SEQ ID NO: 2048829 - protein, 25 aa, Staphylococcus
MYKERGFEIKPEIAGLMISAIISDS

SEQ ID NO: 2048830 - protein, 19 aa, Staphylococcus
NDLPHLVSPVITDVKAATQ

SEQ ID NO: 2048831 - protein, 21 aa, Staphylococcus
NDLPHLVSPVITDVKAATQSL

SEQ ID NO: 2048832 - protein, 20 aa, Staphylococcus
NEIKAKLIIIDEMSMVDTWL

SEQ ID NO: 2048833 - protein, 22 aa, Staphylococcus
NGDIGIIVGIFWAKENALNKDV

SEQ ID NO: 2048834 - protein, 17 aa, Staphylococcus
NLENGKHGFAFGSGMAA

SEQ ID NO: 2048835 - protein, 18 aa, Staphylococcus
NNGYKYWVDLGWKETDKK

SEQ ID NO: 2048836 - protein, 23 aa, Staphylococcus
NPPHLKAMIPWEGLNDMYREVAF

SEQ ID NO: 2048837 - protein, 20 aa, Staphylococcus
NRLTGRRICEKCGTTYHLVF

SEQ ID NO: 2048838 - protein, 21 aa, Staphylococcus
NRPMMYIALSYDHRIIDGKEA

SEQ ID NO: 2048839 - protein, 26 aa, Staphylococcus
NSVKPNWCPGCGDFSVQAAIQKAAAN

SEQ ID NO: 2048840 - protein, 17 aa, Staphylococcus
NWPVCGIPEKFYTDHGS

SEQ ID NO: 2048841 - protein, 19 aa, Staphylococcus
NYFHPFRASKRFTIVPSWE

SEQ ID NO: 2048842 - protein, 23 aa, Staphylococcus
PAENFKEAVQWLYLAYLAAIKEQ

SEQ ID NO: 2048843 - protein, 18 aa, Staphylococcus
PAPCEQSCVMKINRESVA

SEQ ID NO: 2048844 - protein, 20 aa, Staphylococcus
PEFIGRVPIVANLETLDVDA

SEQ ID NO: 2048845 - protein, 20 aa, Staphylococcus
PEFIGRVPIVANLETLDVEA

SEQ ID NO: 2048846 - protein, 20 aa, Staphylococcus
PETYDALLIPGGFSPDHLRG

SEQ ID NO: 2048847 - protein, 21 aa, Staphylococcus
PEVLPSRFPNLLVNGASGIAV

SEQ ID NO: 2048848 - protein, 17 aa, Staphylococcus
PGFRKGKVPRPIFEQRF

SEQ ID NO: 2048849 - protein, 19 aa, Staphylococcus
PGLTICGGYQFLGTKYITP

SEQ ID NO: 2048850 - protein, 21 aa, Staphylococcus
PGLTICGGYQFLGTKYITPDG

SEQ ID NO: 2048851 - protein, 24 aa, Staphylococcus
PGYEAPCYIAWSGKNRSPLVRVPT

SEQ ID NO: 2048852 - protein, 17 aa, Staphylococcus
PMMYLALSYDHRIIDGK

SEQ ID NO: 2048853 - protein, 19 aa, Staphylococcus
PRETMIGSMAYYISHAKNE

SEQ ID NO: 2048854 - protein, 20 aa, Staphylococcus
PRETMIGSMAYYISHAKNEK

SEQ ID NO: 2048855 - protein, 17 aa, Staphylococcus
PSFSTCFGAPFLPLNPT

SEQ ID NO: 2048856 - protein, 20 aa, Staphylococcus
PSVLPARFPNLLVNGAAGIA

SEQ ID NO: 2048857 - protein, 19 aa, Staphylococcus
PYGAVPIDFAYAVHSEVGN

SEQ ID NO: 2048858 - protein, 17 aa, Staphylococcus
QLFAAGYSACFNSALSL

SEQ ID NO: 2048859 - protein, 17 aa, Staphylococcus
QLIPLTFFVKKFKQAKS

SEQ ID NO: 2048860 - protein, 17 aa, Staphylococcus
QRMPKIVIVIDELADLM

SEQ ID NO: 2048861 - protein, 18 aa, Staphylococcus
QWAGSCWYYLRYIDPDNE

SEQ ID NO: 2048862 - protein, 18 aa, Staphylococcus
QWAGSCWYYLRYIDPHNE

SEQ ID NO: 2048863 - protein, 19 aa, Staphylococcus
RARRIQFFLSQNFHVAEQF

SEQ ID NO: 2048864 - protein, 23 aa, Staphylococcus
RDGLKSECILLFSERDKGLHEYF

SEQ ID NO: 2048865 - protein, 17 aa, Staphylococcus
RDLFKYIPFDGSIITIS

SEQ ID NO: 2048866 - protein, 17 aa, Staphylococcus
RDLFKYIPFDGSIITIT

SEQ ID NO: 2048867 - protein, 19 aa, Staphylococcus
REKRIVISLTYVYGIGTST

SEQ ID NO: 2048868 - protein, 20 aa, Staphylococcus
RELQDIIAILGMDELSDEDK

SEQ ID NO: 2048869 - protein, 21 aa, Staphylococcus
RELQDIIAILGMDELSEEDKQ

SEQ ID NO: 2048870 - protein, 22 aa, Staphylococcus
RELQKRLGITFIFVTHDQEEAL

SEQ ID NO: 2048871 - protein, 17 aa, Staphylococcus
RFKKCVIGLPGGCPLGP

SEQ ID NO: 2048872 - protein, 20 aa, Staphylococcus
RGYASFMLCRDCGHVPQCPN

SEQ ID NO: 2048873 - protein, 18 aa, Staphylococcus
RHRLLELFLIEILKYNWE

SEQ ID NO: 2048874 - protein, 21 aa, Staphylococcus
RIAPRKVRLVLDLIRGKNAAE

SEQ ID NO: 2048875 - protein, 19 aa, Staphylococcus
RKGLRTGIIADRIGGQVND

SEQ ID NO: 2048876 - protein, 18 aa, Staphylococcus
RLDHRGGVGADGITGDGA

SEQ ID NO: 2048877 - protein, 17 aa, Staphylococcus
RLTGRLSGNIGYVASKV

SEQ ID NO: 2048878 - protein, 18 aa, Staphylococcus
RLTGRRICEKCGTTYHLV

SEQ ID NO: 2048879 - protein, 19 aa, Staphylococcus
RNPYSVILFDEIEKANPQI

SEQ ID NO: 2048880 - protein, 20 aa, Staphylococcus
RPDYISAFWNVVNWEKVDEL

SEQ ID NO: 2048881 - protein, 20 aa, Staphylococcus
RPIMEEWLFNTVAFIGGPSE

SEQ ID NO: 2048882 - protein, 19 aa, Staphylococcus
RPQLRALLRASAYGKLNIM

SEQ ID NO: 2048883 - protein, 18 aa, Staphylococcus
RRGLPYVFAGHFAPQQMK

SEQ ID NO: 2048884 - protein, 17 aa, Staphylococcus
RSGFVANSFAMRLNQLG

SEQ ID NO: 2048885 - protein, 19 aa, Staphylococcus
RSLEEVIYFASYVVVDPGP

SEQ ID NO: 2048886 - protein, 23 aa, Staphylococcus
RVAIEMASPLGWHKYVGTEGKVI

SEQ ID NO: 2048887 - protein, 18 aa, Staphylococcus
RVKYNSALEKLRNQDDTT

SEQ ID NO: 2048888 - protein, 19 aa, Staphylococcus
RVNEEIWRGISVNIQEMPI

SEQ ID NO: 2048889 - protein, 19 aa, Staphylococcus
RYLENQIRDAFGFEGTPIH

SEQ ID NO: 2048890 - protein, 17 aa, Staphylococcus
SCVGKEFCRFGTQYTTR

SEQ ID NO: 2048891 - protein, 18 aa, Staphylococcus
SCVGKEFCRFGTQYTTRL

SEQ ID NO: 2048892 - protein, 18 aa, Staphylococcus
SDAFKLYDTYGFPIELTE

SEQ ID NO: 2048893 - protein, 23 aa, Staphylococcus
SDMYLCPDLDTWVIFPWTAGQGK

SEQ ID NO: 2048894 - protein, 19 aa, Staphylococcus
SEHYGLWAFKRVWGTYLSE

SEQ ID NO: 2048895 - protein, 24 aa, Staphylococcus
SELGSRMRLRIVPELFFEYDESIE

SEQ ID NO: 2048896 - protein, 17 aa, Staphylococcus
SFIESFPLFGYNLNDYE

SEQ ID NO: 2048897 - protein, 23 aa, Staphylococcus
SGWTDIFIYPGFEYKAIDGLITN

SEQ ID NO: 2048898 - protein, 17 aa, Staphylococcus
SHPWDFTDRMIEVIAKG

SEQ ID NO: 2048899 - protein, 19 aa, Staphylococcus
SKGGFYFTDFRGYSTNPKG

SEQ ID NO: 2048900 - protein, 17 aa, Staphylococcus
SKHIGGFPVSGLFLRCK

SEQ ID NO: 2048901 - protein, 17 aa, Staphylococcus
SLEHLLFGLGIRHLGAK

SEQ ID NO: 2048902 - protein, 18 aa, Staphylococcus
SLLPKYRGGAPIHQAIID

SEQ ID NO: 2048903 - protein, 20 aa, Staphylococcus
SLLPKYRGGAPIHQAIIDGE

SEQ ID NO: 2048904 - protein, 21 aa, Staphylococcus
SNITDAIKWVLGEQSAKSLRG

SEQ ID NO: 2048905 - protein, 18 aa, Staphylococcus
SPEFMFPSFYGIDVSTTA

SEQ ID NO: 2048906 - protein, 17 aa, Staphylococcus
SRISDWNKTGWGEIPMS

SEQ ID NO: 2048907 - protein, 21 aa, Staphylococcus
SRLLKDRIIMLGSAIDDNVAN

SEQ ID NO: 2048908 - protein, 22 aa, Staphylococcus
SRRFLDRVWRLFINEDGSLSNK

SEQ ID NO: 2048909 - protein, 23 aa, Staphylococcus
SYKTHLLELFKRANVIAMSGSLP

SEQ ID NO: 2048910 - protein, 26 aa, Staphylococcus
TAMNRKGYFLYGYRHFSSRIKGGHTN

SEQ ID NO: 2048911 - protein, 28 aa, Staphylococcus
TDIEYRFPFGWGELWGIASRTDFDLKKH

SEQ ID NO: 2048912 - protein, 17 aa, Staphylococcus
TEFKEWVGDAIFVAHNA

SEQ ID NO: 2048913 - protein, 17 aa, Staphylococcus
TFVPSICYNESMGPIQT

SEQ ID NO: 2048914 - protein, 24 aa, Staphylococcus
TGSVVLPGRFFVDIIKKLPGKDVK

SEQ ID NO: 2048915 - protein, 19 aa, Staphylococcus
TIHRFTRKLGFDGYSDFKS

SEQ ID NO: 2048916 - protein, 21 aa, Staphylococcus
TKELIDWLKAQSRPFLFSTSL

SEQ ID NO: 2048917 - protein, 23 aa, Staphylococcus
TLKQIKGVIGFKIKVNRLEAAYK

SEQ ID NO: 2048918 - protein, 17 aa, Staphylococcus
TLRGPRGGMILCKEEYK

SEQ ID NO: 2048919 - protein, 18 aa, Staphylococcus
TMNSGLFAQMLHSGNIEG

SEQ ID NO: 2048920 - protein, 17 aa, Staphylococcus
TNTFPSWKRAHPNRLLM

SEQ ID NO: 2048921 - protein, 22 aa, Staphylococcus
TPELAFKLGRYGGYVLAHNKGE

SEQ ID NO: 2048922 - protein, 25 aa, Staphylococcus
TSIPLWKNQMAIALTLMRQRNAVSA

SEQ ID NO: 2048923 - protein, 19 aa, Staphylococcus
TSLYRPGPMEEIPTYISRR

SEQ ID NO: 2048924 - protein, 17 aa, Staphylococcus
TTKWLEDYLKYFKGAII

SEQ ID NO: 2048925 - protein, 24 aa, Staphylococcus
TTLGLRWLVNYSRLRGEKTMEERL

SEQ ID NO: 2048926 - protein, 23 aa, Staphylococcus
TYLPRKFKIGIAVPPSNDIDVYS

SEQ ID NO: 2048927 - protein, 21 aa, Staphylococcus
VAADIYRPAAINQLQTVGKQL

SEQ ID NO: 2048928 - protein, 21 aa, Staphylococcus
VAGDIYRPAAIDQLQTVGKQL

SEQ ID NO: 2048929 - protein, 19 aa, Staphylococcus
VATFTLAVNRTFTNAQGER

SEQ ID NO: 2048930 - protein, 21 aa, Staphylococcus
VDFRLIEPAAFYHTLQHFTGS

SEQ ID NO: 2048931 - protein, 24 aa, Staphylococcus
VDIKEVFLKLPIIGTEVYDESNEI

SEQ ID NO: 2048932 - protein, 18 aa, Staphylococcus
VDVFRIFDSLNWVDQMKV

SEQ ID NO: 2048933 - protein, 32 aa, Staphylococcus
VDVSCFKCKGEGCNVCKHTGWIEILGAGMVHP

SEQ ID NO: 2048934 - protein, 20 aa, Staphylococcus
VEACGICAGDIKAYGGAPSF

SEQ ID NO: 2048935 - protein, 23 aa, Staphylococcus
VEGFRPVMEIQFLGFVFEVFDEV

SEQ ID NO: 2048936 - protein, 23 aa, Staphylococcus
VETALKAARRWAYDVKGIEPNQA

SEQ ID NO: 2048937 - protein, 19 aa, Staphylococcus
VFISWTGKMAETFVLAHEL

SEQ ID NO: 2048938 - protein, 17 aa, Staphylococcus
VGDRKVLCAMSGGVDSS

SEQ ID NO: 2048939 - protein, 17 aa, Staphylococcus
VGIAISDLMGWTAQGLD

SEQ ID NO: 2048940 - protein, 22 aa, Staphylococcus
VGLIPRFRRIFLGDKEFNKKRY

SEQ ID NO: 2048941 - protein, 20 aa, Staphylococcus
VGLIPRFSRIFLGDKEFNKK

SEQ ID NO: 2048942 - protein, 18 aa, Staphylococcus
VIEKLDYLKDLGIDVIWL

SEQ ID NO: 2048943 - protein, 25 aa, Staphylococcus
VKDNKIEMVLSWKLNRISRSMRDVF

SEQ ID NO: 2048944 - protein, 21 aa, Staphylococcus
VKMYVCGPTVYNYIHIGNARP

SEQ ID NO: 2048945 - protein, 23 aa, Staphylococcus
VKNFRVTKIFGYFGLKREEIEEA

SEQ ID NO: 2048946 - protein, 19 aa, Staphylococcus
VLNTFTFRITRNADLTIHE

SEQ ID NO: 2048947 - protein, 19 aa, Staphylococcus
VLRFKRRFGDDVAVLHSGL

SEQ ID NO: 2048948 - protein, 22 aa, Staphylococcus
VRMAQDFSYRYPLVDGQGNFGS

SEQ ID NO: 2048949 - protein, 25 aa, Staphylococcus
VRMEKRYKGPIAFEYTHINNNKERV

SEQ ID NO: 2048950 - protein, 20 aa, Staphylococcus
VSCFKCKGKGCNVCKHTGWI

SEQ ID NO: 2048951 - protein, 18 aa, Staphylococcus
VVAWNFPILLASWKLGPA

SEQ ID NO: 2048952 - protein, 22 aa, Staphylococcus
VVEGPLWIQVHAFEKGVEVTIS

SEQ ID NO: 2048953 - protein, 17 aa, Staphylococcus
VVEKIKVARSFGDLSEN

SEQ ID NO: 2048954 - protein, 18 aa, Staphylococcus
VVEKIKVARSFGDLSENS

SEQ ID NO: 2048955 - protein, 17 aa, Staphylococcus
VYLGMPMGVVIEAEGKT

SEQ ID NO: 2048956 - protein, 18 aa, Staphylococcus
WFNVICMFREDGIYYYCN

SEQ ID NO: 2048957 - protein, 18 aa, Staphylococcus
WGGATFDVAYNFLKENPW

SEQ ID NO: 2048958 - protein, 18 aa, Staphylococcus
WGKIPMSLGFTYSSNTLM

SEQ ID NO: 2048959 - protein, 25 aa, Staphylococcus
WLEDYLKYFKGAIIIISHDRYFLDK

SEQ ID NO: 2048960 - protein, 27 aa, Staphylococcus
WNKTGWGEIPMSLGFTYSSNTLMMHLQ

SEQ ID NO: 2048961 - protein, 17 aa, Staphylococcus
WSTAMSNEIPWYVHEVP

SEQ ID NO: 2048962 - protein, 18 aa, Staphylococcus
YDIAGLRMMCQFVDDIDV

SEQ ID NO: 2048963 - protein, 17 aa, Staphylococcus
YDLFVLVVTDIINSDSK

SEQ ID NO: 2048964 - protein, 18 aa, Staphylococcus
YEALVKIFYRYGEEKFSK

SEQ ID NO: 2048965 - protein, 19 aa, Staphylococcus
YGVGRRISLHYTRQMVNQA

SEQ ID NO: 2048966 - protein, 17 aa, Staphylococcus
YHPTWKMILGLFPKEDK

SEQ ID NO: 2048967 - protein, 18 aa, Staphylococcus
YHPTWKMVLGLFPKEDKI

SEQ ID NO: 2048968 - protein, 18 aa, Staphylococcus
YIMNLPVNFLKTFLPELI

SEQ ID NO: 2048969 - protein, 17 aa, Staphylococcus
YKGEPKLGFKEMEEIGA

SEQ ID NO: 2048970 - protein, 22 aa, Staphylococcus
YLKREDLQWVRSFKLRGAYNAI

SEQ ID NO: 2048971 - protein, 18 aa, Staphylococcus
YMRIAIELHLKRLIVGGL

SEQ ID NO: 2048972 - protein, 17 aa, Staphylococcus
YNPLFIYGGVGLGKTHL

SEQ ID NO: 2048973 - protein, 17 aa, Staphylococcus
YPFGGGQGMVLKPEPVF

SEQ ID NO: 2048974 - protein, 19 aa, Staphylococcus
YPFGGGQGMVLKPEPVFNA

SEQ ID NO: 2048975 - protein, 17 aa, Staphylococcus
YPNRVDLGLGRAPGTDM

SEQ ID NO: 2048976 - protein, 26 aa, Staphylococcus
YQDCLLFFRLGDFYEMFFEDAKEASR

SEQ ID NO: 2048977 - protein, 18 aa, Staphylococcus
YQLSLAIGKRGQNARLAA

SEQ ID NO: 2048978 - protein, 18 aa, Staphylococcus
YRCSWCDSAFTWDGSAKE

SEQ ID NO: 2048979 - protein, 27 aa, Staphylococcus
YRDEKRPRFGLLRGREFIMKDAYSFHA

SEQ ID NO: 2048980 - protein, 21 aa, Staphylococcus
YTTRLGIRLEKTFEYIDTPHK

SEQ ID NO: 2048981 - protein, 23 aa, Staphylococcus
YTTRLGIRLEKTFEYIDTPHKFK

SEQ ID NO: 2048982 - protein, 19 aa, Staphylococcus
YVLRRLLRRAVRFSQSLDI

SEQ ID NO: 2048983 - protein, 19 aa, Staphylococcus
YVLRRLLRRAVRFSQSLGI

SEQ ID NO: 2048984 - protein, 19 aa, Staphylococcus
YVLRRLLRRAVRFSQTLDI

SEQ ID NO: 2048985 - protein, 18 aa, Staphylococcus
YVPYCIEPSLGADRVTLA

SEQ ID NO: 2048986 - protein, 20 aa, Staphylococcus
YWFNVICMFREDGIYYYCNL

SEQ ID NO: 2048987 - protein, 17 aa, Staphylococcus
YYYCNLSSPFVCDDEAL

SEQ ID NO: 2048988 - protein, 17 aa, Staphylococcus
AAAELGYQPILIEDATA

SEQ ID NO: 2048989 - protein, 20 aa, Staphylococcus
AAALERARFTSVSINQQSIG

SEQ ID NO: 2048990 - protein, 19 aa, Staphylococcus
AADMKSGLAALVIAMIEIK

SEQ ID NO: 2048991 - protein, 23 aa, Staphylococcus
AADMKSGLAALVLSLIDIHDQGL

SEQ ID NO: 2048992 - protein, 18 aa, Staphylococcus
AAELQGRIRAERFIHLVQ

SEQ ID NO: 2048993 - protein, 21 aa, Staphylococcus
AAFKRFTMIGPLTFQIRDQKE

SEQ ID NO: 2048994 - protein, 19 aa, Staphylococcus
AAFQGDWRTLLDFCGSNIV

SEQ ID NO: 2048995 - protein, 17 aa, Staphylococcus
AAGLARPAAVTVVEQND

SEQ ID NO: 2048996 - protein, 19 aa, Staphylococcus
AAGRLEYEKGFDLLLQSVE

SEQ ID NO: 2048997 - protein, 21 aa, Staphylococcus
AAIDFPRAHWVFPIQTHENKV

SEQ ID NO: 2048998 - protein, 17 aa, Staphylococcus
AAIEIAVDMVNEGLITR

SEQ ID NO: 2048999 - protein, 22 aa, Staphylococcus
AAIFAGDLFRMYSKYAETLNYK

SEQ ID NO: 2049000 - protein, 23 aa, Staphylococcus
AAIFAGDLMRMYSKYAEAHNFKT

SEQ ID NO: 2049001 - protein, 22 aa, Staphylococcus
AAIFAGDLMRMYSKYAEAYGFK

SEQ ID NO: 2049002 - protein, 18 aa, Staphylococcus
AAIFAGDLMRMYTKYAEA

SEQ ID NO: 2049003 - protein, 25 aa, Staphylococcus
AAIFAGDLYRMYTRFSEGLGYKTGV

SEQ ID NO: 2049004 - protein, 24 aa, Staphylococcus
AAIKLDVFRNFYLIKHKDKYLDVN

SEQ ID NO: 2049005 - protein, 20 aa, Staphylococcus
AAKFKNLCVVGDSDQSIYGW

SEQ ID NO: 2049006 - protein, 17 aa, Staphylococcus
AALGSWRLEGCTLYVTL

SEQ ID NO: 2049007 - protein, 18 aa, Staphylococcus
AALLSGKIDPRWVKDKNV

SEQ ID NO: 2049008 - protein, 20 aa, Staphylococcus
AAMKRTLMRMAHEILEYNRG

SEQ ID NO: 2049009 - protein, 21 aa, Staphylococcus
AAPNLKIIANMAVGFDNIDID

SEQ ID NO: 2049010 - protein, 17 aa, Staphylococcus
AAQGGIMRLFFNEKTPY

SEQ ID NO: 2049011 - protein, 19 aa, Staphylococcus
AAQILKYFAIEKVNLLSNN

SEQ ID NO: 2049012 - protein, 18 aa, Staphylococcus
AAVEFGKMDFNTHLDLKA

SEQ ID NO: 2049013 - protein, 18 aa, Staphylococcus
ACERAGVYGLIIPDLPFE

SEQ ID NO: 2049014 - protein, 19 aa, Staphylococcus
ACGIPGSIGGAVFMNAGAY

SEQ ID NO: 2049015 - protein, 18 aa, Staphylococcus
ACGTWRLVYTRIVALENA

SEQ ID NO: 2049016 - protein, 19 aa, Staphylococcus
ACKAVDCTILRIGMLPMNY

SEQ ID NO: 2049017 - protein, 17 aa, Staphylococcus
ACLDAAVHRSIALSKSE

SEQ ID NO: 2049018 - protein, 20 aa, Staphylococcus
ACLLTAVPVMKFFKYFYTNR

SEQ ID NO: 2049019 - protein, 20 aa, Staphylococcus
ACLLTAVPVMKIFKYFYSNR

SEQ ID NO: 2049020 - protein, 17 aa, Staphylococcus
ACNEVQCGWAASHSLEG

SEQ ID NO: 2049021 - protein, 18 aa, Staphylococcus
ACPNCGGKGYIKTELAFM

SEQ ID NO: 2049022 - protein, 20 aa, Staphylococcus
ADADIPIWYDRHMPYQMEGG

SEQ ID NO: 2049023 - protein, 23 aa, Staphylococcus
ADEAYPSIIRRGGGYRGIDIDAF

SEQ ID NO: 2049024 - protein, 23 aa, Staphylococcus
ADETLRFADSWLVTTKFKLPKWM

SEQ ID NO: 2049025 - protein, 17 aa, Staphylococcus
ADFKKARSFKVPFKAIG

SEQ ID NO: 2049026 - protein, 18 aa, Staphylococcus
ADIARLWVSSVDYLADVR

SEQ ID NO: 2049027 - protein, 18 aa, Staphylococcus
ADIARLWVSSVDYLSDVR

SEQ ID NO: 2049028 - protein, 19 aa, Staphylococcus
ADIIKVFPVSSMGPSYIKD

SEQ ID NO: 2049029 - protein, 21 aa, Staphylococcus
ADIIPMCHQLPLTGIDVTFDW

SEQ ID NO: 2049030 - protein, 17 aa, Staphylococcus
ADIVASMSYFFNLLHGI

SEQ ID NO: 2049031 - protein, 18 aa, Staphylococcus
ADIYRPAAIDQLETVGKQ

SEQ ID NO: 2049032 - protein, 19 aa, Staphylococcus
ADLIKRIDTHLAIDFMDVS

SEQ ID NO: 2049033 - protein, 21 aa, Staphylococcus
ADLKPPFFIQWSKSEEEREEA

SEQ ID NO: 2049034 - protein, 17 aa, Staphylococcus
ADLKVYMIASVEERAVR

SEQ ID NO: 2049035 - protein, 18 aa, Staphylococcus
ADLLSGVVSFHFNNNDVK

SEQ ID NO: 2049036 - protein, 19 aa, Staphylococcus
ADLSPGTRIHFIEVPNYTA

SEQ ID NO: 2049037 - protein, 19 aa, Staphylococcus
ADSKIEIILGAILVQNTNW

SEQ ID NO: 2049038 - protein, 17 aa, Staphylococcus
ADSLKRIDISPLGAAAL

SEQ ID NO: 2049039 - protein, 23 aa, Staphylococcus
ADVGCGYGPIGLMIAKVSPHHQI

SEQ ID NO: 2049040 - protein, 19 aa, Staphylococcus
ADVNWNLGIIWKKESYINY

SEQ ID NO: 2049041 - protein, 17 aa, Staphylococcus
ADVSFKWFPGFSKEQKQ

SEQ ID NO: 2049042 - protein, 18 aa, Staphylococcus
ADVYDFWRPTGYKYPLVA

SEQ ID NO: 2049043 - protein, 18 aa, Staphylococcus
ADYFRYEVPYSFEEARAG

SEQ ID NO: 2049044 - protein, 17 aa, Staphylococcus
ADYGEIFGRMISAQMRN

SEQ ID NO: 2049045 - protein, 19 aa, Staphylococcus
AEACLKLGATMINDQWAGL

SEQ ID NO: 2049046 - protein, 22 aa, Staphylococcus
AEACLKLGATMINDQWAGLYDP

SEQ ID NO: 2049047 - protein, 17 aa, Staphylococcus
AEAFPKLTLNAWSLSDL

SEQ ID NO: 2049048 - protein, 18 aa, Staphylococcus
AEAIRYISGYGFSQQLIT

SEQ ID NO: 2049049 - protein, 25 aa, Staphylococcus
AEDFKWEVVDAFQLTGFDAFYQELE

SEQ ID NO: 2049050 - protein, 19 aa, Staphylococcus
AEEGITFLISSHILSELVK

SEQ ID NO: 2049051 - protein, 21 aa, Staphylococcus
AEEYQCPVIVLSDLQLSLGKQ

SEQ ID NO: 2049052 - protein, 17 aa, Staphylococcus
AEFDFTFIYNVIDETQV

SEQ ID NO: 2049053 - protein, 23 aa, Staphylococcus
AEGYRPVMEIQFLGFVFEVFDSV

SEQ ID NO: 2049054 - protein, 17 aa, Staphylococcus
AEHLGHSITELFPTEVP

SEQ ID NO: 2049055 - protein, 17 aa, Staphylococcus
AEIAGRMRFFFPDVQVR

SEQ ID NO: 2049056 - protein, 18 aa, Staphylococcus
AEIIKKLFLLGIVANINQ

SEQ ID NO: 2049057 - protein, 17 aa, Staphylococcus
AEILEWFDAIGRRRGLL

SEQ ID NO: 2049058 - protein, 21 aa, Staphylococcus
AEIWPDLNFPSSEIAFVVLHF

SEQ ID NO: 2049059 - protein, 19 aa, Staphylococcus
AELFDGMGVNLYFSRNSFN

SEQ ID NO: 2049060 - protein, 18 aa, Staphylococcus
AELIREFLDKVIPHLDKD

SEQ ID NO: 2049061 - protein, 17 aa, Staphylococcus
AELKIYMIASVEERAER

SEQ ID NO: 2049062 - protein, 21 aa, Staphylococcus
AELKLSATVIMTSHEFHHHNH

SEQ ID NO: 2049063 - protein, 17 aa, Staphylococcus
AELKVYMIASVEERAER

SEQ ID NO: 2049064 - protein, 23 aa, Staphylococcus
AELMLRVAAIIRRRKEEISAVMV

SEQ ID NO: 2049065 - protein, 24 aa, Staphylococcus
AELMLRVAAIIRRRKEEISAVMVY

SEQ ID NO: 2049066 - protein, 20 aa, Staphylococcus
AELYEFLGLSVGLNLNSKTT

SEQ ID NO: 2049067 - protein, 17 aa, Staphylococcus
AEMELRILSKIKETLEE

SEQ ID NO: 2049068 - protein, 20 aa, Staphylococcus
AENWLRTTLKAINRELYEMS

SEQ ID NO: 2049069 - protein, 17 aa, Staphylococcus
AESFGAKGLRVTNQEEL

SEQ ID NO: 2049070 - protein, 25 aa, Staphylococcus
AESKKRFEEMLGWFKYEIRQYTESD

SEQ ID NO: 2049071 - protein, 20 aa, Staphylococcus
AESMSICWAMGVTQQDIGSD

SEQ ID NO: 2049072 - protein, 17 aa, Staphylococcus
AESRLQTNLIHRVDEAV

SEQ ID NO: 2049073 - protein, 21 aa, Staphylococcus
AESWLRSNIKDINFHLYNYAQ

SEQ ID NO: 2049074 - protein, 25 aa, Staphylococcus
AETARQCALVWGIFPVVKEGRKTTD

SEQ ID NO: 2049075 - protein, 22 aa, Staphylococcus
AETKRLTGWYSKRVAVGEDGEI

SEQ ID NO: 2049076 - protein, 21 aa, Staphylococcus
AETKRLTGWYSKRVAVGENGE

SEQ ID NO: 2049077 - protein, 19 aa, Staphylococcus
AETVAICWAMGITQQDIGS

SEQ ID NO: 2049078 - protein, 17 aa, Staphylococcus
AETYPAVFIVELDQDKH

SEQ ID NO: 2049079 - protein, 17 aa, Staphylococcus
AEVDIMYGQGISKEGEV

SEQ ID NO: 2049080 - protein, 18 aa, Staphylococcus
AEVLKYIRHVDLSNLHLR

SEQ ID NO: 2049081 - protein, 22 aa, Staphylococcus
AEWLMLDLFEWSRTDYLMHMYD

SEQ ID NO: 2049082 - protein, 22 aa, Staphylococcus
AEWLMLDLFHWTRTDYLMHMYD

SEQ ID NO: 2049083 - protein, 22 aa, Staphylococcus
AFAARSQYALGIDFKEAPPWFQ

SEQ ID NO: 2049084 - protein, 22 aa, Staphylococcus
AFAICLKNMLGLVCDPVAGLVE

SEQ ID NO: 2049085 - protein, 22 aa, Staphylococcus
AFAICMKNMLGLVCDPVAGLVE

SEQ ID NO: 2049086 - protein, 18 aa, Staphylococcus
AFCVLNHLFVNEGNEEAF

SEQ ID NO: 2049087 - protein, 18 aa, Staphylococcus
AFDGRGNYTLGIKEQLIF

SEQ ID NO: 2049088 - protein, 22 aa, Staphylococcus
AFGEALGAIIVRSKKLNEGEAI

SEQ ID NO: 2049089 - protein, 17 aa, Staphylococcus
AFINRFIMDLEHMLMNY

SEQ ID NO: 2049090 - protein, 18 aa, Staphylococcus
AFIRKFTKNWLKKPNAKL

SEQ ID NO: 2049091 - protein, 18 aa, Staphylococcus
AFITRPAIIFADEPTGAL

SEQ ID NO: 2049092 - protein, 18 aa, Staphylococcus
AFNGMSFLNLVDFDALYG

SEQ ID NO: 2049093 - protein, 18 aa, Staphylococcus
AFQKWGFIDWKQGNYSYK

SEQ ID NO: 2049094 - protein, 18 aa, Staphylococcus
AFSGEFFLTGDLAKIDED

SEQ ID NO: 2049095 - protein, 17 aa, Staphylococcus
AFYALPLLTNRAGIHTN

SEQ ID NO: 2049096 - protein, 17 aa, Staphylococcus
AFYLWEAIHQDLLQYDS

SEQ ID NO: 2049097 - protein, 24 aa, Staphylococcus
AGAHGEWTALMIFKAYHENNGQGH

SEQ ID NO: 2049098 - protein, 24 aa, Staphylococcus
AGAHGEWTALMIFKAYHQNNGEGH

SEQ ID NO: 2049099 - protein, 23 aa, Staphylococcus
AGAIGLKVHEDWGATPSALDHAL

SEQ ID NO: 2049100 - protein, 23 aa, Staphylococcus
AGAIGLKVHEDWGATPSALRHAL

SEQ ID NO: 2049101 - protein, 23 aa, Staphylococcus
AGAIGLKVHEDWGATPSALSHAL

SEQ ID NO: 2049102 - protein, 17 aa, Staphylococcus
AGAILKKDLDAFSKKMD

SEQ ID NO: 2049103 - protein, 17 aa, Staphylococcus
AGDFPLVIRTRRDGDKF

SEQ ID NO: 2049104 - protein, 19 aa, Staphylococcus
AGFSMCYFEHGVRFGHQHY

SEQ ID NO: 2049105 - protein, 20 aa, Staphylococcus
AGGCFWCMTKPFDQFDGIET

SEQ ID NO: 2049106 - protein, 20 aa, Staphylococcus
AGGCFWCMTKPFDQFEGIES

SEQ ID NO: 2049107 - protein, 21 aa, Staphylococcus
AGGCFWCMTKPFDSYDGIEKV

SEQ ID NO: 2049108 - protein, 21 aa, Staphylococcus
AGGCFWCMTKPFDTFDGIEKV

SEQ ID NO: 2049109 - protein, 20 aa, Staphylococcus
AGGCFWCMTKPFDTFDGIEQ

SEQ ID NO: 2049110 - protein, 20 aa, Staphylococcus
AGGCFWCMTKPFDTFEGIEK

SEQ ID NO: 2049111 - protein, 19 aa, Staphylococcus
AGGVARPAASHALHYDKLP

SEQ ID NO: 2049112 - protein, 22 aa, Staphylococcus
AGGVLPYLEWRIDETLKTEQYI

SEQ ID NO: 2049113 - protein, 19 aa, Staphylococcus
AGICFKTDVEVGVDISKTT

SEQ ID NO: 2049114 - protein, 17 aa, Staphylococcus
AGIKAIIQPGGSIKDQD

SEQ ID NO: 2049115 - protein, 23 aa, Staphylococcus
AGKDLSCSVVRTWIHQHTVILGT

SEQ ID NO: 2049116 - protein, 17 aa, Staphylococcus
AGNALAFAHGFNIHFDV

SEQ ID NO: 2049117 - protein, 20 aa, Staphylococcus
AGNISAYWKGFKEYSDKNGT

SEQ ID NO: 2049118 - protein, 20 aa, Staphylococcus
AGNITAYWKGFKEFNDKHGT

SEQ ID NO: 2049119 - protein, 20 aa, Staphylococcus
AGNITAYWKGFKEYNEKKGS

SEQ ID NO: 2049120 - protein, 20 aa, Staphylococcus
AGQERLKLIHQWVDGRIPVI

SEQ ID NO: 2049121 - protein, 17 aa, Staphylococcus
AGRLEYEKGFDLLLESI

SEQ ID NO: 2049122 - protein, 19 aa, Staphylococcus
AGRRSMLMGAYYLEAQHQG

SEQ ID NO: 2049123 - protein, 20 aa, Staphylococcus
AGSFLAKFLFDKGAKIVGIS

SEQ ID NO: 2049124 - protein, 27 aa, Staphylococcus
AGTLNRLTSIFVRRQFNIVTLSATPTL

SEQ ID NO: 2049125 - protein, 20 aa, Staphylococcus
AGVHKLPFVCVIINNKYAIS

SEQ ID NO: 2049126 - protein, 21 aa, Staphylococcus
AGVVKEYPIIPGIDLAGTVVE

SEQ ID NO: 2049127 - protein, 20 aa, Staphylococcus
AGYKAGIEYLNFDEQPATIL

SEQ ID NO: 2049128 - protein, 18 aa, Staphylococcus
AGYSACFNNALMHILKSD

SEQ ID NO: 2049129 - protein, 19 aa, Staphylococcus
AGYSACFNSALSLILSQNK

SEQ ID NO: 2049130 - protein, 19 aa, Staphylococcus
AGYSACFNSALSLILSRHK

SEQ ID NO: 2049131 - protein, 17 aa, Staphylococcus
AHAAAYVLMAMRIAYFK

SEQ ID NO: 2049132 - protein, 17 aa, Staphylococcus
AHCLSEWGYDFRPHYAL

SEQ ID NO: 2049133 - protein, 19 aa, Staphylococcus
AHCLSEWGYDFRPHYALIG

SEQ ID NO: 2049134 - protein, 22 aa, Staphylococcus
AHFCSMCGPKFCSMRISHDLRQ

SEQ ID NO: 2049135 - protein, 19 aa, Staphylococcus
AHIMIWEGIEILPVTQNKR

SEQ ID NO: 2049136 - protein, 19 aa, Staphylococcus
AHIMIWEGIEILPVTTRNK

SEQ ID NO: 2049137 - protein, 23 aa, Staphylococcus
AHKTRPSIKFDIYGEGAEKNNLQ

SEQ ID NO: 2049138 - protein, 17 aa, Staphylococcus
AHLKTLIDFGADAFVIG

SEQ ID NO: 2049139 - protein, 20 aa, Staphylococcus
AHLLIWEGIELLPVTDNNKK

SEQ ID NO: 2049140 - protein, 19 aa, Staphylococcus
AHMMIWEGIEILPVTTTNK

SEQ ID NO: 2049141 - protein, 20 aa, Staphylococcus
AHMMIWEGIELLPVTTPSKK

SEQ ID NO: 2049142 - protein, 17 aa, Staphylococcus
AHTVVWNGPMGVFEFSN

SEQ ID NO: 2049143 - protein, 18 aa, Staphylococcus
AHVQRGIVFLIMRFKVLD

SEQ ID NO: 2049144 - protein, 23 aa, Staphylococcus
AIAEMKLAVGLLVEKKLSHMRIH

SEQ ID NO: 2049145 - protein, 26 aa, Staphylococcus
AIALLFAILKVRSAPFVILDEVEAAL

SEQ ID NO: 2049146 - protein, 19 aa, Staphylococcus
AIDEIPIVALLCTQANGTS

SEQ ID NO: 2049147 - protein, 21 aa, Staphylococcus
AIELAEQMGIIFIDEIDKVAT

SEQ ID NO: 2049148 - protein, 22 aa, Staphylococcus
AIELAEQMGIIFIDEIDKVATN

SEQ ID NO: 2049149 - protein, 17 aa, Staphylococcus
AIFCSGGPMKAGLSAQG

SEQ ID NO: 2049150 - protein, 18 aa, Staphylococcus
AIFCSGGPMKAGLSAQGK

SEQ ID NO: 2049151 - protein, 17 aa, Staphylococcus
AIFCSGGPMKAGLSSEG

SEQ ID NO: 2049152 - protein, 17 aa, Staphylococcus
AIFPYNIPTTFTDLLKE

SEQ ID NO: 2049153 - protein, 17 aa, Staphylococcus
AIGAIGIARAFQFSGHF

SEQ ID NO: 2049154 - protein, 18 aa, Staphylococcus
AIHACKSYDVKRLIVAGG

SEQ ID NO: 2049155 - protein, 21 aa, Staphylococcus
AIHRLKGKFSFDVPSEQAETL

SEQ ID NO: 2049156 - protein, 17 aa, Staphylococcus
AIIKLLYSYGVRNMIMC

SEQ ID NO: 2049157 - protein, 24 aa, Staphylococcus
AIKFPSFRPDSWRGKRYLYSGLFD

SEQ ID NO: 2049158 - protein, 20 aa, Staphylococcus
AIKKEGYKLITPVVITNSEN

SEQ ID NO: 2049159 - protein, 19 aa, Staphylococcus
AILEFSNYVAAIVTTQYGA

SEQ ID NO: 2049160 - protein, 18 aa, Staphylococcus
AILLKFFLCLDKDEQLKR

SEQ ID NO: 2049161 - protein, 19 aa, Staphylococcus
AILNWMAEGAYMWMQEGLA

SEQ ID NO: 2049162 - protein, 18 aa, Staphylococcus
AIMGRYILTPEIFDYLET

SEQ ID NO: 2049163 - protein, 18 aa, Staphylococcus
AIMGRYILTPEIFDYLKT

SEQ ID NO: 2049164 - protein, 18 aa, Staphylococcus
AIMGRYVLSPQIFNYLEN

SEQ ID NO: 2049165 - protein, 18 aa, Staphylococcus
AIMGRYVLTANIFDYLKT

SEQ ID NO: 2049166 - protein, 19 aa, Staphylococcus
AINRFDINFGRKFEAFLVP

SEQ ID NO: 2049167 - protein, 19 aa, Staphylococcus
AINVPRLLTNVSEQTWQGI

SEQ ID NO: 2049168 - protein, 22 aa, Staphylococcus
AIPRFPKKIAILTADTGAAIRD

SEQ ID NO: 2049169 - protein, 22 aa, Staphylococcus
AIQEWYRVLPLINELPIKDLDK

SEQ ID NO: 2049170 - protein, 20 aa, Staphylococcus
AIQGFIYRKARTHHLSTPSL

SEQ ID NO: 2049171 - protein, 27 aa, Staphylococcus
AIQTVIKYRVPVCCFTFGIPSKEIIEQ

SEQ ID NO: 2049172 - protein, 20 aa, Staphylococcus
AISQGFSGLEIDVFDFHSNK

SEQ ID NO: 2049173 - protein, 19 aa, Staphylococcus
AIYKRDYLCILGETVKEKL

SEQ ID NO: 2049174 - protein, 17 aa, Staphylococcus
AIYRECAQRCFNFFERV

SEQ ID NO: 2049175 - protein, 20 aa, Staphylococcus
AKADDGAACVAYIGPNGAGH

SEQ ID NO: 2049176 - protein, 22 aa, Staphylococcus
AKAEGYPAIFVHCYTEFFNHIG

SEQ ID NO: 2049177 - protein, 22 aa, Staphylococcus
AKAESVSICWAMGITQQDIGSD

SEQ ID NO: 2049178 - protein, 18 aa, Staphylococcus
AKAFAKEAGFPLMIKATS

SEQ ID NO: 2049179 - protein, 19 aa, Staphylococcus
AKAKDGAACVEYIGPNGAG

SEQ ID NO: 2049180 - protein, 19 aa, Staphylococcus
AKAKDGASCVEYIGPNGAG

SEQ ID NO: 2049181 - protein, 20 aa, Staphylococcus
AKAKDGASCVTYIGPNGAGH

SEQ ID NO: 2049182 - protein, 21 aa, Staphylococcus
AKAKLRPLIRFNTSQNDTSSA

SEQ ID NO: 2049183 - protein, 19 aa, Staphylococcus
AKASGAMALFGEKYGDVVR

SEQ ID NO: 2049184 - protein, 18 aa, Staphylococcus
AKATLSFRTMQLIGKPYH

SEQ ID NO: 2049185 - protein, 17 aa, Staphylococcus
AKECDFFSFGTNDLTQL

SEQ ID NO: 2049186 - protein, 20 aa, Staphylococcus
AKELPSAFIFAGAEPEEGDV

SEQ ID NO: 2049187 - protein, 19 aa, Staphylococcus
AKETYKFAGGKGINVSRVL

SEQ ID NO: 2049188 - protein, 18 aa, Staphylococcus
AKEVLGHTVLDTWWMTET

SEQ ID NO: 2049189 - protein, 18 aa, Staphylococcus
AKFFKLMLNQGINLAPSK

SEQ ID NO: 2049190 - protein, 17 aa, Staphylococcus
AKFMLNTIWGRWGMFEK

SEQ ID NO: 2049191 - protein, 23 aa, Staphylococcus
AKGIKRLILIAAPGIYDELPEAF

SEQ ID NO: 2049192 - protein, 22 aa, Staphylococcus
AKGLKLYDVFTVLYLLDPESYE

SEQ ID NO: 2049193 - protein, 24 aa, Staphylococcus
AKKAFKMAIDYAFLVLNMNKVYLY

SEQ ID NO: 2049194 - protein, 23 aa, Staphylococcus
AKKAFKMAVDYAFLVLNMHKVYL

SEQ ID NO: 2049195 - protein, 17 aa, Staphylococcus
AKKCKKVIVASSISIYA

SEQ ID NO: 2049196 - protein, 20 aa, Staphylococcus
AKKGFLLDGFPRTLEQAEAL

SEQ ID NO: 2049197 - protein, 20 aa, Staphylococcus
AKKGLPFVIAHMGQSHANLT

SEQ ID NO: 2049198 - protein, 17 aa, Staphylococcus
AKLHPAICFTILGHHLG

SEQ ID NO: 2049199 - protein, 21 aa, Staphylococcus
AKLKVLYEMFGLKMVDNELSD

SEQ ID NO: 2049200 - protein, 22 aa, Staphylococcus
AKLLKRFIALNAFDNVEAHGNG

SEQ ID NO: 2049201 - protein, 21 aa, Staphylococcus
AKLNMGYRFPTRFGSNDYYAL

SEQ ID NO: 2049202 - protein, 19 aa, Staphylococcus
AKLSRLSEELLRDINKDTV

SEQ ID NO: 2049203 - protein, 19 aa, Staphylococcus
AKMGTSCIIKSDFKRDTIY

SEQ ID NO: 2049204 - protein, 19 aa, Staphylococcus
AKNSFKFIYSILSKHQSAS

SEQ ID NO: 2049205 - protein, 28 aa, Staphylococcus
AKPEGMDSWDYAHCLPYFKRLEKTFGAT

SEQ ID NO: 2049206 - protein, 19 aa, Staphylococcus
AKPGEISWDSPFGKGRPGW

SEQ ID NO: 2049207 - protein, 18 aa, Staphylococcus
AKPGEISWSSPFGEGRPG

SEQ ID NO: 2049208 - protein, 21 aa, Staphylococcus
AKPGGAFYIFPSIKNYTEDDF

SEQ ID NO: 2049209 - protein, 18 aa, Staphylococcus
AKQIFQWLYEKRVDSIDE

SEQ ID NO: 2049210 - protein, 22 aa, Staphylococcus
AKQKRLDIERVFKQSMLNDDLL

SEQ ID NO: 2049211 - protein, 22 aa, Staphylococcus
AKQLKLKAVIFMPVTTPLQKIN

SEQ ID NO: 2049212 - protein, 17 aa, Staphylococcus
AKQSLVFLGDPQAFDIG

SEQ ID NO: 2049213 - protein, 17 aa, Staphylococcus
AKQSLVFLGDSQAFDIG

SEQ ID NO: 2049214 - protein, 17 aa, Staphylococcus
AKQSLVLLGDPKAFDIA

SEQ ID NO: 2049215 - protein, 18 aa, Staphylococcus
AKRFKRWVTSKVLPAIRK

SEQ ID NO: 2049216 - protein, 23 aa, Staphylococcus
AKRKANELIELVGLKGRENAYPS

SEQ ID NO: 2049217 - protein, 20 aa, Staphylococcus
AKRKGLEPFAQWLQQTNIDT

SEQ ID NO: 2049218 - protein, 17 aa, Staphylococcus
AKSEFWLQLQADVFNTT

SEQ ID NO: 2049219 - protein, 20 aa, Staphylococcus
AKSFSIRGGDKMAIIGSNGT

SEQ ID NO: 2049220 - protein, 20 aa, Staphylococcus
AKSLGCQFAFYGHTHVAKHE

SEQ ID NO: 2049221 - protein, 19 aa, Staphylococcus
AKSRRKTLEKIQRIDKPMI

SEQ ID NO: 2049222 - protein, 18 aa, Staphylococcus
AKVEEMLEFVGLADKMHQ

SEQ ID NO: 2049223 - protein, 21 aa, Staphylococcus
AKVIGSWRLEDCTLYVTLEPC

SEQ ID NO: 2049224 - protein, 20 aa, Staphylococcus
AKVLGSWRLEDCTLYVTLEP

SEQ ID NO: 2049225 - protein, 18 aa, Staphylococcus
AKYRGEFEERLKAVLKEI

SEQ ID NO: 2049226 - protein, 17 aa, Staphylococcus
ALAKGRGAKVWDIEDNC

SEQ ID NO: 2049227 - protein, 22 aa, Staphylococcus
ALELAEQMGIIFIDEIDKVASN

SEQ ID NO: 2049228 - protein, 22 aa, Staphylococcus
ALELAEQMGIIFIDEIDKVATN

SEQ ID NO: 2049229 - protein, 22 aa, Staphylococcus
ALEYRLPIYNSFGMTETCSQFL

SEQ ID NO: 2049230 - protein, 17 aa, Staphylococcus
ALFAAAFITHFSGQTPH

SEQ ID NO: 2049231 - protein, 17 aa, Staphylococcus
ALFAASFISHFSGSVPH

SEQ ID NO: 2049232 - protein, 17 aa, Staphylococcus
ALFAATFINHFAGETPH

SEQ ID NO: 2049233 - protein, 19 aa, Staphylococcus
ALFKECFKALINKQETNLA

SEQ ID NO: 2049234 - protein, 23 aa, Staphylococcus
ALGFAGGFPGDFIAQTLKDSDIH

SEQ ID NO: 2049235 - protein, 23 aa, Staphylococcus
ALGFAGGFPGEFISSILEQSDIN

SEQ ID NO: 2049236 - protein, 17 aa, Staphylococcus
ALHKLGFDEGMYELIKE

SEQ ID NO: 2049237 - protein, 18 aa, Staphylococcus
ALIEKCWESENFIDDNTL

SEQ ID NO: 2049238 - protein, 18 aa, Staphylococcus
ALKAYPMLNSSWNGSEII

SEQ ID NO: 2049239 - protein, 22 aa, Staphylococcus
ALKEEGYDYFGLLYIGAILTKE

SEQ ID NO: 2049240 - protein, 19 aa, Staphylococcus
ALKGKINWVKTLPETSYSK

SEQ ID NO: 2049241 - protein, 24 aa, Staphylococcus
ALKICNYCFDHGLVLIAVAGNVLR

SEQ ID NO: 2049242 - protein, 19 aa, Staphylococcus
ALKITLKRVHFINELETLA

SEQ ID NO: 2049243 - protein, 23 aa, Staphylococcus
ALKQIKRALGWVNLDSEEILGKY

SEQ ID NO: 2049244 - protein, 25 aa, Staphylococcus
ALKRARTNLEFGLSGITARDPLDPN

SEQ ID NO: 2049245 - protein, 17 aa, Staphylococcus
ALKTGYVKVNFHNGNEY

SEQ ID NO: 2049246 - protein, 19 aa, Staphylococcus
ALKVLKARLFDMKLQEEQQ

SEQ ID NO: 2049247 - protein, 19 aa, Staphylococcus
ALKVLKARVYDMKLQEEQE

SEQ ID NO: 2049248 - protein, 23 aa, Staphylococcus
ALLRYGGGISYQLIATGSIYISL

SEQ ID NO: 2049249 - protein, 18 aa, Staphylococcus
ALMFPSGNRFYDWIYSTN

SEQ ID NO: 2049250 - protein, 17 aa, Staphylococcus
ALMLFVKRCKAMADKGT

SEQ ID NO: 2049251 - protein, 22 aa, Staphylococcus
ALNHQLFKGIEWIIVSLGANGA

SEQ ID NO: 2049252 - protein, 17 aa, Staphylococcus
ALNYAFTHFDLRKVYFK

SEQ ID NO: 2049253 - protein, 26 aa, Staphylococcus
ALPYLRWRIDQSYSWMIENLEDAVEL

SEQ ID NO: 2049254 - protein, 21 aa, Staphylococcus
ALQAWDIDHLWGIPGDSVDAV

SEQ ID NO: 2049255 - protein, 17 aa, Staphylococcus
ALQAWDIDHLYGIPGDS

SEQ ID NO: 2049256 - protein, 17 aa, Staphylococcus
ALQIVPLIIKFKNLLYE

SEQ ID NO: 2049257 - protein, 25 aa, Staphylococcus
ALRESFNIPALKAWQSTKENAGNDA

SEQ ID NO: 2049258 - protein, 20 aa, Staphylococcus
ALSQGFSGLEIDVFDFYSNK

SEQ ID NO: 2049259 - protein, 22 aa, Staphylococcus
ALSRFPWLSANIEYIKTKEPYF

SEQ ID NO: 2049260 - protein, 18 aa, Staphylococcus
ALSRLRIVIDLNDEPDLF

SEQ ID NO: 2049261 - protein, 19 aa, Staphylococcus
ALTAHLGFGNYELRLPLIP

SEQ ID NO: 2049262 - protein, 17 aa, Staphylococcus
ALTGELFAGFGAKVVGY

SEQ ID NO: 2049263 - protein, 17 aa, Staphylococcus
ALTSPLLTAEWEEKLTR

SEQ ID NO: 2049264 - protein, 19 aa, Staphylococcus
ALWGARAAYIGGFNSTSNV

SEQ ID NO: 2049265 - protein, 22 aa, Staphylococcus
AMAKEGYSFFGVLYIGAIITKD

SEQ ID NO: 2049266 - protein, 22 aa, Staphylococcus
AMAPCPYVYAMIAKRAMKDPNL

SEQ ID NO: 2049267 - protein, 20 aa, Staphylococcus
AMHLLPFNVFFVPARGGLGE

SEQ ID NO: 2049268 - protein, 18 aa, Staphylococcus
AMMFKGNASKLGFEPKEG

SEQ ID NO: 2049269 - protein, 21 aa, Staphylococcus
AMSGNGRFGGHFVLGHVDDLG

SEQ ID NO: 2049270 - protein, 23 aa, Staphylococcus
AMSKEGYHFFGLLYIGAILTKEG

SEQ ID NO: 2049271 - protein, 24 aa, Staphylococcus
AMVRLSQEWKLRHVLIEMHGNNGS

SEQ ID NO: 2049272 - protein, 17 aa, Staphylococcus
AMVSFLNSFPMFKDDTR

SEQ ID NO: 2049273 - protein, 20 aa, Staphylococcus
ANAFPTPAIFDWLQEQGNIS

SEQ ID NO: 2049274 - protein, 19 aa, Staphylococcus
ANCLMARIGKRITLSQQQA

SEQ ID NO: 2049275 - protein, 25 aa, Staphylococcus
ANEFKNYILGLIFYRFLSEKNEDIA

SEQ ID NO: 2049276 - protein, 17 aa, Staphylococcus
ANFGAFVEIAPGVQGLV

SEQ ID NO: 2049277 - protein, 18 aa, Staphylococcus
ANFKKFCLALGIDSENFK

SEQ ID NO: 2049278 - protein, 17 aa, Staphylococcus
ANIHPIFGMTINLTDGL

SEQ ID NO: 2049279 - protein, 17 aa, Staphylococcus
ANIKPIFGMTVNVTDGL

SEQ ID NO: 2049280 - protein, 20 aa, Staphylococcus
ANILRICARYDNLNIVEDAY

SEQ ID NO: 2049281 - protein, 25 aa, Staphylococcus
ANKDLKNIPIHFAIYVQSSQDAITP

SEQ ID NO: 2049282 - protein, 17 aa, Staphylococcus
ANKECKATNIWQVNFIR

SEQ ID NO: 2049283 - protein, 19 aa, Staphylococcus
ANLIRFIFEEGFIALRPSG

SEQ ID NO: 2049284 - protein, 19 aa, Staphylococcus
ANLIRLIFDEGFIAIRPSG

SEQ ID NO: 2049285 - protein, 20 aa, Staphylococcus
ANLPNFYAYYAIGRQTANTI

SEQ ID NO: 2049286 - protein, 19 aa, Staphylococcus
ANLRLVVSIAKRYVGRGML

SEQ ID NO: 2049287 - protein, 20 aa, Staphylococcus
ANLRLVVSIAKRYVGRGMLF

SEQ ID NO: 2049288 - protein, 18 aa, Staphylococcus
ANLSPGTRIHFVEIPNKD

SEQ ID NO: 2049289 - protein, 19 aa, Staphylococcus
ANLSPGTRIHFVEVPKSNY

SEQ ID NO: 2049290 - protein, 19 aa, Staphylococcus
ANLSPGTRLHFVEVPHSDY

SEQ ID NO: 2049291 - protein, 21 aa, Staphylococcus
ANVIRYAQFLKELSIQTQFIV

SEQ ID NO: 2049292 - protein, 18 aa, Staphylococcus
ANVIRYAQYLKELSDQTQ

SEQ ID NO: 2049293 - protein, 18 aa, Staphylococcus
ANVIRYAQYLNELSDQTQ

SEQ ID NO: 2049294 - protein, 18 aa, Staphylococcus
ANVIRYAQYLNELSEQTQ

SEQ ID NO: 2049295 - protein, 23 aa, Staphylococcus
ANVLKIYFKEGFIALRPSGTEPK

SEQ ID NO: 2049296 - protein, 18 aa, Staphylococcus
APAIRIGWIIAPEKIIER

SEQ ID NO: 2049297 - protein, 20 aa, Staphylococcus
APARAMGMVSVWFKEDDEVD

SEQ ID NO: 2049298 - protein, 20 aa, Staphylococcus
APARAMGMVSVWFKHDDAEL

SEQ ID NO: 2049299 - protein, 20 aa, Staphylococcus
APARAMGMVSVWFKQEDAEI

SEQ ID NO: 2049300 - protein, 20 aa, Staphylococcus
APARAMGMVSVWYKQENAEL

SEQ ID NO: 2049301 - protein, 18 aa, Staphylococcus
APATHPWRTMPRNGMTIH

SEQ ID NO: 2049302 - protein, 17 aa, Staphylococcus
APGGKACHMAEILAPTG

SEQ ID NO: 2049303 - protein, 17 aa, Staphylococcus
APGGKACHMAEILSPEG

SEQ ID NO: 2049304 - protein, 18 aa, Staphylococcus
APGGKACHMAELLASTGH

SEQ ID NO: 2049305 - protein, 17 aa, Staphylococcus
APIRMLVMFGLKLSDLV

SEQ ID NO: 2049306 - protein, 18 aa, Staphylococcus
APISLAFYRRSIGGAATE

SEQ ID NO: 2049307 - protein, 32 aa, Staphylococcus
APKLFIKLNIEWVYRLLIDWKRIGRMRSIPKF

SEQ ID NO: 2049308 - protein, 23 aa, Staphylococcus
APKPRLPFEHVFHKNVYNSNAKE

SEQ ID NO: 2049309 - protein, 22 aa, Staphylococcus
APKPRLPFESVFHENEYNQDKA

SEQ ID NO: 2049310 - protein, 20 aa, Staphylococcus
APLIVLGCVMMRVCHKDTCP

SEQ ID NO: 2049311 - protein, 17 aa, Staphylococcus
APNEVYGLLGINGAGKS

SEQ ID NO: 2049312 - protein, 17 aa, Staphylococcus
APPWFKVSPTHYVKSWL

SEQ ID NO: 2049313 - protein, 17 aa, Staphylococcus
APWFKVSPTHFVKSWLL

SEQ ID NO: 2049314 - protein, 21 aa, Staphylococcus
APWLKRLGFDHVKEVLLDEQR

SEQ ID NO: 2049315 - protein, 17 aa, Staphylococcus
APYKFLLSHGFVMDGEG

SEQ ID NO: 2049316 - protein, 20 aa, Staphylococcus
APYLFKLIVIHYLFEYLHPF

SEQ ID NO: 2049317 - protein, 24 aa, Staphylococcus
AQAHIRFVFCTGKQCERVENIVGD

SEQ ID NO: 2049318 - protein, 18 aa, Staphylococcus
AQAITCYYGGHVIQGEKV

SEQ ID NO: 2049319 - protein, 20 aa, Staphylococcus
AQCLVKLGFGSRAEHLFYEN

SEQ ID NO: 2049320 - protein, 20 aa, Staphylococcus
AQIKRLKFDYLYIDNAQLTS

SEQ ID NO: 2049321 - protein, 18 aa, Staphylococcus
AQILKYFGVDSVNLLSNN

SEQ ID NO: 2049322 - protein, 17 aa, Staphylococcus
AQIVLRWHLAHDRIIIP

SEQ ID NO: 2049323 - protein, 17 aa, Staphylococcus
AQIVLRWHLAHNRIIIP

SEQ ID NO: 2049324 - protein, 18 aa, Staphylococcus
AQIVLRWHLAHNRIIIPK

SEQ ID NO: 2049325 - protein, 18 aa, Staphylococcus
AQIVLRWHVAHNRVVIPK

SEQ ID NO: 2049326 - protein, 20 aa, Staphylococcus
AQNADYFLDLGIKVVVITLG

SEQ ID NO: 2049327 - protein, 24 aa, Staphylococcus
AQNKIRVTFRFDELLKPLTIDFLK

SEQ ID NO: 2049328 - protein, 17 aa, Staphylococcus
AQPFYKRIIDVLEGTNM

SEQ ID NO: 2049329 - protein, 17 aa, Staphylococcus
AQQLERWGVDVIEAGFP

SEQ ID NO: 2049330 - protein, 17 aa, Staphylococcus
AQTCFQFNVPFIVTRAV

SEQ ID NO: 2049331 - protein, 18 aa, Staphylococcus
AQTGITIMYMVKKLDAGN

SEQ ID NO: 2049332 - protein, 18 aa, Staphylococcus
AQVIIKWNMQHNVVVIPK

SEQ ID NO: 2049333 - protein, 18 aa, Staphylococcus
AQVIIRWNIQHDVVVIPK

SEQ ID NO: 2049334 - protein, 19 aa, Staphylococcus
AQVIIRWNIQHGVVVIPKS

SEQ ID NO: 2049335 - protein, 18 aa, Staphylococcus
AQVIIRWNYQHQVVTIPK

SEQ ID NO: 2049336 - protein, 19 aa, Staphylococcus
AQVVIRWNIDNGVITIPKS

SEQ ID NO: 2049337 - protein, 20 aa, Staphylococcus
AQWAKIRLVKSIAEEVWNTE

SEQ ID NO: 2049338 - protein, 29 aa, Staphylococcus
ARAKFEIVSGLKPGGVFIYDGDEPLLKPH

SEQ ID NO: 2049339 - protein, 20 aa, Staphylococcus
ARALKFFKYFYSQRGPILDY

SEQ ID NO: 2049340 - protein, 19 aa, Staphylococcus
ARALKVFKYFYTHRGPVMD

SEQ ID NO: 2049341 - protein, 18 aa, Staphylococcus
ARAREILDDLGILKNGVF

SEQ ID NO: 2049342 - protein, 20 aa, Staphylococcus
ARAYRLLRVGSFLLSEDGYK

SEQ ID NO: 2049343 - protein, 17 aa, Staphylococcus
ARCPKRYLSRVLEKHGF

SEQ ID NO: 2049344 - protein, 17 aa, Staphylococcus
AREKLLLSIGNYNAAVA

SEQ ID NO: 2049345 - protein, 19 aa, Staphylococcus
ARELIKLVDLPEEYLDRYP

SEQ ID NO: 2049346 - protein, 19 aa, Staphylococcus
ARETYKFAGGKGINVSRVL

SEQ ID NO: 2049347 - protein, 19 aa, Staphylococcus
ARFGYEIGEMSQSFDLESF

SEQ ID NO: 2049348 - protein, 19 aa, Staphylococcus
ARFKYELGAEFGIAPESVN

SEQ ID NO: 2049349 - protein, 17 aa, Staphylococcus
ARFQPKQIEDFEDMIQY

SEQ ID NO: 2049350 - protein, 17 aa, Staphylococcus
ARFRPFPFWKRVHDSFI

SEQ ID NO: 2049351 - protein, 18 aa, Staphylococcus
ARGAEIYAEIVGYGYTGD

SEQ ID NO: 2049352 - protein, 18 aa, Staphylococcus
ARGAIFGLSRGTEKEHFI

SEQ ID NO: 2049353 - protein, 19 aa, Staphylococcus
ARHPKRVDLALGRSKSYPN

SEQ ID NO: 2049354 - protein, 18 aa, Staphylococcus
ARIANQYPYKEWLDNHKV

SEQ ID NO: 2049355 - protein, 22 aa, Staphylococcus
ARIKEWDFPFVIKPGDDLPTAG

SEQ ID NO: 2049356 - protein, 17 aa, Staphylococcus
ARILKLQRKAVYNSIQR

SEQ ID NO: 2049357 - protein, 17 aa, Staphylococcus
ARIPVCGAISTYNADEP

SEQ ID NO: 2049358 - protein, 17 aa, Staphylococcus
ARIPVCGTISKYNDKEV

SEQ ID NO: 2049359 - protein, 20 aa, Staphylococcus
ARKGLPYVFAGHFAPQQMKD

SEQ ID NO: 2049360 - protein, 20 aa, Staphylococcus
ARKGLPYVFAGHFAPQQMKE

SEQ ID NO: 2049361 - protein, 20 aa, Staphylococcus
ARKGLPYVFAGHFASQQMKD

SEQ ID NO: 2049362 - protein, 23 aa, Staphylococcus
ARKYGLEVFNVFLSQEPITEDIE

SEQ ID NO: 2049363 - protein, 18 aa, Staphylococcus
ARLIHLNVDFKFDREEET

SEQ ID NO: 2049364 - protein, 21 aa, Staphylococcus
ARLNLPAVFVYGGTILPGKLD

SEQ ID NO: 2049365 - protein, 17 aa, Staphylococcus
ARLYCWNIGLPNVTEYI

SEQ ID NO: 2049366 - protein, 19 aa, Staphylococcus
ARNAYDVVYEWKDFMNQIG

SEQ ID NO: 2049367 - protein, 17 aa, Staphylococcus
ARPALAEVAFIGKAPGK

SEQ ID NO: 2049368 - protein, 19 aa, Staphylococcus
ARPVWKPMHLQPYFESYDY

SEQ ID NO: 2049369 - protein, 21 aa, Staphylococcus
ARPYRLLRVGSFLLSKEGYKI

SEQ ID NO: 2049370 - protein, 18 aa, Staphylococcus
ARRGELVSCFLLEADDSL

SEQ ID NO: 2049371 - protein, 18 aa, Staphylococcus
ARRLKQWIDRPLIHKDNI

SEQ ID NO: 2049372 - protein, 18 aa, Staphylococcus
ARRLKQWIDRPLINKERI

SEQ ID NO: 2049373 - protein, 18 aa, Staphylococcus
ARRLKQWIDRPLIQKKQI

SEQ ID NO: 2049374 - protein, 18 aa, Staphylococcus
ARRLKQWIDRPLIQQQEI

SEQ ID NO: 2049375 - protein, 18 aa, Staphylococcus
ARRLKQWIDRPLIYKQAI

SEQ ID NO: 2049376 - protein, 18 aa, Staphylococcus
ARRLKQWIDRPLIYKQQI

SEQ ID NO: 2049377 - protein, 19 aa, Staphylococcus
ARTLVPVEVPIDIKSQEIF

SEQ ID NO: 2049378 - protein, 18 aa, Staphylococcus
ARVLKIFKYFYSHRGPVM

SEQ ID NO: 2049379 - protein, 22 aa, Staphylococcus
ARVLRWPLPVLMVSRSISDSAS

SEQ ID NO: 2049380 - protein, 18 aa, Staphylococcus
ARYKIQMYYYRSALETIL

SEQ ID NO: 2049381 - protein, 23 aa, Staphylococcus
ASDMKSGLAAFVISMIELHEQGL

SEQ ID NO: 2049382 - protein, 24 aa, Staphylococcus
ASDWSEIRPEWGLAKNAEFIIGKR

SEQ ID NO: 2049383 - protein, 24 aa, Staphylococcus
ASDWSEVRPEWGLAKNAEFIIGKR

SEQ ID NO: 2049384 - protein, 18 aa, Staphylococcus
ASEGKPVLGVCNGFQILT

SEQ ID NO: 2049385 - protein, 22 aa, Staphylococcus
ASEISMMFGIRVEDAEKAVLST

SEQ ID NO: 2049386 - protein, 20 aa, Staphylococcus
ASELRLNEIGFIFQSSHLVP

SEQ ID NO: 2049387 - protein, 18 aa, Staphylococcus
ASEPAKIFGLVHKGSIAV

SEQ ID NO: 2049388 - protein, 18 aa, Staphylococcus
ASERRKFAGIVFGDANYY

SEQ ID NO: 2049389 - protein, 17 aa, Staphylococcus
ASFDYAVHFNKTNPLAG

SEQ ID NO: 2049390 - protein, 25 aa, Staphylococcus
ASFKLGAVYLPINWRLKTQEIESVI

SEQ ID NO: 2049391 - protein, 20 aa, Staphylococcus
ASGALKLFGLQDHQVDTANT

SEQ ID NO: 2049392 - protein, 17 aa, Staphylococcus
ASGGFLIQVMPGAEDET

SEQ ID NO: 2049393 - protein, 20 aa, Staphylococcus
ASGLPSYIYTFLGFLPRKSK

SEQ ID NO: 2049394 - protein, 18 aa, Staphylococcus
ASHKLGRLIQIFEEQSES

SEQ ID NO: 2049395 - protein, 17 aa, Staphylococcus
ASHSYVFISWTGKMTET

SEQ ID NO: 2049396 - protein, 18 aa, Staphylococcus
ASIKAILKQAGYNDVITE

SEQ ID NO: 2049397 - protein, 18 aa, Staphylococcus
ASINEMFSRMQSVSSQID

SEQ ID NO: 2049398 - protein, 19 aa, Staphylococcus
ASINWALGLMNEGNQIIDN

SEQ ID NO: 2049399 - protein, 20 aa, Staphylococcus
ASKLRWEFEFEIESEDAVHC

SEQ ID NO: 2049400 - protein, 18 aa, Staphylococcus
ASLIHEWNKIIQKLRHFF

SEQ ID NO: 2049401 - protein, 20 aa, Staphylococcus
ASLKRYLLEESFELFEAIDN

SEQ ID NO: 2049402 - protein, 20 aa, Staphylococcus
ASLKRYLLEETFELFEAIDN

SEQ ID NO: 2049403 - protein, 19 aa, Staphylococcus
ASNHWYEWLASNLMLEGYN

SEQ ID NO: 2049404 - protein, 20 aa, Staphylococcus
ASPEFMFPSFYGIDVSTTAE

SEQ ID NO: 2049405 - protein, 20 aa, Staphylococcus
ASQYRKDFCKTFLNTVDVVV

SEQ ID NO: 2049406 - protein, 19 aa, Staphylococcus
ASRAEYKKDISLWKTDALR

SEQ ID NO: 2049407 - protein, 22 aa, Staphylococcus
ASSRLNYTYIRMAMYMDPLKPY

SEQ ID NO: 2049408 - protein, 18 aa, Staphylococcus
ASTHPGAGVPIVLTSAKI

SEQ ID NO: 2049409 - protein, 20 aa, Staphylococcus
ASTYRKTFCERFLAEVEVSV

SEQ ID NO: 2049410 - protein, 19 aa, Staphylococcus
ASVENGVPCLTSLDTANAL

SEQ ID NO: 2049411 - protein, 19 aa, Staphylococcus
ASVENGVPCLTSLDTVVAL

SEQ ID NO: 2049412 - protein, 24 aa, Staphylococcus
ASYLKEFMNIYALLIPKVTDIESI

SEQ ID NO: 2049413 - protein, 23 aa, Staphylococcus
ASYLREFANIYALLIPIMPDLES

SEQ ID NO: 2049414 - protein, 23 aa, Staphylococcus
ASYMKRSYLFTAYIVEFQVLNGM

SEQ ID NO: 2049415 - protein, 17 aa, Staphylococcus
ATAAPGWQKWVWSPFLS

SEQ ID NO: 2049416 - protein, 17 aa, Staphylococcus
ATACIGGGLGIALAVEK

SEQ ID NO: 2049417 - protein, 22 aa, Staphylococcus
ATAPLVVLGCIMMRVCHKDTCP

SEQ ID NO: 2049418 - protein, 19 aa, Staphylococcus
ATDLRMMIAALKISTDFER

SEQ ID NO: 2049419 - protein, 20 aa, Staphylococcus
ATEALPNWAAEQGYPVTNYE

SEQ ID NO: 2049420 - protein, 22 aa, Staphylococcus
ATEGMMLCEFLNIKANSLKFML

SEQ ID NO: 2049421 - protein, 17 aa, Staphylococcus
ATFGVTCELDYHDDYPA

SEQ ID NO: 2049422 - protein, 17 aa, Staphylococcus
ATFTLAVNRNFKSKNGE

SEQ ID NO: 2049423 - protein, 17 aa, Staphylococcus
ATFTLAVNRTFTNAQGE

SEQ ID NO: 2049424 - protein, 18 aa, Staphylococcus
ATIKEFRDAKAMLLEEKE

SEQ ID NO: 2049425 - protein, 22 aa, Staphylococcus
ATKRATYTFTVFVDTHSNVTGT

SEQ ID NO: 2049426 - protein, 22 aa, Staphylococcus
ATLFPNRVDLGLGRAPGTDMMT

SEQ ID NO: 2049427 - protein, 23 aa, Staphylococcus
ATPYRLNDIFTRMKREGKAVFLV

SEQ ID NO: 2049428 - protein, 18 aa, Staphylococcus
ATQSLKWAVDEMEKRYKL

SEQ ID NO: 2049429 - protein, 18 aa, Staphylococcus
ATQSLKWAVEEMEKRYKL

SEQ ID NO: 2049430 - protein, 18 aa, Staphylococcus
ATQSLKWAVEEMERRYKV

SEQ ID NO: 2049431 - protein, 17 aa, Staphylococcus
ATVGRYGGRIANATFEL

SEQ ID NO: 2049432 - protein, 17 aa, Staphylococcus
ATVLLRPFITHAPRQIF

SEQ ID NO: 2049433 - protein, 18 aa, Staphylococcus
ATYFAEPHIESFPAAAGQ

SEQ ID NO: 2049434 - protein, 17 aa, Staphylococcus
ATYKAWVDHCLDNKSKH

SEQ ID NO: 2049435 - protein, 17 aa, Staphylococcus
ATYLFDLNLDYIIMDGE

SEQ ID NO: 2049436 - protein, 24 aa, Staphylococcus
AVAEMKLAIGLLVEKKLSHMRIHS

SEQ ID NO: 2049437 - protein, 23 aa, Staphylococcus
AVAEMKLAVGLLVEKKLSHMRIH

SEQ ID NO: 2049438 - protein, 20 aa, Staphylococcus
AVARDVGRIMGFDEITLAEI

SEQ ID NO: 2049439 - protein, 17 aa, Staphylococcus
AVEFGKMDFNTHLDLKA

SEQ ID NO: 2049440 - protein, 23 aa, Staphylococcus
AVEKELGYRLKLISGGNSSMLPQ

SEQ ID NO: 2049441 - protein, 24 aa, Staphylococcus
AVFKMMNWWFEKGIDGFRVDAITH

SEQ ID NO: 2049442 - protein, 19 aa, Staphylococcus
AVGGRQLVKVAAWYDNEMS

SEQ ID NO: 2049443 - protein, 17 aa, Staphylococcus
AVGRDVGRIMGFDETTL

SEQ ID NO: 2049444 - protein, 19 aa, Staphylococcus
AVILKAAFELGERMYARDF

SEQ ID NO: 2049445 - protein, 23 aa, Staphylococcus
AVIPYLRKCFRISQDRKDIGIAG

SEQ ID NO: 2049446 - protein, 22 aa, Staphylococcus
AVSEFKAGFGPRHIEFNNNGKY

SEQ ID NO: 2049447 - protein, 22 aa, Staphylococcus
AVSRTSFDWGVRVPSNPKHVVY

SEQ ID NO: 2049448 - protein, 20 aa, Staphylococcus
AVTLKAAFELGERINKRNSI

SEQ ID NO: 2049449 - protein, 17 aa, Staphylococcus
AVTRFRQGLGRLIRSEN

SEQ ID NO: 2049450 - protein, 19 aa, Staphylococcus
AVTTEFKKSMPILIHGDAA

SEQ ID NO: 2049451 - protein, 19 aa, Staphylococcus
AVVGDTLFKQGIGRTDLYK

SEQ ID NO: 2049452 - protein, 19 aa, Staphylococcus
AVWGARAAYIGGFDSTSNV

SEQ ID NO: 2049453 - protein, 21 aa, Staphylococcus
AWARSRIGKRLDIDGRGGAQC

SEQ ID NO: 2049454 - protein, 20 aa, Staphylococcus
AWNRKAFRGVELYQKTLGVI

SEQ ID NO: 2049455 - protein, 22 aa, Staphylococcus
AWTNRYDIWFSIYSTPSESLTD

SEQ ID NO: 2049456 - protein, 18 aa, Staphylococcus
AYAPEFEKVIPLKIMLIE

SEQ ID NO: 2049457 - protein, 18 aa, Staphylococcus
AYCPGVAKTEMWDRIDAE

SEQ ID NO: 2049458 - protein, 18 aa, Staphylococcus
AYEILKWAYTTYGEDIVY

SEQ ID NO: 2049459 - protein, 31 aa, Staphylococcus
AYERLEFYRLYLLMIHLLKFGGMYASSVNRS

SEQ ID NO: 2049460 - protein, 17 aa, Staphylococcus
AYFGIRFFYEGDKLDLY

SEQ ID NO: 2049461 - protein, 17 aa, Staphylococcus
AYFKLTIHGQGGHGSSP

SEQ ID NO: 2049462 - protein, 21 aa, Staphylococcus
AYKGELPVGILDLIVSASAME

SEQ ID NO: 2049463 - protein, 18 aa, Staphylococcus
AYNPLFIYGGVGLGKTHL

SEQ ID NO: 2049464 - protein, 20 aa, Staphylococcus
AYQKCIPWIYGGVVQSTYAQ

SEQ ID NO: 2049465 - protein, 23 aa, Staphylococcus
AYRGVRYKGCINVFIEKNYLNNI

SEQ ID NO: 2049466 - protein, 18 aa, Staphylococcus
AYVKISLIGSGMRDMSGV

SEQ ID NO: 2049467 - protein, 24 aa, Staphylococcus
CADADLDLAICITEHIPVLDMVKV

SEQ ID NO: 2049468 - protein, 21 aa, Staphylococcus
CAHMMIWEGIELLPVTNNNKK

SEQ ID NO: 2049469 - protein, 21 aa, Staphylococcus
CAHMMIWEGIELLPVTTINKK

SEQ ID NO: 2049470 - protein, 20 aa, Staphylococcus
CAQLWPHFDLFSQFLNDKII

SEQ ID NO: 2049471 - protein, 19 aa, Staphylococcus
CASIICPPDIFSKLLHTVA

SEQ ID NO: 2049472 - protein, 17 aa, Staphylococcus
CATVCPCNAMLEVNMEG

SEQ ID NO: 2049473 - protein, 18 aa, Staphylococcus
CCQSCRWDYDLLAVDEEG

SEQ ID NO: 2049474 - protein, 17 aa, Staphylococcus
CCQSCRWDYDLLEVDED

SEQ ID NO: 2049475 - protein, 17 aa, Staphylococcus
CCQSCRWDYDLLEVDND

SEQ ID NO: 2049476 - protein, 18 aa, Staphylococcus
CCQSCRWDYDLLQVDEDG

SEQ ID NO: 2049477 - protein, 17 aa, Staphylococcus
CCQSCRWDYDLLQVDND

SEQ ID NO: 2049478 - protein, 18 aa, Staphylococcus
CCQSCRWDYDLLSIDQDG

SEQ ID NO: 2049479 - protein, 26 aa, Staphylococcus
CDLFKCAETIFIYGYGASFVVATDLY

SEQ ID NO: 2049480 - protein, 19 aa, Staphylococcus
CDNISWLILKRDFIRAINC

SEQ ID NO: 2049481 - protein, 23 aa, Staphylococcus
CDPEIMGIAPFYAVSKLLEKTGK

SEQ ID NO: 2049482 - protein, 20 aa, Staphylococcus
CEDCGKAIRPDIVLYGEMLD

SEQ ID NO: 2049483 - protein, 19 aa, Staphylococcus
CEINDYILMPFVFTSGLGI

SEQ ID NO: 2049484 - protein, 18 aa, Staphylococcus
CELMFKNQINYFFEHNQT

SEQ ID NO: 2049485 - protein, 18 aa, Staphylococcus
CEMLLRMEQYLELREEAI

SEQ ID NO: 2049486 - protein, 19 aa, Staphylococcus
CFDKAFIGMNGLDLNHGLT

SEQ ID NO: 2049487 - protein, 18 aa, Staphylococcus
CFDKSFIGMNGIDVKYGL

SEQ ID NO: 2049488 - protein, 18 aa, Staphylococcus
CFEIPSYHKMLMISDVAL

SEQ ID NO: 2049489 - protein, 18 aa, Staphylococcus
CFGCKKGGNVFQFIQDIK

SEQ ID NO: 2049490 - protein, 17 aa, Staphylococcus
CFGCKKGGNVFQFTQDI

SEQ ID NO: 2049491 - protein, 20 aa, Staphylococcus
CGDAMMNLPILKRISEELNW

SEQ ID NO: 2049492 - protein, 21 aa, Staphylococcus
CGDAMMNLPILKRISESLQLE

SEQ ID NO: 2049493 - protein, 20 aa, Staphylococcus
CGDIAVSIYTGWLAYSTFDH

SEQ ID NO: 2049494 - protein, 23 aa, Staphylococcus
CGDIAVSVFTGWLAYSTFDHDWV

SEQ ID NO: 2049495 - protein, 17 aa, Staphylococcus
CGECPACKLRARGLNAY

SEQ ID NO: 2049496 - protein, 22 aa, Staphylococcus
CGFIKFVLNINVNIAFQIQTDE

SEQ ID NO: 2049497 - protein, 19 aa, Staphylococcus
CGHNMFNLDAFEVVGNSIK

SEQ ID NO: 2049498 - protein, 21 aa, Staphylococcus
CGINGLYIKQCRFIGFRDVDG

SEQ ID NO: 2049499 - protein, 17 aa, Staphylococcus
CGKAEEVIIEWKQKGIE

SEQ ID NO: 2049500 - protein, 17 aa, Staphylococcus
CGLCSSGLYALVDGEVV

SEQ ID NO: 2049501 - protein, 19 aa, Staphylococcus
CGRNMFNLKTFKVVDNDLE

SEQ ID NO: 2049502 - protein, 21 aa, Staphylococcus
CGSGSLLLRVGREANVRQYYG

SEQ ID NO: 2049503 - protein, 19 aa, Staphylococcus
CGSSREHAAWALKDFGFNI

SEQ ID NO: 2049504 - protein, 19 aa, Staphylococcus
CIFHIKRFDSELFVFKDKG

SEQ ID NO: 2049505 - protein, 19 aa, Staphylococcus
CIGCGAPLQSEDLDAPGYV

SEQ ID NO: 2049506 - protein, 18 aa, Staphylococcus
CILIGPGLGCDFKGNNAI

SEQ ID NO: 2049507 - protein, 20 aa, Staphylococcus
CKAGKAIKSFDERKEINNVQ

SEQ ID NO: 2049508 - protein, 19 aa, Staphylococcus
CKATNIWQVNFIRASDGLF

SEQ ID NO: 2049509 - protein, 18 aa, Staphylococcus
CKMGLSFVELFPNIEEML

SEQ ID NO: 2049510 - protein, 19 aa, Staphylococcus
CKPDHPFVYWATFSNAADL

SEQ ID NO: 2049511 - protein, 24 aa, Staphylococcus
CKQLKRAKTIYVFGYGASYVCALD

SEQ ID NO: 2049512 - protein, 18 aa, Staphylococcus
CLIAGELAEHCDFFSFGT

SEQ ID NO: 2049513 - protein, 19 aa, Staphylococcus
CLIASELAKECDFFSFGTN

SEQ ID NO: 2049514 - protein, 19 aa, Staphylococcus
CLINFGVWDMCLWNKTDNK

SEQ ID NO: 2049515 - protein, 17 aa, Staphylococcus
CLMARIGSRISINQLQE

SEQ ID NO: 2049516 - protein, 20 aa, Staphylococcus
CLYLRVDPYLPYQYRNHDGE

SEQ ID NO: 2049517 - protein, 19 aa, Staphylococcus
CMTCGVCLEVCPNVTKNNG

SEQ ID NO: 2049518 - protein, 18 aa, Staphylococcus
CMTCGVCLEVCPNVTPNN

SEQ ID NO: 2049519 - protein, 18 aa, Staphylococcus
CMTCGVCLEVCPNVTQKN

SEQ ID NO: 2049520 - protein, 18 aa, Staphylococcus
CMTCGVCLEVCPNVTQNN

SEQ ID NO: 2049521 - protein, 18 aa, Staphylococcus
CMTCGVCLEVCPNVTRNN

SEQ ID NO: 2049522 - protein, 17 aa, Staphylococcus
CNKYEKMIFMDYETHID

SEQ ID NO: 2049523 - protein, 20 aa, Staphylococcus
CPEFTSLCPITGQPDFATIY

SEQ ID NO: 2049524 - protein, 19 aa, Staphylococcus
CPKLRPVIITLRRLAAFIE

SEQ ID NO: 2049525 - protein, 18 aa, Staphylococcus
CPLDEGMEIFVGVPSERY

SEQ ID NO: 2049526 - protein, 18 aa, Staphylococcus
CPNNKRLGFKRYAYRHDK

SEQ ID NO: 2049527 - protein, 24 aa, Staphylococcus
CQEEGIKFIGPRVEHLDMFGDKVK

SEQ ID NO: 2049528 - protein, 19 aa, Staphylococcus
CQHFKRANNIFIFGYGASY

SEQ ID NO: 2049529 - protein, 18 aa, Staphylococcus
CRAFGSAALEIISVARGQ

SEQ ID NO: 2049530 - protein, 17 aa, Staphylococcus
CRFCNRGEYWMCEKHDL

SEQ ID NO: 2049531 - protein, 17 aa, Staphylococcus
CRIYKAISYFKAQYTLK

SEQ ID NO: 2049532 - protein, 19 aa, Staphylococcus
CRRTMEIFELLGVKITEHE

SEQ ID NO: 2049533 - protein, 19 aa, Staphylococcus
CRTAFKFHGEVAIQLFLNE

SEQ ID NO: 2049534 - protein, 19 aa, Staphylococcus
CRTSFKFHGEVAMQLFLSD

SEQ ID NO: 2049535 - protein, 18 aa, Staphylococcus
CRTSHAFWASLDTFDIKK

SEQ ID NO: 2049536 - protein, 19 aa, Staphylococcus
CSACSRAIVHSAVYDEVLE

SEQ ID NO: 2049537 - protein, 19 aa, Staphylococcus
CSAGARIIVHNDIKEKFEA

SEQ ID NO: 2049538 - protein, 19 aa, Staphylococcus
CSAGSRILVHNDIKADFEK

SEQ ID NO: 2049539 - protein, 19 aa, Staphylococcus
CSAGSRILVHNDIKDKFEK

SEQ ID NO: 2049540 - protein, 19 aa, Staphylococcus
CSAGSRILVHNDIKEDFEK

SEQ ID NO: 2049541 - protein, 19 aa, Staphylococcus
CSAGSRILVHNDIKGDFEK

SEQ ID NO: 2049542 - protein, 20 aa, Staphylococcus
CSAGSRLLVQSSIYDELLPK

SEQ ID NO: 2049543 - protein, 20 aa, Staphylococcus
CSAGSRLLVQSSIYDKVMPK

SEQ ID NO: 2049544 - protein, 20 aa, Staphylococcus
CSAGSRLLVQSSLYDKLLPK

SEQ ID NO: 2049545 - protein, 19 aa, Staphylococcus
CSAGSRLLVQSSVYDKLLP

SEQ ID NO: 2049546 - protein, 19 aa, Staphylococcus
CSAGSRLVVQEDIYDELIP

SEQ ID NO: 2049547 - protein, 22 aa, Staphylococcus
CSFSEFVPICIFKKQGFKPCSY

SEQ ID NO: 2049548 - protein, 18 aa, Staphylococcus
CSNLYRFLREVSLGNTKF

SEQ ID NO: 2049549 - protein, 18 aa, Staphylococcus
CSNNCLIHYYLQGYEEPM

SEQ ID NO: 2049550 - protein, 19 aa, Staphylococcus
CSVCSCGLYALVDGDTVEG

SEQ ID NO: 2049551 - protein, 18 aa, Staphylococcus
CTELSMGMSNDFHLAAEE

SEQ ID NO: 2049552 - protein, 17 aa, Staphylococcus
CTLWQGFDYEVDMSAPH

SEQ ID NO: 2049553 - protein, 20 aa, Staphylococcus
CTNSSIFSLKAFKSVIKSTL

SEQ ID NO: 2049554 - protein, 19 aa, Staphylococcus
CVNAPTSRNTFDWLQPLLK

SEQ ID NO: 2049555 - protein, 18 aa, Staphylococcus
CYAVLGLVHTLWKPMPGR

SEQ ID NO: 2049556 - protein, 18 aa, Staphylococcus
CYCGCVFAAMKQGIDFKA

SEQ ID NO: 2049557 - protein, 19 aa, Staphylococcus
CYDLRFPEIARHPAVNGAD

SEQ ID NO: 2049558 - protein, 18 aa, Staphylococcus
CYFDRHLLQSSGFVKNII

SEQ ID NO: 2049559 - protein, 19 aa, Staphylococcus
CYIISLAAVLERSGFTDIK

SEQ ID NO: 2049560 - protein, 24 aa, Staphylococcus
CYIYKFRARFAVLAKIIADREGLS

SEQ ID NO: 2049561 - protein, 17 aa, Staphylococcus
CYLGDFKSTGGIFATTD

SEQ ID NO: 2049562 - protein, 17 aa, Staphylococcus
CYLGDFKTTGGIFSTTE

SEQ ID NO: 2049563 - protein, 21 aa, Staphylococcus
CYQFNLPFIITRAISDLADGD

SEQ ID NO: 2049564 - protein, 22 aa, Staphylococcus
CYQFNLPFIVTRAVSDLANGKA

SEQ ID NO: 2049565 - protein, 18 aa, Staphylococcus
DADIKIRYIREIDDLVDL

SEQ ID NO: 2049566 - protein, 19 aa, Staphylococcus
DADLSPGTRIHFVEVPNPE

SEQ ID NO: 2049567 - protein, 23 aa, Staphylococcus
DAEGRYGNFAKYFTTNNVPAFAI

SEQ ID NO: 2049568 - protein, 20 aa, Staphylococcus
DAELKVFMIASVEERAERRQ

SEQ ID NO: 2049569 - protein, 20 aa, Staphylococcus
DAELNPGTRLHFVEVPNPNY

SEQ ID NO: 2049570 - protein, 19 aa, Staphylococcus
DAFIGAIIFQLLKEDRKHL

SEQ ID NO: 2049571 - protein, 18 aa, Staphylococcus
DAFKTSDCNLKFKNELLD

SEQ ID NO: 2049572 - protein, 20 aa, Staphylococcus
DAFWPGPISFILPLKTGYLC

SEQ ID NO: 2049573 - protein, 20 aa, Staphylococcus
DAHLRSGDFLDVENNPEIKF

SEQ ID NO: 2049574 - protein, 18 aa, Staphylococcus
DAIIKKRLSQMALDKDTS

SEQ ID NO: 2049575 - protein, 19 aa, Staphylococcus
DAKRAVQVVDMIKTQIKSN

SEQ ID NO: 2049576 - protein, 17 aa, Staphylococcus
DALLAHYKLDFEKFVKL

SEQ ID NO: 2049577 - protein, 18 aa, Staphylococcus
DALMAFDLDTLYKMIDLI

SEQ ID NO: 2049578 - protein, 21 aa, Staphylococcus
DAPEVMANFFIEGQKMLEAQN

SEQ ID NO: 2049579 - protein, 22 aa, Staphylococcus
DAPEVYYLKEFIKHKIKQLLDE

SEQ ID NO: 2049580 - protein, 17 aa, Staphylococcus
DAPYSGLCVESFTGDYP

SEQ ID NO: 2049581 - protein, 20 aa, Staphylococcus
DARDCIRFSYAYVDAEDIDE

SEQ ID NO: 2049582 - protein, 24 aa, Staphylococcus
DARFKRWVIGSIISRTYYHNMVTH

SEQ ID NO: 2049583 - protein, 24 aa, Staphylococcus
DARKFGIEVFNVFLSQDPITEDIE

SEQ ID NO: 2049584 - protein, 19 aa, Staphylococcus
DARYKDWFPNFTLGDLICD

SEQ ID NO: 2049585 - protein, 20 aa, Staphylococcus
DAVTRFRQGLGRLIRHENDK

SEQ ID NO: 2049586 - protein, 18 aa, Staphylococcus
DAVTRFRQGLGRLIRNED

SEQ ID NO: 2049587 - protein, 20 aa, Staphylococcus
DAVTRFRQGLGRLIRNEDDK

SEQ ID NO: 2049588 - protein, 20 aa, Staphylococcus
DAVTRFRQGLGRLIRNEDDQ

SEQ ID NO: 2049589 - protein, 20 aa, Staphylococcus
DAVTRFRQGLGRLIRNEEDQ

SEQ ID NO: 2049590 - protein, 22 aa, Staphylococcus
DAVWDLPMVFAEFGEEDFHPKT

SEQ ID NO: 2049591 - protein, 20 aa, Staphylococcus
DCKYVLSVASPVFFDIPEDE

SEQ ID NO: 2049592 - protein, 19 aa, Staphylococcus
DCVLAYFQIEWTQFNVKYR

SEQ ID NO: 2049593 - protein, 19 aa, Staphylococcus
DDALLRISLEEMLSVLPKQ

SEQ ID NO: 2049594 - protein, 18 aa, Staphylococcus
DDALRLAHEDLFETKSIL

SEQ ID NO: 2049595 - protein, 17 aa, Staphylococcus
DDALRLAHEDLYETKAI

SEQ ID NO: 2049596 - protein, 17 aa, Staphylococcus
DDARLYSKEEFIAYFIR

SEQ ID NO: 2049597 - protein, 18 aa, Staphylococcus
DDEFDEFIIWDSSYHPKM

SEQ ID NO: 2049598 - protein, 21 aa, Staphylococcus
DDEGWAHCLTLPRVLTVEQGK

SEQ ID NO: 2049599 - protein, 17 aa, Staphylococcus
DDFKKLLSLKEVYKDKN

SEQ ID NO: 2049600 - protein, 24 aa, Staphylococcus
DDFLRAAKVLAQWVKEGKIKSKTS

SEQ ID NO: 2049601 - protein, 17 aa, Staphylococcus
DDILKFALYDGSNHVVI

SEQ ID NO: 2049602 - protein, 20 aa, Staphylococcus
DDILKFGFYDKERYIVVDAD

SEQ ID NO: 2049603 - protein, 21 aa, Staphylococcus
DDIRTAMRMILPRKWTLSYLV

SEQ ID NO: 2049604 - protein, 23 aa, Staphylococcus
DDKKRIAIEYSLPKWLVDHWTTH

SEQ ID NO: 2049605 - protein, 21 aa, Staphylococcus
DDKKRIAIQYSLPKWLVDHWV

SEQ ID NO: 2049606 - protein, 24 aa, Staphylococcus
DDKKRIALEYSLPKWLVNHWVTHY

SEQ ID NO: 2049607 - protein, 24 aa, Staphylococcus
DDKQRISIMYSMPKWIVKHWVTHY

SEQ ID NO: 2049608 - protein, 24 aa, Staphylococcus
DDLDPRFMWNLAYALGAEERDKEA

SEQ ID NO: 2049609 - protein, 18 aa, Staphylococcus
DDLKMFGPNWVERFVRTQ

SEQ ID NO: 2049610 - protein, 21 aa, Staphylococcus
DDPFCKIQLWMPVDQEQYLDY

SEQ ID NO: 2049611 - protein, 25 aa, Staphylococcus
DDTQIYICGGISFLKSIVNELYELG

SEQ ID NO: 2049612 - protein, 19 aa, Staphylococcus
DDVEFKLYLGLKHISPYIE

SEQ ID NO: 2049613 - protein, 20 aa, Staphylococcus
DDVKAILGFHNYPTLNIGEF

SEQ ID NO: 2049614 - protein, 17 aa, Staphylococcus
DEAHCLSEWGYDFRPHY

SEQ ID NO: 2049615 - protein, 20 aa, Staphylococcus
DEAHCLSEWGYDFRPHYALI

SEQ ID NO: 2049616 - protein, 21 aa, Staphylococcus
DEAHCLSEWGYDFRPHYALIG

SEQ ID NO: 2049617 - protein, 21 aa, Staphylococcus
DEAHCLSEWGYDFRPHYALVG

SEQ ID NO: 2049618 - protein, 22 aa, Staphylococcus
DEANVIRYARYLNELSDETQFI

SEQ ID NO: 2049619 - protein, 17 aa, Staphylococcus
DEATWFALMDHLVDMSI

SEQ ID NO: 2049620 - protein, 27 aa, Staphylococcus
DEAYKEFLENEIARWIKIQEEIGLDVL

SEQ ID NO: 2049621 - protein, 17 aa, Staphylococcus
DEEVCILYGTKNGLVAL

SEQ ID NO: 2049622 - protein, 20 aa, Staphylococcus
DEFYQLLLIKMWQLTLNYDE

SEQ ID NO: 2049623 - protein, 20 aa, Staphylococcus
DEFYQLLLIQLWHLTHHYQP

SEQ ID NO: 2049624 - protein, 21 aa, Staphylococcus
DEGLWKAVIFEIGLGKTNEIP

SEQ ID NO: 2049625 - protein, 17 aa, Staphylococcus
DEHLIRLSIGIEDYNDI

SEQ ID NO: 2049626 - protein, 17 aa, Staphylococcus
DEHLIRLSVGIEDYHDI

SEQ ID NO: 2049627 - protein, 20 aa, Staphylococcus
DEIIEFWKDYGLGTFFDGFM

SEQ ID NO: 2049628 - protein, 20 aa, Staphylococcus
DEIKQRWPGTITTIVHRIGP

SEQ ID NO: 2049629 - protein, 17 aa, Staphylococcus
DEIKWYVEEAIRIEKSG

SEQ ID NO: 2049630 - protein, 18 aa, Staphylococcus
DEILVAFDLYGGTFRLFD

SEQ ID NO: 2049631 - protein, 17 aa, Staphylococcus
DEKRYPVKMAHNKIIPT

SEQ ID NO: 2049632 - protein, 21 aa, Staphylococcus
DELKALFQLAGFKNVEVKSFT

SEQ ID NO: 2049633 - protein, 18 aa, Staphylococcus
DELLNMVGLEPKKFKNRK

SEQ ID NO: 2049634 - protein, 24 aa, Staphylococcus
DELMKRLKDVFSHLKVGDPTDENV

SEQ ID NO: 2049635 - protein, 21 aa, Staphylococcus
DELMLRYGNLQSYYEEHGGYE

SEQ ID NO: 2049636 - protein, 19 aa, Staphylococcus
DELNRLLGKVIDAFNEAKD

SEQ ID NO: 2049637 - protein, 22 aa, Staphylococcus
DELRHLPSYFGLDFGYVNDPSA

SEQ ID NO: 2049638 - protein, 21 aa, Staphylococcus
DEMKGRIIGREGRNIRTLETL

SEQ ID NO: 2049639 - protein, 18 aa, Staphylococcus
DENLKLLGDDEMDDDDDI

SEQ ID NO: 2049640 - protein, 23 aa, Staphylococcus
DENMKEWLGEAGIEYRQDHELGG

SEQ ID NO: 2049641 - protein, 17 aa, Staphylococcus
DEPLSVYHQMSFFIEHE

SEQ ID NO: 2049642 - protein, 17 aa, Staphylococcus
DEQKVVGYLKLNINHAQ

SEQ ID NO: 2049643 - protein, 19 aa, Staphylococcus
DERPGVFAFIGSNSDYDLH

SEQ ID NO: 2049644 - protein, 19 aa, Staphylococcus
DERYFGGSFERLQQISETT

SEQ ID NO: 2049645 - protein, 19 aa, Staphylococcus
DERYFGGSFERLQQLSKQT

SEQ ID NO: 2049646 - protein, 21 aa, Staphylococcus
DETSLRTGVRIVIDVRKDANA

SEQ ID NO: 2049647 - protein, 17 aa, Staphylococcus
DETTKWLSVLPIYHISG

SEQ ID NO: 2049648 - protein, 17 aa, Staphylococcus
DEVKIYFSHFVSVLENT

SEQ ID NO: 2049649 - protein, 20 aa, Staphylococcus
DEVKRRIFLGTFALSSGYYD

SEQ ID NO: 2049650 - protein, 17 aa, Staphylococcus
DEVRFILKQMGLKEKTI

SEQ ID NO: 2049651 - protein, 17 aa, Staphylococcus
DEVVQWFKHVRDIDLYP

SEQ ID NO: 2049652 - protein, 21 aa, Staphylococcus
DEWKPKIKKMIPSYGESLIHD

SEQ ID NO: 2049653 - protein, 19 aa, Staphylococcus
DEYDFIYGIIGWHPVDAID

SEQ ID NO: 2049654 - protein, 21 aa, Staphylococcus
DEYGKRILIGWMGLPDTHYPT

SEQ ID NO: 2049655 - protein, 18 aa, Staphylococcus
DFCKEWLESNGLHPEIIT

SEQ ID NO: 2049656 - protein, 17 aa, Staphylococcus
DFFSSDVSFHFNQFTQD

SEQ ID NO: 2049657 - protein, 17 aa, Staphylococcus
DFGLCLIGKPKLLILDE

SEQ ID NO: 2049658 - protein, 18 aa, Staphylococcus
DFIKRFNYKNVFNQYVNT

SEQ ID NO: 2049659 - protein, 22 aa, Staphylococcus
DFKAPMGCRSFLPAWRDAQGQF

SEQ ID NO: 2049660 - protein, 22 aa, Staphylococcus
DFKGSWSVVCFYPADFSFVCPT

SEQ ID NO: 2049661 - protein, 21 aa, Staphylococcus
DFKSLCFHVPFTKMGKKALDS

SEQ ID NO: 2049662 - protein, 17 aa, Staphylococcus
DFLKGCMRQALLDEGKL

SEQ ID NO: 2049663 - protein, 17 aa, Staphylococcus
DFLRGCMRQSLIDQGKL

SEQ ID NO: 2049664 - protein, 18 aa, Staphylococcus
DFNGISFLNLVDFDALYG

SEQ ID NO: 2049665 - protein, 19 aa, Staphylococcus
DFNGLSFLNLVDFDALYGH

SEQ ID NO: 2049666 - protein, 17 aa, Staphylococcus
DFSFKRLNNITDFSQVS

SEQ ID NO: 2049667 - protein, 17 aa, Staphylococcus
DFTHWRKIMGVAPISDE

SEQ ID NO: 2049668 - protein, 17 aa, Staphylococcus
DFTNAYFKRIFNILHDY

SEQ ID NO: 2049669 - protein, 17 aa, Staphylococcus
DFVFAWRKVVDPKTGSE

SEQ ID NO: 2049670 - protein, 18 aa, Staphylococcus
DFVKRGAANLAILTEDPD

SEQ ID NO: 2049671 - protein, 18 aa, Staphylococcus
DGAFFKNKRLFVIGGGDS

SEQ ID NO: 2049672 - protein, 23 aa, Staphylococcus
DGATKEFFAWGLRVGFMSFGVSN

SEQ ID NO: 2049673 - protein, 17 aa, Staphylococcus
DGCPDYFTTLGYASAAQ

SEQ ID NO: 2049674 - protein, 23 aa, Staphylococcus
DGDTRGGAALSIRAVTHKPIKFV

SEQ ID NO: 2049675 - protein, 24 aa, Staphylococcus
DGEIWSTLCSFGYAQQNIDLLNQI

SEQ ID NO: 2049676 - protein, 19 aa, Staphylococcus
DGICAISFFMNASLKEIKE

SEQ ID NO: 2049677 - protein, 19 aa, Staphylococcus
DGIQGYLFYKARKHHLNTP

SEQ ID NO: 2049678 - protein, 25 aa, Staphylococcus
DGIYIDVFCEFKYGINISKTATKIQ

SEQ ID NO: 2049679 - protein, 19 aa, Staphylococcus
DGLCAISFFMTSTVSDINS

SEQ ID NO: 2049680 - protein, 19 aa, Staphylococcus
DGNTGAWIRVYELNPDGTK

SEQ ID NO: 2049681 - protein, 18 aa, Staphylococcus
DGQYRGLATWKYDEERQT

SEQ ID NO: 2049682 - protein, 25 aa, Staphylococcus
DGRGGAQCWDLPNYIFGRYWNFWCN

SEQ ID NO: 2049683 - protein, 18 aa, Staphylococcus
DGRHAIQYLKQRNLGRAT

SEQ ID NO: 2049684 - protein, 17 aa, Staphylococcus
DGVKGEVLVNAFSKQDV

SEQ ID NO: 2049685 - protein, 23 aa, Staphylococcus
DGVPCFLDNKWSRDTIDKLIEHF

SEQ ID NO: 2049686 - protein, 19 aa, Staphylococcus
DGYKLDFPESVVSFFKGEI

SEQ ID NO: 2049687 - protein, 17 aa, Staphylococcus
DGYRFAKNLGHTITELF

SEQ ID NO: 2049688 - protein, 17 aa, Staphylococcus
DHCSVCHAVLPQIEDIV

SEQ ID NO: 2049689 - protein, 19 aa, Staphylococcus
DHVRNLGALVMATTHYPEL

SEQ ID NO: 2049690 - protein, 17 aa, Staphylococcus
DIDEDFLLVKREIFSSG

SEQ ID NO: 2049691 - protein, 17 aa, Staphylococcus
DIDRFGIQEVIERSLEY

SEQ ID NO: 2049692 - protein, 24 aa, Staphylococcus
DIDVPRTDWDWMIYPQGLYDQIMR

SEQ ID NO: 2049693 - protein, 27 aa, Staphylococcus
DIEYKFPFGWGELWGIASRTDFDLKQH

SEQ ID NO: 2049694 - protein, 27 aa, Staphylococcus
DIEYKFPFGWGELWGIASRTDFDLQKH

SEQ ID NO: 2049695 - protein, 27 aa, Staphylococcus
DIEYKFPFGWGELWGIASRTDYDLKQH

SEQ ID NO: 2049696 - protein, 18 aa, Staphylococcus
DIEYLKYAKDYGFSDKVI

SEQ ID NO: 2049697 - protein, 18 aa, Staphylococcus
DIFAPCALGGVLNDDTIP

SEQ ID NO: 2049698 - protein, 17 aa, Staphylococcus
DIFGGYILYKMGYIESE

SEQ ID NO: 2049699 - protein, 22 aa, Staphylococcus
DIFPKTRLDVELDKSDSITSSI

SEQ ID NO: 2049700 - protein, 24 aa, Staphylococcus
DIIDEFKDLGGYEFEEIENRVVQF

SEQ ID NO: 2049701 - protein, 23 aa, Staphylococcus
DIIDEFKSLGGYEYDDIENRVVQ

SEQ ID NO: 2049702 - protein, 18 aa, Staphylococcus
DIKAFPFILYDRNFYKKN

SEQ ID NO: 2049703 - protein, 21 aa, Staphylococcus
DIKKAQGYLATFVSHNCTGMI

SEQ ID NO: 2049704 - protein, 20 aa, Staphylococcus
DIKKEYYVGFVIDRATDRVT

SEQ ID NO: 2049705 - protein, 18 aa, Staphylococcus
DIKWPKQLGHLIDIPNKG

SEQ ID NO: 2049706 - protein, 18 aa, Staphylococcus
DILKEFDNAVILFMGAGD

SEQ ID NO: 2049707 - protein, 19 aa, Staphylococcus
DILRAPGFFRNLTVMPHAQ

SEQ ID NO: 2049708 - protein, 17 aa, Staphylococcus
DILSCLHIQGRPVIEAR

SEQ ID NO: 2049709 - protein, 17 aa, Staphylococcus
DINILPIVEEFRESQAE

SEQ ID NO: 2049710 - protein, 17 aa, Staphylococcus
DINRLATRLIFIKNGEV

SEQ ID NO: 2049711 - protein, 20 aa, Staphylococcus
DIPASWKLVAQMPFGDIEEQ

SEQ ID NO: 2049712 - protein, 17 aa, Staphylococcus
DIPFCILGKTALCKGKG

SEQ ID NO: 2049713 - protein, 21 aa, Staphylococcus
DIPGELIMKVLAFNPDLEKIN

SEQ ID NO: 2049714 - protein, 25 aa, Staphylococcus
DIPNTWKLIAQMPFGDVRESANEKE

SEQ ID NO: 2049715 - protein, 17 aa, Staphylococcus
DIQRKWIKKFKTIEDTF

SEQ ID NO: 2049716 - protein, 17 aa, Staphylococcus
DIRAVLGRFLFVQEDVK

SEQ ID NO: 2049717 - protein, 18 aa, Staphylococcus
DIREHVGIVFQNPENQFV

SEQ ID NO: 2049718 - protein, 23 aa, Staphylococcus
DIRMREVISYFATYVFEKNAEIP

SEQ ID NO: 2049719 - protein, 17 aa, Staphylococcus
DISEDWNLGEITRQMAN

SEQ ID NO: 2049720 - protein, 21 aa, Staphylococcus
DISKWSFQTEMFFLCNRYKQA

SEQ ID NO: 2049721 - protein, 23 aa, Staphylococcus
DISKWSFQTEMFFLCNRYKQAQD

SEQ ID NO: 2049722 - protein, 21 aa, Staphylococcus
DISKWSFQTEMFFLCNRYKQF

SEQ ID NO: 2049723 - protein, 23 aa, Staphylococcus
DISKWSFQTEMFFLCNRYKQFKD

SEQ ID NO: 2049724 - protein, 21 aa, Staphylococcus
DISKWSFQTEMFFLCNRYKQL

SEQ ID NO: 2049725 - protein, 18 aa, Staphylococcus
DIVCAGASAVLFGSVNAI

SEQ ID NO: 2049726 - protein, 20 aa, Staphylococcus
DIVCAGASAVLFGSVNAILG

SEQ ID NO: 2049727 - protein, 23 aa, Staphylococcus
DIVCAGASAVLFGSVNAILSLTS

SEQ ID NO: 2049728 - protein, 23 aa, Staphylococcus
DIVCAGASAVLFGSVNAIMGLTS

SEQ ID NO: 2049729 - protein, 20 aa, Staphylococcus
DIWPEIKRQFIILDTTPSAD

SEQ ID NO: 2049730 - protein, 18 aa, Staphylococcus
DIYKRGIGSLLIEAGPRI

SEQ ID NO: 2049731 - protein, 24 aa, Staphylococcus
DKEIKSSMVGTFFLQDSKELTDPQ

SEQ ID NO: 2049732 - protein, 21 aa, Staphylococcus
DKERFFGMHFFNPPRIMKLVE

SEQ ID NO: 2049733 - protein, 18 aa, Staphylococcus
DKEVQIFTSLIVREDAQL

SEQ ID NO: 2049734 - protein, 17 aa, Staphylococcus
DKFLLRIVEYDLFNNCN

SEQ ID NO: 2049735 - protein, 19 aa, Staphylococcus
DKGDSWLPIGTRFTYNSPF

SEQ ID NO: 2049736 - protein, 21 aa, Staphylococcus
DKGEIFPSFTIPLEHPGFKQL

SEQ ID NO: 2049737 - protein, 24 aa, Staphylococcus
DKHHLRICGGFQFSSHKSDDEWRE

SEQ ID NO: 2049738 - protein, 17 aa, Staphylococcus
DKHRWEPKSGITLIGDA

SEQ ID NO: 2049739 - protein, 25 aa, Staphylococcus
DKLKARLILMITRFSLYLRKATPEA

SEQ ID NO: 2049740 - protein, 24 aa, Staphylococcus
DKLKARLILMITRFSVYLRKATPE

SEQ ID NO: 2049741 - protein, 25 aa, Staphylococcus
DKLKSRLTMMISRFSVYLREATPEA

SEQ ID NO: 2049742 - protein, 17 aa, Staphylococcus
DKLMCDFAKAIKSAIEN

SEQ ID NO: 2049743 - protein, 22 aa, Staphylococcus
DKMKDWYEKFGFGKSTNGMFDG

SEQ ID NO: 2049744 - protein, 24 aa, Staphylococcus
DKNGCPVRHAILWNDTRNSAQCEQ

SEQ ID NO: 2049745 - protein, 18 aa, Staphylococcus
DKPLVCVGILKGSVMFMA

SEQ ID NO: 2049746 - protein, 17 aa, Staphylococcus
DKRIELMIEDAQVSAIL

SEQ ID NO: 2049747 - protein, 18 aa, Staphylococcus
DKTWSVHVPRRIKEIGPR

SEQ ID NO: 2049748 - protein, 18 aa, Staphylococcus
DKYFGLAISCGQPENHYS

SEQ ID NO: 2049749 - protein, 17 aa, Staphylococcus
DLADFNAHFDSWFSETT

SEQ ID NO: 2049750 - protein, 18 aa, Staphylococcus
DLADFNVHFDNWFSETSL

SEQ ID NO: 2049751 - protein, 22 aa, Staphylococcus
DLDPVFMWHLAYALGQEERDKE

SEQ ID NO: 2049752 - protein, 23 aa, Staphylococcus
DLDPVFMWHLAYAYGHEERDKEA

SEQ ID NO: 2049753 - protein, 22 aa, Staphylococcus
DLDPVFMWHLAYAYGQEERDKE

SEQ ID NO: 2049754 - protein, 17 aa, Staphylococcus
DLEHGKHGFAFGSGMAA

SEQ ID NO: 2049755 - protein, 17 aa, Staphylococcus
DLFKQFKQGAVFINAAR

SEQ ID NO: 2049756 - protein, 23 aa, Staphylococcus
DLFTCLRPVRWFQGVPSPVKRPQ

SEQ ID NO: 2049757 - protein, 22 aa, Staphylococcus
DLIELKIPIAYFYIEDNDFFNC

SEQ ID NO: 2049758 - protein, 17 aa, Staphylococcus
DLIKRIDTHLAIDFMDV

SEQ ID NO: 2049759 - protein, 18 aa, Staphylococcus
DLKAFAKNGSINFDYQDK

SEQ ID NO: 2049760 - protein, 17 aa, Staphylococcus
DLKAHRMVNVILDKEAA

SEQ ID NO: 2049761 - protein, 24 aa, Staphylococcus
DLKDRYEFIGGLSPLAGTTDRQAE

SEQ ID NO: 2049762 - protein, 23 aa, Staphylococcus
DLKDRYEFIGGLSPLAKTTNKQA

SEQ ID NO: 2049763 - protein, 17 aa, Staphylococcus
DLKEGADMMIVKPALSY

SEQ ID NO: 2049764 - protein, 22 aa, Staphylococcus
DLKGSWSVVCFYPADFSFVCPT

SEQ ID NO: 2049765 - protein, 24 aa, Staphylococcus
DLKNRYEFIGGLSPLAGTTDRQAE

SEQ ID NO: 2049766 - protein, 24 aa, Staphylococcus
DLKNRYEFIGGLSPLAGTTNRQAE

SEQ ID NO: 2049767 - protein, 24 aa, Staphylococcus
DLKQRYEFIGGLSPLAGTTDRQAE

SEQ ID NO: 2049768 - protein, 21 aa, Staphylococcus
DLLEPAFLVYWFQLAPEVHSQ

SEQ ID NO: 2049769 - protein, 21 aa, Staphylococcus
DLLKQVCSLKYVLRVNDLLVP

SEQ ID NO: 2049770 - protein, 24 aa, Staphylococcus
DLLKRLCKMNEKFDTTIIMVTHDP

SEQ ID NO: 2049771 - protein, 27 aa, Staphylococcus
DLLLRRIYKLPIGFKWDNQANLTLIGD

SEQ ID NO: 2049772 - protein, 20 aa, Staphylococcus
DLLRQHGFKVFGPNQDAAQI

SEQ ID NO: 2049773 - protein, 25 aa, Staphylococcus
DLLSKRLKSEFGLKFDKCATKHLTI

SEQ ID NO: 2049774 - protein, 18 aa, Staphylococcus
DLMIRVEVVLGEFSNLDI

SEQ ID NO: 2049775 - protein, 25 aa, Staphylococcus
DLPEEMNPFLGYRAIRLCLAQPDIF

SEQ ID NO: 2049776 - protein, 24 aa, Staphylococcus
DLPEEMNPFLGYRAIRLCLDQPEI

SEQ ID NO: 2049777 - protein, 22 aa, Staphylococcus
DLPRPAGKDILHFSDYYEGAQK

SEQ ID NO: 2049778 - protein, 24 aa, Staphylococcus
DLQFSVALSTIWKFISRTNKYIDE

SEQ ID NO: 2049779 - protein, 19 aa, Staphylococcus
DLRRLGLRVYFNIENALVS

SEQ ID NO: 2049780 - protein, 19 aa, Staphylococcus
DLRRLGLRVYFNIKNALVS

SEQ ID NO: 2049781 - protein, 23 aa, Staphylococcus
DLSRGCSIEDVYNLSIITAAQSL

SEQ ID NO: 2049782 - protein, 23 aa, Staphylococcus
DLSRGCSIEDVYNLSIITAAQTL

SEQ ID NO: 2049783 - protein, 19 aa, Staphylococcus
DMHLSVWKGLWNSIKKNGT

SEQ ID NO: 2049784 - protein, 17 aa, Staphylococcus
DMIKYKYPRLFDNVSKA

SEQ ID NO: 2049785 - protein, 17 aa, Staphylococcus
DMKRLAPRIQYLVQIVK

SEQ ID NO: 2049786 - protein, 19 aa, Staphylococcus
DMMPKFNLFIALGIRDAIQ

SEQ ID NO: 2049787 - protein, 24 aa, Staphylococcus
DMMRYWLDKGVDGFRMDVINMISK

SEQ ID NO: 2049788 - protein, 22 aa, Staphylococcus
DMNVDWKKRIHMIIGTDEESDW

SEQ ID NO: 2049789 - protein, 22 aa, Staphylococcus
DMNVDWKKRVHIIVGTDEESDW

SEQ ID NO: 2049790 - protein, 21 aa, Staphylococcus
DMQRLAPRVAYLAQVTADVIE

SEQ ID NO: 2049791 - protein, 23 aa, Staphylococcus
DMRLKNLYFKYLILIEQSLKNNV

SEQ ID NO: 2049792 - protein, 17 aa, Staphylococcus
DMYRLLGLAKYEDRFVV

SEQ ID NO: 2049793 - protein, 22 aa, Staphylococcus
DNAIWYKLLVNLAINSVTALTR

SEQ ID NO: 2049794 - protein, 19 aa, Staphylococcus
DNDLAWLIEMMLPRMQSHQ

SEQ ID NO: 2049795 - protein, 18 aa, Staphylococcus
DNDLKWLIDIMATRMKER

SEQ ID NO: 2049796 - protein, 21 aa, Staphylococcus
DNFKGTILFVSHDRYFINQLA

SEQ ID NO: 2049797 - protein, 17 aa, Staphylococcus
DNFKRIRIGIGRPTNGM

SEQ ID NO: 2049798 - protein, 17 aa, Staphylococcus
DNGFDFYAPQTFLDENG

SEQ ID NO: 2049799 - protein, 17 aa, Staphylococcus
DNGFKLAADIKVTLENI

SEQ ID NO: 2049800 - protein, 24 aa, Staphylococcus
DNGIKFFGADGFKLSDAQEEEIET

SEQ ID NO: 2049801 - protein, 24 aa, Staphylococcus
DNGIKFFGADGFKLSDKQEEEIEQ

SEQ ID NO: 2049802 - protein, 24 aa, Staphylococcus
DNGIKFFGSDGFKLSDDQEEEIEA

SEQ ID NO: 2049803 - protein, 24 aa, Staphylococcus
DNGIKFFGSDGFKLSDDQENEIEA

SEQ ID NO: 2049804 - protein, 24 aa, Staphylococcus
DNGIKFFGSDGFKLSDDQENEIEE

SEQ ID NO: 2049805 - protein, 24 aa, Staphylococcus
DNGIKFFGSDGFKLSDDQEQEIEH

SEQ ID NO: 2049806 - protein, 24 aa, Staphylococcus
DNGIKFFGSDGFKLSDDQESEIEA

SEQ ID NO: 2049807 - protein, 17 aa, Staphylococcus
DNGLELLLHIGLDTVQL

SEQ ID NO: 2049808 - protein, 17 aa, Staphylococcus
DNHGWHFDKFYPHEPNH

SEQ ID NO: 2049809 - protein, 19 aa, Staphylococcus
DNILKFGLYTGEHHVVINA

SEQ ID NO: 2049810 - protein, 20 aa, Staphylococcus
DNLAGFLRLNFNDERFGLTD

SEQ ID NO: 2049811 - protein, 18 aa, Staphylococcus
DNLEDWYRKGAFAVGIGS

SEQ ID NO: 2049812 - protein, 18 aa, Staphylococcus
DNLPELLEAFPFQEVHGT

SEQ ID NO: 2049813 - protein, 17 aa, Staphylococcus
DNPLKQKVCDVALESFD

SEQ ID NO: 2049814 - protein, 17 aa, Staphylococcus
DNPLKQKVCDVATMAFE

SEQ ID NO: 2049815 - protein, 19 aa, Staphylococcus
DNVSAKRIIDFLSGTVYAI

SEQ ID NO: 2049816 - protein, 17 aa, Staphylococcus
DNWIKWYDMKVVDETDT

SEQ ID NO: 2049817 - protein, 18 aa, Staphylococcus
DNYIKIWEFYATLADNNY

SEQ ID NO: 2049818 - protein, 17 aa, Staphylococcus
DPDQCILCGRCVEACQD

SEQ ID NO: 2049819 - protein, 18 aa, Staphylococcus
DPELCVLKVIPKSIKLMN

SEQ ID NO: 2049820 - protein, 22 aa, Staphylococcus
DPERLKAGILFTLEEECIKQGH

SEQ ID NO: 2049821 - protein, 22 aa, Staphylococcus
DPERLKAGLLYTLEEECIKQGH

SEQ ID NO: 2049822 - protein, 22 aa, Staphylococcus
DPKFKRWVIGSIISRTYYHNMV

SEQ ID NO: 2049823 - protein, 21 aa, Staphylococcus
DPKFKRWVIGSILSRTYYHNM

SEQ ID NO: 2049824 - protein, 22 aa, Staphylococcus
DPKFKRWVIGSILSRTYYHNMV

SEQ ID NO: 2049825 - protein, 19 aa, Staphylococcus
DPLLKFDLEFIRNNAKSVI

SEQ ID NO: 2049826 - protein, 21 aa, Staphylococcus
DPLRYNLLFERFLNPERVTMP

SEQ ID NO: 2049827 - protein, 22 aa, Staphylococcus
DPNKAFCFGMNYVLESDDEAYR

SEQ ID NO: 2049828 - protein, 17 aa, Staphylococcus
DPNLCVLKVVPKTIKLM

SEQ ID NO: 2049829 - protein, 22 aa, Staphylococcus
DPRGSFYIWFEFSISINVKTLF

SEQ ID NO: 2049830 - protein, 20 aa, Staphylococcus
DPTLMLAFKLAKQFDTTVDD

SEQ ID NO: 2049831 - protein, 21 aa, Staphylococcus
DPVYWKKLFKRYENWINNFNA

SEQ ID NO: 2049832 - protein, 22 aa, Staphylococcus
DQANCLVHPLFIDPYHLIYPSE

SEQ ID NO: 2049833 - protein, 19 aa, Staphylococcus
DQARHILAHFMFYGKDVFK

SEQ ID NO: 2049834 - protein, 18 aa, Staphylococcus
DQFKLRVSEYNDLDLVNS

SEQ ID NO: 2049835 - protein, 17 aa, Staphylococcus
DQFKRIRIGVGRPTNGM

SEQ ID NO: 2049836 - protein, 17 aa, Staphylococcus
DQLPCWLTYTNDRTHKV

SEQ ID NO: 2049837 - protein, 17 aa, Staphylococcus
DQNTKWLSVLPIYHISG

SEQ ID NO: 2049838 - protein, 17 aa, Staphylococcus
DQSIPFLIAGGIDVDKI

SEQ ID NO: 2049839 - protein, 17 aa, Staphylococcus
DQTLRLFTNYQIYLHGY

SEQ ID NO: 2049840 - protein, 17 aa, Staphylococcus
DRAESWLSQTLKDINLE

SEQ ID NO: 2049841 - protein, 17 aa, Staphylococcus
DRFDTIEAFKYADLSQF

SEQ ID NO: 2049842 - protein, 19 aa, Staphylococcus
DRGDSRFYLSLQDELMIRF

SEQ ID NO: 2049843 - protein, 19 aa, Staphylococcus
DRGDSRFYLSLQDELMVRF

SEQ ID NO: 2049844 - protein, 22 aa, Staphylococcus
DRGESRFYLSLQDELMVRFGSE

SEQ ID NO: 2049845 - protein, 18 aa, Staphylococcus
DRGFDFYAPQTFLDKNGQ

SEQ ID NO: 2049846 - protein, 18 aa, Staphylococcus
DRILKPLKLMNANINGIE

SEQ ID NO: 2049847 - protein, 19 aa, Staphylococcus
DRIRLTFDIEDGVINDAKF

SEQ ID NO: 2049848 - protein, 18 aa, Staphylococcus
DRKIPLILVFEGMDAAGK

SEQ ID NO: 2049849 - protein, 20 aa, Staphylococcus
DRKIPLILVFEGMDAAGKGG

SEQ ID NO: 2049850 - protein, 21 aa, Staphylococcus
DRLICDWLKIVDDILPRLIQE

SEQ ID NO: 2049851 - protein, 17 aa, Staphylococcus
DRMPKIVIVIDELADLM

SEQ ID NO: 2049852 - protein, 18 aa, Staphylococcus
DRMYEFLDKLIAVSLPRV

SEQ ID NO: 2049853 - protein, 19 aa, Staphylococcus
DRPLVCVGILKGSVMFMAD

SEQ ID NO: 2049854 - protein, 17 aa, Staphylococcus
DRVDIILPAVSVFKTLY

SEQ ID NO: 2049855 - protein, 18 aa, Staphylococcus
DRVDIILPAVSVFKVLFN

SEQ ID NO: 2049856 - protein, 18 aa, Staphylococcus
DRYDNFVFLFENEFATRW

SEQ ID NO: 2049857 - protein, 21 aa, Staphylococcus
DRYIEMTSDFLALYGTYTRTW

SEQ ID NO: 2049858 - protein, 18 aa, Staphylococcus
DRYLAAFVYMHYKYTNHA

SEQ ID NO: 2049859 - protein, 19 aa, Staphylococcus
DSARLQYLISREFDVAPAS

SEQ ID NO: 2049860 - protein, 19 aa, Staphylococcus
DSFKPLLHYARLKDMKHYQ

SEQ ID NO: 2049861 - protein, 19 aa, Staphylococcus
DSIGLILGFLVQKFTENNE

SEQ ID NO: 2049862 - protein, 19 aa, Staphylococcus
DSIGLILGFLVQKFTENNK

SEQ ID NO: 2049863 - protein, 21 aa, Staphylococcus
DSKELFKLIALESQHAGLSWL

SEQ ID NO: 2049864 - protein, 24 aa, Staphylococcus
DSKKRFDEMLGWFKYEIRQYTESD

SEQ ID NO: 2049865 - protein, 18 aa, Staphylococcus
DSKWKIGVIPSFSLTNKY

SEQ ID NO: 2049866 - protein, 17 aa, Staphylococcus
DSLKMLISYPGYSGYDI

SEQ ID NO: 2049867 - protein, 17 aa, Staphylococcus
DSLPEVEHLFIICSTQG

SEQ ID NO: 2049868 - protein, 17 aa, Staphylococcus
DSLRFNKKIQMIFQDPY

SEQ ID NO: 2049869 - protein, 17 aa, Staphylococcus
DSMNWNEITEGIDHIPG

SEQ ID NO: 2049870 - protein, 18 aa, Staphylococcus
DSPFFRRRVRGIVSKAQR

SEQ ID NO: 2049871 - protein, 25 aa, Staphylococcus
DSPFGKGRPGWHIECSVMAYHELGA

SEQ ID NO: 2049872 - protein, 25 aa, Staphylococcus
DSPFGKGRPGWHIECSVMAYNELGE

SEQ ID NO: 2049873 - protein, 18 aa, Staphylococcus
DSPGGWQIIGRTPLDVFD

SEQ ID NO: 2049874 - protein, 17 aa, Staphylococcus
DSPGGWQIIGRTPLKVF

SEQ ID NO: 2049875 - protein, 18 aa, Staphylococcus
DSPVKFAQHIGGTSHFNY

SEQ ID NO: 2049876 - protein, 17 aa, Staphylococcus
DSREYKELISLMTKIKV

SEQ ID NO: 2049877 - protein, 23 aa, Staphylococcus
DSTVCILEAMKLFNEIQAEITGE

SEQ ID NO: 2049878 - protein, 23 aa, Staphylococcus
DSTVCILEAMKLFNEIQAEVTGE

SEQ ID NO: 2049879 - protein, 18 aa, Staphylococcus
DTAFKRRFEHVYVSTKIK

SEQ ID NO: 2049880 - protein, 27 aa, Staphylococcus
DTGFYRFRIQGIFARWPNNPNIEDLIQ

SEQ ID NO: 2049881 - protein, 18 aa, Staphylococcus
DTILKFGFYDGVDHVVID

SEQ ID NO: 2049882 - protein, 23 aa, Staphylococcus
DTTVCILEAMKLFNEIQAETSGE

SEQ ID NO: 2049883 - protein, 25 aa, Staphylococcus
DTVAINILEEWSHSVAEGIAQLQII

SEQ ID NO: 2049884 - protein, 17 aa, Staphylococcus
DTVLYLMHYHHRISEAE

SEQ ID NO: 2049885 - protein, 22 aa, Staphylococcus
DTVWKFAEKVIFPYVEDDELVG

SEQ ID NO: 2049886 - protein, 19 aa, Staphylococcus
DVAMAFGFFDGMHRGHSKV

SEQ ID NO: 2049887 - protein, 17 aa, Staphylococcus
DVDKFNAFFAWYNSGAK

SEQ ID NO: 2049888 - protein, 21 aa, Staphylococcus
DVDMLRMCRYPWKTKQRILGD

SEQ ID NO: 2049889 - protein, 25 aa, Staphylococcus
DVDMLRMCRYPWKTKQRILGDMGHV

SEQ ID NO: 2049890 - protein, 23 aa, Staphylococcus
DVDVPRTDWDWMIYPQGLYDQIM

SEQ ID NO: 2049891 - protein, 24 aa, Staphylococcus
DVDVPRTDWDWMIYPQGLYDQIMR

SEQ ID NO: 2049892 - protein, 23 aa, Staphylococcus
DVEIRKGRLTSMIGPNGAGKSTL

SEQ ID NO: 2049893 - protein, 17 aa, Staphylococcus
DVFLGFDCASSEFFEDG

SEQ ID NO: 2049894 - protein, 21 aa, Staphylococcus
DVIDVFPIRFIVDGDNEVSDP

SEQ ID NO: 2049895 - protein, 20 aa, Staphylococcus
DVIIKAIRLMKVLDDAKILD

SEQ ID NO: 2049896 - protein, 22 aa, Staphylococcus
DVIPCFEYRNYLSFGNSEEDRE

SEQ ID NO: 2049897 - protein, 20 aa, Staphylococcus
DVLDRFGTWVGHKTIVGTPE

SEQ ID NO: 2049898 - protein, 17 aa, Staphylococcus
DVLKGELLVSGKTTVYF

SEQ ID NO: 2049899 - protein, 20 aa, Staphylococcus
DVLKHLQIRGSVALIGNTDG

SEQ ID NO: 2049900 - protein, 17 aa, Staphylococcus
DVLLPWEKLDKVNLLKD

SEQ ID NO: 2049901 - protein, 22 aa, Staphylococcus
DVLVCTVIGFPLGATTTATKIF

SEQ ID NO: 2049902 - protein, 22 aa, Staphylococcus
DVLVCTVIGFPLGATTTDVKVF

SEQ ID NO: 2049903 - protein, 20 aa, Staphylococcus
DVLVEPFFEWVVEADAWYGP

SEQ ID NO: 2049904 - protein, 18 aa, Staphylococcus
DVMVEPFFEWVVEKDAWY

SEQ ID NO: 2049905 - protein, 20 aa, Staphylococcus
DVMVEPFFEWVVEKDAWYGE

SEQ ID NO: 2049906 - protein, 19 aa, Staphylococcus
DVPRGEFFIWLKLNGNVNI

SEQ ID NO: 2049907 - protein, 21 aa, Staphylococcus
DVPTGLWLGELVHFYDLMHQN

SEQ ID NO: 2049908 - protein, 29 aa, Staphylococcus
DVRKAVFDMMNWWFDKGIDGFRVDAITHI

SEQ ID NO: 2049909 - protein, 17 aa, Staphylococcus
DVRLYELGSVFFANGED

SEQ ID NO: 2049910 - protein, 17 aa, Staphylococcus
DVYKRLLNEAGFKEVKT

SEQ ID NO: 2049911 - protein, 20 aa, Staphylococcus
DVYRAIGYPVQFVGKNDNIE

SEQ ID NO: 2049912 - protein, 20 aa, Staphylococcus
DWDIKVDQLFYVSKFDHPNN

SEQ ID NO: 2049913 - protein, 21 aa, Staphylococcus
DWGSFFMPKFNFVINVTNENR

SEQ ID NO: 2049914 - protein, 22 aa, Staphylococcus
DWKERLRMLKAFPTPTERDFPL

SEQ ID NO: 2049915 - protein, 25 aa, Staphylococcus
DWNKEGWGNIPMTLGFTYSSNTLMM

SEQ ID NO: 2049916 - protein, 18 aa, Staphylococcus
DWNKTGWGKIPMSLGFTY

SEQ ID NO: 2049917 - protein, 19 aa, Staphylococcus
DWNKVGWGKIPMSLGFTYS

SEQ ID NO: 2049918 - protein, 22 aa, Staphylococcus
DWREPGCSMCLGMNPDQVPNGV

SEQ ID NO: 2049919 - protein, 17 aa, Staphylococcus
DWSRFTIAVGKLSKTKI

SEQ ID NO: 2049920 - protein, 23 aa, Staphylococcus
DWWKDVEAAYHFLQAEGYQEIDV

SEQ ID NO: 2049921 - protein, 25 aa, Staphylococcus
DYAYLKRPMLFFAYDLEKYLYSERG

SEQ ID NO: 2049922 - protein, 19 aa, Staphylococcus
DYDALLIPGGFSPDYLRGD

SEQ ID NO: 2049923 - protein, 18 aa, Staphylococcus
DYDGLLIPGGFAPDHLRG

SEQ ID NO: 2049924 - protein, 17 aa, Staphylococcus
DYDGLLIPGGFSPDHLR

SEQ ID NO: 2049925 - protein, 25 aa, Staphylococcus
DYEEMKPLYEWLGLTTSLGFVENPQ

SEQ ID NO: 2049926 - protein, 17 aa, Staphylococcus
DYEKLLGLKDVYKNKNI

SEQ ID NO: 2049927 - protein, 24 aa, Staphylococcus
DYELDYFAGLSFRTLMPELPETLP

SEQ ID NO: 2049928 - protein, 18 aa, Staphylococcus
DYERVRLALGLKNDDILL

SEQ ID NO: 2049929 - protein, 17 aa, Staphylococcus
DYIKAHGYGNEFGHSLG

SEQ ID NO: 2049930 - protein, 21 aa, Staphylococcus
DYIKYLGVDYIWLTPIYESPM

SEQ ID NO: 2049931 - protein, 17 aa, Staphylococcus
DYIKYPFTYLSVGAANA

SEQ ID NO: 2049932 - protein, 23 aa, Staphylococcus
DYIYLIEYARLFAIGAAKATDLN

SEQ ID NO: 2049933 - protein, 25 aa, Staphylococcus
DYKKRWGQKEVQTFHGTFMKTMGFD

SEQ ID NO: 2049934 - protein, 18 aa, Staphylococcus
DYLFFKFAIHTGVKLSEL

SEQ ID NO: 2049935 - protein, 18 aa, Staphylococcus
DYLKDLRFTGSIRAMEEG

SEQ ID NO: 2049936 - protein, 20 aa, Staphylococcus
DYMVRPPFFIEWNKNKVDHM

SEQ ID NO: 2049937 - protein, 19 aa, Staphylococcus
DYPELKLGIITPFLGHTHR

SEQ ID NO: 2049938 - protein, 21 aa, Staphylococcus
DYPEWELGLQIIKPEQEFDFD

SEQ ID NO: 2049939 - protein, 18 aa, Staphylococcus
DYPIAVIFNASWYNETTV

SEQ ID NO: 2049940 - protein, 19 aa, Staphylococcus
DYQFALDHLHVFKPEARSI

SEQ ID NO: 2049941 - protein, 19 aa, Staphylococcus
DYRCSWCDSAFTWDGSAKD

SEQ ID NO: 2049942 - protein, 20 aa, Staphylococcus
EAAEALPINVGFTGKGQAVN

SEQ ID NO: 2049943 - protein, 20 aa, Staphylococcus
EAAEGLPINVGFTGKGQAHN

SEQ ID NO: 2049944 - protein, 18 aa, Staphylococcus
EAAKAFAQEAGFPLMIKA

SEQ ID NO: 2049945 - protein, 19 aa, Staphylococcus
EAAMLAGYFSKAGLSGQIP

SEQ ID NO: 2049946 - protein, 19 aa, Staphylococcus
EAAMLSGYFSKAGSSAQIP

SEQ ID NO: 2049947 - protein, 17 aa, Staphylococcus
EAARLVLQAGALATGGE

SEQ ID NO: 2049948 - protein, 17 aa, Staphylococcus
EACILAYSHTKKNKIVV

SEQ ID NO: 2049949 - protein, 17 aa, Staphylococcus
EACKGDGIIKIEMHFLP

SEQ ID NO: 2049950 - protein, 20 aa, Staphylococcus
EADFKRWGINLVLLGDKLAI

SEQ ID NO: 2049951 - protein, 28 aa, Staphylococcus
EAFDIPKTWKLVAQMPFGNIRDEAGEKA

SEQ ID NO: 2049952 - protein, 18 aa, Staphylococcus
EAGYHLAIATGRPRTETI

SEQ ID NO: 2049953 - protein, 23 aa, Staphylococcus
EAHKRLNSAIIITGKEDVVIQDN

SEQ ID NO: 2049954 - protein, 17 aa, Staphylococcus
EAIELIQKVKLNFKNIK

SEQ ID NO: 2049955 - protein, 20 aa, Staphylococcus
EAKEYWLCWVTTERSESGPY

SEQ ID NO: 2049956 - protein, 20 aa, Staphylococcus
EAKHIVFICGHYEGYDERIR

SEQ ID NO: 2049957 - protein, 18 aa, Staphylococcus
EALDMVVGFVALEQLYTS

SEQ ID NO: 2049958 - protein, 20 aa, Staphylococcus
EALFNFIALLGWSPEGEDEI

SEQ ID NO: 2049959 - protein, 19 aa, Staphylococcus
EALFNFITLLGWSPEGEDE

SEQ ID NO: 2049960 - protein, 19 aa, Staphylococcus
EALFNFITLLGWSPEGENE

SEQ ID NO: 2049961 - protein, 18 aa, Staphylococcus
EALIRFSKMEGIIPAIES

SEQ ID NO: 2049962 - protein, 19 aa, Staphylococcus
EALKAGITMYQFREKGPSS

SEQ ID NO: 2049963 - protein, 22 aa, Staphylococcus
EALLPEYPRALIFKSAAFQGDW

SEQ ID NO: 2049964 - protein, 17 aa, Staphylococcus
EALTGRAAFLYLEGIQH

SEQ ID NO: 2049965 - protein, 17 aa, Staphylococcus
EAMIILFPKLFKQQDNT

SEQ ID NO: 2049966 - protein, 19 aa, Staphylococcus
EAMKGLRVFNQNTKLIAVT

SEQ ID NO: 2049967 - protein, 18 aa, Staphylococcus
EAMMRWFVENDILKVNQE

SEQ ID NO: 2049968 - protein, 19 aa, Staphylococcus
EAQTGIVYAYFINSDLSEL

SEQ ID NO: 2049969 - protein, 21 aa, Staphylococcus
EARRLRYQWFGEVIRDLNADV

SEQ ID NO: 2049970 - protein, 17 aa, Staphylococcus
EASSLPENMIWFDLEQR

SEQ ID NO: 2049971 - protein, 18 aa, Staphylococcus
EATDFKEDDIELFRDIAD

SEQ ID NO: 2049972 - protein, 17 aa, Staphylococcus
EATDFKEEDIELFRDIA

SEQ ID NO: 2049973 - protein, 17 aa, Staphylococcus
EAVRYLIGVGFSKQLIT

SEQ ID NO: 2049974 - protein, 20 aa, Staphylococcus
EAYLLLDFHSMIFNDNQLQI

SEQ ID NO: 2049975 - protein, 20 aa, Staphylococcus
EAYLSYRLEQEYSKDDIFQI

SEQ ID NO: 2049976 - protein, 20 aa, Staphylococcus
EAYLSYRLEQEYSKDEIFEM

SEQ ID NO: 2049977 - protein, 19 aa, Staphylococcus
EAYVKISLIGSGMRDMSGV

SEQ ID NO: 2049978 - protein, 21 aa, Staphylococcus
ECVAEGLPLFLEIVSYDANNA

SEQ ID NO: 2049979 - protein, 18 aa, Staphylococcus
EDAFKLYDTYGFPVELTE

SEQ ID NO: 2049980 - protein, 17 aa, Staphylococcus
EDARRALPQSFGHNNAV

SEQ ID NO: 2049981 - protein, 21 aa, Staphylococcus
EDCPNLKWIAWYATGVNSLPL

SEQ ID NO: 2049982 - protein, 18 aa, Staphylococcus
EDEWKKKRLKDIVEPLKG

SEQ ID NO: 2049983 - protein, 17 aa, Staphylococcus
EDFNINIPERWSIAQLF

SEQ ID NO: 2049984 - protein, 21 aa, Staphylococcus
EDFPRQCIFIGTTNKVDFLRD

SEQ ID NO: 2049985 - protein, 18 aa, Staphylococcus
EDGFSGPIARFFEDKDVE

SEQ ID NO: 2049986 - protein, 18 aa, Staphylococcus
EDGYKIFVHESERKQEPR

SEQ ID NO: 2049987 - protein, 17 aa, Staphylococcus
EDIVNCAIYLASDESNW

SEQ ID NO: 2049988 - protein, 23 aa, Staphylococcus
EDKLPCEFCSFQSVCHVDSLIDS

SEQ ID NO: 2049989 - protein, 23 aa, Staphylococcus
EDKPQIMPVWSLKKRAQKVQEED

SEQ ID NO: 2049990 - protein, 23 aa, Staphylococcus
EDLKGSWSVVCFYPADFSFVCPT

SEQ ID NO: 2049991 - protein, 17 aa, Staphylococcus
EDLKPFILLVVDKGEGL

SEQ ID NO: 2049992 - protein, 22 aa, Staphylococcus
EDLREIYKWMDLGRKLDERLWL

SEQ ID NO: 2049993 - protein, 19 aa, Staphylococcus
EDLTAAGVNLVFNVDTKRF

SEQ ID NO: 2049994 - protein, 19 aa, Staphylococcus
EDPFTCPHGRPIIINFSNY

SEQ ID NO: 2049995 - protein, 23 aa, Staphylococcus
EDPGMRWELGVIWKKDKYLSHAT

SEQ ID NO: 2049996 - protein, 19 aa, Staphylococcus
EDPNLCVLKINPKTITLMN

SEQ ID NO: 2049997 - protein, 23 aa, Staphylococcus
EDPRFKRWVIGSILSRTYYHNMV

SEQ ID NO: 2049998 - protein, 23 aa, Staphylococcus
EDPRFTDRFELFIVGREHGNAFT

SEQ ID NO: 2049999 - protein, 24 aa, Staphylococcus
EDQPRYIYCGTLGILMPDDKMIFN

SEQ ID NO: 2050000 - protein, 22 aa, Staphylococcus
EDRLRSRFEWGLIVDITPPDYE

SEQ ID NO: 2050001 - protein, 18 aa, Staphylococcus
EDTRFSAYINRHRREGLN

SEQ ID NO: 2050002 - protein, 20 aa, Staphylococcus
EDVAMAFGFFDGMHRGHHKV

SEQ ID NO: 2050003 - protein, 23 aa, Staphylococcus
EDVEFKLYLGLKHISPYIEEAVE

SEQ ID NO: 2050004 - protein, 19 aa, Staphylococcus
EDYLNYFKGAIVIISHDRF

SEQ ID NO: 2050005 - protein, 18 aa, Staphylococcus
EEALNYLVNRGFTEELIK

SEQ ID NO: 2050006 - protein, 17 aa, Staphylococcus
EEAQKWLDIGIEQAIYH

SEQ ID NO: 2050007 - protein, 24 aa, Staphylococcus
EECAKAESVAICWAMGVTQQDIGS

SEQ ID NO: 2050008 - protein, 20 aa, Staphylococcus
EEDWNRFTIAVGKLSRTKIF

SEQ ID NO: 2050009 - protein, 23 aa, Staphylococcus
EEFQLRAKLFVDQIVSFVNNSPY

SEQ ID NO: 2050010 - protein, 20 aa, Staphylococcus
EEHLRMVNLIAHKDKYPIQL

SEQ ID NO: 2050011 - protein, 17 aa, Staphylococcus
EEIEVIPIIADVQDKER

SEQ ID NO: 2050012 - protein, 19 aa, Staphylococcus
EEIIKSFNLFSMLDNVEKQ

SEQ ID NO: 2050013 - protein, 17 aa, Staphylococcus
EEIKLLFLEGLYQKMGY

SEQ ID NO: 2050014 - protein, 18 aa, Staphylococcus
EEILPHYFIRISKSEILN

SEQ ID NO: 2050015 - protein, 22 aa, Staphylococcus
EEIPGEIIMKILAFNPDLEKLT

SEQ ID NO: 2050016 - protein, 21 aa, Staphylococcus
EEKYLRLYAEFENYKRRIQNE

SEQ ID NO: 2050017 - protein, 17 aa, Staphylococcus
EELKDLPFISGFIGSCS

SEQ ID NO: 2050018 - protein, 23 aa, Staphylococcus
EELNRRLGWEIGPAKDYEFDHNG

SEQ ID NO: 2050019 - protein, 17 aa, Staphylococcus
EELQLKPTISFLTTSLF

SEQ ID NO: 2050020 - protein, 18 aa, Staphylococcus
EELREILAELGLRTVDEL

SEQ ID NO: 2050021 - protein, 18 aa, Staphylococcus
EELREILASLGLRTVEEL

SEQ ID NO: 2050022 - protein, 23 aa, Staphylococcus
EEMAELYNFLGLSVGLNLNSLST

SEQ ID NO: 2050023 - protein, 26 aa, Staphylococcus
EEMERRYKLFAQYHVRNITAFNKKAS

SEQ ID NO: 2050024 - protein, 19 aa, Staphylococcus
EEMKHYFILNFPQRPGALR

SEQ ID NO: 2050025 - protein, 17 aa, Staphylococcus
EEMKRIYAFQSVPYLLE

SEQ ID NO: 2050026 - protein, 18 aa, Staphylococcus
EEMREILASLGLKRVEDL

SEQ ID NO: 2050027 - protein, 20 aa, Staphylococcus
EEQKAIILYALIQSKIPIKQ

SEQ ID NO: 2050028 - protein, 20 aa, Staphylococcus
EERGYQLSKTEYRGREATDF

SEQ ID NO: 2050029 - protein, 20 aa, Staphylococcus
EERLKAGLLYTLEEECIKQG

SEQ ID NO: 2050030 - protein, 18 aa, Staphylococcus
EESFGFRSGKVIYDREHS

SEQ ID NO: 2050031 - protein, 17 aa, Staphylococcus
EESYFLFYINRPSIIVG

SEQ ID NO: 2050032 - protein, 24 aa, Staphylococcus
EETARQCAIVWGVNPVVKEGRKNT

SEQ ID NO: 2050033 - protein, 18 aa, Staphylococcus
EEVARIYGYDEIPSTLPV

SEQ ID NO: 2050034 - protein, 17 aa, Staphylococcus
EEVKRRIFLGTFALSSG

SEQ ID NO: 2050035 - protein, 18 aa, Staphylococcus
EEVLKKSGYRDMLEREQT

SEQ ID NO: 2050036 - protein, 19 aa, Staphylococcus
EEWCIPIIFVTHSNYEAEV

SEQ ID NO: 2050037 - protein, 21 aa, Staphylococcus
EEYKNTIGLFIEFLPVLDKKS

SEQ ID NO: 2050038 - protein, 17 aa, Staphylococcus
EFDHSWEKIGVRLVNSF

SEQ ID NO: 2050039 - protein, 23 aa, Staphylococcus
EFDIPRVLGDIIICTDVAQEQSE

SEQ ID NO: 2050040 - protein, 19 aa, Staphylococcus
EFDKIIGIDRIKVVHVNDS

SEQ ID NO: 2050041 - protein, 19 aa, Staphylococcus
EFDKIIGLDRIKVVHVNDS

SEQ ID NO: 2050042 - protein, 22 aa, Staphylococcus
EFEGGHMWKSWKPLLGDLLKYF

SEQ ID NO: 2050043 - protein, 19 aa, Staphylococcus
EFEGGHSWKSWKPLLGDIL

SEQ ID NO: 2050044 - protein, 21 aa, Staphylococcus
EFELRKKRLVEIKNDINSHFE

SEQ ID NO: 2050045 - protein, 18 aa, Staphylococcus
EFGRIIVISSIWGETGAS

SEQ ID NO: 2050046 - protein, 19 aa, Staphylococcus
EFIGRIPIVANLETLDIAA

SEQ ID NO: 2050047 - protein, 18 aa, Staphylococcus
EFIGRVPVVANLETLDVK

SEQ ID NO: 2050048 - protein, 23 aa, Staphylococcus
EFIKSRYILADSISIINKIMQAK

SEQ ID NO: 2050049 - protein, 22 aa, Staphylococcus
EFKNYILGLIFYRFLSEKVEEQ

SEQ ID NO: 2050050 - protein, 22 aa, Staphylococcus
EFKNYILGLIFYRFLSEKVEET

SEQ ID NO: 2050051 - protein, 20 aa, Staphylococcus
EFLIRVAAIIRRRKEEISAV

SEQ ID NO: 2050052 - protein, 17 aa, Staphylococcus
EFRKLCEEFALEQIDIQ

SEQ ID NO: 2050053 - protein, 20 aa, Staphylococcus
EFTNCLKLQVDYATELFTSQ

SEQ ID NO: 2050054 - protein, 18 aa, Staphylococcus
EFYFLPSYMAPLKEHQDF

SEQ ID NO: 2050055 - protein, 19 aa, Staphylococcus
EFYHPEFDKEYVILAEEGE

SEQ ID NO: 2050056 - protein, 20 aa, Staphylococcus
EFYHPEFKKEYVVLAEEGAQ

SEQ ID NO: 2050057 - protein, 19 aa, Staphylococcus
EFYQLLLIKLWQLSKNYNK

SEQ ID NO: 2050058 - protein, 26 aa, Staphylococcus
EFYRLYLFMVHLLKFGGMYANSVNRS

SEQ ID NO: 2050059 - protein, 22 aa, Staphylococcus
EFYRLYLFMVHLVKFGGMYASS

SEQ ID NO: 2050060 - protein, 22 aa, Staphylococcus
EGAKAMLYMPCVDLKQQLGTVK

SEQ ID NO: 2050061 - protein, 22 aa, Staphylococcus
EGANLPSVIGWRTIQDTEQIID

SEQ ID NO: 2050062 - protein, 30 aa, Staphylococcus
EGCAYVKEHAMFKCHQRFDVVIASNSGYPL

SEQ ID NO: 2050063 - protein, 20 aa, Staphylococcus
EGCFYRKIFEDWLNYHDINI

SEQ ID NO: 2050064 - protein, 18 aa, Staphylococcus
EGCMPFEVMAARGRKTLL

SEQ ID NO: 2050065 - protein, 18 aa, Staphylococcus
EGCMPFEVMAERGRKTLL

SEQ ID NO: 2050066 - protein, 18 aa, Staphylococcus
EGCMPFEVMAGRGRKTLL

SEQ ID NO: 2050067 - protein, 18 aa, Staphylococcus
EGDIGWRKVIDNFYGSFK

SEQ ID NO: 2050068 - protein, 19 aa, Staphylococcus
EGDIGWRKVIDNFYGSFKL

SEQ ID NO: 2050069 - protein, 17 aa, Staphylococcus
EGELCFGNEPLIRVEAP

SEQ ID NO: 2050070 - protein, 23 aa, Staphylococcus
EGEPEYFRSLGFVPLSNYSVEVP

SEQ ID NO: 2050071 - protein, 24 aa, Staphylococcus
EGFIKFQPIGGWWSQVMLSQKVTI

SEQ ID NO: 2050072 - protein, 18 aa, Staphylococcus
EGHKLIGIRGMPRVGKTE

SEQ ID NO: 2050073 - protein, 19 aa, Staphylococcus
EGIAAKVLESFGITEDLVV

SEQ ID NO: 2050074 - protein, 17 aa, Staphylococcus
EGIAAKVLETFEITEEK

SEQ ID NO: 2050075 - protein, 18 aa, Staphylococcus
EGIKRLGVVRADIDNLGA

SEQ ID NO: 2050076 - protein, 17 aa, Staphylococcus
EGIRVARQLGFNVAIVS

SEQ ID NO: 2050077 - protein, 20 aa, Staphylococcus
EGKKSIAIRLNYLDTENTLT

SEQ ID NO: 2050078 - protein, 18 aa, Staphylococcus
EGLKAYPLLNSSWQDSEI

SEQ ID NO: 2050079 - protein, 20 aa, Staphylococcus
EGLKGANIHLDFPSVGATQN

SEQ ID NO: 2050080 - protein, 19 aa, Staphylococcus
EGLKGGGYYVEYRTDDARL

SEQ ID NO: 2050081 - protein, 18 aa, Staphylococcus
EGLLKGYLYLQVFENTKK

SEQ ID NO: 2050082 - protein, 17 aa, Staphylococcus
EGLRLSQFYKELMVSTG

SEQ ID NO: 2050083 - protein, 17 aa, Staphylococcus
EGLSGPIARFFEDANVA

SEQ ID NO: 2050084 - protein, 19 aa, Staphylococcus
EGLSGPIARFFEEENVNTL

SEQ ID NO: 2050085 - protein, 20 aa, Staphylococcus
EGLVKAAALLLAYDDNADQE

SEQ ID NO: 2050086 - protein, 25 aa, Staphylococcus
EGMDTWDFAHCLPYFKKLETTYGAS

SEQ ID NO: 2050087 - protein, 24 aa, Staphylococcus
EGMETWDFAHCLPYFKKLEKTFGA

SEQ ID NO: 2050088 - protein, 25 aa, Staphylococcus
EGMETWDFAHCLPYFKKLETTYGSA

SEQ ID NO: 2050089 - protein, 20 aa, Staphylococcus
EGSRFPFAFWGSKNFFNLAD

SEQ ID NO: 2050090 - protein, 20 aa, Staphylococcus
EGSVRWGVTTSRSYFPKDNS

SEQ ID NO: 2050091 - protein, 18 aa, Staphylococcus
EGTTLKILFHAGLGTMNC

SEQ ID NO: 2050092 - protein, 17 aa, Staphylococcus
EGVYLSGALLMFAGKKS

SEQ ID NO: 2050093 - protein, 18 aa, Staphylococcus
EGYYLTKEGMEWFWNQYT

SEQ ID NO: 2050094 - protein, 24 aa, Staphylococcus
EHFDRLEVPFIYRVHEQPKSERLR

SEQ ID NO: 2050095 - protein, 18 aa, Staphylococcus
EHFGRPWIAPPMRVDGSE

SEQ ID NO: 2050096 - protein, 17 aa, Staphylococcus
EHFKFLYKKVAGRATAK

SEQ ID NO: 2050097 - protein, 19 aa, Staphylococcus
EHGIKAIIQPGGSIKDQES

SEQ ID NO: 2050098 - protein, 21 aa, Staphylococcus
EHGKHGFAFGSGMAAVSAVMM

SEQ ID NO: 2050099 - protein, 18 aa, Staphylococcus
EHGLKFKGNENVKALKAD

SEQ ID NO: 2050100 - protein, 18 aa, Staphylococcus
EHIWEHIDRVILMNYNGE

SEQ ID NO: 2050101 - protein, 17 aa, Staphylococcus
EHKIAPAVITWIEEQQH

SEQ ID NO: 2050102 - protein, 18 aa, Staphylococcus
EHKIKCFVQVNVSGESSK

SEQ ID NO: 2050103 - protein, 19 aa, Staphylococcus
EHKTRMALFPLKEYAQSKL

SEQ ID NO: 2050104 - protein, 19 aa, Staphylococcus
EHLAHPISYYFKNNFYITP

SEQ ID NO: 2050105 - protein, 18 aa, Staphylococcus
EHMIRAALEGVLFNLYTV

SEQ ID NO: 2050106 - protein, 24 aa, Staphylococcus
EHMNAWLKPYMRAFHLEEPVINID

SEQ ID NO: 2050107 - protein, 30 aa, Staphylococcus; identical to SEQ ID NO: 1678130

SEQ ID NO: 2050108 - protein, 18 aa, Staphylococcus
EHPSHFIDPVLILHGKED

SEQ ID NO: 2050109 - protein, 24 aa, Staphylococcus
EHRGGFCYEMNYFFKHYLEYKGFK

SEQ ID NO: 2050110 - protein, 22 aa, Staphylococcus
EHRIKFKVIDHIGAGSVSQKEV

SEQ ID NO: 2050111 - protein, 18 aa, Staphylococcus
EHYGLWAFKRVWGTYLSE

SEQ ID NO: 2050112 - protein, 22 aa, Staphylococcus
EIAELKARIFAGLSENGVAIIN

SEQ ID NO: 2050113 - protein, 17 aa, Staphylococcus
EIAHLFKSFTFTVNGTL

SEQ ID NO: 2050114 - protein, 20 aa, Staphylococcus
EIAIPLLLGLGLDEFSMSAT

SEQ ID NO: 2050115 - protein, 25 aa, Staphylococcus
EIFNYKKVRLFKEWKTEKGIIDYLL

SEQ ID NO: 2050116 - protein, 21 aa, Staphylococcus
EIFPKTRLDLELDINDTITDK

SEQ ID NO: 2050117 - protein, 17 aa, Staphylococcus
EIGIRYVDVSGRGGTNF

SEQ ID NO: 2050118 - protein, 18 aa, Staphylococcus
EIGPRGDLALVLDTSENQ

SEQ ID NO: 2050119 - protein, 20 aa, Staphylococcus
EIGSAVARRAKAFDMNILYT

SEQ ID NO: 2050120 - protein, 19 aa, Staphylococcus
EIIDFGVVIGKAFVNGRYI

SEQ ID NO: 2050121 - protein, 18 aa, Staphylococcus
EIIHGPKPVHGHTTPIIH

SEQ ID NO: 2050122 - protein, 19 aa, Staphylococcus
EIKDHFKILVTYRTISQGG

SEQ ID NO: 2050123 - protein, 19 aa, Staphylococcus
EIKEALSHFMLDIENANLQ

SEQ ID NO: 2050124 - protein, 20 aa, Staphylococcus
EIKSLIDLFLIWSKEVLLKS

SEQ ID NO: 2050125 - protein, 22 aa, Staphylococcus
EIKYWAELNEVFKILDVEMPIV

SEQ ID NO: 2050126 - protein, 17 aa, Staphylococcus
EILCPFHYFGVSDYIQD

SEQ ID NO: 2050127 - protein, 20 aa, Staphylococcus
EILKPRLIPLLQMSNKEFKN

SEQ ID NO: 2050128 - protein, 18 aa, Staphylococcus
EILQRFGSDIDVLITGHQ

SEQ ID NO: 2050129 - protein, 19 aa, Staphylococcus
EINALPIVEEFRSAQFEAN

SEQ ID NO: 2050130 - protein, 18 aa, Staphylococcus
EINRYGGIETIEIIEDYF

SEQ ID NO: 2050131 - protein, 19 aa, Staphylococcus
EIPAKVCGAEDCFNVMPSS

SEQ ID NO: 2050132 - protein, 20 aa, Staphylococcus
EIPHAIGVNVDRMIKENDER

SEQ ID NO: 2050133 - protein, 20 aa, Staphylococcus
EIPHAIGVNVDRMIKENEDR

SEQ ID NO: 2050134 - protein, 20 aa, Staphylococcus
EIPHAIGVNVDRMIKESEER

SEQ ID NO: 2050135 - protein, 20 aa, Staphylococcus
EIPKNWSIKTVKEIAESFNS

SEQ ID NO: 2050136 - protein, 20 aa, Staphylococcus
EIQNRLGIEVSIMDFDRDEW

SEQ ID NO: 2050137 - protein, 20 aa, Staphylococcus
EIRRFLPRKVRTFQLKEAQR

SEQ ID NO: 2050138 - protein, 18 aa, Staphylococcus
EIVMKILAFDSDLAKIDR

SEQ ID NO: 2050139 - protein, 21 aa, Staphylococcus
EIYICGGTHFLQSIIKALKEM

SEQ ID NO: 2050140 - protein, 20 aa, Staphylococcus
EIYRELPFVVNQNEVDHNKH

SEQ ID NO: 2050141 - protein, 19 aa, Staphylococcus
EIYRKSVENCFNYFKTFIL

SEQ ID NO: 2050142 - protein, 17 aa, Staphylococcus
EKCRIPILFVPGNHDYW

SEQ ID NO: 2050143 - protein, 24 aa, Staphylococcus
EKDGRQAIKFLKQRGLGRATFLPL

SEQ ID NO: 2050144 - protein, 21 aa, Staphylococcus
EKDLKRTPSFSVNRPGEETGV

SEQ ID NO: 2050145 - protein, 19 aa, Staphylococcus
EKDVRAVLGRFLFVQDDVK

SEQ ID NO: 2050146 - protein, 22 aa, Staphylococcus
EKEIYEHFGVNWIEPALREDGS

SEQ ID NO: 2050147 - protein, 17 aa, Staphylococcus
EKELFEFIRYIQNTPML

SEQ ID NO: 2050148 - protein, 20 aa, Staphylococcus
EKELNCRLGISQLPTHGLSI

SEQ ID NO: 2050149 - protein, 22 aa, Staphylococcus
EKFARPFSYNFYKAIDHLKRTI

SEQ ID NO: 2050150 - protein, 17 aa, Staphylococcus
EKFASFKQQIVDMLKNY

SEQ ID NO: 2050151 - protein, 23 aa, Staphylococcus
EKFKTTMITFKFMAPLDYETITA

SEQ ID NO: 2050152 - protein, 23 aa, Staphylococcus
EKFKTTMITFKFMAPLEYETITA

SEQ ID NO: 2050153 - protein, 17 aa, Staphylococcus
EKFNYLFMVTKRCITLL

SEQ ID NO: 2050154 - protein, 19 aa, Staphylococcus
EKFYCEDCGFKIFQYRNTD

SEQ ID NO: 2050155 - protein, 23 aa, Staphylococcus
EKGNIWLDPGIGFAKSRSEEKEV

SEQ ID NO: 2050156 - protein, 20 aa, Staphylococcus
EKGYCLLVGVGKNSTEADIE

SEQ ID NO: 2050157 - protein, 22 aa, Staphylococcus
EKIKELQEFVARFSANASKSKQ

SEQ ID NO: 2050158 - protein, 17 aa, Staphylococcus
EKIWLDPGIGFAKTRDE

SEQ ID NO: 2050159 - protein, 22 aa, Staphylococcus
EKIWYKLLVNLGINSITALGRD

SEQ ID NO: 2050160 - protein, 19 aa, Staphylococcus
EKKIADFILITPHKMINMS

SEQ ID NO: 2050161 - protein, 23 aa, Staphylococcus
EKKRMSIAYSLPKWIVDHWVTHY

SEQ ID NO: 2050162 - protein, 22 aa, Staphylococcus
EKLKGRYSIVVFDSYGKVTLDN

SEQ ID NO: 2050163 - protein, 19 aa, Staphylococcus
EKLLYETYDVIFLDINLMD

SEQ ID NO: 2050164 - protein, 17 aa, Staphylococcus
EKLRMLKSFPTPTFDDI

SEQ ID NO: 2050165 - protein, 20 aa, Staphylococcus
EKLWPIQPLRDFWGINRKTE

SEQ ID NO: 2050166 - protein, 25 aa, Staphylococcus
EKNAMGWYLDGRASAVVGTHTHIQT

SEQ ID NO: 2050167 - protein, 26 aa, Staphylococcus
EKNAMGWYLDGRVSAVVGTHTHIQTS

SEQ ID NO: 2050168 - protein, 23 aa, Staphylococcus
EKNPRLMPFQGYVLQNFELHSDG

SEQ ID NO: 2050169 - protein, 18 aa, Staphylococcus
EKPLPFLFGEDFSFYGQQ

SEQ ID NO: 2050170 - protein, 22 aa, Staphylococcus
EKPQIMPVWSLKNRALKVRDED

SEQ ID NO: 2050171 - protein, 17 aa, Staphylococcus
EKQRLRTLFPYIKEASE

SEQ ID NO: 2050172 - protein, 17 aa, Staphylococcus
EKQYHEWFHQISNQIAQ

SEQ ID NO: 2050173 - protein, 18 aa, Staphylococcus
EKRLEFYRLYLFMVHLLK

SEQ ID NO: 2050174 - protein, 18 aa, Staphylococcus
EKRLEFYRLYLFMVHLVK

SEQ ID NO: 2050175 - protein, 21 aa, Staphylococcus
EKRLRLNIHLENWHKEKLYDR

SEQ ID NO: 2050176 - protein, 19 aa, Staphylococcus
EKRPYILFERCYDYLNGYR

SEQ ID NO: 2050177 - protein, 21 aa, Staphylococcus
EKSLKRTPSFSVNRPGEETGI

SEQ ID NO: 2050178 - protein, 25 aa, Staphylococcus
EKTARQCAIVWGVYPVVKEGRKNTD

SEQ ID NO: 2050179 - protein, 17 aa, Staphylococcus
EKTICGKKVLFIHYEIA

SEQ ID NO: 2050180 - protein, 19 aa, Staphylococcus
EKWEAFPYISFIPAREKTI

SEQ ID NO: 2050181 - protein, 24 aa, Staphylococcus
EKYLPRKFKIGIAVPPSNDIDVFS

SEQ ID NO: 2050182 - protein, 20 aa, Staphylococcus
EKYLRLYAEFENYKRRIQKE

SEQ ID NO: 2050183 - protein, 20 aa, Staphylococcus
EKYLRLYAEFENYKRRIQNE

SEQ ID NO: 2050184 - protein, 20 aa, Staphylococcus
EKYLRLYAEFENYKRRIRNE

SEQ ID NO: 2050185 - protein, 22 aa, Staphylococcus
EKYSRLRSIYSYEIYNEQGELA

SEQ ID NO: 2050186 - protein, 26 aa, Staphylococcus
ELDDRYVLCLFDWRIIENEATNENYE

SEQ ID NO: 2050187 - protein, 19 aa, Staphylococcus
ELDRVGVHLEHFGGHDYIV

SEQ ID NO: 2050188 - protein, 20 aa, Staphylococcus
ELELSFGLKFLRIIDKVMAM

SEQ ID NO: 2050189 - protein, 19 aa, Staphylococcus
ELFDLFIFKHDRLKAKMKE

SEQ ID NO: 2050190 - protein, 23 aa, Staphylococcus
ELFKAALENKVDWIIAVHTTGRY

SEQ ID NO: 2050191 - protein, 24 aa, Staphylococcus
ELFKSELKLAIGPIERGGAGGGIA

SEQ ID NO: 2050192 - protein, 23 aa, Staphylococcus
ELFPENRVEYFVSFYDYYQPEAY

SEQ ID NO: 2050193 - protein, 19 aa, Staphylococcus
ELFQYLWLQYLRTDMGRIN

SEQ ID NO: 2050194 - protein, 23 aa, Staphylococcus
ELIPHCPKCDAPMEINKRKAQVG

SEQ ID NO: 2050195 - protein, 18 aa, Staphylococcus
ELIPLTFFVKKFKQAKSS

SEQ ID NO: 2050196 - protein, 19 aa, Staphylococcus
ELITTEWPAKVSVFDKNVE

SEQ ID NO: 2050197 - protein, 21 aa, Staphylococcus
ELKARFPNVDFVFSNGLSDID

SEQ ID NO: 2050198 - protein, 24 aa, Staphylococcus
ELKELPFEFKVLITYRSNSQGGKG

SEQ ID NO: 2050199 - protein, 18 aa, Staphylococcus
ELKHRKCKIIFANNETIT

SEQ ID NO: 2050200 - protein, 25 aa, Staphylococcus
ELKQLNNWCVWKFEKRNGKRTKIPF

SEQ ID NO: 2050201 - protein, 18 aa, Staphylococcus
ELKSTWKFVDIIQEEWTL

SEQ ID NO: 2050202 - protein, 20 aa, Staphylococcus
ELLESVAFQIGSAIKRILLT

SEQ ID NO: 2050203 - protein, 21 aa, Staphylococcus
ELLKHLKLKLSDFIQLHTGAN

SEQ ID NO: 2050204 - protein, 17 aa, Staphylococcus
ELLQRFKFDKAFISCGS

SEQ ID NO: 2050205 - protein, 22 aa, Staphylococcus
ELMLRVAAIIRRRKEEISAVMV

SEQ ID NO: 2050206 - protein, 19 aa, Staphylococcus
ELNLPIGIIPGGTFNDFVK

SEQ ID NO: 2050207 - protein, 21 aa, Staphylococcus
ELNTRLGWEIEEPRDFEFEHN

SEQ ID NO: 2050208 - protein, 21 aa, Staphylococcus
ELNTRLGWEISEAREFKFEHN

SEQ ID NO: 2050209 - protein, 18 aa, Staphylococcus
ELPKHTFPLFGMALGIPE

SEQ ID NO: 2050210 - protein, 21 aa, Staphylococcus
ELQAGCPLCAPEADAATGMVA

SEQ ID NO: 2050211 - protein, 19 aa, Staphylococcus
ELRDTLHYEMKWNTSKIDV

SEQ ID NO: 2050212 - protein, 17 aa, Staphylococcus
ELREVLASLGLRTVEEL

SEQ ID NO: 2050213 - protein, 20 aa, Staphylococcus
ELRQATGLKGYEAFRMLDKQ

SEQ ID NO: 2050214 - protein, 18 aa, Staphylococcus
ELRRLVCRPIGVNLEPVD

SEQ ID NO: 2050215 - protein, 20 aa, Staphylococcus
ELSRTKLLVSIRRLIEKDKL

SEQ ID NO: 2050216 - protein, 17 aa, Staphylococcus
ELSRTKVLASIRKLVNQ

SEQ ID NO: 2050217 - protein, 22 aa, Staphylococcus
ELVLRINNLLARISKYQSNHLT

SEQ ID NO: 2050218 - protein, 17 aa, Staphylococcus
EMAELYEFLGLSVGLNL

SEQ ID NO: 2050219 - protein, 22 aa, Staphylococcus
EMAELYEFLGLSVGLNLNSKTT

SEQ ID NO: 2050220 - protein, 25 aa, Staphylococcus
EMARKFGIEVFNVFLSQDPITEDIE

SEQ ID NO: 2050221 - protein, 23 aa, Staphylococcus
EMCNRLKKVFGIYSISPVLKIEK

SEQ ID NO: 2050222 - protein, 24 aa, Staphylococcus
EMEKRYKLFAQFHVRNITAFNKKA

SEQ ID NO: 2050223 - protein, 25 aa, Staphylococcus
EMEKRYKLFAQYHVRNITAFNKKAP

SEQ ID NO: 2050224 - protein, 25 aa, Staphylococcus
EMERRYKLFAKYHVRNITAFNKKAS

SEQ ID NO: 2050225 - protein, 24 aa, Staphylococcus
EMERRYKLFAQYHVRNITAFNKKA

SEQ ID NO: 2050226 - protein, 19 aa, Staphylococcus
EMFYKRIINTLTETNLFDD

SEQ ID NO: 2050227 - protein, 26 aa, Staphylococcus
EMGLKCLRTSIAWTRIFPNGDEEEPN

SEQ ID NO: 2050228 - protein, 25 aa, Staphylococcus
EMGLKCLRTSIAWTRIFPNGNETEP

SEQ ID NO: 2050229 - protein, 20 aa, Staphylococcus
EMIKYKYPRLFDIVHKAIDQ

SEQ ID NO: 2050230 - protein, 20 aa, Staphylococcus
EMIPSIKILFSLMVLEDRNS

SEQ ID NO: 2050231 - protein, 22 aa, Staphylococcus
EMKRLGLPVPDGFTITTAACIE

SEQ ID NO: 2050232 - protein, 22 aa, Staphylococcus
EMKRLGLPVPDGFTITTTACIE

SEQ ID NO: 2050233 - protein, 20 aa, Staphylococcus
EMLNHGIISYGYRIETPTTP

SEQ ID NO: 2050234 - protein, 23 aa, Staphylococcus
EMLRRLDHRGGIGADGITGDGAG

SEQ ID NO: 2050235 - protein, 23 aa, Staphylococcus
EMLRRLDHRGGIGADGMTGDGAG

SEQ ID NO: 2050236 - protein, 23 aa, Staphylococcus
EMLRRLDHRGGIGADGVTGDGAG

SEQ ID NO: 2050237 - protein, 25 aa, Staphylococcus
EMNVDWKKRIHIIIGTDEESDWKCT

SEQ ID NO: 2050238 - protein, 19 aa, Staphylococcus
EMPNRIPIGQPINGTTVYV

SEQ ID NO: 2050239 - protein, 24 aa, Staphylococcus
EMPTLRWVAWYAAGVNNLPLEYFK

SEQ ID NO: 2050240 - protein, 17 aa, Staphylococcus
EMQYELRALQSRLGITF

SEQ ID NO: 2050241 - protein, 25 aa, Staphylococcus
EMSRKYGIEVFNVFLSQDPITEEIE

SEQ ID NO: 2050242 - protein, 18 aa, Staphylococcus
EMTVELIAPIAIEDGTRF

SEQ ID NO: 2050243 - protein, 24 aa, Staphylococcus
ENAKFCPECGFKIASINNNSQKIE

SEQ ID NO: 2050244 - protein, 24 aa, Staphylococcus
ENDLAHGEFGKWLENLNLDWNTAN

SEQ ID NO: 2050245 - protein, 19 aa, Staphylococcus
ENEGFKVIGYRDVPVNTNA

SEQ ID NO: 2050246 - protein, 19 aa, Staphylococcus
ENEIARWIKIQEEIGLDVL

SEQ ID NO: 2050247 - protein, 18 aa, Staphylococcus
ENFAISIGIYYNGEAYAG

SEQ ID NO: 2050248 - protein, 22 aa, Staphylococcus
ENGFEILAFVGAHAEIGCDPEL

SEQ ID NO: 2050249 - protein, 19 aa, Staphylococcus
ENIMPYKAAPEFWGYEDTI

SEQ ID NO: 2050250 - protein, 20 aa, Staphylococcus
ENKFILFIYDWRVLESESRN

SEQ ID NO: 2050251 - protein, 18 aa, Staphylococcus
ENLHLKNGLVWSIPITLP

SEQ ID NO: 2050252 - protein, 19 aa, Staphylococcus
ENLWSLFEIALLYSADKSE

SEQ ID NO: 2050253 - protein, 19 aa, Staphylococcus
ENNDLVVVNVDWGIPNERN

SEQ ID NO: 2050254 - protein, 24 aa, Staphylococcus
ENPYKFGATIGRYAGRIENASFNL

SEQ ID NO: 2050255 - protein, 17 aa, Staphylococcus
ENRLEGFLEKKSALPND

SEQ ID NO: 2050256 - protein, 24 aa, Staphylococcus
ENRPVFYPNYWGGDKFHIKEQFEK

SEQ ID NO: 2050257 - protein, 17 aa, Staphylococcus
ENTDCILIGPGLGCDFK

SEQ ID NO: 2050258 - protein, 19 aa, Staphylococcus
ENYLHFKLKHMSHVSDPMM

SEQ ID NO: 2050259 - protein, 24 aa, Staphylococcus
EPALELVEGLKLVTEFVQDEKATQ

SEQ ID NO: 2050260 - protein, 22 aa, Staphylococcus
EPAVLPARFPNLLVNGASGIAV

SEQ ID NO: 2050261 - protein, 22 aa, Staphylococcus
EPCNECAICKGITQGTNSDVIE

SEQ ID NO: 2050262 - protein, 23 aa, Staphylococcus
EPCNECAICKGITTGTNSDVIEI

SEQ ID NO: 2050263 - protein, 18 aa, Staphylococcus
EPCWKIQRKYGIKHLVKR

SEQ ID NO: 2050264 - protein, 21 aa, Staphylococcus
EPFMYRLVDIVADIMEPYYPN

SEQ ID NO: 2050265 - protein, 18 aa, Staphylococcus
EPHERLFALLIKKNGEQI

SEQ ID NO: 2050266 - protein, 18 aa, Staphylococcus
EPHIESFPAAAGQMSLSH

SEQ ID NO: 2050267 - protein, 18 aa, Staphylococcus
EPKLSLPSARSIIAIAVG

SEQ ID NO: 2050268 - protein, 21 aa, Staphylococcus
EPLEFEMWIAIMLAQQPITDT

SEQ ID NO: 2050269 - protein, 21 aa, Staphylococcus
EPLKDLRIMGKFGDSVTTDHI

SEQ ID NO: 2050270 - protein, 23 aa, Staphylococcus
EPMFQFCLGIPWGADNDPETIEY

SEQ ID NO: 2050271 - protein, 18 aa, Staphylococcus
EPMTGGIFLWLKTPESYT

SEQ ID NO: 2050272 - protein, 23 aa, Staphylococcus
EPPCKYYWKCGGCQLQHMTYDAQ

SEQ ID NO: 2050273 - protein, 20 aa, Staphylococcus
EPRIKMGMLESTSQWMGKVI

SEQ ID NO: 2050274 - protein, 22 aa, Staphylococcus
EPSMKWELGIIWRKDIIVDSLT

SEQ ID NO: 2050275 - protein, 20 aa, Staphylococcus
EPTPKWSISRYKGLGEMNAD

SEQ ID NO: 2050276 - protein, 17 aa, Staphylococcus
EQFKRIRIGVGRPTNGM

SEQ ID NO: 2050277 - protein, 19 aa, Staphylococcus
EQILNRFGIEFTTVDTTQP

SEQ ID NO: 2050278 - protein, 20 aa, Staphylococcus
EQLFAAGYSACFNNALMHIL

SEQ ID NO: 2050279 - protein, 19 aa, Staphylococcus
EQLFPEFFAAGIVQMVMVY

SEQ ID NO: 2050280 - protein, 20 aa, Staphylococcus
EQLLKLKAWHDAQMEQLENK

SEQ ID NO: 2050281 - protein, 23 aa, Staphylococcus
EQLMPILGVCLGFQLIVEYYGGR

SEQ ID NO: 2050282 - protein, 25 aa, Staphylococcus
EQLPRLEMLEAYYLNRNTDILTGQR

SEQ ID NO: 2050283 - protein, 19 aa, Staphylococcus
EQMFLGLRMNKGVSKKTFE

SEQ ID NO: 2050284 - protein, 19 aa, Staphylococcus
EQNRIKLKYLFKLSDKKKY

SEQ ID NO: 2050285 - protein, 19 aa, Staphylococcus
EQRIPKIVIVIDELADLMM

SEQ ID NO: 2050286 - protein, 18 aa, Staphylococcus
EQRMPKIVIVIDELADLM

SEQ ID NO: 2050287 - protein, 25 aa, Staphylococcus
EQSYRLVIPDVKFQSNLKVIYDTIN

SEQ ID NO: 2050288 - protein, 22 aa, Staphylococcus
EQTEVRLILSFLRTVDNPLQDI

SEQ ID NO: 2050289 - protein, 22 aa, Staphylococcus
EQTEVRLVLSFLRTVDNPLQDI

SEQ ID NO: 2050290 - protein, 21 aa, Staphylococcus
EQTKHNIGFEVIDYLLESNQF

SEQ ID NO: 2050291 - protein, 23 aa, Staphylococcus
EQYPLCFNIALKIMRLLQQELKI

SEQ ID NO: 2050292 - protein, 18 aa, Staphylococcus
ERDRLPILLNKQGEIVAV

SEQ ID NO: 2050293 - protein, 19 aa, Staphylococcus
ERFKEVFQIFSDVLGIPLK

SEQ ID NO: 2050294 - protein, 17 aa, Staphylococcus
ERFNLFLDEAFEMGIDI

SEQ ID NO: 2050295 - protein, 17 aa, Staphylococcus
ERFNLFLDEVFEMGIDI

SEQ ID NO: 2050296 - protein, 19 aa, Staphylococcus
ERGYQLSKTEYRGREATDF

SEQ ID NO: 2050297 - protein, 17 aa, Staphylococcus
ERHVDFLLINNVKAIIV

SEQ ID NO: 2050298 - protein, 19 aa, Staphylococcus
ERIARVGFELAQKRHKKLT

SEQ ID NO: 2050299 - protein, 17 aa, Staphylococcus
ERIIFCAKRLSGYDSEI

SEQ ID NO: 2050300 - protein, 17 aa, Staphylococcus
ERIIPVIPQQGSLGASG

SEQ ID NO: 2050301 - protein, 18 aa, Staphylococcus
ERIVLRFGSVTHHATVYL

SEQ ID NO: 2050302 - protein, 17 aa, Staphylococcus
ERLKAGLLYTLEEECIK

SEQ ID NO: 2050303 - protein, 22 aa, Staphylococcus
ERLRQFFDFITNFGIMIKGTGE

SEQ ID NO: 2050304 - protein, 23 aa, Staphylococcus
ERLRQFFDFITNFGIMIKGTGED

SEQ ID NO: 2050305 - protein, 21 aa, Staphylococcus
ERLRQFFDFVTNFGLMIKGTG

SEQ ID NO: 2050306 - protein, 25 aa, Staphylococcus
ERMEKRYKGPIAFEYNHINNNKERT

SEQ ID NO: 2050307 - protein, 17 aa, Staphylococcus
ERMPVFFSANMSYGVHA

SEQ ID NO: 2050308 - protein, 18 aa, Staphylococcus
ERQRICLARQLMYIPDVL

SEQ ID NO: 2050309 - protein, 23 aa, Staphylococcus
ERRYKVFAKYHVRNITAFNKKAT

SEQ ID NO: 2050310 - protein, 17 aa, Staphylococcus
ERSDGEPCNECAICKGI

SEQ ID NO: 2050311 - protein, 17 aa, Staphylococcus
ERYPNKLIITLGDKGAM

SEQ ID NO: 2050312 - protein, 21 aa, Staphylococcus
ESARLRLGIEPEKMSVSVNKY

SEQ ID NO: 2050313 - protein, 19 aa, Staphylococcus
ESDCGWPSFSKAIDDDEII

SEQ ID NO: 2050314 - protein, 23 aa, Staphylococcus
ESDCGWPSFSKALADEEIVELVD

SEQ ID NO: 2050315 - protein, 19 aa, Staphylococcus
ESDCGWPSFSKALDDDEIV

SEQ ID NO: 2050316 - protein, 23 aa, Staphylococcus
ESDCGWPSFSKALSDDEVVELVD

SEQ ID NO: 2050317 - protein, 17 aa, Staphylococcus
ESDEIYRELPFVVNQNE

SEQ ID NO: 2050318 - protein, 21 aa, Staphylococcus
ESEGLKVIGYRDVPVEVSAVP

SEQ ID NO: 2050319 - protein, 20 aa, Staphylococcus
ESEILCPFHYFGVTDYSLNG

SEQ ID NO: 2050320 - protein, 17 aa, Staphylococcus
ESFKESLRWGAEIFHNL

SEQ ID NO: 2050321 - protein, 23 aa, Staphylococcus
ESFKESLRWGAEIFHNLKSILSE

SEQ ID NO: 2050322 - protein, 23 aa, Staphylococcus
ESFKESLRWGAEIFHNLKSILSK

SEQ ID NO: 2050323 - protein, 25 aa, Staphylococcus
ESFQFSVALSTVWKFISRTNKYIDE

SEQ ID NO: 2050324 - protein, 19 aa, Staphylococcus
ESFYAMPTVVGFLPNVVEG

SEQ ID NO: 2050325 - protein, 20 aa, Staphylococcus
ESIFKACLDAAVHRSIALSK

SEQ ID NO: 2050326 - protein, 17 aa, Staphylococcus
ESILKWLEQTGIDPKRR

SEQ ID NO: 2050327 - protein, 25 aa, Staphylococcus
ESISHGYSGLEIEVFDFHSNKSRHI

SEQ ID NO: 2050328 - protein, 20 aa, Staphylococcus
ESKHLGGFPITGQFLICTNP

SEQ ID NO: 2050329 - protein, 24 aa, Staphylococcus
ESKYCPNCGKLLVYDYIHYNQIGH

SEQ ID NO: 2050330 - protein, 24 aa, Staphylococcus
ESKYCPNCGRLLAYDYIHYNQIGH

SEQ ID NO: 2050331 - protein, 23 aa, Staphylococcus
ESKYCPNCGRLLTYDYTHYNQLG

SEQ ID NO: 2050332 - protein, 23 aa, Staphylococcus
ESLAHAFHLWLLRINYLDQPKFY

SEQ ID NO: 2050333 - protein, 25 aa, Staphylococcus
ESLQFSVALSTVWKFISRTNKYIDE

SEQ ID NO: 2050334 - protein, 19 aa, Staphylococcus
ESMSDDFKVGGLLNKKKKK

SEQ ID NO: 2050335 - protein, 19 aa, Staphylococcus
ESNCGWPSFSKALNDDEII

SEQ ID NO: 2050336 - protein, 18 aa, Staphylococcus
ESNCGWPSFSKSIDDDEI

SEQ ID NO: 2050337 - protein, 18 aa, Staphylococcus
ESNTSWPLALPVFKMDYA

SEQ ID NO: 2050338 - protein, 19 aa, Staphylococcus
ESNTSWPLALPVFKMDYAH

SEQ ID NO: 2050339 - protein, 20 aa, Staphylococcus
ESQHALVFCVGNIHGPGGRI

SEQ ID NO: 2050340 - protein, 17 aa, Staphylococcus
ESRRLPGRHYAKFNLHG

SEQ ID NO: 2050341 - protein, 21 aa, Staphylococcus
ESSCGWPSFSKALNDDEIVEL

SEQ ID NO: 2050342 - protein, 23 aa, Staphylococcus
ESSGIIKKLFLLGIMANINQSLD

SEQ ID NO: 2050343 - protein, 19 aa, Staphylococcus
ESTFGVTCDFEFNKDYPAL

SEQ ID NO: 2050344 - protein, 20 aa, Staphylococcus
ESTFGVTCEFEFKKDYPALY

SEQ ID NO: 2050345 - protein, 23 aa, Staphylococcus
ESTLKFYYRLGFKNYDIRQNFFI

SEQ ID NO: 2050346 - protein, 26 aa, Staphylococcus
ESTNRVPLTWDIRQAWANERHYPGVD

SEQ ID NO: 2050347 - protein, 24 aa, Staphylococcus
ESTVCILEAMKLFNEIQAEVSGEI

SEQ ID NO: 2050348 - protein, 23 aa, Staphylococcus
ESTVCILEAMKLFNEIQAEVTGE

SEQ ID NO: 2050349 - protein, 18 aa, Staphylococcus
ESYLNYFNGAIVIISHDR

SEQ ID NO: 2050350 - protein, 23 aa, Staphylococcus
ETAVKAARRWAYEHKDIEPDKAE

SEQ ID NO: 2050351 - protein, 18 aa, Staphylococcus
ETCPHGGVIPRNYIYKEK

SEQ ID NO: 2050352 - protein, 22 aa, Staphylococcus
ETDFITCVAFGKTAEIIANNFK

SEQ ID NO: 2050353 - protein, 20 aa, Staphylococcus
ETDRTGLRIAIELKKDVNAE

SEQ ID NO: 2050354 - protein, 20 aa, Staphylococcus
ETDRTGLRIAIELKKDVNSD

SEQ ID NO: 2050355 - protein, 20 aa, Staphylococcus
ETDRTGLRIAIELKKEANSE

SEQ ID NO: 2050356 - protein, 19 aa, Staphylococcus
ETFISLSCHKCPDVVQALN

SEQ ID NO: 2050357 - protein, 19 aa, Staphylococcus
ETGCPWDRVQTHASLKRYL

SEQ ID NO: 2050358 - protein, 25 aa, Staphylococcus
ETGSVVLPGRFFVDIIKKLPGKEVK

SEQ ID NO: 2050359 - protein, 23 aa, Staphylococcus
ETHKLGIPVMIVFEGVPAAGKTR

SEQ ID NO: 2050360 - protein, 19 aa, Staphylococcus
ETIGFVIGPRLNAVGRLDD

SEQ ID NO: 2050361 - protein, 27 aa, Staphylococcus
ETKRLGEYVVLRFGWLYGPGTWYGKDG

SEQ ID NO: 2050362 - protein, 23 aa, Staphylococcus
ETLKALGAHVGWYIPNRFSEGYG

SEQ ID NO: 2050363 - protein, 23 aa, Staphylococcus
ETLRRYCFDRAFIGMNGMDSKYG

SEQ ID NO: 2050364 - protein, 18 aa, Staphylococcus
ETRRSTILSNKKMGDEVH

SEQ ID NO: 2050365 - protein, 22 aa, Staphylococcus
ETSKLFSFFISYHFNKFELGVE

SEQ ID NO: 2050366 - protein, 24 aa, Staphylococcus
ETSPRYIYCGTIGLLLPDDKMIFN

SEQ ID NO: 2050367 - protein, 23 aa, Staphylococcus
ETTIWYKLLVNLGINSITALGGN

SEQ ID NO: 2050368 - protein, 26 aa, Staphylococcus
ETTKWLEDYLRYFKGAIVIISHDRYF

SEQ ID NO: 2050369 - protein, 22 aa, Staphylococcus
ETVEYFFKLGISTVLITLGEQG

SEQ ID NO: 2050370 - protein, 24 aa, Staphylococcus
ETYIWYKLLVNLGINSVTAAGRQT

SEQ ID NO: 2050371 - protein, 19 aa, Staphylococcus
EVAELKLGLKQVSFETSTS

SEQ ID NO: 2050372 - protein, 21 aa, Staphylococcus
EVAEQKLGLSLVNFETATSSV

SEQ ID NO: 2050373 - protein, 18 aa, Staphylococcus
EVAFRLGIDTRKNDQQIR

SEQ ID NO: 2050374 - protein, 19 aa, Staphylococcus
EVAKCPKNYLANVLNKYGF

SEQ ID NO: 2050375 - protein, 25 aa, Staphylococcus
EVARCPRPYLARVLRKYGFEVKEEA

SEQ ID NO: 2050376 - protein, 18 aa, Staphylococcus
EVARLPKDVKVEIEVVGK

SEQ ID NO: 2050377 - protein, 20 aa, Staphylococcus
EVDKFNWLLVAKRIKAYDEL

SEQ ID NO: 2050378 - protein, 20 aa, Staphylococcus
EVEKLCREFGVLLIVDEVAT

SEQ ID NO: 2050379 - protein, 24 aa, Staphylococcus
EVFSKLIQFIACRNIDILSATYKT

SEQ ID NO: 2050380 - protein, 18 aa, Staphylococcus
EVIAACLLTEARVLKIFK

SEQ ID NO: 2050381 - protein, 20 aa, Staphylococcus
EVIDYPTFLGHVIEQYISIA

SEQ ID NO: 2050382 - protein, 21 aa, Staphylococcus
EVIGNGIIMWLLSQGSKVKVL

SEQ ID NO: 2050383 - protein, 20 aa, Staphylococcus
EVIQSFEFNSLYGLMLKDKK

SEQ ID NO: 2050384 - protein, 20 aa, Staphylococcus
EVKLRLKGYPAIIFQHEIDH

SEQ ID NO: 2050385 - protein, 19 aa, Staphylococcus
EVKLRLKGYPAIVFQHEID

SEQ ID NO: 2050386 - protein, 23 aa, Staphylococcus
EVKSSPRILGFDAVGTVQKTGTE

SEQ ID NO: 2050387 - protein, 19 aa, Staphylococcus
EVLKPGGVYYASFADLTNN

SEQ ID NO: 2050388 - protein, 19 aa, Staphylococcus
EVMSIPTLIVFKDGEAVDK

SEQ ID NO: 2050389 - protein, 17 aa, Staphylococcus
EVMSIPTLIVFKDGQPV

SEQ ID NO: 2050390 - protein, 18 aa, Staphylococcus
EVMSIPTLIVFKDGQPVD

SEQ ID NO: 2050391 - protein, 23 aa, Staphylococcus
EVNKYRGEVIDSYTNATDEEMKQ

SEQ ID NO: 2050392 - protein, 25 aa, Staphylococcus
EVNRPKWLHALLKLYQLAPRTIEKT

SEQ ID NO: 2050393 - protein, 18 aa, Staphylococcus
EVNTRLVLEKGLTMFGSS

SEQ ID NO: 2050394 - protein, 20 aa, Staphylococcus
EVPACNEVQCGWAASHSLEG

SEQ ID NO: 2050395 - protein, 18 aa, Staphylococcus
EVPAHVQAGWMLTTIASI

SEQ ID NO: 2050396 - protein, 17 aa, Staphylococcus
EVPKRVFKKLGIEPNTE

SEQ ID NO: 2050397 - protein, 20 aa, Staphylococcus
EVPVVAGFGIRTAAHVKDII

SEQ ID NO: 2050398 - protein, 29 aa, Staphylococcus
EVRNAVFEMMNWWFDKGIDGFRVDAITHI

SEQ ID NO: 2050399 - protein, 29 aa, Staphylococcus
EVRTAIFDMMNWWFDKGIDGFRVDAITHI

SEQ ID NO: 2050400 - protein, 28 aa, Staphylococcus
EVSAWRPEVMQALRLAGLPANSAYANAW

SEQ ID NO: 2050401 - protein, 19 aa, Staphylococcus
EVSEGRGILSYELGSDGSG

SEQ ID NO: 2050402 - protein, 18 aa, Staphylococcus
EVSRLPKDVKVEIELIAK

SEQ ID NO: 2050403 - protein, 17 aa, Staphylococcus
EVSRLPKDVKVEIELVG

SEQ ID NO: 2050404 - protein, 19 aa, Staphylococcus
EVVEKIKVARSFGDLSENS

SEQ ID NO: 2050405 - protein, 20 aa, Staphylococcus
EVVWKFAQKVIFPYVEHNEL

SEQ ID NO: 2050406 - protein, 19 aa, Staphylococcus
EVYDLPVIMLTARDALSDK

SEQ ID NO: 2050407 - protein, 18 aa, Staphylococcus
EVYLSFLDTVNWCQNKFQ

SEQ ID NO: 2050408 - protein, 23 aa, Staphylococcus
EWGDHLKFPLAVIDEVLKVKETY

SEQ ID NO: 2050409 - protein, 21 aa, Staphylococcus
EWLKRAEIYIDGFHNFSTLEY

SEQ ID NO: 2050410 - protein, 19 aa, Staphylococcus
EWLPHLFVAGGLADLELGP

SEQ ID NO: 2050411 - protein, 19 aa, Staphylococcus
EWLPHLFVAGGLDDLELGP

SEQ ID NO: 2050412 - protein, 19 aa, Staphylococcus
EWLQQSAFNFPDRDELKAL

SEQ ID NO: 2050413 - protein, 23 aa, Staphylococcus
EWREPGCSMCLGMNPDQVPEGVH

SEQ ID NO: 2050414 - protein, 23 aa, Staphylococcus
EYADHIIDAFGMRPYIKKKVKKY

SEQ ID NO: 2050415 - protein, 22 aa, Staphylococcus
EYDCPLKVAGIYSFGPNEETKE

SEQ ID NO: 2050416 - protein, 17 aa, Staphylococcus
EYEYPFHFLCGAGVAYK

SEQ ID NO: 2050417 - protein, 19 aa, Staphylococcus
EYGATCGFFPVDEEALKYM

SEQ ID NO: 2050418 - protein, 19 aa, Staphylococcus
EYGATCGFFPVDEESLKYL

SEQ ID NO: 2050419 - protein, 17 aa, Staphylococcus
EYHNCPLILGSATPSLE

SEQ ID NO: 2050420 - protein, 17 aa, Staphylococcus
EYHQCPLILGSATPSLE

SEQ ID NO: 2050421 - protein, 18 aa, Staphylococcus
EYKPEYWIKAGVNANNIK

SEQ ID NO: 2050422 - protein, 23 aa, Staphylococcus
EYPDLKLGVIAPFENHIERWNEQ

SEQ ID NO: 2050423 - protein, 18 aa, Staphylococcus
EYRYCDRYEKSIDMDYEN

SEQ ID NO: 2050424 - protein, 24 aa, Staphylococcus
EYSKRIKNSPLWDTKDNTLTDFTA

SEQ ID NO: 2050425 - protein, 21 aa, Staphylococcus
EYSVSIALQLVRKFPAIEKRV

SEQ ID NO: 2050426 - protein, 21 aa, Staphylococcus
EYSVSIALQLVRKFPLIEKRV

SEQ ID NO: 2050427 - protein, 23 aa, Staphylococcus
EYVVLRFGWLYGPGTWYGKDGMI

SEQ ID NO: 2050428 - protein, 21 aa, Staphylococcus
EYYARWGYDMQQMYELIKYYY

SEQ ID NO: 2050429 - protein, 20 aa, Staphylococcus
EYYLPDVISLIINENGRAST

SEQ ID NO: 2050430 - protein, 21 aa, Staphylococcus
EYYTTLKLCRALHLLLTTRYS

SEQ ID NO: 2050431 - protein, 18 aa, Staphylococcus
FAAAGGWWSQVMLSQKVT

SEQ ID NO: 2050432 - protein, 23 aa, Staphylococcus
FAADEKVGFVYAFFINSNIDVLH

SEQ ID NO: 2050433 - protein, 18 aa, Staphylococcus
FAAVLLRPFLTHAPKEIF

SEQ ID NO: 2050434 - protein, 18 aa, Staphylococcus
FACVSLGYFREWRTKNIY

SEQ ID NO: 2050435 - protein, 17 aa, Staphylococcus
FADRTNVQFDRGVTAIV

SEQ ID NO: 2050436 - protein, 19 aa, Staphylococcus
FAEACILAFNQTRKNKIVV

SEQ ID NO: 2050437 - protein, 22 aa, Staphylococcus
FAEAKSPMWVEYEFQLNKKYFK

SEQ ID NO: 2050438 - protein, 23 aa, Staphylococcus
FAEGFKGICLRTTSIEETAQRLC

SEQ ID NO: 2050439 - protein, 17 aa, Staphylococcus
FAEGIEVGQVFKLGTKY

SEQ ID NO: 2050440 - protein, 17 aa, Staphylococcus
FAGGFPGKFISKTLEES

SEQ ID NO: 2050441 - protein, 17 aa, Staphylococcus
FAGSYAVQWEMINYAIQ

SEQ ID NO: 2050442 - protein, 17 aa, Staphylococcus
FAISRTSGWLAHIFEQY

SEQ ID NO: 2050443 - protein, 25 aa, Staphylococcus
FAKNAFKMAIDYAFLVLNLHKIYLF

SEQ ID NO: 2050444 - protein, 18 aa, Staphylococcus
FAKNLGHTITELFPTEVP

SEQ ID NO: 2050445 - protein, 25 aa, Staphylococcus
FAKQAFKMAIDYAFLVLNMHKVYLY

SEQ ID NO: 2050446 - protein, 21 aa, Staphylococcus
FALLKVRSAPFVILDEVEAAL

SEQ ID NO: 2050447 - protein, 18 aa, Staphylococcus
FALPNAEVMIHQPLGGAQ

SEQ ID NO: 2050448 - protein, 19 aa, Staphylococcus
FALPNAEVMIHQPLGGAQG

SEQ ID NO: 2050449 - protein, 23 aa, Staphylococcus
FAMIPKFNLFIALGIRDAIQAFS

SEQ ID NO: 2050450 - protein, 26 aa, Staphylococcus
FANDWSEIRPEWGLARNAEFIIGQRN

SEQ ID NO: 2050451 - protein, 26 aa, Staphylococcus
FANDWSEIRPEWGLARNAEFIIGQRS

SEQ ID NO: 2050452 - protein, 17 aa, Staphylococcus
FAPNSWAPVSIAWSKDN

SEQ ID NO: 2050453 - protein, 18 aa, Staphylococcus
FAQLRPGADLGKKVKVGN

SEQ ID NO: 2050454 - protein, 18 aa, Staphylococcus
FARHGGGCFSGKDPTKVD

SEQ ID NO: 2050455 - protein, 18 aa, Staphylococcus
FASSGRYGGFLNHDLGIK

SEQ ID NO: 2050456 - protein, 17 aa, Staphylococcus
FATVLLRPFITHAPKEI

SEQ ID NO: 2050457 - protein, 18 aa, Staphylococcus
FATVLLRPFLTHAPKEIF

SEQ ID NO: 2050458 - protein, 18 aa, Staphylococcus
FATVLLRPFLTHAPREVF

SEQ ID NO: 2050459 - protein, 27 aa, Staphylococcus
FATYLYPKRMFWIKGQSFAINIDPFDM

SEQ ID NO: 2050460 - protein, 24 aa, Staphylococcus
FAVFKRPMLFYAFDLEDYITSRDF

SEQ ID NO: 2050461 - protein, 17 aa, Staphylococcus
FAVRIMGDASTRVVEKA

SEQ ID NO: 2050462 - protein, 23 aa, Staphylococcus
FAYDCYRRLLQMFGDVVYGVAMT

SEQ ID NO: 2050463 - protein, 26 aa, Staphylococcus
FAYDCYRRLLQMFGEVVYGIPMLAFD

SEQ ID NO: 2050464 - protein, 24 aa, Staphylococcus
FAYDCYRRLLQMFGEVVYNVPMQA

SEQ ID NO: 2050465 - protein, 23 aa, Staphylococcus
FAYDCYRRLLQMFGQVVYGIPMN

SEQ ID NO: 2050466 - protein, 23 aa, Staphylococcus
FAYDCYRRLLQMFGQVVYGIPMS

SEQ ID NO: 2050467 - protein, 20 aa, Staphylococcus
FAYKHHIPWIYGGVVQSTYA

SEQ ID NO: 2050468 - protein, 21 aa, Staphylococcus
FAYKYNIPWIYGGVVQSTYIE

SEQ ID NO: 2050469 - protein, 18 aa, Staphylococcus
FCTKIAWIEAGKLKQFGE

SEQ ID NO: 2050470 - protein, 17 aa, Staphylococcus
FCTKIAWIEGGKLKEYG

SEQ ID NO: 2050471 - protein, 18 aa, Staphylococcus
FCTKIAWIEGGRLKEFGE

SEQ ID NO: 2050472 - protein, 24 aa, Staphylococcus
FDAPERIKAGLLFTLEEECIKQGH

SEQ ID NO: 2050473 - protein, 17 aa, Staphylococcus
FDECLPFAFPHIILDFA

SEQ ID NO: 2050474 - protein, 19 aa, Staphylococcus
FDEPFYRKMAAQKWKQQDF

SEQ ID NO: 2050475 - protein, 17 aa, Staphylococcus
FDFLSDIVYQWERFAKQ

SEQ ID NO: 2050476 - protein, 19 aa, Staphylococcus
FDFLSDIVYQWERFANKFK

SEQ ID NO: 2050477 - protein, 17 aa, Staphylococcus
FDFLSDVVYQWERFAKR

SEQ ID NO: 2050478 - protein, 18 aa, Staphylococcus
FDFPFYFRGEVYHPFETE

SEQ ID NO: 2050479 - protein, 17 aa, Staphylococcus
FDFPGFVPAYIRPLFCE

SEQ ID NO: 2050480 - protein, 17 aa, Staphylococcus
FDGEDIFTRVNFEVKTG

SEQ ID NO: 2050481 - protein, 22 aa, Staphylococcus
FDIKLKYAYCLNKLNLGRRAEH

SEQ ID NO: 2050482 - protein, 20 aa, Staphylococcus
FDIPDCHCVILLRPTESLSL

SEQ ID NO: 2050483 - protein, 20 aa, Staphylococcus
FDKFPGFKCYRFLKPDKGTT

SEQ ID NO: 2050484 - protein, 18 aa, Staphylococcus
FDKLRFVHHSIPSINVDQ

SEQ ID NO: 2050485 - protein, 19 aa, Staphylococcus
FDKVIKYESVFNFDEMVQR

SEQ ID NO: 2050486 - protein, 19 aa, Staphylococcus
FDKVVKYESVFNFDDLVQE

SEQ ID NO: 2050487 - protein, 20 aa, Staphylococcus
FDLKFGPILLRQKNNLFTKK

SEQ ID NO: 2050488 - protein, 18 aa, Staphylococcus
FDLLEYALNYAFTHFDLR

SEQ ID NO: 2050489 - protein, 21 aa, Staphylococcus
FDLRPAGIIKMLDLKQPIYKQ

SEQ ID NO: 2050490 - protein, 21 aa, Staphylococcus
FDLRPAGIIKMLDLKRPIYKQ

SEQ ID NO: 2050491 - protein, 19 aa, Staphylococcus
FDLSKGFPLLTTKKVSFKL

SEQ ID NO: 2050492 - protein, 20 aa, Staphylococcus
FDLSKGFPLLTTKKVSFKLI

SEQ ID NO: 2050493 - protein, 20 aa, Staphylococcus
FDLSKGFPLLTTKKVSFKLV

SEQ ID NO: 2050494 - protein, 17 aa, Staphylococcus
FDMCGSANVLGMIEAAH

SEQ ID NO: 2050495 - protein, 18 aa, Staphylococcus
FDNLKWLGIEWDESVDKD

SEQ ID NO: 2050496 - protein, 17 aa, Staphylococcus
FDNLKWLGLDWDESIDK

SEQ ID NO: 2050497 - protein, 18 aa, Staphylococcus
FDNLKWLGLEWDESVDKD

SEQ ID NO: 2050498 - protein, 25 aa, Staphylococcus
FDNPFRFGATVGRYGGRISNATFNL

SEQ ID NO: 2050499 - protein, 24 aa, Staphylococcus
FDPNLRFPLWDSLDDLRETVLDFI

SEQ ID NO: 2050500 - protein, 24 aa, Staphylococcus
FDQFPIEAVFGIHVMPFNDEGTVT

SEQ ID NO: 2050501 - protein, 17 aa, Staphylococcus
FDQFRLAIDHVQVDPFA

SEQ ID NO: 2050502 - protein, 19 aa, Staphylococcus
FDQHTKWLSVLPIYHISGL

SEQ ID NO: 2050503 - protein, 23 aa, Staphylococcus
FDSIKWLINYVKQYPHTVLFVTH

SEQ ID NO: 2050504 - protein, 17 aa, Staphylococcus
FDSLNWLDQMKVANEAV

SEQ ID NO: 2050505 - protein, 17 aa, Staphylococcus
FDSMPTIVGFFPEIAEG

SEQ ID NO: 2050506 - protein, 17 aa, Staphylococcus
FDVLVPWVSIKEGPVAY

SEQ ID NO: 2050507 - protein, 17 aa, Staphylococcus
FDYYFAIGKQTANTLHS

SEQ ID NO: 2050508 - protein, 18 aa, Staphylococcus
FEARKACLLEIRDQINTV

SEQ ID NO: 2050509 - protein, 20 aa, Staphylococcus
FEDFFKLGIKEVKDIEFRKL

SEQ ID NO: 2050510 - protein, 22 aa, Staphylococcus
FEEARVALSLNVRKVHFSTYDK

SEQ ID NO: 2050511 - protein, 18 aa, Staphylococcus
FEEELNLWAKSNATELLN

SEQ ID NO: 2050512 - protein, 23 aa, Staphylococcus
FEEGKRAVLLLHGFTGNSADVRQ

SEQ ID NO: 2050513 - protein, 18 aa, Staphylococcus
FEGMPSINLFKQCYKALI

SEQ ID NO: 2050514 - protein, 18 aa, Staphylococcus
FEHAFYCKKCSNMATAKT

SEQ ID NO: 2050515 - protein, 19 aa, Staphylococcus
FEHLKDLFLEETFEEDQSA

SEQ ID NO: 2050516 - protein, 17 aa, Staphylococcus
FEIIDPYSLHQQGQDIG

SEQ ID NO: 2050517 - protein, 17 aa, Staphylococcus
FEIKREIAGLMVSAIIS

SEQ ID NO: 2050518 - protein, 19 aa, Staphylococcus
FEINGLLGLETGHINIGMS

SEQ ID NO: 2050519 - protein, 21 aa, Staphylococcus
FEIYDAGGWCMIDPNSDDHYH

SEQ ID NO: 2050520 - protein, 18 aa, Staphylococcus
FEKEYICLAYGRTQSEGV

SEQ ID NO: 2050521 - protein, 18 aa, Staphylococcus
FEKGELIAIVGPSGSGKS

SEQ ID NO: 2050522 - protein, 18 aa, Staphylococcus
FELACAMSGYQLGVNPFN

SEQ ID NO: 2050523 - protein, 20 aa, Staphylococcus
FELDVHWIWRAGLNPIEVIP

SEQ ID NO: 2050524 - protein, 21 aa, Staphylococcus
FELEGDLPLFPGHGPYTTVDD

SEQ ID NO: 2050525 - protein, 18 aa, Staphylococcus
FELNKDFNFSAAHYIPSE

SEQ ID NO: 2050526 - protein, 19 aa, Staphylococcus
FELNKDFNFSAAHYIPSED

SEQ ID NO: 2050527 - protein, 17 aa, Staphylococcus
FENIFSIRKRDSLLVLT

SEQ ID NO: 2050528 - protein, 18 aa, Staphylococcus
FESLCFHVPFTKMGKKAL

SEQ ID NO: 2050529 - protein, 21 aa, Staphylococcus
FETRAGTLLRYYTGLLESSRK

SEQ ID NO: 2050530 - protein, 17 aa, Staphylococcus
FEVEAKATLSFRTMQLI

SEQ ID NO: 2050531 - protein, 19 aa, Staphylococcus
FEVSEFNTALDYLTEHFNV

SEQ ID NO: 2050532 - protein, 17 aa, Staphylococcus
FEYGTDVPKIFDLAEEG

SEQ ID NO: 2050533 - protein, 18 aa, Staphylococcus
FFEHSYPGIKLITKDYDK

SEQ ID NO: 2050534 - protein, 18 aa, Staphylococcus
FFEQGGAMIDDWMGFTPM

SEQ ID NO: 2050535 - protein, 17 aa, Staphylococcus
FFERASFAPDGQDPSMI

SEQ ID NO: 2050536 - protein, 20 aa, Staphylococcus
FFGICLGHQLFALSQGAKAF

SEQ ID NO: 2050537 - protein, 20 aa, Staphylococcus
FFGICLGHQLFALSQGASSF

SEQ ID NO: 2050538 - protein, 20 aa, Staphylococcus
FFHPEFKKEYVILAEEGAES

SEQ ID NO: 2050539 - protein, 18 aa, Staphylococcus
FFISYHFNKFELGVEKIF

SEQ ID NO: 2050540 - protein, 17 aa, Staphylococcus
FFKDASIQTYQQATEKC

SEQ ID NO: 2050541 - protein, 24 aa, Staphylococcus
FFKVERLKGVFAWGFRINSAESEE

SEQ ID NO: 2050542 - protein, 17 aa, Staphylococcus
FFNCHFDAHLLQSSYFI

SEQ ID NO: 2050543 - protein, 29 aa, Staphylococcus
FFRKLNIEWIYRLLIDWKRLGRLKSIPKF

SEQ ID NO: 2050544 - protein, 18 aa, Staphylococcus
FFSLVFKNPYLRQEEEIR

SEQ ID NO: 2050545 - protein, 19 aa, Staphylococcus
FFYRFMRPLIEAGYVYIAQ

SEQ ID NO: 2050546 - protein, 20 aa, Staphylococcus
FFYRFMRPLLEAGYVYIAQP

SEQ ID NO: 2050547 - protein, 17 aa, Staphylococcus
FGATIGRYAGRIKDASF

SEQ ID NO: 2050548 - protein, 18 aa, Staphylococcus
FGATIGRYSGRIEAGAFK

SEQ ID NO: 2050549 - protein, 17 aa, Staphylococcus
FGATVGRYGGRIANATF

SEQ ID NO: 2050550 - protein, 20 aa, Staphylococcus
FGENRLEGFKAKKEALPDDA

SEQ ID NO: 2050551 - protein, 17 aa, Staphylococcus
FGGGQGMVLKPEPVFNA

SEQ ID NO: 2050552 - protein, 17 aa, Staphylococcus
FGGYDGKGQILVRDEND

SEQ ID NO: 2050553 - protein, 17 aa, Staphylococcus
FGGYGGLVIRSSKSLKH

SEQ ID NO: 2050554 - protein, 24 aa, Staphylococcus
FGHRKSLWVWTGFLYEYLSHDAGI

SEQ ID NO: 2050555 - protein, 17 aa, Staphylococcus
FGHSLGVYEIVRRLIDD

SEQ ID NO: 2050556 - protein, 17 aa, Staphylococcus
FGHSLGVYEIVRRMIDE

SEQ ID NO: 2050557 - protein, 21 aa, Staphylococcus
FGHSMLYLSSIMDIYNGEIVT

SEQ ID NO: 2050558 - protein, 26 aa, Staphylococcus
FGILKRPQFFFAYDIEKYDKGLRGFY

SEQ ID NO: 2050559 - protein, 21 aa, Staphylococcus
FGISVMAAFGYRAGEPPHGKV

SEQ ID NO: 2050560 - protein, 22 aa, Staphylococcus
FGKEVKRRILLGTFALSSGYYD

SEQ ID NO: 2050561 - protein, 19 aa, Staphylococcus
FGKFFKLMLNQGINLAPSK

SEQ ID NO: 2050562 - protein, 22 aa, Staphylococcus
FGLDIICLRFSHLFGANEKNNY

SEQ ID NO: 2050563 - protein, 22 aa, Staphylococcus
FGLRLAGEFDKAAMIEAVDMIH

SEQ ID NO: 2050564 - protein, 17 aa, Staphylococcus
FGLSIKHGLAIQGIEKV

SEQ ID NO: 2050565 - protein, 19 aa, Staphylococcus
FGNALPLIHIYKMAHAFVN

SEQ ID NO: 2050566 - protein, 18 aa, Staphylococcus
FGNLPTVVGFFPNIVEGD

SEQ ID NO: 2050567 - protein, 24 aa, Staphylococcus
FGNYELRLPLLPLEDADAKVLINV

SEQ ID NO: 2050568 - protein, 24 aa, Staphylococcus
FGNYELRLPLLPLEKEKANVLVNA

SEQ ID NO: 2050569 - protein, 25 aa, Staphylococcus
FGPAIKGARGYIFFGHPLDIEMVAG

SEQ ID NO: 2050570 - protein, 18 aa, Staphylococcus
FGRIGRLAFRRIQDVEGL

SEQ ID NO: 2050571 - protein, 19 aa, Staphylococcus
FGRKKLNGIIKKHKNKLIK

SEQ ID NO: 2050572 - protein, 23 aa, Staphylococcus
FGSSEWYLIMIIKYDQPTFAELT

SEQ ID NO: 2050573 - protein, 19 aa, Staphylococcus
FGSWKSWLDKTLGWIKNIK

SEQ ID NO: 2050574 - protein, 24 aa, Staphylococcus
FGSYELRLPLVPLEDNDRQTLEQA

SEQ ID NO: 2050575 - protein, 22 aa, Staphylococcus
FGSYRCAYELFDKALSDKKTLN

SEQ ID NO: 2050576 - protein, 17 aa, Staphylococcus
FGTIDSWLVWKLSGKAA

SEQ ID NO: 2050577 - protein, 18 aa, Staphylococcus
FGTIDSWLVWKLSGKAAH

SEQ ID NO: 2050578 - protein, 17 aa, Staphylococcus
FGTIDSWLVWKLSGKEA

SEQ ID NO: 2050579 - protein, 24 aa, Staphylococcus
FGTPISTCILVFKKCREIDDNVLF

SEQ ID NO: 2050580 - protein, 17 aa, Staphylococcus
FGVALCGTGVGISASAD

SEQ ID NO: 2050581 - protein, 25 aa, Staphylococcus
FGVNGIRISIAWSRIFPDGYGEVNQ

SEQ ID NO: 2050582 - protein, 26 aa, Staphylococcus
FGVNGIRISIAWSRIFPTGYGEVNQK

SEQ ID NO: 2050583 - protein, 26 aa, Staphylococcus
FGYHVSKGWMCVQVFFIRQGNMIQRD

SEQ ID NO: 2050584 - protein, 20 aa, Staphylococcus
FGYMWECPDFFNLNQTDVLL

SEQ ID NO: 2050585 - protein, 28 aa, Staphylococcus
FGYNVSKGWMCIQVFFIRQGNLIQRDAT

SEQ ID NO: 2050586 - protein, 17 aa, Staphylococcus
FHGEVAMQLFLNNQFDL

SEQ ID NO: 2050587 - protein, 26 aa, Staphylococcus
FHRELRLAIETEIKRLNLTLKKTIRV

SEQ ID NO: 2050588 - protein, 20 aa, Staphylococcus
FIADKCRLWVTVHFLPNEDY

SEQ ID NO: 2050589 - protein, 18 aa, Staphylococcus
FIALSIHLIDLLKNVSPE

SEQ ID NO: 2050590 - protein, 19 aa, Staphylococcus
FIEAFKIPTIVTLPAKGIL

SEQ ID NO: 2050591 - protein, 19 aa, Staphylococcus
FIEDFSIKISDVMTKDNLI

SEQ ID NO: 2050592 - protein, 19 aa, Staphylococcus
FIEDFSIKISDVMTKEGLI

SEQ ID NO: 2050593 - protein, 19 aa, Staphylococcus
FIEDFSIKISDVMTKEQLV

SEQ ID NO: 2050594 - protein, 19 aa, Staphylococcus
FIELKRILMEWQIGIHDGN

SEQ ID NO: 2050595 - protein, 17 aa, Staphylococcus
FIEMCLLLPNLNEKQYN

SEQ ID NO: 2050596 - protein, 17 aa, Staphylococcus
FIFAYILDDYKKMRTSY

SEQ ID NO: 2050597 - protein, 17 aa, Staphylococcus
FIGCNTNLIAPVTVNDH

SEQ ID NO: 2050598 - protein, 17 aa, Staphylococcus
FIIAFILDDYKKMKTSF

SEQ ID NO: 2050599 - protein, 18 aa, Staphylococcus
FIIGDGIGPDIWRASRRV

SEQ ID NO: 2050600 - protein, 20 aa, Staphylococcus
FIKDMLNMIDIHFDNQSNGI

SEQ ID NO: 2050601 - protein, 24 aa, Staphylococcus
FIKSCPNLKWIAWYATGVNNLPLE

SEQ ID NO: 2050602 - protein, 17 aa, Staphylococcus
FIKVGVRVVVPFGPRTI

SEQ ID NO: 2050603 - protein, 23 aa, Staphylococcus
FILGETLYNFGLMPQGLEVFRTL

SEQ ID NO: 2050604 - protein, 18 aa, Staphylococcus
FILGHAGGALPYLRWRID

SEQ ID NO: 2050605 - protein, 17 aa, Staphylococcus
FINECRTSHAFWASLDT

SEQ ID NO: 2050606 - protein, 18 aa, Staphylococcus
FINLMGGEMLSFYDWYAD

SEQ ID NO: 2050607 - protein, 23 aa, Staphylococcus
FIPNLKWKRWIYIHLLNMTIGQH

SEQ ID NO: 2050608 - protein, 25 aa, Staphylococcus
FIPSLPLKRWIYRACLGMEIGQKTS

SEQ ID NO: 2050609 - protein, 20 aa, Staphylococcus
FIRLNYYLIDIFRKENKKIP

SEQ ID NO: 2050610 - protein, 19 aa, Staphylococcus
FIRNGECSWKPYTQYDASP

SEQ ID NO: 2050611 - protein, 17 aa, Staphylococcus
FISGFVGSCSFDLVRHA

SEQ ID NO: 2050612 - protein, 18 aa, Staphylococcus
FISWTGKMAETFVLAHEL

SEQ ID NO: 2050613 - protein, 19 aa, Staphylococcus
FIVKTRFGGYDGKGQVLVK

SEQ ID NO: 2050614 - protein, 18 aa, Staphylococcus
FIVTEYWSLSSLFNSGAV

SEQ ID NO: 2050615 - protein, 17 aa, Staphylococcus
FIYCLKGEVVLMLGNQN

SEQ ID NO: 2050616 - protein, 17 aa, Staphylococcus
FIYISTISVGTVFDSHA

SEQ ID NO: 2050617 - protein, 18 aa, Staphylococcus
FKAAEFLQQFEDLQQLFI

SEQ ID NO: 2050618 - protein, 19 aa, Staphylococcus
FKAFLDHAMKLGADYVATG

SEQ ID NO: 2050619 - protein, 18 aa, Staphylococcus
FKAGMVITVEPGIYVPGV

SEQ ID NO: 2050620 - protein, 27 aa, Staphylococcus
FKALLNEVFKAYGLLLIDANNTELRKL

SEQ ID NO: 2050621 - protein, 17 aa, Staphylococcus
FKALRFLRPQTKHRHYI

SEQ ID NO: 2050622 - protein, 24 aa, Staphylococcus
FKAPRWLVNPIKNYSLRKHKEISY

SEQ ID NO: 2050623 - protein, 19 aa, Staphylococcus
FKATYGLLYEEELGLQSTI

SEQ ID NO: 2050624 - protein, 17 aa, Staphylococcus
FKDAMILADFFDTPYQM

SEQ ID NO: 2050625 - protein, 24 aa, Staphylococcus
FKDIDRALVWGFNWKQGPFQLWDL

SEQ ID NO: 2050626 - protein, 20 aa, Staphylococcus
FKDILFNRITKWTSLSKPKY

SEQ ID NO: 2050627 - protein, 17 aa, Staphylococcus
FKDKSALCTTIIEHDFT

SEQ ID NO: 2050628 - protein, 18 aa, Staphylococcus
FKDTGWINLPLVNGAYAN

SEQ ID NO: 2050629 - protein, 20 aa, Staphylococcus
FKDYCALLFHKGVLLPDPEH

SEQ ID NO: 2050630 - protein, 19 aa, Staphylococcus
FKEAMPFLMRASELDDKND

SEQ ID NO: 2050631 - protein, 19 aa, Staphylococcus
FKEEIYTLFASINSYNELS

SEQ ID NO: 2050632 - protein, 18 aa, Staphylococcus
FKEFCDITGYSLNELQTY

SEQ ID NO: 2050633 - protein, 17 aa, Staphylococcus
FKEGFYFIVRIKTDNNR

SEQ ID NO: 2050634 - protein, 18 aa, Staphylococcus
FKEIIIRNIKGYTLSDKF

SEQ ID NO: 2050635 - protein, 18 aa, Staphylococcus
FKEKVPWIYGGVVQSTYI

SEQ ID NO: 2050636 - protein, 18 aa, Staphylococcus
FKELFFIKIKGKANINTE

SEQ ID NO: 2050637 - protein, 21 aa, Staphylococcus
FKESLRWGAEIFHNLKSILKN

SEQ ID NO: 2050638 - protein, 17 aa, Staphylococcus
FKEVYQIFSDVLGVPLK

SEQ ID NO: 2050639 - protein, 24 aa, Staphylococcus
FKFDKAFISCGSFDKNDCYEFDLE

SEQ ID NO: 2050640 - protein, 17 aa, Staphylococcus
FKFLGPVTVFSFLEAAG

SEQ ID NO: 2050641 - protein, 20 aa, Staphylococcus
FKFVIFPAIVPNRFQVIKIA

SEQ ID NO: 2050642 - protein, 18 aa, Staphylococcus
FKGIIGLITMKKVKEPLK

SEQ ID NO: 2050643 - protein, 20 aa, Staphylococcus
FKGLADHGAFAFTDDGVGVQ

SEQ ID NO: 2050644 - protein, 22 aa, Staphylococcus
FKGQDAFEFKPYVKLIFASNEL

SEQ ID NO: 2050645 - protein, 19 aa, Staphylococcus
FKGSLIFTSYDFEFINTIA

SEQ ID NO: 2050646 - protein, 20 aa, Staphylococcus
FKHIPVKAGDFFFIPNGIVH

SEQ ID NO: 2050647 - protein, 18 aa, Staphylococcus
FKHVCDIDLYPSHASVMT

SEQ ID NO: 2050648 - protein, 17 aa, Staphylococcus
FKIEQFNLMGLKRQPMT

SEQ ID NO: 2050649 - protein, 19 aa, Staphylococcus
FKILSEFKLNTPSLPINTY

SEQ ID NO: 2050650 - protein, 20 aa, Staphylococcus
FKINALRSIFWKVLDQEFYL

SEQ ID NO: 2050651 - protein, 22 aa, Staphylococcus
FKITDIRAVAAIAKRHHLLLAV

SEQ ID NO: 2050652 - protein, 20 aa, Staphylococcus
FKITDIRAVAQISQQHQLLL

SEQ ID NO: 2050653 - protein, 20 aa, Staphylococcus
FKITDIRGAADIAKKHHLKL

SEQ ID NO: 2050654 - protein, 18 aa, Staphylococcus
FKIVPLLIFSAMHYLVDI

SEQ ID NO: 2050655 - protein, 17 aa, Staphylococcus
FKKAFRMSGLVNSSEEV

SEQ ID NO: 2050656 - protein, 25 aa, Staphylococcus
FKKELFPFWKIRDFHEGFNFFINNI

SEQ ID NO: 2050657 - protein, 18 aa, Staphylococcus
FKKFKGDHFFINNIFQDP

SEQ ID NO: 2050658 - protein, 25 aa, Staphylococcus
FKKLIFIGVIRFRYANMQKVELAIG

SEQ ID NO: 2050659 - protein, 32 aa, Staphylococcus
FKKRIPILGVCLGFQCIYDYFGGRIIHGKRPV

SEQ ID NO: 2050660 - protein, 19 aa, Staphylococcus
FKKSMPILIHGDAAYPGQG

SEQ ID NO: 2050661 - protein, 18 aa, Staphylococcus
FKKYGFKFMGPVTMFSFL

SEQ ID NO: 2050662 - protein, 17 aa, Staphylococcus
FKKYGINIINGYGLTEA

SEQ ID NO: 2050663 - protein, 17 aa, Staphylococcus
FKLGIILSYLKQYEASQ

SEQ ID NO: 2050664 - protein, 20 aa, Staphylococcus
FKLKEYFLRFSRKQRKNVKS

SEQ ID NO: 2050665 - protein, 17 aa, Staphylococcus
FKLPKWMFKPFKNHSLK

SEQ ID NO: 2050666 - protein, 19 aa, Staphylococcus
FKLYIGLKHIHPFIEDAVQ

SEQ ID NO: 2050667 - protein, 21 aa, Staphylococcus
FKMVEAYLWFDGQEVVGFSGT

SEQ ID NO: 2050668 - protein, 24 aa, Staphylococcus
FKPKDIRAAIFFGGFYNMNTVKKT

SEQ ID NO: 2050669 - protein, 20 aa, Staphylococcus
FKPSSLFMLHQIIKGHTNYN

SEQ ID NO: 2050670 - protein, 20 aa, Staphylococcus
FKPYFNWTIEKLCENFNIAV

SEQ ID NO: 2050671 - protein, 24 aa, Staphylococcus
FKQGFKTICLRTSNIDAIKQTLEE

SEQ ID NO: 2050672 - protein, 23 aa, Staphylococcus
FKQPIIWLCGGLDRGNDFDELIP

SEQ ID NO: 2050673 - protein, 23 aa, Staphylococcus
FKQPIVWLCGGLDRGNDFDELIP

SEQ ID NO: 2050674 - protein, 20 aa, Staphylococcus
FKRKFGINIEEVFGQTITDL

SEQ ID NO: 2050675 - protein, 23 aa, Staphylococcus
FKRLFGDVKIDWMIHYTGFERKE

SEQ ID NO: 2050676 - protein, 20 aa, Staphylococcus
FKSRITVWVLNYLKANHDKL

SEQ ID NO: 2050677 - protein, 20 aa, Staphylococcus
FKSRVEKSINEWDIDLQHIY

SEQ ID NO: 2050678 - protein, 21 aa, Staphylococcus
FKSTRLESSIYFPPYKGKFKY

SEQ ID NO: 2050679 - protein, 20 aa, Staphylococcus
FKTGIIFLPINWRLNPKEIA

SEQ ID NO: 2050680 - protein, 25 aa, Staphylococcus
FKVERLKGIFAWGFRIKSSEPEEGL

SEQ ID NO: 2050681 - protein, 22 aa, Staphylococcus
FKVERLKGVFAWGFRIKSAEPE

SEQ ID NO: 2050682 - protein, 24 aa, Staphylococcus
FKVERLKGVFAWGFRIKSSEPEEG

SEQ ID NO: 2050683 - protein, 23 aa, Staphylococcus
FKVERLKGVFAWGYRINSKIPEE

SEQ ID NO: 2050684 - protein, 22 aa, Staphylococcus
FKVERLKGVFAWGYRINSTNPE

SEQ ID NO: 2050685 - protein, 18 aa, Staphylococcus
FKVGGLFNKAKKKEEAQT

SEQ ID NO: 2050686 - protein, 18 aa, Staphylococcus
FKYMKPLVEAGRVFIALP

SEQ ID NO: 2050687 - protein, 17 aa, Staphylococcus
FLAGPFVRDKDAIQIVP

SEQ ID NO: 2050688 - protein, 17 aa, Staphylococcus
FLDEAYLLLDFHSMIFN

SEQ ID NO: 2050689 - protein, 17 aa, Staphylococcus
FLDRVWRLIVTEDGSLN

SEQ ID NO: 2050690 - protein, 18 aa, Staphylococcus
FLDRVWRLLINEDGSLTS

SEQ ID NO: 2050691 - protein, 17 aa, Staphylococcus
FLEAHAGVMITASHNPK

SEQ ID NO: 2050692 - protein, 18 aa, Staphylococcus
FLERTFRKPSEFYNPLTL

SEQ ID NO: 2050693 - protein, 24 aa, Staphylococcus
FLESCPNLKWIAWYATGVNSLPLN

SEQ ID NO: 2050694 - protein, 17 aa, Staphylococcus
FLESIGIEINTNEYGTA

SEQ ID NO: 2050695 - protein, 17 aa, Staphylococcus
FLFIWGWNEGKEIFSNN

SEQ ID NO: 2050696 - protein, 18 aa, Staphylococcus
FLIAGGLDINHISKLKYL

SEQ ID NO: 2050697 - protein, 20 aa, Staphylococcus
FLKQFCKAHHVELYVRHLDL

SEQ ID NO: 2050698 - protein, 24 aa, Staphylococcus
FLNPDHLPLILGIEKGWFKEEALE

SEQ ID NO: 2050699 - protein, 23 aa, Staphylococcus
FLNPDHMPLIIGIEKGWFADAQL

SEQ ID NO: 2050700 - protein, 24 aa, Staphylococcus
FLNPDHMPLILGIEKGWFKEQNLE

SEQ ID NO: 2050701 - protein, 17 aa, Staphylococcus
FLPSVMVAFGYRAEDPK

SEQ ID NO: 2050702 - protein, 17 aa, Staphylococcus
FLQNIGIDIKTNEYGTA

SEQ ID NO: 2050703 - protein, 17 aa, Staphylococcus
FLSDIVYQWERFAKQFE

SEQ ID NO: 2050704 - protein, 17 aa, Staphylococcus
FLSDVVYQWERFAKRFE

SEQ ID NO: 2050705 - protein, 17 aa, Staphylococcus
FLSDVVYQWERFARRFE

SEQ ID NO: 2050706 - protein, 17 aa, Staphylococcus
FLSEPYVIIGLNVIVAD

SEQ ID NO: 2050707 - protein, 23 aa, Staphylococcus
FLSPCKLAKMISRYMIINETDKV

SEQ ID NO: 2050708 - protein, 18 aa, Staphylococcus
FLTAKARYASAIKGTKPT

SEQ ID NO: 2050709 - protein, 24 aa, Staphylococcus
FLTKDLFIDWAWGEDYFRKKLIDY

SEQ ID NO: 2050710 - protein, 18 aa, Staphylococcus
FLTRRIIKENIESVLKYG

SEQ ID NO: 2050711 - protein, 17 aa, Staphylococcus
FLYKPVIYYQFDKERFL

SEQ ID NO: 2050712 - protein, 23 aa, Staphylococcus
FLYRFESSLPWWLYMGTQALIHD

SEQ ID NO: 2050713 - protein, 18 aa, Staphylococcus
FMAFLGVLPTYYKGKNRE

SEQ ID NO: 2050714 - protein, 18 aa, Staphylococcus
FMAKEGRGLICAPISKDL

SEQ ID NO: 2050715 - protein, 18 aa, Staphylococcus
FMAKEGRGLICAPLDTSI

SEQ ID NO: 2050716 - protein, 17 aa, Staphylococcus
FMKEIEASYSFTDYHLI

SEQ ID NO: 2050717 - protein, 18 aa, Staphylococcus
FMLTWRPWDLVGEISSNS

SEQ ID NO: 2050718 - protein, 23 aa, Staphylococcus
FMNGREVFKFAVRIMGEASNNAV

SEQ ID NO: 2050719 - protein, 24 aa, Staphylococcus
FMNGREVFKFAVRIMGEASRNVVE

SEQ ID NO: 2050720 - protein, 19 aa, Staphylococcus
FMNRFDIKIATTFGNRDAV

SEQ ID NO: 2050721 - protein, 18 aa, Staphylococcus
FNELMVAIQSPFLIDEDD

SEQ ID NO: 2050722 - protein, 18 aa, Staphylococcus
FNELMVAIQSPFLLDDED

SEQ ID NO: 2050723 - protein, 18 aa, Staphylococcus
FNELMVGIQTPFLFDEED

SEQ ID NO: 2050724 - protein, 18 aa, Staphylococcus
FNELMVSIQSAFIYNDED

SEQ ID NO: 2050725 - protein, 18 aa, Staphylococcus
FNELMVSIQSAFLYNDED

SEQ ID NO: 2050726 - protein, 17 aa, Staphylococcus
FNFGATIGRYAGRIKDA

SEQ ID NO: 2050727 - protein, 25 aa, Staphylococcus
FNFKYKPRLPLSINIPKIELNKGKV

SEQ ID NO: 2050728 - protein, 17 aa, Staphylococcus
FNFSAAHFIPCKDAGKC

SEQ ID NO: 2050729 - protein, 17 aa, Staphylococcus
FNFSAAHFIPSEDAGKC

SEQ ID NO: 2050730 - protein, 17 aa, Staphylococcus
FNFSAAHYIPCEDAGKC

SEQ ID NO: 2050731 - protein, 24 aa, Staphylococcus
FNGDIGVIVGIFWAKENALNKDVI

SEQ ID NO: 2050732 - protein, 24 aa, Staphylococcus
FNGDIGVIVGVFWAKENALNKDVL

SEQ ID NO: 2050733 - protein, 25 aa, Staphylococcus
FNGVLCGRATWAGAVQVYIEQDEAA

SEQ ID NO: 2050734 - protein, 17 aa, Staphylococcus
FNGYRIVAFNGGRLLIH

SEQ ID NO: 2050735 - protein, 18 aa, Staphylococcus
FNIARKMGYFDIPKDLLI

SEQ ID NO: 2050736 - protein, 20 aa, Staphylococcus
FNIARKMGYFDISKDLLIPI

SEQ ID NO: 2050737 - protein, 17 aa, Staphylococcus
FNIIIAGGFSDIFYMNC

SEQ ID NO: 2050738 - protein, 19 aa, Staphylococcus
FNILIRCGKGTYIRTLATD

SEQ ID NO: 2050739 - protein, 20 aa, Staphylococcus
FNINIPERWSIAQLFQSAME

SEQ ID NO: 2050740 - protein, 17 aa, Staphylococcus
FNKAEAMIILFPKLFKQ

SEQ ID NO: 2050741 - protein, 24 aa, Staphylococcus
FNLAPEEFIVWVLGFVKNIADLKQ

SEQ ID NO: 2050742 - protein, 23 aa, Staphylococcus
FNLAPEEFIVWVLGFVKSIEELK

SEQ ID NO: 2050743 - protein, 17 aa, Staphylococcus
FNLFIALGIRDAIQQFS

SEQ ID NO: 2050744 - protein, 24 aa, Staphylococcus
FNMAPEEFIIWVLGFTKSIQDLKH

SEQ ID NO: 2050745 - protein, 24 aa, Staphylococcus
FNMIFQFEHLGLWNTGDVKFDVKS

SEQ ID NO: 2050746 - protein, 24 aa, Staphylococcus
FNMIFQFEHLGLWSTGDQKFNVNA

SEQ ID NO: 2050747 - protein, 24 aa, Staphylococcus
FNMIFQFEHLGLWSTGDSKFDVKS

SEQ ID NO: 2050748 - protein, 24 aa, Staphylococcus
FNMIFQFEHLGLWSTGDSKFDVLS

SEQ ID NO: 2050749 - protein, 17 aa, Staphylococcus
FNNAFIIGLKYKSGFIR

SEQ ID NO: 2050750 - protein, 26 aa, Staphylococcus
FNNFRVARTWIGFLLRETDGNFFNNI

SEQ ID NO: 2050751 - protein, 17 aa, Staphylococcus
FNPIGGWWNQVMLSQKV

SEQ ID NO: 2050752 - protein, 17 aa, Staphylococcus
FNSALSLILSRHKVNDA

SEQ ID NO: 2050753 - protein, 21 aa, Staphylococcus
FNSDWSRSQIQDWIKEDLVTV

SEQ ID NO: 2050754 - protein, 17 aa, Staphylococcus
FNVKLDDGMAFLTGVVS

SEQ ID NO: 2050755 - protein, 18 aa, Staphylococcus
FNYDILVVGLGFVSETFG

SEQ ID NO: 2050756 - protein, 22 aa, Staphylococcus
FNYRLGAWGFLDWSFFKSNYDC

SEQ ID NO: 2050757 - protein, 20 aa, Staphylococcus
FPDFIEKYGFFDMLQASLHP

SEQ ID NO: 2050758 - protein, 17 aa, Staphylococcus
FPECGAMSQAYIGYQLQ

SEQ ID NO: 2050759 - protein, 23 aa, Staphylococcus
FPEELAEKFILFFSKKNEVVFDP

SEQ ID NO: 2050760 - protein, 21 aa, Staphylococcus
FPEFDDYLLLWKLEVLDNYKN

SEQ ID NO: 2050761 - protein, 23 aa, Staphylococcus
FPENRARLAIYPAAMRYAGPREA

SEQ ID NO: 2050762 - protein, 17 aa, Staphylococcus
FPFSELISFKEVQEELG

SEQ ID NO: 2050763 - protein, 23 aa, Staphylococcus
FPGVKGEVLVNAFSKHGVMISTT

SEQ ID NO: 2050764 - protein, 23 aa, Staphylococcus
FPGVKGEVLVNAFSKLDVMVSTT

SEQ ID NO: 2050765 - protein, 21 aa, Staphylococcus
FPGVKGEVLVNAFSKQDIMVS

SEQ ID NO: 2050766 - protein, 17 aa, Staphylococcus
FPHRLGHGLGLEEHEYQ

SEQ ID NO: 2050767 - protein, 24 aa, Staphylococcus
FPIFYWKEFEDIIAKHGGTTPANR

SEQ ID NO: 2050768 - protein, 21 aa, Staphylococcus
FPILLASWKLAPALAAGNTIV

SEQ ID NO: 2050769 - protein, 22 aa, Staphylococcus
FPKIKGNFLVVGMKLIATILGK

SEQ ID NO: 2050770 - protein, 21 aa, Staphylococcus
FPLLLASWKLAPALAAGNTVV

SEQ ID NO: 2050771 - protein, 20 aa, Staphylococcus
FPNRLYLSIDAYRRQVKING

SEQ ID NO: 2050772 - protein, 17 aa, Staphylococcus
FPNRVDLGLGRAPGTDM

SEQ ID NO: 2050773 - protein, 18 aa, Staphylococcus
FPPDEIGFIALHIASNTE

SEQ ID NO: 2050774 - protein, 22 aa, Staphylococcus
FPRISYDDAIEFLKEQGFDDIE

SEQ ID NO: 2050775 - protein, 23 aa, Staphylococcus
FPRISYDDAIKFLKEEGFDDIEW

SEQ ID NO: 2050776 - protein, 21 aa, Staphylococcus
FPSFRPDSWRGKRYLYTGLFD

SEQ ID NO: 2050777 - protein, 18 aa, Staphylococcus
FPSHLFRKYAKDVFEDNQ

SEQ ID NO: 2050778 - protein, 18 aa, Staphylococcus
FPSNEAETLFTFENGQVI

SEQ ID NO: 2050779 - protein, 20 aa, Staphylococcus
FPSNKFNLGFTLQDTPGVDS

SEQ ID NO: 2050780 - protein, 17 aa, Staphylococcus
FPTPAVFDWLQKEGNIE

SEQ ID NO: 2050781 - protein, 18 aa, Staphylococcus
FPTSGLILGKSGIRRAYE

SEQ ID NO: 2050782 - protein, 19 aa, Staphylococcus
FPTYYGRPDYYTFVVFNTM

SEQ ID NO: 2050783 - protein, 17 aa, Staphylococcus
FQERIWGGTALRDKFDY

SEQ ID NO: 2050784 - protein, 22 aa, Staphylococcus
FQFECLRKGFIFENDQWTDHYV

SEQ ID NO: 2050785 - protein, 18 aa, Staphylococcus
FQHFNLLWSRTVISNIMF

SEQ ID NO: 2050786 - protein, 18 aa, Staphylococcus
FQHFNLLWSRTVLNNITF

SEQ ID NO: 2050787 - protein, 23 aa, Staphylococcus
FQHFNLLWSRTVLRNITFPLEIA

SEQ ID NO: 2050788 - protein, 18 aa, Staphylococcus
FQKFISCFVFLYEKDTKT

SEQ ID NO: 2050789 - protein, 24 aa, Staphylococcus
FQLIAKRMGFDWNYSHPSEIMDEI

SEQ ID NO: 2050790 - protein, 17 aa, Staphylococcus
FQLLFLLVSNPKHIFTR

SEQ ID NO: 2050791 - protein, 20 aa, Staphylococcus
FQLRAKLFVDQIVSFVNNSP

SEQ ID NO: 2050792 - protein, 17 aa, Staphylococcus
FQPCPGVVKRLHLPQGF

SEQ ID NO: 2050793 - protein, 21 aa, Staphylococcus
FQPRLICDFATLTGAAIAALG

SEQ ID NO: 2050794 - protein, 22 aa, Staphylococcus
FQSEGLKVIGYRDVPVDVNAVA

SEQ ID NO: 2050795 - protein, 17 aa, Staphylococcus
FRANGLFDRYFRNKEKN

SEQ ID NO: 2050796 - protein, 21 aa, Staphylococcus
FRASEKFTIVPSWEQYTKEDD

SEQ ID NO: 2050797 - protein, 21 aa, Staphylococcus
FRASEKFTIVPSWETYQQEDD

SEQ ID NO: 2050798 - protein, 20 aa, Staphylococcus
FRASKRFTIVPSWEDYSKES

SEQ ID NO: 2050799 - protein, 19 aa, Staphylococcus
FRASKRFTIVPSWETYTKD

SEQ ID NO: 2050800 - protein, 18 aa, Staphylococcus
FREAHAIVGQIVYWCIQH

SEQ ID NO: 2050801 - protein, 19 aa, Staphylococcus
FREILKRFYYFSIANPSPF

SEQ ID NO: 2050802 - protein, 19 aa, Staphylococcus
FRGAMKFTQMRYSLRTGRK

SEQ ID NO: 2050803 - protein, 17 aa, Staphylococcus
FRGDIFGGYILYKMGYI

SEQ ID NO: 2050804 - protein, 21 aa, Staphylococcus
FRGDIFGGYILYNLGFIESEA

SEQ ID NO: 2050805 - protein, 21 aa, Staphylococcus
FRGDIFGGYILYNLGFIESEN

SEQ ID NO: 2050806 - protein, 21 aa, Staphylococcus
FRGDIFGGYILYNLGFIESES

SEQ ID NO: 2050807 - protein, 18 aa, Staphylococcus
FRGKMHVGDNVSLIKLDG

SEQ ID NO: 2050808 - protein, 18 aa, Staphylococcus
FRGLFQFIRFIDELIDRG

SEQ ID NO: 2050809 - protein, 23 aa, Staphylococcus
FRHFAGSYAIQWKMINYAIDHNI

SEQ ID NO: 2050810 - protein, 18 aa, Staphylococcus
FRHFAGSYAVQWEMINYA

SEQ ID NO: 2050811 - protein, 22 aa, Staphylococcus
FRKSQEIIQVWHAVGAFKTVGY

SEQ ID NO: 2050812 - protein, 18 aa, Staphylococcus
FRKTVAFLLSNQVESYNL

SEQ ID NO: 2050813 - protein, 20 aa, Staphylococcus
FRLEKELDIFPSHFSKGMKQ

SEQ ID NO: 2050814 - protein, 17 aa, Staphylococcus
FRLGISVSKKIGNAVTR

SEQ ID NO: 2050815 - protein, 19 aa, Staphylococcus
FRPFPFWKRVHDSFIESDD

SEQ ID NO: 2050816 - protein, 19 aa, Staphylococcus
FRPFPFWKRVHDSFIESED

SEQ ID NO: 2050817 - protein, 19 aa, Staphylococcus
FRPFPFWKRVHDSFISSDD

SEQ ID NO: 2050818 - protein, 17 aa, Staphylococcus
FRPGLKARDEFKVRSVL

SEQ ID NO: 2050819 - protein, 21 aa, Staphylococcus
FRPQLRALLRASVYGKLNIMF

SEQ ID NO: 2050820 - protein, 19 aa, Staphylococcus
FRRRVRGIVSKAQRVSEET

SEQ ID NO: 2050821 - protein, 17 aa, Staphylococcus
FRSGKVIYDREHSTFIL

SEQ ID NO: 2050822 - protein, 17 aa, Staphylococcus
FRSIGGLYDEISKKGLS

SEQ ID NO: 2050823 - protein, 21 aa, Staphylococcus
FRSRFRMLVEAQLDLLKNDDW

SEQ ID NO: 2050824 - protein, 21 aa, Staphylococcus
FRSRFRMLVEAQLDLLKSEDW

SEQ ID NO: 2050825 - protein, 18 aa, Staphylococcus
FRTAHEIVGKIVLDCINK

SEQ ID NO: 2050826 - protein, 18 aa, Staphylococcus
FRTAHEIVGKIVLNCIHK

SEQ ID NO: 2050827 - protein, 18 aa, Staphylococcus
FRVGFAVGNRDMIQALKK

SEQ ID NO: 2050828 - protein, 17 aa, Staphylococcus
FRWEPSILSRSISDLTV

SEQ ID NO: 2050829 - protein, 17 aa, Staphylococcus
FSGLEIDVFDFHSNKSR

SEQ ID NO: 2050830 - protein, 17 aa, Staphylococcus
FSGLEIDVFDFYSNKAR

SEQ ID NO: 2050831 - protein, 17 aa, Staphylococcus
FSKAAPLSAVFDVQSLL

SEQ ID NO: 2050832 - protein, 17 aa, Staphylococcus
FSKAAPMSAVFQAQTLI

SEQ ID NO: 2050833 - protein, 17 aa, Staphylococcus
FSKDLGYWVDMDSPYIT

SEQ ID NO: 2050834 - protein, 20 aa, Staphylococcus
FSKEGIEVFVIDNLSSGFLD

SEQ ID NO: 2050835 - protein, 17 aa, Staphylococcus
FSKHLGLMFQIKDDLLD

SEQ ID NO: 2050836 - protein, 18 aa, Staphylococcus
FSKSFKRSISKRVLKETL

SEQ ID NO: 2050837 - protein, 17 aa, Staphylococcus
FSNHMGLMFQIKDDLLD

SEQ ID NO: 2050838 - protein, 21 aa, Staphylococcus
FSNKYPSVFVFIGSNSEYDLH

SEQ ID NO: 2050839 - protein, 17 aa, Staphylococcus
FSPRPGTISVEYENGES

SEQ ID NO: 2050840 - protein, 19 aa, Staphylococcus
FSQEGYLMWIEDFENNIIQ

SEQ ID NO: 2050841 - protein, 17 aa, Staphylococcus
FSRGHFKGNQFPEGVNA

SEQ ID NO: 2050842 - protein, 18 aa, Staphylococcus
FSRGHFKGNQFPEGVNAF

SEQ ID NO: 2050843 - protein, 18 aa, Staphylococcus
FSRGHFKGNQFPEGVNAL

SEQ ID NO: 2050844 - protein, 17 aa, Staphylococcus
FSTGSWGRVPFIPFKNN

SEQ ID NO: 2050845 - protein, 24 aa, Staphylococcus
FSYLAIRIAMEWAIVEPYLPVSQP

SEQ ID NO: 2050846 - protein, 18 aa, Staphylococcus
FTDGIVIGSEIVKRFAND

SEQ ID NO: 2050847 - protein, 18 aa, Staphylococcus
FTEARLPLIRGINQKLIR

SEQ ID NO: 2050848 - protein, 17 aa, Staphylococcus
FTEIIPISALEGLNVDH

SEQ ID NO: 2050849 - protein, 20 aa, Staphylococcus
FTEKAFLRVDLNDMINALPK

SEQ ID NO: 2050850 - protein, 23 aa, Staphylococcus
FTFSRKGLREGYAMNIISERYPT

SEQ ID NO: 2050851 - protein, 18 aa, Staphylococcus
FTGYEVLNTFTFRITRNA

SEQ ID NO: 2050852 - protein, 20 aa, Staphylococcus
FTGYEVLNTFTFRITRNADL

SEQ ID NO: 2050853 - protein, 19 aa, Staphylococcus
FTIDLEVYKEFIAGGILRI

SEQ ID NO: 2050854 - protein, 18 aa, Staphylococcus
FTLMAYSGCRAGEILALK

SEQ ID NO: 2050855 - protein, 21 aa, Staphylococcus
FTLRNAMPFTTFVAFLISQQR

SEQ ID NO: 2050856 - protein, 17 aa, Staphylococcus
FTNKLSFSDEVIEKIAG

SEQ ID NO: 2050857 - protein, 17 aa, Staphylococcus
FTPIGGWWNQVMLSQKV

SEQ ID NO: 2050858 - protein, 22 aa, Staphylococcus
FVGPHECARIWKEWGVSEDRII

SEQ ID NO: 2050859 - protein, 18 aa, Staphylococcus
FVIISFKHKVILIGGTEY

SEQ ID NO: 2050860 - protein, 17 aa, Staphylococcus
FVKAGRMKWVFKFEITS

SEQ ID NO: 2050861 - protein, 21 aa, Staphylococcus
FVLEPSYSFSIITSATQQPDE

SEQ ID NO: 2050862 - protein, 19 aa, Staphylococcus
FVLEPSYSFSVITSATQQP

SEQ ID NO: 2050863 - protein, 21 aa, Staphylococcus
FVLEPTYSFSIITSATHKPDQ

SEQ ID NO: 2050864 - protein, 20 aa, Staphylococcus
FVLEPTYSFSIITSATNHPD

SEQ ID NO: 2050865 - protein, 19 aa, Staphylococcus
FVLLCIANSLGIDMTESFN

SEQ ID NO: 2050866 - protein, 19 aa, Staphylococcus
FVVEMKLTYVWINADKPEE

SEQ ID NO: 2050867 - protein, 18 aa, Staphylococcus
FWIIKLLELHTLKKAYKT

SEQ ID NO: 2050868 - protein, 17 aa, Staphylococcus
FWPFNEFKSNFNPENTK

SEQ ID NO: 2050869 - protein, 24 aa, Staphylococcus
FYDRKEIKDLLSYLRIIANSNDDI

SEQ ID NO: 2050870 - protein, 24 aa, Staphylococcus
FYDRKEIKDLLSYLRLVANSNDDI

SEQ ID NO: 2050871 - protein, 24 aa, Staphylococcus
FYDRKEIKDLLSYLRVVANSNDEI

SEQ ID NO: 2050872 - protein, 17 aa, Staphylococcus
FYERASFAPKGQDPSMI

SEQ ID NO: 2050873 - protein, 17 aa, Staphylococcus
FYFKAWKGFYHEIHNEP

SEQ ID NO: 2050874 - protein, 17 aa, Staphylococcus
FYGVSGFDKTYYPKNKV

SEQ ID NO: 2050875 - protein, 19 aa, Staphylococcus
FYHPEFKKEYVILSEEGAQ

SEQ ID NO: 2050876 - protein, 18 aa, Staphylococcus
FYHPEFKKEYVVLAEEGA

SEQ ID NO: 2050877 - protein, 17 aa, Staphylococcus
FYIKNGFKAYSESQKDN

SEQ ID NO: 2050878 - protein, 17 aa, Staphylococcus
FYIRLLKQTGFNRIETF

SEQ ID NO: 2050879 - protein, 19 aa, Staphylococcus
FYKEMPALEQWFKDMTSQY

SEQ ID NO: 2050880 - protein, 24 aa, Staphylococcus
FYKGEFKTATAFPLPNTNYTPLYL

SEQ ID NO: 2050881 - protein, 18 aa, Staphylococcus
FYKKCKEILTLYNDVPKE

SEQ ID NO: 2050882 - protein, 17 aa, Staphylococcus
FYKKQGFEITGHHDFIN

SEQ ID NO: 2050883 - protein, 19 aa, Staphylococcus
FYKNLFKKISFENTTFDET

SEQ ID NO: 2050884 - protein, 21 aa, Staphylococcus
FYKSDCWYHAKAYKCSSIGKM

SEQ ID NO: 2050885 - protein, 26 aa, Staphylococcus
FYNFSIANPSPFEWLDSLVEIYTDDN

SEQ ID NO: 2050886 - protein, 17 aa, Staphylococcus
FYNRMSFHFGTLGNHEF

SEQ ID NO: 2050887 - protein, 17 aa, Staphylococcus
FYPMPFLSPQTMWYYKS

SEQ ID NO: 2050888 - protein, 22 aa, Staphylococcus
FYQFKGAYALQWDMIQFALDHQ

SEQ ID NO: 2050889 - protein, 23 aa, Staphylococcus
FYRIYEYYKKFGLFSETIDNFKY

SEQ ID NO: 2050890 - protein, 17 aa, Staphylococcus
FYTQRIAHKFKITGTVQ

SEQ ID NO: 2050891 - protein, 28 aa, Staphylococcus
FYYYDINAIPFPAGISFVKVFSTTVSIL

SEQ ID NO: 2050892 - protein, 24 aa, Staphylococcus
GADSFKESLRWGAEIFHNLAKILK

SEQ ID NO: 2050893 - protein, 17 aa, Staphylococcus
GAFGLPITYAIIGGNPR

SEQ ID NO: 2050894 - protein, 17 aa, Staphylococcus
GAFYIFPSIKAFTDDDF

SEQ ID NO: 2050895 - protein, 23 aa, Staphylococcus
GAGRIGIGVAQRLQSFGMKVLAY

SEQ ID NO: 2050896 - protein, 19 aa, Staphylococcus
GAGVRRIEAFTGKSAFLHL

SEQ ID NO: 2050897 - protein, 23 aa, Staphylococcus
GAHGEWTALMIFKAFHQKNGEGH

SEQ ID NO: 2050898 - protein, 23 aa, Staphylococcus
GAHGEWTALMIFKAYHEKNGEGH

SEQ ID NO: 2050899 - protein, 24 aa, Staphylococcus
GAHGEWTALMIFKAYHIKNGEGHR

SEQ ID NO: 2050900 - protein, 24 aa, Staphylococcus
GAHGEWTALMIFKAYHLDNGEGHR

SEQ ID NO: 2050901 - protein, 23 aa, Staphylococcus
GAHGEWTALMIFKAYHQKNGEGH

SEQ ID NO: 2050902 - protein, 18 aa, Staphylococcus
GAHIVPFLSINNIDDLYN

SEQ ID NO: 2050903 - protein, 18 aa, Staphylococcus
GAKMAWRNSNRCVGRLFW

SEQ ID NO: 2050904 - protein, 17 aa, Staphylococcus
GALALAGNHEMRWLNSK

SEQ ID NO: 2050905 - protein, 19 aa, Staphylococcus
GALLIKYLLEYTNVPNHSV

SEQ ID NO: 2050906 - protein, 24 aa, Staphylococcus
GANIKDLWRVTSWNQAKALGIDQT

SEQ ID NO: 2050907 - protein, 20 aa, Staphylococcus
GAREVIRWAYDVYGDSIIYS

SEQ ID NO: 2050908 - protein, 18 aa, Staphylococcus
GASAVLFGSVNAILGLTS

SEQ ID NO: 2050909 - protein, 18 aa, Staphylococcus
GASAVLFGSVNAIMGLTS

SEQ ID NO: 2050910 - protein, 23 aa, Staphylococcus
GASEISIMFGIHVSDADKAVKST

SEQ ID NO: 2050911 - protein, 19 aa, Staphylococcus
GASGIEYFTPILNLGETGI

SEQ ID NO: 2050912 - protein, 20 aa, Staphylococcus
GASLEEVWRTTSLNQAIALD

SEQ ID NO: 2050913 - protein, 17 aa, Staphylococcus
GASWRKLNVPGEDRLIN

SEQ ID NO: 2050914 - protein, 24 aa, Staphylococcus
GAYKRTKGIYAFDQFHLAIDHVQV

SEQ ID NO: 2050915 - protein, 17 aa, Staphylococcus
GCALAIDVLKRLKDEQI

SEQ ID NO: 2050916 - protein, 23 aa, Staphylococcus
GCFWCMVKPFISYPGIKSVVSGY

SEQ ID NO: 2050917 - protein, 19 aa, Staphylococcus
GCFWCMVKPFTSYPGIEEV

SEQ ID NO: 2050918 - protein, 19 aa, Staphylococcus
GCFWCMVKPFTSYPGIESV

SEQ ID NO: 2050919 - protein, 17 aa, Staphylococcus
GCGAPLQSEDKNAPGYV

SEQ ID NO: 2050920 - protein, 17 aa, Staphylococcus
GCGAPLQSEDKSAPGYV

SEQ ID NO: 2050921 - protein, 17 aa, Staphylococcus
GCGAPLQSEDPKKPGYV

SEQ ID NO: 2050922 - protein, 17 aa, Staphylococcus
GCGSSFRTAKVAGHPEN

SEQ ID NO: 2050923 - protein, 18 aa, Staphylococcus
GCLYCKAKGSPSNEYQDE

SEQ ID NO: 2050924 - protein, 17 aa, Staphylococcus
GCNTNLIAPVTVNDHTL

SEQ ID NO: 2050925 - protein, 17 aa, Staphylococcus
GCVMMRVCHKDTCPVGV

SEQ ID NO: 2050926 - protein, 19 aa, Staphylococcus
GDAMMNLPILKRVSEVLNL

SEQ ID NO: 2050927 - protein, 17 aa, Staphylococcus
GDARRGPSLVVWAIKEG

SEQ ID NO: 2050928 - protein, 23 aa, Staphylococcus
GDDAKEYWLCWVTTERSEQGPYY

SEQ ID NO: 2050929 - protein, 22 aa, Staphylococcus
GDEAKEYWLCWVTTERGENGPY

SEQ ID NO: 2050930 - protein, 22 aa, Staphylococcus
GDEAKEYWLCWVTTERSEQGPY

SEQ ID NO: 2050931 - protein, 22 aa, Staphylococcus
GDEVKRRIFLGTFALSSGYYDA

SEQ ID NO: 2050932 - protein, 22 aa, Staphylococcus
GDFKAPMGCRSFLPAWKDKDGH

SEQ ID NO: 2050933 - protein, 23 aa, Staphylococcus
GDFKAPMGCRSFLPAWRNENGEY

SEQ ID NO: 2050934 - protein, 21 aa, Staphylococcus
GDFVIRIDDHFNYDLIADLFH

SEQ ID NO: 2050935 - protein, 19 aa, Staphylococcus
GDGCGKCPACKLRQRGLHQ

SEQ ID NO: 2050936 - protein, 20 aa, Staphylococcus
GDGRIKVYMSYQMDYEEFEK

SEQ ID NO: 2050937 - protein, 22 aa, Staphylococcus
GDGYRFAESMGHTITELFPTEV

SEQ ID NO: 2050938 - protein, 23 aa, Staphylococcus
GDGYRFAQAMGHTITELFPTEVP

SEQ ID NO: 2050939 - protein, 19 aa, Staphylococcus
GDIFGGYILYNCGFIQSEN

SEQ ID NO: 2050940 - protein, 20 aa, Staphylococcus
GDIKTYTGFILKFNVLEKSF

SEQ ID NO: 2050941 - protein, 24 aa, Staphylococcus
GDKIEKGDVIGFIEAMKVMNEVTS

SEQ ID NO: 2050942 - protein, 17 aa, Staphylococcus
GDMRQGYEYSRSANPTR

SEQ ID NO: 2050943 - protein, 17 aa, Staphylococcus
GDMTDFNLNLSFDLITI

SEQ ID NO: 2050944 - protein, 19 aa, Staphylococcus
GDNGFGYDPIFYVPEKNKT

SEQ ID NO: 2050945 - protein, 24 aa, Staphylococcus
GDYFKREAIEFAWEFLTSDRWMGM

SEQ ID NO: 2050946 - protein, 17 aa, Staphylococcus
GDYGFGYDPIFYLPEKN

SEQ ID NO: 2050947 - protein, 18 aa, Staphylococcus
GEAFTLFTPDEEELVGEI

SEQ ID NO: 2050948 - protein, 20 aa, Staphylococcus
GEAKSGPVVAIFGDTKPCPN

SEQ ID NO: 2050949 - protein, 20 aa, Staphylococcus
GEAYAGFVYDVMKDALYHAK

SEQ ID NO: 2050950 - protein, 26 aa, Staphylococcus
GEDCLRTVEIFKLLGVQIEVNEDKIE

SEQ ID NO: 2050951 - protein, 20 aa, Staphylococcus
GEDFYMFAPHTVYNEYGVTL

SEQ ID NO: 2050952 - protein, 22 aa, Staphylococcus
GEEAKEYWLCWVTTERGENGPY

SEQ ID NO: 2050953 - protein, 20 aa, Staphylococcus
GEFRKRYGFIYVNRYDNFEG

SEQ ID NO: 2050954 - protein, 30 aa, Staphylococcus
GEFRRSWWHLDFFWGLNGVEAIKDAGGFEF

SEQ ID NO: 2050955 - protein, 20 aa, Staphylococcus
GEGFPVVLIHTAYDNYSVFN

SEQ ID NO: 2050956 - protein, 17 aa, Staphylococcus
GEGFRWLTLVSPTHQDG

SEQ ID NO: 2050957 - protein, 17 aa, Staphylococcus
GEGQGFVQLVIDEKYKE

SEQ ID NO: 2050958 - protein, 17 aa, Staphylococcus
GEIFPSFTIPTEHPGFK

SEQ ID NO: 2050959 - protein, 17 aa, Staphylococcus
GEIGWKKVISDFYSSFK

SEQ ID NO: 2050960 - protein, 17 aa, Staphylococcus
GEITQELQKGYKLKDRV

SEQ ID NO: 2050961 - protein, 18 aa, Staphylococcus
GEKARLQLALLMLQRDNV

SEQ ID NO: 2050962 - protein, 18 aa, Staphylococcus
GEKLPIWIADYVLSSYGT

SEQ ID NO: 2050963 - protein, 18 aa, Staphylococcus
GEKLPIWIADYVLSTYGT

SEQ ID NO: 2050964 - protein, 20 aa, Staphylococcus
GELKAAVNLPIHLHTHDTSG

SEQ ID NO: 2050965 - protein, 21 aa, Staphylococcus
GELKQRIYFMYGGKWQRVRFE

SEQ ID NO: 2050966 - protein, 19 aa, Staphylococcus
GELPHNVVFIFQPAEETGG

SEQ ID NO: 2050967 - protein, 20 aa, Staphylococcus
GELPHNVVFIFQPAEETGGG

SEQ ID NO: 2050968 - protein, 21 aa, Staphylococcus
GELQAGCPLCAPEGDAATGMV

SEQ ID NO: 2050969 - protein, 21 aa, Staphylococcus
GELRAAVNLPIHLHTHDTSGN

SEQ ID NO: 2050970 - protein, 17 aa, Staphylococcus
GEMAIKLADYLDVNTIS

SEQ ID NO: 2050971 - protein, 22 aa, Staphylococcus
GENDEIFEFYGLKVLVDKYDKP

SEQ ID NO: 2050972 - protein, 17 aa, Staphylococcus
GEPAFLEFVQKLERTTH

SEQ ID NO: 2050973 - protein, 23 aa, Staphylococcus
GEPCNECAICKGITQGTNSDVIE

SEQ ID NO: 2050974 - protein, 21 aa, Staphylococcus
GEPCNECAICKGITRGTNSDV

SEQ ID NO: 2050975 - protein, 20 aa, Staphylococcus
GEPEELGGIVVYLASDASSF

SEQ ID NO: 2050976 - protein, 21 aa, Staphylococcus
GEQRISNFLIWQASYSEFIFN

SEQ ID NO: 2050977 - protein, 21 aa, Staphylococcus
GEQRISNFLIWQISYSEFIFD

SEQ ID NO: 2050978 - protein, 21 aa, Staphylococcus
GEQRISNFLIWQVSYSEFIFN

SEQ ID NO: 2050979 - protein, 21 aa, Staphylococcus
GEQRLSNFLIWQASYSEFIFN

SEQ ID NO: 2050980 - protein, 19 aa, Staphylococcus
GERALRYIIPDTKDFPYTV

SEQ ID NO: 2050981 - protein, 17 aa, Staphylococcus
GESRRFERPKAFAEVEG

SEQ ID NO: 2050982 - protein, 17 aa, Staphylococcus
GEVASQFVVNRIQEIFE

SEQ ID NO: 2050983 - protein, 24 aa, Staphylococcus
GEVIGVKGLVTWFRPESYYTDKPW

SEQ ID NO: 2050984 - protein, 20 aa, Staphylococcus
GEYFRAGIIFEQLIEMNDRI

SEQ ID NO: 2050985 - protein, 23 aa, Staphylococcus
GFELRTGAFYNFCKQAEEDNEKD

SEQ ID NO: 2050986 - protein, 18 aa, Staphylococcus
GFFRFWYQGIVARWPETE

SEQ ID NO: 2050987 - protein, 19 aa, Staphylococcus
GFGRIGRLAFRRIQDVEGL

SEQ ID NO: 2050988 - protein, 19 aa, Staphylococcus
GFGRIGRLAFRRIQNVDGI

SEQ ID NO: 2050989 - protein, 18 aa, Staphylococcus
GFGRPYPYMIFKNMEDLE

SEQ ID NO: 2050990 - protein, 19 aa, Staphylococcus
GFKHLGFDASFAIPRSKEE

SEQ ID NO: 2050991 - protein, 20 aa, Staphylococcus
GFLALHGFLHLLGYDHMNEQ

SEQ ID NO: 2050992 - protein, 17 aa, Staphylococcus
GFLKFTPIGGWWNQVML

SEQ ID NO: 2050993 - protein, 17 aa, Staphylococcus
GFLLDGFPRTIDQAEAL

SEQ ID NO: 2050994 - protein, 22 aa, Staphylococcus
GFMWECPDYFNLNGYDMLLFCP

SEQ ID NO: 2050995 - protein, 18 aa, Staphylococcus
GFNNCIFESVHFYKNQYK

SEQ ID NO: 2050996 - protein, 22 aa, Staphylococcus
GFRGDIFGGYILYKCGFIQSEH

SEQ ID NO: 2050997 - protein, 19 aa, Staphylococcus
GFRGEALASISSVAKVTLR

SEQ ID NO: 2050998 - protein, 19 aa, Staphylococcus
GFRGEALASISSVAKVTLS

SEQ ID NO: 2050999 - protein, 20 aa, Staphylococcus
GFRGEALASISSVAKVTLTT

SEQ ID NO: 2051000 - protein, 20 aa, Staphylococcus
GFRGEALASISSVSKVTLKT

SEQ ID NO: 2051001 - protein, 19 aa, Staphylococcus
GFRGEALASISSVSKVTLR

SEQ ID NO: 2051002 - protein, 19 aa, Staphylococcus
GFSPKQFRSMISKISLNPV

SEQ ID NO: 2051003 - protein, 19 aa, Staphylococcus
GFYIREMRRPKRLQYEFRD

SEQ ID NO: 2051004 - protein, 18 aa, Staphylococcus
GGDRLTLPLKEKFMKLGY

SEQ ID NO: 2051005 - protein, 22 aa, Staphylococcus
GGEKARLQLALLMLQKDNVLIL

SEQ ID NO: 2051006 - protein, 22 aa, Staphylococcus
GGEKARLQLALLMLQRDNVLIL

SEQ ID NO: 2051007 - protein, 23 aa, Staphylococcus
GGEQSVCMSLFFEDPEGNAYKFY

SEQ ID NO: 2051008 - protein, 17 aa, Staphylococcus
GGFLRQLYQTHEFEKGV

SEQ ID NO: 2051009 - protein, 20 aa, Staphylococcus
GGGYNIWRVVPRAWSHVFLS

SEQ ID NO: 2051010 - protein, 19 aa, Staphylococcus
GGGYNLWRVVPRAWSHLYL

SEQ ID NO: 2051011 - protein, 18 aa, Staphylococcus
GGIARPAATHALHYDKLP

SEQ ID NO: 2051012 - protein, 21 aa, Staphylococcus
GGKGCNVCKQTGWIEILGAGM

SEQ ID NO: 2051013 - protein, 21 aa, Staphylococcus
GGKRVRPAFVILSSQFGKEEG

SEQ ID NO: 2051014 - protein, 17 aa, Staphylococcus
GGLDCFDGGIGMLQALG

SEQ ID NO: 2051015 - protein, 22 aa, Staphylococcus
GGLLYHFKNKFALIQGLVDHAD

SEQ ID NO: 2051016 - protein, 20 aa, Staphylococcus
GGLQERVWNALQFMNEFGTD

SEQ ID NO: 2051017 - protein, 20 aa, Staphylococcus
GGLYLEKFIENFRHIEFQIM

SEQ ID NO: 2051018 - protein, 20 aa, Staphylococcus
GGLYLEKFIENFRHIEIQVI

SEQ ID NO: 2051019 - protein, 17 aa, Staphylococcus
GGMAALFYVLERLHQEG

SEQ ID NO: 2051020 - protein, 17 aa, Staphylococcus
GGMKRRLSLAITLLSDP

SEQ ID NO: 2051021 - protein, 17 aa, Staphylococcus
GGMKRRLSLAITLLSKP

SEQ ID NO: 2051022 - protein, 17 aa, Staphylococcus
GGMKRRLSLAITLLSNP

SEQ ID NO: 2051023 - protein, 19 aa, Staphylococcus
GGNTFRWLLDNNVKENPYE

SEQ ID NO: 2051024 - protein, 20 aa, Staphylococcus
GGQFQRLWIAKALIMEPQIL

SEQ ID NO: 2051025 - protein, 20 aa, Staphylococcus
GGQFQRLWIAKALLVEPDVL

SEQ ID NO: 2051026 - protein, 21 aa, Staphylococcus
GGQFQRLWIAKALLVEPEVLI

SEQ ID NO: 2051027 - protein, 19 aa, Staphylococcus
GGQFQRLWIAKALLVNPDI

SEQ ID NO: 2051028 - protein, 17 aa, Staphylococcus
GGVASLFYVLERLNLEG

SEQ ID NO: 2051029 - protein, 18 aa, Staphylococcus
GGVAYIFPDDVEQFKAYH

SEQ ID NO: 2051030 - protein, 17 aa, Staphylococcus
GGYNIWKVVPRAWSHVF

SEQ ID NO: 2051031 - protein, 18 aa, Staphylococcus
GGYNIWRVVPRAWSHVFL

SEQ ID NO: 2051032 - protein, 17 aa, Staphylococcus
GGYNIWTVVPRAWSHVY

SEQ ID NO: 2051033 - protein, 20 aa, Staphylococcus
GHAYKDCPNFVKGHIPELYI

SEQ ID NO: 2051034 - protein, 18 aa, Staphylococcus
GHIIVWFGLTWSLELYQQ

SEQ ID NO: 2051035 - protein, 17 aa, Staphylococcus
GHLFPLIAKDNGVLERN

SEQ ID NO: 2051036 - protein, 17 aa, Staphylococcus
GHLTLPVLFEMRKNETF

SEQ ID NO: 2051037 - protein, 18 aa, Staphylococcus
GHSLRATLVVNRIEEQLQ

SEQ ID NO: 2051038 - protein, 18 aa, Staphylococcus
GHSLRATLVVNRIESQLK

SEQ ID NO: 2051039 - protein, 19 aa, Staphylococcus
GHSWKSWKPLLGDILEYFL

SEQ ID NO: 2051040 - protein, 17 aa, Staphylococcus
GHVKGYFIYPYKEEMKN

SEQ ID NO: 2051041 - protein, 24 aa, Staphylococcus
GHYEFKETIAFLLSNEVEADNLKS

SEQ ID NO: 2051042 - protein, 17 aa, Staphylococcus
GHYEFRKTVAFLLSNQV

SEQ ID NO: 2051043 - protein, 24 aa, Staphylococcus
GIAAREVQGILSLKGNLVDSLSNQ

SEQ ID NO: 2051044 - protein, 19 aa, Staphylococcus
GIAGLRLGVLIGTPETIQL

SEQ ID NO: 2051045 - protein, 17 aa, Staphylococcus
GIARPAAAHALHYDKLP

SEQ ID NO: 2051046 - protein, 19 aa, Staphylococcus
GIASLCIGGGQGIATVVSH

SEQ ID NO: 2051047 - protein, 18 aa, Staphylococcus
GICQLEIKLDTGRTHQIR

SEQ ID NO: 2051048 - protein, 21 aa, Staphylococcus
GIDKFHVAGSFRRVKEMSKDL

SEQ ID NO: 2051049 - protein, 17 aa, Staphylococcus
GIDTYWILMGMVQDEKC

SEQ ID NO: 2051050 - protein, 19 aa, Staphylococcus
GIDVFRIFDSLNWLDQMKV

SEQ ID NO: 2051051 - protein, 18 aa, Staphylococcus
GIELGIPEHLVWRQPFPG

SEQ ID NO: 2051052 - protein, 18 aa, Staphylococcus
GIEMPRVLGDIIICTDVA

SEQ ID NO: 2051053 - protein, 21 aa, Staphylococcus
GIESCVIRLSPQYFYQDTDRD

SEQ ID NO: 2051054 - protein, 17 aa, Staphylococcus
GIFPYNIPTTFTKSLRE

SEQ ID NO: 2051055 - protein, 19 aa, Staphylococcus
GIGAYDWNPNYAITYARNR

SEQ ID NO: 2051056 - protein, 19 aa, Staphylococcus
GIKVAKDLVHISGDTSDYH

SEQ ID NO: 2051057 - protein, 18 aa, Staphylococcus
GILRTLFNSIRFEEIQKL

SEQ ID NO: 2051058 - protein, 21 aa, Staphylococcus
GIPIYLGMPMGVIIETEGKTI

SEQ ID NO: 2051059 - protein, 23 aa, Staphylococcus
GIVSRGGSIMAQWCLAHHEESFL

SEQ ID NO: 2051060 - protein, 18 aa, Staphylococcus
GIVYKLGFDNALVPNVYK

SEQ ID NO: 2051061 - protein, 17 aa, Staphylococcus
GIWKLIKQYGVKANIKK

SEQ ID NO: 2051062 - protein, 23 aa, Staphylococcus
GIYIDVYCSLAYGINISETAKKI

SEQ ID NO: 2051063 - protein, 24 aa, Staphylococcus
GIYKFKFEILQAIETVIPYKSIYE

SEQ ID NO: 2051064 - protein, 24 aa, Staphylococcus
GIYKFRYIIIEAIKKVFKFESVFE

SEQ ID NO: 2051065 - protein, 18 aa, Staphylococcus
GKAEDVIMDWQREGIQPD

SEQ ID NO: 2051066 - protein, 17 aa, Staphylococcus
GKARLNYGASWFEHSKL

SEQ ID NO: 2051067 - protein, 20 aa, Staphylococcus
GKDALLKNGHRFGFYKGYQG

SEQ ID NO: 2051068 - protein, 20 aa, Staphylococcus
GKDHFLRISIDKEGGVDLND

SEQ ID NO: 2051069 - protein, 22 aa, Staphylococcus
GKDISCNVVRTWIHQHTVILGI

SEQ ID NO: 2051070 - protein, 22 aa, Staphylococcus
GKDLKVAIVVSRFNDFITGRLL

SEQ ID NO: 2051071 - protein, 22 aa, Staphylococcus
GKEPTKFLGIINHKVMRKQALE

SEQ ID NO: 2051072 - protein, 23 aa, Staphylococcus
GKGRSGFMANSFAMRLNQLGKEA

SEQ ID NO: 2051073 - protein, 25 aa, Staphylococcus
GKGWDFDGVYGWQCVDLANMYWYKL

SEQ ID NO: 2051074 - protein, 17 aa, Staphylococcus
GKGWLVFYSHTNIFKQN

SEQ ID NO: 2051075 - protein, 19 aa, Staphylococcus
GKGYAKFAFEKAISYAFDI

SEQ ID NO: 2051076 - protein, 18 aa, Staphylococcus
GKHGFAFGSGMAAISAVI

SEQ ID NO: 2051077 - protein, 19 aa, Staphylococcus
GKIDPRWVKDKNVVALVSG

SEQ ID NO: 2051078 - protein, 17 aa, Staphylococcus
GKIKFFHIIATGNLAVK

SEQ ID NO: 2051079 - protein, 18 aa, Staphylococcus
GKIPRVKFEKVFADHFMT

SEQ ID NO: 2051080 - protein, 20 aa, Staphylococcus
GKIRISHKMDMIFTHFGISG

SEQ ID NO: 2051081 - protein, 17 aa, Staphylococcus
GKKLPIWIADYVLSSYG

SEQ ID NO: 2051082 - protein, 23 aa, Staphylococcus
GKKLREARKGFQMVFQDPYASLN

SEQ ID NO: 2051083 - protein, 21 aa, Staphylococcus
GKKRISHKMDMIFTHFGISGP

SEQ ID NO: 2051084 - protein, 18 aa, Staphylococcus
GKKSVAIRLYYLDTENTL

SEQ ID NO: 2051085 - protein, 24 aa, Staphylococcus
GKKYLPRKFKIGIALPPSNDIDVY

SEQ ID NO: 2051086 - protein, 19 aa, Staphylococcus
GKLADLVLWNPAFFGVKPE

SEQ ID NO: 2051087 - protein, 23 aa, Staphylococcus
GKLGSGFQWYSWIHIDDLTRAIL

SEQ ID NO: 2051088 - protein, 23 aa, Staphylococcus
GKLGSGFQWYSWIHIDDLVRAIL

SEQ ID NO: 2051089 - protein, 23 aa, Staphylococcus
GKLGSGFQWYSWIHINDLVRAIL

SEQ ID NO: 2051090 - protein, 21 aa, Staphylococcus
GKLGVKVWIYRGEVLPTKNTS

SEQ ID NO: 2051091 - protein, 21 aa, Staphylococcus
GKLGVKVWIYRGEVLPTTKNT

SEQ ID NO: 2051092 - protein, 22 aa, Staphylococcus
GKMAFRVYPDWETDLNVTALKT

SEQ ID NO: 2051093 - protein, 17 aa, Staphylococcus
GKMAFRVYPSWVTHLNS

SEQ ID NO: 2051094 - protein, 17 aa, Staphylococcus
GKMAIRVYPSWEKNLNK

SEQ ID NO: 2051095 - protein, 19 aa, Staphylococcus
GKMAMRVYPPWEVNLNPSA

SEQ ID NO: 2051096 - protein, 19 aa, Staphylococcus
GKNYPCFWTEKSLAEEFFK

SEQ ID NO: 2051097 - protein, 20 aa, Staphylococcus
GKPRITHRMDMLFTHFGVSG

SEQ ID NO: 2051098 - protein, 19 aa, Staphylococcus
GKPYAGFVYDVMKDVLYHA

SEQ ID NO: 2051099 - protein, 20 aa, Staphylococcus
GKPYAGLVYDVMKDVLYHAK

SEQ ID NO: 2051100 - protein, 22 aa, Staphylococcus
GKQTEMFARFSTVSGERGAADA

SEQ ID NO: 2051101 - protein, 17 aa, Staphylococcus
GKRPLVCYFSNDLNIHR

SEQ ID NO: 2051102 - protein, 17 aa, Staphylococcus
GKRPLVCYFSNNLNIHR

SEQ ID NO: 2051103 - protein, 20 aa, Staphylococcus
GKRSRLEWVNQFVYKSFNKK

SEQ ID NO: 2051104 - protein, 19 aa, Staphylococcus
GKRVRPSFVVLSSEYGVNP

SEQ ID NO: 2051105 - protein, 17 aa, Staphylococcus
GKSIAQVVLRWLVERDI

SEQ ID NO: 2051106 - protein, 18 aa, Staphylococcus
GKSLLAIYRIYWLSKVYP

SEQ ID NO: 2051107 - protein, 17 aa, Staphylococcus
GKSNVTDAIKWVLGEQS

SEQ ID NO: 2051108 - protein, 17 aa, Staphylococcus
GKTECWYILDAEPGSEI

SEQ ID NO: 2051109 - protein, 23 aa, Staphylococcus
GKTYLPRKFKIGIALPPSNDIDV

SEQ ID NO: 2051110 - protein, 25 aa, Staphylococcus
GKTYLPRKFKIGIAVPPSNDIDVYS

SEQ ID NO: 2051111 - protein, 23 aa, Staphylococcus
GKVARLTNFGAFIDIGGVDGLVH

SEQ ID NO: 2051112 - protein, 24 aa, Staphylococcus
GKVARLTNFGAFIDIGGVDGLVHV

SEQ ID NO: 2051113 - protein, 24 aa, Staphylococcus
GKVARLTNFGAFVDIGGVDGLVHV

SEQ ID NO: 2051114 - protein, 23 aa, Staphylococcus
GKVIRLANFGAFVEIAPGVQGLV

SEQ ID NO: 2051115 - protein, 19 aa, Staphylococcus
GKWSYKLDYTFSWELYISK

SEQ ID NO: 2051116 - protein, 19 aa, Staphylococcus
GKYRPCVVLSRTSFNDKTS

SEQ ID NO: 2051117 - protein, 19 aa, Staphylococcus
GLAKPGPIIAIFGDTKPCA

SEQ ID NO: 2051118 - protein, 18 aa, Staphylococcus
GLARCVKKDIDAVYESTK

SEQ ID NO: 2051119 - protein, 19 aa, Staphylococcus
GLDLPFVMKIAQQLEVSNR

SEQ ID NO: 2051120 - protein, 17 aa, Staphylococcus
GLDWRISIIQAQSMGIS

SEQ ID NO: 2051121 - protein, 19 aa, Staphylococcus
GLECARGLLDQGMDVTVLH

SEQ ID NO: 2051122 - protein, 19 aa, Staphylococcus
GLECARGLLDQGMEVTVIH

SEQ ID NO: 2051123 - protein, 19 aa, Staphylococcus
GLECARGLLDQGMEVTVLH

SEQ ID NO: 2051124 - protein, 19 aa, Staphylococcus
GLECARGLLDQGMNVTVVH

SEQ ID NO: 2051125 - protein, 23 aa, Staphylococcus
GLEIPRVLGDIIICTDVAQEQAT

SEQ ID NO: 2051126 - protein, 21 aa, Staphylococcus
GLFKTEMGLLMLGKADIAFSL

SEQ ID NO: 2051127 - protein, 19 aa, Staphylococcus
GLFTLKLAELFDVSKIAVM

SEQ ID NO: 2051128 - protein, 19 aa, Staphylococcus
GLFTLRLAEQFDLERIAVM

SEQ ID NO: 2051129 - protein, 20 aa, Staphylococcus
GLGPARLNAFTVRKVALGLA

SEQ ID NO: 2051130 - protein, 18 aa, Staphylococcus
GLIHRFRRSFLLNDNFEK

SEQ ID NO: 2051131 - protein, 17 aa, Staphylococcus
GLKAMYFYKDGVSPSEL

SEQ ID NO: 2051132 - protein, 19 aa, Staphylococcus
GLKKWLTPVDMWKSHQLTL

SEQ ID NO: 2051133 - protein, 19 aa, Staphylococcus
GLKKWLTPVEMWRNHQMTL

SEQ ID NO: 2051134 - protein, 17 aa, Staphylococcus
GLKLREGGWVYVQGLTH

SEQ ID NO: 2051135 - protein, 20 aa, Staphylococcus
GLLFRSGDDYIWKTHSFARK

SEQ ID NO: 2051136 - protein, 20 aa, Staphylococcus
GLLHIGYRLIWIIPNPYYDK

SEQ ID NO: 2051137 - protein, 20 aa, Staphylococcus
GLLQEVFKDYGVLFIDAQYE

SEQ ID NO: 2051138 - protein, 23 aa, Staphylococcus
GLMSCLNKGIPVILVSRSFNGIV

SEQ ID NO: 2051139 - protein, 17 aa, Staphylococcus
GLNSNWDMLFVVFSIHF

SEQ ID NO: 2051140 - protein, 18 aa, Staphylococcus
GLPTEYLMPEFLRDIFKE

SEQ ID NO: 2051141 - protein, 19 aa, Staphylococcus
GLQEGLLFKGIKKSFDGLD

SEQ ID NO: 2051142 - protein, 21 aa, Staphylococcus
GLRCSACFEMRLDLVADAAQR

SEQ ID NO: 2051143 - protein, 21 aa, Staphylococcus
GLRCSACFEMRLEIVAQAAVE

SEQ ID NO: 2051144 - protein, 21 aa, Staphylococcus
GLRCTACFEMRLELVAEAAVK

SEQ ID NO: 2051145 - protein, 23 aa, Staphylococcus
GLRIGEAMALVWTDYNKYKKEIS

SEQ ID NO: 2051146 - protein, 18 aa, Staphylococcus
GLTFNSAVETLKCILPDV

SEQ ID NO: 2051147 - protein, 20 aa, Staphylococcus
GLTLDFDKFPGFKCYRFLKP

SEQ ID NO: 2051148 - protein, 17 aa, Staphylococcus
GLTRAKQSLVFLGDPQA

SEQ ID NO: 2051149 - protein, 18 aa, Staphylococcus
GLVEGWKRDGLTDEQIAK

SEQ ID NO: 2051150 - protein, 20 aa, Staphylococcus
GLYRKRMLSYGGLLKQKHKI

SEQ ID NO: 2051151 - protein, 19 aa, Staphylococcus
GMCETCSGLGYVEDIDLNE

SEQ ID NO: 2051152 - protein, 22 aa, Staphylococcus
GMGAKPLIFLKWALPDKAFDAL

SEQ ID NO: 2051153 - protein, 21 aa, Staphylococcus
GMGRIGRMVLRIALKNENLNV

SEQ ID NO: 2051154 - protein, 21 aa, Staphylococcus
GMGRIGRMVLRIALKNENLSV

SEQ ID NO: 2051155 - protein, 21 aa, Staphylococcus
GMGRIGRMVLRIALKNKDLNV

SEQ ID NO: 2051156 - protein, 19 aa, Staphylococcus
GMGRIGRMVLRIASKNDDL

SEQ ID NO: 2051157 - protein, 19 aa, Staphylococcus
GMKKRLGIAQAIIHNPQVL

SEQ ID NO: 2051158 - protein, 20 aa, Staphylococcus
GMKKRYATLMGIDENTPIIV

SEQ ID NO: 2051159 - protein, 18 aa, Staphylococcus
GMKKRYATLMGIDENTPV

SEQ ID NO: 2051160 - protein, 18 aa, Staphylococcus
GMKQRLGIAMALIKKPKL

SEQ ID NO: 2051161 - protein, 17 aa, Staphylococcus
GMKRRYAALMGIDENTP

SEQ ID NO: 2051162 - protein, 17 aa, Staphylococcus
GMLLPTFIEDYPGLPNG

SEQ ID NO: 2051163 - protein, 18 aa, Staphylococcus
GMLPWKRINTVNEEKISK

SEQ ID NO: 2051164 - protein, 23 aa, Staphylococcus
GMPGLTICGGYQFLGSKYITPDG

SEQ ID NO: 2051165 - protein, 18 aa, Staphylococcus
GMQEMKFDMCGSANVLGM

SEQ ID NO: 2051166 - protein, 19 aa, Staphylococcus
GMQTMKFDMCGAANVVGML

SEQ ID NO: 2051167 - protein, 18 aa, Staphylococcus
GMVKREVVRIVTPGTVME

SEQ ID NO: 2051168 - protein, 17 aa, Staphylococcus
GMVLPSWAYNMIAPVSI

SEQ ID NO: 2051169 - protein, 24 aa, Staphylococcus
GNAIKGARGYITFGQPLDIPIIAD

SEQ ID NO: 2051170 - protein, 23 aa, Staphylococcus
GNAKNHWYEWLKHNLTLEGYYVQ

SEQ ID NO: 2051171 - protein, 20 aa, Staphylococcus
GNELPISAGFFFINPFEVVY

SEQ ID NO: 2051172 - protein, 20 aa, Staphylococcus
GNELPISAGFFIINPFEVVY

SEQ ID NO: 2051173 - protein, 17 aa, Staphylococcus
GNFVMRGEPALFNKFIR

SEQ ID NO: 2051174 - protein, 23 aa, Staphylococcus
GNGRIKVYVAFRMPSEKLDDYKV

SEQ ID NO: 2051175 - protein, 17 aa, Staphylococcus
GNHMVVFTTTILERGFT

SEQ ID NO: 2051176 - protein, 17 aa, Staphylococcus
GNIGRGFIGYILADNDV

SEQ ID NO: 2051177 - protein, 17 aa, Staphylococcus
GNIGRGFIGYILSDNNI

SEQ ID NO: 2051178 - protein, 18 aa, Staphylococcus
GNITAYWQGFKEYHDKHG

SEQ ID NO: 2051179 - protein, 18 aa, Staphylococcus
GNMLKPWFVNKVDNPISK

SEQ ID NO: 2051180 - protein, 17 aa, Staphylococcus
GNRAVLLLHGFTGNSSD

SEQ ID NO: 2051181 - protein, 18 aa, Staphylococcus
GNSKYLFNHFIKRNPMVD

SEQ ID NO: 2051182 - protein, 17 aa, Staphylococcus
GNSKYLFNYFVKRNPTT

SEQ ID NO: 2051183 - protein, 19 aa, Staphylococcus
GNSKYLFSYFVKRNPTIET

SEQ ID NO: 2051184 - protein, 21 aa, Staphylococcus
GNSVPRFHITWGTGPGLVEPF

SEQ ID NO: 2051185 - protein, 19 aa, Staphylococcus
GNTKSLWVWTGFLFEYLER

SEQ ID NO: 2051186 - protein, 18 aa, Staphylococcus
GNVLRFQPPLVISYDQLD

SEQ ID NO: 2051187 - protein, 17 aa, Staphylococcus
GNVLRFQPPLVITDEEL

SEQ ID NO: 2051188 - protein, 18 aa, Staphylococcus
GNVQRFIKRTELSDVMEI

SEQ ID NO: 2051189 - protein, 19 aa, Staphylococcus
GNVRRFIKRAEIENVMEIT

SEQ ID NO: 2051190 - protein, 17 aa, Staphylococcus
GNWRELRLPGILSSKKQ

SEQ ID NO: 2051191 - protein, 23 aa, Staphylococcus
GNYELRLPLIPLDDAERNVLEQA

SEQ ID NO: 2051192 - protein, 24 aa, Staphylococcus
GNYELRLPLLPLEAAETKVLINAY

SEQ ID NO: 2051193 - protein, 19 aa, Staphylococcus
GNYTLGIKEQLIFPEIDYD

SEQ ID NO: 2051194 - protein, 18 aa, Staphylococcus
GPAALRCSQFIYKEQKQQ

SEQ ID NO: 2051195 - protein, 19 aa, Staphylococcus
GPAALRCSQFVYKEQKNQK

SEQ ID NO: 2051196 - protein, 20 aa, Staphylococcus
GPDAIRYAGLLSRLKKMGLD

SEQ ID NO: 2051197 - protein, 22 aa, Staphylococcus
GPEAKEYWLCWVTTERGENGPY

SEQ ID NO: 2051198 - protein, 22 aa, Staphylococcus
GPEAKEYWLCWVTTERGEQGAY

SEQ ID NO: 2051199 - protein, 18 aa, Staphylococcus
GPGPRKALDYMYEIAQRD

SEQ ID NO: 2051200 - protein, 17 aa, Staphylococcus
GPISFILPLKTGYLCEK

SEQ ID NO: 2051201 - protein, 17 aa, Staphylococcus
GPMLGKMLTNFFVEVRW

SEQ ID NO: 2051202 - protein, 24 aa, Staphylococcus
GPNIKLPSIELLEAPKQHEIDNAW

SEQ ID NO: 2051203 - protein, 18 aa, Staphylococcus
GPNIKLPSLELLEDPEIH

SEQ ID NO: 2051204 - protein, 18 aa, Staphylococcus
GPPFPFPECGAMSQAYIG

SEQ ID NO: 2051205 - protein, 17 aa, Staphylococcus
GPPRLQNGTSWFYFATD

SEQ ID NO: 2051206 - protein, 19 aa, Staphylococcus
GPRAVLLLHGFTGNSSDVR

SEQ ID NO: 2051207 - protein, 23 aa, Staphylococcus
GPYTKAAVMSIAFNHPLPTVDGN

SEQ ID NO: 2051208 - protein, 24 aa, Staphylococcus
GQALRRLLTEWGMSSTELMAFGDA

SEQ ID NO: 2051209 - protein, 23 aa, Staphylococcus
GQDLKIGIVVSRFNDFITGRLLD

SEQ ID NO: 2051210 - protein, 18 aa, Staphylococcus
GQDVLLFIDNIFRFTQAG

SEQ ID NO: 2051211 - protein, 19 aa, Staphylococcus
GQFGSGWAWLVVDKDGKLE

SEQ ID NO: 2051212 - protein, 18 aa, Staphylococcus
GQFQRVWIAKALILEPEI

SEQ ID NO: 2051213 - protein, 18 aa, Staphylococcus
GQGFPVILIHGLDGNMAS

SEQ ID NO: 2051214 - protein, 21 aa, Staphylococcus
GQHAIPVWSKVHIHGMELSEF

SEQ ID NO: 2051215 - protein, 23 aa, Staphylococcus
GQIAKIKGCRVVGIAGGDKKVNY

SEQ ID NO: 2051216 - protein, 23 aa, Staphylococcus
GQIAKIKGCRVVGIAGGPDKVNY

SEQ ID NO: 2051217 - protein, 18 aa, Staphylococcus
GQKCSACSRVIAVDDVYD

SEQ ID NO: 2051218 - protein, 19 aa, Staphylococcus
GQNVLPGFIDIHIHGGYGE

SEQ ID NO: 2051219 - protein, 18 aa, Staphylococcus
GQPKGYRVVKFNQKNDIQ

SEQ ID NO: 2051220 - protein, 21 aa, Staphylococcus
GQRRLFEWLRQNGFLIKRKGV

SEQ ID NO: 2051221 - protein, 20 aa, Staphylococcus
GRAYFKLTIHGEGGHGSSPH

SEQ ID NO: 2051222 - protein, 17 aa, Staphylococcus
GRDCPKCEHYLVEKKKG

SEQ ID NO: 2051223 - protein, 17 aa, Staphylococcus
GRDCPKCEHYLVEKKQG

SEQ ID NO: 2051224 - protein, 17 aa, Staphylococcus
GRDCPKCNHYLVDKKKG

SEQ ID NO: 2051225 - protein, 23 aa, Staphylococcus
GRDRSGVCSVQFAERIQPGDTVP

SEQ ID NO: 2051226 - protein, 23 aa, Staphylococcus
GRDRSGVCSVQFAERLQPGDTVP

SEQ ID NO: 2051227 - protein, 23 aa, Staphylococcus
GRDRTGVCSVQFAERIQEGDTVP

SEQ ID NO: 2051228 - protein, 23 aa, Staphylococcus
GRDRTGVCSVQFAERVQPGDTVP

SEQ ID NO: 2051229 - protein, 21 aa, Staphylococcus
GREVSRIGSTFGKTNRVIIDT

SEQ ID NO: 2051230 - protein, 20 aa, Staphylococcus
GRFIADEVVCRFRGNNTVMA

SEQ ID NO: 2051231 - protein, 26 aa, Staphylococcus
GRFLNVGENIWGLRDWYSVADIEEKI

SEQ ID NO: 2051232 - protein, 17 aa, Staphylococcus
GRGLICTPISSSISEQL

SEQ ID NO: 2051233 - protein, 20 aa, Staphylococcus
GRGNIKWRAFATLPEQFEIL

SEQ ID NO: 2051234 - protein, 20 aa, Staphylococcus
GRGNIKWRAFATLPEQYEIL

SEQ ID NO: 2051235 - protein, 17 aa, Staphylococcus
GRHELMDSVFLWQSGNK

SEQ ID NO: 2051236 - protein, 17 aa, Staphylococcus
GRHELMDSVFLWQSGTK

SEQ ID NO: 2051237 - protein, 19 aa, Staphylococcus
GRIGLPFVIAQMGQEPQQL

SEQ ID NO: 2051238 - protein, 19 aa, Staphylococcus
GRIGRMVLRIALHKEDLNV

SEQ ID NO: 2051239 - protein, 28 aa, Staphylococcus
GRIINMVATYAWRAGIGVIHSASAKAGV

SEQ ID NO: 2051240 - protein, 18 aa, Staphylococcus
GRIPVIGIGSVFSADDAL

SEQ ID NO: 2051241 - protein, 18 aa, Staphylococcus
GRIPVIGVGSVFTADDAL

SEQ ID NO: 2051242 - protein, 20 aa, Staphylococcus
GRKAFKESWSVRYLEKYVNN

SEQ ID NO: 2051243 - protein, 20 aa, Staphylococcus
GRKDIFGKLSYVGSTVKTLM

SEQ ID NO: 2051244 - protein, 17 aa, Staphylococcus
GRKSASSISEWEKGKYT

SEQ ID NO: 2051245 - protein, 19 aa, Staphylococcus
GRLLCAAAIGISKDTDIRA

SEQ ID NO: 2051246 - protein, 18 aa, Staphylococcus
GRLQRDLTNWFIDDQYKL

SEQ ID NO: 2051247 - protein, 18 aa, Staphylococcus
GRLQRNLTNWFIDDQYKL

SEQ ID NO: 2051248 - protein, 22 aa, Staphylococcus
GRPLFKRNLELVKWAYQQTKGQ

SEQ ID NO: 2051249 - protein, 22 aa, Staphylococcus
GRPLFKRNLELVKWAYQQTNGE

SEQ ID NO: 2051250 - protein, 17 aa, Staphylococcus
GRQAIQFLKQKGLGRAT

SEQ ID NO: 2051251 - protein, 19 aa, Staphylococcus
GRQLLPMYLKYKLKSKSKS

SEQ ID NO: 2051252 - protein, 18 aa, Staphylococcus
GRSDYFWDLFIQMPAALM

SEQ ID NO: 2051253 - protein, 18 aa, Staphylococcus
GRSGFVANSFAMRLNQLG

SEQ ID NO: 2051254 - protein, 22 aa, Staphylococcus
GRSPSELGFRYYVNQLLEQTSH

SEQ ID NO: 2051255 - protein, 18 aa, Staphylococcus
GRSTADIFGRCLHTYLIK

SEQ ID NO: 2051256 - protein, 20 aa, Staphylococcus
GRTDILLPWEKLDKVNVLKD

SEQ ID NO: 2051257 - protein, 18 aa, Staphylococcus
GRTFRWLINNGVEENPYQ

SEQ ID NO: 2051258 - protein, 21 aa, Staphylococcus
GRTGKMFAMEWENTEPDIYLL

SEQ ID NO: 2051259 - protein, 25 aa, Staphylococcus
GRTPSELGFRYYVNRLLEQTSHQNQ

SEQ ID NO: 2051260 - protein, 17 aa, Staphylococcus
GRYKVYIIEDFEKLTVQ

SEQ ID NO: 2051261 - protein, 17 aa, Staphylococcus
GRYRFGDGINECGVAIS

SEQ ID NO: 2051262 - protein, 19 aa, Staphylococcus
GRYTYKFKQIYFLRISTLP

SEQ ID NO: 2051263 - protein, 22 aa, Staphylococcus
GSDLKVAIVVSRFNDFITNRLL

SEQ ID NO: 2051264 - protein, 24 aa, Staphylococcus
GSDVLVCTVIGFPLGASTTETKIF

SEQ ID NO: 2051265 - protein, 23 aa, Staphylococcus
GSELKIAIVVSRFNDFITNRLLE

SEQ ID NO: 2051266 - protein, 19 aa, Staphylococcus
GSFFMPKFQFEIDGRNNYF

SEQ ID NO: 2051267 - protein, 18 aa, Staphylococcus
GSFIESFPLFGYNLKDYE

SEQ ID NO: 2051268 - protein, 17 aa, Staphylococcus
GSFKWGVTTSLSYFPKD

SEQ ID NO: 2051269 - protein, 17 aa, Staphylococcus
GSFLAKFLYDLGAKVVG

SEQ ID NO: 2051270 - protein, 27 aa, Staphylococcus
GSHAVPIWSRVRIAGIELPEFETLTGS

SEQ ID NO: 2051271 - protein, 18 aa, Staphylococcus
GSIIPRPIAFVTSSDIEG

SEQ ID NO: 2051272 - protein, 19 aa, Staphylococcus
GSIYLRPWAGGRVGANEFS

SEQ ID NO: 2051273 - protein, 18 aa, Staphylococcus
GSNAIYEFLALRIPMLLI

SEQ ID NO: 2051274 - protein, 20 aa, Staphylococcus
GSPIKRLFLDSAEPYENSNI

SEQ ID NO: 2051275 - protein, 18 aa, Staphylococcus
GSQLPQLFGFQAAGAAPI

SEQ ID NO: 2051276 - protein, 18 aa, Staphylococcus
GSQLPQLFGFQAEGASPI

SEQ ID NO: 2051277 - protein, 22 aa, Staphylococcus
GSQLPRLFGFQAEGASPIVQNK

SEQ ID NO: 2051278 - protein, 19 aa, Staphylococcus
GSQLVKAVVDYARDNNLKV

SEQ ID NO: 2051279 - protein, 21 aa, Staphylococcus
GSRARPGQGYVHHIAVNTPND

SEQ ID NO: 2051280 - protein, 18 aa, Staphylococcus
GSSLKPFLAYGPAIENMQ

SEQ ID NO: 2051281 - protein, 20 aa, Staphylococcus
GSSLKPFLAYGPAIENMSWA

SEQ ID NO: 2051282 - protein, 17 aa, Staphylococcus
GSSREHAAWALKDYGFS

SEQ ID NO: 2051283 - protein, 18 aa, Staphylococcus
GSVLPRPIAFVTSQDKEG

SEQ ID NO: 2051284 - protein, 19 aa, Staphylococcus
GSYRLKVMLQEEGNFDYLV

SEQ ID NO: 2051285 - protein, 18 aa, Staphylococcus
GTAPKRFIREFKNINVDE

SEQ ID NO: 2051286 - protein, 18 aa, Staphylococcus
GTCTNWGCNAKILLENPF

SEQ ID NO: 2051287 - protein, 18 aa, Staphylococcus
GTDKEYFVFYLLCQGKSL

SEQ ID NO: 2051288 - protein, 18 aa, Staphylococcus
GTDLVWLSAVTKYIIDHH

SEQ ID NO: 2051289 - protein, 22 aa, Staphylococcus
GTDVPFCIYNKTAICEGRGEKI

SEQ ID NO: 2051290 - protein, 20 aa, Staphylococcus
GTEPKLKFYLSLNVDDFEQV

SEQ ID NO: 2051291 - protein, 20 aa, Staphylococcus
GTEPKLKFYLSLNVDNFEQV

SEQ ID NO: 2051292 - protein, 17 aa, Staphylococcus
GTFKWGVTTSLSYFPKD

SEQ ID NO: 2051293 - protein, 18 aa, Staphylococcus
GTFKWGVTTSLSYFPKDN

SEQ ID NO: 2051294 - protein, 23 aa, Staphylococcus
GTIARLTNFGAFVDIGGVDGLVH

SEQ ID NO: 2051295 - protein, 17 aa, Staphylococcus
GTICFNGQYIEDELSNQ

SEQ ID NO: 2051296 - protein, 18 aa, Staphylococcus
GTIKFALTQSHLFSKAAP

SEQ ID NO: 2051297 - protein, 19 aa, Staphylococcus
GTKKRGYAFTKLDSQKQPK

SEQ ID NO: 2051298 - protein, 17 aa, Staphylococcus
GTPWLDQKHTVFGQIIE

SEQ ID NO: 2051299 - protein, 17 aa, Staphylococcus
GTPWLDQKHTVFGQLID

SEQ ID NO: 2051300 - protein, 24 aa, Staphylococcus
GTQMPEFERMILLRSIDTHWTDHI

SEQ ID NO: 2051301 - protein, 19 aa, Staphylococcus
GTTCKRIVKMLKDSGADEV

SEQ ID NO: 2051302 - protein, 23 aa, Staphylococcus
GTVVRLANFGAFVEIAPAVQGLV

SEQ ID NO: 2051303 - protein, 23 aa, Staphylococcus
GTVVRLANFGAFVEIAPGVQGLV

SEQ ID NO: 2051304 - protein, 23 aa, Staphylococcus
GTVVRLANFGAFVEIKPGVQGLV

SEQ ID NO: 2051305 - protein, 20 aa, Staphylococcus
GVACPGFVPLVEQMRYDDPT

SEQ ID NO: 2051306 - protein, 20 aa, Staphylococcus
GVACPGFVPLVEQMRYNDPT

SEQ ID NO: 2051307 - protein, 21 aa, Staphylococcus
GVAFCPHCDGPLFENKNVAVI

SEQ ID NO: 2051308 - protein, 17 aa, Staphylococcus
GVATWQYHRQRQKLIGT

SEQ ID NO: 2051309 - protein, 20 aa, Staphylococcus
GVAYCPHCDGPLFEGKDVAV

SEQ ID NO: 2051310 - protein, 18 aa, Staphylococcus
GVCNIIFNVRMTSAKAET

SEQ ID NO: 2051311 - protein, 25 aa, Staphylococcus
GVDIKEVFLKLPIVATEVYDETNEI

SEQ ID NO: 2051312 - protein, 19 aa, Staphylococcus
GVDRYAKFVKQFGDFSVGI

SEQ ID NO: 2051313 - protein, 18 aa, Staphylococcus
GVGRRISLHYTRQMVNQA

SEQ ID NO: 2051314 - protein, 23 aa, Staphylococcus
GVGRRISLHYTRYMVDQAIKGKL

SEQ ID NO: 2051315 - protein, 20 aa, Staphylococcus
GVGRRISLHYTRYMVDQAIS

SEQ ID NO: 2051316 - protein, 24 aa, Staphylococcus
GVIMLTKSLAMEWSKYNIKVNTIA

SEQ ID NO: 2051317 - protein, 17 aa, Staphylococcus
GVKSIFYVMDFISVDKE

SEQ ID NO: 2051318 - protein, 23 aa, Staphylococcus
GVLCGRATWAGAVQVYIEKGEEA

SEQ ID NO: 2051319 - protein, 21 aa, Staphylococcus
GVLCGRATWAGSVKVYIEQGE

SEQ ID NO: 2051320 - protein, 18 aa, Staphylococcus
GVLLPESFYRGAHQHIFR

SEQ ID NO: 2051321 - protein, 22 aa, Staphylococcus
GVLVCTVIGFPLGATTTATKIF

SEQ ID NO: 2051322 - protein, 23 aa, Staphylococcus
GVNGIRISIAWSRIFPNGYGDVN

SEQ ID NO: 2051323 - protein, 17 aa, Staphylococcus
GVSFAFQGCEHINRAIT

SEQ ID NO: 2051324 - protein, 19 aa, Staphylococcus
GVSKGGLLYHFESKQALIQ

SEQ ID NO: 2051325 - protein, 33 aa, Staphylococcus
GVSKRLGVPCLDLYHCSHLRPWIDEVNQHFFSY

SEQ ID NO: 2051326 - protein, 18 aa, Staphylococcus
GVSYCAVCDGAFFKGKKL

SEQ ID NO: 2051327 - protein, 20 aa, Staphylococcus
GVSYCAVCDGAFFKGKKLFV

SEQ ID NO: 2051328 - protein, 19 aa, Staphylococcus
GVSYCAVCDGAFFKNKNIF

SEQ ID NO: 2051329 - protein, 18 aa, Staphylococcus
GVSYCAVCDGAFFKNKNL

SEQ ID NO: 2051330 - protein, 19 aa, Staphylococcus
GVSYCAVCDGAFFKNKNLF

SEQ ID NO: 2051331 - protein, 18 aa, Staphylococcus
GVSYCAVCDGAFFKNKRL

SEQ ID NO: 2051332 - protein, 19 aa, Staphylococcus
GVSYCAVCDGAFFKNKRLF

SEQ ID NO: 2051333 - protein, 19 aa, Staphylococcus
GVTEFPFSDLISFKEIKEQ

SEQ ID NO: 2051334 - protein, 22 aa, Staphylococcus
GVVKRLHLPQGFNVRVDSLLYS

SEQ ID NO: 2051335 - protein, 17 aa, Staphylococcus
GVVPVEFISEAVIQTSD

SEQ ID NO: 2051336 - protein, 17 aa, Staphylococcus
GVYRFKRGFNVYIEELI

SEQ ID NO: 2051337 - protein, 18 aa, Staphylococcus
GWEPPRFGHMSLIVNEER

SEQ ID NO: 2051338 - protein, 17 aa, Staphylococcus
GWPSFSKAIDDDEIIEL

SEQ ID NO: 2051339 - protein, 18 aa, Staphylococcus
GWPSFSKALDDDEIVELV

SEQ ID NO: 2051340 - protein, 18 aa, Staphylococcus
GWPSFSKALNDDEIIELV

SEQ ID NO: 2051341 - protein, 17 aa, Staphylococcus
GWQKWVWSPFLSIMGSG

SEQ ID NO: 2051342 - protein, 23 aa, Staphylococcus
GWTDIFIYPGFEFKAIDALITNF

SEQ ID NO: 2051343 - protein, 17 aa, Staphylococcus
GYARLKGVSALVTTFGV

SEQ ID NO: 2051344 - protein, 17 aa, Staphylococcus
GYARMKGIAAMVTTFGV

SEQ ID NO: 2051345 - protein, 18 aa, Staphylococcus
GYASFMLCRDCGHVPQCP

SEQ ID NO: 2051346 - protein, 19 aa, Staphylococcus
GYASFMLCRDCGYVPQCPH

SEQ ID NO: 2051347 - protein, 20 aa, Staphylococcus
GYDFPMWFIRPFYAKETTKN

SEQ ID NO: 2051348 - protein, 20 aa, Staphylococcus
GYDFPMWFIRPFYAKSTKLN

SEQ ID NO: 2051349 - protein, 17 aa, Staphylococcus
GYEGFYHLMKINGDVEK

SEQ ID NO: 2051350 - protein, 17 aa, Staphylococcus
GYEKRYGLFYVDFDTQE

SEQ ID NO: 2051351 - protein, 19 aa, Staphylococcus
GYFARPTIFINVDNHMTIA

SEQ ID NO: 2051352 - protein, 20 aa, Staphylococcus
GYFARPTIFINVDNHMTIAQ

SEQ ID NO: 2051353 - protein, 19 aa, Staphylococcus
GYHPTWKMVLGLFPKEDKI

SEQ ID NO: 2051354 - protein, 18 aa, Staphylococcus
GYIPLHWHNDLQLMVVTC

SEQ ID NO: 2051355 - protein, 18 aa, Staphylococcus
GYKFKRVLEDAGVFKNTD

SEQ ID NO: 2051356 - protein, 24 aa, Staphylococcus
GYKIAQRLGGYEAIGPVLQGLNSP

SEQ ID NO: 2051357 - protein, 21 aa, Staphylococcus
GYKPGEDVFLGFDCASSEFYE

SEQ ID NO: 2051358 - protein, 19 aa, Staphylococcus
GYLPLNWINKWKHYSSVTL

SEQ ID NO: 2051359 - protein, 18 aa, Staphylococcus
GYLPLNWINKWKLYSTVK

SEQ ID NO: 2051360 - protein, 18 aa, Staphylococcus
GYLSFNPIGGWWNQVMLS

SEQ ID NO: 2051361 - protein, 18 aa, Staphylococcus
GYLYFFKFGTLSLEETEK

SEQ ID NO: 2051362 - protein, 18 aa, Staphylococcus
GYMWECPDYFKLDSKDIL

SEQ ID NO: 2051363 - protein, 23 aa, Staphylococcus
GYMWECPDYFSLNGQDVIIFSPQ

SEQ ID NO: 2051364 - protein, 22 aa, Staphylococcus
GYRPAEGFEAFFMMKKMGAPFL

SEQ ID NO: 2051365 - protein, 20 aa, Staphylococcus
GYSFNLFELELFKILLNNIE

SEQ ID NO: 2051366 - protein, 23 aa, Staphylococcus
GYTDYKAGVLLADAHPQPLVLEP

SEQ ID NO: 2051367 - protein, 20 aa, Staphylococcus
GYVGHHLWIKLGYHQTIFPT

SEQ ID NO: 2051368 - protein, 17 aa, Staphylococcus
GYWTYSINDVWVGLQKS

SEQ ID NO: 2051369 - protein, 17 aa, Staphylococcus
HAENVIFIGLLCKDGQW

SEQ ID NO: 2051370 - protein, 23 aa, Staphylococcus
HAGYLIKVLNNWAKENVKTKEDA

SEQ ID NO: 2051371 - protein, 24 aa, Staphylococcus
HAIDACGLNGLRIANCSFEGFLDI

SEQ ID NO: 2051372 - protein, 19 aa, Staphylococcus
HAMAWKKLMQAFGYPQKTK

SEQ ID NO: 2051373 - protein, 18 aa, Staphylococcus
HAPWSFTIGSAFFDNKFD

SEQ ID NO: 2051374 - protein, 23 aa, Staphylococcus
HAQMKMFLTRLGFDSKMVVTGDQ

SEQ ID NO: 2051375 - protein, 23 aa, Staphylococcus
HAQMKMFLTRLGFGSKMVVTGDK

SEQ ID NO: 2051376 - protein, 23 aa, Staphylococcus
HAQMKMFLTRLGFGSKMVVTGDM

SEQ ID NO: 2051377 - protein, 21 aa, Staphylococcus
HAQMKMFLTRLGFSSKMVVTG

SEQ ID NO: 2051378 - protein, 20 aa, Staphylococcus
HCENCGGPIRPDIVLYGEML

SEQ ID NO: 2051379 - protein, 25 aa, Staphylococcus
HCGLRRKKVDFGWIYSTTPATATGV

SEQ ID NO: 2051380 - protein, 18 aa, Staphylococcus
HCRTKVILKNGAKVIAHF

SEQ ID NO: 2051381 - protein, 18 aa, Staphylococcus
HDEIKRLVAFQEEVVAHI

SEQ ID NO: 2051382 - protein, 18 aa, Staphylococcus
HDIHGYKKARIMRNVGKL

SEQ ID NO: 2051383 - protein, 18 aa, Staphylococcus
HDIHVIPLSITIDGNSYT

SEQ ID NO: 2051384 - protein, 23 aa, Staphylococcus
HDLKITVPVAIHLDHGSSFEKCK

SEQ ID NO: 2051385 - protein, 18 aa, Staphylococcus
HEARYGGTLFDLYYDAQG

SEQ ID NO: 2051386 - protein, 18 aa, Staphylococcus
HEEIKRLVAFQEEVVEHI

SEQ ID NO: 2051387 - protein, 17 aa, Staphylococcus
HEFKIITNMGFEDYFLI

SEQ ID NO: 2051388 - protein, 19 aa, Staphylococcus
HEFMFTRPIFQTEDMIKHH

SEQ ID NO: 2051389 - protein, 21 aa, Staphylococcus
HELDHGFDFYAPQTFLDEQGQ

SEQ ID NO: 2051390 - protein, 17 aa, Staphylococcus
HELGIPVMILFEGVPAS

SEQ ID NO: 2051391 - protein, 19 aa, Staphylococcus
HELGIPVMILFEGVPASGK

SEQ ID NO: 2051392 - protein, 17 aa, Staphylococcus
HELKLAIIMNDFGKTSV

SEQ ID NO: 2051393 - protein, 19 aa, Staphylococcus
HEPELWKKVDVFVLPKDYV

SEQ ID NO: 2051394 - protein, 25 aa, Staphylococcus
HEVAKAESVAICWAMGITQQDIGSD

SEQ ID NO: 2051395 - protein, 17 aa, Staphylococcus
HFFKEIIIRNIKGYTLS

SEQ ID NO: 2051396 - protein, 17 aa, Staphylococcus
HFGRHWIAPAIREDGSE

SEQ ID NO: 2051397 - protein, 17 aa, Staphylococcus
HFGRTDILLPWEKLDKV

SEQ ID NO: 2051398 - protein, 22 aa, Staphylococcus
HFNKLEVPFIYRVHEQPKSERL

SEQ ID NO: 2051399 - protein, 23 aa, Staphylococcus
HGEIDAVISFGKFIKEFEGLKEY

SEQ ID NO: 2051400 - protein, 20 aa, Staphylococcus
HGFNHFPHFIALFNKKYGIT

SEQ ID NO: 2051401 - protein, 24 aa, Staphylococcus
HGFNHFPRFIALFSKKYGMTPGQA

SEQ ID NO: 2051402 - protein, 23 aa, Staphylococcus
HGGILFMFALKWLPIEEVKKINF

SEQ ID NO: 2051403 - protein, 17 aa, Staphylococcus
HGIKAIIQPGGSIKDQD

SEQ ID NO: 2051404 - protein, 19 aa, Staphylococcus
HGKHGFAFGSGMAAISAVI

SEQ ID NO: 2051405 - protein, 19 aa, Staphylococcus
HGLKYGDKVLIMMPRAIAT

SEQ ID NO: 2051406 - protein, 17 aa, Staphylococcus
HGLPLTEAFLFSRGHFK

SEQ ID NO: 2051407 - protein, 21 aa, Staphylococcus
HGNELPISAGFFFINPFEVVY

SEQ ID NO: 2051408 - protein, 24 aa, Staphylococcus
HGRDRSGVCSVQFAERIQPGDTVP

SEQ ID NO: 2051409 - protein, 21 aa, Staphylococcus
HGTGLPKLFGFQAEGASPIVQ

SEQ ID NO: 2051410 - protein, 22 aa, Staphylococcus
HGVTLPRLFGFQAEGASPIVQN

SEQ ID NO: 2051411 - protein, 17 aa, Staphylococcus
HGYRCCINASTITQFEL

SEQ ID NO: 2051412 - protein, 19 aa, Staphylococcus
HGYVGLAHAGWRGTYGEIV

SEQ ID NO: 2051413 - protein, 19 aa, Staphylococcus
HHKSLSDFAALCFHVPFTK

SEQ ID NO: 2051414 - protein, 25 aa, Staphylococcus
HHQCIPCILDYRWSEEQIKTLIDHY

SEQ ID NO: 2051415 - protein, 18 aa, Staphylococcus
HHQLIFFGRYHCLARKPK

SEQ ID NO: 2051416 - protein, 18 aa, Staphylococcus
HHRHASDIFKMIDDSALS

SEQ ID NO: 2051417 - protein, 19 aa, Staphylococcus
HHYLWRFAKDMPRSGHIEL

SEQ ID NO: 2051418 - protein, 18 aa, Staphylococcus
HHYLWRFAKEMPRTGHIE

SEQ ID NO: 2051419 - protein, 17 aa, Staphylococcus
HIAFKIQSLEIMDYIER

SEQ ID NO: 2051420 - protein, 19 aa, Staphylococcus
HIAHPTGRIIGRREGYKPN

SEQ ID NO: 2051421 - protein, 19 aa, Staphylococcus
HIAKFLLGIFIASREDEFT

SEQ ID NO: 2051422 - protein, 21 aa, Staphylococcus
HIEAGDNWILYGLNGAGKTTL

SEQ ID NO: 2051423 - protein, 17 aa, Staphylococcus
HIIKWSKLYLDNFQSSW

SEQ ID NO: 2051424 - protein, 17 aa, Staphylococcus
HIIKWSKLYLDQFQSSW

SEQ ID NO: 2051425 - protein, 17 aa, Staphylococcus
HIIKWSKLYLDTFQSSW

SEQ ID NO: 2051426 - protein, 22 aa, Staphylococcus
HIIWIRCCLYYSGVITEEELFN

SEQ ID NO: 2051427 - protein, 19 aa, Staphylococcus
HIRARYGVILATGGFGANT

SEQ ID NO: 2051428 - protein, 20 aa, Staphylococcus
HIRLKFCLIDILSTDQSIEY

SEQ ID NO: 2051429 - protein, 18 aa, Staphylococcus
HKGFHMLKFEGFDNINDV

SEQ ID NO: 2051430 - protein, 19 aa, Staphylococcus
HKGFHMLKFEGIDNINDIE

SEQ ID NO: 2051431 - protein, 19 aa, Staphylococcus
HKLKEALRIGDVESQKYYL

SEQ ID NO: 2051432 - protein, 24 aa, Staphylococcus
HLFDRYTFNHFKKGSVFVNCARGS

SEQ ID NO: 2051433 - protein, 18 aa, Staphylococcus
HLIEAVAYNVARKNSDVK

SEQ ID NO: 2051434 - protein, 17 aa, Staphylococcus
HLIECGANVVGLNCHHG

SEQ ID NO: 2051435 - protein, 18 aa, Staphylococcus
HLIHLPFDYMFFTGSDKV

SEQ ID NO: 2051436 - protein, 19 aa, Staphylococcus
HLNKVFKYRYGVTAYQYMS

SEQ ID NO: 2051437 - protein, 20 aa, Staphylococcus
HLNQRGGPWVKDVLRQIECA

SEQ ID NO: 2051438 - protein, 20 aa, Staphylococcus
HLRLCGGFQFSSHKSDDEWR

SEQ ID NO: 2051439 - protein, 18 aa, Staphylococcus
HLRLEKYQDLMLISQTDF

SEQ ID NO: 2051440 - protein, 17 aa, Staphylococcus
HLVLKWKFNKDEGKYFT

SEQ ID NO: 2051441 - protein, 17 aa, Staphylococcus
HMIRAALEGVLYNLYTV

SEQ ID NO: 2051442 - protein, 22 aa, Staphylococcus
HMKSCFLQKGLVFLLIRFKVLD

SEQ ID NO: 2051443 - protein, 23 aa, Staphylococcus
HMLSGGMLQRLMIALALSLQPKL

SEQ ID NO: 2051444 - protein, 18 aa, Staphylococcus
HMRVSWKDVLQLIAAQLL

SEQ ID NO: 2051445 - protein, 19 aa, Staphylococcus
HNHWYKWLQHNLELEGYDV

SEQ ID NO: 2051446 - protein, 17 aa, Staphylococcus
HNLKAKGVSFVYISHRM

SEQ ID NO: 2051447 - protein, 21 aa, Staphylococcus
HNLKTALIINEFGKMSVDSQL

SEQ ID NO: 2051448 - protein, 17 aa, Staphylococcus
HNMPVFFSANMSYGVHA

SEQ ID NO: 2051449 - protein, 20 aa, Staphylococcus
HPACMHISIGKGVCGTAVAN

SEQ ID NO: 2051450 - protein, 17 aa, Staphylococcus
HPDLDTWVIFPWTAGQG

SEQ ID NO: 2051451 - protein, 20 aa, Staphylococcus
HPDYEFLQNIGIDIKTNEYG

SEQ ID NO: 2051452 - protein, 19 aa, Staphylococcus
HPDYEFLQSIGIEINQNEY

SEQ ID NO: 2051453 - protein, 23 aa, Staphylococcus
HPELKLGIITPFYGHTSKWNEHN

SEQ ID NO: 2051454 - protein, 19 aa, Staphylococcus
HPGHNRWHPDIPAAFSVDP

SEQ ID NO: 2051455 - protein, 18 aa, Staphylococcus
HPGHNRWHPDIPAVFSVD

SEQ ID NO: 2051456 - protein, 19 aa, Staphylococcus
HPGLLKRLFEQEVPEIFDG

SEQ ID NO: 2051457 - protein, 19 aa, Staphylococcus
HPNLKYPSFERIFKDSNVY

SEQ ID NO: 2051458 - protein, 20 aa, Staphylococcus
HPNYEFLESIGIEINTNEYG

SEQ ID NO: 2051459 - protein, 22 aa, Staphylococcus
HPQLKICACLGLANEEQAEKLK

SEQ ID NO: 2051460 - protein, 18 aa, Staphylococcus
HPQLKICACLGLTNEEQA

SEQ ID NO: 2051461 - protein, 20 aa, Staphylococcus
HPQLKICACLGLVDDEQATQ

SEQ ID NO: 2051462 - protein, 20 aa, Staphylococcus
HPQLKVCACLGLANEDQASR

SEQ ID NO: 2051463 - protein, 24 aa, Staphylococcus
HPREVFKAAIKWSSNAIIVVHNHP

SEQ ID NO: 2051464 - protein, 22 aa, Staphylococcus
HPRTDLNTGVWIVGADVEPGNY

SEQ ID NO: 2051465 - protein, 20 aa, Staphylococcus
HPSVIISFYPNYSVHPDHEA

SEQ ID NO: 2051466 - protein, 21 aa, Staphylococcus
HQKPHIMPVWSIKNRAEKVRN

SEQ ID NO: 2051467 - protein, 24 aa, Staphylococcus
HQLAIKLSSSWSFLVPEILQIDED

SEQ ID NO: 2051468 - protein, 19 aa, Staphylococcus
HQLFRFKSHFDVIFIDEVD

SEQ ID NO: 2051469 - protein, 17 aa, Staphylococcus
HQLRFDLSKGFPLLTTK

SEQ ID NO: 2051470 - protein, 25 aa, Staphylococcus
HREISPRLRLVIPLKRNVNADEYEA

SEQ ID NO: 2051471 - protein, 17 aa, Staphylococcus
HRGGFCYELNTLFQTYL

SEQ ID NO: 2051472 - protein, 17 aa, Staphylococcus
HRGGYCYEQNRLFHSWI

SEQ ID NO: 2051473 - protein, 18 aa, Staphylococcus
HRIGDLLIQYSIEHTHGL

SEQ ID NO: 2051474 - protein, 17 aa, Staphylococcus
HRIIPIIPQQGSLGASG

SEQ ID NO: 2051475 - protein, 22 aa, Staphylococcus
HRKHPANGFVCYMVGRLVLEYC

SEQ ID NO: 2051476 - protein, 23 aa, Staphylococcus
HRKHPGDGFVCYMIGRLVLQYCK

SEQ ID NO: 2051477 - protein, 22 aa, Staphylococcus
HRKKPANGFVCYMVGRLILELC

SEQ ID NO: 2051478 - protein, 23 aa, Staphylococcus
HRKKPGNGFVCYMIGRLILQYCK

SEQ ID NO: 2051479 - protein, 18 aa, Staphylococcus
HRLLELFLIEVLKYNWEE

SEQ ID NO: 2051480 - protein, 24 aa, Staphylococcus
HRMLEVAEALPINVGFTGKGQAVN

SEQ ID NO: 2051481 - protein, 19 aa, Staphylococcus
HRPYHGFKRFNTPRDISDS

SEQ ID NO: 2051482 - protein, 17 aa, Staphylococcus
HRRLGKQLKLFMFSEEA

SEQ ID NO: 2051483 - protein, 22 aa, Staphylococcus
HRRVKEWLKRAAKKYGLEAEDV

SEQ ID NO: 2051484 - protein, 17 aa, Staphylococcus
HRTAFEFRFEDLFTKEE

SEQ ID NO: 2051485 - protein, 20 aa, Staphylococcus
HSEWSRTQIQDWIKASLVKV

SEQ ID NO: 2051486 - protein, 17 aa, Staphylococcus
HSLKEPYIFIGQDAKKL

SEQ ID NO: 2051487 - protein, 17 aa, Staphylococcus
HSMAMILSMARNIPQAH

SEQ ID NO: 2051488 - protein, 19 aa, Staphylococcus
HSMGSIIARLFVKQYPQFA

SEQ ID NO: 2051489 - protein, 17 aa, Staphylococcus
HSNDLIYCFLLDNVFPE

SEQ ID NO: 2051490 - protein, 18 aa, Staphylococcus
HSSMPIFGVNAIKPLIEF

SEQ ID NO: 2051491 - protein, 17 aa, Staphylococcus
HSYDFYGVSGFDKTYYP

SEQ ID NO: 2051492 - protein, 21 aa, Staphylococcus
HTEGLWRLKVMLGQDGTLTHQ

SEQ ID NO: 2051493 - protein, 24 aa, Staphylococcus
HTELPLYVTICSGLIKADKYEWML

SEQ ID NO: 2051494 - protein, 23 aa, Staphylococcus
HTLLMIGRYPICYINIEMDPILV

SEQ ID NO: 2051495 - protein, 17 aa, Staphylococcus
HTYKMKFIKSFIAKDLH

SEQ ID NO: 2051496 - protein, 21 aa, Staphylococcus
HVAINFAKLILCAEDSQCELK

SEQ ID NO: 2051497 - protein, 19 aa, Staphylococcus
HVAMEFAQLILCNGNEQCE

SEQ ID NO: 2051498 - protein, 18 aa, Staphylococcus
HVFKLDPAKVINDSDLDA

SEQ ID NO: 2051499 - protein, 19 aa, Staphylococcus
HVFLKRNLPSYAVPNFIKY

SEQ ID NO: 2051500 - protein, 24 aa, Staphylococcus
HVGSWRYKFFKEREGKYQVEQKEE

SEQ ID NO: 2051501 - protein, 18 aa, Staphylococcus
HVHKPSGAKPGFVTYDNQ

SEQ ID NO: 2051502 - protein, 19 aa, Staphylococcus
HVHKPSGAKPGFVTYDNQK

SEQ ID NO: 2051503 - protein, 20 aa, Staphylococcus
HVIQPVKWVKAKNHHHKTLV

SEQ ID NO: 2051504 - protein, 24 aa, Staphylococcus
HVKLRMFICWGAQFALNYRYGIQK

SEQ ID NO: 2051505 - protein, 18 aa, Staphylococcus
HVPQCPNCDISLTYHKSS

SEQ ID NO: 2051506 - protein, 18 aa, Staphylococcus
HVPQCPNCDISLTYHKST

SEQ ID NO: 2051507 - protein, 19 aa, Staphylococcus
HVQSALNFKFLKRMNEAGL

SEQ ID NO: 2051508 - protein, 18 aa, Staphylococcus
HVQSALNFQFIKRMNDVG

SEQ ID NO: 2051509 - protein, 19 aa, Staphylococcus
HVQSALNFQFMKRINEVGI

SEQ ID NO: 2051510 - protein, 18 aa, Staphylococcus
HVQSALNFQFMKRMNQVG

SEQ ID NO: 2051511 - protein, 17 aa, Staphylococcus
HVREIGSLVMATTHYPE

SEQ ID NO: 2051512 - protein, 23 aa, Staphylococcus
HVSELKQRIPLILEVNTNQYQSY

SEQ ID NO: 2051513 - protein, 23 aa, Staphylococcus
HVSELKQRIPLILEVSTNQYQSQ

SEQ ID NO: 2051514 - protein, 23 aa, Staphylococcus
HVSELKQRIPLILEVTSNQYQSH

SEQ ID NO: 2051515 - protein, 23 aa, Staphylococcus
HVSELKQRIPLILEVTSNQYQSM

SEQ ID NO: 2051516 - protein, 23 aa, Staphylococcus
HVSELKQRIPLILEVTTEQYQST

SEQ ID NO: 2051517 - protein, 23 aa, Staphylococcus
HVTELKQRIPLILEVTSKQFQSA

SEQ ID NO: 2051518 - protein, 25 aa, Staphylococcus
HWEELKHSWEFIDYISTEWKKSNVT

SEQ ID NO: 2051519 - protein, 24 aa, Staphylococcus
HWKPKQGLESLVWDEAQILHGKDI

SEQ ID NO: 2051520 - protein, 18 aa, Staphylococcus
HYDTEYYAGLSFRTLMPK

SEQ ID NO: 2051521 - protein, 18 aa, Staphylococcus
HYELPILGIHNMKNATIA

SEQ ID NO: 2051522 - protein, 19 aa, Staphylococcus
HYFHPFRASEKFTIVPSWE

SEQ ID NO: 2051523 - protein, 26 aa, Staphylococcus
HYHFKSRISVWILNYIKSHTELLEHV

SEQ ID NO: 2051524 - protein, 22 aa, Staphylococcus
HYLFEIIDPYSLNKQGVDKGPK

SEQ ID NO: 2051525 - protein, 17 aa, Staphylococcus
HYLKVRPGAFFLTGCGN

SEQ ID NO: 2051526 - protein, 18 aa, Staphylococcus
HYLKVRPGAFFLTGCGNE

SEQ ID NO: 2051527 - protein, 18 aa, Staphylococcus
HYLKVRPGAFFLTGCGNP

SEQ ID NO: 2051528 - protein, 18 aa, Staphylococcus
HYLKVRPGAFFLTGCGNV

SEQ ID NO: 2051529 - protein, 20 aa, Staphylococcus
HYRKKCIFESLDMTFENLQL

SEQ ID NO: 2051530 - protein, 22 aa, Staphylococcus
HYRMVQELPTFFSSNLNFEELE

SEQ ID NO: 2051531 - protein, 17 aa, Staphylococcus
HYVMKWKETEIFFEKLM

SEQ ID NO: 2051532 - protein, 17 aa, Staphylococcus
IAAREVRGILDMKGGFT

SEQ ID NO: 2051533 - protein, 19 aa, Staphylococcus
IACPGFVPLVEQMRYNDPT

SEQ ID NO: 2051534 - protein, 24 aa, Staphylococcus
IADVGCGYGPIGLMIAKVSPHHQI

SEQ ID NO: 2051535 - protein, 19 aa, Staphylococcus
IADVGCGYGPIGLTIAKVS

SEQ ID NO: 2051536 - protein, 17 aa, Staphylococcus
IAEAFVRSGAVDIIVVD

SEQ ID NO: 2051537 - protein, 17 aa, Staphylococcus
IAEHCLFELDAPIMRLA

SEQ ID NO: 2051538 - protein, 21 aa, Staphylococcus
IAEPSDGFVFYASKGSMGLKV

SEQ ID NO: 2051539 - protein, 20 aa, Staphylococcus
IAFDLLEYALKYAFEHYTIH

SEQ ID NO: 2051540 - protein, 19 aa, Staphylococcus
IAGIKRLWAKLEISNDDFI

SEQ ID NO: 2051541 - protein, 17 aa, Staphylococcus
IAGLSILGGEPFCNLDT

SEQ ID NO: 2051542 - protein, 24 aa, Staphylococcus
IAHFCSMCGPKFCSMKLSHDIRDS

SEQ ID NO: 2051543 - protein, 24 aa, Staphylococcus
IAHFCSMCGPKFCSMRLSHDIRDS

SEQ ID NO: 2051544 - protein, 17 aa, Staphylococcus
IAHPTGRIIGRRPGYKP

SEQ ID NO: 2051545 - protein, 17 aa, Staphylococcus
IAIGGFSPLTGFMGEAD

SEQ ID NO: 2051546 - protein, 17 aa, Staphylococcus
IAKELNIGMGTLYRHFK

SEQ ID NO: 2051547 - protein, 23 aa, Staphylococcus
IAKKELFESYGILSCDEKQFSTL

SEQ ID NO: 2051548 - protein, 17 aa, Staphylococcus
IALFAGIDKCRFKKQVT

SEQ ID NO: 2051549 - protein, 18 aa, Staphylococcus
IALFAGIDKCRFKKQVTP

SEQ ID NO: 2051550 - protein, 17 aa, Staphylococcus
IALHKEDLNVVAINASY

SEQ ID NO: 2051551 - protein, 23 aa, Staphylococcus
IALPLDFPGLFKGYFKDEKRTKD

SEQ ID NO: 2051552 - protein, 21 aa, Staphylococcus
IALPLDFPGLFKGYYKDEERT

SEQ ID NO: 2051553 - protein, 19 aa, Staphylococcus
IANKFYIYDGMKWKIDDKG

SEQ ID NO: 2051554 - protein, 18 aa, Staphylococcus
IANSLGIDMTESFNDTMD

SEQ ID NO: 2051555 - protein, 19 aa, Staphylococcus
IAPALATGCSLIMKPSEIT

SEQ ID NO: 2051556 - protein, 20 aa, Staphylococcus
IAPRKVRLVLDLIRGKSAGE

SEQ ID NO: 2051557 - protein, 18 aa, Staphylococcus
IAPSPVWMQARLMKAGIR

SEQ ID NO: 2051558 - protein, 20 aa, Staphylococcus
IARELIELIIAFMFHHQIPM

SEQ ID NO: 2051559 - protein, 18 aa, Staphylococcus
IASDWFKEEGFNFFDYKY

SEQ ID NO: 2051560 - protein, 19 aa, Staphylococcus
IASEYKLPTFLMGVGLGGL

SEQ ID NO: 2051561 - protein, 17 aa, Staphylococcus
IASRLIGEPAWGLFSGV

SEQ ID NO: 2051562 - protein, 17 aa, Staphylococcus
IATACIGGGLGIALMID

SEQ ID NO: 2051563 - protein, 19 aa, Staphylococcus
IATGRPRTETIIPFESLGL

SEQ ID NO: 2051564 - protein, 17 aa, Staphylococcus
IAVIPCDYYVEKADIDL

SEQ ID NO: 2051565 - protein, 17 aa, Staphylococcus
IAWELGLLYGLNTKDIN

SEQ ID NO: 2051566 - protein, 22 aa, Staphylococcus
IAYRSSGGFGVRLDAGDGFQGA

SEQ ID NO: 2051567 - protein, 24 aa, Staphylococcus
ICDNIKYYFGLTCEKPYDFGENKD

SEQ ID NO: 2051568 - protein, 18 aa, Staphylococcus
ICENIEFYFGLRKALPAP

SEQ ID NO: 2051569 - protein, 17 aa, Staphylococcus
ICIDKCYLKDILKDIYK

SEQ ID NO: 2051570 - protein, 23 aa, Staphylococcus
ICYDLRFPELLRYPARKDAQIAF

SEQ ID NO: 2051571 - protein, 23 aa, Staphylococcus
ICYDLRFPELLRYPARNGAQIAF

SEQ ID NO: 2051572 - protein, 23 aa, Staphylococcus
ICYDLRFPELLRYPARSGAKVAF

SEQ ID NO: 2051573 - protein, 21 aa, Staphylococcus
ICYDLRFPELLRYPSREGAQI

SEQ ID NO: 2051574 - protein, 20 aa, Staphylococcus
ICYLWLRFEHDAQFSRDTVE

SEQ ID NO: 2051575 - protein, 20 aa, Staphylococcus
ICYMPTWRGSVGKVKKSSHT

SEQ ID NO: 2051576 - protein, 18 aa, Staphylococcus
IDAFLGIRYAHLMHGRFK

SEQ ID NO: 2051577 - protein, 22 aa, Staphylococcus
IDAPRYGLKHMMDFYNLDFHGH

SEQ ID NO: 2051578 - protein, 18 aa, Staphylococcus
IDEHLIRLSIGIEDYKDI

SEQ ID NO: 2051579 - protein, 18 aa, Staphylococcus
IDEIPIVALLCTQANGSS

SEQ ID NO: 2051580 - protein, 20 aa, Staphylococcus
IDELKIYYSHYVSVLENKPS

SEQ ID NO: 2051581 - protein, 20 aa, Staphylococcus
IDELKIYYSHYVSVLENKPT

SEQ ID NO: 2051582 - protein, 18 aa, Staphylococcus
IDELPVIALLCTQASGTS

SEQ ID NO: 2051583 - protein, 23 aa, Staphylococcus
IDETLCTFWQGFNYTIDMNQAPF

SEQ ID NO: 2051584 - protein, 20 aa, Staphylococcus
IDETLCTLWQGFDYEVDMSA

SEQ ID NO: 2051585 - protein, 19 aa, Staphylococcus
IDFANRMGIGLNKLFEALS

SEQ ID NO: 2051586 - protein, 18 aa, Staphylococcus
IDFDKALDYWLNRFKIME

SEQ ID NO: 2051587 - protein, 17 aa, Staphylococcus
IDFFPGRFENTFNRWME

SEQ ID NO: 2051588 - protein, 22 aa, Staphylococcus
IDFLFSASICGRVVANNASVAG

SEQ ID NO: 2051589 - protein, 17 aa, Staphylococcus
IDGIEFVEFLISPNKGE

SEQ ID NO: 2051590 - protein, 19 aa, Staphylococcus
IDIAFEWDTTSSYTLNIEA

SEQ ID NO: 2051591 - protein, 18 aa, Staphylococcus
IDIKDMFIDIGVRSKADA

SEQ ID NO: 2051592 - protein, 18 aa, Staphylococcus
IDILENFVLERGIYGKRW

SEQ ID NO: 2051593 - protein, 19 aa, Staphylococcus
IDIPKRVFEKLGIPANTAP

SEQ ID NO: 2051594 - protein, 18 aa, Staphylococcus
IDITFSWSDLDKGQHQLN

SEQ ID NO: 2051595 - protein, 20 aa, Staphylococcus
IDKGFCLLVGIGKDTTEADI

SEQ ID NO: 2051596 - protein, 20 aa, Staphylococcus
IDKISAKRIIDFLSGTVYAI

SEQ ID NO: 2051597 - protein, 19 aa, Staphylococcus
IDLALDFGKPSFLDVFHIV

SEQ ID NO: 2051598 - protein, 19 aa, Staphylococcus
IDLEHGFECTAKFRYRQKD

SEQ ID NO: 2051599 - protein, 17 aa, Staphylococcus
IDLIIKYRVPVCCFTFG

SEQ ID NO: 2051600 - protein, 17 aa, Staphylococcus
IDLLENFVLERGITGKR

SEQ ID NO: 2051601 - protein, 17 aa, Staphylococcus
IDMELEGLLQLINPVIK

SEQ ID NO: 2051602 - protein, 17 aa, Staphylococcus
IDMEVEGLLQLFNPKIK

SEQ ID NO: 2051603 - protein, 23 aa, Staphylococcus
IDMGELRGKIFYKENYKTRVVSY

SEQ ID NO: 2051604 - protein, 22 aa, Staphylococcus
IDMKEMFIDIGVKSKKEAEQFG

SEQ ID NO: 2051605 - protein, 22 aa, Staphylococcus
IDMKPRLDLFLQDKSIFLNEPV

SEQ ID NO: 2051606 - protein, 19 aa, Staphylococcus
IDNPHLWQPLNAYLYHMKV

SEQ ID NO: 2051607 - protein, 17 aa, Staphylococcus
IDRSCRFYGSSYNFKKE

SEQ ID NO: 2051608 - protein, 18 aa, Staphylococcus
IDSPYAPLIKGLRETLKL

SEQ ID NO: 2051609 - protein, 18 aa, Staphylococcus
IDVFRIFDSLNWVDQMKV

SEQ ID NO: 2051610 - protein, 18 aa, Staphylococcus
IDWALSVTGTSEFRHRSI

SEQ ID NO: 2051611 - protein, 19 aa, Staphylococcus
IDWALTVTGTYDFRHRSIN

SEQ ID NO: 2051612 - protein, 18 aa, Staphylococcus
IDYLKFAKNYGFSDRVIA

SEQ ID NO: 2051613 - protein, 23 aa, Staphylococcus
IEAAYKLTDWLILQGYQDILFLS

SEQ ID NO: 2051614 - protein, 18 aa, Staphylococcus
IEACAAKVKILRDLRQSL

SEQ ID NO: 2051615 - protein, 23 aa, Staphylococcus
IEAELDLAICITEHIPVIDMVKV

SEQ ID NO: 2051616 - protein, 21 aa, Staphylococcus
IEAQSRFALLLGNEGEGVNQE

SEQ ID NO: 2051617 - protein, 18 aa, Staphylococcus
IEAVFGIHVMPFENEGRV

SEQ ID NO: 2051618 - protein, 18 aa, Staphylococcus
IECYIHIDLIKGLSHDEY

SEQ ID NO: 2051619 - protein, 17 aa, Staphylococcus
IEDLRIISCHIGNGASI

SEQ ID NO: 2051620 - protein, 24 aa, Staphylococcus
IEDWDIKLTDIFYVTKFDHPENEL

SEQ ID NO: 2051621 - protein, 18 aa, Staphylococcus
IEEIARIYGYDNIPSTLP

SEQ ID NO: 2051622 - protein, 21 aa, Staphylococcus
IEEKNRWLGYYGFNVSSEWMI

SEQ ID NO: 2051623 - protein, 21 aa, Staphylococcus
IEERLMKLYGVFKVSTDIEEG

SEQ ID NO: 2051624 - protein, 17 aa, Staphylococcus
IEFAKSINFEFASYMSA

SEQ ID NO: 2051625 - protein, 26 aa, Staphylococcus
IEFDKSWKKIGLRLVDQFLETFPVAH

SEQ ID NO: 2051626 - protein, 17 aa, Staphylococcus
IEFIKKWVDNFDEYYES

SEQ ID NO: 2051627 - protein, 23 aa, Staphylococcus
IEFYPVLCGTAFKNKGVQLMLDA

SEQ ID NO: 2051628 - protein, 21 aa, Staphylococcus
IEGRIFISLAVKFSKARLIDN

SEQ ID NO: 2051629 - protein, 22 aa, Staphylococcus
IEHFKGAFPLWMAPVQVNIIGV

SEQ ID NO: 2051630 - protein, 22 aa, Staphylococcus
IEHFKGAFPLWMAPVQVNLIGV

SEQ ID NO: 2051631 - protein, 21 aa, Staphylococcus
IEIHKASLLEIMFKDNHSKEV

SEQ ID NO: 2051632 - protein, 21 aa, Staphylococcus
IEIPEGLKLDGEVIVQYGQLI

SEQ ID NO: 2051633 - protein, 17 aa, Staphylococcus
IEIPNFEFGNRVIDSTG

SEQ ID NO: 2051634 - protein, 19 aa, Staphylococcus
IEKALSVLYIIDERVKHFN

SEQ ID NO: 2051635 - protein, 21 aa, Staphylococcus
IEKALSVLYIIDERVKKFNSK

SEQ ID NO: 2051636 - protein, 18 aa, Staphylococcus
IEKDGYWFIQGRIDFQIK

SEQ ID NO: 2051637 - protein, 23 aa, Staphylococcus
IEKIEIAELFSLQAKKALYHFNN

SEQ ID NO: 2051638 - protein, 17 aa, Staphylococcus
IELDWLIADMLKRSQRA

SEQ ID NO: 2051639 - protein, 17 aa, Staphylococcus
IELLTGWLIKQLFNLHL

SEQ ID NO: 2051640 - protein, 21 aa, Staphylococcus
IELLTRLGIKLNLPSLDFDTN

SEQ ID NO: 2051641 - protein, 19 aa, Staphylococcus
IELTRPARALKLWITLQVI

SEQ ID NO: 2051642 - protein, 25 aa, Staphylococcus
IELTRPARALKLWITLQVIGEDEII

SEQ ID NO: 2051643 - protein, 20 aa, Staphylococcus
IEMMDRLGIEAGITSISDPA

SEQ ID NO: 2051644 - protein, 22 aa, Staphylococcus
IEPLKNLRVMGKFGDSVTTDHI

SEQ ID NO: 2051645 - protein, 19 aa, Staphylococcus
IEQFPKLLFISGKDDEIIP

SEQ ID NO: 2051646 - protein, 24 aa, Staphylococcus
IEQSECKRAIILPNNKNILMASEQ

SEQ ID NO: 2051647 - protein, 18 aa, Staphylococcus
IEQSECQRAIILPNNKNI

SEQ ID NO: 2051648 - protein, 19 aa, Staphylococcus
IERAAKVIGSWRLEDCTLY

SEQ ID NO: 2051649 - protein, 19 aa, Staphylococcus
IERGFCLLVGVGKDSTEED

SEQ ID NO: 2051650 - protein, 22 aa, Staphylococcus
IERGHIRLGVSAIMDVRLFTES

SEQ ID NO: 2051651 - protein, 21 aa, Staphylococcus
IERLKPFGIDFNKPLFELDDV

SEQ ID NO: 2051652 - protein, 17 aa, Staphylococcus
IERLRPFLLRDGGDCTL

SEQ ID NO: 2051653 - protein, 17 aa, Staphylococcus
IESCVIRLIPQYFTSKR

SEQ ID NO: 2051654 - protein, 18 aa, Staphylococcus
IESCVKKDIPIVLVSRSF

SEQ ID NO: 2051655 - protein, 17 aa, Staphylococcus
IESEILDVLGLIHKVYS

SEQ ID NO: 2051656 - protein, 19 aa, Staphylococcus
IESLFPIEDWIVAYDVYFK

SEQ ID NO: 2051657 - protein, 24 aa, Staphylococcus
IESYPEYKCHIAIKDINDPMIKLL

SEQ ID NO: 2051658 - protein, 17 aa, Staphylococcus
IEVVYGFAQLKRAAALA

SEQ ID NO: 2051659 - protein, 17 aa, Staphylococcus
IFAPCALGGILNDDTIP

SEQ ID NO: 2051660 - protein, 18 aa, Staphylococcus
IFCLPSYREGMPRSIIEA

SEQ ID NO: 2051661 - protein, 19 aa, Staphylococcus
IFDGAWLWEEYIDTLIHED

SEQ ID NO: 2051662 - protein, 24 aa, Staphylococcus
IFDMMNWWFEKGIDGFRVDAITHI

SEQ ID NO: 2051663 - protein, 19 aa, Staphylococcus
IFEKWQIPIIFVTHSNYEA

SEQ ID NO: 2051664 - protein, 17 aa, Staphylococcus
IFEYLTIYLSFIKHYEA

SEQ ID NO: 2051665 - protein, 18 aa, Staphylococcus
IFKKRDSMNWNEITEGID

SEQ ID NO: 2051666 - protein, 18 aa, Staphylococcus
IFKKRDSMNWNEITQGID

SEQ ID NO: 2051667 - protein, 19 aa, Staphylococcus
IFKRLRKKTGIMVHPHLLR

SEQ ID NO: 2051668 - protein, 22 aa, Staphylococcus
IFKSELKLALGPIQRGGAGGGI

SEQ ID NO: 2051669 - protein, 18 aa, Staphylococcus
IFKSSGFDTPELENAKPN

SEQ ID NO: 2051670 - protein, 21 aa, Staphylococcus
IFKSTRLDSSIIYPPYKGKFK

SEQ ID NO: 2051671 - protein, 18 aa, Staphylococcus
IFKSTRLDSSMIYPPYKG

SEQ ID NO: 2051672 - protein, 23 aa, Staphylococcus
IFKSTRLESSLLFPPYKGKFKYI

SEQ ID NO: 2051673 - protein, 17 aa, Staphylococcus
IFLERSLVDQIITVSDK

SEQ ID NO: 2051674 - protein, 17 aa, Staphylococcus
IFLNRYVDMIQRGQYAP

SEQ ID NO: 2051675 - protein, 21 aa, Staphylococcus
IFQEWQIPIIFVTHSNYEAET

SEQ ID NO: 2051676 - protein, 18 aa, Staphylococcus
IFRAGGPPGKIFKRSTVI

SEQ ID NO: 2051677 - protein, 21 aa, Staphylococcus
IFRKYGIDFCCGGNISINEAV

SEQ ID NO: 2051678 - protein, 23 aa, Staphylococcus
IFRPQLRALLRASVFGKLNIMFP

SEQ ID NO: 2051679 - protein, 18 aa, Staphylococcus
IFRSAFWMDEPRILEIGY

SEQ ID NO: 2051680 - protein, 17 aa, Staphylococcus
IFSVMWSEHCSYKHSKP

SEQ ID NO: 2051681 - protein, 18 aa, Staphylococcus
IFVKARGQTAILFDEVDS

SEQ ID NO: 2051682 - protein, 21 aa, Staphylococcus
IFYKKSLEIMNLFDNLPKEVN

SEQ ID NO: 2051683 - protein, 19 aa, Staphylococcus
IGACGLDSVRVIKGQFGAH

SEQ ID NO: 2051684 - protein, 19 aa, Staphylococcus
IGALMIKYLVDYRTLPKQP

SEQ ID NO: 2051685 - protein, 20 aa, Staphylococcus
IGATVLAGFGPRIVRINDFS

SEQ ID NO: 2051686 - protein, 17 aa, Staphylococcus
IGCGDCFYCNNEMESQC

SEQ ID NO: 2051687 - protein, 17 aa, Staphylococcus
IGCGDCFYCNNHMESQC

SEQ ID NO: 2051688 - protein, 18 aa, Staphylococcus
IGDAGGRLHTGRSRNDQV

SEQ ID NO: 2051689 - protein, 25 aa, Staphylococcus
IGDQMPEFERMILLRSIDTHWTDHI

SEQ ID NO: 2051690 - protein, 17 aa, Staphylococcus
IGGGMAYTFLKAQGKEI

SEQ ID NO: 2051691 - protein, 20 aa, Staphylococcus
IGGTVLSGFGPRIVRINNFS

SEQ ID NO: 2051692 - protein, 21 aa, Staphylococcus
IGHWGEFIPFFLERMDETLFA

SEQ ID NO: 2051693 - protein, 24 aa, Staphylococcus
IGHWGEFIPFFLERMDTILVAEHL

SEQ ID NO: 2051694 - protein, 24 aa, Staphylococcus
IGHWGEFVPFFLERMDDILFADHL

SEQ ID NO: 2051695 - protein, 25 aa, Staphylococcus
IGICLGMQLFYRWSAEGDVEGLNIF

SEQ ID NO: 2051696 - protein, 19 aa, Staphylococcus
IGIGRVFRGKMHVGDNVSL

SEQ ID NO: 2051697 - protein, 17 aa, Staphylococcus
IGIGRVFRGKMRVGDNV

SEQ ID NO: 2051698 - protein, 20 aa, Staphylococcus
IGKALGFPAHMSRLTRTSSG

SEQ ID NO: 2051699 - protein, 18 aa, Staphylococcus
IGKALGLPAHMSKLTRTQ

SEQ ID NO: 2051700 - protein, 19 aa, Staphylococcus
IGLEVLDSVKIEYKLVDNW

SEQ ID NO: 2051701 - protein, 20 aa, Staphylococcus
IGLILGFLAERFLKNNESMH

SEQ ID NO: 2051702 - protein, 17 aa, Staphylococcus
IGLILGFLVQRFTQDND

SEQ ID NO: 2051703 - protein, 18 aa, Staphylococcus
IGLKLRDGGWVYVQGLTH

SEQ ID NO: 2051704 - protein, 17 aa, Staphylococcus
IGLLKGLADHGIELRLS

SEQ ID NO: 2051705 - protein, 24 aa, Staphylococcus
IGLNHSRYLLIEFPSRGVPHYANR

SEQ ID NO: 2051706 - protein, 18 aa, Staphylococcus
IGNPASWKKATVALEESN

SEQ ID NO: 2051707 - protein, 18 aa, Staphylococcus
IGNPASWQKAVKALEESN

SEQ ID NO: 2051708 - protein, 20 aa, Staphylococcus
IGRDCPKCNHYLMEHKKGRS

SEQ ID NO: 2051709 - protein, 22 aa, Staphylococcus
IGRWTAEVFLLFTLQRKNILPI

SEQ ID NO: 2051710 - protein, 20 aa, Staphylococcus
IGRYPICYINIQMDPILVDV

SEQ ID NO: 2051711 - protein, 19 aa, Staphylococcus
IGSISARLFHSFGCKVVGY

SEQ ID NO: 2051712 - protein, 17 aa, Staphylococcus
IGTAIGYSAMQFASVSK

SEQ ID NO: 2051713 - protein, 17 aa, Staphylococcus
IGTAIGYSSMQFSSVAN

SEQ ID NO: 2051714 - protein, 17 aa, Staphylococcus
IGVIQGIFWARENELNK

SEQ ID NO: 2051715 - protein, 19 aa, Staphylococcus
IGYGGGFYDRFLSKFKPNT

SEQ ID NO: 2051716 - protein, 26 aa, Staphylococcus
IGYKIAQRLGGFEAIGPVLQGLNSPV

SEQ ID NO: 2051717 - protein, 17 aa, Staphylococcus
IHACKAYNVKRLIVAGG

SEQ ID NO: 2051718 - protein, 17 aa, Staphylococcus
IHAFKLGFIMSAVDREL

SEQ ID NO: 2051719 - protein, 17 aa, Staphylococcus
IHFIGTFTVEFFIDQQN

SEQ ID NO: 2051720 - protein, 17 aa, Staphylococcus
IHFSQEGYLMWIEDFEN

SEQ ID NO: 2051721 - protein, 17 aa, Staphylococcus
IHGCKGESPIVYIGGKD

SEQ ID NO: 2051722 - protein, 17 aa, Staphylococcus
IHGCTGHESVAYIGGKD

SEQ ID NO: 2051723 - protein, 18 aa, Staphylococcus
IHLDINFGLYATRDSKIE

SEQ ID NO: 2051724 - protein, 18 aa, Staphylococcus
IHLIRANAYLVIMVVVFT

SEQ ID NO: 2051725 - protein, 22 aa, Staphylococcus
IHLPLDWLKDKIIVDSLGLHSN

SEQ ID NO: 2051726 - protein, 17 aa, Staphylococcus
IHLSRFAEEIIFWSTDE

SEQ ID NO: 2051727 - protein, 17 aa, Staphylococcus
IHPIFGMTISLTDGLYT

SEQ ID NO: 2051728 - protein, 21 aa, Staphylococcus
IHPQLRICACLGLTNEKQAAR

SEQ ID NO: 2051729 - protein, 17 aa, Staphylococcus
IHRWIDGRMPLIGIGSI

SEQ ID NO: 2051730 - protein, 17 aa, Staphylococcus
IHSGNLYQIFAYVKNEA

SEQ ID NO: 2051731 - protein, 18 aa, Staphylococcus
IIAHRGFNIDYPENTLLA

SEQ ID NO: 2051732 - protein, 17 aa, Staphylococcus
IIANMAVGFDNIDIDLV

SEQ ID NO: 2051733 - protein, 17 aa, Staphylococcus
IIANMAVGYDNIDVVRA

SEQ ID NO: 2051734 - protein, 17 aa, Staphylococcus
IIARLSFLNNVGLEYLT

SEQ ID NO: 2051735 - protein, 23 aa, Staphylococcus
IIAYRSSGGFGVRLDAGDGFQGA

SEQ ID NO: 2051736 - protein, 22 aa, Staphylococcus
IICYDLRFPELLRYPAKNGAKI

SEQ ID NO: 2051737 - protein, 18 aa, Staphylococcus
IIDLRLQTRLSYTESQIK

SEQ ID NO: 2051738 - protein, 24 aa, Staphylococcus
IIDVGCGYGPIGLMIAKVSPHHEV

SEQ ID NO: 2051739 - protein, 24 aa, Staphylococcus
IIDVGCGYGPIGLMIAKVSPHHKV

SEQ ID NO: 2051740 - protein, 25 aa, Staphylococcus
IIEILKSSGFIPVKGWIFNGDIQND

SEQ ID NO: 2051741 - protein, 22 aa, Staphylococcus
IIEISRFIPFLNVKRYVYIHFL

SEQ ID NO: 2051742 - protein, 17 aa, Staphylococcus
IIEKCWESENFIDDNTL

SEQ ID NO: 2051743 - protein, 23 aa, Staphylococcus
IIEKGLRVAFNIDNYRVIDHLGI

SEQ ID NO: 2051744 - protein, 17 aa, Staphylococcus
IIFNFVHLLEQYPFEAI

SEQ ID NO: 2051745 - protein, 22 aa, Staphylococcus
IIFPKRGAAILLNKIRIINTPG

SEQ ID NO: 2051746 - protein, 22 aa, Staphylococcus
IIIRSVFKYVFKYYDLQDISVL

SEQ ID NO: 2051747 - protein, 17 aa, Staphylococcus
IIKGCKLYDSRQFKDNV

SEQ ID NO: 2051748 - protein, 24 aa, Staphylococcus
IIKYNVPICSFTFGIPDALTIEKL

SEQ ID NO: 2051749 - protein, 17 aa, Staphylococcus
IILPTDRLELFDGHRYD

SEQ ID NO: 2051750 - protein, 18 aa, Staphylococcus
IILQAAFELGERLNASST

SEQ ID NO: 2051751 - protein, 19 aa, Staphylococcus
IIMFGGGGYNIWTVVPRAW

SEQ ID NO: 2051752 - protein, 19 aa, Staphylococcus
IINAFPIKFVVDGENEVSD

SEQ ID NO: 2051753 - protein, 26 aa, Staphylococcus
IINLSLRAKYLFKYNLDYFIFDGEIV

SEQ ID NO: 2051754 - protein, 17 aa, Staphylococcus
IIPHCGALLPVIAQRVA

SEQ ID NO: 2051755 - protein, 20 aa, Staphylococcus
IIPSYRAIMLTIDITQSDAT

SEQ ID NO: 2051756 - protein, 23 aa, Staphylococcus
IIQPGETFSFWNLVGKIDKKRGY

SEQ ID NO: 2051757 - protein, 17 aa, Staphylococcus
IIQTWKKAYQEIADVFI

SEQ ID NO: 2051758 - protein, 22 aa, Staphylococcus
IIRDYLEFMAFLGVLPTYYKGK

SEQ ID NO: 2051759 - protein, 23 aa, Staphylococcus
IIRGLRFQSQFGFHLEEATFTAM

SEQ ID NO: 2051760 - protein, 18 aa, Staphylococcus
IISLAAALERARFDNITI

SEQ ID NO: 2051761 - protein, 18 aa, Staphylococcus
IISLAAALERARFTSVSI

SEQ ID NO: 2051762 - protein, 19 aa, Staphylococcus
IISRLTFLYNVGLEYLTLN

SEQ ID NO: 2051763 - protein, 19 aa, Staphylococcus
IISRYAFVKHMDRLTQSVK

SEQ ID NO: 2051764 - protein, 17 aa, Staphylococcus
IISRYAGIRVPRNKAIV

SEQ ID NO: 2051765 - protein, 19 aa, Staphylococcus
IIVHPRFNLQPDVVDQPLL

SEQ ID NO: 2051766 - protein, 19 aa, Staphylococcus
IIWLCGGLDRGNDFDELIP

SEQ ID NO: 2051767 - protein, 23 aa, Staphylococcus
IIYFDRSWMKIGLQLVDDFMEKY

SEQ ID NO: 2051768 - protein, 19 aa, Staphylococcus
IKAAGGFIIQVMPGAKEET

SEQ ID NO: 2051769 - protein, 18 aa, Staphylococcus
IKAAGGFIIQVMPNAKEE

SEQ ID NO: 2051770 - protein, 19 aa, Staphylococcus
IKAAGGFVIQVMPGASNDT

SEQ ID NO: 2051771 - protein, 17 aa, Staphylococcus
IKALHHLGATDVIQSGR

SEQ ID NO: 2051772 - protein, 17 aa, Staphylococcus
IKCVMIAKLPFMNKYNT

SEQ ID NO: 2051773 - protein, 20 aa, Staphylococcus
IKDEAILKCLERVKDLGYYE

SEQ ID NO: 2051774 - protein, 19 aa, Staphylococcus
IKDEVLWKDAYFYINGGDK

SEQ ID NO: 2051775 - protein, 17 aa, Staphylococcus
IKDGGLFKQGFSKQLDE

SEQ ID NO: 2051776 - protein, 17 aa, Staphylococcus
IKDGILITVDAAQGKIF

SEQ ID NO: 2051777 - protein, 17 aa, Staphylococcus
IKEAFSMKDFKIVVTGN

SEQ ID NO: 2051778 - protein, 18 aa, Staphylococcus
IKEALDFFENIDLSEQDR

SEQ ID NO: 2051779 - protein, 18 aa, Staphylococcus
IKEGLLIAPVMDARREAV

SEQ ID NO: 2051780 - protein, 19 aa, Staphylococcus
IKEIILMGGSAGRGNVTPA

SEQ ID NO: 2051781 - protein, 17 aa, Staphylococcus
IKFAAAGGWWSQVMLSQ

SEQ ID NO: 2051782 - protein, 17 aa, Staphylococcus
IKFEGCYHGHSDSLLIK

SEQ ID NO: 2051783 - protein, 17 aa, Staphylococcus
IKFGIKEDIDYIAASFV

SEQ ID NO: 2051784 - protein, 21 aa, Staphylococcus
IKFPLEIAGVPSGLAVKRALE

SEQ ID NO: 2051785 - protein, 21 aa, Staphylococcus
IKFQPIGGWWSQVMLSQKVTI

SEQ ID NO: 2051786 - protein, 20 aa, Staphylococcus
IKFSSAWSFLIPEILQIDEV

SEQ ID NO: 2051787 - protein, 21 aa, Staphylococcus
IKFSSAWSFLVPEILQLDEKT

SEQ ID NO: 2051788 - protein, 18 aa, Staphylococcus
IKGGFTFAILTKDALYGA

SEQ ID NO: 2051789 - protein, 18 aa, Staphylococcus
IKGGFTFAILTKDALYGV

SEQ ID NO: 2051790 - protein, 19 aa, Staphylococcus
IKGKIIIPGFFGVSKHGYI

SEQ ID NO: 2051791 - protein, 18 aa, Staphylococcus
IKGNVNWMRARQRQLINT

SEQ ID NO: 2051792 - protein, 18 aa, Staphylococcus
IKGNVNWMRARQRQLIQT

SEQ ID NO: 2051793 - protein, 18 aa, Staphylococcus
IKGPVYVLLTMERIVLNL

SEQ ID NO: 2051794 - protein, 17 aa, Staphylococcus
IKHGLAIQGIEKVRDTQ

SEQ ID NO: 2051795 - protein, 17 aa, Staphylococcus
IKIATTFGNRDAVSHDM

SEQ ID NO: 2051796 - protein, 20 aa, Staphylococcus
IKIFLQHGVLGRKNVEYHKK

SEQ ID NO: 2051797 - protein, 19 aa, Staphylococcus
IKIRYNMCPCKIKHDEERF

SEQ ID NO: 2051798 - protein, 20 aa, Staphylococcus
IKISSAWSFLVPEILQIDED

SEQ ID NO: 2051799 - protein, 19 aa, Staphylococcus
IKKEGYVQFEFVKDDLTDL

SEQ ID NO: 2051800 - protein, 19 aa, Staphylococcus
IKKGDKWVLYGLNGAGKTT

SEQ ID NO: 2051801 - protein, 20 aa, Staphylococcus
IKKLYGVNGISIMKLDQSDV

SEQ ID NO: 2051802 - protein, 17 aa, Staphylococcus
IKKRGKQAVAITYTGDG

SEQ ID NO: 2051803 - protein, 20 aa, Staphylococcus
IKLGSKRIGHGVAINQDKQS

SEQ ID NO: 2051804 - protein, 20 aa, Staphylococcus
IKLLSSYLYKIFGKDISIEA

SEQ ID NO: 2051805 - protein, 17 aa, Staphylococcus
IKMDLVLGEFRLQDRYV

SEQ ID NO: 2051806 - protein, 18 aa, Staphylococcus
IKMLYGMEGMLVDDGVPI

SEQ ID NO: 2051807 - protein, 21 aa, Staphylococcus
IKNCKFKGFFDVNGDRSFSEA

SEQ ID NO: 2051808 - protein, 25 aa, Staphylococcus
IKNHVILRYGWLYGPGTWYGEDGMI

SEQ ID NO: 2051809 - protein, 22 aa, Staphylococcus
IKPDEFYFLPSYMAPLKDHKDF

SEQ ID NO: 2051810 - protein, 17 aa, Staphylococcus
IKPEIAGLMISAIISDS

SEQ ID NO: 2051811 - protein, 18 aa, Staphylococcus
IKPGGLLYFHVHDERLSF

SEQ ID NO: 2051812 - protein, 23 aa, Staphylococcus
IKPGVKRMEWMLAQFNNPQHNIR

SEQ ID NO: 2051813 - protein, 22 aa, Staphylococcus
IKPNEMPVFWGCGVTPQSVALD

SEQ ID NO: 2051814 - protein, 17 aa, Staphylococcus
IKPRMNIATGHQYLQAI

SEQ ID NO: 2051815 - protein, 17 aa, Staphylococcus
IKPWILPNFESLVNHEK

SEQ ID NO: 2051816 - protein, 17 aa, Staphylococcus
IKRLNFYDFLLLCSDGL

SEQ ID NO: 2051817 - protein, 22 aa, Staphylococcus
IKRYPTRRLHVENGQLLEMAGV

SEQ ID NO: 2051818 - protein, 19 aa, Staphylococcus
IKSDMVINLGIGMPTLVAN

SEQ ID NO: 2051819 - protein, 22 aa, Staphylococcus
IKSELEGFAWFWHTTFNHTNES

SEQ ID NO: 2051820 - protein, 18 aa, Staphylococcus
IKSLNFDVLVPWVSIKEG

SEQ ID NO: 2051821 - protein, 20 aa, Staphylococcus
IKSNFGIKEVYVIPGNADMH

SEQ ID NO: 2051822 - protein, 17 aa, Staphylococcus
IKSRLLLGTGKFEDEAT

SEQ ID NO: 2051823 - protein, 20 aa, Staphylococcus
IKSTFGIKEVHVIPGDADAQ

SEQ ID NO: 2051824 - protein, 20 aa, Staphylococcus
IKSVEAYFNCHLFYRTSKGI

SEQ ID NO: 2051825 - protein, 18 aa, Staphylococcus
IKSYDITKELGFLNIAEF

SEQ ID NO: 2051826 - protein, 17 aa, Staphylococcus
IKTAVVMYLCNTTKEDA

SEQ ID NO: 2051827 - protein, 23 aa, Staphylococcus
IKTELKKRFAITIAGGQGHLKGE

SEQ ID NO: 2051828 - protein, 18 aa, Staphylococcus
IKTGAPLVYELTDDLEVK

SEQ ID NO: 2051829 - protein, 18 aa, Staphylococcus
IKTGAPLVYELTDELEVK

SEQ ID NO: 2051830 - protein, 18 aa, Staphylococcus
IKTGIKFKYVIGDVQNLP

SEQ ID NO: 2051831 - protein, 20 aa, Staphylococcus
IKTQMLEWILPYYKSLSREG

SEQ ID NO: 2051832 - protein, 17 aa, Staphylococcus
IKVAKDLVHIQGDTSDY

SEQ ID NO: 2051833 - protein, 17 aa, Staphylococcus
IKVRRIIEEDGQQYDGE

SEQ ID NO: 2051834 - protein, 18 aa, Staphylococcus
IKVYFSLNVGDLNKVVTE

SEQ ID NO: 2051835 - protein, 20 aa, Staphylococcus
IKYAKCYRLAFQLYSADYST

SEQ ID NO: 2051836 - protein, 17 aa, Staphylococcus
IKYESVFNFDEMVQRAA

SEQ ID NO: 2051837 - protein, 17 aa, Staphylococcus
IKYKYPRLFDNVSKALR

SEQ ID NO: 2051838 - protein, 18 aa, Staphylococcus
IKYLPCPCKIKYDEARFD

SEQ ID NO: 2051839 - protein, 19 aa, Staphylococcus
IKYMFPKAHAAAYVLMAMR

SEQ ID NO: 2051840 - protein, 17 aa, Staphylococcus
IKYPLIDITVNYNDEKN

SEQ ID NO: 2051841 - protein, 19 aa, Staphylococcus
IKYRPKRVLDTLELFKIAF

SEQ ID NO: 2051842 - protein, 21 aa, Staphylococcus
IKYRVPVCCFTFGIPDEETIQ

SEQ ID NO: 2051843 - protein, 19 aa, Staphylococcus
IKYWAELHDVFQLLNIEMP

SEQ ID NO: 2051844 - protein, 22 aa, Staphylococcus
IKYWAELKEVFNLLNVEMPIVL

SEQ ID NO: 2051845 - protein, 19 aa, Staphylococcus
IKYWAELNNVFKLLNVEMP

SEQ ID NO: 2051846 - protein, 19 aa, Staphylococcus
ILAEIYMKAAFDSLLEAEN

SEQ ID NO: 2051847 - protein, 18 aa, Staphylococcus
ILAELGLRTVDELIGRSD

SEQ ID NO: 2051848 - protein, 18 aa, Staphylococcus
ILAELGLRTVDELVGRTD

SEQ ID NO: 2051849 - protein, 19 aa, Staphylococcus
ILASLGLRTVEELVGRTDL

SEQ ID NO: 2051850 - protein, 23 aa, Staphylococcus
ILDKFKSLTFISGTLTFNHSFDA

SEQ ID NO: 2051851 - protein, 24 aa, Staphylococcus
ILDKFKSLTFISGTLTFNRSFESF

SEQ ID NO: 2051852 - protein, 18 aa, Staphylococcus
ILDVLGLIHKVYSVFGFD

SEQ ID NO: 2051853 - protein, 18 aa, Staphylococcus
ILEKLRFSKMFFSSNGVK

SEQ ID NO: 2051854 - protein, 17 aa, Staphylococcus
ILEQLGLGANDIGTDQL

SEQ ID NO: 2051855 - protein, 23 aa, Staphylococcus
ILHPSEILSCILLEAPHLDNEAS

SEQ ID NO: 2051856 - protein, 19 aa, Staphylococcus
ILHRFKGRLGYKVMKYPLN

SEQ ID NO: 2051857 - protein, 22 aa, Staphylococcus
ILHVLKRFKAMLIQKNESVESM

SEQ ID NO: 2051858 - protein, 23 aa, Staphylococcus
ILHVLKRFKAMLIQKNETVEAMQ

SEQ ID NO: 2051859 - protein, 22 aa, Staphylococcus
ILHVLKRFKAMLIQKNETVESM

SEQ ID NO: 2051860 - protein, 17 aa, Staphylococcus
ILICGDLFISDAQHLHI

SEQ ID NO: 2051861 - protein, 19 aa, Staphylococcus
ILIGGGMAYTFIKAQGHEI

SEQ ID NO: 2051862 - protein, 17 aa, Staphylococcus
ILIKLAFAFLEKQYEIA

SEQ ID NO: 2051863 - protein, 18 aa, Staphylococcus
ILILLTLWKEGSMTLKEM

SEQ ID NO: 2051864 - protein, 17 aa, Staphylococcus
ILILLTLWQKGSMTLKE

SEQ ID NO: 2051865 - protein, 18 aa, Staphylococcus
ILKGHDWFHITGITAGLN

SEQ ID NO: 2051866 - protein, 18 aa, Staphylococcus
ILKNGAKVIAHFAHMDPC

SEQ ID NO: 2051867 - protein, 18 aa, Staphylococcus
ILKPRLIPLLQMSNKEFK

SEQ ID NO: 2051868 - protein, 18 aa, Staphylococcus
ILKRDFIRAINCLNNNKK

SEQ ID NO: 2051869 - protein, 22 aa, Staphylococcus
ILLRGWGGGFFMNGPSEDAFYG

SEQ ID NO: 2051870 - protein, 17 aa, Staphylococcus
ILNDLGILKEGIFTHEI

SEQ ID NO: 2051871 - protein, 17 aa, Staphylococcus
ILNRYHIGGARYQGGNK

SEQ ID NO: 2051872 - protein, 19 aa, Staphylococcus
ILNVFSYTGAFSVIAAENA

SEQ ID NO: 2051873 - protein, 26 aa, Staphylococcus
ILPSKCAYDFLLFCFRNPKTCPLLDV

SEQ ID NO: 2051874 - protein, 17 aa, Staphylococcus
ILQHQLWQLVSEREQEQ

SEQ ID NO: 2051875 - protein, 21 aa, Staphylococcus
ILRAPEFFRHLKVIPHAQEVV

SEQ ID NO: 2051876 - protein, 21 aa, Staphylococcus
ILRGLRFEAQLGFTIDTTTFL

SEQ ID NO: 2051877 - protein, 23 aa, Staphylococcus
ILRKETVCNILFRNAIIKAHDIK

SEQ ID NO: 2051878 - protein, 18 aa, Staphylococcus
ILYCGTFDRGLWKSVDKG

SEQ ID NO: 2051879 - protein, 17 aa, Staphylococcus
ILYKMYKERGFEIKPEI

SEQ ID NO: 2051880 - protein, 17 aa, Staphylococcus
ILYMPVDVFEFLQEYFA

SEQ ID NO: 2051881 - protein, 17 aa, Staphylococcus
IMCEADWIIDVGPGPGL

SEQ ID NO: 2051882 - protein, 17 aa, Staphylococcus
IMGMRFNLVCPKELNPT

SEQ ID NO: 2051883 - protein, 17 aa, Staphylococcus
IMGRYVLTPEIFDYLET

SEQ ID NO: 2051884 - protein, 21 aa, Staphylococcus
IMKKECPDMVLVHGDTTTTFS

SEQ ID NO: 2051885 - protein, 19 aa, Staphylococcus
IMREKRVDTIFVVNNHHKL

SEQ ID NO: 2051886 - protein, 17 aa, Staphylococcus
IMRKRLDKLGAYLEEKV

SEQ ID NO: 2051887 - protein, 24 aa, Staphylococcus
IMSELKINLLEFRKEMDLLEGTGL

SEQ ID NO: 2051888 - protein, 21 aa, Staphylococcus
INAFKGVSFGEGFKAAEKPGS

SEQ ID NO: 2051889 - protein, 24 aa, Staphylococcus
INAFKGVSFGEGFKAAEKPGSQIQ

SEQ ID NO: 2051890 - protein, 21 aa, Staphylococcus
INANLEWLPNLFVSGGLADLE

SEQ ID NO: 2051891 - protein, 19 aa, Staphylococcus
INAPSWLHHLLRIYQLAPR

SEQ ID NO: 2051892 - protein, 22 aa, Staphylococcus
INDEIPKIYAIRGPSGIGKTTI

SEQ ID NO: 2051893 - protein, 23 aa, Staphylococcus
INDEPGFLWKIWTENESEQEAGG

SEQ ID NO: 2051894 - protein, 23 aa, Staphylococcus
INDLLNYCWQRIASDMVVDNYDS

SEQ ID NO: 2051895 - protein, 22 aa, Staphylococcus
INDLRIGESLFRGVNTVDQQPI

SEQ ID NO: 2051896 - protein, 22 aa, Staphylococcus
INELRIGEALFRGIDTTTNQSI

SEQ ID NO: 2051897 - protein, 19 aa, Staphylococcus
INEVGIPIVFVINQIDKHN

SEQ ID NO: 2051898 - protein, 22 aa, Staphylococcus
INFPSSKFKNGFTLQDTPGVDS

SEQ ID NO: 2051899 - protein, 18 aa, Staphylococcus
INHALGLPMVGHRSPDFE

SEQ ID NO: 2051900 - protein, 17 aa, Staphylococcus
INHLQMFVSKNFDKSTE

SEQ ID NO: 2051901 - protein, 23 aa, Staphylococcus
INIKGLELKAGDTIKFDGIHTFR

SEQ ID NO: 2051902 - protein, 20 aa, Staphylococcus
INKGYCLLVGVGKSSTEADI

SEQ ID NO: 2051903 - protein, 25 aa, Staphylococcus
INKPELQDMLGYFIKYVGSSSYDAP

SEQ ID NO: 2051904 - protein, 17 aa, Staphylococcus
INKPLTFEVRGEAYMPK

SEQ ID NO: 2051905 - protein, 21 aa, Staphylococcus
INKRVDIMLGHGLFNEVKNLV

SEQ ID NO: 2051906 - protein, 23 aa, Staphylococcus
INLMKWIGANSFRTAHYPYSEEM

SEQ ID NO: 2051907 - protein, 23 aa, Staphylococcus
INLMKWIGANSFRTSHYPYSEEM

SEQ ID NO: 2051908 - protein, 22 aa, Staphylococcus
INLPLEWLKGKIIVDSLGLHSN

SEQ ID NO: 2051909 - protein, 23 aa, Staphylococcus
INLRLKGYIAIVVQHEIDHLDGI

SEQ ID NO: 2051910 - protein, 17 aa, Staphylococcus
INLRPLLTLAEAYYDGN

SEQ ID NO: 2051911 - protein, 17 aa, Staphylococcus
INLSLRAKYLFDYNLDY

SEQ ID NO: 2051912 - protein, 24 aa, Staphylococcus
INLSLRAKYLFKDNLDYFIYNGEV

SEQ ID NO: 2051913 - protein, 18 aa, Staphylococcus
INMEYCWLVKENNLEDSK

SEQ ID NO: 2051914 - protein, 20 aa, Staphylococcus
INNGRFSPVVFKIASENDID

SEQ ID NO: 2051915 - protein, 22 aa, Staphylococcus
INQLKEIITFVIVNRDTSHQIV

SEQ ID NO: 2051916 - protein, 18 aa, Staphylococcus
INSALKILNKFEVETIFD

SEQ ID NO: 2051917 - protein, 17 aa, Staphylococcus
INYLISMFLPENSPASQ

SEQ ID NO: 2051918 - protein, 19 aa, Staphylococcus
IPASWKLVAQMPFGDIREK

SEQ ID NO: 2051919 - protein, 18 aa, Staphylococcus
IPDEFVVGYGLDYAEHYR

SEQ ID NO: 2051920 - protein, 19 aa, Staphylococcus
IPDEFVVGYGLDYGEHYRN

SEQ ID NO: 2051921 - protein, 19 aa, Staphylococcus
IPDEFVVGYGLDYGELYRN

SEQ ID NO: 2051922 - protein, 22 aa, Staphylococcus
IPDLRSNWILSRDDVESYEGRR

SEQ ID NO: 2051923 - protein, 20 aa, Staphylococcus
IPEELGVLIELFSQKNNISK

SEQ ID NO: 2051924 - protein, 20 aa, Staphylococcus
IPEFKDFTLIGGNGSIISQN

SEQ ID NO: 2051925 - protein, 23 aa, Staphylococcus
IPELQGRFPIRVELDSLSVDDFV

SEQ ID NO: 2051926 - protein, 23 aa, Staphylococcus
IPELQGRFPIRVELDSLSVEDFV

SEQ ID NO: 2051927 - protein, 23 aa, Staphylococcus
IPELQGRFPIRVELESLSVDDFV

SEQ ID NO: 2051928 - protein, 23 aa, Staphylococcus
IPELQGRFPIRVELESLTVDDFY

SEQ ID NO: 2051929 - protein, 24 aa, Staphylococcus
IPESRGIVKWQAFKTLPEQYEQLE

SEQ ID NO: 2051930 - protein, 21 aa, Staphylococcus
IPETRKSTILNQKRVGDPVHL

SEQ ID NO: 2051931 - protein, 20 aa, Staphylococcus
IPETRKSTILSDKKVGDAVH

SEQ ID NO: 2051932 - protein, 21 aa, Staphylococcus
IPETRRSTILSSKKVGDNVHL

SEQ ID NO: 2051933 - protein, 21 aa, Staphylococcus
IPETRRSTILSSKQNGDQVHL

SEQ ID NO: 2051934 - protein, 27 aa, Staphylococcus
IPEVPFIVGLLPDFLGKAAFGQSAVEY

SEQ ID NO: 2051935 - protein, 17 aa, Staphylococcus
IPFEINGLLGLETGHIN

SEQ ID NO: 2051936 - protein, 17 aa, Staphylococcus
IPFERAAVFGCAVITGI

SEQ ID NO: 2051937 - protein, 20 aa, Staphylococcus
IPFTGRMWLSIDGFSEDEQA

SEQ ID NO: 2051938 - protein, 17 aa, Staphylococcus
IPFTSIRNGFYAESGAE

SEQ ID NO: 2051939 - protein, 23 aa, Staphylococcus
IPGADLPSVIGWRTIKDTEQMMT

SEQ ID NO: 2051940 - protein, 18 aa, Staphylococcus
IPGAISFAPFNLVLRFGL

SEQ ID NO: 2051941 - protein, 21 aa, Staphylococcus
IPGELIMKILAFDSDLGKIDL

SEQ ID NO: 2051942 - protein, 20 aa, Staphylococcus
IPGELIMKVLAFNPDLEKIE

SEQ ID NO: 2051943 - protein, 20 aa, Staphylococcus
IPGELIMKVLAFNPDLGKMD

SEQ ID NO: 2051944 - protein, 23 aa, Staphylococcus
IPGSDLPSVIGWRTIDDTKRMME

SEQ ID NO: 2051945 - protein, 23 aa, Staphylococcus
IPGSDLPSVIGWRTIEDTERMIE

SEQ ID NO: 2051946 - protein, 23 aa, Staphylococcus
IPGSELPSVIGWRTIEDTERMIE

SEQ ID NO: 2051947 - protein, 22 aa, Staphylococcus
IPHGHAIMIGMIYQFIVANHLL

SEQ ID NO: 2051948 - protein, 17 aa, Staphylococcus
IPHSIGVNVDRMVKQSE

SEQ ID NO: 2051949 - protein, 18 aa, Staphylococcus
IPIKALTAYEGFGSYELR

SEQ ID NO: 2051950 - protein, 20 aa, Staphylococcus
IPIYLGMPMGVIIEAEGKTI

SEQ ID NO: 2051951 - protein, 18 aa, Staphylococcus
IPIYLGRTLSNVKGTWIM

SEQ ID NO: 2051952 - protein, 23 aa, Staphylococcus
IPKGRGMVKWQAFKTVPEQYEIL

SEQ ID NO: 2051953 - protein, 17 aa, Staphylococcus
IPKHEITVFTGRSGSGK

SEQ ID NO: 2051954 - protein, 18 aa, Staphylococcus
IPKIIGLVDALRFNNRMK

SEQ ID NO: 2051955 - protein, 24 aa, Staphylococcus
IPKTWKLVAQMPFGNVREQAGEKD

SEQ ID NO: 2051956 - protein, 17 aa, Staphylococcus
IPLILVFEGMDAAGKGG

SEQ ID NO: 2051957 - protein, 23 aa, Staphylococcus
IPLKWLQKYSYHLAIVFKDANAS

SEQ ID NO: 2051958 - protein, 23 aa, Staphylococcus
IPLQVCNVMEDFYIPKLITGGAT

SEQ ID NO: 2051959 - protein, 18 aa, Staphylococcus
IPLYLGRTLSNVKGTWIM

SEQ ID NO: 2051960 - protein, 19 aa, Staphylococcus
IPLYLGRTLSNVKGTWIMS

SEQ ID NO: 2051961 - protein, 19 aa, Staphylococcus
IPMAIKYYKIFKEMKEEGL

SEQ ID NO: 2051962 - protein, 19 aa, Staphylococcus
IPMAIKYYKIFKQLKDAGQ

SEQ ID NO: 2051963 - protein, 20 aa, Staphylococcus
IPMAIQYYRVFQKLKEQGVH

SEQ ID NO: 2051964 - protein, 17 aa, Staphylococcus
IPMSLGFTYSSNTLMMH

SEQ ID NO: 2051965 - protein, 17 aa, Staphylococcus
IPMTFHFSKDEQIIINQ

SEQ ID NO: 2051966 - protein, 17 aa, Staphylococcus
IPMTFHFSKDEQMIINQ

SEQ ID NO: 2051967 - protein, 17 aa, Staphylococcus
IPNCDKITPGMLLAAVR

SEQ ID NO: 2051968 - protein, 25 aa, Staphylococcus
IPQGRGMIKWAPFAVMPEQYERINA

SEQ ID NO: 2051969 - protein, 24 aa, Staphylococcus
IPQGRGMVKWAPFATLPEQFESIQ

SEQ ID NO: 2051970 - protein, 21 aa, Staphylococcus
IPQIILKWHVQNGVVPIPKST

SEQ ID NO: 2051971 - protein, 20 aa, Staphylococcus
IPSEEGFRFYVNQLLEDTSH

SEQ ID NO: 2051972 - protein, 17 aa, Staphylococcus
IPVCGAISSYNHPEEDI

SEQ ID NO: 2051973 - protein, 18 aa, Staphylococcus
IPVHMKIIYDEDSHKILG

SEQ ID NO: 2051974 - protein, 18 aa, Staphylococcus
IPVKALTAVEGFGNYEVR

SEQ ID NO: 2051975 - protein, 17 aa, Staphylococcus
IPVMIVFEGVPASGKTR

SEQ ID NO: 2051976 - protein, 20 aa, Staphylococcus
IPVVAGFGIRTKEHIKDLAT

SEQ ID NO: 2051977 - protein, 19 aa, Staphylococcus
IPYRAKRHYSIVSGEKERL

SEQ ID NO: 2051978 - protein, 22 aa, Staphylococcus
IQASETFWTWLADQQMNSTNYF

SEQ ID NO: 2051979 - protein, 17 aa, Staphylococcus
IQASPDFGRIVNQTHFD

SEQ ID NO: 2051980 - protein, 18 aa, Staphylococcus
IQEGVAFAKRYGAKIYVT

SEQ ID NO: 2051981 - protein, 18 aa, Staphylococcus
IQFQYGLVLCHLEMFEAA

SEQ ID NO: 2051982 - protein, 18 aa, Staphylococcus
IQFQYGLVLCQLEMFEQA

SEQ ID NO: 2051983 - protein, 17 aa, Staphylococcus
IQFSIGHTVATFDEVND

SEQ ID NO: 2051984 - protein, 17 aa, Staphylococcus
IQLDLGYTVEELIDVVR

SEQ ID NO: 2051985 - protein, 18 aa, Staphylococcus
IQLPMNWTLDQMVEYYFN

SEQ ID NO: 2051986 - protein, 22 aa, Staphylococcus
IQPDHFYFLPSYMSPLKDHKQH

SEQ ID NO: 2051987 - protein, 18 aa, Staphylococcus
IQPVFSLGDFDSVNEQER

SEQ ID NO: 2051988 - protein, 18 aa, Staphylococcus
IQRANIKLGDFVVLSGAG

SEQ ID NO: 2051989 - protein, 21 aa, Staphylococcus
IQRIEHMLRYALIIEDNGDNN

SEQ ID NO: 2051990 - protein, 18 aa, Staphylococcus
IQSADEWGIHTSNLTIDA

SEQ ID NO: 2051991 - protein, 23 aa, Staphylococcus
IQSHAVEGFILLYSKENDEIANL

SEQ ID NO: 2051992 - protein, 17 aa, Staphylococcus
IQSSPDFGRIVNQKHFN

SEQ ID NO: 2051993 - protein, 17 aa, Staphylococcus
IQYPNCYYFSTVVKKNQ

SEQ ID NO: 2051994 - protein, 17 aa, Staphylococcus
IRAAGGVARMANPKIVE

SEQ ID NO: 2051995 - protein, 20 aa, Staphylococcus
IRAGKEVVHRIFAEAYDRLR

SEQ ID NO: 2051996 - protein, 21 aa, Staphylococcus
IRANAYLVIMVVVFTSGHVEH

SEQ ID NO: 2051997 - protein, 19 aa, Staphylococcus
IRFECKLDRLIELGDDESG

SEQ ID NO: 2051998 - protein, 21 aa, Staphylococcus
IRFGIDEHVDFIAASFVRRPS

SEQ ID NO: 2051999 - protein, 18 aa, Staphylococcus
IRFIDKWYFPVQPFQKFI

SEQ ID NO: 2052000 - protein, 17 aa, Staphylococcus
IRFSYAYVDAEDIDETL

SEQ ID NO: 2052001 - protein, 17 aa, Staphylococcus
IRGGDKMAIIGSNGTGK

SEQ ID NO: 2052002 - protein, 20 aa, Staphylococcus
IRHGIRFTIDLEVYKEFIAG

SEQ ID NO: 2052003 - protein, 21 aa, Staphylococcus
IRHLGVKASRVLAEKYETMDR

SEQ ID NO: 2052004 - protein, 17 aa, Staphylococcus
IRIKEFVKDVAKYDEVY

SEQ ID NO: 2052005 - protein, 18 aa, Staphylococcus
IRKKHKWSKRFLRKLDYL

SEQ ID NO: 2052006 - protein, 20 aa, Staphylococcus
IRLAYNYQISCVHIPRNGEE

SEQ ID NO: 2052007 - protein, 17 aa, Staphylococcus
IRLEKTFEYIDTPHKFK

SEQ ID NO: 2052008 - protein, 17 aa, Staphylococcus
IRLEPMSTFPIIRDLQV

SEQ ID NO: 2052009 - protein, 19 aa, Staphylococcus
IRLNNCDWIDGGMVSPTNA

SEQ ID NO: 2052010 - protein, 17 aa, Staphylococcus
IRLSPTIEEHDFQTKLK

SEQ ID NO: 2052011 - protein, 18 aa, Staphylococcus
IRLSRFFVDILRRSENGR

SEQ ID NO: 2052012 - protein, 17 aa, Staphylococcus
IRMGTVWINDFHPYFAQ

SEQ ID NO: 2052013 - protein, 18 aa, Staphylococcus
IRMNYLFDFYQALLTKKQ

SEQ ID NO: 2052014 - protein, 18 aa, Staphylococcus
IRMSLIFINEKIRLIEYT

SEQ ID NO: 2052015 - protein, 23 aa, Staphylococcus
IRNEMKILEGMGLIEKAHASSGR

SEQ ID NO: 2052016 - protein, 17 aa, Staphylococcus
IRNGWCYGDTGIMNTIW

SEQ ID NO: 2052017 - protein, 19 aa, Staphylococcus
IRPGIVHRIDMDTSGLLMV

SEQ ID NO: 2052018 - protein, 17 aa, Staphylococcus
IRPGVVVTYDRNFVSNQ

SEQ ID NO: 2052019 - protein, 17 aa, Staphylococcus
IRPGVVVTYDRNYVSNQ

SEQ ID NO: 2052020 - protein, 21 aa, Staphylococcus
IRPKLMMKFRMLGIDHQELED

SEQ ID NO: 2052021 - protein, 20 aa, Staphylococcus
IRPVLKMVDYVLVMTVNPGF

SEQ ID NO: 2052022 - protein, 17 aa, Staphylococcus
IRQGLKPVLFVINNDGY

SEQ ID NO: 2052023 - protein, 20 aa, Staphylococcus
IRSIEMFKYLFTLPTEGENS

SEQ ID NO: 2052024 - protein, 25 aa, Staphylococcus
IRSNCGIGFKGFWDRENGFNYAFFE

SEQ ID NO: 2052025 - protein, 19 aa, Staphylococcus
IRSNCGIGFKGFYNETDGF

SEQ ID NO: 2052026 - protein, 17 aa, Staphylococcus
IRTILARMHFFRDDVYK

SEQ ID NO: 2052027 - protein, 22 aa, Staphylococcus
IRTLLLTFFYRFMRPLIEAGYV

SEQ ID NO: 2052028 - protein, 22 aa, Staphylococcus
IRTLLLTFFYRFMRPLLEAGYV

SEQ ID NO: 2052029 - protein, 21 aa, Staphylococcus
IRTSHLYKAYDIWARDNHQYR

SEQ ID NO: 2052030 - protein, 18 aa, Staphylococcus
IRVGFLYNPNRVQFDSKI

SEQ ID NO: 2052031 - protein, 17 aa, Staphylococcus
IRVKEFVRDVAKYDHVY

SEQ ID NO: 2052032 - protein, 17 aa, Staphylococcus
IRYLFLYDKFEKYDFSR

SEQ ID NO: 2052033 - protein, 17 aa, Staphylococcus
ISAGFFFINPFEVVYYA

SEQ ID NO: 2052034 - protein, 18 aa, Staphylococcus
ISAGFFFINPFEVVYYAG

SEQ ID NO: 2052035 - protein, 17 aa, Staphylococcus
ISAGFFIINPFEVVYYA

SEQ ID NO: 2052036 - protein, 19 aa, Staphylococcus
ISALLFKPLYYFKDKHTTL

SEQ ID NO: 2052037 - protein, 17 aa, Staphylococcus
ISASEYRTCFSVHQTNT

SEQ ID NO: 2052038 - protein, 17 aa, Staphylococcus
ISEAAYLLWLLSPDDLG

SEQ ID NO: 2052039 - protein, 19 aa, Staphylococcus
ISEGAICYTGDILDTSRSN

SEQ ID NO: 2052040 - protein, 19 aa, Staphylococcus
ISEGAICYTGDILNPERSN

SEQ ID NO: 2052041 - protein, 19 aa, Staphylococcus
ISEGAICYTGDILNVERSN

SEQ ID NO: 2052042 - protein, 17 aa, Staphylococcus
ISFELWIAILLTVEQTN

SEQ ID NO: 2052043 - protein, 17 aa, Staphylococcus
ISFGLAYQIQRLVELVN

SEQ ID NO: 2052044 - protein, 21 aa, Staphylococcus
ISFLKELLLDESFYIKVHIYD

SEQ ID NO: 2052045 - protein, 21 aa, Staphylococcus
ISGFLKGEWPDINVLMSILSN

SEQ ID NO: 2052046 - protein, 19 aa, Staphylococcus
ISKELGIGMGTLYRHFKDK

SEQ ID NO: 2052047 - protein, 19 aa, Staphylococcus
ISKKDARRMDRFTQYAVVA

SEQ ID NO: 2052048 - protein, 19 aa, Staphylococcus
ISKRAELFINEFSDVSESD

SEQ ID NO: 2052049 - protein, 23 aa, Staphylococcus
ISKSELLENVWGYDYYEDANTVN

SEQ ID NO: 2052050 - protein, 23 aa, Staphylococcus
ISLFAGKMSIIFECHIYTHRQVY

SEQ ID NO: 2052051 - protein, 17 aa, Staphylococcus
ISLHYTRQMVNQAISGK

SEQ ID NO: 2052052 - protein, 17 aa, Staphylococcus
ISLHYTRQMVNQAITGQ

SEQ ID NO: 2052053 - protein, 18 aa, Staphylococcus
ISLHYTRYMVDQAISGKL

SEQ ID NO: 2052054 - protein, 23 aa, Staphylococcus
ISLKGKEIYIRKFAIEKLPKILN

SEQ ID NO: 2052055 - protein, 17 aa, Staphylococcus
ISLNYTRQMVNQAITGK

SEQ ID NO: 2052056 - protein, 17 aa, Staphylococcus
ISMMFGISIEDADKAVL

SEQ ID NO: 2052057 - protein, 22 aa, Staphylococcus
ISPKGIHKWAALKMLGIDKGDY

SEQ ID NO: 2052058 - protein, 23 aa, Staphylococcus
ISPNEFKFGLSFLTRSVALSRFP

SEQ ID NO: 2052059 - protein, 18 aa, Staphylococcus
ISPTHFVKSWLLDERAPK

SEQ ID NO: 2052060 - protein, 17 aa, Staphylococcus
ISQGYSGLEIDVFDAHS

SEQ ID NO: 2052061 - protein, 17 aa, Staphylococcus
ISQGYSGLEIDVFDLYS

SEQ ID NO: 2052062 - protein, 19 aa, Staphylococcus
ISQLWRKTQLQHMFLKQIM

SEQ ID NO: 2052063 - protein, 17 aa, Staphylococcus
ISQRSNYEFNRLQYQII

SEQ ID NO: 2052064 - protein, 23 aa, Staphylococcus
ISSCVKGKFGWDYVDSDERLTKP

SEQ ID NO: 2052065 - protein, 25 aa, Staphylococcus
ISSELEWLPQLFVSGGLADLELGPF

SEQ ID NO: 2052066 - protein, 24 aa, Staphylococcus
ISTGARWRKLEVPGEEALINKGVA

SEQ ID NO: 2052067 - protein, 18 aa, Staphylococcus
ISTTRFKKFLTQAFGNAS

SEQ ID NO: 2052068 - protein, 18 aa, Staphylococcus
ISTWSFQTEMFFLCNRYK

SEQ ID NO: 2052069 - protein, 20 aa, Staphylococcus
ISVKDGGLFKRGFNQQLDEY

SEQ ID NO: 2052070 - protein, 21 aa, Staphylococcus
ISWRVARGFVVGKKLKKKPTL

SEQ ID NO: 2052071 - protein, 18 aa, Staphylococcus
ITCKNCGYTEFYKQDRNR

SEQ ID NO: 2052072 - protein, 21 aa, Staphylococcus
ITERHARALLSLTFEQQEEMV

SEQ ID NO: 2052073 - protein, 24 aa, Staphylococcus
ITGEDYFRLGIPFSTRNNSEDFKK

SEQ ID NO: 2052074 - protein, 18 aa, Staphylococcus
ITHGEIDAVIAFHTLTKE

SEQ ID NO: 2052075 - protein, 17 aa, Staphylococcus
ITHLSFYVGWPKAWSAF

SEQ ID NO: 2052076 - protein, 17 aa, Staphylococcus
ITHRGRVPIIVGGTGLY

SEQ ID NO: 2052077 - protein, 22 aa, Staphylococcus
ITICGMGGPLIASIIEKGKSKL

SEQ ID NO: 2052078 - protein, 17 aa, Staphylococcus
ITIKGVKDIAGYSRNKV

SEQ ID NO: 2052079 - protein, 23 aa, Staphylococcus
ITINRAGSMIGYFLNEGPVTNFE

SEQ ID NO: 2052080 - protein, 17 aa, Staphylococcus
ITKRLGLDKGYQFNEPL

SEQ ID NO: 2052081 - protein, 22 aa, Staphylococcus
ITKTGFGPFAFDEWRYLSDGTD

SEQ ID NO: 2052082 - protein, 20 aa, Staphylococcus
ITLEVMPFKQLVEITNIEKI

SEQ ID NO: 2052083 - protein, 21 aa, Staphylococcus
ITLGLKPGGLFIYDGDEPLLE

SEQ ID NO: 2052084 - protein, 19 aa, Staphylococcus
ITLKAAFEIGERINSVSQQ

SEQ ID NO: 2052085 - protein, 17 aa, Staphylococcus
ITLREGDEVVGLDVAHA

SEQ ID NO: 2052086 - protein, 17 aa, Staphylococcus
ITPKLPDFSNWQQYQFT

SEQ ID NO: 2052087 - protein, 20 aa, Staphylococcus
ITRRCINQVILLFSLSNHLD

SEQ ID NO: 2052088 - protein, 26 aa, Staphylococcus
ITRTEFEIIKLLSLNSNFYFSKDQIY

SEQ ID NO: 2052089 - protein, 22 aa, Staphylococcus
ITSLKIALSLSELVQNKQTIYQ

SEQ ID NO: 2052090 - protein, 24 aa, Staphylococcus
ITVNRAGSMIGYFLNAGPVTNFEQ

SEQ ID NO: 2052091 - protein, 24 aa, Staphylococcus
ITVNRAGSMIGYFLNDGPVTNFEQ

SEQ ID NO: 2052092 - protein, 24 aa, Staphylococcus
ITVNRAGSMIGYFLNEGPVTNFDE

SEQ ID NO: 2052093 - protein, 24 aa, Staphylococcus
ITVNRAGSMIGYFLNEGPVTNFEQ

SEQ ID NO: 2052094 - protein, 24 aa, Staphylococcus
ITVNRAGSMIGYFLNKGPVTNFEE

SEQ ID NO: 2052095 - protein, 19 aa, Staphylococcus
ITVPVAIHLDHGSSFEKCK

SEQ ID NO: 2052096 - protein, 19 aa, Staphylococcus
IVAGRGELHLSILIENMRR

SEQ ID NO: 2052097 - protein, 17 aa, Staphylococcus
IVCAGASAVLFGSVNAI

SEQ ID NO: 2052098 - protein, 18 aa, Staphylococcus
IVCAGASAVLFGSVNAIM

SEQ ID NO: 2052099 - protein, 22 aa, Staphylococcus
IVCAGASAVLFGSVNAIMGLTS

SEQ ID NO: 2052100 - protein, 17 aa, Staphylococcus
IVDGLLLNPLVGETKAD

SEQ ID NO: 2052101 - protein, 23 aa, Staphylococcus
IVEKELIARIGFVIEPQFLFSNL

SEQ ID NO: 2052102 - protein, 24 aa, Staphylococcus
IVEKSLRGAAIWDELKDRLDTNAY

SEQ ID NO: 2052103 - protein, 21 aa, Staphylococcus
IVELRIPLVYFYMKDTQFFYH

SEQ ID NO: 2052104 - protein, 18 aa, Staphylococcus
IVEMKLTYVWINADKPEE

SEQ ID NO: 2052105 - protein, 23 aa, Staphylococcus
IVFVDRLGKIIAMNGAARDILSE

SEQ ID NO: 2052106 - protein, 18 aa, Staphylococcus
IVGIDCKMGLSFVELFPN

SEQ ID NO: 2052107 - protein, 18 aa, Staphylococcus
IVGSFAYYIKGFEMLPQM

SEQ ID NO: 2052108 - protein, 17 aa, Staphylococcus
IVKAEEGFVRYIIPEYI

SEQ ID NO: 2052109 - protein, 34 aa, Staphylococcus
IVKPSKDGYCIARFKMCAEDAVHLCFSCRKQIRI

SEQ ID NO: 2052110 - protein, 19 aa, Staphylococcus
IVKTRFGGYDGKGQILVEN

SEQ ID NO: 2052111 - protein, 18 aa, Staphylococcus
IVKTRFGGYDGKGQILVK

SEQ ID NO: 2052112 - protein, 19 aa, Staphylococcus
IVKTRFGGYDGKGQILVQS

SEQ ID NO: 2052113 - protein, 17 aa, Staphylococcus
IVKTRFGGYDGKGQVLV

SEQ ID NO: 2052114 - protein, 24 aa, Staphylococcus
IVLPRIKITYLYTRIEKLLQQYQL

SEQ ID NO: 2052115 - protein, 21 aa, Staphylococcus
IVNYWIKFGVDGFRFDVINLI

SEQ ID NO: 2052116 - protein, 22 aa, Staphylococcus
IVPYPPGIPVFWKGEKVTKNMI

SEQ ID NO: 2052117 - protein, 18 aa, Staphylococcus
IVSEHRGGYCYEQNRLFH

SEQ ID NO: 2052118 - protein, 19 aa, Staphylococcus
IVVSIPVFLADAVEVTPVE

SEQ ID NO: 2052119 - protein, 22 aa, Staphylococcus
IVYCRKCIQLGRMDHLTDYRII

SEQ ID NO: 2052120 - protein, 18 aa, Staphylococcus
IVYIRKGEFYRLYIEQQL

SEQ ID NO: 2052121 - protein, 19 aa, Staphylococcus
IWEEFGFPSQRTFLKRFKE

SEQ ID NO: 2052122 - protein, 19 aa, Staphylococcus
IWKKEIWQDGSAWQGHQRG

SEQ ID NO: 2052123 - protein, 17 aa, Staphylococcus
IWLDPGIGFAKTRDEEN

SEQ ID NO: 2052124 - protein, 19 aa, Staphylococcus
IYASMLWEGFQPFEIEKIE

SEQ ID NO: 2052125 - protein, 17 aa, Staphylococcus
IYAVCRMIDDSIDEYEN

SEQ ID NO: 2052126 - protein, 18 aa, Staphylococcus
IYEFLALRIPMLLIPLGL

SEQ ID NO: 2052127 - protein, 19 aa, Staphylococcus
IYEHFGVSWIEPSMREDGS

SEQ ID NO: 2052128 - protein, 18 aa, Staphylococcus
IYETFGWEAPRFAHMSLI

SEQ ID NO: 2052129 - protein, 19 aa, Staphylococcus
IYEVLKLAETIAMQDGDLK

SEQ ID NO: 2052130 - protein, 19 aa, Staphylococcus
IYFRLTPKGQQVYHTHQQL

SEQ ID NO: 2052131 - protein, 20 aa, Staphylococcus
IYGMRVAKDLVHISGDTSDY

SEQ ID NO: 2052132 - protein, 24 aa, Staphylococcus
IYHRHFKLRLSYFDKSYEQLIFKQ

SEQ ID NO: 2052133 - protein, 17 aa, Staphylococcus
IYKFRYLIIEAIKTVFG

SEQ ID NO: 2052134 - protein, 18 aa, Staphylococcus
IYKGVSWCKTKNKWRAYI

SEQ ID NO: 2052135 - protein, 17 aa, Staphylococcus
IYKLLSLLENDVDNMKL

SEQ ID NO: 2052136 - protein, 20 aa, Staphylococcus
IYKPYIEGFVKMLAPIAPHI

SEQ ID NO: 2052137 - protein, 17 aa, Staphylococcus
IYLEEARKPFPQEPLKQ

SEQ ID NO: 2052138 - protein, 18 aa, Staphylococcus
IYPSCRIAYIVLPPKLLE

SEQ ID NO: 2052139 - protein, 22 aa, Staphylococcus
IYRCPYCLGEVILRHGVKVIPH

SEQ ID NO: 2052140 - protein, 17 aa, Staphylococcus
IYRLAITDITTFRTQHK

SEQ ID NO: 2052141 - protein, 23 aa, Staphylococcus
IYRRWKDKASIIIDMFVTHTRDI

SEQ ID NO: 2052142 - protein, 19 aa, Staphylococcus
IYSQMAWDGFQPFKIEEIK

SEQ ID NO: 2052143 - protein, 18 aa, Staphylococcus
IYTSCSIETCESRDPKGL

SEQ ID NO: 2052144 - protein, 18 aa, Staphylococcus
IYYDRPKAGWIWNDNKVK

SEQ ID NO: 2052145 - protein, 24 aa, Staphylococcus
KAAARFGSGWAWLVVNNGKLEIVT

SEQ ID NO: 2052146 - protein, 24 aa, Staphylococcus
KAAARFGSGWAWLVVNNGNLEIVT

SEQ ID NO: 2052147 - protein, 22 aa, Staphylococcus
KAAEYFDRIILLNRTLRYFGPS

SEQ ID NO: 2052148 - protein, 24 aa, Staphylococcus
KAAGRFGSGWAWLVVNNGKLEIVT

SEQ ID NO: 2052149 - protein, 18 aa, Staphylococcus
KADWHVVIFDIGRGNTKE

SEQ ID NO: 2052150 - protein, 18 aa, Staphylococcus
KAEGYDYFGLLYIGAILT

SEQ ID NO: 2052151 - protein, 19 aa, Staphylococcus
KAFAPVREWGWSREEEIDY

SEQ ID NO: 2052152 - protein, 20 aa, Staphylococcus
KAGEIVGLIGLNGAGKSTTI

SEQ ID NO: 2052153 - protein, 23 aa, Staphylococcus
KAHDIRKANDWGIETQAMKVNFS

SEQ ID NO: 2052154 - protein, 17 aa, Staphylococcus
KAHGFEILGLIGDYAEV

SEQ ID NO: 2052155 - protein, 21 aa, Staphylococcus
KAIEQRTSFGLGEVILDALNK

SEQ ID NO: 2052156 - protein, 18 aa, Staphylococcus
KAIRRLGAMVAFEVVDPE

SEQ ID NO: 2052157 - protein, 18 aa, Staphylococcus
KAKDGASCVEYIGPNGAG

SEQ ID NO: 2052158 - protein, 19 aa, Staphylococcus
KAKGVSFVYISHRMAEIFE

SEQ ID NO: 2052159 - protein, 18 aa, Staphylococcus
KAKIPLVVRTVHGAGAGA

SEQ ID NO: 2052160 - protein, 18 aa, Staphylococcus
KAKKAIVVGGGYIGIEAA

SEQ ID NO: 2052161 - protein, 20 aa, Staphylococcus
KAKPGEISWESPFGQGRPGW

SEQ ID NO: 2052162 - protein, 17 aa, Staphylococcus
KALCEKLNISLSEVICF

SEQ ID NO: 2052163 - protein, 20 aa, Staphylococcus
KALDYWLNRFKIMENKDKKI

SEQ ID NO: 2052164 - protein, 20 aa, Staphylococcus
KALFAAAFVMHFSGNIPQLH

SEQ ID NO: 2052165 - protein, 19 aa, Staphylococcus
KALFAAAFVTHFSGQTPHI

SEQ ID NO: 2052166 - protein, 17 aa, Staphylococcus
KALHELFSWLHMYHYDY

SEQ ID NO: 2052167 - protein, 17 aa, Staphylococcus
KALHLPQGFNVRVDSLL

SEQ ID NO: 2052168 - protein, 20 aa, Staphylococcus
KALQAWDIDHIYGIPGDSID

SEQ ID NO: 2052169 - protein, 21 aa, Staphylococcus
KALRILKDFLKPEGIFCFQES

SEQ ID NO: 2052170 - protein, 24 aa, Staphylococcus
KALRIVWPDLIFPESEVAFIVLHF

SEQ ID NO: 2052171 - protein, 23 aa, Staphylococcus
KALSTDMPVFFSANMSYGVHALT

SEQ ID NO: 2052172 - protein, 20 aa, Staphylococcus
KALTAVEGFGNYEVRLPLVT

SEQ ID NO: 2052173 - protein, 20 aa, Staphylococcus
KALTAYEGFGSYELRLPLVP

SEQ ID NO: 2052174 - protein, 20 aa, Staphylococcus
KAMGAMALFGEKYGDVVRVV

SEQ ID NO: 2052175 - protein, 19 aa, Staphylococcus
KANELWKNHIGDLLTPPHD

SEQ ID NO: 2052176 - protein, 19 aa, Staphylococcus
KANELWKNQLGDLLTPPNN

SEQ ID NO: 2052177 - protein, 19 aa, Staphylococcus
KANELWKNQLGSLLTPPHD

SEQ ID NO: 2052178 - protein, 21 aa, Staphylococcus
KANERWLRLTINSLILQYQYP

SEQ ID NO: 2052179 - protein, 19 aa, Staphylococcus
KAPNLKIAITAGVGSDHVD

SEQ ID NO: 2052180 - protein, 19 aa, Staphylococcus
KAPNLKLAITAGVGSDHVD

SEQ ID NO: 2052181 - protein, 19 aa, Staphylococcus
KAPNLKLVITAGVGSDHVD

SEQ ID NO: 2052182 - protein, 17 aa, Staphylococcus
KAPRVIDFQAWLNGTPL

SEQ ID NO: 2052183 - protein, 20 aa, Staphylococcus
KARACGIHMLVATQRPSVNV

SEQ ID NO: 2052184 - protein, 22 aa, Staphylococcus
KARDSIKVYSWIGGDRPSDVAR

SEQ ID NO: 2052185 - protein, 17 aa, Staphylococcus
KAREVIKRQSLRQLIIN

SEQ ID NO: 2052186 - protein, 21 aa, Staphylococcus
KARGIRFAFCTGKQVERVEAV

SEQ ID NO: 2052187 - protein, 18 aa, Staphylococcus
KARIVLFIHSLGSKHAKK

SEQ ID NO: 2052188 - protein, 19 aa, Staphylococcus
KARKGYLWFHTKDIPGSHV

SEQ ID NO: 2052189 - protein, 21 aa, Staphylococcus
KARPYRLLRIGSFLLSKEGYK

SEQ ID NO: 2052190 - protein, 21 aa, Staphylococcus
KARPYRLLRIGTFLLTEDGYK

SEQ ID NO: 2052191 - protein, 17 aa, Staphylococcus
KARSFKVPFKAIGKAVI

SEQ ID NO: 2052192 - protein, 19 aa, Staphylococcus
KASEVPSAIFGTKKPRPLE

SEQ ID NO: 2052193 - protein, 18 aa, Staphylococcus
KASNRFTIVPSWETYTKE

SEQ ID NO: 2052194 - protein, 23 aa, Staphylococcus
KATDLRAAAALILAGLVAEGTTQ

SEQ ID NO: 2052195 - protein, 24 aa, Staphylococcus
KATDLRAGAALILAGLVAEGTTEV

SEQ ID NO: 2052196 - protein, 17 aa, Staphylococcus
KATLSFRTMALINKPYH

SEQ ID NO: 2052197 - protein, 17 aa, Staphylococcus
KAVARDVGRIMGFEEST

SEQ ID NO: 2052198 - protein, 17 aa, Staphylococcus
KAVNFGIVYGISDYGLS

SEQ ID NO: 2052199 - protein, 19 aa, Staphylococcus
KAVNFGIVYGISDYGLSQN

SEQ ID NO: 2052200 - protein, 19 aa, Staphylococcus
KAVNFGIVYGISDYGLSQS

SEQ ID NO: 2052201 - protein, 23 aa, Staphylococcus
KAYIKKWALDTCINHIARTISQT

SEQ ID NO: 2052202 - protein, 17 aa, Staphylococcus
KAYKAWRQWSHKDRAEL

SEQ ID NO: 2052203 - protein, 20 aa, Staphylococcus
KAYYRNRFSWVVSYDANDAI

SEQ ID NO: 2052204 - protein, 20 aa, Staphylococcus
KCALDYLFPHFINIPLTIVS

SEQ ID NO: 2052205 - protein, 20 aa, Staphylococcus
KCATLAWKALEKGTVEKEGN

SEQ ID NO: 2052206 - protein, 20 aa, Staphylococcus
KCATLAWKALEKGTVEREGK

SEQ ID NO: 2052207 - protein, 17 aa, Staphylococcus
KCIPCKEGRPALCENGA

SEQ ID NO: 2052208 - protein, 17 aa, Staphylococcus
KCIRRIMRILGLQAQIR

SEQ ID NO: 2052209 - protein, 19 aa, Staphylococcus
KCWMLHQMSSFLELREEAI

SEQ ID NO: 2052210 - protein, 18 aa, Staphylococcus
KDAFKLYDTYGFPVELTE

SEQ ID NO: 2052211 - protein, 18 aa, Staphylococcus
KDAVWDLKKVFAEFGEGD

SEQ ID NO: 2052212 - protein, 20 aa, Staphylococcus
KDDALRLAHEDLYETKSILE

SEQ ID NO: 2052213 - protein, 23 aa, Staphylococcus
KDDLILRPLILITILNESLGMQS

SEQ ID NO: 2052214 - protein, 17 aa, Staphylococcus
KDDSCMDLSGGNQQKVV

SEQ ID NO: 2052215 - protein, 17 aa, Staphylococcus
KDFCKNFLSEVKVAVIK

SEQ ID NO: 2052216 - protein, 17 aa, Staphylococcus
KDFKALIKFNIRKPNPL

SEQ ID NO: 2052217 - protein, 19 aa, Staphylococcus
KDFNGISFLNLVDFDALYG

SEQ ID NO: 2052218 - protein, 20 aa, Staphylococcus
KDFNGLSFLNLVDFDALYGH

SEQ ID NO: 2052219 - protein, 17 aa, Staphylococcus
KDGHWWVRFKYVQPGSS

SEQ ID NO: 2052220 - protein, 20 aa, Staphylococcus
KDGLKKLGFDIGNSESPITP

SEQ ID NO: 2052221 - protein, 20 aa, Staphylococcus
KDGRQAIQFLKQRNLGRATF

SEQ ID NO: 2052222 - protein, 21 aa, Staphylococcus
KDGRQAIQFLKQRSLGRATFL

SEQ ID NO: 2052223 - protein, 17 aa, Staphylococcus
KDHFLRISIDKEGGVNL

SEQ ID NO: 2052224 - protein, 27 aa, Staphylococcus
KDIELLRIMGMPFGRKTIEKEQKLEID

SEQ ID NO: 2052225 - protein, 18 aa, Staphylococcus
KDIIEIFLDSGLGKEAFS

SEQ ID NO: 2052226 - protein, 18 aa, Staphylococcus
KDIIELFLDSGLGKEAFS

SEQ ID NO: 2052227 - protein, 19 aa, Staphylococcus
KDIRAVLGRFLFVQDDVKK

SEQ ID NO: 2052228 - protein, 19 aa, Staphylococcus
KDIRAVLGRFLFVQEDVKK

SEQ ID NO: 2052229 - protein, 23 aa, Staphylococcus
KDIYKTMAWDGFQAFVIKNIETV

SEQ ID NO: 2052230 - protein, 18 aa, Staphylococcus
KDIYQFGPRFGRGSEAIY

SEQ ID NO: 2052231 - protein, 22 aa, Staphylococcus
KDKFIWRGEVINSFDIYNNIDV

SEQ ID NO: 2052232 - protein, 23 aa, Staphylococcus
KDKFYEHHRWIAGHLDEEYYEEL

SEQ ID NO: 2052233 - protein, 17 aa, Staphylococcus
KDKIVLCDRYIDSSLAY

SEQ ID NO: 2052234 - protein, 18 aa, Staphylococcus
KDKRIILLTAHRRENIGE

SEQ ID NO: 2052235 - protein, 19 aa, Staphylococcus
KDLELKGRILVSTEGINGT

SEQ ID NO: 2052236 - protein, 20 aa, Staphylococcus
KDLELPLARILSKMEEIGIY

SEQ ID NO: 2052237 - protein, 19 aa, Staphylococcus
KDLFHDFEMHFYRYVFPYY

SEQ ID NO: 2052238 - protein, 20 aa, Staphylococcus
KDLFRDFEMHFYRYVFPYYD

SEQ ID NO: 2052239 - protein, 19 aa, Staphylococcus
KDLHLKWYGVPIISNMDLK

SEQ ID NO: 2052240 - protein, 21 aa, Staphylococcus
KDLKRTPSFSVNRPNEETGIT

SEQ ID NO: 2052241 - protein, 20 aa, Staphylococcus
KDLNLKWYAVPIISNMDLQI

SEQ ID NO: 2052242 - protein, 17 aa, Staphylococcus
KDLPLTIVIIGEQLDVN

SEQ ID NO: 2052243 - protein, 20 aa, Staphylococcus
KDLRNGVAIEVPTYDYSKHT

SEQ ID NO: 2052244 - protein, 18 aa, Staphylococcus
KDLRVSLITTKRAYEDLE

SEQ ID NO: 2052245 - protein, 18 aa, Staphylococcus
KDMMLRRAYVIFYETISN

SEQ ID NO: 2052246 - protein, 20 aa, Staphylococcus
KDMYRLLGIAKYEERFVVPT

SEQ ID NO: 2052247 - protein, 17 aa, Staphylococcus
KDNCCYMKEGSCWCVTA

SEQ ID NO: 2052248 - protein, 22 aa, Staphylococcus
KDNGVNEFLLWNAGNDYTEGVN

SEQ ID NO: 2052249 - protein, 17 aa, Staphylococcus
KDPHIWLDPVLNKKMVK

SEQ ID NO: 2052250 - protein, 23 aa, Staphylococcus
KDPIKLELLIAIMSFKQSSNISL

SEQ ID NO: 2052251 - protein, 23 aa, Staphylococcus
KDPKRPIGSFIFLGPTGVGKTEL

SEQ ID NO: 2052252 - protein, 24 aa, Staphylococcus
KDQKRVLPTIAFLDGEYGYRDICL

SEQ ID NO: 2052253 - protein, 19 aa, Staphylococcus
KDRARLVIYPAAMRYAGPR

SEQ ID NO: 2052254 - protein, 18 aa, Staphylococcus
KDSLKRLIMPSIEREIRS

SEQ ID NO: 2052255 - protein, 17 aa, Staphylococcus
KDTFDWLQPLLKRKFPH

SEQ ID NO: 2052256 - protein, 27 aa, Staphylococcus
KDTLLKNGWRYGQYYGYHGNSHIHIIG

SEQ ID NO: 2052257 - protein, 17 aa, Staphylococcus
KDVDLAIQFIKDIRPSS

SEQ ID NO: 2052258 - protein, 24 aa, Staphylococcus
KDVKSIFHVIDFLAIDKYPKANWE

SEQ ID NO: 2052259 - protein, 17 aa, Staphylococcus
KDWWELKKILKFDDKYD

SEQ ID NO: 2052260 - protein, 25 aa, Staphylococcus
KDYAYRLLMQLGFERDIMEKSPFQM

SEQ ID NO: 2052261 - protein, 18 aa, Staphylococcus
KEACMLRSLIKSHNLILK

SEQ ID NO: 2052262 - protein, 17 aa, Staphylococcus
KEALTWVNLPSEEILTR

SEQ ID NO: 2052263 - protein, 17 aa, Staphylococcus
KEARFIIELAARVYKSI

SEQ ID NO: 2052264 - protein, 17 aa, Staphylococcus
KEAVGFLKTIKDLIENP

SEQ ID NO: 2052265 - protein, 19 aa, Staphylococcus
KEEDVEWIVLAGYMRLIGA

SEQ ID NO: 2052266 - protein, 17 aa, Staphylococcus
KEEGVLFYSHYEDVQDR

SEQ ID NO: 2052267 - protein, 18 aa, Staphylococcus
KEEIDFFIAKGVVDRIAE

SEQ ID NO: 2052268 - protein, 18 aa, Staphylococcus
KEEIDFFIAKGVVDRVAE

SEQ ID NO: 2052269 - protein, 18 aa, Staphylococcus
KEEVVAFENLANVKITTK

SEQ ID NO: 2052270 - protein, 21 aa, Staphylococcus
KEFIAGGILRIIYAWLKEGQE

SEQ ID NO: 2052271 - protein, 20 aa, Staphylococcus
KEFLDKLGVEYDCPLETGAI

SEQ ID NO: 2052272 - protein, 17 aa, Staphylococcus
KEFTNLYALLIPKAPTM

SEQ ID NO: 2052273 - protein, 24 aa, Staphylococcus
KEGCAYVKEHAMFKCDDRFDVVIA

SEQ ID NO: 2052274 - protein, 22 aa, Staphylococcus
KEHESFNFFSLFTFHEPVEQVV

SEQ ID NO: 2052275 - protein, 17 aa, Staphylococcus
KEHLHGFFLEYDDERSG

SEQ ID NO: 2052276 - protein, 19 aa, Staphylococcus
KEHPEVVKQIAFHEPPINT

SEQ ID NO: 2052277 - protein, 24 aa, Staphylococcus
KEIEEIYPLFPLQEEMLYSSVGDY

SEQ ID NO: 2052278 - protein, 26 aa, Staphylococcus
KEIEFVCAFIFYAELSLEEWLNLSDE

SEQ ID NO: 2052279 - protein, 17 aa, Staphylococcus
KEIGYICALVRDKMQAA

SEQ ID NO: 2052280 - protein, 17 aa, Staphylococcus
KEIKDGILITVDAAQGK

SEQ ID NO: 2052281 - protein, 20 aa, Staphylococcus
KEINSLLGLETGHISIGLSA

SEQ ID NO: 2052282 - protein, 19 aa, Staphylococcus
KEIPFDELVLFSSARSAGQ

SEQ ID NO: 2052283 - protein, 20 aa, Staphylococcus
KEIPGTFYIVGCKPEQVTSP

SEQ ID NO: 2052284 - protein, 22 aa, Staphylococcus
KEIPRFPKKIAVLTASTGAAIR

SEQ ID NO: 2052285 - protein, 17 aa, Staphylococcus
KEIQFSIGHTVATFDEV

SEQ ID NO: 2052286 - protein, 17 aa, Staphylococcus
KEISRQVIVNGKDGKDG

SEQ ID NO: 2052287 - protein, 28 aa, Staphylococcus
KEITKRVAIEMASPLGWHKYVGTEGKVI

SEQ ID NO: 2052288 - protein, 17 aa, Staphylococcus
KEITVPVAIHLDHGSSF

SEQ ID NO: 2052289 - protein, 23 aa, Staphylococcus
KEKGRPIPTIAFYSPHTLPYIDD

SEQ ID NO: 2052290 - protein, 23 aa, Staphylococcus
KEKQRLRTLFPLIKEASENHKKR

SEQ ID NO: 2052291 - protein, 24 aa, Staphylococcus
KEKSDAVIVSAHWGNEGKTKPNET

SEQ ID NO: 2052292 - protein, 17 aa, Staphylococcus
KEKSILVAPGIPFGENG

SEQ ID NO: 2052293 - protein, 19 aa, Staphylococcus
KELEREGFHILAIKDMAGL

SEQ ID NO: 2052294 - protein, 21 aa, Staphylococcus
KELFKKLAHVEGFEKYLHKNF

SEQ ID NO: 2052295 - protein, 19 aa, Staphylococcus
KELIDLVGLNGRENAYPSE

SEQ ID NO: 2052296 - protein, 20 aa, Staphylococcus
KELIQRTAVVLNKRLPIVDL

SEQ ID NO: 2052297 - protein, 20 aa, Staphylococcus
KELLFRIQAVLRRYQINSQD

SEQ ID NO: 2052298 - protein, 20 aa, Staphylococcus
KELLNCFDYLIKHKKHSSRK

SEQ ID NO: 2052299 - protein, 25 aa, Staphylococcus
KELMDFLYIRHAFFIGQELGASIAA

SEQ ID NO: 2052300 - protein, 17 aa, Staphylococcus
KELPAIMKWCVEGYLEW

SEQ ID NO: 2052301 - protein, 21 aa, Staphylococcus
KELRDTLHFEMLWDTSKIDVI

SEQ ID NO: 2052302 - protein, 22 aa, Staphylococcus
KELRNSEGITWTFLSPAAEFDP

SEQ ID NO: 2052303 - protein, 17 aa, Staphylococcus
KELSVDCHFYRTSKKLF

SEQ ID NO: 2052304 - protein, 17 aa, Staphylococcus
KELVTFVVVNRGKAEQE

SEQ ID NO: 2052305 - protein, 20 aa, Staphylococcus
KENFKFIYLDFIQKENIQTL

SEQ ID NO: 2052306 - protein, 18 aa, Staphylococcus
KENVAVCFFGDGAANEGN

SEQ ID NO: 2052307 - protein, 22 aa, Staphylococcus
KEPDIVVGYLFKIIFNGPLRLM

SEQ ID NO: 2052308 - protein, 26 aa, Staphylococcus
KEPIHFQWKPGFVVGVMLASQGYPGT

SEQ ID NO: 2052309 - protein, 18 aa, Staphylococcus
KEQLCLRNNDLLCHVVRS

SEQ ID NO: 2052310 - protein, 20 aa, Staphylococcus
KEQLRLKTLFPYIKEASENH

SEQ ID NO: 2052311 - protein, 17 aa, Staphylococcus
KEQWFFPPRPHTHHVKW

SEQ ID NO: 2052312 - protein, 20 aa, Staphylococcus
KERAFDLLLELGFPRNVMSL

SEQ ID NO: 2052313 - protein, 18 aa, Staphylococcus
KERITQIILPEAQKISKN

SEQ ID NO: 2052314 - protein, 18 aa, Staphylococcus
KERLRLKTLFPYIREASE

SEQ ID NO: 2052315 - protein, 24 aa, Staphylococcus
KESDADVIQFNWRPIAGGDEKLMK

SEQ ID NO: 2052316 - protein, 18 aa, Staphylococcus
KESEAWSNIEAVRNDRVH

SEQ ID NO: 2052317 - protein, 20 aa, Staphylococcus
KESFEARPDQMLKFGLPRLV

SEQ ID NO: 2052318 - protein, 18 aa, Staphylococcus
KESLGFDQNTKWLSVLPI

SEQ ID NO: 2052319 - protein, 18 aa, Staphylococcus
KESLRLRTLFPYITEASE

SEQ ID NO: 2052320 - protein, 17 aa, Staphylococcus
KESRVALFMRKTRTGND

SEQ ID NO: 2052321 - protein, 20 aa, Staphylococcus
KETPFLKIDLNDMIAALPKQ

SEQ ID NO: 2052322 - protein, 21 aa, Staphylococcus
KEVIAGFDFTFGKFGKGNMTV

SEQ ID NO: 2052323 - protein, 20 aa, Staphylococcus
KEVKVSLAREFNPSQLDAQA

SEQ ID NO: 2052324 - protein, 20 aa, Staphylococcus
KEVTEALGINDLGNKYPSEI

SEQ ID NO: 2052325 - protein, 19 aa, Staphylococcus
KEVTEALGIQELGDKYPNE

SEQ ID NO: 2052326 - protein, 21 aa, Staphylococcus
KEYGETVVPVFWIAGEDHDFD

SEQ ID NO: 2052327 - protein, 17 aa, Staphylococcus
KEYRLGIGTPAMATGGM

SEQ ID NO: 2052328 - protein, 20 aa, Staphylococcus
KFAGGKGINVSRVLKTLDVS

SEQ ID NO: 2052329 - protein, 21 aa, Staphylococcus
KFDKAFLSCGAFDTSQIYEYD

SEQ ID NO: 2052330 - protein, 19 aa, Staphylococcus
KFDKERGRLVGTIEVPMTL

SEQ ID NO: 2052331 - protein, 24 aa, Staphylococcus
KFDVKRFDADFAYTMDGSQYGELQ

SEQ ID NO: 2052332 - protein, 23 aa, Staphylococcus
KFEGLIHRFRRSFLLNDNFEKKR

SEQ ID NO: 2052333 - protein, 24 aa, Staphylococcus
KFEGLIHRFRRSFLLNDNFEKKRF

SEQ ID NO: 2052334 - protein, 23 aa, Staphylococcus
KFEGLIHRFRRSFLLNDNFEKNK

SEQ ID NO: 2052335 - protein, 19 aa, Staphylococcus
KFEKVFAEHFMKLYDKTKN

SEQ ID NO: 2052336 - protein, 19 aa, Staphylococcus
KFEYKRITSGMFYFGLEIP

SEQ ID NO: 2052337 - protein, 22 aa, Staphylococcus
KFFKEGQVIWGFQHLASSKETV

SEQ ID NO: 2052338 - protein, 25 aa, Staphylococcus
KFFRPEFLNRFDGIVEFTHLDKDAL

SEQ ID NO: 2052339 - protein, 19 aa, Staphylococcus
KFGGYYIECHLLSKIQFIY

SEQ ID NO: 2052340 - protein, 20 aa, Staphylococcus
KFGLPRLVKYLNMDIEEAQR

SEQ ID NO: 2052341 - protein, 19 aa, Staphylococcus
KFGLRLPGEFNREMMKEAV

SEQ ID NO: 2052342 - protein, 18 aa, Staphylococcus
KFHKAEPISVDFYRESIG

SEQ ID NO: 2052343 - protein, 17 aa, Staphylococcus
KFHNKLTFSDEVIEKIA

SEQ ID NO: 2052344 - protein, 17 aa, Staphylococcus
KFKGFVIDYENPLESDT

SEQ ID NO: 2052345 - protein, 18 aa, Staphylococcus
KFKKMHVRMMPKQEPPYT

SEQ ID NO: 2052346 - protein, 18 aa, Staphylococcus
KFKQYGFKPVISKAQPLS

SEQ ID NO: 2052347 - protein, 22 aa, Staphylococcus
KFKTTMITFKFMAPLEYETITA

SEQ ID NO: 2052348 - protein, 18 aa, Staphylococcus
KFLLRYPTVYIINDKKEK

SEQ ID NO: 2052349 - protein, 19 aa, Staphylococcus
KFPEWIKIDFVYYLEEASF

SEQ ID NO: 2052350 - protein, 28 aa, Staphylococcus
KFRDEQRPRFGLLRGREFIMKDAYSFHA

SEQ ID NO: 2052351 - protein, 18 aa, Staphylococcus
KFSILESTSSWIAMVIQQ

SEQ ID NO: 2052352 - protein, 22 aa, Staphylococcus
KFTEGAFKQWGYDLAENEFGDK

SEQ ID NO: 2052353 - protein, 23 aa, Staphylococcus
KFTEGAFKQWGYDVAHNEFADKV

SEQ ID NO: 2052354 - protein, 23 aa, Staphylococcus
KFTEGAFKQWGYDVAHNEFGDKV

SEQ ID NO: 2052355 - protein, 23 aa, Staphylococcus
KFTEGSFKQWGYDLAHNEFADKV

SEQ ID NO: 2052356 - protein, 23 aa, Staphylococcus
KFTEGSFKQWGYDLAHNEFADQV

SEQ ID NO: 2052357 - protein, 23 aa, Staphylococcus
KFTEGSFKQWGYDLAHNEFGDRV

SEQ ID NO: 2052358 - protein, 23 aa, Staphylococcus
KFTEGSFKQWGYDLAHNEFSDKV

SEQ ID NO: 2052359 - protein, 17 aa, Staphylococcus
KFVDLVLKFIKDNEKEL

SEQ ID NO: 2052360 - protein, 20 aa, Staphylococcus
KGAHTVVWNGPMGVFEFENF

SEQ ID NO: 2052361 - protein, 26 aa, Staphylococcus
KGCAYAKAHAMFKCDNRFDVVIASNS

SEQ ID NO: 2052362 - protein, 20 aa, Staphylococcus
KGDKCKVSIRFRGRAITHKE

SEQ ID NO: 2052363 - protein, 20 aa, Staphylococcus
KGDLYAGDFNKMFYGVPYNM

SEQ ID NO: 2052364 - protein, 23 aa, Staphylococcus
KGEAKPGPIIAIFGDTKPCDNEY

SEQ ID NO: 2052365 - protein, 18 aa, Staphylococcus
KGEHKWADTRAMQKALNY

SEQ ID NO: 2052366 - protein, 23 aa, Staphylococcus
KGELDGHFPLVVWQTGSGTQSNM

SEQ ID NO: 2052367 - protein, 19 aa, Staphylococcus
KGENAFKVSAYRKAAQSLE

SEQ ID NO: 2052368 - protein, 18 aa, Staphylococcus
KGEWSLRQEIAHYLFNSR

SEQ ID NO: 2052369 - protein, 20 aa, Staphylococcus
KGFFCCSGISVAHGVTDFSF

SEQ ID NO: 2052370 - protein, 19 aa, Staphylococcus
KGGIYCWLKTPPGYESESF

SEQ ID NO: 2052371 - protein, 19 aa, Staphylococcus
KGGQTIGLFSYGSGSVGEF

SEQ ID NO: 2052372 - protein, 22 aa, Staphylococcus
KGHLKIGIPTIINIRRLIGLIS

SEQ ID NO: 2052373 - protein, 17 aa, Staphylococcus
KGIKCVMIAKLPFMNKY

SEQ ID NO: 2052374 - protein, 18 aa, Staphylococcus
KGIYKFRYNVLSALENVF

SEQ ID NO: 2052375 - protein, 17 aa, Staphylococcus
KGIYRFVLDEAKAAIEK

SEQ ID NO: 2052376 - protein, 23 aa, Staphylococcus
KGKLRIGAIHKRWSRLEMGQFIM

SEQ ID NO: 2052377 - protein, 19 aa, Staphylococcus
KGLEFPIVFIMGMEESIFP

SEQ ID NO: 2052378 - protein, 21 aa, Staphylococcus
KGLEPLAKWLLHKNLDKNVDE

SEQ ID NO: 2052379 - protein, 21 aa, Staphylococcus
KGLFKADIVLLGISRTSKTPL

SEQ ID NO: 2052380 - protein, 19 aa, Staphylococcus
KGLLCVYEGFLKAMKGEKV

SEQ ID NO: 2052381 - protein, 19 aa, Staphylococcus
KGLLCVYEGFLKGLKGEQV

SEQ ID NO: 2052382 - protein, 19 aa, Staphylococcus
KGLLCVYEGFLKGLTGQTI

SEQ ID NO: 2052383 - protein, 20 aa, Staphylococcus
KGLLKAAALLLKYDDMNDKE

SEQ ID NO: 2052384 - protein, 22 aa, Staphylococcus
KGLYRKRMLSYGGLLKQKHKIL

SEQ ID NO: 2052385 - protein, 23 aa, Staphylococcus
KGMKKRYATLMGIDENTPVVVGA

SEQ ID NO: 2052386 - protein, 21 aa, Staphylococcus
KGNMLKPWFVDSIKNPISKKT

SEQ ID NO: 2052387 - protein, 21 aa, Staphylococcus
KGNMLKPWFVNSIDNPVTKKN

SEQ ID NO: 2052388 - protein, 21 aa, Staphylococcus
KGNMLKPWFVQSIDNPISKKT

SEQ ID NO: 2052389 - protein, 17 aa, Staphylococcus
KGPEVERMLGLSKGSAI

SEQ ID NO: 2052390 - protein, 22 aa, Staphylococcus
KGPKRPNGWILHIPSVYLGIAQ

SEQ ID NO: 2052391 - protein, 18 aa, Staphylococcus
KGPNIKLPSFDLLEEPEP

SEQ ID NO: 2052392 - protein, 19 aa, Staphylococcus
KGPNIKLPSFDLLEEPEPH

SEQ ID NO: 2052393 - protein, 19 aa, Staphylococcus
KGPNLKLPSVELLDDPEIH

SEQ ID NO: 2052394 - protein, 21 aa, Staphylococcus
KGQQHLPGWGLDALKFLLEER

SEQ ID NO: 2052395 - protein, 20 aa, Staphylococcus
KGQTDIVGWGVVSSNHQYKN

SEQ ID NO: 2052396 - protein, 19 aa, Staphylococcus
KGQVTILYFYPRDNTPTCT

SEQ ID NO: 2052397 - protein, 19 aa, Staphylococcus
KGRLQRDLTNWFIDDQYKL

SEQ ID NO: 2052398 - protein, 17 aa, Staphylococcus
KGRSGYVANSFAMRLNQ

SEQ ID NO: 2052399 - protein, 21 aa, Staphylococcus
KGSELSQRFGVSRQIIVKDIS

SEQ ID NO: 2052400 - protein, 20 aa, Staphylococcus
KGTDIIFCLHPNMQPFIDYF

SEQ ID NO: 2052401 - protein, 17 aa, Staphylococcus
KGTMLAKLTDGFHLHTI

SEQ ID NO: 2052402 - protein, 17 aa, Staphylococcus
KHAIGLKADNGLELLVH

SEQ ID NO: 2052403 - protein, 21 aa, Staphylococcus
KHDFTGISFLNLVDFDALYGH

SEQ ID NO: 2052404 - protein, 18 aa, Staphylococcus
KHDNIWIDPGIGFAKSRA

SEQ ID NO: 2052405 - protein, 18 aa, Staphylococcus
KHDPGICILGHIINYMDD

SEQ ID NO: 2052406 - protein, 21 aa, Staphylococcus
KHEFLRYPYIESFEHVDEVIQ

SEQ ID NO: 2052407 - protein, 19 aa, Staphylococcus
KHEFLRYPYIESFENVDEV

SEQ ID NO: 2052408 - protein, 17 aa, Staphylococcus
KHEITVFTGRSGSGKSS

SEQ ID NO: 2052409 - protein, 20 aa, Staphylococcus
KHFRLGISVSKKLGNAVTRN

SEQ ID NO: 2052410 - protein, 18 aa, Staphylococcus
KHGFKFRELEYFKQMQHT

SEQ ID NO: 2052411 - protein, 20 aa, Staphylococcus
KHHLKICGGFQFSMHKSGDE

SEQ ID NO: 2052412 - protein, 20 aa, Staphylococcus
KHHLKVCGGFQFSSHKSDDE

SEQ ID NO: 2052413 - protein, 18 aa, Staphylococcus
KHHLKVIGGFQFSSHKSD

SEQ ID NO: 2052414 - protein, 18 aa, Staphylococcus
KHHLRLCGGFQFSKHKSD

SEQ ID NO: 2052415 - protein, 17 aa, Staphylococcus
KHIPFFNSFNMQRVHID

SEQ ID NO: 2052416 - protein, 22 aa, Staphylococcus
KHKIWLDPGIGFAKSRKEENEV

SEQ ID NO: 2052417 - protein, 20 aa, Staphylococcus
KHKIWLDPGIGFPKSRKEKN

SEQ ID NO: 2052418 - protein, 17 aa, Staphylococcus
KHLEGGFIENIRQIGND

SEQ ID NO: 2052419 - protein, 18 aa, Staphylococcus
KHLEGGIIKSIRQIGNDR

SEQ ID NO: 2052420 - protein, 19 aa, Staphylococcus
KHLEGGIVKSIRQIGNDRR

SEQ ID NO: 2052421 - protein, 17 aa, Staphylococcus
KHLKGERIVLRFGSVTH

SEQ ID NO: 2052422 - protein, 17 aa, Staphylococcus
KHPLKFVFIDLIQNENI

SEQ ID NO: 2052423 - protein, 19 aa, Staphylococcus
KHPYTWGLLSSMPDLDTKN

SEQ ID NO: 2052424 - protein, 19 aa, Staphylococcus
KHPYTWGLLSSMPDLTTGT

SEQ ID NO: 2052425 - protein, 18 aa, Staphylococcus
KHPYTWGLLSSMPDLTTS

SEQ ID NO: 2052426 - protein, 19 aa, Staphylococcus
KHPYTWGLLSSMPDLTTSN

SEQ ID NO: 2052427 - protein, 19 aa, Staphylococcus
KHTFPLFGMALGIPEDDEN

SEQ ID NO: 2052428 - protein, 23 aa, Staphylococcus
KHVAMEFAKLILCNGNQQCEMKV

SEQ ID NO: 2052429 - protein, 17 aa, Staphylococcus
KHWLPVDLYIGGVEHAV

SEQ ID NO: 2052430 - protein, 18 aa, Staphylococcus
KIAELKALIGNQEKPDLE

SEQ ID NO: 2052431 - protein, 18 aa, Staphylococcus
KIAISRYLPNDAINNNHL

SEQ ID NO: 2052432 - protein, 17 aa, Staphylococcus
KICNRCFDNGVVIIAVA

SEQ ID NO: 2052433 - protein, 19 aa, Staphylococcus
KICNYCFDKGVVIIAVAGN

SEQ ID NO: 2052434 - protein, 19 aa, Staphylococcus
KIDFARFARYCRENNAIVL

SEQ ID NO: 2052435 - protein, 18 aa, Staphylococcus
KIDLNDMIAALPKQLTKR

SEQ ID NO: 2052436 - protein, 23 aa, Staphylococcus
KIFDEWKIPIIFVTHSNYEAKKM

SEQ ID NO: 2052437 - protein, 18 aa, Staphylococcus
KIFECIHAGLPVILSPVK

SEQ ID NO: 2052438 - protein, 17 aa, Staphylococcus
KIFPGLVTYVGKTHEEA

SEQ ID NO: 2052439 - protein, 19 aa, Staphylococcus
KIKAIKVFLQHGVLGTKNL

SEQ ID NO: 2052440 - protein, 19 aa, Staphylococcus
KIKAVKVFLQHGVLGTKNL

SEQ ID NO: 2052441 - protein, 19 aa, Staphylococcus
KIKNLRIGYLTQQMTLDSS

SEQ ID NO: 2052442 - protein, 20 aa, Staphylococcus
KILRDLRQSLNLNFNIEVDG

SEQ ID NO: 2052443 - protein, 22 aa, Staphylococcus
KILRKILKYSFVEYKEFMDKNT

SEQ ID NO: 2052444 - protein, 21 aa, Staphylococcus
KIMIKEIINSLLINKIKQEDI

SEQ ID NO: 2052445 - protein, 20 aa, Staphylococcus
KIMKMLHPFMPFVTETIWQS

SEQ ID NO: 2052446 - protein, 23 aa, Staphylococcus
KINDLRIGDTLFRGENTTSGQPM

SEQ ID NO: 2052447 - protein, 23 aa, Staphylococcus
KINELRIGEALFRGIDTTTNEPI

SEQ ID NO: 2052448 - protein, 23 aa, Staphylococcus
KINELRIGETLFRGVDTTTDKPV

SEQ ID NO: 2052449 - protein, 23 aa, Staphylococcus
KINEYRATMKFMEMFSDYYNFNL

SEQ ID NO: 2052450 - protein, 18 aa, Staphylococcus
KINFGNCCILKFEYEADE

SEQ ID NO: 2052451 - protein, 19 aa, Staphylococcus
KINLLEFREYMDLLEGIGL

SEQ ID NO: 2052452 - protein, 18 aa, Staphylococcus
KINWALGLMNEGSQIIDN

SEQ ID NO: 2052453 - protein, 20 aa, Staphylococcus
KIPDEFVVGYGLDYGEHYRN

SEQ ID NO: 2052454 - protein, 22 aa, Staphylococcus
KIPHGHAIMFGIIYQFIVANEI

SEQ ID NO: 2052455 - protein, 18 aa, Staphylococcus
KIQAKYGISDLVKRMSQS

SEQ ID NO: 2052456 - protein, 17 aa, Staphylococcus
KIQQGWFDFDVVVATPD

SEQ ID NO: 2052457 - protein, 17 aa, Staphylococcus
KIRECSVAKYVYDVKKG

SEQ ID NO: 2052458 - protein, 19 aa, Staphylococcus
KIRIKEFVKDVAKEDQVFG

SEQ ID NO: 2052459 - protein, 20 aa, Staphylococcus
KIRYIREIDDLVDLVKDRIE

SEQ ID NO: 2052460 - protein, 26 aa, Staphylococcus
KIRYWGVSNYSGWALAKTHTLAVANH

SEQ ID NO: 2052461 - protein, 25 aa, Staphylococcus
KIRYWGVSNYSGWNLAQTHTYAAQN

SEQ ID NO: 2052462 - protein, 19 aa, Staphylococcus
KISSNWPKNVSVFSNQVET

SEQ ID NO: 2052463 - protein, 19 aa, Staphylococcus
KIVRWRAAMFLFDEGGPEQ

SEQ ID NO: 2052464 - protein, 21 aa, Staphylococcus
KIWYKLLVNLGINSITALGHN

SEQ ID NO: 2052465 - protein, 19 aa, Staphylococcus
KKAIDIGNAMLKDGYDEHD

SEQ ID NO: 2052466 - protein, 18 aa, Staphylococcus
KKAIDIGNAMLKDGYEES

SEQ ID NO: 2052467 - protein, 17 aa, Staphylococcus
KKASHWGIQAPFEVPDE

SEQ ID NO: 2052468 - protein, 23 aa, Staphylococcus
KKDGTCNPVLFQIHTHFWNQFQQ

SEQ ID NO: 2052469 - protein, 18 aa, Staphylococcus
KKDRVVVEGVNIIKKHQK

SEQ ID NO: 2052470 - protein, 19 aa, Staphylococcus
KKDRVVVEGVNIIKKHQKP

SEQ ID NO: 2052471 - protein, 20 aa, Staphylococcus
KKEAIEFAWEFLTSDKWMAM

SEQ ID NO: 2052472 - protein, 20 aa, Staphylococcus
KKEAIEFAWEFLTSDKWMGM

SEQ ID NO: 2052473 - protein, 19 aa, Staphylococcus
KKEGYIRMLGYKNLTTCRR

SEQ ID NO: 2052474 - protein, 21 aa, Staphylococcus
KKELEHWDFFVTGIDDFSAVM

SEQ ID NO: 2052475 - protein, 19 aa, Staphylococcus
KKFDMGINWFFKTPEREKQ

SEQ ID NO: 2052476 - protein, 17 aa, Staphylococcus
KKGFLLDGFPRTIDQAE

SEQ ID NO: 2052477 - protein, 20 aa, Staphylococcus
KKGFPKLVFQMSEHHSDIGF

SEQ ID NO: 2052478 - protein, 20 aa, Staphylococcus
KKGPFAPDFIKVWKQRYKKI

SEQ ID NO: 2052479 - protein, 20 aa, Staphylococcus
KKGPFAPDFIKVWKQRYKKV

SEQ ID NO: 2052480 - protein, 21 aa, Staphylococcus
KKGPFAPDFIKVWRERYKKIR

SEQ ID NO: 2052481 - protein, 21 aa, Staphylococcus
KKGPFAPDFIKVWRERYKKLR

SEQ ID NO: 2052482 - protein, 18 aa, Staphylococcus
KKGVLFWQIIRFIQNTYP

SEQ ID NO: 2052483 - protein, 23 aa, Staphylococcus
KKGWPSMMRKIWKNPEKYDSYFI

SEQ ID NO: 2052484 - protein, 20 aa, Staphylococcus
KKGWPSMMVSIWKNPEKYDS

SEQ ID NO: 2052485 - protein, 17 aa, Staphylococcus
KKHIFLYLMYVYKQMMI

SEQ ID NO: 2052486 - protein, 18 aa, Staphylococcus
KKHPRVIVYAGMSLAQKN

SEQ ID NO: 2052487 - protein, 19 aa, Staphylococcus
KKIASGMSYFITQPVYSKE

SEQ ID NO: 2052488 - protein, 17 aa, Staphylococcus
KKIELHGTVTVKGKWNR

SEQ ID NO: 2052489 - protein, 18 aa, Staphylococcus
KKILRKLVVANLITSNAS

SEQ ID NO: 2052490 - protein, 19 aa, Staphylococcus
KKISIPYILTRALKNEKNS

SEQ ID NO: 2052491 - protein, 18 aa, Staphylococcus
KKKFKVDRLSTIEAEISE

SEQ ID NO: 2052492 - protein, 20 aa, Staphylococcus
KKKLPMSLIHEGVGEVVYDS

SEQ ID NO: 2052493 - protein, 21 aa, Staphylococcus
KKKVCPVCGGPIQTKVIAGRN

SEQ ID NO: 2052494 - protein, 20 aa, Staphylococcus
KKLDAIVILSDFNRRYLSGF

SEQ ID NO: 2052495 - protein, 21 aa, Staphylococcus
KKLDAVVILSDFNRRYLSEFT

SEQ ID NO: 2052496 - protein, 17 aa, Staphylococcus
KKLGHSITELFPTEVPI

SEQ ID NO: 2052497 - protein, 18 aa, Staphylococcus
KKLKAFPPTFIVHGNQDP

SEQ ID NO: 2052498 - protein, 17 aa, Staphylococcus
KKLPFGIGQVGKSFRNE

SEQ ID NO: 2052499 - protein, 22 aa, Staphylococcus
KKLRNELLFEFNLTLDANETLD

SEQ ID NO: 2052500 - protein, 17 aa, Staphylococcus
KKLTGWYSRRIAVGENG

SEQ ID NO: 2052501 - protein, 23 aa, Staphylococcus
KKLVIDGTIHWRKDGNKVGFKDT

SEQ ID NO: 2052502 - protein, 20 aa, Staphylococcus
KKLWPIQPLREFWGISRKIE

SEQ ID NO: 2052503 - protein, 22 aa, Staphylococcus
KKMRRLALRSALSFKVKENGFT

SEQ ID NO: 2052504 - protein, 20 aa, Staphylococcus
KKPANGFVCYMIGRLILELC

SEQ ID NO: 2052505 - protein, 24 aa, Staphylococcus
KKPPYRFEIEMLKSQIFDPKLKEK

SEQ ID NO: 2052506 - protein, 19 aa, Staphylococcus
KKPSLRWDNYYGLTHFIVP

SEQ ID NO: 2052507 - protein, 20 aa, Staphylococcus
KKQRAICVVEGFNYDSVLNS

SEQ ID NO: 2052508 - protein, 22 aa, Staphylococcus
KKRALEILNLVGLPNAEKRFKA

SEQ ID NO: 2052509 - protein, 21 aa, Staphylococcus
KKRALEILNMVGLPNAKERFK

SEQ ID NO: 2052510 - protein, 21 aa, Staphylococcus
KKRALELVELVGLKGREKAYP

SEQ ID NO: 2052511 - protein, 17 aa, Staphylococcus
KKRKLDLGWIVSECPSS

SEQ ID NO: 2052512 - protein, 18 aa, Staphylococcus
KKRLIEWLLLKNALLVTE

SEQ ID NO: 2052513 - protein, 17 aa, Staphylococcus
KKRLKDIVEPLKGNSGE

SEQ ID NO: 2052514 - protein, 20 aa, Staphylococcus
KKRLPYSMLTASRLAKEKHV

SEQ ID NO: 2052515 - protein, 20 aa, Staphylococcus
KKRMGFSFRFEDLFSEEELL

SEQ ID NO: 2052516 - protein, 18 aa, Staphylococcus
KKRVKALKENILFQKMEI

SEQ ID NO: 2052517 - protein, 19 aa, Staphylococcus
KKRVYDLLETVGLNKEHAN

SEQ ID NO: 2052518 - protein, 19 aa, Staphylococcus
KKRVYDLLETVGLSKEHAN

SEQ ID NO: 2052519 - protein, 17 aa, Staphylococcus
KKSGLSYKEKREYEALL

SEQ ID NO: 2052520 - protein, 17 aa, Staphylococcus
KKSRPATQLTVISSVTQ

SEQ ID NO: 2052521 - protein, 17 aa, Staphylococcus
KKVAAGMSYFITQPVYS

SEQ ID NO: 2052522 - protein, 17 aa, Staphylococcus
KKVAIALRNRYRRSQLD

SEQ ID NO: 2052523 - protein, 17 aa, Staphylococcus
KKVEVFLLNSLREVADV

SEQ ID NO: 2052524 - protein, 17 aa, Staphylococcus
KKVISILETLDFKIKII

SEQ ID NO: 2052525 - protein, 18 aa, Staphylococcus
KKVTRLAQHLGWSSEGTD

SEQ ID NO: 2052526 - protein, 19 aa, Staphylococcus
KKVYEAIEALKFEDLTRTD

SEQ ID NO: 2052527 - protein, 17 aa, Staphylococcus
KLAALSFLTFVALDQSG

SEQ ID NO: 2052528 - protein, 18 aa, Staphylococcus
KLADLVMWDPIFFGVKPE

SEQ ID NO: 2052529 - protein, 23 aa, Staphylococcus
KLAGRRGLPFVIAKMGQSSSAIE

SEQ ID NO: 2052530 - protein, 18 aa, Staphylococcus
KLALRTSRQYELRQLMSI

SEQ ID NO: 2052531 - protein, 20 aa, Staphylococcus
KLDFKFRLPDDMLQAHIQAV

SEQ ID NO: 2052532 - protein, 17 aa, Staphylococcus
KLDISLEEVVAFGDSLN

SEQ ID NO: 2052533 - protein, 22 aa, Staphylococcus
KLEALGFQFSYPHLKSALDDLV

SEQ ID NO: 2052534 - protein, 26 aa, Staphylococcus
KLENARLSWHLGVIWRKDTYLSHVTR

SEQ ID NO: 2052535 - protein, 17 aa, Staphylococcus
KLFELEGDLPLFPGHGP

SEQ ID NO: 2052536 - protein, 23 aa, Staphylococcus
KLFELEGDLPLFPGHGPYTTVDD

SEQ ID NO: 2052537 - protein, 20 aa, Staphylococcus
KLFKVCRMRGIPIFTFINKL

SEQ ID NO: 2052538 - protein, 17 aa, Staphylococcus
KLFLRLEFEQVTELKEA

SEQ ID NO: 2052539 - protein, 19 aa, Staphylococcus
KLGLPRLTKYFKLDLKTEQ

SEQ ID NO: 2052540 - protein, 19 aa, Staphylococcus
KLGVKVWIYRGEVLPTKNN

SEQ ID NO: 2052541 - protein, 19 aa, Staphylococcus
KLGVKVWIYRGEVLPTKNT

SEQ ID NO: 2052542 - protein, 21 aa, Staphylococcus
KLICPNCGYALTLNSQKRKRK

SEQ ID NO: 2052543 - protein, 23 aa, Staphylococcus
KLIDEPLELIGLMGNISHIDEQP

SEQ ID NO: 2052544 - protein, 21 aa, Staphylococcus
KLKDYDFRWEPSILSRSISDL

SEQ ID NO: 2052545 - protein, 24 aa, Staphylococcus
KLKEILMDWQIGIFEGGGWNAIFW

SEQ ID NO: 2052546 - protein, 22 aa, Staphylococcus
KLKEILMEWQIGIYQGGGWNAI

SEQ ID NO: 2052547 - protein, 22 aa, Staphylococcus
KLKELPKSIVIVGGGVIGMEFA

SEQ ID NO: 2052548 - protein, 18 aa, Staphylococcus
KLKEVVARLSIEEFKTML

SEQ ID NO: 2052549 - protein, 19 aa, Staphylococcus
KLKPYREALGLSTPKNSTV

SEQ ID NO: 2052550 - protein, 20 aa, Staphylococcus
KLKQEYRPTVSIVNAENAAH

SEQ ID NO: 2052551 - protein, 17 aa, Staphylococcus
KLKSLGLNSNWDMLYIV

SEQ ID NO: 2052552 - protein, 21 aa, Staphylococcus
KLKTFAPVREWAWSREEEIDY

SEQ ID NO: 2052553 - protein, 21 aa, Staphylococcus
KLKVTLSFYFKAPKSWSNRKK

SEQ ID NO: 2052554 - protein, 18 aa, Staphylococcus
KLLEDMRVLNAIKRIRPS

SEQ ID NO: 2052555 - protein, 18 aa, Staphylococcus
KLLKDLQIEYGISIEQSN

SEQ ID NO: 2052556 - protein, 19 aa, Staphylococcus
KLLKYRFDNHHPFNQMRLK

SEQ ID NO: 2052557 - protein, 19 aa, Staphylococcus
KLLNFRKFIIGSTIPHLYY

SEQ ID NO: 2052558 - protein, 19 aa, Staphylococcus
KLLRNFKHPLKFVFIDLIQ

SEQ ID NO: 2052559 - protein, 20 aa, Staphylococcus
KLNALNCVKAFLKAGYDAGR

SEQ ID NO: 2052560 - protein, 17 aa, Staphylococcus
KLNEVLLAMGIKDNRIE

SEQ ID NO: 2052561 - protein, 18 aa, Staphylococcus
KLNIEVRGLIKLSNLVEE

SEQ ID NO: 2052562 - protein, 19 aa, Staphylococcus
KLNILIGPLVKLWRIGFED

SEQ ID NO: 2052563 - protein, 19 aa, Staphylococcus
KLNLGYRFPTHYGNEDYYA

SEQ ID NO: 2052564 - protein, 20 aa, Staphylococcus
KLPEGWKIVLNRPSTVPRKG

SEQ ID NO: 2052565 - protein, 20 aa, Staphylococcus
KLPFTLCYVSRGFVTDYSDK

SEQ ID NO: 2052566 - protein, 21 aa, Staphylococcus
KLPFTLCYVSRGFVVDYEDTA

SEQ ID NO: 2052567 - protein, 19 aa, Staphylococcus
KLPVIFWMHGGGFIAGDKQ

SEQ ID NO: 2052568 - protein, 21 aa, Staphylococcus
KLRRLGIKKGIPVVFSDESPI

SEQ ID NO: 2052569 - protein, 23 aa, Staphylococcus
KLSEHRTSLIIAHRLSTIKDVDR

SEQ ID NO: 2052570 - protein, 22 aa, Staphylococcus
KLSEIHPLFYLLAVKKETLKRH

SEQ ID NO: 2052571 - protein, 17 aa, Staphylococcus
KLSQKLKIPSFVVDPVV

SEQ ID NO: 2052572 - protein, 17 aa, Staphylococcus
KLTPIVRKILESKNITD

SEQ ID NO: 2052573 - protein, 17 aa, Staphylococcus
KLTSIKLKVRFNNHQKL

SEQ ID NO: 2052574 - protein, 17 aa, Staphylococcus
KLTVDWKNVLKYLAKVE

SEQ ID NO: 2052575 - protein, 18 aa, Staphylococcus
KLVIPFERLKWFNPQTSL

SEQ ID NO: 2052576 - protein, 18 aa, Staphylococcus
KLVPFMLEDELKKRGANY

SEQ ID NO: 2052577 - protein, 22 aa, Staphylococcus
KLWNIQPLREFWGINKRTEVKL

SEQ ID NO: 2052578 - protein, 17 aa, Staphylococcus
KLWPIQPLRDFWGINKR

SEQ ID NO: 2052579 - protein, 17 aa, Staphylococcus
KLYDRLIYRYGSSNSAF

SEQ ID NO: 2052580 - protein, 19 aa, Staphylococcus
KLYNIEGLRNFAPQQLQSK

SEQ ID NO: 2052581 - protein, 17 aa, Staphylococcus
KMGVPCYFTMDAGPNVK

SEQ ID NO: 2052582 - protein, 18 aa, Staphylococcus
KMIEAFKVTIWYTAPTAL

SEQ ID NO: 2052583 - protein, 17 aa, Staphylococcus
KMIGHYIGMSFQIVDDI

SEQ ID NO: 2052584 - protein, 19 aa, Staphylococcus
KMIIHKPIWLISERKDSAS

SEQ ID NO: 2052585 - protein, 20 aa, Staphylococcus
KMIKEGICQLEIKLDTGRTH

SEQ ID NO: 2052586 - protein, 21 aa, Staphylococcus
KMKELQDFIARFSANASKSKQ

SEQ ID NO: 2052587 - protein, 26 aa, Staphylococcus
KMNGREVFKFAVRIMGDASTRVVDKA

SEQ ID NO: 2052588 - protein, 25 aa, Staphylococcus
KMNLEWVYRLLIDWKRIGRIKAIPK

SEQ ID NO: 2052589 - protein, 21 aa, Staphylococcus
KMPFIGLQWIFGRKGAAASNH

SEQ ID NO: 2052590 - protein, 20 aa, Staphylococcus
KMSKGGMLDLYFNGEKVGEY

SEQ ID NO: 2052591 - protein, 21 aa, Staphylococcus
KMYSPEFEKVIPLKIMLIHKD

SEQ ID NO: 2052592 - protein, 19 aa, Staphylococcus
KNAGIATCWFNVRNKKNNS

SEQ ID NO: 2052593 - protein, 17 aa, Staphylococcus
KNAIKFGIEQSDIVTSV

SEQ ID NO: 2052594 - protein, 24 aa, Staphylococcus
KNAMGWYLDGRASAVVGTHTHIQT

SEQ ID NO: 2052595 - protein, 20 aa, Staphylococcus
KNDLDSVILIHACWIAQIEI

SEQ ID NO: 2052596 - protein, 17 aa, Staphylococcus
KNFKAFTVDGLDARMEA

SEQ ID NO: 2052597 - protein, 21 aa, Staphylococcus
KNFKGSIIFTSYDFEFINTIA

SEQ ID NO: 2052598 - protein, 18 aa, Staphylococcus
KNFRDIFNKIAWLNKGKM

SEQ ID NO: 2052599 - protein, 18 aa, Staphylococcus
KNGLEILVHIGLDTVQLD

SEQ ID NO: 2052600 - protein, 21 aa, Staphylococcus
KNIIFSPEFLREGNALYDNLY

SEQ ID NO: 2052601 - protein, 19 aa, Staphylococcus
KNIKFVVGGMYEFGLSRYF

SEQ ID NO: 2052602 - protein, 17 aa, Staphylococcus
KNIPFDELVLFSSARSA

SEQ ID NO: 2052603 - protein, 19 aa, Staphylococcus
KNIPFDELVLFSSPRSAGT

SEQ ID NO: 2052604 - protein, 18 aa, Staphylococcus
KNKEIIDFGKIIGKDYIE

SEQ ID NO: 2052605 - protein, 20 aa, Staphylococcus
KNKHLRLAISKAINKKQYVK

SEQ ID NO: 2052606 - protein, 21 aa, Staphylococcus
KNKRAGAWFDRLKFLMKSLEE

SEQ ID NO: 2052607 - protein, 23 aa, Staphylococcus
KNKYPLILVHGFFGGVGENRPVF

SEQ ID NO: 2052608 - protein, 17 aa, Staphylococcus
KNLKLLGEDEMDDDDDI

SEQ ID NO: 2052609 - protein, 17 aa, Staphylococcus
KNNWRYRISLGKNPQTG

SEQ ID NO: 2052610 - protein, 18 aa, Staphylococcus
KNPLCMFCPVQENCEAYD

SEQ ID NO: 2052611 - protein, 17 aa, Staphylococcus
KNPRIIVYAGMKLAQKN

SEQ ID NO: 2052612 - protein, 18 aa, Staphylococcus
KNQKGMVVQDDWKGKKHK

SEQ ID NO: 2052613 - protein, 21 aa, Staphylococcus
KNRALELLNLVGIDKSEEIFN

SEQ ID NO: 2052614 - protein, 17 aa, Staphylococcus
KNRFPWVVAAFPSKDWA

SEQ ID NO: 2052615 - protein, 19 aa, Staphylococcus
KNTLCMFCPVQEHCEAFLN

SEQ ID NO: 2052616 - protein, 20 aa, Staphylococcus
KNVKFGVDITHLFNQPEAFK

SEQ ID NO: 2052617 - protein, 17 aa, Staphylococcus
KNVMDGYLFPKVKMDTF

SEQ ID NO: 2052618 - protein, 20 aa, Staphylococcus
KNVREALDMVINRKEIAKNI

SEQ ID NO: 2052619 - protein, 23 aa, Staphylococcus
KNYDIPLYLGRTLSNEKGTWIMS

SEQ ID NO: 2052620 - protein, 23 aa, Staphylococcus
KNYDIPLYLGRTLSNVKGTWIMP

SEQ ID NO: 2052621 - protein, 23 aa, Staphylococcus
KNYDIPLYLGRTLSNVKGTWIMS

SEQ ID NO: 2052622 - protein, 23 aa, Staphylococcus
KNYEIPLYLGRTLSNVKGTWIMS

SEQ ID NO: 2052623 - protein, 17 aa, Staphylococcus
KPALRLSAIMGLNATFI

SEQ ID NO: 2052624 - protein, 17 aa, Staphylococcus
KPALRLSAIMGLNSTFV

SEQ ID NO: 2052625 - protein, 18 aa, Staphylococcus
KPAMARNDFRIIGATTPS

SEQ ID NO: 2052626 - protein, 21 aa, Staphylococcus
KPARIKLKWSSHLINDIKKLR

SEQ ID NO: 2052627 - protein, 19 aa, Staphylococcus
KPDHPFVYWATFANAAQLL

SEQ ID NO: 2052628 - protein, 18 aa, Staphylococcus
KPDVIVIAGDLYDTSYPS

SEQ ID NO: 2052629 - protein, 17 aa, Staphylococcus
KPDWEIFQLIAQRMGAD

SEQ ID NO: 2052630 - protein, 18 aa, Staphylococcus
KPDWVIFQLIAKRMGFDW

SEQ ID NO: 2052631 - protein, 20 aa, Staphylococcus
KPEARSIIELAARIYKGIID

SEQ ID NO: 2052632 - protein, 19 aa, Staphylococcus
KPEEYWKIEGEFRYKKTKF

SEQ ID NO: 2052633 - protein, 19 aa, Staphylococcus
KPEEYWKIEGNFRYKKSTF

SEQ ID NO: 2052634 - protein, 20 aa, Staphylococcus
KPEEYWSIEGEFRYKKSKFT

SEQ ID NO: 2052635 - protein, 20 aa, Staphylococcus
KPEEYWTIEGEFRYKKSKFN

SEQ ID NO: 2052636 - protein, 19 aa, Staphylococcus
KPEEYWTIEGEFRYQKSKF

SEQ ID NO: 2052637 - protein, 17 aa, Staphylococcus
KPGAYVWRDKVCSMEIW

SEQ ID NO: 2052638 - protein, 21 aa, Staphylococcus
KPGDEILVAFDLYGGTFRLFD

SEQ ID NO: 2052639 - protein, 18 aa, Staphylococcus
KPGEISWDSPFGKGRPGW

SEQ ID NO: 2052640 - protein, 19 aa, Staphylococcus
KPHPYCLVSVIEGDGQLTV

SEQ ID NO: 2052641 - protein, 18 aa, Staphylococcus
KPIKRLWISSVTKKAIKD

SEQ ID NO: 2052642 - protein, 18 aa, Staphylococcus
KPIKRLWISSVTKKAIQQ

SEQ ID NO: 2052643 - protein, 23 aa, Staphylococcus
KPKKVMDTLELFKIAFPTDKSYQ

SEQ ID NO: 2052644 - protein, 17 aa, Staphylococcus
KPLHEFHQGTILVDLQQ

SEQ ID NO: 2052645 - protein, 21 aa, Staphylococcus
KPLKDLRVMGKFGDSVTTDHI

SEQ ID NO: 2052646 - protein, 18 aa, Staphylococcus
KPLPAYWIPFAQQLFQNW

SEQ ID NO: 2052647 - protein, 19 aa, Staphylococcus
KPLRNAILWNDTRSTHQCT

SEQ ID NO: 2052648 - protein, 20 aa, Staphylococcus
KPLSEISMKVYSEFDINQDE

SEQ ID NO: 2052649 - protein, 18 aa, Staphylococcus
KPLYKLCVDIINEFDTWT

SEQ ID NO: 2052650 - protein, 18 aa, Staphylococcus
KPMNCPGHMLIFKNELRS

SEQ ID NO: 2052651 - protein, 19 aa, Staphylococcus
KPMNCPGHMLIFKNELRSY

SEQ ID NO: 2052652 - protein, 18 aa, Staphylococcus
KPNFTIISAPHFKADPSI

SEQ ID NO: 2052653 - protein, 18 aa, Staphylococcus
KPRVCHVEKTILIKAFND

SEQ ID NO: 2052654 - protein, 18 aa, Staphylococcus
KPSLRWDNYYGLTHFIVP

SEQ ID NO: 2052655 - protein, 24 aa, Staphylococcus
KPTGLWLGELVHFYDYFNNNNYQI

SEQ ID NO: 2052656 - protein, 18 aa, Staphylococcus
KPTLRWDNYYGLTHFIVP

SEQ ID NO: 2052657 - protein, 18 aa, Staphylococcus
KPYVEGFVKMLAPIAPHV

SEQ ID NO: 2052658 - protein, 19 aa, Staphylococcus
KQANRVGAEYTIVIGEQEL

SEQ ID NO: 2052659 - protein, 24 aa, Staphylococcus
KQCYKLYFKFVMPIFGKIFAKSKD

SEQ ID NO: 2052660 - protein, 19 aa, Staphylococcus
KQFKARFNVAILDDGNYLP

SEQ ID NO: 2052661 - protein, 20 aa, Staphylococcus
KQGPFQLWDLMGFERVKARM

SEQ ID NO: 2052662 - protein, 19 aa, Staphylococcus
KQGRVCLLEDFISKSNNDR

SEQ ID NO: 2052663 - protein, 19 aa, Staphylococcus
KQIHFCNSFKFTIFKKNNL

SEQ ID NO: 2052664 - protein, 23 aa, Staphylococcus
KQIRKRIGVVFQFPESQLFEDSV

SEQ ID NO: 2052665 - protein, 24 aa, Staphylococcus
KQISRIPLSLTFDHQILDGAGAAD

SEQ ID NO: 2052666 - protein, 21 aa, Staphylococcus
KQKALELVELVGLKGRESAYP

SEQ ID NO: 2052667 - protein, 18 aa, Staphylococcus
KQLHDIKEVIAFDDLPNG

SEQ ID NO: 2052668 - protein, 18 aa, Staphylococcus
KQLIDWLKAQSRPFLFST

SEQ ID NO: 2052669 - protein, 20 aa, Staphylococcus
KQLIRCCRYFIDLIRQSEFG

SEQ ID NO: 2052670 - protein, 22 aa, Staphylococcus
KQLKKVLIMPTWRDWLNSNEAF

SEQ ID NO: 2052671 - protein, 19 aa, Staphylococcus
KQLLYLKERFRQIEQSLKN

SEQ ID NO: 2052672 - protein, 22 aa, Staphylococcus
KQLMIYDAFGWEPPRFAHMSLI

SEQ ID NO: 2052673 - protein, 22 aa, Staphylococcus
KQLMIYEAFGWEAPRFAHMSLI

SEQ ID NO: 2052674 - protein, 22 aa, Staphylococcus
KQLMIYEAFGWEAPRFGHMSLI

SEQ ID NO: 2052675 - protein, 23 aa, Staphylococcus
KQLMIYEAFGWEPPRFAHMSLIV

SEQ ID NO: 2052676 - protein, 23 aa, Staphylococcus
KQLMIYEAFGWEPPRFGHISLIV

SEQ ID NO: 2052677 - protein, 23 aa, Staphylococcus
KQLMIYEAFGWEPPRFGHMSLIV

SEQ ID NO: 2052678 - protein, 22 aa, Staphylococcus
KQPIIWLCGGLDRGNGFDELIP

SEQ ID NO: 2052679 - protein, 17 aa, Staphylococcus
KQPVWIRHVLVPGYSDD

SEQ ID NO: 2052680 - protein, 18 aa, Staphylococcus
KQQIELFKQFKAVADKKK

SEQ ID NO: 2052681 - protein, 21 aa, Staphylococcus
KQRALEILNLVGLPNAEKRFK

SEQ ID NO: 2052682 - protein, 21 aa, Staphylococcus
KQRALELVELVGLKGREDAYP

SEQ ID NO: 2052683 - protein, 21 aa, Staphylococcus
KQRHIPMAIATSSYREDILPT

SEQ ID NO: 2052684 - protein, 18 aa, Staphylococcus
KQRRGHLLLPDYISLDHS

SEQ ID NO: 2052685 - protein, 19 aa, Staphylococcus
KQSLGFDQHTKWLSVLPIY

SEQ ID NO: 2052686 - protein, 20 aa, Staphylococcus
KQTDMFARFSTVAGERGAAD

SEQ ID NO: 2052687 - protein, 21 aa, Staphylococcus
KQTEMFARFSTVAGERGAADA

SEQ ID NO: 2052688 - protein, 21 aa, Staphylococcus
KQTEMFARFSTVAGERGAADL

SEQ ID NO: 2052689 - protein, 21 aa, Staphylococcus
KQTEMFARFSTVSGERGAADL

SEQ ID NO: 2052690 - protein, 23 aa, Staphylococcus
KQTPSPDCLMIFQHHNLFPWKNI

SEQ ID NO: 2052691 - protein, 24 aa, Staphylococcus
KQVSRIPLSLTFDHQILDGAGAAE

SEQ ID NO: 2052692 - protein, 20 aa, Staphylococcus
KRAAGVAFGPVDYVKYAESF

SEQ ID NO: 2052693 - protein, 18 aa, Staphylococcus
KRCKEMFDKGTLPHNVVF

SEQ ID NO: 2052694 - protein, 19 aa, Staphylococcus
KREDLQWVRSFKLRGAYNA

SEQ ID NO: 2052695 - protein, 22 aa, Staphylococcus
KREEAAWDLKKVFADFAEGSFH

SEQ ID NO: 2052696 - protein, 21 aa, Staphylococcus
KRFALPNAEVMIHQPLGGAQG

SEQ ID NO: 2052697 - protein, 26 aa, Staphylococcus
KRFAYDCYRRLLQMFGEVVYSVPMQA

SEQ ID NO: 2052698 - protein, 17 aa, Staphylococcus
KRFRGTYGKMKRIPQNV

SEQ ID NO: 2052699 - protein, 17 aa, Staphylococcus
KRFSINPLWQVYKIVRF

SEQ ID NO: 2052700 - protein, 25 aa, Staphylococcus
KRGIDEFLIRLSIGIENYSDIEADI

SEQ ID NO: 2052701 - protein, 19 aa, Staphylococcus
KRIDTHLAIDFMDVSSYHG

SEQ ID NO: 2052702 - protein, 21 aa, Staphylococcus
KRIKLYYKRFFGLEPSALETN

SEQ ID NO: 2052703 - protein, 21 aa, Staphylococcus
KRIKNVYDFNDFQLAIDHIQV

SEQ ID NO: 2052704 - protein, 18 aa, Staphylococcus
KRILIGWMGLPESDYPTD

SEQ ID NO: 2052705 - protein, 19 aa, Staphylococcus
KRILMEWQIGIHDGNGWNA

SEQ ID NO: 2052706 - protein, 19 aa, Staphylococcus
KRIRPLLVFLTLDVLNQDY

SEQ ID NO: 2052707 - protein, 19 aa, Staphylococcus
KRIRPVLVLLTLEVLNENY

SEQ ID NO: 2052708 - protein, 19 aa, Staphylococcus
KRISVLEVMLPNAIKAKYQ

SEQ ID NO: 2052709 - protein, 20 aa, Staphylococcus
KRIVWLFNHILFDGWSLSIL

SEQ ID NO: 2052710 - protein, 21 aa, Staphylococcus
KRKCERYHVPFIVNDDIELAK

SEQ ID NO: 2052711 - protein, 23 aa, Staphylococcus
KRKGLEPFATWLLQPKLNENVES

SEQ ID NO: 2052712 - protein, 22 aa, Staphylococcus
KRKGLEPFVDWLLLPKLDVDIT

SEQ ID NO: 2052713 - protein, 19 aa, Staphylococcus
KRKIPLVLVFEGMDAAGKG

SEQ ID NO: 2052714 - protein, 17 aa, Staphylococcus
KRKLSVFLYSVNDFTQF

SEQ ID NO: 2052715 - protein, 18 aa, Staphylococcus
KRKRLKWVNQLVYKSFNK

SEQ ID NO: 2052716 - protein, 20 aa, Staphylococcus
KRLDYGGSLALIGLTGGHHF

SEQ ID NO: 2052717 - protein, 20 aa, Staphylococcus
KRLESVIKVPIYTLGTTSLG

SEQ ID NO: 2052718 - protein, 17 aa, Staphylococcus
KRLGFYPKTVANISQIS

SEQ ID NO: 2052719 - protein, 20 aa, Staphylococcus
KRLHLPQGFNIRVDSLLYAG

SEQ ID NO: 2052720 - protein, 23 aa, Staphylococcus
KRLIEGSSFSTGWIFFINAEGIQ

SEQ ID NO: 2052721 - protein, 19 aa, Staphylococcus
KRLIGFLHFYYSLFMIADR

SEQ ID NO: 2052722 - protein, 19 aa, Staphylococcus
KRLIMPSIEREVRGDLTQK

SEQ ID NO: 2052723 - protein, 19 aa, Staphylococcus
KRLKGIKEWGFGLFEGESI

SEQ ID NO: 2052724 - protein, 20 aa, Staphylococcus
KRLKIPVFHMEAGNRCFDQN

SEQ ID NO: 2052725 - protein, 21 aa, Staphylococcus
KRLKIPVFHMEAGNRCFDQNV

SEQ ID NO: 2052726 - protein, 19 aa, Staphylococcus
KRLKQEYGLKFADSKTKNT

SEQ ID NO: 2052727 - protein, 20 aa, Staphylococcus
KRLKSDPSFYGRFLDQSHTC

SEQ ID NO: 2052728 - protein, 20 aa, Staphylococcus
KRLLPSIAYLEGEYGFSDIC

SEQ ID NO: 2052729 - protein, 19 aa, Staphylococcus
KRLPLYYRFVNTLKSKGID

SEQ ID NO: 2052730 - protein, 21 aa, Staphylococcus
KRLPLYYRFVSTLKSKGIDRV

SEQ ID NO: 2052731 - protein, 20 aa, Staphylococcus
KRLRPGGVLATNWLINKGHF

SEQ ID NO: 2052732 - protein, 25 aa, Staphylococcus
KRMEKRYKGPIAFEYTHINNNTERT

SEQ ID NO: 2052733 - protein, 25 aa, Staphylococcus
KRMEKRYKGSIAFEYNHINNNKERT

SEQ ID NO: 2052734 - protein, 19 aa, Staphylococcus
KRMISDLVHYARTGTMPYE

SEQ ID NO: 2052735 - protein, 25 aa, Staphylococcus
KRMLGYNVLHPMGWDAFGLPAEQYA

SEQ ID NO: 2052736 - protein, 17 aa, Staphylococcus
KRNCLYVLVDPYLLENL

SEQ ID NO: 2052737 - protein, 24 aa, Staphylococcus
KRNFPSIRTLFLLLVGFKNSKLSN

SEQ ID NO: 2052738 - protein, 21 aa, Staphylococcus
KRNLPSYAVPNFIKYIEDFPI

SEQ ID NO: 2052739 - protein, 19 aa, Staphylococcus
KRNYICFFEKSKIKPEHYY

SEQ ID NO: 2052740 - protein, 20 aa, Staphylococcus
KRPDYISAFWNVINWEKVDE

SEQ ID NO: 2052741 - protein, 17 aa, Staphylococcus
KRPFLLPIMHKIFNYED

SEQ ID NO: 2052742 - protein, 21 aa, Staphylococcus
KRQALRFGDAELNPGTRLHFV

SEQ ID NO: 2052743 - protein, 19 aa, Staphylococcus
KRQGFPEVIFGEGKTKEQI

SEQ ID NO: 2052744 - protein, 19 aa, Staphylococcus
KRRRLQWVNDLAFKPFNKR

SEQ ID NO: 2052745 - protein, 18 aa, Staphylococcus
KRRVESLQKNVLFGKMEI

SEQ ID NO: 2052746 - protein, 21 aa, Staphylococcus
KRTKGVYEFDQFRLAIDHVQV

SEQ ID NO: 2052747 - protein, 25 aa, Staphylococcus
KRVAIEMASSLGWHKYVGTDGKVIG

SEQ ID NO: 2052748 - protein, 22 aa, Staphylococcus
KRVGLFIKNDLDSVILIHACWI

SEQ ID NO: 2052749 - protein, 18 aa, Staphylococcus
KRVIDFIENFGFSDADID

SEQ ID NO: 2052750 - protein, 17 aa, Staphylococcus
KRVIGQFAAKLIEDNDC

SEQ ID NO: 2052751 - protein, 17 aa, Staphylococcus
KRVNGYLYFFQFGEMSI

SEQ ID NO: 2052752 - protein, 17 aa, Staphylococcus
KRVVISLTYIYGIGTST

SEQ ID NO: 2052753 - protein, 18 aa, Staphylococcus
KRVVISLTYIYGVGKSTA

SEQ ID NO: 2052754 - protein, 17 aa, Staphylococcus
KRYATLMGIDENTPVIV

SEQ ID NO: 2052755 - protein, 17 aa, Staphylococcus
KRYKVIASMGHVRDLPR

SEQ ID NO: 2052756 - protein, 21 aa, Staphylococcus
KRYLENQIRHAFGFEGTPIHI

SEQ ID NO: 2052757 - protein, 18 aa, Staphylococcus
KRYYICSLFNRSGSSACH

SEQ ID NO: 2052758 - protein, 18 aa, Staphylococcus
KSAKYVGLIPRFSRIFLG

SEQ ID NO: 2052759 - protein, 23 aa, Staphylococcus
KSAMERYEFYGAISYIKSKVETE

SEQ ID NO: 2052760 - protein, 19 aa, Staphylococcus
KSCVGKEFCRFGTQYTTRL

SEQ ID NO: 2052761 - protein, 22 aa, Staphylococcus
KSDMPAFWFDPLVNLAAISQVT

SEQ ID NO: 2052762 - protein, 19 aa, Staphylococcus
KSDVLKFYSEQNVDGIVIE

SEQ ID NO: 2052763 - protein, 20 aa, Staphylococcus
KSEFWLQMQADIFNASIRKL

SEQ ID NO: 2052764 - protein, 24 aa, Staphylococcus
KSELATRMRLRIIPELSFEYDKSI

SEQ ID NO: 2052765 - protein, 25 aa, Staphylococcus
KSELGSRMRLRIIPELSFEYDESIE

SEQ ID NO: 2052766 - protein, 17 aa, Staphylococcus
KSERLRQFFDFVTNFGL

SEQ ID NO: 2052767 - protein, 17 aa, Staphylococcus
KSFAKRIMEKYGIPTAE

SEQ ID NO: 2052768 - protein, 21 aa, Staphylococcus
KSFKGSIIFTSYDFEFINTIA

SEQ ID NO: 2052769 - protein, 20 aa, Staphylococcus
KSGEGGKLFGSVSAKQIAQA

SEQ ID NO: 2052770 - protein, 19 aa, Staphylococcus
KSGLAALVIAMIEIKASGQ

SEQ ID NO: 2052771 - protein, 18 aa, Staphylococcus
KSIEWLTNYIKNYHGATV

SEQ ID NO: 2052772 - protein, 19 aa, Staphylococcus
KSIFKRGILKAASYKYQRL

SEQ ID NO: 2052773 - protein, 17 aa, Staphylococcus
KSIKDEVLWKDAYFYIN

SEQ ID NO: 2052774 - protein, 17 aa, Staphylococcus
KSILVAPGIPFGENGKH

SEQ ID NO: 2052775 - protein, 18 aa, Staphylococcus
KSIPFEFASYMSASKFFK

SEQ ID NO: 2052776 - protein, 18 aa, Staphylococcus
KSIYWKPKQSLILNFDKS

SEQ ID NO: 2052777 - protein, 22 aa, Staphylococcus
KSLFPSCRIAFMVLPQNLMQRY

SEQ ID NO: 2052778 - protein, 21 aa, Staphylococcus
KSLFPSCRIAYIVLPYPILNI

SEQ ID NO: 2052779 - protein, 21 aa, Staphylococcus
KSLMLEFLRFAGYNTPININK

SEQ ID NO: 2052780 - protein, 17 aa, Staphylococcus
KSLRLISLLIKIKSLTP

SEQ ID NO: 2052781 - protein, 24 aa, Staphylococcus
KSLSHGYSGLEIDVFDFHSNKSRH

SEQ ID NO: 2052782 - protein, 21 aa, Staphylococcus
KSNELREGWLFGDKYDSTETF

SEQ ID NO: 2052783 - protein, 21 aa, Staphylococcus
KSNVIRLIFDEGFVALRPSGT

SEQ ID NO: 2052784 - protein, 17 aa, Staphylococcus
KSPLCLFCPVQSHCEAF

SEQ ID NO: 2052785 - protein, 18 aa, Staphylococcus
KSPMEVELVFQLKDKQFK

SEQ ID NO: 2052786 - protein, 18 aa, Staphylococcus
KSQIRWLSVLDMEGQKEE

SEQ ID NO: 2052787 - protein, 17 aa, Staphylococcus
KSREILDELGILKDGVF

SEQ ID NO: 2052788 - protein, 18 aa, Staphylococcus
KSRISVWLLNLIKSDVER

SEQ ID NO: 2052789 - protein, 20 aa, Staphylococcus
KSRISVWVLNLIKSSPNLLQ

SEQ ID NO: 2052790 - protein, 19 aa, Staphylococcus
KSRLLEMGFKLDAEPEGAF

SEQ ID NO: 2052791 - protein, 19 aa, Staphylococcus
KSRPYIANMLRLLHLPSAI

SEQ ID NO: 2052792 - protein, 21 aa, Staphylococcus
KSRVEKSIKDWGIELTDTYYV

SEQ ID NO: 2052793 - protein, 33 aa, Staphylococcus
KSTFARCFCGLAKGFKGSVSWQQCHAKRKQLLK

SEQ ID NO: 2052794 - protein, 17 aa, Staphylococcus
KSVKRKYTALVHDNIPH

SEQ ID NO: 2052795 - protein, 17 aa, Staphylococcus
KSVKRKYTALVHGNIPH

SEQ ID NO: 2052796 - protein, 17 aa, Staphylococcus
KSWYERFGFGKSTNGMF

SEQ ID NO: 2052797 - protein, 20 aa, Staphylococcus
KSWYERFGFSKPTGGLFDGE

SEQ ID NO: 2052798 - protein, 18 aa, Staphylococcus
KSYEPWKFQAFRPQKIIL

SEQ ID NO: 2052799 - protein, 18 aa, Staphylococcus
KTAIKHGLAFITENRKEE

SEQ ID NO: 2052800 - protein, 19 aa, Staphylococcus
KTDVKGFLYFFKFGQLSIE

SEQ ID NO: 2052801 - protein, 22 aa, Staphylococcus
KTETPLRHVLPFNKHNRYLVMP

SEQ ID NO: 2052802 - protein, 22 aa, Staphylococcus
KTETPLRYVLPFNKENRYLVMP

SEQ ID NO: 2052803 - protein, 18 aa, Staphylococcus
KTEYRGREATDFKEEDIE

SEQ ID NO: 2052804 - protein, 18 aa, Staphylococcus
KTEYRGREATDFQEEDIE

SEQ ID NO: 2052805 - protein, 19 aa, Staphylococcus
KTFAPVREWGWSREEEIDY

SEQ ID NO: 2052806 - protein, 17 aa, Staphylococcus
KTFKVIDHIGAGTVSHK

SEQ ID NO: 2052807 - protein, 17 aa, Staphylococcus
KTFPGYVLVELVMTDQS

SEQ ID NO: 2052808 - protein, 19 aa, Staphylococcus
KTGESGKLFGSVSTKQIAQ

SEQ ID NO: 2052809 - protein, 21 aa, Staphylococcus
KTICGKKCLFIHYEIENQRLE

SEQ ID NO: 2052810 - protein, 18 aa, Staphylococcus
KTICLRTKNIEEVKATLQ

SEQ ID NO: 2052811 - protein, 23 aa, Staphylococcus
KTISIRWSQDWNDVTALTLYWTA

SEQ ID NO: 2052812 - protein, 19 aa, Staphylococcus
KTKIKGWVRELLWMSIYQY

SEQ ID NO: 2052813 - protein, 21 aa, Staphylococcus
KTKIKGWVRQLLWMSIYQYVY

SEQ ID NO: 2052814 - protein, 18 aa, Staphylococcus
KTKQRILGDMGHVSNEDA

SEQ ID NO: 2052815 - protein, 17 aa, Staphylococcus
KTLIPRQQFEVPVQAAV

SEQ ID NO: 2052816 - protein, 24 aa, Staphylococcus
KTLMPSIRMSYMILPTKLVRQFEL

SEQ ID NO: 2052817 - protein, 17 aa, Staphylococcus
KTLSKWKKWFDVTILEE

SEQ ID NO: 2052818 - protein, 19 aa, Staphylococcus
KTRIKGWVRQLLWMSLYQY

SEQ ID NO: 2052819 - protein, 17 aa, Staphylococcus
KTTEFDDMVSLMLMHHK

SEQ ID NO: 2052820 - protein, 19 aa, Staphylococcus
KTTLVTFKFMAPLDEETMT

SEQ ID NO: 2052821 - protein, 17 aa, Staphylococcus
KTVKRKYTALVHGNIPH

SEQ ID NO: 2052822 - protein, 19 aa, Staphylococcus
KTVLGIIIGQIKWMMNQSR

SEQ ID NO: 2052823 - protein, 20 aa, Staphylococcus
KTYIFYQLFETFVIDQSMAS

SEQ ID NO: 2052824 - protein, 24 aa, Staphylococcus
KTYLPRKFKIGIAVPPSNDIDVYS

SEQ ID NO: 2052825 - protein, 22 aa, Staphylococcus
KVAKRLNKTVAILLDTKGPEIR

SEQ ID NO: 2052826 - protein, 18 aa, Staphylococcus
KVATCVKGKFSWGHINSD

SEQ ID NO: 2052827 - protein, 17 aa, Staphylococcus
KVHDIQSADEWGIHTSN

SEQ ID NO: 2052828 - protein, 21 aa, Staphylococcus
KVHLMKECLERGIKMISSMGA

SEQ ID NO: 2052829 - protein, 17 aa, Staphylococcus
KVIRGGYLYSYRKQNQF

SEQ ID NO: 2052830 - protein, 17 aa, Staphylococcus
KVKRLFDHIDIPTAKDW

SEQ ID NO: 2052831 - protein, 21 aa, Staphylococcus
KVKVALCQLILSPFNLLILDE

SEQ ID NO: 2052832 - protein, 17 aa, Staphylococcus
KVLGRLNYRTSYGQNVL

SEQ ID NO: 2052833 - protein, 23 aa, Staphylococcus
KVLNFGSGHAWGMIGLEIETEEL

SEQ ID NO: 2052834 - protein, 19 aa, Staphylococcus
KVMCLPQNFAVAALTATAT

SEQ ID NO: 2052835 - protein, 24 aa, Staphylococcus
KVRVKEILDELGILKNGIFVHDID

SEQ ID NO: 2052836 - protein, 17 aa, Staphylococcus
KVSFRFWPFNEFKSNFN

SEQ ID NO: 2052837 - protein, 18 aa, Staphylococcus
KVTRLGAILDEFLEADKY

SEQ ID NO: 2052838 - protein, 20 aa, Staphylococcus
KVVGSWRLEECTLYVTLEPC

SEQ ID NO: 2052839 - protein, 17 aa, Staphylococcus
KVVRLANFGAFVEIAPG

SEQ ID NO: 2052840 - protein, 17 aa, Staphylococcus
KVYLSFMDTLKWCKNKF

SEQ ID NO: 2052841 - protein, 17 aa, Staphylococcus
KVYLSLMNIKKWCQNTF

SEQ ID NO: 2052842 - protein, 19 aa, Staphylococcus
KVYRFPIMYIEYSGTFGDM

SEQ ID NO: 2052843 - protein, 20 aa, Staphylococcus
KVYTCLKSVFGELNIISEQL

SEQ ID NO: 2052844 - protein, 20 aa, Staphylococcus
KWHISNCLMYNNYLRYQWTI

SEQ ID NO: 2052845 - protein, 24 aa, Staphylococcus
KWKGIPAGISLKLISIFTGKRKRL

SEQ ID NO: 2052846 - protein, 20 aa, Staphylococcus
KWMSGQVFISLAVKFSKARL

SEQ ID NO: 2052847 - protein, 21 aa, Staphylococcus
KWNKKLVKFMLVFDTETMSIH

SEQ ID NO: 2052848 - protein, 21 aa, Staphylococcus
KWNKKSVRFMLVFDTKSMTIQ

SEQ ID NO: 2052849 - protein, 19 aa, Staphylococcus
KWNYEVIVAKQFDNIIDVF

SEQ ID NO: 2052850 - protein, 21 aa, Staphylococcus
KWSTRLWSDMDVVRRHVQKTT

SEQ ID NO: 2052851 - protein, 19 aa, Staphylococcus
KYAESFGAKGLRVSNQEEL

SEQ ID NO: 2052852 - protein, 19 aa, Staphylococcus
KYAESFGAKGLRVTNQEEL

SEQ ID NO: 2052853 - protein, 18 aa, Staphylococcus
KYDLFVLVVTDIINSDSK

SEQ ID NO: 2052854 - protein, 18 aa, Staphylococcus
KYDLFVLVVTDIINSNSK

SEQ ID NO: 2052855 - protein, 25 aa, Staphylococcus
KYDSFIGGFVWEWCDHSIQVGIKEG

SEQ ID NO: 2052856 - protein, 24 aa, Staphylococcus
KYEHYRLGINMAIQYLSYKKRTEK

SEQ ID NO: 2052857 - protein, 19 aa, Staphylococcus
KYFREGLILFTYLHLANEE

SEQ ID NO: 2052858 - protein, 20 aa, Staphylococcus
KYGKDIPSLITYQSKLEHEI

SEQ ID NO: 2052859 - protein, 19 aa, Staphylococcus
KYIPYCIEPSLGADRVTLA

SEQ ID NO: 2052860 - protein, 24 aa, Staphylococcus
KYKAEYRQGYFTSFERKNEADGIA

SEQ ID NO: 2052861 - protein, 21 aa, Staphylococcus
KYKEIDIYSGIEMDILPDGQL

SEQ ID NO: 2052862 - protein, 20 aa, Staphylococcus
KYKEILGAFIVGPHATDLIG

SEQ ID NO: 2052863 - protein, 17 aa, Staphylococcus
KYLKMKWPFVVITISVE

SEQ ID NO: 2052864 - protein, 18 aa, Staphylococcus
KYMPVDFMAEFTFNTTRA

SEQ ID NO: 2052865 - protein, 24 aa, Staphylococcus
KYPAFIGAFVWEWCDHAVTAGMQH

SEQ ID NO: 2052866 - protein, 21 aa, Staphylococcus
KYPKLFPHIKLSTNVHITGEI

SEQ ID NO: 2052867 - protein, 22 aa, Staphylococcus
KYPSKVILLAWNRYLTDTASNY

SEQ ID NO: 2052868 - protein, 18 aa, Staphylococcus
KYSPEFAQPINLKIILIH

SEQ ID NO: 2052869 - protein, 20 aa, Staphylococcus
KYSRLRSVYRYEIFNEQGEL

SEQ ID NO: 2052870 - protein, 17 aa, Staphylococcus
KYVPKDCIFISLCENQR

SEQ ID NO: 2052871 - protein, 19 aa, Staphylococcus
KYWAELKAAFDVLDVTMPI

SEQ ID NO: 2052872 - protein, 23 aa, Staphylococcus
KYYKDRVLVPLAYLKFDEYIEEL

SEQ ID NO: 2052873 - protein, 18 aa, Staphylococcus
KYYREVADSFIIDTPSAS

SEQ ID NO: 2052874 - protein, 17 aa, Staphylococcus
KYYRFGIQNVSSHLDYI

SEQ ID NO: 2052875 - protein, 18 aa, Staphylococcus
LAAAFAAGSPVVFKPSEE

SEQ ID NO: 2052876 - protein, 20 aa, Staphylococcus
LAAKRKLSIFLYSINDFTDF

SEQ ID NO: 2052877 - protein, 17 aa, Staphylococcus
LAAKRKLSVFLYSVNDF

SEQ ID NO: 2052878 - protein, 17 aa, Staphylococcus
LAAKRKLSVFLYSVNDL

SEQ ID NO: 2052879 - protein, 18 aa, Staphylococcus
LAAMMEGCYVLRAIEMVE

SEQ ID NO: 2052880 - protein, 18 aa, Staphylococcus
LADRRKAFQFAYLSLMQQ

SEQ ID NO: 2052881 - protein, 22 aa, Staphylococcus
LAEEYQCPVIILSDLQLALGKQ

SEQ ID NO: 2052882 - protein, 21 aa, Staphylococcus
LAEGQRGFFIIPLNGLKKLQT

SEQ ID NO: 2052883 - protein, 20 aa, Staphylococcus
LAEPFPFCRVDFLVSENDVK

SEQ ID NO: 2052884 - protein, 19 aa, Staphylococcus
LAFDACFFEIWLPLLNNGS

SEQ ID NO: 2052885 - protein, 18 aa, Staphylococcus
LAGFVEWARCENPNMDAD

SEQ ID NO: 2052886 - protein, 17 aa, Staphylococcus
LAGGILSVILNWIQYGQ

SEQ ID NO: 2052887 - protein, 18 aa, Staphylococcus
LAGLRIGIVISTPETIQQ

SEQ ID NO: 2052888 - protein, 22 aa, Staphylococcus
LAGPVVACAVILNADHAYYGLD

SEQ ID NO: 2052889 - protein, 22 aa, Staphylococcus
LAGPVVACAVILNANHHYLGLN

SEQ ID NO: 2052890 - protein, 18 aa, Staphylococcus
LAGPVVACAVILNEGHRY

SEQ ID NO: 2052891 - protein, 18 aa, Staphylococcus
LAGPVVACAVILNKEHQY

SEQ ID NO: 2052892 - protein, 19 aa, Staphylococcus
LAHAGWRGTVGRIVEEILK

SEQ ID NO: 2052893 - protein, 24 aa, Staphylococcus
LAKEGMMLCEFLKVKPEILKFMLK

SEQ ID NO: 2052894 - protein, 18 aa, Staphylococcus
LAKEILLSLPNDFDREVQ

SEQ ID NO: 2052895 - protein, 24 aa, Staphylococcus
LAKRFGFSEGLVFKQAVTKGVDPT

SEQ ID NO: 2052896 - protein, 17 aa, Staphylococcus
LAKRLKQEYGLKFADSK

SEQ ID NO: 2052897 - protein, 18 aa, Staphylococcus
LALDIFASRIHKYIGSYA

SEQ ID NO: 2052898 - protein, 17 aa, Staphylococcus
LALKHKPKLIVAGTSAY

SEQ ID NO: 2052899 - protein, 17 aa, Staphylococcus
LALKRKRVTAVRFNIQR

SEQ ID NO: 2052900 - protein, 17 aa, Staphylococcus
LANEMGVTIDARYGDVT

SEQ ID NO: 2052901 - protein, 18 aa, Staphylococcus
LANQWWLYLFNHTLKGVG

SEQ ID NO: 2052902 - protein, 19 aa, Staphylococcus
LAPALATGCSLVMKPSEIT

SEQ ID NO: 2052903 - protein, 17 aa, Staphylococcus
LAPEAAFETIISDALTV

SEQ ID NO: 2052904 - protein, 20 aa, Staphylococcus
LAPYRLAPEAAFETIISDAL

SEQ ID NO: 2052905 - protein, 18 aa, Staphylococcus
LAQHLGWQGNHTDFDVLP

SEQ ID NO: 2052906 - protein, 20 aa, Staphylococcus
LARFPWLSANIEYNMTREPY

SEQ ID NO: 2052907 - protein, 23 aa, Staphylococcus
LARHLKWPILKERHGLFKTEMGL

SEQ ID NO: 2052908 - protein, 17 aa, Staphylococcus
LARIRIQEIGFILQSTN

SEQ ID NO: 2052909 - protein, 17 aa, Staphylococcus
LASESVFPKFIETRKSS

SEQ ID NO: 2052910 - protein, 17 aa, Staphylococcus
LASFYVACELFKQMDYS

SEQ ID NO: 2052911 - protein, 17 aa, Staphylococcus
LAVEMGATLGWHKYVGL

SEQ ID NO: 2052912 - protein, 23 aa, Staphylococcus
LAVSRTSFDWGIRVQSNPKHVVY

SEQ ID NO: 2052913 - protein, 18 aa, Staphylococcus
LAYLKSRLLEMGFKLDAE

SEQ ID NO: 2052914 - protein, 26 aa, Staphylococcus
LAYLRKAQCMFGWDWGIKLPDFGIWK

SEQ ID NO: 2052915 - protein, 19 aa, Staphylococcus
LCAFREIIMNYSLSEIKAI

SEQ ID NO: 2052916 - protein, 19 aa, Staphylococcus
LCEALKINVDFIPNDYSQE

SEQ ID NO: 2052917 - protein, 17 aa, Staphylococcus
LCEKLNISLSEVICFGD

SEQ ID NO: 2052918 - protein, 18 aa, Staphylococcus
LCGFGQLFQYLRKEMIAE

SEQ ID NO: 2052919 - protein, 18 aa, Staphylococcus
LCIELCSIASDIKEKQGV

SEQ ID NO: 2052920 - protein, 18 aa, Staphylococcus
LCLFCPIQSHCEAFEQGT

SEQ ID NO: 2052921 - protein, 20 aa, Staphylococcus
LCSGLPRLVEYLNIDIKEEQ

SEQ ID NO: 2052922 - protein, 17 aa, Staphylococcus
LCSSGLYALVDGEVVEG

SEQ ID NO: 2052923 - protein, 19 aa, Staphylococcus
LCTFLKAYFNNDASTEEEI

SEQ ID NO: 2052924 - protein, 18 aa, Staphylococcus
LDEHFPLVVWQTGSGTQS

SEQ ID NO: 2052925 - protein, 21 aa, Staphylococcus
LDENKRLFSIYSNSDLKGMLH

SEQ ID NO: 2052926 - protein, 25 aa, Staphylococcus
LDGATKEFFAWGFRVGFITFGVEDA

SEQ ID NO: 2052927 - protein, 24 aa, Staphylococcus
LDGATKEFFAWGFRVGFMTFGTKN

SEQ ID NO: 2052928 - protein, 25 aa, Staphylococcus
LDGATKEFFAWGLRVGFITFGIKDE

SEQ ID NO: 2052929 - protein, 26 aa, Staphylococcus
LDGATKEFFAWGLRVGFLTFGLNNNV

SEQ ID NO: 2052930 - protein, 25 aa, Staphylococcus
LDGATKEFFAWGLRVGFLTFGLSNQ

SEQ ID NO: 2052931 - protein, 24 aa, Staphylococcus
LDGATKEFFAWGLRVGFMTFGIHN

SEQ ID NO: 2052932 - protein, 19 aa, Staphylococcus
LDGDLPLFPGHGDYTTVDD

SEQ ID NO: 2052933 - protein, 19 aa, Staphylococcus
LDGDLPLFPGHGQYTTVDD

SEQ ID NO: 2052934 - protein, 17 aa, Staphylococcus
LDHRGGVGADGITGDGA

SEQ ID NO: 2052935 - protein, 17 aa, Staphylococcus
LDIALSEVVAFGDSSND

SEQ ID NO: 2052936 - protein, 19 aa, Staphylococcus
LDIDVVLECTGFFADKEKA

SEQ ID NO: 2052937 - protein, 19 aa, Staphylococcus
LDIDVVLECTGFYTDKDKA

SEQ ID NO: 2052938 - protein, 19 aa, Staphylococcus
LDIDVVLECTGFYTSEEKA

SEQ ID NO: 2052939 - protein, 22 aa, Staphylococcus
LDIPRVLGDIIICTDVAHEQAE

SEQ ID NO: 2052940 - protein, 17 aa, Staphylococcus
LDKGLSIKFEEISKEVE

SEQ ID NO: 2052941 - protein, 17 aa, Staphylococcus
LDKYKLYLETRHIEHID

SEQ ID NO: 2052942 - protein, 24 aa, Staphylococcus
LDLFACLRPVRWFKGVPSPVKRPE

SEQ ID NO: 2052943 - protein, 17 aa, Staphylococcus
LDLLSKIAITFSEEENV

SEQ ID NO: 2052944 - protein, 20 aa, Staphylococcus
LDLPERMSVIVGREDVDEVK

SEQ ID NO: 2052945 - protein, 22 aa, Staphylococcus
LDLPFSIRMARTLLGSTDFITY

SEQ ID NO: 2052946 - protein, 21 aa, Staphylococcus
LDMVIPLLVKYGIALEAHLQN

SEQ ID NO: 2052947 - protein, 25 aa, Staphylococcus
LDNKSRWLGYYGFNVSSEWMIPKIM

SEQ ID NO: 2052948 - protein, 20 aa, Staphylococcus
LDPKSRIQVMSLFKQLQEEQ

SEQ ID NO: 2052949 - protein, 19 aa, Staphylococcus
LDPSLPIDLIIDYAHTADG

SEQ ID NO: 2052950 - protein, 21 aa, Staphylococcus
LDPSLPIDLIIDYAHTADGMD

SEQ ID NO: 2052951 - protein, 21 aa, Staphylococcus
LDPSLPIDLIIDYAHTTDGIE

SEQ ID NO: 2052952 - protein, 24 aa, Staphylococcus
LDPVFTWHLAFAFGQEERDKEAQH

SEQ ID NO: 2052953 - protein, 18 aa, Staphylococcus
LDQLPCWLTYTNDKTHQV

SEQ ID NO: 2052954 - protein, 18 aa, Staphylococcus
LDQLPCWLTYTNGDTHQV

SEQ ID NO: 2052955 - protein, 18 aa, Staphylococcus
LDQTVGWFTKTCPVEVDC

SEQ ID NO: 2052956 - protein, 17 aa, Staphylococcus
LDRCRIAKMISRYMITN

SEQ ID NO: 2052957 - protein, 17 aa, Staphylococcus
LDREGFFYAPTILDHVK

SEQ ID NO: 2052958 - protein, 19 aa, Staphylococcus
LDRGFDFYAPQTFIDKDGK

SEQ ID NO: 2052959 - protein, 17 aa, Staphylococcus
LDRIMRMLHPFMPFVTE

SEQ ID NO: 2052960 - protein, 17 aa, Staphylococcus
LDSCKKIKYMFPKAHAA

SEQ ID NO: 2052961 - protein, 19 aa, Staphylococcus
LDVAGEFDIQIALHADTLN

SEQ ID NO: 2052962 - protein, 24 aa, Staphylococcus
LDVMVEPFFEWVIEKDAWYGEELE

SEQ ID NO: 2052963 - protein, 18 aa, Staphylococcus
LDYAYDFLKFCFKNPKTC

SEQ ID NO: 2052964 - protein, 19 aa, Staphylococcus
LDYGFDFYAPQTFLDKQGN

SEQ ID NO: 2052965 - protein, 17 aa, Staphylococcus
LDYLDLYLIHWPCEKDG

SEQ ID NO: 2052966 - protein, 22 aa, Staphylococcus
LDYLHFLGVDYIWLTPIYESPM

SEQ ID NO: 2052967 - protein, 18 aa, Staphylococcus
LDYTFSWELYISKENITN

SEQ ID NO: 2052968 - protein, 18 aa, Staphylococcus
LEAAELLELFQWKTPEEV

SEQ ID NO: 2052969 - protein, 17 aa, Staphylococcus
LEAERALACNYDMIIAA

SEQ ID NO: 2052970 - protein, 25 aa, Staphylococcus
LEATFGVKCDFEFSKDYPALYNDPD

SEQ ID NO: 2052971 - protein, 19 aa, Staphylococcus
LEDGCIYREVYHLKRITES

SEQ ID NO: 2052972 - protein, 19 aa, Staphylococcus
LEDYLKYFQGAIVIISHDR

SEQ ID NO: 2052973 - protein, 18 aa, Staphylococcus
LEECGQCSSCIQQNKTYD

SEQ ID NO: 2052974 - protein, 19 aa, Staphylococcus
LEELCALGIQIGTDIPFCI

SEQ ID NO: 2052975 - protein, 17 aa, Staphylococcus
LEFEQWLAILLIKNNNL

SEQ ID NO: 2052976 - protein, 21 aa, Staphylococcus
LEFKCQIIGLPFWKTKYSTQE

SEQ ID NO: 2052977 - protein, 17 aa, Staphylococcus
LEFKTCKPIDISKVEPA

SEQ ID NO: 2052978 - protein, 18 aa, Staphylococcus
LEGDLPLFPGHGPYTTVD

SEQ ID NO: 2052979 - protein, 18 aa, Staphylococcus
LEGYHYFGLLYIGAILTS

SEQ ID NO: 2052980 - protein, 18 aa, Staphylococcus
LEGYQFLKNKGFDTIFVT

SEQ ID NO: 2052981 - protein, 19 aa, Staphylococcus
LEHILKEIGSLSCIHLIST

SEQ ID NO: 2052982 - protein, 21 aa, Staphylococcus
LEHLRNLNISYVFGGPNKNLD

SEQ ID NO: 2052983 - protein, 17 aa, Staphylococcus
LEIAEAFVRSGAVDIIV

SEQ ID NO: 2052984 - protein, 21 aa, Staphylococcus
LEIGESIALYGEDNHLYGVLE

SEQ ID NO: 2052985 - protein, 17 aa, Staphylococcus
LEIGTAIGYSAMQFASV

SEQ ID NO: 2052986 - protein, 19 aa, Staphylococcus
LEIGTAIGYSAMQFASVSD

SEQ ID NO: 2052987 - protein, 18 aa, Staphylococcus
LEILKKLDIHNACVVVTR

SEQ ID NO: 2052988 - protein, 17 aa, Staphylococcus
LEILKKLDLHDVCVVVT

SEQ ID NO: 2052989 - protein, 22 aa, Staphylococcus
LEIQNRLGIEVSIMDFDRDEWA

SEQ ID NO: 2052990 - protein, 23 aa, Staphylococcus
LEKDIYKQMAWEGFKPFEVTNIT

SEQ ID NO: 2052991 - protein, 19 aa, Staphylococcus
LEKGYTEWTHIWSGQSTRL

SEQ ID NO: 2052992 - protein, 22 aa, Staphylococcus
LEKLRLLTHVQYFYNYNNENAL

SEQ ID NO: 2052993 - protein, 17 aa, Staphylococcus
LEKRIDRFIAYKDRNNC

SEQ ID NO: 2052994 - protein, 17 aa, Staphylococcus
LELKRIQIANLRLDEEL

SEQ ID NO: 2052995 - protein, 17 aa, Staphylococcus
LELLESVAFQIGSAIKR

SEQ ID NO: 2052996 - protein, 19 aa, Staphylococcus
LELLPYLFFQFAKDGKRLY

SEQ ID NO: 2052997 - protein, 17 aa, Staphylococcus
LEMTLRLLGIGPGDEVI

SEQ ID NO: 2052998 - protein, 25 aa, Staphylococcus
LENAELSWHLGLIWRRDAYLNFVTR

SEQ ID NO: 2052999 - protein, 22 aa, Staphylococcus
LENEIWKDMALILKDILSNITE

SEQ ID NO: 2053000 - protein, 18 aa, Staphylococcus
LENIEFKMLCMGFKPKEI

SEQ ID NO: 2053001 - protein, 18 aa, Staphylococcus
LENVPGFKALRFLRPKTV

SEQ ID NO: 2053002 - protein, 22 aa, Staphylococcus
LEPEEFIMWFLGMNESIADVKE

SEQ ID NO: 2053003 - protein, 21 aa, Staphylococcus
LEPLPSILIRSSVSQSFLNLI

SEQ ID NO: 2053004 - protein, 23 aa, Staphylococcus
LEPRINQLLPYQVNKEMLINTMN

SEQ ID NO: 2053005 - protein, 20 aa, Staphylococcus
LEPWRFLVIQNKTLREKLIP

SEQ ID NO: 2053006 - protein, 18 aa, Staphylococcus
LEPWRFVVIESQELKDKL

SEQ ID NO: 2053007 - protein, 17 aa, Staphylococcus
LEPWRFVVIQNREIRDK

SEQ ID NO: 2053008 - protein, 17 aa, Staphylococcus
LEQEYSKDEIFEMYLNK

SEQ ID NO: 2053009 - protein, 18 aa, Staphylococcus
LEQHVQFLLDNNVKAIIV

SEQ ID NO: 2053010 - protein, 23 aa, Staphylococcus
LEQKFELLFVRWVPRNQNKEANH

SEQ ID NO: 2053011 - protein, 18 aa, Staphylococcus
LEQLPCWLTYTNDKTHQV

SEQ ID NO: 2053012 - protein, 17 aa, Staphylococcus
LERAMPSQGRFGGHFVL

SEQ ID NO: 2053013 - protein, 19 aa, Staphylococcus
LERHVKFLLENNTQAIIVN

SEQ ID NO: 2053014 - protein, 19 aa, Staphylococcus
LESEVKFTAHMDVQDKLSD

SEQ ID NO: 2053015 - protein, 20 aa, Staphylococcus
LESFPSKYLILYMDNQAEIS

SEQ ID NO: 2053016 - protein, 22 aa, Staphylococcus
LESMALDFKVGGLLNKKKKTEE

SEQ ID NO: 2053017 - protein, 22 aa, Staphylococcus
LESWIKQGIRVEGLKDNKIRIE

SEQ ID NO: 2053018 - protein, 18 aa, Staphylococcus
LEVLKFLYFKMNKLGADI

SEQ ID NO: 2053019 - protein, 22 aa, Staphylococcus
LEVLKRGTAILITGGFQPTKEV

SEQ ID NO: 2053020 - protein, 25 aa, Staphylococcus
LEVNPRYIYCGTIGLLCPDDKMIFN

SEQ ID NO: 2053021 - protein, 20 aa, Staphylococcus
LEWFYRLITDWKRMARMQRL

SEQ ID NO: 2053022 - protein, 20 aa, Staphylococcus
LEYIDLYLIHWPCEKNELYI

SEQ ID NO: 2053023 - protein, 17 aa, Staphylococcus
LFAGFGAKVVGYDLYPN

SEQ ID NO: 2053024 - protein, 17 aa, Staphylococcus
LFDAVLMTIKYIMREAD

SEQ ID NO: 2053025 - protein, 18 aa, Staphylococcus
LFDAVLMTVKYVIREANI

SEQ ID NO: 2053026 - protein, 18 aa, Staphylococcus
LFDAVLMTVKYVVREADI

SEQ ID NO: 2053027 - protein, 18 aa, Staphylococcus
LFDAVLMTVKYVVREANI

SEQ ID NO: 2053028 - protein, 19 aa, Staphylococcus
LFDDVCRFMLNEGHISTSL

SEQ ID NO: 2053029 - protein, 18 aa, Staphylococcus
LFEQAGFSHVKVRSFTGG

SEQ ID NO: 2053030 - protein, 18 aa, Staphylococcus
LFEQFRLMISPLVEADKL

SEQ ID NO: 2053031 - protein, 19 aa, Staphylococcus
LFFKACERAGVYGLIIPDL

SEQ ID NO: 2053032 - protein, 17 aa, Staphylococcus
LFFQKGIFNGEENMLVS

SEQ ID NO: 2053033 - protein, 18 aa, Staphylococcus
LFHMYGWDNVDTEYNMRL

SEQ ID NO: 2053034 - protein, 26 aa, Staphylococcus
LFHYEFKSRISVWVLNYLKASPKKLQ

SEQ ID NO: 2053035 - protein, 18 aa, Staphylococcus
LFIDWTWGEDYFRRKLID

SEQ ID NO: 2053036 - protein, 18 aa, Staphylococcus
LFIDWTWGEEYFRQKLID

SEQ ID NO: 2053037 - protein, 18 aa, Staphylococcus
LFIDWTWGENYFKNLLID

SEQ ID NO: 2053038 - protein, 18 aa, Staphylococcus
LFINETLILFPLKHHRAP

SEQ ID NO: 2053039 - protein, 19 aa, Staphylococcus
LFKRVLPDVLIKLEKAGYE

SEQ ID NO: 2053040 - protein, 17 aa, Staphylococcus
LFKTLPFDFLSDIVYQW

SEQ ID NO: 2053041 - protein, 22 aa, Staphylococcus
LFKYKIIFCFDGADFFSFGRIH

SEQ ID NO: 2053042 - protein, 23 aa, Staphylococcus
LFKYKVIFCFDGLDFFRYGRIHR

SEQ ID NO: 2053043 - protein, 18 aa, Staphylococcus
LFLDEVFEMGIDIDTLVR

SEQ ID NO: 2053044 - protein, 22 aa, Staphylococcus
LFLFELRMQWLNRLEKASDEAI

SEQ ID NO: 2053045 - protein, 19 aa, Staphylococcus
LFNEEDWIIAYDVYFKSMI

SEQ ID NO: 2053046 - protein, 18 aa, Staphylococcus
LFPLIARTGGVLVRNGHT

SEQ ID NO: 2053047 - protein, 18 aa, Staphylococcus
LFPNRVNLGLGRAPGTDM

SEQ ID NO: 2053048 - protein, 18 aa, Staphylococcus
LFPSCRIAYLVLPKKLLA

SEQ ID NO: 2053049 - protein, 24 aa, Staphylococcus
LFPVLERRGIYILPRKMWADDDII

SEQ ID NO: 2053050 - protein, 30 aa, Staphylococcus
LFQKLNIEWVYRLLIDWKRIGRMMSIPKFM

SEQ ID NO: 2053051 - protein, 17 aa, Staphylococcus
LFRGVHYEICCVDRKGY

SEQ ID NO: 2053052 - protein, 20 aa, Staphylococcus
LFRNLNMEWVYRLLIDWKRI

SEQ ID NO: 2053053 - protein, 23 aa, Staphylococcus
LFRSEGLKVLGYREVPVNKEVLA

SEQ ID NO: 2053054 - protein, 23 aa, Staphylococcus
LFRVPAEQSIPIWTDSKRDTLQA

SEQ ID NO: 2053055 - protein, 17 aa, Staphylococcus
LFSEPRFNVDVLKVEVP

SEQ ID NO: 2053056 - protein, 18 aa, Staphylococcus
LFSQVGMFSPMFNEVVDV

SEQ ID NO: 2053057 - protein, 25 aa, Staphylococcus
LFVGYEVLNTFAFRITRNADLTIHE

SEQ ID NO: 2053058 - protein, 19 aa, Staphylococcus
LFYEHGWILVEDRIRELQQ

SEQ ID NO: 2053059 - protein, 18 aa, Staphylococcus
LGALRLKLARELDLIDES

SEQ ID NO: 2053060 - protein, 22 aa, Staphylococcus
LGAPLWKKWLMAFAARKINKAA

SEQ ID NO: 2053061 - protein, 18 aa, Staphylococcus
LGASRLMIEYGITNLISK

SEQ ID NO: 2053062 - protein, 23 aa, Staphylococcus
LGAVWHFAEKVIFPYVEDDELIG

SEQ ID NO: 2053063 - protein, 23 aa, Staphylococcus
LGDFKAPMGCRSFLPSWKDATGN

SEQ ID NO: 2053064 - protein, 23 aa, Staphylococcus
LGDFKAPMGCRSFLPSWRNEQGE

SEQ ID NO: 2053065 - protein, 27 aa, Staphylococcus
LGEDCLRTIEIFKLLGVEIEIEEHRLI

SEQ ID NO: 2053066 - protein, 27 aa, Staphylococcus
LGEDCLRTIEIFKLLGVNIELAEEKII

SEQ ID NO: 2053067 - protein, 24 aa, Staphylococcus
LGEDCLRTLNIFKLLGVDITIKDD

SEQ ID NO: 2053068 - protein, 19 aa, Staphylococcus
LGFAGGFPGQFIAETLAKS

SEQ ID NO: 2053069 - protein, 18 aa, Staphylococcus
LGFGEPFPISGSHGLGLG

SEQ ID NO: 2053070 - protein, 21 aa, Staphylococcus
LGFKEGHSFSHHLLIEQSVTA

SEQ ID NO: 2053071 - protein, 20 aa, Staphylococcus
LGFKEGHSYSHYLLIEQAVN

SEQ ID NO: 2053072 - protein, 25 aa, Staphylococcus
LGFKVLRISISWPRIFPNGDELEPN

SEQ ID NO: 2053073 - protein, 21 aa, Staphylococcus
LGFLALHGFLHLLGYDHMNEA

SEQ ID NO: 2053074 - protein, 21 aa, Staphylococcus
LGFLALHGFLHLLGYDHMNEE

SEQ ID NO: 2053075 - protein, 21 aa, Staphylococcus
LGFLALHGFLHLLGYDHMTDE

SEQ ID NO: 2053076 - protein, 18 aa, Staphylococcus
LGFPEARIPLSQAVIELS

SEQ ID NO: 2053077 - protein, 19 aa, Staphylococcus
LGFRGDIFGGYILYNCGFI

SEQ ID NO: 2053078 - protein, 24 aa, Staphylococcus
LGFRGDIFGGYILYRLGFIESEGR

SEQ ID NO: 2053079 - protein, 17 aa, Staphylococcus
LGFRKLKTGMAIYNNAK

SEQ ID NO: 2053080 - protein, 24 aa, Staphylococcus
LGIDEYKPHIAIITNIYSAHLDYH

SEQ ID NO: 2053081 - protein, 17 aa, Staphylococcus
LGIEVGDFISLDPRTEI

SEQ ID NO: 2053082 - protein, 18 aa, Staphylococcus
LGIITPFYGHIDRWNEQN

SEQ ID NO: 2053083 - protein, 17 aa, Staphylococcus
LGIQIGTDIPFCILGKT

SEQ ID NO: 2053084 - protein, 19 aa, Staphylococcus
LGIRLRQPIDLQYGDILYQ

SEQ ID NO: 2053085 - protein, 23 aa, Staphylococcus
LGKDRITAIFPKLVFSIKRGVNL

SEQ ID NO: 2053086 - protein, 22 aa, Staphylococcus
LGKNRITAIFPKLVFTIKKGVN

SEQ ID NO: 2053087 - protein, 17 aa, Staphylococcus
LGKQLKLFMFSEEAPGM

SEQ ID NO: 2053088 - protein, 17 aa, Staphylococcus
LGLAIGVLTGIAKKEEL

SEQ ID NO: 2053089 - protein, 18 aa, Staphylococcus
LGLDYLDLYLIHWPGTDN

SEQ ID NO: 2053090 - protein, 24 aa, Staphylococcus
LGLEYLDLFLIHWPCEENGLFIES

SEQ ID NO: 2053091 - protein, 18 aa, Staphylococcus
LGLNSNWDMLFIVFSIHF

SEQ ID NO: 2053092 - protein, 18 aa, Staphylococcus
LGLNSNWDMLFIVFSIHL

SEQ ID NO: 2053093 - protein, 18 aa, Staphylococcus
LGLNSNWDMLYIVFSLHY

SEQ ID NO: 2053094 - protein, 20 aa, Staphylococcus
LGLPRLSQYLKFNLKAEQER

SEQ ID NO: 2053095 - protein, 17 aa, Staphylococcus
LGLSIGVLTGIAKREEL

SEQ ID NO: 2053096 - protein, 19 aa, Staphylococcus
LGMKQRLGIALALLTGPDI

SEQ ID NO: 2053097 - protein, 23 aa, Staphylococcus
LGMKQRLGLALALLNGPDLLVLD

SEQ ID NO: 2053098 - protein, 17 aa, Staphylococcus
LGMYPKDVQVMGAIVMH

SEQ ID NO: 2053099 - protein, 23 aa, Staphylococcus
LGNKNSRVDFGLSQWGLKQQPGE

SEQ ID NO: 2053100 - protein, 21 aa, Staphylococcus
LGRTRELPVLDIYDISYSFEK

SEQ ID NO: 2053101 - protein, 22 aa, Staphylococcus
LGSPRLGAHFVDYLVTLKDQGG

SEQ ID NO: 2053102 - protein, 21 aa, Staphylococcus
LGSRMRLRIVPELQFEYDHSI

SEQ ID NO: 2053103 - protein, 18 aa, Staphylococcus
LGSSEMNLDLAIEMYEGS

SEQ ID NO: 2053104 - protein, 18 aa, Staphylococcus
LGSVYIKITFYRKNDTEH

SEQ ID NO: 2053105 - protein, 19 aa, Staphylococcus
LGVALPWAIAAALVRPNTQ

SEQ ID NO: 2053106 - protein, 19 aa, Staphylococcus
LGVALPWAISAALVRPNTQ

SEQ ID NO: 2053107 - protein, 17 aa, Staphylococcus
LGVYRYLINTPKVYART

SEQ ID NO: 2053108 - protein, 18 aa, Staphylococcus
LGYQAEWIAALTHQALNG

SEQ ID NO: 2053109 - protein, 18 aa, Staphylococcus
LHCSKLCFEHPVNKKMIH

SEQ ID NO: 2053110 - protein, 19 aa, Staphylococcus
LHESLKIAGYHPFTIVLND

SEQ ID NO: 2053111 - protein, 17 aa, Staphylococcus
LHFETFISLSCHKCPDV

SEQ ID NO: 2053112 - protein, 18 aa, Staphylococcus
LHFFVRYGGEFQLKQGFS

SEQ ID NO: 2053113 - protein, 18 aa, Staphylococcus
LHHLLRIYQLAPRFIEKH

SEQ ID NO: 2053114 - protein, 24 aa, Staphylococcus
LHIGHLLPFLTLRRFQEHGHRPLV

SEQ ID NO: 2053115 - protein, 23 aa, Staphylococcus
LHIGHLLPFLTLRRFQQHGHRPI

SEQ ID NO: 2053116 - protein, 25 aa, Staphylococcus
LHMPGHSPGSLTFVFKDFAVVGDTL

SEQ ID NO: 2053117 - protein, 17 aa, Staphylococcus
LHPAICFTMLGHFLGID

SEQ ID NO: 2053118 - protein, 18 aa, Staphylococcus
LHYLRPKLLIDFEKQLFI

SEQ ID NO: 2053119 - protein, 18 aa, Staphylococcus
LIDDMAIHCILHITPSIN

SEQ ID NO: 2053120 - protein, 20 aa, Staphylococcus
LIDLALPLYVKYGIALEAHL

SEQ ID NO: 2053121 - protein, 17 aa, Staphylococcus
LIDLGHKTFLFLAEMGD

SEQ ID NO: 2053122 - protein, 25 aa, Staphylococcus
LIEELRPSLIISFYPGYAVHPDHEA

SEQ ID NO: 2053123 - protein, 17 aa, Staphylococcus
LIEKCWESENFIDDNTL

SEQ ID NO: 2053124 - protein, 18 aa, Staphylococcus
LIESPPLLMSMFKKARGN

SEQ ID NO: 2053125 - protein, 20 aa, Staphylococcus
LIGEPAWGLFSGVFGKGDNI

SEQ ID NO: 2053126 - protein, 18 aa, Staphylococcus
LIGKTLLTEYEFNKDVYE

SEQ ID NO: 2053127 - protein, 18 aa, Staphylococcus
LIGLSRLGIHSSLISALG

SEQ ID NO: 2053128 - protein, 19 aa, Staphylococcus
LIHGFKHYVALLFHKGAIL

SEQ ID NO: 2053129 - protein, 19 aa, Staphylococcus
LIHGFKHYVALLFHKGALL

SEQ ID NO: 2053130 - protein, 22 aa, Staphylococcus
LIHGFKTYVALLFFKGALIEDS

SEQ ID NO: 2053131 - protein, 17 aa, Staphylococcus
LIIKFSSAWSFLIPEIL

SEQ ID NO: 2053132 - protein, 17 aa, Staphylococcus
LIIKISSAWSFLVPEIL

SEQ ID NO: 2053133 - protein, 22 aa, Staphylococcus
LIIKISSAWSFLVPEILQIDEE

SEQ ID NO: 2053134 - protein, 17 aa, Staphylococcus
LIKERFPQALAVEMEAT

SEQ ID NO: 2053135 - protein, 18 aa, Staphylococcus
LIKQYGLRANINKTLTPH

SEQ ID NO: 2053136 - protein, 24 aa, Staphylococcus
LIKVKELYQLFAHLYTDAITLKEF

SEQ ID NO: 2053137 - protein, 17 aa, Staphylococcus
LILEELERTLSHVQDEQ

SEQ ID NO: 2053138 - protein, 18 aa, Staphylococcus
LILPYGFYRCHRSYIINL

SEQ ID NO: 2053139 - protein, 24 aa, Staphylococcus
LIPELQGRFPIRVELESLSVEDFV

SEQ ID NO: 2053140 - protein, 18 aa, Staphylococcus
LIPMPRAQFLDAIKDATA

SEQ ID NO: 2053141 - protein, 20 aa, Staphylococcus
LIQLPDKWYKGIVMPTIQSQ

SEQ ID NO: 2053142 - protein, 18 aa, Staphylococcus
LIRCCRYFIDILRKSTNG

SEQ ID NO: 2053143 - protein, 17 aa, Staphylococcus
LIRIYLALHTFDFSTDV

SEQ ID NO: 2053144 - protein, 17 aa, Staphylococcus
LISEIDCLQSFAEIAQK

SEQ ID NO: 2053145 - protein, 17 aa, Staphylococcus
LISRINIVNEWYDKNVI

SEQ ID NO: 2053146 - protein, 18 aa, Staphylococcus
LIVRTLLGIAVPTQIATH

SEQ ID NO: 2053147 - protein, 17 aa, Staphylococcus
LKAAVDLPIHLHTHDTS

SEQ ID NO: 2053148 - protein, 17 aa, Staphylococcus
LKADILLTAHHQDDQIE

SEQ ID NO: 2053149 - protein, 21 aa, Staphylococcus
LKADLIREFLDSVIPHLEEGT

SEQ ID NO: 2053150 - protein, 17 aa, Staphylococcus
LKADPAFYGEFLDHSHQ

SEQ ID NO: 2053151 - protein, 18 aa, Staphylococcus
LKAFNLYGALSMANAGPN

SEQ ID NO: 2053152 - protein, 17 aa, Staphylococcus
LKAGLLYTLEEECIKQG

SEQ ID NO: 2053153 - protein, 24 aa, Staphylococcus
LKALMKWPIPRRMLWLRKVQSTIK

SEQ ID NO: 2053154 - protein, 20 aa, Staphylococcus
LKARFPNTIKLVSSGHDSID

SEQ ID NO: 2053155 - protein, 18 aa, Staphylococcus
LKAYGFKFLGPVTVFSFM

SEQ ID NO: 2053156 - protein, 18 aa, Staphylococcus
LKDFNLSDTVGWYTEIYN

SEQ ID NO: 2053157 - protein, 18 aa, Staphylococcus
LKDGLLFRKMQIITDGGI

SEQ ID NO: 2053158 - protein, 17 aa, Staphylococcus
LKDGVLGKMDVAFSRDT

SEQ ID NO: 2053159 - protein, 20 aa, Staphylococcus
LKDLELPLAKILSEMEEIGI

SEQ ID NO: 2053160 - protein, 18 aa, Staphylococcus
LKDLPPAIVLNAEADVLR

SEQ ID NO: 2053161 - protein, 18 aa, Staphylococcus
LKDQHRLLPSIALLEGEY

SEQ ID NO: 2053162 - protein, 19 aa, Staphylococcus
LKDQKRLLPSIAYLEGEYG

SEQ ID NO: 2053163 - protein, 21 aa, Staphylococcus
LKEAIRILNRFDNIKVTQISD

SEQ ID NO: 2053164 - protein, 22 aa, Staphylococcus
LKEAYRGLARLQLFEHVMAPLA

SEQ ID NO: 2053165 - protein, 17 aa, Staphylococcus
LKEEPRHGYQIIKDLEE

SEQ ID NO: 2053166 - protein, 18 aa, Staphylococcus
LKEFPMLNSSWQGSEIKI

SEQ ID NO: 2053167 - protein, 20 aa, Staphylococcus
LKELGIKWYAVPIISNMDLK

SEQ ID NO: 2053168 - protein, 20 aa, Staphylococcus
LKELLPIPVIGVIEPGSRTA

SEQ ID NO: 2053169 - protein, 18 aa, Staphylococcus
LKEMKVIYSYMITMIKAA

SEQ ID NO: 2053170 - protein, 24 aa, Staphylococcus
LKENIMVINIYDWLSNFRLLTGSY

SEQ ID NO: 2053171 - protein, 17 aa, Staphylococcus
LKEPYIFIGQDAKKLSA

SEQ ID NO: 2053172 - protein, 20 aa, Staphylococcus
LKEYSILVAPGIPFGENGRN

SEQ ID NO: 2053173 - protein, 17 aa, Staphylococcus
LKFAKKIYTTFEDTLKY

SEQ ID NO: 2053174 - protein, 17 aa, Staphylococcus
LKFAKKIYTTFEDTLNY

SEQ ID NO: 2053175 - protein, 17 aa, Staphylococcus
LKFDYLYIDNAQLTSPY

SEQ ID NO: 2053176 - protein, 18 aa, Staphylococcus
LKFGLSFSPYRIVITENN

SEQ ID NO: 2053177 - protein, 19 aa, Staphylococcus
LKFNIDICFKVVKHWDEDT

SEQ ID NO: 2053178 - protein, 17 aa, Staphylococcus
LKFPMAVIDEVLKAKKD

SEQ ID NO: 2053179 - protein, 17 aa, Staphylococcus
LKFSKKIYTTFEDTLKY

SEQ ID NO: 2053180 - protein, 17 aa, Staphylococcus
LKFTPIGGWWNQVMLSQ

SEQ ID NO: 2053181 - protein, 19 aa, Staphylococcus
LKFYVDYDFEMWKYDEDNR

SEQ ID NO: 2053182 - protein, 19 aa, Staphylococcus
LKGAIKFGIEQSDLVTSVS

SEQ ID NO: 2053183 - protein, 17 aa, Staphylococcus
LKGALGVEKIFDSYLSG

SEQ ID NO: 2053184 - protein, 18 aa, Staphylococcus
LKGAMGVEKVFDSYLSGQ

SEQ ID NO: 2053185 - protein, 18 aa, Staphylococcus
LKGGDPFIFGRGGEEAEI

SEQ ID NO: 2053186 - protein, 19 aa, Staphylococcus
LKGGDPFLFGRGAEEAEVL

SEQ ID NO: 2053187 - protein, 17 aa, Staphylococcus
LKGWVRQLLWMSIYQYV

SEQ ID NO: 2053188 - protein, 20 aa, Staphylococcus
LKHLAQLYAMHWISKKRNPN

SEQ ID NO: 2053189 - protein, 18 aa, Staphylococcus
LKHYKDRVLVPMAYIDFD

SEQ ID NO: 2053190 - protein, 17 aa, Staphylococcus
LKIANLALDENLKSGEY

SEQ ID NO: 2053191 - protein, 20 aa, Staphylococcus
LKICNYCFEHGVVIIAVAGN

SEQ ID NO: 2053192 - protein, 24 aa, Staphylococcus
LKIPELRKRIKLVAEQNYQHLESL

SEQ ID NO: 2053193 - protein, 17 aa, Staphylococcus
LKIPNRIIPIIKIAISH

SEQ ID NO: 2053194 - protein, 17 aa, Staphylococcus
LKISFNKVFGYFIEITR

SEQ ID NO: 2053195 - protein, 17 aa, Staphylococcus
LKIYMIASVEERAERRQ

SEQ ID NO: 2053196 - protein, 28 aa, Staphylococcus
LKKDFIKKSAMVGSAFATMNLIDGHQAF

SEQ ID NO: 2053197 - protein, 17 aa, Staphylococcus
LKKGEILGVSGLMGAGR

SEQ ID NO: 2053198 - protein, 19 aa, Staphylococcus
LKKHHCLYVLVDPYILENL

SEQ ID NO: 2053199 - protein, 20 aa, Staphylococcus
LKKKEDLLMWIVIHDHKEYK

SEQ ID NO: 2053200 - protein, 17 aa, Staphylococcus
LKKLIGHTLMITDGTSL

SEQ ID NO: 2053201 - protein, 21 aa, Staphylococcus
LKKNRISHVSLLFDTFQAHEL

SEQ ID NO: 2053202 - protein, 17 aa, Staphylococcus
LKKRGKNAVAITYTGDG

SEQ ID NO: 2053203 - protein, 19 aa, Staphylococcus
LKKRLKVGDIMKLPTVEQL

SEQ ID NO: 2053204 - protein, 18 aa, Staphylococcus
LKKYFALDYKRVFGNLDP

SEQ ID NO: 2053205 - protein, 19 aa, Staphylococcus
LKKYGFKFLGPITVFSFLE

SEQ ID NO: 2053206 - protein, 18 aa, Staphylococcus
LKLAELFDVSKIAVMSAP

SEQ ID NO: 2053207 - protein, 17 aa, Staphylococcus
LKLAIIMNDFGKTSVDR

SEQ ID NO: 2053208 - protein, 18 aa, Staphylococcus
LKLAIITPFEGHTQRWNE

SEQ ID NO: 2053209 - protein, 19 aa, Staphylococcus
LKLDSNLPKGSYRELTQEE

SEQ ID NO: 2053210 - protein, 17 aa, Staphylococcus
LKLGATMINDQWAGLYD

SEQ ID NO: 2053211 - protein, 19 aa, Staphylococcus
LKLGIITPFLGHTHRWNEQ

SEQ ID NO: 2053212 - protein, 18 aa, Staphylococcus
LKLGVITPFEGHTSKWNE

SEQ ID NO: 2053213 - protein, 19 aa, Staphylococcus
LKLKAFEAHASQTGPFLKQ

SEQ ID NO: 2053214 - protein, 21 aa, Staphylococcus
LKLKKGEIVPIEIEILPSSTY

SEQ ID NO: 2053215 - protein, 20 aa, Staphylococcus
LKLLNDLAMIFLKAAYEEII

SEQ ID NO: 2053216 - protein, 18 aa, Staphylococcus
LKLPIEWLQDKIIVDSLG

SEQ ID NO: 2053217 - protein, 22 aa, Staphylococcus
LKLPYRRVILCTGDIGFSAAKT

SEQ ID NO: 2053218 - protein, 20 aa, Staphylococcus
LKLSDLVKFVEKCNVRLKTG

SEQ ID NO: 2053219 - protein, 17 aa, Staphylococcus
LKLSKLVFLLNEKMGLK

SEQ ID NO: 2053220 - protein, 17 aa, Staphylococcus
LKLVIQLVDLRHNPTED

SEQ ID NO: 2053221 - protein, 20 aa, Staphylococcus
LKLYLKHGVCKVLIGVARGK

SEQ ID NO: 2053222 - protein, 18 aa, Staphylococcus
LKMGTVWINDFHPYFAQA

SEQ ID NO: 2053223 - protein, 18 aa, Staphylococcus
LKMLISYPGYSGYDIQKW

SEQ ID NO: 2053224 - protein, 19 aa, Staphylococcus
LKMNYAEIIKAALYEAIGH

SEQ ID NO: 2053225 - protein, 24 aa, Staphylococcus
LKMTKREIFDWLGVTKYKLDSAVK

SEQ ID NO: 2053226 - protein, 18 aa, Staphylococcus
LKNRFVVIQVDYIDGDIL

SEQ ID NO: 2053227 - protein, 19 aa, Staphylococcus
LKNRFVVIQVDYIDGDILK

SEQ ID NO: 2053228 - protein, 19 aa, Staphylococcus
LKNRFVVIQVDYIDGDILS

SEQ ID NO: 2053229 - protein, 18 aa, Staphylococcus
LKNRFVVIQVDYIDGEIL

SEQ ID NO: 2053230 - protein, 18 aa, Staphylococcus
LKPALRLSAIMGLNSTFI

SEQ ID NO: 2053231 - protein, 18 aa, Staphylococcus
LKPFLKTKIKGWVRELLW

SEQ ID NO: 2053232 - protein, 18 aa, Staphylococcus
LKPFVKTRIKGWVRQLLW

SEQ ID NO: 2053233 - protein, 21 aa, Staphylococcus
LKPISDRGIGFYNLDKNTAQF

SEQ ID NO: 2053234 - protein, 17 aa, Staphylococcus
LKPYLLYKIKDCSKGTR

SEQ ID NO: 2053235 - protein, 19 aa, Staphylococcus
LKQCPNLNWIAWYATGVNN

SEQ ID NO: 2053236 - protein, 18 aa, Staphylococcus
LKQPLKRRVPGIELMEEC

SEQ ID NO: 2053237 - protein, 17 aa, Staphylococcus
LKQSRTVFIFGFGASYV

SEQ ID NO: 2053238 - protein, 19 aa, Staphylococcus
LKREDLQWVRSFKLRGAYN

SEQ ID NO: 2053239 - protein, 18 aa, Staphylococcus
LKRGYRYDIHLNITATPT

SEQ ID NO: 2053240 - protein, 22 aa, Staphylococcus
LKRIGHYIGMSFQIVDDVLDFT

SEQ ID NO: 2053241 - protein, 17 aa, Staphylococcus
LKRKLRPVHNIRKLSKK

SEQ ID NO: 2053242 - protein, 21 aa, Staphylococcus
LKRLIMPSIEREIRADLTEKA

SEQ ID NO: 2053243 - protein, 21 aa, Staphylococcus
LKRLIMPSIEREIRGDLTEKA

SEQ ID NO: 2053244 - protein, 20 aa, Staphylococcus
LKRLIMPSIEREIRNDLTEK

SEQ ID NO: 2053245 - protein, 17 aa, Staphylococcus
LKRVIQFIEHFHFSDSD

SEQ ID NO: 2053246 - protein, 18 aa, Staphylococcus
LKSAINLPIHLHTHDTSG

SEQ ID NO: 2053247 - protein, 22 aa, Staphylococcus
LKSFKGSIIFTSHDFEFINTIA

SEQ ID NO: 2053248 - protein, 22 aa, Staphylococcus
LKSFKGSIIFTSYDFEFINTIA

SEQ ID NO: 2053249 - protein, 17 aa, Staphylococcus
LKSKWSRIEALAGAKPR

SEQ ID NO: 2053250 - protein, 23 aa, Staphylococcus
LKSLMLKHGFEFETEVPKLFELA

SEQ ID NO: 2053251 - protein, 17 aa, Staphylococcus
LKSQFKGKVVIIHQPAE

SEQ ID NO: 2053252 - protein, 20 aa, Staphylococcus
LKSRIATQYPYKAWLAKHKI

SEQ ID NO: 2053253 - protein, 18 aa, Staphylococcus
LKSRLLLGTGKFDNEDIQ

SEQ ID NO: 2053254 - protein, 18 aa, Staphylococcus
LKSRLLLGTGKFEDEETQ

SEQ ID NO: 2053255 - protein, 19 aa, Staphylococcus
LKSRVPYQLHFEDYSPEEV

SEQ ID NO: 2053256 - protein, 17 aa, Staphylococcus
LKSTWKFVDAIQEEWDQ

SEQ ID NO: 2053257 - protein, 17 aa, Staphylococcus
LKSTWKFVDAIQEEWNQ

SEQ ID NO: 2053258 - protein, 17 aa, Staphylococcus
LKSTWKFVDAIQEHWTM

SEQ ID NO: 2053259 - protein, 18 aa, Staphylococcus
LKSYGFKFLGPVTVFSFL

SEQ ID NO: 2053260 - protein, 19 aa, Staphylococcus
LKSYGFKFLGPVTVFSFLE

SEQ ID NO: 2053261 - protein, 20 aa, Staphylococcus
LKTAESWDNVGLLIGDDTKE

SEQ ID NO: 2053262 - protein, 20 aa, Staphylococcus
LKTAESWDNVGLLIGDKHTK

SEQ ID NO: 2053263 - protein, 22 aa, Staphylococcus
LKTFSTRLGVEYSYDDAALLKG

SEQ ID NO: 2053264 - protein, 17 aa, Staphylococcus
LKTLFPYIKEASENHKK

SEQ ID NO: 2053265 - protein, 17 aa, Staphylococcus
LKTLFPYIREASENHKK

SEQ ID NO: 2053266 - protein, 17 aa, Staphylococcus
LKTRLENMIGVEKVDID

SEQ ID NO: 2053267 - protein, 20 aa, Staphylococcus
LKTSGRMVGIISHVSELKQR

SEQ ID NO: 2053268 - protein, 17 aa, Staphylococcus
LKVGDIMKLPTVEQLSQ

SEQ ID NO: 2053269 - protein, 24 aa, Staphylococcus
LKVGDRVSIAWLFESCGHCEYCTT

SEQ ID NO: 2053270 - protein, 18 aa, Staphylococcus
LKVHAFELLMIDLNHYEL

SEQ ID NO: 2053271 - protein, 17 aa, Staphylococcus
LKVIGYRDVPVDTQALA

SEQ ID NO: 2053272 - protein, 17 aa, Staphylococcus
LKVIHHYDIEHRWTITY

SEQ ID NO: 2053273 - protein, 19 aa, Staphylococcus
LKYADCLNELNLNKKAEKM

SEQ ID NO: 2053274 - protein, 18 aa, Staphylococcus
LKYVFGLNVKVMPNALKG

SEQ ID NO: 2053275 - protein, 25 aa, Staphylococcus
LLAEDCLRTMKIFELLGVNFDIKDD

SEQ ID NO: 2053276 - protein, 22 aa, Staphylococcus
LLARCYRSCLALADEKGLRHLA

SEQ ID NO: 2053277 - protein, 23 aa, Staphylococcus
LLDDEIKGVFSFIGGEESMRIVP

SEQ ID NO: 2053278 - protein, 20 aa, Staphylococcus
LLDKEIEGFGELFRYLSYTE

SEQ ID NO: 2053279 - protein, 17 aa, Staphylococcus
LLEDLGFTIQREVLYPN

SEQ ID NO: 2053280 - protein, 23 aa, Staphylococcus
LLEDWLFEYKDMFPIEASNIDTD

SEQ ID NO: 2053281 - protein, 19 aa, Staphylococcus
LLESVAFQIGSAIKRIILT

SEQ ID NO: 2053282 - protein, 19 aa, Staphylococcus
LLESVAFQIGSAIKRILLT

SEQ ID NO: 2053283 - protein, 19 aa, Staphylococcus
LLESVAFQIGSTIKRIELT

SEQ ID NO: 2053284 - protein, 19 aa, Staphylococcus
LLESVALQIGSAIKRIYLT

SEQ ID NO: 2053285 - protein, 17 aa, Staphylococcus
LLFLEGLYQKMGYEGSN

SEQ ID NO: 2053286 - protein, 17 aa, Staphylococcus
LLFLSFAGALAYQVNAK

SEQ ID NO: 2053287 - protein, 19 aa, Staphylococcus
LLGGTCLHKGCIPTKSLLK

SEQ ID NO: 2053288 - protein, 22 aa, Staphylococcus
LLGGTCLHKGCIPTKSLLKSAK

SEQ ID NO: 2053289 - protein, 18 aa, Staphylococcus
LLIDLGLIEDVDYIAARL

SEQ ID NO: 2053290 - protein, 19 aa, Staphylococcus
LLIDWRWGETYFKDKLIDY

SEQ ID NO: 2053291 - protein, 18 aa, Staphylococcus
LLIEYAQFELLDIEWSGA

SEQ ID NO: 2053292 - protein, 24 aa, Staphylococcus
LLITLARFSAFYGLGVDAKLDVTD

SEQ ID NO: 2053293 - protein, 19 aa, Staphylococcus
LLKDRIIMLGSAIDDNVAN

SEQ ID NO: 2053294 - protein, 20 aa, Staphylococcus
LLKEHARYFVAHFVSKNDSA

SEQ ID NO: 2053295 - protein, 18 aa, Staphylococcus
LLLDESFYIKVHIYDYDA

SEQ ID NO: 2053296 - protein, 19 aa, Staphylococcus
LLLPSLRISYMVLPISLIN

SEQ ID NO: 2053297 - protein, 20 aa, Staphylococcus
LLLTFFFKYMKPLVEAGRVF

SEQ ID NO: 2053298 - protein, 18 aa, Staphylococcus
LLLTFFFKYMKPLVQAGR

SEQ ID NO: 2053299 - protein, 17 aa, Staphylococcus
LLNDLAMIFINAGHESL

SEQ ID NO: 2053300 - protein, 17 aa, Staphylococcus
LLNEAGFKEVKTFTDFD

SEQ ID NO: 2053301 - protein, 23 aa, Staphylococcus
LLNQERFELFLGRTDVNILLDNN

SEQ ID NO: 2053302 - protein, 18 aa, Staphylococcus
LLPFQGYVLQHFDLNEKG

SEQ ID NO: 2053303 - protein, 17 aa, Staphylococcus
LLRKALEDMIKRLKLED

SEQ ID NO: 2053304 - protein, 23 aa, Staphylococcus
LLRKCNETIKFVFLDFIKNENIQ

SEQ ID NO: 2053305 - protein, 18 aa, Staphylococcus
LLRQEADSFIEIAERSNS

SEQ ID NO: 2053306 - protein, 17 aa, Staphylococcus
LLSKIAITFSEEENVER

SEQ ID NO: 2053307 - protein, 23 aa, Staphylococcus
LLSLPGWAGMMLWQDEHNHKVHD

SEQ ID NO: 2053308 - protein, 19 aa, Staphylococcus
LLSRYEKFASFKQQIVDML

SEQ ID NO: 2053309 - protein, 18 aa, Staphylococcus
LLSTEGIIVLVIYHGHKE

SEQ ID NO: 2053310 - protein, 18 aa, Staphylococcus
LLTGWLIKQLFNLHLERL

SEQ ID NO: 2053311 - protein, 17 aa, Staphylococcus
LLTIGRYPICYINIEMD

SEQ ID NO: 2053312 - protein, 18 aa, Staphylococcus
LLTIGRYPICYINIEMDP

SEQ ID NO: 2053313 - protein, 18 aa, Staphylococcus
LLTIGRYPICYINIQMDP

SEQ ID NO: 2053314 - protein, 22 aa, Staphylococcus
LLYARFWHKVLFDLGVVPTKEP

SEQ ID NO: 2053315 - protein, 19 aa, Staphylococcus
LLYKLCLISPMLDATMTNP

SEQ ID NO: 2053316 - protein, 23 aa, Staphylococcus
LLYRAGLDLDVDFVIRVGKPVIS

SEQ ID NO: 2053317 - protein, 19 aa, Staphylococcus
LLYRVGFNPDVDFVIRVGK

SEQ ID NO: 2053318 - protein, 26 aa, Staphylococcus
LMDEFWPGPISFILPLRQGYLCEKVT

SEQ ID NO: 2053319 - protein, 18 aa, Staphylococcus
LMIDLGLIDEVDYVATRL

SEQ ID NO: 2053320 - protein, 17 aa, Staphylococcus
LMIEYGITNLISKCVQK

SEQ ID NO: 2053321 - protein, 18 aa, Staphylococcus
LMKLRHLFVVNGRPPFGT

SEQ ID NO: 2053322 - protein, 20 aa, Staphylococcus
LMLPPGLSFVAYNHRAQERF

SEQ ID NO: 2053323 - protein, 20 aa, Staphylococcus
LMQLKELFLVSLQERAIPFE

SEQ ID NO: 2053324 - protein, 21 aa, Staphylococcus
LNAKKEWRNILLSTGESSISN

SEQ ID NO: 2053325 - protein, 23 aa, Staphylococcus
LNAPRLGAINVHASLLPKYRGGA

SEQ ID NO: 2053326 - protein, 18 aa, Staphylococcus
LNDCRYFGEDTLTFLSWM

SEQ ID NO: 2053327 - protein, 17 aa, Staphylococcus
LNDLSLKPLHEFHQGTI

SEQ ID NO: 2053328 - protein, 23 aa, Staphylococcus
LNEFKVPYLIVGKSLNYENIIHI

SEQ ID NO: 2053329 - protein, 23 aa, Staphylococcus
LNFCHDWSFNFLGDMTFNDYPEF

SEQ ID NO: 2053330 - protein, 17 aa, Staphylococcus
LNFKNIKIIKALPATQN

SEQ ID NO: 2053331 - protein, 18 aa, Staphylococcus
LNGKQLWLTAAKKLKHIY

SEQ ID NO: 2053332 - protein, 20 aa, Staphylococcus
LNGRLKLQLLDDVKSIYNSQ

SEQ ID NO: 2053333 - protein, 18 aa, Staphylococcus
LNGVEAIKDAGGFEFENV

SEQ ID NO: 2053334 - protein, 19 aa, Staphylococcus
LNHGVPSFGYRIEAPTTSG

SEQ ID NO: 2053335 - protein, 22 aa, Staphylococcus
LNHLRLKFCLNDILTTRRPIEE

SEQ ID NO: 2053336 - protein, 20 aa, Staphylococcus
LNIGFRFPTYYGRPDYYTFV

SEQ ID NO: 2053337 - protein, 18 aa, Staphylococcus
LNIKELILLDLKKTSLND

SEQ ID NO: 2053338 - protein, 18 aa, Staphylococcus
LNIKGGKDDSCMDLSGGN

SEQ ID NO: 2053339 - protein, 19 aa, Staphylococcus
LNINKGFFCCSGISVAHGV

SEQ ID NO: 2053340 - protein, 17 aa, Staphylococcus
LNIPADETIVFGDGYND

SEQ ID NO: 2053341 - protein, 19 aa, Staphylococcus
LNIRLQIPVIMISGNHDGK

SEQ ID NO: 2053342 - protein, 20 aa, Staphylococcus
LNIYKEFYLSLSKFSNLFYT

SEQ ID NO: 2053343 - protein, 19 aa, Staphylococcus
LNKELGCTIVMVLHDINQA

SEQ ID NO: 2053344 - protein, 19 aa, Staphylococcus
LNLGYRFPATYGNVNYYTL

SEQ ID NO: 2053345 - protein, 18 aa, Staphylococcus
LNLGYRFPTHYGKSNYYA

SEQ ID NO: 2053346 - protein, 17 aa, Staphylococcus
LNLGYRFPTYFGKENYY

SEQ ID NO: 2053347 - protein, 22 aa, Staphylococcus
LNLPLEWLKGKIIVDSLGLHSN

SEQ ID NO: 2053348 - protein, 17 aa, Staphylococcus
LNLPYDIVFTVGSATTE

SEQ ID NO: 2053349 - protein, 18 aa, Staphylococcus
LNNGLRLFVIPKKGFQKT

SEQ ID NO: 2053350 - protein, 17 aa, Staphylococcus
LNNGRFSPVVFKLASEH

SEQ ID NO: 2053351 - protein, 18 aa, Staphylococcus
LNNIKFPLEIAGVPSGLA

SEQ ID NO: 2053352 - protein, 18 aa, Staphylococcus
LNNMFKLLDTVSVPRGIV

SEQ ID NO: 2053353 - protein, 19 aa, Staphylococcus
LNPEITSKELLTFKNVIEK

SEQ ID NO: 2053354 - protein, 21 aa, Staphylococcus
LNPEVIKWAKDVFGKRVLDTW

SEQ ID NO: 2053355 - protein, 17 aa, Staphylococcus
LNQKFNIITIFCDSLNY

SEQ ID NO: 2053356 - protein, 21 aa, Staphylococcus
LNQRLGWEIQEPKAFKFEHNG

SEQ ID NO: 2053357 - protein, 21 aa, Staphylococcus
LNQRLKLQLMDDIKSVYNSQM

SEQ ID NO: 2053358 - protein, 23 aa, Staphylococcus
LNRAFKLSPIYQGEFLEIGYPRL

SEQ ID NO: 2053359 - protein, 17 aa, Staphylococcus
LNRHARIPVCGTISNYN

SEQ ID NO: 2053360 - protein, 17 aa, Staphylococcus
LNRLYIPLIGFKAIGVY

SEQ ID NO: 2053361 - protein, 17 aa, Staphylococcus
LNRYIAAHVYLYYRYHK

SEQ ID NO: 2053362 - protein, 20 aa, Staphylococcus
LNSDWSRSQIQDWIKEDLVK

SEQ ID NO: 2053363 - protein, 18 aa, Staphylococcus
LNTIYIRDFEGLRIDEQL

SEQ ID NO: 2053364 - protein, 17 aa, Staphylococcus
LNVFRMELLGAKVVSVE

SEQ ID NO: 2053365 - protein, 18 aa, Staphylococcus
LNVFRMELLGAKVVSVED

SEQ ID NO: 2053366 - protein, 18 aa, Staphylococcus
LNVFRMELLGAKVVSVEE

SEQ ID NO: 2053367 - protein, 18 aa, Staphylococcus
LNVFRMELLGAKVVSVTD

SEQ ID NO: 2053368 - protein, 18 aa, Staphylococcus
LNVRRVYFSTFNREELND

SEQ ID NO: 2053369 - protein, 17 aa, Staphylococcus
LNVSRYALGTIPFAGSN

SEQ ID NO: 2053370 - protein, 18 aa, Staphylococcus
LNYPILCANILKDNKSLT

SEQ ID NO: 2053371 - protein, 17 aa, Staphylococcus
LPAFRPDDVFKVGDPAF

SEQ ID NO: 2053372 - protein, 17 aa, Staphylococcus
LPAFRPDDVFKVGEPAF

SEQ ID NO: 2053373 - protein, 21 aa, Staphylococcus
LPAIMKWCVEGYLEWQKIGLS

SEQ ID NO: 2053374 - protein, 23 aa, Staphylococcus
LPDNVLRLKGYVKFRDMPHETYE

SEQ ID NO: 2053375 - protein, 18 aa, Staphylococcus
LPDRERRAVWAIYAVCRV

SEQ ID NO: 2053376 - protein, 25 aa, Staphylococcus
LPDSVLRLKGFVKFRDLPEVTYEFQ

SEQ ID NO: 2053377 - protein, 22 aa, Staphylococcus
LPESFYRGAHQHIFRAMMHLNE

SEQ ID NO: 2053378 - protein, 21 aa, Staphylococcus
LPESFYRGAHQHIFRAMMHLS

SEQ ID NO: 2053379 - protein, 17 aa, Staphylococcus
LPETFKVMRYHSLKAHA

SEQ ID NO: 2053380 - protein, 19 aa, Staphylococcus
LPEYMIPRKFEWMEQLPLT

SEQ ID NO: 2053381 - protein, 17 aa, Staphylococcus
LPFGHSMLYLSSIMDIY

SEQ ID NO: 2053382 - protein, 17 aa, Staphylococcus
LPFHAKRFNDWLEQMPQ

SEQ ID NO: 2053383 - protein, 19 aa, Staphylococcus
LPFRIDFRDCQTIKEDLIP

SEQ ID NO: 2053384 - protein, 20 aa, Staphylococcus
LPFTLCYISRGFVTDYNNKE

SEQ ID NO: 2053385 - protein, 18 aa, Staphylococcus
LPHAEPFLASWFAEIIAE

SEQ ID NO: 2053386 - protein, 22 aa, Staphylococcus
LPHIRVVMLTSFIEDKEVYRAL

SEQ ID NO: 2053387 - protein, 17 aa, Staphylococcus
LPHLVSPVITDVKAATQ

SEQ ID NO: 2053388 - protein, 20 aa, Staphylococcus
LPIIPIWVSRYWVQLISKVP

SEQ ID NO: 2053389 - protein, 21 aa, Staphylococcus
LPIMHLYRFVSTFSNESFQIS

SEQ ID NO: 2053390 - protein, 20 aa, Staphylococcus
LPISAGFFIINPFEVVYYAG

SEQ ID NO: 2053391 - protein, 23 aa, Staphylococcus
LPKEMNPFLGYRAIRLCLDQPDI

SEQ ID NO: 2053392 - protein, 23 aa, Staphylococcus
LPKEMNPFLGYRAIRLCLDQQDI

SEQ ID NO: 2053393 - protein, 20 aa, Staphylococcus
LPKGRKTIMTSWAKHEQYEQ

SEQ ID NO: 2053394 - protein, 21 aa, Staphylococcus
LPKIKELWPQAGDYLLVTLRI

SEQ ID NO: 2053395 - protein, 18 aa, Staphylococcus
LPKRMTFIGVGIISVEFA

SEQ ID NO: 2053396 - protein, 17 aa, Staphylococcus
LPKRPFAPFNEAHRATL

SEQ ID NO: 2053397 - protein, 18 aa, Staphylococcus
LPLSLGIESCVIRIIPQY

SEQ ID NO: 2053398 - protein, 18 aa, Staphylococcus
LPLSLGIESCVIRIVPQY

SEQ ID NO: 2053399 - protein, 18 aa, Staphylococcus
LPLSLGIESCVIRLIPQY

SEQ ID NO: 2053400 - protein, 19 aa, Staphylococcus
LPLSLGIESCVIRLSPQYF

SEQ ID NO: 2053401 - protein, 21 aa, Staphylococcus
LPLTEAFLFSRGHFKGNQFPE

SEQ ID NO: 2053402 - protein, 21 aa, Staphylococcus
LPLTEAFLFSRGHFKGNQMPE

SEQ ID NO: 2053403 - protein, 22 aa, Staphylococcus
LPLTEAFLFSRGHFKGNRMPEG

SEQ ID NO: 2053404 - protein, 18 aa, Staphylococcus
LPLTGIDVQFNWQINDNT

SEQ ID NO: 2053405 - protein, 19 aa, Staphylococcus
LPLVKRFVGLTGTPSPNSL

SEQ ID NO: 2053406 - protein, 20 aa, Staphylococcus
LPNEHFGDFVIRTGVVSKVN

SEQ ID NO: 2053407 - protein, 22 aa, Staphylococcus
LPNGVELKNRFVLAPLTHISSN

SEQ ID NO: 2053408 - protein, 23 aa, Staphylococcus
LPNGVELKNRFVLAPMTHNTSND

SEQ ID NO: 2053409 - protein, 17 aa, Staphylococcus
LPNIIPIYTRYFDNVYW

SEQ ID NO: 2053410 - protein, 23 aa, Staphylococcus
LPNKEFHLLFLLVSHPKQIFSRE

SEQ ID NO: 2053411 - protein, 19 aa, Staphylococcus
LPPNLWKKFNNGFYPLPRT

SEQ ID NO: 2053412 - protein, 17 aa, Staphylococcus
LPQLFGFQAAGAAPIVH

SEQ ID NO: 2053413 - protein, 17 aa, Staphylococcus
LPQLFGFQAEGASPIVQ

SEQ ID NO: 2053414 - protein, 23 aa, Staphylococcus
LPQNVFRLKGFVRFRDCADVIYE

SEQ ID NO: 2053415 - protein, 19 aa, Staphylococcus
LPRPERWGLLVSEDSPFRG

SEQ ID NO: 2053416 - protein, 18 aa, Staphylococcus
LPRPFFILAPMEDVTDIV

SEQ ID NO: 2053417 - protein, 18 aa, Staphylococcus
LPSLELLEDPEIHQIDNS

SEQ ID NO: 2053418 - protein, 20 aa, Staphylococcus
LPTDRLELFDGHRYDLSKSH

SEQ ID NO: 2053419 - protein, 20 aa, Staphylococcus
LPTKEFQLLFLLCTHPRQIY

SEQ ID NO: 2053420 - protein, 18 aa, Staphylococcus
LPVIALLCTQASGTSVIK

SEQ ID NO: 2053421 - protein, 20 aa, Staphylococcus
LPVIPEFADYTLIGGNGAII

SEQ ID NO: 2053422 - protein, 19 aa, Staphylococcus
LPVRPCIKMELSEMQDETL

SEQ ID NO: 2053423 - protein, 17 aa, Staphylococcus
LPWKRFHTLPSNQVNKV

SEQ ID NO: 2053424 - protein, 17 aa, Staphylococcus
LPYHLAIKNLKQLDEDF

SEQ ID NO: 2053425 - protein, 18 aa, Staphylococcus
LPYICLNGAEVRDESFNI

SEQ ID NO: 2053426 - protein, 19 aa, Staphylococcus
LPYLTWRINQCYELIEQTM

SEQ ID NO: 2053427 - protein, 19 aa, Staphylococcus
LPYRAKRHYSIVGGDKDTL

SEQ ID NO: 2053428 - protein, 20 aa, Staphylococcus
LPYRRVILCTGDIGFGSSKT

SEQ ID NO: 2053429 - protein, 17 aa, Staphylococcus
LPYRYYEDYGIRKYGFH

SEQ ID NO: 2053430 - protein, 19 aa, Staphylococcus
LPYYKEFIKEVAQFLESEN

SEQ ID NO: 2053431 - protein, 19 aa, Staphylococcus
LQARIRVALRVSKKTTTEE

SEQ ID NO: 2053432 - protein, 17 aa, Staphylococcus
LQDRRKAFQFAYLSLMQ

SEQ ID NO: 2053433 - protein, 18 aa, Staphylococcus
LQDVPGFKALRFLRPQAK

SEQ ID NO: 2053434 - protein, 23 aa, Staphylococcus
LQERGVEITSFFYNRMFTQHPEL

SEQ ID NO: 2053435 - protein, 17 aa, Staphylococcus
LQERIWNPLQIMNDFGI

SEQ ID NO: 2053436 - protein, 17 aa, Staphylococcus
LQERIWNPLQIMNDFGM

SEQ ID NO: 2053437 - protein, 17 aa, Staphylococcus
LQHAASVAAMFLTTEAV

SEQ ID NO: 2053438 - protein, 17 aa, Staphylococcus
LQIKVAQLLGEPKAIYL

SEQ ID NO: 2053439 - protein, 17 aa, Staphylococcus
LQIPVIMISGNHDGKER

SEQ ID NO: 2053440 - protein, 18 aa, Staphylococcus
LQLTLPYEHNSLYVEIYP

SEQ ID NO: 2053441 - protein, 23 aa, Staphylococcus
LQNCGICSNGLYALVDGDIVEGD

SEQ ID NO: 2053442 - protein, 19 aa, Staphylococcus
LQPKFELMRQFIYPGTTGV

SEQ ID NO: 2053443 - protein, 22 aa, Staphylococcus
LQQFVKYLLCLQQLPHAIITSD

SEQ ID NO: 2053444 - protein, 17 aa, Staphylococcus
LQQGAWNRKAFRGVELY

SEQ ID NO: 2053445 - protein, 18 aa, Staphylococcus
LQSCLKFGALELNDTQKR

SEQ ID NO: 2053446 - protein, 18 aa, Staphylococcus
LQSGYKLKERVLRPSMVK

SEQ ID NO: 2053447 - protein, 17 aa, Staphylococcus
LQSLKKRLVFLAWETNF

SEQ ID NO: 2053448 - protein, 17 aa, Staphylococcus
LQSPRLMLGFKNEPTEA

SEQ ID NO: 2053449 - protein, 17 aa, Staphylococcus
LQSPRLMLGFKNQPLKE

SEQ ID NO: 2053450 - protein, 22 aa, Staphylococcus
LQYHVPVCSFTFGIPNQEIIER

SEQ ID NO: 2053451 - protein, 18 aa, Staphylococcus
LRANELLDEIGLTHRVKS

SEQ ID NO: 2053452 - protein, 19 aa, Staphylococcus
LRARIRVALRMSRSTETIQ

SEQ ID NO: 2053453 - protein, 18 aa, Staphylococcus
LRARLFVDQIISFVKNSP

SEQ ID NO: 2053454 - protein, 17 aa, Staphylococcus
LRATLVVNRIEEQLQKR

SEQ ID NO: 2053455 - protein, 17 aa, Staphylococcus
LRATLVVNRIESQLKKR

SEQ ID NO: 2053456 - protein, 23 aa, Staphylococcus
LRDIKGKIIVPGFFGYSKKGNIV

SEQ ID NO: 2053457 - protein, 17 aa, Staphylococcus
LRDKVCWFYSRSKGRLW

SEQ ID NO: 2053458 - protein, 20 aa, Staphylococcus
LREIMSYGVLTVESKSGYGL

SEQ ID NO: 2053459 - protein, 18 aa, Staphylococcus
LRELNIFRLPAESKQFEY

SEQ ID NO: 2053460 - protein, 22 aa, Staphylococcus
LRELRPLIFRKIGYITSNQFDI

SEQ ID NO: 2053461 - protein, 21 aa, Staphylococcus
LRERICEAAIQLMENIKYVNA

SEQ ID NO: 2053462 - protein, 23 aa, Staphylococcus
LRFDLSEGFPLLTTKKVSFKLLA

SEQ ID NO: 2053463 - protein, 17 aa, Staphylococcus
LRFDLSKGFPLLTTKKV

SEQ ID NO: 2053464 - protein, 22 aa, Staphylococcus
LRFDLSKGFPLLTTKKVSFKLV

SEQ ID NO: 2053465 - protein, 19 aa, Staphylococcus
LRFIYKKCHVHTIFVDKSV

SEQ ID NO: 2053466 - protein, 18 aa, Staphylococcus
LRFKRRFGDDVAVLHSGL

SEQ ID NO: 2053467 - protein, 19 aa, Staphylococcus
LRFPEFKGEWVRKKLKNIA

SEQ ID NO: 2053468 - protein, 17 aa, Staphylococcus
LRFTYTFSEDTELTGNI

SEQ ID NO: 2053469 - protein, 18 aa, Staphylococcus
LRGAWNVIVFYPADFSFV

SEQ ID NO: 2053470 - protein, 18 aa, Staphylococcus
LRGFKPFYIEHGAFSGAL

SEQ ID NO: 2053471 - protein, 23 aa, Staphylococcus
LRHALDVADEFDVQIALHADTLN

SEQ ID NO: 2053472 - protein, 22 aa, Staphylococcus
LRHCETCGSPIRPDIVLYGEML

SEQ ID NO: 2053473 - protein, 21 aa, Staphylococcus
LRHVYKNVITCFLDTKEVQPL

SEQ ID NO: 2053474 - protein, 17 aa, Staphylococcus
LRICRKLVDEVTKHFNG

SEQ ID NO: 2053475 - protein, 20 aa, Staphylococcus
LRIKEFDLLWYLATHENVAL

SEQ ID NO: 2053476 - protein, 17 aa, Staphylococcus
LRILALFRLINPTKEIR

SEQ ID NO: 2053477 - protein, 17 aa, Staphylococcus
LRINKPLTFEVRGEAYM

SEQ ID NO: 2053478 - protein, 17 aa, Staphylococcus
LRIPGYMVVLDTGIKGN

SEQ ID NO: 2053479 - protein, 19 aa, Staphylococcus
LRKALPKQFVFIIEELLYK

SEQ ID NO: 2053480 - protein, 19 aa, Staphylococcus
LRKGEAIGLNHSRYLLIEF

SEQ ID NO: 2053481 - protein, 21 aa, Staphylococcus
LRKQIWRRLATDLKPEQLHTI

SEQ ID NO: 2053482 - protein, 19 aa, Staphylococcus
LRKRIKLVAEQNYGQIRSI

SEQ ID NO: 2053483 - protein, 17 aa, Staphylococcus
LRLEAGLPLHGQDLSED

SEQ ID NO: 2053484 - protein, 17 aa, Staphylococcus
LRLEAGLPLHGQDLTES

SEQ ID NO: 2053485 - protein, 17 aa, Staphylococcus
LRLKADLIREFLDSVIP

SEQ ID NO: 2053486 - protein, 17 aa, Staphylococcus
LRLKRDLIKEFMDKIIP

SEQ ID NO: 2053487 - protein, 17 aa, Staphylococcus
LRLNKHYSVAKFLENLE

SEQ ID NO: 2053488 - protein, 22 aa, Staphylococcus
LRLPENIYRLKGYVRFRDTPET

SEQ ID NO: 2053489 - protein, 20 aa, Staphylococcus
LRMHYLIAIALNLEGYEDFA

SEQ ID NO: 2053490 - protein, 17 aa, Staphylococcus
LRMKISYLMQQSQLFGE

SEQ ID NO: 2053491 - protein, 17 aa, Staphylococcus
LRMNYLFDFYQALLTKK

SEQ ID NO: 2053492 - protein, 17 aa, Staphylococcus
LRMNYLFDFYQSLLTDK

SEQ ID NO: 2053493 - protein, 17 aa, Staphylococcus
LRMNYLFDFYQTLLTEK

SEQ ID NO: 2053494 - protein, 17 aa, Staphylococcus
LRPETLFGTKFEGYLNQ

SEQ ID NO: 2053495 - protein, 25 aa, Staphylococcus
LRPFVKTKIKSWVRQLLWMSLYQYI

SEQ ID NO: 2053496 - protein, 20 aa, Staphylococcus
LRPKLLIDFEKQLFIFKDKK

SEQ ID NO: 2053497 - protein, 21 aa, Staphylococcus
LRPNVPFDMMPKFNLFIALGI

SEQ ID NO: 2053498 - protein, 22 aa, Staphylococcus
LRPQDSFEVIQDFYLNSQHLEI

SEQ ID NO: 2053499 - protein, 21 aa, Staphylococcus
LRPRDSFEVIRHFELSQAHLE

SEQ ID NO: 2053500 - protein, 19 aa, Staphylococcus
LRPVCPNCHAMIHRGLEVD

SEQ ID NO: 2053501 - protein, 20 aa, Staphylococcus
LRQFFDFITNFGIMVKGTGE

SEQ ID NO: 2053502 - protein, 23 aa, Staphylococcus
LRQREHFSIFPASHYVTRDEKLK

SEQ ID NO: 2053503 - protein, 19 aa, Staphylococcus
LRQRVWRRLATDLKSNKLH

SEQ ID NO: 2053504 - protein, 24 aa, Staphylococcus
LRQSFNIPALKAWQQTKQDAGDDA

SEQ ID NO: 2053505 - protein, 19 aa, Staphylococcus
LRQSIGLKQHEVFHLMDKQ

SEQ ID NO: 2053506 - protein, 20 aa, Staphylococcus
LRRHVKYLLDNNAKSIVVNG

SEQ ID NO: 2053507 - protein, 17 aa, Staphylococcus
LRRLGLRVYSNVNNAIE

SEQ ID NO: 2053508 - protein, 22 aa, Staphylococcus
LRSTLPFKHVYQAVVYISGQKK

SEQ ID NO: 2053509 - protein, 22 aa, Staphylococcus
LRTLLDFRFQRHFKAKKGENGQ

SEQ ID NO: 2053510 - protein, 21 aa, Staphylococcus
LRTQTAFNFFSLFTFHEPIEQ

SEQ ID NO: 2053511 - protein, 17 aa, Staphylococcus
LRVAHGLEIERLLRQNE

SEQ ID NO: 2053512 - protein, 17 aa, Staphylococcus
LRVCSFLKEGTLADIGS

SEQ ID NO: 2053513 - protein, 18 aa, Staphylococcus
LRVKFLWDQLDEYPHGIV

SEQ ID NO: 2053514 - protein, 18 aa, Staphylococcus
LRVKRRFGDDVAVLHSGL

SEQ ID NO: 2053515 - protein, 19 aa, Staphylococcus
LRVNELLEMVGLDPEIYKN

SEQ ID NO: 2053516 - protein, 22 aa, Staphylococcus
LRVTDIKGAVAIAKKHNLISVV

SEQ ID NO: 2053517 - protein, 20 aa, Staphylococcus
LRVTMDVAFHIADDKAFAKL

SEQ ID NO: 2053518 - protein, 17 aa, Staphylococcus
LRWCKNKYPDVKIIKAL

SEQ ID NO: 2053519 - protein, 17 aa, Staphylococcus
LRYKILKADAFRSSNKL

SEQ ID NO: 2053520 - protein, 18 aa, Staphylococcus
LRYPARSGAKVAFYVAQW

SEQ ID NO: 2053521 - protein, 20 aa, Staphylococcus
LRYYHEIGLLVPSYIDDNGY

SEQ ID NO: 2053522 - protein, 22 aa, Staphylococcus
LRYYKDRVLVPLAYMDFDEYIT

SEQ ID NO: 2053523 - protein, 18 aa, Staphylococcus
LSADSIIAYAFYLSRYEY

SEQ ID NO: 2053524 - protein, 17 aa, Staphylococcus
LSAIACRGGLLKPIVGG

SEQ ID NO: 2053525 - protein, 17 aa, Staphylococcus
LSATCDATLKDAEKKVN

SEQ ID NO: 2053526 - protein, 17 aa, Staphylococcus
LSDFNRRYLSGFTGTSG

SEQ ID NO: 2053527 - protein, 24 aa, Staphylococcus
LSDRLRSRFEWGLIVDITPPDYET

SEQ ID NO: 2053528 - protein, 17 aa, Staphylococcus
LSFSHEFMFARPLNQTD

SEQ ID NO: 2053529 - protein, 20 aa, Staphylococcus
LSGKKLPIWIADYVLSTYGT

SEQ ID NO: 2053530 - protein, 17 aa, Staphylococcus
LSGPIARFFEDANVATL

SEQ ID NO: 2053531 - protein, 19 aa, Staphylococcus
LSHLRLIVRSLLGIAVPTQ

SEQ ID NO: 2053532 - protein, 20 aa, Staphylococcus
LSHLRLIVRTLLGIAVPTQI

SEQ ID NO: 2053533 - protein, 22 aa, Staphylococcus
LSHVLDFSDWIHVIKNGEMVES

SEQ ID NO: 2053534 - protein, 17 aa, Staphylococcus
LSIHPVVLGTGKPLFEN

SEQ ID NO: 2053535 - protein, 17 aa, Staphylococcus
LSKAIGVVGGYVAGTKA

SEQ ID NO: 2053536 - protein, 17 aa, Staphylococcus
LSKAIGVVGGYVAGTQS

SEQ ID NO: 2053537 - protein, 19 aa, Staphylococcus
LSKDELKEIVTMMVNKLTL

SEQ ID NO: 2053538 - protein, 19 aa, Staphylococcus
LSKDELKQIVTMMVNKLTN

SEQ ID NO: 2053539 - protein, 20 aa, Staphylococcus
LSKEELKEIVTMMVKKLTDR

SEQ ID NO: 2053540 - protein, 18 aa, Staphylococcus
LSKLLIRATKKWSTDKAF

SEQ ID NO: 2053541 - protein, 20 aa, Staphylococcus
LSKREIEVLAEMVKGKTNKE

SEQ ID NO: 2053542 - protein, 17 aa, Staphylococcus
LSKREMEVLKEMVKGKT

SEQ ID NO: 2053543 - protein, 22 aa, Staphylococcus
LSKTEYRGREATDFKEDDIELF

SEQ ID NO: 2053544 - protein, 22 aa, Staphylococcus
LSKTEYRGREATDFQEEDIELF

SEQ ID NO: 2053545 - protein, 17 aa, Staphylococcus
LSLEEWLNLSDELKLRY

SEQ ID NO: 2053546 - protein, 18 aa, Staphylococcus
LSLEMIKQLIRIHRAKNI

SEQ ID NO: 2053547 - protein, 17 aa, Staphylococcus
LSLKCFKYTNNGTQSLQ

SEQ ID NO: 2053548 - protein, 17 aa, Staphylococcus
LSLPGWAGMMYYRAEKN

SEQ ID NO: 2053549 - protein, 21 aa, Staphylococcus
LSLRAKYLFDYNLDYLVSNGE

SEQ ID NO: 2053550 - protein, 17 aa, Staphylococcus
LSLRICRKLVDEVTKHF

SEQ ID NO: 2053551 - protein, 17 aa, Staphylococcus
LSLRLNKHYSVAKFLEN

SEQ ID NO: 2053552 - protein, 17 aa, Staphylococcus
LSNELLLNFDAKYTHFI

SEQ ID NO: 2053553 - protein, 17 aa, Staphylococcus
LSNELLLNFDAKYTRFI

SEQ ID NO: 2053554 - protein, 17 aa, Staphylococcus
LSNELLLTFDAKYTQFI

SEQ ID NO: 2053555 - protein, 25 aa, Staphylococcus
LSPKFAGICAISFFMKSSASVIHQF

SEQ ID NO: 2053556 - protein, 24 aa, Staphylococcus
LSPLRFKEIMHLFDIPILEEVQNA

SEQ ID NO: 2053557 - protein, 17 aa, Staphylococcus
LSPNEVWNAVTVNAAKA

SEQ ID NO: 2053558 - protein, 17 aa, Staphylococcus
LSQFYKELMVSTGSIEI

SEQ ID NO: 2053559 - protein, 17 aa, Staphylococcus
LSQFYKELMVSTGSLEI

SEQ ID NO: 2053560 - protein, 18 aa, Staphylococcus
LSQYLKFNLKAEQERLKK

SEQ ID NO: 2053561 - protein, 18 aa, Staphylococcus
LSSARLVQISSFISDYFN

SEQ ID NO: 2053562 - protein, 18 aa, Staphylococcus
LSYQRLLKVWGYTFQYLK

SEQ ID NO: 2053563 - protein, 24 aa, Staphylococcus
LSYRVHKGFHMLKFEGINNINDVE

SEQ ID NO: 2053564 - protein, 17 aa, Staphylococcus
LTAKARYASSIKGTKPQ

SEQ ID NO: 2053565 - protein, 17 aa, Staphylococcus
LTAVEGFGNYEVRLPLV

SEQ ID NO: 2053566 - protein, 19 aa, Staphylococcus
LTDIAWKYNVQVMIEGPGH

SEQ ID NO: 2053567 - protein, 24 aa, Staphylococcus
LTDKRVSPLYGELRGLPPVYMYGG

SEQ ID NO: 2053568 - protein, 19 aa, Staphylococcus
LTEKEGWLYGRGVSDMKGG

SEQ ID NO: 2053569 - protein, 23 aa, Staphylococcus
LTEMIKFKYPRLFETIHKALHMV

SEQ ID NO: 2053570 - protein, 17 aa, Staphylococcus
LTENITWADNRSSRYAD

SEQ ID NO: 2053571 - protein, 18 aa, Staphylococcus
LTENLEWVPGVYVSGALA

SEQ ID NO: 2053572 - protein, 18 aa, Staphylococcus
LTFALVLAVARRIPEGDK

SEQ ID NO: 2053573 - protein, 17 aa, Staphylococcus
LTFGLVLAVARRIVEGD

SEQ ID NO: 2053574 - protein, 17 aa, Staphylococcus
LTGRRICENCGTTYHLV

SEQ ID NO: 2053575 - protein, 17 aa, Staphylococcus
LTIRPGVVVTYDRNFVS

SEQ ID NO: 2053576 - protein, 17 aa, Staphylococcus
LTIRPGVVVTYDRNYVS

SEQ ID NO: 2053577 - protein, 17 aa, Staphylococcus
LTKGFPLLTTKKVSFKL

SEQ ID NO: 2053578 - protein, 26 aa, Staphylococcus
LTKRVAIEMASPLGWHKYVGTEGKVI

SEQ ID NO: 2053579 - protein, 20 aa, Staphylococcus
LTKVFTRFGIDVDFVDTTKI

SEQ ID NO: 2053580 - protein, 17 aa, Staphylococcus
LTLFLPHAFEGQGPEHS

SEQ ID NO: 2053581 - protein, 17 aa, Staphylococcus
LTLSGVFTRAGASYDDI

SEQ ID NO: 2053582 - protein, 23 aa, Staphylococcus
LTPELAFKLGRYGGYVLAHNEDK

SEQ ID NO: 2053583 - protein, 23 aa, Staphylococcus
LTPELAFKLGRYGGYVLAHNEGA

SEQ ID NO: 2053584 - protein, 23 aa, Staphylococcus
LTPELAFKLGRYGGYVLAHNENE

SEQ ID NO: 2053585 - protein, 18 aa, Staphylococcus
LTQFFDFITNFGIMVRGT

SEQ ID NO: 2053586 - protein, 17 aa, Staphylococcus
LTSHLGFGNYELRLPLL

SEQ ID NO: 2053587 - protein, 18 aa, Staphylococcus
LTSVKWLTDKGVHFDRSF

SEQ ID NO: 2053588 - protein, 18 aa, Staphylococcus
LTTELGICDNVVFNTHTN

SEQ ID NO: 2053589 - protein, 21 aa, Staphylococcus
LTTEYYWHWDLDQAQLDVFEY

SEQ ID NO: 2053590 - protein, 17 aa, Staphylococcus
LTTEYYWHWDLKNSGLD

SEQ ID NO: 2053591 - protein, 22 aa, Staphylococcus
LTTEYYWHWDLKNSKLDVYEYK

SEQ ID NO: 2053592 - protein, 22 aa, Staphylococcus
LTTEYYWHWDLKQAKLDVFEYK

SEQ ID NO: 2053593 - protein, 22 aa, Staphylococcus
LTTEYYWHWDLKSAKLDVFEYK

SEQ ID NO: 2053594 - protein, 23 aa, Staphylococcus
LTTGFCLWCQLAFSTYLENADQA

SEQ ID NO: 2053595 - protein, 20 aa, Staphylococcus
LTVKIKYALLQEKPKIKSVE

SEQ ID NO: 2053596 - protein, 18 aa, Staphylococcus
LTVLSYRVHKGFHMLKFE

SEQ ID NO: 2053597 - protein, 17 aa, Staphylococcus
LTYRLKSATGLLSAKTY

SEQ ID NO: 2053598 - protein, 21 aa, Staphylococcus
LTYYMKRFEAFGIKHDGIQNV

SEQ ID NO: 2053599 - protein, 18 aa, Staphylococcus
LVAQMPFGDIREKAGEKE

SEQ ID NO: 2053600 - protein, 24 aa, Staphylococcus
LVDRSVLRLLKLIDRYTLEGEMPN

SEQ ID NO: 2053601 - protein, 17 aa, Staphylococcus
LVEACWLVLHNDNVNGN

SEQ ID NO: 2053602 - protein, 18 aa, Staphylococcus
LVEGLKIITEFIQNEKAN

SEQ ID NO: 2053603 - protein, 19 aa, Staphylococcus
LVEGLKLVTEFVQDENATQ

SEQ ID NO: 2053604 - protein, 19 aa, Staphylococcus
LVEMRRFILSSSREDRLEA

SEQ ID NO: 2053605 - protein, 19 aa, Staphylococcus
LVEMRRFILSSSYEQRVEA

SEQ ID NO: 2053606 - protein, 17 aa, Staphylococcus
LVGYCSGGLVALETANI

SEQ ID NO: 2053607 - protein, 22 aa, Staphylococcus
LVHEVFKVYGVLFIDAQYEPLR

SEQ ID NO: 2053608 - protein, 18 aa, Staphylococcus
LVKLWRIGFEDAQLPTNT

SEQ ID NO: 2053609 - protein, 22 aa, Staphylococcus
LVKRLKRRGALALAGNHEMRWL

SEQ ID NO: 2053610 - protein, 25 aa, Staphylococcus
LVKRLKRRGALALAGNHEMRWLESK

SEQ ID NO: 2053611 - protein, 17 aa, Staphylococcus
LVLLGIKTRGEFLAIRI

SEQ ID NO: 2053612 - protein, 17 aa, Staphylococcus
LVLRLGGEYTVKRVRRT

SEQ ID NO: 2053613 - protein, 31 aa, Staphylococcus
LVNFNIPENMWLKFVVEFLLKEINSIDKEII

SEQ ID NO: 2053614 - protein, 17 aa, Staphylococcus
LVQSSIYDKVMPKLKEA

SEQ ID NO: 2053615 - protein, 23 aa, Staphylococcus
LVREVKKLKGLCLKWVSPGTRGV

SEQ ID NO: 2053616 - protein, 18 aa, Staphylococcus
LVSKLVLRLKAFDEFDFT

SEQ ID NO: 2053617 - protein, 25 aa, Staphylococcus
LVYMLGFMPGFPFLGGLDERIHTPR

SEQ ID NO: 2053618 - protein, 18 aa, Staphylococcus
LWGARAAFIGGFDSTSNV

SEQ ID NO: 2053619 - protein, 18 aa, Staphylococcus
LWGARAAIIGGFDSTSNV

SEQ ID NO: 2053620 - protein, 18 aa, Staphylococcus
LWKKVDVFVLPKDYVRYC

SEQ ID NO: 2053621 - protein, 19 aa, Staphylococcus
LYARFWHKVLYDMGVVPTK

SEQ ID NO: 2053622 - protein, 18 aa, Staphylococcus
LYFEGVSVFDMLDIIDNI

SEQ ID NO: 2053623 - protein, 18 aa, Staphylococcus
LYFEGVSVFDMLDIVENI

SEQ ID NO: 2053624 - protein, 18 aa, Staphylococcus
LYFEGVSVFDMLEIVENI

SEQ ID NO: 2053625 - protein, 18 aa, Staphylococcus
LYFEGVSVFDMLNIVENI

SEQ ID NO: 2053626 - protein, 19 aa, Staphylococcus
LYFFSIANPNPFEWLDQLS

SEQ ID NO: 2053627 - protein, 18 aa, Staphylococcus
LYFKFVMPIFGKLFAKSR

SEQ ID NO: 2053628 - protein, 17 aa, Staphylococcus
LYFSRNSFNAIHIFDEN

SEQ ID NO: 2053629 - protein, 19 aa, Staphylococcus
LYGDVKFGVGPVIEGGFYY

SEQ ID NO: 2053630 - protein, 19 aa, Staphylococcus
LYGDVKFGVGPVVEGGFYY

SEQ ID NO: 2053631 - protein, 17 aa, Staphylococcus
LYHLPIMYIEYSGIYGD

SEQ ID NO: 2053632 - protein, 20 aa, Staphylococcus
LYKHRIPVVIKNTNHPEDKG

SEQ ID NO: 2053633 - protein, 21 aa, Staphylococcus
LYKHRIPVVIKNTNRPQDKGT

SEQ ID NO: 2053634 - protein, 18 aa, Staphylococcus
LYLERKFPEKNIYATGEA

SEQ ID NO: 2053635 - protein, 18 aa, Staphylococcus
LYNFIWDEFCDWYIEMSK

SEQ ID NO: 2053636 - protein, 18 aa, Staphylococcus
LYPPRKFDGEKWYGATAN

SEQ ID NO: 2053637 - protein, 22 aa, Staphylococcus
LYPQCFNTAYKILKMIQRQFDV

SEQ ID NO: 2053638 - protein, 18 aa, Staphylococcus
LYPSCRMAYIVLPNKLLK

SEQ ID NO: 2053639 - protein, 17 aa, Staphylococcus
LYPYAFNVLFDIVQTLS

SEQ ID NO: 2053640 - protein, 17 aa, Staphylococcus
LYQTHEFEKGVGIDLAY

SEQ ID NO: 2053641 - protein, 24 aa, Staphylococcus
LYSKSEFELIRWFGKKGRGLYQKV

SEQ ID NO: 2053642 - protein, 20 aa, Staphylococcus
LYSRFWHKVLYDLGVVPTKE

SEQ ID NO: 2053643 - protein, 18 aa, Staphylococcus
LYTYKRLVNFNIPENMWL

SEQ ID NO: 2053644 - protein, 17 aa, Staphylococcus
MAAQCLIQAIGGEGNVY

SEQ ID NO: 2053645 - protein, 17 aa, Staphylococcus
MAAQCLIQAIGGEGYVY

SEQ ID NO: 2053646 - protein, 17 aa, Staphylococcus
MAERGRKTLLFGPMKPV

SEQ ID NO: 2053647 - protein, 19 aa, Staphylococcus
MAFAKLILCNDNEICQAKV

SEQ ID NO: 2053648 - protein, 21 aa, Staphylococcus
MALKIKKAFVSKGYQLYIDSP

SEQ ID NO: 2053649 - protein, 18 aa, Staphylococcus
MALNVVVEYVARTIAQSE

SEQ ID NO: 2053650 - protein, 18 aa, Staphylococcus
MALPPCHTMFQFYVQDGK

SEQ ID NO: 2053651 - protein, 22 aa, Staphylococcus
MAPCPYVYAVIGKRAIKDNQLN

SEQ ID NO: 2053652 - protein, 18 aa, Staphylococcus
MAPGDRDLGMVFQDFALW

SEQ ID NO: 2053653 - protein, 24 aa, Staphylococcus
MARKYGIEVFNVFLSQDVITEDIE

SEQ ID NO: 2053654 - protein, 17 aa, Staphylococcus
MAVRIAYFKVHYPLYYY

SEQ ID NO: 2053655 - protein, 17 aa, Staphylococcus
MCETCSGLGYVEDIDLH

SEQ ID NO: 2053656 - protein, 19 aa, Staphylococcus
MCGYPWKTKQRILSDMGHV

SEQ ID NO: 2053657 - protein, 26 aa, Staphylococcus
MCRRIYKLPIGFKWDNHPHITLIGDA

SEQ ID NO: 2053658 - protein, 19 aa, Staphylococcus
MCRYPWKTKQRILGDMGHV

SEQ ID NO: 2053659 - protein, 21 aa, Staphylococcus
MCYADCVPIYFYSESHDFVGL

SEQ ID NO: 2053660 - protein, 18 aa, Staphylococcus
MDAGMPLGIVIGSEGQGM

SEQ ID NO: 2053661 - protein, 21 aa, Staphylococcus
MDIQFPFAFELSKILGDSITK

SEQ ID NO: 2053662 - protein, 17 aa, Staphylococcus
MDLERIASIMFTSGTTG

SEQ ID NO: 2053663 - protein, 17 aa, Staphylococcus
MDRLLCGDVGYGKTEVA

SEQ ID NO: 2053664 - protein, 18 aa, Staphylococcus
MDTLELFKVAFPTDKSYQ

SEQ ID NO: 2053665 - protein, 24 aa, Staphylococcus
MDVFWPGPISFILPLKEGFLCKRV

SEQ ID NO: 2053666 - protein, 17 aa, Staphylococcus
MEAFNLYGALSMANAGP

SEQ ID NO: 2053667 - protein, 24 aa, Staphylococcus
MEAFWPGPISFILPLKSGYLCPKV

SEQ ID NO: 2053668 - protein, 19 aa, Staphylococcus
MEGCYVLRAIEMVEQGYKP

SEQ ID NO: 2053669 - protein, 18 aa, Staphylococcus
MEHFLRFGNQEEIDYQRT

SEQ ID NO: 2053670 - protein, 26 aa, Staphylococcus
MEKEMAVAMGIKWGMLYRDAVTTGVD

SEQ ID NO: 2053671 - protein, 23 aa, Staphylococcus
MEKRYKLFAQYHVRNITAFNKKA

SEQ ID NO: 2053672 - protein, 20 aa, Staphylococcus
MELEGLLQLINPVIKSYSDE

SEQ ID NO: 2053673 - protein, 17 aa, Staphylococcus
MELPYRFYVGGKLGSGQ

SEQ ID NO: 2053674 - protein, 19 aa, Staphylococcus
MELYYRVSLHLHSDACTTY

SEQ ID NO: 2053675 - protein, 21 aa, Staphylococcus
MELYYRVSLHLKDDSNDFYQL

SEQ ID NO: 2053676 - protein, 22 aa, Staphylococcus
MELYYRVSLHLNDKGQSMYRYN

SEQ ID NO: 2053677 - protein, 18 aa, Staphylococcus
MESRLLLGTGKFDNEEIQ

SEQ ID NO: 2053678 - protein, 17 aa, Staphylococcus
MEVEGLLQLFNPKIKSE

SEQ ID NO: 2053679 - protein, 22 aa, Staphylococcus
MEWVYRLLIDWKRIGRIKSIPK

SEQ ID NO: 2053680 - protein, 19 aa, Staphylococcus
MFKARFKTMRDVESFIDTI

SEQ ID NO: 2053681 - protein, 22 aa, Staphylococcus
MFKSEAYRYLAIGQIENIARIT

SEQ ID NO: 2053682 - protein, 25 aa, Staphylococcus
MGEKSRLQFVLLFFSNANLLILDEP

SEQ ID NO: 2053683 - protein, 19 aa, Staphylococcus
MGGRVALYYAVYGKCSLSK

SEQ ID NO: 2053684 - protein, 18 aa, Staphylococcus
MGLNSNWDMLFVVFCIHF

SEQ ID NO: 2053685 - protein, 18 aa, Staphylococcus
MGRIGRMVLRIALHNENF

SEQ ID NO: 2053686 - protein, 20 aa, Staphylococcus
MGRIGRMVLRIALKNEALNV

SEQ ID NO: 2053687 - protein, 17 aa, Staphylococcus
MGTTCVCALIFDNKIVV

SEQ ID NO: 2053688 - protein, 17 aa, Staphylococcus
MGTTCVCALIFEKKVVI

SEQ ID NO: 2053689 - protein, 17 aa, Staphylococcus
MGTTCVCALVFDKQLVV

SEQ ID NO: 2053690 - protein, 17 aa, Staphylococcus
MGTTCVCALVFDNYIVV

SEQ ID NO: 2053691 - protein, 21 aa, Staphylococcus
MGVKLTPILGWAERGGASASG

SEQ ID NO: 2053692 - protein, 17 aa, Staphylococcus
MGYFDISKDLLIPINEV

SEQ ID NO: 2053693 - protein, 17 aa, Staphylococcus
MHALRAGVTLIKDQGKT

SEQ ID NO: 2053694 - protein, 17 aa, Staphylococcus
MHCEIPKGAGNKVDLVA

SEQ ID NO: 2053695 - protein, 21 aa, Staphylococcus
MHIGHLIPFMMMKRFQLAGHK

SEQ ID NO: 2053696 - protein, 23 aa, Staphylococcus
MHIGHLLPLLTLRRFQNHGHKPI

SEQ ID NO: 2053697 - protein, 18 aa, Staphylococcus
MHLLPFNVFFVPARGGLG

SEQ ID NO: 2053698 - protein, 24 aa, Staphylococcus
MHRKHPANGFVCYMIGRLVLEYCK

SEQ ID NO: 2053699 - protein, 26 aa, Staphylococcus
MHSCIHKRFYLFVALMTEFQALNGMR

SEQ ID NO: 2053700 - protein, 19 aa, Staphylococcus
MHSNGRFGGHFVLGHVDEL

SEQ ID NO: 2053701 - protein, 18 aa, Staphylococcus
MHVLLCVENAYFRKKENY

SEQ ID NO: 2053702 - protein, 17 aa, Staphylococcus
MIEHFGIAQQETLVIGD

SEQ ID NO: 2053703 - protein, 17 aa, Staphylococcus
MIEHFGIQQEETLVIGD

SEQ ID NO: 2053704 - protein, 20 aa, Staphylococcus
MIHAFPLLPIRESHKVVKQI

SEQ ID NO: 2053705 - protein, 23 aa, Staphylococcus
MIKQFKGQVLIVTHDSYLQKHFD

SEQ ID NO: 2053706 - protein, 17 aa, Staphylococcus
MILERILPILSDREREI

SEQ ID NO: 2053707 - protein, 20 aa, Staphylococcus
MILFTRLKKPLSITSSGQTR

SEQ ID NO: 2053708 - protein, 17 aa, Staphylococcus
MIPKFNLFIALGIRDAI

SEQ ID NO: 2053709 - protein, 22 aa, Staphylococcus
MIPRKFEWMEQLPLTSNGKLDR

SEQ ID NO: 2053710 - protein, 25 aa, Staphylococcus
MIRERLGSVPLEWNEQLQVVATELE

SEQ ID NO: 2053711 - protein, 26 aa, Staphylococcus
MIRHRLGSMPLEWSDKLNIVATELET

SEQ ID NO: 2053712 - protein, 18 aa, Staphylococcus
MIRQAAFRLVDNIKNDIK

SEQ ID NO: 2053713 - protein, 18 aa, Staphylococcus
MIRQAAFRLVENIKNDIK

SEQ ID NO: 2053714 - protein, 17 aa, Staphylococcus
MIRRRLYHFAIHPNDQE

SEQ ID NO: 2053715 - protein, 18 aa, Staphylococcus
MKAREILDELGILKEGVF

SEQ ID NO: 2053716 - protein, 17 aa, Staphylococcus
MKCLRIIAMFRLINPTK

SEQ ID NO: 2053717 - protein, 19 aa, Staphylococcus
MKEVWKYDIDVAKAAAKAG

SEQ ID NO: 2053718 - protein, 17 aa, Staphylococcus
MKFTNCCILKFDYEDGA

SEQ ID NO: 2053719 - protein, 19 aa, Staphylococcus
MKGSGFVFKQSVSPNESLK

SEQ ID NO: 2053720 - protein, 17 aa, Staphylococcus
MKHYFILNFPQRPGALR

SEQ ID NO: 2053721 - protein, 24 aa, Staphylococcus
MKHYFSIKGEEIFKEDLRNKTVTI

SEQ ID NO: 2053722 - protein, 23 aa, Staphylococcus
MKILALYIRKNYRNPIVCITGSM

SEQ ID NO: 2053723 - protein, 19 aa, Staphylococcus
MKINQRLGFDSSLVTYEGL

SEQ ID NO: 2053724 - protein, 19 aa, Staphylococcus
MKKGRPSTQLTLICKTENA

SEQ ID NO: 2053725 - protein, 25 aa, Staphylococcus
MKKKWGEKVVERFSFRNYLYVFVSN

SEQ ID NO: 2053726 - protein, 17 aa, Staphylococcus
MKKRYATLMGVDENTPV

SEQ ID NO: 2053727 - protein, 17 aa, Staphylococcus
MKKRYGLIYVDRDNEGH

SEQ ID NO: 2053728 - protein, 21 aa, Staphylococcus
MKLMLKFDFVYDGDKLTDRFQ

SEQ ID NO: 2053729 - protein, 19 aa, Staphylococcus
MKLQSPRLMLGFKNNPLVD

SEQ ID NO: 2053730 - protein, 17 aa, Staphylococcus
MKLYRSFREEVPEEEYE

SEQ ID NO: 2053731 - protein, 20 aa, Staphylococcus
MKMTWPKSSKILYAPISGFH

SEQ ID NO: 2053732 - protein, 22 aa, Staphylococcus
MKPLYEWLGLSASLGFVDIPNY

SEQ ID NO: 2053733 - protein, 22 aa, Staphylococcus
MKSYIKFCIKPLIKKIEDELNA

SEQ ID NO: 2053734 - protein, 18 aa, Staphylococcus
MKVIYSYMITMIKAAQKM

SEQ ID NO: 2053735 - protein, 25 aa, Staphylococcus
MKVKEIIKFWIKWYSIDTTIDDILY

SEQ ID NO: 2053736 - protein, 17 aa, Staphylococcus
MLDFRLKALKLFYKMPM

SEQ ID NO: 2053737 - protein, 21 aa, Staphylococcus
MLEILKKLEIHDACVVVTRYF

SEQ ID NO: 2053738 - protein, 18 aa, Staphylococcus
MLFRGVHYEICCIDEKGY

SEQ ID NO: 2053739 - protein, 22 aa, Staphylococcus
MLGFMPGFPYLGGLDERLHTPR

SEQ ID NO: 2053740 - protein, 22 aa, Staphylococcus
MLGFMPGFPYLGGLDERLYTPR

SEQ ID NO: 2053741 - protein, 22 aa, Staphylococcus
MLGFMPGFPYLGGLDKRIHTPR

SEQ ID NO: 2053742 - protein, 18 aa, Staphylococcus
MLKVIAFFNQIERYYESS

SEQ ID NO: 2053743 - protein, 17 aa, Staphylococcus
MLLELGFSRNVMSLSPF

SEQ ID NO: 2053744 - protein, 17 aa, Staphylococcus
MLLHPVIPMLANSDEID

SEQ ID NO: 2053745 - protein, 22 aa, Staphylococcus
MLLKNGRFGFKMGNQTLEDSMV

SEQ ID NO: 2053746 - protein, 24 aa, Staphylococcus
MLMKNARFGFKMGNQALVDSMVAD

SEQ ID NO: 2053747 - protein, 22 aa, Staphylococcus
MLNEFSDHLGLMFQIKDDLLDI

SEQ ID NO: 2053748 - protein, 23 aa, Staphylococcus
MLNHGIPSFGYRIEAPYTSGKID

SEQ ID NO: 2053749 - protein, 17 aa, Staphylococcus
MLNTIWGRWGMFEKEVD

SEQ ID NO: 2053750 - protein, 18 aa, Staphylococcus
MLRKAMIQLIEFHDDLKV

SEQ ID NO: 2053751 - protein, 25 aa, Staphylococcus
MLRLLRPKFFLPIHGEYRMLKAHGQ

SEQ ID NO: 2053752 - protein, 17 aa, Staphylococcus
MLTENFIPRAELRETTM

SEQ ID NO: 2053753 - protein, 17 aa, Staphylococcus
MLVKRPLAILGDKITLG

SEQ ID NO: 2053754 - protein, 17 aa, Staphylococcus
MLVKRPLAISGDKVTVG

SEQ ID NO: 2053755 - protein, 17 aa, Staphylococcus
MLVKRPLAISGEKITLG

SEQ ID NO: 2053756 - protein, 21 aa, Staphylococcus
MLVMFGLKLSDLVKFVEKCNV

SEQ ID NO: 2053757 - protein, 17 aa, Staphylococcus
MMFGGGGYNIWKVVPRA

SEQ ID NO: 2053758 - protein, 17 aa, Staphylococcus
MMFGGGGYNIWRVVPRA

SEQ ID NO: 2053759 - protein, 17 aa, Staphylococcus
MMFYTCILDLIRNEETS

SEQ ID NO: 2053760 - protein, 17 aa, Staphylococcus
MMFYTCILDMIKFEETS

SEQ ID NO: 2053761 - protein, 20 aa, Staphylococcus
MMMAALKISTDFERMGDNAA

SEQ ID NO: 2053762 - protein, 18 aa, Staphylococcus
MMTEEDWNRFTIAVGKLS

SEQ ID NO: 2053763 - protein, 25 aa, Staphylococcus
MNAAIKGARGYLFFGHPLDVPEVAG

SEQ ID NO: 2053764 - protein, 23 aa, Staphylococcus
MNAICPKLGLTVEARLKIMEPKT

SEQ ID NO: 2053765 - protein, 21 aa, Staphylococcus
MNAWLKPYRKALNLEEPVVNI

SEQ ID NO: 2053766 - protein, 17 aa, Staphylococcus
MNDDFKKLLSLKEVYKD

SEQ ID NO: 2053767 - protein, 17 aa, Staphylococcus
MNDKCLFINVGRGTIVE

SEQ ID NO: 2053768 - protein, 22 aa, Staphylococcus
MNGREVFKFAVRIMGDASTRVV

SEQ ID NO: 2053769 - protein, 22 aa, Staphylococcus
MNGREVFKFAVRIMGEASTRVV

SEQ ID NO: 2053770 - protein, 21 aa, Staphylococcus
MNHLRLAKYQDIMLITNDTDW

SEQ ID NO: 2053771 - protein, 18 aa, Staphylococcus
MNLDMAIEMYDGEYRVEK

SEQ ID NO: 2053772 - protein, 18 aa, Staphylococcus
MNTEYFKRIEAIEYSVKY

SEQ ID NO: 2053773 - protein, 21 aa, Staphylococcus
MNVDWKKRIHMIIGTDEESDW

SEQ ID NO: 2053774 - protein, 24 aa, Staphylococcus
MNVNWKKRIHIIIGTDEESDWKCT

SEQ ID NO: 2053775 - protein, 24 aa, Staphylococcus
MNYFWPGPISFILPLKRGYLCEKV

SEQ ID NO: 2053776 - protein, 18 aa, Staphylococcus
MPEMTGLEVLAKVREGND

SEQ ID NO: 2053777 - protein, 19 aa, Staphylococcus
MPGGFGHYIQVHGGDLDVI

SEQ ID NO: 2053778 - protein, 22 aa, Staphylococcus
MPGLTICGGYQFLGTKYITPDG

SEQ ID NO: 2053779 - protein, 17 aa, Staphylococcus
MPIEVVYGFAQLKRAAA

SEQ ID NO: 2053780 - protein, 27 aa, Staphylococcus
MPIVLPRLRISYLYPRTEKLLSQYQLK

SEQ ID NO: 2053781 - protein, 22 aa, Staphylococcus
MPQSQWLKRAEIYIDGFHNFSS

SEQ ID NO: 2053782 - protein, 17 aa, Staphylococcus
MPQTRFVLKKALEQNLK

SEQ ID NO: 2053783 - protein, 18 aa, Staphylococcus
MPVKKGWHTIPLHAIAPV

SEQ ID NO: 2053784 - protein, 17 aa, Staphylococcus
MPYEEAKSWMLKALEPM

SEQ ID NO: 2053785 - protein, 20 aa, Staphylococcus
MPYRAKRHYSIVAGTPQHLT

SEQ ID NO: 2053786 - protein, 18 aa, Staphylococcus
MPYRAKRHYSIVKGDKQH

SEQ ID NO: 2053787 - protein, 18 aa, Staphylococcus
MPYRAKRHYSIVKGDQNH

SEQ ID NO: 2053788 - protein, 19 aa, Staphylococcus
MPYRAKRHYSIVSGDNNHL

SEQ ID NO: 2053789 - protein, 17 aa, Staphylococcus
MQDEIPVHMKIIYDEDS

SEQ ID NO: 2053790 - protein, 17 aa, Staphylococcus
MQGLKYYKAINVDSEGG

SEQ ID NO: 2053791 - protein, 18 aa, Staphylococcus
MQMIANKMGFDWNYSHPS

SEQ ID NO: 2053792 - protein, 19 aa, Staphylococcus
MQRLGHAFALLQVSGEILN

SEQ ID NO: 2053793 - protein, 18 aa, Staphylococcus
MQSYRAGKNIFPYAASKH

SEQ ID NO: 2053794 - protein, 17 aa, Staphylococcus
MRASSDFVRHGEKKSTI

SEQ ID NO: 2053795 - protein, 18 aa, Staphylococcus
MRCSHCAVGYTLQTKDSE

SEQ ID NO: 2053796 - protein, 18 aa, Staphylococcus
MRCSHCAVGYTLQTQDPD

SEQ ID NO: 2053797 - protein, 17 aa, Staphylococcus
MRCSHCAVGYTLQTTDP

SEQ ID NO: 2053798 - protein, 18 aa, Staphylococcus
MREPYIALGTRKVILRRA

SEQ ID NO: 2053799 - protein, 24 aa, Staphylococcus
MRKVYRYKLTYIIDALSSYKDQLL

SEQ ID NO: 2053800 - protein, 17 aa, Staphylococcus
MRKWIPLMMQGHSAGDI

SEQ ID NO: 2053801 - protein, 20 aa, Staphylococcus
MRPLYEWLGLTTSLGFIGDP

SEQ ID NO: 2053802 - protein, 18 aa, Staphylococcus
MRRNIGMIFQHFNLVKRS

SEQ ID NO: 2053803 - protein, 22 aa, Staphylococcus
MRVDRMKGIFAWGKILHSSQKE

SEQ ID NO: 2053804 - protein, 19 aa, Staphylococcus
MRYAKARYGGRMLSTIGVG

SEQ ID NO: 2053805 - protein, 20 aa, Staphylococcus
MRYFCMGNALVVPLVTRIGN

SEQ ID NO: 2053806 - protein, 22 aa, Staphylococcus
MRYPEFANGLILTGTGMFPKWK

SEQ ID NO: 2053807 - protein, 19 aa, Staphylococcus
MSEFMKFVLKDEGKSAEAK

SEQ ID NO: 2053808 - protein, 21 aa, Staphylococcus
MSELLLDFAYDTFKYEYERNN

SEQ ID NO: 2053809 - protein, 18 aa, Staphylococcus
MSGFRVGFAVGNRDMIQA

SEQ ID NO: 2053810 - protein, 17 aa, Staphylococcus
MSGNFVMRGEPALFNKF

SEQ ID NO: 2053811 - protein, 20 aa, Staphylococcus
MSGNGRFGGHFVLGHVDDKG

SEQ ID NO: 2053812 - protein, 20 aa, Staphylococcus
MSGNGRFGGHFVLGHVDELG

SEQ ID NO: 2053813 - protein, 20 aa, Staphylococcus
MSGQGRFGGHFVLGHVDEVA

SEQ ID NO: 2053814 - protein, 20 aa, Staphylococcus
MSGSGRFGGHFVLGHVDAKG

SEQ ID NO: 2053815 - protein, 18 aa, Staphylococcus
MSGYRVGFALGNKDVIQA

SEQ ID NO: 2053816 - protein, 17 aa, Staphylococcus
MSLKAFKALTLFDDAQL

SEQ ID NO: 2053817 - protein, 17 aa, Staphylococcus
MSQIRWLSVLDLKDKTE

SEQ ID NO: 2053818 - protein, 23 aa, Staphylococcus
MSRVRRYPLPLALEVSNVESVMP

SEQ ID NO: 2053819 - protein, 25 aa, Staphylococcus
MSVVLRPNVSFAMIPKFNLFIALGI

SEQ ID NO: 2053820 - protein, 22 aa, Staphylococcus
MSYLFEVIDPYSLNKQGQDVGE

SEQ ID NO: 2053821 - protein, 17 aa, Staphylococcus
MTCGVCLEVCPNVTKKN

SEQ ID NO: 2053822 - protein, 17 aa, Staphylococcus
MTCGVCLEVCPNVTPNN

SEQ ID NO: 2053823 - protein, 17 aa, Staphylococcus
MTKRRFSAFTGSGLEVF

SEQ ID NO: 2053824 - protein, 22 aa, Staphylococcus
MTLPELIEWAWKNEVSDKAFYS

SEQ ID NO: 2053825 - protein, 21 aa, Staphylococcus
MTSLYRPGPMEEIPTYITRRH

SEQ ID NO: 2053826 - protein, 23 aa, Staphylococcus
MTVNRAGSMIGYFLNDGPVTNFE

SEQ ID NO: 2053827 - protein, 19 aa, Staphylococcus
MVDVYRFLVQLLRKNKLDV

SEQ ID NO: 2053828 - protein, 17 aa, Staphylococcus
MVECFKASFEATDDQFL

SEQ ID NO: 2053829 - protein, 19 aa, Staphylococcus
MVLNKTVPEDLFFIISLSG

SEQ ID NO: 2053830 - protein, 19 aa, Staphylococcus
MVLNKTVPQDLFFIISLSG

SEQ ID NO: 2053831 - protein, 18 aa, Staphylococcus
MVLPARFPNLLINGSTGI

SEQ ID NO: 2053832 - protein, 18 aa, Staphylococcus
MVLPARFPNLLVNGSTGI

SEQ ID NO: 2053833 - protein, 17 aa, Staphylococcus
MVLPSRFPNLLVNGSTG

SEQ ID NO: 2053834 - protein, 17 aa, Staphylococcus
MVMHIYESFGLKHLKLV

SEQ ID NO: 2053835 - protein, 22 aa, Staphylococcus
MVYRPTDFFIRRTGKLYFKIDD

SEQ ID NO: 2053836 - protein, 17 aa, Staphylococcus
MWFIRPFYAKETTKNKI

SEQ ID NO: 2053837 - protein, 17 aa, Staphylococcus
MWFIRPFYAKSTKLNAV

SEQ ID NO: 2053838 - protein, 19 aa, Staphylococcus
MYDIAGLRMMCQFVDDIDV

SEQ ID NO: 2053839 - protein, 19 aa, Staphylococcus
MYKERGFEIKPEIAGLMIS

SEQ ID NO: 2053840 - protein, 25 aa, Staphylococcus
MYKERGFEIKPHIAGLMISAIISDS

SEQ ID NO: 2053841 - protein, 18 aa, Staphylococcus
MYKERGFEIKREIAGLMV

SEQ ID NO: 2053842 - protein, 23 aa, Staphylococcus
MYKIHLMKECLKRDVKLISSMGA

SEQ ID NO: 2053843 - protein, 22 aa, Staphylococcus
MYKIWAEFKFNDEVHRFTYNIK

SEQ ID NO: 2053844 - protein, 18 aa, Staphylococcus
MYTEIKRSLNLVSPIRYI

SEQ ID NO: 2053845 - protein, 17 aa, Staphylococcus
MYYYRSALETILQKEVK

SEQ ID NO: 2053846 - protein, 18 aa, Staphylococcus
NAALRICENIKYYFHIIS

SEQ ID NO: 2053847 - protein, 18 aa, Staphylococcus
NAELKVYMIASVEERAER

SEQ ID NO: 2053848 - protein, 25 aa, Staphylococcus
NAESKLTVAMGLRINNEPLLMDISK

SEQ ID NO: 2053849 - protein, 25 aa, Staphylococcus
NAESKLTVAMGYRINNEPLLMDIAK

SEQ ID NO: 2053850 - protein, 20 aa, Staphylococcus
NAFDFPGFVPAYIRPLFCEG

SEQ ID NO: 2053851 - protein, 18 aa, Staphylococcus
NAFHLWLIRIFYANQPKS

SEQ ID NO: 2053852 - protein, 23 aa, Staphylococcus
NAFWPGPISFILPLKQGYLCEKV

SEQ ID NO: 2053853 - protein, 18 aa, Staphylococcus
NAGITTCWFNYRNKENNS

SEQ ID NO: 2053854 - protein, 20 aa, Staphylococcus
NAILRTIFRSELPSLESIKN

SEQ ID NO: 2053855 - protein, 19 aa, Staphylococcus
NALKLKRFFSSTVPVHRGS

SEQ ID NO: 2053856 - protein, 18 aa, Staphylococcus
NAMKRNDLVFGIGPAGTG

SEQ ID NO: 2053857 - protein, 21 aa, Staphylococcus
NAPFLPRFGLLITLPSTYEQI

SEQ ID NO: 2053858 - protein, 19 aa, Staphylococcus
NARIATCWFNLRGKENQTS

SEQ ID NO: 2053859 - protein, 24 aa, Staphylococcus
NASLRICESIKYYFGLTSKMPKPF

SEQ ID NO: 2053860 - protein, 19 aa, Staphylococcus
NAVELRRSIGYVIQQIGLM

SEQ ID NO: 2053861 - protein, 20 aa, Staphylococcus
NAYFKRIFNILHDYYSNNDM

SEQ ID NO: 2053862 - protein, 18 aa, Staphylococcus
NCGMCSSGLYVLFDGDIV

SEQ ID NO: 2053863 - protein, 19 aa, Staphylococcus
NCLMARIGNRITLDQQQSF

SEQ ID NO: 2053864 - protein, 20 aa, Staphylococcus
NCLPVFKILFEKRSLHFNVY

SEQ ID NO: 2053865 - protein, 21 aa, Staphylococcus
NCPIKVRYFYNGRILMMNMMP

SEQ ID NO: 2053866 - protein, 18 aa, Staphylococcus
NDAHTSWNNALKGVNGID

SEQ ID NO: 2053867 - protein, 17 aa, Staphylococcus
NDAWSRSQLQDWIKEDL

SEQ ID NO: 2053868 - protein, 19 aa, Staphylococcus
NDEGLKVIGYRDVPVDTQA

SEQ ID NO: 2053869 - protein, 17 aa, Staphylococcus
NDFAYKHHIPWIYGGVV

SEQ ID NO: 2053870 - protein, 24 aa, Staphylococcus
NDFSYRYRIPWIYGGVVQSTYVET

SEQ ID NO: 2053871 - protein, 17 aa, Staphylococcus
NDIKMLYGMEGMLVDDG

SEQ ID NO: 2053872 - protein, 18 aa, Staphylococcus
NDIPVFFVQDAIKFPDVI

SEQ ID NO: 2053873 - protein, 20 aa, Staphylococcus
NDIRTALRMILPRKWSLEQL

SEQ ID NO: 2053874 - protein, 18 aa, Staphylococcus
NDIWPEFEIEGDVELQYT

SEQ ID NO: 2053875 - protein, 23 aa, Staphylococcus
NDKAMRWQLGVIWKKEKYINYAT

SEQ ID NO: 2053876 - protein, 19 aa, Staphylococcus
NDKQRMAVEYSIPKWIIEH

SEQ ID NO: 2053877 - protein, 22 aa, Staphylococcus
NDLAHGEFGKWLKSINLNQNVA

SEQ ID NO: 2053878 - protein, 19 aa, Staphylococcus
NDLEALGKEMEQISEENDE

SEQ ID NO: 2053879 - protein, 17 aa, Staphylococcus
NDLFKYYDFILIDTPPV

SEQ ID NO: 2053880 - protein, 17 aa, Staphylococcus
NDLIYCFLLDNVFPERM

SEQ ID NO: 2053881 - protein, 17 aa, Staphylococcus
NDLLGRIEFKIMKTPKA

SEQ ID NO: 2053882 - protein, 17 aa, Staphylococcus
NDLVFGIGPAGTGKTFL

SEQ ID NO: 2053883 - protein, 23 aa, Staphylococcus
NDPKFKRWVIGSILSRTYYHNMI

SEQ ID NO: 2053884 - protein, 21 aa, Staphylococcus
NDQWKRMGILGIEMESAALYL

SEQ ID NO: 2053885 - protein, 18 aa, Staphylococcus
NDRLKLQLLDDVKSVFNS

SEQ ID NO: 2053886 - protein, 17 aa, Staphylococcus
NDRSMFAFGHYTVAMKN

SEQ ID NO: 2053887 - protein, 19 aa, Staphylococcus
NDTFLAWQAFRGEVPLSVY

SEQ ID NO: 2053888 - protein, 18 aa, Staphylococcus
NDTLYKWAHHQQLLPNQL

SEQ ID NO: 2053889 - protein, 20 aa, Staphylococcus
NDTSEWKSDFNIYKPHSGVA

SEQ ID NO: 2053890 - protein, 19 aa, Staphylococcus
NDYEHMLFYFAYKTFTLTA

SEQ ID NO: 2053891 - protein, 21 aa, Staphylococcus
NEAKPTYQAHSFKASEVPSAI

SEQ ID NO: 2053892 - protein, 18 aa, Staphylococcus
NEALKHLIECGANVVGLN

SEQ ID NO: 2053893 - protein, 21 aa, Staphylococcus
NEDFKGQCNYLLLRPTSKNRY

SEQ ID NO: 2053894 - protein, 22 aa, Staphylococcus
NEEKYLRLYAEFENYKRRIQNE

SEQ ID NO: 2053895 - protein, 17 aa, Staphylococcus
NEFGPYIVIAPEIAIAH

SEQ ID NO: 2053896 - protein, 17 aa, Staphylococcus
NEFKAGMVITVEPGIYV

SEQ ID NO: 2053897 - protein, 23 aa, Staphylococcus
NEFKNYILGMIFYRFLSEKIEEQ

SEQ ID NO: 2053898 - protein, 18 aa, Staphylococcus
NEFLRYPYIESFENIDEV

SEQ ID NO: 2053899 - protein, 17 aa, Staphylococcus
NEGEKWMLYGLNGAGKT

SEQ ID NO: 2053900 - protein, 17 aa, Staphylococcus
NEGFGMVILEAMAQDNI

SEQ ID NO: 2053901 - protein, 18 aa, Staphylococcus
NEGFGMVILEAMAQDNIV

SEQ ID NO: 2053902 - protein, 18 aa, Staphylococcus
NEGFGMVILEAMAQHNIV

SEQ ID NO: 2053903 - protein, 17 aa, Staphylococcus
NEIALNFIIHGHLGVIE

SEQ ID NO: 2053904 - protein, 20 aa, Staphylococcus
NEIIGYLGLWMVIDQAQITT

SEQ ID NO: 2053905 - protein, 20 aa, Staphylococcus
NEIKAKLIIIDEMSMVDSWL

SEQ ID NO: 2053906 - protein, 19 aa, Staphylococcus
NEILTGFYLAIAPAGEYHY

SEQ ID NO: 2053907 - protein, 19 aa, Staphylococcus
NEINGLLGLETGHINIGMS

SEQ ID NO: 2053908 - protein, 17 aa, Staphylococcus
NEIVLAMKLERIMSKEE

SEQ ID NO: 2053909 - protein, 20 aa, Staphylococcus
NEIYDFYSLGFGDPYPISGS

SEQ ID NO: 2053910 - protein, 25 aa, Staphylococcus
NEKHFKLRIEQFLIYKDISNKEVFN

SEQ ID NO: 2053911 - protein, 18 aa, Staphylococcus
NEKLRGFIDYVLEIGKVD

SEQ ID NO: 2053912 - protein, 21 aa, Staphylococcus
NELKAAISALMFKRYENDIEN

SEQ ID NO: 2053913 - protein, 22 aa, Staphylococcus
NELKSLCVNSGFVEIDQSDDLI

SEQ ID NO: 2053914 - protein, 22 aa, Staphylococcus
NELLPKFIIGFGGIPNHKLKEH

SEQ ID NO: 2053915 - protein, 17 aa, Staphylococcus
NELPISAGFFIINPFEV

SEQ ID NO: 2053916 - protein, 20 aa, Staphylococcus
NELRIGETLFRGVDTTTNEN

SEQ ID NO: 2053917 - protein, 21 aa, Staphylococcus
NELRIGETLFRGVETTTNQSI

SEQ ID NO: 2053918 - protein, 20 aa, Staphylococcus
NELRINIIHKFCENPNKEIE

SEQ ID NO: 2053919 - protein, 17 aa, Staphylococcus
NELSRLSQYLVEKDNYR

SEQ ID NO: 2053920 - protein, 19 aa, Staphylococcus
NELYHFPVMYLEYSGAYGD

SEQ ID NO: 2053921 - protein, 20 aa, Staphylococcus
NELYRFPIMYLEYSGEYGDV

SEQ ID NO: 2053922 - protein, 22 aa, Staphylococcus
NEPELWKKAATFLLPKDYLRYC

SEQ ID NO: 2053923 - protein, 20 aa, Staphylococcus
NEPKCILPYGVVATLDAEQL

SEQ ID NO: 2053924 - protein, 20 aa, Staphylococcus
NEPLCVKVGMELFYQTGPGL

SEQ ID NO: 2053925 - protein, 19 aa, Staphylococcus
NEPNCPFIINMQLTGVFDI

SEQ ID NO: 2053926 - protein, 19 aa, Staphylococcus
NEPSYRDAIDWGSVNQPIE

SEQ ID NO: 2053927 - protein, 19 aa, Staphylococcus
NEPSYRDNIAWGDINQPID

SEQ ID NO: 2053928 - protein, 18 aa, Staphylococcus
NEQFCRKLWLDAWEATYN

SEQ ID NO: 2053929 - protein, 18 aa, Staphylococcus
NERIIPVIPQQGSLGASG

SEQ ID NO: 2053930 - protein, 18 aa, Staphylococcus
NERLKLQLQDEVKSIYNG

SEQ ID NO: 2053931 - protein, 18 aa, Staphylococcus
NESLRFTYTFSEDTELTG

SEQ ID NO: 2053932 - protein, 17 aa, Staphylococcus
NESLRYAYHMNMQQFKI

SEQ ID NO: 2053933 - protein, 17 aa, Staphylococcus
NESRVGLYIGNDIESII

SEQ ID NO: 2053934 - protein, 25 aa, Staphylococcus
NESRYCPNCGRLLHYDYIQYNQIGH

SEQ ID NO: 2053935 - protein, 26 aa, Staphylococcus
NESRYCPNCGRLLKYDYIHYNQIGHY

SEQ ID NO: 2053936 - protein, 20 aa, Staphylococcus
NEVCHKLHLPWVYGAAVGGK

SEQ ID NO: 2053937 - protein, 26 aa, Staphylococcus
NEVKEMYRRVNFLFGDIVKVTPSSKV

SEQ ID NO: 2053938 - protein, 22 aa, Staphylococcus
NEVLYRKVLEFFHPEFKKEYVI

SEQ ID NO: 2053939 - protein, 20 aa, Staphylococcus
NEWFKRPSIVHKFLDNFDVS

SEQ ID NO: 2053940 - protein, 18 aa, Staphylococcus
NEYRSCNKYEKMIFMDYE

SEQ ID NO: 2053941 - protein, 21 aa, Staphylococcus
NFAMWWLGNCGIWIKTPEGAN

SEQ ID NO: 2053942 - protein, 24 aa, Staphylococcus
NFDWKEVEKAFSWYDTGKVNMAYE

SEQ ID NO: 2053943 - protein, 17 aa, Staphylococcus
NFFNIKFNREITVNMES

SEQ ID NO: 2053944 - protein, 23 aa, Staphylococcus
NFKAVELNLFFAICSLLKHCGSE

SEQ ID NO: 2053945 - protein, 17 aa, Staphylococcus
NFMCFKSGTPIEDDVFM

SEQ ID NO: 2053946 - protein, 23 aa, Staphylococcus
NFNFKLLEFCLNRIKEKDSAQLM

SEQ ID NO: 2053947 - protein, 19 aa, Staphylococcus
NFNYFSFKGLRSKGNNELH

SEQ ID NO: 2053948 - protein, 22 aa, Staphylococcus
NGDGRIKVYMSYKMDYDEFDQF

SEQ ID NO: 2053949 - protein, 23 aa, Staphylococcus
NGEYFRAGIIFKQLLDINEKVCT

SEQ ID NO: 2053950 - protein, 19 aa, Staphylococcus
NGFKKWLTPVDMWKNHQMT

SEQ ID NO: 2053951 - protein, 17 aa, Staphylococcus
NGIYLSGALLMFAGNKS

SEQ ID NO: 2053952 - protein, 22 aa, Staphylococcus
NGKAEMSFEEFLGKAAQSSSNI

SEQ ID NO: 2053953 - protein, 21 aa, Staphylococcus
NGKEISRIGSTFGKTNRVIID

SEQ ID NO: 2053954 - protein, 20 aa, Staphylococcus
NGKIKFIPCHEVNAVGPMGG

SEQ ID NO: 2053955 - protein, 17 aa, Staphylococcus
NGLKGTEIHLDFPSVGA

SEQ ID NO: 2053956 - protein, 18 aa, Staphylococcus
NGLMYLPAMFMNRGNMRK

SEQ ID NO: 2053957 - protein, 17 aa, Staphylococcus
NGLWKGKKAIIIYTQGG

SEQ ID NO: 2053958 - protein, 24 aa, Staphylococcus
NGPKARLKLLIGLSNHMNHKELKE

SEQ ID NO: 2053959 - protein, 24 aa, Staphylococcus
NGQKARLKLLVAISNHLNKNQLKS

SEQ ID NO: 2053960 - protein, 18 aa, Staphylococcus
NGQNFFALRNDWTDQLQH

SEQ ID NO: 2053961 - protein, 19 aa, Staphylococcus
NGSVIKSGMRFDFYETVGG

SEQ ID NO: 2053962 - protein, 17 aa, Staphylococcus
NGVELRNRFVLAPLTHI

SEQ ID NO: 2053963 - protein, 18 aa, Staphylococcus
NGVLCGRATWQGATEVLA

SEQ ID NO: 2053964 - protein, 18 aa, Staphylococcus
NGVLCGRATWRGATDHFA

SEQ ID NO: 2053965 - protein, 17 aa, Staphylococcus
NGWCAGFTMAALLNATK

SEQ ID NO: 2053966 - protein, 32 aa, Staphylococcus
NHARATAALCAKCNVSYLVLRGEMAEYEGNLF

SEQ ID NO: 2053967 - protein, 24 aa, Staphylococcus
NHMNAWLKPYRRAFNLEEPVVNVT

SEQ ID NO: 2053968 - protein, 17 aa, Staphylococcus
NHWFEWLATQMKSYDYH

SEQ ID NO: 2053969 - protein, 19 aa, Staphylococcus
NIEAAFKFLKDAFDAKYAY

SEQ ID NO: 2053970 - protein, 18 aa, Staphylococcus
NIEVLRFANAMFEPLWNN

SEQ ID NO: 2053971 - protein, 25 aa, Staphylococcus
NIFYKRYWTSNGWADWSKFTNSIFY

SEQ ID NO: 2053972 - protein, 18 aa, Staphylococcus
NIGGKWEFEFGSVKYVQA

SEQ ID NO: 2053973 - protein, 18 aa, Staphylococcus
NIGPSTELRKWFGHDPDK

SEQ ID NO: 2053974 - protein, 20 aa, Staphylococcus
NIGYKIAQRLGGYDAVGPVL

SEQ ID NO: 2053975 - protein, 23 aa, Staphylococcus
NIHNYRSALYIKHLEQYVNEIIT

SEQ ID NO: 2053976 - protein, 17 aa, Staphylococcus
NILKRGKLTLSVATQGA

SEQ ID NO: 2053977 - protein, 27 aa, Staphylococcus
NIMFRRIYRLPIGFEWQHQSNVTLIGD

SEQ ID NO: 2053978 - protein, 25 aa, Staphylococcus
NIPAGRGMVKWAPFATLPEQFETIH

SEQ ID NO: 2053979 - protein, 20 aa, Staphylococcus
NIPDCINLTIGQPDFPMPDV

SEQ ID NO: 2053980 - protein, 20 aa, Staphylococcus
NIPFLWRLSSELNVEQLKRA

SEQ ID NO: 2053981 - protein, 20 aa, Staphylococcus
NIPFLWRLTSELNVNQLQRS

SEQ ID NO: 2053982 - protein, 22 aa, Staphylococcus
NIQRRGGKVILFNDGDILNGLK

SEQ ID NO: 2053983 - protein, 18 aa, Staphylococcus
NITGRATLEAVINSNNYS

SEQ ID NO: 2053984 - protein, 22 aa, Staphylococcus
NKAEKCTFCFPRIEAGLPTVCS

SEQ ID NO: 2053985 - protein, 23 aa, Staphylococcus
NKAEKCTFCFPRIEAGLPTVCSE

SEQ ID NO: 2053986 - protein, 19 aa, Staphylococcus
NKAEKCTFCFPRVEAGMPT

SEQ ID NO: 2053987 - protein, 17 aa, Staphylococcus
NKALKFEREKAYGKHLD

SEQ ID NO: 2053988 - protein, 21 aa, Staphylococcus
NKARLKGIFLTHGHEHAIGAV

SEQ ID NO: 2053989 - protein, 21 aa, Staphylococcus
NKDKEVIGFFVLHQYYQHEGY

SEQ ID NO: 2053990 - protein, 17 aa, Staphylococcus
NKFKPYFNWTIEKLCEN

SEQ ID NO: 2053991 - protein, 24 aa, Staphylococcus
NKHFAQKVAHQWLRLASIDENGDI

SEQ ID NO: 2053992 - protein, 21 aa, Staphylococcus
NKIVKFVGCYHGHSDSLLIKA

SEQ ID NO: 2053993 - protein, 23 aa, Staphylococcus
NKIWYKLLVNLGINSITAIGHQP

SEQ ID NO: 2053994 - protein, 17 aa, Staphylococcus
NKKNIIFSPEFLREGNA

SEQ ID NO: 2053995 - protein, 22 aa, Staphylococcus
NKKRILGKFSYVFTTLKVIANP

SEQ ID NO: 2053996 - protein, 19 aa, Staphylococcus
NKKVICYMPTWRGSVGKVK

SEQ ID NO: 2053997 - protein, 21 aa, Staphylococcus
NKLKIPILLNRFIKKIKPDIV

SEQ ID NO: 2053998 - protein, 19 aa, Staphylococcus
NKMAALILRKDLNGLMTKM

SEQ ID NO: 2053999 - protein, 18 aa, Staphylococcus
NKMGFDWNYSHPSEIMDE

SEQ ID NO: 2054000 - protein, 19 aa, Staphylococcus
NKMKKGFIDKGYRVYFDSP

SEQ ID NO: 2054001 - protein, 19 aa, Staphylococcus
NKNEIYKLLSLLENDVDNM

SEQ ID NO: 2054002 - protein, 21 aa, Staphylococcus
NKRFKGIIGLVTMNKVREPLE

SEQ ID NO: 2054003 - protein, 29 aa, Staphylococcus
NKRIEFYRLYLLMVHLVKFGNMYAGSVNR

SEQ ID NO: 2054004 - protein, 17 aa, Staphylococcus
NKRIIQIPVLYGEEYGP

SEQ ID NO: 2054005 - protein, 24 aa, Staphylococcus
NKRKGQKYFIVWHGTPLKYMGKDM

SEQ ID NO: 2054006 - protein, 20 aa, Staphylococcus
NKRVALIGGGRIGFRKFKQL

SEQ ID NO: 2054007 - protein, 19 aa, Staphylococcus
NKSGTAWGCDLTYDYVKIN

SEQ ID NO: 2054008 - protein, 18 aa, Staphylococcus
NKTIPQIILKWHVQNGVV

SEQ ID NO: 2054009 - protein, 19 aa, Staphylococcus
NKVHFVGTFTVEFFIDKNN

SEQ ID NO: 2054010 - protein, 23 aa, Staphylococcus
NLAEEYQCPVIILSDLQLSLGKQ

SEQ ID NO: 2054011 - protein, 24 aa, Staphylococcus
NLALRARYLFEVDIDYYVLKGEIV

SEQ ID NO: 2054012 - protein, 18 aa, Staphylococcus
NLFFGTNIPTCILVFKKC

SEQ ID NO: 2054013 - protein, 18 aa, Staphylococcus
NLHKGAMLKQAFGVASPQ

SEQ ID NO: 2054014 - protein, 22 aa, Staphylococcus
NLKGSWSVVCFYPADFSFVCPT

SEQ ID NO: 2054015 - protein, 19 aa, Staphylococcus
NLKHFKATYGLLYEEELGL

SEQ ID NO: 2054016 - protein, 20 aa, Staphylococcus
NLKLKLSPNEVWNAVTVNAA

SEQ ID NO: 2054017 - protein, 19 aa, Staphylococcus
NLLFLSFAGALAYQIKAKH

SEQ ID NO: 2054018 - protein, 19 aa, Staphylococcus
NLLFLSFAGALAYQIKARH

SEQ ID NO: 2054019 - protein, 18 aa, Staphylococcus
NLLFLSFAGALAYQLNAK

SEQ ID NO: 2054020 - protein, 19 aa, Staphylococcus
NLLFLSFAGALAYQLNAKH

SEQ ID NO: 2054021 - protein, 18 aa, Staphylococcus
NLLFLSFAGALAYQRNAK

SEQ ID NO: 2054022 - protein, 18 aa, Staphylococcus
NLLFLSFAGALAYQTNAK

SEQ ID NO: 2054023 - protein, 17 aa, Staphylococcus
NLMNCFKVLDAVSIPQG

SEQ ID NO: 2054024 - protein, 18 aa, Staphylococcus
NLNLSFDLITIFCDSLNY

SEQ ID NO: 2054025 - protein, 25 aa, Staphylococcus
NLPEEMNPFLGYRAIRLCLAQQDIF

SEQ ID NO: 2054026 - protein, 24 aa, Staphylococcus
NLPEEMNPFLGYRAIRLCLDQPDI

SEQ ID NO: 2054027 - protein, 24 aa, Staphylococcus
NLPKEMNPFLGYRAIRLCLDQQDI

SEQ ID NO: 2054028 - protein, 22 aa, Staphylococcus
NLPLEWLKDKIIVDSLGLHSNN

SEQ ID NO: 2054029 - protein, 24 aa, Staphylococcus
NLQFSVALSTVWKFISRTNKYIDE

SEQ ID NO: 2054030 - protein, 17 aa, Staphylococcus
NLQILGMGPVELRLRDI

SEQ ID NO: 2054031 - protein, 23 aa, Staphylococcus
NLSNDAKITWSILRDRLDLSIRN

SEQ ID NO: 2054032 - protein, 18 aa, Staphylococcus
NMEVIWLIQDCRYHRGRL

SEQ ID NO: 2054033 - protein, 24 aa, Staphylococcus
NMGLDYFDLFLIHWPCEQNGRYIE

SEQ ID NO: 2054034 - protein, 22 aa, Staphylococcus
NMIFQFEHLGLWSTGDSQFDVK

SEQ ID NO: 2054035 - protein, 23 aa, Staphylococcus
NMIFQFEHLGLWSTGDSQFDVSA

SEQ ID NO: 2054036 - protein, 17 aa, Staphylococcus
NMIQEVYSDFGFEDYTF

SEQ ID NO: 2054037 - protein, 19 aa, Staphylococcus
NMRCSHCAVGYTLQTKDPD

SEQ ID NO: 2054038 - protein, 22 aa, Staphylococcus
NMRCSHCAVGYTLQTKDPDALP

SEQ ID NO: 2054039 - protein, 21 aa, Staphylococcus
NMRCSHCAVGYTLQTKDPDPL

SEQ ID NO: 2054040 - protein, 20 aa, Staphylococcus
NMRCSHCAVGYTLQTQDPEP

SEQ ID NO: 2054041 - protein, 18 aa, Staphylococcus
NMSGFRVGFAVGNKDMIQ

SEQ ID NO: 2054042 - protein, 18 aa, Staphylococcus
NMSGFRVGFAVGNKEMIQ

SEQ ID NO: 2054043 - protein, 18 aa, Staphylococcus
NNFILWKYNNVIYNVFSD

SEQ ID NO: 2054044 - protein, 17 aa, Staphylococcus
NNIKIGMELGYIKAPPE

SEQ ID NO: 2054045 - protein, 18 aa, Staphylococcus
NNIKKAWWQKFITQSPYN

SEQ ID NO: 2054046 - protein, 18 aa, Staphylococcus
NNLLKFVVYIDCKQDSIF

SEQ ID NO: 2054047 - protein, 22 aa, Staphylococcus
NNNIKWQLGHLILLNDFLVFET

SEQ ID NO: 2054048 - protein, 26 aa, Staphylococcus
NNPHCWKLRFDWCLSNASPFQSAYHI

SEQ ID NO: 2054049 - protein, 23 aa, Staphylococcus
NNPNAIVWEGEFIDIIGNSKVGD

SEQ ID NO: 2054050 - protein, 19 aa, Staphylococcus
NNRIVPVIPQQGSLGASGD

SEQ ID NO: 2054051 - protein, 24 aa, Staphylococcus
NNRVKEVIAGFDFTYGKFGKGNMS

SEQ ID NO: 2054052 - protein, 17 aa, Staphylococcus
NNSSFKILSEFKLNTPS

SEQ ID NO: 2054053 - protein, 22 aa, Staphylococcus
NNSYRWLLRFDWARPEHVHFAS

SEQ ID NO: 2054054 - protein, 24 aa, Staphylococcus
NNTRGMCETCSGLGYVEDIDLNEL

SEQ ID NO: 2054055 - protein, 23 aa, Staphylococcus
NNVKEVIAGFDFTFGKFGKGNMT

SEQ ID NO: 2054056 - protein, 19 aa, Staphylococcus
NNVRFLKNRVKALQKNVLF

SEQ ID NO: 2054057 - protein, 18 aa, Staphylococcus
NNVYKWAYVNSILVSWYQ

SEQ ID NO: 2054058 - protein, 17 aa, Staphylococcus
NPEESWHGFNGYGKDQY

SEQ ID NO: 2054059 - protein, 19 aa, Staphylococcus
NPEVIKWAKEVLGHTVLDT

SEQ ID NO: 2054060 - protein, 18 aa, Staphylococcus
NPFPKDWRMHAFFMDALP

SEQ ID NO: 2054061 - protein, 19 aa, Staphylococcus
NPFPKEWRMHAFFMDALPI

SEQ ID NO: 2054062 - protein, 20 aa, Staphylococcus
NPFPKEWRMHAFFVDALPIL

SEQ ID NO: 2054063 - protein, 18 aa, Staphylococcus
NPIIPFIIGDGIGPDIWK

SEQ ID NO: 2054064 - protein, 20 aa, Staphylococcus
NPIKCLRIIAMFRLINPTKE

SEQ ID NO: 2054065 - protein, 19 aa, Staphylococcus
NPLDYLLCFYRDFDNDFIR

SEQ ID NO: 2054066 - protein, 18 aa, Staphylococcus
NPLFLGMGGMHGSYASNM

SEQ ID NO: 2054067 - protein, 17 aa, Staphylococcus
NPLLPEEMRFILKQMGL

SEQ ID NO: 2054068 - protein, 19 aa, Staphylococcus
NPNPFEWLTQLVKPYQNEA

SEQ ID NO: 2054069 - protein, 22 aa, Staphylococcus
NPSHLKAMIPWEGLNDMYREAA

SEQ ID NO: 2054070 - protein, 18 aa, Staphylococcus
NPSPFKWLDSLVDPYEND

SEQ ID NO: 2054071 - protein, 23 aa, Staphylococcus
NPTHLKAMIPWEGLNDMYREIAF

SEQ ID NO: 2054072 - protein, 19 aa, Staphylococcus
NPWHKFKIELAYKIASIYK

SEQ ID NO: 2054073 - protein, 19 aa, Staphylococcus
NQDPIILVHGFNGFTDDIN

SEQ ID NO: 2054074 - protein, 19 aa, Staphylococcus
NQELGITIIINLHFVDLAR

SEQ ID NO: 2054075 - protein, 18 aa, Staphylococcus
NQHLPGWGLDALKFLIEE

SEQ ID NO: 2054076 - protein, 17 aa, Staphylococcus
NQIKLLWEDIEAFDDEQ

SEQ ID NO: 2054077 - protein, 17 aa, Staphylococcus
NQLANWGVDGIFTDHAD

SEQ ID NO: 2054078 - protein, 17 aa, Staphylococcus
NQLGLALAKKFATNHQV

SEQ ID NO: 2054079 - protein, 19 aa, Staphylococcus
NQRISDEAYKEFLENEIAR

SEQ ID NO: 2054080 - protein, 24 aa, Staphylococcus
NQTSVKFILGFGGIPFSKLNDHTN

SEQ ID NO: 2054081 - protein, 22 aa, Staphylococcus
NRAGKIPFVISCQGQEAAQIGM

SEQ ID NO: 2054082 - protein, 17 aa, Staphylococcus
NRARLVIYPAAMRYAGP

SEQ ID NO: 2054083 - protein, 20 aa, Staphylococcus
NRDLFKFLPFDGSIITMNEL

SEQ ID NO: 2054084 - protein, 19 aa, Staphylococcus
NREGLRIAVIVNDMSEVNI

SEQ ID NO: 2054085 - protein, 19 aa, Staphylococcus
NRFKGIIGLVTMKKVREPL

SEQ ID NO: 2054086 - protein, 26 aa, Staphylococcus
NRFKHFKDRVLVPLAYIDFDEYIEEL

SEQ ID NO: 2054087 - protein, 21 aa, Staphylococcus
NRFRVKCVIFAPEGFSEEKIS

SEQ ID NO: 2054088 - protein, 20 aa, Staphylococcus
NRIEGFFSIAGFGPDAKDID

SEQ ID NO: 2054089 - protein, 19 aa, Staphylococcus
NRISDILSRLSIAPSEELD

SEQ ID NO: 2054090 - protein, 20 aa, Staphylococcus
NRITSAFVRLQYNIEELHVK

SEQ ID NO: 2054091 - protein, 19 aa, Staphylococcus
NRITSAFVRLQYNINELTV

SEQ ID NO: 2054092 - protein, 18 aa, Staphylococcus
NRLMKLKYVRQIDGSPYK

SEQ ID NO: 2054093 - protein, 19 aa, Staphylococcus
NRLTKIFGIKSISPVHKTS

SEQ ID NO: 2054094 - protein, 23 aa, Staphylococcus
NRNLLQRLWDGIVEIIQSIIQFF

SEQ ID NO: 2054095 - protein, 19 aa, Staphylococcus
NRPDCLIGVCGCMSQEESV

SEQ ID NO: 2054096 - protein, 20 aa, Staphylococcus
NRPIGSFLFLGPTGVGKTEL

SEQ ID NO: 2054097 - protein, 24 aa, Staphylococcus
NRPRGKFRFPMHVSEEASYNDLDN

SEQ ID NO: 2054098 - protein, 19 aa, Staphylococcus
NRQSIKMELDLRGYRYDEA

SEQ ID NO: 2054099 - protein, 24 aa, Staphylococcus
NRTHFKLPHWLFKMIQNHFVKKHQ

SEQ ID NO: 2054100 - protein, 17 aa, Staphylococcus
NRVDLGLGRAPGTDMMT

SEQ ID NO: 2054101 - protein, 17 aa, Staphylococcus
NRVNLGLGRAPGTDMMT

SEQ ID NO: 2054102 - protein, 21 aa, Staphylococcus
NRYGCLIAIEILELLKDIELD

SEQ ID NO: 2054103 - protein, 22 aa, Staphylococcus
NRYGCLLAIEILKLFKDIQLDV

SEQ ID NO: 2054104 - protein, 20 aa, Staphylococcus
NRYGCVLAIEILELLKDIEL

SEQ ID NO: 2054105 - protein, 21 aa, Staphylococcus
NRYGCVLAIEILELLKDVELD

SEQ ID NO: 2054106 - protein, 20 aa, Staphylococcus
NRYHLKCVIFAPEGFSEEKI

SEQ ID NO: 2054107 - protein, 21 aa, Staphylococcus
NRYHLKCVIFAPEGFSEEKIS

SEQ ID NO: 2054108 - protein, 17 aa, Staphylococcus
NSELWQRNNITITPHIS

SEQ ID NO: 2054109 - protein, 18 aa, Staphylococcus
NSEWSRSQLQDWIKNDLV

SEQ ID NO: 2054110 - protein, 17 aa, Staphylococcus
NSFELFTLMAYSGCRAG

SEQ ID NO: 2054111 - protein, 22 aa, Staphylococcus
NSKRLPINRSFTLEYLVGTEFY

SEQ ID NO: 2054112 - protein, 18 aa, Staphylococcus
NSLEHLLFGLGIRHLGVK

SEQ ID NO: 2054113 - protein, 19 aa, Staphylococcus
NSLEHLLFGLGIRHLGVKA

SEQ ID NO: 2054114 - protein, 17 aa, Staphylococcus
NSPELFELASLERYGAL

SEQ ID NO: 2054115 - protein, 17 aa, Staphylococcus
NSSVFSLKAFKNVIKTT

SEQ ID NO: 2054116 - protein, 18 aa, Staphylococcus
NSYPVWLPKADVEDIIKD

SEQ ID NO: 2054117 - protein, 18 aa, Staphylococcus
NTFLKERLGTVITTAGAS

SEQ ID NO: 2054118 - protein, 17 aa, Staphylococcus
NTHLVIMVIVFSSGHVE

SEQ ID NO: 2054119 - protein, 17 aa, Staphylococcus
NTNELYKLLSLLENDVD

SEQ ID NO: 2054120 - protein, 20 aa, Staphylococcus
NTNPKFKAITFLTSKNASIS

SEQ ID NO: 2054121 - protein, 19 aa, Staphylococcus
NTTESKCLILFTSYKMMHM

SEQ ID NO: 2054122 - protein, 17 aa, Staphylococcus
NVAKAMRTGRIWINTYN

SEQ ID NO: 2054123 - protein, 24 aa, Staphylococcus
NVDFLRRRVKALTENALFKEMTMT

SEQ ID NO: 2054124 - protein, 22 aa, Staphylococcus
NVEFKLYLGLKHISPYIEEAVE

SEQ ID NO: 2054125 - protein, 20 aa, Staphylococcus
NVFVDWSFILEFIKYANGFV

SEQ ID NO: 2054126 - protein, 17 aa, Staphylococcus
NVGVPALVVFLNKADMV

SEQ ID NO: 2054127 - protein, 18 aa, Staphylococcus
NVGVPALVVFLNKVDMVD

SEQ ID NO: 2054128 - protein, 18 aa, Staphylococcus
NVHKSVFHALDLARASSK

SEQ ID NO: 2054129 - protein, 18 aa, Staphylococcus
NVHKSVFHGLDIVQQPAD

SEQ ID NO: 2054130 - protein, 18 aa, Staphylococcus
NVHKSVFHGLDLAQQKAQ

SEQ ID NO: 2054131 - protein, 20 aa, Staphylococcus
NVIFIGLLCRNGEWLSIIYE

SEQ ID NO: 2054132 - protein, 21 aa, Staphylococcus
NVIKIYFNDGFIALRPSGTEP

SEQ ID NO: 2054133 - protein, 23 aa, Staphylococcus
NVIRILFKEGFIALRPSGTEPKL

SEQ ID NO: 2054134 - protein, 17 aa, Staphylococcus
NVKEVIAGFDFTFGKFG

SEQ ID NO: 2054135 - protein, 24 aa, Staphylococcus
NVKFLKDRYEAMRNFPMFDNIEYT

SEQ ID NO: 2054136 - protein, 18 aa, Staphylococcus
NVKFLKNRVAALKENILF

SEQ ID NO: 2054137 - protein, 17 aa, Staphylococcus
NVKPILKEDGYVYSDGT

SEQ ID NO: 2054138 - protein, 17 aa, Staphylococcus
NVLKEIVKGFGYSYRDY

SEQ ID NO: 2054139 - protein, 21 aa, Staphylococcus
NVPEPRLLVVSPYDKTSLSDI

SEQ ID NO: 2054140 - protein, 17 aa, Staphylococcus
NVQYLFKQNNYIPSNVF

SEQ ID NO: 2054141 - protein, 24 aa, Staphylococcus
NVRECMKLQSPRIMLGFKNTPGDL

SEQ ID NO: 2054142 - protein, 22 aa, Staphylococcus
NWNSAVFFEWIKVFDLPMKQKV

SEQ ID NO: 2054143 - protein, 21 aa, Staphylococcus
NWPVGMGQNFFGIIDRKSKSI

SEQ ID NO: 2054144 - protein, 18 aa, Staphylococcus
NWSTRLWQDMALVQKEVE

SEQ ID NO: 2054145 - protein, 17 aa, Staphylococcus
NYAQCLVKLGFGSRAEH

SEQ ID NO: 2054146 - protein, 18 aa, Staphylococcus
NYCDEFKFLNSLLGILAN

SEQ ID NO: 2054147 - protein, 17 aa, Staphylococcus
NYDALLIPGGFSPDHLR

SEQ ID NO: 2054148 - protein, 19 aa, Staphylococcus
NYFHPFRASEKFTIVPSWE

SEQ ID NO: 2054149 - protein, 21 aa, Staphylococcus
NYGSGHAWGIIGLEIESAELG

SEQ ID NO: 2054150 - protein, 22 aa, Staphylococcus
NYHLKNKFGRKIFKVALDGGFD

SEQ ID NO: 2054151 - protein, 23 aa, Staphylococcus
NYHLKNKFGRKIFKVALDGGFDC

SEQ ID NO: 2054152 - protein, 19 aa, Staphylococcus
NYIDFGIAMDNYWNLTFLP

SEQ ID NO: 2054153 - protein, 23 aa, Staphylococcus
NYIKEQYKGIGIMYKNHQWYFVV

SEQ ID NO: 2054154 - protein, 17 aa, Staphylococcus
NYKEVTEALGINDLGNK

SEQ ID NO: 2054155 - protein, 20 aa, Staphylococcus
NYLAAHGWRVLHIMQNNKGD

SEQ ID NO: 2054156 - protein, 20 aa, Staphylococcus
NYLYHCFEFSNNLVKARVNG

SEQ ID NO: 2054157 - protein, 17 aa, Staphylococcus
NYPEYNYIWVFKNPDKN

SEQ ID NO: 2054158 - protein, 23 aa, Staphylococcus
NYPKEFIVAITIIFLINELNISQ

SEQ ID NO: 2054159 - protein, 19 aa, Staphylococcus
NYVDFGIAFDSLWNLAVLP

SEQ ID NO: 2054160 - protein, 19 aa, Staphylococcus
NYVDFGIAFDSQWNFAVLP

SEQ ID NO: 2054161 - protein, 18 aa, Staphylococcus
NYVKQYPYTVLFVTHDRY

SEQ ID NO: 2054162 - protein, 19 aa, Staphylococcus
NYYIKRYMLAVPFENINVQ

SEQ ID NO: 2054163 - protein, 23 aa, Staphylococcus
NYYPRPDTGLALNLFEQRNNLIR

SEQ ID NO: 2054164 - protein, 24 aa, Staphylococcus
NYYPRPDTGLSYSFIEYKNQLIKT

SEQ ID NO: 2054165 - protein, 22 aa, Staphylococcus
PAALMFPSGNPFYDWRYQTEEE

SEQ ID NO: 2054166 - protein, 18 aa, Staphylococcus
PAKIFGLVHKGSIAVGKD

SEQ ID NO: 2054167 - protein, 21 aa, Staphylococcus
PANRYVLKFGDYGMLSENTPD

SEQ ID NO: 2054168 - protein, 18 aa, Staphylococcus
PAPCEQSCVMKINRNSVA

SEQ ID NO: 2054169 - protein, 20 aa, Staphylococcus
PAQVIIRWNIEHGVVVIPKS

SEQ ID NO: 2054170 - protein, 18 aa, Staphylococcus
PARAMGMVSVWFKQEDAE

SEQ ID NO: 2054171 - protein, 18 aa, Staphylococcus
PARAMGMVSVWFNHEDEE

SEQ ID NO: 2054172 - protein, 18 aa, Staphylococcus
PARAMGMVSVWYKQEDAE

SEQ ID NO: 2054173 - protein, 19 aa, Staphylococcus
PASERRKFVGIVFGDANYY

SEQ ID NO: 2054174 - protein, 19 aa, Staphylococcus
PATNFKEAVQWLYLAYLAA

SEQ ID NO: 2054175 - protein, 20 aa, Staphylococcus
PAVLPARFPNLLVNGASGIA

SEQ ID NO: 2054176 - protein, 19 aa, Staphylococcus
PCPYVYAVIAKRAIKDPKL

SEQ ID NO: 2054177 - protein, 19 aa, Staphylococcus
PDAFYILATRHGMIKRSNV

SEQ ID NO: 2054178 - protein, 19 aa, Staphylococcus
PDAIRYAGIVARIEAIGLT

SEQ ID NO: 2054179 - protein, 22 aa, Staphylococcus
PDARYIDWFPNFTLADLISDDT

SEQ ID NO: 2054180 - protein, 22 aa, Staphylococcus
PDARYIDWFPNFTLGDLISDNT

SEQ ID NO: 2054181 - protein, 21 aa, Staphylococcus
PDARYKDWFPNFALSDLISDN

SEQ ID NO: 2054182 - protein, 21 aa, Staphylococcus
PDARYKDWFPNFTLGDLISDN

SEQ ID NO: 2054183 - protein, 19 aa, Staphylococcus
PDGIYLSGALLMFAGNKSY

SEQ ID NO: 2054184 - protein, 17 aa, Staphylococcus
PDIFYPLIKKLKENNDY

SEQ ID NO: 2054185 - protein, 23 aa, Staphylococcus
PDIYKILASYYMFEYIHPFYDGN

SEQ ID NO: 2054186 - protein, 19 aa, Staphylococcus
PDKKCECGAEMIKEGQDIP

SEQ ID NO: 2054187 - protein, 26 aa, Staphylococcus
PDKKGLRLALDWSNRVNQLIQRLPSI

SEQ ID NO: 2054188 - protein, 23 aa, Staphylococcus
PDKLWRISPLKSFWGINKKTEIK

SEQ ID NO: 2054189 - protein, 19 aa, Staphylococcus
PDLAIAVDVCVPYDIPGMS

SEQ ID NO: 2054190 - protein, 17 aa, Staphylococcus
PDLKLGIITPFYGHIDR

SEQ ID NO: 2054191 - protein, 21 aa, Staphylococcus
PDLKLGIITPFYGHTSKWNEQ

SEQ ID NO: 2054192 - protein, 24 aa, Staphylococcus
PDTEVIDVFPIRFIVDGDNEVSDP

SEQ ID NO: 2054193 - protein, 27 aa, Staphylococcus
PDTGFFRFWIQGIFARWTDNPNIEDLI

SEQ ID NO: 2054194 - protein, 24 aa, Staphylococcus
PDTLRVASILAHTLFDYPSQQLTT

SEQ ID NO: 2054195 - protein, 25 aa, Staphylococcus
PDTLRVASLLAHELFDFPSHQLVTY

SEQ ID NO: 2054196 - protein, 25 aa, Staphylococcus
PDTLRVASLLAHTLFDFPSHQLTTY

SEQ ID NO: 2054197 - protein, 23 aa, Staphylococcus
PDTLRVASLLAHTLYDFPSHQLT

SEQ ID NO: 2054198 - protein, 22 aa, Staphylococcus
PDVKVLHCLPAFHNTQTQVGKE

SEQ ID NO: 2054199 - protein, 19 aa, Staphylococcus
PDVLRFFMISVHYRSPINY

SEQ ID NO: 2054200 - protein, 17 aa, Staphylococcus
PDYFKLDSKDILLFSPQ

SEQ ID NO: 2054201 - protein, 19 aa, Staphylococcus
PDYIDAFWNVVNWNKVDEL

SEQ ID NO: 2054202 - protein, 20 aa, Staphylococcus
PDYLGGLLFDDIPYLEVAQQ

SEQ ID NO: 2054203 - protein, 20 aa, Staphylococcus
PEDFDGLLIPGGFSPDHLRG

SEQ ID NO: 2054204 - protein, 23 aa, Staphylococcus
PEDITSAVALEFSFVDALVALDI

SEQ ID NO: 2054205 - protein, 20 aa, Staphylococcus
PEDYDALLIPGGFSPDHLRG

SEQ ID NO: 2054206 - protein, 17 aa, Staphylococcus
PEDYDALLIPGGFSPDY

SEQ ID NO: 2054207 - protein, 20 aa, Staphylococcus
PEEIKRTFDRLGIPEAEQKY

SEQ ID NO: 2054208 - protein, 20 aa, Staphylococcus
PEELKLLLIDPKMVELAPYN

SEQ ID NO: 2054209 - protein, 18 aa, Staphylococcus
PEELRMKISYLMQQSQLF

SEQ ID NO: 2054210 - protein, 18 aa, Staphylococcus
PEEVRFILKQMGLKEKTI

SEQ ID NO: 2054211 - protein, 19 aa, Staphylococcus
PEEVRFILKQMGLKEKTID

SEQ ID NO: 2054212 - protein, 19 aa, Staphylococcus
PEEYWSIEGEFRYKKSKFT

SEQ ID NO: 2054213 - protein, 19 aa, Staphylococcus
PEEYWTIEGEFRYKKSKFT

SEQ ID NO: 2054214 - protein, 20 aa, Staphylococcus
PEFIGRVPIVANLETLDVAA

SEQ ID NO: 2054215 - protein, 17 aa, Staphylococcus
PEGIPSNDVFKYETVEV

SEQ ID NO: 2054216 - protein, 23 aa, Staphylococcus
PEGKRILVDRVWPRGISKAHAQL

SEQ ID NO: 2054217 - protein, 25 aa, Staphylococcus
PEGMESWDFAHCLPYFKKLEKTFGA

SEQ ID NO: 2054218 - protein, 25 aa, Staphylococcus
PEGMESWDFAHCLPYFKRLEKTYGA

SEQ ID NO: 2054219 - protein, 18 aa, Staphylococcus
PEIFKASTTFSFQTLSER

SEQ ID NO: 2054220 - protein, 19 aa, Staphylococcus
PEIYKALDAEVLFNKVQMR

SEQ ID NO: 2054221 - protein, 18 aa, Staphylococcus
PEIYKAVNAEVLFNKVAM

SEQ ID NO: 2054222 - protein, 19 aa, Staphylococcus
PEKRLYATEIEYLLEKEKI

SEQ ID NO: 2054223 - protein, 20 aa, Staphylococcus
PELFELASLERYGALKQPVM

SEQ ID NO: 2054224 - protein, 17 aa, Staphylococcus
PELKKLIGHTLMITDGT

SEQ ID NO: 2054225 - protein, 20 aa, Staphylococcus
PELKNSRVLKEWSGVRPYTN

SEQ ID NO: 2054226 - protein, 21 aa, Staphylococcus
PELKVFAPVREWAWSREEEID

SEQ ID NO: 2054227 - protein, 18 aa, Staphylococcus
PELLTIKGLRAIKEADVI

SEQ ID NO: 2054228 - protein, 21 aa, Staphylococcus
PELRKRVKLVAEHNYDQIKSI

SEQ ID NO: 2054229 - protein, 25 aa, Staphylococcus
PELYTHCVLVWKKSRIQTPILKNFI

SEQ ID NO: 2054230 - protein, 20 aa, Staphylococcus
PENYDALLIPGGFSPDNLRG

SEQ ID NO: 2054231 - protein, 17 aa, Staphylococcus
PEPPMLMISVGKQDGAL

SEQ ID NO: 2054232 - protein, 21 aa, Staphylococcus
PERLKAGLLYTIEEECIKQGH

SEQ ID NO: 2054233 - protein, 22 aa, Staphylococcus
PESKHLGGFPISGQFLICTNPE

SEQ ID NO: 2054234 - protein, 24 aa, Staphylococcus
PETEVINVFPIRFVVDKENEVSDP

SEQ ID NO: 2054235 - protein, 17 aa, Staphylococcus
PETLFGTKFEGYLNQQQ

SEQ ID NO: 2054236 - protein, 20 aa, Staphylococcus
PFFGICLGHQLFALSQGATS

SEQ ID NO: 2054237 - protein, 22 aa, Staphylococcus
PFFGICLGHQLFALSQGATSFK

SEQ ID NO: 2054238 - protein, 21 aa, Staphylococcus
PFFGICLGHQLFALSQGGTSF

SEQ ID NO: 2054239 - protein, 18 aa, Staphylococcus
PFGDCHFALAAKPETSSF

SEQ ID NO: 2054240 - protein, 17 aa, Staphylococcus
PFHPVYILPLVEIVPGA

SEQ ID NO: 2054241 - protein, 22 aa, Staphylococcus
PFIIKTRFGGYDGKGQILVKDH

SEQ ID NO: 2054242 - protein, 22 aa, Staphylococcus
PFKSKEAIYNYVLFEVDKAEKE

SEQ ID NO: 2054243 - protein, 24 aa, Staphylococcus
PFLDKALDRKAVWDKWMEQDLNNN

SEQ ID NO: 2054244 - protein, 20 aa, Staphylococcus
PFLLSSWKLAPALAAGNTVV

SEQ ID NO: 2054245 - protein, 22 aa, Staphylococcus
PFMVKTRFGGYDGKGQILVRDE

SEQ ID NO: 2054246 - protein, 17 aa, Staphylococcus
PFPFWKRVHDSFISSDD

SEQ ID NO: 2054247 - protein, 17 aa, Staphylococcus
PFPFWKRVHDSFISSGD

SEQ ID NO: 2054248 - protein, 17 aa, Staphylococcus
PFPKDWRMHAFFMDALP

SEQ ID NO: 2054249 - protein, 18 aa, Staphylococcus
PFPKEWRMHAFFMDALPI

SEQ ID NO: 2054250 - protein, 24 aa, Staphylococcus
PFPRISYDDAIKFLKEEGFNDIEW

SEQ ID NO: 2054251 - protein, 19 aa, Staphylococcus
PFTYLSVGAANAFTTVQNT

SEQ ID NO: 2054252 - protein, 19 aa, Staphylococcus
PFVKRKLIFLVGMAGERDL

SEQ ID NO: 2054253 - protein, 17 aa, Staphylococcus
PFYEWVIEKDAWFGPEL

SEQ ID NO: 2054254 - protein, 20 aa, Staphylococcus
PGDLALKVIHHYDIEHRWTI

SEQ ID NO: 2054255 - protein, 19 aa, Staphylococcus
PGDQCPICGNTIDSPSDHL

SEQ ID NO: 2054256 - protein, 17 aa, Staphylococcus
PGGKACHIAELLAPSGH

SEQ ID NO: 2054257 - protein, 17 aa, Staphylococcus
PGGLFIYDGDEPLLEPY

SEQ ID NO: 2054258 - protein, 19 aa, Staphylococcus
PGHELPSVIGWRTIEDTER

SEQ ID NO: 2054259 - protein, 18 aa, Staphylococcus
PGHLFPLIARTGGVLVRN

SEQ ID NO: 2054260 - protein, 17 aa, Staphylococcus
PGICLVGPIVEHMSQIP

SEQ ID NO: 2054261 - protein, 20 aa, Staphylococcus
PGLFKRLIASTFFLKMNEKQ

SEQ ID NO: 2054262 - protein, 18 aa, Staphylococcus
PGLLKRLFEQEVPEIFDG

SEQ ID NO: 2054263 - protein, 18 aa, Staphylococcus
PGLLKRLFEQEVPEIYDG

SEQ ID NO: 2054264 - protein, 21 aa, Staphylococcus
PGLPEELGGIVVYLASDASSF

SEQ ID NO: 2054265 - protein, 20 aa, Staphylococcus
PGLTICGGYQFLGTKYITPD

SEQ ID NO: 2054266 - protein, 19 aa, Staphylococcus
PGPMQEIPTYISRRHRQSD

SEQ ID NO: 2054267 - protein, 17 aa, Staphylococcus
PGQEIRITDQILSLLQK

SEQ ID NO: 2054268 - protein, 18 aa, Staphylococcus
PGRHYAKFNLHGEIDYAV

SEQ ID NO: 2054269 - protein, 20 aa, Staphylococcus
PGRKQFEWEKIVSKVSPQTS

SEQ ID NO: 2054270 - protein, 20 aa, Staphylococcus
PGTDLVWLGAVTKYIIDHDL

SEQ ID NO: 2054271 - protein, 20 aa, Staphylococcus
PGTDLVWLGAVTKYIIDNDL

SEQ ID NO: 2054272 - protein, 20 aa, Staphylococcus
PGTDLVWLSAVTKYIIDEDL

SEQ ID NO: 2054273 - protein, 25 aa, Staphylococcus
PGVAKTEMWDRIDAEMVRYNDELQP

SEQ ID NO: 2054274 - protein, 24 aa, Staphylococcus
PGYEAPCYIAWSGKNRSPLIRVPS

SEQ ID NO: 2054275 - protein, 17 aa, Staphylococcus
PHELGGIVVYLASDAST

SEQ ID NO: 2054276 - protein, 24 aa, Staphylococcus
PHGFKGICAISFFMNASLQQIELL

SEQ ID NO: 2054277 - protein, 23 aa, Staphylococcus
PHKIVRWRAAMFIFDEGGPEQLD

SEQ ID NO: 2054278 - protein, 20 aa, Staphylococcus
PHVIQPVEWIKGKDHHRTLV

SEQ ID NO: 2054279 - protein, 24 aa, Staphylococcus
PHVKKIKHAKCLSVGLKQDNALVC

SEQ ID NO: 2054280 - protein, 21 aa, Staphylococcus
PHYKTRIVSHVRWFDDKGRLR

SEQ ID NO: 2054281 - protein, 24 aa, Staphylococcus
PIAAICGAVDYLARQGHLNTYRHT

SEQ ID NO: 2054282 - protein, 18 aa, Staphylococcus
PIAIVFRASLFDEKILTG

SEQ ID NO: 2054283 - protein, 18 aa, Staphylococcus
PIEIPNFEFGERVIDSTG

SEQ ID NO: 2054284 - protein, 18 aa, Staphylococcus
PIEIPNFEFGKRVIDSTG

SEQ ID NO: 2054285 - protein, 18 aa, Staphylococcus
PIEIPNFKFGDRVIDSTG

SEQ ID NO: 2054286 - protein, 18 aa, Staphylococcus
PIEIPNFKFGERVIDSTG

SEQ ID NO: 2054287 - protein, 25 aa, Staphylococcus
PIEWLKRYANHLIIIFKGVEEHHQL

SEQ ID NO: 2054288 - protein, 18 aa, Staphylococcus
PIGSFLFVGPTGVGKTEL

SEQ ID NO: 2054289 - protein, 17 aa, Staphylococcus
PIIPFIIGDGIGPDIWR

SEQ ID NO: 2054290 - protein, 20 aa, Staphylococcus
PIIWLCGGLDRGNDFDELIP

SEQ ID NO: 2054291 - protein, 20 aa, Staphylococcus
PIIWLCGGLDRGNEFDELIP

SEQ ID NO: 2054292 - protein, 21 aa, Staphylococcus
PILGVCLGFQFLIEHYGGNIV

SEQ ID NO: 2054293 - protein, 20 aa, Staphylococcus
PILKEKFENLGLIVKEDNAS

SEQ ID NO: 2054294 - protein, 18 aa, Staphylococcus
PIMHLYQFIAAFIDVPIH

SEQ ID NO: 2054295 - protein, 17 aa, Staphylococcus
PIMSRPVKNMTVAIIGT

SEQ ID NO: 2054296 - protein, 22 aa, Staphylococcus
PIPKFPKRIAVLTASTGAAIRD

SEQ ID NO: 2054297 - protein, 22 aa, Staphylococcus
PIPRFPKKIAILTASTGAAIRD

SEQ ID NO: 2054298 - protein, 19 aa, Staphylococcus
PIQIKALLNQAGYNDTINE

SEQ ID NO: 2054299 - protein, 23 aa, Staphylococcus
PIREKSRMPGMWDRVLKGDINFV

SEQ ID NO: 2054300 - protein, 18 aa, Staphylococcus
PIVDRLSLEMIKQLIRIH

SEQ ID NO: 2054301 - protein, 25 aa, Staphylococcus
PIVLPRLRISYMYDRTKKLLKQYNL

SEQ ID NO: 2054302 - protein, 23 aa, Staphylococcus
PIVLPRMRITYLYHRTQKLLSQY

SEQ ID NO: 2054303 - protein, 18 aa, Staphylococcus
PIWFSQSVAEHFIENNSG

SEQ ID NO: 2054304 - protein, 20 aa, Staphylococcus
PKAIAHYFKERWHNIPDFNY

SEQ ID NO: 2054305 - protein, 18 aa, Staphylococcus
PKAIAHYFKERWQHIPHF

SEQ ID NO: 2054306 - protein, 18 aa, Staphylococcus
PKCNHYLMEHKKGRSSQV

SEQ ID NO: 2054307 - protein, 17 aa, Staphylococcus
PKCNLPYFISFLSFHNY

SEQ ID NO: 2054308 - protein, 18 aa, Staphylococcus
PKDKSAAVLGLFTSKNGD

SEQ ID NO: 2054309 - protein, 21 aa, Staphylococcus
PKDRRAGVITFNIKDIHPHDV

SEQ ID NO: 2054310 - protein, 21 aa, Staphylococcus
PKDRRAGVITFNLADIHPHDV

SEQ ID NO: 2054311 - protein, 21 aa, Staphylococcus
PKDRRAGVITFNLKDVHPHDV

SEQ ID NO: 2054312 - protein, 21 aa, Staphylococcus
PKDRRAGVITFNLSDIHPHDV

SEQ ID NO: 2054313 - protein, 19 aa, Staphylococcus
PKELIARHSLRVEAGVIAI

SEQ ID NO: 2054314 - protein, 17 aa, Staphylococcus
PKFDYYFAIGKQTANTL

SEQ ID NO: 2054315 - protein, 18 aa, Staphylococcus
PKFFKRMLVDFINKTNYT

SEQ ID NO: 2054316 - protein, 17 aa, Staphylococcus
PKFNLFIALGIRDAIQQ

SEQ ID NO: 2054317 - protein, 18 aa, Staphylococcus
PKFYPGWNDFAFNQQVKS

SEQ ID NO: 2054318 - protein, 23 aa, Staphylococcus
PKGKFRFPMEGFESGNAESENTT

SEQ ID NO: 2054319 - protein, 19 aa, Staphylococcus
PKGKFRFPMNISDNEVQDD

SEQ ID NO: 2054320 - protein, 21 aa, Staphylococcus
PKGKFRFPMRVLEEANDSLKT

SEQ ID NO: 2054321 - protein, 18 aa, Staphylococcus
PKGMCKTCEGLGYIEDIN

SEQ ID NO: 2054322 - protein, 20 aa, Staphylococcus
PKHPYTWGLLSSMPDLTTSN

SEQ ID NO: 2054323 - protein, 20 aa, Staphylococcus
PKHRIIQLPARFHRHPLPVP

SEQ ID NO: 2054324 - protein, 24 aa, Staphylococcus
PKKMRRLALRSALSFKVKENGFTV

SEQ ID NO: 2054325 - protein, 24 aa, Staphylococcus
PKKMRRLALRSALSFKVKENNFTI

SEQ ID NO: 2054326 - protein, 24 aa, Staphylococcus
PKKMRRLALRSALSFKVQEKGLTV

SEQ ID NO: 2054327 - protein, 23 aa, Staphylococcus
PKKMRRLALRSALSFKVQENGFT

SEQ ID NO: 2054328 - protein, 24 aa, Staphylococcus
PKKMRRLALRSALSFKVQENGFTV

SEQ ID NO: 2054329 - protein, 23 aa, Staphylococcus
PKKMRRLALRSALSFKVQENNFT

SEQ ID NO: 2054330 - protein, 20 aa, Staphylococcus
PKLPARIPIGSPINGTTVYV

SEQ ID NO: 2054331 - protein, 22 aa, Staphylococcus
PKLPFTLCYVSRGFVADYNDRD

SEQ ID NO: 2054332 - protein, 22 aa, Staphylococcus
PKLPFTLCYVSRGFVTEYDNKD

SEQ ID NO: 2054333 - protein, 21 aa, Staphylococcus
PKLPYTLCYISRGFVTDYSNK

SEQ ID NO: 2054334 - protein, 21 aa, Staphylococcus
PKLPYTLCYVSRGFVADYNDK

SEQ ID NO: 2054335 - protein, 17 aa, Staphylococcus
PKLVWSFKDLQSHMQLS

SEQ ID NO: 2054336 - protein, 17 aa, Staphylococcus
PKMFHDFALFPIHESHK

SEQ ID NO: 2054337 - protein, 21 aa, Staphylococcus
PKPRLPFEHIFHKNSYDASND

SEQ ID NO: 2054338 - protein, 20 aa, Staphylococcus
PKQLKSLLLLHGLSSDETTY

SEQ ID NO: 2054339 - protein, 18 aa, Staphylococcus
PKQLPVLLLLHGLSSDET

SEQ ID NO: 2054340 - protein, 21 aa, Staphylococcus
PKSHYRYAFNLAEIDAENFPL

SEQ ID NO: 2054341 - protein, 17 aa, Staphylococcus
PKSIIGIGIDFTSCTIV

SEQ ID NO: 2054342 - protein, 19 aa, Staphylococcus
PKWIVKHWVTHYGVDTTER

SEQ ID NO: 2054343 - protein, 25 aa, Staphylococcus
PLAAQFKFRGKQVIAIANHWNSKNG

SEQ ID NO: 2054344 - protein, 18 aa, Staphylococcus
PLAILGDKITLGFKEEEY

SEQ ID NO: 2054345 - protein, 23 aa, Staphylococcus
PLDSEGLLSFGTHLQQNMSQFSH

SEQ ID NO: 2054346 - protein, 24 aa, Staphylococcus
PLGLKLDRYRVMIVHPWQYKHVIA

SEQ ID NO: 2054347 - protein, 17 aa, Staphylococcus
PLKALIFDSEYDPYRGV

SEQ ID NO: 2054348 - protein, 22 aa, Staphylococcus
PLKNCTRIIPFSSISYIDLLEE

SEQ ID NO: 2054349 - protein, 22 aa, Staphylococcus
PLKNCTRIIPFSSISYLDLLDR

SEQ ID NO: 2054350 - protein, 22 aa, Staphylococcus
PLKRGAATIAMLGKVPILPAAY

SEQ ID NO: 2054351 - protein, 18 aa, Staphylococcus
PLPLTGIDITFSWSDLDK

SEQ ID NO: 2054352 - protein, 18 aa, Staphylococcus
PLPLTGIDVNFEWDTSQT

SEQ ID NO: 2054353 - protein, 21 aa, Staphylococcus
PLRREAIVLLGMIEDKAVLPY

SEQ ID NO: 2054354 - protein, 21 aa, Staphylococcus
PLRREAIVLLGMIEDRQILPY

SEQ ID NO: 2054355 - protein, 21 aa, Staphylococcus
PLRREAVVLLGMIEDPKILPY

SEQ ID NO: 2054356 - protein, 19 aa, Staphylococcus
PLTELIAFDINDWWHDAQN

SEQ ID NO: 2054357 - protein, 17 aa, Staphylococcus
PLYGFGFVKMAQVAEDE

SEQ ID NO: 2054358 - protein, 18 aa, Staphylococcus
PMEGRATITLSLDATSTD

SEQ ID NO: 2054359 - protein, 21 aa, Staphylococcus
PMKCLRILSIFRLINPTKEIR

SEQ ID NO: 2054360 - protein, 23 aa, Staphylococcus
PMKNCTRIIPFGAISYLDLLEKN

SEQ ID NO: 2054361 - protein, 18 aa, Staphylococcus
PMLGICLGAQLIAQVLGA

SEQ ID NO: 2054362 - protein, 18 aa, Staphylococcus
PMMYIALSYDHRIIDGKE

SEQ ID NO: 2054363 - protein, 20 aa, Staphylococcus
PMVLPARFPNLLINGSTGIS

SEQ ID NO: 2054364 - protein, 17 aa, Staphylococcus
PNDHVFAMIGYHPDYDF

SEQ ID NO: 2054365 - protein, 23 aa, Staphylococcus
PNGFAGICAISYFMSASLQQIQH

SEQ ID NO: 2054366 - protein, 19 aa, Staphylococcus
PNKEFQLLFLLASNEKQIF

SEQ ID NO: 2054367 - protein, 21 aa, Staphylococcus
PNKEFQLLFLLASNPRQVFNR

SEQ ID NO: 2054368 - protein, 19 aa, Staphylococcus
PNKEFQLLFLLVSNPKHIF

SEQ ID NO: 2054369 - protein, 17 aa, Staphylococcus
PNLKWISWYATGVNNLP

SEQ ID NO: 2054370 - protein, 21 aa, Staphylococcus
PNNKFPTGWKVIENMPETVPQ

SEQ ID NO: 2054371 - protein, 17 aa, Staphylococcus
PNPFEWLDQLSQPYKNE

SEQ ID NO: 2054372 - protein, 19 aa, Staphylococcus
PNQYKLLGLLLYAIPKSIR

SEQ ID NO: 2054373 - protein, 24 aa, Staphylococcus
PPFKLTEVDGWLYGRGVSDMKGGM

SEQ ID NO: 2054374 - protein, 17 aa, Staphylococcus
PPKARDMIIKKGDVINI

SEQ ID NO: 2054375 - protein, 24 aa, Staphylococcus
PQARKLKEGFFFAALTPTLRHLGK

SEQ ID NO: 2054376 - protein, 20 aa, Staphylococcus
PQGEFKRFLLSKSVEKQDIL

SEQ ID NO: 2054377 - protein, 19 aa, Staphylococcus
PQGEFKRFLVSSSSDKQSI

SEQ ID NO: 2054378 - protein, 23 aa, Staphylococcus
PQGRGMVKWAPFATMPEQYQQLN

SEQ ID NO: 2054379 - protein, 17 aa, Staphylococcus
PQLKICACLGLTKEEQA

SEQ ID NO: 2054380 - protein, 23 aa, Staphylococcus
PQSKIWLDPGIGFAKTRDEENEV

SEQ ID NO: 2054381 - protein, 19 aa, Staphylococcus
PQWAGSCWYYLRYIDPHNE

SEQ ID NO: 2054382 - protein, 19 aa, Staphylococcus
PRETMIGSMAYYISHAKND

SEQ ID NO: 2054383 - protein, 20 aa, Staphylococcus
PRETMIGSMAYYISHANNNK

SEQ ID NO: 2054384 - protein, 19 aa, Staphylococcus
PRFYLDFNKYIASAENNST

SEQ ID NO: 2054385 - protein, 18 aa, Staphylococcus
PRGGEIVEHILGLEEGAS

SEQ ID NO: 2054386 - protein, 19 aa, Staphylococcus
PRHIYCGTIGLLLPNDKMI

SEQ ID NO: 2054387 - protein, 19 aa, Staphylococcus
PRHVYCGTIGLLLPNGKAI

SEQ ID NO: 2054388 - protein, 20 aa, Staphylococcus
PRIFNLYLRHELPIIHLIQQ

SEQ ID NO: 2054389 - protein, 19 aa, Staphylococcus
PRKFDGEKWYGATANDTEQ

SEQ ID NO: 2054390 - protein, 19 aa, Staphylococcus
PRLFEGFSMGNPKIQTGNL

SEQ ID NO: 2054391 - protein, 20 aa, Staphylococcus
PRLFEGFSMGNPRIQTGNLL

SEQ ID NO: 2054392 - protein, 19 aa, Staphylococcus
PRLFWPIYYVIQAPLQGLI

SEQ ID NO: 2054393 - protein, 20 aa, Staphylococcus
PRLRHELQIWIRLNTTTGFR

SEQ ID NO: 2054394 - protein, 18 aa, Staphylococcus
PRLVPYTRLDVVKRQNEL

SEQ ID NO: 2054395 - protein, 17 aa, Staphylococcus
PRPIGWISTVSKDGEDN

SEQ ID NO: 2054396 - protein, 17 aa, Staphylococcus
PRPIGWISTVSKDGKDN

SEQ ID NO: 2054397 - protein, 17 aa, Staphylococcus
PRPPARRALPRAQHPRE

SEQ ID NO: 2054398 - protein, 18 aa, Staphylococcus
PRQGHVWIMDPIDGTANL

SEQ ID NO: 2054399 - protein, 21 aa, Staphylococcus
PRSIYCGTIGMLLPEGRMIFN

SEQ ID NO: 2054400 - protein, 19 aa, Staphylococcus
PRTLAISVFGEMDVSSIKQ

SEQ ID NO: 2054401 - protein, 19 aa, Staphylococcus
PRVLGDIIICTDVAKEQAE

SEQ ID NO: 2054402 - protein, 19 aa, Staphylococcus
PRVLGDIIICTDVAQEQAD

SEQ ID NO: 2054403 - protein, 21 aa, Staphylococcus
PRVRFTTSHPWDFTDHMIDVI

SEQ ID NO: 2054404 - protein, 25 aa, Staphylococcus
PRVRFTTSHPWDFTDRMIQVIAQGG

SEQ ID NO: 2054405 - protein, 19 aa, Staphylococcus
PRWKCIYRVIKRVIIHNLK

SEQ ID NO: 2054406 - protein, 19 aa, Staphylococcus
PRWLFLKIITDEGLEGWGE

SEQ ID NO: 2054407 - protein, 19 aa, Staphylococcus
PSCGHKLVRIEGEVALRCI

SEQ ID NO: 2054408 - protein, 19 aa, Staphylococcus
PSDQWLRVRAEYLQNRKQD

SEQ ID NO: 2054409 - protein, 19 aa, Staphylococcus
PSEGWTWNDGFVKMDTLEV

SEQ ID NO: 2054410 - protein, 22 aa, Staphylococcus
PSEYFMVKFLWDQLLEQPQGDV

SEQ ID NO: 2054411 - protein, 21 aa, Staphylococcus
PSEYPKFILGFGGIKQRELAD

SEQ ID NO: 2054412 - protein, 20 aa, Staphylococcus
PSFIEMCLLLPTLDEKQYPS

SEQ ID NO: 2054413 - protein, 21 aa, Staphylococcus
PSFIEMCLLLPTLNEEQYGSL

SEQ ID NO: 2054414 - protein, 20 aa, Staphylococcus
PSFIEMCLLLPTLNENDYPS

SEQ ID NO: 2054415 - protein, 23 aa, Staphylococcus
PSFSNPWTYYWVGINGKQILTYL

SEQ ID NO: 2054416 - protein, 24 aa, Staphylococcus
PSIKHGPHWCRSRIVNPLTLEPVP

SEQ ID NO: 2054417 - protein, 18 aa, Staphylococcus
PSIPLKIVYPALKVTIVD

SEQ ID NO: 2054418 - protein, 20 aa, Staphylococcus
PSKFKFSRLVIDADQEKTAV

SEQ ID NO: 2054419 - protein, 20 aa, Staphylococcus
PSKVSLDWECFVVSKSDMEL

SEQ ID NO: 2054420 - protein, 26 aa, Staphylococcus
PSLNLLRWPWIGLQWIFSRKGPAASN

SEQ ID NO: 2054421 - protein, 23 aa, Staphylococcus
PSPFHWRFMDKLALSTLYEVVLP

SEQ ID NO: 2054422 - protein, 22 aa, Staphylococcus
PSPFHWRLMDKLALNTLYEVVL

SEQ ID NO: 2054423 - protein, 22 aa, Staphylococcus
PSPFHWRLMDKLTLATLYEVVL

SEQ ID NO: 2054424 - protein, 25 aa, Staphylococcus
PSRTKELLTRFGFNFKKSLGQNFLV

SEQ ID NO: 2054425 - protein, 21 aa, Staphylococcus
PSTVPRKGWIAVFTDGTYWEY

SEQ ID NO: 2054426 - protein, 18 aa, Staphylococcus
PSVIISFYPQFAVHPDHE

SEQ ID NO: 2054427 - protein, 20 aa, Staphylococcus
PSVLPARFPNLLVNGASGIA

SEQ ID NO: 2054428 - protein, 17 aa, Staphylococcus
PSVRVFKDFISNITAHL

SEQ ID NO: 2054429 - protein, 23 aa, Staphylococcus
PTDSEGWAHCLTIPRELTLENGK

SEQ ID NO: 2054430 - protein, 17 aa, Staphylococcus
PTEEQWKAMELGWKVVP

SEQ ID NO: 2054431 - protein, 22 aa, Staphylococcus
PTESTVMCLIKLMTKKVKTSNL

SEQ ID NO: 2054432 - protein, 17 aa, Staphylococcus
PTIKAVFNYYLQGYGYK

SEQ ID NO: 2054433 - protein, 19 aa, Staphylococcus
PTIRTLFLLLVGFKNSKLN

SEQ ID NO: 2054434 - protein, 18 aa, Staphylococcus
PTKASVCHADLRYYTGNR

SEQ ID NO: 2054435 - protein, 22 aa, Staphylococcus
PTKEFQLLFLLCGQPKHIFTRD

SEQ ID NO: 2054436 - protein, 24 aa, Staphylococcus
PTLRLKRDLLREFIDDVIPELSEE

SEQ ID NO: 2054437 - protein, 17 aa, Staphylococcus
PTPKWSIARYKGLGEMN

SEQ ID NO: 2054438 - protein, 17 aa, Staphylococcus
PTPKWSISRYKGLGEMN

SEQ ID NO: 2054439 - protein, 19 aa, Staphylococcus
PTPRLNHWRVLLQARAIEN

SEQ ID NO: 2054440 - protein, 19 aa, Staphylococcus
PTSRLNHWRSLLQARAIEN

SEQ ID NO: 2054441 - protein, 19 aa, Staphylococcus
PVAVKALLKQAGYNDDITE

SEQ ID NO: 2054442 - protein, 20 aa, Staphylococcus
PVCGFPWIHWAVANVSVNSD

SEQ ID NO: 2054443 - protein, 21 aa, Staphylococcus
PVDCNYMIGMSFNQLNAHKEA

SEQ ID NO: 2054444 - protein, 18 aa, Staphylococcus
PVELRRSIGYVIQQIGLM

SEQ ID NO: 2054445 - protein, 17 aa, Staphylococcus
PVFEEFDVYPAQWLVLK

SEQ ID NO: 2054446 - protein, 17 aa, Staphylococcus
PVGRCWLVQASKLKWVF

SEQ ID NO: 2054447 - protein, 18 aa, Staphylococcus
PVIMDIALDILKLDKSDV

SEQ ID NO: 2054448 - protein, 18 aa, Staphylococcus
PVKEVGWNKVYRESSIIP

SEQ ID NO: 2054449 - protein, 17 aa, Staphylococcus
PVLKKLEQVHIFIQPEL

SEQ ID NO: 2054450 - protein, 20 aa, Staphylococcus
PVQNEVLIIYALVNGFLDDI

SEQ ID NO: 2054451 - protein, 20 aa, Staphylococcus
PVSTLRAGLIIGAKGSSYPI

SEQ ID NO: 2054452 - protein, 19 aa, Staphylococcus
PVVACAVILNEGHRYLGLD

SEQ ID NO: 2054453 - protein, 20 aa, Staphylococcus
PVVTCAVILNPGHRYLGLND

SEQ ID NO: 2054454 - protein, 19 aa, Staphylococcus
PVYLGMPMGLILEVEGKTI

SEQ ID NO: 2054455 - protein, 23 aa, Staphylococcus
PWGDLDIDVVLECTGFYTDKDKA

SEQ ID NO: 2054456 - protein, 22 aa, Staphylococcus
PWGDLDIDVVLECTGFYTDKEK

SEQ ID NO: 2054457 - protein, 22 aa, Staphylococcus
PWGDLDIDVVLECTGFYTEKEK

SEQ ID NO: 2054458 - protein, 20 aa, Staphylococcus
PWKTKQRILSDMGHVSNEDA

SEQ ID NO: 2054459 - protein, 20 aa, Staphylococcus
PYAPEWGPMHWGHARSKDLV

SEQ ID NO: 2054460 - protein, 18 aa, Staphylococcus
PYGTILIIGPFNYPVQLL

SEQ ID NO: 2054461 - protein, 18 aa, Staphylococcus
PYIMPVWSMKGRALKVRD

SEQ ID NO: 2054462 - protein, 23 aa, Staphylococcus
PYRFLKRDFGVLGIDMHLHANGI

SEQ ID NO: 2054463 - protein, 19 aa, Staphylococcus
PYTKAAVMSIAFDLPLPTV

SEQ ID NO: 2054464 - protein, 17 aa, Staphylococcus
PYVIIGLNVIVADTDEE

SEQ ID NO: 2054465 - protein, 17 aa, Staphylococcus
PYVRHIAHPTGRIIGRR

SEQ ID NO: 2054466 - protein, 19 aa, Staphylococcus
PYYAGLSFRTLMPKFPSTL

SEQ ID NO: 2054467 - protein, 21 aa, Staphylococcus
QAAILKWPMSVIRLKGEDLDE

SEQ ID NO: 2054468 - protein, 17 aa, Staphylococcus
QADEVYRELPFVVNQAR

SEQ ID NO: 2054469 - protein, 18 aa, Staphylococcus
QAIYRRVYEFGVEEKRIL

SEQ ID NO: 2054470 - protein, 18 aa, Staphylococcus
QAIYRRVYEFGVEEKRTL

SEQ ID NO: 2054471 - protein, 17 aa, Staphylococcus
QAIYRRVYQFSLDEKRV

SEQ ID NO: 2054472 - protein, 23 aa, Staphylococcus
QALKDFAERLGVNYSYDDKELLK

SEQ ID NO: 2054473 - protein, 17 aa, Staphylococcus
QALRLVLERAKTYSVPN

SEQ ID NO: 2054474 - protein, 22 aa, Staphylococcus
QANIRLDIMSGRRYQLKRRESI

SEQ ID NO: 2054475 - protein, 21 aa, Staphylococcus
QANLRLATMSGQRYHLQRRKS

SEQ ID NO: 2054476 - protein, 21 aa, Staphylococcus
QANLRLATMSGQRYQLQRREA

SEQ ID NO: 2054477 - protein, 18 aa, Staphylococcus
QAPKLKLAITAGVGSDHV

SEQ ID NO: 2054478 - protein, 19 aa, Staphylococcus
QAPYKFLLSHGFVMDGEGK

SEQ ID NO: 2054479 - protein, 24 aa, Staphylococcus
QAQFGLPGRYLWSVYEPESDDSNM

SEQ ID NO: 2054480 - protein, 17 aa, Staphylococcus
QAYWSFGGLFLVNSKVQ

SEQ ID NO: 2054481 - protein, 20 aa, Staphylococcus
QCDICGATIRPDIVLYGEML

SEQ ID NO: 2054482 - protein, 19 aa, Staphylococcus
QCNQLGLALAEKFATNHQV

SEQ ID NO: 2054483 - protein, 17 aa, Staphylococcus
QCNQLGLALAKKFATNH

SEQ ID NO: 2054484 - protein, 19 aa, Staphylococcus
QCYQCIRKVFHVIHRPFYL

SEQ ID NO: 2054485 - protein, 18 aa, Staphylococcus
QDAIKFPDFVHALKPEPH

SEQ ID NO: 2054486 - protein, 17 aa, Staphylococcus
QDALGLSSADSFRELIK

SEQ ID NO: 2054487 - protein, 23 aa, Staphylococcus
QDAYSLRCIPQIHGASYQVFNYV

SEQ ID NO: 2054488 - protein, 25 aa, Staphylococcus
QDCLLFFRLGDFYEMFFEDAKEASR

SEQ ID NO: 2054489 - protein, 17 aa, Staphylococcus
QDIKAGYDFGSKGIGLV

SEQ ID NO: 2054490 - protein, 19 aa, Staphylococcus
QDKGEIITSHFYKRMFKQH

SEQ ID NO: 2054491 - protein, 17 aa, Staphylococcus
QDKGVEITSFFYNRMFN

SEQ ID NO: 2054492 - protein, 17 aa, Staphylococcus
QDKRIILLTAHRRENIG

SEQ ID NO: 2054493 - protein, 19 aa, Staphylococcus
QDLLIPMTFHFSKDEQIII

SEQ ID NO: 2054494 - protein, 19 aa, Staphylococcus
QDLQARLSLITNDEAIALI

SEQ ID NO: 2054495 - protein, 17 aa, Staphylococcus
QDLVAGFVGQTAIKTEK

SEQ ID NO: 2054496 - protein, 17 aa, Staphylococcus
QDPCMRHELTFYTSKGE

SEQ ID NO: 2054497 - protein, 19 aa, Staphylococcus
QDRARLVIYPAAMRYAGPR

SEQ ID NO: 2054498 - protein, 18 aa, Staphylococcus
QDWKARLRMLKAFPTPTF

SEQ ID NO: 2054499 - protein, 21 aa, Staphylococcus
QECARLLKKWGLPANRNTIRL

SEQ ID NO: 2054500 - protein, 20 aa, Staphylococcus
QEDYCIILGYFVDGEPKLSY

SEQ ID NO: 2054501 - protein, 21 aa, Staphylococcus
QEEIIGYLGLWIVIDQAQITT

SEQ ID NO: 2054502 - protein, 22 aa, Staphylococcus
QEFKMIYQLIMIFLQNNRDYKW

SEQ ID NO: 2054503 - protein, 20 aa, Staphylococcus
QEGELCFGNEPLLRVEAPLI

SEQ ID NO: 2054504 - protein, 17 aa, Staphylococcus
QEGLCAAGIPVTMFGVD

SEQ ID NO: 2054505 - protein, 23 aa, Staphylococcus
QEHLLKFYGSFGFERTSETYLED

SEQ ID NO: 2054506 - protein, 17 aa, Staphylococcus
QEIFLKGHIDAFNNYED

SEQ ID NO: 2054507 - protein, 19 aa, Staphylococcus
QEIYKAGFLTGIYHGDMSY

SEQ ID NO: 2054508 - protein, 20 aa, Staphylococcus
QELEKLILFLGDRSTINKQD

SEQ ID NO: 2054509 - protein, 24 aa, Staphylococcus
QELFKLMFYTGLRIGEAMALVWTD

SEQ ID NO: 2054510 - protein, 18 aa, Staphylococcus
QELIDWLKVQSRPFLFST

SEQ ID NO: 2054511 - protein, 21 aa, Staphylococcus
QELKKACAEHDIKLSIPSPKL

SEQ ID NO: 2054512 - protein, 24 aa, Staphylococcus
QEMRPLYEWLGLTASLGFVDIPDY

SEQ ID NO: 2054513 - protein, 25 aa, Staphylococcus
QESIYRLGVEYLDLYLIHWPNPKQG

SEQ ID NO: 2054514 - protein, 17 aa, Staphylococcus
QEVRAWTFIKGMTAPQC

SEQ ID NO: 2054515 - protein, 19 aa, Staphylococcus
QEVYQEWYLGQSLYEEIEQ

SEQ ID NO: 2054516 - protein, 25 aa, Staphylococcus
QFDDFSCRIGMPFLRSPHVHHVHPD

SEQ ID NO: 2054517 - protein, 22 aa, Staphylococcus
QFDFGIKWGEAFKGTRISKLED

SEQ ID NO: 2054518 - protein, 18 aa, Staphylococcus
QFENKLTFSDEVVEKIAG

SEQ ID NO: 2054519 - protein, 22 aa, Staphylococcus
QFETRAGTLLRYYTGLLEHSKV

SEQ ID NO: 2054520 - protein, 20 aa, Staphylococcus
QFGLRFGLDISCLLNETVMF

SEQ ID NO: 2054521 - protein, 21 aa, Staphylococcus
QFKPGDVIQFKWISVDEANAM

SEQ ID NO: 2054522 - protein, 17 aa, Staphylococcus
QFKSLKKGVEMVHESLL

SEQ ID NO: 2054523 - protein, 19 aa, Staphylococcus
QFSNLEWLGLEWDESVDKD

SEQ ID NO: 2054524 - protein, 22 aa, Staphylococcus
QFVLEPTYCFSIITSATQYPDK

SEQ ID NO: 2054525 - protein, 18 aa, Staphylococcus
QFYFEILDYFFGNRKIRF

SEQ ID NO: 2054526 - protein, 18 aa, Staphylococcus
QGDILTWRNLTIDKQTRK

SEQ ID NO: 2054527 - protein, 21 aa, Staphylococcus
QGEIPDTLTIEWVTKDKLEDY

SEQ ID NO: 2054528 - protein, 17 aa, Staphylococcus
QGFDGWAPLFFRGREVS

SEQ ID NO: 2054529 - protein, 20 aa, Staphylococcus
QGIWKLIKQYGLRANINKTL

SEQ ID NO: 2054530 - protein, 20 aa, Staphylococcus
QGLGRTGTWSSIDHFNFTPD

SEQ ID NO: 2054531 - protein, 17 aa, Staphylococcus
QGLTYKIYFGFESRTAY

SEQ ID NO: 2054532 - protein, 22 aa, Staphylococcus
QGMGRTGKWSSIEHFNFEPDLV

SEQ ID NO: 2054533 - protein, 18 aa, Staphylococcus
QGQRILIGWMGLPEINYP

SEQ ID NO: 2054534 - protein, 22 aa, Staphylococcus
QGVWKPVPINGFRYYDGGSYSV

SEQ ID NO: 2054535 - protein, 23 aa, Staphylococcus
QGYRPVMEIQFLGFVFEVFDEVA

SEQ ID NO: 2054536 - protein, 20 aa, Staphylococcus
QGYSGLEIVVFDSHSNKTRH

SEQ ID NO: 2054537 - protein, 19 aa, Staphylococcus
QHALKFYIKNGFKAYSESQ

SEQ ID NO: 2054538 - protein, 17 aa, Staphylococcus
QHFNLLWSRTVLDNITF

SEQ ID NO: 2054539 - protein, 17 aa, Staphylococcus
QHFNLLWSRTVLNNIKF

SEQ ID NO: 2054540 - protein, 18 aa, Staphylococcus
QHHIPMAIATSSYRQDIM

SEQ ID NO: 2054541 - protein, 21 aa, Staphylococcus
QHKVWLDPGIGFAKTREEEKE

SEQ ID NO: 2054542 - protein, 17 aa, Staphylococcus
QHLPGWGLDALKFLIEE

SEQ ID NO: 2054543 - protein, 22 aa, Staphylococcus
QHRGGFCYEMNHFFGSYLETKG

SEQ ID NO: 2054544 - protein, 23 aa, Staphylococcus
QHRGGFCYEMNHFFGTYLEEKGF

SEQ ID NO: 2054545 - protein, 23 aa, Staphylococcus
QHRGGFCYEMNHLFGTYLEKKGF

SEQ ID NO: 2054546 - protein, 25 aa, Staphylococcus
QHYFKEAHPFFNLDVTVIGGKNSAV

SEQ ID NO: 2054547 - protein, 23 aa, Staphylococcus
QHYKEVTDALGIYDLSQKYPNEI

SEQ ID NO: 2054548 - protein, 18 aa, Staphylococcus
QIERIDMGILFPSPNDMP

SEQ ID NO: 2054549 - protein, 22 aa, Staphylococcus
QIFKQLLMISGFDKYYQIVKCF

SEQ ID NO: 2054550 - protein, 18 aa, Staphylococcus
QIFRLLEDMRVFNHIRNE

SEQ ID NO: 2054551 - protein, 20 aa, Staphylococcus
QIFVSAYCRYAPFIEQMESI

SEQ ID NO: 2054552 - protein, 18 aa, Staphylococcus
QIILNWHLCHGRIVIPKS

SEQ ID NO: 2054553 - protein, 17 aa, Staphylococcus
QIKGLEFDTVIMPFLSK

SEQ ID NO: 2054554 - protein, 21 aa, Staphylococcus
QILAGIVMRYSVEHFRSENDY

SEQ ID NO: 2054555 - protein, 22 aa, Staphylococcus
QILEIGTAIGYSAMHFASVNQD

SEQ ID NO: 2054556 - protein, 18 aa, Staphylococcus
QINREFENIFSIRKRDSL

SEQ ID NO: 2054557 - protein, 22 aa, Staphylococcus
QIPCTCLRFFNIYGPRQNPTSD

SEQ ID NO: 2054558 - protein, 17 aa, Staphylococcus
QIYDIVKQYGFVKRFQV

SEQ ID NO: 2054559 - protein, 17 aa, Staphylococcus
QKAIILYALIQSKHAVK

SEQ ID NO: 2054560 - protein, 19 aa, Staphylococcus
QKDVFELVRLFGKRGRGLY

SEQ ID NO: 2054561 - protein, 19 aa, Staphylococcus
QKDWGKLKWRSLLESFDKY

SEQ ID NO: 2054562 - protein, 26 aa, Staphylococcus
QKEGWVYMLSCLKVYLEHGVTIRAAI

SEQ ID NO: 2054563 - protein, 17 aa, Staphylococcus
QKEIFLLTEILSGKNSH

SEQ ID NO: 2054564 - protein, 19 aa, Staphylococcus
QKERIELFMKYNVKGYRTI

SEQ ID NO: 2054565 - protein, 20 aa, Staphylococcus
QKFGLRLAGEFDREAMKEAV

SEQ ID NO: 2054566 - protein, 23 aa, Staphylococcus
QKFGLRLAGEFKRTDMKKAVEIA

SEQ ID NO: 2054567 - protein, 19 aa, Staphylococcus
QKFGLRLPGEFNREDIKQA

SEQ ID NO: 2054568 - protein, 19 aa, Staphylococcus
QKFGLRLPGEFNREDMTKA

SEQ ID NO: 2054569 - protein, 19 aa, Staphylococcus
QKFGLRLPGEFNREDVRKA

SEQ ID NO: 2054570 - protein, 20 aa, Staphylococcus
QKGLPFVIAFMGQSQTKINS

SEQ ID NO: 2054571 - protein, 20 aa, Staphylococcus
QKGYCLLVGIGKNSTEADVQ

SEQ ID NO: 2054572 - protein, 22 aa, Staphylococcus
QKIVRWRAAMFIFDEGGEAQLP

SEQ ID NO: 2054573 - protein, 22 aa, Staphylococcus
QKIVRWRAAMFIFDEGNEEQLA

SEQ ID NO: 2054574 - protein, 22 aa, Staphylococcus
QKIVRWRAAMFIFDEGNEQQLV

SEQ ID NO: 2054575 - protein, 20 aa, Staphylococcus
QKIVRWRAAMFLFEEGGKAQ

SEQ ID NO: 2054576 - protein, 24 aa, Staphylococcus
QKKGLRLALDWSNRVNELIGRLPS

SEQ ID NO: 2054577 - protein, 25 aa, Staphylococcus
QKKVPMKVVYDIEDFEVPKGIEDHL

SEQ ID NO: 2054578 - protein, 17 aa, Staphylococcus
QKLEPAYSFMIRVRAPG

SEQ ID NO: 2054579 - protein, 17 aa, Staphylococcus
QKLIFLIGMAGERDLTK

SEQ ID NO: 2054580 - protein, 17 aa, Staphylococcus
QKLSRFILNSPHKLVSM

SEQ ID NO: 2054581 - protein, 19 aa, Staphylococcus
QKNAFPWVVAAFPSKAWAK

SEQ ID NO: 2054582 - protein, 23 aa, Staphylococcus
QKNQFPWCVAAFPSKAWAQRVYP

SEQ ID NO: 2054583 - protein, 19 aa, Staphylococcus
QKPHIMPVWSIKNRASKVR

SEQ ID NO: 2054584 - protein, 21 aa, Staphylococcus
QKPNIMPVWSIKNRARKVRDK

SEQ ID NO: 2054585 - protein, 22 aa, Staphylococcus
QKSDGSWGFSFVDKSGNLAGSY

SEQ ID NO: 2054586 - protein, 18 aa, Staphylococcus
QKSIWVWSGFLFETLMHD

SEQ ID NO: 2054587 - protein, 18 aa, Staphylococcus
QKSPRWAIAYKFPAEEVV

SEQ ID NO: 2054588 - protein, 21 aa, Staphylococcus
QKTQSKCLILFTSYKMMHMVQ

SEQ ID NO: 2054589 - protein, 23 aa, Staphylococcus
QKVAINFAKLILCNNDEQCEVKV

SEQ ID NO: 2054590 - protein, 20 aa, Staphylococcus
QKVFFKLLFYSGARKGEVRA

SEQ ID NO: 2054591 - protein, 18 aa, Staphylococcus
QKVSMVFQHFNLLWSRTV

SEQ ID NO: 2054592 - protein, 18 aa, Staphylococcus
QKYYIIWHGTPLKNMGKD

SEQ ID NO: 2054593 - protein, 25 aa, Staphylococcus
QKYYPNYRYVWSFKNPKNHVVPGNA

SEQ ID NO: 2054594 - protein, 18 aa, Staphylococcus
QLDKCFYKYYGLNKLMNL

SEQ ID NO: 2054595 - protein, 22 aa, Staphylococcus
QLEHNLTHWADLVAHKKSIRLH

SEQ ID NO: 2054596 - protein, 20 aa, Staphylococcus
QLFSRLKLALTEEHPSAPEF

SEQ ID NO: 2054597 - protein, 17 aa, Staphylococcus
QLIANRLGFNWNYKHPS

SEQ ID NO: 2054598 - protein, 17 aa, Staphylococcus
QLICYDLRFPEVARHSI

SEQ ID NO: 2054599 - protein, 19 aa, Staphylococcus
QLIGMRASSDFVRHGEKKS

SEQ ID NO: 2054600 - protein, 18 aa, Staphylococcus
QLIIKFSSAWSFLVPEIL

SEQ ID NO: 2054601 - protein, 23 aa, Staphylococcus
QLIIKFSSGWSFLVPEILQIDEE

SEQ ID NO: 2054602 - protein, 20 aa, Staphylococcus
QLKGRYSIVIFDTYGAITLD

SEQ ID NO: 2054603 - protein, 23 aa, Staphylococcus
QLLIKRLIKTYGMTAIFVTHDQY

SEQ ID NO: 2054604 - protein, 18 aa, Staphylococcus
QLLLKYGMTYAAHTCDTM

SEQ ID NO: 2054605 - protein, 22 aa, Staphylococcus
QLNRFGSIYIKFDQTLFRFIFH

SEQ ID NO: 2054606 - protein, 17 aa, Staphylococcus
QLPEFYERASFAPKGQD

SEQ ID NO: 2054607 - protein, 18 aa, Staphylococcus
QLRAKLFVDQIVSFANNS

SEQ ID NO: 2054608 - protein, 17 aa, Staphylococcus
QLSLAIGKRGQNARLAA

SEQ ID NO: 2054609 - protein, 24 aa, Staphylococcus
QLSNKIGGYFLKKLNLNMINSNDE

SEQ ID NO: 2054610 - protein, 18 aa, Staphylococcus
QLTCLHVNHGLREASHKE

SEQ ID NO: 2054611 - protein, 18 aa, Staphylococcus
QLTGLKFDKVEAIKTEEI

SEQ ID NO: 2054612 - protein, 18 aa, Staphylococcus
QLTWFKNKMNVHWLDREN

SEQ ID NO: 2054613 - protein, 20 aa, Staphylococcus
QLVPKIGVFRGRNALKKALK

SEQ ID NO: 2054614 - protein, 19 aa, Staphylococcus
QMELIKILFKKAQKLDSVN

SEQ ID NO: 2054615 - protein, 18 aa, Staphylococcus
QMGVFKLLNEHGSLTINE

SEQ ID NO: 2054616 - protein, 24 aa, Staphylococcus
QMIRLLEHYLRFGNQEEIDYQKEH

SEQ ID NO: 2054617 - protein, 18 aa, Staphylococcus
QMMRCCRFFIDKLRQSQH

SEQ ID NO: 2054618 - protein, 17 aa, Staphylococcus
QMMRVILLEQVYRAFKI

SEQ ID NO: 2054619 - protein, 19 aa, Staphylococcus
QMNDCWPTISWSGVDYYGR

SEQ ID NO: 2054620 - protein, 18 aa, Staphylococcus
QMSLPLLWEFPGGKIEQG

SEQ ID NO: 2054621 - protein, 23 aa, Staphylococcus
QNDFLYDRVEVVVATNAFGMGID

SEQ ID NO: 2054622 - protein, 18 aa, Staphylococcus
QNDFLYDRVNVVIATNAF

SEQ ID NO: 2054623 - protein, 18 aa, Staphylococcus
QNEIARWIKIQEDIGLDV

SEQ ID NO: 2054624 - protein, 22 aa, Staphylococcus
QNEQRLPNQLLFTTEQHTNNEV

SEQ ID NO: 2054625 - protein, 18 aa, Staphylococcus
QNEVITWVLGYNKNIDDL

SEQ ID NO: 2054626 - protein, 18 aa, Staphylococcus
QNEVLTWVLGYHQSIEEL

SEQ ID NO: 2054627 - protein, 17 aa, Staphylococcus
QNKRPDYISAFWNVINW

SEQ ID NO: 2054628 - protein, 18 aa, Staphylococcus
QNLKDLRNGVAIEVPTYD

SEQ ID NO: 2054629 - protein, 19 aa, Staphylococcus
QNLLIPMTFHFSKDEQFII

SEQ ID NO: 2054630 - protein, 19 aa, Staphylococcus
QNLLIPMTFHFSKDEQMII

SEQ ID NO: 2054631 - protein, 18 aa, Staphylococcus
QNLTWDPPMVMFAANQSV

SEQ ID NO: 2054632 - protein, 17 aa, Staphylococcus
QNPILWQPLDAYLYHMK

SEQ ID NO: 2054633 - protein, 23 aa, Staphylococcus
QNYKEVTEALGIYELSDKYPSEI

SEQ ID NO: 2054634 - protein, 17 aa, Staphylococcus
QPDFISVFLGTNDWGLV

SEQ ID NO: 2054635 - protein, 19 aa, Staphylococcus
QPESWGWKQFTDQIALGKL

SEQ ID NO: 2054636 - protein, 18 aa, Staphylococcus
QPIHFKWKDEAVVGVMLA

SEQ ID NO: 2054637 - protein, 23 aa, Staphylococcus
QPILKEKFESLGLKVEEDQASQT

SEQ ID NO: 2054638 - protein, 23 aa, Staphylococcus
QPKRIKIKWSNHILKDLAHMNKQ

SEQ ID NO: 2054639 - protein, 20 aa, Staphylococcus
QPLLVKFLWDNLTDQPIGQV

SEQ ID NO: 2054640 - protein, 18 aa, Staphylococcus
QPRSAVCFDAPSWYELVV

SEQ ID NO: 2054641 - protein, 18 aa, Staphylococcus
QPRSSVCFDAPSWYELVV

SEQ ID NO: 2054642 - protein, 22 aa, Staphylococcus
QQALDWTLDYDKFVITLCHGPA

SEQ ID NO: 2054643 - protein, 19 aa, Staphylococcus
QQEGYCIIIGYFVNGKPKL

SEQ ID NO: 2054644 - protein, 18 aa, Staphylococcus
QQHMDGWLFYAQPFQDQK

SEQ ID NO: 2054645 - protein, 18 aa, Staphylococcus
QQHMDGWLFYAQPFQGQK

SEQ ID NO: 2054646 - protein, 23 aa, Staphylococcus
QQIKASMVGTFFLQDSKELTEPV

SEQ ID NO: 2054647 - protein, 19 aa, Staphylococcus
QQLGLKWYAVPIISSMDLK

SEQ ID NO: 2054648 - protein, 20 aa, Staphylococcus
QQPGESYISYLLRVKNSKLW

SEQ ID NO: 2054649 - protein, 19 aa, Staphylococcus
QQQRVCIARCLAIEPDVIL

SEQ ID NO: 2054650 - protein, 22 aa, Staphylococcus
QQRKGWSQVKMKAVLHNQAIQN

SEQ ID NO: 2054651 - protein, 17 aa, Staphylococcus
QQRRLKLVIDMLQDKVN

SEQ ID NO: 2054652 - protein, 18 aa, Staphylococcus
QQRVCIARTLAIEPDVIL

SEQ ID NO: 2054653 - protein, 17 aa, Staphylococcus
QRAKVVVIVLDLKQVLT

SEQ ID NO: 2054654 - protein, 23 aa, Staphylococcus
QREFKQFFPKSGWVEHDANEIWT

SEQ ID NO: 2054655 - protein, 17 aa, Staphylococcus
QRGEIQGEFVLRQQIAH

SEQ ID NO: 2054656 - protein, 19 aa, Staphylococcus
QRHIPMAIATSSYKKDIFP

SEQ ID NO: 2054657 - protein, 19 aa, Staphylococcus
QRHIPMAIATSSYREDIYP

SEQ ID NO: 2054658 - protein, 19 aa, Staphylococcus
QRHIPMAIATSSYREEIMP

SEQ ID NO: 2054659 - protein, 17 aa, Staphylococcus
QRIGIRMGDLVEKETFE

SEQ ID NO: 2054660 - protein, 23 aa, Staphylococcus
QRIYEAYPFKRGIYSGGVGYINC

SEQ ID NO: 2054661 - protein, 18 aa, Staphylococcus
QRKGLSYKEKREYETVME

SEQ ID NO: 2054662 - protein, 17 aa, Staphylococcus
QRLAPRVNILADIVKDV

SEQ ID NO: 2054663 - protein, 18 aa, Staphylococcus
QRMENIFGLKVKVMKHAL

SEQ ID NO: 2054664 - protein, 20 aa, Staphylococcus
QRPDVAQSWDIEYGDRNTQF

SEQ ID NO: 2054665 - protein, 21 aa, Staphylococcus
QRPHHQRFLIIFSDGEPSAYN

SEQ ID NO: 2054666 - protein, 26 aa, Staphylococcus
QRTAIKEGLFRKGLRRRYKLIGQIMS

SEQ ID NO: 2054667 - protein, 21 aa, Staphylococcus
QRTQVQLAFCIDVRSEPFRRH

SEQ ID NO: 2054668 - protein, 19 aa, Staphylococcus
QRVGISIVDPVRFFTVYRA

SEQ ID NO: 2054669 - protein, 19 aa, Staphylococcus
QRVSFNVIDHIGAGSVSDK

SEQ ID NO: 2054670 - protein, 19 aa, Staphylococcus
QRYAMPILLAISHIHQLLI

SEQ ID NO: 2054671 - protein, 19 aa, Staphylococcus
QSELWRYRVQDMKNIIDHL

SEQ ID NO: 2054672 - protein, 23 aa, Staphylococcus
QSFKFHGVVAMQLFLSDDLELPS

SEQ ID NO: 2054673 - protein, 17 aa, Staphylococcus
QSFPTPAVFDWLQKEGN

SEQ ID NO: 2054674 - protein, 18 aa, Staphylococcus
QSGRIVVISSIWGETGAS

SEQ ID NO: 2054675 - protein, 27 aa, Staphylococcus
QSILRTLFNSIRFEEMQNLLLNQVKDE

SEQ ID NO: 2054676 - protein, 25 aa, Staphylococcus
QSKIFRSRFRMLVEAQLDLLKSEDW

SEQ ID NO: 2054677 - protein, 19 aa, Staphylococcus
QSKVFRSRFRMLVEAQLDL

SEQ ID NO: 2054678 - protein, 25 aa, Staphylococcus
QSKVFRSRFRMLVEAQLDLLKNEDW

SEQ ID NO: 2054679 - protein, 17 aa, Staphylococcus
QSLKQFHLFAGQYNFIG

SEQ ID NO: 2054680 - protein, 18 aa, Staphylococcus
QSPYKFLLSHGFVMDGEG

SEQ ID NO: 2054681 - protein, 19 aa, Staphylococcus
QSYRLIIPNIIFKSNLNEI

SEQ ID NO: 2054682 - protein, 18 aa, Staphylococcus
QSYRLIIPTFEFISNLKQ

SEQ ID NO: 2054683 - protein, 18 aa, Staphylococcus
QTDGRMKALVSITLDDAF

SEQ ID NO: 2054684 - protein, 18 aa, Staphylococcus
QTDYCIILSYFADGEAQL

SEQ ID NO: 2054685 - protein, 19 aa, Staphylococcus
QTEVLTWVLGYNKTIEELI

SEQ ID NO: 2054686 - protein, 18 aa, Staphylococcus
QTEVLVWALGYNRTIEEL

SEQ ID NO: 2054687 - protein, 21 aa, Staphylococcus
QTEVRLVLSFLRTVDNPLQDI

SEQ ID NO: 2054688 - protein, 21 aa, Staphylococcus
QTFKPELLKILGRTHKTQDIY

SEQ ID NO: 2054689 - protein, 21 aa, Staphylococcus
QTFKPELLKILGRTHNTQDIY

SEQ ID NO: 2054690 - protein, 18 aa, Staphylococcus
QTHLKWGAQKDVIRLIPG

SEQ ID NO: 2054691 - protein, 18 aa, Staphylococcus
QTHLKWGAQKEVIKLIPG

SEQ ID NO: 2054692 - protein, 17 aa, Staphylococcus
QTHLKWGAQKEVIQLIP

SEQ ID NO: 2054693 - protein, 18 aa, Staphylococcus
QTHLKWGAQKEVIQLIPG

SEQ ID NO: 2054694 - protein, 18 aa, Staphylococcus
QTIFLRYDVRVEKKDSSK

SEQ ID NO: 2054695 - protein, 22 aa, Staphylococcus
QTKEMYRLLGLAKYEDRFVVPS

SEQ ID NO: 2054696 - protein, 21 aa, Staphylococcus
QTLKIESIIGFKGDAEDEISR

SEQ ID NO: 2054697 - protein, 19 aa, Staphylococcus
QTSFKRWFVDFEFPDEDGN

SEQ ID NO: 2054698 - protein, 26 aa, Staphylococcus
QVCYQFKVPFIITRAVSDLANGEADM

SEQ ID NO: 2054699 - protein, 21 aa, Staphylococcus
QVKPRLDAMIQEFKADEVLVV

SEQ ID NO: 2054700 - protein, 24 aa, Staphylococcus
QVLEKFKSLTFISGTLTFNHSFEA

SEQ ID NO: 2054701 - protein, 26 aa, Staphylococcus
QVLLLTFFFKYMRPLVQAGRVFIALP

SEQ ID NO: 2054702 - protein, 18 aa, Staphylococcus
QVLNGLRIGELLALQPEN

SEQ ID NO: 2054703 - protein, 18 aa, Staphylococcus
QVPPRWLFLKIITDEGLE

SEQ ID NO: 2054704 - protein, 19 aa, Staphylococcus
QVVIRCCFVYLGYDSEATV

SEQ ID NO: 2054705 - protein, 23 aa, Staphylococcus
QVYRLYFKFVMPIFGKLFAKSKE

SEQ ID NO: 2054706 - protein, 18 aa, Staphylococcus
QWAGSCWYYLRYIDPDND

SEQ ID NO: 2054707 - protein, 18 aa, Staphylococcus
QWAGSCWYYLRYIDPHNS

SEQ ID NO: 2054708 - protein, 18 aa, Staphylococcus
QWFPLGPVHGLKYWYTYT

SEQ ID NO: 2054709 - protein, 23 aa, Staphylococcus
QWPSARLNHWLALLKARAIENDM

SEQ ID NO: 2054710 - protein, 18 aa, Staphylococcus
QWQRMGVLGIEMESAALY

SEQ ID NO: 2054711 - protein, 22 aa, Staphylococcus
QWREPGCSMCLGMNPDQVPAGV

SEQ ID NO: 2054712 - protein, 22 aa, Staphylococcus
QWREPGCSMCLGMNPDQVPEGI

SEQ ID NO: 2054713 - protein, 19 aa, Staphylococcus
QYAPEFEKIIGLPIMLIHK

SEQ ID NO: 2054714 - protein, 17 aa, Staphylococcus
QYCKAKGQPTGSLKDEK

SEQ ID NO: 2054715 - protein, 23 aa, Staphylococcus
QYDFRWQPSILSRSIRDLTVAVI

SEQ ID NO: 2054716 - protein, 22 aa, Staphylococcus
QYFKRIFNVLHEFYSENDTFNI

SEQ ID NO: 2054717 - protein, 20 aa, Staphylococcus
QYLWRFARDMPRTGHIEMFD

SEQ ID NO: 2054718 - protein, 17 aa, Staphylococcus
QYMLKRKYHFMGYSQMK

SEQ ID NO: 2054719 - protein, 19 aa, Staphylococcus
QYRLYKLIWDRFVASQMAP

SEQ ID NO: 2054720 - protein, 17 aa, Staphylococcus
QYTLFLYDWRVFESEAS

SEQ ID NO: 2054721 - protein, 17 aa, Staphylococcus
RAAKVLGSWRLEDCTLY

SEQ ID NO: 2054722 - protein, 17 aa, Staphylococcus
RACGIHMLVATQRPSVN

SEQ ID NO: 2054723 - protein, 19 aa, Staphylococcus
RADILFRAAAITRRRKHEF

SEQ ID NO: 2054724 - protein, 21 aa, Staphylococcus
RADKLYKWFSLINEHKDELAE

SEQ ID NO: 2054725 - protein, 18 aa, Staphylococcus
RAEIYIDGFHNFSSLEYD

SEQ ID NO: 2054726 - protein, 23 aa, Staphylococcus
RAEWLLLDLFKWSRTDYLIHREE

SEQ ID NO: 2054727 - protein, 17 aa, Staphylococcus
RAEWLLMDLFDWSFTDY

SEQ ID NO: 2054728 - protein, 23 aa, Staphylococcus
RAEWLMLDLFNWSKANYLMHMDD

SEQ ID NO: 2054729 - protein, 17 aa, Staphylococcus
RAGACLITAGLIAEGVT

SEQ ID NO: 2054730 - protein, 21 aa, Staphylococcus
RAGKIPFVISCQGQEATQIGM

SEQ ID NO: 2054731 - protein, 20 aa, Staphylococcus
RAGKNIFPYAASKHGVVGIT

SEQ ID NO: 2054732 - protein, 18 aa, Staphylococcus
RAKLFVDQIVSFVNNSPY

SEQ ID NO: 2054733 - protein, 21 aa, Staphylococcus
RAKLHPAICFTMLGHYLGVDI

SEQ ID NO: 2054734 - protein, 17 aa, Staphylococcus
RALACNYDMIIAAGGDG

SEQ ID NO: 2054735 - protein, 20 aa, Staphylococcus
RALEEVIYFASYVVVNPGPT

SEQ ID NO: 2054736 - protein, 22 aa, Staphylococcus
RALELVELVGLKGREHAYPSEL

SEQ ID NO: 2054737 - protein, 17 aa, Staphylococcus
RALGYGMYGEQVDGNDP

SEQ ID NO: 2054738 - protein, 20 aa, Staphylococcus
RALLRASAFGKLNIMFPMVA

SEQ ID NO: 2054739 - protein, 22 aa, Staphylococcus
RAMPSQGRFGGHFVLGHVDEVG

SEQ ID NO: 2054740 - protein, 19 aa, Staphylococcus
RANNIFIFGYGASYVCATD

SEQ ID NO: 2054741 - protein, 17 aa, Staphylococcus
RAPYAICLMLALEQHGI

SEQ ID NO: 2054742 - protein, 17 aa, Staphylococcus
RAQKILQDRAFKNDKVN

SEQ ID NO: 2054743 - protein, 18 aa, Staphylococcus
RATPQWFASIDKVREDIL

SEQ ID NO: 2054744 - protein, 21 aa, Staphylococcus
RATRPVNCFVQINVSGEESKH

SEQ ID NO: 2054745 - protein, 19 aa, Staphylococcus
RAWTFIKGMTAPQCAGIIH

SEQ ID NO: 2054746 - protein, 18 aa, Staphylococcus
RAYELKPEIIGVNNRDLK

SEQ ID NO: 2054747 - protein, 19 aa, Staphylococcus
RCEACKGDGIIKIEMHFLP

SEQ ID NO: 2054748 - protein, 17 aa, Staphylococcus
RCINKVIILLPLNKPCK

SEQ ID NO: 2054749 - protein, 17 aa, Staphylococcus
RCPYCKKKLLLKKGLKK

SEQ ID NO: 2054750 - protein, 18 aa, Staphylococcus
RCTACFEMRLELVAEAAV

SEQ ID NO: 2054751 - protein, 18 aa, Staphylococcus
RDAIPVIVTVAYDLTGKF

SEQ ID NO: 2054752 - protein, 27 aa, Staphylococcus
RDCMEMKPLYEWLGLTASLGFIDIPDY

SEQ ID NO: 2054753 - protein, 20 aa, Staphylococcus
RDDIVFCSSLTFSASANPII

SEQ ID NO: 2054754 - protein, 19 aa, Staphylococcus
RDEATWFALMDHLVAISID

SEQ ID NO: 2054755 - protein, 18 aa, Staphylococcus
RDEIARWIQIQEDISLDV

SEQ ID NO: 2054756 - protein, 19 aa, Staphylococcus
RDERHMLGQMINQVHQQQQ

SEQ ID NO: 2054757 - protein, 23 aa, Staphylococcus
RDGLKSECILLFSERDRGLHEYF

SEQ ID NO: 2054758 - protein, 18 aa, Staphylococcus
RDHFEEITPEQVKETFQT

SEQ ID NO: 2054759 - protein, 20 aa, Staphylococcus
RDHYDQFGICFAQTTYDLRG

SEQ ID NO: 2054760 - protein, 18 aa, Staphylococcus
RDIPRFVSLYKQGRLNID

SEQ ID NO: 2054761 - protein, 18 aa, Staphylococcus
RDIPRFVSLYQQERLNID

SEQ ID NO: 2054762 - protein, 18 aa, Staphylococcus
RDLFKYIPFDGSIITITE

SEQ ID NO: 2054763 - protein, 17 aa, Staphylococcus
RDLKERLIRTVGEPRER

SEQ ID NO: 2054764 - protein, 21 aa, Staphylococcus
RDLKGGQTIGLFSYGSGSVGE

SEQ ID NO: 2054765 - protein, 17 aa, Staphylococcus
RDLRELNIFRLPAESKQ

SEQ ID NO: 2054766 - protein, 19 aa, Staphylococcus
RDLRYQWFDEMMSKINADV

SEQ ID NO: 2054767 - protein, 25 aa, Staphylococcus
RDLVVSIRAGMEMDRSELLKKLVDV

SEQ ID NO: 2054768 - protein, 17 aa, Staphylococcus
RDMQLLAPRVRYLSEIV

SEQ ID NO: 2054769 - protein, 23 aa, Staphylococcus
RDNDFWKSIAFGVSTGNRNQTLT

SEQ ID NO: 2054770 - protein, 19 aa, Staphylococcus
RDRVDIILPAVAVFKALFK

SEQ ID NO: 2054771 - protein, 18 aa, Staphylococcus
RDSMNWNKMTEGIKHLPA

SEQ ID NO: 2054772 - protein, 24 aa, Staphylococcus
RDTYRKLTCLHVNHGLREESIEEE

SEQ ID NO: 2054773 - protein, 18 aa, Staphylococcus
RDVFGYNVSKGWMCIQVF

SEQ ID NO: 2054774 - protein, 30 aa, Staphylococcus
RDVFGYNVSKGWMCVQVFFIRQGNMIKRDA

SEQ ID NO: 2054775 - protein, 30 aa, Staphylococcus
RDVFGYSISKGWMCIQVFFIRQGNMIKRDA

SEQ ID NO: 2054776 - protein, 30 aa, Staphylococcus
RDVFGYSVSKGWMCIQVFFIRQGNMIKRDT

SEQ ID NO: 2054777 - protein, 30 aa, Staphylococcus
RDVFGYSVSKGWMCIQVFFIRQGNMIQRDA

SEQ ID NO: 2054778 - protein, 18 aa, Staphylococcus
RDVTRLAQHLGWQGNHTD

SEQ ID NO: 2054779 - protein, 19 aa, Staphylococcus
RDYLFFKFAIHTGIKLTDL

SEQ ID NO: 2054780 - protein, 18 aa, Staphylococcus
RDYLKAKLLSLGFELEAQ

SEQ ID NO: 2054781 - protein, 19 aa, Staphylococcus
RDYLLFKFAIHTGIKLSEL

SEQ ID NO: 2054782 - protein, 19 aa, Staphylococcus
RDYSKRHIKLFENLAKTRT

SEQ ID NO: 2054783 - protein, 17 aa, Staphylococcus
REALEMAERVGLDLVVV

SEQ ID NO: 2054784 - protein, 20 aa, Staphylococcus
REAWSVRELEHYVTTHYSDN

SEQ ID NO: 2054785 - protein, 21 aa, Staphylococcus
REFKQYFPQSGWVEHDANEIW

SEQ ID NO: 2054786 - protein, 19 aa, Staphylococcus
REIGDPLVVTFGRVDPVPN

SEQ ID NO: 2054787 - protein, 17 aa, Staphylococcus
REIILFAPTWRGNNVNK

SEQ ID NO: 2054788 - protein, 18 aa, Staphylococcus
REIKGHIPSGEWGVPENL

SEQ ID NO: 2054789 - protein, 20 aa, Staphylococcus
REILNAPGFFRQLPVLPAAQ

SEQ ID NO: 2054790 - protein, 24 aa, Staphylococcus
REIMSIGVGLGFFGVAGFDLLLDE

SEQ ID NO: 2054791 - protein, 21 aa, Staphylococcus
REIQSRLGITFIFVTHDQEEA

SEQ ID NO: 2054792 - protein, 18 aa, Staphylococcus
REIRRTKINMVFQNFGLF

SEQ ID NO: 2054793 - protein, 19 aa, Staphylococcus
REKRIVISLTYVYGIGTTT

SEQ ID NO: 2054794 - protein, 19 aa, Staphylococcus
RELGQTLPIVIDGKHITKD

SEQ ID NO: 2054795 - protein, 18 aa, Staphylococcus
RELLDHYAELGIDEQDLV

SEQ ID NO: 2054796 - protein, 17 aa, Staphylococcus
RELNEWYILTIERLIDL

SEQ ID NO: 2054797 - protein, 20 aa, Staphylococcus
RELQDIIAILGMDELSEEDK

SEQ ID NO: 2054798 - protein, 21 aa, Staphylococcus
RELQDIIAILGMDELSEEDKL

SEQ ID NO: 2054799 - protein, 20 aa, Staphylococcus
RELQDIIAILGMDELSEEDR

SEQ ID NO: 2054800 - protein, 17 aa, Staphylococcus
RELRLIKTLQHFDINIS

SEQ ID NO: 2054801 - protein, 21 aa, Staphylococcus
RELRQQVGLVFQFPESQLFED

SEQ ID NO: 2054802 - protein, 20 aa, Staphylococcus
RENLRLVIQLVDLRHNPTED

SEQ ID NO: 2054803 - protein, 20 aa, Staphylococcus
RENLRLVIQLVDLRHNPTQD

SEQ ID NO: 2054804 - protein, 19 aa, Staphylococcus
REPCWKIQAKYGISDLVKR

SEQ ID NO: 2054805 - protein, 19 aa, Staphylococcus
REPCWKIQTKYGIKDLVKR

SEQ ID NO: 2054806 - protein, 22 aa, Staphylococcus
REQCGVCHAVLPQLKDILDTSY

SEQ ID NO: 2054807 - protein, 21 aa, Staphylococcus
REREHFAIFPASHFVTRDEKM

SEQ ID NO: 2054808 - protein, 19 aa, Staphylococcus
RERICEAAIQLMENIEYVN

SEQ ID NO: 2054809 - protein, 18 aa, Staphylococcus
RERVWRRLATDLKSDKLH

SEQ ID NO: 2054810 - protein, 18 aa, Staphylococcus
RETMIGSMAYYISHAKNE

SEQ ID NO: 2054811 - protein, 21 aa, Staphylococcus
REVLASLGLRTVEELVGRTDL

SEQ ID NO: 2054812 - protein, 17 aa, Staphylococcus
REVRGILDMKGGFTDSI

SEQ ID NO: 2054813 - protein, 18 aa, Staphylococcus
REWGDYGIEEFLEIKSIA

SEQ ID NO: 2054814 - protein, 19 aa, Staphylococcus
REWGDYGIEEFLEVKSIAG

SEQ ID NO: 2054815 - protein, 17 aa, Staphylococcus
REWRTADIYSEMNHALM

SEQ ID NO: 2054816 - protein, 17 aa, Staphylococcus
REYKELISLMTKIKVSK

SEQ ID NO: 2054817 - protein, 19 aa, Staphylococcus
RFAKACPLSAAFNAQGLID

SEQ ID NO: 2054818 - protein, 25 aa, Staphylococcus
RFAYDCYRRLLQMFGEVVYNIPMVA

SEQ ID NO: 2054819 - protein, 25 aa, Staphylococcus
RFDHFKDRVLVPLAYIKFDEYLEEL

SEQ ID NO: 2054820 - protein, 19 aa, Staphylococcus
RFEAYGWKHILVKDGNDLD

SEQ ID NO: 2054821 - protein, 23 aa, Staphylococcus
RFERTRHNIGFEVIDYILDKNQF

SEQ ID NO: 2054822 - protein, 17 aa, Staphylococcus
RFFLKYPYIKLASAPIL

SEQ ID NO: 2054823 - protein, 17 aa, Staphylococcus
RFFRCHNSFVVNRHNID

SEQ ID NO: 2054824 - protein, 17 aa, Staphylococcus
RFFRCHNSFVVNRHNIS

SEQ ID NO: 2054825 - protein, 25 aa, Staphylococcus
RFFRPEFLNRFNGIVEFTHLDKHAL

SEQ ID NO: 2054826 - protein, 18 aa, Staphylococcus
RFKEVYQIFSDVLGVPLK

SEQ ID NO: 2054827 - protein, 17 aa, Staphylococcus
RFKGIMVKKQETVEAMQ

SEQ ID NO: 2054828 - protein, 18 aa, Staphylococcus
RFKNLRFDEDIVFCEEHT

SEQ ID NO: 2054829 - protein, 17 aa, Staphylococcus
RFKPFFENMEILEASFD

SEQ ID NO: 2054830 - protein, 22 aa, Staphylococcus
RFLGRDEFHIFLDLYRETEART

SEQ ID NO: 2054831 - protein, 19 aa, Staphylococcus
RFLLKDIQSAYLIGQQSKF

SEQ ID NO: 2054832 - protein, 19 aa, Staphylococcus
RFNPLYFKKIWLEAWEETH

SEQ ID NO: 2054833 - protein, 17 aa, Staphylococcus
RFRGIRSNIMFSGVEEA

SEQ ID NO: 2054834 - protein, 23 aa, Staphylococcus
RFTSTEVDLFFTLCNKLKEQDTR

SEQ ID NO: 2054835 - protein, 18 aa, Staphylococcus
RFVRIFDFPFYFRGEVYH

SEQ ID NO: 2054836 - protein, 25 aa, Staphylococcus
RFYDHGALDYKRLFGAVAKNVTGGF

SEQ ID NO: 2054837 - protein, 24 aa, Staphylococcus
RFYKHGALDYKRLFGAVGKNITGG

SEQ ID NO: 2054838 - protein, 20 aa, Staphylococcus
RFYYFSIANPSPFKWLDSLV

SEQ ID NO: 2054839 - protein, 18 aa, Staphylococcus
RGAANLAILTEDPDLLSG

SEQ ID NO: 2054840 - protein, 20 aa, Staphylococcus
RGDNGFGYDPVFYVPEKGRT

SEQ ID NO: 2054841 - protein, 18 aa, Staphylococcus
RGDSRFYLSLQDELMVRF

SEQ ID NO: 2054842 - protein, 20 aa, Staphylococcus
RGFEIKPEIAGLMISAIISD

SEQ ID NO: 2054843 - protein, 17 aa, Staphylococcus
RGGQKFILEGGMPEVKG

SEQ ID NO: 2054844 - protein, 20 aa, Staphylococcus
RGGYLYSYRKQNQFTRNILT

SEQ ID NO: 2054845 - protein, 20 aa, Staphylococcus
RGIATWKFDKERGRLVGTIE

SEQ ID NO: 2054846 - protein, 22 aa, Staphylococcus
RGIDEYLIRLSIGIEDYEDIEQ

SEQ ID NO: 2054847 - protein, 22 aa, Staphylococcus
RGIDEYLIRLSIGIEHYQDIEA

SEQ ID NO: 2054848 - protein, 17 aa, Staphylococcus
RGKGGHVRANWRDVTDI

SEQ ID NO: 2054849 - protein, 17 aa, Staphylococcus
RGLKREIIKPVAKIAEE

SEQ ID NO: 2054850 - protein, 18 aa, Staphylococcus
RGLMRHLVIRTGYHTDEI

SEQ ID NO: 2054851 - protein, 17 aa, Staphylococcus
RGPLLMQDWYFLEQMAH

SEQ ID NO: 2054852 - protein, 22 aa, Staphylococcus
RGPRGFGNFGGFGGRHGGRDRF

SEQ ID NO: 2054853 - protein, 20 aa, Staphylococcus
RGQNEWMKFLGITQTTNPEF

SEQ ID NO: 2054854 - protein, 18 aa, Staphylococcus
RGSAVLITGGFNTSEEII

SEQ ID NO: 2054855 - protein, 18 aa, Staphylococcus
RGSGVLITGGFKTTQKII

SEQ ID NO: 2054856 - protein, 20 aa, Staphylococcus
RGYASFMLCRDCGYVPQCPH

SEQ ID NO: 2054857 - protein, 20 aa, Staphylococcus
RGYASFMLCRDCGYVPQCPN

SEQ ID NO: 2054858 - protein, 17 aa, Staphylococcus
RGYHLAIATGRPRTETL

SEQ ID NO: 2054859 - protein, 17 aa, Staphylococcus
RHFAGSYAVQWTMINYA

SEQ ID NO: 2054860 - protein, 22 aa, Staphylococcus
RHFGENRLEGFLEKKAALPEDA

SEQ ID NO: 2054861 - protein, 22 aa, Staphylococcus
RHFGENRVEGFLEKKQALPKDV

SEQ ID NO: 2054862 - protein, 20 aa, Staphylococcus
RHIAHPTGRIIGRRPGYEPN

SEQ ID NO: 2054863 - protein, 20 aa, Staphylococcus
RHIKVFPGLVTYVGQTKEEA

SEQ ID NO: 2054864 - protein, 18 aa, Staphylococcus
RHIRHCYKADPDYGKGVA

SEQ ID NO: 2054865 - protein, 20 aa, Staphylococcus
RHLLEFKKQKAIDISRVEPA

SEQ ID NO: 2054866 - protein, 24 aa, Staphylococcus
RHLLKLKDKLGFHVVITGHEGLNS

SEQ ID NO: 2054867 - protein, 18 aa, Staphylococcus
RHNIGFEVVDYLLDKYNF

SEQ ID NO: 2054868 - protein, 17 aa, Staphylococcus
RHPYTWGLLSSMPDLDS

SEQ ID NO: 2054869 - protein, 20 aa, Staphylococcus
RHRFGEGIGRQYGFDINLIS

SEQ ID NO: 2054870 - protein, 18 aa, Staphylococcus
RHRLLELFLIEILQYNWE

SEQ ID NO: 2054871 - protein, 17 aa, Staphylococcus
RHTHCSLLFEAGLSVQE

SEQ ID NO: 2054872 - protein, 19 aa, Staphylococcus
RIAEVDIMYGQGISKEGEL

SEQ ID NO: 2054873 - protein, 21 aa, Staphylococcus
RIAPRKVRLVLDLIRGKNVGE

SEQ ID NO: 2054874 - protein, 18 aa, Staphylococcus
RIAQRWRDIPMLIIDNHI

SEQ ID NO: 2054875 - protein, 18 aa, Staphylococcus
RIAVIPCEYYVEKADPDL

SEQ ID NO: 2054876 - protein, 19 aa, Staphylococcus
RIFYCLQKNNCCFIPVSND

SEQ ID NO: 2054877 - protein, 19 aa, Staphylococcus
RIGEALALQWKDYDFEKGE

SEQ ID NO: 2054878 - protein, 19 aa, Staphylococcus
RIGELLSLYIDDIKYDLTN

SEQ ID NO: 2054879 - protein, 19 aa, Staphylococcus
RIGEPFVGYSDAFSFNSPN

SEQ ID NO: 2054880 - protein, 19 aa, Staphylococcus
RIGEPFVGYSDSFSFNSPN

SEQ ID NO: 2054881 - protein, 18 aa, Staphylococcus
RIGIEFEKMTPMKLGGYT

SEQ ID NO: 2054882 - protein, 20 aa, Staphylococcus
RIHKGFHMLKFEGINNINDI

SEQ ID NO: 2054883 - protein, 25 aa, Staphylococcus
RIIDVGCGYGPIGLMIAKVSPHHQM

SEQ ID NO: 2054884 - protein, 18 aa, Staphylococcus
RIILRRGPLFASLKEMYI

SEQ ID NO: 2054885 - protein, 20 aa, Staphylococcus
RIKEFELLWYLASRENEVIS

SEQ ID NO: 2054886 - protein, 21 aa, Staphylococcus
RIKEFELLWYLGKHENEVISK

SEQ ID NO: 2054887 - protein, 17 aa, Staphylococcus
RILARFPEKLSHYIEKW

SEQ ID NO: 2054888 - protein, 20 aa, Staphylococcus
RIMRMLHPFMPFVTEKIWQS

SEQ ID NO: 2054889 - protein, 20 aa, Staphylococcus
RINENVAMAFGFFDGMHKGH

SEQ ID NO: 2054890 - protein, 17 aa, Staphylococcus
RIPHTFDFEDYKLPQLV

SEQ ID NO: 2054891 - protein, 18 aa, Staphylococcus
RIPLSQAVIELCLSPKSN

SEQ ID NO: 2054892 - protein, 23 aa, Staphylococcus
RIPQGRGMVKWQPFKTMPEQYER

SEQ ID NO: 2054893 - protein, 17 aa, Staphylococcus
RIRIQEIGFILQSTNLV

SEQ ID NO: 2054894 - protein, 22 aa, Staphylococcus
RIRRLLKLYLERESFDIEEAQD

SEQ ID NO: 2054895 - protein, 22 aa, Staphylococcus
RIRRLLKLYLERESFEIHEAND

SEQ ID NO: 2054896 - protein, 23 aa, Staphylococcus
RIRRLLKLYLERESFEIHEASDG

SEQ ID NO: 2054897 - protein, 22 aa, Staphylococcus
RIRRLLKLYLERESFETHEARD

SEQ ID NO: 2054898 - protein, 22 aa, Staphylococcus
RIRRLLKLYLERESFNIHEASD

SEQ ID NO: 2054899 - protein, 23 aa, Staphylococcus
RIRRLLKLYLERESFTIHEASDG

SEQ ID NO: 2054900 - protein, 22 aa, Staphylococcus
RIRRLLKLYLKRESFTIHEASN

SEQ ID NO: 2054901 - protein, 19 aa, Staphylococcus
RISEELNWEVRVFHRDEDT

SEQ ID NO: 2054902 - protein, 18 aa, Staphylococcus
RISGCSIFGDFFGQGDIH

SEQ ID NO: 2054903 - protein, 23 aa, Staphylococcus
RISKSGFGPFAFDEWRYLDDGSD

SEQ ID NO: 2054904 - protein, 19 aa, Staphylococcus
RISMLEVMLPSAIKAKYTK

SEQ ID NO: 2054905 - protein, 18 aa, Staphylococcus
RISSILKQAGERGITPSE

SEQ ID NO: 2054906 - protein, 23 aa, Staphylococcus
RITKSGFGPFAFDEWRYLPDGTN

SEQ ID NO: 2054907 - protein, 24 aa, Staphylococcus
RITKTGFGPFAFDEWRYLPDGSDN

SEQ ID NO: 2054908 - protein, 18 aa, Staphylococcus
RITSGMFYFGLEIPMKYP

SEQ ID NO: 2054909 - protein, 22 aa, Staphylococcus
RIWTYKDGKPWYFLEEKYPDYG

SEQ ID NO: 2054910 - protein, 18 aa, Staphylococcus
RIYRSLGLLRYSRLMSVE

SEQ ID NO: 2054911 - protein, 21 aa, Staphylococcus
RKAGIPVIFVRVAFSKNFSEV

SEQ ID NO: 2054912 - protein, 21 aa, Staphylococcus
RKAVWAIYAVCRIIDDSIDVY

SEQ ID NO: 2054913 - protein, 21 aa, Staphylococcus
RKAVWAIYAVCRMIDDSIDEY

SEQ ID NO: 2054914 - protein, 19 aa, Staphylococcus
RKDIFGKLSYVGSTVKTLM

SEQ ID NO: 2054915 - protein, 19 aa, Staphylococcus
RKEILLKISEVYKRRMEDL

SEQ ID NO: 2054916 - protein, 19 aa, Staphylococcus
RKEINEFSALVYYPEEKLK

SEQ ID NO: 2054917 - protein, 20 aa, Staphylococcus
RKFIEAFPKYKGVQFEAWSF

SEQ ID NO: 2054918 - protein, 18 aa, Staphylococcus
RKFLKRKKFKEALQQKRE

SEQ ID NO: 2054919 - protein, 17 aa, Staphylococcus
RKGLEIIDSVNIDYTMV

SEQ ID NO: 2054920 - protein, 19 aa, Staphylococcus
RKGLPYVFAGHFAPQQMKE

SEQ ID NO: 2054921 - protein, 19 aa, Staphylococcus
RKGLRTGIVADRIGGQVNE

SEQ ID NO: 2054922 - protein, 19 aa, Staphylococcus
RKHIWRRLAKDLKPDNLHD

SEQ ID NO: 2054923 - protein, 20 aa, Staphylococcus
RKIKGGFTFAVLTKDALYGA

SEQ ID NO: 2054924 - protein, 17 aa, Staphylococcus
RKIKGKWLVHGHVPTRR

SEQ ID NO: 2054925 - protein, 17 aa, Staphylococcus
RKKALLFEWSRINEMLD

SEQ ID NO: 2054926 - protein, 20 aa, Staphylococcus
RKKEIVKYPFNVNGYFLSIE

SEQ ID NO: 2054927 - protein, 19 aa, Staphylococcus
RKKELKLLIDEALVNKDEK

SEQ ID NO: 2054928 - protein, 18 aa, Staphylococcus
RKKFGEDQVHIWRRSYDV

SEQ ID NO: 2054929 - protein, 22 aa, Staphylococcus
RKKPANGFVCYMIGRLILEYCK

SEQ ID NO: 2054930 - protein, 17 aa, Staphylococcus
RKLAERRVFPAIDIGRS

SEQ ID NO: 2054931 - protein, 17 aa, Staphylococcus
RKLDLGWIVSECPSSVA

SEQ ID NO: 2054932 - protein, 17 aa, Staphylococcus
RKLIFLVGMAGERDLTK

SEQ ID NO: 2054933 - protein, 20 aa, Staphylococcus
RKLLEALICVGAFDSFGKTR

SEQ ID NO: 2054934 - protein, 25 aa, Staphylococcus
RKLNIEWVYRLLIDWKRIGRLKSIP

SEQ ID NO: 2054935 - protein, 17 aa, Staphylococcus
RKLRLSNISAFEHDATE

SEQ ID NO: 2054936 - protein, 18 aa, Staphylococcus
RKLSERRIFPAIDIARSS

SEQ ID NO: 2054937 - protein, 18 aa, Staphylococcus
RKPMGKSFKRACEHMDLK

SEQ ID NO: 2054938 - protein, 23 aa, Staphylococcus
RKPSEFYNPLTLYRGLKLKTFNN

SEQ ID NO: 2054939 - protein, 19 aa, Staphylococcus
RKQALEIFNNLNIQLDLNQ

SEQ ID NO: 2054940 - protein, 19 aa, Staphylococcus
RKQPVWIRHVLVPGYTDDE

SEQ ID NO: 2054941 - protein, 24 aa, Staphylococcus
RKQTRLYLFYGLVFKRYFDEALSA

SEQ ID NO: 2054942 - protein, 17 aa, Staphylococcus
RKQVLIDHGFRLPSAID

SEQ ID NO: 2054943 - protein, 17 aa, Staphylococcus
RKRGELMAQAFPNGVGS

SEQ ID NO: 2054944 - protein, 18 aa, Staphylococcus
RKRGELMAQAFPSGVGSM

SEQ ID NO: 2054945 - protein, 18 aa, Staphylococcus
RKRGELMTQAFPNGVGSM

SEQ ID NO: 2054946 - protein, 20 aa, Staphylococcus
RKSAKYVGLIPRFSRIFLGD

SEQ ID NO: 2054947 - protein, 21 aa, Staphylococcus
RKSDEVWDINNIIMLSSKFTV

SEQ ID NO: 2054948 - protein, 23 aa, Staphylococcus
RKTHFPINLLIKLNNEIEEYLTT

SEQ ID NO: 2054949 - protein, 17 aa, Staphylococcus
RKTVRGYHIVVGERRFR

SEQ ID NO: 2054950 - protein, 18 aa, Staphylococcus
RKVAIALRNRYRRSLLTE

SEQ ID NO: 2054951 - protein, 18 aa, Staphylococcus
RKVFGDIQFDYAIDYSGY

SEQ ID NO: 2054952 - protein, 21 aa, Staphylococcus
RKVFGNSKFDYAIDFSGYSMF

SEQ ID NO: 2054953 - protein, 23 aa, Staphylococcus
RKVRREVMDMLLLVKEKAYYSYR

SEQ ID NO: 2054954 - protein, 23 aa, Staphylococcus
RKVSKRLGKTVAILLDTKGPEIR

SEQ ID NO: 2054955 - protein, 21 aa, Staphylococcus
RKVTGKWSWLVPSLSPTLVPN

SEQ ID NO: 2054956 - protein, 26 aa, Staphylococcus
RKYPNIKIGICFQNRYNATFQALQEI

SEQ ID NO: 2054957 - protein, 19 aa, Staphylococcus
RLAQHLVPYPPGIPSFFKG

SEQ ID NO: 2054958 - protein, 20 aa, Staphylococcus
RLDVKFPPDEIGFIALHIAS

SEQ ID NO: 2054959 - protein, 18 aa, Staphylococcus
RLEGFKSLQWPVAPDGTD

SEQ ID NO: 2054960 - protein, 19 aa, Staphylococcus
RLEKCKLQTGLNPKKYSDA

SEQ ID NO: 2054961 - protein, 18 aa, Staphylococcus
RLENELQIFPSHFSKGMK

SEQ ID NO: 2054962 - protein, 23 aa, Staphylococcus
RLERVCALTMLYVLGKYLDKKQS

SEQ ID NO: 2054963 - protein, 20 aa, Staphylococcus
RLFDHIDIPTAKDWKALQEQ

SEQ ID NO: 2054964 - protein, 19 aa, Staphylococcus
RLGDHVHMVGCIGDDMLGK

SEQ ID NO: 2054965 - protein, 19 aa, Staphylococcus
RLGTPLKRRVPGIELMEHC

SEQ ID NO: 2054966 - protein, 24 aa, Staphylococcus
RLIKVKELYKLFCQLYKDAISIDE

SEQ ID NO: 2054967 - protein, 18 aa, Staphylococcus
RLKGGDPFVFGRGGEEAE

SEQ ID NO: 2054968 - protein, 19 aa, Staphylococcus
RLKGQLVPFVHLGTGNYND

SEQ ID NO: 2054969 - protein, 18 aa, Staphylococcus
RLKLLVGLSNDLTFKQLK

SEQ ID NO: 2054970 - protein, 21 aa, Staphylococcus
RLKLTMHYFKDPLIFKLTKSA

SEQ ID NO: 2054971 - protein, 18 aa, Staphylococcus
RLKLTVINELAWHNLFAH

SEQ ID NO: 2054972 - protein, 20 aa, Staphylococcus
RLKRPLARRIPGIELMDQCL

SEQ ID NO: 2054973 - protein, 22 aa, Staphylococcus
RLKSKKGTLLWLMDETKTPMGA

SEQ ID NO: 2054974 - protein, 17 aa, Staphylococcus
RLLFWVVMNIIRGQRHY

SEQ ID NO: 2054975 - protein, 20 aa, Staphylococcus
RLLKDRIIMLGSAIDDNVAN

SEQ ID NO: 2054976 - protein, 18 aa, Staphylococcus
RLLKLKWWQYGFADFKGV

SEQ ID NO: 2054977 - protein, 23 aa, Staphylococcus
RLLNHGIPSYGYRIEAPTTPGTI

SEQ ID NO: 2054978 - protein, 19 aa, Staphylococcus
RLLNMFKQRQIAGVIMGAL

SEQ ID NO: 2054979 - protein, 22 aa, Staphylococcus
RLNYPVLCANIFENGELLTHQG

SEQ ID NO: 2054980 - protein, 23 aa, Staphylococcus
RLPDEVFRLKGFVKFKDQSDSTY

SEQ ID NO: 2054981 - protein, 21 aa, Staphylococcus
RLPDNVLRLKGYVQFRDTPNE

SEQ ID NO: 2054982 - protein, 19 aa, Staphylococcus
RLPESLNFISWLQHLQDSG

SEQ ID NO: 2054983 - protein, 22 aa, Staphylococcus
RLPLYYRFVNSLKIKGIDRVSS

SEQ ID NO: 2054984 - protein, 18 aa, Staphylococcus
RLPLYYRFVNTLKSKGID

SEQ ID NO: 2054985 - protein, 20 aa, Staphylococcus
RLPLYYRFVSNLKSKGIDRV

SEQ ID NO: 2054986 - protein, 20 aa, Staphylococcus
RLQHTLKLPVNIVGSKSLAN

SEQ ID NO: 2054987 - protein, 19 aa, Staphylococcus
RLQLPINIVGVIASAENMI

SEQ ID NO: 2054988 - protein, 21 aa, Staphylococcus
RLQWEMIKFAKAHHIDRYNFY

SEQ ID NO: 2054989 - protein, 17 aa, Staphylococcus
RLRAKIIDKYVLTRLNT

SEQ ID NO: 2054990 - protein, 23 aa, Staphylococcus
RLSEICGLLIKYGKPIDTPVALI

SEQ ID NO: 2054991 - protein, 21 aa, Staphylococcus
RLSEVKLGIDLGYLTLSDFKF

SEQ ID NO: 2054992 - protein, 21 aa, Staphylococcus
RLSQDWKLRHVLVEMHGNNGS

SEQ ID NO: 2054993 - protein, 20 aa, Staphylococcus
RLSQGWKLCHVLIEMQGNNG

SEQ ID NO: 2054994 - protein, 17 aa, Staphylococcus
RLTEIGFIFQASHLVPY

SEQ ID NO: 2054995 - protein, 19 aa, Staphylococcus
RLTESITWADNRASHYAER

SEQ ID NO: 2054996 - protein, 19 aa, Staphylococcus
RLTKAAIEMMIFNIVQQHK

SEQ ID NO: 2054997 - protein, 18 aa, Staphylococcus
RLTKIFGIKSISPVFKTT

SEQ ID NO: 2054998 - protein, 27 aa, Staphylococcus
RLTNDWSEIRPEWGLAKNAAFIIGQRE

SEQ ID NO: 2054999 - protein, 18 aa, Staphylococcus
RLTPKLNFENRLFIPDAS

SEQ ID NO: 2055000 - protein, 17 aa, Staphylococcus
RLVDFKIEFGITDEGNI

SEQ ID NO: 2055001 - protein, 21 aa, Staphylococcus
RLVEMRRFILASSYDERVDAL

SEQ ID NO: 2055002 - protein, 17 aa, Staphylococcus
RLVPAITYLDGEYGFKD

SEQ ID NO: 2055003 - protein, 24 aa, Staphylococcus
RMAMSHPYIRISLISDGKTLLKTN

SEQ ID NO: 2055004 - protein, 18 aa, Staphylococcus
RMAVFDLYFRSMPFDSGY

SEQ ID NO: 2055005 - protein, 22 aa, Staphylococcus
RMDDLRASLGISQFKNMKRNKI

SEQ ID NO: 2055006 - protein, 24 aa, Staphylococcus
RMEQRYKGPIAFEYNHINNNKERT

SEQ ID NO: 2055007 - protein, 22 aa, Staphylococcus
RMGCGIGACYACVCHTPESDTS

SEQ ID NO: 2055008 - protein, 19 aa, Staphylococcus
RMILERILPILSDREKEII

SEQ ID NO: 2055009 - protein, 19 aa, Staphylococcus
RMILERILPILSDREREII

SEQ ID NO: 2055010 - protein, 19 aa, Staphylococcus
RMILERILPILSDRERQII

SEQ ID NO: 2055011 - protein, 20 aa, Staphylococcus
RMILERILPILSEREREIIQ

SEQ ID NO: 2055012 - protein, 20 aa, Staphylococcus
RMMIAALKISTDFERMGDNA

SEQ ID NO: 2055013 - protein, 21 aa, Staphylococcus
RMMMAALKIATDFERMGDNVA

SEQ ID NO: 2055014 - protein, 19 aa, Staphylococcus
RMQGYNVLHPMGWDAFGLP

SEQ ID NO: 2055015 - protein, 18 aa, Staphylococcus
RMVHELPTFFSSNFDYSE

SEQ ID NO: 2055016 - protein, 18 aa, Staphylococcus
RMVHELPTFFSSNLNLEE

SEQ ID NO: 2055017 - protein, 18 aa, Staphylococcus
RMVHELPTFFTSNLSYDE

SEQ ID NO: 2055018 - protein, 18 aa, Staphylococcus
RMVHELPTLFSSNLDFNA

SEQ ID NO: 2055019 - protein, 20 aa, Staphylococcus
RMYRRFTILTTIKMHQPVGR

SEQ ID NO: 2055020 - protein, 18 aa, Staphylococcus
RNDYALWLKVIKKAKKVH

SEQ ID NO: 2055021 - protein, 20 aa, Staphylococcus
RNEGFGLIILEAMNQGDIVV

SEQ ID NO: 2055022 - protein, 21 aa, Staphylococcus
RNEGFGMIILEAMLQDNIVIS

SEQ ID NO: 2055023 - protein, 24 aa, Staphylococcus
RNGPTGTVKLHFMKQYNKFTDIDY

SEQ ID NO: 2055024 - protein, 18 aa, Staphylococcus
RNGQWFAIVYEIGFGRTR

SEQ ID NO: 2055025 - protein, 19 aa, Staphylococcus
RNHCSVCHAVLPQIEDIVN

SEQ ID NO: 2055026 - protein, 17 aa, Staphylococcus
RNIKGKIIIPGFFGVSK

SEQ ID NO: 2055027 - protein, 23 aa, Staphylococcus
RNIVYKVFFCLTKEIGIKTEKIM

SEQ ID NO: 2055028 - protein, 18 aa, Staphylococcus
RNKLKPFGKDKCIETVRG

SEQ ID NO: 2055029 - protein, 24 aa, Staphylococcus
RNLIELKIPMAYFYLEDAAFFNCH

SEQ ID NO: 2055030 - protein, 24 aa, Staphylococcus
RNLKEYRFELPLIIRNDYLSHGGM

SEQ ID NO: 2055031 - protein, 17 aa, Staphylococcus
RNLKVGAKCLVYMNDTL

SEQ ID NO: 2055032 - protein, 17 aa, Staphylococcus
RNSFNAIHIFDENGFKT

SEQ ID NO: 2055033 - protein, 17 aa, Staphylococcus
RNTFDWLQPLLKRKYPD

SEQ ID NO: 2055034 - protein, 19 aa, Staphylococcus
RNVHKSVFHGLELANQKAT

SEQ ID NO: 2055035 - protein, 21 aa, Staphylococcus
RPARALKLWITLQVIGEDEII

SEQ ID NO: 2055036 - protein, 20 aa, Staphylococcus
RPDQMLKFGLPRLVKYLNMD

SEQ ID NO: 2055037 - protein, 18 aa, Staphylococcus
RPIEGFFSIAGFKEDAQD

SEQ ID NO: 2055038 - protein, 19 aa, Staphylococcus
RPIGSFLFLGPTGVGKTEL

SEQ ID NO: 2055039 - protein, 19 aa, Staphylococcus
RPIGSFLFVGPTGVGKTEL

SEQ ID NO: 2055040 - protein, 20 aa, Staphylococcus
RPIMEEWLFNTVSFIGGPSE

SEQ ID NO: 2055041 - protein, 18 aa, Staphylococcus
RPKAGWIWNDNKVKMDTL

SEQ ID NO: 2055042 - protein, 20 aa, Staphylococcus
RPKAVIYDLNFLKTLPYHEI

SEQ ID NO: 2055043 - protein, 19 aa, Staphylococcus
RPMMYIALSYDHRIIDGKE

SEQ ID NO: 2055044 - protein, 20 aa, Staphylococcus
RPMMYIALSYDHRIIDGKEA

SEQ ID NO: 2055045 - protein, 17 aa, Staphylococcus
RPMVFRRELLDHYAELG

SEQ ID NO: 2055046 - protein, 17 aa, Staphylococcus
RPPEDMLHIGFTSGTTG

SEQ ID NO: 2055047 - protein, 21 aa, Staphylococcus
RPQDSFEVIKEFQLTTEHLEI

SEQ ID NO: 2055048 - protein, 18 aa, Staphylococcus
RPQLRALLRASAFGKLNI

SEQ ID NO: 2055049 - protein, 20 aa, Staphylococcus
RPSIQPAIQMRKEVRLNYTK

SEQ ID NO: 2055050 - protein, 18 aa, Staphylococcus
RPSSLDDLGLEAAFKSYF

SEQ ID NO: 2055051 - protein, 17 aa, Staphylococcus
RPVGQDIVHYSDYFEGA

SEQ ID NO: 2055052 - protein, 18 aa, Staphylococcus
RPVGTDIVHFSDYFEGAQ

SEQ ID NO: 2055053 - protein, 21 aa, Staphylococcus
RPYRLLRIGSFLLSKYGYKIF

SEQ ID NO: 2055054 - protein, 21 aa, Staphylococcus
RQDLKEAFQFAAEGKVIPKVQ

SEQ ID NO: 2055055 - protein, 24 aa, Staphylococcus
RQFYKFFGENIFRADICNADVDLG

SEQ ID NO: 2055056 - protein, 18 aa, Staphylococcus
RQGFPEVIFGQGKTKEQI

SEQ ID NO: 2055057 - protein, 19 aa, Staphylococcus
RQGLPYVFAGHFAPQQMKE

SEQ ID NO: 2055058 - protein, 20 aa, Staphylococcus
RQIKGGFTFAVLTKDALYGA

SEQ ID NO: 2055059 - protein, 17 aa, Staphylococcus
RQKVSMVFQHFNLLWSR

SEQ ID NO: 2055060 - protein, 18 aa, Staphylococcus
RQSGVLPEMVRLSIGTEN

SEQ ID NO: 2055061 - protein, 24 aa, Staphylococcus
RQVSRIPLSLTFDHQILDGAGAAE

SEQ ID NO: 2055062 - protein, 17 aa, Staphylococcus
RRANIRFKRDASSKPEL

SEQ ID NO: 2055063 - protein, 18 aa, Staphylococcus
RRAVWAIYAVCRVIDDSI

SEQ ID NO: 2055064 - protein, 17 aa, Staphylococcus
RREGLRIKFSQLIEKPT

SEQ ID NO: 2055065 - protein, 18 aa, Staphylococcus
RRFSAFTGSGLEVFLNAN

SEQ ID NO: 2055066 - protein, 21 aa, Staphylococcus
RRGEIVMKILAYDADVEKIER

SEQ ID NO: 2055067 - protein, 18 aa, Staphylococcus
RRHVTFLLENNAQAIIVN

SEQ ID NO: 2055068 - protein, 28 aa, Staphylococcus
RRIEFYKLYLLLVHLVKFGLMYESSVET

SEQ ID NO: 2055069 - protein, 18 aa, Staphylococcus
RRIKSWIICNIVLMNYMI

SEQ ID NO: 2055070 - protein, 18 aa, Staphylococcus
RRILGLKAKIHLPKKQAQ

SEQ ID NO: 2055071 - protein, 17 aa, Staphylococcus
RRILIGWMAMWESHMPE

SEQ ID NO: 2055072 - protein, 17 aa, Staphylococcus
RRKFVGIVFGDANYYLK

SEQ ID NO: 2055073 - protein, 22 aa, Staphylococcus
RRLCHSCSQLGFQFSENAWYSY

SEQ ID NO: 2055074 - protein, 20 aa, Staphylococcus
RRLGAMVAFEVVDPETGEPD

SEQ ID NO: 2055075 - protein, 19 aa, Staphylococcus
RRLGWDIEGARDFEFEHNG

SEQ ID NO: 2055076 - protein, 17 aa, Staphylococcus
RRNSVAVIFVRVAFTGE

SEQ ID NO: 2055077 - protein, 19 aa, Staphylococcus
RRRLIKFDKPISIPYVLNR

SEQ ID NO: 2055078 - protein, 19 aa, Staphylococcus
RRRMIKFDKPISIPYVLNR

SEQ ID NO: 2055079 - protein, 19 aa, Staphylococcus
RRRMIQFKKDIDIAYVLEN

SEQ ID NO: 2055080 - protein, 19 aa, Staphylococcus
RRTNLIGAIIPRMNSFAVD

SEQ ID NO: 2055081 - protein, 17 aa, Staphylococcus
RRVKSIVNKAQRVSEET

SEQ ID NO: 2055082 - protein, 17 aa, Staphylococcus
RRVNLCTGDIGFSASKT

SEQ ID NO: 2055083 - protein, 18 aa, Staphylococcus
RRYPTRRLHVEDGILKEI

SEQ ID NO: 2055084 - protein, 18 aa, Staphylococcus
RSAAFFALGLIKGSERPV

SEQ ID NO: 2055085 - protein, 17 aa, Staphylococcus
RSAHEVVGKIVLWSIQH

SEQ ID NO: 2055086 - protein, 20 aa, Staphylococcus
RSASEIQLDLGYTVEELIDV

SEQ ID NO: 2055087 - protein, 17 aa, Staphylococcus
RSASQPVIITGHEINSF

SEQ ID NO: 2055088 - protein, 19 aa, Staphylococcus
RSDYPWDLLIQMPAALMYP

SEQ ID NO: 2055089 - protein, 17 aa, Staphylococcus
RSEIMRVLFGLDKGQMQ

SEQ ID NO: 2055090 - protein, 22 aa, Staphylococcus
RSGLELEADFVIRVGKPVISKK

SEQ ID NO: 2055091 - protein, 20 aa, Staphylococcus
RSGVCSVQLAERVEPGDKLK

SEQ ID NO: 2055092 - protein, 20 aa, Staphylococcus
RSHHQRFLIVFSDGEPSAYN

SEQ ID NO: 2055093 - protein, 18 aa, Staphylococcus
RSIPFKFASYMSASKFFK

SEQ ID NO: 2055094 - protein, 19 aa, Staphylococcus
RSLKFFKYFYTHRGPVMDY

SEQ ID NO: 2055095 - protein, 18 aa, Staphylococcus
RSQIQDWIKEDLVTVNGK

SEQ ID NO: 2055096 - protein, 19 aa, Staphylococcus
RSSNFVKIRGYRINPNEVT

SEQ ID NO: 2055097 - protein, 23 aa, Staphylococcus
RSYNCLKRAGINTVQELADKSEA

SEQ ID NO: 2055098 - protein, 18 aa, Staphylococcus
RTAGPAFFWGTFDVSAIV

SEQ ID NO: 2055099 - protein, 18 aa, Staphylococcus
RTELRIRDDVPFITDNGN

SEQ ID NO: 2055100 - protein, 24 aa, Staphylococcus
RTFKEWKIPIIFVTHSNFEAEVLA

SEQ ID NO: 2055101 - protein, 17 aa, Staphylococcus
RTLAISVFGEMDVSSIK

SEQ ID NO: 2055102 - protein, 20 aa, Staphylococcus
RTLFNSIRFEEIQKLLQSEV

SEQ ID NO: 2055103 - protein, 18 aa, Staphylococcus
RTLKFFKYFYTHRGPVMD

SEQ ID NO: 2055104 - protein, 19 aa, Staphylococcus
RTLLDFRYQRQFKAKRGEG

SEQ ID NO: 2055105 - protein, 18 aa, Staphylococcus
RTQIQDWIKASLVKVNDQ

SEQ ID NO: 2055106 - protein, 21 aa, Staphylococcus
RTRHEAIFSMGVIRHYREKGL

SEQ ID NO: 2055107 - protein, 20 aa, Staphylococcus
RTVMPGFEYEAPPSQNKLNP

SEQ ID NO: 2055108 - protein, 18 aa, Staphylococcus
RTVMPGFKYEAPPTQNKR

SEQ ID NO: 2055109 - protein, 18 aa, Staphylococcus
RTVMPGFQYEAPPTQNKL

SEQ ID NO: 2055110 - protein, 19 aa, Staphylococcus
RTWLKRRIETPYKATINSD

SEQ ID NO: 2055111 - protein, 19 aa, Staphylococcus
RTWLKRRIETPYKATLNHD

SEQ ID NO: 2055112 - protein, 25 aa, Staphylococcus
RTYLKRPDLLMAYPLSEQDKEIIES

SEQ ID NO: 2055113 - protein, 18 aa, Staphylococcus
RVDIILPAVCVFKALYKK

SEQ ID NO: 2055114 - protein, 18 aa, Staphylococcus
RVDLSLNVRRVYFSTFNR

SEQ ID NO: 2055115 - protein, 26 aa, Staphylococcus
RVDPPCVYYWKCGGCQLQHMSYEAQL

SEQ ID NO: 2055116 - protein, 17 aa, Staphylococcus
RVDYKGTTTYGFTGAGS

SEQ ID NO: 2055117 - protein, 19 aa, Staphylococcus
RVFECGVCINVFGLDVTHQ

SEQ ID NO: 2055118 - protein, 25 aa, Staphylococcus
RVFNMIPFKVQVMGGIAIHKGDIAE

SEQ ID NO: 2055119 - protein, 21 aa, Staphylococcus
RVFNMIPYKVQVMGGIAIHGG

SEQ ID NO: 2055120 - protein, 21 aa, Staphylococcus
RVFNMIPYKVQVMGGIAIHHG

SEQ ID NO: 2055121 - protein, 25 aa, Staphylococcus
RVFNMIPYRVQVMGGIAIHKGDIAE

SEQ ID NO: 2055122 - protein, 18 aa, Staphylococcus
RVGLKLQDNGWVYVQGLT

SEQ ID NO: 2055123 - protein, 19 aa, Staphylococcus
RVIQFIEHFHFSDSDIEYL

SEQ ID NO: 2055124 - protein, 18 aa, Staphylococcus
RVLGDIIICTNVAEEQAD

SEQ ID NO: 2055125 - protein, 20 aa, Staphylococcus
RVLGGLTYRESHFALEFLHN

SEQ ID NO: 2055126 - protein, 18 aa, Staphylococcus
RVNDIKAYINDSVPKAMG

SEQ ID NO: 2055127 - protein, 18 aa, Staphylococcus
RVNEEIWRGISVHIQEMP

SEQ ID NO: 2055128 - protein, 17 aa, Staphylococcus
RVNKSIEDWDIKLTDIF

SEQ ID NO: 2055129 - protein, 19 aa, Staphylococcus
RVSPDLFIKRLNFYDFLLL

SEQ ID NO: 2055130 - protein, 18 aa, Staphylococcus
RVTLGFPKVRRQIRDGLV

SEQ ID NO: 2055131 - protein, 17 aa, Staphylococcus
RVTNAWNVMHLIFPVVS

SEQ ID NO: 2055132 - protein, 20 aa, Staphylococcus
RVTPKFSLEYIAFFPSDKPE

SEQ ID NO: 2055133 - protein, 20 aa, Staphylococcus
RVVSMPNWFAFEQQPEEYKE

SEQ ID NO: 2055134 - protein, 20 aa, Staphylococcus
RVVSMPNWFAFEQQSDEYKE

SEQ ID NO: 2055135 - protein, 20 aa, Staphylococcus
RVVSMPNWFAFEQQSEDYKE

SEQ ID NO: 2055136 - protein, 20 aa, Staphylococcus
RVYRSLGILKYSRLISMEEA

SEQ ID NO: 2055137 - protein, 18 aa, Staphylococcus
RWFTKDVFAVNVKKIESK

SEQ ID NO: 2055138 - protein, 23 aa, Staphylococcus
RWLERKDKPAIQWHQFINELPYY

SEQ ID NO: 2055139 - protein, 20 aa, Staphylococcus
RYAPEFEKIIPLHIMLVSSS

SEQ ID NO: 2055140 - protein, 21 aa, Staphylococcus
RYCFDKAFLGMNGIDLKHGLT

SEQ ID NO: 2055141 - protein, 19 aa, Staphylococcus
RYGCLIGIELLELLKNTEL

SEQ ID NO: 2055142 - protein, 19 aa, Staphylococcus
RYGCVLAIEILELLKDVEL

SEQ ID NO: 2055143 - protein, 19 aa, Staphylococcus
RYGIPSVILGVGYENIHTT

SEQ ID NO: 2055144 - protein, 25 aa, Staphylococcus
RYKHFKDRVLVPLAYIYFDEYLEEL

SEQ ID NO: 2055145 - protein, 20 aa, Staphylococcus
RYLENQIRAAFGFEGTPVHI

SEQ ID NO: 2055146 - protein, 19 aa, Staphylococcus
RYLENQIRDAFGFEGTPIR

SEQ ID NO: 2055147 - protein, 20 aa, Staphylococcus
RYLENQIRHAFGFEGTPVHI

SEQ ID NO: 2055148 - protein, 19 aa, Staphylococcus
RYLENQIRNAFGFEGTPIH

SEQ ID NO: 2055149 - protein, 20 aa, Staphylococcus
RYPFELSGGMAQRVAFIMSL

SEQ ID NO: 2055150 - protein, 17 aa, Staphylococcus
RYPKMIHDFSLFPIHES

SEQ ID NO: 2055151 - protein, 20 aa, Staphylococcus
RYSDDVDIIFILGGDGTVNE

SEQ ID NO: 2055152 - protein, 17 aa, Staphylococcus
RYSIVAFDYYGTVKLND

SEQ ID NO: 2055153 - protein, 18 aa, Staphylococcus
RYTHKWNLKVIFSLYDEF

SEQ ID NO: 2055154 - protein, 19 aa, Staphylococcus
SAFDYAIEVPEIWHDPEIE

SEQ ID NO: 2055155 - protein, 20 aa, Staphylococcus
SAFHWRFMDKLSLSTLSEVV

SEQ ID NO: 2055156 - protein, 22 aa, Staphylococcus
SAHFKAIFDFANFVQCGEDTQA

SEQ ID NO: 2055157 - protein, 18 aa, Staphylococcus
SAHTARQLALVWGAYPVI

SEQ ID NO: 2055158 - protein, 22 aa, Staphylococcus
SAKPRLPLEHVFHRNQYNSDKE

SEQ ID NO: 2055159 - protein, 17 aa, Staphylococcus
SAKVASCAVTWGTHSIE

SEQ ID NO: 2055160 - protein, 18 aa, Staphylococcus
SALQLWLLRINYLDQPQF

SEQ ID NO: 2055161 - protein, 18 aa, Staphylococcus
SANEIGLDLGYTVDELID

SEQ ID NO: 2055162 - protein, 26 aa, Staphylococcus
SAQMNVRWGVGVVHHIAWSVPTDKVQ

SEQ ID NO: 2055163 - protein, 19 aa, Staphylococcus
SASEIQIDLGYTVEELTDI

SEQ ID NO: 2055164 - protein, 18 aa, Staphylococcus
SASGRLGIYFTESGYAQR

SEQ ID NO: 2055165 - protein, 26 aa, Staphylococcus
SASIYRASEKWCHGFSDVPAETYIQS

SEQ ID NO: 2055166 - protein, 21 aa, Staphylococcus
SATEIPHGWMMIEVDATNLVK

SEQ ID NO: 2055167 - protein, 19 aa, Staphylococcus
SAYSFKRAVAIQMTKSPQI

SEQ ID NO: 2055168 - protein, 20 aa, Staphylococcus
SCFKCGGKGCNVCKQTGWIE

SEQ ID NO: 2055169 - protein, 23 aa, Staphylococcus
SCGKCYYCKKGIYAHCENDGGWI

SEQ ID NO: 2055170 - protein, 24 aa, Staphylococcus
SCGKCYYCKKGIYAHCENGGGWIL

SEQ ID NO: 2055171 - protein, 26 aa, Staphylococcus
SCKNRFCPVCAWRKARKDALGLSLMM

SEQ ID NO: 2055172 - protein, 20 aa, Staphylococcus
SCLIDYGIWDLCQWNKTDNK

SEQ ID NO: 2055173 - protein, 18 aa, Staphylococcus
SCVGKEFCRFGTQYTTQL

SEQ ID NO: 2055174 - protein, 18 aa, Staphylococcus
SDAFDLLMQLGFPRNIMS

SEQ ID NO: 2055175 - protein, 18 aa, Staphylococcus
SDCNLKFKNELLDLGIID

SEQ ID NO: 2055176 - protein, 24 aa, Staphylococcus
SDELEWLPQLFVVGGLADLELGPF

SEQ ID NO: 2055177 - protein, 17 aa, Staphylococcus
SDELLNFVVKEDANGTK

SEQ ID NO: 2055178 - protein, 20 aa, Staphylococcus
SDFAALCFHVPFTKMGQKAL

SEQ ID NO: 2055179 - protein, 19 aa, Staphylococcus
SDFTTGWIFFIDDFGHHEL

SEQ ID NO: 2055180 - protein, 17 aa, Staphylococcus
SDGEPCNECAICKGITR

SEQ ID NO: 2055181 - protein, 18 aa, Staphylococcus
SDGYRIGYGGGFYDRFLS

SEQ ID NO: 2055182 - protein, 17 aa, Staphylococcus
SDIFGVSSRQALRGNDE

SEQ ID NO: 2055183 - protein, 21 aa, Staphylococcus
SDKAIKFFVRYGGEKQLKQGF

SEQ ID NO: 2055184 - protein, 24 aa, Staphylococcus
SDKEIFKSLMFYWSDKDNRRINNL

SEQ ID NO: 2055185 - protein, 22 aa, Staphylococcus
SDKELIGVIGLHYLDLVNKRTS

SEQ ID NO: 2055186 - protein, 21 aa, Staphylococcus
SDKRFSYTYMHLLNEIYVDDA

SEQ ID NO: 2055187 - protein, 19 aa, Staphylococcus
SDLIARFAGIRVPRNKAIV

SEQ ID NO: 2055188 - protein, 19 aa, Staphylococcus
SDLISRYAGIRVPKNKAIV

SEQ ID NO: 2055189 - protein, 20 aa, Staphylococcus
SDLISRYAGIRVPRNKAIVG

SEQ ID NO: 2055190 - protein, 19 aa, Staphylococcus
SDLRGLKVWVFAVDEGSEI

SEQ ID NO: 2055191 - protein, 19 aa, Staphylococcus
SDPKLCVIRAIPTSIKLMN

SEQ ID NO: 2055192 - protein, 22 aa, Staphylococcus
SDPLKQKVCDVALMAFENAMAK

SEQ ID NO: 2055193 - protein, 20 aa, Staphylococcus
SDSPGGWQIIGRTPLKVFDI

SEQ ID NO: 2055194 - protein, 20 aa, Staphylococcus
SDSPGGWQIIGRTPLKVFDQ

SEQ ID NO: 2055195 - protein, 19 aa, Staphylococcus
SDVLVCTVIGFPLGANTSA

SEQ ID NO: 2055196 - protein, 23 aa, Staphylococcus
SDVLVCTVVGFPLGASTTATKTF

SEQ ID NO: 2055197 - protein, 21 aa, Staphylococcus
SDVPFCIYSKTAICTGHGEKV

SEQ ID NO: 2055198 - protein, 24 aa, Staphylococcus
SDWNRVGWGRIPMTQGFTYSSNTL

SEQ ID NO: 2055199 - protein, 19 aa, Staphylococcus
SEAILILFPYIFKEQSRAM

SEQ ID NO: 2055200 - protein, 22 aa, Staphylococcus
SEAKFSILMLLSYEENMTLSPS

SEQ ID NO: 2055201 - protein, 19 aa, Staphylococcus
SEAKLKLDDYFALIEQYFK

SEQ ID NO: 2055202 - protein, 17 aa, Staphylococcus
SEALAQVGVCRFSSLET

SEQ ID NO: 2055203 - protein, 19 aa, Staphylococcus
SEALLILFPYIYKKNDVAM

SEQ ID NO: 2055204 - protein, 23 aa, Staphylococcus
SEAMPILGVCLGFQQIVTYFGGD

SEQ ID NO: 2055205 - protein, 18 aa, Staphylococcus
SEAVLLLFPILFKEQDNT

SEQ ID NO: 2055206 - protein, 17 aa, Staphylococcus
SEEALDMVVGFVALEQL

SEQ ID NO: 2055207 - protein, 28 aa, Staphylococcus
SEEEIRFARFRPFPFWKRVHDSFISDGR

SEQ ID NO: 2055208 - protein, 25 aa, Staphylococcus
SEFRNYILGLIFYRFLSEKAEAEVA

SEQ ID NO: 2055209 - protein, 25 aa, Staphylococcus
SEFRNYILGLIFYRFLSEKAETEVA

SEQ ID NO: 2055210 - protein, 17 aa, Staphylococcus
SEFWLQLQADVFNTTVR

SEQ ID NO: 2055211 - protein, 21 aa, Staphylococcus
SEGLKLHIIPAINRLNANIET

SEQ ID NO: 2055212 - protein, 26 aa, Staphylococcus
SEGLLEGFKLLGFDAYFAIPRSKEER

SEQ ID NO: 2055213 - protein, 27 aa, Staphylococcus
SEGLLEGFKLLGFEAYFAIPRSKEERE

SEQ ID NO: 2055214 - protein, 17 aa, Staphylococcus
SEGTICYTGDILNPERS

SEQ ID NO: 2055215 - protein, 17 aa, Staphylococcus
SEGTICYTGDILNPNRS

SEQ ID NO: 2055216 - protein, 18 aa, Staphylococcus
SEGYRPGDFESITVTVDA

SEQ ID NO: 2055217 - protein, 18 aa, Staphylococcus
SEGYRPGDFESITVTVDS

SEQ ID NO: 2055218 - protein, 20 aa, Staphylococcus
SEIDLPILIIASQHGERTTI

SEQ ID NO: 2055219 - protein, 25 aa, Staphylococcus
SEIHFKQGMCLFDIDITCGKGTYIR

SEQ ID NO: 2055220 - protein, 19 aa, Staphylococcus
SEISMMFGISVKDADNAVR

SEQ ID NO: 2055221 - protein, 20 aa, Staphylococcus
SEISMMFGISVKDAEKAVHA

SEQ ID NO: 2055222 - protein, 18 aa, Staphylococcus
SEKWPIFLERSLVDQIIT

SEQ ID NO: 2055223 - protein, 19 aa, Staphylococcus
SEKWPSFLPKALVSDIIKV

SEQ ID NO: 2055224 - protein, 18 aa, Staphylococcus
SEKYKKLWEYYATIAEND

SEQ ID NO: 2055225 - protein, 19 aa, Staphylococcus
SELGRFGVGLPRVSDGQLL

SEQ ID NO: 2055226 - protein, 24 aa, Staphylococcus
SELGSRMRLRIIPDLTFEYDESIE

SEQ ID NO: 2055227 - protein, 23 aa, Staphylococcus
SELGSRMRLRIIPELNFEYDESI

SEQ ID NO: 2055228 - protein, 24 aa, Staphylococcus
SELISRYAGIRVPRNKAIVGQNAF

SEQ ID NO: 2055229 - protein, 23 aa, Staphylococcus
SELKPTPKWSISRYKGLGEMDAD

SEQ ID NO: 2055230 - protein, 20 aa, Staphylococcus
SELLTAFGFKVVDADIAARK

SEQ ID NO: 2055231 - protein, 20 aa, Staphylococcus
SELLTAFGFKVVDADTAARE

SEQ ID NO: 2055232 - protein, 20 aa, Staphylococcus
SELLTAYGFKVVDADVASRK

SEQ ID NO: 2055233 - protein, 21 aa, Staphylococcus
SELPYLLAHGERFLTQTVENI

SEQ ID NO: 2055234 - protein, 21 aa, Staphylococcus
SELYLTIPHRFRIMRYHSLVS

SEQ ID NO: 2055235 - protein, 21 aa, Staphylococcus
SEMNIDLAIDMYKGKYHIYKV

SEQ ID NO: 2055236 - protein, 25 aa, Staphylococcus
SEMNRLLAIKGIGKWTAQYIGMRAL

SEQ ID NO: 2055237 - protein, 18 aa, Staphylococcus
SENDSICCVIDIPYDSYL

SEQ ID NO: 2055238 - protein, 24 aa, Staphylococcus
SENFKIGKFYAFKYDSKLVIHDIL

SEQ ID NO: 2055239 - protein, 22 aa, Staphylococcus
SEPRIKMGILESTSQWMANVIH

SEQ ID NO: 2055240 - protein, 21 aa, Staphylococcus
SEQIVPCWYCRFCNRGQYWMC

SEQ ID NO: 2055241 - protein, 22 aa, Staphylococcus
SERIFELILKFADYGFPRAHAV

SEQ ID NO: 2055242 - protein, 25 aa, Staphylococcus
SESEWKSRLDAMSGKIDWKEDIPED

SEQ ID NO: 2055243 - protein, 22 aa, Staphylococcus
SESVYQCIKSVFKELDTISKQL

SEQ ID NO: 2055244 - protein, 25 aa, Staphylococcus
SETLRVASLLAHTLFDFPSHQLTTY

SEQ ID NO: 2055245 - protein, 18 aa, Staphylococcus
SEVFKLWVDYLFEQNFVH

SEQ ID NO: 2055246 - protein, 20 aa, Staphylococcus
SEVKEFFKDASIQTYQQATE

SEQ ID NO: 2055247 - protein, 20 aa, Staphylococcus
SEVKPGGLLYFHIHDERLKF

SEQ ID NO: 2055248 - protein, 18 aa, Staphylococcus
SEVKRLKADPAFYGEFLD

SEQ ID NO: 2055249 - protein, 18 aa, Staphylococcus
SEVKRLKSDPAFYGDFIE

SEQ ID NO: 2055250 - protein, 24 aa, Staphylococcus
SEVNPRFGGGYPHAYLSGCNFPQF

SEQ ID NO: 2055251 - protein, 19 aa, Staphylococcus
SEVPAHVQAGWMLTTIASI

SEQ ID NO: 2055252 - protein, 19 aa, Staphylococcus
SEVPAHVQAGWMLTTIASV

SEQ ID NO: 2055253 - protein, 17 aa, Staphylococcus
SEVPSAIFGTKKRRPIE

SEQ ID NO: 2055254 - protein, 22 aa, Staphylococcus
SEYQLGLLISRKKYWYKSPNFE

SEQ ID NO: 2055255 - protein, 19 aa, Staphylococcus
SFCVLNHLFVNEGMEDAFE

SEQ ID NO: 2055256 - protein, 21 aa, Staphylococcus
SFDIFKGETFGLVGESGCGKS

SEQ ID NO: 2055257 - protein, 18 aa, Staphylococcus
SFDLMFVKWVPRDKNKEA

SEQ ID NO: 2055258 - protein, 25 aa, Staphylococcus
SFFVKFHWRPVHGLESLVWDEAQTL

SEQ ID NO: 2055259 - protein, 19 aa, Staphylococcus
SFIEMCLLLPNLNEKDYPS

SEQ ID NO: 2055260 - protein, 17 aa, Staphylococcus
SFIESFPLFGYDLDDYD

SEQ ID NO: 2055261 - protein, 25 aa, Staphylococcus
SFINFACPFCKNYFKAADHALTPHI

SEQ ID NO: 2055262 - protein, 19 aa, Staphylococcus
SFKSLKKGVQMIHESLLRA

SEQ ID NO: 2055263 - protein, 19 aa, Staphylococcus
SFMEMCLLLPNLNESSYPS

SEQ ID NO: 2055264 - protein, 18 aa, Staphylococcus
SFMEMCLMLPNLSENQYD

SEQ ID NO: 2055265 - protein, 23 aa, Staphylococcus
SFQFSVALATVWKLISRTNKYID

SEQ ID NO: 2055266 - protein, 24 aa, Staphylococcus
SFQFSVALSTVWKLISRTNKYIDE

SEQ ID NO: 2055267 - protein, 18 aa, Staphylococcus
SFTLPILGTHNMKNATIA

SEQ ID NO: 2055268 - protein, 18 aa, Staphylococcus
SFVECFKKTVTPVVKSYQ

SEQ ID NO: 2055269 - protein, 24 aa, Staphylococcus
SFYIWFKFSISINVKTLFNESIKE

SEQ ID NO: 2055270 - protein, 17 aa, Staphylococcus
SGARPVLKQAILNSKET

SEQ ID NO: 2055271 - protein, 23 aa, Staphylococcus
SGDWLPWQSINDFKDTGWINLPL

SEQ ID NO: 2055272 - protein, 19 aa, Staphylococcus
SGERLPIWIADYVLSSIWY

SEQ ID NO: 2055273 - protein, 17 aa, Staphylococcus
SGFGPRIVRINNFSLDF

SEQ ID NO: 2055274 - protein, 22 aa, Staphylococcus
SGGKRVRPAFVILSSQFGKEMN

SEQ ID NO: 2055275 - protein, 22 aa, Staphylococcus
SGGKRVRPAFVILSSQFGKSKQ

SEQ ID NO: 2055276 - protein, 22 aa, Staphylococcus
SGGKRVRPAFVILSSQFGPQKK

SEQ ID NO: 2055277 - protein, 22 aa, Staphylococcus
SGGKRVRPAFVLLSSQFGPKKI

SEQ ID NO: 2055278 - protein, 22 aa, Staphylococcus
SGGKRVRPVFVILSSQFGTSEG

SEQ ID NO: 2055279 - protein, 18 aa, Staphylococcus
SGGMAQRVAFILSLIRNP

SEQ ID NO: 2055280 - protein, 21 aa, Staphylococcus
SGGQFQRVWIAKALIIQPKLL

SEQ ID NO: 2055281 - protein, 18 aa, Staphylococcus
SGIGREWGDFGIEEFLEV

SEQ ID NO: 2055282 - protein, 19 aa, Staphylococcus
SGIGRSVAILFAKEGANVA

SEQ ID NO: 2055283 - protein, 19 aa, Staphylococcus
SGISRMLATFDWKYNNNPP

SEQ ID NO: 2055284 - protein, 18 aa, Staphylococcus
SGIWKFKLVGYKEHVDVS

SEQ ID NO: 2055285 - protein, 17 aa, Staphylococcus
SGLHLRLDQVPTREPGI

SEQ ID NO: 2055286 - protein, 22 aa, Staphylococcus
SGLKLHLIPAINRLNANIETHN

SEQ ID NO: 2055287 - protein, 18 aa, Staphylococcus
SGLPSYIYTFIGFLPRKE

SEQ ID NO: 2055288 - protein, 20 aa, Staphylococcus
SGNVRRFIKRAEIDDTLEIT

SEQ ID NO: 2055289 - protein, 20 aa, Staphylococcus
SGPGALRCSQFVYKEQKSQK

SEQ ID NO: 2055290 - protein, 18 aa, Staphylococcus
SGQAPRLAIDSHVAGLFD

SEQ ID NO: 2055291 - protein, 19 aa, Staphylococcus
SGQIGRLAFRIPKDSMTSW

SEQ ID NO: 2055292 - protein, 18 aa, Staphylococcus
SGQPLVFLHGWPANNTMF

SEQ ID NO: 2055293 - protein, 19 aa, Staphylococcus
SGSVIPRPIAFVTSEDEKG

SEQ ID NO: 2055294 - protein, 20 aa, Staphylococcus
SGSVIPRPVAFVTTQDKDGN

SEQ ID NO: 2055295 - protein, 26 aa, Staphylococcus
SGTLNRLTSTFLRRQFNIVTLSVTPS

SEQ ID NO: 2055296 - protein, 19 aa, Staphylococcus
SGVGTAKFKKGLAATKTLD

SEQ ID NO: 2055297 - protein, 25 aa, Staphylococcus
SGWTDIFIFPGFNFKAIDGLITNFH

SEQ ID NO: 2055298 - protein, 24 aa, Staphylococcus
SGWTDIFIYPGFEFKAIDGLITNF

SEQ ID NO: 2055299 - protein, 24 aa, Staphylococcus
SGWTDIFIYPGFTYKAIDGLITNF

SEQ ID NO: 2055300 - protein, 20 aa, Staphylococcus
SHGLALGRLRGVEFDVAIFS

SEQ ID NO: 2055301 - protein, 20 aa, Staphylococcus
SHGLALGRLRGVEFDVAVFS

SEQ ID NO: 2055302 - protein, 21 aa, Staphylococcus
SHGLSLGRLRGVDFDVAIFSN

SEQ ID NO: 2055303 - protein, 20 aa, Staphylococcus
SHIKKGIIFPAIFLNQKQII

SEQ ID NO: 2055304 - protein, 18 aa, Staphylococcus
SHLRLIVRSLLGIAVPTQ

SEQ ID NO: 2055305 - protein, 23 aa, Staphylococcus
SHMLWEGFQPFKIVKIEELSSDI

SEQ ID NO: 2055306 - protein, 24 aa, Staphylococcus
SHNWKSWKPMIGDILYYFLNNNHS

SEQ ID NO: 2055307 - protein, 17 aa, Staphylococcus
SHPWDFTDRMIEVIANG

SEQ ID NO: 2055308 - protein, 19 aa, Staphylococcus
SHYLKVRPGAFFLTGCGNP

SEQ ID NO: 2055309 - protein, 19 aa, Staphylococcus
SHYLKVRPGAFFLTGCGNQ

SEQ ID NO: 2055310 - protein, 23 aa, Staphylococcus
SIAQVVLRWLVERDIVVLAKSVN

SEQ ID NO: 2055311 - protein, 19 aa, Staphylococcus
SICGMGGPLIAKILTEGQA

SEQ ID NO: 2055312 - protein, 17 aa, Staphylococcus
SIFGERAMYFVAENGAV

SEQ ID NO: 2055313 - protein, 17 aa, Staphylococcus
SIFTGKRKRLKWVNQLV

SEQ ID NO: 2055314 - protein, 18 aa, Staphylococcus
SIGLILGFLVERFMQDKE

SEQ ID NO: 2055315 - protein, 18 aa, Staphylococcus
SIGTVWPDNVSVFSENVE

SEQ ID NO: 2055316 - protein, 21 aa, Staphylococcus
SIKDWGIELTDTYYVSKFEHP

SEQ ID NO: 2055317 - protein, 25 aa, Staphylococcus
SIKNFRVTKIFGFFGLKREEVNEAY

SEQ ID NO: 2055318 - protein, 24 aa, Staphylococcus
SIKNFRVTKIFGYFGLKREEIEEA

SEQ ID NO: 2055319 - protein, 23 aa, Staphylococcus
SIKQGYCLLVGFGKSSTEQEIET

SEQ ID NO: 2055320 - protein, 21 aa, Staphylococcus
SILKAHEWFHITGITAALNDA

SEQ ID NO: 2055321 - protein, 17 aa, Staphylococcus
SILKRGKLSISVSTNGA

SEQ ID NO: 2055322 - protein, 18 aa, Staphylococcus
SILRRGRLTLSISTNGAS

SEQ ID NO: 2055323 - protein, 19 aa, Staphylococcus
SINTFEWIKPLLERKYPDI

SEQ ID NO: 2055324 - protein, 23 aa, Staphylococcus
SIPELRKRIKLVAEQNYEQIRAL

SEQ ID NO: 2055325 - protein, 24 aa, Staphylococcus
SIPLWKNQMSIALTLMRQRNAVSA

SEQ ID NO: 2055326 - protein, 17 aa, Staphylococcus
SISPELFFQKGIFNGEE

SEQ ID NO: 2055327 - protein, 18 aa, Staphylococcus
SITFTHEFMYTRALYDDD

SEQ ID NO: 2055328 - protein, 17 aa, Staphylococcus
SIVHKFLDNFDVSFTDI

SEQ ID NO: 2055329 - protein, 19 aa, Staphylococcus
SKAFPRVNLTEVYRQQDGS

SEQ ID NO: 2055330 - protein, 17 aa, Staphylococcus
SKAPRVLGFDAIGVVES

SEQ ID NO: 2055331 - protein, 18 aa, Staphylococcus
SKATLSFRTMDLIHKPYH

SEQ ID NO: 2055332 - protein, 18 aa, Staphylococcus
SKATLSFRTMELLHHPFH

SEQ ID NO: 2055333 - protein, 19 aa, Staphylococcus
SKDLFKLLALESQHAGLSW

SEQ ID NO: 2055334 - protein, 24 aa, Staphylococcus
SKDLFWRLILSIAQIGCCPQEFLE

SEQ ID NO: 2055335 - protein, 19 aa, Staphylococcus
SKDTFDWLQALLKRKYPDI

SEQ ID NO: 2055336 - protein, 18 aa, Staphylococcus
SKEAISILEALDIDIDED

SEQ ID NO: 2055337 - protein, 17 aa, Staphylococcus
SKECFKLSAILSKLRIE

SEQ ID NO: 2055338 - protein, 18 aa, Staphylococcus
SKECFKLSAILSKLRIEY

SEQ ID NO: 2055339 - protein, 19 aa, Staphylococcus
SKEEILILLTLWKEGSMTL

SEQ ID NO: 2055340 - protein, 22 aa, Staphylococcus
SKFKRWVIGSIISRTYYHNMVT

SEQ ID NO: 2055341 - protein, 17 aa, Staphylococcus
SKFPLGQAVYFDTEKDG

SEQ ID NO: 2055342 - protein, 18 aa, Staphylococcus
SKGGFYFTDFRGYSTHPQ

SEQ ID NO: 2055343 - protein, 18 aa, Staphylococcus
SKGGFYFTDFRGYSTNLK

SEQ ID NO: 2055344 - protein, 19 aa, Staphylococcus
SKGGFYFTDFRGYSTNPLG

SEQ ID NO: 2055345 - protein, 18 aa, Staphylococcus
SKGGFYFTDFRGYSTQPQ

SEQ ID NO: 2055346 - protein, 19 aa, Staphylococcus
SKHIGGFPVSGLFLVCRDE

SEQ ID NO: 2055347 - protein, 19 aa, Staphylococcus
SKIKNLRMGYLTQQMTLNS

SEQ ID NO: 2055348 - protein, 20 aa, Staphylococcus
SKIKTILHGLNFTETDFDRP

SEQ ID NO: 2055349 - protein, 19 aa, Staphylococcus
SKIKTVLHGLDFSEDDFHR

SEQ ID NO: 2055350 - protein, 20 aa, Staphylococcus
SKIKTVLHGLNFNEDDFDKP

SEQ ID NO: 2055351 - protein, 20 aa, Staphylococcus
SKIKTVLHGLNFNEDDFNKP

SEQ ID NO: 2055352 - protein, 20 aa, Staphylococcus
SKIKTVLHGLNFTEEEFDKP

SEQ ID NO: 2055353 - protein, 20 aa, Staphylococcus
SKIKTVLHGLNFTESDFNKP

SEQ ID NO: 2055354 - protein, 20 aa, Staphylococcus
SKIKTVLHGLNFTESDFNRP

SEQ ID NO: 2055355 - protein, 18 aa, Staphylococcus
SKKLGLNMKVIQKAKSMI

SEQ ID NO: 2055356 - protein, 19 aa, Staphylococcus
SKKPMVVEFEFKLRNQYFK

SEQ ID NO: 2055357 - protein, 17 aa, Staphylococcus
SKLTLLALFEKLLSISS

SEQ ID NO: 2055358 - protein, 23 aa, Staphylococcus
SKMPLNKRMHAVRQRLGNVDWTG

SEQ ID NO: 2055359 - protein, 22 aa, Staphylococcus
SKNLPFILGEGVDSDNGILANN

SEQ ID NO: 2055360 - protein, 20 aa, Staphylococcus
SKQARPLLRDTLARNNNVVK

SEQ ID NO: 2055361 - protein, 21 aa, Staphylococcus
SKRAISIHGCTGHESVAYIGG

SEQ ID NO: 2055362 - protein, 22 aa, Staphylococcus
SKRDLPYGRALIIYSDSSIVEN

SEQ ID NO: 2055363 - protein, 25 aa, Staphylococcus
SKSEWLKRAEIFIDGFYNFSTLEYR

SEQ ID NO: 2055364 - protein, 22 aa, Staphylococcus
SKSHHQLIFFGRYHCIARKPKC

SEQ ID NO: 2055365 - protein, 18 aa, Staphylococcus
SKTESCFFSIFVSPDYQE

SEQ ID NO: 2055366 - protein, 20 aa, Staphylococcus
SKTEYRGREATDFKEEDIEL

SEQ ID NO: 2055367 - protein, 21 aa, Staphylococcus
SKTEYRGREATDFKEEDIELF

SEQ ID NO: 2055368 - protein, 20 aa, Staphylococcus
SKTLTKWQSWFNMDIIEENE

SEQ ID NO: 2055369 - protein, 23 aa, Staphylococcus
SKVTFDLPIVWAQSTRYLNSQDS

SEQ ID NO: 2055370 - protein, 18 aa, Staphylococcus
SLAMCFRETFNQNEAADE

SEQ ID NO: 2055371 - protein, 22 aa, Staphylococcus
SLAMCLRESFNFEDAASELEQA

SEQ ID NO: 2055372 - protein, 19 aa, Staphylococcus
SLCGWGEKHIEVMKENEEL

SEQ ID NO: 2055373 - protein, 18 aa, Staphylococcus
SLEFPFDIVIDANESLDI

SEQ ID NO: 2055374 - protein, 17 aa, Staphylococcus
SLEHLLFGLGIRHLGVK

SEQ ID NO: 2055375 - protein, 18 aa, Staphylococcus
SLEHLLFGLGIRHLGVKA

SEQ ID NO: 2055376 - protein, 18 aa, Staphylococcus
SLEQLVAYFFKWLNDTRG

SEQ ID NO: 2055377 - protein, 19 aa, Staphylococcus
SLESLRIPGYMVVLDTGIK

SEQ ID NO: 2055378 - protein, 22 aa, Staphylococcus
SLKDSRFPFSIMWIEELGEFKT

SEQ ID NO: 2055379 - protein, 19 aa, Staphylococcus
SLLDEFREGLLIGTACDEG

SEQ ID NO: 2055380 - protein, 24 aa, Staphylococcus
SLLGGTCLHKGCIPTKALLKSAEV

SEQ ID NO: 2055381 - protein, 17 aa, Staphylococcus
SLLPKYRGGAPIHQAII

SEQ ID NO: 2055382 - protein, 19 aa, Staphylococcus
SLLPKYRGGAPIHQAIIDG

SEQ ID NO: 2055383 - protein, 19 aa, Staphylococcus
SLLPKYRGGAPIHQAIMDG

SEQ ID NO: 2055384 - protein, 19 aa, Staphylococcus
SLNVFRMELLGAKVESVTE

SEQ ID NO: 2055385 - protein, 19 aa, Staphylococcus
SLNVRRVFFSTFDRSELND

SEQ ID NO: 2055386 - protein, 24 aa, Staphylococcus
SLQFSVALSTVWKFISRTNKYIDE

SEQ ID NO: 2055387 - protein, 22 aa, Staphylococcus
SLQPRMDICFVREKGSGTRFYQ

SEQ ID NO: 2055388 - protein, 17 aa, Staphylococcus
SLRKIKGGFTFAVLTKD

SEQ ID NO: 2055389 - protein, 20 aa, Staphylococcus
SLSLYPIVPMNFYERYQYLL

SEQ ID NO: 2055390 - protein, 17 aa, Staphylococcus
SLTFHAACDEWFENYKL

SEQ ID NO: 2055391 - protein, 23 aa, Staphylococcus
SLTGGCPMGPFIVTKDELPTPEN

SEQ ID NO: 2055392 - protein, 21 aa, Staphylococcus
SLTGGCPMGPYIVTKDELPTP

SEQ ID NO: 2055393 - protein, 18 aa, Staphylococcus
SLYYKFDYLVSVSEETCK

SEQ ID NO: 2055394 - protein, 20 aa, Staphylococcus
SMGGRIGLYYALYGQAQLTG

SEQ ID NO: 2055395 - protein, 22 aa, Staphylococcus
SMGGRTALYYALHGKIKLEGLI

SEQ ID NO: 2055396 - protein, 22 aa, Staphylococcus
SMGGRVALYYALHGSIELAGLI

SEQ ID NO: 2055397 - protein, 19 aa, Staphylococcus
SMLERYVFDGAFTYQCGDE

SEQ ID NO: 2055398 - protein, 24 aa, Staphylococcus
SMLKFILKVFLDLEFIKDENGIIK

SEQ ID NO: 2055399 - protein, 22 aa, Staphylococcus
SMLPKIQAAIEFAKTGKEAIIC

SEQ ID NO: 2055400 - protein, 18 aa, Staphylococcus
SMMFYTCILDMIKDEETA

SEQ ID NO: 2055401 - protein, 18 aa, Staphylococcus
SMMFYTCILDMMKVEETA

SEQ ID NO: 2055402 - protein, 18 aa, Staphylococcus
SMSWLQQHMDGWLFYAQP

SEQ ID NO: 2055403 - protein, 25 aa, Staphylococcus
SNALYRIAKDLDIGFISLYRALGDF

SEQ ID NO: 2055404 - protein, 17 aa, Staphylococcus
SNCGIGFKGFYDEVNGF

SEQ ID NO: 2055405 - protein, 18 aa, Staphylococcus
SNFNIKHFVDYAEKLQYP

SEQ ID NO: 2055406 - protein, 17 aa, Staphylococcus
SNFTTGWIFFINEEGDH

SEQ ID NO: 2055407 - protein, 18 aa, Staphylococcus
SNFTTGWIFFINKKGEQE

SEQ ID NO: 2055408 - protein, 23 aa, Staphylococcus
SNGKEFRHGCDCSMIAAGKEAEQ

SEQ ID NO: 2055409 - protein, 19 aa, Staphylococcus
SNGVKRFKFKDNKSELELD

SEQ ID NO: 2055410 - protein, 23 aa, Staphylococcus
SNLPFELIGAIPVLIKKNGNIDE

SEQ ID NO: 2055411 - protein, 17 aa, Staphylococcus
SNPEAYILLGYNETTNN

SEQ ID NO: 2055412 - protein, 24 aa, Staphylococcus
SNPYHFGATIGRYAGRIGNAKFHL

SEQ ID NO: 2055413 - protein, 20 aa, Staphylococcus
SNQFKSCFKALMTKKETNLE

SEQ ID NO: 2055414 - protein, 22 aa, Staphylococcus
SNTRSAIYLHMCKLAANPDIAI

SEQ ID NO: 2055415 - protein, 17 aa, Staphylococcus
SNTSWPLAMPVFKMDYA

SEQ ID NO: 2055416 - protein, 21 aa, Staphylococcus
SNVTDAIKWVLGEQSAKSLRG

SEQ ID NO: 2055417 - protein, 19 aa, Staphylococcus
SNYVNFQFDLPIADGSEQL

SEQ ID NO: 2055418 - protein, 21 aa, Staphylococcus
SPAQVVIRWNIEHGVVTIPKS

SEQ ID NO: 2055419 - protein, 25 aa, Staphylococcus
SPCGKCYYCKKGIYAHCEKDGGWIL

SEQ ID NO: 2055420 - protein, 23 aa, Staphylococcus
SPDDFKFGLSFLTKAVSLSRFQW

SEQ ID NO: 2055421 - protein, 17 aa, Staphylococcus
SPDSTTFYAHFPKKGMY

SEQ ID NO: 2055422 - protein, 24 aa, Staphylococcus
SPETARQLALVWGVFPVVKKGRKT

SEQ ID NO: 2055423 - protein, 24 aa, Staphylococcus
SPFGEGRPGWHIECSVMAFHELGK

SEQ ID NO: 2055424 - protein, 24 aa, Staphylococcus
SPFGEGRPGWHIECSVMAFHELGP

SEQ ID NO: 2055425 - protein, 24 aa, Staphylococcus
SPFGEGRPGWHIECSVMAYHELGA

SEQ ID NO: 2055426 - protein, 24 aa, Staphylococcus
SPFGEGRPGWHIECSVMAYHELGK

SEQ ID NO: 2055427 - protein, 24 aa, Staphylococcus
SPFGQGRPGWHIECSVMAYHELGK

SEQ ID NO: 2055428 - protein, 20 aa, Staphylococcus
SPFHWRFIDKLTLSTIHEVV

SEQ ID NO: 2055429 - protein, 20 aa, Staphylococcus
SPFHWRLLDKLALNTLHEVV

SEQ ID NO: 2055430 - protein, 20 aa, Staphylococcus
SPGLRIGWIVANKNVIRHLS

SEQ ID NO: 2055431 - protein, 19 aa, Staphylococcus
SPGSLSFVFDEFAVVGDTL

SEQ ID NO: 2055432 - protein, 18 aa, Staphylococcus
SPGSLSYVFNDFAIVGDT

SEQ ID NO: 2055433 - protein, 24 aa, Staphylococcus
SPKPRLPFEHVFHANKYDSDKDSQ

SEQ ID NO: 2055434 - protein, 23 aa, Staphylococcus
SPKPRLPFELIFHKNVYNSNKAH

SEQ ID NO: 2055435 - protein, 17 aa, Staphylococcus
SPLWKVMDFMILDKAEE

SEQ ID NO: 2055436 - protein, 17 aa, Staphylococcus
SPRRAGTVIIRVEVDEH

SEQ ID NO: 2055437 - protein, 18 aa, Staphylococcus
SPVVFKLAAEHQVDLTQV

SEQ ID NO: 2055438 - protein, 18 aa, Staphylococcus
SQALTCYYGGKVVQGETV

SEQ ID NO: 2055439 - protein, 23 aa, Staphylococcus
SQELDKLMLFLGDRPTINKDDVN

SEQ ID NO: 2055440 - protein, 19 aa, Staphylococcus
SQFAFLNLMKHMFKNEAYR

SEQ ID NO: 2055441 - protein, 18 aa, Staphylococcus
SQFGEKLILPALFPSKFQ

SEQ ID NO: 2055442 - protein, 18 aa, Staphylococcus
SQIKRIGFDYLFIDNAHL

SEQ ID NO: 2055443 - protein, 23 aa, Staphylococcus
SQIKRLKFEYLFIDNAKLKTSYL

SEQ ID NO: 2055444 - protein, 17 aa, Staphylococcus
SQIQDWIKHELVIVNGK

SEQ ID NO: 2055445 - protein, 18 aa, Staphylococcus
SQIRRFEIKLGDKVTGKV

SEQ ID NO: 2055446 - protein, 18 aa, Staphylococcus
SQKLWAWSKLIDEHKEEL

SEQ ID NO: 2055447 - protein, 21 aa, Staphylococcus
SQKSNGRWARNFVQELLVRHK

SEQ ID NO: 2055448 - protein, 19 aa, Staphylococcus
SQLELKMYFNIDDLLTSDN

SEQ ID NO: 2055449 - protein, 22 aa, Staphylococcus
SQLFSFFIGYHFNKFELTFEKL

SEQ ID NO: 2055450 - protein, 18 aa, Staphylococcus
SQLLKLKQWHDAQFQQLQ

SEQ ID NO: 2055451 - protein, 17 aa, Staphylococcus
SQLPQLFGFQAEGASPI

SEQ ID NO: 2055452 - protein, 17 aa, Staphylococcus
SQMYRPRLHCVRQDFFN

SEQ ID NO: 2055453 - protein, 25 aa, Staphylococcus
SQPRRPCWKPGRRVRWIEWGRRIQE

SEQ ID NO: 2055454 - protein, 17 aa, Staphylococcus
SQWRRPALRNFNTKVEI

SEQ ID NO: 2055455 - protein, 19 aa, Staphylococcus
SQYLIDILENFVLERGIYG

SEQ ID NO: 2055456 - protein, 19 aa, Staphylococcus
SRFAEEIIFWSSAEANFIT

SEQ ID NO: 2055457 - protein, 20 aa, Staphylococcus
SRIAYVVEFFEWFNTLETFK

SEQ ID NO: 2055458 - protein, 18 aa, Staphylococcus
SRIGEPFVGYSDIFSFNN

SEQ ID NO: 2055459 - protein, 18 aa, Staphylococcus
SRIGEPFVGYSDVFSFNS

SEQ ID NO: 2055460 - protein, 18 aa, Staphylococcus
SRKSALDGNVNWVDEIPE

SEQ ID NO: 2055461 - protein, 17 aa, Staphylococcus
SRLDAMKDKIDWRDDLP

SEQ ID NO: 2055462 - protein, 19 aa, Staphylococcus
SRLDFGDFILGGHRFTDAH

SEQ ID NO: 2055463 - protein, 21 aa, Staphylococcus
SRLEFLYNVGLEYLTLNRASG

SEQ ID NO: 2055464 - protein, 17 aa, Staphylococcus
SRLKGEHFGDFVIRSGV

SEQ ID NO: 2055465 - protein, 20 aa, Staphylococcus
SRLNLFLGGIDRYGLEFEYL

SEQ ID NO: 2055466 - protein, 19 aa, Staphylococcus
SRLQTNLIHRVDEAVQIQP

SEQ ID NO: 2055467 - protein, 19 aa, Staphylococcus
SRPIVYVSLGTVFNQNIGF

SEQ ID NO: 2055468 - protein, 19 aa, Staphylococcus
SRPYIANMLRLLKLPSDVA

SEQ ID NO: 2055469 - protein, 19 aa, Staphylococcus
SRPYIANMLRLLNLPQTVS

SEQ ID NO: 2055470 - protein, 21 aa, Staphylococcus
SRRFLDRVWRLFINEDDSLSQ

SEQ ID NO: 2055471 - protein, 18 aa, Staphylococcus
SRRFLDRVWRLLINEDGS

SEQ ID NO: 2055472 - protein, 17 aa, Staphylococcus
SRRKVLEKIERIDKPML

SEQ ID NO: 2055473 - protein, 22 aa, Staphylococcus
SRSHHQLIFFGRYHCLARKPKC

SEQ ID NO: 2055474 - protein, 19 aa, Staphylococcus
SRSIPIFVFLNDNFEQENV

SEQ ID NO: 2055475 - protein, 17 aa, Staphylococcus
SRTKLLVSIRRLIEKEK

SEQ ID NO: 2055476 - protein, 17 aa, Staphylococcus
SRTKLLVSIRRLIEKER

SEQ ID NO: 2055477 - protein, 20 aa, Staphylococcus
SRTSGWLAHIFEQYRDNRIM

SEQ ID NO: 2055478 - protein, 23 aa, Staphylococcus
SRYCFDKAFLGMNGLDLKYGLTT

SEQ ID NO: 2055479 - protein, 24 aa, Staphylococcus
SRYLFQRLHFYLVDIFRKKSRQLN

SEQ ID NO: 2055480 - protein, 21 aa, Staphylococcus
SSAMPAFWFDPLINLTAISQV

SEQ ID NO: 2055481 - protein, 24 aa, Staphylococcus
SSASIEILMGWLLKALFNLEVERL

SEQ ID NO: 2055482 - protein, 24 aa, Staphylococcus
SSCGKCYYCKKGIYAHCENDGGWI

SEQ ID NO: 2055483 - protein, 25 aa, Staphylococcus
SSCGKCYYCKKGIYAHCENDGGWIL

SEQ ID NO: 2055484 - protein, 22 aa, Staphylococcus
SSDEFKFGLSFLTRSVSLARFP

SEQ ID NO: 2055485 - protein, 23 aa, Staphylococcus
SSDYLLCKAFGKTATNIEKYTSQ

SEQ ID NO: 2055486 - protein, 25 aa, Staphylococcus
SSEILELYFRIVIAYLKDDDGIIDS

SEQ ID NO: 2055487 - protein, 17 aa, Staphylococcus
SSFRGLFQFIRFIDELI

SEQ ID NO: 2055488 - protein, 21 aa, Staphylococcus
SSFRGLFQFIRFIDELIDRGR

SEQ ID NO: 2055489 - protein, 22 aa, Staphylococcus
SSGIIKKLFLLGIMANINQSLD

SEQ ID NO: 2055490 - protein, 21 aa, Staphylococcus
SSGIIKKLFLLGIVANINQAL

SEQ ID NO: 2055491 - protein, 17 aa, Staphylococcus
SSGRMVGIISHVSELKQ

SEQ ID NO: 2055492 - protein, 17 aa, Staphylococcus
SSGRMVGIISHVTELKQ

SEQ ID NO: 2055493 - protein, 17 aa, Staphylococcus
SSGWEWENGFIKMDTLE

SEQ ID NO: 2055494 - protein, 17 aa, Staphylococcus
SSIEDWGKYIIKQPRFS

SEQ ID NO: 2055495 - protein, 20 aa, Staphylococcus
SSKALLLYRLIEGLISENSN

SEQ ID NO: 2055496 - protein, 17 aa, Staphylococcus
SSMKKYVPKDCIFISLC

SEQ ID NO: 2055497 - protein, 17 aa, Staphylococcus
SSPDVFKALDLNIAHAV

SEQ ID NO: 2055498 - protein, 19 aa, Staphylococcus
STETFLFIWGWNEGKEIFS

SEQ ID NO: 2055499 - protein, 17 aa, Staphylococcus
STGRMVGIISHVSELKQ

SEQ ID NO: 2055500 - protein, 18 aa, Staphylococcus
STHLLKLKRWHDIQLQES

SEQ ID NO: 2055501 - protein, 19 aa, Staphylococcus
STHPVLFKKAKKITTFDEN

SEQ ID NO: 2055502 - protein, 23 aa, Staphylococcus
STISVNINHHFIKSFPIFSSLIN

SEQ ID NO: 2055503 - protein, 24 aa, Staphylococcus
STLGLRWLVNYARLRGEKTMEERL

SEQ ID NO: 2055504 - protein, 17 aa, Staphylococcus
STLNWPMSVIRLKSENR

SEQ ID NO: 2055505 - protein, 22 aa, Staphylococcus
STMIPMCHPLPLTGIDITFSWS

SEQ ID NO: 2055506 - protein, 18 aa, Staphylococcus
STNTFPSWKRAHPNRLLM

SEQ ID NO: 2055507 - protein, 17 aa, Staphylococcus
STRLESSLFFPPYKGKF

SEQ ID NO: 2055508 - protein, 23 aa, Staphylococcus
SVAERLFYEYGFKGVGLKQIIQE

SEQ ID NO: 2055509 - protein, 20 aa, Staphylococcus
SVAINSMLLSLLYKNHPEEL

SEQ ID NO: 2055510 - protein, 22 aa, Staphylococcus
SVEIAIKMAYQYWKNKNPEKYA

SEQ ID NO: 2055511 - protein, 17 aa, Staphylococcus
SVEKWAVSDSLPFNVND

SEQ ID NO: 2055512 - protein, 20 aa, Staphylococcus
SVFNMMNWWFEKGIDGFRVD

SEQ ID NO: 2055513 - protein, 20 aa, Staphylococcus
SVHVPRRIKEIGPRIKKVTD

SEQ ID NO: 2055514 - protein, 25 aa, Staphylococcus
SVKNFRVTKLFGFFGLKREEIQEAH

SEQ ID NO: 2055515 - protein, 18 aa, Staphylococcus
SVLKRFKAMLLQKNETVE

SEQ ID NO: 2055516 - protein, 22 aa, Staphylococcus
SVMSRYEFVGPITFRCGTNIME

SEQ ID NO: 2055517 - protein, 18 aa, Staphylococcus
SVNSEWMIPKILEMKHKA

SEQ ID NO: 2055518 - protein, 24 aa, Staphylococcus
SVQETRPGFKLVRPLLNVTKRVIR

SEQ ID NO: 2055519 - protein, 24 aa, Staphylococcus
SVQFLKKEVSAFIGDKNVKSIGIA

SEQ ID NO: 2055520 - protein, 20 aa, Staphylococcus
SVRVDKKWARPDYIFPGNQV

SEQ ID NO: 2055521 - protein, 23 aa, Staphylococcus
SVVLRYGLLYGPGTWYGKDGMIY

SEQ ID NO: 2055522 - protein, 20 aa, Staphylococcus
SWLTYEEFFILRGFIESAIK

SEQ ID NO: 2055523 - protein, 18 aa, Staphylococcus
SYDAMAIVHECRKMGVPC

SEQ ID NO: 2055524 - protein, 17 aa, Staphylococcus
SYFKLTIQGEGGHGSSP

SEQ ID NO: 2055525 - protein, 17 aa, Staphylococcus
SYIEYALFHYHFKSRIS

SEQ ID NO: 2055526 - protein, 18 aa, Staphylococcus
SYKALFIRKEMNLEKEGL

SEQ ID NO: 2055527 - protein, 23 aa, Staphylococcus
SYKQLERLGGVGLHLRNQIYQII

SEQ ID NO: 2055528 - protein, 18 aa, Staphylococcus
SYLAEWLPFVAYTNQVED

SEQ ID NO: 2055529 - protein, 22 aa, Staphylococcus
SYLKEFANLYALLIPKVHNMDD

SEQ ID NO: 2055530 - protein, 22 aa, Staphylococcus
SYLKEFTNLYALLIPKAPSMKD

SEQ ID NO: 2055531 - protein, 23 aa, Staphylococcus
SYLKEFTNLYALLIPKVHTMQDV

SEQ ID NO: 2055532 - protein, 19 aa, Staphylococcus
SYMPTWRGTVGKVKKSTEV

SEQ ID NO: 2055533 - protein, 24 aa, Staphylococcus
SYPQEPRMPFSIITASRLASEKHV

SEQ ID NO: 2055534 - protein, 17 aa, Staphylococcus
SYRAILIYFDNKRIEGN

SEQ ID NO: 2055535 - protein, 18 aa, Staphylococcus
SYSLGMKQKLGIAIAFLN

SEQ ID NO: 2055536 - protein, 18 aa, Staphylococcus
SYSYLIFVQETWSLLHEN

SEQ ID NO: 2055537 - protein, 17 aa, Staphylococcus
SYTRRLYAKLGYTNTDS

SEQ ID NO: 2055538 - protein, 18 aa, Staphylococcus
SYYKGAFLKCYLKNDKNH

SEQ ID NO: 2055539 - protein, 19 aa, Staphylococcus
TADQIPVVYCLDKIAKQNL

SEQ ID NO: 2055540 - protein, 20 aa, Staphylococcus
TAELTFALVLAVARRIPEGD

SEQ ID NO: 2055541 - protein, 21 aa, Staphylococcus
TAEYDFRWQPDILSRSIRDLK

SEQ ID NO: 2055542 - protein, 17 aa, Staphylococcus
TAKFEGLIHRFRRSFLL

SEQ ID NO: 2055543 - protein, 25 aa, Staphylococcus
TAKFEGLIHRFRRSFLLNDNFEKKR

SEQ ID NO: 2055544 - protein, 18 aa, Staphylococcus
TALALEMIHTYSLIHDDL

SEQ ID NO: 2055545 - protein, 24 aa, Staphylococcus
TALGFAGGFPGEFIAQTLEESQIK

SEQ ID NO: 2055546 - protein, 23 aa, Staphylococcus
TALGFTGGFPGEFIKDTLAANEI

SEQ ID NO: 2055547 - protein, 19 aa, Staphylococcus
TALMLFVKRCKVMADQHQL

SEQ ID NO: 2055548 - protein, 17 aa, Staphylococcus
TALPVVAGFGIRTTDHI

SEQ ID NO: 2055549 - protein, 25 aa, Staphylococcus
TAMNRKGYYLYGYRHFSSRIMGGHT

SEQ ID NO: 2055550 - protein, 20 aa, Staphylococcus
TARFKYELAEEFGVSDRSVH

SEQ ID NO: 2055551 - protein, 24 aa, Staphylococcus
TARKFGIEVFNVFLSQEAITEDIE

SEQ ID NO: 2055552 - protein, 23 aa, Staphylococcus
TAVCGLARCIKSDIDAVYEATKH

SEQ ID NO: 2055553 - protein, 19 aa, Staphylococcus
TCCGCGFHSKFLIDKGHHV

SEQ ID NO: 2055554 - protein, 18 aa, Staphylococcus
TCEFEFKKDYPALYNDPE

SEQ ID NO: 2055555 - protein, 21 aa, Staphylococcus
TCFQFNVPFIVTRAVSDLANG

SEQ ID NO: 2055556 - protein, 20 aa, Staphylococcus
TCGSGSLLLRVGKETKVYRY

SEQ ID NO: 2055557 - protein, 20 aa, Staphylococcus
TCGSGSLLLRVGKETTVYRY

SEQ ID NO: 2055558 - protein, 18 aa, Staphylococcus
TCVKGKFSWGHINSDQRL

SEQ ID NO: 2055559 - protein, 25 aa, Staphylococcus
TCYQFKVPFIITRAVSDLANGEANM

SEQ ID NO: 2055560 - protein, 17 aa, Staphylococcus
TDEGLDEVVEWIERDTL

SEQ ID NO: 2055561 - protein, 18 aa, Staphylococcus
TDFTTGWIFFIDDVGQHE

SEQ ID NO: 2055562 - protein, 17 aa, Staphylococcus
TDGPCLFTSIKDIPYSE

SEQ ID NO: 2055563 - protein, 17 aa, Staphylococcus
TDGRMKALVSITLDESF

SEQ ID NO: 2055564 - protein, 18 aa, Staphylococcus
TDGRMKALVSITLDKAFV

SEQ ID NO: 2055565 - protein, 21 aa, Staphylococcus
TDHHIPFVFIDRINNEHNGIS

SEQ ID NO: 2055566 - protein, 19 aa, Staphylococcus
TDIPFCIYNKTAVCTGRGE

SEQ ID NO: 2055567 - protein, 19 aa, Staphylococcus
TDIPFCIYNRTAVCKGRGE

SEQ ID NO: 2055568 - protein, 22 aa, Staphylococcus
TDIYNRIGFDFGTLGNHEFNYG

SEQ ID NO: 2055569 - protein, 17 aa, Staphylococcus
TDKALREIMSYGVLTVE

SEQ ID NO: 2055570 - protein, 22 aa, Staphylococcus
TDLCVPFICLNGAEVRDETFNI

SEQ ID NO: 2055571 - protein, 17 aa, Staphylococcus
TDLKVAIVVSRFNDFIT

SEQ ID NO: 2055572 - protein, 18 aa, Staphylococcus
TDLRMMIAALKIASEFER

SEQ ID NO: 2055573 - protein, 23 aa, Staphylococcus
TDMKGGLAALVIAMIEIKASGHL

SEQ ID NO: 2055574 - protein, 22 aa, Staphylococcus
TDPKSKESLAFDSLDSQSENEQ

SEQ ID NO: 2055575 - protein, 17 aa, Staphylococcus
TDRIAARIVEYFQGNTE

SEQ ID NO: 2055576 - protein, 22 aa, Staphylococcus
TDTGWIPLPLVNGAAPDVYSDV

SEQ ID NO: 2055577 - protein, 19 aa, Staphylococcus
TDTIVWGRKTYEMMYDDYW

SEQ ID NO: 2055578 - protein, 21 aa, Staphylococcus
TDTPLRYSLPFNEANRYLVMP

SEQ ID NO: 2055579 - protein, 19 aa, Staphylococcus
TDVALPWERVDKVDVLKEA

SEQ ID NO: 2055580 - protein, 17 aa, Staphylococcus
TDVIPLPTFTSLRKVSV

SEQ ID NO: 2055581 - protein, 23 aa, Staphylococcus
TDVLVCTVIGFPLGASTKEVKAF

SEQ ID NO: 2055582 - protein, 17 aa, Staphylococcus
TDVMLAAYGYKLMDEKI

SEQ ID NO: 2055583 - protein, 19 aa, Staphylococcus
TDVPFCIYNQTALCTGLGE

SEQ ID NO: 2055584 - protein, 17 aa, Staphylococcus
TDYKVCVLLDMHVGHLR

SEQ ID NO: 2055585 - protein, 21 aa, Staphylococcus
TEAIKPVPHRSFLDKTLKRKA

SEQ ID NO: 2055586 - protein, 19 aa, Staphylococcus
TEALPNWAAENGYPVTNYE

SEQ ID NO: 2055587 - protein, 17 aa, Staphylococcus
TECWYILDAEPGSEIIY

SEQ ID NO: 2055588 - protein, 19 aa, Staphylococcus
TEELYFKAWEGLYHEIHNE

SEQ ID NO: 2055589 - protein, 17 aa, Staphylococcus
TEFCGVCHTDLHVKNAD

SEQ ID NO: 2055590 - protein, 17 aa, Staphylococcus
TEFGVWHPHAWDYAPKP

SEQ ID NO: 2055591 - protein, 17 aa, Staphylococcus
TEFKIVPLLIFSAMHYL

SEQ ID NO: 2055592 - protein, 20 aa, Staphylococcus
TEFPFSELISFKEVQDQLGL

SEQ ID NO: 2055593 - protein, 17 aa, Staphylococcus
TEFPFSELISFKEVQEE

SEQ ID NO: 2055594 - protein, 23 aa, Staphylococcus
TEGRYGTFAKYFTKNDVPAFAIC

SEQ ID NO: 2055595 - protein, 20 aa, Staphylococcus
TEIIPSYRAILIYFDNKRIE

SEQ ID NO: 2055596 - protein, 19 aa, Staphylococcus
TEIPHGWMMIEADATNLVK

SEQ ID NO: 2055597 - protein, 19 aa, Staphylococcus
TEIRKHIGIVFQNPENQFV

SEQ ID NO: 2055598 - protein, 23 aa, Staphylococcus
TEIYVCGGKSFIQSMIKSLKELN

SEQ ID NO: 2055599 - protein, 24 aa, Staphylococcus
TEIYVCGGNSFLKAMIAELQTLGI

SEQ ID NO: 2055600 - protein, 17 aa, Staphylococcus
TEKLYDRLIYRYGSSNS

SEQ ID NO: 2055601 - protein, 17 aa, Staphylococcus
TELKHFIPREHIEGRDI

SEQ ID NO: 2055602 - protein, 19 aa, Staphylococcus
TELKRCINKVIILLPLNKP

SEQ ID NO: 2055603 - protein, 23 aa, Staphylococcus
TELKRTICSIIRRDNRKNDIQLM

SEQ ID NO: 2055604 - protein, 19 aa, Staphylococcus
TEPKLSLPTARSIIAIAVG

SEQ ID NO: 2055605 - protein, 21 aa, Staphylococcus
TEPLKRFGIPKTLHASRVDNV

SEQ ID NO: 2055606 - protein, 19 aa, Staphylococcus
TEPSYRDDIDWGNINQPIE

SEQ ID NO: 2055607 - protein, 22 aa, Staphylococcus
TERLKQHFPAIVSIKQNVNDTH

SEQ ID NO: 2055608 - protein, 23 aa, Staphylococcus
TERYCLYRKFYPNSQVVKFEDFF

SEQ ID NO: 2055609 - protein, 18 aa, Staphylococcus
TESGKLFLHYAKIICQNY

SEQ ID NO: 2055610 - protein, 24 aa, Staphylococcus
TESKLTVAMGYRINNEPLLMDIAK

SEQ ID NO: 2055611 - protein, 20 aa, Staphylococcus
TESLSLFIQQTMRAMRYQLN

SEQ ID NO: 2055612 - protein, 23 aa, Staphylococcus
TETEVINVFPIRFVVDKDNEVSD

SEQ ID NO: 2055613 - protein, 23 aa, Staphylococcus
TETYHPAMLILLFQVFYEFQEKQ

SEQ ID NO: 2055614 - protein, 17 aa, Staphylococcus
TEVDDWLYGRGVSDMKG

SEQ ID NO: 2055615 - protein, 20 aa, Staphylococcus
TEVKKAGALLVIGNFSKTAL

SEQ ID NO: 2055616 - protein, 19 aa, Staphylococcus
TEVPLELYLSVLGMPGQTA

SEQ ID NO: 2055617 - protein, 17 aa, Staphylococcus
TEYRGREATDFKEEDIE

SEQ ID NO: 2055618 - protein, 21 aa, Staphylococcus
TEYYAGLSFRTLMPKLPILTP

SEQ ID NO: 2055619 - protein, 19 aa, Staphylococcus
TEYYWHWDLKNSGLDVYEY

SEQ ID NO: 2055620 - protein, 21 aa, Staphylococcus
TFAEMAIKVAHYLDIDEISFG

SEQ ID NO: 2055621 - protein, 17 aa, Staphylococcus
TFFPPYTFEEWEVESSV

SEQ ID NO: 2055622 - protein, 17 aa, Staphylococcus
TFGFSRMFRKECPTCGS

SEQ ID NO: 2055623 - protein, 20 aa, Staphylococcus
TFKPELLTILGRTHNTQDIY

SEQ ID NO: 2055624 - protein, 21 aa, Staphylococcus
TFKRRVDKSINEWEIDLDQTF

SEQ ID NO: 2055625 - protein, 18 aa, Staphylococcus
TFLRPCHIAKMISRYMIL

SEQ ID NO: 2055626 - protein, 17 aa, Staphylococcus
TFPESFKVFGSEHSKVI

SEQ ID NO: 2055627 - protein, 21 aa, Staphylococcus
TFSRKGLREGYVMHHLNEKYP

SEQ ID NO: 2055628 - protein, 19 aa, Staphylococcus
TFVIISFKHRIILIGGTEY

SEQ ID NO: 2055629 - protein, 23 aa, Staphylococcus
TFYFPYRLIIRFNPTPSLNIEVD

SEQ ID NO: 2055630 - protein, 20 aa, Staphylococcus
TGALLKFAVMAAVDIAEPEN

SEQ ID NO: 2055631 - protein, 18 aa, Staphylococcus
TGALLKFSILSAADIANV

SEQ ID NO: 2055632 - protein, 18 aa, Staphylococcus
TGHIKVRFHNGSEYLAVS

SEQ ID NO: 2055633 - protein, 19 aa, Staphylococcus
TGIGFALSIERLLLALEEE

SEQ ID NO: 2055634 - protein, 17 aa, Staphylococcus
TGIKEMIEHFGIAQQET

SEQ ID NO: 2055635 - protein, 17 aa, Staphylococcus
TGIKEMIEHFGIQQEET

SEQ ID NO: 2055636 - protein, 18 aa, Staphylococcus
TGKYNLCPDVVFLATPPV

SEQ ID NO: 2055637 - protein, 19 aa, Staphylococcus
TGLGPFAFDEWRYLEDGSE

SEQ ID NO: 2055638 - protein, 19 aa, Staphylococcus
TGLRIGVTVAKTLAYALNT

SEQ ID NO: 2055639 - protein, 23 aa, Staphylococcus
TGLRPIAELMFNDFLGFGLDPIL

SEQ ID NO: 2055640 - protein, 24 aa, Staphylococcus
TGMKMKLSFAIAFSHHAELYILDE

SEQ ID NO: 2055641 - protein, 23 aa, Staphylococcus
TGMLSLRLNKAFSVAKFLENLDI

SEQ ID NO: 2055642 - protein, 24 aa, Staphylococcus
TGMLSLRLNKDFSVAKFLENLEIC

SEQ ID NO: 2055643 - protein, 18 aa, Staphylococcus
TGNVRRFIARSGFENTLE

SEQ ID NO: 2055644 - protein, 23 aa, Staphylococcus
TGSVVLPGRFFVDIIKKLPGKDV

SEQ ID NO: 2055645 - protein, 24 aa, Staphylococcus
TGSVVLPGRFFVDIIKKLPGNEVK

SEQ ID NO: 2055646 - protein, 17 aa, Staphylococcus
TGSWGRVPFIPFKNNSE

SEQ ID NO: 2055647 - protein, 17 aa, Staphylococcus
TGTIYSRPGAIMASPDE

SEQ ID NO: 2055648 - protein, 23 aa, Staphylococcus
TGVDFPKLFKAFKDMGIIVNTVN

SEQ ID NO: 2055649 - protein, 19 aa, Staphylococcus
TGYDYSWFILTEDIIKKEF

SEQ ID NO: 2055650 - protein, 20 aa, Staphylococcus
THDLGIPVMIVFEGVPASGK

SEQ ID NO: 2055651 - protein, 19 aa, Staphylococcus
THELGIPVMIIFEGIPASG

SEQ ID NO: 2055652 - protein, 20 aa, Staphylococcus
THELGIPVMILFEGVPASGK

SEQ ID NO: 2055653 - protein, 20 aa, Staphylococcus
THKARFIYISTISVGTVFDS

SEQ ID NO: 2055654 - protein, 20 aa, Staphylococcus
THLPEFFERASFAPDGQDPS

SEQ ID NO: 2055655 - protein, 18 aa, Staphylococcus
THLSRFAEEIIFWSTDEA

SEQ ID NO: 2055656 - protein, 23 aa, Staphylococcus
THPHVIQPIEWVKSEHGHHQTLV

SEQ ID NO: 2055657 - protein, 23 aa, Staphylococcus
THPKFIVPMPHRIFDFFNAYIGT

SEQ ID NO: 2055658 - protein, 19 aa, Staphylococcus
TICGKKLLFIHYEIENQKL

SEQ ID NO: 2055659 - protein, 17 aa, Staphylococcus
TIDSLRFLQSLGKRLVF

SEQ ID NO: 2055660 - protein, 19 aa, Staphylococcus
TIEGIEFVEFLISPNKGEP

SEQ ID NO: 2055661 - protein, 19 aa, Staphylococcus
TIELKAGRLASVLEGAERP

SEQ ID NO: 2055662 - protein, 18 aa, Staphylococcus
TIFRSELPSLESIKNDKQ

SEQ ID NO: 2055663 - protein, 19 aa, Staphylococcus
TIHGFKHYVALLFHKGAII

SEQ ID NO: 2055664 - protein, 23 aa, Staphylococcus
TIHRFTRKLGFDGYSDFKSYLKF

SEQ ID NO: 2055665 - protein, 17 aa, Staphylococcus
TIISVFRGAQSPYFKLN

SEQ ID NO: 2055666 - protein, 22 aa, Staphylococcus
TIKEAAMLAGYFSKAGNSGQIP

SEQ ID NO: 2055667 - protein, 20 aa, Staphylococcus
TIPRFPKKIAVLTASTGAAI

SEQ ID NO: 2055668 - protein, 18 aa, Staphylococcus
TITARSILSKVLVRATQQ

SEQ ID NO: 2055669 - protein, 24 aa, Staphylococcus
TIYKHFALPFGHRFADESVKRTRI

SEQ ID NO: 2055670 - protein, 22 aa, Staphylococcus
TKAEIVELFAFISFTNCQQQFG

SEQ ID NO: 2055671 - protein, 17 aa, Staphylococcus
TKASFNFFSLFTFTEPI

SEQ ID NO: 2055672 - protein, 18 aa, Staphylococcus
TKDELKEIVTMMVNKLTK

SEQ ID NO: 2055673 - protein, 18 aa, Staphylococcus
TKGIYQFDQFRLAIDHVQ

SEQ ID NO: 2055674 - protein, 22 aa, Staphylococcus
TKGRLQKDLINWFIDDQYKLFY

SEQ ID NO: 2055675 - protein, 22 aa, Staphylococcus
TKGRLQKNLINWFIDDQYKLFY

SEQ ID NO: 2055676 - protein, 22 aa, Staphylococcus
TKGRLQKNLLNWFIDDQYKLFY

SEQ ID NO: 2055677 - protein, 23 aa, Staphylococcus
TKGRLQRDLINWFIDDQYKMFYK

SEQ ID NO: 2055678 - protein, 18 aa, Staphylococcus
TKHFWVWSKKFVNKAYIS

SEQ ID NO: 2055679 - protein, 23 aa, Staphylococcus
TKHWKGDIYFNFSKDNLEKFNLD

SEQ ID NO: 2055680 - protein, 18 aa, Staphylococcus
TKISEIGIDFAIDENGHI

SEQ ID NO: 2055681 - protein, 25 aa, Staphylococcus
TKKFKTTMVTFKFMAPLDYKTITAR

SEQ ID NO: 2055682 - protein, 17 aa, Staphylococcus
TKLKETFSLLVNDTAKS

SEQ ID NO: 2055683 - protein, 17 aa, Staphylococcus
TKLLVSIRRLIDKEKLS

SEQ ID NO: 2055684 - protein, 17 aa, Staphylococcus
TKNGVGVQIELTSSLRK

SEQ ID NO: 2055685 - protein, 18 aa, Staphylococcus
TKNLEHWRILLRARAVEN

SEQ ID NO: 2055686 - protein, 22 aa, Staphylococcus
TKQQIKGIVGFKIKVNDIQGAY

SEQ ID NO: 2055687 - protein, 17 aa, Staphylococcus
TKQRILGDMGHVSNEDA

SEQ ID NO: 2055688 - protein, 18 aa, Staphylococcus
TKVFNRFGIDAEFIDTTN

SEQ ID NO: 2055689 - protein, 18 aa, Staphylococcus
TKVFTRFGLDVDFVDTTN

SEQ ID NO: 2055690 - protein, 18 aa, Staphylococcus
TKVFTRFGVEVDFVDTTH

SEQ ID NO: 2055691 - protein, 18 aa, Staphylococcus
TKVFTRYGIDVDFVDTTH

SEQ ID NO: 2055692 - protein, 18 aa, Staphylococcus
TKVFTRYGIEVDFVDTSY

SEQ ID NO: 2055693 - protein, 19 aa, Staphylococcus
TKYEGWEFLGIVKDHDGAA

SEQ ID NO: 2055694 - protein, 17 aa, Staphylococcus
TLCIRPGVVITYNRNYV

SEQ ID NO: 2055695 - protein, 25 aa, Staphylococcus
TLEERLKLSAAYVRDFYQTEISISL

SEQ ID NO: 2055696 - protein, 20 aa, Staphylococcus
TLELPVTIGEDFSGLLDERP

SEQ ID NO: 2055697 - protein, 22 aa, Staphylococcus
TLFKLEMLLLMLKKPKGAYSIN

SEQ ID NO: 2055698 - protein, 19 aa, Staphylococcus
TLFPHRVDLGLGRAPGTDM

SEQ ID NO: 2055699 - protein, 18 aa, Staphylococcus
TLIFGKRSRLEWVNQFVY

SEQ ID NO: 2055700 - protein, 25 aa, Staphylococcus
TLIKEYRKADIFAMASLHETFGLTY

SEQ ID NO: 2055701 - protein, 21 aa, Staphylococcus
TLIPHCPKCDAPMEINKRKAQ

SEQ ID NO: 2055702 - protein, 17 aa, Staphylococcus
TLIRLIMNLIRPDSGNI

SEQ ID NO: 2055703 - protein, 19 aa, Staphylococcus
TLKFELFYFDIFRYGTSFI

SEQ ID NO: 2055704 - protein, 21 aa, Staphylococcus
TLKLAELFRASTIPAGLIQIV

SEQ ID NO: 2055705 - protein, 22 aa, Staphylococcus
TLKQIHGVVGFRIEITEVYAAN

SEQ ID NO: 2055706 - protein, 20 aa, Staphylococcus
TLKRKAVWDKWMEKDMNNTS

SEQ ID NO: 2055707 - protein, 19 aa, Staphylococcus
TLLAKIGITYLRKGKFHQL

SEQ ID NO: 2055708 - protein, 18 aa, Staphylococcus
TLLHLPFDYIFFTGSEKV

SEQ ID NO: 2055709 - protein, 19 aa, Staphylococcus
TLLTIGRYPICYINIEMDP

SEQ ID NO: 2055710 - protein, 26 aa, Staphylococcus
TLMMIGRYPICYINIKMDPILVDVNV

SEQ ID NO: 2055711 - protein, 18 aa, Staphylococcus
TLMRMAHEILEYNRGTKD

SEQ ID NO: 2055712 - protein, 21 aa, Staphylococcus
TLPHLFADILIYSSERNVMLI

SEQ ID NO: 2055713 - protein, 19 aa, Staphylococcus
TLPLKEKFMKLGYADGGIG

SEQ ID NO: 2055714 - protein, 21 aa, Staphylococcus
TLPVAAFVNWFSLVEYGNIKA

SEQ ID NO: 2055715 - protein, 20 aa, Staphylococcus
TLQLAFKLAKQFNTTVDDLF

SEQ ID NO: 2055716 - protein, 19 aa, Staphylococcus
TLRLAELFRASTIPAGLVQ

SEQ ID NO: 2055717 - protein, 17 aa, Staphylococcus
TLTFHAACDEWFERYKL

SEQ ID NO: 2055718 - protein, 23 aa, Staphylococcus
TLYPNRIDLGLGRAPGTDMMTAS

SEQ ID NO: 2055719 - protein, 21 aa, Staphylococcus
TMCYADCVPIYFYSEKNHFIG

SEQ ID NO: 2055720 - protein, 22 aa, Staphylococcus
TMFSGKMWLSYTGFSEDEQAYK

SEQ ID NO: 2055721 - protein, 19 aa, Staphylococcus
TMILKPRFRDYLLKLATEN

SEQ ID NO: 2055722 - protein, 21 aa, Staphylococcus
TMILRPSFRDYLLQLVNQYDI

SEQ ID NO: 2055723 - protein, 18 aa, Staphylococcus
TMNCLRYLIDDLKAIDRD

SEQ ID NO: 2055724 - protein, 19 aa, Staphylococcus
TMPQTRFVLKKALEQDLKP

SEQ ID NO: 2055725 - protein, 18 aa, Staphylococcus
TMRSEIPLARGLGSSASA

SEQ ID NO: 2055726 - protein, 19 aa, Staphylococcus
TMVKWEISGTLNYMKPREF

SEQ ID NO: 2055727 - protein, 18 aa, Staphylococcus
TMYYAMLVADNFDLKNFA

SEQ ID NO: 2055728 - protein, 18 aa, Staphylococcus
TNCCILKFDYEDGAFTFK

SEQ ID NO: 2055729 - protein, 20 aa, Staphylococcus
TNIPTCILVFKKCREESDDV

SEQ ID NO: 2055730 - protein, 23 aa, Staphylococcus
TNKKAHKSHLWFHTKDIPGSHVV

SEQ ID NO: 2055731 - protein, 23 aa, Staphylococcus
TNLIRFIFENGFIALRPSGTEPK

SEQ ID NO: 2055732 - protein, 17 aa, Staphylococcus
TNLKVAIVVSRFNDFIT

SEQ ID NO: 2055733 - protein, 22 aa, Staphylococcus
TNLNGAVVFLGFDYGFRGNSRY

SEQ ID NO: 2055734 - protein, 18 aa, Staphylococcus
TNLYGYASLERVVHLMKH

SEQ ID NO: 2055735 - protein, 17 aa, Staphylococcus
TNTFPSWKRAHPNRMLM

SEQ ID NO: 2055736 - protein, 18 aa, Staphylococcus
TNTFPSWKRAHPNRMLMH

SEQ ID NO: 2055737 - protein, 17 aa, Staphylococcus
TNTSWPLALPVFKMDYA

SEQ ID NO: 2055738 - protein, 18 aa, Staphylococcus
TPAVFDWLQKEGNIETEE

SEQ ID NO: 2055739 - protein, 17 aa, Staphylococcus
TPGGIAWDNELQQKTSA

SEQ ID NO: 2055740 - protein, 22 aa, Staphylococcus
TPMKCLRIIAIFRLVNPTKEIR

SEQ ID NO: 2055741 - protein, 23 aa, Staphylococcus
TPQDIKAGYNFSAKGIGLVRTEH

SEQ ID NO: 2055742 - protein, 23 aa, Staphylococcus
TPQDIKVGYQFGAKGIGLVRTEH

SEQ ID NO: 2055743 - protein, 25 aa, Staphylococcus
TPTGLWLSELVHFYDAFKDTNVDID

SEQ ID NO: 2055744 - protein, 18 aa, Staphylococcus
TPWNFPAAMITRKMAPAL

SEQ ID NO: 2055745 - protein, 19 aa, Staphylococcus
TQAFLGEFAECLSLADKTF

SEQ ID NO: 2055746 - protein, 19 aa, Staphylococcus
TQFGLKGNRLFYLAMAPQF

SEQ ID NO: 2055747 - protein, 17 aa, Staphylococcus
TQFPFRIARPGSITQAM

SEQ ID NO: 2055748 - protein, 23 aa, Staphylococcus
TQFRIVPLLIFRAMHYIGDIPNI

SEQ ID NO: 2055749 - protein, 24 aa, Staphylococcus
TQGYRPVMEIQFLGFVFEVFDSVA

SEQ ID NO: 2055750 - protein, 18 aa, Staphylococcus
TRGPLLFDNINSIPLDKQ

SEQ ID NO: 2055751 - protein, 19 aa, Staphylococcus
TRIKGWMRHLLWMSIYQYQ

SEQ ID NO: 2055752 - protein, 17 aa, Staphylococcus
TRKELKSLLSVESGGIV

SEQ ID NO: 2055753 - protein, 17 aa, Staphylococcus
TRLDSSMIYPPYKGKLK

SEQ ID NO: 2055754 - protein, 19 aa, Staphylococcus
TRLKGFKSGESIFIKDNDD

SEQ ID NO: 2055755 - protein, 21 aa, Staphylococcus
TRLKINIGFSDIYFYIDFLND

SEQ ID NO: 2055756 - protein, 18 aa, Staphylococcus
TRLNFYLIDLFRKQHNTY

SEQ ID NO: 2055757 - protein, 18 aa, Staphylococcus
TRLWQDMALVQKEVETTT

SEQ ID NO: 2055758 - protein, 17 aa, Staphylococcus
TRNAFFIGRTIDYNVSL

SEQ ID NO: 2055759 - protein, 19 aa, Staphylococcus
TRPELSFPADLYFEGSDQY

SEQ ID NO: 2055760 - protein, 17 aa, Staphylococcus
TRREYYIFFLLCEGKSM

SEQ ID NO: 2055761 - protein, 18 aa, Staphylococcus
TRTLRYYHEIGLLVPSYI

SEQ ID NO: 2055762 - protein, 21 aa, Staphylococcus
TSAFYRKLFDQVLYQSENCMV

SEQ ID NO: 2055763 - protein, 18 aa, Staphylococcus
TSCLRFFNIYGPKQNPTS

SEQ ID NO: 2055764 - protein, 23 aa, Staphylococcus
TSDMKAGLAALVIAMIEINQSGA

SEQ ID NO: 2055765 - protein, 24 aa, Staphylococcus
TSDMKGGLAALVIAMIEIKASNLL

SEQ ID NO: 2055766 - protein, 24 aa, Staphylococcus
TSDMKSGLMALAIAMIELKENDAL

SEQ ID NO: 2055767 - protein, 24 aa, Staphylococcus
TSELEWLPQLFVAGGLADLELGPF

SEQ ID NO: 2055768 - protein, 17 aa, Staphylococcus
TSFNWGVSVPSNPKHVV

SEQ ID NO: 2055769 - protein, 17 aa, Staphylococcus
TSGRMVGIISHVSELKQ

SEQ ID NO: 2055770 - protein, 18 aa, Staphylococcus
TSHPWDFTDHMIDVIAKG

SEQ ID NO: 2055771 - protein, 20 aa, Staphylococcus
TSIDELEWIYVPSLTSEAKK

SEQ ID NO: 2055772 - protein, 25 aa, Staphylococcus
TSIPLWKNQMAIALTLLRQRHAVRS

SEQ ID NO: 2055773 - protein, 25 aa, Staphylococcus
TSIPLWKNQMAIALTLMRQKNAVTA

SEQ ID NO: 2055774 - protein, 26 aa, Staphylococcus
TSIPLWKNQMAIALTLMRQRNAVSAQ

SEQ ID NO: 2055775 - protein, 25 aa, Staphylococcus
TSIPLWKNQMAIALTLMRQRQAMSA

SEQ ID NO: 2055776 - protein, 19 aa, Staphylococcus
TSMALRYEMIISRLKYAND

SEQ ID NO: 2055777 - protein, 19 aa, Staphylococcus
TSMPSFWFDPLINLTAISQ

SEQ ID NO: 2055778 - protein, 20 aa, Staphylococcus
TSQLFSFFISYHFNQFDLSF

SEQ ID NO: 2055779 - protein, 18 aa, Staphylococcus
TSRQYELRQLMSIINACA

SEQ ID NO: 2055780 - protein, 21 aa, Staphylococcus
TSSIRIYINWNGQPVNLNTID

SEQ ID NO: 2055781 - protein, 28 aa, Staphylococcus
TSTIIPMCHPLPLTGIDIEFSWNQANTQ

SEQ ID NO: 2055782 - protein, 23 aa, Staphylococcus
TSTIIPMCHPLPLTGIDVNFEWD

SEQ ID NO: 2055783 - protein, 23 aa, Staphylococcus
TSTIIPMCHPLPLTGIDVQFNWQ

SEQ ID NO: 2055784 - protein, 32 aa, Staphylococcus
TSTIIPMCHPLPLTGIDVSFEWNTTSSNHFEL

SEQ ID NO: 2055785 - protein, 23 aa, Staphylococcus
TSTIIPMCHPLSLTGIDIAFEWD

SEQ ID NO: 2055786 - protein, 23 aa, Staphylococcus
TTDMKGALMGMVIALIELKLSGD

SEQ ID NO: 2055787 - protein, 24 aa, Staphylococcus
TTEFDWKHHRAMHDYTAYMLSEVL

SEQ ID NO: 2055788 - protein, 22 aa, Staphylococcus
TTEIFKRAFALETIYGGQILEI

SEQ ID NO: 2055789 - protein, 19 aa, Staphylococcus
TTLHPEFSYSDFIGQVMPS

SEQ ID NO: 2055790 - protein, 21 aa, Staphylococcus
TTLKCTLNFRNREDKVIDTIE

SEQ ID NO: 2055791 - protein, 18 aa, Staphylococcus
TTRLGIRLEETFEYIDTP

SEQ ID NO: 2055792 - protein, 26 aa, Staphylococcus
TTYDLLYRAGMDWDVDFVIRVGKPVI

SEQ ID NO: 2055793 - protein, 20 aa, Staphylococcus
TVAGRGELHLSILIENMRRE

SEQ ID NO: 2055794 - protein, 18 aa, Staphylococcus
TVGIRLVIKYNQSPNNIL

SEQ ID NO: 2055795 - protein, 24 aa, Staphylococcus
TVHLKLPIDWLKNKIIVDSLGLYS

SEQ ID NO: 2055796 - protein, 23 aa, Staphylococcus
TVIRCAHKLGFKGFVDLKLSLSR

SEQ ID NO: 2055797 - protein, 25 aa, Staphylococcus
TVKNFRVTKIFGFFGLKREEIEEAQ

SEQ ID NO: 2055798 - protein, 26 aa, Staphylococcus
TVLDCTRFPFKIARPGSITKSMIEAV

SEQ ID NO: 2055799 - protein, 19 aa, Staphylococcus
TVLKRFKGIMVKKQETVEA

SEQ ID NO: 2055800 - protein, 17 aa, Staphylococcus
TVSELLTAYGFKVVDAD

SEQ ID NO: 2055801 - protein, 22 aa, Staphylococcus
TVSELLTAYGFKVVDADIAARE

SEQ ID NO: 2055802 - protein, 19 aa, Staphylococcus
TVVAALCMFALKTAGYQSA

SEQ ID NO: 2055803 - protein, 20 aa, Staphylococcus
TVVIPTKWIPQGIGALFQYL

SEQ ID NO: 2055804 - protein, 17 aa, Staphylococcus
TVVRLAAFGAFVEVAPG

SEQ ID NO: 2055805 - protein, 22 aa, Staphylococcus
TVWDFADKIIFPYVEDDELDGV

SEQ ID NO: 2055806 - protein, 18 aa, Staphylococcus
TWLEDGGIDPRRRGETLS

SEQ ID NO: 2055807 - protein, 18 aa, Staphylococcus
TWLKRRIETPYKADLNKN

SEQ ID NO: 2055808 - protein, 18 aa, Staphylococcus
TWLVWKLSGGEAHITDYS

SEQ ID NO: 2055809 - protein, 19 aa, Staphylococcus
TYMPLPIFLSHQLAKRLSD

SEQ ID NO: 2055810 - protein, 18 aa, Staphylococcus
TYNIFQIYAPKIWDELIG

SEQ ID NO: 2055811 - protein, 19 aa, Staphylococcus
TYPELKLGVITPFEGHTSK

SEQ ID NO: 2055812 - protein, 25 aa, Staphylococcus
TYTMPCARTLVPVEVPLDVETSEVF

SEQ ID NO: 2055813 - protein, 21 aa, Staphylococcus
VAADIYRPAAIDQLQTVGKQI

SEQ ID NO: 2055814 - protein, 19 aa, Staphylococcus
VACPGFVPLVEQMRYDDPT

SEQ ID NO: 2055815 - protein, 18 aa, Staphylococcus
VACPGFVPLVEQMRYNDP

SEQ ID NO: 2055816 - protein, 23 aa, Staphylococcus
VAEACLKLGATMINDQWAGLYDP

SEQ ID NO: 2055817 - protein, 22 aa, Staphylococcus
VAEACLRLGATMINDQWAGLYD

SEQ ID NO: 2055818 - protein, 23 aa, Staphylococcus
VAEACLRLGATMINDQWAGLYDP

SEQ ID NO: 2055819 - protein, 19 aa, Staphylococcus
VAEILCKLLPAFVNEPLPE

SEQ ID NO: 2055820 - protein, 18 aa, Staphylococcus
VAEVDIMYGQGISKEGEL

SEQ ID NO: 2055821 - protein, 22 aa, Staphylococcus
VAFLTYRKCIIINLEKQIFSRS

SEQ ID NO: 2055822 - protein, 21 aa, Staphylococcus
VAGDIYRPAAIDQLQTVGKQI

SEQ ID NO: 2055823 - protein, 17 aa, Staphylococcus
VAGFGIRTTDHIKDLVK

SEQ ID NO: 2055824 - protein, 25 aa, Staphylococcus
VAGMGIAIKSSVDWEQALAGVAKTT

SEQ ID NO: 2055825 - protein, 21 aa, Staphylococcus
VAHPFHPVYILPLVEIVPGKA

SEQ ID NO: 2055826 - protein, 20 aa, Staphylococcus
VAIDFTKLILCNGDYQCQLK

SEQ ID NO: 2055827 - protein, 22 aa, Staphylococcus
VAIEMASTLGWHKYVGTQGKVI

SEQ ID NO: 2055828 - protein, 17 aa, Staphylococcus
VAIVVSRFNDFITGRLL

SEQ ID NO: 2055829 - protein, 20 aa, Staphylococcus
VAKIPYEYCKDGISNTFSIV

SEQ ID NO: 2055830 - protein, 17 aa, Staphylococcus
VAKRLDKTVALLLDTKG

SEQ ID NO: 2055831 - protein, 17 aa, Staphylococcus
VALPEIFDRVDVFQAEL

SEQ ID NO: 2055832 - protein, 17 aa, Staphylococcus
VAMAFGFFDGMHKGHDK

SEQ ID NO: 2055833 - protein, 18 aa, Staphylococcus
VAMAFGFFDGMHKGHLKV

SEQ ID NO: 2055834 - protein, 18 aa, Staphylococcus
VAMAFGFFDGMHRGHDKV

SEQ ID NO: 2055835 - protein, 17 aa, Staphylococcus
VANKLKLGTVWINDFHP

SEQ ID NO: 2055836 - protein, 17 aa, Staphylococcus
VAPEVRADILFRAAAIT

SEQ ID NO: 2055837 - protein, 18 aa, Staphylococcus
VAPGKPWKNGPVPMDKAI

SEQ ID NO: 2055838 - protein, 19 aa, Staphylococcus
VAQALALHLEHIYGVQFNQ

SEQ ID NO: 2055839 - protein, 18 aa, Staphylococcus
VARCPKNYLAHVLSKYGF

SEQ ID NO: 2055840 - protein, 17 aa, Staphylococcus
VARDVFFEKALKVMRPV

SEQ ID NO: 2055841 - protein, 17 aa, Staphylococcus
VASDFKIVTGFIEPHFF

SEQ ID NO: 2055842 - protein, 19 aa, Staphylococcus
VATIKEFRDAKAILLEEKD

SEQ ID NO: 2055843 - protein, 19 aa, Staphylococcus
VATIKEFRDAKAILLEEKK

SEQ ID NO: 2055844 - protein, 19 aa, Staphylococcus
VATINEFRDAKAILLEEKE

SEQ ID NO: 2055845 - protein, 20 aa, Staphylococcus
VATINEFRDAKALLLEEKEN

SEQ ID NO: 2055846 - protein, 19 aa, Staphylococcus
VATIQEFRDAKALLEEERA

SEQ ID NO: 2055847 - protein, 21 aa, Staphylococcus
VATIQEFRDAKALLLEEKDNL

SEQ ID NO: 2055848 - protein, 17 aa, Staphylococcus
VAWNFPILLASWKLGPA

SEQ ID NO: 2055849 - protein, 18 aa, Staphylococcus
VCGAEDCFNVMPSSQKEC

SEQ ID NO: 2055850 - protein, 20 aa, Staphylococcus
VCSAGSRILVHNDIKDKFEK

SEQ ID NO: 2055851 - protein, 21 aa, Staphylococcus
VCSAGSRLLVQEGIYDELMKR

SEQ ID NO: 2055852 - protein, 22 aa, Staphylococcus
VCSAGSRLLVQTSIYDKVIPKL

SEQ ID NO: 2055853 - protein, 18 aa, Staphylococcus
VCVLLDMHVGHLRSIIEL

SEQ ID NO: 2055854 - protein, 20 aa, Staphylococcus
VDAQGFFKETFVFPTIDSTQ

SEQ ID NO: 2055855 - protein, 22 aa, Staphylococcus
VDFRLIEPAAFYHTLQHFTGSK

SEQ ID NO: 2055856 - protein, 22 aa, Staphylococcus
VDFRLIEPVAFYHTLQHFTGSK

SEQ ID NO: 2055857 - protein, 18 aa, Staphylococcus
VDGGFTIGGINFDVGGSV

SEQ ID NO: 2055858 - protein, 23 aa, Staphylococcus
VDHKEVIEALSLLEYDNQEDKWN

SEQ ID NO: 2055859 - protein, 25 aa, Staphylococcus
VDIKEVFLKLPIIGTEVFDESNEIE

SEQ ID NO: 2055860 - protein, 24 aa, Staphylococcus
VDIKEVFLKLPIIGTEVYDEANEI

SEQ ID NO: 2055861 - protein, 24 aa, Staphylococcus
VDIKEVFLKLPIIGTEVYDEENEI

SEQ ID NO: 2055862 - protein, 24 aa, Staphylococcus
VDIKEVFLKLPIVSTEVFDETNEI

SEQ ID NO: 2055863 - protein, 17 aa, Staphylococcus
VDKFNWLLVSKKITKDT

SEQ ID NO: 2055864 - protein, 19 aa, Staphylococcus
VDLTLPLVVRLEGTNVELG

SEQ ID NO: 2055865 - protein, 23 aa, Staphylococcus
VDMLRMCRYPWKTKQRILSDMGH

SEQ ID NO: 2055866 - protein, 22 aa, Staphylococcus
VDMSEVRTALYAIGPENDTGQR

SEQ ID NO: 2055867 - protein, 25 aa, Staphylococcus
VDSLENRARFGLEVMQAVQKVIDEE

SEQ ID NO: 2055868 - protein, 25 aa, Staphylococcus
VDSLENRARFGLQVMQAVQNVIDQQ

SEQ ID NO: 2055869 - protein, 18 aa, Staphylococcus
VDVFEFLQEYFAFKGIDP

SEQ ID NO: 2055870 - protein, 18 aa, Staphylococcus
VDVFRIFDSLNWVDQMKI

SEQ ID NO: 2055871 - protein, 18 aa, Staphylococcus
VDVGCGYGPIGLTIAKVC

SEQ ID NO: 2055872 - protein, 18 aa, Staphylococcus
VEAIKHFISKQIDRFRVA

SEQ ID NO: 2055873 - protein, 22 aa, Staphylococcus
VEDFKEIFKLSGEHPTIVRLLD

SEQ ID NO: 2055874 - protein, 18 aa, Staphylococcus
VEEFKELFFIKIKGKANI

SEQ ID NO: 2055875 - protein, 23 aa, Staphylococcus
VEFYPVLCGTAFKNKGVQLMLDA

SEQ ID NO: 2055876 - protein, 23 aa, Staphylococcus
VEFYPVLVGTAFKNKGVQLMLNA

SEQ ID NO: 2055877 - protein, 23 aa, Staphylococcus
VEGFRPVMEIQFLGFVFEVFDSV

SEQ ID NO: 2055878 - protein, 17 aa, Staphylococcus
VEGILDFYGYSRFHIPQ

SEQ ID NO: 2055879 - protein, 22 aa, Staphylococcus
VEGLPGICIIGDIINYSLPQNK

SEQ ID NO: 2055880 - protein, 20 aa, Staphylococcus
VEGYVAAFVYLFFQQSQQKV

SEQ ID NO: 2055881 - protein, 20 aa, Staphylococcus
VEHMKRSGFEIVSINHDNSW

SEQ ID NO: 2055882 - protein, 26 aa, Staphylococcus
VEHMNAWLKPYRRAFNIEEPVINMTE

SEQ ID NO: 2055883 - protein, 17 aa, Staphylococcus
VEISIRIAEAFASEDID

SEQ ID NO: 2055884 - protein, 18 aa, Staphylococcus
VEITSFFYNRMFNEHPEL

SEQ ID NO: 2055885 - protein, 19 aa, Staphylococcus
VEITSNFYARMFKQHPELK

SEQ ID NO: 2055886 - protein, 18 aa, Staphylococcus
VEKGRLEGLITIKDIEKV

SEQ ID NO: 2055887 - protein, 24 aa, Staphylococcus
VEKSLRGAVIWDELKDRLNENAYG

SEQ ID NO: 2055888 - protein, 17 aa, Staphylococcus
VELIAPIAIEDGTRFSI

SEQ ID NO: 2055889 - protein, 18 aa, Staphylococcus
VELRNRFVLAPLTHISSN

SEQ ID NO: 2055890 - protein, 17 aa, Staphylococcus
VELRRKIGYVIQQIGLM

SEQ ID NO: 2055891 - protein, 17 aa, Staphylococcus
VELRRSIGYVIQQIGLM

SEQ ID NO: 2055892 - protein, 18 aa, Staphylococcus
VELTLPLVVRLEGTNVKR

SEQ ID NO: 2055893 - protein, 21 aa, Staphylococcus
VEMAQRLAGAGAQAGFSSDEI

SEQ ID NO: 2055894 - protein, 17 aa, Staphylococcus
VEMEFQDSLYLLKDAQN

SEQ ID NO: 2055895 - protein, 17 aa, Staphylococcus
VEMKLTYLWINADKPEE

SEQ ID NO: 2055896 - protein, 20 aa, Staphylococcus
VEMMICIFHIKRFDSELFVF

SEQ ID NO: 2055897 - protein, 26 aa, Staphylococcus
VEMSRKMGIEVFNVFLSQEPITEDIE

SEQ ID NO: 2055898 - protein, 18 aa, Staphylococcus
VEMVRPKLSSVIQPLYDI

SEQ ID NO: 2055899 - protein, 23 aa, Staphylococcus
VEREVPVKIARKILTDDFADELI

SEQ ID NO: 2055900 - protein, 18 aa, Staphylococcus
VERQEIYGVIGYSGAGKS

SEQ ID NO: 2055901 - protein, 22 aa, Staphylococcus
VETAIKMARKWGADIKNIDESS

SEQ ID NO: 2055902 - protein, 23 aa, Staphylococcus
VETALKAARRWAYDVKGIEPNKA

SEQ ID NO: 2055903 - protein, 23 aa, Staphylococcus
VETALKAARRWAYDVKGLEPDKA

SEQ ID NO: 2055904 - protein, 23 aa, Staphylococcus
VETALKAARRWAYDVKNIQPDKA

SEQ ID NO: 2055905 - protein, 19 aa, Staphylococcus
VEVARLPKDVKIEIEAIAQ

SEQ ID NO: 2055906 - protein, 19 aa, Staphylococcus
VEVARLPKDVKVEIELIGK

SEQ ID NO: 2055907 - protein, 19 aa, Staphylococcus
VEVGNPFFRTDMHGCSTGG

SEQ ID NO: 2055908 - protein, 18 aa, Staphylococcus
VEVTICSGLLKADKYEWL

SEQ ID NO: 2055909 - protein, 18 aa, Staphylococcus
VEYQFKIPHGHAVMIGII

SEQ ID NO: 2055910 - protein, 17 aa, Staphylococcus
VFEKLVRKFSESYNEEA

SEQ ID NO: 2055911 - protein, 18 aa, Staphylococcus
VFGLLRCEKGTFGKADRL

SEQ ID NO: 2055912 - protein, 18 aa, Staphylococcus
VFHFCAYSLVGESVEKPL

SEQ ID NO: 2055913 - protein, 22 aa, Staphylococcus
VFKKRDSMDWNEITNGIDHIAG

SEQ ID NO: 2055914 - protein, 21 aa, Staphylococcus
VFKRSGIDFCCGGQVSIEEAA

SEQ ID NO: 2055915 - protein, 17 aa, Staphylococcus
VFMWHLAHAFGQEERDK

SEQ ID NO: 2055916 - protein, 18 aa, Staphylococcus
VFNKIAWLNKSEMQESLK

SEQ ID NO: 2055917 - protein, 24 aa, Staphylococcus
VFSNIKGLFLISGFNEPLHNLPEL

SEQ ID NO: 2055918 - protein, 19 aa, Staphylococcus
VFSSFPFKSFYRIYEYYKK

SEQ ID NO: 2055919 - protein, 20 aa, Staphylococcus
VFTDVKWCRMMIRQILSNSL

SEQ ID NO: 2055920 - protein, 17 aa, Staphylococcus
VGALYPWGLSEAKDYAQ

SEQ ID NO: 2055921 - protein, 20 aa, Staphylococcus
VGDPIIKFDVEYIRNNAKSV

SEQ ID NO: 2055922 - protein, 22 aa, Staphylococcus
VGDPLIRFDLEYIKNNAKSVIS

SEQ ID NO: 2055923 - protein, 19 aa, Staphylococcus
VGEGFRWLTLVSPNQPDGA

SEQ ID NO: 2055924 - protein, 17 aa, Staphylococcus
VGGRQLVKVAAWYDNEM

SEQ ID NO: 2055925 - protein, 20 aa, Staphylococcus
VGILNEFAGIHFYNSNDEEA

SEQ ID NO: 2055926 - protein, 23 aa, Staphylococcus
VGKDLSCSVVRTWVHQHTVILGI

SEQ ID NO: 2055927 - protein, 18 aa, Staphylococcus
VGLGRTGKMFAMEWENTE

SEQ ID NO: 2055928 - protein, 18 aa, Staphylococcus
VGLKLRDGGWVYVQGLTH

SEQ ID NO: 2055929 - protein, 19 aa, Staphylococcus
VGLKLRDGGWVYVQGLTHY

SEQ ID NO: 2055930 - protein, 17 aa, Staphylococcus
VGLYIGNDIESIILVHA

SEQ ID NO: 2055931 - protein, 17 aa, Staphylococcus
VGNSIYLNILVKDIEEK

SEQ ID NO: 2055932 - protein, 17 aa, Staphylococcus
VGPFAYYIKGFEMLPQM

SEQ ID NO: 2055933 - protein, 24 aa, Staphylococcus
VGQFLKRLGFKAAITQADSNKYPE

SEQ ID NO: 2055934 - protein, 18 aa, Staphylococcus
VGRAFSFETTEFILDQLP

SEQ ID NO: 2055935 - protein, 23 aa, Staphylococcus
VGRDCPKCNHYLMEHKKGRSSQV

SEQ ID NO: 2055936 - protein, 23 aa, Staphylococcus
VGRECPKCNHYLVDKKKGRSSQV

SEQ ID NO: 2055937 - protein, 18 aa, Staphylococcus
VGVARPGTTLSITDEDEL

SEQ ID NO: 2055938 - protein, 19 aa, Staphylococcus
VGVLLPFKSQCFVRHYSKG

SEQ ID NO: 2055939 - protein, 20 aa, Staphylococcus
VGVPRPGTILSLAENDELVI

SEQ ID NO: 2055940 - protein, 18 aa, Staphylococcus
VHIKFRINDYLELYEIFN

SEQ ID NO: 2055941 - protein, 18 aa, Staphylococcus
VHLFYKYLEYVNVKHIAV

SEQ ID NO: 2055942 - protein, 17 aa, Staphylococcus
VHLGIVFKIRVDTENVE

SEQ ID NO: 2055943 - protein, 20 aa, Staphylococcus
VHLMRECFERGIKVISSMGA

SEQ ID NO: 2055944 - protein, 17 aa, Staphylococcus
VHLSRFAEEIIFWSSAE

SEQ ID NO: 2055945 - protein, 17 aa, Staphylococcus
VHLSRFAEEIIFWSTDE

SEQ ID NO: 2055946 - protein, 19 aa, Staphylococcus
VHMVICCYYGLGISQLLET

SEQ ID NO: 2055947 - protein, 20 aa, Staphylococcus
VHNYARYVSRFIVGYLTGNP

SEQ ID NO: 2055948 - protein, 23 aa, Staphylococcus
VHTFKMKFIKSFEAIDLHHAIFE

SEQ ID NO: 2055949 - protein, 18 aa, Staphylococcus
VIAGFDFTFGKFGKGNMM

SEQ ID NO: 2055950 - protein, 17 aa, Staphylococcus
VIAGFDFTFGKHGKGNM

SEQ ID NO: 2055951 - protein, 18 aa, Staphylococcus
VIDELRAGGAYESKLETD

SEQ ID NO: 2055952 - protein, 20 aa, Staphylococcus
VIDENWRLVGIVTSKEIIKM

SEQ ID NO: 2055953 - protein, 19 aa, Staphylococcus
VIDHLGICFNDAVLKLKNA

SEQ ID NO: 2055954 - protein, 18 aa, Staphylococcus
VIEGIKLGSKRIGHGVAI

SEQ ID NO: 2055955 - protein, 17 aa, Staphylococcus
VIFENGGLIAIPTETVY

SEQ ID NO: 2055956 - protein, 18 aa, Staphylococcus
VIFIGLLCKDGQWHAVVF

SEQ ID NO: 2055957 - protein, 17 aa, Staphylococcus
VIHDWRMLTTFSEHKYA

SEQ ID NO: 2055958 - protein, 17 aa, Staphylococcus
VIKELRQSIGLKQHEVF

SEQ ID NO: 2055959 - protein, 21 aa, Staphylococcus
VILLRPTESLSLFIQQTMRAM

SEQ ID NO: 2055960 - protein, 22 aa, Staphylococcus
VILRHGVKVIPHFAHKVKSTRL

SEQ ID NO: 2055961 - protein, 18 aa, Staphylococcus
VILSQLFRGFCKNIENND

SEQ ID NO: 2055962 - protein, 17 aa, Staphylococcus
VILSQLFRGFCKNIETE

SEQ ID NO: 2055963 - protein, 17 aa, Staphylococcus
VIQGIFWARENELNKDV

SEQ ID NO: 2055964 - protein, 18 aa, Staphylococcus
VIVYKFKHPIPWKQHDVK

SEQ ID NO: 2055965 - protein, 17 aa, Staphylococcus
VIYPAAMRYAGPREAIL

SEQ ID NO: 2055966 - protein, 20 aa, Staphylococcus
VIYYAGGHGVMWDFAKDKGL

SEQ ID NO: 2055967 - protein, 19 aa, Staphylococcus
VIYYIHGAGWVFGSPETHD

SEQ ID NO: 2055968 - protein, 26 aa, Staphylococcus
VKARAYKLLIDFGFSRDILQQSPFQM

SEQ ID NO: 2055969 - protein, 19 aa, Staphylococcus
VKDIDEWIGLLDQLEEKVK

SEQ ID NO: 2055970 - protein, 25 aa, Staphylococcus
VKDNKIEIVLSWKLNRISRSMRDVF

SEQ ID NO: 2055971 - protein, 18 aa, Staphylococcus
VKDRFKATFFEVQDYFTS

SEQ ID NO: 2055972 - protein, 20 aa, Staphylococcus
VKDRYDNFVFLFENEFATRW

SEQ ID NO: 2055973 - protein, 17 aa, Staphylococcus
VKEAGYELNVWTVNKPA

SEQ ID NO: 2055974 - protein, 19 aa, Staphylococcus
VKEALKLVKLTGYEQRHID

SEQ ID NO: 2055975 - protein, 20 aa, Staphylococcus
VKEILVFKGHFKMFYISEDE

SEQ ID NO: 2055976 - protein, 22 aa, Staphylococcus
VKGYFLWSLMDVFSWSNGYEKR

SEQ ID NO: 2055977 - protein, 17 aa, Staphylococcus
VKIYFSHFVSVLENTPS

SEQ ID NO: 2055978 - protein, 20 aa, Staphylococcus
VKKDIPIVLVSRSFNGIVSP

SEQ ID NO: 2055979 - protein, 21 aa, Staphylococcus
VKLIKRLSFASGHLGMVGGQT

SEQ ID NO: 2055980 - protein, 18 aa, Staphylococcus
VKLRLKGYPAIIFQHEID

SEQ ID NO: 2055981 - protein, 17 aa, Staphylococcus
VKLRLKGYPAIVFQHEI

SEQ ID NO: 2055982 - protein, 18 aa, Staphylococcus
VKMALWYQEMLRNLKRFK

SEQ ID NO: 2055983 - protein, 20 aa, Staphylococcus
VKMYVCGPTVYNYIHIGNAR

SEQ ID NO: 2055984 - protein, 24 aa, Staphylococcus
VKNFRVTKIFGYFGLKREEIEEAQ

SEQ ID NO: 2055985 - protein, 20 aa, Staphylococcus
VKNLRLAGVKIELLIEFCKL

SEQ ID NO: 2055986 - protein, 25 aa, Staphylococcus
VKQVSRIPLSLTFDHQILDGASAAD

SEQ ID NO: 2055987 - protein, 18 aa, Staphylococcus
VKRRIFLGTFALSSGYYD

SEQ ID NO: 2055988 - protein, 19 aa, Staphylococcus
VKRTCGYLGNPVQRPTIEG

SEQ ID NO: 2055989 - protein, 20 aa, Staphylococcus
VKTPRFYLNLNKYFDSIEQN

SEQ ID NO: 2055990 - protein, 17 aa, Staphylococcus
VKVIAWYDNEWGYSNRV

SEQ ID NO: 2055991 - protein, 24 aa, Staphylococcus
VKVLNFGSGHAWGMIGLEIETEEL

SEQ ID NO: 2055992 - protein, 17 aa, Staphylococcus
VKYESVFNFDDLVQEAA

SEQ ID NO: 2055993 - protein, 17 aa, Staphylococcus
VKYPFNVNGYFLSIEND

SEQ ID NO: 2055994 - protein, 17 aa, Staphylococcus
VLCEVDWETLRPASEIT

SEQ ID NO: 2055995 - protein, 23 aa, Staphylococcus
VLDKFKSLTFISGTLTFNHSFEN

SEQ ID NO: 2055996 - protein, 19 aa, Staphylococcus
VLEIKGSELVRGRGGPRCM

SEQ ID NO: 2055997 - protein, 18 aa, Staphylococcus
VLEMPFYYILQILDERHL

SEQ ID NO: 2055998 - protein, 17 aa, Staphylococcus
VLEQEFISRIGYVIEPQ

SEQ ID NO: 2055999 - protein, 17 aa, Staphylococcus
VLGDIIICADVAKEQAE

SEQ ID NO: 2056000 - protein, 17 aa, Staphylococcus
VLIIYALVNGFLDDIPV

SEQ ID NO: 2056001 - protein, 18 aa, Staphylococcus
VLKGLSFKVEKGEFISIM

SEQ ID NO: 2056002 - protein, 23 aa, Staphylococcus
VLKQEVYQFVALMKSLGKEVTQQ

SEQ ID NO: 2056003 - protein, 20 aa, Staphylococcus
VLLHEIFKDYGVLFIDAQNH

SEQ ID NO: 2056004 - protein, 26 aa, Staphylococcus
VLLRRIYKLPIGFKWENQSNLTLIGD

SEQ ID NO: 2056005 - protein, 19 aa, Staphylococcus
VLLVYIFKCIEFIPDSYTR

SEQ ID NO: 2056006 - protein, 19 aa, Staphylococcus
VLNCIHKGIYLLDVPLSEY

SEQ ID NO: 2056007 - protein, 18 aa, Staphylococcus
VLQARGVFRKEYESHMLK

SEQ ID NO: 2056008 - protein, 17 aa, Staphylococcus
VLQEALNFVRMGDRFIV

SEQ ID NO: 2056009 - protein, 20 aa, Staphylococcus
VLRFKKRFGDEVAVLHSALS

SEQ ID NO: 2056010 - protein, 20 aa, Staphylococcus
VLRFKRRFGDDVAVLHSGLS

SEQ ID NO: 2056011 - protein, 19 aa, Staphylococcus
VLRFKRRFGDEVAVLHSGL

SEQ ID NO: 2056012 - protein, 17 aa, Staphylococcus
VLSGAYKDIGWFRWVTP

SEQ ID NO: 2056013 - protein, 25 aa, Staphylococcus
VLTTEYYWHWDLKYAQLDVFEYKRL

SEQ ID NO: 2056014 - protein, 17 aa, Staphylococcus
VLWSVRLPDNFKTYCAK

SEQ ID NO: 2056015 - protein, 22 aa, Staphylococcus
VLWSVRLPENFKIYCAKMSIKT

SEQ ID NO: 2056016 - protein, 19 aa, Staphylococcus
VLYNFIWDEFCDWYIEMSK

SEQ ID NO: 2056017 - protein, 23 aa, Staphylococcus
VMNGREVFKFAVRIMGEASKRVV

SEQ ID NO: 2056018 - protein, 23 aa, Staphylococcus
VMNGREVFKFAVRIMGEASTRVV

SEQ ID NO: 2056019 - protein, 19 aa, Staphylococcus
VMPGFDFYFIPSILNSNDV

SEQ ID NO: 2056020 - protein, 17 aa, Staphylococcus
VMSSRIRLARNLDNHVH

SEQ ID NO: 2056021 - protein, 20 aa, Staphylococcus
VNAPTSINTFEWIKPLLERK

SEQ ID NO: 2056022 - protein, 17 aa, Staphylococcus
VNARLAATQSYSYSDYL

SEQ ID NO: 2056023 - protein, 17 aa, Staphylococcus
VNEEIWKGIDVTIKEMP

SEQ ID NO: 2056024 - protein, 17 aa, Staphylococcus
VNEGIKPIFGMTVMVSD

SEQ ID NO: 2056025 - protein, 20 aa, Staphylococcus
VNEIKHFIKSYVQSHSFIKS

SEQ ID NO: 2056026 - protein, 18 aa, Staphylococcus
VNEWPYEALVKIFYRYGE

SEQ ID NO: 2056027 - protein, 19 aa, Staphylococcus
VNFPESFKVFGSDHSKVIF

SEQ ID NO: 2056028 - protein, 19 aa, Staphylococcus
VNHVPRILGFDAAGIVEQV

SEQ ID NO: 2056029 - protein, 18 aa, Staphylococcus
VNIPERWSIAQLYQSALE

SEQ ID NO: 2056030 - protein, 18 aa, Staphylococcus
VNKSAAQVVIRWNMQHGV

SEQ ID NO: 2056031 - protein, 19 aa, Staphylococcus
VNKTAAQVIIKWNMQHNVV

SEQ ID NO: 2056032 - protein, 17 aa, Staphylococcus
VNLSYSFPYIVCAIDQH

SEQ ID NO: 2056033 - protein, 17 aa, Staphylococcus
VNLYAMITWAFRAIQQL

SEQ ID NO: 2056034 - protein, 18 aa, Staphylococcus
VNNQAWLAAFMLKQNGIT

SEQ ID NO: 2056035 - protein, 17 aa, Staphylococcus
VNTGHAFLAYAGHFENK

SEQ ID NO: 2056036 - protein, 17 aa, Staphylococcus
VNVKLIYWVKGQGTIDI

SEQ ID NO: 2056037 - protein, 18 aa, Staphylococcus
VPEARLLVISPYDKSSVA

SEQ ID NO: 2056038 - protein, 20 aa, Staphylococcus
VPEARLLVISPYDKSSVADI

SEQ ID NO: 2056039 - protein, 18 aa, Staphylococcus
VPEARLLVISPYDKSSVG

SEQ ID NO: 2056040 - protein, 18 aa, Staphylococcus
VPEARLLVISPYDKTSVA

SEQ ID NO: 2056041 - protein, 18 aa, Staphylococcus
VPEARLLVISPYDKTSVD

SEQ ID NO: 2056042 - protein, 18 aa, Staphylococcus
VPEARLLVISPYDKTSVK

SEQ ID NO: 2056043 - protein, 18 aa, Staphylococcus
VPEDLFFIISLSGETYQL

SEQ ID NO: 2056044 - protein, 20 aa, Staphylococcus
VPFKELKYFYAQSKLNVVGI

SEQ ID NO: 2056045 - protein, 18 aa, Staphylococcus
VPGFRKGKVPRPIFEQRF

SEQ ID NO: 2056046 - protein, 23 aa, Staphylococcus
VPIWKPELEPVKEFSNETARGEK

SEQ ID NO: 2056047 - protein, 17 aa, Staphylococcus
VPKEINSLLGLETGHIS

SEQ ID NO: 2056048 - protein, 20 aa, Staphylococcus
VPLIECEALLLSDVLADVDV

SEQ ID NO: 2056049 - protein, 18 aa, Staphylococcus
VPLSVYHEMTFFKLNDHK

SEQ ID NO: 2056050 - protein, 18 aa, Staphylococcus
VPMPRAQFLTAIKDATAC

SEQ ID NO: 2056051 - protein, 23 aa, Staphylococcus
VPNREGIEFVEFLISPNKGEPLK

SEQ ID NO: 2056052 - protein, 23 aa, Staphylococcus
VPPVLKGSLTWTVYQDGKVNVDY

SEQ ID NO: 2056053 - protein, 17 aa, Staphylococcus
VPSQFWLERAIHYIEDN

SEQ ID NO: 2056054 - protein, 17 aa, Staphylococcus
VPVDLPALFKGYFKDPE

SEQ ID NO: 2056055 - protein, 18 aa, Staphylococcus
VPVVAGFGIRNPEQVSTL

SEQ ID NO: 2056056 - protein, 17 aa, Staphylococcus
VPYSYALPMFAVNKKNN

SEQ ID NO: 2056057 - protein, 23 aa, Staphylococcus
VQAKEILDALGILKNGIFTYDID

SEQ ID NO: 2056058 - protein, 24 aa, Staphylococcus
VQDAYSLRCIPQIHGASFQVFNYV

SEQ ID NO: 2056059 - protein, 19 aa, Staphylococcus
VQDEGRFGFQHLGFSSAGA

SEQ ID NO: 2056060 - protein, 23 aa, Staphylococcus
VQFLKDRYEAMKEFPMFDNIEYT

SEQ ID NO: 2056061 - protein, 17 aa, Staphylococcus
VQFPRDHFEEITPEQVK

SEQ ID NO: 2056062 - protein, 19 aa, Staphylococcus
VQFQYGLALCHLEMFNQAI

SEQ ID NO: 2056063 - protein, 19 aa, Staphylococcus
VQFQYGLTLCHLEMFQEAI

SEQ ID NO: 2056064 - protein, 18 aa, Staphylococcus
VQLLFQFLFSQGRLEQAK

SEQ ID NO: 2056065 - protein, 17 aa, Staphylococcus
VQLVLSFLKTVDNPLQD

SEQ ID NO: 2056066 - protein, 19 aa, Staphylococcus
VQSALNFKFMRRINEVGIP

SEQ ID NO: 2056067 - protein, 18 aa, Staphylococcus
VQSALNFQFMKQLNQAGV

SEQ ID NO: 2056068 - protein, 21 aa, Staphylococcus
VQSLRAGNHMVVFTTTILERG

SEQ ID NO: 2056069 - protein, 22 aa, Staphylococcus
VRAKEILDELGILKNGIFVHDI

SEQ ID NO: 2056070 - protein, 21 aa, Staphylococcus
VRAKSDIVAVCYHGGFERDLE

SEQ ID NO: 2056071 - protein, 17 aa, Staphylococcus
VRARRNGDMFKLNGRNG

SEQ ID NO: 2056072 - protein, 18 aa, Staphylococcus
VRDAFKFYHVRHEEVASL

SEQ ID NO: 2056073 - protein, 27 aa, Staphylococcus
VRFKLYKAGKHWIKAGLKDIELLRIMG

SEQ ID NO: 2056074 - protein, 17 aa, Staphylococcus
VRHAILWNDTRNSEQCK

SEQ ID NO: 2056075 - protein, 24 aa, Staphylococcus
VRHYRPEKVILFFTESIWFGNENI

SEQ ID NO: 2056076 - protein, 28 aa, Staphylococcus
VRLEFYRLYLLMVHLVKFGEMYAGSVDR

SEQ ID NO: 2056077 - protein, 23 aa, Staphylococcus
VRMAQDFSYRYPLVDGQGNFGSM

SEQ ID NO: 2056078 - protein, 24 aa, Staphylococcus
VRMAQEFSYRYPLVDGQGNFGSMD

SEQ ID NO: 2056079 - protein, 25 aa, Staphylococcus
VRMEKRYKGPIAFEYTHINNNRERV

SEQ ID NO: 2056080 - protein, 18 aa, Staphylococcus
VRPGAFFLTGCGNPDKGI

SEQ ID NO: 2056081 - protein, 18 aa, Staphylococcus
VRPGAFFLTGCGNPEKET

SEQ ID NO: 2056082 - protein, 17 aa, Staphylococcus
VRPGAFFLTGCGNQDKN

SEQ ID NO: 2056083 - protein, 21 aa, Staphylococcus
VRSALSIQLPMNWTLDQMVEY

SEQ ID NO: 2056084 - protein, 23 aa, Staphylococcus
VRSIIRFIKEYVQSHGFIKSLVL

SEQ ID NO: 2056085 - protein, 19 aa, Staphylococcus
VRVGMEMERSELLRKLVDV

SEQ ID NO: 2056086 - protein, 18 aa, Staphylococcus
VRVGMEMERTELLRKLVD

SEQ ID NO: 2056087 - protein, 21 aa, Staphylococcus
VRVVSMPNWFAFDKQSDDYKE

SEQ ID NO: 2056088 - protein, 21 aa, Staphylococcus
VRVVSMPNWFAFEQQSDDYKE

SEQ ID NO: 2056089 - protein, 17 aa, Staphylococcus
VRWGGGIFHHIAWSVPN

SEQ ID NO: 2056090 - protein, 19 aa, Staphylococcus
VRWGTGIFHHIAWAVPNNE

SEQ ID NO: 2056091 - protein, 19 aa, Staphylococcus
VRYLIGVGFSKQLITLDVF

SEQ ID NO: 2056092 - protein, 19 aa, Staphylococcus
VRYRLCPCKIKYDEERLSS

SEQ ID NO: 2056093 - protein, 19 aa, Staphylococcus
VSELMRWVSGEAFSKKLIT

SEQ ID NO: 2056094 - protein, 18 aa, Staphylococcus
VSEMDAFGSIYFVNLYSN

SEQ ID NO: 2056095 - protein, 17 aa, Staphylococcus
VSFAAKIIQDYFAEGFK

SEQ ID NO: 2056096 - protein, 18 aa, Staphylococcus
VSFGEGFKAAEKPGSAIQ

SEQ ID NO: 2056097 - protein, 17 aa, Staphylococcus
VSFTHEFMFTRPIFQTE

SEQ ID NO: 2056098 - protein, 22 aa, Staphylococcus
VSGGKRPLVCFFSNELNIHRTK

SEQ ID NO: 2056099 - protein, 20 aa, Staphylococcus
VSGRQLVKVAAWYDNEMSYT

SEQ ID NO: 2056100 - protein, 22 aa, Staphylococcus
VSHSLMSFFFIKISRTELQTFL

SEQ ID NO: 2056101 - protein, 20 aa, Staphylococcus
VSHSPRILGFDAVGIVESIG

SEQ ID NO: 2056102 - protein, 20 aa, Staphylococcus
VSICGMGGPLIAKILNEGTE

SEQ ID NO: 2056103 - protein, 23 aa, Staphylococcus
VSILKMKLLIWLTETETGDIQEL

SEQ ID NO: 2056104 - protein, 21 aa, Staphylococcus
VSIRDIDEWIGLLDQLEEKVK

SEQ ID NO: 2056105 - protein, 23 aa, Staphylococcus
VSIREFFPFIELKAFDDYSKNID

SEQ ID NO: 2056106 - protein, 24 aa, Staphylococcus
VSKKSGTIGLIWPSVDRVAVTHLI

SEQ ID NO: 2056107 - protein, 23 aa, Staphylococcus
VSKPVTCKMRIGWDEDHIYAVEN

SEQ ID NO: 2056108 - protein, 23 aa, Staphylococcus
VSNKIKALELIKQYQNVEQQIHE

SEQ ID NO: 2056109 - protein, 21 aa, Staphylococcus
VSPGLRIGWIVADKNVINHLS

SEQ ID NO: 2056110 - protein, 17 aa, Staphylococcus
VSQRLNKTIAIMLDTKG

SEQ ID NO: 2056111 - protein, 24 aa, Staphylococcus
VSTCIKGKFGWDFVNSEERLTRPL

SEQ ID NO: 2056112 - protein, 18 aa, Staphylococcus
VSYCKARFDIVQFSPEDA

SEQ ID NO: 2056113 - protein, 23 aa, Staphylococcus
VSYLPLRFCEGLERFDFNNVSLY

SEQ ID NO: 2056114 - protein, 19 aa, Staphylococcus
VTGAGCLLGAVIASFLPTD

SEQ ID NO: 2056115 - protein, 23 aa, Staphylococcus
VTGYRPVMEIQFLGFVFEVFDEV

SEQ ID NO: 2056116 - protein, 22 aa, Staphylococcus
VTHPKFAVPMPHRLFDYFNAFI

SEQ ID NO: 2056117 - protein, 17 aa, Staphylococcus
VTIGEDFSGLLDERPGV

SEQ ID NO: 2056118 - protein, 18 aa, Staphylococcus
VTKILLKRLKNIKLKTMN

SEQ ID NO: 2056119 - protein, 18 aa, Staphylococcus
VTLGYPEVRRAIRDGLSQ

SEQ ID NO: 2056120 - protein, 17 aa, Staphylococcus
VTPSMMIFTNFFRDQMD

SEQ ID NO: 2056121 - protein, 24 aa, Staphylococcus
VTRFRIVPLLIFRAMHYIGDIPEI

SEQ ID NO: 2056122 - protein, 20 aa, Staphylococcus
VTRPRGSVVIVSIFAHEVNF

SEQ ID NO: 2056123 - protein, 21 aa, Staphylococcus
VTSLYRPGPMQEIPTYISRRH

SEQ ID NO: 2056124 - protein, 17 aa, Staphylococcus
VTTMAITLAREFDTENV

SEQ ID NO: 2056125 - protein, 17 aa, Staphylococcus
VVAAICMYALKTAGFQS

SEQ ID NO: 2056126 - protein, 17 aa, Staphylococcus
VVAALLLKQADVKLLKR

SEQ ID NO: 2056127 - protein, 18 aa, Staphylococcus
VVACAVILNKGHHYLGLN

SEQ ID NO: 2056128 - protein, 17 aa, Staphylococcus
VVAEYGAEIVLMHNGDG

SEQ ID NO: 2056129 - protein, 18 aa, Staphylococcus
VVAGFDFTFGKFGKGNMA

SEQ ID NO: 2056130 - protein, 19 aa, Staphylococcus
VVAGRGELHLSILIENMRR

SEQ ID NO: 2056131 - protein, 18 aa, Staphylococcus
VVAWNFPILLASWKLAPA

SEQ ID NO: 2056132 - protein, 19 aa, Staphylococcus
VVAWNFPLLLASWKLAPAL

SEQ ID NO: 2056133 - protein, 17 aa, Staphylococcus
VVDFGAFVDIGVKQDGL

SEQ ID NO: 2056134 - protein, 19 aa, Staphylococcus
VVDQAKLNLGYRFPATYGN

SEQ ID NO: 2056135 - protein, 21 aa, Staphylococcus
VVDTFPIRFVVDGDNEVSDPK

SEQ ID NO: 2056136 - protein, 22 aa, Staphylococcus
VVEGPLWIQVHAFEKGVEVLIS

SEQ ID NO: 2056137 - protein, 23 aa, Staphylococcus
VVEGPLWIQVHAFEKGVEVTISK

SEQ ID NO: 2056138 - protein, 22 aa, Staphylococcus
VVEGPLWIQVHAFEKGVEVVIS

SEQ ID NO: 2056139 - protein, 17 aa, Staphylococcus
VVEKIKIARSFGDLSEN

SEQ ID NO: 2056140 - protein, 17 aa, Staphylococcus
VVGDTLFNNGIGRTDLY

SEQ ID NO: 2056141 - protein, 19 aa, Staphylococcus
VVILPRIGIEFEKMTPMKL

SEQ ID NO: 2056142 - protein, 20 aa, Staphylococcus
VVIRCIFAYFNVIGEEEALD

SEQ ID NO: 2056143 - protein, 20 aa, Staphylococcus
VVIRCIMVYFGYINKEEALI

SEQ ID NO: 2056144 - protein, 19 aa, Staphylococcus
VVLPETWIKTGDYAYIKDN

SEQ ID NO: 2056145 - protein, 19 aa, Staphylococcus
VVLRFGWLYGPGTWYGKDG

SEQ ID NO: 2056146 - protein, 18 aa, Staphylococcus
VVNDWPYEALVKIFYRYG

SEQ ID NO: 2056147 - protein, 17 aa, Staphylococcus
VVSIPVFLADRVEVTPV

SEQ ID NO: 2056148 - protein, 18 aa, Staphylococcus
VVSIPVFLADSVEIIPVE

SEQ ID NO: 2056149 - protein, 17 aa, Staphylococcus
VVTIPVFLSDSVQITPV

SEQ ID NO: 2056150 - protein, 22 aa, Staphylococcus
VVVNRGRIVGIGAHLKKGDKHA

SEQ ID NO: 2056151 - protein, 20 aa, Staphylococcus
VVYEWKDFMNQIGIFDNQML

SEQ ID NO: 2056152 - protein, 19 aa, Staphylococcus
VVYWHHFLRPEIKFDGIDP

SEQ ID NO: 2056153 - protein, 24 aa, Staphylococcus
VWKQFKSVFYFGTFDSPKQHDTIP

SEQ ID NO: 2056154 - protein, 20 aa, Staphylococcus
VYCRNCINLGRMDNVKPIFI

SEQ ID NO: 2056155 - protein, 20 aa, Staphylococcus
VYEMRWDIGYVLQQIALFPH

SEQ ID NO: 2056156 - protein, 18 aa, Staphylococcus
VYIIESFEKLTVQGENSI

SEQ ID NO: 2056157 - protein, 17 aa, Staphylococcus
VYKAAGAAADFGYDLEE

SEQ ID NO: 2056158 - protein, 17 aa, Staphylococcus
VYLGMPMGLILEIEGKT

SEQ ID NO: 2056159 - protein, 22 aa, Staphylococcus
VYLRYVPECVMIIDVQNNNKNE

SEQ ID NO: 2056160 - protein, 17 aa, Staphylococcus
VYNRNGVVTARAVISHR

SEQ ID NO: 2056161 - protein, 22 aa, Staphylococcus
VYNRRLRFTLAHEYGHYIMEHD

SEQ ID NO: 2056162 - protein, 17 aa, Staphylococcus
VYRAGSMPKEFKIPDQD

SEQ ID NO: 2056163 - protein, 19 aa, Staphylococcus
VYRELPFVVNQARVDEIPD

SEQ ID NO: 2056164 - protein, 19 aa, Staphylococcus
VYRSLGILQNCRMISMEEA

SEQ ID NO: 2056165 - protein, 20 aa, Staphylococcus
VYSDVYLPVSYRVRKNGNNK

SEQ ID NO: 2056166 - protein, 17 aa, Staphylococcus
VYWKNEYYYGFGAGASG

SEQ ID NO: 2056167 - protein, 18 aa, Staphylococcus
VYYLKQFIRHKLINYLDE

SEQ ID NO: 2056168 - protein, 17 aa, Staphylococcus
WAIAYKFPAEEVVTELL

SEQ ID NO: 2056169 - protein, 19 aa, Staphylococcus
WAKQFPFWSERTIKRAFGS

SEQ ID NO: 2056170 - protein, 17 aa, Staphylococcus
WAPLFFRGREVSGKTIG

SEQ ID NO: 2056171 - protein, 20 aa, Staphylococcus
WARPEHVHFASAYHILDLVF

SEQ ID NO: 2056172 - protein, 17 aa, Staphylococcus
WATWCGPCKMIAPVLEE

SEQ ID NO: 2056173 - protein, 17 aa, Staphylococcus
WAYVNSILVSWYQEGIN

SEQ ID NO: 2056174 - protein, 19 aa, Staphylococcus
WCAGFTMAALLNATKNTSQ

SEQ ID NO: 2056175 - protein, 17 aa, Staphylococcus
WCRMMIRQILSNSLKYS

SEQ ID NO: 2056176 - protein, 21 aa, Staphylococcus
WDLDILRTFYVSKFDYPENQI

SEQ ID NO: 2056177 - protein, 22 aa, Staphylococcus
WDMLFIVFSIHFIHILKELSKG

SEQ ID NO: 2056178 - protein, 22 aa, Staphylococcus
WDMLFVVFSIHFIHLLKQLDSE

SEQ ID NO: 2056179 - protein, 20 aa, Staphylococcus
WDMLFVVLAIHFIEICKTLP

SEQ ID NO: 2056180 - protein, 22 aa, Staphylococcus
WDNRYGCVIAIEILELLSDVEL

SEQ ID NO: 2056181 - protein, 17 aa, Staphylococcus
WDNYPICMAKTQYSFSD

SEQ ID NO: 2056182 - protein, 17 aa, Staphylococcus
WEGIELLPVTTINKKLL

SEQ ID NO: 2056183 - protein, 24 aa, Staphylococcus
WEIAQEVYQEWYLGHRLYRKVENK

SEQ ID NO: 2056184 - protein, 17 aa, Staphylococcus
WEKIGVRLVNSFLETFP

SEQ ID NO: 2056185 - protein, 18 aa, Staphylococcus
WENGFIKMDTLEVDAQDL

SEQ ID NO: 2056186 - protein, 17 aa, Staphylococcus
WEPPRFAHMSLIVNEQR

SEQ ID NO: 2056187 - protein, 23 aa, Staphylococcus
WFDLFKELGFKLGVLEFYLIEGH

SEQ ID NO: 2056188 - protein, 18 aa, Staphylococcus
WFENELWGVLLLGQRQNK

SEQ ID NO: 2056189 - protein, 24 aa, Staphylococcus
WFMKSGRTKWIFKFEIASADRVHC

SEQ ID NO: 2056190 - protein, 29 aa, Staphylococcus
WGAPEGMDTWDFAHCLPYFKRLEKTFGAT

SEQ ID NO: 2056191 - protein, 18 aa, Staphylococcus
WGEIPVRFISPKGNTDVL

SEQ ID NO: 2056192 - protein, 19 aa, Staphylococcus
WGGATFDVAYNFLKENPWK

SEQ ID NO: 2056193 - protein, 17 aa, Staphylococcus
WGGGIFHHIAWSVPNDE

SEQ ID NO: 2056194 - protein, 17 aa, Staphylococcus
WHFTQEVYQEWYLGQSL

SEQ ID NO: 2056195 - protein, 17 aa, Staphylococcus
WHPHAWDYAPKPITFPS

SEQ ID NO: 2056196 - protein, 17 aa, Staphylococcus
WHPHAWDYAPKSTLSSD

SEQ ID NO: 2056197 - protein, 17 aa, Staphylococcus
WHPYAWDYAPIRTDLTP

SEQ ID NO: 2056198 - protein, 23 aa, Staphylococcus
WIGAEHFCLKFAQILVKENEELN

SEQ ID NO: 2056199 - protein, 21 aa, Staphylococcus
WIKENMDGWMFYPQGFQQQKA

SEQ ID NO: 2056200 - protein, 17 aa, Staphylococcus
WILSTFPEWGTWLNEEI

SEQ ID NO: 2056201 - protein, 19 aa, Staphylococcus
WIPQGIGALFQYLPDASLE

SEQ ID NO: 2056202 - protein, 19 aa, Staphylococcus
WIVPHCGALLPIIAQRVAM

SEQ ID NO: 2056203 - protein, 18 aa, Staphylococcus
WKDKSSIIMDMFVEQSQK

SEQ ID NO: 2056204 - protein, 19 aa, Staphylococcus
WKDKSSIIVDMFVSRIHVF

SEQ ID NO: 2056205 - protein, 17 aa, Staphylococcus
WKEKLRMLKSFPTPTFD

SEQ ID NO: 2056206 - protein, 17 aa, Staphylococcus
WKGHIHFTTLMKVRKKP

SEQ ID NO: 2056207 - protein, 20 aa, Staphylococcus
WKIQRKYGIKHLVKRMSSSG

SEQ ID NO: 2056208 - protein, 20 aa, Staphylococcus
WKIQTKYGIKDLVKRMSTSG

SEQ ID NO: 2056209 - protein, 21 aa, Staphylococcus
WKNEYYYGFGAGASGYVDGVR

SEQ ID NO: 2056210 - protein, 17 aa, Staphylococcus
WKSDFNIYKPHSGVAVE

SEQ ID NO: 2056211 - protein, 21 aa, Staphylococcus
WLEDYLKYFKGAIVIISHDRY

SEQ ID NO: 2056212 - protein, 19 aa, Staphylococcus
WLGYYGFNVSSEWMIPKIM

SEQ ID NO: 2056213 - protein, 22 aa, Staphylococcus
WLKKHVFPGLTFNQILSLASNS

SEQ ID NO: 2056214 - protein, 22 aa, Staphylococcus
WLKKYSTNFAIIFKQANQSHYS

SEQ ID NO: 2056215 - protein, 20 aa, Staphylococcus
WLKRAEIYIDGFHNFSTLEY

SEQ ID NO: 2056216 - protein, 18 aa, Staphylococcus
WLPNLFVSGGLADLELGP

SEQ ID NO: 2056217 - protein, 19 aa, Staphylococcus
WLTDKGVHFDRSFVDMPVG

SEQ ID NO: 2056218 - protein, 21 aa, Staphylococcus
WLTKPRLGEMFKPIVNEARSA

SEQ ID NO: 2056219 - protein, 19 aa, Staphylococcus
WLTPVEMWRNHQMTLNVGD

SEQ ID NO: 2056220 - protein, 17 aa, Staphylococcus
WLVWKLSGGEAHITDYS

SEQ ID NO: 2056221 - protein, 20 aa, Staphylococcus
WMAEGAYMWMQEGLAMPEKL

SEQ ID NO: 2056222 - protein, 18 aa, Staphylococcus
WMDGRMPLIGIGSIFTAD

SEQ ID NO: 2056223 - protein, 25 aa, Staphylococcus
WMSAVFRPNVPFSMITTFNLFMALA

SEQ ID NO: 2056224 - protein, 34 aa, Staphylococcus
WMSLVLRPNVPFAMIPKFNLFIALGIRDAIQQFS

SEQ ID NO: 2056225 - protein, 35 aa, Staphylococcus
WMSLVLRPNVPFSMIPKFNLFVALGIRDAIQSFTN

SEQ ID NO: 2056226 - protein, 20 aa, Staphylococcus
WNIKQARNFRKRMDAEIAKQ

SEQ ID NO: 2056227 - protein, 19 aa, Staphylococcus
WNLQLGDLAMIWRAGCIIR

SEQ ID NO: 2056228 - protein, 21 aa, Staphylococcus
WNLQSEYPWIVKVIIRDQQVF

SEQ ID NO: 2056229 - protein, 20 aa, Staphylococcus
WNRKAFKGVELYQKTLGVIG

SEQ ID NO: 2056230 - protein, 20 aa, Staphylococcus
WNRKAFKGVELYQKVLGVIG

SEQ ID NO: 2056231 - protein, 19 aa, Staphylococcus
WNRKAFRGVELYGKTLGVI

SEQ ID NO: 2056232 - protein, 17 aa, Staphylococcus
WPADLILLAIGFIGTEN

SEQ ID NO: 2056233 - protein, 18 aa, Staphylococcus
WPADLVLLSIGFEGTETT

SEQ ID NO: 2056234 - protein, 17 aa, Staphylococcus
WPIFLERSLVDQIITVS

SEQ ID NO: 2056235 - protein, 20 aa, Staphylococcus
WPIGMGQNFFGIIDRDSKSI

SEQ ID NO: 2056236 - protein, 20 aa, Staphylococcus
WPIGMGQNFFGIIDRETKTI

SEQ ID NO: 2056237 - protein, 20 aa, Staphylococcus
WPIGMGQNFFGIIDRKTKTI

SEQ ID NO: 2056238 - protein, 17 aa, Staphylococcus
WPIQPLRDFWGINKRTE

SEQ ID NO: 2056239 - protein, 20 aa, Staphylococcus
WPVGMGQNFFGIIDRATKTI

SEQ ID NO: 2056240 - protein, 20 aa, Staphylococcus
WPVGMGQNFFGIIDREQRTI

SEQ ID NO: 2056241 - protein, 20 aa, Staphylococcus
WPVGMGQNFFGIIDRESHTI

SEQ ID NO: 2056242 - protein, 20 aa, Staphylococcus
WPYEALVKIFYRYGEEKFSK

SEQ ID NO: 2056243 - protein, 19 aa, Staphylococcus
WQAFRGEVPLSVYHEMTFF

SEQ ID NO: 2056244 - protein, 18 aa, Staphylococcus
WQFAEKVIFPYVEDDELV

SEQ ID NO: 2056245 - protein, 19 aa, Staphylococcus
WQKQFPFWSERTIKRTFSS

SEQ ID NO: 2056246 - protein, 20 aa, Staphylococcus
WQYKTLPSINQWYSDMEKQR

SEQ ID NO: 2056247 - protein, 23 aa, Staphylococcus
WRAGCIIRARFLQKIKDAYDNNS

SEQ ID NO: 2056248 - protein, 19 aa, Staphylococcus
WREGCIIRAQFLQKIKEAY

SEQ ID NO: 2056249 - protein, 19 aa, Staphylococcus
WRKSKLADVVNVYDGTHQT

SEQ ID NO: 2056250 - protein, 17 aa, Staphylococcus
WRKTQLQHMFLKQIMQR

SEQ ID NO: 2056251 - protein, 17 aa, Staphylococcus
WRLVNLTTFMYGTKLHF

SEQ ID NO: 2056252 - protein, 17 aa, Staphylococcus
WRRPALRNFNTKVEIIE

SEQ ID NO: 2056253 - protein, 21 aa, Staphylococcus
WRYIIQDGIVFRDFVHQYDMI

SEQ ID NO: 2056254 - protein, 20 aa, Staphylococcus
WSEIYALYLLEAYQRHMIGY

SEQ ID NO: 2056255 - protein, 17 aa, Staphylococcus
WSFHLQIYFLAERFKEQ

SEQ ID NO: 2056256 - protein, 18 aa, Staphylococcus
WSHFLRKVIVPALVPNRF

SEQ ID NO: 2056257 - protein, 19 aa, Staphylococcus
WSHLFKFVIFPAIVPNRFQ

SEQ ID NO: 2056258 - protein, 18 aa, Staphylococcus
WSKTFLKKVNRLLHPSFK

SEQ ID NO: 2056259 - protein, 20 aa, Staphylococcus
WSQLELKMYFDIEDLLTSDN

SEQ ID NO: 2056260 - protein, 21 aa, Staphylococcus
WSRIGEPFVGYSDAYSFNSPK

SEQ ID NO: 2056261 - protein, 21 aa, Staphylococcus
WSVHVPRRIKEIGPRIKKISD

SEQ ID NO: 2056262 - protein, 21 aa, Staphylococcus
WSVHVPRRIKEIGPRIKKTTD

SEQ ID NO: 2056263 - protein, 21 aa, Staphylococcus
WSVHVPRRIKEIGPRIKKVGD

SEQ ID NO: 2056264 - protein, 20 aa, Staphylococcus
WSVRLPDNFKTYCAKMSIKT

SEQ ID NO: 2056265 - protein, 21 aa, Staphylococcus
WTDIFIYPGFEYKAIDGLITN

SEQ ID NO: 2056266 - protein, 20 aa, Staphylococcus
WTHDEMLKVIAFFNQIERYY

SEQ ID NO: 2056267 - protein, 19 aa, Staphylococcus
WTLSYLVDYFMKWLNDTRG

SEQ ID NO: 2056268 - protein, 19 aa, Staphylococcus
WVHRRCLKPMFTIANQIAY

SEQ ID NO: 2056269 - protein, 21 aa, Staphylococcus
WVIEKDAWFGPELDHIKYVDN

SEQ ID NO: 2056270 - protein, 23 aa, Staphylococcus
WVTKPKMGPIFSEIVNQARSCRA

SEQ ID NO: 2056271 - protein, 18 aa, Staphylococcus
WVYMLTCLKSYLEFNAII

SEQ ID NO: 2056272 - protein, 17 aa, Staphylococcus
WWFEKGIDGFRVDAITH

SEQ ID NO: 2056273 - protein, 17 aa, Staphylococcus
WYAVHTYSGYENKVKKN

SEQ ID NO: 2056274 - protein, 20 aa, Staphylococcus
WYCRFCNRGQYWMCEKHDLY

SEQ ID NO: 2056275 - protein, 17 aa, Staphylococcus
WYERFGFGKTTGGMFDG

SEQ ID NO: 2056276 - protein, 24 aa, Staphylococcus
WYGANLFLPFAIAIKYYSIDQLID

SEQ ID NO: 2056277 - protein, 18 aa, Staphylococcus
WYINSFRYFRNMYKNFYY

SEQ ID NO: 2056278 - protein, 20 aa, Staphylococcus
YADMEVWLAFQYELHEVGKD

SEQ ID NO: 2056279 - protein, 21 aa, Staphylococcus
YAIEVPEIWHDPEIEPQTIEA

SEQ ID NO: 2056280 - protein, 17 aa, Staphylococcus
YAKDCYKVIGPFTKGEH

SEQ ID NO: 2056281 - protein, 25 aa, Staphylococcus
YAKKAFKMAIDYAFLVLNLNKVYLY

SEQ ID NO: 2056282 - protein, 19 aa, Staphylococcus
YALKITLRREHFINELESL

SEQ ID NO: 2056283 - protein, 17 aa, Staphylococcus
YARGVAVYGDIKDSTDE

SEQ ID NO: 2056284 - protein, 18 aa, Staphylococcus
YASACFKTAFDFQKEILE

SEQ ID NO: 2056285 - protein, 26 aa, Staphylococcus
YASDWSEIRPEWGLARNASFIIGQRE

SEQ ID NO: 2056286 - protein, 17 aa, Staphylococcus
YATLMGIDENTPVIVGA

SEQ ID NO: 2056287 - protein, 17 aa, Staphylococcus
YAVGLFFSKERVIGSKH

SEQ ID NO: 2056288 - protein, 17 aa, Staphylococcus
YCIILAYFENGQPKLSY

SEQ ID NO: 2056289 - protein, 20 aa, Staphylococcus
YCLFYPRFANQPNNVMTELL

SEQ ID NO: 2056290 - protein, 17 aa, Staphylococcus
YCQCFDYLVVDFVYQKD

SEQ ID NO: 2056291 - protein, 26 aa, Staphylococcus
YDDCLLFFRLGDFYEMFFDDAKEASR

SEQ ID NO: 2056292 - protein, 19 aa, Staphylococcus
YDDVEFKLYLGLKHISPYI

SEQ ID NO: 2056293 - protein, 17 aa, Staphylococcus
YDFLKQKRKAIIDNAYI

SEQ ID NO: 2056294 - protein, 17 aa, Staphylococcus
YDFYALGFGEPFPISGS

SEQ ID NO: 2056295 - protein, 17 aa, Staphylococcus
YDFYGVSGFDKTYYPKN

SEQ ID NO: 2056296 - protein, 22 aa, Staphylococcus
YDGKRAAYSYIVQVDVFVKANA

SEQ ID NO: 2056297 - protein, 23 aa, Staphylococcus
YDHYRFGIHIALHYLSFKKRTEK

SEQ ID NO: 2056298 - protein, 18 aa, Staphylococcus
YDIAGLRMMCQFVDDIDI

SEQ ID NO: 2056299 - protein, 24 aa, Staphylococcus
YDIIDEFRSLGGYDYEEIENRVVQ

SEQ ID NO: 2056300 - protein, 17 aa, Staphylococcus
YDIRMSLIFINEKIRLI

SEQ ID NO: 2056301 - protein, 17 aa, Staphylococcus
YDITKELGFLNIAEFIL

SEQ ID NO: 2056302 - protein, 20 aa, Staphylococcus
YDIVKQYGFVKRFQVVEPSL

SEQ ID NO: 2056303 - protein, 18 aa, Staphylococcus
YDKARGRLVGTIEVPMTL

SEQ ID NO: 2056304 - protein, 18 aa, Staphylococcus
YDKERGKLIGTIEVPMTL

SEQ ID NO: 2056305 - protein, 24 aa, Staphylococcus
YDKTEFELIRWFGKRGRGLYLKAR

SEQ ID NO: 2056306 - protein, 18 aa, Staphylococcus
YDKTPAQIVLRWHLAHNR

SEQ ID NO: 2056307 - protein, 17 aa, Staphylococcus
YDLLYLLATNRNHVLQR

SEQ ID NO: 2056308 - protein, 17 aa, Staphylococcus
YDLLYLLATNRNRVLQR

SEQ ID NO: 2056309 - protein, 17 aa, Staphylococcus
YDLRFPEVARHSIMEGS

SEQ ID NO: 2056310 - protein, 22 aa, Staphylococcus
YDLRGVAIFKEYFTREGEPLIY

SEQ ID NO: 2056311 - protein, 20 aa, Staphylococcus
YDNPLFLGMGGMHGSYASNM

SEQ ID NO: 2056312 - protein, 18 aa, Staphylococcus
YDPDQCILCGRCVEACQD

SEQ ID NO: 2056313 - protein, 22 aa, Staphylococcus
YDPRKYLGPAREAIKATVIGKI

SEQ ID NO: 2056314 - protein, 22 aa, Staphylococcus
YDPRKYLGPAREAIKATVKGKI

SEQ ID NO: 2056315 - protein, 22 aa, Staphylococcus
YDPRKYLGPAREAIKATVTGKI

SEQ ID NO: 2056316 - protein, 18 aa, Staphylococcus
YDRAVELYYYIKGGTVDY

SEQ ID NO: 2056317 - protein, 17 aa, Staphylococcus
YDRLIYRYGSSNSAFSL

SEQ ID NO: 2056318 - protein, 25 aa, Staphylococcus
YDRPRGKFRFPIDLGQDAETYDEAV

SEQ ID NO: 2056319 - protein, 24 aa, Staphylococcus
YDRPRGKFRFPIDVGQDENYEEAI

SEQ ID NO: 2056320 - protein, 18 aa, Staphylococcus
YDRVNVVIATNAFGMGID

SEQ ID NO: 2056321 - protein, 17 aa, Staphylococcus
YDYLISDSMFSFGNLIA

SEQ ID NO: 2056322 - protein, 19 aa, Staphylococcus
YEASRLAGMHGIYRENGEN

SEQ ID NO: 2056323 - protein, 19 aa, Staphylococcus
YEEGPCMGAAMLAIVGLSW

SEQ ID NO: 2056324 - protein, 24 aa, Staphylococcus
YEELRFLTFTGFRIGRFKEIAVDE

SEQ ID NO: 2056325 - protein, 19 aa, Staphylococcus
YEESYGFLAGPFVRDKDAI

SEQ ID NO: 2056326 - protein, 21 aa, Staphylococcus
YEFLTLRLPMLLIPLGLDQSR

SEQ ID NO: 2056327 - protein, 18 aa, Staphylococcus
YEGIEFVEFLISPNKGEP

SEQ ID NO: 2056328 - protein, 23 aa, Staphylococcus
YEHFRFGLHLAIQYLSYRKRTEQ

SEQ ID NO: 2056329 - protein, 23 aa, Staphylococcus
YEHYRLGINMAIQYLSYKKRTEK

SEQ ID NO: 2056330 - protein, 17 aa, Staphylococcus
YEIGRVFFANGEGELPD

SEQ ID NO: 2056331 - protein, 17 aa, Staphylococcus
YEILEWAYRTYGDSIVY

SEQ ID NO: 2056332 - protein, 17 aa, Staphylococcus
YEIYQIWCANNGYHNMN

SEQ ID NO: 2056333 - protein, 17 aa, Staphylococcus
YELKADILLTAHHQDDQ

SEQ ID NO: 2056334 - protein, 21 aa, Staphylococcus
YELKFGPILLRNKSDIFFSKW

SEQ ID NO: 2056335 - protein, 17 aa, Staphylococcus
YELLRLKGFYKDSNKKA

SEQ ID NO: 2056336 - protein, 18 aa, Staphylococcus
YELPILGVHNMRNAAIAI

SEQ ID NO: 2056337 - protein, 17 aa, Staphylococcus
YELTLRDKVCWFYSRSK

SEQ ID NO: 2056338 - protein, 20 aa, Staphylococcus
YENPLFLGMGGMHGSYAANM

SEQ ID NO: 2056339 - protein, 23 aa, Staphylococcus
YEPSLQYFNEWWKQLYGESEGKD

SEQ ID NO: 2056340 - protein, 17 aa, Staphylococcus
YEPSMQYFNEWWKQLYG

SEQ ID NO: 2056341 - protein, 23 aa, Staphylococcus
YEQAETWLRFNLKEINRELFEYA

SEQ ID NO: 2056342 - protein, 20 aa, Staphylococcus
YEQRLPKIVIVIDELADLMM

SEQ ID NO: 2056343 - protein, 21 aa, Staphylococcus
YERKIPLILVFEGMDAAGKGG

SEQ ID NO: 2056344 - protein, 17 aa, Staphylococcus
YESFKLFESTFFDHQLL

SEQ ID NO: 2056345 - protein, 22 aa, Staphylococcus
YEVCILKMQLLIWITETDTGDI

SEQ ID NO: 2056346 - protein, 17 aa, Staphylococcus
YEYDIVLAIGQAGGRYE

SEQ ID NO: 2056347 - protein, 17 aa, Staphylococcus
YEYEVISVFNLDEKEIR

SEQ ID NO: 2056348 - protein, 20 aa, Staphylococcus
YFATFAIKVAHYLDIDTIAF

SEQ ID NO: 2056349 - protein, 18 aa, Staphylococcus
YFDIFKYATSFITLQVPR

SEQ ID NO: 2056350 - protein, 18 aa, Staphylococcus
YFDIFKYGTSFVTLQVHR

SEQ ID NO: 2056351 - protein, 18 aa, Staphylococcus
YFDIFRYATSFITLQVER

SEQ ID NO: 2056352 - protein, 18 aa, Staphylococcus
YFDIFRYGTSFITLQVSR

SEQ ID NO: 2056353 - protein, 20 aa, Staphylococcus
YFDKEAYAVLGLITSKTPEL

SEQ ID NO: 2056354 - protein, 17 aa, Staphylococcus
YFFNLLSGIGFTDDIDH

SEQ ID NO: 2056355 - protein, 17 aa, Staphylococcus
YFGKSDITFNDWIENIN

SEQ ID NO: 2056356 - protein, 22 aa, Staphylococcus
YFICAAGVRSGRIVEYLNQHKP

SEQ ID NO: 2056357 - protein, 22 aa, Staphylococcus
YFKKEAIHFAWEFLTSENWMGM

SEQ ID NO: 2056358 - protein, 17 aa, Staphylococcus
YFKRMLVDFAEQTNYTC

SEQ ID NO: 2056359 - protein, 18 aa, Staphylococcus
YFLDLGIKVVVITLGEQG

SEQ ID NO: 2056360 - protein, 21 aa, Staphylococcus
YGAKMAWRHSNRCIGRFFWES

SEQ ID NO: 2056361 - protein, 17 aa, Staphylococcus
YGDIWEGYHHAIGFKNM

SEQ ID NO: 2056362 - protein, 17 aa, Staphylococcus
YGDVKFGVGPVIEGGFY

SEQ ID NO: 2056363 - protein, 18 aa, Staphylococcus
YGFYRCHRSYIINLQKVK

SEQ ID NO: 2056364 - protein, 18 aa, Staphylococcus
YGGSVLLGLDGNVVKAHG

SEQ ID NO: 2056365 - protein, 18 aa, Staphylococcus
YGGSVLLGLDGTVVKAHG

SEQ ID NO: 2056366 - protein, 17 aa, Staphylococcus
YGGTCINHGCIPSKVLV

SEQ ID NO: 2056367 - protein, 17 aa, Staphylococcus
YGIAWEIGLLKGLADHG

SEQ ID NO: 2056368 - protein, 18 aa, Staphylococcus
YGRIRAMVNDLGKRIKSA

SEQ ID NO: 2056369 - protein, 17 aa, Staphylococcus
YGRIRAMVNDLGQRIKT

SEQ ID NO: 2056370 - protein, 21 aa, Staphylococcus
YGSEIDILFILGGDGTVNELV

SEQ ID NO: 2056371 - protein, 17 aa, Staphylococcus
YGSKWFEKSHMYIRTDL

SEQ ID NO: 2056372 - protein, 26 aa, Staphylococcus
YGVGRRISLKYTRRMVDAAIKGELKN

SEQ ID NO: 2056373 - protein, 20 aa, Staphylococcus
YGVGRRISLNYTRQMVNQAI

SEQ ID NO: 2056374 - protein, 21 aa, Staphylococcus
YGVKIYDVFTILYLLQPQAFN

SEQ ID NO: 2056375 - protein, 24 aa, Staphylococcus
YGVLKRPQFFFAYDLDKYGQDLRG

SEQ ID NO: 2056376 - protein, 19 aa, Staphylococcus
YGVYRFKRGFNVHIEELIG

SEQ ID NO: 2056377 - protein, 25 aa, Staphylococcus
YHFKSRISVWLLNYIKASDKMLSQI

SEQ ID NO: 2056378 - protein, 24 aa, Staphylococcus
YHFKSRISVWLLNYLKASPPKLNC

SEQ ID NO: 2056379 - protein, 17 aa, Staphylococcus
YHILDLVFWFGKLEILK

SEQ ID NO: 2056380 - protein, 21 aa, Staphylococcus
YHLKNKFGRKIFKVALDGGFD

SEQ ID NO: 2056381 - protein, 18 aa, Staphylococcus
YHPTWKMVLGLFPKEDKV

SEQ ID NO: 2056382 - protein, 17 aa, Staphylococcus
YIAALKLGIAIIPSSEM

SEQ ID NO: 2056383 - protein, 23 aa, Staphylococcus
YIALEFASLFAHLDVDVTVLANH

SEQ ID NO: 2056384 - protein, 21 aa, Staphylococcus
YIALEFASLFANLGTHVSVLE

SEQ ID NO: 2056385 - protein, 17 aa, Staphylococcus
YICLKLITTEYWSLNSL

SEQ ID NO: 2056386 - protein, 22 aa, Staphylococcus
YIDLRLDTRLAFTDSQINVYKT

SEQ ID NO: 2056387 - protein, 18 aa, Staphylococcus
YIDLRLITRLTFTESQIN

SEQ ID NO: 2056388 - protein, 18 aa, Staphylococcus
YIEKTICGKKLLFIHYEI

SEQ ID NO: 2056389 - protein, 23 aa, Staphylococcus
YIFCKAYGKIAINIAKYTKKGSL

SEQ ID NO: 2056390 - protein, 23 aa, Staphylococcus
YIICAAGARSARVVQYLEDSNIH

SEQ ID NO: 2056391 - protein, 18 aa, Staphylococcus
YIIKTWLEDGGIDPRRRG

SEQ ID NO: 2056392 - protein, 22 aa, Staphylococcus
YIKANTFSLIWEEMVENYLNNY

SEQ ID NO: 2056393 - protein, 17 aa, Staphylococcus
YILCKAFGKMASNIEKY

SEQ ID NO: 2056394 - protein, 17 aa, Staphylococcus
YILEQGGKLVLFSHLGK

SEQ ID NO: 2056395 - protein, 17 aa, Staphylococcus
YILKYVFANGISRDIIY

SEQ ID NO: 2056396 - protein, 22 aa, Staphylococcus
YILKYVFANGISRDIIYPLLEE

SEQ ID NO: 2056397 - protein, 22 aa, Staphylococcus
YILKYVFANGISRDIIYPLLEK

SEQ ID NO: 2056398 - protein, 22 aa, Staphylococcus
YILKYVFANGISRDIIYPLLVK

SEQ ID NO: 2056399 - protein, 23 aa, Staphylococcus
YILKYVFANGISREIIYPLLEQM

SEQ ID NO: 2056400 - protein, 17 aa, Staphylococcus
YILYRLGFIESEGRYFI

SEQ ID NO: 2056401 - protein, 17 aa, Staphylococcus
YIMNLPVNFLKTFLPEL

SEQ ID NO: 2056402 - protein, 17 aa, Staphylococcus
YIMSLPVNFLKTFLPEL

SEQ ID NO: 2056403 - protein, 18 aa, Staphylococcus
YIPNCDKITPGMLLAAVR

SEQ ID NO: 2056404 - protein, 18 aa, Staphylococcus
YIPNCDKITPGMLLASVR

SEQ ID NO: 2056405 - protein, 18 aa, Staphylococcus
YIPNCDKITPGMLMAAVR

SEQ ID NO: 2056406 - protein, 19 aa, Staphylococcus
YIQYLGVDYIWLTPIYESP

SEQ ID NO: 2056407 - protein, 17 aa, Staphylococcus
YIQYLGVDYIWLTPVYE

SEQ ID NO: 2056408 - protein, 19 aa, Staphylococcus
YIQYLGVDYIWLTPVYESP

SEQ ID NO: 2056409 - protein, 18 aa, Staphylococcus
YIVTWALGHLVTNAQPEH

SEQ ID NO: 2056410 - protein, 20 aa, Staphylococcus
YIWFQFKFSIDMKRLFDEAI

SEQ ID NO: 2056411 - protein, 17 aa, Staphylococcus
YKAWRQWSHKDRAELLL

SEQ ID NO: 2056412 - protein, 17 aa, Staphylococcus
YKDLPLRIAEFGQVHRH

SEQ ID NO: 2056413 - protein, 17 aa, Staphylococcus
YKDNIHWGDINQPIDEE

SEQ ID NO: 2056414 - protein, 20 aa, Staphylococcus
YKDRIPVVIKNTNRPNDKGT

SEQ ID NO: 2056415 - protein, 17 aa, Staphylococcus
YKDRVLVPMAYIDFDEY

SEQ ID NO: 2056416 - protein, 17 aa, Staphylococcus
YKEHVGVVFDDLRVPNK

SEQ ID NO: 2056417 - protein, 18 aa, Staphylococcus
YKEKREYESLMSRIEETE

SEQ ID NO: 2056418 - protein, 18 aa, Staphylococcus
YKELISLMTKIKVSKQLA

SEQ ID NO: 2056419 - protein, 21 aa, Staphylococcus
YKFAGGKGINVSRVLKTLDVD

SEQ ID NO: 2056420 - protein, 21 aa, Staphylococcus
YKFAGGKGINVSRVLKTLDVS

SEQ ID NO: 2056421 - protein, 21 aa, Staphylococcus
YKFAGGKGINVSRVLKTLGVP

SEQ ID NO: 2056422 - protein, 20 aa, Staphylococcus
YKFAGGKGINVSRVLQTHET

SEQ ID NO: 2056423 - protein, 26 aa, Staphylococcus
YKFRYHILEAIKIVFEYQSIYEKMRF

SEQ ID NO: 2056424 - protein, 23 aa, Staphylococcus
YKGEPKLGFKEMEEIGASTGLPL

SEQ ID NO: 2056425 - protein, 17 aa, Staphylococcus
YKGIPAIIVLKLITLIF

SEQ ID NO: 2056426 - protein, 20 aa, Staphylococcus
YKHRIPVVIKNTNRPQDKGT

SEQ ID NO: 2056427 - protein, 20 aa, Staphylococcus
YKIPSSVFYTNFNKTIDINK

SEQ ID NO: 2056428 - protein, 20 aa, Staphylococcus
YKKDISLWKTDALRTIAEDL

SEQ ID NO: 2056429 - protein, 17 aa, Staphylococcus
YKKEILNDNYLVVATKD

SEQ ID NO: 2056430 - protein, 20 aa, Staphylococcus
YKLAEFDKIIVYRNEKDLTQ

SEQ ID NO: 2056431 - protein, 23 aa, Staphylococcus
YKLDADFTPKFVVGYVETKDKHP

SEQ ID NO: 2056432 - protein, 18 aa, Staphylococcus
YKLIWDRFVASQMAPAVL

SEQ ID NO: 2056433 - protein, 17 aa, Staphylococcus
YKLPILGIHNMKNAAIA

SEQ ID NO: 2056434 - protein, 18 aa, Staphylococcus
YKNNIVFHRIWKAKATGK

SEQ ID NO: 2056435 - protein, 19 aa, Staphylococcus
YKPYIEGFIKMLAPIAPHI

SEQ ID NO: 2056436 - protein, 19 aa, Staphylococcus
YKPYIEGFVTMLAPIAPHI

SEQ ID NO: 2056437 - protein, 24 aa, Staphylococcus
YKTFLKNEIARWIKIQEDIGLDVL

SEQ ID NO: 2056438 - protein, 22 aa, Staphylococcus
YKTTRLESGLIFPPYKGKFSYV

SEQ ID NO: 2056439 - protein, 17 aa, Staphylococcus
YKVCVLLDMHVGHLRSI

SEQ ID NO: 2056440 - protein, 26 aa, Staphylococcus
YKVHLMKECLDRGISVISSMGAANKT

SEQ ID NO: 2056441 - protein, 22 aa, Staphylococcus
YKVHLMKECLNRGINLISSMGA

SEQ ID NO: 2056442 - protein, 18 aa, Staphylococcus
YKVLGPFVRKSLSLTEEN

SEQ ID NO: 2056443 - protein, 17 aa, Staphylococcus
YKVQVMGGIAIHGGDIS

SEQ ID NO: 2056444 - protein, 17 aa, Staphylococcus
YKVQVMGGIAIHHGDIA

SEQ ID NO: 2056445 - protein, 17 aa, Staphylococcus
YKWAYVNSILVSWYQEG

SEQ ID NO: 2056446 - protein, 19 aa, Staphylococcus
YKYARGVAVYGDIKDGTND

SEQ ID NO: 2056447 - protein, 18 aa, Staphylococcus
YLAACKPAFKDALHSAVQ

SEQ ID NO: 2056448 - protein, 18 aa, Staphylococcus
YLDLKPYLLYKIKDCSKG

SEQ ID NO: 2056449 - protein, 18 aa, Staphylococcus
YLDLYLIHWPCEKDGLYI

SEQ ID NO: 2056450 - protein, 17 aa, Staphylococcus
YLEEFRKGFKQQIEHTK

SEQ ID NO: 2056451 - protein, 27 aa, Staphylococcus
YLEKYSLKCFAHLFKMIIHKPIWLISE

SEQ ID NO: 2056452 - protein, 17 aa, Staphylococcus
YLFEIIDPYSLHQQGQD

SEQ ID NO: 2056453 - protein, 17 aa, Staphylococcus
YLFEVIDPYSLNQQGQD

SEQ ID NO: 2056454 - protein, 17 aa, Staphylococcus
YLGRIGIGRVFRGTIKV

SEQ ID NO: 2056455 - protein, 21 aa, Staphylococcus
YLIDLLENFALERGVYGKRWL

SEQ ID NO: 2056456 - protein, 20 aa, Staphylococcus
YLIEGTDFTTGWIFFIDDVG

SEQ ID NO: 2056457 - protein, 18 aa, Staphylococcus
YLIIEAIKTVFGYTSLYE

SEQ ID NO: 2056458 - protein, 19 aa, Staphylococcus
YLIKELKFESAIYDLVSSY

SEQ ID NO: 2056459 - protein, 20 aa, Staphylococcus
YLINGSNFTTGWIFFINEEG

SEQ ID NO: 2056460 - protein, 17 aa, Staphylococcus
YLIPRNVHKSVFHGLEL

SEQ ID NO: 2056461 - protein, 24 aa, Staphylococcus
YLKKYNCLYVRIDPYLPYQYRDHD

SEQ ID NO: 2056462 - protein, 19 aa, Staphylococcus
YLLPYVPFEYFWKRYQQEI

SEQ ID NO: 2056463 - protein, 18 aa, Staphylococcus
YLQTRLKINIGFSDIYFY

SEQ ID NO: 2056464 - protein, 19 aa, Staphylococcus
YLRKLKCIYVLVDPYLLES

SEQ ID NO: 2056465 - protein, 20 aa, Staphylococcus
YLRVDPYLAYQYRNHDGEVL

SEQ ID NO: 2056466 - protein, 18 aa, Staphylococcus
YLTIPRGDTGYFFNTAYL

SEQ ID NO: 2056467 - protein, 17 aa, Staphylococcus
YLYCKAFGKTATNIEKF

SEQ ID NO: 2056468 - protein, 18 aa, Staphylococcus
YMAALSFLTFVALDDNGK

SEQ ID NO: 2056469 - protein, 20 aa, Staphylococcus
YMCEGTCWCVQAYQNKKLTK

SEQ ID NO: 2056470 - protein, 18 aa, Staphylococcus
YMGAYRLQWEMIKFAKEH

SEQ ID NO: 2056471 - protein, 18 aa, Staphylococcus
YMGPYAMHWHMINYCFDN

SEQ ID NO: 2056472 - protein, 18 aa, Staphylococcus
YMIGMSFNQLGAFKEAMP

SEQ ID NO: 2056473 - protein, 18 aa, Staphylococcus
YMIVCLNVIVAESDEEAE

SEQ ID NO: 2056474 - protein, 22 aa, Staphylococcus
YMLGFMPGFPFLGGLDSRLHTP

SEQ ID NO: 2056475 - protein, 22 aa, Staphylococcus
YMLGFMPGFPFLGGLNKQLHTP

SEQ ID NO: 2056476 - protein, 25 aa, Staphylococcus
YMTIFKFRGHRIVAFNGGRFLIHNM

SEQ ID NO: 2056477 - protein, 17 aa, Staphylococcus
YMVGSTYRFKKSDVDDF

SEQ ID NO: 2056478 - protein, 19 aa, Staphylococcus
YMWECPDLFELDGQHVLLF

SEQ ID NO: 2056479 - protein, 27 aa, Staphylococcus
YNDCLLFFRLGDFYEMFFDDAKEASRV

SEQ ID NO: 2056480 - protein, 23 aa, Staphylococcus
YNDLPHLVAPVITDVKAATQSLK

SEQ ID NO: 2056481 - protein, 18 aa, Staphylococcus
YNEFMGAYCLQWDMIRYA

SEQ ID NO: 2056482 - protein, 18 aa, Staphylococcus
YNEKLIIPGFFGVSRQNY

SEQ ID NO: 2056483 - protein, 20 aa, Staphylococcus
YNGKPLVCIGILKGSVMFMA

SEQ ID NO: 2056484 - protein, 19 aa, Staphylococcus
YNIGAPLGMPTFDSTVNPL

SEQ ID NO: 2056485 - protein, 17 aa, Staphylococcus
YNIPLYLGRTLSNVKGT

SEQ ID NO: 2056486 - protein, 18 aa, Staphylococcus
YNMFLPFTVTGNVIGKAT

SEQ ID NO: 2056487 - protein, 19 aa, Staphylococcus
YNMWCQHIFNFLSSGVRSS

SEQ ID NO: 2056488 - protein, 20 aa, Staphylococcus
YNNYREWFATILIRRDETQE

SEQ ID NO: 2056489 - protein, 17 aa, Staphylococcus
YNQVGMINLCFEIFDDK

SEQ ID NO: 2056490 - protein, 20 aa, Staphylococcus
YNVLHPMGWDAFGLPAEQYA

SEQ ID NO: 2056491 - protein, 17 aa, Staphylococcus
YNYFGIGAYDWNPNYAI

SEQ ID NO: 2056492 - protein, 18 aa, Staphylococcus
YPELKLAIITPFEGHTQR

SEQ ID NO: 2056493 - protein, 19 aa, Staphylococcus
YPGYSGYHVQEWLEKQEIY

SEQ ID NO: 2056494 - protein, 21 aa, Staphylococcus
YPHLKIKWIRGNIDTRLNKLE

SEQ ID NO: 2056495 - protein, 17 aa, Staphylococcus
YPIIPGIDLAGTVVESN

SEQ ID NO: 2056496 - protein, 17 aa, Staphylococcus
YPIRALMMSHMFVEVDD

SEQ ID NO: 2056497 - protein, 19 aa, Staphylococcus
YPKFGFKKASHWGIQAPFE

SEQ ID NO: 2056498 - protein, 18 aa, Staphylococcus
YPKFGFKKASNWCIQAPF

SEQ ID NO: 2056499 - protein, 25 aa, Staphylococcus
YPKLAHLNLKWYAVPIISNMDLKIG

SEQ ID NO: 2056500 - protein, 21 aa, Staphylococcus
YPLCYNIAVKIIKMMQQHLDV

SEQ ID NO: 2056501 - protein, 22 aa, Staphylococcus
YPLDSPGGWQIIGRTPLKVFDL

SEQ ID NO: 2056502 - protein, 17 aa, Staphylococcus
YPLNKLFSINDMIKEAG

SEQ ID NO: 2056503 - protein, 18 aa, Staphylococcus
YPMLCANIFENGEPFTGQ

SEQ ID NO: 2056504 - protein, 17 aa, Staphylococcus
YPNVFMIGATVRHDNAT

SEQ ID NO: 2056505 - protein, 21 aa, Staphylococcus
YPTILKRVCEVFKINMDKPFK

SEQ ID NO: 2056506 - protein, 20 aa, Staphylococcus
YPTYKLCRDLLHLLDHSSQF

SEQ ID NO: 2056507 - protein, 17 aa, Staphylococcus
YPYFPFEKSKSFEFFYV

SEQ ID NO: 2056508 - protein, 18 aa, Staphylococcus
YQAQCVLTDILPTIDNIE

SEQ ID NO: 2056509 - protein, 27 aa, Staphylococcus
YQDCLLFFRLGDFYEMFFEDAKVASRV

SEQ ID NO: 2056510 - protein, 18 aa, Staphylococcus
YQFKSVCINPTHVSYASQ

SEQ ID NO: 2056511 - protein, 19 aa, Staphylococcus
YQHLIKGFSVYTVIRAECS

SEQ ID NO: 2056512 - protein, 18 aa, Staphylococcus
YQIQMPRFRAMLLDDEIQ

SEQ ID NO: 2056513 - protein, 19 aa, Staphylococcus
YQKTPAQIVLRWHLAHNRI

SEQ ID NO: 2056514 - protein, 18 aa, Staphylococcus
YQNKRPDYISAFWNVVNW

SEQ ID NO: 2056515 - protein, 19 aa, Staphylococcus
YQRLNFYLIDLFRKENLKP

SEQ ID NO: 2056516 - protein, 20 aa, Staphylococcus
YQYKGAYALQWHMIKFAIKH

SEQ ID NO: 2056517 - protein, 20 aa, Staphylococcus
YRAGLDIDVDFVIRVGKPVI

SEQ ID NO: 2056518 - protein, 18 aa, Staphylococcus
YRCSWCDSSFTWDGSAKE

SEQ ID NO: 2056519 - protein, 17 aa, Staphylococcus
YRDAIDWGSVNQPIEEE

SEQ ID NO: 2056520 - protein, 18 aa, Staphylococcus
YRDDIDWGNINQPIEEEK

SEQ ID NO: 2056521 - protein, 17 aa, Staphylococcus
YRDNIAWGDINQPIDED

SEQ ID NO: 2056522 - protein, 24 aa, Staphylococcus
YREYFKNRIVSFVEWFDTKDRLRS

SEQ ID NO: 2056523 - protein, 17 aa, Staphylococcus
YRFGDGINEQGLAISNH

SEQ ID NO: 2056524 - protein, 18 aa, Staphylococcus
YRFKHHFDLIIVDEVDAF

SEQ ID NO: 2056525 - protein, 20 aa, Staphylococcus
YRFLVQLLRKNKLDVSEIET

SEQ ID NO: 2056526 - protein, 19 aa, Staphylococcus
YRGLFRFIQLFVVSNKKET

SEQ ID NO: 2056527 - protein, 19 aa, Staphylococcus
YRGSAGIKRLNKVLQDILN

SEQ ID NO: 2056528 - protein, 23 aa, Staphylococcus
YRHFAGSYAIQWTMINYAIDHGI

SEQ ID NO: 2056529 - protein, 24 aa, Staphylococcus
YRHFKDRVLVPLAYIKFDEYIEEL

SEQ ID NO: 2056530 - protein, 21 aa, Staphylococcus
YRHGKMPLTMFITKKGKKVKV

SEQ ID NO: 2056531 - protein, 23 aa, Staphylococcus
YRHYAGSYAIQWKMINYALEHGI

SEQ ID NO: 2056532 - protein, 17 aa, Staphylococcus
YRIASAILNLKGDNTST

SEQ ID NO: 2056533 - protein, 18 aa, Staphylococcus
YRIVCFHDGRFLIHGMTN

SEQ ID NO: 2056534 - protein, 17 aa, Staphylococcus
YRKDFCKNFLSEVKVAV

SEQ ID NO: 2056535 - protein, 18 aa, Staphylococcus
YRKSLMIKVFEHTTQYDE

SEQ ID NO: 2056536 - protein, 17 aa, Staphylococcus
YRLIKFIDKSPIFPLFG

SEQ ID NO: 2056537 - protein, 21 aa, Staphylococcus
YRLLSKLVLRMKAFDEFEFTS

SEQ ID NO: 2056538 - protein, 24 aa, Staphylococcus
YRLSEIKLGIDLGYLNLSNFKFNE

SEQ ID NO: 2056539 - protein, 20 aa, Staphylococcus
YRLSEVKLGIDLGYVQLQDF

SEQ ID NO: 2056540 - protein, 21 aa, Staphylococcus
YRMKLLEFKKYIIGSTIPHLY

SEQ ID NO: 2056541 - protein, 17 aa, Staphylococcus
YRNELSWIYSYEETEKL

SEQ ID NO: 2056542 - protein, 19 aa, Staphylococcus
YRPAIKALHHLGATDVIQS

SEQ ID NO: 2056543 - protein, 17 aa, Staphylococcus
YRPDYAIMTNIDFDHPD

SEQ ID NO: 2056544 - protein, 18 aa, Staphylococcus
YRPHIAIITNIYSAHLDY

SEQ ID NO: 2056545 - protein, 19 aa, Staphylococcus
YRPRLHCVRQDFFNIGFEG

SEQ ID NO: 2056546 - protein, 17 aa, Staphylococcus
YRPTVSIVNAENAAHGK

SEQ ID NO: 2056547 - protein, 18 aa, Staphylococcus
YRRVILCTGDLGFSSSKT

SEQ ID NO: 2056548 - protein, 18 aa, Staphylococcus
YRRWKDKSSIIVDMFVSR

SEQ ID NO: 2056549 - protein, 22 aa, Staphylococcus
YRRWKDKSSIIVDMFVSRTQIF

SEQ ID NO: 2056550 - protein, 20 aa, Staphylococcus
YRSSGGFGVRLDAGDGFQGA

SEQ ID NO: 2056551 - protein, 18 aa, Staphylococcus
YRVGFALGNKDVIQALKK

SEQ ID NO: 2056552 - protein, 20 aa, Staphylococcus
YRVGLKLKDNGWVYVQGLTH

SEQ ID NO: 2056553 - protein, 20 aa, Staphylococcus
YRVKNGVCNIIFNVRMTSAK

SEQ ID NO: 2056554 - protein, 17 aa, Staphylococcus
YRVLKVGSFLLSKDGYK

SEQ ID NO: 2056555 - protein, 17 aa, Staphylococcus
YRYEAFKPYSPAFRKSS

SEQ ID NO: 2056556 - protein, 22 aa, Staphylococcus
YSDHIIDAFGMRPYIKKKVKKY

SEQ ID NO: 2056557 - protein, 18 aa, Staphylococcus
YSGCRAGEILALKWSDVD

SEQ ID NO: 2056558 - protein, 17 aa, Staphylococcus
YSGLEIDVFDAHSNQSR

SEQ ID NO: 2056559 - protein, 18 aa, Staphylococcus
YSKYGIDIAKIFEVGILH

SEQ ID NO: 2056560 - protein, 17 aa, Staphylococcus
YSLPFNEANRYLVMPAL

SEQ ID NO: 2056561 - protein, 18 aa, Staphylococcus
YSNIKFILAHSGGTLPYI

SEQ ID NO: 2056562 - protein, 17 aa, Staphylococcus
YSQRIGTPAARMGDQID

SEQ ID NO: 2056563 - protein, 18 aa, Staphylococcus
YSSAWSFLVPEILQLDQS

SEQ ID NO: 2056564 - protein, 20 aa, Staphylococcus
YSSDVDIVFILGGDGTVNEL

SEQ ID NO: 2056565 - protein, 23 aa, Staphylococcus
YSSICFYAYAGGSKVIFFWGDKE

SEQ ID NO: 2056566 - protein, 18 aa, Staphylococcus
YSTGKWGEIPVRFISPKG

SEQ ID NO: 2056567 - protein, 18 aa, Staphylococcus
YSTNIAMVLTKIAKRNPR

SEQ ID NO: 2056568 - protein, 17 aa, Staphylococcus
YSTNIAMVLTKVAKRNP

SEQ ID NO: 2056569 - protein, 20 aa, Staphylococcus
YSVSIALQLVRRFPAIEKRV

SEQ ID NO: 2056570 - protein, 20 aa, Staphylococcus
YSVSIALQLVRRFPAIERRV

SEQ ID NO: 2056571 - protein, 18 aa, Staphylococcus
YSYAYSMRLVDEFSSINI

SEQ ID NO: 2056572 - protein, 18 aa, Staphylococcus
YTDFRMGIQIRHYTVQAL

SEQ ID NO: 2056573 - protein, 18 aa, Staphylococcus
YTELPFVVNQAMVDQLPE

SEQ ID NO: 2056574 - protein, 22 aa, Staphylococcus
YTETYPGVFAFIGSNSEYDLHH

SEQ ID NO: 2056575 - protein, 17 aa, Staphylococcus
YTGLRIGVTTAKTLAYA

SEQ ID NO: 2056576 - protein, 22 aa, Staphylococcus
YTGLRIGVTVAKTLAYALQTRL

SEQ ID NO: 2056577 - protein, 20 aa, Staphylococcus
YTIFRPAWLTNYDEIDYEVT

SEQ ID NO: 2056578 - protein, 22 aa, Staphylococcus
YTKDYPGVFAIIGSNSKYDLHH

SEQ ID NO: 2056579 - protein, 19 aa, Staphylococcus
YTKRISMPFLRSPFVHHIH

SEQ ID NO: 2056580 - protein, 17 aa, Staphylococcus
YTLGVKEQLIFPEIDYD

SEQ ID NO: 2056581 - protein, 20 aa, Staphylococcus
YTLRCIPQIHGASFQVFNYV

SEQ ID NO: 2056582 - protein, 18 aa, Staphylococcus
YTMPCARTLEPVDVPLDV

SEQ ID NO: 2056583 - protein, 24 aa, Staphylococcus
YTMPCARTLVPVDVPLDVRTSEVF

SEQ ID NO: 2056584 - protein, 24 aa, Staphylococcus
YTMPCARTLVPVEVPLDVRTSEIF

SEQ ID NO: 2056585 - protein, 19 aa, Staphylococcus
YTMSCARTLVPVEVPIDIK

SEQ ID NO: 2056586 - protein, 20 aa, Staphylococcus
YTPELLKFPFIPVSDASGIV

SEQ ID NO: 2056587 - protein, 17 aa, Staphylococcus
YTQAAVMSIAFNRPLAT

SEQ ID NO: 2056588 - protein, 20 aa, Staphylococcus
YTVSIALQLVRKFPAIEKRV

SEQ ID NO: 2056589 - protein, 17 aa, Staphylococcus
YVIVCLNAIIADSDEEA

SEQ ID NO: 2056590 - protein, 26 aa, Staphylococcus
YVKKYNCLYLRVDPYLPYQYLNHDGE

SEQ ID NO: 2056591 - protein, 17 aa, Staphylococcus
YVKQYPYTVLFVTHDRY

SEQ ID NO: 2056592 - protein, 19 aa, Staphylococcus
YVLRRLLRRAVRFSQTLGI

SEQ ID NO: 2056593 - protein, 24 aa, Staphylococcus
YVLYRKYYEGINMLQFEDVMTPAS

SEQ ID NO: 2056594 - protein, 19 aa, Staphylococcus
YVQRPTVDKIRHFQEVAKG

SEQ ID NO: 2056595 - protein, 21 aa, Staphylococcus
YVSCSPFRIPGAILATAQSQV

SEQ ID NO: 2056596 - protein, 24 aa, Staphylococcus
YVSGGKRPLICFFSNDLNIHRTKT

SEQ ID NO: 2056597 - protein, 17 aa, Staphylococcus
YVTYSDFANAFLDVAEQ

SEQ ID NO: 2056598 - protein, 22 aa, Staphylococcus
YVVLRFGWLYGPGTWYGKDGMI

SEQ ID NO: 2056599 - protein, 17 aa, Staphylococcus
YYAVIDFKGFEKMIDEL

SEQ ID NO: 2056600 - protein, 17 aa, Staphylococcus
YYEKRYKQLIADLDDIN

SEQ ID NO: 2056601 - protein, 23 aa, Staphylococcus
YYENVHIFEVEWGKAVNVPDFID

SEQ ID NO: 2056602 - protein, 24 aa, Staphylococcus
YYHAAEILKHFGIEKINLLSNNPE

SEQ ID NO: 2056603 - protein, 23 aa, Staphylococcus
YYIICAAGMRSAKVVKYLEDHDI

SEQ ID NO: 2056604 - protein, 24 aa, Staphylococcus
YYISKGWMCIQVFFVRNGNMIQRD

SEQ ID NO: 2056605 - protein, 17 aa, Staphylococcus
YYKQGFNAKEYVNQNEA

SEQ ID NO: 2056606 - protein, 19 aa, Staphylococcus
YYLPDVISLILAENGVAEV

SEQ ID NO: 2056607 - protein, 19 aa, Staphylococcus
YYLPDVLSLILDDGGKAEV

SEQ ID NO: 2056608 - protein, 18 aa, Staphylococcus
YYLPDVLSLILEDRGIVE

SEQ ID NO: 2056609 - protein, 19 aa, Staphylococcus
YYLPDVLSLILEEGGKAEV

SEQ ID NO: 2056610 - protein, 25 aa, Staphylococcus
YYPKFGFKQASNWGIQAPFDVPDEL

SEQ ID NO: 2056611 - protein, 20 aa, Staphylococcus
YYPSYSIRNGWCYGDTGIMN

SEQ ID NO: 2056612 - protein, 33 aa, Staphylococcus
YYREIRLAIEAEVKRLNLSLKRTIRIDGQQDHI

SEQ ID NO: 2056613 - protein, 22 aa, Staphylococcus
DNLRNRIIITSRLFASTTKKEI

SEQ ID NO: 2056614 - protein, 17 aa, Staphylococcus
LKSLKDHFYRYSLKLRQ

SEQ ID NO: 2056615 - protein, 27 aa, Staphylococcus
IDMYEPYMSLIKQLFPNAKIIIDRFHI

SEQ ID NO: 2056616 - protein, 18 aa, Staphylococcus
DVDPLNDVLALVESLTLV

SEQ ID NO: 2056617 - protein, 20 aa, Staphylococcus
GRMSLFYYAELTYQPTHCEN

SEQ ID NO: 2056618 - protein, 17 aa, Staphylococcus
ETWTTFFEYLKERGLQG

SEQ ID NO: 2056619 - protein, 19 aa, Staphylococcus
KGIFKFTDINLAREAKNRL

SEQ ID NO: 2056620 - protein, 28 aa, Staphylococcus
NVSWQRCQVHFLRNIFTTIPKKNSKSFR

SEQ ID NO: 2056621 - protein, 24 aa, Staphylococcus
RRREKIIRIFPNQTSANRLIGAVL

SEQ ID NO: 2056622 - protein, 20 aa, Staphylococcus
WTTFFEYLKERGLQGTELVI

SEQ ID NO: 2056623 - protein, 31 aa, Staphylococcus
RPLYNKYKSYWKLFLKPFETLEAFNYHKVHL

SEQ ID NO: 2056624 - protein, 25 aa, Staphylococcus
YHPKMMLKVILYAYTQSVFSGRKIE

SEQ ID NO: 2056625 - protein, 19 aa, Staphylococcus
KGKWSYLYRAIDAEGHTLD

SEQ ID NO: 2056626 - protein, 20 aa, Staphylococcus
AEGQRRYVESLSAYARQFLG

SEQ ID NO: 2056627 - protein, 24 aa, Staphylococcus
EKYRNIDVLLIDDIQFIQNKEQTQ

SEQ ID NO: 2056628 - protein, 26 aa, Staphylococcus
ENAKSLLYSRFFDPKRYDLASVGRYK

SEQ ID NO: 2056629 - protein, 24 aa, Staphylococcus
ERAGQFYVNQRWLGGILTNYKTIS

SEQ ID NO: 2056630 - protein, 20 aa, Staphylococcus
FDNRISVGVMYMLKLAHMVD

SEQ ID NO: 2056631 - protein, 24 aa, Staphylococcus
GIAMGHIGMRYSLPSREIIADAAE

SEQ ID NO: 2056632 - protein, 25 aa, Staphylococcus
IAYPRQIAMYLSRELTDFSLPKIGE

SEQ ID NO: 2056633 - protein, 27 aa, Staphylococcus
KAAVDTLIVIPNDRLLDIVDKSTPMME

SEQ ID NO: 2056634 - protein, 24 aa, Staphylococcus
KHVEVMVRQMLRKVRIIEAGDTKL

SEQ ID NO: 2056635 - protein, 18 aa, Staphylococcus
KPPTVVMMVGLQGAGKTT

SEQ ID NO: 2056636 - protein, 26 aa, Staphylococcus
KVNLKSIMGVMSLGVGKDAEITIYAD

SEQ ID NO: 2056637 - protein, 26 aa, Staphylococcus
LFFTNKGRVYKLKGYEVPELSRQSKG

SEQ ID NO: 2056638 - protein, 27 aa, Staphylococcus
LGQKKFYALDMFPYPSGAGLHVGHPEG

SEQ ID NO: 2056639 - protein, 25 aa, Staphylococcus
LTNIVLNRMRGTFTAVAVKAPGFGD

SEQ ID NO: 2056640 - protein, 32 aa, Staphylococcus; identical to SEQ ID NO: 1680534

SEQ ID NO: 2056641 - protein, 18 aa, Staphylococcus
MNIGQVLELHLGMAAKNL

SEQ ID NO: 2056642 - protein, 25 aa, Staphylococcus
NTLDISAVPILKQGTHLPVMVDVTH

SEQ ID NO: 2056643 - protein, 19 aa, Staphylococcus
RESFLDYAMSVIVSRALPD

SEQ ID NO: 2056644 - protein, 30 aa, Staphylococcus
RPLYNKYKSYWKLFLKPFETLEAFNYRKVH

SEQ ID NO: 2056645 - protein, 24 aa, Staphylococcus
SDRYITDRFLPDKAIDLVDQACAT

SEQ ID NO: 2056646 - protein, 23 aa, Staphylococcus
SGKIRMNYIRILPGDKVTVEMSP

SEQ ID NO: 2056647 - protein, 18 aa, Staphylococcus
SIRMMWLSQNQKPSYKTI

SEQ ID NO: 2056648 - protein, 38 aa, Staphylococcus; identical to SEQ ID NO: 1819417

SEQ ID NO: 2056649 - protein, 24 aa, Staphylococcus
SSKEELFNLRFQLATGQLEETARI

SEQ ID NO: 2056650 - protein, 18 aa, Staphylococcus
TAEERLLHAIFGEKAREV

SEQ ID NO: 2056651 - protein, 27 aa, Staphylococcus
TEKVRRKPYSVILFDEIEKAHPDVFNI

SEQ ID NO: 2056652 - protein, 24 aa, Staphylococcus
TGVEMFRKLLDYAEAGDNIGALLR

SEQ ID NO: 2056653 - protein, 26 aa, Staphylococcus
VYEDRSFTFITKTPPAPVLLKKAAGV

SEQ ID NO: 2056654 - protein, 26 aa, Staphylococcus
AAYRELSLLLRRPPGREAYPGDVFYL

SEQ ID NO: 2056655 - protein, 19 aa, Staphylococcus
AISSPLLETSIVGAQGVLM

SEQ ID NO: 2056656 - protein, 22 aa, Staphylococcus
ARGFIIGCPVAYSMGIGFAPVR

SEQ ID NO: 2056657 - protein, 17 aa, Staphylococcus
DAIEAALITAYKKNYDS

SEQ ID NO: 2056658 - protein, 25 aa, Staphylococcus
DECKIGIMPGYIHKKGHVGVVSRSG

SEQ ID NO: 2056659 - protein, 17 aa, Staphylococcus
DIDYLLDRRDSFGTVTN

SEQ ID NO: 2056660 - protein, 23 aa, Staphylococcus
DKNTSRIYAKFGKEIYVAAKSGE

SEQ ID NO: 2056661 - protein, 20 aa, Staphylococcus
DPGVDILSIIYQHGIEIEFP

SEQ ID NO: 2056662 - protein, 18 aa, Staphylococcus
DQLTCIFVDHGLLRKGEG

SEQ ID NO: 2056663 - protein, 17 aa, Staphylococcus
DRLIKFLGGIRDMKSMP

SEQ ID NO: 2056664 - protein, 24 aa, Staphylococcus
EDGIFIAVVTLDPKNRRIAAGPEI

SEQ ID NO: 2056665 - protein, 17 aa, Staphylococcus
EKPRKILLMVKAGPATD

SEQ ID NO: 2056666 - protein, 34 aa, Staphylococcus; identical to SEQ ID NO: 1819097

SEQ ID NO: 2056667 - protein, 23 aa, Staphylococcus
ENHRKLFIAIAKDVRVILVKLAD

SEQ ID NO: 2056668 - protein, 24 aa, Staphylococcus
ERAKAGLFLAMQYPSEITGVTNAD

SEQ ID NO: 2056669 - protein, 25 aa, Staphylococcus
ESKSLKLYLFSFRNHGDFHEDCMNI

SEQ ID NO: 2056670 - protein, 24 aa, Staphylococcus
ETTPGGRALKFYSSVRLEVRRAEQ

SEQ ID NO: 2056671 - protein, 19 aa, Staphylococcus
FDFDVVVATPDMMGEVGKL

SEQ ID NO: 2056672 - protein, 18 aa, Staphylococcus
FLGNIIAEVFNRFSITDT

SEQ ID NO: 2056673 - protein, 20 aa, Staphylococcus
GDFSLYDHILDTSLLFNIIP

SEQ ID NO: 2056674 - protein, 23 aa, Staphylococcus
GDMHYDVMSAFQKSIRGSDVNAA

SEQ ID NO: 2056675 - protein, 27 aa, Staphylococcus
GIDHNRLSLLMAVLEKKENYLLQQQDA

SEQ ID NO: 2056676 - protein, 17 aa, Staphylococcus
GLGLERTVAWISGVEHV

SEQ ID NO: 2056677 - protein, 20 aa, Staphylococcus
GMVFQQPNPFPKSIYDNITY

SEQ ID NO: 2056678 - protein, 27 aa, Staphylococcus
GTVNTEHMLFIGAGAFHVSKPSDLIPE

SEQ ID NO: 2056679 - protein, 17 aa, Staphylococcus
GVKINDPVRMYLKEIGR

SEQ ID NO: 2056680 - protein, 29 aa, Staphylococcus
HAVENFIMSRYQMYWQIYFHPVSRGGEVL

SEQ ID NO: 2056681 - protein, 18 aa, Staphylococcus
HLLQTVWGYDYFGDVRTV

SEQ ID NO: 2056682 - protein, 23 aa, Staphylococcus
HNHAPFANYWMHNGFINIDNEKM

SEQ ID NO: 2056683 - protein, 23 aa, Staphylococcus
KAHPDVFNILLQVLDDGHLTDTK

SEQ ID NO: 2056684 - protein, 24 aa, Staphylococcus
KAKQDFLLPHLENGKIVLIGATTS

SEQ ID NO: 2056685 - protein, 24 aa, Staphylococcus
KKFGAFVELPEGKSGLVHISEVAD

SEQ ID NO: 2056686 - protein, 20 aa, Staphylococcus
KLHHNFVGTEHILLGLIREN

SEQ ID NO: 2056687 - protein, 26 aa, Staphylococcus
KRGGKVWIKIFPHTPYTKKPLEVRMG

SEQ ID NO: 2056688 - protein, 18 aa, Staphylococcus
KRPATAKPVLLGITKASL

SEQ ID NO: 2056689 - protein, 29 aa, Staphylococcus
KTMASITFQNYFRMYNKLAGMTGTAKTEE

SEQ ID NO: 2056690 - protein, 24 aa, Staphylococcus
KVKRELGFVLMALNIRKVVAQRAE

SEQ ID NO: 2056691 - protein, 19 aa, Staphylococcus
LFQFCDSQFPTGAFSHSFG

SEQ ID NO: 2056692 - protein, 19 aa, Staphylococcus
LILVLDFGSQYNQLITRRI

SEQ ID NO: 2056693 - protein, 18 aa, Staphylococcus
LKRLLDLGAPGIIVQNEK

SEQ ID NO: 2056694 - protein, 17 aa, Staphylococcus
LLGLIRENEGVAARVFA

SEQ ID NO: 2056695 - protein, 20 aa, Staphylococcus
LNDVLALVESLTLVDAESLN

SEQ ID NO: 2056696 - protein, 24 aa, Staphylococcus
LNRAPTLHRLGIQAFEPTLVEGRA

SEQ ID NO: 2056697 - protein, 38 aa, Staphylococcus; identical to SEQ ID NO: 1680532

SEQ ID NO: 2056698 - protein, 20 aa, Staphylococcus
MIVMGFIEPFTKELPMEYAV

SEQ ID NO: 2056699 - protein, 36 aa, Staphylococcus; identical to SEQ ID NO: 1679643

SEQ ID NO: 2056700 - protein, 23 aa, Staphylococcus
PQDAALMMELGADGVFVGSGIFK

SEQ ID NO: 2056701 - protein, 18 aa, Staphylococcus
QEYAPILYQIWKKKHKKA

SEQ ID NO: 2056702 - protein, 30 aa, Staphylococcus; identical to SEQ ID NO: 1679991

SEQ ID NO: 2056703 - protein, 32 aa, Staphylococcus; identical to SEQ ID NO: 1688711

SEQ ID NO: 2056704 - protein, 18 aa, Staphylococcus
REGLTVLEYFISTHGARK

SEQ ID NO: 2056705 - protein, 23 aa, Staphylococcus
RVINRNNRLKRLLDLGAPGIIVQ

SEQ ID NO: 2056706 - protein, 35 aa, Staphylococcus; identical to SEQ ID NO: 1819390

SEQ ID NO: 2056707 - protein, 23 aa, Staphylococcus
SAANINIVVPYYGYARQDRKARS

SEQ ID NO: 2056708 - protein, 26 aa, Staphylococcus
SIGELEPRMFSFNSPFGACPTCDGLG

SEQ ID NO: 2056709 - protein, 17 aa, Staphylococcus
SIRMMWLSQNQKPSYKT

SEQ ID NO: 2056710 - protein, 25 aa, Staphylococcus
STGQLLFHLFAAFAEFERNLILERS

SEQ ID NO: 2056711 - protein, 19 aa, Staphylococcus
TCLGKVIGGGLPVGAFGGK

SEQ ID NO: 2056712 - protein, 19 aa, Staphylococcus
TIRIAPRKVRLVLDLIRGK

SEQ ID NO: 2056713 - protein, 19 aa, Staphylococcus
TIVVWRLDRLGRNMEDLIT

SEQ ID NO: 2056714 - protein, 24 aa, Staphylococcus
TKGAFPTWLAPKQVEIIPVNVDLH

SEQ ID NO: 2056715 - protein, 25 aa, Staphylococcus
TLVEGRAIRLHPLVTTAYNADFDGD

SEQ ID NO: 2056716 - protein, 21 aa, Staphylococcus
TMERFVAFLTEETKGAFPTWL

SEQ ID NO: 2056717 - protein, 24 aa, Staphylococcus
TTTTERILYYTGRIHKIGETHEGA

SEQ ID NO: 2056718 - protein, 24 aa, Staphylococcus
VEDVSTIIMNIKKLALKIYSEEDK

SEQ ID NO: 2056719 - protein, 23 aa, Staphylococcus
VPNATFMMIYDADRFGLSTLHQL

SEQ ID NO: 2056720 - protein, 35 aa, Staphylococcus; identical to SEQ ID NO: 1819477

SEQ ID NO: 2056721 - protein, 22 aa, Staphylococcus
VTTQVGCRIGCTFCASTLGGLK

SEQ ID NO: 2056722 - protein, 24 aa, Staphylococcus
WNPKMKKYIFTERNGIYIIDLQKT

SEQ ID NO: 2056723 - protein, 18 aa, Staphylococcus
YAFIKRLIKQFGKPQKVI

SEQ ID NO: 2056724 - protein, 17 aa, Staphylococcus
YARVNEFGFIETPYRKV

SEQ ID NO: 2056725 - protein, 19 aa, Staphylococcus
YGRVSRFGLVAFASSLDQI

SEQ ID NO: 2056726 - protein, 26 aa, Staphylococcus
YLKAEKGVHRLVRISPFDSSGRRHTS

SEQ ID NO: 2056727 - protein, 27 aa, Staphylococcus
AADLLGQPLYKYLGGFNGKQLPVPMMN

SEQ ID NO: 2056728 - protein, 24 aa, Staphylococcus
AAGTLYNIVGFQTHLKWGAQKEVI

SEQ ID NO: 2056729 - protein, 19 aa, Staphylococcus
AAMAHGRVFSFGPTFRAEK

SEQ ID NO: 2056730 - protein, 23 aa, Staphylococcus
ADKFKLTVLVDMFGRETPVEVEF

SEQ ID NO: 2056731 - protein, 25 aa, Staphylococcus
AEVIERLRPFLLRDGGDCTLVDVED

SEQ ID NO: 2056732 - protein, 24 aa, Staphylococcus
AHSDVFNVLLQILDEGRLTDSKGR

SEQ ID NO: 2056733 - protein, 42 aa, Staphylococcus; identical to SEQ ID NO: 1679526

SEQ ID NO: 2056734 - protein, 26 aa, Staphylococcus
AKTLMLTINLDNIAFMPCNPSVGGPA

SEQ ID NO: 2056735 - protein, 18 aa, Staphylococcus
ALEIVDGLLLNPLVGETK

SEQ ID NO: 2056736 - protein, 20 aa, Staphylococcus
ALSMWMTLKCGIVNLPYGGG

SEQ ID NO: 2056737 - protein, 19 aa, Staphylococcus
AYAFIKRLIKQFGKPQKVI

SEQ ID NO: 2056738 - protein, 22 aa, Staphylococcus
AYVPLSEMFGYATSLRSNTQGR

SEQ ID NO: 2056739 - protein, 26 aa, Staphylococcus
CYAILGLVHTLWKPMPGRFKDYIAMP

SEQ ID NO: 2056740 - protein, 24 aa, Staphylococcus
DDKQGVIRLFLKYGQNNERVITGL

SEQ ID NO: 2056741 - protein, 20 aa, Staphylococcus
DMTNMFWRQNISQMWVETEF

SEQ ID NO: 2056742 - protein, 24 aa, Staphylococcus
DRVDHRYVYVNLGRIEAVLSEAER

SEQ ID NO: 2056743 - protein, 17 aa, Staphylococcus
DVAFQYNDQYSESILSF

SEQ ID NO: 2056744 - protein, 22 aa, Staphylococcus
EDEIRRFLPRKVRTFQLQEAQR

SEQ ID NO: 2056745 - protein, 22 aa, Staphylococcus
EEAYEPQFGARPLKRFVQRQIE

SEQ ID NO: 2056746 - protein, 25 aa, Staphylococcus
EEIHQAGNVILFIDELHTLVGAGGA

SEQ ID NO: 2056747 - protein, 29 aa, Staphylococcus
EGCNNFCTFCIIPWARGLMRSRDPEKVVE

SEQ ID NO: 2056748 - protein, 24 aa, Staphylococcus
EKNVAPLELALSSGATFVAQGFSS

SEQ ID NO: 2056749 - protein, 23 aa, Staphylococcus
EKVQLIGFGNFEVRERAARKGRN

SEQ ID NO: 2056750 - protein, 23 aa, Staphylococcus
EQTETFLRGFLGRMLFSGEEVKK

SEQ ID NO: 2056751 - protein, 24 aa, Staphylococcus
ESLLLELNLIKQYQPRYNILLKDD

SEQ ID NO: 2056752 - protein, 26 aa, Staphylococcus
FGEKLQGFLVTKFGWVQSYGSRAVKP

SEQ ID NO: 2056753 - protein, 38 aa, Staphylococcus; identical to SEQ ID NO: 1819987

SEQ ID NO: 2056754 - protein, 22 aa, Staphylococcus
GKSQRVLVFAKGDKITEAEEAG

SEQ ID NO: 2056755 - protein, 17 aa, Staphylococcus
GPGMPEMLAPTSSIVGR

SEQ ID NO: 2056756 - protein, 24 aa, Staphylococcus
GSVELDIIFKSEGPKRLLAQFAPI

SEQ ID NO: 2056757 - protein, 26 aa, Staphylococcus
HDWRTKKPVIFRATPQWFASINKVRQ

SEQ ID NO: 2056758 - protein, 24 aa, Staphylococcus
IGIDRLVMLLTDSPSIRDVLLFPY

SEQ ID NO: 2056759 - protein, 24 aa, Staphylococcus
ISTGLIVPSKFFDLAKEGKDFYMF

SEQ ID NO: 2056760 - protein, 27 aa, Staphylococcus
ITDGQIFLQSDLFFSGVRPAINAGQSV

SEQ ID NO: 2056761 - protein, 24 aa, Staphylococcus
KAIDYLREKGIAKAAKKADRIAAE

SEQ ID NO: 2056762 - protein, 18 aa, Staphylococcus
KAMGFLVGQIMKASKGQA

SEQ ID NO: 2056763 - protein, 29 aa, Staphylococcus
KEEFLEKIRKALYMSKICSYAQGFAQMRK

SEQ ID NO: 2056764 - protein, 23 aa, Staphylococcus
KEEHLDFVIIDTAGRLHIDEALM

SEQ ID NO: 2056765 - protein, 21 aa, Staphylococcus
KEVELTLPLVVRLEGTNVERG

SEQ ID NO: 2056766 - protein, 37 aa, Staphylococcus; identical to SEQ ID NO: 1681723

SEQ ID NO: 2056767 - protein, 20 aa, Staphylococcus
KIQQGWFDFDVVVATPDMMG

SEQ ID NO: 2056768 - protein, 22 aa, Staphylococcus
KNSIDCHLGNRIVLKANGGRKK

SEQ ID NO: 2056769 - protein, 19 aa, Staphylococcus
KQILGVDPAFRTGCKLAVI

SEQ ID NO: 2056770 - protein, 17 aa, Staphylococcus
KQTAAYGHFGRTDVLLP

SEQ ID NO: 2056771 - protein, 27 aa, Staphylococcus
KRNEILQLMMLEPKFAILDEIDSGLDI

SEQ ID NO: 2056772 - protein, 26 aa, Staphylococcus
KTTPEKSLLQPLPKRAGRNNQGKLTV

SEQ ID NO: 2056773 - protein, 24 aa, Staphylococcus
KYDLSYIALDGDIGCMVNGAGLAM

SEQ ID NO: 2056774 - protein, 20 aa, Staphylococcus
LEIYAPLAHRLGINTIKWEL

SEQ ID NO: 2056775 - protein, 28 aa, Staphylococcus
LGGEMLSFYDWYADLPPASPQIWGEQTD

SEQ ID NO: 2056776 - protein, 24 aa, Staphylococcus
LSRDGQVFYLYNKVQSIYEKREQL

SEQ ID NO: 2056777 - protein, 18 aa, Staphylococcus
LTESIRLKSKKGTLLWLM

SEQ ID NO: 2056778 - protein, 25 aa, Staphylococcus
LTPKEYELLIYLAKTPNKVFDREQL

SEQ ID NO: 2056779 - protein, 19 aa, Staphylococcus
LWINSGVATLKKYFDGRET

SEQ ID NO: 2056780 - protein, 25 aa, Staphylococcus
MAKRLLDFGVHPPTIYFPLNVEEGM

SEQ ID NO: 2056781 - protein, 23 aa, Staphylococcus
MEKHAVSRLVGAPPGYVGHDDGG

SEQ ID NO: 2056782 - protein, 18 aa, Staphylococcus
MHTDPMKFLPEDGSLELT

SEQ ID NO: 2056783 - protein, 17 aa, Staphylococcus
MLNDSIRMMWLSQNQKP

SEQ ID NO: 2056784 - protein, 19 aa, Staphylococcus
MSMTRGYGIINHTFEEFRP

SEQ ID NO: 2056785 - protein, 34 aa, Staphylococcus; identical to SEQ ID NO: 1679646

SEQ ID NO: 2056786 - protein, 24 aa, Staphylococcus
NASSILYPILKRPDEKRVTERAYE

SEQ ID NO: 2056787 - protein, 25 aa, Staphylococcus
NCLMEVLGLALPYNGTALAVSDQRR

SEQ ID NO: 2056788 - protein, 18 aa, Staphylococcus
PAVEVILTVLHAGGKFGG

SEQ ID NO: 2056789 - protein, 25 aa, Staphylococcus
PDFATIYISYIPNIKMVESKSLKLY

SEQ ID NO: 2056790 - protein, 19 aa, Staphylococcus
PEILLLDESLSALDLKLRT

SEQ ID NO: 2056791 - protein, 19 aa, Staphylococcus
PFNKKFLGNIIAEVFNRFS

SEQ ID NO: 2056792 - protein, 23 aa, Staphylococcus
PGVNQLVRVYIVQKRKIHVGDKM

SEQ ID NO: 2056793 - protein, 17 aa, Staphylococcus
PIDIMLNPLGVPSRMNI

SEQ ID NO: 2056794 - protein, 22 aa, Staphylococcus
PKHVVYVWIDALVNYISSLGYL

SEQ ID NO: 2056795 - protein, 20 aa, Staphylococcus
PKIGAYHFTTIKPNLGVVST

SEQ ID NO: 2056796 - protein, 18 aa, Staphylococcus
PPTIYFPLNVEEGMMIEP

SEQ ID NO: 2056797 - protein, 17 aa, Staphylococcus
PREVLIDAIEAALITAY

SEQ ID NO: 2056798 - protein, 23 aa, Staphylococcus
PRFTDRFELFIVGREHANAFTEL

SEQ ID NO: 2056799 - protein, 29 aa, Staphylococcus
PTNGLDIPAISWLEDFLINFENTVIVVSH

SEQ ID NO: 2056800 - protein, 20 aa, Staphylococcus
PTVYNYIHIGNARPAINYDV

SEQ ID NO: 2056801 - protein, 21 aa, Staphylococcus
PVELRRSIGYVIQQIGLMPHM

SEQ ID NO: 2056802 - protein, 25 aa, Staphylococcus
PVNLHLMELLIMIDACKRASAANIN

SEQ ID NO: 2056803 - protein, 18 aa, Staphylococcus
QALLEIYERLRPGEPPTV

SEQ ID NO: 2056804 - protein, 29 aa, Staphylococcus
QGQFRKNGLPYIMHPIQVAGILTEMRLDG

SEQ ID NO: 2056805 - protein, 18 aa, Staphylococcus
QMELEFFCKPGEEIEWQN

SEQ ID NO: 2056806 - protein, 18 aa, Staphylococcus
RGYQKGRFSFNVKGGRCE

SEQ ID NO: 2056807 - protein, 24 aa, Staphylococcus
RNFEGRIHPLVKANYLASPQLVVA

SEQ ID NO: 2056808 - protein, 31 aa, Staphylococcus; identical to SEQ ID NO: 1680689

SEQ ID NO: 2056809 - protein, 17 aa, Staphylococcus
RVFKGQKMPGRMGGNTV

SEQ ID NO: 2056810 - protein, 18 aa, Staphylococcus
RWYAVHTYSGYENKVKKN

SEQ ID NO: 2056811 - protein, 20 aa, Staphylococcus
RYVSDRFLPDKAIDLIDEAS

SEQ ID NO: 2056812 - protein, 24 aa, Staphylococcus
SGKTLLAQTLAKTLNVPFAIADAT

SEQ ID NO: 2056813 - protein, 19 aa, Staphylococcus
SISDKLYFEPLTEEDVMNI

SEQ ID NO: 2056814 - protein, 22 aa, Staphylococcus
SSLAFDTIYAEGQRRYVESLSA

SEQ ID NO: 2056815 - protein, 26 aa, Staphylococcus
SVVDNTFMTPYYQNPLDFGIDIVLHS

SEQ ID NO: 2056816 - protein, 18 aa, Staphylococcus
SVVLLDFGKKQNIVRELN

SEQ ID NO: 2056817 - protein, 21 aa, Staphylococcus
TATMPTYLNALAGRGVHVITV

SEQ ID NO: 2056818 - protein, 31 aa, Staphylococcus; identical to SEQ ID NO: 1693464

SEQ ID NO: 2056819 - protein, 30 aa, Staphylococcus; identical to SEQ ID NO: 1680760

SEQ ID NO: 2056820 - protein, 19 aa, Staphylococcus
TFVIGPGNRFPHAASLAVA

SEQ ID NO: 2056821 - protein, 20 aa, Staphylococcus
TPQQLINIRPVIASIKEFFG

SEQ ID NO: 2056822 - protein, 26 aa, Staphylococcus
VDQLEQPIRLEPMSTFPVIRDLQVDR

SEQ ID NO: 2056823 - protein, 24 aa, Staphylococcus
VEPVFGFMKAILGFTRMSVRGLNK

SEQ ID NO: 2056824 - protein, 23 aa, Staphylococcus
VGKSTLFNAITKAGALAANYPFA

SEQ ID NO: 2056825 - protein, 26 aa, Staphylococcus
VIEGNSGLFVAMPSKRTPDGEFRDIA

SEQ ID NO: 2056826 - protein, 18 aa, Staphylococcus
VIKMGRYGKFMACSNFPD

SEQ ID NO: 2056827 - protein, 29 aa, Staphylococcus
VNYAEERVMRPLHFAIIDEVDSILIDEAR

SEQ ID NO: 2056828 - protein, 26 aa, Staphylococcus
VPEEDMPYLPDGRPIDIMLNPLGVPS

SEQ ID NO: 2056829 - protein, 26 aa, Staphylococcus
VRIASPEFMFPSFYGIDVSTTAELIS

SEQ ID NO: 2056830 - protein, 23 aa, Staphylococcus
VSEEQLFYLMSRGISEEEATEMI

SEQ ID NO: 2056831 - protein, 17 aa, Staphylococcus
VSQLLFLQAQDSEKDIY

SEQ ID NO: 2056832 - protein, 17 aa, Staphylococcus
VSRLVKRRTLAKEISDQ

SEQ ID NO: 2056833 - protein, 24 aa, Staphylococcus
VTDKEKILVLGSGPIRIGQGVEFD

SEQ ID NO: 2056834 - protein, 40 aa, Staphylococcus; identical to SEQ ID NO: 1833618

SEQ ID NO: 2056835 - protein, 30 aa, Staphylococcus; identical to SEQ ID NO: 1701024

SEQ ID NO: 2056836 - protein, 29 aa, Staphylococcus
YAAFEPTLDYVISKIPRFPFDKFEKGERE

SEQ ID NO: 2056837 - protein, 30 aa, Staphylococcus; identical to SEQ ID NO: 1681631

SEQ ID NO: 2056838 - protein, 17 aa, Staphylococcus
YMKIGLASPEKIRSWSY

SEQ ID NO: 2056839 - protein, 18 aa, Staphylococcus
YVMLGAGLVAKKAVEKGL

SEQ ID NO: 2056840 - protein, 25 aa, Staphylococcus
AEPYIRRRAIRHLEKKRVVIFAAGI

SEQ ID NO: 2056841 - protein, 25 aa, Staphylococcus
AEQRQTMLFSATMPKAIQTLVQQFM

SEQ ID NO: 2056842 - protein, 22 aa, Staphylococcus
AGLKAIVVIPEGKIALGKLSQA

SEQ ID NO: 2056843 - protein, 20 aa, Staphylococcus
AKTFLNKLYGGDMKSLVLNF

SEQ ID NO: 2056844 - protein, 21 aa, Staphylococcus
ALGFGYRTGFLGMLHMEIIQE

SEQ ID NO: 2056845 - protein, 17 aa, Staphylococcus
AMVFGQMNEPPGARMRV

SEQ ID NO: 2056846 - protein, 17 aa, Staphylococcus
ANLDLNITKARAQVVKA

SEQ ID NO: 2056847 - protein, 22 aa, Staphylococcus
AQTLANVYLALDNDLELLPVVN

SEQ ID NO: 2056848 - protein, 18 aa, Staphylococcus
ASRILGMGDVLSLIEKAQ

SEQ ID NO: 2056849 - protein, 17 aa, Staphylococcus
AVAVMALERVPSDIRAA

SEQ ID NO: 2056850 - protein, 21 aa, Staphylococcus
DDLFHIRTLGFRGEALASISS

SEQ ID NO: 2056851 - protein, 21 aa, Staphylococcus
DDLQPFNPESYVYGLFADMIE

SEQ ID NO: 2056852 - protein, 26 aa, Staphylococcus
DEEIRNTIRILSRKTKNNPVLIGEPG

SEQ ID NO: 2056853 - protein, 21 aa, Staphylococcus
DFNRTLLITYGMFIKDKTKKY

SEQ ID NO: 2056854 - protein, 30 aa, Staphylococcus; identical to SEQ ID NO: 1819664

SEQ ID NO: 2056855 - protein, 23 aa, Staphylococcus
DHHSRRGLLKMVGRRRHLLNYLR

SEQ ID NO: 2056856 - protein, 24 aa, Staphylococcus
DIVSIGARPINLLNSLRFGELSVK

SEQ ID NO: 2056857 - protein, 30 aa, Staphylococcus; identical to SEQ ID NO: 1819055

SEQ ID NO: 2056858 - protein, 23 aa, Staphylococcus
DMRLAAYIVGIKRTAEAARYRGW

SEQ ID NO: 2056859 - protein, 25 aa, Staphylococcus
DNPGLLRRPIILDEKRLQVGYNEDE

SEQ ID NO: 2056860 - protein, 21 aa, Staphylococcus
DQISKLLFESTKRRPMIIPVI

SEQ ID NO: 2056861 - protein, 21 aa, Staphylococcus
DQVIIDYLVSEFKKENGVDLS

SEQ ID NO: 2056862 - protein, 20 aa, Staphylococcus
DSGFYPLGSCTMKYNPKINE

SEQ ID NO: 2056863 - protein, 26 aa, Staphylococcus
DTEVNIVWNPPWNKDMMSRYAKIALG

SEQ ID NO: 2056864 - protein, 26 aa, Staphylococcus
DVQGIKIHLLHLLKGTPMVKQYEKGM

SEQ ID NO: 2056865 - protein, 23 aa, Staphylococcus
EAKTGAGFIVALTGAIMTMPGLP

SEQ ID NO: 2056866 - protein, 19 aa, Staphylococcus
EAPCYIAWSGKNRSPLVRV

SEQ ID NO: 2056867 - protein, 26 aa, Staphylococcus
EDRLRSRFEWGLIVDITPPDYETRMA

SEQ ID NO: 2056868 - protein, 18 aa, Staphylococcus
EFQRLRRIKQLGTLYLSF

SEQ ID NO: 2056869 - protein, 21 aa, Staphylococcus
EGTRPLLIEVQALVTPTTFNN

SEQ ID NO: 2056870 - protein, 25 aa, Staphylococcus
EHVASALIKWFNTNYHYIVPEWDNV

SEQ ID NO: 2056871 - protein, 19 aa, Staphylococcus
EIFNNLLSKQVDGIIFLGG

SEQ ID NO: 2056872 - protein, 33 aa, Staphylococcus; identical to SEQ ID NO: 1826558

SEQ ID NO: 2056873 - protein, 27 aa, Staphylococcus
EKARLQLALLMLQRDNVLILDEPTNHL

SEQ ID NO: 2056874 - protein, 25 aa, Staphylococcus
EKFNRPIFTFIDTKGAYPGKAAEER

SEQ ID NO: 2056875 - protein, 21 aa, Staphylococcus
EKHSVSRLIGAPPGYVGHDEG

SEQ ID NO: 2056876 - protein, 23 aa, Staphylococcus
ELFNAMVMTPYFPKPDVLIYLEC

SEQ ID NO: 2056877 - protein, 23 aa, Staphylococcus
EQDQKVLVFDLGGGTFDVSILEL

SEQ ID NO: 2056878 - protein, 23 aa, Staphylococcus
ERKLTEMGIYPAVDPLASTSRAL

SEQ ID NO: 2056879 - protein, 24 aa, Staphylococcus
ESLLDKTIFELDLSALVAGAKYRG

SEQ ID NO: 2056880 - protein, 23 aa, Staphylococcus
ETIDPVVGLSPYQARRIAFNINI

SEQ ID NO: 2056881 - protein, 27 aa, Staphylococcus
EWSRIPHFYMNYYVYQYATGYSAAQSL

SEQ ID NO: 2056882 - protein, 25 aa, Staphylococcus
FEDEFSLEAFNLYGALSMANAGPNT

SEQ ID NO: 2056883 - protein, 28 aa, Staphylococcus
FGGETYKLHLVPSGIFYKDKLAVIGNGV

SEQ ID NO: 2056884 - protein, 19 aa, Staphylococcus
FHPERMASRILGMGDVLSL

SEQ ID NO: 2056885 - protein, 19 aa, Staphylococcus
FKYHRHFFVPDNVGHDGFL

SEQ ID NO: 2056886 - protein, 24 aa, Staphylococcus
FPETKILILTMYDDEEYLFHVLRN

SEQ ID NO: 2056887 - protein, 18 aa, Staphylococcus
FPLTVNYEEKMYAAGKIP

SEQ ID NO: 2056888 - protein, 22 aa, Staphylococcus
FQFDETFMMYLPRLCEHCLNPS

SEQ ID NO: 2056889 - protein, 19 aa, Staphylococcus
FVIMGIANKRSIGFGVAKV

SEQ ID NO: 2056890 - protein, 18 aa, Staphylococcus
GATWLRTSDFKDDKDRVL

SEQ ID NO: 2056891 - protein, 24 aa, Staphylococcus
GDDVENILLRLIQAADFDIDKAEK

SEQ ID NO: 2056892 - protein, 26 aa, Staphylococcus
GDVKDVVLLDVTPLSLGIEIMGGRMN

SEQ ID NO: 2056893 - protein, 18 aa, Staphylococcus
GDYLADKGVVPFLKVDKG

SEQ ID NO: 2056894 - protein, 27 aa, Staphylococcus
GEVGRALYNFIWDEFCDWYIEMSKIPM

SEQ ID NO: 2056895 - protein, 17 aa, Staphylococcus
GFDCASSEFYENGVYDY

SEQ ID NO: 2056896 - protein, 32 aa, Staphylococcus; identical to SEQ ID NO: 1680328

SEQ ID NO: 2056897 - protein, 18 aa, Staphylococcus
GIGLYRTEFLYMGRDQMP

SEQ ID NO: 2056898 - protein, 18 aa, Staphylococcus
GKGKTVVTVLPSNGERYL

SEQ ID NO: 2056899 - protein, 25 aa, Staphylococcus
GLEFPIVFIMGMEESLFPHIRAIKS

SEQ ID NO: 2056900 - protein, 25 aa, Staphylococcus
GLERDIWQYFTVLPGIQSVGVMGDY

SEQ ID NO: 2056901 - protein, 25 aa, Staphylococcus
GLQARLMSQALRKLSGAISKSNTTA

SEQ ID NO: 2056902 - protein, 20 aa, Staphylococcus
GTEHILLGLIRENEGVAARV

SEQ ID NO: 2056903 - protein, 21 aa, Staphylococcus
GTREQFLREKILNGLVRSCEK

SEQ ID NO: 2056904 - protein, 17 aa, Staphylococcus
HAAAYVLMAVRIAYFKV

SEQ ID NO: 2056905 - protein, 26 aa, Staphylococcus
HDVDMLRMCRYPWKTKQRILSDMGHV

SEQ ID NO: 2056906 - protein, 23 aa, Staphylococcus
HVMNLLMHVDQVSYVRFASVYKE

SEQ ID NO: 2056907 - protein, 23 aa, Staphylococcus
HVQRQMLETIPGLEKADMMRAGY

SEQ ID NO: 2056908 - protein, 21 aa, Staphylococcus
IALGLDRLVMLLTNRTNLRDT

SEQ ID NO: 2056909 - protein, 26 aa, Staphylococcus
IARKHNLHATFMPKPLFGVNGSGMHF

SEQ ID NO: 2056910 - protein, 24 aa, Staphylococcus
IEKKLSRYPQLYSRIGFAHEFDNL

SEQ ID NO: 2056911 - protein, 23 aa, Staphylococcus
IIGNGFSVIYLISQRLVKKSLDD

SEQ ID NO: 2056912 - protein, 25 aa, Staphylococcus
IIKDSIADIFLQQILTRPAEHDVVA

SEQ ID NO: 2056913 - protein, 19 aa, Staphylococcus
IQIGEKLTRGLGAGANPEI

SEQ ID NO: 2056914 - protein, 26 aa, Staphylococcus
IRLKSKKGTLLWLMDETKTPMGARRL

SEQ ID NO: 2056915 - protein, 18 aa, Staphylococcus
ITIKDIVIYPDAYSIKKR

SEQ ID NO: 2056916 - protein, 23 aa, Staphylococcus
ITRDNLLMRMKEQEWDDVIDTNL

SEQ ID NO: 2056917 - protein, 24 aa, Staphylococcus
IVHKHYWNIGIAADTDRGLLVPVV

SEQ ID NO: 2056918 - protein, 18 aa, Staphylococcus
KALVEKLKTLIPRQQFEV

SEQ ID NO: 2056919 - protein, 38 aa, Staphylococcus; identical to SEQ ID NO: 1819215

SEQ ID NO: 2056920 - protein, 23 aa, Staphylococcus
KEIAKKIAILPQSPEVADGLTVG

SEQ ID NO: 2056921 - protein, 24 aa, Staphylococcus
KGLNIVGLINIQFVIAHDGVYVLE

SEQ ID NO: 2056922 - protein, 17 aa, Staphylococcus
KIDIPRVRFTTSHPWDF

SEQ ID NO: 2056923 - protein, 20 aa, Staphylococcus
KIILGNTYHLWLQPGNDIIK

SEQ ID NO: 2056924 - protein, 24 aa, Staphylococcus
KNRDATYAAPLRVKVRLIIKETGE

SEQ ID NO: 2056925 - protein, 23 aa, Staphylococcus
KTIRTLITRLYKKEIIKRYKSEN

SEQ ID NO: 2056926 - protein, 18 aa, Staphylococcus
KVMYITDGVFSMDGDVAK

SEQ ID NO: 2056927 - protein, 21 aa, Staphylococcus
KYKVYIIDEVHMLTTGAFNAL

SEQ ID NO: 2056928 - protein, 29 aa, Staphylococcus
LADPEKLKHWLPVDLYIGGVEHAVLHLLY

SEQ ID NO: 2056929 - protein, 20 aa, Staphylococcus
LADPLNDVLALVESLTLVDV

SEQ ID NO: 2056930 - protein, 27 aa, Staphylococcus
LAYFEVLHEMKLIVDLMYEGGMENVRY

SEQ ID NO: 2056931 - protein, 26 aa, Staphylococcus
LDEETFGYVVYFFELACAMSGYQLGV

SEQ ID NO: 2056932 - protein, 18 aa, Staphylococcus
LIEQPDLLLLDEPTNHLD

SEQ ID NO: 2056933 - protein, 25 aa, Staphylococcus
LIQIDTTNILFILGGAFDGIDEVIK

SEQ ID NO: 2056934 - protein, 25 aa, Staphylococcus
LKGLDSLLSIVQMPGGIPVATTAIG

SEQ ID NO: 2056935 - protein, 25 aa, Staphylococcus
LMITHYQRLLNYITPDKVHVMYGGK

SEQ ID NO: 2056936 - protein, 20 aa, Staphylococcus
LNQAPFSFDLSVMAIYPCLT

SEQ ID NO: 2056937 - protein, 22 aa, Staphylococcus
LNVPLIGFTGAPFTLASYMIEG

SEQ ID NO: 2056938 - protein, 19 aa, Staphylococcus
LREPALGPTFGIKGGATGG

SEQ ID NO: 2056939 - protein, 21 aa, Staphylococcus
LRKPDWLKIKLNTNENYTGLK

SEQ ID NO: 2056940 - protein, 21 aa, Staphylococcus
LTNFGAFVDIGGVDGLVHVSE

SEQ ID NO: 2056941 - protein, 23 aa, Staphylococcus
LTQYVGHLNVVLFAPEDLNIVKG

SEQ ID NO: 2056942 - protein, 19 aa, Staphylococcus
LVMKPSEITPLTTIRVFEL

SEQ ID NO: 2056943 - protein, 17 aa, Staphylococcus
LVVRLEGTNVERGKEIL

SEQ ID NO: 2056944 - protein, 22 aa, Staphylococcus
LYIDEQTFVPCTPLGIMEILKH

SEQ ID NO: 2056945 - protein, 17 aa, Staphylococcus
LYRSVIMDHYKNPRNKG

SEQ ID NO: 2056946 - protein, 24 aa, Staphylococcus
MDAGNMLKPMLARGELHCIGATTL

SEQ ID NO: 2056947 - protein, 17 aa, Staphylococcus
NDVLALVESLTLVDVDA

SEQ ID NO: 2056948 - protein, 17 aa, Staphylococcus
NHMLQMVALLAMEAPIS

SEQ ID NO: 2056949 - protein, 23 aa, Staphylococcus
NHYDLPVFITNYPTKIKPFYMQP

SEQ ID NO: 2056950 - protein, 20 aa, Staphylococcus
NIPLNVFSIMEEGNIKRAVM

SEQ ID NO: 2056951 - protein, 23 aa, Staphylococcus
NIQKAVAEMKLAVGLLVDKKLSH

SEQ ID NO: 2056952 - protein, 24 aa, Staphylococcus
NKVAPPFRVAEVDIMYGQGISKEG

SEQ ID NO: 2056953 - protein, 20 aa, Staphylococcus
NPELYIIDEPFLGLDPLGIQ

SEQ ID NO: 2056954 - protein, 26 aa, Staphylococcus
NRIAQTINRFGFTIRGIYGEGSQVYG

SEQ ID NO: 2056955 - protein, 20 aa, Staphylococcus
NVHASLLPKYRGGAPIHQAI

SEQ ID NO: 2056956 - protein, 27 aa, Staphylococcus
NVTAARLGWLPSYPQFNKNSLLFGEEA

SEQ ID NO: 2056957 - protein, 18 aa, Staphylococcus
NYTLGIKEQLIFPEIDYD

SEQ ID NO: 2056958 - protein, 29 aa, Staphylococcus
PAEDTVLTAYKLIEILEEAGLPKGVVNFV

SEQ ID NO: 2056959 - protein, 17 aa, Staphylococcus
PCLITIFGATGDLSHRK

SEQ ID NO: 2056960 - protein, 24 aa, Staphylococcus
PDDKRIMQDIFIPKGQSLGAVDGH

SEQ ID NO: 2056961 - protein, 26 aa, Staphylococcus
PENRVEYFVSYYDYYQPEAYVPSTDT

SEQ ID NO: 2056962 - protein, 21 aa, Staphylococcus
PQLLYIDLHLIHEVTSPQAFE

SEQ ID NO: 2056963 - protein, 25 aa, Staphylococcus
PSPTGYLHIGNARTALFNYLFAKHY

SEQ ID NO: 2056964 - protein, 23 aa, Staphylococcus
PSSELLSSVLMLEHLGWQEAADK

SEQ ID NO: 2056965 - protein, 23 aa, Staphylococcus
PVNFGANLGLMLDLYDDYLQDPS

SEQ ID NO: 2056966 - protein, 25 aa, Staphylococcus
QAAILGMHSIITRPIAIDKDTIENR

SEQ ID NO: 2056967 - protein, 20 aa, Staphylococcus
QDILPLLEQVVQSSRPILIV

SEQ ID NO: 2056968 - protein, 22 aa, Staphylococcus
QEYLDDLGFNLVGYGCTTCIGN

SEQ ID NO: 2056969 - protein, 26 aa, Staphylococcus
QGPDFPTAGLILGKSGIRRAYETGRG

SEQ ID NO: 2056970 - protein, 20 aa, Staphylococcus
QGRDYFVKFNCPEFTSLCPI

SEQ ID NO: 2056971 - protein, 27 aa, Staphylococcus
QGTIRAPQWRGGGIVFGPTPRSYSYKM

SEQ ID NO: 2056972 - protein, 20 aa, Staphylococcus
QKFLDLFDKHELDSAVIGEV

SEQ ID NO: 2056973 - protein, 25 aa, Staphylococcus
QNPLDFGIDIVLHSATKYIGGHSDV

SEQ ID NO: 2056974 - protein, 17 aa, Staphylococcus
QSHLLGLSLIGVNEILA

SEQ ID NO: 2056975 - protein, 19 aa, Staphylococcus
QVILLLDEIHRLDKAKQDF

SEQ ID NO: 2056976 - protein, 21 aa, Staphylococcus
QVLPMEDINLHFNGDFHAITT

SEQ ID NO: 2056977 - protein, 29 aa, Staphylococcus
RDEQGQDVLLFIDNIFRFTQAGSEVSALL

SEQ ID NO: 2056978 - protein, 17 aa, Staphylococcus
RDIFFHHPYESFEPIVD

SEQ ID NO: 2056979 - protein, 17 aa, Staphylococcus
RDLKAPIRMHRLLQGDV

SEQ ID NO: 2056980 - protein, 25 aa, Staphylococcus
RELSRLYVYAHHKGLKSLYYTRNKL

SEQ ID NO: 2056981 - protein, 25 aa, Staphylococcus
RFSTNTFPSWKRAHPNRLLMHNGEI

SEQ ID NO: 2056982 - protein, 22 aa, Staphylococcus
RGTAQRILYSAFDLVEQRSGRD

SEQ ID NO: 2056983 - protein, 19 aa, Staphylococcus
RLGFPEARIPLSQAVIELC

SEQ ID NO: 2056984 - protein, 20 aa, Staphylococcus
RRVNFLFGDIVKVTPSSKVV

SEQ ID NO: 2056985 - protein, 21 aa, Staphylococcus
RTALFNYLFAKHYDGDFVVRI

SEQ ID NO: 2056986 - protein, 33 aa, Staphylococcus; identical to SEQ ID NO: 1820829

SEQ ID NO: 2056987 - protein, 37 aa, Staphylococcus; identical to SEQ ID NO: 1680698

SEQ ID NO: 2056988 - protein, 30 aa, Staphylococcus
RWMEEIRDWTISRQLWWGHQIPAWYHKETG

SEQ ID NO: 2056989 - protein, 30 aa, Staphylococcus; identical to SEQ ID NO: 1680703

SEQ ID NO: 2056990 - protein, 24 aa, Staphylococcus
SDNKTLGRFQLTDIPPAPRGVPQI

SEQ ID NO: 2056991 - protein, 29 aa, Staphylococcus
SHDGLVSMLLSVLQAPVRNFAYAVKAVGE

SEQ ID NO: 2056992 - protein, 21 aa, Staphylococcus
SIHYIATVVSVYRKVIDAYAE

SEQ ID NO: 2056993 - protein, 26 aa, Staphylococcus
SKFGHQLRFDLSKGFPLLTTKKVSFK

SEQ ID NO: 2056994 - protein, 23 aa, Staphylococcus
SKIKEFKLLSTAGAYWRGDSNNK

SEQ ID NO: 2056995 - protein, 21 aa, Staphylococcus
SPQEAYAYLEKLRSIIQYTGV

SEQ ID NO: 2056996 - protein, 18 aa, Staphylococcus
SPVLWKKVKKGLSAGRVQ

SEQ ID NO: 2056997 - protein, 20 aa, Staphylococcus
SRLTTFLEHELAKTTSLHGV

SEQ ID NO: 2056998 - protein, 23 aa, Staphylococcus
SVALLAQDYYYKDQSHLTFEERL

SEQ ID NO: 2056999 - protein, 19 aa, Staphylococcus
SVVEKLITLGKKGDLASRR

SEQ ID NO: 2057000 - protein, 20 aa, Staphylococcus
TATFMILGAVCTRACRFCAV

SEQ ID NO: 2057001 - protein, 24 aa, Staphylococcus
TEFLMDHRHLWLRSKKQHAVMKIR

SEQ ID NO: 2057002 - protein, 18 aa, Staphylococcus
TEVIMHLIRRSKAPTFEE

SEQ ID NO: 2057003 - protein, 22 aa, Staphylococcus
TFHSMCVRILRRDADRIGIERN

SEQ ID NO: 2057004 - protein, 19 aa, Staphylococcus
TFLDTPGHAAFTTMRARGA

SEQ ID NO: 2057005 - protein, 24 aa, Staphylococcus
TGAEPLYFLDYIATNKVVPEVIEQ

SEQ ID NO: 2057006 - protein, 17 aa, Staphylococcus
TGDMFRKAIKDETDLGK

SEQ ID NO: 2057007 - protein, 29 aa, Staphylococcus
TGSVVLPGRFFVDIIKKLPGKDVKLSTNE

SEQ ID NO: 2057008 - protein, 22 aa, Staphylococcus
THAQMKMFLTRLGFGSKMVVTG

SEQ ID NO: 2057009 - protein, 24 aa, Staphylococcus
TIDPEIYNLGIPVLGICYGMQLTT

SEQ ID NO: 2057010 - protein, 23 aa, Staphylococcus
TLAMNFWATIEHTLRYKYDGDYP

SEQ ID NO: 2057011 - protein, 18 aa, Staphylococcus
TMIELYEAYADYHDIMDL

SEQ ID NO: 2057012 - protein, 24 aa, Staphylococcus
TRGQAPYKFLLSHGFVMDGEGKKM

SEQ ID NO: 2057013 - protein, 22 aa, Staphylococcus
TRLARAYNLVIPPSGRTLSGGL

SEQ ID NO: 2057014 - protein, 24 aa, Staphylococcus
TSKTPLSMYLANKGYKIANIPLVP

SEQ ID NO: 2057015 - protein, 26 aa, Staphylococcus
TTGRPRRVGWFDSVVLRHSRRVSGIT

SEQ ID NO: 2057016 - protein, 25 aa, Staphylococcus
TTGTIFNHLFKQAITFAKKAHNETD

SEQ ID NO: 2057017 - protein, 26 aa, Staphylococcus
TVERARRIQFFLSQNFHVAEQFTGQK

SEQ ID NO: 2057018 - protein, 33 aa, Staphylococcus; identical to SEQ ID NO: 1680060

SEQ ID NO: 2057019 - protein, 19 aa, Staphylococcus
VCTRACRFCAVKTGLPNEL

SEQ ID NO: 2057020 - protein, 29 aa, Staphylococcus
VEETLIQPTFIYGHPIEISPLAKKNPEDP

SEQ ID NO: 2057021 - protein, 24 aa, Staphylococcus
VELAQLDYLLPRLQGHGKSLSRLG

SEQ ID NO: 2057022 - protein, 22 aa, Staphylococcus
VGKTEIARRMAKIVGAPFIKVE

SEQ ID NO: 2057023 - protein, 19 aa, Staphylococcus
VILTVLHAGGKFGGGGYKV

SEQ ID NO: 2057024 - protein, 18 aa, Staphylococcus
VITGLKRISKPGLRVYAK

SEQ ID NO: 2057025 - protein, 20 aa, Staphylococcus
VQEYAPILYQIWKKKHKKAY

SEQ ID NO: 2057026 - protein, 26 aa, Staphylococcus
VRPERRTTLGLRWLVNYARLRGEKTM

SEQ ID NO: 2057027 - protein, 19 aa, Staphylococcus
VSALKNGYYADTGISFVVG

SEQ ID NO: 2057028 - protein, 21 aa, Staphylococcus
VSVATFTLAVNRTFTNAQGER

SEQ ID NO: 2057029 - protein, 23 aa, Staphylococcus
VVAAICMYALKTAGYQSALMVPT

SEQ ID NO: 2057030 - protein, 18 aa, Staphylococcus
VYIEPLTHDFIARIIRKE

SEQ ID NO: 2057031 - protein, 25 aa, Staphylococcus
VYLVDRVIPMIPHRLSNGICSLNPE

SEQ ID NO: 2057032 - protein, 17 aa, Staphylococcus
WLVMIDESHVTLPQIRG

SEQ ID NO: 2057033 - protein, 27 aa, Staphylococcus
WSRRSTIFPNFIGHTFAVYDGRKHVPV

SEQ ID NO: 2057034 - protein, 25 aa, Staphylococcus
YANDLLTTPVNLAGLPGISVPCGQS

SEQ ID NO: 2057035 - protein, 17 aa, Staphylococcus
YDAAMKYKEDGTGLAVL

SEQ ID NO: 2057036 - protein, 23 aa, Staphylococcus
YEEMNHLLYCSSAGHEPGYIYRA

SEQ ID NO: 2057037 - protein, 17 aa, Staphylococcus
YEIPLSEVVFDFFDQLK

SEQ ID NO: 2057038 - protein, 23 aa, Staphylococcus
YEMRWDIGYVLQQIALFPHMTIK

SEQ ID NO: 2057039 - protein, 22 aa, Staphylococcus
YGVPRIVFVNKMDKLGANFEYS

SEQ ID NO: 2057040 - protein, 23 aa, Staphylococcus
YKHSKPFLKQFPTTGEHVLMGPG

SEQ ID NO: 2057041 - protein, 19 aa, Staphylococcus
YLISQRLVKKSLDDGYLVG

SEQ ID NO: 2057042 - protein, 26 aa, Staphylococcus
YQNKRPDYISAFWNVVNWEKVDELYN

SEQ ID NO: 2057043 - protein, 24 aa, Staphylococcus
YTGQIITFTYPLIGNYGINRDDFE

SEQ ID NO: 2057044 - protein, 18 aa, Staphylococcus
YTRILKVGPRRGDGAESV

SEQ ID NO: 2057045 - protein, 18 aa, Staphylococcus
YVLPDAVTRFRQGLGRLI

SEQ ID NO: 2057046 - protein, 23 aa, Staphylococcus
AAISAVIMLLDKGDHLILNSDVY

SEQ ID NO: 2057047 - protein, 25 aa, Staphylococcus
ACYTNYTIPPYYDSMVAKLIVHEPT

SEQ ID NO: 2057048 - protein, 28 aa, Staphylococcus
ADEEYHLRKDQFTVPFVCGCRNLGEAAR

SEQ ID NO: 2057049 - protein, 28 aa, Staphylococcus
ADIIASMSYFFNLLNGIGYTDDIDHLGN

SEQ ID NO: 2057050 - protein, 17 aa, Staphylococcus
ADKGLIYKGKKPVYWSP

SEQ ID NO: 2057051 - protein, 26 aa, Staphylococcus
ADLKVEGALAMILKDAIKPNLVQSIE

SEQ ID NO: 2057052 - protein, 23 aa, Staphylococcus
AEKISDFLSLIGGYQALLKFEDV

SEQ ID NO: 2057053 - protein, 32 aa, Staphylococcus; identical to SEQ ID NO: 1819543

SEQ ID NO: 2057054 - protein, 19 aa, Staphylococcus
AFRPEFLNRVDDIIVFHKL

SEQ ID NO: 2057055 - protein, 23 aa, Staphylococcus
AGGQWFTPVINHPEVAILGIGRI

SEQ ID NO: 2057056 - protein, 25 aa, Staphylococcus
AGRTNKPILLKRGLSATIEEFTYAA

SEQ ID NO: 2057057 - protein, 33 aa, Staphylococcus; identical to SEQ ID NO: 1823124

SEQ ID NO: 2057058 - protein, 17 aa, Staphylococcus
AKMSGQVILLLDEIHRL

SEQ ID NO: 2057059 - protein, 44 aa, Staphylococcus; identical to SEQ ID NO: 1825343

SEQ ID NO: 2057060 - protein, 18 aa, Staphylococcus
ALELFKPFVMKELVQREI

SEQ ID NO: 2057061 - protein, 20 aa, Staphylococcus
ALRLMKQAEKFNRPIFTFID

SEQ ID NO: 2057062 - protein, 20 aa, Staphylococcus
APQCAGIIHTDFERGFIRAE

SEQ ID NO: 2057063 - protein, 21 aa, Staphylococcus
APQCAGIIHTDFERGFIRAEV

SEQ ID NO: 2057064 - protein, 22 aa, Staphylococcus
APVLALSLSFDHRQIDGATGQN

SEQ ID NO: 2057065 - protein, 23 aa, Staphylococcus
AQAILDMRLRRLTGLERDKIESE

SEQ ID NO: 2057066 - protein, 20 aa, Staphylococcus
ARRIYSLIKRIFNVEVEILV

SEQ ID NO: 2057067 - protein, 19 aa, Staphylococcus
ARSIIAIAVGYPNKLKGAP

SEQ ID NO: 2057068 - protein, 17 aa, Staphylococcus
ARVFANLDLNITKARAQ

SEQ ID NO: 2057069 - protein, 23 aa, Staphylococcus
ASDVIELPYGAVPIDFAYAIHSE

SEQ ID NO: 2057070 - protein, 32 aa, Staphylococcus; identical to SEQ ID NO: 1825498

SEQ ID NO: 2057071 - protein, 17 aa, Staphylococcus
ATQIGSRLTGVLYVLDE

SEQ ID NO: 2057072 - protein, 26 aa, Staphylococcus
ATRILTERGILLVPDVLASAGGVTVS

SEQ ID NO: 2057073 - protein, 20 aa, Staphylococcus
AVCTRACRFCAVKTGLPNEL

SEQ ID NO: 2057074 - protein, 18 aa, Staphylococcus
CILAFNHTKKNKIVVSKG

SEQ ID NO: 2057075 - protein, 25 aa, Staphylococcus
CTEHRLPFILFSASGGARMQEGIIS

SEQ ID NO: 2057076 - protein, 17 aa, Staphylococcus
DDEDKEMFLEDLGIEEP

SEQ ID NO: 2057077 - protein, 24 aa, Staphylococcus
DDERRLLLLNQELERFRATLFRQT

SEQ ID NO: 2057078 - protein, 23 aa, Staphylococcus
DELKNRRATLVNLQRIDKVSAKR

SEQ ID NO: 2057079 - protein, 19 aa, Staphylococcus
DELNHASIIDGCRLSKAKI

SEQ ID NO: 2057080 - protein, 29 aa, Staphylococcus
DFPNQINNVLAFPGIFRGALDVEATHINE

SEQ ID NO: 2057081 - protein, 26 aa, Staphylococcus
DGMYDLIKEPLRFLQVRIPVRMDDGT

SEQ ID NO: 2057082 - protein, 17 aa, Staphylococcus
DGPDRIAGFTPIPAMSM

SEQ ID NO: 2057083 - protein, 23 aa, Staphylococcus
DGRTWITREPAIVYFHSEYWFNV

SEQ ID NO: 2057084 - protein, 54 aa, Staphylococcus; identical to SEQ ID NO: 1823175

SEQ ID NO: 2057085 - protein, 20 aa, Staphylococcus
DILTIGQYLQPSRKHLKVEK

SEQ ID NO: 2057086 - protein, 19 aa, Staphylococcus
DIVAVTSLYRPGPMEEIPT

SEQ ID NO: 2057087 - protein, 20 aa, Staphylococcus
DIYSRLLKDRIIMLGSAIDD

SEQ ID NO: 2057088 - protein, 21 aa, Staphylococcus
DLMKIANDVRWLASGPRAGLA

SEQ ID NO: 2057089 - protein, 18 aa, Staphylococcus
DLMLVQTDRHYGKTLVLN

SEQ ID NO: 2057090 - protein, 21 aa, Staphylococcus
DMRLAAYIVGIKRTAEAARYR

SEQ ID NO: 2057091 - protein, 18 aa, Staphylococcus
DNLKRMKAWIPIDGTYDL

SEQ ID NO: 2057092 - protein, 25 aa, Staphylococcus
DSNNKMLQRIYGTAFFDKKDLKAHL

SEQ ID NO: 2057093 - protein, 27 aa, Staphylococcus
DTIENRPMMYIALSYDHRIIDGKEAVG

SEQ ID NO: 2057094 - protein, 17 aa, Staphylococcus
DTKVLTMGFIDDLLYPD

SEQ ID NO: 2057095 - protein, 20 aa, Staphylococcus
DTNWPVCGIPEKFYTDHGSD

SEQ ID NO: 2057096 - protein, 23 aa, Staphylococcus
DTSVAVQWLIDKGYDVVACCLDV

SEQ ID NO: 2057097 - protein, 23 aa, Staphylococcus
DTYCGIGTIGLYMAPVAKHVYGV

SEQ ID NO: 2057098 - protein, 23 aa, Staphylococcus
EAAKDVAMHIAAINPKYVSSEQV

SEQ ID NO: 2057099 - protein, 18 aa, Staphylococcus
EDVFLGFDCASSEFYENG

SEQ ID NO: 2057100 - protein, 18 aa, Staphylococcus
EEALKESLRQIKGGFTFA

SEQ ID NO: 2057101 - protein, 25 aa, Staphylococcus
EELGITILINLHFVDLALEYGTRII

SEQ ID NO: 2057102 - protein, 17 aa, Staphylococcus
EERSAVSIGRRVQDPLS

SEQ ID NO: 2057103 - protein, 19 aa, Staphylococcus
EFFGTMKPFILKPKDDDSV

SEQ ID NO: 2057104 - protein, 18 aa, Staphylococcus
EGAKNAVLPVLTASLLAS

SEQ ID NO: 2057105 - protein, 22 aa, Staphylococcus
EGDSFTFDKVLFVGGDSVKVGA

SEQ ID NO: 2057106 - protein, 41 aa, Staphylococcus
EGFGAEVKRRIFLGTFALSSGYYDAYYKKSQKVRTLIKNDF

SEQ ID NO: 2057107 - protein, 26 aa, Staphylococcus
EGTMPQTRFVLKKALEQNLKPVVVVN

SEQ ID NO: 2057108 - protein, 24 aa, Staphylococcus
EGYDPEYGARPLIRAIQKTVEDNL

SEQ ID NO: 2057109 - protein, 17 aa, Staphylococcus
EHILLGLIRENEGVAAR

SEQ ID NO: 2057110 - protein, 36 aa, Staphylococcus; identical to SEQ ID NO: 1826620

SEQ ID NO: 2057111 - protein, 23 aa, Staphylococcus
EKYLQDAHEFCPYSKATRGNIDV

SEQ ID NO: 2057112 - protein, 22 aa, Staphylococcus
ELERFRATLFRQTMFAEFEHKI

SEQ ID NO: 2057113 - protein, 20 aa, Staphylococcus
ELIASFSRALASDLRASQSQ

SEQ ID NO: 2057114 - protein, 18 aa, Staphylococcus
ELNHASIIDGCRLSKAKI

SEQ ID NO: 2057115 - protein, 24 aa, Staphylococcus
ELTPKEFELLLYLIERQGRVITRE

SEQ ID NO: 2057116 - protein, 25 aa, Staphylococcus
EMLTEREMEILLLIAKGYSNQEIAS

SEQ ID NO: 2057117 - protein, 19 aa, Staphylococcus
EPEFFLFKLDEKGEPTLEL

SEQ ID NO: 2057118 - protein, 33 aa, Staphylococcus; identical to SEQ ID NO: 1680269

SEQ ID NO: 2057119 - protein, 17 aa, Staphylococcus
EQNLNIKRLMEISSYRG

SEQ ID NO: 2057120 - protein, 22 aa, Staphylococcus
EQPERGKIYDRNGKVLAEDVER

SEQ ID NO: 2057121 - protein, 25 aa, Staphylococcus
ESLLDKTIFELDLSALVAGAKFRGE

SEQ ID NO: 2057122 - protein, 20 aa, Staphylococcus
EVEFLLNLSEDLKRAKYAGI

SEQ ID NO: 2057123 - protein, 21 aa, Staphylococcus
EVEHVFATQTLWQTKPKNLKI

SEQ ID NO: 2057124 - protein, 24 aa, Staphylococcus
EVFQGRQYKVYRGMGSLGAMEKGS

SEQ ID NO: 2057125 - protein, 17 aa, Staphylococcus
EVGLLPRAHGSGLFTRG

SEQ ID NO: 2057126 - protein, 23 aa, Staphylococcus
EVLDPSLPIDLIIDYAHTADGMN

SEQ ID NO: 2057127 - protein, 23 aa, Staphylococcus
EVMLLRHMILAHHGKMEFGSPKL

SEQ ID NO: 2057128 - protein, 21 aa, Staphylococcus
EVRKKFEMPIIMLTAKDSEID

SEQ ID NO: 2057129 - protein, 18 aa, Staphylococcus
EVVQAIHELPFDKGLDRV

SEQ ID NO: 2057130 - protein, 22 aa, Staphylococcus
FAELCEACQLKFIGPSYESIQK

SEQ ID NO: 2057131 - protein, 23 aa, Staphylococcus
FDRKNYFYPDNPKAYQISQFDEP

SEQ ID NO: 2057132 - protein, 26 aa, Staphylococcus
FDYVLNQPLYQLIEQVKPRLTKAKIK

SEQ ID NO: 2057133 - protein, 20 aa, Staphylococcus
FEGCMPFEVMAERGRKTLLF

SEQ ID NO: 2057134 - protein, 22 aa, Staphylococcus
FELPYMQLVVITERELFKTKQK

SEQ ID NO: 2057135 - protein, 17 aa, Staphylococcus
FENKRYHTWNYHLKNKF

SEQ ID NO: 2057136 - protein, 25 aa, Staphylococcus
FERNYERYQFLNWATKAFDNYNAVP

SEQ ID NO: 2057137 - protein, 17 aa, Staphylococcus
FGPFAFDEWRYLPDGSD

SEQ ID NO: 2057138 - protein, 33 aa, Staphylococcus; identical to SEQ ID NO: 1819128

SEQ ID NO: 2057139 - protein, 27 aa, Staphylococcus
FKEQVGYPLIVRPAFTMGGTGGGICHN

SEQ ID NO: 2057140 - protein, 17 aa, Staphylococcus
FLEIPFDVYPQDAIMPL

SEQ ID NO: 2057141 - protein, 19 aa, Staphylococcus
FMAQSHLLALRSTCQRLSV

SEQ ID NO: 2057142 - protein, 17 aa, Staphylococcus
FMKHLLGTRSGLMAEPN

SEQ ID NO: 2057143 - protein, 17 aa, Staphylococcus
FPHMTIKENIAQVPQMK

SEQ ID NO: 2057144 - protein, 26 aa, Staphylococcus
FRVGYNCAQGYFGVTPDLTCLGKVIG

SEQ ID NO: 2057145 - protein, 21 aa, Staphylococcus
FTCPHGRPIIINFSNYELEKL

SEQ ID NO: 2057146 - protein, 18 aa, Staphylococcus
FTEVGIFSVMWSEHCSYK

SEQ ID NO: 2057147 - protein, 34 aa, Staphylococcus; identical to SEQ ID NO: 1681439

SEQ ID NO: 2057148 - protein, 29 aa, Staphylococcus
GADREIRLRPSYFPFTEPSVEVDVSCFKC

SEQ ID NO: 2057149 - protein, 23 aa, Staphylococcus
GAEGLIFHPYLAGERAPLWNADA

SEQ ID NO: 2057150 - protein, 22 aa, Staphylococcus
GAKNIRFMCLIAAPEGVEKMQE

SEQ ID NO: 2057151 - protein, 23 aa, Staphylococcus
GARRLHTILEKMLEDLSFEAPNM

SEQ ID NO: 2057152 - protein, 20 aa, Staphylococcus
GCDKFCTYCIVPFTRGKERS

SEQ ID NO: 2057153 - protein, 25 aa, Staphylococcus
GCRDDIMVYLMYAGLEPSMAFKTME

SEQ ID NO: 2057154 - protein, 27 aa, Staphylococcus
GDGIIKIEMHFLPDVYVPCEVCDGKRY

SEQ ID NO: 2057155 - protein, 28 aa, Staphylococcus
GDLKEKVDPYLRPLYDGLNTVLGREQTA

SEQ ID NO: 2057156 - protein, 18 aa, Staphylococcus
GESSQFDNLKWLGLDWDE

SEQ ID NO: 2057157 - protein, 20 aa, Staphylococcus
GFGRIGRLAFRRIQDVEGIE

SEQ ID NO: 2057158 - protein, 28 aa, Staphylococcus
GGEQKRLYLLRLLVHQPNVLLLDEPTND

SEQ ID NO: 2057159 - protein, 32 aa, Staphylococcus; identical to SEQ ID NO: 1827533

SEQ ID NO: 2057160 - protein, 32 aa, Staphylococcus; identical to SEQ ID NO: 1819982

SEQ ID NO: 2057161 - protein, 21 aa, Staphylococcus
GHLNHSLFWELLTPNSEEKGT

SEQ ID NO: 2057162 - protein, 18 aa, Staphylococcus
GIEEPGLDRLIRTTYDLL

SEQ ID NO: 2057163 - protein, 17 aa, Staphylococcus
GIIRRMVETKRLSSMIF

SEQ ID NO: 2057164 - protein, 17 aa, Staphylococcus
GLELFHPERMASRILGM

SEQ ID NO: 2057165 - protein, 23 aa, Staphylococcus
GLRVGIIRDWEAKWYAEKDFASL

SEQ ID NO: 2057166 - protein, 23 aa, Staphylococcus
GLRVGVIRDWEAKWYAEKDFASL

SEQ ID NO: 2057167 - protein, 28 aa, Staphylococcus
GMKQKVMIICAFIVNPELYIIDEPFLGL

SEQ ID NO: 2057168 - protein, 19 aa, Staphylococcus
GNGAFMKTLEDAEALAHAM

SEQ ID NO: 2057169 - protein, 20 aa, Staphylococcus
GNVVFIFQYGEEIMPGGSQE

SEQ ID NO: 2057170 - protein, 20 aa, Staphylococcus
GPATNPLFKSFFDAGVEAGY

SEQ ID NO: 2057171 - protein, 19 aa, Staphylococcus
GPCKMIAPVLEELAGDYDG

SEQ ID NO: 2057172 - protein, 27 aa, Staphylococcus
GRKVDERLWLLNRAGKIPFVVSGQGQE

SEQ ID NO: 2057173 - protein, 24 aa, Staphylococcus
GRRRHLLNYLRSKDIQRYRELIKS

SEQ ID NO: 2057174 - protein, 23 aa, Staphylococcus
GSGKSLAYLLAALMYNIETGRHV

SEQ ID NO: 2057175 - protein, 20 aa, Staphylococcus
GSGSVFMKPAAPGTGVIAGG

SEQ ID NO: 2057176 - protein, 17 aa, Staphylococcus
GTFTKYFTQNDVPTFAI

SEQ ID NO: 2057177 - protein, 25 aa, Staphylococcus
GVCLNVGCIPSKALLHASHRFVEAQ

SEQ ID NO: 2057178 - protein, 30 aa, Staphylococcus; identical to SEQ ID NO: 1682250

SEQ ID NO: 2057179 - protein, 25 aa, Staphylococcus
GVQEVRAWTFRQGMTAPQCAGIIHT

SEQ ID NO: 2057180 - protein, 23 aa, Staphylococcus
GYDPEYGARPLIRAIQKTVEDNL

SEQ ID NO: 2057181 - protein, 30 aa, Staphylococcus; identical to SEQ ID NO: 1680362

SEQ ID NO: 2057182 - protein, 17 aa, Staphylococcus
HSYPHDWRTKKPVIFRA

SEQ ID NO: 2057183 - protein, 17 aa, Staphylococcus
HTKNKDVLAVDHVDLNI

SEQ ID NO: 2057184 - protein, 17 aa, Staphylococcus
HWEIMGLNIMQPFKVYP

SEQ ID NO: 2057185 - protein, 28 aa, Staphylococcus
IDMYEPYMSLIKQLFPNAKIIIDRFHIV

SEQ ID NO: 2057186 - protein, 18 aa, Staphylococcus
IDYDLDIKVYPNGKYHLL

SEQ ID NO: 2057187 - protein, 22 aa, Staphylococcus
IEEYFPLPEHLTSTHNSDIFIL

SEQ ID NO: 2057188 - protein, 26 aa, Staphylococcus
IENIQPFLYHFYDMSVAICHNGNLIN

SEQ ID NO: 2057189 - protein, 17 aa, Staphylococcus
IFTVLHAGGKFGQGGYK

SEQ ID NO: 2057190 - protein, 24 aa, Staphylococcus
IGTEHLLLGLMKEPEGIAAKVLES

SEQ ID NO: 2057191 - protein, 27 aa, Staphylococcus
IIEINCHGGILTINRILELTMTHGARM

SEQ ID NO: 2057192 - protein, 17 aa, Staphylococcus
IIQCTFIEGLSQKETGE

SEQ ID NO: 2057193 - protein, 26 aa, Staphylococcus
IKDDDTLVLVGFGGGLTWGAMVIKWG

SEQ ID NO: 2057194 - protein, 18 aa, Staphylococcus
IKLKRGPATNPLFKSFFD

SEQ ID NO: 2057195 - protein, 17 aa, Staphylococcus
IKQLFPNAKIIIDRFHI

SEQ ID NO: 2057196 - protein, 19 aa, Staphylococcus
INEPTAAALAYGLDKTEQD

SEQ ID NO: 2057197 - protein, 17 aa, Staphylococcus
IPHISTGDMFRKAIKDE

SEQ ID NO: 2057198 - protein, 22 aa, Staphylococcus
IQGEGRVIGRKTMFVRTAGCDY

SEQ ID NO: 2057199 - protein, 24 aa, Staphylococcus
IQQQGLDLQTYFQISGQDESQLRE

SEQ ID NO: 2057200 - protein, 18 aa, Staphylococcus
IRVFYRDEFLCTAICPEI

SEQ ID NO: 2057201 - protein, 17 aa, Staphylococcus
IVTIFPDGSDRYMSKQI

SEQ ID NO: 2057202 - protein, 18 aa, Staphylococcus
IVVGNTYGRIRAMVNDLG

SEQ ID NO: 2057203 - protein, 23 aa, Staphylococcus
IVVPDYMDIYDFTPIQYPADDQS

SEQ ID NO: 2057204 - protein, 18 aa, Staphylococcus
IYKTMNEIRYFEEKVHKI

SEQ ID NO: 2057205 - protein, 17 aa, Staphylococcus
KALDELFDAILTLENRE

SEQ ID NO: 2057206 - protein, 26 aa, Staphylococcus
KAPGFGDRRKAMLEDLAILTGAQVIT

SEQ ID NO: 2057207 - protein, 17 aa, Staphylococcus
KDLIRKCNKLGKPVITA

SEQ ID NO: 2057208 - protein, 18 aa, Staphylococcus
KDYGIRKYGFHGTSHKYV

SEQ ID NO: 2057209 - protein, 22 aa, Staphylococcus
KEAAMLAGYFSKAGNSGQIPVD

SEQ ID NO: 2057210 - protein, 24 aa, Staphylococcus
KERGITFLFIAHDLSMVKYISDRI

SEQ ID NO: 2057211 - protein, 26 aa, Staphylococcus
KESDGRIILFIDEIHMLVGAGKTDGA

SEQ ID NO: 2057212 - protein, 24 aa, Staphylococcus
KESILSVILPQYVESLIYGTILDA

SEQ ID NO: 2057213 - protein, 20 aa, Staphylococcus
KGLIYKGKKPVYWSPSSESS

SEQ ID NO: 2057214 - protein, 20 aa, Staphylococcus
KHGIKMIYGMEGMLVDDGVP

SEQ ID NO: 2057215 - protein, 25 aa, Staphylococcus
KHKGRMSLFYYAELTYQPTHCENCS

SEQ ID NO: 2057216 - protein, 24 aa, Staphylococcus
KHPKLKNLYFLQENAKQAIASMSQ

SEQ ID NO: 2057217 - protein, 24 aa, Staphylococcus
KKDLPHIKVVMLTSFIEDKEVYRA

SEQ ID NO: 2057218 - protein, 25 aa, Staphylococcus
KKGIFSVMNYLLPMQDIMSMHCSAN

SEQ ID NO: 2057219 - protein, 22 aa, Staphylococcus
KKGYDIELAYEAGLLSRNEENF

SEQ ID NO: 2057220 - protein, 20 aa, Staphylococcus
KLVHGGLRYLKQLQVGVVAE

SEQ ID NO: 2057221 - protein, 17 aa, Staphylococcus
KMALWYTEMKRNLKRFK

SEQ ID NO: 2057222 - protein, 35 aa, Staphylococcus; identical to SEQ ID NO: 1819229

SEQ ID NO: 2057223 - protein, 18 aa, Staphylococcus
KQVAFLVPTTILAQQHYE

SEQ ID NO: 2057224 - protein, 20 aa, Staphylococcus
KTEKLVFIADYIEPGRKTPG

SEQ ID NO: 2057225 - protein, 23 aa, Staphylococcus
KTPKDDIFKFEKELKRLGINATI

SEQ ID NO: 2057226 - protein, 27 aa, Staphylococcus
KTTTAGKLALLMRKKYNKKPMLVAADI

SEQ ID NO: 2057227 - protein, 27 aa, Staphylococcus
KTTTAGKLALLMRKKYNKKPMLVAGDI

SEQ ID NO: 2057228 - protein, 26 aa, Staphylococcus
KVSAKRIIDFLSGTVYAIGGDIQRVG

SEQ ID NO: 2057229 - protein, 18 aa, Staphylococcus
KYFGPYPNAYSAQETKKL

SEQ ID NO: 2057230 - protein, 21 aa, Staphylococcus
LDLLVSLDFRMTATPLYSDIV

SEQ ID NO: 2057231 - protein, 19 aa, Staphylococcus
LDVTLELKLLADVGLVGFP

SEQ ID NO: 2057232 - protein, 18 aa, Staphylococcus
LEERGYQLSKTEYRGREA

SEQ ID NO: 2057233 - protein, 20 aa, Staphylococcus
LEGVLYNLYTVYLALIEVMN

SEQ ID NO: 2057234 - protein, 18 aa, Staphylococcus
LEKLIRLPGKFKYFEHNV

SEQ ID NO: 2057235 - protein, 25 aa, Staphylococcus
LELTPKEFELLLYLIERQGRVITRE

SEQ ID NO: 2057236 - protein, 17 aa, Staphylococcus
LFKSFFDAGVEAGYHKT

SEQ ID NO: 2057237 - protein, 26 aa, Staphylococcus
LGELAMIWREGCIIRAQFLQKIKDAY

SEQ ID NO: 2057238 - protein, 27 aa, Staphylococcus
LGRDRKFQAILPLRGKVINTEKARLED

SEQ ID NO: 2057239 - protein, 19 aa, Staphylococcus
LHGMALRVPTKNVSLVDLV

SEQ ID NO: 2057240 - protein, 19 aa, Staphylococcus
LHLKHRLFNQKLAEPIVNS

SEQ ID NO: 2057241 - protein, 19 aa, Staphylococcus
LIEVQALVTPTTFNNPRRM

SEQ ID NO: 2057242 - protein, 19 aa, Staphylococcus
LILPGGESTTLRRLMDLYG

SEQ ID NO: 2057243 - protein, 25 aa, Staphylococcus
LINTTQEVLLPESFYRGAHQHIFRA

SEQ ID NO: 2057244 - protein, 25 aa, Staphylococcus
LKGSWSVVCFYPADFSFVCPTELED

SEQ ID NO: 2057245 - protein, 17 aa, Staphylococcus
LLESIYTLALAKSHRTS

SEQ ID NO: 2057246 - protein, 20 aa, Staphylococcus
LLLDEGFIYSKPRSGYYVSD

SEQ ID NO: 2057247 - protein, 17 aa, Staphylococcus
LLNLMQQDIPIDGYVVM

SEQ ID NO: 2057248 - protein, 22 aa, Staphylococcus
LPRPFFILAPMEDVTDIVFRHV

SEQ ID NO: 2057249 - protein, 20 aa, Staphylococcus
LQLSRQIAIQTAPQIRMIQN

SEQ ID NO: 2057250 - protein, 22 aa, Staphylococcus
LRDTLHFEMLWDTSKIDVIIRK

SEQ ID NO: 2057251 - protein, 31 aa, Staphylococcus; identical to SEQ ID NO: 1697869

SEQ ID NO: 2057252 - protein, 18 aa, Staphylococcus
LREKILNGLVRSCEKRPV

SEQ ID NO: 2057253 - protein, 17 aa, Staphylococcus
LRELGFEVVRFKTGTPP

SEQ ID NO: 2057254 - protein, 25 aa, Staphylococcus
LRHKTLPAFSVQYHPEARPGPSDSN

SEQ ID NO: 2057255 - protein, 25 aa, Staphylococcus
LRKNHPKTLFVWRSNLISSSAKGQE

SEQ ID NO: 2057256 - protein, 20 aa, Staphylococcus
LSRTKIFIDDTPGIRITDLR

SEQ ID NO: 2057257 - protein, 26 aa, Staphylococcus
LTDDEMLAHLLKYDTMQGRFTGEVEV

SEQ ID NO: 2057258 - protein, 19 aa, Staphylococcus
LVEGLIHFVSRQAMNIDGL

SEQ ID NO: 2057259 - protein, 17 aa, Staphylococcus
MAEIRVFYRDEFLCTAI

SEQ ID NO: 2057260 - protein, 26 aa, Staphylococcus
MAGDETAIPLLLGLGLDEFSMSATSI

SEQ ID NO: 2057261 - protein, 26 aa, Staphylococcus
MALAAKDIRIEAPIPGTSLVGIEVPN

SEQ ID NO: 2057262 - protein, 19 aa, Staphylococcus
MALELFKPFVMKELVQREI

SEQ ID NO: 2057263 - protein, 19 aa, Staphylococcus
MDAGNMLKPMLARGELHCI

SEQ ID NO: 2057264 - protein, 17 aa, Staphylococcus
MEEWLFNTVAFIGGPSE

SEQ ID NO: 2057265 - protein, 23 aa, Staphylococcus
MEKHAVSRLIGAPPGYVGHDEGG

SEQ ID NO: 2057266 - protein, 21 aa, Staphylococcus
MFMADLIKRIDTHLAIDFMDV

SEQ ID NO: 2057267 - protein, 24 aa, Staphylococcus
MGALTVGVVTRPFGFEGRKRQTQA

SEQ ID NO: 2057268 - protein, 23 aa, Staphylococcus
MGALTVGVVTRPFGFEGRKRSTQ

SEQ ID NO: 2057269 - protein, 18 aa, Staphylococcus
MGDIMGDVTARRGRVDGM

SEQ ID NO: 2057270 - protein, 24 aa, Staphylococcus
MGFEDYFLIVSDLIHYAKTHDVMV

SEQ ID NO: 2057271 - protein, 30 aa, Staphylococcus
MGNRINNEPLLMDIAKTPHALIAGATGSGK

SEQ ID NO: 2057272 - protein, 17 aa, Staphylococcus
MIPFLNSIQETYGHLPE

SEQ ID NO: 2057273 - protein, 24 aa, Staphylococcus
MKMDYYAKRNLELTESIRLKSKKG

SEQ ID NO: 2057274 - protein, 25 aa, Staphylococcus
MNMGFIDDMRFIMDKIPAEQRQTML

SEQ ID NO: 2057275 - protein, 26 aa, Staphylococcus
MNRKGYYLYGYRHFSSRIKGGHTNNK

SEQ ID NO: 2057276 - protein, 18 aa, Staphylococcus
MTGHLLGATGGIEAIFSA

SEQ ID NO: 2057277 - protein, 19 aa, Staphylococcus
MTVELIAPIAIEDGTRFSI

SEQ ID NO: 2057278 - protein, 23 aa, Staphylococcus
NAVNQIVGYLLSGDPAYIPRQNE

SEQ ID NO: 2057279 - protein, 17 aa, Staphylococcus
NDYEFDLGHFRGAIRPD

SEQ ID NO: 2057280 - protein, 24 aa, Staphylococcus
NDYLDKILPEAYALVREGSKRVFN

SEQ ID NO: 2057281 - protein, 17 aa, Staphylococcus
NEFLKKGSSNYPIEILK

SEQ ID NO: 2057282 - protein, 25 aa, Staphylococcus
NEPPGARMRVALSALTMAEYFRDEQ

SEQ ID NO: 2057283 - protein, 25 aa, Staphylococcus
NFEEKLRYFLIEDYNQKEHSTIHTT

SEQ ID NO: 2057284 - protein, 21 aa, Staphylococcus
NGIIIGFNVRPDAGAKRAAEA

SEQ ID NO: 2057285 - protein, 17 aa, Staphylococcus
NILLEYVSANPTGDLHI

SEQ ID NO: 2057286 - protein, 20 aa, Staphylococcus
NMLKPMLARGELHCIGATTL

SEQ ID NO: 2057287 - protein, 26 aa, Staphylococcus
NNTSDLPIGVIPVDSLYSPVERVNYT

SEQ ID NO: 2057288 - protein, 28 aa, Staphylococcus
NPGNTDAMIKYLLPKATVVTPNLFEAGQ

SEQ ID NO: 2057289 - protein, 36 aa, Staphylococcus
NPYLDKFYDDFERWSFHLQIYFLAERFKEQKRMFEY

SEQ ID NO: 2057290 - protein, 22 aa, Staphylococcus
NQSLMLVTALNPHIGYEKAAQI

SEQ ID NO: 2057291 - protein, 19 aa, Staphylococcus
NRYVGNIYTGSLYLSLISL

SEQ ID NO: 2057292 - protein, 24 aa, Staphylococcus
NSIPLIASSIMSKKIAAGADAIVL

SEQ ID NO: 2057293 - protein, 24 aa, Staphylococcus
NSLQEMYQGFFLAPHVVSQSLKGA

SEQ ID NO: 2057294 - protein, 26 aa, Staphylococcus
NSMKLHALIDGLALHKLLNPNGVSND

SEQ ID NO: 2057295 - protein, 20 aa, Staphylococcus
NVFIVSRRGKILGSSLNELL

SEQ ID NO: 2057296 - protein, 19 aa, Staphylococcus
NVIRKMSFIYADAVSHRIV

SEQ ID NO: 2057297 - protein, 22 aa, Staphylococcus
PCHTMFQFYVQDGKLSCQLYQR

SEQ ID NO: 2057298 - protein, 20 aa, Staphylococcus
PEARIPLSQAVIELCLSPKS

SEQ ID NO: 2057299 - protein, 25 aa, Staphylococcus
PEIAGLMISAIISDSLLFKSPTCTE

SEQ ID NO: 2057300 - protein, 18 aa, Staphylococcus
PGRREIGHGALGERALRY

SEQ ID NO: 2057301 - protein, 44 aa, Staphylococcus; identical to SEQ ID NO: 1820632

SEQ ID NO: 2057302 - protein, 18 aa, Staphylococcus
PILYQIWKKKHKKAYYKW

SEQ ID NO: 2057303 - protein, 20 aa, Staphylococcus
PIVIMAEFILSAQKIISRTI

SEQ ID NO: 2057304 - protein, 18 aa, Staphylococcus
PIYNSFGMTETCSQFLTA

SEQ ID NO: 2057305 - protein, 20 aa, Staphylococcus
PKNKLIVMTGLSGSGKSSLA

SEQ ID NO: 2057306 - protein, 24 aa, Staphylococcus
PLEEQSLINFLTDLSLVADIDEAD

SEQ ID NO: 2057307 - protein, 26 aa, Staphylococcus
PLGSTPYTLLDYFGDDWLVMIDESHV

SEQ ID NO: 2057308 - protein, 27 aa, Staphylococcus
PLPVENQVLIIYALTKGYLDDIPVEDI

SEQ ID NO: 2057309 - protein, 17 aa, Staphylococcus
PLVLPKHHTCLITPVNH

SEQ ID NO: 2057310 - protein, 22 aa, Staphylococcus
PLYSDIVLPAATWYEKHDLSST

SEQ ID NO: 2057311 - protein, 17 aa, Staphylococcus
PNWTTCVSICALFRDSD

SEQ ID NO: 2057312 - protein, 24 aa, Staphylococcus
PPRLQNGTSWFYFATDQWKYEESN

SEQ ID NO: 2057313 - protein, 20 aa, Staphylococcus
PQFFFAYDIEKYDKGLRGFY

SEQ ID NO: 2057314 - protein, 22 aa, Staphylococcus
PSKLKSIVGPFAYYIKGFEMLP

SEQ ID NO: 2057315 - protein, 21 aa, Staphylococcus
PTKLKNPPSNWPRTAKFEGLI

SEQ ID NO: 2057316 - protein, 25 aa, Staphylococcus
PTRVGYKFVDGKKVRIAKKSGEEIK

SEQ ID NO: 2057317 - protein, 17 aa, Staphylococcus
PVLWKKVKKGLSAGRVQ

SEQ ID NO: 2057318 - protein, 25 aa, Staphylococcus
QEHGLDMIVIDYLQLIQGSGSRFSD

SEQ ID NO: 2057319 - protein, 17 aa, Staphylococcus
QETKKLLDRIYPFRKCD

SEQ ID NO: 2057320 - protein, 20 aa, Staphylococcus
QFDNLKWLGLDWDESIDKDK

SEQ ID NO: 2057321 - protein, 40 aa, Staphylococcus; identical to SEQ ID NO: 1831412

SEQ ID NO: 2057322 - protein, 24 aa, Staphylococcus
QKEYYVGFVIDRATDRITLMASEE

SEQ ID NO: 2057323 - protein, 18 aa, Staphylococcus
QPIVVRPIEEDMFEIIAG

SEQ ID NO: 2057324 - protein, 25 aa, Staphylococcus
QPVKLYYNGPMFRYERKQKGRYRQF

SEQ ID NO: 2057325 - protein, 17 aa, Staphylococcus
QSIARIAQKARACGIHM

SEQ ID NO: 2057326 - protein, 20 aa, Staphylococcus
QSIVTLLKYNLETAGYIVEV

SEQ ID NO: 2057327 - protein, 19 aa, Staphylococcus
QSSTLTTLILKELGVKKVT

SEQ ID NO: 2057328 - protein, 18 aa, Staphylococcus
QTAINSKIMLLTGGPGTG

SEQ ID NO: 2057329 - protein, 24 aa, Staphylococcus
QTYNFKNAIIATGSRPIEIPNFEF

SEQ ID NO: 2057330 - protein, 22 aa, Staphylococcus
QVDYLEELIGKYPIITIEDGMD

SEQ ID NO: 2057331 - protein, 24 aa, Staphylococcus
RAAAALILAGLVADGTTQVTELKH

SEQ ID NO: 2057332 - protein, 22 aa, Staphylococcus
RAAAALILAGLVAEGTTQVTEL

SEQ ID NO: 2057333 - protein, 21 aa, Staphylococcus
RDTLHFEMLWDTSKIDVIIRK

SEQ ID NO: 2057334 - protein, 18 aa, Staphylococcus
REQNLNIKRLMEISSYRG

SEQ ID NO: 2057335 - protein, 18 aa, Staphylococcus
RFLQVRIPVRMDDGTVKT

SEQ ID NO: 2057336 - protein, 30 aa, Staphylococcus; identical to SEQ ID NO: 1819372

SEQ ID NO: 2057337 - protein, 23 aa, Staphylococcus
RGFTAVCNPLVNSYKRLVPGYEA

SEQ ID NO: 2057338 - protein, 17 aa, Staphylococcus
RGKVRRAKLYYLRNLRG

SEQ ID NO: 2057339 - protein, 19 aa, Staphylococcus
RHKNCVFLVDTFHTLKSGV

SEQ ID NO: 2057340 - protein, 30 aa, Staphylococcus; identical to SEQ ID NO: 1819376

SEQ ID NO: 2057341 - protein, 24 aa, Staphylococcus
RIDEPTLEMTFKVNNSPFAGREGD

SEQ ID NO: 2057342 - protein, 18 aa, Staphylococcus
RIIRIEGNFWDIGEGPSG

SEQ ID NO: 2057343 - protein, 20 aa, Staphylococcus
RISRLFDITGLKDLMHVNEG

SEQ ID NO: 2057344 - protein, 22 aa, Staphylococcus
RKIKYMFPKAHAAAYVLMAVRI

SEQ ID NO: 2057345 - protein, 24 aa, Staphylococcus
RKLKSLKDHFYRYSLKLRQKVKTI

SEQ ID NO: 2057346 - protein, 22 aa, Staphylococcus
RKRGQFINMDYLDDIRVNIVYE

SEQ ID NO: 2057347 - protein, 18 aa, Staphylococcus
RLLTSRAEYRLLLRHDNA

SEQ ID NO: 2057348 - protein, 17 aa, Staphylococcus
RMSLFYYAELTYQPTYC

SEQ ID NO: 2057349 - protein, 19 aa, Staphylococcus
RNYNIEFITKLEGAHLEYE

SEQ ID NO: 2057350 - protein, 19 aa, Staphylococcus
RPIIINFSNYELEKLFKRV

SEQ ID NO: 2057351 - protein, 19 aa, Staphylococcus
RRAKLYYLRSLRGKAARIQ

SEQ ID NO: 2057352 - protein, 20 aa, Staphylococcus
RRFRFTALVVVGDKNGRVGF

SEQ ID NO: 2057353 - protein, 22 aa, Staphylococcus
RRGELVSCFLLEVDDSLNSINF

SEQ ID NO: 2057354 - protein, 18 aa, Staphylococcus
RRIAFNINIPKESINKAA

SEQ ID NO: 2057355 - protein, 25 aa, Staphylococcus
RRQRKRDFRKLWITRINAAARQHDM

SEQ ID NO: 2057356 - protein, 22 aa, Staphylococcus
RSPKEAYAYLEKLRSIIQYTGV

SEQ ID NO: 2057357 - protein, 20 aa, Staphylococcus
RVAAIIRRRKEEISAVMVYE

SEQ ID NO: 2057358 - protein, 19 aa, Staphylococcus
RVITGLKRISKPGLRVYAK

SEQ ID NO: 2057359 - protein, 22 aa, Staphylococcus
RYTERQGGYTRILKVGPRRGDG

SEQ ID NO: 2057360 - protein, 24 aa, Staphylococcus
SAAFFIVAALITPGSDITIHNVGI

SEQ ID NO: 2057361 - protein, 20 aa, Staphylococcus
SCQALPDEPLHSSFIMSKMA

SEQ ID NO: 2057362 - protein, 30 aa, Staphylococcus; identical to SEQ ID NO: 1680709

SEQ ID NO: 2057363 - protein, 24 aa, Staphylococcus
SEKIMIRLHDLGFGPKLSMAIYQF

SEQ ID NO: 2057364 - protein, 27 aa, Staphylococcus
SERVSYLYQPYNPAILRLVKQVIEASH

SEQ ID NO: 2057365 - protein, 22 aa, Staphylococcus
SFDMGFIDTGYERLGFGPSTNG

SEQ ID NO: 2057366 - protein, 23 aa, Staphylococcus
SKDPDFIQGYFYLQSLYENEKNY

SEQ ID NO: 2057367 - protein, 17 aa, Staphylococcus
SLKDHFYRYSLKLRQKV

SEQ ID NO: 2057368 - protein, 18 aa, Staphylococcus
SLLIFDEVMTGFRVGYNC

SEQ ID NO: 2057369 - protein, 19 aa, Staphylococcus
SLQPSLDVKRMPWIGLQWI

SEQ ID NO: 2057370 - protein, 23 aa, Staphylococcus
SMAEWDVMNIIWGKKSVSANEIV

SEQ ID NO: 2057371 - protein, 21 aa, Staphylococcus
SMTGHLLGATGGLEAIFSALS

SEQ ID NO: 2057372 - protein, 26 aa, Staphylococcus
SNGMQTLGVALPWAIAAALVRPNTQV

SEQ ID NO: 2057373 - protein, 22 aa, Staphylococcus
SQERRNLLKAYGAELVLTPGSE

SEQ ID NO: 2057374 - protein, 33 aa, Staphylococcus
SQGDQQLMLRLIQPKYFLPIHGEYRMLKAHGQT

SEQ ID NO: 2057375 - protein, 23 aa, Staphylococcus
SSRLEILDLLSCGELCACDLLEH

SEQ ID NO: 2057376 - protein, 34 aa, Staphylococcus
SYKQLPLTLFQIQSKFRDEKRPRFGLLRGREFIM

SEQ ID NO: 2057377 - protein, 21 aa, Staphylococcus
TATFMILGAVCTRACRFCAVK

SEQ ID NO: 2057378 - protein, 24 aa, Staphylococcus
TDIEYKFPFGWGELWGIASRTDFD

SEQ ID NO: 2057379 - protein, 18 aa, Staphylococcus
TEEKLNVPLIGFTGAPFT

SEQ ID NO: 2057380 - protein, 21 aa, Staphylococcus
TGPVTILNWSFERVDVPRKVV

SEQ ID NO: 2057381 - protein, 23 aa, Staphylococcus
THELGIPVMILFEGVPASGKTRL

SEQ ID NO: 2057382 - protein, 26 aa, Staphylococcus
TISVDNGIWKVIDFQHVKPGKGSAFV

SEQ ID NO: 2057383 - protein, 26 aa, Staphylococcus
TKAMPKEMLPILDKPTIQYIVEEASR

SEQ ID NO: 2057384 - protein, 17 aa, Staphylococcus
TMFITKKGKQVKVNHLE

SEQ ID NO: 2057385 - protein, 17 aa, Staphylococcus
TNLKGVFNCIQKVTPQM

SEQ ID NO: 2057386 - protein, 21 aa, Staphylococcus
TNVIDLAYPGVLPVVNRRAVD

SEQ ID NO: 2057387 - protein, 18 aa, Staphylococcus
TRFVNGERSLLFGPFAGF

SEQ ID NO: 2057388 - protein, 29 aa, Staphylococcus
TRIMDLVTPIGLGQRGLIVAPPKAGKTSL

SEQ ID NO: 2057389 - protein, 25 aa, Staphylococcus
TRLSLAQMLLSEPDLLLLDEPTNHL

SEQ ID NO: 2057390 - protein, 20 aa, Staphylococcus
TRYYLMRELPFGSDGVFTPE

SEQ ID NO: 2057391 - protein, 24 aa, Staphylococcus
TSGKELFKRTLPDVLIKLERAGYE

SEQ ID NO: 2057392 - protein, 27 aa, Staphylococcus
TTDNGLTRLIFMVPARGMIGYTTEFMS

SEQ ID NO: 2057393 - protein, 25 aa, Staphylococcus
VAGAKFRGEFEERLKAVLKEVKESD

SEQ ID NO: 2057394 - protein, 18 aa, Staphylococcus
VANSIVSQLLFLQAQDSE

SEQ ID NO: 2057395 - protein, 18 aa, Staphylococcus
VDKILTQLNIRLMDQRIS

SEQ ID NO: 2057396 - protein, 19 aa, Staphylococcus
VDRLLVVTFTNLSAREMKH

SEQ ID NO: 2057397 - protein, 23 aa, Staphylococcus
VEDIRWLRCDIKSLNLLGNVLAK

SEQ ID NO: 2057398 - protein, 26 aa, Staphylococcus
VEEYVDIVEIGTPIVINEGLPAVQHL

SEQ ID NO: 2057399 - protein, 23 aa, Staphylococcus
VESVWNFINKIWNGARFSLMNIG

SEQ ID NO: 2057400 - protein, 20 aa, Staphylococcus
VFANLDLNITKARAQVVKAL

SEQ ID NO: 2057401 - protein, 32 aa, Staphylococcus; identical to SEQ ID NO: 1821060

SEQ ID NO: 2057402 - protein, 33 aa, Staphylococcus; identical to SEQ ID NO: 1681615

SEQ ID NO: 2057403 - protein, 17 aa, Staphylococcus
VIAGWTGIPLTKINETE

SEQ ID NO: 2057404 - protein, 21 aa, Staphylococcus
VIREREHFAIFPASHFVTREE

SEQ ID NO: 2057405 - protein, 18 aa, Staphylococcus
VKPIGIKVTRLAQGLSVG

SEQ ID NO: 2057406 - protein, 25 aa, Staphylococcus
VMDSLHAFFKPEILNRMDDIVLFKP

SEQ ID NO: 2057407 - protein, 25 aa, Staphylococcus
VNNKDWLGQISLISFLRDYGKHVGV

SEQ ID NO: 2057408 - protein, 23 aa, Staphylococcus
VNQYAVFQYPPYDITLSTKISEV

SEQ ID NO: 2057409 - protein, 23 aa, Staphylococcus
VQEAQTRHYTWPTASAAMGRTMT

SEQ ID NO: 2057410 - protein, 18 aa, Staphylococcus
VSEKVRIHTPSQMGIRKP

SEQ ID NO: 2057411 - protein, 24 aa, Staphylococcus
VSGLVTPWNFPTNQTSLKLAAAFA

SEQ ID NO: 2057412 - protein, 25 aa, Staphylococcus
VTACYLLVNKSIRRGYKSMPEHVNM

SEQ ID NO: 2057413 - protein, 25 aa, Staphylococcus
VTIAPFGATIPYYFTGHEGPDSCCI

SEQ ID NO: 2057414 - protein, 19 aa, Staphylococcus
VTNPKILLCDEATSALDPA

SEQ ID NO: 2057415 - protein, 24 aa, Staphylococcus
VVGIAFIIELKYLNGIEKIKDYDV

SEQ ID NO: 2057416 - protein, 23 aa, Staphylococcus
VYADGEKRYIIAPKGLQVGQTVE

SEQ ID NO: 2057417 - protein, 19 aa, Staphylococcus
WLNCGYNRWNHNEPLVGQT

SEQ ID NO: 2057418 - protein, 19 aa, Staphylococcus
YDALSAVTPFYYPFSFEEI

SEQ ID NO: 2057419 - protein, 17 aa, Staphylococcus
YDDEGIAFVILDDNQGT

SEQ ID NO: 2057420 - protein, 21 aa, Staphylococcus
YDIEPLVHITCRDRNLIGLQS

SEQ ID NO: 2057421 - protein, 20 aa, Staphylococcus
YEPGSTFKSYGLAAAIQEGK

SEQ ID NO: 2057422 - protein, 21 aa, Staphylococcus
YGCDKFCTYCIVPFTRGKERS

SEQ ID NO: 2057423 - protein, 24 aa, Staphylococcus
YGKLGVKVWIYRGEVLPTKNTSEG

SEQ ID NO: 2057424 - protein, 17 aa, Staphylococcus
YGSLLIFDEVMTGFRVG

SEQ ID NO: 2057425 - protein, 21 aa, Staphylococcus
YHKVIFLDTTTNFKFLSGSTK

SEQ ID NO: 2057426 - protein, 17 aa, Staphylococcus
YIEVWGKFTPRGGISID

SEQ ID NO: 2057427 - protein, 17 aa, Staphylococcus
YIVGIKRTAEAARYRGW

SEQ ID NO: 2057428 - protein, 18 aa, Staphylococcus
YLEHMKLYRSFREEVPEE

SEQ ID NO: 2057429 - protein, 18 aa, Staphylococcus
YNPLIQQLLDEDKAYKCY

SEQ ID NO: 2057430 - protein, 26 aa, Staphylococcus
YNYYLDLRRYGSVPHSGFGLGLERTV

SEQ ID NO: 2057431 - protein, 17 aa, Staphylococcus
YQLLLDEGFIYSKPRSG

SEQ ID NO: 2057432 - protein, 26 aa, Staphylococcus
YSYYLDLRRYGSVPHSGFGLGLERTV

SEQ ID NO: 2057433 - protein, 19 aa, Staphylococcus
YVGRIGVGRVFRGKMRVGD

SEQ ID NO: 2057434 - protein, 17 aa, Staphylococcus
YVPVIKHADEKSIKGIA

SEQ ID NO: 2057435 - protein, 27 aa, Staphylococcus
YVSRSHPGLLKRLFEQEVPEIYDGTVI

SEQ ID NO: 2057436 - protein, 18 aa, Staphylococcus
AAHPNTIIFLTADAFGVI

SEQ ID NO: 2057437 - protein, 18 aa, Staphylococcus
AAHPNTIIFLTADAFGVL

SEQ ID NO: 2057438 - protein, 41 aa, Staphylococcus
AAIDLKVILEYGESAPKIFRKVTDLVKEQVKYITGLEVVEV

SEQ ID NO: 2057439 - protein, 20 aa, Staphylococcus
AARRGLPYVFAGHFAPQQMK

SEQ ID NO: 2057440 - protein, 41 aa, Staphylococcus
AAVDLKVILEYGESAPKIFRKVTDLVKEQVKYITGLDVVEV

SEQ ID NO: 2057441 - protein, 25 aa, Staphylococcus
ACGDREVFTLLWQVINDSLNGNYTR

SEQ ID NO: 2057442 - protein, 30 aa, Staphylococcus; identical to SEQ ID NO: 1819526

SEQ ID NO: 2057443 - protein, 28 aa, Staphylococcus
ADAAWITTPLNIYYFTGYRSEPHERLFA

SEQ ID NO: 2057444 - protein, 24 aa, Staphylococcus
ADDYLRHANLKYTIVHPGALTNEH

SEQ ID NO: 2057445 - protein, 24 aa, Staphylococcus
ADELKNRRATLVNLQRIDKVSAKR

SEQ ID NO: 2057446 - protein, 22 aa, Staphylococcus
ADKGLIYKGKKPVYWSPSSESS

SEQ ID NO: 2057447 - protein, 26 aa, Staphylococcus
ADLKVEGALAMILKDAIKPNLVQTIE

SEQ ID NO: 2057448 - protein, 22 aa, Staphylococcus
AEDIPFFLEVLTYDDNIPDNKS

SEQ ID NO: 2057449 - protein, 23 aa, Staphylococcus
AEEFGFATAPLVVLGCIMMRVCH

SEQ ID NO: 2057450 - protein, 35 aa, Staphylococcus; identical to SEQ ID NO: 1679734

SEQ ID NO: 2057451 - protein, 36 aa, Staphylococcus; identical to SEQ ID NO: 1825169

SEQ ID NO: 2057452 - protein, 24 aa, Staphylococcus
AEQYFDRILLLNRTVRFFGPSHQA

SEQ ID NO: 2057453 - protein, 19 aa, Staphylococcus
AERSYYLTDQFFTERVSKE

SEQ ID NO: 2057454 - protein, 21 aa, Staphylococcus
AESGIGGLALGLTVEGFRPVM

SEQ ID NO: 2057455 - protein, 32 aa, Staphylococcus; identical to SEQ ID NO: 1825197

SEQ ID NO: 2057456 - protein, 22 aa, Staphylococcus
AGASKIFVFDLSEERLAKAKEV

SEQ ID NO: 2057457 - protein, 18 aa, Staphylococcus
AGKKLAIVPILRAGLGMT

SEQ ID NO: 2057458 - protein, 26 aa, Staphylococcus
AGKSTLINLLLEQDILPSSPVPTTSN

SEQ ID NO: 2057459 - protein, 28 aa, Staphylococcus
AGLSLGGVFALKLSLNRPVKGIITMCAP

SEQ ID NO: 2057460 - protein, 28 aa, Staphylococcus
AGRSDYPWDLFIQMPAALMFPSGNPFYD

SEQ ID NO: 2057461 - protein, 25 aa, Staphylococcus
AGRTNKPILLKRGLSATIEEFTFAA

SEQ ID NO: 2057462 - protein, 26 aa, Staphylococcus
AGVIMLTKSLAMEWSKYGIKVNTIAP

SEQ ID NO: 2057463 - protein, 26 aa, Staphylococcus
AIEYDAIVPTQLWPTLETKKIKNLYT

SEQ ID NO: 2057464 - protein, 18 aa, Staphylococcus
AIVVSRFNDFITNRLLDG

SEQ ID NO: 2057465 - protein, 27 aa, Staphylococcus
AKGLEFPIVFLMGMEESLFPHIRAIKS

SEQ ID NO: 2057466 - protein, 18 aa, Staphylococcus
AKYYDFIEVQPPKLYQDL

SEQ ID NO: 2057467 - protein, 24 aa, Staphylococcus
ALAAKDIRIEAPIPGTSLVGIEVP

SEQ ID NO: 2057468 - protein, 27 aa, Staphylococcus
ALNDDQLVMLKLTIPTKANLYKELADH

SEQ ID NO: 2057469 - protein, 24 aa, Staphylococcus
ALNGSILPGITRKSIIELAKELGY

SEQ ID NO: 2057470 - protein, 17 aa, Staphylococcus
AMETSRRVAKEEGILAG

SEQ ID NO: 2057471 - protein, 27 aa, Staphylococcus
AMNRKGYFLYGYRHFSSRIKGGHTNNK

SEQ ID NO: 2057472 - protein, 17 aa, Staphylococcus
AMVRMAQTFSYRYPLVD

SEQ ID NO: 2057473 - protein, 22 aa, Staphylococcus
APENMEVLIGWTGSPASSPHLV

SEQ ID NO: 2057474 - protein, 25 aa, Staphylococcus
APIAFQEFMILPVGAESFKESLRWG

SEQ ID NO: 2057475 - protein, 19 aa, Staphylococcus
APIMSRPVKNMTVAIIGTG

SEQ ID NO: 2057476 - protein, 19 aa, Staphylococcus
APITHMALAGFSASRALST

SEQ ID NO: 2057477 - protein, 22 aa, Staphylococcus
AQAILDMRLRRLTGLERDKIEN

SEQ ID NO: 2057478 - protein, 17 aa, Staphylococcus
AQELDAALWGARAAYIG

SEQ ID NO: 2057479 - protein, 18 aa, Staphylococcus
ARGLGSSASALVGALYIA

SEQ ID NO: 2057480 - protein, 24 aa, Staphylococcus
ARLTNFGAFIDIGGVDGLVHVSEL

SEQ ID NO: 2057481 - protein, 20 aa, Staphylococcus
ARTVMHFHPALAPYKAAVLP

SEQ ID NO: 2057482 - protein, 17 aa, Staphylococcus
ARVLYLGIVGDTGRFLF

SEQ ID NO: 2057483 - protein, 26 aa, Staphylococcus
ASAYGKLNIMFPMVATIKEFRDAKAI

SEQ ID NO: 2057484 - protein, 24 aa, Staphylococcus
ASGHAMALAISNLLGLVCDPVAGL

SEQ ID NO: 2057485 - protein, 23 aa, Staphylococcus
ASKTYDLEVWLPSYNDYKEISSC

SEQ ID NO: 2057486 - protein, 24 aa, Staphylococcus
ATADLTIGLILSVARRIVEGDELS

SEQ ID NO: 2057487 - protein, 26 aa, Staphylococcus
ATGIRIGFLIGPEYLIEKLTFMHAYN

SEQ ID NO: 2057488 - protein, 26 aa, Staphylococcus
ATGIRIGFLLGPEYLIEKLTFMHAYN

SEQ ID NO: 2057489 - protein, 34 aa, Staphylococcus
ATGVVNLVNFYYPKLTFKSSILQLIKDNKVTAKA

SEQ ID NO: 2057490 - protein, 26 aa, Staphylococcus
ATLSPLDSYLLQRGLKTLHLRIDRSQ

SEQ ID NO: 2057491 - protein, 21 aa, Staphylococcus
ATQKYNIIKPFILGNQSLSSI

SEQ ID NO: 2057492 - protein, 21 aa, Staphylococcus
ATRYYLMRELPFGSDGVFTPE

SEQ ID NO: 2057493 - protein, 37 aa, Staphylococcus; identical to SEQ ID NO: 1680910

SEQ ID NO: 2057494 - protein, 23 aa, Staphylococcus
AVLPLYDTFYDGKIKHILARHEQ

SEQ ID NO: 2057495 - protein, 17 aa, Staphylococcus
AVLPVLTASLLASEGQS

SEQ ID NO: 2057496 - protein, 25 aa, Staphylococcus
AVNFEQEYWDKVFTYFLDEYKKGRT

SEQ ID NO: 2057497 - protein, 29 aa, Staphylococcus
AVRAGHHCAQPLMKWLNVSSTARASFYVY

SEQ ID NO: 2057498 - protein, 27 aa, Staphylococcus
AVRKKLNIIQLIWNDGKYNMVEFQEEM

SEQ ID NO: 2057499 - protein, 26 aa, Staphylococcus
AVRKNLNIIQLIWNDGKYNMVEFQEE

SEQ ID NO: 2057500 - protein, 18 aa, Staphylococcus
AVRRNPYSVILLDEVEKA

SEQ ID NO: 2057501 - protein, 19 aa, Staphylococcus
AVRRNPYSVILLDEVEKAH

SEQ ID NO: 2057502 - protein, 23 aa, Staphylococcus
AVTPFYYPFSFEEIKQYYFDIIE

SEQ ID NO: 2057503 - protein, 23 aa, Staphylococcus
AYATEIGILLKSIKLARKELKNW

SEQ ID NO: 2057504 - protein, 18 aa, Staphylococcus
AYEMGVSKAFKPIMENTL

SEQ ID NO: 2057505 - protein, 18 aa, Staphylococcus
AYPIHHIDNIVLPSKAAH

SEQ ID NO: 2057506 - protein, 34 aa, Staphylococcus; identical to SEQ ID NO: 1825551

SEQ ID NO: 2057507 - protein, 33 aa, Staphylococcus
CDKIMVVANLPYYITTPILLNLMQQDIPIDGYV

SEQ ID NO: 2057508 - protein, 20 aa, Staphylococcus
CDVFIIQPTSYPVNLHLMEL

SEQ ID NO: 2057509 - protein, 17 aa, Staphylococcus
CERIFGPTKDWECSCGK

SEQ ID NO: 2057510 - protein, 29 aa, Staphylococcus
CESSYKLPFAFKIYNDPFNVVYLVSKGKM

SEQ ID NO: 2057511 - protein, 17 aa, Staphylococcus
CGKFMIKVKTKNGQMLV

SEQ ID NO: 2057512 - protein, 18 aa, Staphylococcus
CGSPMVIKMGRYGKFMAC

SEQ ID NO: 2057513 - protein, 23 aa, Staphylococcus
CGSPMVIKMGRYGKFMACSNFPD

SEQ ID NO: 2057514 - protein, 17 aa, Staphylococcus
CIPGPFDKRVAPSVARE

SEQ ID NO: 2057515 - protein, 35 aa, Staphylococcus
CMEELKMMINIMKPEYFIPVQGEFKMQIAHAKLAN

SEQ ID NO: 2057516 - protein, 17 aa, Staphylococcus
CVFFNQPYLKKKIELHG

SEQ ID NO: 2057517 - protein, 26 aa, Staphylococcus
CYAVLGLVHTLWKPMPGRFKDYIAMP

SEQ ID NO: 2057518 - protein, 23 aa, Staphylococcus
DAAKHMYLVYQNPELQFITNSVY

SEQ ID NO: 2057519 - protein, 23 aa, Staphylococcus
DAARYFLTMRSPDTHFDFDMELA

SEQ ID NO: 2057520 - protein, 25 aa, Staphylococcus
DADDILFGIKEDVDYIAASFVRRPS

SEQ ID NO: 2057521 - protein, 27 aa, Staphylococcus
DADLVFDVRFLPNPYYVEDLRPMTGED

SEQ ID NO: 2057522 - protein, 23 aa, Staphylococcus
DAKPEHLLQYAQLGNIYAQKIRG

SEQ ID NO: 2057523 - protein, 23 aa, Staphylococcus
DALFILGETLYNFGLTPQGLEVF

SEQ ID NO: 2057524 - protein, 26 aa, Staphylococcus
DAPIAFQEFMILPTGAESFKEALRWG

SEQ ID NO: 2057525 - protein, 24 aa, Staphylococcus
DDAKRKVAIALRNRYRRSLLDEET

SEQ ID NO: 2057526 - protein, 22 aa, Staphylococcus
DDDLFHIRTLGFRGEALASISS

SEQ ID NO: 2057527 - protein, 20 aa, Staphylococcus
DDIHNVFMYFAGLADKDGGE

SEQ ID NO: 2057528 - protein, 17 aa, Staphylococcus
DDIIVFHKLSKDELKEI

SEQ ID NO: 2057529 - protein, 23 aa, Staphylococcus
DDTNGFVKLITLKEDDTLIGAQV

SEQ ID NO: 2057530 - protein, 27 aa, Staphylococcus
DDTTLEPMVLPARFPNLLVNGSTGISA

SEQ ID NO: 2057531 - protein, 23 aa, Staphylococcus
DDVENILLRLIQAADFDIDKAEK

SEQ ID NO: 2057532 - protein, 17 aa, Staphylococcus
DEALQPLHKDRIPVVIK

SEQ ID NO: 2057533 - protein, 29 aa, Staphylococcus
DEAYTQQLALHRSLEKYLLIDTSKIGKED

SEQ ID NO: 2057534 - protein, 17 aa, Staphylococcus
DELLYITGNPYDTLLEV

SEQ ID NO: 2057535 - protein, 25 aa, Staphylococcus
DEMGFTQKSPRWAIAYKFPAEEVVT

SEQ ID NO: 2057536 - protein, 22 aa, Staphylococcus
DEPLNRLFNTSPVFSQIPGPNH

SEQ ID NO: 2057537 - protein, 24 aa, Staphylococcus
DEQVLFLSDVVPTAYWSVEHAGVK

SEQ ID NO: 2057538 - protein, 23 aa, Staphylococcus
DETTFVVINSTCGCAAGLARPAA

SEQ ID NO: 2057539 - protein, 20 aa, Staphylococcus
DEVFKYLNRFARVPVCGAIS

SEQ ID NO: 2057540 - protein, 26 aa, Staphylococcus
DFASLLHEDLRIRKFIDNELKEASVS

SEQ ID NO: 2057541 - protein, 17 aa, Staphylococcus
DFEKDYPYYASGGFIHY

SEQ ID NO: 2057542 - protein, 20 aa, Staphylococcus
DFMPSPGKITQYLAPGGFGV

SEQ ID NO: 2057543 - protein, 17 aa, Staphylococcus
DFNVHFDNWFSETSLYE

SEQ ID NO: 2057544 - protein, 20 aa, Staphylococcus
DGMAFLSGVVSRKKQVVPQI

SEQ ID NO: 2057545 - protein, 20 aa, Staphylococcus
DGNKYIDYLQAYGPIITGHA

SEQ ID NO: 2057546 - protein, 23 aa, Staphylococcus
DGTKKRIRYYSCSNFRNKGSKVC

SEQ ID NO: 2057547 - protein, 33 aa, Staphylococcus
DHISSYGLILEPKTQFYNMYRKGKLKLPNEDLG

SEQ ID NO: 2057548 - protein, 19 aa, Staphylococcus
DIEIEAFIHGAMCIAYSGR

SEQ ID NO: 2057549 - protein, 25 aa, Staphylococcus
DIFGRCLHTYLIKDAIHDGNVLGFS

SEQ ID NO: 2057550 - protein, 18 aa, Staphylococcus
DIIFLDEPTTYLDICHQL

SEQ ID NO: 2057551 - protein, 20 aa, Staphylococcus
DIIPLITSANIACGFHAGDE

SEQ ID NO: 2057552 - protein, 18 aa, Staphylococcus
DIKTLPHPGFPTDMQSQM

SEQ ID NO: 2057553 - protein, 19 aa, Staphylococcus
DILTIGQYLQPSRKHLKVQ

SEQ ID NO: 2057554 - protein, 25 aa, Staphylococcus
DISNYVLLEYGQPLHMFDQDHIGSK

SEQ ID NO: 2057555 - protein, 19 aa, Staphylococcus
DKAVITVPAYFNDAERQAT

SEQ ID NO: 2057556 - protein, 24 aa, Staphylococcus
DKFGVYVIFDKKTPIFVGQTGGYS

SEQ ID NO: 2057557 - protein, 25 aa, Staphylococcus
DKGDSRFYLSLQDELMVRFGSERLQ

SEQ ID NO: 2057558 - protein, 20 aa, Staphylococcus
DKHDITVTAWMPLMRNRGLL

SEQ ID NO: 2057559 - protein, 29 aa, Staphylococcus
DLADFYCKEAPFYTLGPLVTDIAPAYDHI

SEQ ID NO: 2057560 - protein, 17 aa, Staphylococcus
DLIFNRDVQVKSGQAPV

SEQ ID NO: 2057561 - protein, 20 aa, Staphylococcus
DLIKSASYPNILPSSTNPTL

SEQ ID NO: 2057562 - protein, 30 aa, Staphylococcus; identical to SEQ ID NO: 1819689

SEQ ID NO: 2057563 - protein, 21 aa, Staphylococcus
DLTQIAFYERGELVDADSIEM

SEQ ID NO: 2057564 - protein, 30 aa, Staphylococcus; identical to SEQ ID NO: 1682912

SEQ ID NO: 2057565 - protein, 23 aa, Staphylococcus
DMAEIRVFYRDEFLCTAISPDLA

SEQ ID NO: 2057566 - protein, 23 aa, Staphylococcus
DNKVKVIAWYDNEWGYSNRVVEV

SEQ ID NO: 2057567 - protein, 17 aa, Staphylococcus
DNLKRMKAWIPIDGTYD

SEQ ID NO: 2057568 - protein, 25 aa, Staphylococcus
DNMPDKLCLYYHIGQCMGPCVYDVD

SEQ ID NO: 2057569 - protein, 21 aa, Staphylococcus
DNPIYYAQYAHARICSILKQA

SEQ ID NO: 2057570 - protein, 27 aa, Staphylococcus
DNRIVQALPTIKYIIEQGGKLVLFSHL

SEQ ID NO: 2057571 - protein, 20 aa, Staphylococcus
DPELYIIDEPFLGLDPLGIQ

SEQ ID NO: 2057572 - protein, 19 aa, Staphylococcus
DPLRSRKLLLHKKEIIKLG

SEQ ID NO: 2057573 - protein, 23 aa, Staphylococcus
DQEKPFVTSGIRLGTPAATTRGF

SEQ ID NO: 2057574 - protein, 23 aa, Staphylococcus
DQHVREYIVLKLQSKPNRLHQVS

SEQ ID NO: 2057575 - protein, 21 aa, Staphylococcus
DQSWLFNQQLVVDAQVLGVFE

SEQ ID NO: 2057576 - protein, 20 aa, Staphylococcus
DRAELMLRVAAIIRRRKEEI

SEQ ID NO: 2057577 - protein, 18 aa, Staphylococcus
DREDLFITSKLWNDYQGY

SEQ ID NO: 2057578 - protein, 22 aa, Staphylococcus
DREQLLKEVWHYEFYGDLRTVD

SEQ ID NO: 2057579 - protein, 21 aa, Staphylococcus
DRLDKRIYDLQLSRQIAIQTA

SEQ ID NO: 2057580 - protein, 24 aa, Staphylococcus
DRLRARDMLGKYHKLFIDKKELST

SEQ ID NO: 2057581 - protein, 24 aa, Staphylococcus
DRVDHRYVYVNLGRTEAVLSEAER

SEQ ID NO: 2057582 - protein, 25 aa, Staphylococcus
DSCLKIKYMFPKAHAAAYVLMAVRI

SEQ ID NO: 2057583 - protein, 24 aa, Staphylococcus
DSFGAYLHMGGRIGVLTVVEGSTD

SEQ ID NO: 2057584 - protein, 20 aa, Staphylococcus
DSLKRIDISPLGAAALSGTT

SEQ ID NO: 2057585 - protein, 21 aa, Staphylococcus
DSLKRIDISPLGAAALSGTTH

SEQ ID NO: 2057586 - protein, 25 aa, Staphylococcus
DSPEFVNESPYEKAWMVKVELSDES

SEQ ID NO: 2057587 - protein, 24 aa, Staphylococcus
DSSSPHTYYLIANSMINGFSHKDR

SEQ ID NO: 2057588 - protein, 19 aa, Staphylococcus
DSVILLEQIRTLDKKRLKE

SEQ ID NO: 2057589 - protein, 23 aa, Staphylococcus
DSYSQLLEFAYPTDKTEVYLNDY

SEQ ID NO: 2057590 - protein, 23 aa, Staphylococcus
DTAPAFFEGTPGYEEQMFGVQQN

SEQ ID NO: 2057591 - protein, 28 aa, Staphylococcus
DTIENRPMMYIALSYDHRIIDGKEAVGF

SEQ ID NO: 2057592 - protein, 19 aa, Staphylococcus
DTRFVNGERALLFGPFAGF

SEQ ID NO: 2057593 - protein, 25 aa, Staphylococcus
DTVAVLLPATTFYLDKNDYADARGM

SEQ ID NO: 2057594 - protein, 17 aa, Staphylococcus
DVALITDGRFSGATRGI

SEQ ID NO: 2057595 - protein, 24 aa, Staphylococcus
DVDPLNDVLILVESLMLVDVDTLS

SEQ ID NO: 2057596 - protein, 22 aa, Staphylococcus
DVEMLQDLVLAATNEAMNKADE

SEQ ID NO: 2057597 - protein, 25 aa, Staphylococcus
DVEPVFGFMKAILGFTRMSVRGLNK

SEQ ID NO: 2057598 - protein, 26 aa, Staphylococcus
DVEPVFGFMKAILGFTRMSVRGLNKV

SEQ ID NO: 2057599 - protein, 19 aa, Staphylococcus
DVFKSIWSKATLNSVLNPL

SEQ ID NO: 2057600 - protein, 17 aa, Staphylococcus
DVGNLYLNRGCTAAVVG

SEQ ID NO: 2057601 - protein, 18 aa, Staphylococcus
DVGNLYLNRGCTAAVVGY

SEQ ID NO: 2057602 - protein, 26 aa, Staphylococcus
DVMAHLTMEFFTKGLVPITSLSFGYD

SEQ ID NO: 2057603 - protein, 21 aa, Staphylococcus
DVPAFAICHGPQILIDTDDLN

SEQ ID NO: 2057604 - protein, 25 aa, Staphylococcus
DVPRGLPIIPEAYTPKLKRVNRKPI

SEQ ID NO: 2057605 - protein, 22 aa, Staphylococcus
DVPTFAICHGPLLLVDTDDLNG

SEQ ID NO: 2057606 - protein, 26 aa, Staphylococcus
DWYNASYIIMWGSNVPLTRTPDAHFM

SEQ ID NO: 2057607 - protein, 17 aa, Staphylococcus
DYDLDIKVYPNGKYHLL

SEQ ID NO: 2057608 - protein, 29 aa, Staphylococcus
DYELQLPDWQVTLVELIGATKLIHCVNGE

SEQ ID NO: 2057609 - protein, 28 aa, Staphylococcus
DYLKDLGIDVIWLSPMYKSPNDDNGYDI

SEQ ID NO: 2057610 - protein, 19 aa, Staphylococcus
DYQAIYFAGGHGAIWDLRN

SEQ ID NO: 2057611 - protein, 23 aa, Staphylococcus
DYSKYFEHVYQPPNLKEAKKRGK

SEQ ID NO: 2057612 - protein, 24 aa, Staphylococcus
DYSTNIAMVLTKIAKRNPREIAQA

SEQ ID NO: 2057613 - protein, 23 aa, Staphylococcus
EAAKDVAMHIAAINPKYVSSDQV

SEQ ID NO: 2057614 - protein, 23 aa, Staphylococcus
EAAPKMLPMFSDELVNYAVNYLE

SEQ ID NO: 2057615 - protein, 18 aa, Staphylococcus
EAARKLNFKARKTMMIAQ

SEQ ID NO: 2057616 - protein, 24 aa, Staphylococcus
EACEYRRHFLSYHPDYAIMTNIDF

SEQ ID NO: 2057617 - protein, 17 aa, Staphylococcus
EAIAWHLSKILELEDSK

SEQ ID NO: 2057618 - protein, 23 aa, Staphylococcus
EAPAKAYNPLFIYGGVGLGKTHL

SEQ ID NO: 2057619 - protein, 34 aa, Staphylococcus
EATLTARLIDRPIRPLFPKGYRHDVQIMNTVLSA

SEQ ID NO: 2057620 - protein, 20 aa, Staphylococcus
EAVRRNPYSVILLDEVEKAH

SEQ ID NO: 2057621 - protein, 23 aa, Staphylococcus
EAYKQNMFALLGKPGYEDKKKEL

SEQ ID NO: 2057622 - protein, 17 aa, Staphylococcus
ECHIYTLRQVYAESLLE

SEQ ID NO: 2057623 - protein, 18 aa, Staphylococcus
ECVAEDIPFFLEVLTYDD

SEQ ID NO: 2057624 - protein, 24 aa, Staphylococcus
EDEQRTKLYKGWKKAVEATQVFKL

SEQ ID NO: 2057625 - protein, 22 aa, Staphylococcus
EDLTQIAFYERGELVDADSIEL

SEQ ID NO: 2057626 - protein, 26 aa, Staphylococcus
EDMGYTDFNLGPEPEFFLFKLDEKGE

SEQ ID NO: 2057627 - protein, 25 aa, Staphylococcus
EDRLRSRFEWGLIVDITPPDYETRM

SEQ ID NO: 2057628 - protein, 23 aa, Staphylococcus
EDRPLALCAALLHDLGHGPFSHS

SEQ ID NO: 2057629 - protein, 32 aa, Staphylococcus
EDVSYENWLKVINLNLNGVFLVAQAVGRQMIK

SEQ ID NO: 2057630 - protein, 21 aa, Staphylococcus
EEALLAQIRPEDLQAYGLIPE

SEQ ID NO: 2057631 - protein, 18 aa, Staphylococcus
EEAYEPQFGARPLKRFVQ

SEQ ID NO: 2057632 - protein, 25 aa, Staphylococcus
EEEKRFMHHYNFPNFSVGETGPVRA

SEQ ID NO: 2057633 - protein, 18 aa, Staphylococcus
EEFGLLTYVDDAHGSGVM

SEQ ID NO: 2057634 - protein, 24 aa, Staphylococcus
EEFYTFIGQFYSLNQHILPKEVHV

SEQ ID NO: 2057635 - protein, 25 aa, Staphylococcus
EEIEWQNYWKTFASQWLKDLNINEE

SEQ ID NO: 2057636 - protein, 26 aa, Staphylococcus
EEIEWQNYWKTFASQWLKDLNISEEN

SEQ ID NO: 2057637 - protein, 22 aa, Staphylococcus
EELIRRLRRGIYAKQKVIVFKP

SEQ ID NO: 2057638 - protein, 22 aa, Staphylococcus
EEMRLMYVALTRAKEQLILIGT

SEQ ID NO: 2057639 - protein, 24 aa, Staphylococcus
EERERIFFLKAKGYSLRKIAKDIC

SEQ ID NO: 2057640 - protein, 21 aa, Staphylococcus
EESSILKFPGVLIRTSTERPE

SEQ ID NO: 2057641 - protein, 25 aa, Staphylococcus
EETPFAAIILAEIFDKVGVPKGVFN

SEQ ID NO: 2057642 - protein, 29 aa, Staphylococcus
EETTLLTLKIAELFRDSTIPAGLIQIVPG

SEQ ID NO: 2057643 - protein, 19 aa, Staphylococcus
EEYVNVRGVPLRLVDTAGI

SEQ ID NO: 2057644 - protein, 20 aa, Staphylococcus
EFDFIIFDTAPTGHTLRMLE

SEQ ID NO: 2057645 - protein, 27 aa, Staphylococcus
EFDLGHFRGAIRPDITRFRDLPDWIRE

SEQ ID NO: 2057646 - protein, 17 aa, Staphylococcus
EFNKDVVIDLVGYRRYG

SEQ ID NO: 2057647 - protein, 24 aa, Staphylococcus
EGAARYMSGFYTVVKMVEGLIHDL

SEQ ID NO: 2057648 - protein, 25 aa, Staphylococcus
EGAARYMSGFYTVVKMVEGLMHDLN

SEQ ID NO: 2057649 - protein, 36 aa, Staphylococcus; identical to SEQ ID NO: 1819082

SEQ ID NO: 2057650 - protein, 19 aa, Staphylococcus
EGELDRYPLAKFKRSNSGT

SEQ ID NO: 2057651 - protein, 25 aa, Staphylococcus
EGELPEERLFRKYAHTIRNWDDEKQ

SEQ ID NO: 2057652 - protein, 19 aa, Staphylococcus
EGFLLAQDISSYSLTIVAH

SEQ ID NO: 2057653 - protein, 25 aa, Staphylococcus
EGIEFVEFLISPNKGEPLKSLNKIA

SEQ ID NO: 2057654 - protein, 22 aa, Staphylococcus
EGKNIWFGVREFAMGAAVNGMA

SEQ ID NO: 2057655 - protein, 20 aa, Staphylococcus
EGLKNLFKIVSASLVKYYYR

SEQ ID NO: 2057656 - protein, 22 aa, Staphylococcus
EGLSIKASKFPYAANGRALSLD

SEQ ID NO: 2057657 - protein, 34 aa, Staphylococcus
EGNFHEGLNFASILNLPVIFVCENNQFGEGTTHD

SEQ ID NO: 2057658 - protein, 24 aa, Staphylococcus
EGQTLFFGGLARIDYVSGGKRPLV

SEQ ID NO: 2057659 - protein, 22 aa, Staphylococcus
EGQYIAYFQAFTNTHAPVEVLK

SEQ ID NO: 2057660 - protein, 22 aa, Staphylococcus
EGTGNLLVLKTLPGNAQSIGAI

SEQ ID NO: 2057661 - protein, 25 aa, Staphylococcus
EGTRPLLIEVQALVTPTTFNNPRRM

SEQ ID NO: 2057662 - protein, 17 aa, Staphylococcus
EHAYTYLYSQRDGTPAA

SEQ ID NO: 2057663 - protein, 24 aa, Staphylococcus
EHFNKLEVPFIYRVHEQPKSDRLR

SEQ ID NO: 2057664 - protein, 25 aa, Staphylococcus
EHVASALIKWFNTNYHYIVPEWDNA

SEQ ID NO: 2057665 - protein, 33 aa, Staphylococcus; identical to SEQ ID NO: 1819810

SEQ ID NO: 2057666 - protein, 26 aa, Staphylococcus
EILNRMDDIVLFKPLSINDMSMIVDK

SEQ ID NO: 2057667 - protein, 19 aa, Staphylococcus
EIPFDVYPQDAIMPLPLEE

SEQ ID NO: 2057668 - protein, 32 aa, Staphylococcus
EIPRLNVLDLQRLIRVIPKPVIAMVRGYAIGG

SEQ ID NO: 2057669 - protein, 18 aa, Staphylococcus
EKAGANVTVLYRGDRYSA

SEQ ID NO: 2057670 - protein, 25 aa, Staphylococcus
EKANPQILTLLLQVMDDGNLTDGQG

SEQ ID NO: 2057671 - protein, 26 aa, Staphylococcus
EKARLQLALLMLERNNVLILDEPTNH

SEQ ID NO: 2057672 - protein, 23 aa, Staphylococcus
EKKLKIILSLIKEDELCVCDISL

SEQ ID NO: 2057673 - protein, 17 aa, Staphylococcus
EKNAMGWYLDGRVSAVV

SEQ ID NO: 2057674 - protein, 25 aa, Staphylococcus
EKQKLRYLYGMTERQFRNTFDIAAK

SEQ ID NO: 2057675 - protein, 26 aa, Staphylococcus
EKVRRNPYSVILFDEIEKANPQILTL

SEQ ID NO: 2057676 - protein, 20 aa, Staphylococcus
ELDAALWGARAAYIGGFNST

SEQ ID NO: 2057677 - protein, 20 aa, Staphylococcus
ELERFRATLFRQTMFAEFEH

SEQ ID NO: 2057678 - protein, 21 aa, Staphylococcus
ELERFRATLFRQTMFAEFEHK

SEQ ID NO: 2057679 - protein, 21 aa, Staphylococcus
ELIRRLRRGIYAKQKVVVFKP

SEQ ID NO: 2057680 - protein, 31 aa, Staphylococcus
ELKSRLPEYMIPRKFVWMKQLPLTSNGKLDR

SEQ ID NO: 2057681 - protein, 26 aa, Staphylococcus
ELNNPHSFFYFIYDEDKLAGYLKLNI

SEQ ID NO: 2057682 - protein, 18 aa, Staphylococcus
ELVGAVPVLIKKNGRVDK

SEQ ID NO: 2057683 - protein, 30 aa, Staphylococcus; identical to SEQ ID NO: 1826737

SEQ ID NO: 2057684 - protein, 18 aa, Staphylococcus
EMSVLELNDLVKAIEEEF

SEQ ID NO: 2057685 - protein, 19 aa, Staphylococcus
ENHFFGRVGLFRNQVGDEL

SEQ ID NO: 2057686 - protein, 17 aa, Staphylococcus
ENKLTFSDEVVEKIAGI

SEQ ID NO: 2057687 - protein, 17 aa, Staphylococcus
ENPYKNFMPSPGKITQY

SEQ ID NO: 2057688 - protein, 29 aa, Staphylococcus
ENRYLTEDIAYGLVLWSSLGRVIDVPTPN

SEQ ID NO: 2057689 - protein, 21 aa, Staphylococcus
EPAYSFMIRVRVPGGKATPEQ

SEQ ID NO: 2057690 - protein, 24 aa, Staphylococcus
EPYIRRRAIRHLEKKRVVIFAAGI

SEQ ID NO: 2057691 - protein, 25 aa, Staphylococcus
EQEKRFMHHYNFPNFSVGETGPVRA

SEQ ID NO: 2057692 - protein, 29 aa, Staphylococcus
EQILTSSDLILYVSYFNHSFTDNDKAFIE

SEQ ID NO: 2057693 - protein, 18 aa, Staphylococcus
EQLDLLLLEIPKSRKIHS

SEQ ID NO: 2057694 - protein, 25 aa, Staphylococcus
EQRISNFLIWQVSYSEFIFNEKLWP

SEQ ID NO: 2057695 - protein, 24 aa, Staphylococcus
EQTETFLRGFLGRMLFSGEEVKKK

SEQ ID NO: 2057696 - protein, 40 aa, Staphylococcus
EQTEVRLVLSFLRTIDNPLQDIYLVGLMRSVIYQFTEDEL

SEQ ID NO: 2057697 - protein, 25 aa, Staphylococcus
ERELGFLALHGFLHLLGYDHMNEED

SEQ ID NO: 2057698 - protein, 22 aa, Staphylococcus
ERKLTEMGIYPAVDPLASTSRA

SEQ ID NO: 2057699 - protein, 23 aa, Staphylococcus
ERSAAFFALGLIKGSERPVAILC

SEQ ID NO: 2057700 - protein, 31 aa, Staphylococcus
ESDMYLYPDLDTWVIFPWTAGQGKVARLICD

SEQ ID NO: 2057701 - protein, 20 aa, Staphylococcus
ESGIGGLALGLTTQGYRPVM

SEQ ID NO: 2057702 - protein, 23 aa, Staphylococcus
ESKFKVYIIDEVHMLTTGAFNAL

SEQ ID NO: 2057703 - protein, 18 aa, Staphylococcus
ESLTFDDVLLIPAESNVL

SEQ ID NO: 2057704 - protein, 35 aa, Staphylococcus
ESLTVITNCFPVFQILFEKRSLNFKVYLLGGEMRE

SEQ ID NO: 2057705 - protein, 27 aa, Staphylococcus
ETAGPLYYRAEPVGCTATILYKMYKER

SEQ ID NO: 2057706 - protein, 20 aa, Staphylococcus
ETFLKLYNKVLDYLGKKDEL

SEQ ID NO: 2057707 - protein, 18 aa, Staphylococcus
ETGRYSYQRLFKKDLRKD

SEQ ID NO: 2057708 - protein, 28 aa, Staphylococcus
EVDYPNLMFHFLPIAVRYDGQKAPVAHG

SEQ ID NO: 2057709 - protein, 24 aa, Staphylococcus
EVFQGRQYKVYRGMGSLGAMERGS

SEQ ID NO: 2057710 - protein, 29 aa, Staphylococcus
EVIGNPLLDKFMKDLIIQILAMVSEQERN

SEQ ID NO: 2057711 - protein, 17 aa, Staphylococcus
EVIRISVPALTEERRKE

SEQ ID NO: 2057712 - protein, 18 aa, Staphylococcus
EVIRITVPALTEERRKEL

SEQ ID NO: 2057713 - protein, 27 aa, Staphylococcus
EVLNYLYRPNHPRSFSFIPGPASRLSW

SEQ ID NO: 2057714 - protein, 23 aa, Staphylococcus
EVLPELEGKLHGLALRVPTKNVS

SEQ ID NO: 2057715 - protein, 21 aa, Staphylococcus
EVLPELEGKLHGMALRVPTKN

SEQ ID NO: 2057716 - protein, 18 aa, Staphylococcus
EVLVQYHIPGISGVDTRS

SEQ ID NO: 2057717 - protein, 24 aa, Staphylococcus
EVMGRDCGDLALWAGLSVGAETIV

SEQ ID NO: 2057718 - protein, 18 aa, Staphylococcus
EVMPIYDAAMKYKEDGTG

SEQ ID NO: 2057719 - protein, 23 aa, Staphylococcus
EVNYIMNLPVNFLKTFLPELIEK

SEQ ID NO: 2057720 - protein, 23 aa, Staphylococcus
EVPRGLPIIPEEYTPKLKRVNRK

SEQ ID NO: 2057721 - protein, 27 aa, Staphylococcus
EVQEIIDHFIMKLRIVKFARTPDYNEL

SEQ ID NO: 2057722 - protein, 23 aa, Staphylococcus
EVVTELLDIELSIGRTGVVTPTA

SEQ ID NO: 2057723 - protein, 24 aa, Staphylococcus
EYGKVFNIPTPTNALITHLIHQLE

SEQ ID NO: 2057724 - protein, 17 aa, Staphylococcus
EYLIEKLTFMHAYNCIC

SEQ ID NO: 2057725 - protein, 18 aa, Staphylococcus
EYMPYLLEDEFISNGAHF

SEQ ID NO: 2057726 - protein, 24 aa, Staphylococcus
EYNQYIRIRHILNPSLKVLTKCQA

SEQ ID NO: 2057727 - protein, 18 aa, Staphylococcus
FAAEYIASQGNKNIILCE

SEQ ID NO: 2057728 - protein, 18 aa, Staphylococcus
FAKKLRDAIPSLEKIRFV

SEQ ID NO: 2057729 - protein, 17 aa, Staphylococcus
FANAMFEPLWNNKYISN

SEQ ID NO: 2057730 - protein, 24 aa, Staphylococcus
FASLLHEDLKIRKFIDNELKEASV

SEQ ID NO: 2057731 - protein, 24 aa, Staphylococcus
FDQEKPFVTSGIRLGTPAATTRGF

SEQ ID NO: 2057732 - protein, 23 aa, Staphylococcus
FDRKNYFYPDNPKAYQISQFDQP

SEQ ID NO: 2057733 - protein, 24 aa, Staphylococcus
FDRKNYFYPDNPKAYQISQFDQPI

SEQ ID NO: 2057734 - protein, 27 aa, Staphylococcus
FDVNTLSPTYKLLMGVPGRSNAFDISK

SEQ ID NO: 2057735 - protein, 17 aa, Staphylococcus
FEDCCTIFTPKNPVTEP

SEQ ID NO: 2057736 - protein, 18 aa, Staphylococcus
FEEGKRAVLLLHGFTGNS

SEQ ID NO: 2057737 - protein, 25 aa, Staphylococcus
FENNQYIVTWALGHLVTNATPEQYD

SEQ ID NO: 2057738 - protein, 26 aa, Staphylococcus
FERELGFLALHGFLHLLGYDHMNEED

SEQ ID NO: 2057739 - protein, 25 aa, Staphylococcus
FERNYERYQFLNWATKAFNNYNAVP

SEQ ID NO: 2057740 - protein, 25 aa, Staphylococcus
FETTEYILDQLPCWLTYTNDRTHKV

SEQ ID NO: 2057741 - protein, 19 aa, Staphylococcus
FEVMSIPTLIVFKDGEPVD

SEQ ID NO: 2057742 - protein, 20 aa, Staphylococcus
FFENIPKIHRKLQTLVDVGL

SEQ ID NO: 2057743 - protein, 21 aa, Staphylococcus
FGESLPVYKPTLPPMVFGTRD

SEQ ID NO: 2057744 - protein, 19 aa, Staphylococcus
FGMFIELPNTIEGMVHISN

SEQ ID NO: 2057745 - protein, 18 aa, Staphylococcus
FGMGPDRIAMLKYGIEDI

SEQ ID NO: 2057746 - protein, 17 aa, Staphylococcus
FIKVIREVGRNGVIELG

SEQ ID NO: 2057747 - protein, 17 aa, Staphylococcus
FITEKVANHIAYLCSII

SEQ ID NO: 2057748 - protein, 20 aa, Staphylococcus
FIVITHRKGTMEFSDRLYGV

SEQ ID NO: 2057749 - protein, 18 aa, Staphylococcus
FKDWLQSDVFRKAHQHVR

SEQ ID NO: 2057750 - protein, 25 aa, Staphylococcus
FKIVTGFIEPHFFAGFSGGPKGIMP

SEQ ID NO: 2057751 - protein, 17 aa, Staphylococcus
FLDLFEKHELDSAVIGE

SEQ ID NO: 2057752 - protein, 22 aa, Staphylococcus
FLEIPFDVYPQDAIMPLPLEEA

SEQ ID NO: 2057753 - protein, 18 aa, Staphylococcus
FLNKVAQEYWYIHDGKME

SEQ ID NO: 2057754 - protein, 20 aa, Staphylococcus
FLQNMLLDNGKYIYGYFPHF

SEQ ID NO: 2057755 - protein, 24 aa, Staphylococcus
FNEVRNMFGYTGTYKGKEISVMGS

SEQ ID NO: 2057756 - protein, 24 aa, Staphylococcus
FNGPLDLLLHLIQKFEIDIYDIPM

SEQ ID NO: 2057757 - protein, 18 aa, Staphylococcus
FNIKEGEFFVLIGPSGCG

SEQ ID NO: 2057758 - protein, 26 aa, Staphylococcus
FNLDHTKVVAPFVRLAGTMEGLNGDV

SEQ ID NO: 2057759 - protein, 20 aa, Staphylococcus
FQDLPQFTPEIFMKVSAKNV

SEQ ID NO: 2057760 - protein, 24 aa, Staphylococcus
FQPMNANFGLLPSLEKRIKDKKER

SEQ ID NO: 2057761 - protein, 17 aa, Staphylococcus
FQRLRRIKQLGTLYLSF

SEQ ID NO: 2057762 - protein, 18 aa, Staphylococcus
FRDLKAPIRMHRLLQGDV

SEQ ID NO: 2057763 - protein, 26 aa, Staphylococcus
FSFIPGPASRLSWLGDILTTANNIHA

SEQ ID NO: 2057764 - protein, 18 aa, Staphylococcus
FSKGLLMGARGNSGVILS

SEQ ID NO: 2057765 - protein, 17 aa, Staphylococcus
FTLDDFLEQLDQVKNLG

SEQ ID NO: 2057766 - protein, 18 aa, Staphylococcus
FTMVKWEISGTLNYMKPR

SEQ ID NO: 2057767 - protein, 28 aa, Staphylococcus
FTNNQLVGAGLPLWLPNGATIRREIERY

SEQ ID NO: 2057768 - protein, 24 aa, Staphylococcus
FVANSFAMRLNQLGKQAFVIGEST

SEQ ID NO: 2057769 - protein, 27 aa, Staphylococcus
FVEKSGWTDIFIYPGFEYKAIDGLITN

SEQ ID NO: 2057770 - protein, 21 aa, Staphylococcus
FYHDMNGLLMAKLNDIHINIV

SEQ ID NO: 2057771 - protein, 20 aa, Staphylococcus
FYIISIEIVFFHLSKNFMSR

SEQ ID NO: 2057772 - protein, 23 aa, Staphylococcus
GADGLIFHPYLAGERAPLWNADA

SEQ ID NO: 2057773 - protein, 29 aa, Staphylococcus
GAEREIRLRPSYFPFTEPSVEVDVSCFKC

SEQ ID NO: 2057774 - protein, 26 aa, Staphylococcus
GANVKGYFIWSLMDVFSWSNGYEKRY

SEQ ID NO: 2057775 - protein, 17 aa, Staphylococcus
GAQAWVGTLLKMKPVLR

SEQ ID NO: 2057776 - protein, 21 aa, Staphylococcus
GCDVFIIQPTSYPVNLHLMEL

SEQ ID NO: 2057777 - protein, 23 aa, Staphylococcus
GDPQLLYIDLHLIHEVTSPQAFE

SEQ ID NO: 2057778 - protein, 19 aa, Staphylococcus
GDVIRPDIVLYGEMLDQPT

SEQ ID NO: 2057779 - protein, 27 aa, Staphylococcus
GDVKDVVLLDVTPLSLGIEIMGGRMNT

SEQ ID NO: 2057780 - protein, 18 aa, Staphylococcus
GGDFYLRGLIKCPECGNN

SEQ ID NO: 2057781 - protein, 24 aa, Staphylococcus
GGELSRIMLALKSIFVQSRGQTAI

SEQ ID NO: 2057782 - protein, 18 aa, Staphylococcus
GGGWNAIFWCNHDQPRVV

SEQ ID NO: 2057783 - protein, 29 aa, Staphylococcus
GGIVLAIRNELHIPVKYVGLGEKLDDLQP

SEQ ID NO: 2057784 - protein, 24 aa, Staphylococcus
GGKRPLVCYFSNDLNIHRTKTEKA

SEQ ID NO: 2057785 - protein, 21 aa, Staphylococcus
GGQWFTPVINHPEVAILGIGR

SEQ ID NO: 2057786 - protein, 34 aa, Staphylococcus
GGVEHAVLHLLYARFWHKVLYDLGVVPTKEPFQK

SEQ ID NO: 2057787 - protein, 35 aa, Staphylococcus; identical to SEQ ID NO: 1819984

SEQ ID NO: 2057788 - protein, 17 aa, Staphylococcus
GGYVPLDPISLSPEMMG

SEQ ID NO: 2057789 - protein, 39 aa, Staphylococcus
GHEERLSKLVPLSQIYLAVTMWTAGLRGPGQLLLEGEGA

SEQ ID NO: 2057790 - protein, 35 aa, Staphylococcus
GHIELAAPVSHIWYFKGIPSRMGLLLDMSPRSLEE

SEQ ID NO: 2057791 - protein, 26 aa, Staphylococcus
GIENYSVHLTLRPLGSTPYTLLDYFG

SEQ ID NO: 2057792 - protein, 18 aa, Staphylococcus
GIIVADPLIIETCKKVAP

SEQ ID NO: 2057793 - protein, 18 aa, Staphylococcus
GIPIVAHLGLMPQSVGVM

SEQ ID NO: 2057794 - protein, 22 aa, Staphylococcus
GKDGEHLDLLSKIAITFSEEEN

SEQ ID NO: 2057795 - protein, 17 aa, Staphylococcus
GKKLAIVPILRAGLGMT

SEQ ID NO: 2057796 - protein, 21 aa, Staphylococcus
GKQKYSFQDLPQFTPEIFMKV

SEQ ID NO: 2057797 - protein, 19 aa, Staphylococcus
GKQVAFLVPTTILAQQHYE

SEQ ID NO: 2057798 - protein, 29 aa, Staphylococcus
GKSVCINSILMSLLYKNHPEELRLLLIDP

SEQ ID NO: 2057799 - protein, 26 aa, Staphylococcus
GKTTLTEKLLLFGGAIREAGTVKGKK

SEQ ID NO: 2057800 - protein, 25 aa, Staphylococcus
GKVAGELFIFDIVDAFIKAEYKPTE

SEQ ID NO: 2057801 - protein, 18 aa, Staphylococcus
GLAFVCAAKGYKAVFTMP

SEQ ID NO: 2057802 - protein, 23 aa, Staphylococcus
GLDGSRRFLDRVWRLFINEDGSL

SEQ ID NO: 2057803 - protein, 28 aa, Staphylococcus
GLDRLIRTTYDLLGLSTYFTAGVQEVRA

SEQ ID NO: 2057804 - protein, 25 aa, Staphylococcus
GLEREIWQYFTVLPGIQSVGVMGDY

SEQ ID NO: 2057805 - protein, 26 aa, Staphylococcus
GLHAVWSHLIAHKLYNKKRYVLARII

SEQ ID NO: 2057806 - protein, 36 aa, Staphylococcus
GLHPYGATFFVFSDYLKPALRLSAIMGLNSTFIFTH

SEQ ID NO: 2057807 - protein, 21 aa, Staphylococcus
GLKVPEFVKTSLAPGSKVVTG

SEQ ID NO: 2057808 - protein, 17 aa, Staphylococcus
GLMAQKFAKLKGAERVI

SEQ ID NO: 2057809 - protein, 18 aa, Staphylococcus
GLRLSQFYKELMVSTGSL

SEQ ID NO: 2057810 - protein, 27 aa, Staphylococcus
GMKQKVMIICAFIVDPELYIIDEPFLG

SEQ ID NO: 2057811 - protein, 27 aa, Staphylococcus
GMKQKVMIICAFIVNPELYIIDEPFLG

SEQ ID NO: 2057812 - protein, 30 aa, Staphylococcus
GMNKLIDAVKPFVKQKLIFLVGMAGERDMT

SEQ ID NO: 2057813 - protein, 29 aa, Staphylococcus
GMTCMFQSKRMLLGNYYTFQDRQMKIQRS

SEQ ID NO: 2057814 - protein, 25 aa, Staphylococcus
GMVKQWQDKFFNQRFSHSVFNDQPD

SEQ ID NO: 2057815 - protein, 23 aa, Staphylococcus
GNATNPEQLFAAGYASCFNGAFD

SEQ ID NO: 2057816 - protein, 30 aa, Staphylococcus; identical to SEQ ID NO: 1681042

SEQ ID NO: 2057817 - protein, 22 aa, Staphylococcus
GPAGLFASFYSGLRGMSVRIID

SEQ ID NO: 2057818 - protein, 25 aa, Staphylococcus
GPVNNGGVILRWLRDEILASEVETA

SEQ ID NO: 2057819 - protein, 24 aa, Staphylococcus
GQAEYLRVPFADFSSFKVPDSDLK

SEQ ID NO: 2057820 - protein, 17 aa, Staphylococcus
GQRFGEMEVWALEAYGA

SEQ ID NO: 2057821 - protein, 19 aa, Staphylococcus
GQRGFVPASLISTDFIEDF

SEQ ID NO: 2057822 - protein, 27 aa, Staphylococcus
GQRQRVWIAMALAQKTDIIFLDEPTTY

SEQ ID NO: 2057823 - protein, 28 aa, Staphylococcus
GQRQRVWIAMALAQKTDIIFLDEPTTYL

SEQ ID NO: 2057824 - protein, 22 aa, Staphylococcus
GQTIKFKGFMTLYVEAKDDKDN

SEQ ID NO: 2057825 - protein, 22 aa, Staphylococcus
GQTIKFKGFMTLYVEAKDDKEN

SEQ ID NO: 2057826 - protein, 18 aa, Staphylococcus
GRGPVNHFAYLKKVGLDD

SEQ ID NO: 2057827 - protein, 19 aa, Staphylococcus
GRMSLFYYAELTYQPTYCE

SEQ ID NO: 2057828 - protein, 23 aa, Staphylococcus
GRRRHLLNYLRGKDIQRYRELIK

SEQ ID NO: 2057829 - protein, 25 aa, Staphylococcus
GRSSRIGYAYFLHPANKVLNETAEE

SEQ ID NO: 2057830 - protein, 23 aa, Staphylococcus
GRYSVLTAVGLLPIAAAGINIEA

SEQ ID NO: 2057831 - protein, 23 aa, Staphylococcus
GRYSVLTAVGLLPIATAGINIES

SEQ ID NO: 2057832 - protein, 18 aa, Staphylococcus
GSALLYSLLHVSGSLELE

SEQ ID NO: 2057833 - protein, 24 aa, Staphylococcus
GSDDYRYFPEPDIVPLYVDDEWKE

SEQ ID NO: 2057834 - protein, 24 aa, Staphylococcus
GSDDYRYFPEPDIVPLYVDEEWKE

SEQ ID NO: 2057835 - protein, 25 aa, Staphylococcus
GSGKTLLAQTLAKTLNVPFAIADAT

SEQ ID NO: 2057836 - protein, 22 aa, Staphylococcus
GSKFQPWMRQINDLTISPKPPS

SEQ ID NO: 2057837 - protein, 17 aa, Staphylococcus
GSQLSFMGLPTPNIFTG

SEQ ID NO: 2057838 - protein, 25 aa, Staphylococcus
GSSGTIPGVLFKLEKTHDLTEDQMI

SEQ ID NO: 2057839 - protein, 25 aa, Staphylococcus
GTEFLMDHRHLWLRSKKQHAVMKIR

SEQ ID NO: 2057840 - protein, 17 aa, Staphylococcus
GTEHILLGLIRENEGVA

SEQ ID NO: 2057841 - protein, 22 aa, Staphylococcus
GTEHLLLGLMKEPEGIAAKVLE

SEQ ID NO: 2057842 - protein, 23 aa, Staphylococcus
GTEHLLLGLMKEPEGIAAKVLES

SEQ ID NO: 2057843 - protein, 32 aa, Staphylococcus
GTELTWMRQPHYYMGLYSYTYSAGLTIGTVMS

SEQ ID NO: 2057844 - protein, 24 aa, Staphylococcus
GTGKTFLAVVYAAKQLRKGSVKRI

SEQ ID NO: 2057845 - protein, 27 aa, Staphylococcus
GVASKAFITLINAKIPFYQTTTSEISI

SEQ ID NO: 2057846 - protein, 26 aa, Staphylococcus
GVCLNVGCIPSKALLHASHRFVEAQH

SEQ ID NO: 2057847 - protein, 27 aa, Staphylococcus
GVCNGFQILTEIGLLPGALLHNDSHLF

SEQ ID NO: 2057848 - protein, 23 aa, Staphylococcus
GVDVFRIFDSLNWVDQMKVANEA

SEQ ID NO: 2057849 - protein, 27 aa, Staphylococcus
GVDVSGKWFFDRFSPVTNIKAVGNADV

SEQ ID NO: 2057850 - protein, 24 aa, Staphylococcus
GVGPLTITMVLNNTLLAEKMRRGI

SEQ ID NO: 2057851 - protein, 28 aa, Staphylococcus
GVHGLPVQFDIDKLWIKNINVTTGLVSA

SEQ ID NO: 2057852 - protein, 22 aa, Staphylococcus
GVHSGLMYYTIGQRHGLGIGGD

SEQ ID NO: 2057853 - protein, 24 aa, Staphylococcus
GVKLVDFWATWCGPCKMIAPVLEE

SEQ ID NO: 2057854 - protein, 17 aa, Staphylococcus
GVKVSRITALQDDIKMA

SEQ ID NO: 2057855 - protein, 25 aa, Staphylococcus
GVLAGYPLIDVKAKLFDGSYHDVDS

SEQ ID NO: 2057856 - protein, 22 aa, Staphylococcus
GYEAPCYIAWSGKNRSPLVRVP

SEQ ID NO: 2057857 - protein, 23 aa, Staphylococcus
GYGDYFPHRLGHGLGLEEHEYQD

SEQ ID NO: 2057858 - protein, 21 aa, Staphylococcus
GYPVVVRPSYVLGGRAMEIVD

SEQ ID NO: 2057859 - protein, 18 aa, Staphylococcus
GYTIVLITHDYELLMACT

SEQ ID NO: 2057860 - protein, 24 aa, Staphylococcus
HAIHTARQFIGNEPFAVLLGDDIV

SEQ ID NO: 2057861 - protein, 25 aa, Staphylococcus
HALTKILEAAVPLLQDFDIELTEAH

SEQ ID NO: 2057862 - protein, 21 aa, Staphylococcus
HAMALAISNLLGLVCDPVAGL

SEQ ID NO: 2057863 - protein, 17 aa, Staphylococcus
HAPDLIKSASYPNILPS

SEQ ID NO: 2057864 - protein, 29 aa, Staphylococcus
HDGTKLGFMSFFTKAAVAALKKYPEVNAE

SEQ ID NO: 2057865 - protein, 33 aa, Staphylococcus; identical to SEQ ID NO: 1820067

SEQ ID NO: 2057866 - protein, 29 aa, Staphylococcus
HDIKIDKRKMDLPNGIHALGYTNVPVKLD

SEQ ID NO: 2057867 - protein, 30 aa, Staphylococcus; identical to SEQ ID NO: 1696065

SEQ ID NO: 2057868 - protein, 26 aa, Staphylococcus
HDVDMLRMCRYPWKTKQRILGDMGHV

SEQ ID NO: 2057869 - protein, 26 aa, Staphylococcus
HECREAGLPCYFTMDAGPNVKVLIEK

SEQ ID NO: 2057870 - protein, 37 aa, Staphylococcus
HEGEFYALPQSPQLFKQLLMISGFDKYYQIVKCFRDE

SEQ ID NO: 2057871 - protein, 20 aa, Staphylococcus
HFAIFPASHFVTREEKMKVA

SEQ ID NO: 2057872 - protein, 30 aa, Staphylococcus
HGNELPISAGFFFINPFEVVYYAGGTSNKY

SEQ ID NO: 2057873 - protein, 26 aa, Staphylococcus
HGQDHLMTTLLLKDLMKHLIELYKKG

SEQ ID NO: 2057874 - protein, 25 aa, Staphylococcus
HKYPDESELLIYFIEGLMSENQTDE

SEQ ID NO: 2057875 - protein, 33 aa, Staphylococcus
HNPANLMGIRAFKKLLPNIPHVAVFDTSFHQTM

SEQ ID NO: 2057876 - protein, 18 aa, Staphylococcus
HPFAFDNDLLIQNLKDLR

SEQ ID NO: 2057877 - protein, 24 aa, Staphylococcus
HPKMMLKVILYAYTQSVFSGRKIE

SEQ ID NO: 2057878 - protein, 19 aa, Staphylococcus
HPPTIYFPLNVEEGMMIEP

SEQ ID NO: 2057879 - protein, 21 aa, Staphylococcus
HQGRDYFVKFNCPEFTSLCPI

SEQ ID NO: 2057880 - protein, 24 aa, Staphylococcus
HSDAGLLYISYITNPTTGGVSASF

SEQ ID NO: 2057881 - protein, 25 aa, Staphylococcus
HSDAGLLYISYLTHPTTGGVSASFA

SEQ ID NO: 2057882 - protein, 24 aa, Staphylococcus
HSQSLYNMFAAIPGVKVVVPSNPY

SEQ ID NO: 2057883 - protein, 18 aa, Staphylococcus
HTFFEMLGNFSIGDYFKK

SEQ ID NO: 2057884 - protein, 17 aa, Staphylococcus
HVEMVEVPIKPSDRLRA

SEQ ID NO: 2057885 - protein, 18 aa, Staphylococcus
HVHPLMFPSEQEGFRVIN

SEQ ID NO: 2057886 - protein, 27 aa, Staphylococcus
HVTTPEWMLLPMHKGGTFGKFSTSIGL

SEQ ID NO: 2057887 - protein, 23 aa, Staphylococcus
HWDHYRDDMFPPMKLDETEEMVL

SEQ ID NO: 2057888 - protein, 22 aa, Staphylococcus
HYLYEHDAIARKILIASQPGNP

SEQ ID NO: 2057889 - protein, 24 aa, Staphylococcus
HYQYQVLDIIKWLHEEYQMTIIMV

SEQ ID NO: 2057890 - protein, 27 aa, Staphylococcus
HYTGTLVNGLMYQIKNLSGINGEIRPG

SEQ ID NO: 2057891 - protein, 18 aa, Staphylococcus
IAGLRMMCQFVDDIDVVV

SEQ ID NO: 2057892 - protein, 19 aa, Staphylococcus
IALANMMTSAALLGIDSCP

SEQ ID NO: 2057893 - protein, 18 aa, Staphylococcus
IAMVFQNYALYPHMSVYK

SEQ ID NO: 2057894 - protein, 25 aa, Staphylococcus
IARKHNLHATFMPKPLFGVNGSGMH

SEQ ID NO: 2057895 - protein, 23 aa, Staphylococcus
IAVSVYSGWLAYSTFDHDWVKQQ

SEQ ID NO: 2057896 - protein, 22 aa, Staphylococcus
IDAARYFLTMRSPDSHFDFDLE

SEQ ID NO: 2057897 - protein, 22 aa, Staphylococcus
IDDLLEMIGLVAEVQELKANPD

SEQ ID NO: 2057898 - protein, 27 aa, Staphylococcus
IDGNEYIDYVLSWGPLILGHKNKQVIE

SEQ ID NO: 2057899 - protein, 23 aa, Staphylococcus
IDIDEDFLLVKREIFSSGKSICR

SEQ ID NO: 2057900 - protein, 17 aa, Staphylococcus
IDLLKKVAEFEPTIESA

SEQ ID NO: 2057901 - protein, 25 aa, Staphylococcus
IDMYEPYMSLIKQLFPNAKIIIDRF

SEQ ID NO: 2057902 - protein, 18 aa, Staphylococcus
IDNTFLTPYLSTPLEEGA

SEQ ID NO: 2057903 - protein, 30 aa, Staphylococcus; identical to SEQ ID NO: 1820124

SEQ ID NO: 2057904 - protein, 22 aa, Staphylococcus
IEEAFVVKQILQHLATKHGINF

SEQ ID NO: 2057905 - protein, 21 aa, Staphylococcus
IEELRIISCHIGNGASIAAID

SEQ ID NO: 2057906 - protein, 33 aa, Staphylococcus
IEESDMYLCPDLDTWVIFPWTAGQGKVARLICD

SEQ ID NO: 2057907 - protein, 18 aa, Staphylococcus
IEGNDWEVLLKPAKRIKV

SEQ ID NO: 2057908 - protein, 25 aa, Staphylococcus
IEKIYDFDYVFIDVPPTINSDFTNN

SEQ ID NO: 2057909 - protein, 24 aa, Staphylococcus
IENIQPFLYHFYDMSVAVCHNGNL

SEQ ID NO: 2057910 - protein, 28 aa, Staphylococcus
IEQDIQRIEHMLRYALIIEDTGDNNVVQ

SEQ ID NO: 2057911 - protein, 18 aa, Staphylococcus
IETRFFEALGDTSHEMPA

SEQ ID NO: 2057912 - protein, 25 aa, Staphylococcus
IEYDAIVPTQLWPTLETKMIKNLYT

SEQ ID NO: 2057913 - protein, 29 aa, Staphylococcus
IFITHMHGDHIFGLPGLLTSRSFQGGEDK

SEQ ID NO: 2057914 - protein, 25 aa, Staphylococcus
IGEEYSFFIYPNRSGELFATQNMPD

SEQ ID NO: 2057915 - protein, 18 aa, Staphylococcus
IGEQKFGLRLPGEFNRED

SEQ ID NO: 2057916 - protein, 38 aa, Staphylococcus
IGGDKELPYLNLPKEMNPFLGYRAIRLCLDQQDIFRTQ

SEQ ID NO: 2057917 - protein, 20 aa, Staphylococcus
IGLAFVCAAKGYKAVFTMPE

SEQ ID NO: 2057918 - protein, 20 aa, Staphylococcus
IGQTLLPEVLSLYNTQFPNV

SEQ ID NO: 2057919 - protein, 31 aa, Staphylococcus; identical to SEQ ID NO: 1828389

SEQ ID NO: 2057920 - protein, 26 aa, Staphylococcus
IGVDFRLIEPAAFYHTLQHFTGSKDH

SEQ ID NO: 2057921 - protein, 17 aa, Staphylococcus
IGWNALFIENHDQPRRV

SEQ ID NO: 2057922 - protein, 23 aa, Staphylococcus
IHKSILINMIKCVESCGVDVLDV

SEQ ID NO: 2057923 - protein, 30 aa, Staphylococcus
IHNACVVVTRYFGGIKLGGGGLIRAYSGAV

SEQ ID NO: 2057924 - protein, 19 aa, Staphylococcus
IHNLLGIQPFARCFEMKEA

SEQ ID NO: 2057925 - protein, 17 aa, Staphylococcus
IIALKQRAKKRNIKLNV

SEQ ID NO: 2057926 - protein, 18 aa, Staphylococcus
IIDNSGLVGGYYKTYFKE

SEQ ID NO: 2057927 - protein, 32 aa, Staphylococcus
IIEKLDYIQYLGVDYIWLTPVYESPMNDNGYD

SEQ ID NO: 2057928 - protein, 24 aa, Staphylococcus
IIGNGFSVIYLISQRLVKKSLNDG

SEQ ID NO: 2057929 - protein, 22 aa, Staphylococcus
IIIDAIGQLIGMRASSDFVRHG

SEQ ID NO: 2057930 - protein, 21 aa, Staphylococcus
IIIDAIGQLIGMRASSDYVRH

SEQ ID NO: 2057931 - protein, 17 aa, Staphylococcus
IIINFSNYELEKLFKRV

SEQ ID NO: 2057932 - protein, 33 aa, Staphylococcus; identical to SEQ ID NO: 1820159

SEQ ID NO: 2057933 - protein, 18 aa, Staphylococcus
IIPLITSANIACGFHAGD

SEQ ID NO: 2057934 - protein, 17 aa, Staphylococcus
IIVFHKLSKDELKEIVT

SEQ ID NO: 2057935 - protein, 24 aa, Staphylococcus
IKDVVEQQFEFAKKIIAKGLVPII

SEQ ID NO: 2057936 - protein, 18 aa, Staphylococcus
IKFKAFLEHALKLGADYV

SEQ ID NO: 2057937 - protein, 17 aa, Staphylococcus
IKKTAMVFGQMNEPPGA

SEQ ID NO: 2057938 - protein, 18 aa, Staphylococcus
IKKTAMVFGQMNEPPGAR

SEQ ID NO: 2057939 - protein, 28 aa, Staphylococcus
IKSELGSRMRLRIVPELFFEYDESIEYG

SEQ ID NO: 2057940 - protein, 17 aa, Staphylococcus
IKVVIPSGPYDAKGLLL

SEQ ID NO: 2057941 - protein, 33 aa, Staphylococcus; identical to SEQ ID NO: 1681094

SEQ ID NO: 2057942 - protein, 18 aa, Staphylococcus
ILTVLHAGGKFGGGGYKV

SEQ ID NO: 2057943 - protein, 20 aa, Staphylococcus
ILVQVPLPKQVSEQKVLEAI

SEQ ID NO: 2057944 - protein, 18 aa, Staphylococcus
IMGCYGIGVSRTLSAIVE

SEQ ID NO: 2057945 - protein, 18 aa, Staphylococcus
IMSKMALAAYQGGAVGIR

SEQ ID NO: 2057946 - protein, 20 aa, Staphylococcus
INSKYLIATTAAKRARELDE

SEQ ID NO: 2057947 - protein, 17 aa, Staphylococcus
IPGGFSFGDYLRSGAMA

SEQ ID NO: 2057948 - protein, 18 aa, Staphylococcus
IPHISTGDMFRKAIKDET

SEQ ID NO: 2057949 - protein, 18 aa, Staphylococcus
IPLTIITESVFARFISSI

SEQ ID NO: 2057950 - protein, 25 aa, Staphylococcus
IPMDQKFIFNPYETKSIAGFDIESF

SEQ ID NO: 2057951 - protein, 30 aa, Staphylococcus
IPREKRVVISLTYVYGIGTSTAKKIVEEAN

SEQ ID NO: 2057952 - protein, 25 aa, Staphylococcus
IQDNSNILVIFSGPHSYISSSWYEE

SEQ ID NO: 2057953 - protein, 24 aa, Staphylococcus
IQGDANVFIFPSLEAGNIGYKIAQ

SEQ ID NO: 2057954 - protein, 19 aa, Staphylococcus
IQGTLIKNQALMQGFVVAQ

SEQ ID NO: 2057955 - protein, 40 aa, Staphylococcus
IQLTKKPIGVTAGIVPWNAPILVLMRKVIPAIVTGCSVVI

SEQ ID NO: 2057956 - protein, 19 aa, Staphylococcus
IQQGWFDFDVVVATPDMMG

SEQ ID NO: 2057957 - protein, 19 aa, Staphylococcus
IQVLAPMYKGSAGIKRLNQ

SEQ ID NO: 2057958 - protein, 20 aa, Staphylococcus
IREGGIRGIVISLLSLNHIN

SEQ ID NO: 2057959 - protein, 25 aa, Staphylococcus
IRLEKTFEYIDTPHKFKMGVSGCPR

SEQ ID NO: 2057960 - protein, 31 aa, Staphylococcus; identical to SEQ ID NO: 1820199

SEQ ID NO: 2057961 - protein, 18 aa, Staphylococcus
ISIDHRILDGVQTGRFMS

SEQ ID NO: 2057962 - protein, 21 aa, Staphylococcus
ISMPGMMDTILNLGLNDDNVK

SEQ ID NO: 2057963 - protein, 20 aa, Staphylococcus
ISMPGMMDTILNLGLNDENV

SEQ ID NO: 2057964 - protein, 18 aa, Staphylococcus
ISNLLKKRGIRHDVLNAK

SEQ ID NO: 2057965 - protein, 29 aa, Staphylococcus
ITDDLSTDLVWYLWTGKYSSLFGKRAMTT

SEQ ID NO: 2057966 - protein, 17 aa, Staphylococcus
ITEAMKMETTIQAPFDG

SEQ ID NO: 2057967 - protein, 23 aa, Staphylococcus
ITGLIKANIPTRIAFMVSSSVDS

SEQ ID NO: 2057968 - protein, 19 aa, Staphylococcus
ITKQYYDIGIAVSTDDGLL

SEQ ID NO: 2057969 - protein, 27 aa, Staphylococcus
ITSNIPFRIRKPLPNITFHQVEVNQYA

SEQ ID NO: 2057970 - protein, 26 aa, Staphylococcus
ITTIDPIKFNLLFERFLNPERVTMPD

SEQ ID NO: 2057971 - protein, 19 aa, Staphylococcus
ITVPAYFNDAERQATKDAG

SEQ ID NO: 2057972 - protein, 17 aa, Staphylococcus
IVDAFIKAEYKPTEENK

SEQ ID NO: 2057973 - protein, 27 aa, Staphylococcus
IVEKMVEGRLRKYLQEICAVDQNFVKD

SEQ ID NO: 2057974 - protein, 28 aa, Staphylococcus
IVEKMVEGRLRKYLQEICAVDQNFVKNP

SEQ ID NO: 2057975 - protein, 17 aa, Staphylococcus
IVHEHRHLLKGNVVFIF

SEQ ID NO: 2057976 - protein, 17 aa, Staphylococcus
IVLITHDYELLMACTDE

SEQ ID NO: 2057977 - protein, 19 aa, Staphylococcus
IVPWQQLAKRKNASLKFIP

SEQ ID NO: 2057978 - protein, 18 aa, Staphylococcus
IVSQLLFLQAQDAEKDIY

SEQ ID NO: 2057979 - protein, 17 aa, Staphylococcus
IVTIFPDGSDRYMSKKI

SEQ ID NO: 2057980 - protein, 18 aa, Staphylococcus
IVTLLDKPNRRKADIEAK

SEQ ID NO: 2057981 - protein, 19 aa, Staphylococcus
IWKVIDFQHVKPGKGSAFV

SEQ ID NO: 2057982 - protein, 17 aa, Staphylococcus
IYGPPKERRAGVITFNL

SEQ ID NO: 2057983 - protein, 19 aa, Staphylococcus
IYHQAYKKGVPQFDLKEVG

SEQ ID NO: 2057984 - protein, 24 aa, Staphylococcus
IYLSGALLMFAGNKSYYLYGASSN

SEQ ID NO: 2057985 - protein, 27 aa, Staphylococcus
IYNNIEVYGIYQGYQGLLDDNIHKLEL

SEQ ID NO: 2057986 - protein, 32 aa, Staphylococcus; identical to SEQ ID NO: 1828805

SEQ ID NO: 2057987 - protein, 19 aa, Staphylococcus
KAKASLLTVLPLDKERLAD

SEQ ID NO: 2057988 - protein, 21 aa, Staphylococcus
KAKIPLVVRTVHGAGAGAAAQ

SEQ ID NO: 2057989 - protein, 30 aa, Staphylococcus; identical to SEQ ID NO: 1680441

SEQ ID NO: 2057990 - protein, 20 aa, Staphylococcus
KAPEIGLATVYRTLELLAEL

SEQ ID NO: 2057991 - protein, 17 aa, Staphylococcus
KAYLSIAPKNTILITDE

SEQ ID NO: 2057992 - protein, 25 aa, Staphylococcus
KDDDTLVLVGFGGGLTWGAIVIKWG

SEQ ID NO: 2057993 - protein, 18 aa, Staphylococcus
KDEFLEKIRKALYMSKIC

SEQ ID NO: 2057994 - protein, 24 aa, Staphylococcus
KDFANIFFMMMNYYSIERSMEIAK

SEQ ID NO: 2057995 - protein, 21 aa, Staphylococcus
KDGRLFTCYLGDFESTGGIFA

SEQ ID NO: 2057996 - protein, 20 aa, Staphylococcus
KDHAMLKLAYIDLKDYLSTL

SEQ ID NO: 2057997 - protein, 17 aa, Staphylococcus
KDIMLPTAKAALAVGAD

SEQ ID NO: 2057998 - protein, 19 aa, Staphylococcus
KDIRIIPLGGVGEIAKNMY

SEQ ID NO: 2057999 - protein, 24 aa, Staphylococcus
KDKHGVEWVLRLPRRPDVYKRTKP

SEQ ID NO: 2058000 - protein, 19 aa, Staphylococcus
KDLELFTNNQLVGAGLPLW

SEQ ID NO: 2058001 - protein, 21 aa, Staphylococcus
KDPKYLIGRVIARPYVGEPGN

SEQ ID NO: 2058002 - protein, 24 aa, Staphylococcus
KDSDLVIGAVLIPGAKAPNLVTED

SEQ ID NO: 2058003 - protein, 19 aa, Staphylococcus
KDSVILLEQIRTLDKKRLK

SEQ ID NO: 2058004 - protein, 24 aa, Staphylococcus
KDVDVFLVAPKGPGHLVRRTFVEG

SEQ ID NO: 2058005 - protein, 19 aa, Staphylococcus
KDYFNRDRFILSAGHGSAL

SEQ ID NO: 2058006 - protein, 19 aa, Staphylococcus
KDYGPFYRYDPNQCILCGR

SEQ ID NO: 2058007 - protein, 24 aa, Staphylococcus
KDYVDIVEIGTPIIYNEGLPSVQY

SEQ ID NO: 2058008 - protein, 26 aa, Staphylococcus
KEAERLVIHGFLDPVVRELPIEDVKR

SEQ ID NO: 2058009 - protein, 21 aa, Staphylococcus
KEIDKTIFPGIQGGPLEHVIA

SEQ ID NO: 2058010 - protein, 21 aa, Staphylococcus
KEIFNNLLSKQVDGIIFLGGT

SEQ ID NO: 2058011 - protein, 17 aa, Staphylococcus
KEKYSLFDITHQPELCA

SEQ ID NO: 2058012 - protein, 18 aa, Staphylococcus
KEMFLEDLGIEEPGLDRL

SEQ ID NO: 2058013 - protein, 22 aa, Staphylococcus
KERGFEIKPEIAGLMISAIISD

SEQ ID NO: 2058014 - protein, 24 aa, Staphylococcus
KESDLVIGAVLIPGAKAPNLVTED

SEQ ID NO: 2058015 - protein, 25 aa, Staphylococcus
KESDLVIGAVLIPGAKAPSLVTEDM

SEQ ID NO: 2058016 - protein, 24 aa, Staphylococcus
KESLELYINAYRLAERYSNIATNC

SEQ ID NO: 2058017 - protein, 25 aa, Staphylococcus
KFRAKQIFEWLYQKRVDSIDEMTNL

SEQ ID NO: 2058018 - protein, 18 aa, Staphylococcus
KFRYDLNERFIITRGLDK

SEQ ID NO: 2058019 - protein, 30 aa, Staphylococcus; identical to SEQ ID NO: 1821736

SEQ ID NO: 2058020 - protein, 17 aa, Staphylococcus
KGFGINPIIIKSVAKQV

SEQ ID NO: 2058021 - protein, 19 aa, Staphylococcus
KGLKVALPKEYLGEGVSED

SEQ ID NO: 2058022 - protein, 22 aa, Staphylococcus
KGLKVPEFVKTSLAPGSKVVTG

SEQ ID NO: 2058023 - protein, 17 aa, Staphylococcus
KGLRTGIIADRIGGQVN

SEQ ID NO: 2058024 - protein, 17 aa, Staphylococcus
KHSPTALRFLKAAMNAD

SEQ ID NO: 2058025 - protein, 20 aa, Staphylococcus
KHSPTALRFLKAAMNADTDG

SEQ ID NO: 2058026 - protein, 18 aa, Staphylococcus
KIDEELALKWLKDGAKPT

SEQ ID NO: 2058027 - protein, 24 aa, Staphylococcus
KIDVLIVVNMFLTGFDSKVLNTLY

SEQ ID NO: 2058028 - protein, 27 aa, Staphylococcus
KIEQEDKMYILFYKPTQVITSVSDDRG

SEQ ID NO: 2058029 - protein, 31 aa, Staphylococcus; identical to SEQ ID NO: 1690242

SEQ ID NO: 2058030 - protein, 22 aa, Staphylococcus
KIQTDGRMKALVSITLDEAFVI

SEQ ID NO: 2058031 - protein, 36 aa, Staphylococcus; identical to SEQ ID NO: 1697078

SEQ ID NO: 2058032 - protein, 19 aa, Staphylococcus
KKRPHFQALTPLYPEERIV

SEQ ID NO: 2058033 - protein, 18 aa, Staphylococcus
KKSKFTAKFLHYKNKPYK

SEQ ID NO: 2058034 - protein, 29 aa, Staphylococcus
KKYNKKPMLVAADIYRPAAINQLQTVGKQ

SEQ ID NO: 2058035 - protein, 27 aa, Staphylococcus
KLERDFKLTILPTLTPLGIDAYHPFPK

SEQ ID NO: 2058036 - protein, 18 aa, Staphylococcus
KLLLKSKILFDKVKFLFL

SEQ ID NO: 2058037 - protein, 23 aa, Staphylococcus
KLLTQVRFQIPYGKNIALVGANG

SEQ ID NO: 2058038 - protein, 20 aa, Staphylococcus
KLMVDMAHIAGLVAAGLHQN

SEQ ID NO: 2058039 - protein, 19 aa, Staphylococcus
KLPGIGPKTAQRLAFHTLD

SEQ ID NO: 2058040 - protein, 27 aa, Staphylococcus
KLQERFDNAFLLRTFSKAYGLAGLRVG

SEQ ID NO: 2058041 - protein, 25 aa, Staphylococcus
KLREEPLDHVLLFGPPGLGKTTLSN

SEQ ID NO: 2058042 - protein, 32 aa, Staphylococcus; identical to SEQ ID NO: 1829228

SEQ ID NO: 2058043 - protein, 20 aa, Staphylococcus
KLTKMSIDELGPVNLNAIEQ

SEQ ID NO: 2058044 - protein, 20 aa, Staphylococcus
KLTRIQFGPLDLKGLNAGEG

SEQ ID NO: 2058045 - protein, 23 aa, Staphylococcus
KLVDFWATWCGPCKMIAPVLEEL

SEQ ID NO: 2058046 - protein, 18 aa, Staphylococcus
KLYALRDVTGTVNSIPLI

SEQ ID NO: 2058047 - protein, 21 aa, Staphylococcus
KLYHGIFNEEIGCPTMNSGLF

SEQ ID NO: 2058048 - protein, 27 aa, Staphylococcus
KMALAAKDIRIEAPIPGTSLVGIEVPN

SEQ ID NO: 2058049 - protein, 25 aa, Staphylococcus
KNEQIVLFLNRRGYASFMLCRDCGY

SEQ ID NO: 2058050 - protein, 21 aa, Staphylococcus
KNIALIFEKDSTRTRCAFEVA

SEQ ID NO: 2058051 - protein, 20 aa, Staphylococcus
KNIEFYLIPTKGTEKVDKTL

SEQ ID NO: 2058052 - protein, 23 aa, Staphylococcus
KNSFRPEFLNRVDDIIVFHKLSK

SEQ ID NO: 2058053 - protein, 17 aa, Staphylococcus
KPIGIKVTRLAQGLSVG

SEQ ID NO: 2058054 - protein, 24 aa, Staphylococcus
KPTVQVIFTILHAGGKFGQGGYKT

SEQ ID NO: 2058055 - protein, 21 aa, Staphylococcus
KPVIGFIGGQTAPPGKRMGHA

SEQ ID NO: 2058056 - protein, 17 aa, Staphylococcus
KPVIREKMSRRKKTAAK

SEQ ID NO: 2058057 - protein, 26 aa, Staphylococcus
KQFDQIFDLLAIRVIVNSINDCYAIL

SEQ ID NO: 2058058 - protein, 23 aa, Staphylococcus
KQTKWFPVVGQAVSASISYYFMN

SEQ ID NO: 2058059 - protein, 18 aa, Staphylococcus
KQTNSYDLAFEELEKEKD

SEQ ID NO: 2058060 - protein, 25 aa, Staphylococcus
KQYQPRYNILLKDDKSYPFIKITKE

SEQ ID NO: 2058061 - protein, 30 aa, Staphylococcus
KRTDGIPAGLLTYPPLMAADIVIYNTNIVP

SEQ ID NO: 2058062 - protein, 20 aa, Staphylococcus
KRVLDMNDRALRHVNVGLGG

SEQ ID NO: 2058063 - protein, 18 aa, Staphylococcus
KRYIAKYTINPAITHGIS

SEQ ID NO: 2058064 - protein, 19 aa, Staphylococcus
KRYIAKYTINPAITHGISD

SEQ ID NO: 2058065 - protein, 22 aa, Staphylococcus
KSDVKVFPIALGTNAVGGHNLY

SEQ ID NO: 2058066 - protein, 26 aa, Staphylococcus
KSLQLLDTPGILWPKFEDEEVGKKLS

SEQ ID NO: 2058067 - protein, 21 aa, Staphylococcus
KSNVRFVIHYNMPGDLESYYQ

SEQ ID NO: 2058068 - protein, 20 aa, Staphylococcus
KSTQIGIPIVAHLGLMPQSV

SEQ ID NO: 2058069 - protein, 25 aa, Staphylococcus
KSVLIDLGLIIGKDARRKREILGRK

SEQ ID NO: 2058070 - protein, 22 aa, Staphylococcus
KSWMLKALEPMGEEYLNVVKEG

SEQ ID NO: 2058071 - protein, 18 aa, Staphylococcus
KTLEQEFDFIIFDTAPTG

SEQ ID NO: 2058072 - protein, 23 aa, Staphylococcus
KTQAILPLRGKILNVEKARLDRI

SEQ ID NO: 2058073 - protein, 18 aa, Staphylococcus
KTTLLRMINALEIPTEGN

SEQ ID NO: 2058074 - protein, 23 aa, Staphylococcus
KTTLTEKLLYFSGAIREAGTVKG

SEQ ID NO: 2058075 - protein, 24 aa, Staphylococcus
KTTLTEKLLYFSGAIREAGTVKGK

SEQ ID NO: 2058076 - protein, 20 aa, Staphylococcus
KTVVTVLPSNGERYLSTPLY

SEQ ID NO: 2058077 - protein, 25 aa, Staphylococcus
KVAGELLCQYYFTKFGVDTRSVRFP

SEQ ID NO: 2058078 - protein, 17 aa, Staphylococcus
KVFVRNALSPSQVLEVI

SEQ ID NO: 2058079 - protein, 25 aa, Staphylococcus
KVKRELGFVLMALNIRKVVAQRAEN

SEQ ID NO: 2058080 - protein, 26 aa, Staphylococcus
KVMVSDYQFDPLKNQITHIDFLAINM

SEQ ID NO: 2058081 - protein, 17 aa, Staphylococcus
KVMYITDGVFSMDGDVA

SEQ ID NO: 2058082 - protein, 29 aa, Staphylococcus
KVNYKLRDWLFSRQRYWGEPIPIIHWEDG

SEQ ID NO: 2058083 - protein, 29 aa, Staphylococcus
KVNYKLRDWLFSRQRYWGEPIPVIHWEDG

SEQ ID NO: 2058084 - protein, 20 aa, Staphylococcus
KVRIHTPSQMGIRKPEFSSA

SEQ ID NO: 2058085 - protein, 24 aa, Staphylococcus
KVSEEQLFYLMSRGISEEEATEMI

SEQ ID NO: 2058086 - protein, 25 aa, Staphylococcus
KVSGARFVYLTKDGALLERALMNYM

SEQ ID NO: 2058087 - protein, 17 aa, Staphylococcus
KVSLELGGKSPYIVLDD

SEQ ID NO: 2058088 - protein, 19 aa, Staphylococcus
KVYLELWVKVQKDWRNKVN

SEQ ID NO: 2058089 - protein, 26 aa, Staphylococcus
KWKVHAKDLIAYPKLTGKPAATIDPE

SEQ ID NO: 2058090 - protein, 28 aa, Staphylococcus
KYDCNVYLKREDLQWVRSFKLRGAYNAI

SEQ ID NO: 2058091 - protein, 21 aa, Staphylococcus
KYEVMSIPTLIVFKDGQPVDK

SEQ ID NO: 2058092 - protein, 19 aa, Staphylococcus
KYHPLEKLGRYLMDSFVNI

SEQ ID NO: 2058093 - protein, 27 aa, Staphylococcus
LAETLHAIFLEVVIAPRFTDEALDILT

SEQ ID NO: 2058094 - protein, 19 aa, Staphylococcus
LAFGLKMRGIHKKEYDQRI

SEQ ID NO: 2058095 - protein, 17 aa, Staphylococcus
LAHILGVELPNPSMIDE

SEQ ID NO: 2058096 - protein, 18 aa, Staphylococcus
LCCSTFLGDFEPVSIKMA

SEQ ID NO: 2058097 - protein, 19 aa, Staphylococcus
LDNIPFYFPDPHSPWQRGT

SEQ ID NO: 2058098 - protein, 30 aa, Staphylococcus
LDQQDIFRTQLRALLRASAYGKLNIMFPMV

SEQ ID NO: 2058099 - protein, 24 aa, Staphylococcus
LEANVKYLAYDLGPDNIRVNAISA

SEQ ID NO: 2058100 - protein, 30 aa, Staphylococcus; identical to SEQ ID NO: 1692822

SEQ ID NO: 2058101 - protein, 25 aa, Staphylococcus
LEGALTRLLAYSKLQGKPITTELAA

SEQ ID NO: 2058102 - protein, 25 aa, Staphylococcus
LEKIRKALYMSKICSYAQGFAQMRK

SEQ ID NO: 2058103 - protein, 26 aa, Staphylococcus
LEQEDKLYILFYKPAQVITSVSDDRG

SEQ ID NO: 2058104 - protein, 33 aa, Staphylococcus
LFKIVSASLVKYYYRTPRIPRSLLNEYREGILV

SEQ ID NO: 2058105 - protein, 26 aa, Staphylococcus
LGDLAMIWREGCIIRAQFLQKIKDAY

SEQ ID NO: 2058106 - protein, 18 aa, Staphylococcus
LGEQVIMKQTARKVRRLY

SEQ ID NO: 2058107 - protein, 17 aa, Staphylococcus
LGKDIQYKDLGLLIVDE

SEQ ID NO: 2058108 - protein, 20 aa, Staphylococcus
LGKTIGILLDTKGPEIRTHD

SEQ ID NO: 2058109 - protein, 27 aa, Staphylococcus
LGPYSHAMVVNNLVFTSGQIPLDTEGN

SEQ ID NO: 2058110 - protein, 19 aa, Staphylococcus
LGQQVIMKQTARKVRRLYD

SEQ ID NO: 2058111 - protein, 18 aa, Staphylococcus
LHAPQIQGFFDIPIDHLM

SEQ ID NO: 2058112 - protein, 17 aa, Staphylococcus
LHASHRFVEAQHSENLG

SEQ ID NO: 2058113 - protein, 19 aa, Staphylococcus
LHEAPSHVMNYYDPKDKTL

SEQ ID NO: 2058114 - protein, 23 aa, Staphylococcus
LIDVDVLAEILPLNDVDLLVESA

SEQ ID NO: 2058115 - protein, 17 aa, Staphylococcus
LIMDLSMPPGESGLIAT

SEQ ID NO: 2058116 - protein, 18 aa, Staphylococcus
LINGKRYPIRALMMSHMF

SEQ ID NO: 2058117 - protein, 25 aa, Staphylococcus
LIRLIAADLVEFDWIDGFDIECRNE

SEQ ID NO: 2058118 - protein, 19 aa, Staphylococcus
LIVVDMFLTGFDSKKLNTL

SEQ ID NO: 2058119 - protein, 19 aa, Staphylococcus
LKAARRWAYDVKGIEPNQA

SEQ ID NO: 2058120 - protein, 17 aa, Staphylococcus
LKEVLPELEGKLHGMAL

SEQ ID NO: 2058121 - protein, 24 aa, Staphylococcus
LKHSQIETLMSQFNLIDNRPESLL

SEQ ID NO: 2058122 - protein, 18 aa, Staphylococcus
LKNAFRPEFLNRVDDIIV

SEQ ID NO: 2058123 - protein, 22 aa, Staphylococcus
LLDRIYPFRKCDNMPDKLCLYY

SEQ ID NO: 2058124 - protein, 18 aa, Staphylococcus
LLEKLNFVSIFSSNLDEF

SEQ ID NO: 2058125 - protein, 17 aa, Staphylococcus
LLLEIPKSRKIHSDGIH

SEQ ID NO: 2058126 - protein, 28 aa, Staphylococcus
LLYEEMKHYFILNFPQRPGALKEFVNDV

SEQ ID NO: 2058127 - protein, 28 aa, Staphylococcus
LLYEEMKHYFILNFPQRPGALREFVNDV

SEQ ID NO: 2058128 - protein, 31 aa, Staphylococcus
LPANEGRGYVLRRLLRRAVRFSQSLDINEPF

SEQ ID NO: 2058129 - protein, 30 aa, Staphylococcus; identical to SEQ ID NO: 1830061

SEQ ID NO: 2058130 - protein, 19 aa, Staphylococcus
LPEVEGKLHGMALRVPTKN

SEQ ID NO: 2058131 - protein, 19 aa, Staphylococcus
LPIYNSFGMTETCSQFLTA

SEQ ID NO: 2058132 - protein, 21 aa, Staphylococcus
LPKNKLIVMTGLSGSGKSSLA

SEQ ID NO: 2058133 - protein, 21 aa, Staphylococcus
LPRPFFILAPMEDVTDIVFRH

SEQ ID NO: 2058134 - protein, 24 aa, Staphylococcus
LQARLMSQALRKLSGAISKSNTTA

SEQ ID NO: 2058135 - protein, 26 aa, Staphylococcus
LQKNIKLFVVIGQLNQLIKGGRISKT

SEQ ID NO: 2058136 - protein, 25 aa, Staphylococcus
LQQSDLPMFGTCAGLIVLAKDVEGE

SEQ ID NO: 2058137 - protein, 25 aa, Staphylococcus
LQRVFIGMALAQEPQYLLLDEPTTF

SEQ ID NO: 2058138 - protein, 30 aa, Staphylococcus; identical to SEQ ID NO: 1681159

SEQ ID NO: 2058139 - protein, 21 aa, Staphylococcus
LRELQKRLGITFIFVTHDQEE

SEQ ID NO: 2058140 - protein, 23 aa, Staphylococcus
LRGGIIDIYPLIGQPVRIELFDT

SEQ ID NO: 2058141 - protein, 20 aa, Staphylococcus
LRLKGYPAIVFQHEIDHLNG

SEQ ID NO: 2058142 - protein, 23 aa, Staphylococcus
LRSTHPQFIPGTNQLLICTNDIE

SEQ ID NO: 2058143 - protein, 18 aa, Staphylococcus
LSDPLNDVLALVESLTLV

SEQ ID NO: 2058144 - protein, 19 aa, Staphylococcus
LSFIVHRDFAYERGKALVE

SEQ ID NO: 2058145 - protein, 23 aa, Staphylococcus
LSIASHLIGVKRIKALDIDEMAV

SEQ ID NO: 2058146 - protein, 18 aa, Staphylococcus
LSIMCEADWIIDVGPGPG

SEQ ID NO: 2058147 - protein, 19 aa, Staphylococcus
LSQMHVSRLQRTAIKKLQE

SEQ ID NO: 2058148 - protein, 21 aa, Staphylococcus
LSRTKIFIDDTPGIRITDIRS

SEQ ID NO: 2058149 - protein, 19 aa, Staphylococcus
LSTLYRWNKLYKEEGLTGL

SEQ ID NO: 2058150 - protein, 30 aa, Staphylococcus; identical to SEQ ID NO: 1690324

SEQ ID NO: 2058151 - protein, 25 aa, Staphylococcus
LTPKEYELLIFLAKTPNKVFDREQL

SEQ ID NO: 2058152 - protein, 23 aa, Staphylococcus
LTQYIGHLNVVLFAPEDLNIVKG

SEQ ID NO: 2058153 - protein, 18 aa, Staphylococcus
LVEFFYKNDDLNDPLITD

SEQ ID NO: 2058154 - protein, 17 aa, Staphylococcus
LVKMDILLNGEKVDALS

SEQ ID NO: 2058155 - protein, 20 aa, Staphylococcus
LVPEWANWDHFNELDKKGLM

SEQ ID NO: 2058156 - protein, 27 aa, Staphylococcus
LVQYDYLVEDLLKTLGIPYSHEDRKVN

SEQ ID NO: 2058157 - protein, 17 aa, Staphylococcus
LVRRTFVEGTAVPALFG

SEQ ID NO: 2058158 - protein, 23 aa, Staphylococcus
LYHKKRCHFVQGIYSTLNRHFNS

SEQ ID NO: 2058159 - protein, 18 aa, Staphylococcus
LYPFIIRENNHSNAVALQ

SEQ ID NO: 2058160 - protein, 23 aa, Staphylococcus
MAQDFSYRYPLVDGQGNFGSMDG

SEQ ID NO: 2058161 - protein, 23 aa, Staphylococcus
MAQTFSYRYPLVDGQGNFGSMDG

SEQ ID NO: 2058162 - protein, 20 aa, Staphylococcus
MASRILGMGDVLSLIEKAQQ

SEQ ID NO: 2058163 - protein, 32 aa, Staphylococcus; identical to SEQ ID NO: 1830280

SEQ ID NO: 2058164 - protein, 26 aa, Staphylococcus
MDKDFVIHTPLMWLDKAQTWELSDEL

SEQ ID NO: 2058165 - protein, 28 aa, Staphylococcus
MEMLKNVKTPVFLVLNKIDLVHPDALMP

SEQ ID NO: 2058166 - protein, 18 aa, Staphylococcus
MFDNDYFMYGLETFAESN

SEQ ID NO: 2058167 - protein, 17 aa, Staphylococcus
MGDIMGDVTARRGRVDG

SEQ ID NO: 2058168 - protein, 24 aa, Staphylococcus
MGEPDDVWKERIELLKPYQVNQEM

SEQ ID NO: 2058169 - protein, 24 aa, Staphylococcus
MGKDLTLEKALYKGLTGSGVEVKD

SEQ ID NO: 2058170 - protein, 30 aa, Staphylococcus; identical to SEQ ID NO: 1819293

SEQ ID NO: 2058171 - protein, 18 aa, Staphylococcus
MIIVTLAEKTPYLESKRL

SEQ ID NO: 2058172 - protein, 17 aa, Staphylococcus
MIPLDIKDQSWLFNQQL

SEQ ID NO: 2058173 - protein, 17 aa, Staphylococcus
MKFLPEDGSLELTAGWT

SEQ ID NO: 2058174 - protein, 18 aa, Staphylococcus
MKQKLGIAIAFLNQPQLI

SEQ ID NO: 2058175 - protein, 17 aa, Staphylococcus
MLDELHFLGEEKAYELV

SEQ ID NO: 2058176 - protein, 17 aa, Staphylococcus
MLESIRYVDLVIPEDGW

SEQ ID NO: 2058177 - protein, 25 aa, Staphylococcus
MLGDAYEFLIGRFAANAGKKAGEFY

SEQ ID NO: 2058178 - protein, 23 aa, Staphylococcus
MLNAVIDYLPSPLDVKPIIGHRA

SEQ ID NO: 2058179 - protein, 23 aa, Staphylococcus
MLNAVIDYLPSPLDVKPIVGHRA

SEQ ID NO: 2058180 - protein, 25 aa, Staphylococcus
MMTQADWFIDIGPYAGDKGGQLLYS

SEQ ID NO: 2058181 - protein, 24 aa, Staphylococcus
MQTVLYQILVDMTKLLAPILVHTA

SEQ ID NO: 2058182 - protein, 18 aa, Staphylococcus
MQYELRELQKRLGITFIF

SEQ ID NO: 2058183 - protein, 25 aa, Staphylococcus
MRTGRIWINTYNQIPAGAPFGGYKK

SEQ ID NO: 2058184 - protein, 18 aa, Staphylococcus
MSYFITQPVYSKEKIKQV

SEQ ID NO: 2058185 - protein, 19 aa, Staphylococcus
MTNMFWRQNISQMWVETEF

SEQ ID NO: 2058186 - protein, 17 aa, Staphylococcus
MVRLSQDWKLRHVLIEM

SEQ ID NO: 2058187 - protein, 18 aa, Staphylococcus
MVRLSQDWKLRHVLIEMH

SEQ ID NO: 2058188 - protein, 25 aa, Staphylococcus
NAAKALAFAYDKPLIPVHHIAGHIY

SEQ ID NO: 2058189 - protein, 19 aa, Staphylococcus
NAGSFLAKFLYDLGAKVVG

SEQ ID NO: 2058190 - protein, 17 aa, Staphylococcus
NAIFKMNPPLRSKEDRD

SEQ ID NO: 2058191 - protein, 18 aa, Staphylococcus
NAITFLLQNIQPHQNLIV

SEQ ID NO: 2058192 - protein, 22 aa, Staphylococcus
NAKPPVARIMDYGKYKFEQQKK

SEQ ID NO: 2058193 - protein, 23 aa, Staphylococcus
NAKPPVARIMDYGKYKFEQQKKE

SEQ ID NO: 2058194 - protein, 33 aa, Staphylococcus
NALDATLYMRIAIELHLKRLIVGGLEKVYEIGR

SEQ ID NO: 2058195 - protein, 28 aa, Staphylococcus
NALVTGYDIIFFWVARMIFQGLEFTDRR

SEQ ID NO: 2058196 - protein, 20 aa, Staphylococcus
NAMGWYLDGRVSAIVGTHTH

SEQ ID NO: 2058197 - protein, 20 aa, Staphylococcus
NAMGWYLDGRVSAVVGTHTH

SEQ ID NO: 2058198 - protein, 18 aa, Staphylococcus
NANLQKVRILVDGKPKKV

SEQ ID NO: 2058199 - protein, 23 aa, Staphylococcus
NAVNQIVGYLLSGDPAYIPRQND

SEQ ID NO: 2058200 - protein, 23 aa, Staphylococcus
NCKKKMTLFGRGKEAVYRCVCGH

SEQ ID NO: 2058201 - protein, 25 aa, Staphylococcus
NCLMEVLGLALPYNGTALAVSEQRR

SEQ ID NO: 2058202 - protein, 18 aa, Staphylococcus
NDEKYIENLTKQLDQQNS

SEQ ID NO: 2058203 - protein, 23 aa, Staphylococcus
NDFSFNHYGIHLNYGRISGFHCY

SEQ ID NO: 2058204 - protein, 18 aa, Staphylococcus
NDPELGKYWASLGDVFVN

SEQ ID NO: 2058205 - protein, 23 aa, Staphylococcus
NDTTFVVINSTCGCAAGLARPAA

SEQ ID NO: 2058206 - protein, 23 aa, Staphylococcus
NDVQVGSYILLDDGLVELQVKDI

SEQ ID NO: 2058207 - protein, 24 aa, Staphylococcus
NDYEKLYLTYLVQGLTLNKLDFIH

SEQ ID NO: 2058208 - protein, 26 aa, Staphylococcus
NEEEDFVVEGPLWIQVHAFEKGVEVT

SEQ ID NO: 2058209 - protein, 27 aa, Staphylococcus
NEEEDFVVEGPLWIQVHAFEKGVEVTI

SEQ ID NO: 2058210 - protein, 27 aa, Staphylococcus
NEEEKDMFLSLIKVTGIGPKSALAILA

SEQ ID NO: 2058211 - protein, 19 aa, Staphylococcus
NEFLIAGFNYEGQLAATIE

SEQ ID NO: 2058212 - protein, 28 aa, Staphylococcus
NEKDIRAVLGRFLFVQEDVKKIINDLSG

SEQ ID NO: 2058213 - protein, 23 aa, Staphylococcus
NEKYDLFVLVVTDIINSDSKILV

SEQ ID NO: 2058214 - protein, 24 aa, Staphylococcus
NEQAQLILQAMLVSLQTIEDEYNE

SEQ ID NO: 2058215 - protein, 25 aa, Staphylococcus
NEREPSVLPARFPNLLVNGAAGIAV

SEQ ID NO: 2058216 - protein, 25 aa, Staphylococcus
NEVKSLLQMLLLHAIPEPVISDKKA

SEQ ID NO: 2058217 - protein, 25 aa, Staphylococcus
NFEEKLRYFLIEDYNQKEHSVIQST

SEQ ID NO: 2058218 - protein, 17 aa, Staphylococcus
NFETASPLYYRAEPVGC

SEQ ID NO: 2058219 - protein, 20 aa, Staphylococcus
NFMPSPGKITQYLAPGGYGV

SEQ ID NO: 2058220 - protein, 19 aa, Staphylococcus
NFTEVGIFSVMWSEHCSYK

SEQ ID NO: 2058221 - protein, 21 aa, Staphylococcus
NFYVPKYYVDMAKLAEARQVD

SEQ ID NO: 2058222 - protein, 36 aa, Staphylococcus; identical to SEQ ID NO: 1830602

SEQ ID NO: 2058223 - protein, 23 aa, Staphylococcus
NGIIWPKSVTPFDLHLITINPKK

SEQ ID NO: 2058224 - protein, 19 aa, Staphylococcus
NGLLRVRTFCQDDAHIFIM

SEQ ID NO: 2058225 - protein, 24 aa, Staphylococcus
NGMKSIIKMLGTDQFKRIRIGVGR

SEQ ID NO: 2058226 - protein, 26 aa, Staphylococcus
NGVLAGYPLIDVKAKLFDGSYHDVDS

SEQ ID NO: 2058227 - protein, 25 aa, Staphylococcus
NGYYDGITFHRVINDFMIQGGDPTA

SEQ ID NO: 2058228 - protein, 17 aa, Staphylococcus
NHFFLIHRATQGVTAQG

SEQ ID NO: 2058229 - protein, 18 aa, Staphylococcus
NHNLKALEAVWDYAYDKV

SEQ ID NO: 2058230 - protein, 17 aa, Staphylococcus
NIDNPHKDLRRARSCNE

SEQ ID NO: 2058231 - protein, 17 aa, Staphylococcus
NIEVLRFANAMFEPLWN

SEQ ID NO: 2058232 - protein, 24 aa, Staphylococcus
NIKKAWWQKFITQSPYNVGIDAAI

SEQ ID NO: 2058233 - protein, 18 aa, Staphylococcus
NINTVEDLVLYLPTRYED

SEQ ID NO: 2058234 - protein, 25 aa, Staphylococcus
NIYAIGDIVPGLPLAHKASYEAKVA

SEQ ID NO: 2058235 - protein, 17 aa, Staphylococcus
NKKNIEFYLIPTKGTEK

SEQ ID NO: 2058236 - protein, 26 aa, Staphylococcus
NKKPMLVAGDIYRPAAIDQLQTVGKQ

SEQ ID NO: 2058237 - protein, 32 aa, Staphylococcus
NKVFKKYNLTYPQFLVLSILWDESPVNVKKVV

SEQ ID NO: 2058238 - protein, 32 aa, Staphylococcus; identical to SEQ ID NO: 1682127

SEQ ID NO: 2058239 - protein, 17 aa, Staphylococcus
NLIGLQSHLLGLSLLGI

SEQ ID NO: 2058240 - protein, 23 aa, Staphylococcus
NLKHLKKERPDCLIGVCGCMSQE

SEQ ID NO: 2058241 - protein, 18 aa, Staphylococcus
NLTQMIIVTLAEKTPYLE

SEQ ID NO: 2058242 - protein, 17 aa, Staphylococcus
NLVGHTHRFREAAASVH

SEQ ID NO: 2058243 - protein, 19 aa, Staphylococcus
NNLIARYRKVDEDFFEALE

SEQ ID NO: 2058244 - protein, 19 aa, Staphylococcus
NNLIARYRKVDEEFFEALE

SEQ ID NO: 2058245 - protein, 19 aa, Staphylococcus
NNRELSWLDFNYRVLQEAY

SEQ ID NO: 2058246 - protein, 27 aa, Staphylococcus
NNSELQNLLLDPYFKGIVTEYQDALRD

SEQ ID NO: 2058247 - protein, 24 aa, Staphylococcus
NNTPNLLAVLKEVGVVDSGGKGLL

SEQ ID NO: 2058248 - protein, 27 aa, Staphylococcus
NNTSDLPIGVIPVDSLYSPVERVNYTV

SEQ ID NO: 2058249 - protein, 24 aa, Staphylococcus
NPQVRRYFPSLLSYRRSELDMKKM

SEQ ID NO: 2058250 - protein, 29 aa, Staphylococcus
NPTEDDVLMYNYLKHFDIPTLVICTKEDK

SEQ ID NO: 2058251 - protein, 36 aa, Staphylococcus; identical to SEQ ID NO: 1693079

SEQ ID NO: 2058252 - protein, 26 aa, Staphylococcus
NQMQKPPVFFLKDGKAREVIKRQSLR

SEQ ID NO: 2058253 - protein, 26 aa, Staphylococcus
NQPIKLYYNGPMFRYERKQKGRYRQF

SEQ ID NO: 2058254 - protein, 29 aa, Staphylococcus
NQVAYPNLMFHFLPIAVRYDGQKAPVAHG

SEQ ID NO: 2058255 - protein, 21 aa, Staphylococcus
NRDLRFIEDFSIKISDVMTKE

SEQ ID NO: 2058256 - protein, 26 aa, Staphylococcus
NRNTIFYNTLFDENASCHLAIGSAYG

SEQ ID NO: 2058257 - protein, 19 aa, Staphylococcus
NSFAMRLNQLGKASHVIGG

SEQ ID NO: 2058258 - protein, 21 aa, Staphylococcus
NSVLFEAINLQRASLRQGTHA

SEQ ID NO: 2058259 - protein, 24 aa, Staphylococcus
NSVLNPLCTILDKTIYEFGCYEDA

SEQ ID NO: 2058260 - protein, 20 aa, Staphylococcus
NTIISGPALVAQWINLQYYA

SEQ ID NO: 2058261 - protein, 20 aa, Staphylococcus
NTNWPVCGIPEKFYTDHGSD

SEQ ID NO: 2058262 - protein, 36 aa, Staphylococcus; identical to SEQ ID NO: 1830973

SEQ ID NO: 2058263 - protein, 21 aa, Staphylococcus
NTRPRKRFDWKTPAELFNDKV

SEQ ID NO: 2058264 - protein, 17 aa, Staphylococcus
NVDILKRISNLEKAVFG

SEQ ID NO: 2058265 - protein, 17 aa, Staphylococcus
NVFIFDIGDVLALTHDS

SEQ ID NO: 2058266 - protein, 24 aa, Staphylococcus
NVKKAWWQKFITQSPYNVGIDAAI

SEQ ID NO: 2058267 - protein, 25 aa, Staphylococcus
NVNQNMFVTMFYGLYEEMNHLLYCS

SEQ ID NO: 2058268 - protein, 26 aa, Staphylococcus
NVNQNMFVTMFYGLYEEMNHLLYCSS

SEQ ID NO: 2058269 - protein, 23 aa, Staphylococcus
NVNTLNKLLENQQILALESNKKI

SEQ ID NO: 2058270 - protein, 24 aa, Staphylococcus
NVQYYTDIVFKHALKRKLIQTADS

SEQ ID NO: 2058271 - protein, 24 aa, Staphylococcus
NYEPSMQYFNEWWKQLFGESEGKD

SEQ ID NO: 2058272 - protein, 24 aa, Staphylococcus
NYIDDNDYLKIIEKITKKESTIQN

SEQ ID NO: 2058273 - protein, 21 aa, Staphylococcus
NYIMNLPVNFLKTFLPELIEK

SEQ ID NO: 2058274 - protein, 22 aa, Staphylococcus
NYRIRWSTAMSNEIPWYVHEVP

SEQ ID NO: 2058275 - protein, 24 aa, Staphylococcus
PAASHALHYDKLPDRLVTVFAGQD

SEQ ID NO: 2058276 - protein, 30 aa, Staphylococcus; identical to SEQ ID NO: 1679653

SEQ ID NO: 2058277 - protein, 24 aa, Staphylococcus
PASDVIELPYGAVPIDFAYAIHSE

SEQ ID NO: 2058278 - protein, 17 aa, Staphylococcus
PAVEVILTVLHAGGKFG

SEQ ID NO: 2058279 - protein, 24 aa, Staphylococcus
PDFATIYISYIPNVKMVESKSLKL

SEQ ID NO: 2058280 - protein, 19 aa, Staphylococcus
PDPFPTMVRDFQSVIGQEI

SEQ ID NO: 2058281 - protein, 17 aa, Staphylococcus
PDRIAGFTPIPAMSMIS

SEQ ID NO: 2058282 - protein, 26 aa, Staphylococcus
PEDWGGDTIFVPLSALSGDGIEDLLE

SEQ ID NO: 2058283 - protein, 26 aa, Staphylococcus
PEILNRMDDIVLFKPLSVSDMSMIVD

SEQ ID NO: 2058284 - protein, 25 aa, Staphylococcus
PENRVEYFVSYYDYYQPEAYVPSTD

SEQ ID NO: 2058285 - protein, 23 aa, Staphylococcus
PGLTICGGYQFLGTKYITPDGTE

SEQ ID NO: 2058286 - protein, 18 aa, Staphylococcus
PGRREIGHGALGERALKY

SEQ ID NO: 2058287 - protein, 24 aa, Staphylococcus
PGVNQLVRVYIVQKRKIHVGDKMC

SEQ ID NO: 2058288 - protein, 19 aa, Staphylococcus
PHCGYFATTKKLMRKVPGR

SEQ ID NO: 2058289 - protein, 20 aa, Staphylococcus
PHCGYFATTKKLMRKVPGRL

SEQ ID NO: 2058290 - protein, 18 aa, Staphylococcus
PITLIKIKDIYQSMEEIA

SEQ ID NO: 2058291 - protein, 18 aa, Staphylococcus
PKADIVLLGISRTSKTPL

SEQ ID NO: 2058292 - protein, 20 aa, Staphylococcus
PKDKLIVMTGLSGSGKSSLA

SEQ ID NO: 2058293 - protein, 27 aa, Staphylococcus
PKSDRLRQFFDFITNFGIMIKGTGEDI

SEQ ID NO: 2058294 - protein, 24 aa, Staphylococcus
PLEEQSLINFLTDLSLVADIDEAQ

SEQ ID NO: 2058295 - protein, 19 aa, Staphylococcus
PLIVCYTNDVVKNFTANGL

SEQ ID NO: 2058296 - protein, 21 aa, Staphylococcus
PLNDVLALVESLTLVDAESLN

SEQ ID NO: 2058297 - protein, 21 aa, Staphylococcus
PLVCVGILKGSVMFMADLIKR

SEQ ID NO: 2058298 - protein, 28 aa, Staphylococcus
PLYNKYKSYWKLFLKPFETLEAFNYHKV

SEQ ID NO: 2058299 - protein, 29 aa, Staphylococcus
PLYNKYKSYWKLFLKPFETLEAFNYHKVH

SEQ ID NO: 2058300 - protein, 29 aa, Staphylococcus
PLYNKYKSYWKLFLKPFETLEAFNYRKVH

SEQ ID NO: 2058301 - protein, 21 aa, Staphylococcus
PMAHGSHFHRAPGSVGMASDA

SEQ ID NO: 2058302 - protein, 17 aa, Staphylococcus
PMVIKMGRYGKFMACSN

SEQ ID NO: 2058303 - protein, 17 aa, Staphylococcus
PNPLLPEEMRFILKQMG

SEQ ID NO: 2058304 - protein, 25 aa, Staphylococcus
PPELSEQFPYIRQLLDAYHIKHYEL

SEQ ID NO: 2058305 - protein, 23 aa, Staphylococcus
PPKLIEHLLEIRGLGIINVMTLF

SEQ ID NO: 2058306 - protein, 24 aa, Staphylococcus
PPKLIEHLLEIRGLGIINVMTLFG

SEQ ID NO: 2058307 - protein, 25 aa, Staphylococcus
PPNVKKEHWGFDDPAGKEWPEFQRV

SEQ ID NO: 2058308 - protein, 18 aa, Staphylococcus
PQHHVKVAELLLERAKRL

SEQ ID NO: 2058309 - protein, 19 aa, Staphylococcus
PQHHVKVAELLLERAKRLV

SEQ ID NO: 2058310 - protein, 20 aa, Staphylococcus
PQQLYLSEIILEQLMHNDKA

SEQ ID NO: 2058311 - protein, 26 aa, Staphylococcus
PRDGDFFPLMVNYEEKMYAAGKIPGG

SEQ ID NO: 2058312 - protein, 19 aa, Staphylococcus
PRGVLRKFEMSRIAFREHA

SEQ ID NO: 2058313 - protein, 26 aa, Staphylococcus
PRMKEHIIELNAVFPMFIAEFAMESG

SEQ ID NO: 2058314 - protein, 18 aa, Staphylococcus
PSGPYDAKGLLLSSIRSN

SEQ ID NO: 2058315 - protein, 31 aa, Staphylococcus; identical to SEQ ID NO: 1819343

SEQ ID NO: 2058316 - protein, 28 aa, Staphylococcus
PSKDVPLHLYLSVLGMPGMTAYTGLLQI

SEQ ID NO: 2058317 - protein, 22 aa, Staphylococcus
PSWMTELRQKALKLTETLEMPK

SEQ ID NO: 2058318 - protein, 21 aa, Staphylococcus
PTGHTLRMLELPSAWTDYLNT

SEQ ID NO: 2058319 - protein, 29 aa, Staphylococcus
PTNGLDIPAISWLEDFLINFDNTVIVVSH

SEQ ID NO: 2058320 - protein, 21 aa, Staphylococcus
PTQFDVIVTENLFGDILSDEA

SEQ ID NO: 2058321 - protein, 17 aa, Staphylococcus
PVGYIDMNDDCEFIVAI

SEQ ID NO: 2058322 - protein, 21 aa, Staphylococcus
PVLALSLSFDHRQIDGATGQN

SEQ ID NO: 2058323 - protein, 18 aa, Staphylococcus
PYLCIIFCNSRDSADELA

SEQ ID NO: 2058324 - protein, 24 aa, Staphylococcus
QAGDRFVVFKDEKQARRIGEARHE

SEQ ID NO: 2058325 - protein, 32 aa, Staphylococcus
QAGKTVIIAEHRLYYLYDIVDRLVVMEQGAVA

SEQ ID NO: 2058326 - protein, 24 aa, Staphylococcus
QALGFGFRTGFLGMLHMEIIQERI

SEQ ID NO: 2058327 - protein, 25 aa, Staphylococcus
QARRILDRLVGYNISPVLWKKVKKG

SEQ ID NO: 2058328 - protein, 26 aa, Staphylococcus
QARRILDRLVGYNISPVLWKKVKKGL

SEQ ID NO: 2058329 - protein, 18 aa, Staphylococcus
QASLALALGLSEIVQQES

SEQ ID NO: 2058330 - protein, 24 aa, Staphylococcus
QDDERLFFIGEAIRRGTTLEEIHE

SEQ ID NO: 2058331 - protein, 24 aa, Staphylococcus
QDDERLFFIGEAIRRGTTLEEIHN

SEQ ID NO: 2058332 - protein, 26 aa, Staphylococcus
QDEKKEIFLYLMYVYKQIVKNDIEYL

SEQ ID NO: 2058333 - protein, 22 aa, Staphylococcus
QDILPLLEQVVQSNRPILIVAD

SEQ ID NO: 2058334 - protein, 19 aa, Staphylococcus
QDLPQFTPEIFMKVSAKNV

SEQ ID NO: 2058335 - protein, 19 aa, Staphylococcus
QDMVLGNYYLTLERKDAVN

SEQ ID NO: 2058336 - protein, 26 aa, Staphylococcus
QDNPGLLRRPIILDDKRLQVGYNEDE

SEQ ID NO: 2058337 - protein, 26 aa, Staphylococcus
QEAERLVIHGFLDPVVRELPIEDVKR

SEQ ID NO: 2058338 - protein, 24 aa, Staphylococcus
QEMRPLIVMSPKSLLRNKTVAKPI

SEQ ID NO: 2058339 - protein, 25 aa, Staphylococcus
QERPTTLDYIPYIFDSFIELHGDRN

SEQ ID NO: 2058340 - protein, 19 aa, Staphylococcus
QETKKLLDRIYPFRKCDKM

SEQ ID NO: 2058341 - protein, 18 aa, Staphylococcus
QFFFAYDIDKYDKGLRGF

SEQ ID NO: 2058342 - protein, 21 aa, Staphylococcus
QFKSLRRFFKIYVRGIKGASQ

SEQ ID NO: 2058343 - protein, 28 aa, Staphylococcus
QFRKKELGFIFQDYSVLPTLTVKENIML

SEQ ID NO: 2058344 - protein, 24 aa, Staphylococcus
QGANAVKFLLYYDVDDSEEINIQK

SEQ ID NO: 2058345 - protein, 23 aa, Staphylococcus
QGDANVFVFPSLEAGNIGYKIAQ

SEQ ID NO: 2058346 - protein, 21 aa, Staphylococcus
QGEGRVIGRKTMFVRTAGCDY

SEQ ID NO: 2058347 - protein, 22 aa, Staphylococcus
QGNKNIILCERGIRTYEKATRN

SEQ ID NO: 2058348 - protein, 26 aa, Staphylococcus
QGTIRAPQWRGGGIVFGPTPRSYAYK

SEQ ID NO: 2058349 - protein, 29 aa, Staphylococcus
QIHTGRYYIQRFLARSFGFEVDDIKAMSE

SEQ ID NO: 2058350 - protein, 23 aa, Staphylococcus
QIIPKVHLKRISKTGFGPFAFDE

SEQ ID NO: 2058351 - protein, 27 aa, Staphylococcus
QIMPKHNLLFTHIPIPEYQAISQTKLY

SEQ ID NO: 2058352 - protein, 31 aa, Staphylococcus
QIPRLNVLDLQRLIRVIPKPVIAMVRGYAIG

SEQ ID NO: 2058353 - protein, 25 aa, Staphylococcus
QISKQIFDLILKFADYGFPRAHAVS

SEQ ID NO: 2058354 - protein, 26 aa, Staphylococcus
QKEDALDFTLWKKAKPGEISWDSPFG

SEQ ID NO: 2058355 - protein, 25 aa, Staphylococcus
QKEDALDFTLWKKAKPGEISWESPF

SEQ ID NO: 2058356 - protein, 23 aa, Staphylococcus
QKEYYVGFVIDRATDKVTLMASE

SEQ ID NO: 2058357 - protein, 28 aa, Staphylococcus
QKGVQMVHESLLRALKDNGLEEIESEGQ

SEQ ID NO: 2058358 - protein, 17 aa, Staphylococcus
QKYNIIKPFILGEQSLS

SEQ ID NO: 2058359 - protein, 26 aa, Staphylococcus
QLERVYIASVLMLDPKLIIADEPVAS

SEQ ID NO: 2058360 - protein, 29 aa, Staphylococcus
QLGVVLFETLKLPVIKKTKTGYSTAVDVL

SEQ ID NO: 2058361 - protein, 18 aa, Staphylococcus
QLPSITLADNLRELGFEV

SEQ ID NO: 2058362 - protein, 17 aa, Staphylococcus
QLSKTEYRGREATDFKE

SEQ ID NO: 2058363 - protein, 21 aa, Staphylococcus
QMMRVVLIEQVYRAFKIMRGE

SEQ ID NO: 2058364 - protein, 29 aa, Staphylococcus
QNREKALKVLKARLYDMKLQEEQQKYAAQ

SEQ ID NO: 2058365 - protein, 29 aa, Staphylococcus
QNREKAMKVLKARLYDMKLQEEQQKYASQ

SEQ ID NO: 2058366 - protein, 26 aa, Staphylococcus
QNYALYPHMSVYKNLAFGLKMRGIHK

SEQ ID NO: 2058367 - protein, 22 aa, Staphylococcus
QPDLLLLDEPTNHLDFESINWL

SEQ ID NO: 2058368 - protein, 18 aa, Staphylococcus
QPPLKAKLKLYEQMLDNA

SEQ ID NO: 2058369 - protein, 17 aa, Staphylococcus
QPSYFPIPEVIGVRLTN

SEQ ID NO: 2058370 - protein, 27 aa, Staphylococcus
QQARRILDRLVGYNISPVLWKKVKKGL

SEQ ID NO: 2058371 - protein, 20 aa, Staphylococcus
QQIALFPHMTIKENIAQVPQ

SEQ ID NO: 2058372 - protein, 25 aa, Staphylococcus
QQQKQKALYKQELAWMRAGAKARTT

SEQ ID NO: 2058373 - protein, 23 aa, Staphylococcus
QRIKLIRHLNSPLSDLVYIIDEP

SEQ ID NO: 2058374 - protein, 26 aa, Staphylococcus
QRSADIFLGVPFNIASYALLTHLIAK

SEQ ID NO: 2058375 - protein, 27 aa, Staphylococcus
QRSADIFLGVPFNIASYALLTHLIAKE

SEQ ID NO: 2058376 - protein, 18 aa, Staphylococcus
QRVLIARALISNPSVLVL

SEQ ID NO: 2058377 - protein, 22 aa, Staphylococcus
QSEVPAHVQAGWMLTTISSVGE

SEQ ID NO: 2058378 - protein, 18 aa, Staphylococcus
QSIARIAQKARACGIHML

SEQ ID NO: 2058379 - protein, 25 aa, Staphylococcus
QSIDELIELFKSYDQILFSVGSGGS

SEQ ID NO: 2058380 - protein, 23 aa, Staphylococcus
QSSTLTTLILKELGVKKVTAKAQ

SEQ ID NO: 2058381 - protein, 25 aa, Staphylococcus
QSVFHLHFHLIPRYENDIDGFGYKW

SEQ ID NO: 2058382 - protein, 30 aa, Staphylococcus
QTARFIERGIIEIAPLAYMRGRTLDDAFVI

SEQ ID NO: 2058383 - protein, 29 aa, Staphylococcus
QTLQRDRHAYYIATLALIATSLEKFAVEI

SEQ ID NO: 2058384 - protein, 31 aa, Staphylococcus; identical to SEQ ID NO: 1831691

SEQ ID NO: 2058385 - protein, 18 aa, Staphylococcus
QWHVSRTTIYRYLNKLED

SEQ ID NO: 2058386 - protein, 33 aa, Staphylococcus
QYLKIKSQYQDCLLFFRLGDFYEMFFEDAKEAS

SEQ ID NO: 2058387 - protein, 24 aa, Staphylococcus
QYQPRYNILLKDDKSYPFIKITKE

SEQ ID NO: 2058388 - protein, 36 aa, Staphylococcus; identical to SEQ ID NO: 1681784

SEQ ID NO: 2058389 - protein, 25 aa, Staphylococcus
RAATLLRYFTGLCESSYKLPFAFKI

SEQ ID NO: 2058390 - protein, 17 aa, Staphylococcus
RAELYEMLTEREMEILL

SEQ ID NO: 2058391 - protein, 24 aa, Staphylococcus
RAGLKAIVVIPEGKIALGKLSQAV

SEQ ID NO: 2058392 - protein, 19 aa, Staphylococcus
RAIAGYFLSFDAPNAQNTA

SEQ ID NO: 2058393 - protein, 17 aa, Staphylococcus
RAILSLEAPIARVAAAD

SEQ ID NO: 2058394 - protein, 23 aa, Staphylococcus
RANIGHNWWVVNQSLVTLNQRDD

SEQ ID NO: 2058395 - protein, 21 aa, Staphylococcus
RDDKAIEGIPQELALKNAKET

SEQ ID NO: 2058396 - protein, 24 aa, Staphylococcus
RDRKYQAILPLRGKVINTEKARLD

SEQ ID NO: 2058397 - protein, 30 aa, Staphylococcus
REKGAMTNVLFMTATPIPRTLAISVFGEMD

SEQ ID NO: 2058398 - protein, 26 aa, Staphylococcus
REKQKLRYLYGMTERQFRNTFDIAGK

SEQ ID NO: 2058399 - protein, 18 aa, Staphylococcus
RELREGNFMKIVSLAPEV

SEQ ID NO: 2058400 - protein, 25 aa, Staphylococcus
RELTKDPKYLIGRIIARPYVGEPGN

SEQ ID NO: 2058401 - protein, 19 aa, Staphylococcus
RELTKDPKYLIGRVIARPY

SEQ ID NO: 2058402 - protein, 20 aa, Staphylococcus
REVHHVACLLGYGANAIVPY

SEQ ID NO: 2058403 - protein, 20 aa, Staphylococcus
RFANAMFEPLWNNKYISNIQ

SEQ ID NO: 2058404 - protein, 24 aa, Staphylococcus
RFDLSFDRKFEAFLVPTVIGEIKR

SEQ ID NO: 2058405 - protein, 19 aa, Staphylococcus
RFHLVCPKELNPTDELLSR

SEQ ID NO: 2058406 - protein, 18 aa, Staphylococcus
RFIREFRNVNVDEYEVGQ

SEQ ID NO: 2058407 - protein, 18 aa, Staphylococcus
RFPNLLINGSTGISAGYA

SEQ ID NO: 2058408 - protein, 25 aa, Staphylococcus
RFSTNTFPSWKRAHPNRMLMHNGEI

SEQ ID NO: 2058409 - protein, 20 aa, Staphylococcus
RGELVSCFLLEVDDSLNSIN

SEQ ID NO: 2058410 - protein, 24 aa, Staphylococcus
RGFTAVCNPLVNSYKRLVPGYEAP

SEQ ID NO: 2058411 - protein, 21 aa, Staphylococcus
RGIVISLLSLNHINVSDDAII

SEQ ID NO: 2058412 - protein, 23 aa, Staphylococcus
RGKKITVFTYRRRKDSKRKKGHR

SEQ ID NO: 2058413 - protein, 20 aa, Staphylococcus
RGLLVPVVKNADRKSIFQIS

SEQ ID NO: 2058414 - protein, 22 aa, Staphylococcus
RGRKTLLFGPMKPVGLEDPKTG

SEQ ID NO: 2058415 - protein, 17 aa, Staphylococcus
RGYGIINHTFEEFRPRV

SEQ ID NO: 2058416 - protein, 18 aa, Staphylococcus
RHDYALKPFGRTVMNELK

SEQ ID NO: 2058417 - protein, 22 aa, Staphylococcus
RHGTMPLTMFITKKGKQVKVNH

SEQ ID NO: 2058418 - protein, 17 aa, Staphylococcus
RIHTPSQMGIRKPEFSS

SEQ ID NO: 2058419 - protein, 19 aa, Staphylococcus
RIIRIEGNFWDIGEGPSGP

SEQ ID NO: 2058420 - protein, 21 aa, Staphylococcus
RIMRLHYDGILQERLDELGEM

SEQ ID NO: 2058421 - protein, 17 aa, Staphylococcus
RKALRLMKQAEKFNRPI

SEQ ID NO: 2058422 - protein, 17 aa, Staphylococcus
RKIDVEPVFGFMKAILG

SEQ ID NO: 2058423 - protein, 19 aa, Staphylococcus
RKLLLHKKEIIKLGERTRE

SEQ ID NO: 2058424 - protein, 22 aa, Staphylococcus
RKMLEFYHPEFKKEYVILAEEG

SEQ ID NO: 2058425 - protein, 28 aa, Staphylococcus
RLGIRLEKTFEYIDTPHKFKMGVSGCPR

SEQ ID NO: 2058426 - protein, 17 aa, Staphylococcus
RLLTSRAEYRLLLRHDN

SEQ ID NO: 2058427 - protein, 18 aa, Staphylococcus
RLSDLEKLIRLPGKFKYF

SEQ ID NO: 2058428 - protein, 23 aa, Staphylococcus
RLSDLEKLIRLPGKFKYFEHNVA

SEQ ID NO: 2058429 - protein, 17 aa, Staphylococcus
RLYEMFMGPLDAAIAWS

SEQ ID NO: 2058430 - protein, 17 aa, Staphylococcus
RMGLLLDMSPRSLEEVI

SEQ ID NO: 2058431 - protein, 17 aa, Staphylococcus
RMLELPSAWTDYLNTTS

SEQ ID NO: 2058432 - protein, 17 aa, Staphylococcus
RNAGLIRSVRGAKGGYQ

SEQ ID NO: 2058433 - protein, 20 aa, Staphylococcus
RNMFGYTGTYKGKEVSVMGS

SEQ ID NO: 2058434 - protein, 24 aa, Staphylococcus
RNTIFYNTLFDENASCHLAIGSAY

SEQ ID NO: 2058435 - protein, 30 aa, Staphylococcus
RPEDLQSYGLIPEFIGRVPIVANLETLDVD

SEQ ID NO: 2058436 - protein, 19 aa, Staphylococcus
RPMNCPHHMMIYKNKPHSY

SEQ ID NO: 2058437 - protein, 18 aa, Staphylococcus
RPMNCPHHMMIYNNKPHS

SEQ ID NO: 2058438 - protein, 21 aa, Staphylococcus
RPQDLIFLSDMKKEFEKSVTA

SEQ ID NO: 2058439 - protein, 19 aa, Staphylococcus
RQIKALKRGPQIVVGTPGR

SEQ ID NO: 2058440 - protein, 23 aa, Staphylococcus
RQLVKVAAWYDNEMSYTAQLVRT

SEQ ID NO: 2058441 - protein, 26 aa, Staphylococcus
RQRAYIAMTIAQDTEYILLDEPLNNL

SEQ ID NO: 2058442 - protein, 18 aa, Staphylococcus
RRAKLYYLRNLRGKAARI

SEQ ID NO: 2058443 - protein, 26 aa, Staphylococcus
RRQRKRDFRKLWITRINAAARQHDIS

SEQ ID NO: 2058444 - protein, 18 aa, Staphylococcus
RSIIAIAVGYPNKLKGAP

SEQ ID NO: 2058445 - protein, 21 aa, Staphylococcus
RSIRIDLPPFTLVGATTRAGS

SEQ ID NO: 2058446 - protein, 22 aa, Staphylococcus
RSIRIDLPPFTLVGATTRAGSL

SEQ ID NO: 2058447 - protein, 19 aa, Staphylococcus
RSLQQIDRSLFWVNPDCGL

SEQ ID NO: 2058448 - protein, 25 aa, Staphylococcus
RSMVNLCISIDHRILDGLQTGQFMN

SEQ ID NO: 2058449 - protein, 22 aa, Staphylococcus
RTIKRYYICSLFNRSGSSACHS

SEQ ID NO: 2058450 - protein, 24 aa, Staphylococcus
RTKLSLAVLFSTKANMLILDEPTN

SEQ ID NO: 2058451 - protein, 24 aa, Staphylococcus
RTLAMNFWATIEHTLRYKYDGDYP

SEQ ID NO: 2058452 - protein, 25 aa, Staphylococcus
RTTGHLMSMLVTLKGLPLAYNKDMQ

SEQ ID NO: 2058453 - protein, 34 aa, Staphylococcus; identical to SEQ ID NO: 1832067

SEQ ID NO: 2058454 - protein, 30 aa, Staphylococcus
RVANEKVRFARFRPFPFWKRVHDSFIESED

SEQ ID NO: 2058455 - protein, 30 aa, Staphylococcus; identical to SEQ ID NO: 1819387

SEQ ID NO: 2058456 - protein, 29 aa, Staphylococcus
RVGYHPTWKMILGLFPKEDKIKAMDALER

SEQ ID NO: 2058457 - protein, 17 aa, Staphylococcus
RVIFEHCLPSFHNTDTK

SEQ ID NO: 2058458 - protein, 21 aa, Staphylococcus
RVNEFGFIETPYRKVDLDTNS

SEQ ID NO: 2058459 - protein, 19 aa, Staphylococcus
RVNFLFGDIVKVTPSSKVV

SEQ ID NO: 2058460 - protein, 29 aa, Staphylococcus
RWMEEIRDWTISRQLWWGHQIPAWYHNET

SEQ ID NO: 2058461 - protein, 20 aa, Staphylococcus
RYEAWLEVEILACEAWSKLG

SEQ ID NO: 2058462 - protein, 21 aa, Staphylococcus
RYGTFAKYFTKNDVPAFAICH

SEQ ID NO: 2058463 - protein, 17 aa, Staphylococcus
SALLYSLLHVSGSLELE

SEQ ID NO: 2058464 - protein, 24 aa, Staphylococcus
SAPLKALIFDSEYDPYRGVISSIR

SEQ ID NO: 2058465 - protein, 31 aa, Staphylococcus
SDGEAFAKFFKLMLNQGINLAPSKFEAWFLT

SEQ ID NO: 2058466 - protein, 23 aa, Staphylococcus
SDGRPKLMGIRQIIDSYLNHQIE

SEQ ID NO: 2058467 - protein, 17 aa, Staphylococcus
SDVLVLVESLTLVDVDA

SEQ ID NO: 2058468 - protein, 24 aa, Staphylococcus
SEEMRLIYVALTRAKEQLILIGRV

SEQ ID NO: 2058469 - protein, 23 aa, Staphylococcus
SEGKYIAYFQAFTNTHAPVEVLK

SEQ ID NO: 2058470 - protein, 23 aa, Staphylococcus
SEHPKVRMMSFTGSGPTGSKIME

SEQ ID NO: 2058471 - protein, 19 aa, Staphylococcus
SELKQRIPLILEVTSNQYQ

SEQ ID NO: 2058472 - protein, 26 aa, Staphylococcus
SERVSYLYQPYNPSILRLVKQVIEAS

SEQ ID NO: 2058473 - protein, 17 aa, Staphylococcus
SFFIKHHGYRVRIDDIE

SEQ ID NO: 2058474 - protein, 37 aa, Staphylococcus
SFIEGKKALFIVYANPLALGLLTPPGSFGADIVVGDT

SEQ ID NO: 2058475 - protein, 21 aa, Staphylococcus
SFIRQQWAKLGLGLDYSRERF

SEQ ID NO: 2058476 - protein, 27 aa, Staphylococcus
SGAHLTNPFILLNWSDTVSDLYTLVHE

SEQ ID NO: 2058477 - protein, 23 aa, Staphylococcus
SGAKIVEFGGWAMPVQFSSIKEE

SEQ ID NO: 2058478 - protein, 33 aa, Staphylococcus
SGCGKTTLLRLFNGLIPYFFNGKLTGEIIINGT

SEQ ID NO: 2058479 - protein, 17 aa, Staphylococcus
SGHAMALAISNLLGLVC

SEQ ID NO: 2058480 - protein, 52 aa, Staphylococcus
SGKSVCINSILMSLLYKNHPEELRLLLIDPKMVELAPYNDLPHLVSPVITDV

SEQ ID NO: 2058481 - protein, 17 aa, Staphylococcus
SGLKYNISYASKAFTCI

SEQ ID NO: 2058482 - protein, 33 aa, Staphylococcus; identical to SEQ ID NO: 1820875

SEQ ID NO: 2058483 - protein, 20 aa, Staphylococcus
SGPLHLEISLTRSKFEELAD

SEQ ID NO: 2058484 - protein, 21 aa, Staphylococcus
SGQVILLLDEIHRLDKAKQDF

SEQ ID NO: 2058485 - protein, 17 aa, Staphylococcus
SGQYVYSLPNDRKYHPL

SEQ ID NO: 2058486 - protein, 25 aa, Staphylococcus
SGSAAIYTARKGLRTGIIADRIGGQ

SEQ ID NO: 2058487 - protein, 23 aa, Staphylococcus
SGSAAIYTARKGLRTGIVADRIG

SEQ ID NO: 2058488 - protein, 26 aa, Staphylococcus
SGVSQTQISLPFISAGESGPLHLEIS

SEQ ID NO: 2058489 - protein, 31 aa, Staphylococcus; identical to SEQ ID NO: 1822951

SEQ ID NO: 2058490 - protein, 27 aa, Staphylococcus
SHDAIDPQFYIFHNNYKKFTMITDTGY

SEQ ID NO: 2058491 - protein, 25 aa, Staphylococcus
SHQMDMIFTHFGVSGPAALRCSQFV

SEQ ID NO: 2058492 - protein, 22 aa, Staphylococcus
SHTPVWFMRQAGRSQPEYRKLK

SEQ ID NO: 2058493 - protein, 30 aa, Staphylococcus; identical to SEQ ID NO: 1822953

SEQ ID NO: 2058494 - protein, 31 aa, Staphylococcus
SICKKWYINSFKYFRNMYKNFYYSRPDELDK

SEQ ID NO: 2058495 - protein, 17 aa, Staphylococcus
SIGDYFKKEAIEFAWEF

SEQ ID NO: 2058496 - protein, 24 aa, Staphylococcus
SIIETLQPYLYEKTARRPMILPVI

SEQ ID NO: 2058497 - protein, 25 aa, Staphylococcus
SINKAAKFLISLYNVFIEKDCSIVE

SEQ ID NO: 2058498 - protein, 27 aa, Staphylococcus
SISVTQLLERFLFPSSTHGKKIYKLSG

SEQ ID NO: 2058499 - protein, 23 aa, Staphylococcus
SKHFEISFYLTTHSIPEAYGVIV

SEQ ID NO: 2058500 - protein, 17 aa, Staphylococcus
SKILFDKVKFLFLNQQW

SEQ ID NO: 2058501 - protein, 23 aa, Staphylococcus
SKRFEPRMFIGAISNLKNELKTP

SEQ ID NO: 2058502 - protein, 18 aa, Staphylococcus
SKRFSSIQDYILEYCNFG

SEQ ID NO: 2058503 - protein, 22 aa, Staphylococcus
SLARFISTIRSFHQFALREKYA

SEQ ID NO: 2058504 - protein, 35 aa, Staphylococcus
SLDAILLHSRPIKIGLAALVDRGHRELPIRADFVG

SEQ ID NO: 2058505 - protein, 28 aa, Staphylococcus
SLDVKRMPWIGLQWIFARKGAAASNHFE

SEQ ID NO: 2058506 - protein, 32 aa, Staphylococcus
SLGKSQSFIANKLRLLKLAPKVIVRLREGKIT

SEQ ID NO: 2058507 - protein, 21 aa, Staphylococcus
SLIQRHFQIGYNRAARIVDQL

SEQ ID NO: 2058508 - protein, 18 aa, Staphylococcus
SLLTVLPLDKERLADMEV

SEQ ID NO: 2058509 - protein, 18 aa, Staphylococcus
SLPNDRKYHPLEKLGRYL

SEQ ID NO: 2058510 - protein, 17 aa, Staphylococcus
SLQQIDRSLFWVNPDCG

SEQ ID NO: 2058511 - protein, 25 aa, Staphylococcus
SLRGGIIDIYPLIGSPVRIELFDTE

SEQ ID NO: 2058512 - protein, 26 aa, Staphylococcus
SMQTVLYQILVDMTKLLAPILVHTAE

SEQ ID NO: 2058513 - protein, 21 aa, Staphylococcus
SMYDGITSFAEACILAFNHTK

SEQ ID NO: 2058514 - protein, 25 aa, Staphylococcus
SNDPVLFFEHKKAYRFLKEEVPEDY

SEQ ID NO: 2058515 - protein, 25 aa, Staphylococcus
SNFTQWLSVYFSKTNIRVNAIAPGF

SEQ ID NO: 2058516 - protein, 20 aa, Staphylococcus
SNGDQIVLPVDAKVAKEFSN

SEQ ID NO: 2058517 - protein, 17 aa, Staphylococcus
SNIIIREGGIRGIVISL

SEQ ID NO: 2058518 - protein, 21 aa, Staphylococcus
SNLLNGVNVDYYGAPTPVQQL

SEQ ID NO: 2058519 - protein, 21 aa, Staphylococcus
SNLLNGVTVDYYGAPTPVQQL

SEQ ID NO: 2058520 - protein, 23 aa, Staphylococcus
SNNDWQCPITIRAPFGGGVHGGL

SEQ ID NO: 2058521 - protein, 20 aa, Staphylococcus
SNVRYVIHYNMPGDLESYYQ

SEQ ID NO: 2058522 - protein, 23 aa, Staphylococcus
SPDKILGAILFEQTMDREVEGKY

SEQ ID NO: 2058523 - protein, 19 aa, Staphylococcus
SPTPKWQISRYKGLGEMNA

SEQ ID NO: 2058524 - protein, 27 aa, Staphylococcus
SQFPARIKCATLAWKALEKGTVEKEGK

SEQ ID NO: 2058525 - protein, 27 aa, Staphylococcus
SQFPARIKCATLAWKALEKGTVQKEGK

SEQ ID NO: 2058526 - protein, 23 aa, Staphylococcus
SQISRIPLIVLTSDRPHELRSVG

SEQ ID NO: 2058527 - protein, 23 aa, Staphylococcus
SRAEYRLLLRHDNADLRLTDVGY

SEQ ID NO: 2058528 - protein, 18 aa, Staphylococcus
SRITALQDDIKMALAAKD

SEQ ID NO: 2058529 - protein, 17 aa, Staphylococcus
SRYNDILVKPEIRMPKV

SEQ ID NO: 2058530 - protein, 24 aa, Staphylococcus
SSERRNLLKAYGAELVLTPGSEAM

SEQ ID NO: 2058531 - protein, 25 aa, Staphylococcus
STDMHPFIHPFNPAIDPLWESRSDW

SEQ ID NO: 2058532 - protein, 28 aa, Staphylococcus
STDNVYFVPAFVGLGTPYWDSEARGAIF

SEQ ID NO: 2058533 - protein, 17 aa, Staphylococcus
STFKDYVLPDAVTRFRQ

SEQ ID NO: 2058534 - protein, 28 aa, Staphylococcus
STVVVVPDYQLSLAIGKRGQNARLAAKL

SEQ ID NO: 2058535 - protein, 22 aa, Staphylococcus
STVWSTRYLNLSVNNKFIISSW

SEQ ID NO: 2058536 - protein, 25 aa, Staphylococcus
SVGDYVTGILPWKKINTVNGDDVTP

SEQ ID NO: 2058537 - protein, 26 aa, Staphylococcus
SVHDTIPWPNYVNYAASKGGLKLMME

SEQ ID NO: 2058538 - protein, 25 aa, Staphylococcus
SVKNFRVTKIFGYFGLKREEIEEAQ

SEQ ID NO: 2058539 - protein, 19 aa, Staphylococcus
SVNPFRIEGQKTGAFEIVE

SEQ ID NO: 2058540 - protein, 25 aa, Staphylococcus
SVQRGDYLAILSTGAYHYSMASNYN

SEQ ID NO: 2058541 - protein, 24 aa, Staphylococcus
SYIERYVYNLYNKHTTHITVVTSD

SEQ ID NO: 2058542 - protein, 19 aa, Staphylococcus
SYPFIKITKEKHPRLIVTR

SEQ ID NO: 2058543 - protein, 19 aa, Staphylococcus
SYQRLFKKDLRKDSVVNTV

SEQ ID NO: 2058544 - protein, 32 aa, Staphylococcus
SYTLDQIMRMLHPFMPFVTEKIWQSLPHEGET

SEQ ID NO: 2058545 - protein, 30 aa, Staphylococcus; identical to SEQ ID NO: 1680752

SEQ ID NO: 2058546 - protein, 26 aa, Staphylococcus
TADSLHIGHLLPFMTLRRFQEHGHRP

SEQ ID NO: 2058547 - protein, 17 aa, Staphylococcus
TAKGGIVLAIRNELHIP

SEQ ID NO: 2058548 - protein, 18 aa, Staphylococcus
TALYGAKYQALLVNRHEE

SEQ ID NO: 2058549 - protein, 18 aa, Staphylococcus
TAPKRFIREFRNVNVDEY

SEQ ID NO: 2058550 - protein, 26 aa, Staphylococcus
TASPLYYRAEPVGCTATILYKMYKER

SEQ ID NO: 2058551 - protein, 19 aa, Staphylococcus
TAYIFIKMVQQMKELGVTN

SEQ ID NO: 2058552 - protein, 17 aa, Staphylococcus
TDAIKWVLGEQSAKSLR

SEQ ID NO: 2058553 - protein, 18 aa, Staphylococcus
TDAIKWVLGEQSAKSLRG

SEQ ID NO: 2058554 - protein, 17 aa, Staphylococcus
TDATIDGLLPLLDDDDI

SEQ ID NO: 2058555 - protein, 18 aa, Staphylococcus
TDEHPGWWREIIDGGYMP

SEQ ID NO: 2058556 - protein, 23 aa, Staphylococcus
TDIEYRFPFGWGELWGIASRTDF

SEQ ID NO: 2058557 - protein, 24 aa, Staphylococcus
TDMHPFVHPFNPAIDPLWESRSDW

SEQ ID NO: 2058558 - protein, 25 aa, Staphylococcus
TEAMRPLIVMSPKSLLRNKTVAKPI

SEQ ID NO: 2058559 - protein, 23 aa, Staphylococcus
TEDIRWLRCDIKSLNLLGNVLAK

SEQ ID NO: 2058560 - protein, 30 aa, Staphylococcus; identical to SEQ ID NO: 1832735

SEQ ID NO: 2058561 - protein, 31 aa, Staphylococcus
TEFEIITTMMFLYFGEIHPVDFVIVEAGLGI

SEQ ID NO: 2058562 - protein, 23 aa, Staphylococcus
TEKLYKQLLRDGVDFMTMGNHTY

SEQ ID NO: 2058563 - protein, 25 aa, Staphylococcus
TEREPAVLPARFPNLLVNGASGIAV

SEQ ID NO: 2058564 - protein, 26 aa, Staphylococcus
TESLLLELNLIKQYQPRYNILLKDDK

SEQ ID NO: 2058565 - protein, 17 aa, Staphylococcus
TFDMERILRLMRPSKDE

SEQ ID NO: 2058566 - protein, 21 aa, Staphylococcus
TFTSPFIETFNERISLNGYPI

SEQ ID NO: 2058567 - protein, 20 aa, Staphylococcus
TGAGFIVALTGAIMTMPGLP

SEQ ID NO: 2058568 - protein, 34 aa, Staphylococcus; identical to SEQ ID NO: 1832787

SEQ ID NO: 2058569 - protein, 26 aa, Staphylococcus
TGIKVVDLLAPYIKGGKIGLFGGAGV

SEQ ID NO: 2058570 - protein, 17 aa, Staphylococcus
TGKRPFNDVLLHGLVRA

SEQ ID NO: 2058571 - protein, 20 aa, Staphylococcus
TGLIKANIPTRIAFMVSSSV

SEQ ID NO: 2058572 - protein, 25 aa, Staphylococcus
TGLKAIICIHDTTLGPALGGCRVRN

SEQ ID NO: 2058573 - protein, 17 aa, Staphylococcus
TGLTISVDNGIWKVIDF

SEQ ID NO: 2058574 - protein, 19 aa, Staphylococcus
TGNLLVLKTLPGNAQSIGA

SEQ ID NO: 2058575 - protein, 18 aa, Staphylococcus
TGRKDIMLPTAKAALAVG

SEQ ID NO: 2058576 - protein, 20 aa, Staphylococcus
TGRKDIMLPTAKAALAVGAD

SEQ ID NO: 2058577 - protein, 19 aa, Staphylococcus
TGRMRYLGVLLYDADRVHE

SEQ ID NO: 2058578 - protein, 20 aa, Staphylococcus
TGRMRYLGVLLYDADRVHEA

SEQ ID NO: 2058579 - protein, 21 aa, Staphylococcus
TGYTLNVPLFVNEGDVLVINT

SEQ ID NO: 2058580 - protein, 18 aa, Staphylococcus
THMRTEIIKLHKKMGATT

SEQ ID NO: 2058581 - protein, 18 aa, Staphylococcus
TIHRFTRKLGFDGYSDFK

SEQ ID NO: 2058582 - protein, 18 aa, Staphylococcus
TIISGPALVAQWINLQYY

SEQ ID NO: 2058583 - protein, 24 aa, Staphylococcus
TIKEYLIAVKGPLTTPIGGGIRSL

SEQ ID NO: 2058584 - protein, 21 aa, Staphylococcus
TIQLDALISLVNDGKAKGLKI

SEQ ID NO: 2058585 - protein, 24 aa, Staphylococcus
TKGNFRLIHRLFAQIDRIMDINGL

SEQ ID NO: 2058586 - protein, 25 aa, Staphylococcus
TKGNFRLIHRLFAQIDRIMDINGLD

SEQ ID NO: 2058587 - protein, 22 aa, Staphylococcus
TKGQFIYLTRICENPGIIQEKL

SEQ ID NO: 2058588 - protein, 20 aa, Staphylococcus
TKKQLFNATSIYLEAIYSLC

SEQ ID NO: 2058589 - protein, 26 aa, Staphylococcus
TKSETFVIISFKHKTILIGGTEYAGE

SEQ ID NO: 2058590 - protein, 28 aa, Staphylococcus
TLDTIKEYLIAIKGPLTTPIGGGIRSLN

SEQ ID NO: 2058591 - protein, 31 aa, Staphylococcus; identical to SEQ ID NO: 1690557

SEQ ID NO: 2058592 - protein, 17 aa, Staphylococcus
TLKLVKRLKRRGALALA

SEQ ID NO: 2058593 - protein, 17 aa, Staphylococcus
TLKMINRLIPLSEGYIY

SEQ ID NO: 2058594 - protein, 24 aa, Staphylococcus
TLKQIKGVIGFKIKVNRLEAAYKL

SEQ ID NO: 2058595 - protein, 17 aa, Staphylococcus
TLLLQICASLSQKLNVL

SEQ ID NO: 2058596 - protein, 17 aa, Staphylococcus
TLRLYEMFMGPLDAAIA

SEQ ID NO: 2058597 - protein, 22 aa, Staphylococcus
TLSHNNYIKRLPVSTYRSQNRG

SEQ ID NO: 2058598 - protein, 18 aa, Staphylococcus
TMIELYEAYADFHDIMDL

SEQ ID NO: 2058599 - protein, 18 aa, Staphylococcus
TMYMMTSTNYSFISSSIV

SEQ ID NO: 2058600 - protein, 29 aa, Staphylococcus
TNETETYMPLPIFLSHQLAKRLSDVRKDG

SEQ ID NO: 2058601 - protein, 32 aa, Staphylococcus
TNGMPIIVNGVMKPIPTLYKPLNSVDINTKED

SEQ ID NO: 2058602 - protein, 29 aa, Staphylococcus
TNHLDFESINWLINYVKQYPHTVLFVTHD

SEQ ID NO: 2058603 - protein, 25 aa, Staphylococcus
TNKAQYTLVKLLASKFKNLCVVGDS

SEQ ID NO: 2058604 - protein, 23 aa, Staphylococcus
TNKKNKLLFPTEKGKSLYPFIIR

SEQ ID NO: 2058605 - protein, 24 aa, Staphylococcus
TNNLQLAMAIAALKLKLSPNEVWN

SEQ ID NO: 2058606 - protein, 18 aa, Staphylococcus
TPELFMKVSAKNVMKQKH

SEQ ID NO: 2058607 - protein, 18 aa, Staphylococcus
TQLNIRLMDQRISIEVSD

SEQ ID NO: 2058608 - protein, 27 aa, Staphylococcus
TRELSRLYVYAHYKGLKSLYYTRNKLL

SEQ ID NO: 2058609 - protein, 19 aa, Staphylococcus
TREQFLREKILNGLVRSCE

SEQ ID NO: 2058610 - protein, 23 aa, Staphylococcus
TRLARAYNLVIPPSGRTLSGGLD

SEQ ID NO: 2058611 - protein, 17 aa, Staphylococcus
TRQLFHDLGWKTVVGFQ

SEQ ID NO: 2058612 - protein, 18 aa, Staphylococcus
TRYYLMRELPFGSDGVFT

SEQ ID NO: 2058613 - protein, 23 aa, Staphylococcus
TSDKILGAILFEQTMDREVEGKY

SEQ ID NO: 2058614 - protein, 21 aa, Staphylococcus
TSFAEACILAFNHTKKNKIVV

SEQ ID NO: 2058615 - protein, 17 aa, Staphylococcus
TSINALELGIPLTIITE

SEQ ID NO: 2058616 - protein, 22 aa, Staphylococcus
TSPYDFQGLGVEGLKILKNVKD

SEQ ID NO: 2058617 - protein, 17 aa, Staphylococcus
TVELIAPIAIEDGTRFS

SEQ ID NO: 2058618 - protein, 25 aa, Staphylococcus
VAGAKYRGEFEERLKAVLKEVKDSD

SEQ ID NO: 2058619 - protein, 33 aa, Staphylococcus; identical to SEQ ID NO: 1682781

SEQ ID NO: 2058620 - protein, 18 aa, Staphylococcus
VANSIVSQLLFLQAQDAE

SEQ ID NO: 2058621 - protein, 17 aa, Staphylococcus
VANSIVSQLLFLQAQDS

SEQ ID NO: 2058622 - protein, 25 aa, Staphylococcus
VARRRKARGLKLNHPEALALISDEL

SEQ ID NO: 2058623 - protein, 17 aa, Staphylococcus
VCILEAMKLFNEIQAEI

SEQ ID NO: 2058624 - protein, 26 aa, Staphylococcus
VDEGLRTLLDFRYQRHFKAKKGENGQ

SEQ ID NO: 2058625 - protein, 49 aa, Staphylococcus; identical to SEQ ID NO: 1819459

SEQ ID NO: 2058626 - protein, 22 aa, Staphylococcus
VDGNKFIDYLQAYGPIITGHAH

SEQ ID NO: 2058627 - protein, 23 aa, Staphylococcus
VDGNKFIDYLQAYGPIITGHAHP

SEQ ID NO: 2058628 - protein, 25 aa, Staphylococcus
VDIKTLVYPGFATDLQQPITPLLFM

SEQ ID NO: 2058629 - protein, 19 aa, Staphylococcus
VDMVKVKRYLEGRKTRLVG

SEQ ID NO: 2058630 - protein, 25 aa, Staphylococcus
VDVDPLNDVLPLIESLTLVDVDPLN

SEQ ID NO: 2058631 - protein, 22 aa, Staphylococcus
VDYVFGIPGAKIDYLFNALEDD

SEQ ID NO: 2058632 - protein, 34 aa, Staphylococcus
VEAVRKHFDLRPAGIIKMLDLKHPIYKQTAAYGH

SEQ ID NO: 2058633 - protein, 26 aa, Staphylococcus
VEAYKQNMFALLGKPGFEDMKKDLEA

SEQ ID NO: 2058634 - protein, 26 aa, Staphylococcus
VEDVITYFINYLFTGYEVLNTFTFRI

SEQ ID NO: 2058635 - protein, 18 aa, Staphylococcus
VEEYLAPLKEMFAKYVPA

SEQ ID NO: 2058636 - protein, 25 aa, Staphylococcus
VEGFRPVMEIQFLGFVFEVFDEVAG

SEQ ID NO: 2058637 - protein, 17 aa, Staphylococcus
VFGDGIYEYIRAYEGKL

SEQ ID NO: 2058638 - protein, 19 aa, Staphylococcus
VFIVSRRGKILGSSLNELL

SEQ ID NO: 2058639 - protein, 17 aa, Staphylococcus
VFPLLHGPNGEDGTIQG

SEQ ID NO: 2058640 - protein, 22 aa, Staphylococcus
VFQSYNLFPHKTALENVMEGLV

SEQ ID NO: 2058641 - protein, 19 aa, Staphylococcus
VFVDLYNKGIIYRGERIIN

SEQ ID NO: 2058642 - protein, 20 aa, Staphylococcus
VHNRRDLGGLIFIDLRDREG

SEQ ID NO: 2058643 - protein, 19 aa, Staphylococcus
VIAGFDFTFGKFGKGNMTV

SEQ ID NO: 2058644 - protein, 18 aa, Staphylococcus
VIMGIANKRSIGFGVAKV

SEQ ID NO: 2058645 - protein, 23 aa, Staphylococcus
VINKLNFYVSLGGPVTFKNAKQP

SEQ ID NO: 2058646 - protein, 19 aa, Staphylococcus
VIRLIPGLENVDIVRYGVM

SEQ ID NO: 2058647 - protein, 25 aa, Staphylococcus
VKDKCDFYIKIPMVGHVNSLNASVA

SEQ ID NO: 2058648 - protein, 25 aa, Staphylococcus
VKDNKIEMVLSWKLNRISRSMRDVF

SEQ ID NO: 2058649 - protein, 25 aa, Staphylococcus
VKGENPYFVSFIGDAPKKNPKVIVY

SEQ ID NO: 2058650 - protein, 19 aa, Staphylococcus
VKIDEELALKWLKDGAKPT

SEQ ID NO: 2058651 - protein, 17 aa, Staphylococcus
VKQADVIMVLLPDEIQG

SEQ ID NO: 2058652 - protein, 25 aa, Staphylococcus
VKSNYILKYVFANGISRDIIYPLLE

SEQ ID NO: 2058653 - protein, 24 aa, Staphylococcus
VKTERFYQLPKYLFEDAYFKKMSA

SEQ ID NO: 2058654 - protein, 20 aa, Staphylococcus
VKVAAWYDNEMSYTSQLVRT

SEQ ID NO: 2058655 - protein, 23 aa, Staphylococcus
VLEGITFSLYDSIQLMREAGKEI

SEQ ID NO: 2058656 - protein, 22 aa, Staphylococcus
VLGCGPIGLMAQKFAKLKGAER

SEQ ID NO: 2058657 - protein, 28 aa, Staphylococcus
VLGPQDSYLLVRGIKTLGLRMEQINRNV

SEQ ID NO: 2058658 - protein, 19 aa, Staphylococcus
VLIMDLSMPPGESGLIATS

SEQ ID NO: 2058659 - protein, 28 aa, Staphylococcus
VLNERPESLFNYFKQLFAQVTNPPIDAY

SEQ ID NO: 2058660 - protein, 25 aa, Staphylococcus
VLSDPLNDVLILVESLTLVDVDALN

SEQ ID NO: 2058661 - protein, 17 aa, Staphylococcus
VLVAFDLYGGTFRLFDF

SEQ ID NO: 2058662 - protein, 23 aa, Staphylococcus
VMGRDCGDLALWAGLSVGAETIL

SEQ ID NO: 2058663 - protein, 18 aa, Staphylococcus
VMKPSEITPLTTIRVFEL

SEQ ID NO: 2058664 - protein, 28 aa, Staphylococcus
VMKQLFEHRGLPQLPYISFLRSEYEKYE

SEQ ID NO: 2058665 - protein, 28 aa, Staphylococcus
VNEWSYEALVKIFYRYGEEKFSKQIARR

SEQ ID NO: 2058666 - protein, 29 aa, Staphylococcus
VNNRDVRDYLPFESLILDLNQPFDVTETK

SEQ ID NO: 2058667 - protein, 23 aa, Staphylococcus
VNQYAVFQYPPYDITLSTKIAEV

SEQ ID NO: 2058668 - protein, 23 aa, Staphylococcus
VNRAGSMIGYFLNDGPVTNFEQA

SEQ ID NO: 2058669 - protein, 17 aa, Staphylococcus
VNSYKRLVPGYEAPCYI

SEQ ID NO: 2058670 - protein, 28 aa, Staphylococcus
VNVITGLIKANIPTRIAFMVSSSVDSRT

SEQ ID NO: 2058671 - protein, 30 aa, Staphylococcus
VPEEDMPYLPDGTPIDIMLNPLGVPSRMNI

SEQ ID NO: 2058672 - protein, 25 aa, Staphylococcus
VPRTDWDWMIYPQGLYDQIMRVVKD

SEQ ID NO: 2058673 - protein, 27 aa, Staphylococcus
VPYLLKQINVPIYGGPLALGLIRNKLD

SEQ ID NO: 2058674 - protein, 19 aa, Staphylococcus
VQEHNFKWAAPIMSTPVKN

SEQ ID NO: 2058675 - protein, 24 aa, Staphylococcus
VQEYAPILYQIWKKKHKKAYYKWR

SEQ ID NO: 2058676 - protein, 17 aa, Staphylococcus
VQNIEVLRFANAMFEPL

SEQ ID NO: 2058677 - protein, 18 aa, Staphylococcus
VRITHLPTGVIATSSEKS

SEQ ID NO: 2058678 - protein, 26 aa, Staphylococcus
VRPERRTTLGLRWLVNYSRLRGEKTM

SEQ ID NO: 2058679 - protein, 25 aa, Staphylococcus
VSAKRIIDFLSGTVYAIGGDIQRVG

SEQ ID NO: 2058680 - protein, 24 aa, Staphylococcus
VSDRNPENLPWKDLDIDIVIEATG

SEQ ID NO: 2058681 - protein, 22 aa, Staphylococcus
VSGPAALRCSQFVYKEQKNQKK

SEQ ID NO: 2058682 - protein, 36 aa, Staphylococcus
VSKMRASILVMGPLLARLGHAIVALPGGCAIGSRPI

SEQ ID NO: 2058683 - protein, 30 aa, Staphylococcus
VSKMRASILVMGPLLARLGHAKVALPGGCA

SEQ ID NO: 2058684 - protein, 17 aa, Staphylococcus
VSRTTIYRYLNKLEDKE

SEQ ID NO: 2058685 - protein, 18 aa, Staphylococcus
VTEVVCDSVQFLEPKNSQ

SEQ ID NO: 2058686 - protein, 25 aa, Staphylococcus
VTIAPFGATIPYYFTGHEGPDSVCI

SEQ ID NO: 2058687 - protein, 20 aa, Staphylococcus
VTNGDLIIITAGVPTGEKGT

SEQ ID NO: 2058688 - protein, 27 aa, Staphylococcus
VTQPIFKGIEWIIVSLGGDGAFAKHHQ

SEQ ID NO: 2058689 - protein, 25 aa, Staphylococcus
VTSTPVLRPLLTLDKEDIVKKAKEI

SEQ ID NO: 2058690 - protein, 21 aa, Staphylococcus
VTTSKPFFLEFMAKDVSKGNA

SEQ ID NO: 2058691 - protein, 17 aa, Staphylococcus
VVDSIQTIYHPEISSAP

SEQ ID NO: 2058692 - protein, 31 aa, Staphylococcus
VVGAVVAWNFPILLASWKLGPALAAGNTVVI

SEQ ID NO: 2058693 - protein, 17 aa, Staphylococcus
VVGKFVEFFGPGVQHLP

SEQ ID NO: 2058694 - protein, 18 aa, Staphylococcus
VVGMTYGSLFDATQTRVM

SEQ ID NO: 2058695 - protein, 17 aa, Staphylococcus
VVKFKKGFNADVIEYVG

SEQ ID NO: 2058696 - protein, 26 aa, Staphylococcus
VVRLANFGAFVEIAPGVQGLVHISEI

SEQ ID NO: 2058697 - protein, 24 aa, Staphylococcus
VVTRPIMEEWLFNTVAFIGGPSEI

SEQ ID NO: 2058698 - protein, 18 aa, Staphylococcus
VVTVLPSNGERYLSTPLY

SEQ ID NO: 2058699 - protein, 25 aa, Staphylococcus
VYEMRWDIGYVLQQIALFPHMTIKE

SEQ ID NO: 2058700 - protein, 24 aa, Staphylococcus
VYEPFLIQKGFLERTPRGRKATPL

SEQ ID NO: 2058701 - protein, 17 aa, Staphylococcus
WAAPIMSRPVKNMTVAI

SEQ ID NO: 2058702 - protein, 18 aa, Staphylococcus
WAPLFFRGREVSGKTIGI

SEQ ID NO: 2058703 - protein, 20 aa, Staphylococcus
WDAHKLLFQTYSCAMVIVKE

SEQ ID NO: 2058704 - protein, 17 aa, Staphylococcus
WEHAYYLKYQNKRPDYI

SEQ ID NO: 2058705 - protein, 17 aa, Staphylococcus
WNAIFWCNHDQPRVVSR

SEQ ID NO: 2058706 - protein, 18 aa, Staphylococcus
WNIIRPPFNVTRISEYAA

SEQ ID NO: 2058707 - protein, 29 aa, Staphylococcus
WRKSAKYVGLIPRFRRIFLGDKEFNKKRY

SEQ ID NO: 2058708 - protein, 30 aa, Staphylococcus; identical to SEQ ID NO: 1825046

SEQ ID NO: 2058709 - protein, 26 aa, Staphylococcus
WSRIPHFYMNYYVYQYATGYSAAQSL

SEQ ID NO: 2058710 - protein, 17 aa, Staphylococcus
WVLGEQSAKSLRGSKME

SEQ ID NO: 2058711 - protein, 17 aa, Staphylococcus
WVRSFKLRGAYNAISVL

SEQ ID NO: 2058712 - protein, 18 aa, Staphylococcus
WVRSFKLRGAYNAISVLS

SEQ ID NO: 2058713 - protein, 18 aa, Staphylococcus
YAFIKRLIKQFGKPQKVV

SEQ ID NO: 2058714 - protein, 23 aa, Staphylococcus
YANNFLLKNKYAVEATPGNLKQL

SEQ ID NO: 2058715 - protein, 23 aa, Staphylococcus
YANNFLLKNNYAVEATPGNLKQL

SEQ ID NO: 2058716 - protein, 19 aa, Staphylococcus
YAQYGIRINNISPGAIVTE

SEQ ID NO: 2058717 - protein, 20 aa, Staphylococcus
YASSILLDPEYGLPASDARN

SEQ ID NO: 2058718 - protein, 20 aa, Staphylococcus
YATISFLNWFLDEQVEEEST

SEQ ID NO: 2058719 - protein, 29 aa, Staphylococcus
YAVGTRREYYIFFLLCEGKSMNEIAKIFN

SEQ ID NO: 2058720 - protein, 27 aa, Staphylococcus
YAVNFEKEYWDKVFTYFLDEYKKGRTP

SEQ ID NO: 2058721 - protein, 22 aa, Staphylococcus
YCAVCDGAFFKNKRLFVIGGGD

SEQ ID NO: 2058722 - protein, 24 aa, Staphylococcus
YDDEEYLFHVLRNGAKGYILKNAP

SEQ ID NO: 2058723 - protein, 25 aa, Staphylococcus
YDDEEYLFHVLRNGAKGYILKNAPD

SEQ ID NO: 2058724 - protein, 21 aa, Staphylococcus
YDGRYLLFQPNDGGLAQIGPT

SEQ ID NO: 2058725 - protein, 25 aa, Staphylococcus
YDGVNKFKTVIGKDAFIGCNTNLIA

SEQ ID NO: 2058726 - protein, 26 aa, Staphylococcus
YDLNERFIITRGLDKCLFGYTLEEWQ

SEQ ID NO: 2058727 - protein, 21 aa, Staphylococcus
YDLPMTVFVLNNKQLSFIKYE

SEQ ID NO: 2058728 - protein, 29 aa, Staphylococcus
YDLTEKRMILERILPILSDREREIIQCTF

SEQ ID NO: 2058729 - protein, 19 aa, Staphylococcus
YEFYQFWINQSDDDVIKFL

SEQ ID NO: 2058730 - protein, 18 aa, Staphylococcus
YEIGWRLIPEVWGNGIAT

SEQ ID NO: 2058731 - protein, 24 aa, Staphylococcus
YEINEKVIMLITKQQPIATDLRMM

SEQ ID NO: 2058732 - protein, 19 aa, Staphylococcus
YENEIIIYPLKNCTRIIPF

SEQ ID NO: 2058733 - protein, 19 aa, Staphylococcus
YEPQFGARPLKRFVQRQIE

SEQ ID NO: 2058734 - protein, 17 aa, Staphylococcus
YFGPYPNAYSAQETKKL

SEQ ID NO: 2058735 - protein, 18 aa, Staphylococcus
YFTQNDVPTFAICHGPLL

SEQ ID NO: 2058736 - protein, 23 aa, Staphylococcus
YGAGSFIVATKVKGMIAAEVSDE

SEQ ID NO: 2058737 - protein, 27 aa, Staphylococcus
YGHFGRTDVLLPWEKLDKVNVLKDAVQ

SEQ ID NO: 2058738 - protein, 17 aa, Staphylococcus
YGRFPHQKGFGRLSAED

SEQ ID NO: 2058739 - protein, 22 aa, Staphylococcus
YGVPRIVFVNKMDKLGANFDYS

SEQ ID NO: 2058740 - protein, 20 aa, Staphylococcus
YHKVIFLDTTTNFKFLSGST

SEQ ID NO: 2058741 - protein, 26 aa, Staphylococcus
YHPKMMLKVILYAYTQSVFSGRKIEK

SEQ ID NO: 2058742 - protein, 17 aa, Staphylococcus
YIIAPKGLQVGQTVESG

SEQ ID NO: 2058743 - protein, 23 aa, Staphylococcus
YIKIKGKWSYLYRAIDTEGHTLD

SEQ ID NO: 2058744 - protein, 20 aa, Staphylococcus
YIKNFVLNKAIVEGYHTLLT

SEQ ID NO: 2058745 - protein, 18 aa, Staphylococcus
YINSYGVHGIHGRALPLA

SEQ ID NO: 2058746 - protein, 18 aa, Staphylococcus
YIQTWHGTPLKRLANDMK

SEQ ID NO: 2058747 - protein, 17 aa, Staphylococcus
YKGPLQDTIYQLMGGVR

SEQ ID NO: 2058748 - protein, 19 aa, Staphylococcus
YLISQRLVKKSLNDGYLVG

SEQ ID NO: 2058749 - protein, 17 aa, Staphylococcus
YLNLSVNNKFIISSWLG

SEQ ID NO: 2058750 - protein, 25 aa, Staphylococcus
YLRSLAHNIDPIFQIGKAGINDNMI

SEQ ID NO: 2058751 - protein, 18 aa, Staphylococcus
YLRSLAHNTDPTFQIGKG

SEQ ID NO: 2058752 - protein, 18 aa, Staphylococcus
YLTDELGFDAAIDYKQDD

SEQ ID NO: 2058753 - protein, 18 aa, Staphylococcus
YMEASQKNQFPWVVAAFP

SEQ ID NO: 2058754 - protein, 18 aa, Staphylococcus
YMGAYRLQWEMIKFAKEH

SEQ ID NO: 2058755 - protein, 20 aa, Staphylococcus
YMQKPFYTNVLIAKLQAIYR

SEQ ID NO: 2058756 - protein, 17 aa, Staphylococcus
YNAEIKTILSKLGINDT

SEQ ID NO: 2058757 - protein, 18 aa, Staphylococcus
YNDLPHLVSPVITDVKAA

SEQ ID NO: 2058758 - protein, 25 aa, Staphylococcus
YNRAARIIDQLEQLGYISGANGSKP

SEQ ID NO: 2058759 - protein, 25 aa, Staphylococcus
YNTIYRAIYLGLFDPPKLSHGNRGC

SEQ ID NO: 2058760 - protein, 21 aa, Staphylococcus
YPAMEDFFLDIIIGKGDEARS

SEQ ID NO: 2058761 - protein, 18 aa, Staphylococcus
YPHLDGVLSLDLTTVLIL

SEQ ID NO: 2058762 - protein, 18 aa, Staphylococcus
YPKQAYAFFDHKKVKVVL

SEQ ID NO: 2058763 - protein, 25 aa, Staphylococcus
YQVEDFEAIFRLSGERPTIVRLLDP

SEQ ID NO: 2058764 - protein, 25 aa, Staphylococcus
YREMAKEGVFLPPSQFEGTFLSTAH

SEQ ID NO: 2058765 - protein, 24 aa, Staphylococcus
YRKMLEFYHPEFKKEYVVLAEEGA

SEQ ID NO: 2058766 - protein, 26 aa, Staphylococcus
YSLPNDRKYHPLEKLGRYLMDSFVNI

SEQ ID NO: 2058767 - protein, 25 aa, Staphylococcus
YSSVMFDYGILKRPQFFFAYDIDKY

SEQ ID NO: 2058768 - protein, 25 aa, Staphylococcus
YSSVMFDYGILKRPQFFFAYDIEKY

SEQ ID NO: 2058769 - protein, 17 aa, Staphylococcus
YTIAKHYADDYLRHANL

SEQ ID NO: 2058770 - protein, 19 aa, Staphylococcus
YTIVIPPPNVTGKLHLGHA

SEQ ID NO: 2058771 - protein, 18 aa, Staphylococcus
YVCGPTVYNYIHIGNARP

SEQ ID NO: 2058772 - protein, 20 aa, Staphylococcus
YVKSIVFPTVPRGTGRVRNM

SEQ ID NO: 2058773 - protein, 23 aa, Staphylococcus
YVNQAQLLTSKKMLYIANVGEDE

SEQ ID NO: 2058774 - protein, 17 aa, Staphylococcus
YYLKYQNKRPDYISAFW

SEQ ID NO: 2058775 - protein, 25 aa, Staphylococcus
AAAFYAASFLNKNLSRLGSIATFGV

SEQ ID NO: 2058776 - protein, 25 aa, Staphylococcus
AAAGLFAVSFLSKTASRLGSLATIS

SEQ ID NO: 2058777 - protein, 23 aa, Staphylococcus
AAAKDVAMHIAAINPKYVSSDQV

SEQ ID NO: 2058778 - protein, 26 aa, Staphylococcus
AAAKPRIHVFIATSPIHRDSKLMMSK

SEQ ID NO: 2058779 - protein, 26 aa, Staphylococcus
AAAKQTRWFPLVGQAISASISYYFMN

SEQ ID NO: 2058780 - protein, 25 aa, Staphylococcus
AAALFAASFLNKNISRLGSIATFGV

SEQ ID NO: 2058781 - protein, 25 aa, Staphylococcus
AAALFAASFLNKNISRLGSLATISV

SEQ ID NO: 2058782 - protein, 24 aa, Staphylococcus
AAATLDLVNLFNKNKIRLTEMFES

SEQ ID NO: 2058783 - protein, 24 aa, Staphylococcus
AAAVQIHHLLGIQPYARCFEMKEA

SEQ ID NO: 2058784 - protein, 25 aa, Staphylococcus
AAAVQIHHLLNIQPFARCFEMKEAC

SEQ ID NO: 2058785 - protein, 31 aa, Staphylococcus
AACLLTEAPALRFFKYFYTHRGPVMDYSNIE

SEQ ID NO: 2058786 - protein, 23 aa, Staphylococcus
AADKHGIDLKKANALLLEEVGVP

SEQ ID NO: 2058787 - protein, 17 aa, Staphylococcus
AADLVNLLVFIINQRMT

SEQ ID NO: 2058788 - protein, 19 aa, Staphylococcus
AADMKSGLAALAIALIEIK

SEQ ID NO: 2058789 - protein, 24 aa, Staphylococcus
AADPAPLLYIAPYSGVTMGEEFMF

SEQ ID NO: 2058790 - protein, 25 aa, Staphylococcus
AADPAPMLYIAPYSGVAMAEEFMFA

SEQ ID NO: 2058791 - protein, 18 aa, Staphylococcus
AAEALKEFPMLNSSWQGS

SEQ ID NO: 2058792 - protein, 17 aa, Staphylococcus
AAEDLSYNGWHSVIDIV

SEQ ID NO: 2058793 - protein, 27 aa, Staphylococcus
AAELLGQPLYKYLGGFNGKQLPVPMMN

SEQ ID NO: 2058794 - protein, 32 aa, Staphylococcus
AAETVINAHWFDGVFYIPNCDKITPGMILAAV

SEQ ID NO: 2058795 - protein, 40 aa, Staphylococcus
AAETVINAHWFDGVFYIPNCDKITPGMLLAAVRTNVPAIF

SEQ ID NO: 2058796 - protein, 41 aa, Staphylococcus
AAETVINAHWFDGVFYIPNCDKITPGMLLAAVRTNVPAIFC

SEQ ID NO: 2058797 - protein, 40 aa, Staphylococcus
AAETVINAHWFDGVFYIPNCDKITPGMLLASVRTNVPAIF

SEQ ID NO: 2058798 - protein, 32 aa, Staphylococcus
AAETVINAHWFDGVFYIPNCDKITPGMLMAAV

SEQ ID NO: 2058799 - protein, 25 aa, Staphylococcus
AAEYFDRIILLNRTLRYFGPSQEAM

SEQ ID NO: 2058800 - protein, 27 aa, Staphylococcus
AAFGQLLPDQLLQLPKLGAINVHASLL

SEQ ID NO: 2058801 - protein, 26 aa, Staphylococcus
AAFGQLLPESLLKLPKLGAVNVHASL

SEQ ID NO: 2058802 - protein, 22 aa, Staphylococcus
AAFMKKVIDTRAVFKIGGVGLA

SEQ ID NO: 2058803 - protein, 26 aa, Staphylococcus
AAFMKKVIDTRAVFKLGGIGLAFKKG

SEQ ID NO: 2058804 - protein, 22 aa, Staphylococcus
AAGASKIFAFDLSDERLEKAKE

SEQ ID NO: 2058805 - protein, 22 aa, Staphylococcus
AAGCPIILKPSEITPLASIILA

SEQ ID NO: 2058806 - protein, 28 aa, Staphylococcus
AAGDSLNWLKKHVFPGLTFNQILSLASN

SEQ ID NO: 2058807 - protein, 28 aa, Staphylococcus
AAGIAICKLLDAYGVRHMIMCDSKGAIY

SEQ ID NO: 2058808 - protein, 29 aa, Staphylococcus
AAGLDVSAKWFFDRFSPITQIKAVGHADV

SEQ ID NO: 2058809 - protein, 21 aa, Staphylococcus
AAGQFGSGWAWLVVDKDGKLE

SEQ ID NO: 2058810 - protein, 24 aa, Staphylococcus
AAGTDQIIYLGGPRSTLRDEMGTQ

SEQ ID NO: 2058811 - protein, 24 aa, Staphylococcus
AAGTLYNIVGFQTHLKWGAQKDVI

SEQ ID NO: 2058812 - protein, 25 aa, Staphylococcus
AAGTLYNIVGFQTHLKWGAQKEVIK

SEQ ID NO: 2058813 - protein, 17 aa, Staphylococcus
AAGVDIIVQPPGKKLQH

SEQ ID NO: 2058814 - protein, 17 aa, Staphylococcus
AAGYYYYKAGVTSSLDL

SEQ ID NO: 2058815 - protein, 29 aa, Staphylococcus
AAHGMIVFDPNVRLPLWDSAEACKATIQS

SEQ ID NO: 2058816 - protein, 23 aa, Staphylococcus
AAHPNTIIFLTADAFGVLPPIAK

SEQ ID NO: 2058817 - protein, 23 aa, Staphylococcus
AAHPNTIIFLTADAFGVLPPISK

SEQ ID NO: 2058818 - protein, 26 aa, Staphylococcus
AAHYYAIVAPYKRHPMIKLMNAMQYD

SEQ ID NO: 2058819 - protein, 24 aa, Staphylococcus
AAIASNWNWDKIWQNQIELTINEE

SEQ ID NO: 2058820 - protein, 27 aa, Staphylococcus
AAIDLKVILEYGESAPKIFRKVTELVK

SEQ ID NO: 2058821 - protein, 18 aa, Staphylococcus
AAIIAAYGLGWYQSFEDC

SEQ ID NO: 2058822 - protein, 18 aa, Staphylococcus
AAIILAEIFEKAGVPKGA

SEQ ID NO: 2058823 - protein, 23 aa, Staphylococcus
AAILGMHSIITRPIAIDKDTIEN

SEQ ID NO: 2058824 - protein, 22 aa, Staphylococcus
AAILGMHSIMTRPIAIDKDTIE

SEQ ID NO: 2058825 - protein, 20 aa, Staphylococcus
AAILLVPEPWQYSKANQSSV

SEQ ID NO: 2058826 - protein, 18 aa, Staphylococcus
AAISAVIMLLDKGDHLIL

SEQ ID NO: 2058827 - protein, 23 aa, Staphylococcus
AAISAVIMLLDKGDHLLINSDVY

SEQ ID NO: 2058828 - protein, 25 aa, Staphylococcus
AAISTTLIIEKFNPKLIINTGSAGA

SEQ ID NO: 2058829 - protein, 25 aa, Staphylococcus
AAISTTLLIEKFKPTLIINTGSAGA

SEQ ID NO: 2058830 - protein, 25 aa, Staphylococcus
AAISTTLLINTFSPDVILNTGSAGA

SEQ ID NO: 2058831 - protein, 17 aa, Staphylococcus
AAITRRRKHEFSALLTK

SEQ ID NO: 2058832 - protein, 23 aa, Staphylococcus
AAKDVWINGFTPKYSMSVWMGFN

SEQ ID NO: 2058833 - protein, 23 aa, Staphylococcus
AAKGMLSEKIKWNFTKFLVDRDG

SEQ ID NO: 2058834 - protein, 23 aa, Staphylococcus
AAKILDLELCECLFVGDSFKNDY

SEQ ID NO: 2058835 - protein, 27 aa, Staphylococcus
AAKKMKVFDLCLINWIPRAQNKEANHH

SEQ ID NO: 2058836 - protein, 22 aa, Staphylococcus
AAKLGFKRVIIPKTNIGGWTFP

SEQ ID NO: 2058837 - protein, 30 aa, Staphylococcus
AAKNTSTIIPMCHPLPLTGIDVSFEWNTTS

SEQ ID NO: 2058838 - protein, 21 aa, Staphylococcus
AAKRKLSVFLYSVNDLTEFDA

SEQ ID NO: 2058839 - protein, 23 aa, Staphylococcus
AAKTYDLEVWLPSYNDYKEISSC

SEQ ID NO: 2058840 - protein, 23 aa, Staphylococcus
AALALLRLYQIDKNPRWLETVKA

SEQ ID NO: 2058841 - protein, 20 aa, Staphylococcus
AALEFSFIDDLVALGISPVA

SEQ ID NO: 2058842 - protein, 24 aa, Staphylococcus
AALEGVLFNLYTVYLALIEVMNET

SEQ ID NO: 2058843 - protein, 19 aa, Staphylococcus
AALEMTLRLLGIGPGDEVI

SEQ ID NO: 2058844 - protein, 25 aa, Staphylococcus
AALEYSFVDDLLALGIKPAAIADDG

SEQ ID NO: 2058845 - protein, 20 aa, Staphylococcus
AALIGFTRNIAAELGQYGVT

SEQ ID NO: 2058846 - protein, 17 aa, Staphylococcus
AALKALDLPLLVEDEYA

SEQ ID NO: 2058847 - protein, 17 aa, Staphylococcus
AALLLKYDDMNDKETIE

SEQ ID NO: 2058848 - protein, 20 aa, Staphylococcus
AALNDALFEYLKKAVKIAKT

SEQ ID NO: 2058849 - protein, 17 aa, Staphylococcus
AALPKQLTKRKILNPNS

SEQ ID NO: 2058850 - protein, 17 aa, Staphylococcus
AALTLCHDFIKQLELDM

SEQ ID NO: 2058851 - protein, 34 aa, Staphylococcus
AALVEALNADWRYIRVRDPLSRPIMAGYAITPNK

SEQ ID NO: 2058852 - protein, 24 aa, Staphylococcus
AAMIAAYGLQWFDSFDDCVAQFID

SEQ ID NO: 2058853 - protein, 24 aa, Staphylococcus
AANDLVNLLVFIINQHMTAEDLNQ

SEQ ID NO: 2058854 - protein, 21 aa, Staphylococcus
AANFVAFSERYLFESHFGEKM

SEQ ID NO: 2058855 - protein, 19 aa, Staphylococcus
AANLPIKAIARNKSRDFFV

SEQ ID NO: 2058856 - protein, 27 aa, Staphylococcus
AANNQLKILPFYHYDKNQTSVKFILGF

SEQ ID NO: 2058857 - protein, 20 aa, Staphylococcus
AANPYMALAAILQAGLDGIK

SEQ ID NO: 2058858 - protein, 21 aa, Staphylococcus
AANPYMALAAILQAGLDGIKN

SEQ ID NO: 2058859 - protein, 18 aa, Staphylococcus
AAQFIDYLNNHQIPHLYV

SEQ ID NO: 2058860 - protein, 17 aa, Staphylococcus
AAQFLFAKELGLKMTSL

SEQ ID NO: 2058861 - protein, 17 aa, Staphylococcus
AAQRNNYLALIEPLKRA

SEQ ID NO: 2058862 - protein, 18 aa, Staphylococcus
AAQVVIRWNMQHGVIVIP

SEQ ID NO: 2058863 - protein, 26 aa, Staphylococcus
AARAHQIPVVFMRVALEKNFADVSPH

SEQ ID NO: 2058864 - protein, 24 aa, Staphylococcus
AARDYVLTGLEFACGIPGSVGGAV

SEQ ID NO: 2058865 - protein, 21 aa, Staphylococcus
AARIPFIKKMQSNHLFASISV

SEQ ID NO: 2058866 - protein, 18 aa, Staphylococcus
AARKGLPYVFAGHFASQQ

SEQ ID NO: 2058867 - protein, 24 aa, Staphylococcus
AASARFLSWGLYGTAKHWFHSSQL

SEQ ID NO: 2058868 - protein, 23 aa, Staphylococcus
AASIISRYAFIKHMNSISKMMHF

SEQ ID NO: 2058869 - protein, 25 aa, Staphylococcus
AASPMSRLPLKTKTLIIQGFNDSGV

SEQ ID NO: 2058870 - protein, 22 aa, Staphylococcus
AASSCYIISLAATLERAKFTDI

SEQ ID NO: 2058871 - protein, 28 aa, Staphylococcus
AATAELTFGLVLAIARRIVEGDKLSRTK

SEQ ID NO: 2058872 - protein, 21 aa, Staphylococcus
AATIKLEKFLYSINLDTLTIN

SEQ ID NO: 2058873 - protein, 24 aa, Staphylococcus
AAVDTYEFEMPYFTFDWSGKELEN

SEQ ID NO: 2058874 - protein, 18 aa, Staphylococcus
AAVKIAYKQKGNARFFLI

SEQ ID NO: 2058875 - protein, 18 aa, Staphylococcus
AAVPPLTHFVTNSTYFLW

SEQ ID NO: 2058876 - protein, 24 aa, Staphylococcus
AAVPPLTHFVTNSTYFLWDVLTTA

SEQ ID NO: 2058877 - protein, 30 aa, Staphylococcus
AAVPPLTHFVTNSTYFLWDVLTTAYVGMPK

SEQ ID NO: 2058878 - protein, 21 aa, Staphylococcus
AAVQFIPYDKLEELGYGDLIP

SEQ ID NO: 2058879 - protein, 22 aa, Staphylococcus
AAVQFIPYEKLEELGYGDLIPH

SEQ ID NO: 2058880 - protein, 24 aa, Staphylococcus
AAVQLHRLLGIQPFARCFEMKEAC

SEQ ID NO: 2058881 - protein, 26 aa, Staphylococcus
AAVRDWDFPLVLKPGDDLPTAGGYGV

SEQ ID NO: 2058882 - protein, 26 aa, Staphylococcus
AAVSEWSFPFVLKPGDDLPTAGGYGV

SEQ ID NO: 2058883 - protein, 23 aa, Staphylococcus
AAVSRRISKLLDAGLVVLEKPNA

SEQ ID NO: 2058884 - protein, 26 aa, Staphylococcus
AAVVTRYFGGIKLGTGGLIRAYSGAV

SEQ ID NO: 2058885 - protein, 27 aa, Staphylococcus
AAYKLTDWLILQGYQDILFLSEKGNYA

SEQ ID NO: 2058886 - protein, 22 aa, Staphylococcus
ACDYIFCKAFGKTATNIESYTD

SEQ ID NO: 2058887 - protein, 22 aa, Staphylococcus
ACDYILCKAFGKMASNIEKYTS

SEQ ID NO: 2058888 - protein, 20 aa, Staphylococcus
ACEMSIDIRYLPKQSKESIL

SEQ ID NO: 2058889 - protein, 22 aa, Staphylococcus
ACEYRRHFLSYHPDYAIMTNID

SEQ ID NO: 2058890 - protein, 23 aa, Staphylococcus
ACEYRRHFLSYHPDYAIMTNIDF

SEQ ID NO: 2058891 - protein, 23 aa, Staphylococcus
ACEYRRHFLSYRPDYAIMTNIDF

SEQ ID NO: 2058892 - protein, 19 aa, Staphylococcus
ACHHLIFKKITLTERYFVK

SEQ ID NO: 2058893 - protein, 17 aa, Staphylococcus
ACILLDLMLPEMDGIEV

SEQ ID NO: 2058894 - protein, 28 aa, Staphylococcus
ACKAVDCTILRIGMLPMNYMGSKESTLN

SEQ ID NO: 2058895 - protein, 30 aa, Staphylococcus
ACLLTAVPVMKFFKYFYSNRGPVIDFENKE

SEQ ID NO: 2058896 - protein, 29 aa, Staphylococcus
ACLLTAVPVMKFFKYFYSNRGPVIDYANQ

SEQ ID NO: 2058897 - protein, 29 aa, Staphylococcus
ACLLTAVPVMKFFKYFYSNRGPVIDYENK

SEQ ID NO: 2058898 - protein, 30 aa, Staphylococcus
ACLLTAVPVMKFFKYFYTNRGPVIDYDNKE

SEQ ID NO: 2058899 - protein, 29 aa, Staphylococcus
ACLLTAVPVMKIFKYFYSNRGPVIDYDNK

SEQ ID NO: 2058900 - protein, 29 aa, Staphylococcus
ACMLTAVPVMKFFKYFYSNRGPVIDYDNR

SEQ ID NO: 2058901 - protein, 17 aa, Staphylococcus
ACNGSLVAAFKKCGFKI

SEQ ID NO: 2058902 - protein, 26 aa, Staphylococcus
ACTAPHPYLNFLNYILMEASNAPIAA

SEQ ID NO: 2058903 - protein, 19 aa, Staphylococcus
ACYTGFELYVKPAALHMMG

SEQ ID NO: 2058904 - protein, 26 aa, Staphylococcus
ACYTNYTIPPFYDSMVAKLIVHEPTR

SEQ ID NO: 2058905 - protein, 27 aa, Staphylococcus
ACYTNYTIPPYYDSMVAKLIIHEPTRE

SEQ ID NO: 2058906 - protein, 28 aa, Staphylococcus
ADAAWITTPLNVFYFTGYRSEPHERLFA

SEQ ID NO: 2058907 - protein, 18 aa, Staphylococcus
ADADFVFLGTKPYDFESL

SEQ ID NO: 2058908 - protein, 26 aa, Staphylococcus
ADAEETIYFMLKDTPFYAVSGGQVAD

SEQ ID NO: 2058909 - protein, 25 aa, Staphylococcus
ADAGDTVFFVLEATPFYAVSGGQVA

SEQ ID NO: 2058910 - protein, 27 aa, Staphylococcus
ADAINQLLILLQPLIRQRIQNRSIAVS

SEQ ID NO: 2058911 - protein, 24 aa, Staphylococcus
ADAVMLITPYYNKTNQRGLIKHFE

SEQ ID NO: 2058912 - protein, 25 aa, Staphylococcus
ADDADRLYFLKRHTIINQLDFNEED

SEQ ID NO: 2058913 - protein, 24 aa, Staphylococcus
ADDATYLFTPPFIASAEQGVNETP

SEQ ID NO: 2058914 - protein, 20 aa, Staphylococcus
ADDELGERLGFISNSTGGVL

SEQ ID NO: 2058915 - protein, 25 aa, Staphylococcus
ADDHYQWLQILPEKKRYSITAMFDD

SEQ ID NO: 2058916 - protein, 24 aa, Staphylococcus
ADDKAGLAAIFELIRSLKENNIRH

SEQ ID NO: 2058917 - protein, 25 aa, Staphylococcus
ADDKQVLFVLPLWHEDDKYPFETLL

SEQ ID NO: 2058918 - protein, 28 aa, Staphylococcus
ADDNIMFRRIYRLPIGFEWQHQSNVTLI

SEQ ID NO: 2058919 - protein, 25 aa, Staphylococcus
ADDNYKWLQILPEKKRYSLTVMFDD

SEQ ID NO: 2058920 - protein, 25 aa, Staphylococcus
ADDNYQWLQILPEKKRYSITAMFDD

SEQ ID NO: 2058921 - protein, 25 aa, Staphylococcus
ADDNYQWLQILPEKKRYSITVMLDD

SEQ ID NO: 2058922 - protein, 17 aa, Staphylococcus
ADDVDMFVPHQANIRIM

SEQ ID NO: 2058923 - protein, 27 aa, Staphylococcus
ADDVRNQFQFLDYAPIAFVSAKERLRL

SEQ ID NO: 2058924 - protein, 26 aa, Staphylococcus
ADDVRNQFQFLDYAQIAFVSAKEGTR

SEQ ID NO: 2058925 - protein, 23 aa, Staphylococcus
ADDYLRHSNLNYTIVHPGGLKDD

SEQ ID NO: 2058926 - protein, 24 aa, Staphylococcus
ADEDKLYVPVIKNADEKSIKGIAR

SEQ ID NO: 2058927 - protein, 28 aa, Staphylococcus
ADEEFHLRKDQFTVPFVCGCRNLGEAAR

SEQ ID NO: 2058928 - protein, 21 aa, Staphylococcus
ADEEYHLLKSDYTVPFVCGCR

SEQ ID NO: 2058929 - protein, 28 aa, Staphylococcus
ADEEYHLRKDQFTVPFVCGCRDLGEAAR

SEQ ID NO: 2058930 - protein, 29 aa, Staphylococcus
ADEEYHLRKDTFTVPFVCGCRNLGEAARR

SEQ ID NO: 2058931 - protein, 26 aa, Staphylococcus
ADEFEDLLYMVDSQYYYAIHFDDTVD

SEQ ID NO: 2058932 - protein, 17 aa, Staphylococcus
ADEFYPSNPYHFGATIG

SEQ ID NO: 2058933 - protein, 31 aa, Staphylococcus
ADEFYQPKPGTDLVWLGAVTKYIIDHDLHDK

SEQ ID NO: 2058934 - protein, 19 aa, Staphylococcus
ADEIIRWMTGYTQSEIDRL

SEQ ID NO: 2058935 - protein, 17 aa, Staphylococcus
ADEKYMITLLSNTSALL

SEQ ID NO: 2058936 - protein, 24 aa, Staphylococcus
ADEYQGELIFLHKVKDGAVDDSYG

SEQ ID NO: 2058937 - protein, 17 aa, Staphylococcus
ADFFYQPKPGTDLAWMS

SEQ ID NO: 2058938 - protein, 22 aa, Staphylococcus
ADFINCVVFRKQAENVNNYLFK

SEQ ID NO: 2058939 - protein, 19 aa, Staphylococcus
ADFINKVGKLWWVSNVEGN

SEQ ID NO: 2058940 - protein, 20 aa, Staphylococcus
ADFKSLCFHVPFTKMGKKAL

SEQ ID NO: 2058941 - protein, 29 aa, Staphylococcus
ADFLQLPLNAIVKSMIFKIDGEFVMILIR

SEQ ID NO: 2058942 - protein, 23 aa, Staphylococcus
ADFNLVDFSFIESLAWQTLNKDD

SEQ ID NO: 2058943 - protein, 28 aa, Staphylococcus
ADFRKKEVGFIFQNYSVLNTLTVKENIM

SEQ ID NO: 2058944 - protein, 23 aa, Staphylococcus
ADGIIIVSPVFKAAYSGIVKTYL

SEQ ID NO: 2058945 - protein, 26 aa, Staphylococcus
ADGLNPKYLSIPSLIQYIQDAYHKPM

SEQ ID NO: 2058946 - protein, 19 aa, Staphylococcus
ADGTLWSIPITLPVTEEQA

SEQ ID NO: 2058947 - protein, 18 aa, Staphylococcus
ADGYLRIMQGHFVNVKGQ

SEQ ID NO: 2058948 - protein, 19 aa, Staphylococcus
ADHDTAVVRWFVGDYMTSL

SEQ ID NO: 2058949 - protein, 29 aa, Staphylococcus
ADHIIDAFGMRPYIKKKVKKYSMGMKQKL

SEQ ID NO: 2058950 - protein, 25 aa, Staphylococcus
ADHVVNFMHFIAHELREILAELGLR

SEQ ID NO: 2058951 - protein, 19 aa, Staphylococcus
ADIAPIFGLDKRQGRQLLE

SEQ ID NO: 2058952 - protein, 23 aa, Staphylococcus
ADIAPIFGLNKRQGRQLLKYLNA

SEQ ID NO: 2058953 - protein, 22 aa, Staphylococcus
ADIAPIFGLNKRQGRQLLVFLH

SEQ ID NO: 2058954 - protein, 19 aa, Staphylococcus
ADIASELPYQQWLETFKID

SEQ ID NO: 2058955 - protein, 25 aa, Staphylococcus
ADIFGKCLHTYLIKDAIRDGNVLGF

SEQ ID NO: 2058956 - protein, 18 aa, Staphylococcus
ADIHMKDVYQNTKAWLGI

SEQ ID NO: 2058957 - protein, 29 aa, Staphylococcus
ADIIASMSYFFNLLSGIGFTDDIDHLGNR

SEQ ID NO: 2058958 - protein, 28 aa, Staphylococcus
ADIIASMSYFFNLLSGIGYTDDIDHLGN

SEQ ID NO: 2058959 - protein, 20 aa, Staphylococcus
ADILYIGFISSKGAIQEGAE

SEQ ID NO: 2058960 - protein, 26 aa, Staphylococcus
ADINRGTFYLHYEDKYILLESMEDEY

SEQ ID NO: 2058961 - protein, 26 aa, Staphylococcus
ADINRGTFYLHYEDKYLLLSDMEDEF

SEQ ID NO: 2058962 - protein, 25 aa, Staphylococcus
ADINRGTFYLHYEDKYLLLTDMEDE

SEQ ID NO: 2058963 - protein, 20 aa, Staphylococcus
ADIPVWLDRTSPFNIEGGDE

SEQ ID NO: 2058964 - protein, 27 aa, Staphylococcus
ADIVASMSYFFNLLHGIGQTDDIDHLG

SEQ ID NO: 2058965 - protein, 22 aa, Staphylococcus
ADKDADLIIFGHNHRLHMFDDK

SEQ ID NO: 2058966 - protein, 23 aa, Staphylococcus
ADKITYMPTWRPWEEAEVFNGHI

SEQ ID NO: 2058967 - protein, 24 aa, Staphylococcus
ADKKVIMYAPTWRDDEFVKKGKYL

SEQ ID NO: 2058968 - protein, 17 aa, Staphylococcus
ADKLYEKFGFISTEPHS

SEQ ID NO: 2058969 - protein, 24 aa, Staphylococcus
ADKMKSWYERFGFGKSTNGMFDGE

SEQ ID NO: 2058970 - protein, 25 aa, Staphylococcus
ADKMKSWYERFGFSKPTGGLFDGEA

SEQ ID NO: 2058971 - protein, 25 aa, Staphylococcus
ADKTEVTVFFLNGFQMKGVIEDFDK

SEQ ID NO: 2058972 - protein, 25 aa, Staphylococcus
ADKYGVFVIFDNKTPIFVGQSGGYS

SEQ ID NO: 2058973 - protein, 21 aa, Staphylococcus
ADLEFHLAIAHAAQNSLLVEL

SEQ ID NO: 2058974 - protein, 17 aa, Staphylococcus
ADLGIKNAGLRLKFLKS

SEQ ID NO: 2058975 - protein, 25 aa, Staphylococcus
ADLHDVTVLIRLLKNKHPQAFVHMI

SEQ ID NO: 2058976 - protein, 17 aa, Staphylococcus
ADLILTMTQEHLGLLIQ

SEQ ID NO: 2058977 - protein, 26 aa, Staphylococcus
ADLKKKLNYYMTLNPRVYKHFEEYVT

SEQ ID NO: 2058978 - protein, 26 aa, Staphylococcus
ADLKVEGALAMILKDAMKPNLVQTIE

SEQ ID NO: 2058979 - protein, 27 aa, Staphylococcus
ADLLGQPLYKYFGGFNGKQLPVPMMNI

SEQ ID NO: 2058980 - protein, 17 aa, Staphylococcus
ADLLIMAGTNFPYANYL

SEQ ID NO: 2058981 - protein, 25 aa, Staphylococcus
ADLMKIANDIRWLASGPRAGLAEIS

SEQ ID NO: 2058982 - protein, 18 aa, Staphylococcus
ADLTPEKLEYWKTLYSDE

SEQ ID NO: 2058983 - protein, 31 aa, Staphylococcus
ADLVLGGHKLDLEGFFYAPTILDHVKTTDSA

SEQ ID NO: 2058984 - protein, 21 aa, Staphylococcus
ADLWQKIQSLWRDQTVLIVEH

SEQ ID NO: 2058985 - protein, 21 aa, Staphylococcus
ADMALANILAFWCARDYSQMD

SEQ ID NO: 2058986 - protein, 21 aa, Staphylococcus
ADMMIVKPALSFLDIIRDVRN

SEQ ID NO: 2058987 - protein, 18 aa, Staphylococcus
ADMMIVKPALSYLDIVRD

SEQ ID NO: 2058988 - protein, 19 aa, Staphylococcus
ADMMIVKPALSYLDIVRDV

SEQ ID NO: 2058989 - protein, 20 aa, Staphylococcus
ADMMIVKPSLSFLDIIRDVR

SEQ ID NO: 2058990 - protein, 27 aa, Staphylococcus
ADMNPYLAYAALIGAGLYGIEHKETLT

SEQ ID NO: 2058991 - protein, 25 aa, Staphylococcus
ADNKADLLSFALKKVDKAAQRNLIH

SEQ ID NO: 2058992 - protein, 26 aa, Staphylococcus
ADNRHLSLIEDVFRAFQSLYNAHHNQ

SEQ ID NO: 2058993 - protein, 23 aa, Staphylococcus
ADNSYINISWFKGNGSEFVASSK

SEQ ID NO: 2058994 - protein, 23 aa, Staphylococcus
ADNTRRVLAIELIIALQAVELKG

SEQ ID NO: 2058995 - protein, 23 aa, Staphylococcus
ADPDYMVRPPFFIEWNKNKVDHM

SEQ ID NO: 2058996 - protein, 22 aa, Staphylococcus
ADQALLQRLDLLKFQHEELQEA

SEQ ID NO: 2058997 - protein, 24 aa, Staphylococcus
ADQALLQRLDLMKFQFEELTEASL

SEQ ID NO: 2058998 - protein, 22 aa, Staphylococcus
ADQALLQRLDLMKFQYEELEEA

SEQ ID NO: 2058999 - protein, 23 aa, Staphylococcus
ADQALLQRLDLMKFQYEELQEAQ

SEQ ID NO: 2059000 - protein, 26 aa, Staphylococcus
ADQIYAFQKVANGLIKIITFAPEVEG

SEQ ID NO: 2059001 - protein, 24 aa, Staphylococcus
ADQKIFETVSLWLDEYFQGKNPSI

SEQ ID NO: 2059002 - protein, 24 aa, Staphylococcus
ADQNLKVAVVMHLCDINKSEAVTR

SEQ ID NO: 2059003 - protein, 27 aa, Staphylococcus
ADQNRPYYCQIDFLLEFTFNTTRAAAN

SEQ ID NO: 2059004 - protein, 27 aa, Staphylococcus
ADQSVFHLHFHLLPRYENDVDGFGYKW

SEQ ID NO: 2059005 - protein, 25 aa, Staphylococcus
ADRDLLQAQLYLMKHDELPFTQDDI

SEQ ID NO: 2059006 - protein, 19 aa, Staphylococcus
ADRILHLIKVQMDNLTLPS

SEQ ID NO: 2059007 - protein, 18 aa, Staphylococcus
ADRILQLIKVQMDNLTLP

SEQ ID NO: 2059008 - protein, 23 aa, Staphylococcus
ADRLGFIERYGDNDFRYFNGNEI

SEQ ID NO: 2059009 - protein, 17 aa, Staphylococcus
ADRYHVHYLQQSHILQK

SEQ ID NO: 2059010 - protein, 23 aa, Staphylococcus
ADSIPINFLHPIKGTKFGDMDEL

SEQ ID NO: 2059011 - protein, 24 aa, Staphylococcus
ADSIPINFLHPIKGTKFGGLDLLS

SEQ ID NO: 2059012 - protein, 25 aa, Staphylococcus
ADSIPINFLHPIKGTKFGGLDLLSP

SEQ ID NO: 2059013 - protein, 20 aa, Staphylococcus
ADSIPINFLHPIQGTKFGEM

SEQ ID NO: 2059014 - protein, 25 aa, Staphylococcus
ADSIPVNFLHPIKGTKFGGLDLLSP

SEQ ID NO: 2059015 - protein, 22 aa, Staphylococcus
ADTAYPSILKRGGGYQKIDVDT

SEQ ID NO: 2059016 - protein, 18 aa, Staphylococcus
ADTFLPYMKDALKVRRRV

SEQ ID NO: 2059017 - protein, 29 aa, Staphylococcus
ADTIILGCTHYPLLYKPINDYFGGEKKVI

SEQ ID NO: 2059018 - protein, 24 aa, Staphylococcus
ADTKLRRGLFLYGTAKNGKSVYIK

SEQ ID NO: 2059019 - protein, 19 aa, Staphylococcus
ADTVLFAVGVEPATDWLKG

SEQ ID NO: 2059020 - protein, 27 aa, Staphylococcus
ADTYQRIFHYFQPKFMLGMTATPERTD

SEQ ID NO: 2059021 - protein, 25 aa, Staphylococcus
ADVDVFLVAPKGPGHLVRRTFEEGS

SEQ ID NO: 2059022 - protein, 24 aa, Staphylococcus
ADVDYVHQHLLSLPLDQFSLNFAK

SEQ ID NO: 2059023 - protein, 24 aa, Staphylococcus
ADVIGVVAIFTYGLKKADEQFKQA

SEQ ID NO: 2059024 - protein, 29 aa, Staphylococcus
ADVILYDRLVNKALLNHASPSAKFMYCGK

SEQ ID NO: 2059025 - protein, 24 aa, Staphylococcus
ADVLGVVAIFTYGLAKADTMFKEA

SEQ ID NO: 2059026 - protein, 25 aa, Staphylococcus
ADVNWNLGIIWKKESYINYVTREWI

SEQ ID NO: 2059027 - protein, 23 aa, Staphylococcus
ADVSPHNRVFASFKQRGISMTED

SEQ ID NO: 2059028 - protein, 23 aa, Staphylococcus
ADYEGWWLFDDWRDLITEQYQFS

SEQ ID NO: 2059029 - protein, 30 aa, Staphylococcus
ADYQRTGFFYPELAMYFKNPARILGSFFIK

SEQ ID NO: 2059030 - protein, 25 aa, Staphylococcus
ADYQRVGFFYPEIAMYFKNPSRILG

SEQ ID NO: 2059031 - protein, 24 aa, Staphylococcus
AEAEALSHQLLLKAGLIKQSTSGI

SEQ ID NO: 2059032 - protein, 27 aa, Staphylococcus
AEAFEIVLIEIDYPQKFVTLQHQHILG

SEQ ID NO: 2059033 - protein, 27 aa, Staphylococcus
AEAGETIYFILRETPFYAVSGGQVADQ

SEQ ID NO: 2059034 - protein, 27 aa, Staphylococcus
AEAGVYKRYALSDLPFSNKTKFETKGE

SEQ ID NO: 2059035 - protein, 17 aa, Staphylococcus
AEAIRYIEKLGFEAIHQ

SEQ ID NO: 2059036 - protein, 23 aa, Staphylococcus
AEAIRYISGYGFSQQLITLDAFN

SEQ ID NO: 2059037 - protein, 17 aa, Staphylococcus
AEAIRYLQNIGFEAIHQ

SEQ ID NO: 2059038 - protein, 18 aa, Staphylococcus
AEARNHRKLGKQLKLFMF

SEQ ID NO: 2059039 - protein, 18 aa, Staphylococcus
AEAWALNRHIRRLEASIV

SEQ ID NO: 2059040 - protein, 27 aa, Staphylococcus
AEDFHKPGHLFPLIAKDNGVLEREGHT

SEQ ID NO: 2059041 - protein, 23 aa, Staphylococcus
AEDIPFFLEVLTYDDNIPDNSSL

SEQ ID NO: 2059042 - protein, 24 aa, Staphylococcus
AEDLNQLIFAFPGASSGVIDLLKM

SEQ ID NO: 2059043 - protein, 23 aa, Staphylococcus
AEDNAFFPSPYSLSQYTAPKTDF

SEQ ID NO: 2059044 - protein, 30 aa, Staphylococcus
AEDYKIAFKDITFLPPVTPPNNVIAFGRNY

SEQ ID NO: 2059045 - protein, 30 aa, Staphylococcus
AEEEGSRFPFAFWGSKNFFNLADEEDVKDI

SEQ ID NO: 2059046 - protein, 22 aa, Staphylococcus
AEEFGFATAPLIVLGCVMMRVC

SEQ ID NO: 2059047 - protein, 22 aa, Staphylococcus
AEEFGFATAPLVVLGCVMMRVC

SEQ ID NO: 2059048 - protein, 19 aa, Staphylococcus
AEEFKLTISGKLPENYKDE

SEQ ID NO: 2059049 - protein, 25 aa, Staphylococcus
AEEHHAYYRFIFTRDSRQQLNKIRK

SEQ ID NO: 2059050 - protein, 18 aa, Staphylococcus
AEEININAFVRPTKDKKS

SEQ ID NO: 2059051 - protein, 24 aa, Staphylococcus
AEEKISYQGLPSRIAWLGYEERAK

SEQ ID NO: 2059052 - protein, 30 aa, Staphylococcus; identical to SEQ ID NO: 1679733

SEQ ID NO: 2059053 - protein, 23 aa, Staphylococcus
AEELLQHDISITQLSLLEQESYR

SEQ ID NO: 2059054 - protein, 20 aa, Staphylococcus
AEELVIIEKPMRAYSDNSNQ

SEQ ID NO: 2059055 - protein, 17 aa, Staphylococcus
AEELVRKKSLWSSAASV

SEQ ID NO: 2059056 - protein, 32 aa, Staphylococcus
AEERAKFYQIPQSKHFLPSQTNFVFVQTDKSK

SEQ ID NO: 2059057 - protein, 25 aa, Staphylococcus
AEERALIIAMLKQQKPMLGICLGAQ

SEQ ID NO: 2059058 - protein, 22 aa, Staphylococcus
AEERFPELKPLGKPNPFSYITA

SEQ ID NO: 2059059 - protein, 24 aa, Staphylococcus
AEERHHFMLQFLKQFLHEWNFNNN

SEQ ID NO: 2059060 - protein, 24 aa, Staphylococcus
AEERNHRRLGKQLKLFMFSEEAPG

SEQ ID NO: 2059061 - protein, 25 aa, Staphylococcus
AEEYQCPVIILSDLQLALGKQTVEQ

SEQ ID NO: 2059062 - protein, 24 aa, Staphylococcus
AEEYQCPVIILSDLQLSLGKQTVE

SEQ ID NO: 2059063 - protein, 24 aa, Staphylococcus
AEEYQCPVIILSDLQLSLGKQTVK

SEQ ID NO: 2059064 - protein, 25 aa, Staphylococcus
AEEYQCPVIILSDLQLSLGKQTVKS

SEQ ID NO: 2059065 - protein, 17 aa, Staphylococcus
AEFLLEHGQLDKVIHRK

SEQ ID NO: 2059066 - protein, 18 aa, Staphylococcus
AEFLPFVEYTKKAEDSKH

SEQ ID NO: 2059067 - protein, 35 aa, Staphylococcus
AEGAHLTAFIRKATQIGIPVMAHLGLTPQSVGVMG

SEQ ID NO: 2059068 - protein, 34 aa, Staphylococcus
AEGFEAFFMMKKMGAPFLLFGDPRLEGGAFYAGS

SEQ ID NO: 2059069 - protein, 33 aa, Staphylococcus
AEGFEGFFMMNRLNAPFILISDPRIEGGAFYLG

SEQ ID NO: 2059070 - protein, 25 aa, Staphylococcus
AEGLAQIQIIYDPGLILIGGGISAQ

SEQ ID NO: 2059071 - protein, 23 aa, Staphylococcus
AEGRKCEFIAVKLPYGVQKDAAE

SEQ ID NO: 2059072 - protein, 26 aa, Staphylococcus
AEHDDKWLVLIHGGYWRQKYDRSLND

SEQ ID NO: 2059073 - protein, 24 aa, Staphylococcus
AEHKARIDTIRKVSKRLGKTVAIL

SEQ ID NO: 2059074 - protein, 26 aa, Staphylococcus
AEHLAHPISYYFKNNFYITPSGMLTK

SEQ ID NO: 2059075 - protein, 22 aa, Staphylococcus
AEHPFELIYGILSKHKSYELTP

SEQ ID NO: 2059076 - protein, 24 aa, Staphylococcus
AEHPLFVYIPCGVGGGPGGVTFGL

SEQ ID NO: 2059077 - protein, 19 aa, Staphylococcus
AEHYRNLPYIGTLKPEIYS

SEQ ID NO: 2059078 - protein, 18 aa, Staphylococcus
AEIAGRMRFFFPDVQVRG

SEQ ID NO: 2059079 - protein, 25 aa, Staphylococcus
AEIDHFELQLLLDGPYDANNAILEL

SEQ ID NO: 2059080 - protein, 23 aa, Staphylococcus
AEIDNLIWYFSELVKNEMKIAMG

SEQ ID NO: 2059081 - protein, 26 aa, Staphylococcus
AEIDNLVWYFSELFKSELRVTIGPIE

SEQ ID NO: 2059082 - protein, 17 aa, Staphylococcus
AEIGYTVFTLENHLIYK

SEQ ID NO: 2059083 - protein, 20 aa, Staphylococcus
AEILEWFDAIGRRRGLLQRG

SEQ ID NO: 2059084 - protein, 23 aa, Staphylococcus
AEIPALLGAYILEGSKAGATAVS

SEQ ID NO: 2059085 - protein, 18 aa, Staphylococcus
AEIQFADFILPAVNQIIS

SEQ ID NO: 2059086 - protein, 18 aa, Staphylococcus
AEITFITIHLRGAKRRKD

SEQ ID NO: 2059087 - protein, 19 aa, Staphylococcus
AEIYEHFGVSWIEPSMRED

SEQ ID NO: 2059088 - protein, 26 aa, Staphylococcus
AEKAKSLSCQFAFYGHTHVAKYENIA

SEQ ID NO: 2059089 - protein, 26 aa, Staphylococcus
AEKAQALGCQFAFYGHTHIAKYEKLG

SEQ ID NO: 2059090 - protein, 27 aa, Staphylococcus
AEKDFFNFFSNFFTRKWRREIVINAEA

SEQ ID NO: 2059091 - protein, 24 aa, Staphylococcus
AEKEKQFKLRELKADVESDLKEKG

SEQ ID NO: 2059092 - protein, 23 aa, Staphylococcus
AEKFKLTVLVDMFGRETPVEVEF

SEQ ID NO: 2059093 - protein, 25 aa, Staphylococcus
AEKIKWLLNFLDQSGPTIIYVSSKK

SEQ ID NO: 2059094 - protein, 37 aa, Staphylococcus
AEKIQSSILTSIPLWKNQMSIALTLMRQRNAVSAQKA

SEQ ID NO: 2059095 - protein, 22 aa, Staphylococcus
AEKLNLDFTYKAGEIKGLHPGR

SEQ ID NO: 2059096 - protein, 28 aa, Staphylococcus
AEKNLIKYTNWLNQLFHGIEYRMQLEML

SEQ ID NO: 2059097 - protein, 25 aa, Staphylococcus
AEKNPLFAWDLNMGGLMNALEAART

SEQ ID NO: 2059098 - protein, 25 aa, Staphylococcus
AEKNPLFAWDLNMGGLMNALEVARE

SEQ ID NO: 2059099 - protein, 25 aa, Staphylococcus
AEKNPLLAWDLNMGGLMNALETART

SEQ ID NO: 2059100 - protein, 24 aa, Staphylococcus
AEKNPLLAWNINMGGLVNALEVSR

SEQ ID NO: 2059101 - protein, 26 aa, Staphylococcus
AEKNPMFAWDLNMGGLMNALKTARTY

SEQ ID NO: 2059102 - protein, 17 aa, Staphylococcus
AEKPRLNIYRSNKHIYA

SEQ ID NO: 2059103 - protein, 17 aa, Staphylococcus
AEKVGVDPGLVYKTLVL

SEQ ID NO: 2059104 - protein, 22 aa, Staphylococcus
AEKVIILSPHLPVDTPLSLEDQ

SEQ ID NO: 2059105 - protein, 23 aa, Staphylococcus
AEKYQIPVIYSTHPRSWKKIEER

SEQ ID NO: 2059106 - protein, 26 aa, Staphylococcus
AEKYVQDGRWTSWGPYLLSGKDVYGS

SEQ ID NO: 2059107 - protein, 19 aa, Staphylococcus
AELAAKMFQNHNYSFLVGG

SEQ ID NO: 2059108 - protein, 24 aa, Staphylococcus
AELAPSYVFLATPADSSYITGQVI

SEQ ID NO: 2059109 - protein, 28 aa, Staphylococcus
AELARAFGADLILLNGLDAFDPKVVNVD

SEQ ID NO: 2059110 - protein, 26 aa, Staphylococcus
AELHDLAFLLLVYPLSEVEGALEAAY

SEQ ID NO: 2059111 - protein, 19 aa, Staphylococcus
AELIKKAEPQLILADKTRH

SEQ ID NO: 2059112 - protein, 35 aa, Staphylococcus
AELKEVFNLLNVEMPIVLPRLRISYMYDRTKKLLK

SEQ ID NO: 2059113 - protein, 25 aa, Staphylococcus
AELKSLLIQFKQFATIVLTSHEQIV

SEQ ID NO: 2059114 - protein, 17 aa, Staphylococcus
AELLQYEFGERLGVGRV

SEQ ID NO: 2059115 - protein, 25 aa, Staphylococcus
AELPKVFHYFKEAHPYFNQNVVIIG

SEQ ID NO: 2059116 - protein, 22 aa, Staphylococcus
AELTMGILLAVARRIPEGDQLC

SEQ ID NO: 2059117 - protein, 31 aa, Staphylococcus
AELTWMRQPHYYMGLYSYTYSAGLTIGTVVA

SEQ ID NO: 2059118 - protein, 21 aa, Staphylococcus
AELVNFAIKLVDKSAQSNLIH

SEQ ID NO: 2059119 - protein, 24 aa, Staphylococcus
AELVNLWKPIIINKLKKVDYYLND

SEQ ID NO: 2059120 - protein, 19 aa, Staphylococcus
AELWNKLIELWADQTVLIV

SEQ ID NO: 2059121 - protein, 20 aa, Staphylococcus
AELYIFDEPTSGLDPLMEKV

SEQ ID NO: 2059122 - protein, 21 aa, Staphylococcus
AELYVNIFRPNKEGQFPVVMS

SEQ ID NO: 2059123 - protein, 28 aa, Staphylococcus
AEMAGIPKHKIWLDPGIGFAKSRKEENE

SEQ ID NO: 2059124 - protein, 27 aa, Staphylococcus
AEMAGIPKHKIWLDPGIGFPKSRKEKN

SEQ ID NO: 2059125 - protein, 30 aa, Staphylococcus
AEMFDHQVLRRLVAFMYEQPATIMDYFKED

SEQ ID NO: 2059126 - protein, 27 aa, Staphylococcus
AEMHDLAFLLLVYPLSDYEGALHSAYY

SEQ ID NO: 2059127 - protein, 27 aa, Staphylococcus
AEMHDLAFLLLVYPLSELHGALDSAFY

SEQ ID NO: 2059128 - protein, 27 aa, Staphylococcus
AENALFEEVVFLLWNYRLPTQDELDAL

SEQ ID NO: 2059129 - protein, 28 aa, Staphylococcus
AENAQFEEIIFLLWNYRLPNKEELKELK

SEQ ID NO: 2059130 - protein, 28 aa, Staphylococcus
AENAQFEEIIFLLWNYRLPNKEELQELK

SEQ ID NO: 2059131 - protein, 28 aa, Staphylococcus
AENAQFEEIMFLLWNYRLPTQEELEELK

SEQ ID NO: 2059132 - protein, 27 aa, Staphylococcus
AENASFEEIIFLLWNYRLPTQEELDEL

SEQ ID NO: 2059133 - protein, 28 aa, Staphylococcus
AENELLPYLLEGDKLIFSEQLRFAGIGE

SEQ ID NO: 2059134 - protein, 17 aa, Staphylococcus
AENIANWFWEQFKHHLP

SEQ ID NO: 2059135 - protein, 25 aa, Staphylococcus
AENIEWFDAIGRRRGLLRRGNEIDY

SEQ ID NO: 2059136 - protein, 26 aa, Staphylococcus
AENKGFAIYELILNDLPKVLNKDAYV

SEQ ID NO: 2059137 - protein, 25 aa, Staphylococcus
AENLYKDFFITKRQSVPMVTVKVSC

SEQ ID NO: 2059138 - protein, 24 aa, Staphylococcus
AENNYLLTDLLRNQWNFDGVVVSD

SEQ ID NO: 2059139 - protein, 25 aa, Staphylococcus
AENQYKFLFYGELSQILEYINKHSH

SEQ ID NO: 2059140 - protein, 23 aa, Staphylococcus
AENRSVLNLFSYTGAFSVVASKN

SEQ ID NO: 2059141 - protein, 26 aa, Staphylococcus
AENVIFIGLLCKDGQWHAVVFEIGLG

SEQ ID NO: 2059142 - protein, 34 aa, Staphylococcus
AENVIFIGLLCRNGEWLSIIYEIGLGRTRELPVL

SEQ ID NO: 2059143 - protein, 22 aa, Staphylococcus
AEPLLKIFRLQDELKVFPSHFS

SEQ ID NO: 2059144 - protein, 20 aa, Staphylococcus
AEPYIRRRAIRHLEKNRVVI

SEQ ID NO: 2059145 - protein, 25 aa, Staphylococcus
AEQAKSLGCQFAFYGHTHVAKHENI

SEQ ID NO: 2059146 - protein, 24 aa, Staphylococcus
AEQFGTMETLFPHRVDLGLGRAPG

SEQ ID NO: 2059147 - protein, 25 aa, Staphylococcus
AEQFGTMETLFPNRVNLGLGRAPGT

SEQ ID NO: 2059148 - protein, 35 aa, Staphylococcus
AEQGTKLTFLPYVVKALVSALKKYPALNSEFDEEN

SEQ ID NO: 2059149 - protein, 29 aa, Staphylococcus
AEQLKGTDVLVCTVIGFPLGASTKEVKAF

SEQ ID NO: 2059150 - protein, 25 aa, Staphylococcus
AEQRQTMLFSATMPKAIQALVQQFM

SEQ ID NO: 2059151 - protein, 27 aa, Staphylococcus
AEQTYNGLWFSPLTDSLKLFIDSTQEH

SEQ ID NO: 2059152 - protein, 26 aa, Staphylococcus
AEQTYNGLWFSPLTDSLKLFIDSTQQ

SEQ ID NO: 2059153 - protein, 22 aa, Staphylococcus
AEQYQCPVIVLSDLQLSLGKQT

SEQ ID NO: 2059154 - protein, 18 aa, Staphylococcus
AERALLKHFMNDKDLFLN

SEQ ID NO: 2059155 - protein, 24 aa, Staphylococcus
AERFKDWFDHLPSNIVRAKGIVWF

SEQ ID NO: 2059156 - protein, 21 aa, Staphylococcus
AERHPVDVCFIPIGDNFTMGI

SEQ ID NO: 2059157 - protein, 24 aa, Staphylococcus
AERKIAAVAFLTFVALDEKKKPIK

SEQ ID NO: 2059158 - protein, 25 aa, Staphylococcus
AERLAALKFSMLCQEAGLEVHFDYF

SEQ ID NO: 2059159 - protein, 30 aa, Staphylococcus
AERRIEFYKLYLLLVHLVKFGLMYESSVET

SEQ ID NO: 2059160 - protein, 23 aa, Staphylococcus
AERTLKRFIGPLRARTAGPAFFW

SEQ ID NO: 2059161 - protein, 21 aa, Staphylococcus
AERYCDRFIILDKGKIVAFGN

SEQ ID NO: 2059162 - protein, 24 aa, Staphylococcus
AESALRQIPTYVRKHFKQAKTIMI

SEQ ID NO: 2059163 - protein, 26 aa, Staphylococcus
AESALRQLPTYVRKHFNNIQTLNIML

SEQ ID NO: 2059164 - protein, 23 aa, Staphylococcus
AESDKFYIPENVYIIGTMNDIDR

SEQ ID NO: 2059165 - protein, 18 aa, Staphylococcus
AESGIGGLALGLAVTGYR

SEQ ID NO: 2059166 - protein, 24 aa, Staphylococcus
AETEVLTFAVRRMNLYDKDLPNPL

SEQ ID NO: 2059167 - protein, 36 aa, Staphylococcus
AETFETNVYPVFWTVQKALEYLKPGASITTTSSVQG

SEQ ID NO: 2059168 - protein, 24 aa, Staphylococcus
AETGVDFISMGSLFYAQSALDISA

SEQ ID NO: 2059169 - protein, 35 aa, Staphylococcus
AETSFLTLPSNVLPKYAFSFLARTDGNSGKNPVKC

SEQ ID NO: 2059170 - protein, 18 aa, Staphylococcus
AETVAICWAMGITQQDIG

SEQ ID NO: 2059171 - protein, 23 aa, Staphylococcus
AETVDALLETKLSSGKTVDERMK

SEQ ID NO: 2059172 - protein, 30 aa, Staphylococcus; identical to SEQ ID NO: 1825176

SEQ ID NO: 2059173 - protein, 37 aa, Staphylococcus; identical to SEQ ID NO: 1819539

SEQ ID NO: 2059174 - protein, 23 aa, Staphylococcus
AEVETPRFYLDFNKYIASAENNS

SEQ ID NO: 2059175 - protein, 21 aa, Staphylococcus
AEVFLKEQFMRLEKEQIFVYI

SEQ ID NO: 2059176 - protein, 21 aa, Staphylococcus
AEVLGVVAIFTYGLAKADEMF

SEQ ID NO: 2059177 - protein, 21 aa, Staphylococcus
AEVLVKMRNRMKQRAELYEML

SEQ ID NO: 2059178 - protein, 19 aa, Staphylococcus
AEWNAFWDPEAVKTVFDSE

SEQ ID NO: 2059179 - protein, 20 aa, Staphylococcus
AEWNAFWDPEAVKTVFDSNL

SEQ ID NO: 2059180 - protein, 19 aa, Staphylococcus
AEWNAFWDPESVKTVFDTN

SEQ ID NO: 2059181 - protein, 30 aa, Staphylococcus
AEWRYQDVPKKLWPIQPLREFWGISRKIEA

SEQ ID NO: 2059182 - protein, 28 aa, Staphylococcus
AEYAVMGTLYFARQVPLIRQRVHQHDFR

SEQ ID NO: 2059183 - protein, 22 aa, Staphylococcus
AEYKSRIFAGLNEKGIAIYNAD

SEQ ID NO: 2059184 - protein, 18 aa, Staphylococcus
AEYSVSIALQLVRKFPAI

SEQ ID NO: 2059185 - protein, 25 aa, Staphylococcus
AFAEEKMVILFGSNAPAELEDYCYI

SEQ ID NO: 2059186 - protein, 18 aa, Staphylococcus
AFAVGLQKGYSIAQALKL

SEQ ID NO: 2059187 - protein, 18 aa, Staphylococcus
AFDAKALLRENPDYILNE

SEQ ID NO: 2059188 - protein, 26 aa, Staphylococcus
AFDDKDDLLVPFRTWRNNNANTAAGI

SEQ ID NO: 2059189 - protein, 26 aa, Staphylococcus
AFDFSFLNKPVIYYQFDRNEFLGKEA

SEQ ID NO: 2059190 - protein, 19 aa, Staphylococcus
AFDNIKIVGLMTMAPYTDD

SEQ ID NO: 2059191 - protein, 23 aa, Staphylococcus
AFDYNLLILGYKETAHHLTITSP

SEQ ID NO: 2059192 - protein, 26 aa, Staphylococcus
AFEFNGHLYYIYTGNHRDNYWKRTSS

SEQ ID NO: 2059193 - protein, 28 aa, Staphylococcus
AFEHIDLVIFIPSIIHPSFKRLPEVENL

SEQ ID NO: 2059194 - protein, 18 aa, Staphylococcus
AFELLMVSLERYDLEDLK

SEQ ID NO: 2059195 - protein, 22 aa, Staphylococcus
AFEMGIDIDTLVKFNLKKNQMI

SEQ ID NO: 2059196 - protein, 18 aa, Staphylococcus
AFENILRDLNEIYDFILI

SEQ ID NO: 2059197 - protein, 19 aa, Staphylococcus
AFESGIYVFPTEVTPGTDA

SEQ ID NO: 2059198 - protein, 22 aa, Staphylococcus
AFFKYSRLIKKYNPNIKIVGEI

SEQ ID NO: 2059199 - protein, 21 aa, Staphylococcus
AFFNEIPLFDYKFLLLNHELE

SEQ ID NO: 2059200 - protein, 22 aa, Staphylococcus
AFGLGEIYPPLIPSHGYVGNVK

SEQ ID NO: 2059201 - protein, 19 aa, Staphylococcus
AFGMGPDRIAMLKYGIEDI

SEQ ID NO: 2059202 - protein, 20 aa, Staphylococcus
AFGQLLPESLLNAPRLGAIN

SEQ ID NO: 2059203 - protein, 17 aa, Staphylococcus
AFGYTEEDVRRALNENK

SEQ ID NO: 2059204 - protein, 25 aa, Staphylococcus
AFHEPPINTFLPDAKYWQDKNAEII

SEQ ID NO: 2059205 - protein, 21 aa, Staphylococcus
AFIELFGDRVVITRPSIEELM

SEQ ID NO: 2059206 - protein, 25 aa, Staphylococcus
AFIETAKIVMNWLNDQQIHVDLLNL

SEQ ID NO: 2059207 - protein, 26 aa, Staphylococcus
AFIGALYLDQGLEVVWKFAQKVIFPY

SEQ ID NO: 2059208 - protein, 19 aa, Staphylococcus
AFILPQQKVQISLNIDLLV

SEQ ID NO: 2059209 - protein, 25 aa, Staphylococcus
AFINKAKIPTIITLPAKTIIPDDHP

SEQ ID NO: 2059210 - protein, 30 aa, Staphylococcus
AFIRELLFREFYYVLMVYYPETAHTSFNDK

SEQ ID NO: 2059211 - protein, 19 aa, Staphylococcus
AFIVLHFGGSLKSQSTQLL

SEQ ID NO: 2059212 - protein, 25 aa, Staphylococcus
AFKDIPAYDLGATLIKHILKTTQID

SEQ ID NO: 2059213 - protein, 23 aa, Staphylococcus
AFKDIVYALGRMGGGKLANIDFG

SEQ ID NO: 2059214 - protein, 25 aa, Staphylococcus
AFKHPKFYQQIFRLLEDSRVFNHIR

SEQ ID NO: 2059215 - protein, 24 aa, Staphylococcus
AFKKDAHFYYRQLEEIDTFQPLPN

SEQ ID NO: 2059216 - protein, 21 aa, Staphylococcus
AFKNDKIDFIWSHTLKSINEK

SEQ ID NO: 2059217 - protein, 24 aa, Staphylococcus
AFKNEKIDFIWSHTLKTINDKDGK

SEQ ID NO: 2059218 - protein, 24 aa, Staphylococcus
AFKNEKMDFIWNHTLAAINEENGK

SEQ ID NO: 2059219 - protein, 18 aa, Staphylococcus
AFKQRKRPATAKPVLLGI

SEQ ID NO: 2059220 - protein, 31 aa, Staphylococcus
AFKVMTDPYVGKLTFFRVYSGTLNSGSYVKN

SEQ ID NO: 2059221 - protein, 32 aa, Staphylococcus
AFKVMTDPYVGKLTFFRVYSGTLTSGSYIKNS

SEQ ID NO: 2059222 - protein, 17 aa, Staphylococcus
AFLASEKAKYITGQTIH

SEQ ID NO: 2059223 - protein, 25 aa, Staphylococcus
AFLKYKHMYDEVMRFGRYHPDYQTI

SEQ ID NO: 2059224 - protein, 39 aa, Staphylococcus
AFLQKGIVFLIIRFKLLDEVYLLPFSKFQKYWDRYKNEI

SEQ ID NO: 2059225 - protein, 22 aa, Staphylococcus
AFLTSLTYPSIFSQIAMFSPHS

SEQ ID NO: 2059226 - protein, 21 aa, Staphylococcus
AFMKKVIDTRAVFKIGGVGLA

SEQ ID NO: 2059227 - protein, 23 aa, Staphylococcus
AFMVPTPHRLFDFFNAYIGTTDI

SEQ ID NO: 2059228 - protein, 17 aa, Staphylococcus
AFNFRHATKRFDANKKI

SEQ ID NO: 2059229 - protein, 18 aa, Staphylococcus
AFNGFLHKNNIKGKDIFN

SEQ ID NO: 2059230 - protein, 23 aa, Staphylococcus
AFNHLKPMFGTKNKVMILTSSGT

SEQ ID NO: 2059231 - protein, 20 aa, Staphylococcus
AFNINIPKESINKAAKFLIS

SEQ ID NO: 2059232 - protein, 18 aa, Staphylococcus
AFNMSMALDGLRLNEGPL

SEQ ID NO: 2059233 - protein, 27 aa, Staphylococcus
AFNNSRKWLGQLPGKTSSWFKSAKKNT

SEQ ID NO: 2059234 - protein, 25 aa, Staphylococcus
AFPNLRIHHLRHSYASYLINNGVDM

SEQ ID NO: 2059235 - protein, 21 aa, Staphylococcus
AFPNRQVIGIAGDGAFQMVMQ

SEQ ID NO: 2059236 - protein, 18 aa, Staphylococcus
AFPNTIHWQYGHVLTIFE

SEQ ID NO: 2059237 - protein, 17 aa, Staphylococcus
AFPTPAIFDWLQEQGNI

SEQ ID NO: 2059238 - protein, 24 aa, Staphylococcus
AFQAYCGTWVQILKHFINMTTHSS

SEQ ID NO: 2059239 - protein, 23 aa, Staphylococcus
AFQIENVLTARKLSRHIEDKFAN

SEQ ID NO: 2059240 - protein, 17 aa, Staphylococcus
AFQLSMSKAIITVNEIK

SEQ ID NO: 2059241 - protein, 19 aa, Staphylococcus
AFSSWSKLTAAERAEYLHA

SEQ ID NO: 2059242 - protein, 21 aa, Staphylococcus
AFTDKYNVRWMLHGQDYTKIN

SEQ ID NO: 2059243 - protein, 24 aa, Staphylococcus
AFTEDVYDFWRPSGQSYPLVDGAL

SEQ ID NO: 2059244 - protein, 18 aa, Staphylococcus
AFTGLFRSINYRVEVPVS

SEQ ID NO: 2059245 - protein, 20 aa, Staphylococcus
AFTPLTKIPAYSGAKAAISN

SEQ ID NO: 2059246 - protein, 22 aa, Staphylococcus
AFTVMYLLICKIFENENVDIDT

SEQ ID NO: 2059247 - protein, 22 aa, Staphylococcus
AFTVMYLLICKMFENEDVEIDT

SEQ ID NO: 2059248 - protein, 17 aa, Staphylococcus
AFVAIIEETIRYKMRQL

SEQ ID NO: 2059249 - protein, 20 aa, Staphylococcus
AFVGALYLDQGLDAVWQFSE

SEQ ID NO: 2059250 - protein, 23 aa, Staphylococcus
AFVGALYLDQGLDTVWDFADKII

SEQ ID NO: 2059251 - protein, 24 aa, Staphylococcus
AFVGALYLDQGLDTVWKFAEKVIF

SEQ ID NO: 2059252 - protein, 24 aa, Staphylococcus
AFVGALYLDQGLDVVWQFAEKVIF

SEQ ID NO: 2059253 - protein, 20 aa, Staphylococcus
AFVGALYLDQGLEAVWQFSE

SEQ ID NO: 2059254 - protein, 17 aa, Staphylococcus
AFVLRQFKHLGLDQPES

SEQ ID NO: 2059255 - protein, 22 aa, Staphylococcus
AFVPLSEMFGYATSLRSNTQGR

SEQ ID NO: 2059256 - protein, 18 aa, Staphylococcus
AFVVAVLYKYYTEKVNDG

SEQ ID NO: 2059257 - protein, 18 aa, Staphylococcus
AFYIFPSIRNYTSDDFDF

SEQ ID NO: 2059258 - protein, 21 aa, Staphylococcus
AFYTHGHLYSVNRGRQQLAER

SEQ ID NO: 2059259 - protein, 26 aa, Staphylococcus
AGAAGIAIIKLLYSYGVRNMIMCDSK

SEQ ID NO: 2059260 - protein, 25 aa, Staphylococcus
AGAAGIAIVKLLYSYGVRDMIMCDS

SEQ ID NO: 2059261 - protein, 26 aa, Staphylococcus
AGAAGIAIVKLLYSYGVRNMIMCDSK

SEQ ID NO: 2059262 - protein, 25 aa, Staphylococcus
AGAAGIAIVKLLYSYGVRNMVMCDS

SEQ ID NO: 2059263 - protein, 24 aa, Staphylococcus
AGAAPKRFIREFRNVNVDEYEVGQ

SEQ ID NO: 2059264 - protein, 25 aa, Staphylococcus
AGAEALSHRLLLKAGLIKQSTSGIY

SEQ ID NO: 2059265 - protein, 33 aa, Staphylococcus
AGANAIYEFLTLNIPMLLIPLGLDQSRGDQIDN

SEQ ID NO: 2059266 - protein, 33 aa, Staphylococcus; identical to SEQ ID NO: 1825209

SEQ ID NO: 2059267 - protein, 26 aa, Staphylococcus
AGCLLGGIITSFLFRNNHPQQETLVE

SEQ ID NO: 2059268 - protein, 25 aa, Staphylococcus
AGDATAVPLLLGLGLDEFSMSPTSI

SEQ ID NO: 2059269 - protein, 22 aa, Staphylococcus
AGDAYMILTWLDEGTTGSQEAL

SEQ ID NO: 2059270 - protein, 21 aa, Staphylococcus
AGDEAQWMYPPFELHEQDGKL

SEQ ID NO: 2059271 - protein, 25 aa, Staphylococcus
AGDETAIPLLLGLGLDEFSMSATSI

SEQ ID NO: 2059272 - protein, 25 aa, Staphylococcus
AGDFNKMFYGVPYNMNYEISTQAQL

SEQ ID NO: 2059273 - protein, 23 aa, Staphylococcus
AGDGMLVKRPLAISGDRITLGFK

SEQ ID NO: 2059274 - protein, 17 aa, Staphylococcus
AGDVWYPQPAPADHPWR

SEQ ID NO: 2059275 - protein, 28 aa, Staphylococcus
AGEKIPKGLALDYVYGYTIINDITDRTA

SEQ ID NO: 2059276 - protein, 27 aa, Staphylococcus
AGETQLSLTFHKLPIDVQKDLLGLIEH

SEQ ID NO: 2059277 - protein, 18 aa, Staphylococcus
AGFHIHFANDDRDFGGHI

SEQ ID NO: 2059278 - protein, 18 aa, Staphylococcus
AGFHIHFANDDRNFGGHV

SEQ ID NO: 2059279 - protein, 22 aa, Staphylococcus
AGFIDAKYRALAPLYDDLEALF

SEQ ID NO: 2059280 - protein, 28 aa, Staphylococcus
AGFNKAEAMIILFPKLFKQQDNTMKWYQ

SEQ ID NO: 2059281 - protein, 29 aa, Staphylococcus
AGFNKSEALLILFPYIYKKNDVAMKWFQR

SEQ ID NO: 2059282 - protein, 29 aa, Staphylococcus
AGFNKSEALLLLFPYIYKEQESAMKWIQR

SEQ ID NO: 2059283 - protein, 30 aa, Staphylococcus
AGFNKSEAVLLLFPILFKEQDNTMRWFQDQ

SEQ ID NO: 2059284 - protein, 24 aa, Staphylococcus
AGFPSIPLKIVYPALKVTIVDSLN

SEQ ID NO: 2059285 - protein, 31 aa, Staphylococcus
AGFTILEYDLHAPHILGMLTPFYEGQYVMQT

SEQ ID NO: 2059286 - protein, 17 aa, Staphylococcus
AGFTYKLDADFTPKFVV

SEQ ID NO: 2059287 - protein, 20 aa, Staphylococcus
AGGCFWCMTKPFDSYDGIEK

SEQ ID NO: 2059288 - protein, 18 aa, Staphylococcus
AGGCFWCMTKPFDTFDGI

SEQ ID NO: 2059289 - protein, 19 aa, Staphylococcus
AGGCFWCMTKPFDTFDGIE

SEQ ID NO: 2059290 - protein, 20 aa, Staphylococcus
AGGCFWCMTKPFDTFEGIEK

SEQ ID NO: 2059291 - protein, 27 aa, Staphylococcus
AGGDEAAIFAGDLYRMYTRFSEGLGYK

SEQ ID NO: 2059292 - protein, 19 aa, Staphylococcus
AGGLLMYGIPNMKLDKDVV

SEQ ID NO: 2059293 - protein, 25 aa, Staphylococcus
AGGMGTALLAFLDANLQAGIDVVLD

SEQ ID NO: 2059294 - protein, 28 aa, Staphylococcus
AGGTGIALLAFFSAALTRGIDVVLKETE

SEQ ID NO: 2059295 - protein, 22 aa, Staphylococcus
AGHALYLLNQLNDDGRLIAIDQ

SEQ ID NO: 2059296 - protein, 21 aa, Staphylococcus
AGHALYLLNQLNDEGRLIAID

SEQ ID NO: 2059297 - protein, 22 aa, Staphylococcus
AGHALYLLNQLSDEGRLIAIDQ

SEQ ID NO: 2059298 - protein, 21 aa, Staphylococcus
AGHDWIFDKMKQLGYKHEGFL

SEQ ID NO: 2059299 - protein, 25 aa, Staphylococcus
AGHHCAQPLMKWLGQSSTARASFYI

SEQ ID NO: 2059300 - protein, 26 aa, Staphylococcus
AGHHEKWTYLPFKLTEQDGKLYGRGT

SEQ ID NO: 2059301 - protein, 18 aa, Staphylococcus
AGHYIPTIGFYSPKTKAM

SEQ ID NO: 2059302 - protein, 18 aa, Staphylococcus
AGIINMFLNWLHPENHIP

SEQ ID NO: 2059303 - protein, 19 aa, Staphylococcus
AGIKFIESLELFSLLANVG

SEQ ID NO: 2059304 - protein, 20 aa, Staphylococcus
AGIKPVFGMTIYLSDGLTEL

SEQ ID NO: 2059305 - protein, 23 aa, Staphylococcus
AGILYQIIAWHQDYDVALHLGDS

SEQ ID NO: 2059306 - protein, 26 aa, Staphylococcus
AGIMTEIPFQFFKAHVNLDLPNEGDY

SEQ ID NO: 2059307 - protein, 31 aa, Staphylococcus
AGINHWFNSDTIYRAILNLVLLCGCQGVNGG

SEQ ID NO: 2059308 - protein, 31 aa, Staphylococcus
AGINHWFNSDTIYRAVLNLVLLCGCQGVNGG

SEQ ID NO: 2059309 - protein, 22 aa, Staphylococcus
AGINHWFNSDTIYRAVLNLVML

SEQ ID NO: 2059310 - protein, 19 aa, Staphylococcus
AGIPAFYTKTGVGTPIAEG

SEQ ID NO: 2059311 - protein, 19 aa, Staphylococcus
AGIPVIFVRVAFSKNFSEV

SEQ ID NO: 2059312 - protein, 19 aa, Staphylococcus
AGIVFGDANYYLKNMLMIL

SEQ ID NO: 2059313 - protein, 31 aa, Staphylococcus
AGKLLARHIVPYPPGVPILFKGEKITLNMIK

SEQ ID NO: 2059314 - protein, 27 aa, Staphylococcus
AGKSTLINLLLEQDILPSSPVPTTSNT

SEQ ID NO: 2059315 - protein, 26 aa, Staphylococcus
AGKSTLINLLLEQEILPSSPVPTTSN

SEQ ID NO: 2059316 - protein, 28 aa, Staphylococcus
AGKSTLLKIILGLLPLQSGEIFIDGHPI

SEQ ID NO: 2059317 - protein, 28 aa, Staphylococcus
AGKSTLLKIILGLLPLQTGDIYVDGQQY

SEQ ID NO: 2059318 - protein, 26 aa, Staphylococcus
AGKTTTFRMILGLTPITKGSITYNDK

SEQ ID NO: 2059319 - protein, 26 aa, Staphylococcus
AGKTTTFRMILGLTPLTEGSVTYNGN

SEQ ID NO: 2059320 - protein, 19 aa, Staphylococcus
AGLFASFYSGLRGMSVRII

SEQ ID NO: 2059321 - protein, 25 aa, Staphylococcus
AGLHAVWSHLIAHKLYNNQRYVAAR

SEQ ID NO: 2059322 - protein, 22 aa, Staphylococcus
AGLSWLTILKKKDAYSEAFHNF

SEQ ID NO: 2059323 - protein, 23 aa, Staphylococcus
AGLSWLTILKKKEAYEKAFHQFD

SEQ ID NO: 2059324 - protein, 23 aa, Staphylococcus
AGLSWLTILKKKQSYEQAFYNFE

SEQ ID NO: 2059325 - protein, 23 aa, Staphylococcus
AGLTACYLMVNKKIRRGYKSMPE

SEQ ID NO: 2059326 - protein, 20 aa, Staphylococcus
AGLTALMASGLPSFTYTFLG

SEQ ID NO: 2059327 - protein, 23 aa, Staphylococcus
AGLVTPWNFPTNQTSLKLAAAFA

SEQ ID NO: 2059328 - protein, 28 aa, Staphylococcus
AGMKEKGMFLVPTLLAPVSVIECAEELG

SEQ ID NO: 2059329 - protein, 22 aa, Staphylococcus
AGMNPPQFLQPGDEIKVTIDNI

SEQ ID NO: 2059330 - protein, 22 aa, Staphylococcus
AGNIYACEALYRTGIRPDKIAN

SEQ ID NO: 2059331 - protein, 46 aa, Staphylococcus
AGNNYIEGLLGVDIEQFRQLFILPQGEFKKFLFSKSSAKQEILRTL

SEQ ID NO: 2059332 - protein, 22 aa, Staphylococcus
AGNVLRFQPPLVITYEQLDTAL

SEQ ID NO: 2059333 - protein, 18 aa, Staphylococcus
AGPVVACAVILNANHHYL

SEQ ID NO: 2059334 - protein, 18 aa, Staphylococcus
AGPVVACAVILNKEHQYL

SEQ ID NO: 2059335 - protein, 19 aa, Staphylococcus
AGPVVACAVILNKGHHYLG

SEQ ID NO: 2059336 - protein, 22 aa, Staphylococcus
AGPVVTCAVILNPGHRYLGLND

SEQ ID NO: 2059337 - protein, 28 aa, Staphylococcus
AGQERLPLIHRWIDGRMPLIGIGSIFTA

SEQ ID NO: 2059338 - protein, 20 aa, Staphylococcus
AGQPLYQLLIDDPEKQHRIE

SEQ ID NO: 2059339 - protein, 19 aa, Staphylococcus
AGQPVLLGTVAVETSEYIS

SEQ ID NO: 2059340 - protein, 24 aa, Staphylococcus
AGRRGLPFVIAKMGQSSSAIEEVI

SEQ ID NO: 2059341 - protein, 20 aa, Staphylococcus
AGRRSMLMGAYYLEAQHQGE

SEQ ID NO: 2059342 - protein, 33 aa, Staphylococcus
AGRSDYPWDLFIQMPAALMFPSGNRFYDWIYQT

SEQ ID NO: 2059343 - protein, 23 aa, Staphylococcus
AGSCWYYLRYIDPDNDKMIADPE

SEQ ID NO: 2059344 - protein, 18 aa, Staphylococcus
AGSDFLGWLDLPVDYDKE

SEQ ID NO: 2059345 - protein, 23 aa, Staphylococcus
AGSFLAKFLFDKGAKIVGISDAY

SEQ ID NO: 2059346 - protein, 33 aa, Staphylococcus
AGSNAIYEFLALRIPMLLIPLGLDQSRGDQIDN

SEQ ID NO: 2059347 - protein, 33 aa, Staphylococcus
AGSNAIYEFLTLRLPMLLIPLGLDQSRGDQIDN

SEQ ID NO: 2059348 - protein, 25 aa, Staphylococcus
AGSSTIEMIPFITAKDIVVVTNGLT

SEQ ID NO: 2059349 - protein, 25 aa, Staphylococcus
AGTDMTFFDFLGIPKGRKGTNSITK

SEQ ID NO: 2059350 - protein, 24 aa, Staphylococcus
AGTDMTFFDFPGIPQGRKGTNSIT

SEQ ID NO: 2059351 - protein, 24 aa, Staphylococcus
AGTLLRYYTGLLESSRKTPFGFKI

SEQ ID NO: 2059352 - protein, 25 aa, Staphylococcus
AGVHKLPFVCVIINNKYAISVPNTL

SEQ ID NO: 2059353 - protein, 25 aa, Staphylococcus
AGVHKLPLVCVIINNKYAISVPDSL

SEQ ID NO: 2059354 - protein, 23 aa, Staphylococcus
AGVHNLPFICVIENNKYAISVPD

SEQ ID NO: 2059355 - protein, 18 aa, Staphylococcus
AGVNLAHKLLAKGEVIFP

SEQ ID NO: 2059356 - protein, 26 aa, Staphylococcus
AGVNNLPLEYFKEKSILLTNASGVHA

SEQ ID NO: 2059357 - protein, 22 aa, Staphylococcus
AGVPMLDILKKLEIHNACVVVT

SEQ ID NO: 2059358 - protein, 27 aa, Staphylococcus
AGVQEVRAWTFIKGMTAPQCAGIIHTD

SEQ ID NO: 2059359 - protein, 19 aa, Staphylococcus
AGVRRIEALTGKAAFLYLE

SEQ ID NO: 2059360 - protein, 20 aa, Staphylococcus
AGVRRIEALTGKAAFLYLEE

SEQ ID NO: 2059361 - protein, 24 aa, Staphylococcus
AGYEIFPVSLTYTATKYYVSAYTE

SEQ ID NO: 2059362 - protein, 25 aa, Staphylococcus
AGYGEYFVHRLGHGLGLEEHEYQDV

SEQ ID NO: 2059363 - protein, 25 aa, Staphylococcus
AGYTCGYYLIKYYLEKTKSSIEKAT

SEQ ID NO: 2059364 - protein, 41 aa, Staphylococcus
AHAAAYVLMAMRIAYFKVHYPLYYYASYFTVRASDFDLITM

SEQ ID NO: 2059365 - protein, 19 aa, Staphylococcus
AHCLTIPRVLTIENNQLRQ

SEQ ID NO: 2059366 - protein, 31 aa, Staphylococcus
AHEGQFRKNGLPYIMHPIQVAGILTEMHLDG

SEQ ID NO: 2059367 - protein, 19 aa, Staphylococcus
AHENKLYVPVIKHADEKSI

SEQ ID NO: 2059368 - protein, 18 aa, Staphylococcus
AHFLEHKLFEKEQGEDLF

SEQ ID NO: 2059369 - protein, 17 aa, Staphylococcus
AHFRLGISVSKKIGNAV

SEQ ID NO: 2059370 - protein, 22 aa, Staphylococcus
AHGEWTALMIFKAYHLDNGEGH

SEQ ID NO: 2059371 - protein, 18 aa, Staphylococcus
AHGILGPFSLLALSKIKG

SEQ ID NO: 2059372 - protein, 17 aa, Staphylococcus
AHHILDMSLLSQLTPNA

SEQ ID NO: 2059373 - protein, 28 aa, Staphylococcus
AHHKLAMVLVQFPPWFDCTAQNINYILY

SEQ ID NO: 2059374 - protein, 24 aa, Staphylococcus
AHHRDYHIMIIRGSKITNLNNEHL

SEQ ID NO: 2059375 - protein, 20 aa, Staphylococcus
AHIKGLTFNSAVETLKCILP

SEQ ID NO: 2059376 - protein, 18 aa, Staphylococcus
AHIRFVFCTGKQCERVEN

SEQ ID NO: 2059377 - protein, 27 aa, Staphylococcus
AHKLGFKGFVDLKLSLSRNLPQHEAHN

SEQ ID NO: 2059378 - protein, 20 aa, Staphylococcus
AHKLISLLTQRHFTLSITLK

SEQ ID NO: 2059379 - protein, 19 aa, Staphylococcus
AHKTPKKRGYFFAMWCKDD

SEQ ID NO: 2059380 - protein, 26 aa, Staphylococcus
AHLKSDQLIILTAVDYVYINYGKDNQ

SEQ ID NO: 2059381 - protein, 21 aa, Staphylococcus
AHLMYQAFLKSKVAYDEVMRF

SEQ ID NO: 2059382 - protein, 26 aa, Staphylococcus
AHLQRITRHLLKKYQDKFFTYPAASS

SEQ ID NO: 2059383 - protein, 31 aa, Staphylococcus
AHLVENIRFATVLLRPFITHAPKEIFKQLNI

SEQ ID NO: 2059384 - protein, 31 aa, Staphylococcus
AHLVENIRFATVLLRPFITHAPRQIFEQLNI

SEQ ID NO: 2059385 - protein, 31 aa, Staphylococcus
AHLVENIRFATVLLRPFLTHAPKEIFKQLNI

SEQ ID NO: 2059386 - protein, 30 aa, Staphylococcus
AHLVENIRFATVLLRPFLTHAPREVFKQLN

SEQ ID NO: 2059387 - protein, 30 aa, Staphylococcus
AHLVENIRIIAVLLRPFLTHAPKQIFSQLN

SEQ ID NO: 2059388 - protein, 23 aa, Staphylococcus
AHLVSFIQKATRMGIPIVSHLGL

SEQ ID NO: 2059389 - protein, 20 aa, Staphylococcus
AHMMIWEGIELLPVTTINKK

SEQ ID NO: 2059390 - protein, 24 aa, Staphylococcus
AHNDWVNMLGVVPVIRALREKAMT

SEQ ID NO: 2059391 - protein, 25 aa, Staphylococcus
AHNDWVNMLGVVPVIRALREKAMTI

SEQ ID NO: 2059392 - protein, 26 aa, Staphylococcus
AHNEPSWMTELRKKALKLTETLEMPK

SEQ ID NO: 2059393 - protein, 17 aa, Staphylococcus
AHNKKPTKRLWISSVTN

SEQ ID NO: 2059394 - protein, 30 aa, Staphylococcus
AHNTSIANVVLAFYLTRPALDVVIPGAKHA

SEQ ID NO: 2059395 - protein, 30 aa, Staphylococcus; identical to SEQ ID NO: 1825251

SEQ ID NO: 2059396 - protein, 31 aa, Staphylococcus
AHPAVHVFIATSPIHLKYKLKMSQAEVLASI

SEQ ID NO: 2059397 - protein, 17 aa, Staphylococcus
AHPRLVSGPPRPGRAHV

SEQ ID NO: 2059398 - protein, 22 aa, Staphylococcus
AHPTGRIIGKRPGYQPNIEQLM

SEQ ID NO: 2059399 - protein, 24 aa, Staphylococcus
AHPTGRIIGRRPGYEPNIEKLAQL

SEQ ID NO: 2059400 - protein, 18 aa, Staphylococcus
AHPTLFDSLVVLSDGNGL

SEQ ID NO: 2059401 - protein, 19 aa, Staphylococcus
AHPVIVGPITFVKLSKGGH

SEQ ID NO: 2059402 - protein, 33 aa, Staphylococcus
AHQDLFKHIPVKAGDFFFIPNGIVHAIGKGITV

SEQ ID NO: 2059403 - protein, 17 aa, Staphylococcus
AHQGLMNSLGHRKNILK

SEQ ID NO: 2059404 - protein, 21 aa, Staphylococcus
AHQHALLFKLPTIAVLGFGHM

SEQ ID NO: 2059405 - protein, 24 aa, Staphylococcus
AHQHQAKFIYISTISVGAVFDVHT

SEQ ID NO: 2059406 - protein, 30 aa, Staphylococcus
AHQTSIANIVLAFYLTRPALDVVIPGAKRA

SEQ ID NO: 2059407 - protein, 30 aa, Staphylococcus
AHQTSIANIVLAFYLTRPALDVVIPGAKRV

SEQ ID NO: 2059408 - protein, 23 aa, Staphylococcus
AHSFPFGVVTLKRQFFGDKDHND

SEQ ID NO: 2059409 - protein, 24 aa, Staphylococcus
AHSFPFGVVTLQRKFFDGKDHNDK

SEQ ID NO: 2059410 - protein, 17 aa, Staphylococcus
AHSKEGVKLLWASCREL

SEQ ID NO: 2059411 - protein, 19 aa, Staphylococcus
AHSLLKYNLDYILIGDTAI

SEQ ID NO: 2059412 - protein, 27 aa, Staphylococcus
AHSLSLYTCIYALYTGRTFIGQTRFNA

SEQ ID NO: 2059413 - protein, 18 aa, Staphylococcus
AHSNAMVMLPSGTRGFHA

SEQ ID NO: 2059414 - protein, 20 aa, Staphylococcus
AHSNWYEWLEQSLNLEGYDM

SEQ ID NO: 2059415 - protein, 23 aa, Staphylococcus
AHTNIALIKYWGKADEALIIPMN

SEQ ID NO: 2059416 - protein, 24 aa, Staphylococcus
AHTNIALIKYWGKADEKLIIPMNN

SEQ ID NO: 2059417 - protein, 23 aa, Staphylococcus
AHTNIALIKYWGKADENLIIPMN

SEQ ID NO: 2059418 - protein, 23 aa, Staphylococcus
AHTNIALIKYWGKADESYIIPMN

SEQ ID NO: 2059419 - protein, 23 aa, Staphylococcus
AHTNIALIKYWGKADETLIIPMN

SEQ ID NO: 2059420 - protein, 23 aa, Staphylococcus
AHTNIALIKYWGKADETYIIPMN

SEQ ID NO: 2059421 - protein, 28 aa, Staphylococcus
AHTQMFVYGLFIYNKWRGMGTLNSVDVI

SEQ ID NO: 2059422 - protein, 18 aa, Staphylococcus
AHVDWELGIVWKQGKRLS

SEQ ID NO: 2059423 - protein, 24 aa, Staphylococcus
AHVEADHFKVYWKEITQLCINEPT

SEQ ID NO: 2059424 - protein, 24 aa, Staphylococcus
AHYLFEHDAIARKILIASQPGNPL

SEQ ID NO: 2059425 - protein, 25 aa, Staphylococcus
AIAAGCDMFLFFNDLEEDFHFMLKG

SEQ ID NO: 2059426 - protein, 25 aa, Staphylococcus
AIAAKIYFRDLYGPQFKRGRYNDII

SEQ ID NO: 2059427 - protein, 24 aa, Staphylococcus
AIAHSNAMIMLPGGTRGYSQGHTV

SEQ ID NO: 2059428 - protein, 18 aa, Staphylococcus
AIAIGHELGLSYETIKDN

SEQ ID NO: 2059429 - protein, 20 aa, Staphylococcus
AIAKAYLIVEPDLSFDSSET

SEQ ID NO: 2059430 - protein, 26 aa, Staphylococcus
AIALTFNPPLTQLKQFEKNPLYTLHV

SEQ ID NO: 2059431 - protein, 18 aa, Staphylococcus
AICIGFTEVYIKLGDQIP

SEQ ID NO: 2059432 - protein, 18 aa, Staphylococcus
AIDAFGVGSFMTATKIKG

SEQ ID NO: 2059433 - protein, 29 aa, Staphylococcus
AIDAYGAGSFIVATKIKGMIAAEVSDERS

SEQ ID NO: 2059434 - protein, 27 aa, Staphylococcus
AIDFSNPELLLPLLDEDFELPLVVATT

SEQ ID NO: 2059435 - protein, 28 aa, Staphylococcus
AIDFSNPKLLLPLLDEDFELPLVIATTG

SEQ ID NO: 2059436 - protein, 29 aa, Staphylococcus
AIDFYHKYKEDIKLFAELGFKVLRISISW

SEQ ID NO: 2059437 - protein, 28 aa, Staphylococcus
AIDKGYNTIIAHHPLIFKGVKSIIDDGY

SEQ ID NO: 2059438 - protein, 18 aa, Staphylococcus
AIDTFYETFGPFYTDENL

SEQ ID NO: 2059439 - protein, 24 aa, Staphylococcus
AIDVDMYIIVSYGTKISEVANNVQ

SEQ ID NO: 2059440 - protein, 19 aa, Staphylococcus
AIDYLNTLDIVDDKRIGIL

SEQ ID NO: 2059441 - protein, 25 aa, Staphylococcus
AIDYSGYAFFWGNLVLATNAKKKYI

SEQ ID NO: 2059442 - protein, 28 aa, Staphylococcus
AIEIKDPIKLELLIAIMSFKQSSNISLS

SEQ ID NO: 2059443 - protein, 26 aa, Staphylococcus
AIEISLPYRHLHLGSELIKLSLKADE

SEQ ID NO: 2059444 - protein, 22 aa, Staphylococcus
AIEKWNIIRPPFNVTRISEYAA

SEQ ID NO: 2059445 - protein, 23 aa, Staphylococcus
AIEKWNIIRPPFNVTRISEYAAI

SEQ ID NO: 2059446 - protein, 22 aa, Staphylococcus
AIEKWNIIRPPFNVTRLSEYAA

SEQ ID NO: 2059447 - protein, 21 aa, Staphylococcus
AIELRMHGIDAKLLVLGVIPT

SEQ ID NO: 2059448 - protein, 22 aa, Staphylococcus
AIELRMHGIKAQILILGVIPIE

SEQ ID NO: 2059449 - protein, 17 aa, Staphylococcus
AIENTYPIDYDKFKRRF

SEQ ID NO: 2059450 - protein, 22 aa, Staphylococcus
AIEPPTFIVFVNDVELMHFSYK

SEQ ID NO: 2059451 - protein, 23 aa, Staphylococcus
AIERLARQILFDDQSTFTKVLAI

SEQ ID NO: 2059452 - protein, 26 aa, Staphylococcus
AIESIFKLLSTEGIIVLVIYHGHKEG

SEQ ID NO: 2059453 - protein, 22 aa, Staphylococcus
AIETIKRYHFDKVFIGMNGVDL

SEQ ID NO: 2059454 - protein, 27 aa, Staphylococcus
AIETLKEAKPYLFADNKPVGNKPADGE

SEQ ID NO: 2059455 - protein, 40 aa, Staphylococcus
AIEVFSENLKHLLLQPPMKGKQILGIDPAFRTGCKLAVIN

SEQ ID NO: 2059456 - protein, 31 aa, Staphylococcus
AIEVFSVNLKHLLLQPPLKGKQILGVDPAFR

SEQ ID NO: 2059457 - protein, 26 aa, Staphylococcus
AIEYDAIVPTQLWPTLETKMIKNLYT

SEQ ID NO: 2059458 - protein, 29 aa, Staphylococcus
AIEYDAIVPTQLWPTLETKSIKNLYTAGQ

SEQ ID NO: 2059459 - protein, 24 aa, Staphylococcus
AIFAGDLMRMYSKYAEAHNFKTEI

SEQ ID NO: 2059460 - protein, 26 aa, Staphylococcus
AIFAGDLMRMYSKYAEAYGFKTEIVE

SEQ ID NO: 2059461 - protein, 24 aa, Staphylococcus
AIFDYLSVEGIIVLVIYHGHAEGQ

SEQ ID NO: 2059462 - protein, 18 aa, Staphylococcus
AIFECQTPIISAVGHETD

SEQ ID NO: 2059463 - protein, 17 aa, Staphylococcus
AIFGTKQRRPLENGVIP

SEQ ID NO: 2059464 - protein, 18 aa, Staphylococcus
AIFSALSIRDSKIAPTIH

SEQ ID NO: 2059465 - protein, 18 aa, Staphylococcus
AIFSALSIRDSKVAPTIH

SEQ ID NO: 2059466 - protein, 19 aa, Staphylococcus
AIFSALSIRDSKVAPTIHA

SEQ ID NO: 2059467 - protein, 18 aa, Staphylococcus
AIGHLYKNKIITIESGKI

SEQ ID NO: 2059468 - protein, 17 aa, Staphylococcus
AIGKVPLTFNRVDSMSF

SEQ ID NO: 2059469 - protein, 23 aa, Staphylococcus
AIGLVHQFHSLLPANEVPERTEG

SEQ ID NO: 2059470 - protein, 22 aa, Staphylococcus
AIGVFLDYWVEREQFFEAGNCH

SEQ ID NO: 2059471 - protein, 18 aa, Staphylococcus
AIHFYEQIGFKATEHKKP

SEQ ID NO: 2059472 - protein, 18 aa, Staphylococcus
AIHHAFLQLLTETSFDKL

SEQ ID NO: 2059473 - protein, 19 aa, Staphylococcus
AIIDGSYLTRLRTGALSGI

SEQ ID NO: 2059474 - protein, 18 aa, Staphylococcus
AIIEISFTDYLRFADDYI

SEQ ID NO: 2059475 - protein, 18 aa, Staphylococcus
AIIEQLPFVMQNGAIVVF

SEQ ID NO: 2059476 - protein, 18 aa, Staphylococcus
AIILQQIHYWLNSSKHNY

SEQ ID NO: 2059477 - protein, 18 aa, Staphylococcus
AIIPKKLASELHVDLIMC

SEQ ID NO: 2059478 - protein, 20 aa, Staphylococcus
AIIVANHALLIGVLHGLNNN

SEQ ID NO: 2059479 - protein, 17 aa, Staphylococcus
AIKAYLSIAPKNTILIT

SEQ ID NO: 2059480 - protein, 21 aa, Staphylococcus
AIKDIFPMYDNVRIMGATSDH

SEQ ID NO: 2059481 - protein, 25 aa, Staphylococcus
AIKDSLKRLIMPSIEREIRGDLTEK

SEQ ID NO: 2059482 - protein, 23 aa, Staphylococcus
AIKHFYDKLFKLKDLMHTETAQA

SEQ ID NO: 2059483 - protein, 23 aa, Staphylococcus
AIKHFYEKLLKLKSLMHTSTGRK

SEQ ID NO: 2059484 - protein, 26 aa, Staphylococcus
AIKKEDIVFIYNNKYLGLYPFNYSFD

SEQ ID NO: 2059485 - protein, 20 aa, Staphylococcus
AIKKGKFAVLLMAGGQGTRL

SEQ ID NO: 2059486 - protein, 26 aa, Staphylococcus
AIKKTFANLPVIRQCNVMTMATLNTI

SEQ ID NO: 2059487 - protein, 36 aa, Staphylococcus
AIKKVERCAPWPPSEDFAYYAKELPSAFIFAGAEPE

SEQ ID NO: 2059488 - protein, 18 aa, Staphylococcus
AIKLLKKFSTVENVYNHI

SEQ ID NO: 2059489 - protein, 18 aa, Staphylococcus
AIKLLKQFTSVEGVYEHI

SEQ ID NO: 2059490 - protein, 26 aa, Staphylococcus
AIKLSSSWSFLVPEILQIDEDKIQSF

SEQ ID NO: 2059491 - protein, 23 aa, Staphylococcus
AIKNAFIHLLEEKDLDHITVSDI

SEQ ID NO: 2059492 - protein, 30 aa, Staphylococcus
AIKPVPHRSFLDKTLKRKAVWDKWMEKDMN

SEQ ID NO: 2059493 - protein, 32 aa, Staphylococcus
AIKVTQTNIPLYLYLSVLGMTGQTAYHGLLKI

SEQ ID NO: 2059494 - protein, 19 aa, Staphylococcus
AILDITGPLGDHIHFANSA

SEQ ID NO: 2059495 - protein, 23 aa, Staphylococcus
AILEELKLPYRRVNLCTGDIGFS

SEQ ID NO: 2059496 - protein, 19 aa, Staphylococcus
AILHAIVRLNYGCTHFIVG

SEQ ID NO: 2059497 - protein, 19 aa, Staphylococcus
AILKGLRDRYEAHHRINIS

SEQ ID NO: 2059498 - protein, 34 aa, Staphylococcus
AILKNYFPKDRARLVIYPAAMRYAGPREAILHAT

SEQ ID NO: 2059499 - protein, 17 aa, Staphylococcus
AILNCHDGKLTKIKKEL

SEQ ID NO: 2059500 - protein, 18 aa, Staphylococcus
AILQVESIIKKPVVIDDM

SEQ ID NO: 2059501 - protein, 18 aa, Staphylococcus
AILYNYNIFKTLQSDKLV

SEQ ID NO: 2059502 - protein, 25 aa, Staphylococcus
AIMAAFHFDVPCLFAKKAKPSTLKD

SEQ ID NO: 2059503 - protein, 27 aa, Staphylococcus
AIMAALHFQVPCLFAKKAKPSTLKDGF

SEQ ID NO: 2059504 - protein, 26 aa, Staphylococcus
AIMASIIYIEILRQIAIGYSFKVSVE

SEQ ID NO: 2059505 - protein, 22 aa, Staphylococcus
AIMFGIIYQFIVANEILRSNFN

SEQ ID NO: 2059506 - protein, 19 aa, Staphylococcus
AIMGGYVLTPEIFDYLETQ

SEQ ID NO: 2059507 - protein, 19 aa, Staphylococcus
AIMGRYVLSPQIFNYLENQ

SEQ ID NO: 2059508 - protein, 26 aa, Staphylococcus
AINDFGIEVVVLKPFRLGGIDKVMDL

SEQ ID NO: 2059509 - protein, 19 aa, Staphylococcus
AINFFNYLSGYSLKPHYNE

SEQ ID NO: 2059510 - protein, 18 aa, Staphylococcus
AINFPTQQWVFPIQTHEN

SEQ ID NO: 2059511 - protein, 33 aa, Staphylococcus
AINLMLRDKAPFKKALLFAPLYPIDASTSKDMS

SEQ ID NO: 2059512 - protein, 23 aa, Staphylococcus
AINTLIEFIQKIKEKYDDIKKNE

SEQ ID NO: 2059513 - protein, 18 aa, Staphylococcus
AIPGTPPDLLHPPKGDAF

SEQ ID NO: 2059514 - protein, 24 aa, Staphylococcus
AIPQIVALFDLKDAIRRLNDCQTK

SEQ ID NO: 2059515 - protein, 20 aa, Staphylococcus
AIQAFVPFADIIKISDEELS

SEQ ID NO: 2059516 - protein, 26 aa, Staphylococcus
AIQENTVCYLWLDIQLNDVDRTRIEN

SEQ ID NO: 2059517 - protein, 26 aa, Staphylococcus
AIQERRPVHLHLPIDVALAEIEVSET

SEQ ID NO: 2059518 - protein, 18 aa, Staphylococcus
AIQKGYCLLVGIGKNSTE

SEQ ID NO: 2059519 - protein, 23 aa, Staphylococcus
AIQKSILVNLIKCVESCGVDVLD

SEQ ID NO: 2059520 - protein, 17 aa, Staphylococcus
AIQNVLRHPTGSKPLKE

SEQ ID NO: 2059521 - protein, 26 aa, Staphylococcus
AIQPILIKNQALMQGFLVFQFEKNFD

SEQ ID NO: 2059522 - protein, 19 aa, Staphylococcus
AIQQPIFVSLYAPIENNKE

SEQ ID NO: 2059523 - protein, 17 aa, Staphylococcus
AIQRYQIQMPRFRAMLL

SEQ ID NO: 2059524 - protein, 17 aa, Staphylococcus
AIQWLFQGHVQAVIYTK

SEQ ID NO: 2059525 - protein, 30 aa, Staphylococcus
AIRDVATKAWYNTYLNIYAASTINELLAAS

SEQ ID NO: 2059526 - protein, 20 aa, Staphylococcus
AIRKAFELYGDDIAGVIVEP

SEQ ID NO: 2059527 - protein, 20 aa, Staphylococcus
AIRLYEKLGFKRYGREPKSI

SEQ ID NO: 2059528 - protein, 28 aa, Staphylococcus
AISKGYNTIIAHHPLIFKGIKSLVNDGY

SEQ ID NO: 2059529 - protein, 21 aa, Staphylococcus
AISNLLLVTGNYRKPGAGAYP

SEQ ID NO: 2059530 - protein, 22 aa, Staphylococcus
AISNLLLVTGNYRKPGCGAYPL

SEQ ID NO: 2059531 - protein, 21 aa, Staphylococcus
AISNLLLVTGNYRKPGTGAYP

SEQ ID NO: 2059532 - protein, 23 aa, Staphylococcus
AISNLLLVTGNYRRPGTGAYPLR

SEQ ID NO: 2059533 - protein, 24 aa, Staphylococcus
AITDALKGIAWFWHTTFNHQTESP

SEQ ID NO: 2059534 - protein, 25 aa, Staphylococcus
AITDTLKGVAWFWNTTYSHRTESPR

SEQ ID NO: 2059535 - protein, 23 aa, Staphylococcus
AITEYYFKQPLLDWLNHYPGSNK

SEQ ID NO: 2059536 - protein, 25 aa, Staphylococcus
AITVPQDRLKLRKQIKQLAAIYLAS

SEQ ID NO: 2059537 - protein, 34 aa, Staphylococcus; identical to SEQ ID NO: 1823944

SEQ ID NO: 2059538 - protein, 33 aa, Staphylococcus; identical to SEQ ID NO: 1825294

SEQ ID NO: 2059539 - protein, 17 aa, Staphylococcus
AITYMKCSFFNDNIESF

SEQ ID NO: 2059540 - protein, 21 aa, Staphylococcus
AITYPELYIMQAEAIIESALE

SEQ ID NO: 2059541 - protein, 24 aa, Staphylococcus
AIVEYIVPHYTNQTFWLSVTVNED

SEQ ID NO: 2059542 - protein, 17 aa, Staphylococcus
AIVISRSETYKKVLFMP

SEQ ID NO: 2059543 - protein, 20 aa, Staphylococcus
AIVMSRIPRVVYGAVDPKGG

SEQ ID NO: 2059544 - protein, 20 aa, Staphylococcus
AIVRPQIISGTHAITLALQS

SEQ ID NO: 2059545 - protein, 18 aa, Staphylococcus
AIVSLILCATACYHFRRS

SEQ ID NO: 2059546 - protein, 18 aa, Staphylococcus
AIVTLQLYRLTNTDIVQL

SEQ ID NO: 2059547 - protein, 17 aa, Staphylococcus
AIVVSRFNDFITGRLLE

SEQ ID NO: 2059548 - protein, 17 aa, Staphylococcus
AIVVSRFNDFITNRLLD

SEQ ID NO: 2059549 - protein, 18 aa, Staphylococcus
AIWEGLLEYDVTPCGLGA

SEQ ID NO: 2059550 - protein, 17 aa, Staphylococcus
AIYANMLKLIKNPDFAV

SEQ ID NO: 2059551 - protein, 20 aa, Staphylococcus
AIYDVPVGEVWPLDKIKALK

SEQ ID NO: 2059552 - protein, 21 aa, Staphylococcus
AIYDVPVGEVWPLDKIKALKQ

SEQ ID NO: 2059553 - protein, 19 aa, Staphylococcus
AIYEGILKDLPQVMKEQGH

SEQ ID NO: 2059554 - protein, 17 aa, Staphylococcus
AIYIPKDGQINANHYTK

SEQ ID NO: 2059555 - protein, 18 aa, Staphylococcus
AIYKDKIEIIPIIADVQN

SEQ ID NO: 2059556 - protein, 19 aa, Staphylococcus
AIYLSRYEYSVFKDIFYDK

SEQ ID NO: 2059557 - protein, 18 aa, Staphylococcus
AIYNCQTPIISAVGHETD

SEQ ID NO: 2059558 - protein, 18 aa, Staphylococcus
AIYNQFVFDLGVIGNHEF

SEQ ID NO: 2059559 - protein, 20 aa, Staphylococcus
AIYNYPTHQTFFSSSDKLSI

SEQ ID NO: 2059560 - protein, 18 aa, Staphylococcus
AIYSARQFIGDEPFAVLL

SEQ ID NO: 2059561 - protein, 17 aa, Staphylococcus
AIYSCNTPIISAVGHET

SEQ ID NO: 2059562 - protein, 36 aa, Staphylococcus
AIYTHPINNFILNGITRRVIKWIAEDYGIPFKEETF

SEQ ID NO: 2059563 - protein, 34 aa, Staphylococcus
AKADCGEVTVISKAFWPEFFEHSYPGIKLITKDY

SEQ ID NO: 2059564 - protein, 22 aa, Staphylococcus
AKAEHLLQYAQLGNIYAQKIRG

SEQ ID NO: 2059565 - protein, 23 aa, Staphylococcus
AKAEHLLQYAQLGNIYAQKIRGI

SEQ ID NO: 2059566 - protein, 20 aa, Staphylococcus
AKAESVAICWAMGITQQDIG

SEQ ID NO: 2059567 - protein, 20 aa, Staphylococcus
AKAFIDCKNTYFLHDKVNVV

SEQ ID NO: 2059568 - protein, 20 aa, Staphylococcus
AKAFKVPFKAIGKAVIENVT

SEQ ID NO: 2059569 - protein, 27 aa, Staphylococcus
AKAHELKPDLILMDLLMDDMDGVEATT

SEQ ID NO: 2059570 - protein, 25 aa, Staphylococcus
AKAISTLFNWLNQYQFDYCKINEVY

SEQ ID NO: 2059571 - protein, 22 aa, Staphylococcus
AKALFDLNKNILLKGPTGSGKT

SEQ ID NO: 2059572 - protein, 22 aa, Staphylococcus
AKALFNLNKNILLKGPTGSGKT

SEQ ID NO: 2059573 - protein, 21 aa, Staphylococcus
AKAMGYDWNYTHPSQIMDEIA

SEQ ID NO: 2059574 - protein, 23 aa, Staphylococcus
AKAMLYMPCVDLKQQLGTVKITS

SEQ ID NO: 2059575 - protein, 21 aa, Staphylococcus
AKANIIIVHGVAEHLDRYDEI

SEQ ID NO: 2059576 - protein, 26 aa, Staphylococcus
AKAQSKKFFELYTPLLKEGGVVITDN

SEQ ID NO: 2059577 - protein, 26 aa, Staphylococcus
AKAQSKKFFELYTPLLREGGIVITDN

SEQ ID NO: 2059578 - protein, 30 aa, Staphylococcus
AKAQSKKFFELYTPLLRKGGIVVTDNVLYH

SEQ ID NO: 2059579 - protein, 26 aa, Staphylococcus
AKAQSRKFFELYTPLLNNGGIVITDN

SEQ ID NO: 2059580 - protein, 18 aa, Staphylococcus
AKAYLKHVNPKVIGVTGS

SEQ ID NO: 2059581 - protein, 23 aa, Staphylococcus
AKDAMINAVLLGQQFNALLPQNE

SEQ ID NO: 2059582 - protein, 28 aa, Staphylococcus
AKDDTTMPAFWFDPIVNLTAISQVTNHV

SEQ ID NO: 2059583 - protein, 25 aa, Staphylococcus
AKDFALWRSEYHNCPLILGSATPSL

SEQ ID NO: 2059584 - protein, 26 aa, Staphylococcus
AKDFANIFFMMLNYYSIERSMEIAKE

SEQ ID NO: 2059585 - protein, 25 aa, Staphylococcus
AKDLDIGFISLYRALGDFNTTNSNG

SEQ ID NO: 2059586 - protein, 19 aa, Staphylococcus
AKDLLGVKLIFDDGENQFS

SEQ ID NO: 2059587 - protein, 30 aa, Staphylococcus
AKDQQIYYEVFPFSGKRMILNEDYDWITKM

SEQ ID NO: 2059588 - protein, 18 aa, Staphylococcus
AKDTYQEWYLGKDLFNKV

SEQ ID NO: 2059589 - protein, 33 aa, Staphylococcus
AKEALLPYFINGENTIFSELLRFAGIGESKVET

SEQ ID NO: 2059590 - protein, 25 aa, Staphylococcus
AKECLELYINAYRLAERYSNVATNC

SEQ ID NO: 2059591 - protein, 25 aa, Staphylococcus
AKEFKFFKEGQVIWGFQHLASSKET

SEQ ID NO: 2059592 - protein, 24 aa, Staphylococcus
AKEGKDFHMFAPHTIYKEYGLTLD

SEQ ID NO: 2059593 - protein, 20 aa, Staphylococcus
AKEILLSLPNDFDREVQTEL

SEQ ID NO: 2059594 - protein, 42 aa, Staphylococcus
AKEIVRFHSIIWPILLMALDIPLPKKVFAHGWILMKDGKMSK

SEQ ID NO: 2059595 - protein, 42 aa, Staphylococcus
AKEIVRFHSIVWPILLMALDLPLPKRVFAHGWILMKDGKMSK

SEQ ID NO: 2059596 - protein, 24 aa, Staphylococcus
AKEKDILNLFSYTGAFSVVAAQNA

SEQ ID NO: 2059597 - protein, 22 aa, Staphylococcus
AKELFEEYGAISAPIHDENFPG

SEQ ID NO: 2059598 - protein, 21 aa, Staphylococcus
AKELGLIPKLRFVDSEVAGVN

SEQ ID NO: 2059599 - protein, 24 aa, Staphylococcus
AKELRGVVDSLITLGKKGDLASRR

SEQ ID NO: 2059600 - protein, 19 aa, Staphylococcus
AKENLTFFGNLKGLSGKKL

SEQ ID NO: 2059601 - protein, 25 aa, Staphylococcus
AKESLTLYINAYRLAEKYSNIATNC

SEQ ID NO: 2059602 - protein, 20 aa, Staphylococcus
AKFDLALHRMLSGEPIQYIV

SEQ ID NO: 2059603 - protein, 19 aa, Staphylococcus
AKFIQSVIEVLKALDVDQS

SEQ ID NO: 2059604 - protein, 17 aa, Staphylococcus
AKFSILMLLSYEENMTL

SEQ ID NO: 2059605 - protein, 33 aa, Staphylococcus
AKGANKRIEFYRLYLLMVHLVKFGNMYAGSVNR

SEQ ID NO: 2059606 - protein, 24 aa, Staphylococcus
AKGATYYGIAMGLLHISKAILRNQ

SEQ ID NO: 2059607 - protein, 31 aa, Staphylococcus
AKGIKCVMIAKLPFMNKYNTKHWLMDSEFDS

SEQ ID NO: 2059608 - protein, 17 aa, Staphylococcus
AKGISIYYISKRLGHKN

SEQ ID NO: 2059609 - protein, 25 aa, Staphylococcus
AKGIVWLAQYNQVACLLSQAGSSCN

SEQ ID NO: 2059610 - protein, 26 aa, Staphylococcus
AKGLDIIGLINIQFVLAHDGVYVLEV

SEQ ID NO: 2059611 - protein, 27 aa, Staphylococcus
AKGLKLYDVFTVLYLLDPESYETILAS

SEQ ID NO: 2059612 - protein, 26 aa, Staphylococcus
AKGLNIVGLINIQFVIAHDGVYVLEV

SEQ ID NO: 2059613 - protein, 30 aa, Staphylococcus
AKGQLAAYITPRLQPWDFAGGLIVLNEVGG

SEQ ID NO: 2059614 - protein, 25 aa, Staphylococcus
AKGQLAAYLTPRLQPWDFAGGLMIL

SEQ ID NO: 2059615 - protein, 27 aa, Staphylococcus
AKGSTYYGIALALMRISKAILNNENNV

SEQ ID NO: 2059616 - protein, 24 aa, Staphylococcus
AKHEALIKGKRYPIRALMMSHMFV

SEQ ID NO: 2059617 - protein, 21 aa, Staphylococcus
AKHEIFLAQHGMEIDLGAIAK

SEQ ID NO: 2059618 - protein, 20 aa, Staphylococcus
AKHHDLVRMLLMNQDGFITE

SEQ ID NO: 2059619 - protein, 26 aa, Staphylococcus
AKHKHYIIVTLWQSRQAFYDWQKSSA

SEQ ID NO: 2059620 - protein, 24 aa, Staphylococcus
AKIIKKRMLVFGNGPNIEMFEFAN

SEQ ID NO: 2059621 - protein, 22 aa, Staphylococcus
AKIKEFKLLSTAGAYWRGDSNN

SEQ ID NO: 2059622 - protein, 23 aa, Staphylococcus
AKILEIENLLQRKPKALSGGQRQ

SEQ ID NO: 2059623 - protein, 19 aa, Staphylococcus
AKIPLVVRTVHGAGAGAAA

SEQ ID NO: 2059624 - protein, 17 aa, Staphylococcus
AKIPLVVRTVHGAGASA

SEQ ID NO: 2059625 - protein, 17 aa, Staphylococcus
AKIPVIHTLPAKTVLPD

SEQ ID NO: 2059626 - protein, 17 aa, Staphylococcus
AKKAGASIILLIVNVLT

SEQ ID NO: 2059627 - protein, 23 aa, Staphylococcus
AKKEAIVFACDRVIKGELDEHFP

SEQ ID NO: 2059628 - protein, 17 aa, Staphylococcus
AKKIGYPVIIKATAGGG

SEQ ID NO: 2059629 - protein, 17 aa, Staphylococcus
AKKLLPNDDIQSRGLFA

SEQ ID NO: 2059630 - protein, 26 aa, Staphylococcus
AKKLNLRAVIFMPVTTPLQKINQVQF

SEQ ID NO: 2059631 - protein, 18 aa, Staphylococcus
AKKLWDSGKFLVGFGGEH

SEQ ID NO: 2059632 - protein, 20 aa, Staphylococcus
AKKRALEILNMVGLPNAKER

SEQ ID NO: 2059633 - protein, 26 aa, Staphylococcus
AKKSIYIQTPYFIPDNSYINALKMAA

SEQ ID NO: 2059634 - protein, 25 aa, Staphylococcus
AKKVKVLARGPVFKGLLTSNSNQAL

SEQ ID NO: 2059635 - protein, 25 aa, Staphylococcus
AKKVLILATNLPISTPYKLEDAIKE

SEQ ID NO: 2059636 - protein, 27 aa, Staphylococcus
AKKVPSTIVYLPEYIRTLKGGFKDGSY

SEQ ID NO: 2059637 - protein, 28 aa, Staphylococcus
AKKYIDIKGYILYQLYGKYVMDYSIGSA

SEQ ID NO: 2059638 - protein, 22 aa, Staphylococcus
AKLGWLPSYPQFNKNSLLFAEE

SEQ ID NO: 2059639 - protein, 26 aa, Staphylococcus
AKLINDYPNRFGAFATLPLPDVEGAI

SEQ ID NO: 2059640 - protein, 24 aa, Staphylococcus
AKLPKVFHYFKEAHPYFDQNVVII

SEQ ID NO: 2059641 - protein, 18 aa, Staphylococcus
AKLQDFLKDLKFYQEFSL

SEQ ID NO: 2059642 - protein, 29 aa, Staphylococcus
AKLRYHKVGNGPLLILIPGANGTGDIFMP

SEQ ID NO: 2059643 - protein, 25 aa, Staphylococcus
AKLRYHQIGQGPVLIFIPGTNGTGD

SEQ ID NO: 2059644 - protein, 24 aa, Staphylococcus
AKLYILGEGLLRKALEDMIKRLKL

SEQ ID NO: 2059645 - protein, 28 aa, Staphylococcus
AKMRVAVRRLLKKYGYPPDLQKMAVEQV

SEQ ID NO: 2059646 - protein, 24 aa, Staphylococcus
AKNKARLFMIYYEETMIGTIDLHH

SEQ ID NO: 2059647 - protein, 23 aa, Staphylococcus
AKNKMFNLIYAYNGIKKNFKVVE

SEQ ID NO: 2059648 - protein, 17 aa, Staphylococcus
AKNLQFVTHMYGSPGFS

SEQ ID NO: 2059649 - protein, 18 aa, Staphylococcus
AKNMFRILKQYKHTGYVK

SEQ ID NO: 2059650 - protein, 27 aa, Staphylococcus
AKNVDFTFDYLIPERLAPIIQVGVRVI

SEQ ID NO: 2059651 - protein, 22 aa, Staphylococcus
AKPLEFLHAILPTKVFDKMTKA

SEQ ID NO: 2059652 - protein, 17 aa, Staphylococcus
AKPLKTVMLLHGLSSDA

SEQ ID NO: 2059653 - protein, 21 aa, Staphylococcus
AKPPVARIMDYGKYKFEQQKK

SEQ ID NO: 2059654 - protein, 22 aa, Staphylococcus
AKQDFLLPHLENGKIILIGATT

SEQ ID NO: 2059655 - protein, 22 aa, Staphylococcus
AKQIDIHNITGRATLEAVINSN

SEQ ID NO: 2059656 - protein, 25 aa, Staphylococcus
AKQISMGLIFSLMDGIEYLKAHAQN

SEQ ID NO: 2059657 - protein, 26 aa, Staphylococcus
AKQKAGYYVALYIAYEAAPYFNSQMS

SEQ ID NO: 2059658 - protein, 26 aa, Staphylococcus
AKQKYSFQDLPQFTPEIFMKVSAKNV

SEQ ID NO: 2059659 - protein, 23 aa, Staphylococcus
AKQLKPYFYNIKINDVYVSDLTR

SEQ ID NO: 2059660 - protein, 33 aa, Staphylococcus
AKQLNELLPTLTPEQKLWLSGYLTASQQAETNE

SEQ ID NO: 2059661 - protein, 26 aa, Staphylococcus
AKQMSQFIFAYILDDYKKMAVSRRNQ

SEQ ID NO: 2059662 - protein, 25 aa, Staphylococcus
AKQTKWFPVIGQAVSASISYYFMNK

SEQ ID NO: 2059663 - protein, 23 aa, Staphylococcus
AKQVIHATKYFTLAESLGAVESL

SEQ ID NO: 2059664 - protein, 25 aa, Staphylococcus
AKQVKLLARGPVFKGLLTANSIDVL

SEQ ID NO: 2059665 - protein, 19 aa, Staphylococcus
AKQVLLIDRIQDPGNLGTL

SEQ ID NO: 2059666 - protein, 20 aa, Staphylococcus
AKQVLLLDRIQDPGNLGTLI

SEQ ID NO: 2059667 - protein, 28 aa, Staphylococcus
AKRDIQFDVIFLDPPYKKGLIDEAIERI

SEQ ID NO: 2059668 - protein, 28 aa, Staphylococcus
AKREIQFDVIFLDPPYEKGLIDEALEGI

SEQ ID NO: 2059669 - protein, 22 aa, Staphylococcus
AKREISLWFEPNELSVYTANDE

SEQ ID NO: 2059670 - protein, 19 aa, Staphylococcus
AKRFNDWLEQIPNNIVRAK

SEQ ID NO: 2059671 - protein, 28 aa, Staphylococcus
AKRIDFIQIYKNNLFYRAFKSEKELFQY

SEQ ID NO: 2059672 - protein, 26 aa, Staphylococcus
AKRKGLEPLAKWLLHKNLDKNVDEKA

SEQ ID NO: 2059673 - protein, 17 aa, Staphylococcus
AKRLLDFGVHPPTIYFP

SEQ ID NO: 2059674 - protein, 25 aa, Staphylococcus
AKRPFLDKALDRKAVWDKWMEQDLN

SEQ ID NO: 2059675 - protein, 23 aa, Staphylococcus
AKRVFNMTPYKVQVMGGIAIHKG

SEQ ID NO: 2059676 - protein, 30 aa, Staphylococcus
AKSIKLHGILQPIVLRKTISGYHIVVGERR

SEQ ID NO: 2059677 - protein, 33 aa, Staphylococcus
AKSLCDIYPLLNRSLLYSGIILHDIGKVKELSG

SEQ ID NO: 2059678 - protein, 31 aa, Staphylococcus
AKSLCNIYPLLNRSLLYSSIILHDLGKVREL

SEQ ID NO: 2059679 - protein, 34 aa, Staphylococcus
AKSPMWVEYEFQLNKKYFKIIRQGAFTKEGNTSQ

SEQ ID NO: 2059680 - protein, 23 aa, Staphylococcus
AKSWMLKALEPMGEEYLNVVKEG

SEQ ID NO: 2059681 - protein, 22 aa, Staphylococcus
AKTIIRGLRAVSDFEYELRLTS

SEQ ID NO: 2059682 - protein, 23 aa, Staphylococcus
AKTIIRGLRAVSDFEYELRLTSM

SEQ ID NO: 2059683 - protein, 25 aa, Staphylococcus
AKTLMLTINLDNIAFMPCNPSVGGP

SEQ ID NO: 2059684 - protein, 25 aa, Staphylococcus
AKTLMLTINLDNVGFMPCNPSVGGP

SEQ ID NO: 2059685 - protein, 18 aa, Staphylococcus
AKTRGLIAAEYIIDEIVN

SEQ ID NO: 2059686 - protein, 21 aa, Staphylococcus
AKTRKILDDYGIKYDQIIVRG

SEQ ID NO: 2059687 - protein, 24 aa, Staphylococcus
AKVERVAILKPYRKDGYGKTMMHA

SEQ ID NO: 2059688 - protein, 23 aa, Staphylococcus
AKVFFSSLGFENLGFEKNASKIG

SEQ ID NO: 2059689 - protein, 19 aa, Staphylococcus
AKWFLQDVEVLINGSRETR

SEQ ID NO: 2059690 - protein, 27 aa, Staphylococcus
AKWGERSGLTLFLPHAFEGQGPEHSSA

SEQ ID NO: 2059691 - protein, 27 aa, Staphylococcus
AKWGERSGLTLFLPHSFEGQGPEHSSA

SEQ ID NO: 2059692 - protein, 27 aa, Staphylococcus
AKWGERSGLTLFLPHSYEGQGAEHSSA

SEQ ID NO: 2059693 - protein, 23 aa, Staphylococcus
AKYLGLDFVLFGHVFETSSKPQQ

SEQ ID NO: 2059694 - protein, 29 aa, Staphylococcus
ALAGSILKMNTGLKNLINFTGDTLDHLWR

SEQ ID NO: 2059695 - protein, 19 aa, Staphylococcus
ALALLRLYQIDQQPQWIKT

SEQ ID NO: 2059696 - protein, 17 aa, Staphylococcus
ALAMALAHDTKLLILDE

SEQ ID NO: 2059697 - protein, 24 aa, Staphylococcus
ALAMHPDVLLFDEPTSALDPEVVG

SEQ ID NO: 2059698 - protein, 20 aa, Staphylococcus
ALAMSILDHVRDIGSLVMAT

SEQ ID NO: 2059699 - protein, 23 aa, Staphylococcus
ALANDITYTLDYVKGYLPVHNHP

SEQ ID NO: 2059700 - protein, 21 aa, Staphylococcus
ALANKEPIHFQWKPGFVVGVM

SEQ ID NO: 2059701 - protein, 26 aa, Staphylococcus
ALAPYKAAVLPLSKKLSGDAIKVFEE

SEQ ID NO: 2059702 - protein, 26 aa, Staphylococcus
ALAPYKAAVLPLSKKLSGEAIKIFED

SEQ ID NO: 2059703 - protein, 26 aa, Staphylococcus
ALAPYKAAVLPLSKKLSSEAIKIFEQ

SEQ ID NO: 2059704 - protein, 34 aa, Staphylococcus
ALAQGQRGLFIVPLNGFKKWLTPVDMWKNHQMTL

SEQ ID NO: 2059705 - protein, 18 aa, Staphylococcus
ALARLLDVWEMQPSELMA

SEQ ID NO: 2059706 - protein, 20 aa, Staphylococcus
ALCSFASRIPYGEPLSISKI

SEQ ID NO: 2059707 - protein, 17 aa, Staphylococcus
ALDDFILDTYQPNIKAF

SEQ ID NO: 2059708 - protein, 31 aa, Staphylococcus
ALDFDDLIMVTIRLFERVPDVLDYYQNKFQY

SEQ ID NO: 2059709 - protein, 23 aa, Staphylococcus
ALDIDFKTPPPWYQVSPTHFAKS

SEQ ID NO: 2059710 - protein, 20 aa, Staphylococcus
ALDKFRTFLSNQGGNPEVVD

SEQ ID NO: 2059711 - protein, 19 aa, Staphylococcus
ALDPYSLNYYIIEVNPRVS

SEQ ID NO: 2059712 - protein, 19 aa, Staphylococcus
ALDRAHILEGLRIALDHID

SEQ ID NO: 2059713 - protein, 27 aa, Staphylococcus
ALDTLSRYCFDKAFLGMNGLDLKYGLT

SEQ ID NO: 2059714 - protein, 20 aa, Staphylococcus
ALDYIGLSYLTLNRVTTTLS

SEQ ID NO: 2059715 - protein, 22 aa, Staphylococcus
ALDYIVIDQFAERGVYQRYALS

SEQ ID NO: 2059716 - protein, 33 aa, Staphylococcus
ALDYLINGSNFTTGWIFFINKKGEQELVASTDL

SEQ ID NO: 2059717 - protein, 17 aa, Staphylococcus
ALEFHYDLMNDKSRGVR

SEQ ID NO: 2059718 - protein, 22 aa, Staphylococcus
ALEGVLYNLYTVYLALVEVMNE

SEQ ID NO: 2059719 - protein, 20 aa, Staphylococcus
ALEIGYVKINFDGGSEYIAV

SEQ ID NO: 2059720 - protein, 17 aa, Staphylococcus
ALEILGLNKEDVAMVGD

SEQ ID NO: 2059721 - protein, 43 aa, Staphylococcus
ALEKEDFILPGYRDVPQIIWHGLPLTEAFLFSRGHFKGNQFPE

SEQ ID NO: 2059722 - protein, 43 aa, Staphylococcus
ALEKEDFILPGYRDVPQLIWHGLPLTDAFLFSRGHFKGNQFPE

SEQ ID NO: 2059723 - protein, 43 aa, Staphylococcus
ALEKGDWILPGYRDVPQLIWHGLPLTEAFLFSRGHFKGNQMPE

SEQ ID NO: 2059724 - protein, 20 aa, Staphylococcus
ALELGAQKIILGIGGSATND

SEQ ID NO: 2059725 - protein, 20 aa, Staphylococcus
ALELLYNRRFQVDKAVILAA

SEQ ID NO: 2059726 - protein, 19 aa, Staphylococcus
ALEMRLSDKDLSRLARRGS

SEQ ID NO: 2059727 - protein, 22 aa, Staphylococcus
ALENDVPLLEYLEELASNINVE

SEQ ID NO: 2059728 - protein, 44 aa, Staphylococcus
ALEQEDFILPGYRDVPQLIWQGLPLTEAFLFSRGHFKGNRMPEG

SEQ ID NO: 2059729 - protein, 21 aa, Staphylococcus
ALEQLVEWLENLPQSIYRVKG

SEQ ID NO: 2059730 - protein, 18 aa, Staphylococcus
ALESVDGLLLNPLVGETK

SEQ ID NO: 2059731 - protein, 20 aa, Staphylococcus
ALETGEIFDYFPIPNSQENN

SEQ ID NO: 2059732 - protein, 24 aa, Staphylococcus
ALETPINVEVLPDAIKLLTFPDQN

SEQ ID NO: 2059733 - protein, 19 aa, Staphylococcus
ALETVDGLLLNPLVGETKA

SEQ ID NO: 2059734 - protein, 19 aa, Staphylococcus
ALEYSFVEALVKLDVNVTG

SEQ ID NO: 2059735 - protein, 19 aa, Staphylococcus
ALFELNKNILLKGPTGSGK

SEQ ID NO: 2059736 - protein, 22 aa, Staphylococcus
ALFILGETLYNFGLTPQGLEVF

SEQ ID NO: 2059737 - protein, 19 aa, Staphylococcus
ALFKGTELKHFIPREHIEG

SEQ ID NO: 2059738 - protein, 18 aa, Staphylococcus
ALFNYLYAKHYDGDFIVR

SEQ ID NO: 2059739 - protein, 17 aa, Staphylococcus
ALFQTSFSYRIIGSCGL

SEQ ID NO: 2059740 - protein, 27 aa, Staphylococcus
ALGADAIMLITPYYNKTNQRGLVKHFE

SEQ ID NO: 2059741 - protein, 26 aa, Staphylococcus
ALGERALKYIIPDTSDFPYTVRIVSE

SEQ ID NO: 2059742 - protein, 26 aa, Staphylococcus
ALGERALKYIIPDTTEFPYTVRIVSE

SEQ ID NO: 2059743 - protein, 26 aa, Staphylococcus
ALGERALRYIIPDTTEFPYTIRIVSE

SEQ ID NO: 2059744 - protein, 20 aa, Staphylococcus
ALGITRFMLHTPVGSIPHER

SEQ ID NO: 2059745 - protein, 18 aa, Staphylococcus
ALGKIPFNIEGIDSLSLS

SEQ ID NO: 2059746 - protein, 25 aa, Staphylococcus
ALGLDRFVMLLAGRNNLRDTIAFPK

SEQ ID NO: 2059747 - protein, 20 aa, Staphylococcus
ALGLPITYAIIGGDPKRFKR

SEQ ID NO: 2059748 - protein, 17 aa, Staphylococcus
ALGNMMTSAALLGIDSC

SEQ ID NO: 2059749 - protein, 25 aa, Staphylococcus
ALGPDPFPTIVRDFQKIIGQEIKAQ

SEQ ID NO: 2059750 - protein, 18 aa, Staphylococcus
ALGPIQRGGAGGGIAAVL

SEQ ID NO: 2059751 - protein, 25 aa, Staphylococcus
ALGQFDVIIGRRVLMYLPDVPKALR

SEQ ID NO: 2059752 - protein, 22 aa, Staphylococcus
ALGREILLDYNFISKIQEGKED

SEQ ID NO: 2059753 - protein, 26 aa, Staphylococcus
ALHKDKIIGHILLSKIFIVKGEKSIE

SEQ ID NO: 2059754 - protein, 18 aa, Staphylococcus
ALIAGLISIGAEVMRLGV

SEQ ID NO: 2059755 - protein, 19 aa, Staphylococcus
ALIETPLFELDHHDIFSNL

SEQ ID NO: 2059756 - protein, 25 aa, Staphylococcus
ALIHDQFDHYLLNDLPHFKDQSPST

SEQ ID NO: 2059757 - protein, 26 aa, Staphylococcus
ALIITHYQRLLNYITPDQVHVMYGGK

SEQ ID NO: 2059758 - protein, 26 aa, Staphylococcus
ALIITPNHQYLITDFRYIEQAKEQAS

SEQ ID NO: 2059759 - protein, 19 aa, Staphylococcus
ALINAAEAWALNRHIRRLE

SEQ ID NO: 2059760 - protein, 23 aa, Staphylococcus
ALINACWLANVEIAMLNTRLTET

SEQ ID NO: 2059761 - protein, 20 aa, Staphylococcus
ALISERLDIPVIGIGAGKGT

SEQ ID NO: 2059762 - protein, 20 aa, Staphylococcus
ALISLENLLLNRNPYEHEVQ

SEQ ID NO: 2059763 - protein, 27 aa, Staphylococcus
ALITGYDIIFFWVARMIFQGLEFTERR

SEQ ID NO: 2059764 - protein, 32 aa, Staphylococcus
ALITHLWSGNIPGLPLWSFISSLLVKSGSICK

SEQ ID NO: 2059765 - protein, 22 aa, Staphylococcus
ALKALIKAYGLDANISVPALFD

SEQ ID NO: 2059766 - protein, 28 aa, Staphylococcus
ALKDAISHPIFISLYIPIENEKEWLGIL

SEQ ID NO: 2059767 - protein, 24 aa, Staphylococcus
ALKDFGFNIIIAGGFSDIFYMNCT

SEQ ID NO: 2059768 - protein, 25 aa, Staphylococcus
ALKDSDVLVCTVIGFPLGANTSATK

SEQ ID NO: 2059769 - protein, 29 aa, Staphylococcus
ALKDYNVPDFCQLIFITTPDKLHSEEEKI

SEQ ID NO: 2059770 - protein, 29 aa, Staphylococcus
ALKDYNVPDFCQLIFITTPNKLKEDKGKI

SEQ ID NO: 2059771 - protein, 20 aa, Staphylococcus
ALKEFPMLNSSWQGSEIKIH

SEQ ID NO: 2059772 - protein, 22 aa, Staphylococcus
ALKFYTEILGFQKKADEPAGEY

SEQ ID NO: 2059773 - protein, 31 aa, Staphylococcus
ALKHNNKFIGQPLWGSIGYTLPATLGTQMAD

SEQ ID NO: 2059774 - protein, 24 aa, Staphylococcus
ALKKQLFENYFLDLIDLSKYNNMR

SEQ ID NO: 2059775 - protein, 19 aa, Staphylococcus
ALKLIIRDVAKRTAAKQTK

SEQ ID NO: 2059776 - protein, 17 aa, Staphylococcus
ALKNGYYADTGISFVVG

SEQ ID NO: 2059777 - protein, 26 aa, Staphylococcus
ALKTGQVLLQQGLNVYIIQLPNDMDP

SEQ ID NO: 2059778 - protein, 23 aa, Staphylococcus
ALKYAFEHYTIHKVYFKIRNKNS

SEQ ID NO: 2059779 - protein, 19 aa, Staphylococcus
ALKYYEEVFGATDINRLPV

SEQ ID NO: 2059780 - protein, 19 aa, Staphylococcus
ALLDRRLTLRRDKHVDYVV

SEQ ID NO: 2059781 - protein, 17 aa, Staphylococcus
ALLETKLSSGKTVDERM

SEQ ID NO: 2059782 - protein, 17 aa, Staphylococcus
ALLETNLPDGKSVDQRV

SEQ ID NO: 2059783 - protein, 17 aa, Staphylococcus
ALLIFDEVMTGFRVGYN

SEQ ID NO: 2059784 - protein, 20 aa, Staphylococcus
ALLKDADYVFLGTKPHDFEA

SEQ ID NO: 2059785 - protein, 21 aa, Staphylococcus
ALLKEIIWNPLVTDQQFDEVF

SEQ ID NO: 2059786 - protein, 17 aa, Staphylococcus
ALLKNGKPYIFYHEYRG

SEQ ID NO: 2059787 - protein, 18 aa, Staphylococcus
ALLLNYRIKQTAKMTNRL

SEQ ID NO: 2059788 - protein, 26 aa, Staphylococcus
ALLTNLPFIFIERPIFQKLIHLHDTD

SEQ ID NO: 2059789 - protein, 20 aa, Staphylococcus
ALMGMVIALIELKLSGDLSK

SEQ ID NO: 2059790 - protein, 25 aa, Staphylococcus
ALMKKVIDTRAVFKLGGIGLAFKKG

SEQ ID NO: 2059791 - protein, 29 aa, Staphylococcus
ALMQMPHAVTYFKQVILLSGTLKLDSADV

SEQ ID NO: 2059792 - protein, 38 aa, Staphylococcus
ALMSAGLFIVGRIKGVARPALVVTLPTVSGKGFTFLDV

SEQ ID NO: 2059793 - protein, 17 aa, Staphylococcus
ALMSAGLFIVGRIKGVS

SEQ ID NO: 2059794 - protein, 26 aa, Staphylococcus
ALNDDQLVMLKLTIPTEANLYKELAD

SEQ ID NO: 2059795 - protein, 25 aa, Staphylococcus
ALNELEQHWAVMKYSPGMPPGANTI

SEQ ID NO: 2059796 - protein, 24 aa, Staphylococcus
ALNELESHWAVMKKSPGMPPGANT

SEQ ID NO: 2059797 - protein, 34 aa, Staphylococcus
ALNFKFMRRINEVGIPIVFVINQIDKHNEDEISF

SEQ ID NO: 2059798 - protein, 27 aa, Staphylococcus
ALNFQFMKQLNQAGVPVVFVINQIDKH

SEQ ID NO: 2059799 - protein, 33 aa, Staphylococcus
ALNFQFMKRINEVGIPVVFIINQIDKHNDDELS

SEQ ID NO: 2059800 - protein, 34 aa, Staphylococcus
ALNFQFMKRMNQVGIPIIFVINQIDKHNENEISF

SEQ ID NO: 2059801 - protein, 17 aa, Staphylococcus
ALNFYRNLTINDVIKET

SEQ ID NO: 2059802 - protein, 24 aa, Staphylococcus
ALNGSILPGITRKSIIELAQDLGY

SEQ ID NO: 2059803 - protein, 24 aa, Staphylococcus
ALNGSILPGITRKSIIELTKELGY

SEQ ID NO: 2059804 - protein, 26 aa, Staphylococcus
ALNGSILPGITRKSIIQLAEDLGYEV

SEQ ID NO: 2059805 - protein, 17 aa, Staphylococcus
ALNIPPKHFHLIKEIMA

SEQ ID NO: 2059806 - protein, 19 aa, Staphylococcus
ALNKLALFKGKDFLKTCDF

SEQ ID NO: 2059807 - protein, 27 aa, Staphylococcus
ALNKSYDLIILDLMLPNINGLEICRQI

SEQ ID NO: 2059808 - protein, 27 aa, Staphylococcus
ALNKTYDLIILDLMLPNINGLEICRQI

SEQ ID NO: 2059809 - protein, 19 aa, Staphylococcus
ALNLFKLMKVSVSGIRRVT

SEQ ID NO: 2059810 - protein, 18 aa, Staphylococcus
ALNLPIPIYAIGGISEHT

SEQ ID NO: 2059811 - protein, 20 aa, Staphylococcus
ALNNATLPYAQLLANKGYKE

SEQ ID NO: 2059812 - protein, 17 aa, Staphylococcus
ALNNCMALYPVYNGTYP

SEQ ID NO: 2059813 - protein, 21 aa, Staphylococcus
ALNNYFRPEFLNRIDEFITFK

SEQ ID NO: 2059814 - protein, 25 aa, Staphylococcus
ALNPADYIYTGIAFMQLHNGQFVSP

SEQ ID NO: 2059815 - protein, 23 aa, Staphylococcus
ALNPNLKAFAPVREWAWSREEEI

SEQ ID NO: 2059816 - protein, 22 aa, Staphylococcus
ALNPNLKAFAPVREWGWSREEE

SEQ ID NO: 2059817 - protein, 26 aa, Staphylococcus
ALNSFKQPIIWLCGGLDRGNGFDELI

SEQ ID NO: 2059818 - protein, 26 aa, Staphylococcus
ALNSFNQPIIWLCGGLDRGNEFDELI

SEQ ID NO: 2059819 - protein, 25 aa, Staphylococcus
ALNVNPAFLMGWIEETDEQPQHRAA

SEQ ID NO: 2059820 - protein, 20 aa, Staphylococcus
ALPHTFSDLLIYCAERNVML

SEQ ID NO: 2059821 - protein, 24 aa, Staphylococcus
ALPKSNVIRLIFDEGFVALRPSGT

SEQ ID NO: 2059822 - protein, 17 aa, Staphylococcus
ALPVSAYLIEHPKGLIL

SEQ ID NO: 2059823 - protein, 18 aa, Staphylococcus
ALQEIDRSLFWVNPDCGL

SEQ ID NO: 2059824 - protein, 24 aa, Staphylococcus
ALQFYTDILGFKKKIDEPVGEGFR

SEQ ID NO: 2059825 - protein, 19 aa, Staphylococcus
ALQHEDVDFIFGYPGGAVL

SEQ ID NO: 2059826 - protein, 19 aa, Staphylococcus
ALQNENVDFIFGYPGGAVL

SEQ ID NO: 2059827 - protein, 28 aa, Staphylococcus
ALQQSTLPMFGTCAGLIVMAKQISGEDG

SEQ ID NO: 2059828 - protein, 19 aa, Staphylococcus
ALQSRLGITFIFVTHDQEE

SEQ ID NO: 2059829 - protein, 17 aa, Staphylococcus
ALRCSQFIYKEQKQQKT

SEQ ID NO: 2059830 - protein, 17 aa, Staphylococcus
ALRCSQFVYKEQKNQKK

SEQ ID NO: 2059831 - protein, 17 aa, Staphylococcus
ALRCSQFVYKEQKNQKT

SEQ ID NO: 2059832 - protein, 17 aa, Staphylococcus
ALRCSQFVYKEQKSQKK

SEQ ID NO: 2059833 - protein, 19 aa, Staphylococcus
ALREGLPLRSEYHEQYLKD

SEQ ID NO: 2059834 - protein, 20 aa, Staphylococcus
ALREPALGPTFGIKGGATGG

SEQ ID NO: 2059835 - protein, 18 aa, Staphylococcus
ALRILRGLRFKSQLRFEI

SEQ ID NO: 2059836 - protein, 20 aa, Staphylococcus
ALRLGFTYEGMFRQAVIYKG

SEQ ID NO: 2059837 - protein, 32 aa, Staphylococcus
ALRLTDIGFIFQAAYLIPYLSVIEQLTLVGKE

SEQ ID NO: 2059838 - protein, 19 aa, Staphylococcus
ALRNKGITILPFDANNIKE

SEQ ID NO: 2059839 - protein, 31 aa, Staphylococcus; identical to SEQ ID NO: 1694020

SEQ ID NO: 2059840 - protein, 32 aa, Staphylococcus
ALRQELDLFTCLRPVRWFQGVPSPVKRPEDTD

SEQ ID NO: 2059841 - protein, 19 aa, Staphylococcus
ALRRHVTFLLENNAQAIIV

SEQ ID NO: 2059842 - protein, 23 aa, Staphylococcus
ALRVGFTATPWRANSKGFTDIYD

SEQ ID NO: 2059843 - protein, 30 aa, Staphylococcus
ALSEYLILGIDTTIPFHLKLMNNDIFKSGD

SEQ ID NO: 2059844 - protein, 33 aa, Staphylococcus
ALSEYLILGIDTTIPFHLKLMNNDIFRSGSFNT

SEQ ID NO: 2059845 - protein, 20 aa, Staphylococcus
ALSFIVHRDFAYERGKALVE

SEQ ID NO: 2059846 - protein, 22 aa, Staphylococcus
ALSHFEKRYATRSQLREFNVEE

SEQ ID NO: 2059847 - protein, 22 aa, Staphylococcus
ALSHVQYKLPFQKLSDLEPFKN

SEQ ID NO: 2059848 - protein, 23 aa, Staphylococcus
ALSHYEKRYAKRSQLRDFNVEKM

SEQ ID NO: 2059849 - protein, 17 aa, Staphylococcus
ALSIERLLLALEEEGIE

SEQ ID NO: 2059850 - protein, 18 aa, Staphylococcus
ALSIERLLLALEEEGIEL

SEQ ID NO: 2059851 - protein, 18 aa, Staphylococcus
ALSLNYLPSIKLSDTSQD

SEQ ID NO: 2059852 - protein, 18 aa, Staphylococcus
ALSLVKKFKEPAAVAVKH

SEQ ID NO: 2059853 - protein, 21 aa, Staphylococcus
ALSNAKLLILGAGALGSHVAE

SEQ ID NO: 2059854 - protein, 25 aa, Staphylococcus
ALSSSKVILIDTYYLMLGGYTKKKA

SEQ ID NO: 2059855 - protein, 17 aa, Staphylococcus
ALSVITISYLESLNIDN

SEQ ID NO: 2059856 - protein, 20 aa, Staphylococcus
ALTEEALELILPKVQFNLLN

SEQ ID NO: 2059857 - protein, 21 aa, Staphylococcus
ALTEFVNIYGAKGLAWVKVVE

SEQ ID NO: 2059858 - protein, 18 aa, Staphylococcus
ALTHGLSLVADLFINSGD

SEQ ID NO: 2059859 - protein, 18 aa, Staphylococcus
ALTHGLSLVADLFVDEND

SEQ ID NO: 2059860 - protein, 22 aa, Staphylococcus
ALTLADLIMKGIYHNGCHLGGG

SEQ ID NO: 2059861 - protein, 20 aa, Staphylococcus
ALTLFNFQFNHNLDYQKFCI

SEQ ID NO: 2059862 - protein, 19 aa, Staphylococcus
ALTMPFISEKKAIVVKNAF

SEQ ID NO: 2059863 - protein, 24 aa, Staphylococcus
ALTSYFEITKLTKPLLESAAQIFD

SEQ ID NO: 2059864 - protein, 20 aa, Staphylococcus
ALTVGVVTRPFSFEGRKRQT

SEQ ID NO: 2059865 - protein, 17 aa, Staphylococcus
ALTVYDMTKALDKSMVI

SEQ ID NO: 2059866 - protein, 26 aa, Staphylococcus
ALVAMIEAVRITLHNALTLVGVTAPE

SEQ ID NO: 2059867 - protein, 24 aa, Staphylococcus
ALVARLLNLPNWQYGIATMGIGGG

SEQ ID NO: 2059868 - protein, 24 aa, Staphylococcus
ALVDAVRITLHNALALVGVSAPES

SEQ ID NO: 2059869 - protein, 26 aa, Staphylococcus
ALVDRSVLRLLKLIDRYTLEGEMPNY

SEQ ID NO: 2059870 - protein, 25 aa, Staphylococcus
ALVEALLQWDIDHLYGIPGDSIDAV

SEQ ID NO: 2059871 - protein, 24 aa, Staphylococcus
ALVEAVRITLNNALALVGVSAPET

SEQ ID NO: 2059872 - protein, 17 aa, Staphylococcus
ALVEKLKTLIPRQQFEV

SEQ ID NO: 2059873 - protein, 21 aa, Staphylococcus
ALVFVETCDLPIVIKKDGLAA

SEQ ID NO: 2059874 - protein, 18 aa, Staphylococcus
ALVFYNLISNLIKEQEFL

SEQ ID NO: 2059875 - protein, 25 aa, Staphylococcus
ALVKALQAWDIDHLWGIPGDSVDAV

SEQ ID NO: 2059876 - protein, 21 aa, Staphylococcus
ALVKALQAWDIDHLYGIPGDS

SEQ ID NO: 2059877 - protein, 25 aa, Staphylococcus
ALVKALQAWDIDHLYGIPGDSIDAV

SEQ ID NO: 2059878 - protein, 26 aa, Staphylococcus
ALVRALQAWDIDHLYGIPGDSIDAVV

SEQ ID NO: 2059879 - protein, 17 aa, Staphylococcus
ALVSKLHQSPLIEKLYA

SEQ ID NO: 2059880 - protein, 27 aa, Staphylococcus
ALVTGYDIIFFWVARMIFQGLEFTDRR

SEQ ID NO: 2059881 - protein, 17 aa, Staphylococcus
ALVYYPEDKLKLVKNQF

SEQ ID NO: 2059882 - protein, 23 aa, Staphylococcus
ALYDIVNYWIKFGVDGFRFDVIN

SEQ ID NO: 2059883 - protein, 18 aa, Staphylococcus
ALYEKRPVHIHLPIDVAN

SEQ ID NO: 2059884 - protein, 18 aa, Staphylococcus
ALYFREGFITELMPKTDR

SEQ ID NO: 2059885 - protein, 22 aa, Staphylococcus
ALYGDEVDYIITLTYGSQDAVK

SEQ ID NO: 2059886 - protein, 22 aa, Staphylococcus
ALYKESYILLTPKDAFPKQKTI

SEQ ID NO: 2059887 - protein, 23 aa, Staphylococcus
ALYPVYNGTYPGSSARALVISGY

SEQ ID NO: 2059888 - protein, 19 aa, Staphylococcus
AMAFRKEFNKDVVIDLVGY

SEQ ID NO: 2059889 - protein, 18 aa, Staphylococcus
AMAIFFQDMTEQERAALT

SEQ ID NO: 2059890 - protein, 28 aa, Staphylococcus
AMAKEGYSFFGVLYIGAIITKDGPKVIE

SEQ ID NO: 2059891 - protein, 20 aa, Staphylococcus
AMALAISNLLGLVCDPVAGL

SEQ ID NO: 2059892 - protein, 21 aa, Staphylococcus
AMDALVRFTKAEGIIPAIESA

SEQ ID NO: 2059893 - protein, 18 aa, Staphylococcus
AMDILKLPKDEVAMVGDL

SEQ ID NO: 2059894 - protein, 18 aa, Staphylococcus
AMDMARRVAKEEGILAGI

SEQ ID NO: 2059895 - protein, 35 aa, Staphylococcus
AMEEYVLKHLPSDDSYFLFYVNGPSIIVGKNQNTI

SEQ ID NO: 2059896 - protein, 36 aa, Staphylococcus
AMEEYVLKYLPQDSDYFLFYINRPSIIIGKNQNTIE

SEQ ID NO: 2059897 - protein, 25 aa, Staphylococcus
AMEHDYACILLDLMLPEMDGITVAS

SEQ ID NO: 2059898 - protein, 24 aa, Staphylococcus
AMEIRDLIKYISKQTLLIVGNRED

SEQ ID NO: 2059899 - protein, 20 aa, Staphylococcus
AMELLYNNQFQIDKAIILAA

SEQ ID NO: 2059900 - protein, 29 aa, Staphylococcus
AMEPEEAAMLLIPEPWLYNKENDDNVRAF

SEQ ID NO: 2059901 - protein, 28 aa, Staphylococcus
AMEPEEAAMLLIPEPWLYNKSNDEHVRA

SEQ ID NO: 2059902 - protein, 31 aa, Staphylococcus
AMETGVDLVKLFPGDLLGANFIKNVHGPIPQ

SEQ ID NO: 2059903 - protein, 29 aa, Staphylococcus
AMFADIKTYIFYQLFEKYVIDYSMASATG

SEQ ID NO: 2059904 - protein, 25 aa, Staphylococcus
AMFADIKTYIFYQLYGEYVMDHSMA

SEQ ID NO: 2059905 - protein, 17 aa, Staphylococcus
AMFAFGHYTVAMKNARP

SEQ ID NO: 2059906 - protein, 24 aa, Staphylococcus
AMFEEQLLKIVKTKKLRSSEENYY

SEQ ID NO: 2059907 - protein, 19 aa, Staphylococcus
AMFGVVPKPLWTKKYKVND

SEQ ID NO: 2059908 - protein, 31 aa, Staphylococcus
AMGLRINNEPLLMDISKTPHALIAGATGSGK

SEQ ID NO: 2059909 - protein, 19 aa, Staphylococcus
AMGRLFVTLVGAMAEWERE

SEQ ID NO: 2059910 - protein, 19 aa, Staphylococcus
AMGYNFMHRKKPANGFVCY

SEQ ID NO: 2059911 - protein, 25 aa, Staphylococcus
AMHKQPHDVFFVPARGGLGENVVYQ

SEQ ID NO: 2059912 - protein, 21 aa, Staphylococcus
AMHQFAIWTALSSKGIGASLQ

SEQ ID NO: 2059913 - protein, 21 aa, Staphylococcus
AMIDHIWLFERQKYYDIAFSL

SEQ ID NO: 2059914 - protein, 18 aa, Staphylococcus
AMIDVNIKGTLYTINAVL

SEQ ID NO: 2059915 - protein, 27 aa, Staphylococcus
AMIETSNIVIQWLKGLNLEVDLLNIGG

SEQ ID NO: 2059916 - protein, 20 aa, Staphylococcus
AMILADFFDTPYQMLVESKY

SEQ ID NO: 2059917 - protein, 20 aa, Staphylococcus
AMISFFNGIAQLRQQIKKGE

SEQ ID NO: 2059918 - protein, 21 aa, Staphylococcus
AMISYFNGVAQLRQQIKKSHR

SEQ ID NO: 2059919 - protein, 25 aa, Staphylococcus
AMKHHVKFEPMESLPRLLVDVDIVI

SEQ ID NO: 2059920 - protein, 27 aa, Staphylococcus
AMKLEGYHYFGLLYIGAILTSEGPKVI

SEQ ID NO: 2059921 - protein, 22 aa, Staphylococcus
AMKSYIKFCIKPLIKKIEDELN

SEQ ID NO: 2059922 - protein, 18 aa, Staphylococcus
AMLAGYFSKAGNSGQIPV

SEQ ID NO: 2059923 - protein, 18 aa, Staphylococcus
AMLDDYRRLLASLTDVDN

SEQ ID NO: 2059924 - protein, 32 aa, Staphylococcus
AMLHIVRHYRPEKVILFFTESIWFGNENIPGR

SEQ ID NO: 2059925 - protein, 18 aa, Staphylococcus
AMLIHDKPLIILGVKVKN

SEQ ID NO: 2059926 - protein, 19 aa, Staphylococcus
AMLKLAYIDLNDYLATLKA

SEQ ID NO: 2059927 - protein, 19 aa, Staphylococcus
AMLLIPEPWQHNKANDATV

SEQ ID NO: 2059928 - protein, 19 aa, Staphylococcus
AMLSGYFSKAGSSAQIPVD

SEQ ID NO: 2059929 - protein, 18 aa, Staphylococcus
AMMAFYNALILKSKRHYD

SEQ ID NO: 2059930 - protein, 32 aa, Staphylococcus
AMNFQFMKRLNHAGIPVVFVINQIDKHNDDEL

SEQ ID NO: 2059931 - protein, 27 aa, Staphylococcus
AMNRKGYYLYGYRHFSSRIKGGHTNNK

SEQ ID NO: 2059932 - protein, 24 aa, Staphylococcus
AMPILGVCLGFQQIVTYFGGDIIK

SEQ ID NO: 2059933 - protein, 20 aa, Staphylococcus
AMQAIMGTRLKDLGYKQGVQ

SEQ ID NO: 2059934 - protein, 28 aa, Staphylococcus
AMQEEGYPFFGVLYIGAILTDEGPKVIE

SEQ ID NO: 2059935 - protein, 24 aa, Staphylococcus
AMQEYIYYKIFDSNKQKFIKNTSV

SEQ ID NO: 2059936 - protein, 24 aa, Staphylococcus
AMQGCQYVLSVASPVFFEIPDDES

SEQ ID NO: 2059937 - protein, 26 aa, Staphylococcus
AMQVTFEFELNDKLFKIVRTGPFVKE

SEQ ID NO: 2059938 - protein, 26 aa, Staphylococcus
AMRTGRIWINTYNQFPAGAPFGGYKK

SEQ ID NO: 2059939 - protein, 23 aa, Staphylococcus
AMSHPDIRISLLSDGKTLISTNG

SEQ ID NO: 2059940 - protein, 18 aa, Staphylococcus
AMTRACEQMTFSYSLMGM

SEQ ID NO: 2059941 - protein, 32 aa, Staphylococcus
AMTSSFSSMLFAIYILFGGKYNASFFDKAKEN

SEQ ID NO: 2059942 - protein, 20 aa, Staphylococcus
AMTTFERYFIKDKATHKEEK

SEQ ID NO: 2059943 - protein, 25 aa, Staphylococcus
AMTTFKMMILPHFKDMAIKDITVPH

SEQ ID NO: 2059944 - protein, 20 aa, Staphylococcus
AMTYAVYKLSGFPKERVLGQ

SEQ ID NO: 2059945 - protein, 20 aa, Staphylococcus
AMVAIPLWKNNRVYGALLLG

SEQ ID NO: 2059946 - protein, 21 aa, Staphylococcus
AMVSFLNSFPMFKDDTRNTHP

SEQ ID NO: 2059947 - protein, 24 aa, Staphylococcus
ANAEPIIEKAIESGITYFDTADIY

SEQ ID NO: 2059948 - protein, 21 aa, Staphylococcus
ANAHIIKQWSGVRPYTDGELP

SEQ ID NO: 2059949 - protein, 26 aa, Staphylococcus
ANALETLRRYCFDRAFIGMNGMDSKY

SEQ ID NO: 2059950 - protein, 23 aa, Staphylococcus
ANANVILNNLYKHTPLQTSFGVN

SEQ ID NO: 2059951 - protein, 28 aa, Staphylococcus
ANANVILNNLYKLTPLQTSFGANMIALV

SEQ ID NO: 2059952 - protein, 29 aa, Staphylococcus
ANASVILNNLYKLTPLQTSFGVNMIALIN

SEQ ID NO: 2059953 - protein, 18 aa, Staphylococcus
ANDLLVTGALLGVNMNIV

SEQ ID NO: 2059954 - protein, 29 aa, Staphylococcus
ANDSSAMPAFWFDPLINLTAISQVTQYVG

SEQ ID NO: 2059955 - protein, 37 aa, Staphylococcus
ANDTEFGLAAYFFTKDYATGFYLYDNLDYGVIGWNDG

SEQ ID NO: 2059956 - protein, 27 aa, Staphylococcus
ANDTQFGLAAYFFTNDYRTGFHLYNSL

SEQ ID NO: 2059957 - protein, 36 aa, Staphylococcus
ANDVLNYQIFYPYNKNIFYKRYWTSNGWADWSKFTN

SEQ ID NO: 2059958 - protein, 26 aa, Staphylococcus
ANEFKNYILGLIFYRFLSEKVEEQSE

SEQ ID NO: 2059959 - protein, 26 aa, Staphylococcus
ANEFKNYILGLIFYRFLSEKVEETSA

SEQ ID NO: 2059960 - protein, 31 aa, Staphylococcus
ANEKNNYMINYFMRLAYLGQPLTVMGASDVE

SEQ ID NO: 2059961 - protein, 22 aa, Staphylococcus
ANELLQLMVSTMEQSLNNHNEK

SEQ ID NO: 2059962 - protein, 20 aa, Staphylococcus
ANEVFKHLNTFARIPVCGTI

SEQ ID NO: 2059963 - protein, 35 aa, Staphylococcus
ANEYGLKWYTYHNQYHSFIMVSYIDNKVNAMYTNQ

SEQ ID NO: 2059964 - protein, 20 aa, Staphylococcus
ANEYKGELIFLHKVKDGAVD

SEQ ID NO: 2059965 - protein, 32 aa, Staphylococcus
ANFDFRLRHDQTWDFIYNGGISVAYLSFAEID

SEQ ID NO: 2059966 - protein, 22 aa, Staphylococcus
ANFEFNVLHMPGHSPGSLTFVF

SEQ ID NO: 2059967 - protein, 17 aa, Staphylococcus
ANFLFHASRLNVPVGGG

SEQ ID NO: 2059968 - protein, 20 aa, Staphylococcus
ANFVSFIDSKMDKLLFDTCQ

SEQ ID NO: 2059969 - protein, 17 aa, Staphylococcus
ANGFVCYMVGRLVLEYC

SEQ ID NO: 2059970 - protein, 31 aa, Staphylococcus
ANGIKCVMIAKLPFMNKNNAKYWLMDSEFES

SEQ ID NO: 2059971 - protein, 22 aa, Staphylococcus
ANGMLVKRPLAISGDKVTVGFK

SEQ ID NO: 2059972 - protein, 21 aa, Staphylococcus
ANGMRIGELLAIKRENINYED

SEQ ID NO: 2059973 - protein, 23 aa, Staphylococcus
ANHDHFVCVIPVSETLDLKEAAH

SEQ ID NO: 2059974 - protein, 24 aa, Staphylococcus
ANHDHFVFVIPVDTTLDLKQAAHV

SEQ ID NO: 2059975 - protein, 17 aa, Staphylococcus
ANHIAYLCSIISATSNP

SEQ ID NO: 2059976 - protein, 18 aa, Staphylococcus
ANHIAYLCSIISATSNPK

SEQ ID NO: 2059977 - protein, 24 aa, Staphylococcus
ANHLATFKQGIKVSLFIGGTDIEK

SEQ ID NO: 2059978 - protein, 28 aa, Staphylococcus
ANHLEEPLVFPLIALIVSGGHTELVYMK

SEQ ID NO: 2059979 - protein, 18 aa, Staphylococcus
ANHQPVVYCLDKIAKDYL

SEQ ID NO: 2059980 - protein, 26 aa, Staphylococcus
ANHYDLPVFIINYPTSIKPFYMQPNP

SEQ ID NO: 2059981 - protein, 31 aa, Staphylococcus
ANHYFKVNNIYLPQYFDLVRVINLSLRAKYL

SEQ ID NO: 2059982 - protein, 25 aa, Staphylococcus
ANHYGLRCVIYAPEGFAAEKISIME

SEQ ID NO: 2059983 - protein, 17 aa, Staphylococcus
ANIFLDMVSVGATINIM

SEQ ID NO: 2059984 - protein, 23 aa, Staphylococcus
ANIIPDFTHARFYTRATSRKELD

SEQ ID NO: 2059985 - protein, 20 aa, Staphylococcus
ANIIPDFTHARFYTRATTRK

SEQ ID NO: 2059986 - protein, 19 aa, Staphylococcus
ANIIPDFTHARFYTRSRTR

SEQ ID NO: 2059987 - protein, 21 aa, Staphylococcus
ANIIPDYTHARFYTRATTRKE

SEQ ID NO: 2059988 - protein, 18 aa, Staphylococcus
ANIRKWFKRYLSESEHIY

SEQ ID NO: 2059989 - protein, 22 aa, Staphylococcus
ANIVGYIIKPISESQLLTAVEI

SEQ ID NO: 2059990 - protein, 23 aa, Staphylococcus
ANIVIWDAPNHEYIPYHYGINHA

SEQ ID NO: 2059991 - protein, 21 aa, Staphylococcus
ANIVPWQQLAKRKKATLKFIP

SEQ ID NO: 2059992 - protein, 24 aa, Staphylococcus
ANKALKLYNLTMKVSREKLLKQQL

SEQ ID NO: 2059993 - protein, 22 aa, Staphylococcus
ANKDFITLINTSGLNKYITEVP

SEQ ID NO: 2059994 - protein, 17 aa, Staphylococcus
ANKKLHLKHRLFNQRLA

SEQ ID NO: 2059995 - protein, 25 aa, Staphylococcus
ANKNVKRLIFVAAPGIYNELPEQFN

SEQ ID NO: 2059996 - protein, 22 aa, Staphylococcus
ANKYKPYLDGPYLQMTPDQLAE

SEQ ID NO: 2059997 - protein, 40 aa, Staphylococcus
ANLEISFQLLDKPTIDGIEFVEFLISPNKGEPLKSLNKIA

SEQ ID NO: 2059998 - protein, 28 aa, Staphylococcus
ANLEVIDKPLPFLFGEDFSFYGQQLAPA

SEQ ID NO: 2059999 - protein, 28 aa, Staphylococcus
ANLEVIEKPLPFLFGEDFSFYGQQLAPS

SEQ ID NO: 2060000 - protein, 21 aa, Staphylococcus
ANLGDLFQIFTAHSTQGRLYT

SEQ ID NO: 2060001 - protein, 28 aa, Staphylococcus
ANLQRITRYLIKKYQDQFFTFPAASSHH

SEQ ID NO: 2060002 - protein, 18 aa, Staphylococcus
ANMIALVDGRPKLINLKE

SEQ ID NO: 2060003 - protein, 24 aa, Staphylococcus
ANMLNLLGFTLQPTNDGLIIHPSA

SEQ ID NO: 2060004 - protein, 18 aa, Staphylococcus
ANMMVHEASTMAFGNKSD

SEQ ID NO: 2060005 - protein, 21 aa, Staphylococcus
ANNFLLKKNMAVEATPGNLRQ

SEQ ID NO: 2060006 - protein, 17 aa, Staphylococcus
ANNLKFITDMYGCPGFT

SEQ ID NO: 2060007 - protein, 18 aa, Staphylococcus
ANNVYNLVTKRTLVYENG

SEQ ID NO: 2060008 - protein, 22 aa, Staphylococcus
ANPGCFPTATLLALHPLIDKDI

SEQ ID NO: 2060009 - protein, 21 aa, Staphylococcus
ANPQLTINYLTQEVARLTQEN

SEQ ID NO: 2060010 - protein, 24 aa, Staphylococcus
ANQKACINLLRKLIEIKPGSRIKV

SEQ ID NO: 2060011 - protein, 35 aa, Staphylococcus
ANQQQLDLYFTSLSHRTIVYKGWLRSDQINALYED

SEQ ID NO: 2060012 - protein, 26 aa, Staphylococcus
ANQRLAIMTGQRYQLTRRAQISQGYS

SEQ ID NO: 2060013 - protein, 26 aa, Staphylococcus
ANRDLLQAQLYLMQHNELPFTQEDIT

SEQ ID NO: 2060014 - protein, 21 aa, Staphylococcus
ANRFRVKCVIFAPEGFSEEKI

SEQ ID NO: 2060015 - protein, 27 aa, Staphylococcus
ANRFVRILGFPFYYRGEVYDPFETEKL

SEQ ID NO: 2060016 - protein, 19 aa, Staphylococcus
ANRIGVWIGSGIGGMETFE

SEQ ID NO: 2060017 - protein, 18 aa, Staphylococcus
ANRISRSVIYPLLEQMEL

SEQ ID NO: 2060018 - protein, 21 aa, Staphylococcus
ANRLYFLKQHTLVDELYFNED

SEQ ID NO: 2060019 - protein, 22 aa, Staphylococcus
ANRQFVIYMMPDKGLTHFKLGI

SEQ ID NO: 2060020 - protein, 23 aa, Staphylococcus
ANRQFVVYTLKNEYEHFRLGISV

SEQ ID NO: 2060021 - protein, 26 aa, Staphylococcus
ANRRDDVLFFMFEENPFLSKKIIDIL

SEQ ID NO: 2060022 - protein, 18 aa, Staphylococcus
ANRVIFVDEWKRTIDGQY

SEQ ID NO: 2060023 - protein, 23 aa, Staphylococcus
ANSHLVILVMVFSSGHVENIHVV

SEQ ID NO: 2060024 - protein, 22 aa, Staphylococcus
ANSITLVYRKSDIKGYEAMISV

SEQ ID NO: 2060025 - protein, 22 aa, Staphylococcus
ANSNLLAGVKVDYYGAPTPVQQ

SEQ ID NO: 2060026 - protein, 27 aa, Staphylococcus
ANSQLVGAGLPLWLPNGATIRREIERY

SEQ ID NO: 2060027 - protein, 24 aa, Staphylococcus
ANSTHIPYIYLSAGMDSQLFNKSL

SEQ ID NO: 2060028 - protein, 24 aa, Staphylococcus
ANTFKAILRCDPDIILIGEIRDAI

SEQ ID NO: 2060029 - protein, 25 aa, Staphylococcus
ANTIKSVHFTSLKLGPMGDAVIKGY

SEQ ID NO: 2060030 - protein, 25 aa, Staphylococcus
ANTTLDKMIVYLLNEVKNLVVGVDG

SEQ ID NO: 2060031 - protein, 21 aa, Staphylococcus
ANTVAFLASDKAKYITGQTIH

SEQ ID NO: 2060032 - protein, 22 aa, Staphylococcus
ANTVAFLASDKAKYITGQTIHV

SEQ ID NO: 2060033 - protein, 17 aa, Staphylococcus
ANTVAFLASEKAKYITG

SEQ ID NO: 2060034 - protein, 25 aa, Staphylococcus
ANVKGYFLWSLMDVFSWSNGYEKRY

SEQ ID NO: 2060035 - protein, 17 aa, Staphylococcus
ANVKYLALDLGEDNIRV

SEQ ID NO: 2060036 - protein, 23 aa, Staphylococcus
ANVNLFALLAKQARIQGVNLGHH

SEQ ID NO: 2060037 - protein, 24 aa, Staphylococcus
ANVQTPMVIGLLDAPRFLTRTQYT

SEQ ID NO: 2060038 - protein, 20 aa, Staphylococcus
ANVTVIYRGDHYPKAIKPWI

SEQ ID NO: 2060039 - protein, 20 aa, Staphylococcus
ANWLNQKYIEIMQSIIYEVI

SEQ ID NO: 2060040 - protein, 32 aa, Staphylococcus
ANWTVAFTKLHNFHWYVKGPNFFSLHTKFEEL

SEQ ID NO: 2060041 - protein, 17 aa, Staphylococcus
ANYLYKCQSCGYKYLRI

SEQ ID NO: 2060042 - protein, 18 aa, Staphylococcus
ANYYRPEMPNTNPLFIGA

SEQ ID NO: 2060043 - protein, 17 aa, Staphylococcus
ANYYRPTMPNTNPLFIN

SEQ ID NO: 2060044 - protein, 20 aa, Staphylococcus
APAEGLYLEKIYLTPNELIQ

SEQ ID NO: 2060045 - protein, 17 aa, Staphylococcus
APAFTDAKLQDPIPAKI

SEQ ID NO: 2060046 - protein, 20 aa, Staphylococcus
APALQKSLQLAEKLYREGER

SEQ ID NO: 2060047 - protein, 19 aa, Staphylococcus
APDLYLKAVQELNLNPVSC

SEQ ID NO: 2060048 - protein, 28 aa, Staphylococcus
APEAYPHPIYNNVLPHIDIFLEDGYTKE

SEQ ID NO: 2060049 - protein, 28 aa, Staphylococcus
APEAYPHPIYNNVLPHIDVFLEDGYTKE

SEQ ID NO: 2060050 - protein, 20 aa, Staphylococcus
APENMEVIIGWTGSPASSPH

SEQ ID NO: 2060051 - protein, 21 aa, Staphylococcus
APENMEVLIGWTGSPASSPHL

SEQ ID NO: 2060052 - protein, 22 aa, Staphylococcus
APENMEVLIGWTGSPASSPYLV

SEQ ID NO: 2060053 - protein, 27 aa, Staphylococcus
APEPNLTVLWSVRLPDNFKTYCAKMSI

SEQ ID NO: 2060054 - protein, 28 aa, Staphylococcus
APEPNLTVLWSVRLPENFKIYCAKMSIK

SEQ ID NO: 2060055 - protein, 28 aa, Staphylococcus
APEVYYLKAFIKHKLLQYIDEGLEWVLI

SEQ ID NO: 2060056 - protein, 19 aa, Staphylococcus
APFLLIGDPRIEGGSFYLG

SEQ ID NO: 2060057 - protein, 25 aa, Staphylococcus
APGFGDRRKAMLEDLAILTGAQVIT

SEQ ID NO: 2060058 - protein, 25 aa, Staphylococcus
APGFGDRRKAMLEDLAILTGATVIT

SEQ ID NO: 2060059 - protein, 30 aa, Staphylococcus
APGFGDRRKSMLEDIAILTGAQFITDDLGY

SEQ ID NO: 2060060 - protein, 24 aa, Staphylococcus
APGMKYKHYAPKTPVYMLTEFTQP

SEQ ID NO: 2060061 - protein, 19 aa, Staphylococcus
APGMKYKHYSPDTPVAMLT

SEQ ID NO: 2060062 - protein, 26 aa, Staphylococcus
APGWQKWVWSPFLSTMTSGATAFVYN

SEQ ID NO: 2060063 - protein, 23 aa, Staphylococcus
APHEALLCLDATTGQNALSQARS

SEQ ID NO: 2060064 - protein, 23 aa, Staphylococcus
APHEALLCLDATTGQNALSQART

SEQ ID NO: 2060065 - protein, 25 aa, Staphylococcus
APIAFQEFMILPVGAESFKEALRWG

SEQ ID NO: 2060066 - protein, 24 aa, Staphylococcus
APIAFQEFMVLPVGAESFKESLRW

SEQ ID NO: 2060067 - protein, 28 aa, Staphylococcus
APIDRQMFYQFILRLPENIYRLKGYVRF

SEQ ID NO: 2060068 - protein, 25 aa, Staphylococcus
APIEDIRFLFLPQDLPKHEKIEKNQ

SEQ ID NO: 2060069 - protein, 17 aa, Staphylococcus
APIIKEALLALEALGYS

SEQ ID NO: 2060070 - protein, 18 aa, Staphylococcus
APIIKELGFIFNNLNINK

SEQ ID NO: 2060071 - protein, 28 aa, Staphylococcus
APKAYPHPIYNNVLPHIDVFLENGYTKE

SEQ ID NO: 2060072 - protein, 33 aa, Staphylococcus
APKLFQKLNIEWVYRLLIDWKRIGRMMSIPKFM

SEQ ID NO: 2060073 - protein, 24 aa, Staphylococcus
APKLIEHLLEIRGLGIINVMTLFG

SEQ ID NO: 2060074 - protein, 19 aa, Staphylococcus
APKPRLPFESVFHENEYNQ

SEQ ID NO: 2060075 - protein, 33 aa, Staphylococcus
APKVFRKLNIEWVYRLLIDWKRIGRLKSIPIFM

SEQ ID NO: 2060076 - protein, 17 aa, Staphylococcus
APLFFRGREVSGKTIGI

SEQ ID NO: 2060077 - protein, 19 aa, Staphylococcus
APLILNKRTIQTTGKIQAV

SEQ ID NO: 2060078 - protein, 24 aa, Staphylococcus
APLKALIFDSEYDPYRGVISSIRI

SEQ ID NO: 2060079 - protein, 20 aa, Staphylococcus
APLNSMIKLFARQFKKSKIP

SEQ ID NO: 2060080 - protein, 38 aa, Staphylococcus
APNKRGYKMLPHFQIGLFRDQLFIMYGIMHEGKNKEER

SEQ ID NO: 2060081 - protein, 25 aa, Staphylococcus
APPRLQNGTSWFYFATDQWKYEESN

SEQ ID NO: 2060082 - protein, 22 aa, Staphylococcus
APQCAGIIHTDFERGFIRAEVT

SEQ ID NO: 2060083 - protein, 22 aa, Staphylococcus
APQFFGIISDFLKTSGLTNTHG

SEQ ID NO: 2060084 - protein, 19 aa, Staphylococcus
APQFFGPISDYLKASGLTE

SEQ ID NO: 2060085 - protein, 21 aa, Staphylococcus
APRWKCILNVIKRYFKLLKNE

SEQ ID NO: 2060086 - protein, 18 aa, Staphylococcus
APSIAQPQVAQSAPQVSD

SEQ ID NO: 2060087 - protein, 26 aa, Staphylococcus
APSPTGYLHIGNARTALFNYLFAKHY

SEQ ID NO: 2060088 - protein, 26 aa, Staphylococcus
APSPTGYLHIGNARTALFNYLYAKHY

SEQ ID NO: 2060089 - protein, 30 aa, Staphylococcus
APTDDQWDAMLLGWKVIPSVKSNAVILSNT

SEQ ID NO: 2060090 - protein, 25 aa, Staphylococcus
APTGHTLRMLELPSAWTDYLNTTSN

SEQ ID NO: 2060091 - protein, 26 aa, Staphylococcus
APTGMHFYYVYPPKGQFASIIGMNKD

SEQ ID NO: 2060092 - protein, 19 aa, Staphylococcus
APTIYGGLLAGFYNPDTKE

SEQ ID NO: 2060093 - protein, 17 aa, Staphylococcus
APTIYGGLLAGYYNPET

SEQ ID NO: 2060094 - protein, 28 aa, Staphylococcus
APTRAEHVKLLIPLLEQHKDDIAHLYVK

SEQ ID NO: 2060095 - protein, 28 aa, Staphylococcus
APTRAEHVKLLIPLLEQNKDELAKLYVK

SEQ ID NO: 2060096 - protein, 23 aa, Staphylococcus
APTTNVIYFKVAKTDSLEKLFDQ

SEQ ID NO: 2060097 - protein, 21 aa, Staphylococcus
APVYHILPHILKNYLQAYPHI

SEQ ID NO: 2060098 - protein, 17 aa, Staphylococcus
APWLIVPADHKKTARIE

SEQ ID NO: 2060099 - protein, 25 aa, Staphylococcus
APYSRFKVGAYLRTKDGRTFHGANV

SEQ ID NO: 2060100 - protein, 24 aa, Staphylococcus
AQAILDMRLRRLTGLERDKIEAEY

SEQ ID NO: 2060101 - protein, 30 aa, Staphylococcus
AQAMSKEGYHFFGLLYIGAILTKEGPKVIE

SEQ ID NO: 2060102 - protein, 19 aa, Staphylococcus
AQDIANVALFLASDLAHYI

SEQ ID NO: 2060103 - protein, 17 aa, Staphylococcus
AQDIGYPLVLKAASGGG

SEQ ID NO: 2060104 - protein, 23 aa, Staphylococcus
AQDLNQLIFAFPGASSGVIDMLK

SEQ ID NO: 2060105 - protein, 25 aa, Staphylococcus
AQDLYKVYPDLTAFGKIIGGGLPIG

SEQ ID NO: 2060106 - protein, 20 aa, Staphylococcus
AQDVANVALFLASDLANYIH

SEQ ID NO: 2060107 - protein, 17 aa, Staphylococcus
AQDYYYKDQSHLTFEER

SEQ ID NO: 2060108 - protein, 36 aa, Staphylococcus
AQEERGLFIVPLNGLKKWLTPVDMWKSHQLTLNVGD

SEQ ID NO: 2060109 - protein, 26 aa, Staphylococcus
AQEGRGLICAPLAPSLAKKLNLTPMV

SEQ ID NO: 2060110 - protein, 25 aa, Staphylococcus
AQEHYQMTIVFITHDINLVKDYATH

SEQ ID NO: 2060111 - protein, 25 aa, Staphylococcus
AQELLNNVNYFGTMLVYAGHAEGLV

SEQ ID NO: 2060112 - protein, 19 aa, Staphylococcus
AQEYWYIHDGKMERIIGTF

SEQ ID NO: 2060113 - protein, 19 aa, Staphylococcus
AQFEMMKPTSYLINASRGP

SEQ ID NO: 2060114 - protein, 25 aa, Staphylococcus
AQFGLNLLTPYVGVRVIEFADVPAG

SEQ ID NO: 2060115 - protein, 17 aa, Staphylococcus
AQFIDYLNQQGIPHLYV

SEQ ID NO: 2060116 - protein, 17 aa, Staphylococcus
AQFISYLNNQNIPHLYV

SEQ ID NO: 2060117 - protein, 24 aa, Staphylococcus
AQFKPGDLIRFKWSTIEESAKVQE

SEQ ID NO: 2060118 - protein, 19 aa, Staphylococcus
AQGYFNVIPDLTCLGKVIG

SEQ ID NO: 2060119 - protein, 21 aa, Staphylococcus
AQHALDLLGLAALSFADTFDC

SEQ ID NO: 2060120 - protein, 27 aa, Staphylococcus
AQHDMVLTFFNWPNQYRGRIGSGQVGH

SEQ ID NO: 2060121 - protein, 24 aa, Staphylococcus
AQHEVNVPIFLKLTSDLELEGFKT

SEQ ID NO: 2060122 - protein, 24 aa, Staphylococcus
AQHKIRVQFRLTEALKPLTADYLK

SEQ ID NO: 2060123 - protein, 23 aa, Staphylococcus
AQHYYYIDPLWSHLGKSFILPAI

SEQ ID NO: 2060124 - protein, 25 aa, Staphylococcus
AQIAFFVAQWPTPRLNHWRVLLQAR

SEQ ID NO: 2060125 - protein, 31 aa, Staphylococcus
AQIAFYVAQWPLVRLDHWIALLKARAIENDM

SEQ ID NO: 2060126 - protein, 24 aa, Staphylococcus
AQIANFLKTSLIARGVTFYENCAL

SEQ ID NO: 2060127 - protein, 24 aa, Staphylococcus
AQIDKLIKEAKTYHFKSVCVNPTQ

SEQ ID NO: 2060128 - protein, 19 aa, Staphylococcus
AQIEQSFFKIKGETRNCIA

SEQ ID NO: 2060129 - protein, 21 aa, Staphylococcus
AQIEQSFFKIKGETRNCIAIL

SEQ ID NO: 2060130 - protein, 17 aa, Staphylococcus
AQIIALANKEPIHFQWK

SEQ ID NO: 2060131 - protein, 19 aa, Staphylococcus
AQIIFLDTPGIHKPKHKLG

SEQ ID NO: 2060132 - protein, 19 aa, Staphylococcus
AQILIKPTDLLLLDEPTNH

SEQ ID NO: 2060133 - protein, 18 aa, Staphylococcus
AQILKTFNVLKEIVKGFG

SEQ ID NO: 2060134 - protein, 18 aa, Staphylococcus
AQIVGLTKALELAHKNRD

SEQ ID NO: 2060135 - protein, 18 aa, Staphylococcus
AQIVLRWHVAHNRVVIPK

SEQ ID NO: 2060136 - protein, 25 aa, Staphylococcus
AQKNVSRLIFIAAPGIYDELPDKFN

SEQ ID NO: 2060137 - protein, 24 aa, Staphylococcus
AQKQSYVLPIMKKLFDYQNPMLSQ

SEQ ID NO: 2060138 - protein, 17 aa, Staphylococcus
AQLDERFFRCHNSFVVN

SEQ ID NO: 2060139 - protein, 22 aa, Staphylococcus
AQLIEGLIHFVSRQAMNIDGLG

SEQ ID NO: 2060140 - protein, 25 aa, Staphylococcus
AQLKEVVIAYEPIWAIGTGKSATSD

SEQ ID NO: 2060141 - protein, 20 aa, Staphylococcus
AQLKLTYRPQQLYLSEIILD

SEQ ID NO: 2060142 - protein, 20 aa, Staphylococcus
AQLLQLEPDLIVTAAFGQLL

SEQ ID NO: 2060143 - protein, 24 aa, Staphylococcus
AQMIKFIRHIDISGLPSTLENVRL

SEQ ID NO: 2060144 - protein, 17 aa, Staphylococcus
AQMMFDNFLSSARAKWG

SEQ ID NO: 2060145 - protein, 24 aa, Staphylococcus
AQMNAWLKPYRRALQLEEPTVNIT

SEQ ID NO: 2060146 - protein, 24 aa, Staphylococcus
AQNGYGLLPQLPFNRKYQAVVYIS

SEQ ID NO: 2060147 - protein, 25 aa, Staphylococcus
AQNITTYQPAYYRLFEKLHHDTFKH

SEQ ID NO: 2060148 - protein, 18 aa, Staphylococcus
AQNYAEVQLKLDNKARKL

SEQ ID NO: 2060149 - protein, 27 aa, Staphylococcus
AQQDQGFPKAYFTPAHVWLSEQHKDEI

SEQ ID NO: 2060150 - protein, 25 aa, Staphylococcus
AQQEAIYYEIFPFDSNRIVLQEDKA

SEQ ID NO: 2060151 - protein, 26 aa, Staphylococcus
AQQNFKDLFQYIESLFARPISPYEIE

SEQ ID NO: 2060152 - protein, 26 aa, Staphylococcus
AQQQHIYYEVFPFGAQRIVLKEDYQW

SEQ ID NO: 2060153 - protein, 25 aa, Staphylococcus
AQQQNIYYEVFPFGEQRLVLKEDEQ

SEQ ID NO: 2060154 - protein, 25 aa, Staphylococcus
AQQQPLPVVLYIHGGGTFFGTVEGN

SEQ ID NO: 2060155 - protein, 32 aa, Staphylococcus
AQQRAYVPYSHFKVGAYLKTKDGRHFYGANVE

SEQ ID NO: 2060156 - protein, 20 aa, Staphylococcus
AQREFKQFFPKSGWVEHDAN

SEQ ID NO: 2060157 - protein, 21 aa, Staphylococcus
AQRILYSAFDLVKERSGREAV

SEQ ID NO: 2060158 - protein, 25 aa, Staphylococcus
AQRLKLIRHLNSPLSDLVYIIDEPS

SEQ ID NO: 2060159 - protein, 24 aa, Staphylococcus
AQRLKLIRHLNSSLSDLVYIIDEP

SEQ ID NO: 2060160 - protein, 24 aa, Staphylococcus
AQRRRRVFIFGYKQDLNYADLIDK

SEQ ID NO: 2060161 - protein, 25 aa, Staphylococcus
AQSKKFFEYYTPLLRNGGLVITDNV

SEQ ID NO: 2060162 - protein, 24 aa, Staphylococcus
AQTCYQFKVPFIITRAVSDLANGE

SEQ ID NO: 2060163 - protein, 24 aa, Staphylococcus
AQTDIQVPIYLKLTSDLNLDDFKN

SEQ ID NO: 2060164 - protein, 23 aa, Staphylococcus
AQTIIRGLRAVSDFEYELRLTSM

SEQ ID NO: 2060165 - protein, 22 aa, Staphylococcus
AQTLANVYLALDNDLELLPVIN

SEQ ID NO: 2060166 - protein, 21 aa, Staphylococcus
AQTLANVYLALDNDLELLPVV

SEQ ID NO: 2060167 - protein, 22 aa, Staphylococcus
AQTLANVYLALDNNLELLPVVN

SEQ ID NO: 2060168 - protein, 22 aa, Staphylococcus
AQTMKHVAINFAKLILCAEDSQ

SEQ ID NO: 2060169 - protein, 23 aa, Staphylococcus
AQTPFGYGRIVRDQNHHLNRIVE

SEQ ID NO: 2060170 - protein, 25 aa, Staphylococcus
AQTYNFKHAIIATGSRPIEIPNFEF

SEQ ID NO: 2060171 - protein, 24 aa, Staphylococcus
AQTYNFKHAIIATGSRPIEIPNFK

SEQ ID NO: 2060172 - protein, 18 aa, Staphylococcus
AQVKQIFYIGFYADQHNN

SEQ ID NO: 2060173 - protein, 26 aa, Staphylococcus
AQVMDEVLFPLIPQKRLIDIQEIADY

SEQ ID NO: 2060174 - protein, 25 aa, Staphylococcus
AQYPYQYLRRDFGILGVDMHLHANG

SEQ ID NO: 2060175 - protein, 23 aa, Staphylococcus
AQYQRILKQKNNYLKQLQIGQKT

SEQ ID NO: 2060176 - protein, 23 aa, Staphylococcus
AQYQRILKQKNNYLKQLQLGQKQ

SEQ ID NO: 2060177 - protein, 23 aa, Staphylococcus
AQYQRILKQKNNYLKQLQYGHKT

SEQ ID NO: 2060178 - protein, 20 aa, Staphylococcus
AQYRPFISQLGYLYDYQKPN

SEQ ID NO: 2060179 - protein, 32 aa, Staphylococcus
ARADAFYQPKPGTDLVWLGAATKYIIDNDLHD

SEQ ID NO: 2060180 - protein, 18 aa, Staphylococcus
ARAFITNPSIIFADEPTG

SEQ ID NO: 2060181 - protein, 22 aa, Staphylococcus
ARAGIYKWYIDIIAGTCAYIDK

SEQ ID NO: 2060182 - protein, 20 aa, Staphylococcus
ARAHQLAIKLSSSWSFLVPE

SEQ ID NO: 2060183 - protein, 18 aa, Staphylococcus
ARAIINEPKFIIADEPTG

SEQ ID NO: 2060184 - protein, 29 aa, Staphylococcus
ARCHRLIVSNYLAAHGWRVLHIMQNNKGD

SEQ ID NO: 2060185 - protein, 18 aa, Staphylococcus
ARDYELQTGAYYLNQFES

SEQ ID NO: 2060186 - protein, 18 aa, Staphylococcus
AREDVFITSKLWNDYQGY

SEQ ID NO: 2060187 - protein, 17 aa, Staphylococcus
AREILDELGILKEGVFT

SEQ ID NO: 2060188 - protein, 22 aa, Staphylococcus
ARELIRLIQQLRKKKNLPINQR

SEQ ID NO: 2060189 - protein, 25 aa, Staphylococcus
ARERGLIILTAGQNVIRLLPPLTIS

SEQ ID NO: 2060190 - protein, 23 aa, Staphylococcus
AREVHHIACLLGYGANAVVPYLA

SEQ ID NO: 2060191 - protein, 25 aa, Staphylococcus
AREVRGILDMKGGFTDSISSAFSSG

SEQ ID NO: 2060192 - protein, 19 aa, Staphylococcus
ARGIEVDAKFLFGAKIKIT

SEQ ID NO: 2060193 - protein, 31 aa, Staphylococcus
ARGKLAAYMTPRLQPWDFAGGLIILNEVGGV

SEQ ID NO: 2060194 - protein, 31 aa, Staphylococcus
ARGQLAAYITPRLQPWDFAGGLIILNEVGGI

SEQ ID NO: 2060195 - protein, 23 aa, Staphylococcus
ARGTARLFFIFSDDDLIGTIDLH

SEQ ID NO: 2060196 - protein, 18 aa, Staphylococcus
ARHILADFMFYGKDVFKK

SEQ ID NO: 2060197 - protein, 18 aa, Staphylococcus
ARIASIKGGLPESVPAFT

SEQ ID NO: 2060198 - protein, 18 aa, Staphylococcus
ARIPLSQAVIELSLSPKS

SEQ ID NO: 2060199 - protein, 17 aa, Staphylococcus
ARISAHYSLGLKAKVNL

SEQ ID NO: 2060200 - protein, 23 aa, Staphylococcus
ARKEFLDKYKLKPPIHEWEKKGL

SEQ ID NO: 2060201 - protein, 17 aa, Staphylococcus
ARKGLPYVFAGHFAPQQ

SEQ ID NO: 2060202 - protein, 27 aa, Staphylococcus
ARKGTVHVYRPFFIETYATVYQMTSMV

SEQ ID NO: 2060203 - protein, 21 aa, Staphylococcus
ARKHPWLLDIYKKRGYEIYNE

SEQ ID NO: 2060204 - protein, 27 aa, Staphylococcus
ARKLKEGFFFAALTPTLRHLGKLEEEF

SEQ ID NO: 2060205 - protein, 26 aa, Staphylococcus
ARKMGYFDIPKDLLLPINEVENYPKN

SEQ ID NO: 2060206 - protein, 34 aa, Staphylococcus
ARLILDKVHNKKPIKRLWISSITAKAIRNGFKQL

SEQ ID NO: 2060207 - protein, 34 aa, Staphylococcus
ARLILDKVHNKKPIKRLWISSVTKKAIQEGFKKL

SEQ ID NO: 2060208 - protein, 22 aa, Staphylococcus
ARLKLKDYFIKQIRAYMAGKQP

SEQ ID NO: 2060209 - protein, 18 aa, Staphylococcus
ARLKLLVAISNHLNKNQL

SEQ ID NO: 2060210 - protein, 23 aa, Staphylococcus
ARLTNFGAFVDIGGVDGLVHVSE

SEQ ID NO: 2060211 - protein, 18 aa, Staphylococcus
ARLYTNPMRILDCKVDRD

SEQ ID NO: 2060212 - protein, 33 aa, Staphylococcus
ARMDNYVVLRFGWLYGPGTWYGKDGMIYNQFID

SEQ ID NO: 2060213 - protein, 33 aa, Staphylococcus
ARMDQYVVLRFGWLYGPGTWYGKDGMIYNQFKD

SEQ ID NO: 2060214 - protein, 20 aa, Staphylococcus
ARNELHYLLDNIPTVKHVEE

SEQ ID NO: 2060215 - protein, 42 aa, Staphylococcus
ARNIFFEKALKVLRPVYLNQSTIPTFYIVNVGGGYLDGDRYR

SEQ ID NO: 2060216 - protein, 28 aa, Staphylococcus
ARNISEAAYLLWLLSPDDLGISTNHDFH

SEQ ID NO: 2060217 - protein, 23 aa, Staphylococcus
ARNNVAHDLLITGAILGVNIHVA

SEQ ID NO: 2060218 - protein, 30 aa, Staphylococcus
ARPIRDLLPVIPEFADYTLIGGNGAIISQN

SEQ ID NO: 2060219 - protein, 26 aa, Staphylococcus
ARPKKIGLATLVDRGHRELPIRADFV

SEQ ID NO: 2060220 - protein, 18 aa, Staphylococcus
ARPMRRSFKFDGRKIRLV

SEQ ID NO: 2060221 - protein, 26 aa, Staphylococcus
ARPVWKPMHLQPYFESYDYIMVDGVD

SEQ ID NO: 2060222 - protein, 26 aa, Staphylococcus
ARQDIERLLGSKVYLELWVKVQKDWR

SEQ ID NO: 2060223 - protein, 17 aa, Staphylococcus
ARQGLPYVFAGHFAPQQ

SEQ ID NO: 2060224 - protein, 24 aa, Staphylococcus
ARQHNLHATFMPKPLFGVNGSGMH

SEQ ID NO: 2060225 - protein, 17 aa, Staphylococcus
ARQIAINAGVPNTTPAM

SEQ ID NO: 2060226 - protein, 26 aa, Staphylococcus
ARQMFDFIENHYLDLPFKSKEAIYNY

SEQ ID NO: 2060227 - protein, 23 aa, Staphylococcus
ARQNKYFYTEILGLRLVEKTVNQ

SEQ ID NO: 2060228 - protein, 18 aa, Staphylococcus
ARQRQLIQTLFPNDAHKI

SEQ ID NO: 2060229 - protein, 23 aa, Staphylococcus
ARRGELVSCFLLEADDSLNSINF

SEQ ID NO: 2060230 - protein, 24 aa, Staphylococcus
ARRIVDRLVGYNISPVLWKKVKKG

SEQ ID NO: 2060231 - protein, 22 aa, Staphylococcus
ARRKREVIGRKLHIGHSNGKQL

SEQ ID NO: 2060232 - protein, 22 aa, Staphylococcus
ARRLHTILEKMLEDLSFEAPNM

SEQ ID NO: 2060233 - protein, 22 aa, Staphylococcus
ARRLHTILEKMLEDLSFEAPSM

SEQ ID NO: 2060234 - protein, 27 aa, Staphylococcus
ARRRESIFMTYILKYHPRFKDADIPVW

SEQ ID NO: 2060235 - protein, 27 aa, Staphylococcus
ARRRETLFIDYILKHHPRFADADIPIW

SEQ ID NO: 2060236 - protein, 24 aa, Staphylococcus
ARRRKSRGLKLNHPEALALISDEL

SEQ ID NO: 2060237 - protein, 30 aa, Staphylococcus
ARRTYAFTELFMFELRMQWLNRLEKAADNA

SEQ ID NO: 2060238 - protein, 30 aa, Staphylococcus
ARRTYAFTELFMFELRMQWLNRLEKASDDA

SEQ ID NO: 2060239 - protein, 30 aa, Staphylococcus
ARRTYAFTELFMFELRMQWLNRLEKASDEA

SEQ ID NO: 2060240 - protein, 30 aa, Staphylococcus
ARRTYAFTELFMFELRMQWLNRLEKSSDEA

SEQ ID NO: 2060241 - protein, 23 aa, Staphylococcus
ARSIPFKFASYMSASKFFKDYAL

SEQ ID NO: 2060242 - protein, 23 aa, Staphylococcus
ARSLLSKVLVRATKKWPTDRSFN

SEQ ID NO: 2060243 - protein, 27 aa, Staphylococcus
ARSQRDYLFFKFAIHTGIKLTDLLNMK

SEQ ID NO: 2060244 - protein, 22 aa, Staphylococcus
ARTIIRGLRAVSDFEYELRLTS

SEQ ID NO: 2060245 - protein, 22 aa, Staphylococcus
ARTLDLCLDVLVLPTGEYELVD

SEQ ID NO: 2060246 - protein, 21 aa, Staphylococcus
ARTVMHFHPALAPYKAAILPL

SEQ ID NO: 2060247 - protein, 26 aa, Staphylococcus
ARVQDWTFPFVIKPGDDLPTAGGYGV

SEQ ID NO: 2060248 - protein, 26 aa, Staphylococcus
ARYHANEIGYLLYRSSDGLTYEQRAS

SEQ ID NO: 2060249 - protein, 20 aa, Staphylococcus
ARYKTFIAEALHLSVQDITG

SEQ ID NO: 2060250 - protein, 26 aa, Staphylococcus
ASAKENINCRCKLLYYIDEDELPTVM

SEQ ID NO: 2060251 - protein, 25 aa, Staphylococcus
ASALETLRRYRFDKVFLGMNGIDLK

SEQ ID NO: 2060252 - protein, 19 aa, Staphylococcus
ASALVGALYIANYFGNIQL

SEQ ID NO: 2060253 - protein, 22 aa, Staphylococcus
ASATEYRFFLKGLSSHVADKEQ

SEQ ID NO: 2060254 - protein, 25 aa, Staphylococcus
ASAVKNLPLIKYSIDQILMTKEGTM

SEQ ID NO: 2060255 - protein, 24 aa, Staphylococcus
ASAVKNLPLIKYSIDQVLMTKEGC

SEQ ID NO: 2060256 - protein, 25 aa, Staphylococcus
ASAVQIHHLLGIQPFARCFEMKEAC

SEQ ID NO: 2060257 - protein, 17 aa, Staphylococcus
ASAYGKLNIMFPMVATI

SEQ ID NO: 2060258 - protein, 18 aa, Staphylococcus
ASAYGKLNIMFPMVATIN

SEQ ID NO: 2060259 - protein, 25 aa, Staphylococcus
ASAYHILDLVFWFGKMDILQGHSIK

SEQ ID NO: 2060260 - protein, 22 aa, Staphylococcus
ASCKAYVEAHAKYIAQDLEKVG

SEQ ID NO: 2060261 - protein, 26 aa, Staphylococcus
ASDFNRPGHLFPLIAKDNGVLERNGH

SEQ ID NO: 2060262 - protein, 23 aa, Staphylococcus
ASDGMLVKRPLAISGEKITLGFK

SEQ ID NO: 2060263 - protein, 19 aa, Staphylococcus
ASDIKAQWEGAIAQCLTTV

SEQ ID NO: 2060264 - protein, 26 aa, Staphylococcus
ASDLTYVDYIGVGPIFATPSKDDASE

SEQ ID NO: 2060265 - protein, 25 aa, Staphylococcus
ASDNKTLGRFSLTDIPPAPRGVPQI

SEQ ID NO: 2060266 - protein, 25 aa, Staphylococcus
ASDVDLFIKPYIKLSKDVFPASVKS

SEQ ID NO: 2060267 - protein, 26 aa, Staphylococcus
ASDVILYDRLVNKEILDFAKPHTKFF

SEQ ID NO: 2060268 - protein, 19 aa, Staphylococcus
ASEIMAILCLARDIKDLKS

SEQ ID NO: 2060269 - protein, 23 aa, Staphylococcus
ASEMLRSFLQRHHFSKRTISAIK

SEQ ID NO: 2060270 - protein, 25 aa, Staphylococcus
ASEPSPLLYIAPYSGVTMGEEFMFN

SEQ ID NO: 2060271 - protein, 23 aa, Staphylococcus
ASEVFFFFTVPQKDELYYSQHIP

SEQ ID NO: 2060272 - protein, 17 aa, Staphylococcus
ASEVPSAIFGTKKPRPL

SEQ ID NO: 2060273 - protein, 34 aa, Staphylococcus
ASFSWYEYSPLRVKYPYIRGKLLDLWNTALEENN

SEQ ID NO: 2060274 - protein, 35 aa, Staphylococcus
ASFSWYEYSPLRVKYPYIRGKLLDLWTEALEDNNG

SEQ ID NO: 2060275 - protein, 34 aa, Staphylococcus
ASFSWYEYSPLRVKYPYIRGKLLDLWTQALEENN

SEQ ID NO: 2060276 - protein, 34 aa, Staphylococcus
ASFSWYEYSPLRVKYPYIRGKLLDLWTTALEENN

SEQ ID NO: 2060277 - protein, 20 aa, Staphylococcus
ASFVPMKRIAQPEDVARAVA

SEQ ID NO: 2060278 - protein, 26 aa, Staphylococcus
ASGIEYFTPILNLGETGILGVGALAK

SEQ ID NO: 2060279 - protein, 19 aa, Staphylococcus
ASGKYFDFYKSQEFVPQFE

SEQ ID NO: 2060280 - protein, 25 aa, Staphylococcus
ASGLDNVILLSDYQKHSFGKNFGVL

SEQ ID NO: 2060281 - protein, 29 aa, Staphylococcus
ASGLPSFTYTFLGFLPRKEKQKHSILEQR

SEQ ID NO: 2060282 - protein, 24 aa, Staphylococcus
ASGNAFNLALSYAKGIGATKAGVI

SEQ ID NO: 2060283 - protein, 22 aa, Staphylococcus
ASGPLYGFSFVKMSQVVNEEID

SEQ ID NO: 2060284 - protein, 24 aa, Staphylococcus
ASGSAAIYTARKGLRTGIVADRIG

SEQ ID NO: 2060285 - protein, 24 aa, Staphylococcus
ASGTLEFFDYTYSGWRGVTLNSGM

SEQ ID NO: 2060286 - protein, 22 aa, Staphylococcus
ASGYINHLLQLIGPSISQQQAY

SEQ ID NO: 2060287 - protein, 18 aa, Staphylococcus
ASHSYVGQFLQKVGFNGS

SEQ ID NO: 2060288 - protein, 20 aa, Staphylococcus
ASIIGFTRNIAAELGQYGIT

SEQ ID NO: 2060289 - protein, 23 aa, Staphylococcus
ASIILLIVNILTDEQLHRLYHYA

SEQ ID NO: 2060290 - protein, 22 aa, Staphylococcus
ASIISRYAFVKHMDQIGSELHT

SEQ ID NO: 2060291 - protein, 19 aa, Staphylococcus
ASIKQLRMWASQSNPPNAA

SEQ ID NO: 2060292 - protein, 27 aa, Staphylococcus
ASILNTFALFDINLSWIESRPLKTQLG

SEQ ID NO: 2060293 - protein, 26 aa, Staphylococcus
ASILTTFALFDINLSWIESRPLKTQL

SEQ ID NO: 2060294 - protein, 18 aa, Staphylococcus
ASISGRYYAMDRDKRWER

SEQ ID NO: 2060295 - protein, 22 aa, Staphylococcus
ASIVLLIVNILTDKELKTLYDY

SEQ ID NO: 2060296 - protein, 32 aa, Staphylococcus
ASIVYPLLNELQFFKYVPFFKSFNTSAIEIKD

SEQ ID NO: 2060297 - protein, 21 aa, Staphylococcus
ASKAPIRKFAVKIQQKLAHQK

SEQ ID NO: 2060298 - protein, 18 aa, Staphylococcus
ASKGLEFPFVIYSGLSKS

SEQ ID NO: 2060299 - protein, 20 aa, Staphylococcus
ASKHLYLKGIHFHVGSQIEG

SEQ ID NO: 2060300 - protein, 19 aa, Staphylococcus
ASKIATFIRRDIFEQTGLT

SEQ ID NO: 2060301 - protein, 30 aa, Staphylococcus
ASKKNSLEHLLFGLGIRHLGVKASQVIAER

SEQ ID NO: 2060302 - protein, 29 aa, Staphylococcus
ASKLIVNSIRHLLKLKDKLGFHVVITGHE

SEQ ID NO: 2060303 - protein, 18 aa, Staphylococcus
ASKRFTIVPSWETYTKDS

SEQ ID NO: 2060304 - protein, 17 aa, Staphylococcus
ASKSLLQYVSGLSSTIA

SEQ ID NO: 2060305 - protein, 22 aa, Staphylococcus
ASKSLLQYVSGLSSTIAQNIID

SEQ ID NO: 2060306 - protein, 17 aa, Staphylococcus
ASKYMSKPDARILGMIG

SEQ ID NO: 2060307 - protein, 33 aa, Staphylococcus
ASKYTRSKLRKALPKQFVFIIEELLYKNNGLDN

SEQ ID NO: 2060308 - protein, 26 aa, Staphylococcus
ASLIHRPELLILDEPFSGLDPVNVEL

SEQ ID NO: 2060309 - protein, 19 aa, Staphylococcus
ASLIRFPESALRPLGRTAA

SEQ ID NO: 2060310 - protein, 19 aa, Staphylococcus
ASLIRFPETALRPLGRTAA

SEQ ID NO: 2060311 - protein, 23 aa, Staphylococcus
ASLKDFAAVGLLFRSGDDYIWKT

SEQ ID NO: 2060312 - protein, 22 aa, Staphylococcus
ASLKEIEHNLTALTFNYLRSQD

SEQ ID NO: 2060313 - protein, 25 aa, Staphylococcus
ASLKSYLYDLNQKGVKGRILTSNYL

SEQ ID NO: 2060314 - protein, 23 aa, Staphylococcus
ASLLHEDLKIRKFIDKELKEASV

SEQ ID NO: 2060315 - protein, 22 aa, Staphylococcus
ASLLHEDLKIRKYIDNALQEAS

SEQ ID NO: 2060316 - protein, 24 aa, Staphylococcus
ASLLTHVFGLHHFAEYESSEFEDK

SEQ ID NO: 2060317 - protein, 27 aa, Staphylococcus
ASNAIFKVETLFPYITLSHFCDEENAN

SEQ ID NO: 2060318 - protein, 17 aa, Staphylococcus
ASNATIHRFTRKLGFDG

SEQ ID NO: 2060319 - protein, 22 aa, Staphylococcus
ASNATIHRFTRKLGFDGYSDFK

SEQ ID NO: 2060320 - protein, 29 aa, Staphylococcus
ASNHQYLQTFWNHLKPVIETLVLLSMRHR

SEQ ID NO: 2060321 - protein, 26 aa, Staphylococcus
ASQEQRLFISPLARKMADKEDLDITR

SEQ ID NO: 2060322 - protein, 23 aa, Staphylococcus
ASQIYYHELNLETPIVNFNGAFV

SEQ ID NO: 2060323 - protein, 28 aa, Staphylococcus
ASQKNQFPWVVAAFPSKAWAQRVYPNKS

SEQ ID NO: 2060324 - protein, 24 aa, Staphylococcus
ASQYFDRIMLLNQTLRYFGDAEDA

SEQ ID NO: 2060325 - protein, 26 aa, Staphylococcus
ASREYLNYTYSKFFEKMKPQIAEQFY

SEQ ID NO: 2060326 - protein, 23 aa, Staphylococcus
ASRFRQIFHIQPETGLLNDPNGL

SEQ ID NO: 2060327 - protein, 22 aa, Staphylococcus
ASRKYKFISQPIKGLFKSSYVA

SEQ ID NO: 2060328 - protein, 17 aa, Staphylococcus
ASRLGGYAVDLLMQGRS

SEQ ID NO: 2060329 - protein, 36 aa, Staphylococcus
ASRLTMIYVDTGAMYRAITYKYLQNGKPSNFDELIQ

SEQ ID NO: 2060330 - protein, 18 aa, Staphylococcus
ASRMRFFFPDVQARGYYP

SEQ ID NO: 2060331 - protein, 25 aa, Staphylococcus
ASRTLMFNIYDLKWDDELLEILDVP

SEQ ID NO: 2060332 - protein, 28 aa, Staphylococcus
ASSKSDMPAFWFDPLVNLAAISQVTQHV

SEQ ID NO: 2060333 - protein, 23 aa, Staphylococcus
ASSVLYPILKRPDEKRVTERAYE

SEQ ID NO: 2060334 - protein, 28 aa, Staphylococcus
ASTAELTFGLVLAVARRIVEGDKLSRTQ

SEQ ID NO: 2060335 - protein, 25 aa, Staphylococcus
ASTENHWFEWLATQMKSYDYHTEIV

SEQ ID NO: 2060336 - protein, 24 aa, Staphylococcus
ASTKGAIVSFTRSLATTLMEKNIR

SEQ ID NO: 2060337 - protein, 23 aa, Staphylococcus
ASTNLPYIYLSAGVSADLFQKTL

SEQ ID NO: 2060338 - protein, 33 aa, Staphylococcus
ASTSKKLVRIYYQGQLYPAAWTNEYMARTFLED

SEQ ID NO: 2060339 - protein, 20 aa, Staphylococcus
ASVLRTLIWTPDASRALALL

SEQ ID NO: 2060340 - protein, 30 aa, Staphylococcus
ASVSDSMHVLPFKTFFVPARGGLGENMVYQ

SEQ ID NO: 2060341 - protein, 25 aa, Staphylococcus
ASVVNLPELLPTAEYQIDYKAKSSG

SEQ ID NO: 2060342 - protein, 29 aa, Staphylococcus
ASYLKEFMNIYALLIPKVTDIESIKFLVE

SEQ ID NO: 2060343 - protein, 26 aa, Staphylococcus
ASYQKVFNYFTPKFMLGMTATPERTD

SEQ ID NO: 2060344 - protein, 24 aa, Staphylococcus
ASYQRFKIGPKETLNILQSLYERH

SEQ ID NO: 2060345 - protein, 17 aa, Staphylococcus
ASYYKFKQPSLLYDQQI

SEQ ID NO: 2060346 - protein, 21 aa, Staphylococcus
ASYYKFKQPSLLYDQQIQKKD

SEQ ID NO: 2060347 - protein, 20 aa, Staphylococcus
ASYYKFQTPSLLYDQQIQKR

SEQ ID NO: 2060348 - protein, 27 aa, Staphylococcus
ATADLWQRLIQLWSDQTVLIVEHKVEH

SEQ ID NO: 2060349 - protein, 27 aa, Staphylococcus
ATAELTFGLVLAVARRIVEGDKLSRTQ

SEQ ID NO: 2060350 - protein, 23 aa, Staphylococcus
ATAPNPFGYGRIVRDEEGRLSNI

SEQ ID NO: 2060351 - protein, 28 aa, Staphylococcus
ATAPVFNFVLPYMLQFIENLPVVAHNAA

SEQ ID NO: 2060352 - protein, 27 aa, Staphylococcus
ATDLQQPITPLLFKASGPSFVTETIYP

SEQ ID NO: 2060353 - protein, 27 aa, Staphylococcus
ATDLQQPITPLLFLADGPSFVTDTIYP

SEQ ID NO: 2060354 - protein, 27 aa, Staphylococcus
ATDLQQPITPLLFMADGPSFVTETIYP

SEQ ID NO: 2060355 - protein, 27 aa, Staphylococcus
ATDLQQPITPLLFMTDGPSFVTETIYP

SEQ ID NO: 2060356 - protein, 27 aa, Staphylococcus
ATDLQQPITPLLFMTNGPSFVTDTIYP

SEQ ID NO: 2060357 - protein, 19 aa, Staphylococcus
ATDLRLMMAALKIASDFER

SEQ ID NO: 2060358 - protein, 25 aa, Staphylococcus
ATDPRILSKAKRLDYFSYEEMMEMS

SEQ ID NO: 2060359 - protein, 31 aa, Staphylococcus
ATEFEIITTMMFLYFGEIRPVDFVVIEAGLG

SEQ ID NO: 2060360 - protein, 35 aa, Staphylococcus
ATEGILGVRPSYSYKLLIILSPSGSYYGGASLNPT

SEQ ID NO: 2060361 - protein, 25 aa, Staphylococcus
ATEHRLPFILFSASGGARMQEGIIS

SEQ ID NO: 2060362 - protein, 25 aa, Staphylococcus
ATEHSIAMILAMARNIPQAHQSLKA

SEQ ID NO: 2060363 - protein, 25 aa, Staphylococcus
ATEHSIAMILAMARNIPQAHQSLRN

SEQ ID NO: 2060364 - protein, 24 aa, Staphylococcus
ATEHSMAMILAMARQIPMAHQSLK

SEQ ID NO: 2060365 - protein, 20 aa, Staphylococcus
ATEHSMAMILSMARNIPQAH

SEQ ID NO: 2060366 - protein, 25 aa, Staphylococcus
ATEHSVAMILAMARNIPQAHASLKN

SEQ ID NO: 2060367 - protein, 25 aa, Staphylococcus
ATEISVVPVLLLSAGHYYKDIPAEI

SEQ ID NO: 2060368 - protein, 25 aa, Staphylococcus
ATENHIEFATINPVAILGPSLNQHM

SEQ ID NO: 2060369 - protein, 17 aa, Staphylococcus
ATEPDNTIDYLKTILNK

SEQ ID NO: 2060370 - protein, 25 aa, Staphylococcus
ATEQMEEEMFLGLRLNNGVNKNKFN

SEQ ID NO: 2060371 - protein, 32 aa, Staphylococcus
ATEVYHFIQPDHFYFLPSYMSPLKDHKQHLNT

SEQ ID NO: 2060372 - protein, 19 aa, Staphylococcus
ATEYRFFLKGLSSHVADKE

SEQ ID NO: 2060373 - protein, 20 aa, Staphylococcus
ATFLPLNVIQPRRVAQEIKQ

SEQ ID NO: 2060374 - protein, 25 aa, Staphylococcus
ATFQDRRKAFQFAYLSLLQEENIQA

SEQ ID NO: 2060375 - protein, 18 aa, Staphylococcus
ATFTLAVNRTFTNAQGER

SEQ ID NO: 2060376 - protein, 20 aa, Staphylococcus
ATGIIVADPLIIETCKAVAP

SEQ ID NO: 2060377 - protein, 21 aa, Staphylococcus
ATGIIVADPLIIETCKRVAPN

SEQ ID NO: 2060378 - protein, 30 aa, Staphylococcus
ATGIRIGFLIGPEYLIEKLTFMHAYNCICA

SEQ ID NO: 2060379 - protein, 31 aa, Staphylococcus
ATGKLGAYMTPRLQPWDFAGGLIILNEVGGV

SEQ ID NO: 2060380 - protein, 26 aa, Staphylococcus
ATGKYDMRFFNTIGAAAQLQQGKQYS

SEQ ID NO: 2060381 - protein, 18 aa, Staphylococcus
ATGNLAVKHPLFEQLRSF

SEQ ID NO: 2060382 - protein, 29 aa, Staphylococcus
ATGNLAVKHPLFEYARTFDYVVITEKGIF

SEQ ID NO: 2060383 - protein, 25 aa, Staphylococcus
ATGSKAFVLPIPGSDLPSVIGWRTI

SEQ ID NO: 2060384 - protein, 25 aa, Staphylococcus
ATGSKAFVLPIPGSELPSVIGWRTI

SEQ ID NO: 2060385 - protein, 24 aa, Staphylococcus
ATGSKPFIPPIEGLNDIKYETTDT

SEQ ID NO: 2060386 - protein, 27 aa, Staphylococcus
ATGSQPMDLPFLPFDHKIVLSSDDILK

SEQ ID NO: 2060387 - protein, 32 aa, Staphylococcus
ATGVVNLVNFYYPKLTFKSSILPLIKDNKVTA

SEQ ID NO: 2060388 - protein, 32 aa, Staphylococcus
ATGVVNLVNFYYPKLTFKSSILPLIKENKVTA

SEQ ID NO: 2060389 - protein, 31 aa, Staphylococcus
ATGVVNLVNFYYPKLTFKSSILQLIKENNVT

SEQ ID NO: 2060390 - protein, 32 aa, Staphylococcus
ATGVVNLVNFYYPKLTFKSSILSLIKENKVTA

SEQ ID NO: 2060391 - protein, 22 aa, Staphylococcus
ATGYINHLLQLIGPSISQQQAY

SEQ ID NO: 2060392 - protein, 18 aa, Staphylococcus
ATHKDIQLISLTGSMRAG

SEQ ID NO: 2060393 - protein, 25 aa, Staphylococcus
ATHKINRYAFFDQLISQIVYRYQQF

SEQ ID NO: 2060394 - protein, 22 aa, Staphylococcus
ATHTPVWFMRQAGRSQPEYRKL

SEQ ID NO: 2060395 - protein, 19 aa, Staphylococcus
ATIHRFTRKLGFDGYSDFK

SEQ ID NO: 2060396 - protein, 25 aa, Staphylococcus
ATINKSTFKGPKGPTGYMIPTVVEW

SEQ ID NO: 2060397 - protein, 20 aa, Staphylococcus
ATISIIKYWVQDDSRISVND

SEQ ID NO: 2060398 - protein, 27 aa, Staphylococcus
ATITFQNLFKLFDKFAGMTGTGKQGEK

SEQ ID NO: 2060399 - protein, 25 aa, Staphylococcus
ATIVFDPNVRLPLWQNAEACKEAIH

SEQ ID NO: 2060400 - protein, 23 aa, Staphylococcus
ATKAWYNTYLNIYAVSTINELLA

SEQ ID NO: 2060401 - protein, 22 aa, Staphylococcus
ATKIEVTIPLKKVTLRAEERND

SEQ ID NO: 2060402 - protein, 25 aa, Staphylococcus
ATKKLNFEAPYEYVSKMRASILVMG

SEQ ID NO: 2060403 - protein, 25 aa, Staphylococcus
ATLADRRKAFQFAYLSLMQQQEIQA

SEQ ID NO: 2060404 - protein, 30 aa, Staphylococcus
ATLDLVHEAYLIRRHYFGHKVKLNMILNAK

SEQ ID NO: 2060405 - protein, 24 aa, Staphylococcus
ATLEGLSPLLYYIDAQSKEKENYE

SEQ ID NO: 2060406 - protein, 36 aa, Staphylococcus
ATLELVEQLKFFINERIIPVIPQQGSLGASGDLAPL

SEQ ID NO: 2060407 - protein, 18 aa, Staphylococcus
ATLFDGEKFVPDSQFGVG

SEQ ID NO: 2060408 - protein, 18 aa, Staphylococcus
ATLILPNNLLTRKVKDTT

SEQ ID NO: 2060409 - protein, 31 aa, Staphylococcus
ATLMEDFTKPNPFTRFIRAKATLTPSGTTVV

SEQ ID NO: 2060410 - protein, 25 aa, Staphylococcus
ATLQDRRKAFQFAYLSLMQEENIQA

SEQ ID NO: 2060411 - protein, 24 aa, Staphylococcus
ATLQDRRKAFQFAYLSLMQKEDIQ

SEQ ID NO: 2060412 - protein, 24 aa, Staphylococcus
ATLSFRTMALINKPYHIKLPVNVQ

SEQ ID NO: 2060413 - protein, 26 aa, Staphylococcus
ATLSFRTMALLNRPYHIKLPVEVQAT

SEQ ID NO: 2060414 - protein, 26 aa, Staphylococcus
ATLSPIDSYLLQRGLKTLHLRIERSE

SEQ ID NO: 2060415 - protein, 25 aa, Staphylococcus
ATLSPLDCYLLQRGLKTLHLRIERS

SEQ ID NO: 2060416 - protein, 25 aa, Staphylococcus
ATLSPLDSYLLQRGLKTLHLRVERA

SEQ ID NO: 2060417 - protein, 24 aa, Staphylococcus
ATLSSDIYRLWQNAFIVGRDDATK

SEQ ID NO: 2060418 - protein, 24 aa, Staphylococcus
ATMDLGLTMRLVAPSVTFSTGHFK

SEQ ID NO: 2060419 - protein, 23 aa, Staphylococcus
ATMKFMEMFSDYYNFNLKSLIND

SEQ ID NO: 2060420 - protein, 20 aa, Staphylococcus
ATMPTYLNALAGRGVHVITV

SEQ ID NO: 2060421 - protein, 18 aa, Staphylococcus
ATMPVYLNALTGRGVHVI

SEQ ID NO: 2060422 - protein, 22 aa, Staphylococcus
ATNIWQVNFIRASDGLFGGAEI

SEQ ID NO: 2060423 - protein, 24 aa, Staphylococcus
ATNLGAQPPFTYLVPESYDAMRIV

SEQ ID NO: 2060424 - protein, 24 aa, Staphylococcus
ATNLGAQPPFTYLVPESYEAMRIV

SEQ ID NO: 2060425 - protein, 28 aa, Staphylococcus
ATNLGAQPPFTYLVPESYLAMEIVHQCR

SEQ ID NO: 2060426 - protein, 23 aa, Staphylococcus
ATPYRLNDIFTRMKREGKAVFLV

SEQ ID NO: 2060427 - protein, 18 aa, Staphylococcus
ATQFALNSFKQPIIWLCG

SEQ ID NO: 2060428 - protein, 18 aa, Staphylococcus
ATQFALNSFTQPIIWLCG

SEQ ID NO: 2060429 - protein, 25 aa, Staphylococcus
ATQHLAQFKSNVKVSLFIGGTDIEK

SEQ ID NO: 2060430 - protein, 17 aa, Staphylococcus
ATQIGSRLSGVLYVLDE

SEQ ID NO: 2060431 - protein, 24 aa, Staphylococcus
ATQPEVYLNIVKLKNIILQQVPQC

SEQ ID NO: 2060432 - protein, 36 aa, Staphylococcus
ATQSLKWAVDEMEKRYKLFAQFHVRNITAFNKKAPY

SEQ ID NO: 2060433 - protein, 34 aa, Staphylococcus
ATQSLKWAVDEMEKRYKLFAQYHVRNITAFNKKA

SEQ ID NO: 2060434 - protein, 35 aa, Staphylococcus; identical to SEQ ID NO: 1825504

SEQ ID NO: 2060435 - protein, 35 aa, Staphylococcus
ATQSLKWAVEEMERRYKLFAQYHVRNITAFNKKAS

SEQ ID NO: 2060436 - protein, 23 aa, Staphylococcus
ATQSLKWAVEEMERRYKVFAKYH

SEQ ID NO: 2060437 - protein, 35 aa, Staphylococcus
ATQYFGHIDAIVNNALVGFKFDPVQQQAFVDLTWE

SEQ ID NO: 2060438 - protein, 19 aa, Staphylococcus
ATRILTERDILLVPDVLAS

SEQ ID NO: 2060439 - protein, 27 aa, Staphylococcus
ATRILTERGILLVPDVLASAGGVTVSY

SEQ ID NO: 2060440 - protein, 23 aa, Staphylococcus
ATRKIEFATINPVAMMGPSLDAH

SEQ ID NO: 2060441 - protein, 25 aa, Staphylococcus
ATRLLQALDVWLLGKRYFAEFERFP

SEQ ID NO: 2060442 - protein, 24 aa, Staphylococcus
ATSFEHLMTLLKTKRYTYTHIQRL

SEQ ID NO: 2060443 - protein, 26 aa, Staphylococcus
ATSLITLKIAELLRASTIPAGLVQIL

SEQ ID NO: 2060444 - protein, 17 aa, Staphylococcus
ATSPYSIIIRGAKYRFE

SEQ ID NO: 2060445 - protein, 31 aa, Staphylococcus
ATTALFAQLYTIDIIFYRFIARNYHDSLDYI

SEQ ID NO: 2060446 - protein, 26 aa, Staphylococcus
ATTAQLMIIAFEKFESLPLDTLKQLY

SEQ ID NO: 2060447 - protein, 17 aa, Staphylococcus
ATTEFLLAQSKKIKNEI

SEQ ID NO: 2060448 - protein, 17 aa, Staphylococcus
ATTGGFLKAGNTTFLCG

SEQ ID NO: 2060449 - protein, 24 aa, Staphylococcus
ATTSQKMFKPLRDSLLEEVGVDIE

SEQ ID NO: 2060450 - protein, 26 aa, Staphylococcus
ATTTALLMIKAFQKFEQLPIDTLKQL

SEQ ID NO: 2060451 - protein, 26 aa, Staphylococcus
ATTTAYLMIKAFKKFESLPIDTLKQL

SEQ ID NO: 2060452 - protein, 18 aa, Staphylococcus
ATVEQRPKMDGRQMFIML

SEQ ID NO: 2060453 - protein, 20 aa, Staphylococcus
ATVGTGIAALTLSHHDADAA

SEQ ID NO: 2060454 - protein, 31 aa, Staphylococcus
ATVIDLIKDYKYLDLFPVGRLDKDTEGLLLI

SEQ ID NO: 2060455 - protein, 28 aa, Staphylococcus
ATVKESQPFFYPLDKLLSIGKMIEKEGY

SEQ ID NO: 2060456 - protein, 32 aa, Staphylococcus
ATVPPLTHFITNSTYFLWDVLTTAYIGKPDLV

SEQ ID NO: 2060457 - protein, 18 aa, Staphylococcus
ATVRSTVFLKDTTRFQYN

SEQ ID NO: 2060458 - protein, 27 aa, Staphylococcus
ATVTEIYDYIRLLYTRVGKAYCPEHGI

SEQ ID NO: 2060459 - protein, 19 aa, Staphylococcus
ATWFALMDHLVDMSITYAS

SEQ ID NO: 2060460 - protein, 22 aa, Staphylococcus
ATYPDLKLGIITPFYGHIDRWN

SEQ ID NO: 2060461 - protein, 18 aa, Staphylococcus
AVAALKKYPAVNAEIDGD

SEQ ID NO: 2060462 - protein, 22 aa, Staphylococcus
AVAFTRAAFDFLDKPLSDEELI

SEQ ID NO: 2060463 - protein, 20 aa, Staphylococcus
AVDALQLRFIMDWNSQSKRE

SEQ ID NO: 2060464 - protein, 22 aa, Staphylococcus
AVDFLREKGIAKAAKKSDRIAA

SEQ ID NO: 2060465 - protein, 18 aa, Staphylococcus
AVDFVKYAESFGAKGLRV

SEQ ID NO: 2060466 - protein, 17 aa, Staphylococcus
AVDIAYKQKGYTHMYLI

SEQ ID NO: 2060467 - protein, 22 aa, Staphylococcus
AVDIMGPLMNILLDQIDEKPYF

SEQ ID NO: 2060468 - protein, 20 aa, Staphylococcus
AVDLKVVLEYGESAPKIFQK

SEQ ID NO: 2060469 - protein, 21 aa, Staphylococcus
AVDLKVVLEYGESAPKIFRKV

SEQ ID NO: 2060470 - protein, 26 aa, Staphylococcus
AVDTGDGVLLIIKNYAGDVMNFEMAQ

SEQ ID NO: 2060471 - protein, 19 aa, Staphylococcus
AVDVKGVFFCTKQLYHSYV

SEQ ID NO: 2060472 - protein, 25 aa, Staphylococcus
AVDVNDFIKFLKQLNHRVTAVFSQF

SEQ ID NO: 2060473 - protein, 31 aa, Staphylococcus
AVDYIFCKAYGKIAINIAKYTKKGSLVGITG

SEQ ID NO: 2060474 - protein, 23 aa, Staphylococcus
AVDYIKKPFDPMELYYRVSLHLH

SEQ ID NO: 2060475 - protein, 27 aa, Staphylococcus
AVEIDNLIWYLNEIMKNELHIALGPIE

SEQ ID NO: 2060476 - protein, 21 aa, Staphylococcus
AVEKFINISKINKIKQQKGLQ

SEQ ID NO: 2060477 - protein, 21 aa, Staphylococcus
AVELVVHAFKYAKTGDIMVQK

SEQ ID NO: 2060478 - protein, 25 aa, Staphylococcus
AVEQAMGGVLFIDEAYQLTPKGQSD

SEQ ID NO: 2060479 - protein, 26 aa, Staphylococcus
AVEQLHHVFARLKYALKPIVTAVQGK

SEQ ID NO: 2060480 - protein, 20 aa, Staphylococcus
AVETKKLLDRIYPFRKCDKM

SEQ ID NO: 2060481 - protein, 22 aa, Staphylococcus
AVEYFKPYLSKLNYKKIAVIGE

SEQ ID NO: 2060482 - protein, 19 aa, Staphylococcus
AVEYYLKTKKLLSYRKKTV

SEQ ID NO: 2060483 - protein, 27 aa, Staphylococcus
AVFDIRDYFAARQLLNKAIVNLNETQI

SEQ ID NO: 2060484 - protein, 24 aa, Staphylococcus
AVFDIRDYFSARQLLMEAVINLDR

SEQ ID NO: 2060485 - protein, 22 aa, Staphylococcus
AVFDMMNWWFDKGIDGFRVDAI

SEQ ID NO: 2060486 - protein, 18 aa, Staphylococcus
AVFSATIPKSLHPFLNKY

SEQ ID NO: 2060487 - protein, 28 aa, Staphylococcus
AVFSATIPKSLQPFLNKYLEQPDFVEVD

SEQ ID NO: 2060488 - protein, 26 aa, Staphylococcus
AVFVGRVNLYVVLDNDVYDYVIANLH

SEQ ID NO: 2060489 - protein, 18 aa, Staphylococcus
AVGASQYRKDFCKNFLSE

SEQ ID NO: 2060490 - protein, 19 aa, Staphylococcus
AVGASQYRKDFCKTFLNTV

SEQ ID NO: 2060491 - protein, 25 aa, Staphylococcus
AVGEKKLHLLPLQELTKVTGYIRGG

SEQ ID NO: 2060492 - protein, 25 aa, Staphylococcus
AVGEKKLHLMPLDDLKKVTGYIRGG

SEQ ID NO: 2060493 - protein, 25 aa, Staphylococcus
AVGKDADFVFIKPDSPYTLQAEDLE

SEQ ID NO: 2060494 - protein, 20 aa, Staphylococcus
AVGVNLLPIIAKSLAPALKE

SEQ ID NO: 2060495 - protein, 18 aa, Staphylococcus
AVHLETDVLFKYVENIMN

SEQ ID NO: 2060496 - protein, 30 aa, Staphylococcus
AVHNYARYVSRFIVGYLTGNPITITHKNNK

SEQ ID NO: 2060497 - protein, 22 aa, Staphylococcus
AVHVLCFLAKHKDKHYSSTELA

SEQ ID NO: 2060498 - protein, 23 aa, Staphylococcus
AVIDALSYYQFVILKVVVGEEKL

SEQ ID NO: 2060499 - protein, 23 aa, Staphylococcus
AVIDKMIAAAPFLVDVVPAKDKI

SEQ ID NO: 2060500 - protein, 28 aa, Staphylococcus
AVIGAGPIGLLNIIAAKAAGASKIFAFD

SEQ ID NO: 2060501 - protein, 18 aa, Staphylococcus
AVIGFLYLDHQHARLEEL

SEQ ID NO: 2060502 - protein, 25 aa, Staphylococcus
AVIGYMPMITLYSKKSIWVCDLVTD

SEQ ID NO: 2060503 - protein, 19 aa, Staphylococcus
AVILFKSLGFIIEGELRDK

SEQ ID NO: 2060504 - protein, 20 aa, Staphylococcus
AVIYDLNFLKTLPYHEILSG

SEQ ID NO: 2060505 - protein, 18 aa, Staphylococcus
AVKALMNDYLIPVSDEII

SEQ ID NO: 2060506 - protein, 22 aa, Staphylococcus
AVKCIFFNQPYLKKKIELHGTV

SEQ ID NO: 2060507 - protein, 21 aa, Staphylococcus
AVKCVFFNQPYLKNKIALNQR

SEQ ID NO: 2060508 - protein, 31 aa, Staphylococcus
AVKEGNLLFGDTVAIFGAGPIGLLTVVAAKA

SEQ ID NO: 2060509 - protein, 17 aa, Staphylococcus
AVKHIKPHDFYVPGDIS

SEQ ID NO: 2060510 - protein, 21 aa, Staphylococcus
AVKIAKTLGLFVSCDLNFRDA

SEQ ID NO: 2060511 - protein, 18 aa, Staphylococcus
AVKKVFVDLYNKGIIYRG

SEQ ID NO: 2060512 - protein, 36 aa, Staphylococcus
AVKMINGILGKIPFFGICLGHQLFALSQGATSFKMK

SEQ ID NO: 2060513 - protein, 35 aa, Staphylococcus
AVKVSKIKPGQWIGIFGIGGLGNLALQYAKNVFNA

SEQ ID NO: 2060514 - protein, 17 aa, Staphylococcus
AVLCAKQFIGNEPFAIL

SEQ ID NO: 2060515 - protein, 18 aa, Staphylococcus
AVLFLASDEARFITGAAL

SEQ ID NO: 2060516 - protein, 20 aa, Staphylococcus
AVLLMIMDKKTALAHKFKEG

SEQ ID NO: 2060517 - protein, 17 aa, Staphylococcus
AVLNFPPEHAKALERRI

SEQ ID NO: 2060518 - protein, 21 aa, Staphylococcus
AVLNYLYKNTDLQVAYNFNMV

SEQ ID NO: 2060519 - protein, 18 aa, Staphylococcus
AVLPVLTASLLASEGVSK

SEQ ID NO: 2060520 - protein, 18 aa, Staphylococcus
AVLPVLTASLLASKGTSK

SEQ ID NO: 2060521 - protein, 17 aa, Staphylococcus
AVLPVLTASLLASKGVS

SEQ ID NO: 2060522 - protein, 20 aa, Staphylococcus
AVLQYARPKKIGLATLVDRG

SEQ ID NO: 2060523 - protein, 21 aa, Staphylococcus
AVMIGIIYQFIVANTLLDTQF

SEQ ID NO: 2060524 - protein, 19 aa, Staphylococcus
AVMIGIIYQFIVSNIILNT

SEQ ID NO: 2060525 - protein, 24 aa, Staphylococcus
AVMQYGMPSFVVPLATYPDGYLKR

SEQ ID NO: 2060526 - protein, 25 aa, Staphylococcus
AVNEMRSLIWQLKPVGLEQGLVHAL

SEQ ID NO: 2060527 - protein, 24 aa, Staphylococcus
AVNEMRTLIWQLKPVGLEHGLVQA

SEQ ID NO: 2060528 - protein, 25 aa, Staphylococcus
AVNVNSFLDFLKSLNVKVTAIFTQF

SEQ ID NO: 2060529 - protein, 23 aa, Staphylococcus
AVNYDLPYHLAIKNLKQLDEDFG

SEQ ID NO: 2060530 - protein, 30 aa, Staphylococcus
AVPPLTHFQTNSTYFLWDVLTTAYVGEPEL

SEQ ID NO: 2060531 - protein, 17 aa, Staphylococcus
AVPVFNDTYYIKRSDFE

SEQ ID NO: 2060532 - protein, 23 aa, Staphylococcus
AVQAFGKIPLLIEGINSMSLSGH

SEQ ID NO: 2060533 - protein, 20 aa, Staphylococcus
AVQGVWKPVPINGFRYYDGG

SEQ ID NO: 2060534 - protein, 40 aa, Staphylococcus
AVQKSMYLLWSVNPKDTVYNIPFLWRLTSELNVNQLQRSL

SEQ ID NO: 2060535 - protein, 18 aa, Staphylococcus
AVQYPNFFGSIEDLEKIQ

SEQ ID NO: 2060536 - protein, 29 aa, Staphylococcus
AVRAGHHCAQPLMKWLNVSSTARASFYIY

SEQ ID NO: 2060537 - protein, 17 aa, Staphylococcus
AVRANFDLRPAGIIKML

SEQ ID NO: 2060538 - protein, 17 aa, Staphylococcus
AVREFGLSRSAFYKYKD

SEQ ID NO: 2060539 - protein, 27 aa, Staphylococcus
AVRISHDQNFLYISNRGHDSLAIFKVG

SEQ ID NO: 2060540 - protein, 27 aa, Staphylococcus
AVRKNLNIIQLIWNDGKYNMVEFQEEM

SEQ ID NO: 2060541 - protein, 26 aa, Staphylococcus
AVRKNLNIIQLIWNDGRYNMVEFQEE

SEQ ID NO: 2060542 - protein, 26 aa, Staphylococcus
AVRNEIFDMMNWWFEKGIDGFRVDAI

SEQ ID NO: 2060543 - protein, 17 aa, Staphylococcus
AVRNNFDLRPAGIIKML

SEQ ID NO: 2060544 - protein, 24 aa, Staphylococcus
AVRVGISLYGYYPSAYVKSNVKVH

SEQ ID NO: 2060545 - protein, 19 aa, Staphylococcus
AVRYDIGLFDVSHMGEIAI

SEQ ID NO: 2060546 - protein, 19 aa, Staphylococcus
AVRYYFSEAFPKHFKNYYA

SEQ ID NO: 2060547 - protein, 18 aa, Staphylococcus
AVSFLASNRAKYITGQTL

SEQ ID NO: 2060548 - protein, 24 aa, Staphylococcus
AVSIPVMAKCRIGHITEARVLESM

SEQ ID NO: 2060549 - protein, 21 aa, Staphylococcus
AVSKLWRNTQLKHTFLRQVME

SEQ ID NO: 2060550 - protein, 26 aa, Staphylococcus
AVSLEDALDLYQKGMKLSASCDETLK

SEQ ID NO: 2060551 - protein, 25 aa, Staphylococcus
AVSLSPDALFTWSSGIKSPIYCDNR

SEQ ID NO: 2060552 - protein, 22 aa, Staphylococcus
AVSRRIKKLIDAKLVCLEKPNS

SEQ ID NO: 2060553 - protein, 17 aa, Staphylococcus
AVSVFKTLYKKVDATQF

SEQ ID NO: 2060554 - protein, 21 aa, Staphylococcus
AVSVYSGWLAYSTFDHDWVKQ

SEQ ID NO: 2060555 - protein, 23 aa, Staphylococcus
AVSYPRTDFLFSGKNIFNAYTIT

SEQ ID NO: 2060556 - protein, 17 aa, Staphylococcus
AVTAWYDLAKLANRYVL

SEQ ID NO: 2060557 - protein, 25 aa, Staphylococcus
AVTEAFDIPKTWKLVAQMPFGNIRD

SEQ ID NO: 2060558 - protein, 21 aa, Staphylococcus
AVTPFYYPFSFEEIKDYYFEL

SEQ ID NO: 2060559 - protein, 22 aa, Staphylococcus
AVTPFYYPFSFEEIKQYYFDII

SEQ ID NO: 2060560 - protein, 19 aa, Staphylococcus
AVTYFLQQGTPFIYQGQEI

SEQ ID NO: 2060561 - protein, 27 aa, Staphylococcus
AVVDRDYTLIYDKYVTAGPLLETAKLG

SEQ ID NO: 2060562 - protein, 17 aa, Staphylococcus
AVVTYPNYYGECFDINS

SEQ ID NO: 2060563 - protein, 25 aa, Staphylococcus
AVYLNHNFVPFKNGVYLAVPVFNDT

SEQ ID NO: 2060564 - protein, 18 aa, Staphylococcus
AWDIDHIYGIPGDSIDAV

SEQ ID NO: 2060565 - protein, 26 aa, Staphylococcus
AWEFLTSDRWMGMEPEKLYVTIHPED

SEQ ID NO: 2060566 - protein, 29 aa, Staphylococcus
AWEFLTSEKWMAMEPKLLYVTIHPEDKEA

SEQ ID NO: 2060567 - protein, 24 aa, Staphylococcus
AWIDLKKEMAEMYPVLVNDVEITN

SEQ ID NO: 2060568 - protein, 19 aa, Staphylococcus
AWLTELRKEALKLTETLEM

SEQ ID NO: 2060569 - protein, 19 aa, Staphylococcus
AWSSQLLKQYQLPRVVVGV

SEQ ID NO: 2060570 - protein, 26 aa, Staphylococcus
AWVGYEQFIPLMKKSSPLLLDLDEND

SEQ ID NO: 2060571 - protein, 20 aa, Staphylococcus
AWYNTYMNIYAAKTVNELLA

SEQ ID NO: 2060572 - protein, 29 aa, Staphylococcus
AYAAENNITFIPYFPLASGILAGKYTEDM

SEQ ID NO: 2060573 - protein, 29 aa, Staphylococcus
AYAAENNITFVPYFPLASGILAGKYDEDQ

SEQ ID NO: 2060574 - protein, 21 aa, Staphylococcus
AYALMTNELYRFPIMYLEYSG

SEQ ID NO: 2060575 - protein, 25 aa, Staphylococcus
AYANRIQVYFKTMSPFITLDIFTDE

SEQ ID NO: 2060576 - protein, 29 aa, Staphylococcus
AYCASPFASHSYVFISWTGKMNETFVLAH

SEQ ID NO: 2060577 - protein, 30 aa, Staphylococcus
AYCASPYASHSYVFISWTGKMTETFVLAHE

SEQ ID NO: 2060578 - protein, 17 aa, Staphylococcus
AYCLKRYFVYLEFKNKG

SEQ ID NO: 2060579 - protein, 17 aa, Staphylococcus
AYDAVFPLLHGPNGEDG

SEQ ID NO: 2060580 - protein, 26 aa, Staphylococcus
AYDCYRRLLQMFGEVVYNVPMQAFDT

SEQ ID NO: 2060581 - protein, 25 aa, Staphylococcus
AYDDLTIQTLRRLITTIYMQSVNQP

SEQ ID NO: 2060582 - protein, 24 aa, Staphylococcus
AYDELMLYYIKALNGLGQYYESVN

SEQ ID NO: 2060583 - protein, 17 aa, Staphylococcus
AYDFNSGYFMALKVKHV

SEQ ID NO: 2060584 - protein, 28 aa, Staphylococcus
AYDGSFHIYKVNAPIVEGSFTATVNLSM

SEQ ID NO: 2060585 - protein, 17 aa, Staphylococcus
AYDHMWGYFKKWATDEE

SEQ ID NO: 2060586 - protein, 20 aa, Staphylococcus
AYDLGIRAVIFFGVPNEKDS

SEQ ID NO: 2060587 - protein, 22 aa, Staphylococcus
AYDMVSLFKGLIREIAKDETPK

SEQ ID NO: 2060588 - protein, 18 aa, Staphylococcus
AYDRIFKRVGINARPVVA

SEQ ID NO: 2060589 - protein, 25 aa, Staphylococcus
AYDSSPRVIPNRASLKTLNRVKAIE

SEQ ID NO: 2060590 - protein, 22 aa, Staphylococcus
AYELGIRAIMFFGVPNAKDDVG

SEQ ID NO: 2060591 - protein, 17 aa, Staphylococcus
AYELGVSKAFKPIMENT

SEQ ID NO: 2060592 - protein, 18 aa, Staphylococcus
AYELGVSKAFKPIMENTL

SEQ ID NO: 2060593 - protein, 17 aa, Staphylococcus
AYELIKVRQPQVAILDI

SEQ ID NO: 2060594 - protein, 20 aa, Staphylococcus
AYENGIYNLLNLKRMVRPVH

SEQ ID NO: 2060595 - protein, 25 aa, Staphylococcus
AYENGIYRQLNLQRMVRPVKNIRNL

SEQ ID NO: 2060596 - protein, 24 aa, Staphylococcus
AYENIKVIGLMTMAPLTDDSVYIK

SEQ ID NO: 2060597 - protein, 19 aa, Staphylococcus
AYEQFFHFDTDLNIEPKQW

SEQ ID NO: 2060598 - protein, 24 aa, Staphylococcus
AYFGIRFFYEGDKLDLYLSKAIQL

SEQ ID NO: 2060599 - protein, 18 aa, Staphylococcus
AYFKGMFNEEAPAFEDIF

SEQ ID NO: 2060600 - protein, 27 aa, Staphylococcus
AYFLDIKSYILHQLFDTFVIDHSMASA

SEQ ID NO: 2060601 - protein, 20 aa, Staphylococcus
AYFNRLRFVQFSGNGSEILT

SEQ ID NO: 2060602 - protein, 19 aa, Staphylococcus
AYGINLRPLLTLAEAYYDG

SEQ ID NO: 2060603 - protein, 20 aa, Staphylococcus
AYGINLRPLLTLAEKHYDGK

SEQ ID NO: 2060604 - protein, 23 aa, Staphylococcus
AYGINLRPLLTLAEKYYDAENPA

SEQ ID NO: 2060605 - protein, 17 aa, Staphylococcus
AYGLGWFESVADCVETF

SEQ ID NO: 2060606 - protein, 17 aa, Staphylococcus
AYGSQLGLKYYLQAKFP

SEQ ID NO: 2060607 - protein, 29 aa, Staphylococcus
AYGSQLGLKYYLQLKFPDKDIYAVGDEEA

SEQ ID NO: 2060608 - protein, 19 aa, Staphylococcus
AYHDPYHLKGLKGYIKSPY

SEQ ID NO: 2060609 - protein, 20 aa, Staphylococcus
AYHSLYQAALARSEADWIVG

SEQ ID NO: 2060610 - protein, 17 aa, Staphylococcus
AYHVLKWAYDTYGDEIV

SEQ ID NO: 2060611 - protein, 17 aa, Staphylococcus
AYIFIKMIQQMTELGVH

SEQ ID NO: 2060612 - protein, 23 aa, Staphylococcus
AYIGQFKAGYFSPLANLARLTEE

SEQ ID NO: 2060613 - protein, 30 aa, Staphylococcus
AYILKIENTFPLITIKRFIPNADTSFINDK

SEQ ID NO: 2060614 - protein, 18 aa, Staphylococcus
AYILSKRQLETEQSYDYL

SEQ ID NO: 2060615 - protein, 19 aa, Staphylococcus
AYIRSFQQAWKTYASRQHK

SEQ ID NO: 2060616 - protein, 25 aa, Staphylococcus
AYITWVADAVIPYLRKCFRISQDRK

SEQ ID NO: 2060617 - protein, 20 aa, Staphylococcus
AYIWADIDAWVKNNLKWRTI

SEQ ID NO: 2060618 - protein, 25 aa, Staphylococcus
AYKAYEAILDLPFAKESDDLYDGPS

SEQ ID NO: 2060619 - protein, 28 aa, Staphylococcus
AYKIAQTLNAPIYLLSDIPGVMIDNKVK

SEQ ID NO: 2060620 - protein, 26 aa, Staphylococcus
AYKKRYPKGRFIVSIPAVVTTDGNQK

SEQ ID NO: 2060621 - protein, 26 aa, Staphylococcus
AYKQKGYTHMYLITDAMRAKGMKDGE

SEQ ID NO: 2060622 - protein, 19 aa, Staphylococcus
AYLPPMLEPGPVSATVKIE

SEQ ID NO: 2060623 - protein, 32 aa, Staphylococcus
AYLRKAQCMFGWDWGIKLPDFGIWKSIAIEYG

SEQ ID NO: 2060624 - protein, 18 aa, Staphylococcus
AYMGAYKLQWEMIKFAKN

SEQ ID NO: 2060625 - protein, 20 aa, Staphylococcus
AYMGAYRLQWEMIKFAKEHD

SEQ ID NO: 2060626 - protein, 25 aa, Staphylococcus
AYNKDKVVMILNYPNNPTGYTPNNE

SEQ ID NO: 2060627 - protein, 18 aa, Staphylococcus
AYNSAVANGVIPQGNVME

SEQ ID NO: 2060628 - protein, 24 aa, Staphylococcus
AYPHSIYNNVLPHIDTFLEDGYTK

SEQ ID NO: 2060629 - protein, 17 aa, Staphylococcus
AYPSFLSIAPEPFDEDA

SEQ ID NO: 2060630 - protein, 17 aa, Staphylococcus
AYQISQFDEPIGENGYI

SEQ ID NO: 2060631 - protein, 21 aa, Staphylococcus
AYQLKYILDDKYNYSTNLDAT

SEQ ID NO: 2060632 - protein, 22 aa, Staphylococcus
AYQLTQYLYHLGHRHILFLQES

SEQ ID NO: 2060633 - protein, 17 aa, Staphylococcus
AYQRKVYQLVDEGESLT

SEQ ID NO: 2060634 - protein, 18 aa, Staphylococcus
AYRLLRVGSFLLSEDGYK

SEQ ID NO: 2060635 - protein, 20 aa, Staphylococcus
AYRRFKMGPKETLNTLQNLY

SEQ ID NO: 2060636 - protein, 30 aa, Staphylococcus
AYRSKLLREINQPAKFIFLDFISAENIQTL

SEQ ID NO: 2060637 - protein, 18 aa, Staphylococcus
AYSELVSVSWHALQRFER

SEQ ID NO: 2060638 - protein, 24 aa, Staphylococcus
AYSLPKWIVDHWVTHYGLAQTHRI

SEQ ID NO: 2060639 - protein, 19 aa, Staphylococcus
AYSRIFKRVGINARPVVAD

SEQ ID NO: 2060640 - protein, 27 aa, Staphylococcus
AYSYYLDLRRYGSVPHSGFGLGLERTV

SEQ ID NO: 2060641 - protein, 22 aa, Staphylococcus
AYTAQIAVLSILSQIVAERHGK

SEQ ID NO: 2060642 - protein, 19 aa, Staphylococcus
AYTAQIAVLSILSQIVAKN

SEQ ID NO: 2060643 - protein, 26 aa, Staphylococcus
AYTQNLMLLLYEKGIGTCWKTPLYIF

SEQ ID NO: 2060644 - protein, 26 aa, Staphylococcus
AYVDKQGFLYLMSRHNERLIIGGNNI

SEQ ID NO: 2060645 - protein, 27 aa, Staphylococcus
AYVEENGYLFIFVMDYHRHELINEQID

SEQ ID NO: 2060646 - protein, 24 aa, Staphylococcus
AYVESHLLSLPGWAGMMYYRAEKN

SEQ ID NO: 2060647 - protein, 25 aa, Staphylococcus
CADLPTDYILWLTDNQYKAWGNAKD

SEQ ID NO: 2060648 - protein, 25 aa, Staphylococcus
CADLTIDYILWLTDNEFRIRGNAKD

SEQ ID NO: 2060649 - protein, 19 aa, Staphylococcus
CAGTFTHLHLIKPLGFSTD

SEQ ID NO: 2060650 - protein, 25 aa, Staphylococcus
CALDYLFPHFINIPLTIVSGLAKGA

SEQ ID NO: 2060651 - protein, 17 aa, Staphylococcus
CALIDILKEHRTVEDIA

SEQ ID NO: 2060652 - protein, 23 aa, Staphylococcus
CAMITFRLLKHYDDLPSMLSIYG

SEQ ID NO: 2060653 - protein, 20 aa, Staphylococcus
CAQGYFDVIPDLTCLGKVIG

SEQ ID NO: 2060654 - protein, 17 aa, Staphylococcus
CASYVVNDILKDIPVRR

SEQ ID NO: 2060655 - protein, 24 aa, Staphylococcus
CATKPRVHVFIATSPIHLEHKLKM

SEQ ID NO: 2060656 - protein, 17 aa, Staphylococcus
CCPYIHFFTSRNNATNY

SEQ ID NO: 2060657 - protein, 17 aa, Staphylococcus
CCQSCRWDYDLLHIESD

SEQ ID NO: 2060658 - protein, 17 aa, Staphylococcus
CDELLKESKAHLLNLAI

SEQ ID NO: 2060659 - protein, 19 aa, Staphylococcus
CDEWFERYKLTSGSKQSTI

SEQ ID NO: 2060660 - protein, 17 aa, Staphylococcus
CDGIIKFARAYTGRPNV

SEQ ID NO: 2060661 - protein, 28 aa, Staphylococcus
CDIYSLLNRSLLYSAIILHDIGKVRELS

SEQ ID NO: 2060662 - protein, 23 aa, Staphylococcus
CDKATLPIFDQIFTRIGAADDLV

SEQ ID NO: 2060663 - protein, 26 aa, Staphylococcus
CDKMPDKLCLYYHIGQCMGPCVYDVD

SEQ ID NO: 2060664 - protein, 21 aa, Staphylococcus
CDLPIVIKKDGLAAGKGVVIA

SEQ ID NO: 2060665 - protein, 21 aa, Staphylococcus
CDSLPLVVFTGQVATPGIGKD

SEQ ID NO: 2060666 - protein, 22 aa, Staphylococcus
CDTLHFLNKVLKIKEDLLVYND

SEQ ID NO: 2060667 - protein, 25 aa, Staphylococcus
CEADDWKPFYESYQNKFEDIEIEMD

SEQ ID NO: 2060668 - protein, 31 aa, Staphylococcus
CEAQPPSEDFAYYAKALPSTFIYAGAAPEDG

SEQ ID NO: 2060669 - protein, 17 aa, Staphylococcus
CEAWSELGYIPKDDVKK

SEQ ID NO: 2060670 - protein, 26 aa, Staphylococcus
CECGKELKYQYILRSKSKDTIMKLWI

SEQ ID NO: 2060671 - protein, 24 aa, Staphylococcus
CEIEGVIDYLLIRVPMNTEEVIQW

SEQ ID NO: 2060672 - protein, 20 aa, Staphylococcus
CELFKQMDYSPDSKLGLATG

SEQ ID NO: 2060673 - protein, 17 aa, Staphylococcus
CELIYASADPYLRSEQA

SEQ ID NO: 2060674 - protein, 18 aa, Staphylococcus
CELLVDWLNNETEDFKII

SEQ ID NO: 2060675 - protein, 25 aa, Staphylococcus
CEQQGEYLIITLSALLHDVIDDKLT

SEQ ID NO: 2060676 - protein, 23 aa, Staphylococcus
CESATLPIFDQIFTRIGAADDLV

SEQ ID NO: 2060677 - protein, 18 aa, Staphylococcus
CESYHISLRIFGTRAELG

SEQ ID NO: 2060678 - protein, 25 aa, Staphylococcus
CETCTHYLYFYKEELDDIGAIAKCS

SEQ ID NO: 2060679 - protein, 20 aa, Staphylococcus
CFEDKFVANLFFENSTRTKS

SEQ ID NO: 2060680 - protein, 23 aa, Staphylococcus
CFEIPSYHKMLMISDVALNILPS

SEQ ID NO: 2060681 - protein, 21 aa, Staphylococcus
CFELLAMITYADKLKSIIKKE

SEQ ID NO: 2060682 - protein, 17 aa, Staphylococcus
CFELLAMVTYADKLKGI

SEQ ID NO: 2060683 - protein, 17 aa, Staphylococcus
CFFEKSKVKPEHYYRLL

SEQ ID NO: 2060684 - protein, 23 aa, Staphylococcus
CFGAPFLPLHPTVYADLLGELID

SEQ ID NO: 2060685 - protein, 23 aa, Staphylococcus
CFNGAFDLILKQNKVRDAEPEVT

SEQ ID NO: 2060686 - protein, 24 aa, Staphylococcus
CFNGAFDLILKQNKVRDAEPEVTL

SEQ ID NO: 2060687 - protein, 24 aa, Staphylococcus
CFNGAFDLILKQNKVRDAQPEVTL

SEQ ID NO: 2060688 - protein, 24 aa, Staphylococcus
CFNGAFDLILKQNKVRGAEPEVTL

SEQ ID NO: 2060689 - protein, 26 aa, Staphylococcus
CFSSKWRIIYLDSDILIIQFSSILVT

SEQ ID NO: 2060690 - protein, 17 aa, Staphylococcus
CGALMQYYRETGIYAER

SEQ ID NO: 2060691 - protein, 18 aa, Staphylococcus
CGAPMVIKMGRYGKFMAC

SEQ ID NO: 2060692 - protein, 25 aa, Staphylococcus
CGDIAVSIYTGWLAYSTFDHEWVSQ

SEQ ID NO: 2060693 - protein, 17 aa, Staphylococcus
CGGYQFLGTKYITPDGT

SEQ ID NO: 2060694 - protein, 25 aa, Staphylococcus
CGIKTDILLIYIGMRNRTLYNYTIN

SEQ ID NO: 2060695 - protein, 27 aa, Staphylococcus
CGKSLLAIYRIYWLSKVYPNDRIVLLT

SEQ ID NO: 2060696 - protein, 23 aa, Staphylococcus
CGKTTLLRLIAGLETPDSGSINH

SEQ ID NO: 2060697 - protein, 19 aa, Staphylococcus
CGLRRKKVDFGWIYSTTPA

SEQ ID NO: 2060698 - protein, 19 aa, Staphylococcus
CGMGGPLIAKILKEGQQKL

SEQ ID NO: 2060699 - protein, 22 aa, Staphylococcus
CGMGGPLIARILNEGRIHLANG

SEQ ID NO: 2060700 - protein, 20 aa, Staphylococcus
CGNIYACEALFRAGILPSRL

SEQ ID NO: 2060701 - protein, 20 aa, Staphylococcus
CGNIYACEALFRSGIHPARL

SEQ ID NO: 2060702 - protein, 17 aa, Staphylococcus
CGRTYLFRYQSSIFEHA

SEQ ID NO: 2060703 - protein, 20 aa, Staphylococcus
CGSPMVIKMGRYGKFMACSN

SEQ ID NO: 2060704 - protein, 31 aa, Staphylococcus
CGTLTLKDFNFKYKPRLPLSINIPKIELNKG

SEQ ID NO: 2060705 - protein, 22 aa, Staphylococcus
CGTTYHLVFNPPKVDGICDIDG

SEQ ID NO: 2060706 - protein, 23 aa, Staphylococcus
CGTTYHLVFNPPKVDGICDLDGG

SEQ ID NO: 2060707 - protein, 24 aa, Staphylococcus
CGYGPIGLMIAKVSPHHKVILLDV

SEQ ID NO: 2060708 - protein, 24 aa, Staphylococcus
CGYGPIGLMIAKVSPHHQITMLDV

SEQ ID NO: 2060709 - protein, 24 aa, Staphylococcus
CGYGPIGLMIAKVSPHHQMTMVDV

SEQ ID NO: 2060710 - protein, 22 aa, Staphylococcus
CHKHHIPWVYGAAVGSKGTVYG

SEQ ID NO: 2060711 - protein, 22 aa, Staphylococcus
CHKHQIPWVYGAAVGNKGTVYG

SEQ ID NO: 2060712 - protein, 23 aa, Staphylococcus
CHKYEIPWVYGAAVGSKGTVYGI

SEQ ID NO: 2060713 - protein, 22 aa, Staphylococcus
CHKYQIPWVYGAAVGSKGTVYG

SEQ ID NO: 2060714 - protein, 18 aa, Staphylococcus
CHLGWFNTTVDENFRPHI

SEQ ID NO: 2060715 - protein, 18 aa, Staphylococcus
CHLTALLKYGGGICYHLF

SEQ ID NO: 2060716 - protein, 18 aa, Staphylococcus
CHNDFSCNHLLLDGNNRL

SEQ ID NO: 2060717 - protein, 18 aa, Staphylococcus
CHNYYPRPDTGLSYSFIE

SEQ ID NO: 2060718 - protein, 22 aa, Staphylococcus
CHQDLLSIESFYQDIKAQQSKL

SEQ ID NO: 2060719 - protein, 23 aa, Staphylococcus
CHQDLLSIESFYQDIKAQQSKLD

SEQ ID NO: 2060720 - protein, 20 aa, Staphylococcus
CHTMFQFYVQDGKLSCQLYQ

SEQ ID NO: 2060721 - protein, 21 aa, Staphylococcus
CHTMFQFYVQDGKLSCQLYQR

SEQ ID NO: 2060722 - protein, 26 aa, Staphylococcus
CIFEQVNFYKNLFKKISFENTTFDET

SEQ ID NO: 2060723 - protein, 19 aa, Staphylococcus
CIGRFFWDSLTVSDARHIQ

SEQ ID NO: 2060724 - protein, 19 aa, Staphylococcus
CIGRFFWESLNVKDARDIN

SEQ ID NO: 2060725 - protein, 27 aa, Staphylococcus
CIHYHTFLDIIAIKFKCCEKYYPCYQC

SEQ ID NO: 2060726 - protein, 25 aa, Staphylococcus
CIIDKKIVRLLDSIKIMIDSLIRCY

SEQ ID NO: 2060727 - protein, 17 aa, Staphylococcus
CINCYLDTTKPNDMNFQ

SEQ ID NO: 2060728 - protein, 17 aa, Staphylococcus
CINFYETITHLIKEQEF

SEQ ID NO: 2060729 - protein, 26 aa, Staphylococcus
CINSAAIQFIPYEKLEELGYGDLIPH

SEQ ID NO: 2060730 - protein, 18 aa, Staphylococcus
CINSAAVQFIPYDKLEEL

SEQ ID NO: 2060731 - protein, 17 aa, Staphylococcus
CINSAAVQFIPYEKLEE

SEQ ID NO: 2060732 - protein, 21 aa, Staphylococcus
CIPDREIPLDAFISKNHVQLA

SEQ ID NO: 2060733 - protein, 23 aa, Staphylococcus
CIQQGIYLLDVPLERYKELNSNI

SEQ ID NO: 2060734 - protein, 18 aa, Staphylococcus
CIVPFTRGKERSRRPQDI

SEQ ID NO: 2060735 - protein, 22 aa, Staphylococcus
CIYCYNYAIWLIQNGLSKSYEF

SEQ ID NO: 2060736 - protein, 27 aa, Staphylococcus
CKAHFDNCLYTYYISKTIDLINEGNLK

SEQ ID NO: 2060737 - protein, 24 aa, Staphylococcus
CKELEYQLLLNYTGLDLSEEIIAL

SEQ ID NO: 2060738 - protein, 18 aa, Staphylococcus
CKGQHDIISELLLQVNKY

SEQ ID NO: 2060739 - protein, 24 aa, Staphylococcus
CKLDKDNFIYLITGPNMSGKSTYM

SEQ ID NO: 2060740 - protein, 17 aa, Staphylococcus
CKQLEGYAWAFHTTYNH

SEQ ID NO: 2060741 - protein, 23 aa, Staphylococcus
CKVLLERGYIVCPYISNDVVLAK

SEQ ID NO: 2060742 - protein, 17 aa, Staphylococcus
CKVTPLHMFYTEETYED

SEQ ID NO: 2060743 - protein, 18 aa, Staphylococcus
CKVTPLHMFYTEETYEDL

SEQ ID NO: 2060744 - protein, 25 aa, Staphylococcus
CKYPLGLVENQIYYFNTENVDRVIF

SEQ ID NO: 2060745 - protein, 22 aa, Staphylococcus
CLDLYHCSHLRPWIDEVNQHFF

SEQ ID NO: 2060746 - protein, 31 aa, Staphylococcus
CLDQPDIFRPQLRALLRASAYGKLNIMFPMV

SEQ ID NO: 2060747 - protein, 29 aa, Staphylococcus
CLDYLREGDILVIYKLDRLGRTTKQLIDL

SEQ ID NO: 2060748 - protein, 18 aa, Staphylococcus
CLGHQLFALSQGASSFKM

SEQ ID NO: 2060749 - protein, 17 aa, Staphylococcus
CLLHLLLNEYQHTYSKL

SEQ ID NO: 2060750 - protein, 24 aa, Staphylococcus
CLLNKENFIYLITGPNMSGKSTYM

SEQ ID NO: 2060751 - protein, 19 aa, Staphylococcus
CLMPQLPVINLTCDTAGVI

SEQ ID NO: 2060752 - protein, 17 aa, Staphylococcus
CLPLVKKGGQFIALKSS

SEQ ID NO: 2060753 - protein, 17 aa, Staphylococcus
CLPYFKRLEKTYGATPF

SEQ ID NO: 2060754 - protein, 23 aa, Staphylococcus
CLSKDMYVVPPSNLIKEIPYAMK

SEQ ID NO: 2060755 - protein, 19 aa, Staphylococcus
CLTMNRIDLPHLAWCLDKI

SEQ ID NO: 2060756 - protein, 28 aa, Staphylococcus
CLYVKMDPYWIYQIYDKDIKPLDNHEKN

SEQ ID NO: 2060757 - protein, 28 aa, Staphylococcus
CLYVKMDPYWIYQIYDKDINPLPNHDKN

SEQ ID NO: 2060758 - protein, 29 aa, Staphylococcus
CLYVKMDPYWIYQIYDKDVNPFPSRQQND

SEQ ID NO: 2060759 - protein, 28 aa, Staphylococcus
CMLTAVPVMKIFKYFYSNRGPVIDYENK

SEQ ID NO: 2060760 - protein, 18 aa, Staphylococcus
CMSALGKQGIYDISVQNF

SEQ ID NO: 2060761 - protein, 23 aa, Staphylococcus
CNDEYIFFHLTTSYFIIFDVRHP

SEQ ID NO: 2060762 - protein, 33 aa, Staphylococcus
CNDLDIPVFDAYRYEAFKPYSPAFRKSSMPDGL

SEQ ID NO: 2060763 - protein, 23 aa, Staphylococcus
CNDYNIFRQCYCGCVFAAMEQGI

SEQ ID NO: 2060764 - protein, 24 aa, Staphylococcus
CNHDLDFALAIRTMLIDDTYVNVE

SEQ ID NO: 2060765 - protein, 20 aa, Staphylococcus
CNHDLDFALAIRTMMIDETH

SEQ ID NO: 2060766 - protein, 18 aa, Staphylococcus
CNHQPFIPSQFISKPKVT

SEQ ID NO: 2060767 - protein, 19 aa, Staphylococcus
CNHVLYQLGYLADTQFTGL

SEQ ID NO: 2060768 - protein, 23 aa, Staphylococcus
CNIKFKSFLLENEIIDEQWLSDL

SEQ ID NO: 2060769 - protein, 25 aa, Staphylococcus
CNIRFKNHLLDLGIIDDAWLTEIEQ

SEQ ID NO: 2060770 - protein, 17 aa, Staphylococcus
CNISPVTYWVAAMSKEQ

SEQ ID NO: 2060771 - protein, 20 aa, Staphylococcus
CNISPVTYWVASMSKEKREE

SEQ ID NO: 2060772 - protein, 19 aa, Staphylococcus
CNRSIMIPRQTFNKKMKKI

SEQ ID NO: 2060773 - protein, 29 aa, Staphylococcus
CNTNLVAPITLGNRSFIAAGSTITDNVPE

SEQ ID NO: 2060774 - protein, 17 aa, Staphylococcus
CNYLKTLSFDESLNAFR

SEQ ID NO: 2060775 - protein, 18 aa, Staphylococcus
CNYQYKGVVKQLIHQYKL

SEQ ID NO: 2060776 - protein, 17 aa, Staphylococcus
CPAILQSIGPRDKMFSS

SEQ ID NO: 2060777 - protein, 25 aa, Staphylococcus
CPDDKMIFNIPIRTLEYRNEKVHYG

SEQ ID NO: 2060778 - protein, 25 aa, Staphylococcus
CPGVVKRLHLPQGFNVRVDSLLYSG

SEQ ID NO: 2060779 - protein, 17 aa, Staphylococcus
CPIVEALYRKGYAITVI

SEQ ID NO: 2060780 - protein, 24 aa, Staphylococcus
CPKLRPVIITLRRLAAFIENTMTY

SEQ ID NO: 2060781 - protein, 21 aa, Staphylococcus
CPNCHMTIKDIAYKGKFGCAQ

SEQ ID NO: 2060782 - protein, 24 aa, Staphylococcus
CPRIRYKNVILKPATWKLNKDMFS

SEQ ID NO: 2060783 - protein, 17 aa, Staphylococcus
CQAGKDFDYILGQLGAN

SEQ ID NO: 2060784 - protein, 24 aa, Staphylococcus
CQDPTIIEYINMPQIISLVDAERF

SEQ ID NO: 2060785 - protein, 24 aa, Staphylococcus
CQQHNYQLLLNYTGLHMEAEIEAI

SEQ ID NO: 2060786 - protein, 24 aa, Staphylococcus
CRDYNIYRQCYCGCVFAAQVQGID

SEQ ID NO: 2060787 - protein, 24 aa, Staphylococcus
CRDYNVYRQCYCGCVFAAMRQGID

SEQ ID NO: 2060788 - protein, 24 aa, Staphylococcus
CRNINQIIILFSLSHELRIKINGE

SEQ ID NO: 2060789 - protein, 19 aa, Staphylococcus
CRRKFLLEFFGESPNQPNE

SEQ ID NO: 2060790 - protein, 24 aa, Staphylococcus
CRRKYLLEFFGEVPDIPSICCDHD

SEQ ID NO: 2060791 - protein, 17 aa, Staphylococcus
CRWENWAQLPPMKMIRK

SEQ ID NO: 2060792 - protein, 17 aa, Staphylococcus
CSAFIPAGEERPLPTTA

SEQ ID NO: 2060793 - protein, 23 aa, Staphylococcus
CSAWFYLPDISEKPPIIVMAPGL

SEQ ID NO: 2060794 - protein, 23 aa, Staphylococcus
CSDVLFDCDAAVLSDVLIDCERL

SEQ ID NO: 2060795 - protein, 20 aa, Staphylococcus
CSIHPVTYWVASMSKAQQES

SEQ ID NO: 2060796 - protein, 17 aa, Staphylococcus
CSIISVMSNPKYIILGG

SEQ ID NO: 2060797 - protein, 18 aa, Staphylococcus
CSLASRIPYGEALSFTKV

SEQ ID NO: 2060798 - protein, 19 aa, Staphylococcus
CSLSPGDFKKRVIFGLTGS

SEQ ID NO: 2060799 - protein, 18 aa, Staphylococcus
CSNLFVRILNINFKDYYT

SEQ ID NO: 2060800 - protein, 24 aa, Staphylococcus
CSSKYTRSKLRKALPTQYVYIVEE

SEQ ID NO: 2060801 - protein, 17 aa, Staphylococcus
CSSLIGQTLLPEVLSHY

SEQ ID NO: 2060802 - protein, 17 aa, Staphylococcus
CSTIQSVVPLKILQDAY

SEQ ID NO: 2060803 - protein, 17 aa, Staphylococcus
CSYAQGFAQMRKASEEH

SEQ ID NO: 2060804 - protein, 18 aa, Staphylococcus
CSYLLAKGISIYYISKRL

SEQ ID NO: 2060805 - protein, 26 aa, Staphylococcus
CTEHRLPFILFSASGGARMQEGIISL

SEQ ID NO: 2060806 - protein, 25 aa, Staphylococcus
CTEHRLPFVLFSASGGARMQEGIIS

SEQ ID NO: 2060807 - protein, 20 aa, Staphylococcus
CTHPYIRDYIIPNVAHKYDD

SEQ ID NO: 2060808 - protein, 24 aa, Staphylococcus
CTHYHSFLDVIAIKFKCCDKYYPC

SEQ ID NO: 2060809 - protein, 18 aa, Staphylococcus
CTKNAMLPIVLDKPSREH

SEQ ID NO: 2060810 - protein, 18 aa, Staphylococcus
CTLGDDFVAAKPTGICAC

SEQ ID NO: 2060811 - protein, 18 aa, Staphylococcus
CTLGDEFVAAKPTGICAC

SEQ ID NO: 2060812 - protein, 17 aa, Staphylococcus
CTPTEYRLMAKLPNLTD

SEQ ID NO: 2060813 - protein, 24 aa, Staphylococcus
CTSIQYPNCYYFSTVVKKNQTEIF

SEQ ID NO: 2060814 - protein, 17 aa, Staphylococcus
CVAEDIPFFLEVLTYDD

SEQ ID NO: 2060815 - protein, 25 aa, Staphylococcus
CVEAGLGIAFLPMSVLNKGNSDGIE

SEQ ID NO: 2060816 - protein, 18 aa, Staphylococcus
CVFFNQPYLKKKIELNQT

SEQ ID NO: 2060817 - protein, 17 aa, Staphylococcus
CVGAAYFDLAVAVGAYQ

SEQ ID NO: 2060818 - protein, 18 aa, Staphylococcus
CVKAFLKAGYDAGRHQIR

SEQ ID NO: 2060819 - protein, 17 aa, Staphylococcus
CVLVFKKCREADQDVLF

SEQ ID NO: 2060820 - protein, 25 aa, Staphylococcus
CVMCAGAIVMSRIPRVVYGAIDPKG

SEQ ID NO: 2060821 - protein, 21 aa, Staphylococcus
CVMCAGAIVMSRIPRVVYGAV

SEQ ID NO: 2060822 - protein, 19 aa, Staphylococcus
CVPVYFYSEKHGYVGLAHA

SEQ ID NO: 2060823 - protein, 25 aa, Staphylococcus
CVTYNKINTYDWFKENLISIDDIEN

SEQ ID NO: 2060824 - protein, 21 aa, Staphylococcus
CVVVTRYFGGIKLGGGGLIRA

SEQ ID NO: 2060825 - protein, 46 aa, Staphylococcus
CWDLPNYIFGRYWNFWCNGNAIHMAWYRYPRGFKFYRNTASFVPEP

SEQ ID NO: 2060826 - protein, 27 aa, Staphylococcus
CWDLPNYIFQRYWHFRTWGNANAMANR

SEQ ID NO: 2060827 - protein, 23 aa, Staphylococcus
CWKTPLYIFEPKVRKAFGIAKDE

SEQ ID NO: 2060828 - protein, 17 aa, Staphylococcus
CWYYLRYIDPDNENMIA

SEQ ID NO: 2060829 - protein, 18 aa, Staphylococcus
CWYYLRYIDPHNEEMLAD

SEQ ID NO: 2060830 - protein, 18 aa, Staphylococcus
CYADCVPIYFYSEKNHFI

SEQ ID NO: 2060831 - protein, 17 aa, Staphylococcus
CYADCVPVYFYSEKHGY

SEQ ID NO: 2060832 - protein, 24 aa, Staphylococcus
CYELNTLFQTYLKAKGFDAQMISA

SEQ ID NO: 2060833 - protein, 18 aa, Staphylococcus
CYIISLAAVLERSGFTDI

SEQ ID NO: 2060834 - protein, 17 aa, Staphylococcus
CYIVPKQPNRFLIGATS

SEQ ID NO: 2060835 - protein, 20 aa, Staphylococcus
CYNFMPVFDWTRSQLDYRLD

SEQ ID NO: 2060836 - protein, 19 aa, Staphylococcus
CYQTIGWFKRVDHASKMKF

SEQ ID NO: 2060837 - protein, 21 aa, Staphylococcus
CYRSCLALADEKGLRHLAFCC

SEQ ID NO: 2060838 - protein, 24 aa, Staphylococcus
CYTNYTIPPYYDSMVAKLIVHEPT

SEQ ID NO: 2060839 - protein, 24 aa, Staphylococcus
CYTNYTIPPYYDSMVAKLIVHEST

SEQ ID NO: 2060840 - protein, 23 aa, Staphylococcus
DAAIYLCFEIYEDKIRVVVSDQG

SEQ ID NO: 2060841 - protein, 25 aa, Staphylococcus
DAAKDVWINGFTPKYSMSVWMGFNE

SEQ ID NO: 2060842 - protein, 18 aa, Staphylococcus
DAARYFLTMRSPDSHFDF

SEQ ID NO: 2060843 - protein, 22 aa, Staphylococcus
DAARYFLTMRSPDTHFDFDMEL

SEQ ID NO: 2060844 - protein, 17 aa, Staphylococcus
DADATLALAKKFEEPAA

SEQ ID NO: 2060845 - protein, 24 aa, Staphylococcus
DADDINFGISEGVDFIAASFVRRP

SEQ ID NO: 2060846 - protein, 31 aa, Staphylococcus
DADDIRFGIKEDVDFIAASFVRRPSDVLDIR

SEQ ID NO: 2060847 - protein, 31 aa, Staphylococcus; identical to SEQ ID NO: 1822422

SEQ ID NO: 2060848 - protein, 27 aa, Staphylococcus
DADEFAALQGLLKQLLTDDSEILTVIT

SEQ ID NO: 2060849 - protein, 28 aa, Staphylococcus
DADGNTGAWIRVYELNPDGTKGQLISET

SEQ ID NO: 2060850 - protein, 21 aa, Staphylococcus
DADIVAFLYRDDYYNREGDED

SEQ ID NO: 2060851 - protein, 21 aa, Staphylococcus
DADIVAFLYRDDYYNRGDGEE

SEQ ID NO: 2060852 - protein, 32 aa, Staphylococcus; identical to SEQ ID NO: 1825599

SEQ ID NO: 2060853 - protein, 32 aa, Staphylococcus
DADLLIMAGTNYPYVDYLPKKNIKAIQIDTNP

SEQ ID NO: 2060854 - protein, 20 aa, Staphylococcus
DADRILHLIKVQMDNLTVPS

SEQ ID NO: 2060855 - protein, 20 aa, Staphylococcus
DADRILQLIKVQIDNLTLPS

SEQ ID NO: 2060856 - protein, 20 aa, Staphylococcus
DADRILQLIKVQMDNLTLPQ

SEQ ID NO: 2060857 - protein, 24 aa, Staphylococcus
DADRPLALCAALLHDLGHGPFSHS

SEQ ID NO: 2060858 - protein, 21 aa, Staphylococcus
DAEILEWFDAIGRRRGLLQKG

SEQ ID NO: 2060859 - protein, 22 aa, Staphylococcus
DAEILEWFDAIGRRRGLLQKGN

SEQ ID NO: 2060860 - protein, 32 aa, Staphylococcus
DAEKDLVDTVLPYRPLFIKPNKDELEVMFNTT

SEQ ID NO: 2060861 - protein, 31 aa, Staphylococcus
DAEKDLVESVLGYHPLFIKPNKDELEVMFNT

SEQ ID NO: 2060862 - protein, 33 aa, Staphylococcus
DAEKDLVNTILPFQPLFIKPNKYELEEMFDITI

SEQ ID NO: 2060863 - protein, 31 aa, Staphylococcus
DAEKDLVNTVLKYQPLFIKPNKDELEEMFDM

SEQ ID NO: 2060864 - protein, 32 aa, Staphylococcus
DAEKHLVEAVLPYHPFFIKPNKDELEVMFDTE

SEQ ID NO: 2060865 - protein, 21 aa, Staphylococcus
DAELAERLGFIQNSTGGVLGP

SEQ ID NO: 2060866 - protein, 18 aa, Staphylococcus
DAELFLVKLEPEPVLKEI

SEQ ID NO: 2060867 - protein, 22 aa, Staphylococcus
DAELFLVKLEPKPVLDDIDNEL

SEQ ID NO: 2060868 - protein, 22 aa, Staphylococcus
DAELFLVKLEPKPVLEDLRQEL

SEQ ID NO: 2060869 - protein, 21 aa, Staphylococcus
DAELFLVKLEPKPVLEQVNKD

SEQ ID NO: 2060870 - protein, 21 aa, Staphylococcus
DAELFLVKLEPKPVLETVNSE

SEQ ID NO: 2060871 - protein, 27 aa, Staphylococcus
DAEPEGAFYIFPSLAPFGIDDDFQFCV

SEQ ID NO: 2060872 - protein, 24 aa, Staphylococcus
DAFGAYLHMGGRIGVLSVVEGSTD

SEQ ID NO: 2060873 - protein, 24 aa, Staphylococcus
DAFGAYLHMGGRIGVLTVVEGSTD

SEQ ID NO: 2060874 - protein, 25 aa, Staphylococcus
DAFGAYLHMGGRIGVLTVVEGSTDE

SEQ ID NO: 2060875 - protein, 19 aa, Staphylococcus
DAFGMRPYVKKKVKKYSMG

SEQ ID NO: 2060876 - protein, 19 aa, Staphylococcus
DAFGMRSYINKKVKKYSMG

SEQ ID NO: 2060877 - protein, 24 aa, Staphylococcus
DAFGSYLHMGGRIGVLTVVEGTTD

SEQ ID NO: 2060878 - protein, 18 aa, Staphylococcus
DAFKFRFATKEFDTTKKI

SEQ ID NO: 2060879 - protein, 24 aa, Staphylococcus
DAFKNVKRLALQEGILAGSSSGAA

SEQ ID NO: 2060880 - protein, 22 aa, Staphylococcus
DAFLDDIIADYQKMADLDNEVV

SEQ ID NO: 2060881 - protein, 22 aa, Staphylococcus
DAFLDDIIADYQKMADLDSEVV

SEQ ID NO: 2060882 - protein, 17 aa, Staphylococcus
DAFMFLDADDQFLPGKM

SEQ ID NO: 2060883 - protein, 17 aa, Staphylococcus
DAFQESLRKIKGGFTFA

SEQ ID NO: 2060884 - protein, 17 aa, Staphylococcus
DAFSTPFILLNEEPMYQ

SEQ ID NO: 2060885 - protein, 23 aa, Staphylococcus
DAFSTYIDRFEWQNAKFPVVQNV

SEQ ID NO: 2060886 - protein, 28 aa, Staphylococcus
DAFYGIAEHAFVPHFTIAQGLSSQEFED

SEQ ID NO: 2060887 - protein, 33 aa, Staphylococcus
DAGAAWITTPLNVFYFTGYLSEPHERLLALLIT

SEQ ID NO: 2060888 - protein, 20 aa, Staphylococcus
DAGALHLPGWGLDALKYLFE

SEQ ID NO: 2060889 - protein, 26 aa, Staphylococcus
DAGSSTIEMIPFIKAQDIVVVTNGLS

SEQ ID NO: 2060890 - protein, 26 aa, Staphylococcus
DAGSSTIEMIPFIKAQNIVVVTNGLT

SEQ ID NO: 2060891 - protein, 23 aa, Staphylococcus
DAGSYIYNTVKNNGFEILVTTKN

SEQ ID NO: 2060892 - protein, 20 aa, Staphylococcus
DAGVFLWETLRNNFYYSAIN

SEQ ID NO: 2060893 - protein, 26 aa, Staphylococcus
DAHNDWVNMLGVVPVIRALREKAMAI

SEQ ID NO: 2060894 - protein, 25 aa, Staphylococcus
DAHRNEFIYYFNPGDLKPPLNVYFS

SEQ ID NO: 2060895 - protein, 31 aa, Staphylococcus
DAIDVPLDLLPYLFFQFAKDGKRLYEDNAVD

SEQ ID NO: 2060896 - protein, 17 aa, Staphylococcus
DAIEAALITAYKKNYEA

SEQ ID NO: 2060897 - protein, 31 aa, Staphylococcus
DAIEIPVELLPYLFFQFAKDGKRLYSDNAVD

SEQ ID NO: 2060898 - protein, 17 aa, Staphylococcus
DAIFFADNQSFPASSKS

SEQ ID NO: 2060899 - protein, 20 aa, Staphylococcus
DAIIKIEAIFPQITISYFSE

SEQ ID NO: 2060900 - protein, 18 aa, Staphylococcus
DAIKNAAFPVLLAGMRSS

SEQ ID NO: 2060901 - protein, 21 aa, Staphylococcus
DAILDELLKKDPDARVACETV

SEQ ID NO: 2060902 - protein, 19 aa, Staphylococcus
DAIPVIVTVAYDLTGKFEY

SEQ ID NO: 2060903 - protein, 22 aa, Staphylococcus
DAIRYAGLLSRLKKMGLDVIDK

SEQ ID NO: 2060904 - protein, 22 aa, Staphylococcus
DAISIISKLKLDIPKCHRIVYT

SEQ ID NO: 2060905 - protein, 31 aa, Staphylococcus
DAISKARFEFRWIDQFNLALDPDRAREFHDE

SEQ ID NO: 2060906 - protein, 30 aa, Staphylococcus
DAISKARFEFRWIDQFNLSLDPDRAREFHD

SEQ ID NO: 2060907 - protein, 29 aa, Staphylococcus
DAISKARFEFRWIDQFNLSLDPERAREYH

SEQ ID NO: 2060908 - protein, 22 aa, Staphylococcus
DAITIFCKLKPDIPTCRVIFTP

SEQ ID NO: 2060909 - protein, 21 aa, Staphylococcus
DAITIFSKLKPDIPTCRVIFT

SEQ ID NO: 2060910 - protein, 21 aa, Staphylococcus
DAITIFSKLKPQLPSCRVIFT

SEQ ID NO: 2060911 - protein, 21 aa, Staphylococcus
DAIVVGNTYGRIRAMVNDLGQ

SEQ ID NO: 2060912 - protein, 20 aa, Staphylococcus
DAIYVYHEIFEGAGGLPVGT

SEQ ID NO: 2060913 - protein, 30 aa, Staphylococcus
DAKANSLEHLLFGLGIRHLGVKASQVLAEK

SEQ ID NO: 2060914 - protein, 28 aa, Staphylococcus
DAKEGIHYKNLLGTYLHGPILPKNHEIT

SEQ ID NO: 2060915 - protein, 24 aa, Staphylococcus
DAKGIKRLILIAAPGIYDELPEAF

SEQ ID NO: 2060916 - protein, 18 aa, Staphylococcus
DAKGLLMSAIQDDNLVVF

SEQ ID NO: 2060917 - protein, 22 aa, Staphylococcus
DAKGTIINIRETPNSRIVSIKA

SEQ ID NO: 2060918 - protein, 32 aa, Staphylococcus
DAKKLDAIVILSDFNRRYLSGFTGTSGALIIS

SEQ ID NO: 2060919 - protein, 17 aa, Staphylococcus
DAKKSTPLKVYINGDFE

SEQ ID NO: 2060920 - protein, 17 aa, Staphylococcus
DAKKTFVIAHRLNINIQ

SEQ ID NO: 2060921 - protein, 24 aa, Staphylococcus
DAKPEHLLQYAQLGNIYAEKIRGI

SEQ ID NO: 2060922 - protein, 28 aa, Staphylococcus
DAKPEHLLQYAQLGNIYAKKIRGIQNPK

SEQ ID NO: 2060923 - protein, 24 aa, Staphylococcus
DAKPEHLLQYAQLGNIYAQKIRGI

SEQ ID NO: 2060924 - protein, 27 aa, Staphylococcus
DAKTGQYYFHLFSKKQPDLNWNNKDVR

SEQ ID NO: 2060925 - protein, 22 aa, Staphylococcus
DAKVLFELNKNILLKGPTGSGK

SEQ ID NO: 2060926 - protein, 26 aa, Staphylococcus
DAKYPQLHVFIASSPIHLEHKLKMTQ

SEQ ID NO: 2060927 - protein, 29 aa, Staphylococcus
DALAYIDTCEFPIVLKKDGLAAGKGVIIA

SEQ ID NO: 2060928 - protein, 24 aa, Staphylococcus
DALFILGETLYNFGLMPQGLEVFR

SEQ ID NO: 2060929 - protein, 18 aa, Staphylococcus
DALFILGETLYNYGLMPQ

SEQ ID NO: 2060930 - protein, 17 aa, Staphylococcus
DALKFQLLEELPQQLQG

SEQ ID NO: 2060931 - protein, 23 aa, Staphylococcus
DALKPFYEQILGFNIVNETMTSI

SEQ ID NO: 2060932 - protein, 25 aa, Staphylococcus
DALLKNGHRFGFYKGYQGNSHIYIK

SEQ ID NO: 2060933 - protein, 22 aa, Staphylococcus
DALNLFIELTGINFNIVQQELE

SEQ ID NO: 2060934 - protein, 17 aa, Staphylococcus
DALNLFIELTGVNFNIV

SEQ ID NO: 2060935 - protein, 22 aa, Staphylococcus
DALRIIRGLRFQAQLNFKIVDN

SEQ ID NO: 2060936 - protein, 19 aa, Staphylococcus
DALRIIRGLRFQSQLTFDI

SEQ ID NO: 2060937 - protein, 17 aa, Staphylococcus
DALRRFKRSVSKSGTIQ

SEQ ID NO: 2060938 - protein, 18 aa, Staphylococcus
DALRRFKRTVSKSGTIQE

SEQ ID NO: 2060939 - protein, 19 aa, Staphylococcus
DALRRHVKYLLDNNAKSIV

SEQ ID NO: 2060940 - protein, 22 aa, Staphylococcus
DALTEFVNIYGAKGLAWVKVTD

SEQ ID NO: 2060941 - protein, 22 aa, Staphylococcus
DALTEFVNIYGAKGLAWVKVVD

SEQ ID NO: 2060942 - protein, 28 aa, Staphylococcus
DAMAKEGHHFFGLLYIGAILTQEGPKVI

SEQ ID NO: 2060943 - protein, 23 aa, Staphylococcus
DAMGKMFFTMMSAFAELEANLLS

SEQ ID NO: 2060944 - protein, 20 aa, Staphylococcus
DAMISYFNGVAQLRQHIKKS

SEQ ID NO: 2060945 - protein, 20 aa, Staphylococcus
DAMISYFNGVAQLRQHIKSS

SEQ ID NO: 2060946 - protein, 21 aa, Staphylococcus
DAMLRLFKTDILTYQIKNSSY

SEQ ID NO: 2060947 - protein, 21 aa, Staphylococcus
DAMNLADFFDAPYELFVESKY

SEQ ID NO: 2060948 - protein, 21 aa, Staphylococcus
DAMRPLVVMSPKSLLRNKTVA

SEQ ID NO: 2060949 - protein, 31 aa, Staphylococcus
DAMTELLNRILDKGLTKIAYIGGHHTIRELN

SEQ ID NO: 2060950 - protein, 18 aa, Staphylococcus
DAMVRMAQTFSYRYPLVD

SEQ ID NO: 2060951 - protein, 17 aa, Staphylococcus
DANDLLQMMIKTMEDRL

SEQ ID NO: 2060952 - protein, 29 aa, Staphylococcus
DANEFKNYILGLIFYRFLSEKNEDIAAGL

SEQ ID NO: 2060953 - protein, 28 aa, Staphylococcus
DANEFKNYILGMIFYRFLSEKIEEQAQI

SEQ ID NO: 2060954 - protein, 23 aa, Staphylococcus
DANIKGILNFTPRRVKAPSTVQV

SEQ ID NO: 2060955 - protein, 27 aa, Staphylococcus
DANWTYLFSEPIHDYGIFSEYIKGLMS

SEQ ID NO: 2060956 - protein, 22 aa, Staphylococcus
DAPDLVNLLTFIVNQKLTAQDL

SEQ ID NO: 2060957 - protein, 26 aa, Staphylococcus
DAPIAFQEFMILPVGADSFKESLRWG

SEQ ID NO: 2060958 - protein, 26 aa, Staphylococcus
DAPLKALIFDSEYDPYRGVISSIRVI

SEQ ID NO: 2060959 - protein, 27 aa, Staphylococcus
DAQAFDVPMPVYSAIYQPLVTYGENGK

SEQ ID NO: 2060960 - protein, 24 aa, Staphylococcus
DAQDNFILMVKNLYPQCFNTAYKI

SEQ ID NO: 2060961 - protein, 29 aa, Staphylococcus
DAQGFDAPMPVYIAIYQPLVTYGKNGKIE

SEQ ID NO: 2060962 - protein, 20 aa, Staphylococcus
DAQIIFIDTPGIHKPKHKLG

SEQ ID NO: 2060963 - protein, 21 aa, Staphylococcus
DAQIIFLDTPGIHKPKHKLGD

SEQ ID NO: 2060964 - protein, 25 aa, Staphylococcus
DAQKNDHLPILNKLLKAGTVKEVTL

SEQ ID NO: 2060965 - protein, 21 aa, Staphylococcus
DAQLLYGFINEEEKDMFLSLI

SEQ ID NO: 2060966 - protein, 23 aa, Staphylococcus
DARELFMQGYFKNNRKILKSIIA

SEQ ID NO: 2060967 - protein, 23 aa, Staphylococcus
DARRKREILGRKLHIGHSNGKQL

SEQ ID NO: 2060968 - protein, 22 aa, Staphylococcus
DARRRREILGQKLHIGHSNGKQ

SEQ ID NO: 2060969 - protein, 23 aa, Staphylococcus
DARRRREILGRKLHIGHSNGKQL

SEQ ID NO: 2060970 - protein, 30 aa, Staphylococcus
DARVKPHPFINLLNYILLESIGADIACTAL

SEQ ID NO: 2060971 - protein, 24 aa, Staphylococcus
DARYKDWFPNFALSDLISDNTATG

SEQ ID NO: 2060972 - protein, 21 aa, Staphylococcus
DARYKDWFPNFTLGDLICDDT

SEQ ID NO: 2060973 - protein, 20 aa, Staphylococcus
DASGPYHKKLRQHLTQLCET

SEQ ID NO: 2060974 - protein, 23 aa, Staphylococcus
DASIFEMTLAFSTFSVLIIFNNN

SEQ ID NO: 2060975 - protein, 17 aa, Staphylococcus
DASKFEFIINDTPVFIK

SEQ ID NO: 2060976 - protein, 23 aa, Staphylococcus
DASYAERVIFIKDGKLYHEIYRG

SEQ ID NO: 2060977 - protein, 23 aa, Staphylococcus
DASYAKRILFIKDGRLYHEIYRG

SEQ ID NO: 2060978 - protein, 24 aa, Staphylococcus
DASYANRVVFIKDGRLYHEIYRGE

SEQ ID NO: 2060979 - protein, 26 aa, Staphylococcus
DASYLKEFTNLYALLIPKAPSMKDVK

SEQ ID NO: 2060980 - protein, 19 aa, Staphylococcus
DATAFGYKLGQIPQMPLEF

SEQ ID NO: 2060981 - protein, 24 aa, Staphylococcus
DATGYINHLLQLIGPTISQQQGYY

SEQ ID NO: 2060982 - protein, 23 aa, Staphylococcus
DATIFLMNAVYDFEKVRHYQIQM

SEQ ID NO: 2060983 - protein, 23 aa, Staphylococcus
DATIIRLAVDGLWLSEIFGLDGL

SEQ ID NO: 2060984 - protein, 26 aa, Staphylococcus
DATVRAFYEFYSYLMEPWDGPTMISF

SEQ ID NO: 2060985 - protein, 17 aa, Staphylococcus
DAVFPLLHGPNGEDGTI

SEQ ID NO: 2060986 - protein, 18 aa, Staphylococcus
DAVFVAFGAPKGKEELYV

SEQ ID NO: 2060987 - protein, 20 aa, Staphylococcus
DAVKFLLYYDVDDEEQINIQ

SEQ ID NO: 2060988 - protein, 19 aa, Staphylococcus
DAVLELTVSRYLFDKYPEL

SEQ ID NO: 2060989 - protein, 19 aa, Staphylococcus
DAVNVSFPGFLPKLKLLEN

SEQ ID NO: 2060990 - protein, 17 aa, Staphylococcus
DAVYLPGGHGAVFDFAH

SEQ ID NO: 2060991 - protein, 17 aa, Staphylococcus
DAWADWYANQLNVSPEI

SEQ ID NO: 2060992 - protein, 17 aa, Staphylococcus
DAWLPYLNQLNAAPAAR

SEQ ID NO: 2060993 - protein, 18 aa, Staphylococcus
DAYDKIYKLREIEGKIII

SEQ ID NO: 2060994 - protein, 22 aa, Staphylococcus
DAYGINIRPLLNLAEKFYGDNP

SEQ ID NO: 2060995 - protein, 25 aa, Staphylococcus
DAYGINLRPLLTLAEKYYSGDNPAF

SEQ ID NO: 2060996 - protein, 25 aa, Staphylococcus
DAYGSQLGLKYYLEAKYPNKHIYAV

SEQ ID NO: 2060997 - protein, 30 aa, Staphylococcus
DAYGSQLGLKYYLQRKFPEKSIYAVGQPES

SEQ ID NO: 2060998 - protein, 20 aa, Staphylococcus
DAYKEFAYYLFELEQEDTAS

SEQ ID NO: 2060999 - protein, 23 aa, Staphylococcus
DAYKRFHLGPKETLNTLQTLYER

SEQ ID NO: 2061000 - protein, 21 aa, Staphylococcus
DAYLEHLRNLNISYVFGGPNK

SEQ ID NO: 2061001 - protein, 18 aa, Staphylococcus
DAYLTKFPGIGKKTARQI

SEQ ID NO: 2061002 - protein, 20 aa, Staphylococcus
DAYLTKFPGIGKKTARQIIL

SEQ ID NO: 2061003 - protein, 19 aa, Staphylococcus
DAYLTKFPGIGKKTARQIV

SEQ ID NO: 2061004 - protein, 20 aa, Staphylococcus
DAYLTQFPGIGKKTARQIVL

SEQ ID NO: 2061005 - protein, 21 aa, Staphylococcus
DAYNTLFEEGYFITSGIIEEK

SEQ ID NO: 2061006 - protein, 22 aa, Staphylococcus
DAYRRFKMGPKDTLNTLQNLYE

SEQ ID NO: 2061007 - protein, 19 aa, Staphylococcus
DAYSRIFKRAGINARPVVA

SEQ ID NO: 2061008 - protein, 24 aa, Staphylococcus
DAYYGLFYEDVYTQSIFTAITQLD

SEQ ID NO: 2061009 - protein, 24 aa, Staphylococcus
DAYYGLFYEDVYTQSIFTALTTLN

SEQ ID NO: 2061010 - protein, 26 aa, Staphylococcus
DAYYGLFYEDVYTQSLFTALTNIQSK

SEQ ID NO: 2061011 - protein, 24 aa, Staphylococcus
DAYYGLFYEDVYTQSLFTALTNLH

SEQ ID NO: 2061012 - protein, 37 aa, Staphylococcus; identical to SEQ ID NO: 1825639

SEQ ID NO: 2061013 - protein, 26 aa, Staphylococcus
DCEINEKVILLIMKQQPIASDLRMMM

SEQ ID NO: 2061014 - protein, 34 aa, Staphylococcus
DCEKIMVVANLPYYITTPILLNLMQQDIPIDGYV

SEQ ID NO: 2061015 - protein, 37 aa, Staphylococcus; identical to SEQ ID NO: 1679540

SEQ ID NO: 2061016 - protein, 38 aa, Staphylococcus
DCEKIMVVANLPYYITTPILLNLMQQKLPIDGYVVMMQ

SEQ ID NO: 2061017 - protein, 22 aa, Staphylococcus
DCELDKETFIYLITGPNMSGKS

SEQ ID NO: 2061018 - protein, 21 aa, Staphylococcus
DCGTPFCQTGLPFGRETIGCP

SEQ ID NO: 2061019 - protein, 19 aa, Staphylococcus
DCLMAARHLLKQGGRLYMV

SEQ ID NO: 2061020 - protein, 27 aa, Staphylococcus
DCMEMKPLYEWLGLTASLGFIDIPDYE

SEQ ID NO: 2061021 - protein, 24 aa, Staphylococcus
DCPKWEDFLNDIFLGNQELIKFIQ

SEQ ID NO: 2061022 - protein, 20 aa, Staphylococcus
DCRLDDDQFIYLITGPNMSG

SEQ ID NO: 2061023 - protein, 18 aa, Staphylococcus
DCSAFIPAGEERPLPTTA

SEQ ID NO: 2061024 - protein, 17 aa, Staphylococcus
DCTQYPFRIARPGAITA

SEQ ID NO: 2061025 - protein, 18 aa, Staphylococcus
DCTQYPFRIARPGSITTS

SEQ ID NO: 2061026 - protein, 18 aa, Staphylococcus
DCTTYPFKIARPGAITQS

SEQ ID NO: 2061027 - protein, 18 aa, Staphylococcus
DCYVMGLLKTKWIEQRNG

SEQ ID NO: 2061028 - protein, 39 aa, Staphylococcus
DDAGYYNVPIMSYGIKYASSFFGPFRDAADSAPSFGDRK

SEQ ID NO: 2061029 - protein, 38 aa, Staphylococcus
DDAGYYNVPIMSYGIKYASSFFGPFRDAAESTPQFGDR

SEQ ID NO: 2061030 - protein, 18 aa, Staphylococcus
DDAIIEQIIKFNEDLRTM

SEQ ID NO: 2061031 - protein, 20 aa, Staphylococcus
DDAIKILPFVNLEALREHPK

SEQ ID NO: 2061032 - protein, 24 aa, Staphylococcus
DDAKEYWLCWVTTERSEQGPYYAG

SEQ ID NO: 2061033 - protein, 26 aa, Staphylococcus
DDAKKGFLLDGFPRTIDQAEALNDIM

SEQ ID NO: 2061034 - protein, 26 aa, Staphylococcus
DDAKKGFLLDGFPRTIDQAEALNEIM

SEQ ID NO: 2061035 - protein, 26 aa, Staphylococcus
DDAKKGFLLDGFPRTIDQAEALNSIM

SEQ ID NO: 2061036 - protein, 26 aa, Staphylococcus
DDAKKGFLLDGFPRTIEQAEALNNIM

SEQ ID NO: 2061037 - protein, 26 aa, Staphylococcus
DDAKKGFLLDGFPRTIEQAEALNSIM

SEQ ID NO: 2061038 - protein, 26 aa, Staphylococcus
DDAKKGFLLDGFPRTIEQAEALSNIM

SEQ ID NO: 2061039 - protein, 26 aa, Staphylococcus
DDAKKGFLLDGFPRTLEQAEALSKIM

SEQ ID NO: 2061040 - protein, 36 aa, Staphylococcus
DDAKKHWIGIPLWVHRRCLKPMFTIANQIAYDNKMV

SEQ ID NO: 2061041 - protein, 24 aa, Staphylococcus
DDAKRKVAIALRNRYRRSLLDEEA

SEQ ID NO: 2061042 - protein, 24 aa, Staphylococcus
DDAKRKVAIALRNRYRRSLLDEES

SEQ ID NO: 2061043 - protein, 25 aa, Staphylococcus
DDAKRKVAIALRNRYRRSLLTEEEK

SEQ ID NO: 2061044 - protein, 21 aa, Staphylococcus
DDALCFYDLGSAEMNLDMAIE

SEQ ID NO: 2061045 - protein, 21 aa, Staphylococcus
DDALCFYDLGSSEMNLDLAIE

SEQ ID NO: 2061046 - protein, 30 aa, Staphylococcus
DDANHKAPIRRGPNIKLPSLDLLEDHEEHE

SEQ ID NO: 2061047 - protein, 25 aa, Staphylococcus
DDAYYGLFYEDVYTQSIFTALSQVN

SEQ ID NO: 2061048 - protein, 25 aa, Staphylococcus
DDCKIGIMPGYIHKRGHVGVVSRSG

SEQ ID NO: 2061049 - protein, 17 aa, Staphylococcus
DDCNTLYLYEKELAARS

SEQ ID NO: 2061050 - protein, 25 aa, Staphylococcus
DDCRAQLIELPLTLTAKELGTALMK

SEQ ID NO: 2061051 - protein, 33 aa, Staphylococcus
DDDAIQEWYRVLPLINELPIKDLDKGLLATYCQ

SEQ ID NO: 2061052 - protein, 28 aa, Staphylococcus
DDDDKIKWLIPFLSYSGPTIIYISSKKR

SEQ ID NO: 2061053 - protein, 35 aa, Staphylococcus
DDDFRTIIKSLYYFSIANPNPFEWLTQLVKPYQNE

SEQ ID NO: 2061054 - protein, 19 aa, Staphylococcus
DDDIIKKIIKFNEDLRTMS

SEQ ID NO: 2061055 - protein, 24 aa, Staphylococcus
DDDNSLVVLPLTKAIKESTLNQIK

SEQ ID NO: 2061056 - protein, 26 aa, Staphylococcus
DDDNVIFLRKWKEVGLRYGELSLVME

SEQ ID NO: 2061057 - protein, 24 aa, Staphylococcus
DDDRRLLLLNQELERFRATLFRQT

SEQ ID NO: 2061058 - protein, 29 aa, Staphylococcus
DDDVYFVDGPLDLTFLFGLVDHLSHKLSY

SEQ ID NO: 2061059 - protein, 24 aa, Staphylococcus
DDEAHLLYQAFLKSKEKYDEIMRF

SEQ ID NO: 2061060 - protein, 23 aa, Staphylococcus
DDEAHLLYSAFLKSKDKYDDVMR

SEQ ID NO: 2061061 - protein, 23 aa, Staphylococcus
DDEDRIRRLLKLYLERESFETHE

SEQ ID NO: 2061062 - protein, 22 aa, Staphylococcus
DDEDRIRRLLKLYLERESFTIH

SEQ ID NO: 2061063 - protein, 25 aa, Staphylococcus
DDEDRIRRLLKLYLKRESFTIHEAS

SEQ ID NO: 2061064 - protein, 24 aa, Staphylococcus
DDEFDEFIIWDSSYHPKMITSCIL

SEQ ID NO: 2061065 - protein, 23 aa, Staphylococcus
DDEILRKVWELSGKTAERLNKLQ

SEQ ID NO: 2061066 - protein, 17 aa, Staphylococcus
DDELGERIGFISNSTGG

SEQ ID NO: 2061067 - protein, 20 aa, Staphylococcus
DDELIISAIIKILKQTNAHV

SEQ ID NO: 2061068 - protein, 22 aa, Staphylococcus
DDELREQLITLWNVRDDRYSDE

SEQ ID NO: 2061069 - protein, 30 aa, Staphylococcus
DDEPVKGDVWAAWYADLLNVNPQLNIQPAE

SEQ ID NO: 2061070 - protein, 20 aa, Staphylococcus
DDEQLYYLMSRGISQQEAER

SEQ ID NO: 2061071 - protein, 25 aa, Staphylococcus
DDERRLLLLNQELERFRATLFRQTM

SEQ ID NO: 2061072 - protein, 28 aa, Staphylococcus
DDESYIKRLFQLLKLKRDEIKALNLNYA

SEQ ID NO: 2061073 - protein, 29 aa, Staphylococcus
DDEVFQGETLLFLLGLTNSMAGFEKLVPD

SEQ ID NO: 2061074 - protein, 26 aa, Staphylococcus
DDEWRAYGLNHFVLPEVLISTENERT

SEQ ID NO: 2061075 - protein, 27 aa, Staphylococcus
DDEWRQFGLNHFVLPKVLITMEENETI

SEQ ID NO: 2061076 - protein, 23 aa, Staphylococcus
DDFEDLLYMSDSHYYYAIHFDST

SEQ ID NO: 2061077 - protein, 20 aa, Staphylococcus
DDFILDTYQPNIKAFANLHS

SEQ ID NO: 2061078 - protein, 26 aa, Staphylococcus
DDFKSYLPDLVLLDINLPTLNGFHWC

SEQ ID NO: 2061079 - protein, 24 aa, Staphylococcus
DDFPEHLLHFINLSTPRPIVYTED

SEQ ID NO: 2061080 - protein, 18 aa, Staphylococcus
DDFPEHLMHYVNLSTPRP

SEQ ID NO: 2061081 - protein, 27 aa, Staphylococcus
DDFVANWLKMNYAEIIKAALYEAIGHE

SEQ ID NO: 2061082 - protein, 25 aa, Staphylococcus
DDGDYLFEAVYGAGIIRLYELDSST

SEQ ID NO: 2061083 - protein, 26 aa, Staphylococcus
DDGFLPFNIFSPYRYFTKEKKERFKP

SEQ ID NO: 2061084 - protein, 20 aa, Staphylococcus
DDGIHIDVYCSIKHGIKIAK

SEQ ID NO: 2061085 - protein, 21 aa, Staphylococcus
DDGIYIDVFCEFKYGINISKT

SEQ ID NO: 2061086 - protein, 22 aa, Staphylococcus
DDGLLVPFVRDCDKKNFAEIEQ

SEQ ID NO: 2061087 - protein, 23 aa, Staphylococcus
DDGLLVPFVRDCDKKNFAEIEQE

SEQ ID NO: 2061088 - protein, 23 aa, Staphylococcus
DDGLLVPFVRDCDKKNFAELEKS

SEQ ID NO: 2061089 - protein, 24 aa, Staphylococcus
DDGMAFLTGVVSRKKQVVPQITEV

SEQ ID NO: 2061090 - protein, 27 aa, Staphylococcus
DDGMYDLIKEPLRFLQVRIPVRMDDGT

SEQ ID NO: 2061091 - protein, 23 aa, Staphylococcus
DDHDYVWHPFTQMGVYSETDPII

SEQ ID NO: 2061092 - protein, 20 aa, Staphylococcus
DDHEIIKTWKKAYQEIADIF

SEQ ID NO: 2061093 - protein, 18 aa, Staphylococcus
DDIDFVILGHYQLIDLLL

SEQ ID NO: 2061094 - protein, 25 aa, Staphylococcus
DDIDTLIQTFKQFDTIIFSVGSGGS

SEQ ID NO: 2061095 - protein, 25 aa, Staphylococcus
DDIEELRRFIEQTQLFFEKANKYKD

SEQ ID NO: 2061096 - protein, 21 aa, Staphylococcus
DDIHNVFMYFAGLADKDGGEV

SEQ ID NO: 2061097 - protein, 24 aa, Staphylococcus
DDIIQLLDYLYIDESALIGHEMGA

SEQ ID NO: 2061098 - protein, 19 aa, Staphylococcus
DDIIVFHKLSKEELKEIVT

SEQ ID NO: 2061099 - protein, 17 aa, Staphylococcus
DDIIVFHKLTKDELKEI

SEQ ID NO: 2061100 - protein, 23 aa, Staphylococcus
DDILNHMFQYLPNFFQNRSSEDN

SEQ ID NO: 2061101 - protein, 18 aa, Staphylococcus
DDIMIQKIIKFNEDLRTM

SEQ ID NO: 2061102 - protein, 19 aa, Staphylococcus
DDIPGILKKEHRKHDVRLT

SEQ ID NO: 2061103 - protein, 35 aa, Staphylococcus
DDIPNFDKLKARLILMITRFSVYLRKATPEAKNQL

SEQ ID NO: 2061104 - protein, 36 aa, Staphylococcus
DDIRTAMRMILPRKWTLSYLVDYFMKWLNDTRGTFM

SEQ ID NO: 2061105 - protein, 26 aa, Staphylococcus
DDISLLDDILPYDFELALDANESLDV

SEQ ID NO: 2061106 - protein, 23 aa, Staphylococcus
DDISYLNHFNPSVGDTLYVVGDT

SEQ ID NO: 2061107 - protein, 27 aa, Staphylococcus
DDIYHAVPLYKEKLMLVVDKNSKYAKQ

SEQ ID NO: 2061108 - protein, 22 aa, Staphylococcus
DDKAFPLDELILYLNDLAGKHG

SEQ ID NO: 2061109 - protein, 20 aa, Staphylococcus
DDKALIFTPSYGPFKMACDK

SEQ ID NO: 2061110 - protein, 17 aa, Staphylococcus
DDKAQLISVMRGTIAIK

SEQ ID NO: 2061111 - protein, 23 aa, Staphylococcus
DDKKKLYFNPGSVGLNNGAYAVY

SEQ ID NO: 2061112 - protein, 24 aa, Staphylococcus
DDKKVKVIAWYDNEWGYSNRVVDI

SEQ ID NO: 2061113 - protein, 27 aa, Staphylococcus
DDKLFDNLLLHMKPALHRLKYRMSQQN

SEQ ID NO: 2061114 - protein, 18 aa, Staphylococcus
DDKLPIETALKQLSFFVQ

SEQ ID NO: 2061115 - protein, 17 aa, Staphylococcus
DDKLYVPVIKHADEKSI

SEQ ID NO: 2061116 - protein, 23 aa, Staphylococcus
DDKQGVLRLFLKYGQNNERVITG

SEQ ID NO: 2061117 - protein, 24 aa, Staphylococcus
DDKQGVLRLFLKYGQNNERVITGL

SEQ ID NO: 2061118 - protein, 27 aa, Staphylococcus
DDKQRISIMYSMPKWIVKHWVTHYGVD

SEQ ID NO: 2061119 - protein, 23 aa, Staphylococcus
DDKSDLIYISQKGKFDAVVEDVV

SEQ ID NO: 2061120 - protein, 23 aa, Staphylococcus
DDKYFDIEQFRKMGLKRQPLTDE

SEQ ID NO: 2061121 - protein, 24 aa, Staphylococcus
DDLDKSMKFYKDIGFTIIQQPEQE

SEQ ID NO: 2061122 - protein, 21 aa, Staphylococcus
DDLFDMFIFKNERLKDKMKTA

SEQ ID NO: 2061123 - protein, 17 aa, Staphylococcus
DDLFKQFKQGAVFINAA

SEQ ID NO: 2061124 - protein, 31 aa, Staphylococcus
DDLGLEAAFKSYFKHFEQTYGLAISYQANIQ

SEQ ID NO: 2061125 - protein, 24 aa, Staphylococcus
DDLISLFLLLQMEDVSLIGVSAIG

SEQ ID NO: 2061126 - protein, 26 aa, Staphylococcus
DDLKKDFIKKSAMVGSAFATMNLIDG

SEQ ID NO: 2061127 - protein, 24 aa, Staphylococcus
DDLNIFELFDYNVAFEIRLQEALE

SEQ ID NO: 2061128 - protein, 22 aa, Staphylococcus
DDLQHLPLILPNRQYQVRKHLD

SEQ ID NO: 2061129 - protein, 20 aa, Staphylococcus
DDLQPFNPESYVYGLFADMI

SEQ ID NO: 2061130 - protein, 22 aa, Staphylococcus
DDLQYTMTVTFDEAVFGSEKEI

SEQ ID NO: 2061131 - protein, 20 aa, Staphylococcus
DDLQYTMTVTFEEAVFGTKK

SEQ ID NO: 2061132 - protein, 23 aa, Staphylococcus
DDLSIIKNILRYAQKKYHITDIS

SEQ ID NO: 2061133 - protein, 17 aa, Staphylococcus
DDLYLCYETFYHPSNMV

SEQ ID NO: 2061134 - protein, 19 aa, Staphylococcus
DDLYLCYETFYHPSNMVLF

SEQ ID NO: 2061135 - protein, 23 aa, Staphylococcus
DDMAFLTGVVSRKKQVVPQITEA

SEQ ID NO: 2061136 - protein, 19 aa, Staphylococcus
DDMVKRYEPKDLFAVVMDA

SEQ ID NO: 2061137 - protein, 19 aa, Staphylococcus
DDMVKRYQPKDLFAVVMDA

SEQ ID NO: 2061138 - protein, 22 aa, Staphylococcus
DDMVTSFRDLGRRVVLYQHKIA

SEQ ID NO: 2061139 - protein, 17 aa, Staphylococcus
DDNANRIGVWIGSGIGG

SEQ ID NO: 2061140 - protein, 24 aa, Staphylococcus
DDNEEVLLIFQGPHAYISSTWYSD

SEQ ID NO: 2061141 - protein, 25 aa, Staphylococcus
DDNIAYQYATIRNVLYNKGYTTEML

SEQ ID NO: 2061142 - protein, 25 aa, Staphylococcus
DDNKDKIELFKKLEFKQLLSDIDSN

SEQ ID NO: 2061143 - protein, 21 aa, Staphylococcus
DDNLLKLLQAFSDAVAQRGKV

SEQ ID NO: 2061144 - protein, 28 aa, Staphylococcus
DDNNLHLMQLKELFLVSLQERAIPFEVN

SEQ ID NO: 2061145 - protein, 24 aa, Staphylococcus
DDNPDYAPFINYVNDVFLQEGDLA

SEQ ID NO: 2061146 - protein, 24 aa, Staphylococcus
DDNPDYAPFINYVNDVFLQEGDLK

SEQ ID NO: 2061147 - protein, 26 aa, Staphylococcus
DDNRIVQALPTIKYIIEQGGKVVLFS

SEQ ID NO: 2061148 - protein, 27 aa, Staphylococcus
DDNVRAFYEFYSYLMEPWDGPTMISFC

SEQ ID NO: 2061149 - protein, 22 aa, Staphylococcus
DDPDYEPFINYVDDVFLNEGDI

SEQ ID NO: 2061150 - protein, 21 aa, Staphylococcus
DDPELFATEHLAFCKDLELKG

SEQ ID NO: 2061151 - protein, 25 aa, Staphylococcus
DDPHKIVRWRAAMFIFDEGGPEQLD

SEQ ID NO: 2061152 - protein, 17 aa, Staphylococcus
DDQFIYLITGPNMSGKS

SEQ ID NO: 2061153 - protein, 24 aa, Staphylococcus
DDQFLRTGLPRLVPYTRLDVVKRQ

SEQ ID NO: 2061154 - protein, 23 aa, Staphylococcus
DDQIIPMIEYFKYKGIEIRFIEF

SEQ ID NO: 2061155 - protein, 23 aa, Staphylococcus
DDQIIPMVQYFKDKNIQVRFIEF

SEQ ID NO: 2061156 - protein, 24 aa, Staphylococcus
DDQRRLLLLNQELERFRATLFRQT

SEQ ID NO: 2061157 - protein, 26 aa, Staphylococcus
DDREWNYPPFELTHVNDWLYGRGVSD

SEQ ID NO: 2061158 - protein, 22 aa, Staphylococcus
DDRTEALLFAASRREHLVGKVI

SEQ ID NO: 2061159 - protein, 20 aa, Staphylococcus
DDRYLLETILFADMILPYDI

SEQ ID NO: 2061160 - protein, 21 aa, Staphylococcus
DDSEPLCELIYASADPYLRSE

SEQ ID NO: 2061161 - protein, 24 aa, Staphylococcus
DDSHYRLYGIFLLNQLNGKEILMT

SEQ ID NO: 2061162 - protein, 24 aa, Staphylococcus
DDSTGYFIKPTIISGLKSSDQIMQ

SEQ ID NO: 2061163 - protein, 24 aa, Staphylococcus
DDSTGYFIKPTIISGLKSSDQVMQ

SEQ ID NO: 2061164 - protein, 27 aa, Staphylococcus
DDTDLYIDFMNLKQWCQNKFQVTNQIS

SEQ ID NO: 2061165 - protein, 34 aa, Staphylococcus
DDTHYYYIDPLWSHFLRKVIVPALVPNRFQIIKI

SEQ ID NO: 2061166 - protein, 39 aa, Staphylococcus
DDTHYYYIDPLWSHLGWKIVFPAILPNKFQIIKISKQKM

SEQ ID NO: 2061167 - protein, 31 aa, Staphylococcus
DDTISLSKLFSPLLEPEIMFKLTADLPKDAD

SEQ ID NO: 2061168 - protein, 21 aa, Staphylococcus
DDTLYLFYTGHHYYGDNDPDH

SEQ ID NO: 2061169 - protein, 25 aa, Staphylococcus
DDTNTTMFLITPQYDKPGLLASVLN

SEQ ID NO: 2061170 - protein, 24 aa, Staphylococcus
DDTTFVVINSTCGCAAGLARPAAV

SEQ ID NO: 2061171 - protein, 23 aa, Staphylococcus
DDTTGFVKLLTLKEDNTLVGAQV

SEQ ID NO: 2061172 - protein, 17 aa, Staphylococcus
DDTTIQKIIKFNEDLRT

SEQ ID NO: 2061173 - protein, 27 aa, Staphylococcus
DDTTKQYYFHLFSKKQPDLNWSNPDVR

SEQ ID NO: 2061174 - protein, 27 aa, Staphylococcus
DDTTLEPMVLPARFPNLLINGSTGISA

SEQ ID NO: 2061175 - protein, 27 aa, Staphylococcus
DDTTLEPMVLPARFPNLLVNGSTGISS

SEQ ID NO: 2061176 - protein, 27 aa, Staphylococcus
DDTTLEPMVLPARLPNLLINGSTGISA

SEQ ID NO: 2061177 - protein, 27 aa, Staphylococcus
DDTTLEPMVLPSRFPNLLVNGSTGISS

SEQ ID NO: 2061178 - protein, 20 aa, Staphylococcus
DDTWGQIPVLYFVSENEVNR

SEQ ID NO: 2061179 - protein, 28 aa, Staphylococcus
DDVKYPNLMFHFLPIAVRYDGQKADTEH

SEQ ID NO: 2061180 - protein, 18 aa, Staphylococcus
DDVLLLPAESDVLPKEVD

SEQ ID NO: 2061181 - protein, 19 aa, Staphylococcus
DDVSLYIAAAQRKKQDINA

SEQ ID NO: 2061182 - protein, 25 aa, Staphylococcus
DDYATIGPFAQLRPGADLGKKVKVG

SEQ ID NO: 2061183 - protein, 25 aa, Staphylococcus
DDYDAIMETLYLQQNPSNAKHLAES

SEQ ID NO: 2061184 - protein, 17 aa, Staphylococcus
DDYFALIEQYFKQINHI

SEQ ID NO: 2061185 - protein, 19 aa, Staphylococcus
DDYFLRTLLRERTNFCFLP

SEQ ID NO: 2061186 - protein, 23 aa, Staphylococcus
DDYHRLFLFVSEGILKGYLYLQI

SEQ ID NO: 2061187 - protein, 20 aa, Staphylococcus
DDYLQILINDLITYIKRHPS

SEQ ID NO: 2061188 - protein, 27 aa, Staphylococcus
DDYPDLEFDFIYWLVSGVKDHEPVLDE

SEQ ID NO: 2061189 - protein, 23 aa, Staphylococcus
DDYQLMIMHPWQYDHVLHQDYME

SEQ ID NO: 2061190 - protein, 23 aa, Staphylococcus
DDYQNFLMVSYINNKVNALFSNQ

SEQ ID NO: 2061191 - protein, 33 aa, Staphylococcus
DDYTLKIDLTKPIPYFKQMLAFGTFMPQNEKAV

SEQ ID NO: 2061192 - protein, 25 aa, Staphylococcus
DDYVVLLRMHYLISNALDLRGYEDF

SEQ ID NO: 2061193 - protein, 39 aa, Staphylococcus
DEAGYYNIPIMSYGIKYASSFFGPFRDAADSAPSFGDRK

SEQ ID NO: 2061194 - protein, 38 aa, Staphylococcus
DEAGYYNIPIMSYGIKYASSFYGPFRDAAESTPSFGDR

SEQ ID NO: 2061195 - protein, 23 aa, Staphylococcus
DEAHLLYQAFLKSKERYDEVMRF

SEQ ID NO: 2061196 - protein, 25 aa, Staphylococcus
DEAKEYWLCWVTTERSEQGPYYAGV

SEQ ID NO: 2061197 - protein, 20 aa, Staphylococcus
DEAKILDLMNGGIRGRQVII

SEQ ID NO: 2061198 - protein, 24 aa, Staphylococcus
DEALDYNPFINYVNDVFLQEGSLT

SEQ ID NO: 2061199 - protein, 21 aa, Staphylococcus
DEALLKLTYYDRKAVTHWSNE

SEQ ID NO: 2061200 - protein, 28 aa, Staphylococcus
DEARSIRIDLPPFTLIGATTRAGSLTGP

SEQ ID NO: 2061201 - protein, 17 aa, Staphylococcus
DEATWFALMDHLVDMSI

SEQ ID NO: 2061202 - protein, 24 aa, Staphylococcus
DEAVDRACYLLQTYAGGSVAQGRV

SEQ ID NO: 2061203 - protein, 22 aa, Staphylococcus
DEAVLNYARLAHKAGLDGVVCS

SEQ ID NO: 2061204 - protein, 19 aa, Staphylococcus
DECFGYVPILPLGGKEEAA

SEQ ID NO: 2061205 - protein, 23 aa, Staphylococcus
DEDFELVLLELEYPEKFATIDHR

SEQ ID NO: 2061206 - protein, 34 aa, Staphylococcus
DEDFKLLHLSFNPNLRLFLHKYDLYEANIWSLFD

SEQ ID NO: 2061207 - protein, 19 aa, Staphylococcus
DEDGYFWFEGRRDDIIISS

SEQ ID NO: 2061208 - protein, 19 aa, Staphylococcus
DEDGYFWFEGRSDDIIISS

SEQ ID NO: 2061209 - protein, 19 aa, Staphylococcus
DEDGYFWFQGRVDDVIMTA

SEQ ID NO: 2061210 - protein, 19 aa, Staphylococcus
DEDGYYWFQGRVDDVIMTA

SEQ ID NO: 2061211 - protein, 23 aa, Staphylococcus
DEDIDIFFASNQVLFRVGHVNFI

SEQ ID NO: 2061212 - protein, 23 aa, Staphylococcus
DEDIDIFFASNQVLFRVGNVNFI

SEQ ID NO: 2061213 - protein, 17 aa, Staphylococcus
DEDIYRLAITDITTFRT

SEQ ID NO: 2061214 - protein, 18 aa, Staphylococcus
DEDKLYVPVIKHADEKSI

SEQ ID NO: 2061215 - protein, 23 aa, Staphylococcus
DEDKLYVPVIKNADEKSIKGIAR

SEQ ID NO: 2061216 - protein, 24 aa, Staphylococcus
DEDLQLLTLIQPGDTFKFTFTKEN

SEQ ID NO: 2061217 - protein, 22 aa, Staphylococcus
DEDLRDYHIAAQILNYFNVQQV

SEQ ID NO: 2061218 - protein, 21 aa, Staphylococcus
DEDVTLPLKDILRIATEEDIQ

SEQ ID NO: 2061219 - protein, 28 aa, Staphylococcus
DEDVTQPLLVKFLWDNLTDQPIGQVKYP

SEQ ID NO: 2061220 - protein, 26 aa, Staphylococcus
DEDYYDVLNTLPRYLEKTICGKKCLF

SEQ ID NO: 2061221 - protein, 25 aa, Staphylococcus
DEEDLDPVFTWHLAFAFGQEERDKE

SEQ ID NO: 2061222 - protein, 26 aa, Staphylococcus
DEEDPIIQAWINAYWEIANVFIDVEK

SEQ ID NO: 2061223 - protein, 17 aa, Staphylococcus
DEEEFLNILNLAREQHA

SEQ ID NO: 2061224 - protein, 17 aa, Staphylococcus
DEEGRIPFIKKMQDKGL

SEQ ID NO: 2061225 - protein, 23 aa, Staphylococcus
DEEGRIPFIKKMQEKGLFASISV

SEQ ID NO: 2061226 - protein, 22 aa, Staphylococcus
DEEIKSLYFALSSISNLKSLPF

SEQ ID NO: 2061227 - protein, 26 aa, Staphylococcus
DEEIRNSIRILSRKTKNNPVLIGEPG

SEQ ID NO: 2061228 - protein, 25 aa, Staphylococcus
DEEIRNTIRILSRKTKNNPVLIGEP

SEQ ID NO: 2061229 - protein, 24 aa, Staphylococcus
DEEKKLWQYGVTSGLRIICLYDQA

SEQ ID NO: 2061230 - protein, 24 aa, Staphylococcus
DEEKLWENLNYFIQKVIPVAEEED

SEQ ID NO: 2061231 - protein, 23 aa, Staphylococcus
DEEKLYQAYRYNDQLKAKIESLS

SEQ ID NO: 2061232 - protein, 21 aa, Staphylococcus
DEELFFVVSVDTPMITSKAIS

SEQ ID NO: 2061233 - protein, 23 aa, Staphylococcus
DEELNRLFLYKEVKSTGFVGFTK

SEQ ID NO: 2061234 - protein, 27 aa, Staphylococcus
DEEMRRLFPDNEKLLRWLDLAEEKISY

SEQ ID NO: 2061235 - protein, 22 aa, Staphylococcus
DEETFLNLYHKVLDYLDERNEL

SEQ ID NO: 2061236 - protein, 19 aa, Staphylococcus
DEFDAFYSELKPLSELYNS

SEQ ID NO: 2061237 - protein, 21 aa, Staphylococcus
DEFESMIRFAEKYNAHLDHEI

SEQ ID NO: 2061238 - protein, 17 aa, Staphylococcus
DEFKEHLSQYGIEIARV

SEQ ID NO: 2061239 - protein, 19 aa, Staphylococcus
DEFKHYRGTTSYPPKMITS

SEQ ID NO: 2061240 - protein, 22 aa, Staphylococcus
DEFKPFMHPLVIDLSKDPNEKI

SEQ ID NO: 2061241 - protein, 24 aa, Staphylococcus
DEFKRILHPNDILDWILTESPELD

SEQ ID NO: 2061242 - protein, 22 aa, Staphylococcus
DEFLKKTLMFPIIDKVIQKESK

SEQ ID NO: 2061243 - protein, 17 aa, Staphylococcus
DEFSMEAFNLYGALSMA

SEQ ID NO: 2061244 - protein, 32 aa, Staphylococcus
DEGAIPYEPMTGGIFLWLKTPESYTGEQFVEF

SEQ ID NO: 2061245 - protein, 23 aa, Staphylococcus
DEGAIVLKFFLTLDKKEQLKRFK

SEQ ID NO: 2061246 - protein, 29 aa, Staphylococcus
DEGESFFVKFHWRPVHGLESLVWDEAQTL

SEQ ID NO: 2061247 - protein, 25 aa, Staphylococcus
DEGIYIDVYCSLAYGINISETAKKI

SEQ ID NO: 2061248 - protein, 18 aa, Staphylococcus
DEGIYVKSIVFPTVPRGT

SEQ ID NO: 2061249 - protein, 25 aa, Staphylococcus
DEGNRPIGSFLFVGPTGVGKTELAK

SEQ ID NO: 2061250 - protein, 17 aa, Staphylococcus
DEGTIIIKFFLCLDKEE

SEQ ID NO: 2061251 - protein, 24 aa, Staphylococcus
DEHFPYISFIPVNGEVVLSLEGFK

SEQ ID NO: 2061252 - protein, 25 aa, Staphylococcus
DEHKELFGEFPTAQFPLMVKMIDAQ

SEQ ID NO: 2061253 - protein, 18 aa, Staphylococcus
DEHLEVIEKLNVPVILVG

SEQ ID NO: 2061254 - protein, 22 aa, Staphylococcus
DEIANRWKLDKAFKPKMPEAER

SEQ ID NO: 2061255 - protein, 17 aa, Staphylococcus
DEIAPVGTIYQAGTLSG

SEQ ID NO: 2061256 - protein, 25 aa, Staphylococcus
DEIERLHYLVDNDFYFNVFEKYSEE

SEQ ID NO: 2061257 - protein, 20 aa, Staphylococcus
DEIGIPYQILNQGDAQSLRI

SEQ ID NO: 2061258 - protein, 25 aa, Staphylococcus
DEIHHAGNVILFIDELHTLVGAGGA

SEQ ID NO: 2061259 - protein, 21 aa, Staphylococcus
DEIIGFANFIYGKELYLSAHY

SEQ ID NO: 2061260 - protein, 30 aa, Staphylococcus
DEIILPSPIYAGYIPLIETLGGNPVYVDTT

SEQ ID NO: 2061261 - protein, 24 aa, Staphylococcus
DEIKAIFEQLGFKTIQNADTLTVY

SEQ ID NO: 2061262 - protein, 18 aa, Staphylococcus
DEIKLLKAHRSAENGYRI

SEQ ID NO: 2061263 - protein, 29 aa, Staphylococcus
DEIKNLYPDLPLFTFGRSSGGYLAIQIAN

SEQ ID NO: 2061264 - protein, 18 aa, Staphylococcus
DEILARIGEYYYGSDDIL

SEQ ID NO: 2061265 - protein, 27 aa, Staphylococcus
DEILIPGPIYAGYIPLVETLGGKPIYI

SEQ ID NO: 2061266 - protein, 18 aa, Staphylococcus
DEILNYLEPAFQRGKVDK

SEQ ID NO: 2061267 - protein, 22 aa, Staphylococcus
DEILRKVWELSGKTAERLNKLQ

SEQ ID NO: 2061268 - protein, 19 aa, Staphylococcus
DEIMPIYDAAMKYKEDGTG

SEQ ID NO: 2061269 - protein, 24 aa, Staphylococcus
DEINEKVIMLITKQQPIATDLRMM

SEQ ID NO: 2061270 - protein, 17 aa, Staphylococcus
DEINQLLEFFNQSFSSL

SEQ ID NO: 2061271 - protein, 18 aa, Staphylococcus
DEIPSTLPVFEDVTNGAL

SEQ ID NO: 2061272 - protein, 26 aa, Staphylococcus
DEIQYPAIPSVLYSLPRLSQIGVSVQ

SEQ ID NO: 2061273 - protein, 26 aa, Staphylococcus
DEIRLPITDLYVHLTRHAHGNYTVLL

SEQ ID NO: 2061274 - protein, 20 aa, Staphylococcus
DEIRRFLPRKVRTFQLKEAQ

SEQ ID NO: 2061275 - protein, 24 aa, Staphylococcus
DEIYLIVEYGFAKRLLNTKRSLAL

SEQ ID NO: 2061276 - protein, 23 aa, Staphylococcus
DEKAQLILQAMLVSLQTIEDEYH

SEQ ID NO: 2061277 - protein, 44 aa, Staphylococcus
DEKDGRQAIQFLKQRSLGRATFLPLNVIQPRYLAADIKSTAQAS

SEQ ID NO: 2061278 - protein, 25 aa, Staphylococcus
DEKEALFREIYRVLKDGGKAVISDI

SEQ ID NO: 2061279 - protein, 17 aa, Staphylococcus
DEKGRIFCYVLTEDQYV

SEQ ID NO: 2061280 - protein, 25 aa, Staphylococcus
DEKIIYIDKVYIMLNKPSGVVSATE

SEQ ID NO: 2061281 - protein, 22 aa, Staphylococcus
DEKLRQLYQYASSKGLEVLVEV

SEQ ID NO: 2061282 - protein, 24 aa, Staphylococcus
DEKNFHILQMLKLNMQHKTIKDLM

SEQ ID NO: 2061283 - protein, 30 aa, Staphylococcus
DEKNRLLPGGYLFLSDLVGNPTLLNRVGKL

SEQ ID NO: 2061284 - protein, 25 aa, Staphylococcus
DEKQIVFPVKYAKPKLLGELFNCSY

SEQ ID NO: 2061285 - protein, 23 aa, Staphylococcus
DEKRLNYAGFYRLHHSYKKEVMM

SEQ ID NO: 2061286 - protein, 24 aa, Staphylococcus
DEKRLNYAGFYRLHHSYKKKVVMA

SEQ ID NO: 2061287 - protein, 25 aa, Staphylococcus
DEKRLNYVGFYRLHHAYHKKVMMAQ

SEQ ID NO: 2061288 - protein, 24 aa, Staphylococcus
DEKRLNYVGFYRLHHPYKKKVMMA

SEQ ID NO: 2061289 - protein, 24 aa, Staphylococcus
DEKSFIDMAYTLLNDKGATMNLYD

SEQ ID NO: 2061290 - protein, 26 aa, Staphylococcus
DEKTLFAEGAYLYYLGRFIDSDSSSP

SEQ ID NO: 2061291 - protein, 25 aa, Staphylococcus
DEKVGFVYAFFINSNIDVLHQSIKA

SEQ ID NO: 2061292 - protein, 17 aa, Staphylococcus
DEKVLVFDLGGGTFDVS

SEQ ID NO: 2061293 - protein, 24 aa, Staphylococcus
DEKYKEILGAFIVGPHATDLIGEL

SEQ ID NO: 2061294 - protein, 17 aa, Staphylococcus
DEKYRTWDWNYGKNPKY

SEQ ID NO: 2061295 - protein, 25 aa, Staphylococcus
DELGKLFRSLIDIVAKAIGIPPSLI

SEQ ID NO: 2061296 - protein, 19 aa, Staphylococcus
DELGTALQLPPFYEARRHE

SEQ ID NO: 2061297 - protein, 18 aa, Staphylococcus
DELIKDLRRLGLRVYFNI

SEQ ID NO: 2061298 - protein, 18 aa, Staphylococcus
DELIPYMKNVRVMVVFGE

SEQ ID NO: 2061299 - protein, 20 aa, Staphylococcus
DELKEIVTMMVNKLTKRLSE

SEQ ID NO: 2061300 - protein, 31 aa, Staphylococcus
DELKLRYLNFARLFQRQYFQNLWLNAWEETH

SEQ ID NO: 2061301 - protein, 23 aa, Staphylococcus
DELKNRRATLVNLQRIDKISAKR

SEQ ID NO: 2061302 - protein, 22 aa, Staphylococcus
DELKNRRATLVNLQRIDNVSAK

SEQ ID NO: 2061303 - protein, 24 aa, Staphylococcus
DELLNNVNYFGTMLVYAGHADGLV

SEQ ID NO: 2061304 - protein, 20 aa, Staphylococcus
DELMELYNYKEIRTPIFEST

SEQ ID NO: 2061305 - protein, 31 aa, Staphylococcus
DELNPIKCLRIIAMFRLINPTKEIRIAGGRE

SEQ ID NO: 2061306 - protein, 18 aa, Staphylococcus
DELRFKGFLNEYNEILTC

SEQ ID NO: 2061307 - protein, 23 aa, Staphylococcus
DELSALGIQIGTDIPFCIYNKTA

SEQ ID NO: 2061308 - protein, 36 aa, Staphylococcus
DELSHILYMPVDVFEFLQEYFAFKGIDPLDLVSPEE

SEQ ID NO: 2061309 - protein, 29 aa, Staphylococcus
DELSRTKGFDGWAPLFFRGREVSEKTIGI

SEQ ID NO: 2061310 - protein, 26 aa, Staphylococcus
DELSRTKGFDGWAPLFFRGREVSGKT

SEQ ID NO: 2061311 - protein, 27 aa, Staphylococcus
DELTNQYYFHLFSKKQPDLNWDNPEVR

SEQ ID NO: 2061312 - protein, 20 aa, Staphylococcus
DELVATEYPVLLATSRKRFI

SEQ ID NO: 2061313 - protein, 27 aa, Staphylococcus
DELVATEYPVLLATSRKRFIKEMIGKE

SEQ ID NO: 2061314 - protein, 27 aa, Staphylococcus
DELVATEYPVLLATSRKRFIKEMIGTD

SEQ ID NO: 2061315 - protein, 26 aa, Staphylococcus
DELVTHIFKIIYYGPLRIMAEQRYNH

SEQ ID NO: 2061316 - protein, 19 aa, Staphylococcus
DELYALYQEARYGGAIFDL

SEQ ID NO: 2061317 - protein, 25 aa, Staphylococcus
DELYEIWCYINIIEILKSSGFIPVK

SEQ ID NO: 2061318 - protein, 18 aa, Staphylococcus
DELYELNKNYFDDISLYI

SEQ ID NO: 2061319 - protein, 18 aa, Staphylococcus
DEMARAGIYKWYIDIIAG

SEQ ID NO: 2061320 - protein, 22 aa, Staphylococcus
DEMDLQLVDFKIEFGKTQDGKI

SEQ ID NO: 2061321 - protein, 22 aa, Staphylococcus
DEMDLRLVDFKVEFGKTSDGKI

SEQ ID NO: 2061322 - protein, 25 aa, Staphylococcus
DEMGYTQKSPRWAIAYKFPAEEVVT

SEQ ID NO: 2061323 - protein, 26 aa, Staphylococcus
DEMKVQKLMYYIQKTSIALTGDTIID

SEQ ID NO: 2061324 - protein, 23 aa, Staphylococcus
DENDPIPDMYYLDVASPGAERPI

SEQ ID NO: 2061325 - protein, 23 aa, Staphylococcus
DENGQIFYPLGKDATGFIMYNPD

SEQ ID NO: 2061326 - protein, 24 aa, Staphylococcus
DENGVPVYLGMPMGLILEIEGKTI

SEQ ID NO: 2061327 - protein, 24 aa, Staphylococcus
DENIRLKYRYLDLRRPELAQTFKM

SEQ ID NO: 2061328 - protein, 23 aa, Staphylococcus
DENLKEWFISRYQKEVPTKLDMG

SEQ ID NO: 2061329 - protein, 25 aa, Staphylococcus
DENQQPILYSLNYLKSSLVKFKITR

SEQ ID NO: 2061330 - protein, 23 aa, Staphylococcus
DENVFDYLPLYSEDLRLVVSKEH

SEQ ID NO: 2061331 - protein, 23 aa, Staphylococcus
DEPDYELLSFKSGQRYNMVPDFA

SEQ ID NO: 2061332 - protein, 24 aa, Staphylococcus
DEQAEILEWFDAIGRRRGLLQKGN

SEQ ID NO: 2061333 - protein, 23 aa, Staphylococcus
DEQDLIILIKLIYASETSNKQPS

SEQ ID NO: 2061334 - protein, 17 aa, Staphylococcus
DEQEFLNVLQLAREQNA

SEQ ID NO: 2061335 - protein, 17 aa, Staphylococcus
DEQFRVVIACYYGLGVS

SEQ ID NO: 2061336 - protein, 26 aa, Staphylococcus
DEQTQEYYFHLFSKKQPDLNWDNPAV

SEQ ID NO: 2061337 - protein, 17 aa, Staphylococcus
DERHMLGQMINQVHQQQ

SEQ ID NO: 2061338 - protein, 24 aa, Staphylococcus
DERRIDLAVTKALPRFIDVLETVV

SEQ ID NO: 2061339 - protein, 26 aa, Staphylococcus
DERSAAFFALGLIKGSKKPVAILCTS

SEQ ID NO: 2061340 - protein, 25 aa, Staphylococcus
DERSAAFFALGLIKGSQRPVAILCT

SEQ ID NO: 2061341 - protein, 36 aa, Staphylococcus
DERTVLKFHPALAPYKAAILPLSKKLSSEAIKIFEQ

SEQ ID NO: 2061342 - protein, 24 aa, Staphylococcus
DESISIDDFKQIILKTIFGEHEVE

SEQ ID NO: 2061343 - protein, 32 aa, Staphylococcus
DESKLAMILVQFPPWFDCTVPNITYIRYVREQ

SEQ ID NO: 2061344 - protein, 24 aa, Staphylococcus
DESYAYLMESILPQYDIPYNIDVK

SEQ ID NO: 2061345 - protein, 25 aa, Staphylococcus
DESYQNEFLIQYILPCLRELFDNNH

SEQ ID NO: 2061346 - protein, 24 aa, Staphylococcus
DETAIMIAWLNRHPNDIMPVLGTH

SEQ ID NO: 2061347 - protein, 18 aa, Staphylococcus
DETDLIPVALRLNPDYNV

SEQ ID NO: 2061348 - protein, 19 aa, Staphylococcus
DETFLAFIKETFDEFLKLY

SEQ ID NO: 2061349 - protein, 18 aa, Staphylococcus
DETGYINHLLQLIGPSIS

SEQ ID NO: 2061350 - protein, 23 aa, Staphylococcus
DETHRLFLFVSEGLLKGYLYLDV

SEQ ID NO: 2061351 - protein, 25 aa, Staphylococcus
DETKKIVLARRRLIKFNKDINIPYV

SEQ ID NO: 2061352 - protein, 21 aa, Staphylococcus
DETMPEIEVYDYTDDNGDGKP

SEQ ID NO: 2061353 - protein, 25 aa, Staphylococcus
DETNPSLIISFYPKFAVHPDHEATA

SEQ ID NO: 2061354 - protein, 25 aa, Staphylococcus
DETNPSLIISFYPKFAVHPDHEATG

SEQ ID NO: 2061355 - protein, 24 aa, Staphylococcus
DETQFIVITHRKGTMEYADRLYGV

SEQ ID NO: 2061356 - protein, 28 aa, Staphylococcus
DETQTLLHLPFDYIFFTGSEKVGRIVYE

SEQ ID NO: 2061357 - protein, 24 aa, Staphylococcus
DETTFVVINSTCGCAAGLARPAAV

SEQ ID NO: 2061358 - protein, 27 aa, Staphylococcus
DETTNQYYFHLFSKKQPDLNWDNPEVR

SEQ ID NO: 2061359 - protein, 26 aa, Staphylococcus
DETYRGYGLGQLLLKYAMNYVQTKCD

SEQ ID NO: 2061360 - protein, 28 aa, Staphylococcus
DEVFQGEALLFLLGLTNSMAGFEKLVPD

SEQ ID NO: 2061361 - protein, 21 aa, Staphylococcus
DEVHLETDVLFKYVESIVGKN

SEQ ID NO: 2061362 - protein, 17 aa, Staphylococcus
DEVIEYYGLKVLVDNYD

SEQ ID NO: 2061363 - protein, 17 aa, Staphylococcus
DEVIISHGFDIENPLLE

SEQ ID NO: 2061364 - protein, 32 aa, Staphylococcus
DEVKILTIWDAESCFKNWLKSDVFKNAHKNVR

SEQ ID NO: 2061365 - protein, 19 aa, Staphylococcus
DEVLLNTSSLFLPQTLYFQ

SEQ ID NO: 2061366 - protein, 24 aa, Staphylococcus
DEVNYHILQMMKRGMKHKTIMDIA

SEQ ID NO: 2061367 - protein, 24 aa, Staphylococcus
DEVTKLPFIEFQADPIYINQIKQW

SEQ ID NO: 2061368 - protein, 23 aa, Staphylococcus
DEVYALVNTLKKYPIFIISDEIY

SEQ ID NO: 2061369 - protein, 27 aa, Staphylococcus
DEWHRIHPLLEELPVASLDLMLVSTYC

SEQ ID NO: 2061370 - protein, 25 aa, Staphylococcus
DEWIQKCMLTLPKGPVLALNPDFVM

SEQ ID NO: 2061371 - protein, 27 aa, Staphylococcus
DEWREYGLNHFVLPKVLISIEGDRTFI

SEQ ID NO: 2061372 - protein, 19 aa, Staphylococcus
DEWVNMLDAGIVDPTKVTR

SEQ ID NO: 2061373 - protein, 17 aa, Staphylococcus
DEYCDFIYLLEDSEEEI

SEQ ID NO: 2061374 - protein, 23 aa, Staphylococcus
DEYDKGYILNWPVSQSNEFDMEP

SEQ ID NO: 2061375 - protein, 30 aa, Staphylococcus
DEYEKLYLTYLIKELKLVKLDFIHRGMLAL

SEQ ID NO: 2061376 - protein, 19 aa, Staphylococcus
DEYFYPKLNSIYQNCKIID

SEQ ID NO: 2061377 - protein, 32 aa, Staphylococcus
DEYIMEMLKTIKTPVFLVLNKIDLVHPDELMP

SEQ ID NO: 2061378 - protein, 17 aa, Staphylococcus
DEYKITISPTLIGKGLP

SEQ ID NO: 2061379 - protein, 18 aa, Staphylococcus
DEYKLWYKKEPVNNDIQK

SEQ ID NO: 2061380 - protein, 19 aa, Staphylococcus
DEYQDVHWLIYHTKRAKQK

SEQ ID NO: 2061381 - protein, 17 aa, Staphylococcus
DEYQGELIFLHKVKDGA

SEQ ID NO: 2061382 - protein, 18 aa, Staphylococcus
DEYQGELIFLHKVKDGAV

SEQ ID NO: 2061383 - protein, 24 aa, Staphylococcus
DEYQYDHILLATGFKNNIMQMPVI

SEQ ID NO: 2061384 - protein, 21 aa, Staphylococcus
DFADFIDQFEWSDAQFPVVQN

SEQ ID NO: 2061385 - protein, 21 aa, Staphylococcus
DFAFYAVELPSTFIYSGAAPE

SEQ ID NO: 2061386 - protein, 28 aa, Staphylococcus
DFANTKKPMLFFTYDLDYYKNQLRGFYF

SEQ ID NO: 2061387 - protein, 23 aa, Staphylococcus
DFANVFFMMMNYYSLERSMQIAK

SEQ ID NO: 2061388 - protein, 17 aa, Staphylococcus
DFARRLPKRVKTRKLLE

SEQ ID NO: 2061389 - protein, 23 aa, Staphylococcus
DFASFIDQFTWNDAQFPIVQNYN

SEQ ID NO: 2061390 - protein, 26 aa, Staphylococcus
DFDDLIMTTIRLFERVPDALEYYQNK

SEQ ID NO: 2061391 - protein, 21 aa, Staphylococcus
DFDELIPYMKHVRVMVVFGET

SEQ ID NO: 2061392 - protein, 20 aa, Staphylococcus
DFDELIPYMKNVRVMVVFGQ

SEQ ID NO: 2061393 - protein, 32 aa, Staphylococcus
DFDETYIEAMLNKGFRYIFTSLQIPEDDQTQY

SEQ ID NO: 2061394 - protein, 25 aa, Staphylococcus
DFDFIELKRILMEWQIGIHDGNGWN

SEQ ID NO: 2061395 - protein, 38 aa, Staphylococcus
DFDGRTYLETFLAPTQLYVKPILALKKAVQIKGMNHIT

SEQ ID NO: 2061396 - protein, 32 aa, Staphylococcus
DFDHLFTHVPVHPGDFYYVPAGTVHAIGSGIL

SEQ ID NO: 2061397 - protein, 21 aa, Staphylococcus
DFDKLRFVHHSIPSINVDQVD

SEQ ID NO: 2061398 - protein, 23 aa, Staphylococcus
DFDKSLVLVGLSNTLLISEAEAL

SEQ ID NO: 2061399 - protein, 17 aa, Staphylococcus
DFDKVYGVNVKGVLWGI

SEQ ID NO: 2061400 - protein, 18 aa, Staphylococcus
DFDKVYPIKDLDKALRSA

SEQ ID NO: 2061401 - protein, 20 aa, Staphylococcus
DFDNQFFKRIYSVLEDFYAE

SEQ ID NO: 2061402 - protein, 23 aa, Staphylococcus
DFDQLYQQFPIKYSIMGHVHFRK

SEQ ID NO: 2061403 - protein, 18 aa, Staphylococcus
DFDTLYQVLRTLQDNMKQ

SEQ ID NO: 2061404 - protein, 20 aa, Staphylococcus
DFDYLPQIYEALNAEVLFNK

SEQ ID NO: 2061405 - protein, 17 aa, Staphylococcus
DFEEVLIQINYPEKFVN

SEQ ID NO: 2061406 - protein, 26 aa, Staphylococcus
DFEGPTYFVLPYPFVDKNFTFNESLP

SEQ ID NO: 2061407 - protein, 19 aa, Staphylococcus
DFEIDFPYELTPDQSKSIE

SEQ ID NO: 2061408 - protein, 17 aa, Staphylococcus
DFEKALIDRVGKIKLGN

SEQ ID NO: 2061409 - protein, 18 aa, Staphylococcus
DFEKALIDRVGKIKLGNG

SEQ ID NO: 2061410 - protein, 17 aa, Staphylococcus
DFEKALIDRVSKIKLGN

SEQ ID NO: 2061411 - protein, 23 aa, Staphylococcus
DFEKDYPYLASGGYIHYCEYPKL

SEQ ID NO: 2061412 - protein, 22 aa, Staphylococcus
DFENDRIYFSKSSLSRFDVSIE

SEQ ID NO: 2061413 - protein, 23 aa, Staphylococcus
DFEQINKEQLFLISGKTGSGKTM

SEQ ID NO: 2061414 - protein, 25 aa, Staphylococcus
DFESELFFVISVDTPLITAKAISQL

SEQ ID NO: 2061415 - protein, 22 aa, Staphylococcus
DFFDLTRRLPNRVKTRKLLESL

SEQ ID NO: 2061416 - protein, 22 aa, Staphylococcus
DFFDRKFKNLLNGKAKQILYNY

SEQ ID NO: 2061417 - protein, 21 aa, Staphylococcus
DFFVESKRKPQPNGWILHIPS

SEQ ID NO: 2061418 - protein, 23 aa, Staphylococcus
DFGCFAPVHVFIDIFKDAGIDVT

SEQ ID NO: 2061419 - protein, 18 aa, Staphylococcus
DFGGSQLEKLLYGKVNHE

SEQ ID NO: 2061420 - protein, 23 aa, Staphylococcus
DFGKIKLYVGNYDFWYQSSQLAQ

SEQ ID NO: 2061421 - protein, 18 aa, Staphylococcus
DFGKIKVYVGNYDFWYQS

SEQ ID NO: 2061422 - protein, 24 aa, Staphylococcus
DFGKIKVYVGNYDFWYQSSQLAQK

SEQ ID NO: 2061423 - protein, 17 aa, Staphylococcus
DFGLWKDSTFEGTRIMT

SEQ ID NO: 2061424 - protein, 23 aa, Staphylococcus
DFGRQFFEQFPDSTSIKSDVKEL

SEQ ID NO: 2061425 - protein, 23 aa, Staphylococcus
DFGSDLLIQTFLNEHPPGPSKSI

SEQ ID NO: 2061426 - protein, 24 aa, Staphylococcus
DFHKAMPIIIHGDAAYPGQGINFE

SEQ ID NO: 2061427 - protein, 22 aa, Staphylococcus
DFHVVLAPYRLAPEAAFETIIS

SEQ ID NO: 2061428 - protein, 17 aa, Staphylococcus
DFIALDMGALGDGQSSD

SEQ ID NO: 2061429 - protein, 21 aa, Staphylococcus
DFIEKPFNLSLTIAKIQALLR

SEQ ID NO: 2061430 - protein, 18 aa, Staphylococcus
DFIEKYNFFDMLQASLHP

SEQ ID NO: 2061431 - protein, 19 aa, Staphylococcus
DFIEVQPPKLYQDLIDREL

SEQ ID NO: 2061432 - protein, 17 aa, Staphylococcus
DFIFKDDPAELKTRIID

SEQ ID NO: 2061433 - protein, 18 aa, Staphylococcus
DFIGRLPNKDVRQWYHDH

SEQ ID NO: 2061434 - protein, 18 aa, Staphylococcus
DFILFNEDFYLNDKIIEA

SEQ ID NO: 2061435 - protein, 28 aa, Staphylococcus
DFIQKPFYTNVLIAKLKAVYRRVYQFNL

SEQ ID NO: 2061436 - protein, 18 aa, Staphylococcus
DFIRPEHVNWLKETYEAY

SEQ ID NO: 2061437 - protein, 19 aa, Staphylococcus
DFIVPIPSLIKEDMKRTFN

SEQ ID NO: 2061438 - protein, 26 aa, Staphylococcus
DFKAAQGGIMRLFFNEKTPYTMGHDF

SEQ ID NO: 2061439 - protein, 19 aa, Staphylococcus
DFKAPMGCRSFLPAWRDAQ

SEQ ID NO: 2061440 - protein, 22 aa, Staphylococcus
DFKDLEIILFGDKEQYNLNHDR

SEQ ID NO: 2061441 - protein, 27 aa, Staphylococcus
DFKEDDIELFRDIADKVKQTNSYDLAF

SEQ ID NO: 2061442 - protein, 17 aa, Staphylococcus
DFKETIHYLLSHSTFEN

SEQ ID NO: 2061443 - protein, 17 aa, Staphylococcus
DFKFHETVIFATNHQYL

SEQ ID NO: 2061444 - protein, 17 aa, Staphylococcus
DFKKGDFVLGAMPWCLY

SEQ ID NO: 2061445 - protein, 18 aa, Staphylococcus
DFKKIPYYIPEFNEQKKI

SEQ ID NO: 2061446 - protein, 23 aa, Staphylococcus
DFKKVSLELGGKSPYIVLDDADI

SEQ ID NO: 2061447 - protein, 23 aa, Staphylococcus
DFKKVSLELGGKSPYIVLDDVDI

SEQ ID NO: 2061448 - protein, 23 aa, Staphylococcus
DFKKVSLELGGKSPYIVLDDVDV

SEQ ID NO: 2061449 - protein, 20 aa, Staphylococcus
DFKMTTFKITQSRNILPNRS

SEQ ID NO: 2061450 - protein, 19 aa, Staphylococcus
DFKTVVLPAFRPDDVFKVG

SEQ ID NO: 2061451 - protein, 19 aa, Staphylococcus
DFLDYLKDLRFTGSIRAME

SEQ ID NO: 2061452 - protein, 24 aa, Staphylococcus
DFLEDLLVEGLIKELRRYNDVSPY

SEQ ID NO: 2061453 - protein, 26 aa, Staphylococcus
DFLEKYFHTKILDRQLRRVITSTARM

SEQ ID NO: 2061454 - protein, 17 aa, Staphylococcus
DFLGLRNLSIIHQIVKQ

SEQ ID NO: 2061455 - protein, 18 aa, Staphylococcus
DFLKDLKFYQEFSLEHPV

SEQ ID NO: 2061456 - protein, 21 aa, Staphylococcus
DFLSMDELPKRMTFIGVGIIS

SEQ ID NO: 2061457 - protein, 19 aa, Staphylococcus
DFLVDILGYQPLSADVYSL

SEQ ID NO: 2061458 - protein, 17 aa, Staphylococcus
DFLYDRVNVVIATNAFG

SEQ ID NO: 2061459 - protein, 19 aa, Staphylococcus
DFMEYYGRQMLKLKDGKPV

SEQ ID NO: 2061460 - protein, 25 aa, Staphylococcus
DFMMRQFFHYATENTVWLRTNLDSD

SEQ ID NO: 2061461 - protein, 19 aa, Staphylococcus
DFMPSPGKITQYLAPGGFG

SEQ ID NO: 2061462 - protein, 18 aa, Staphylococcus
DFMVVQDEFLTFTATYAD

SEQ ID NO: 2061463 - protein, 20 aa, Staphylococcus
DFNDFKPLMNKKQGLILLTG

SEQ ID NO: 2061464 - protein, 21 aa, Staphylococcus
DFNGISFLNLVDFDALYGHRR

SEQ ID NO: 2061465 - protein, 22 aa, Staphylococcus
DFNGISFLNLVDFDALYGHRRD

SEQ ID NO: 2061466 - protein, 21 aa, Staphylococcus
DFNGLSFLNLVDFDALYGHRR

SEQ ID NO: 2061467 - protein, 18 aa, Staphylococcus
DFNHLFLVVDAENQAAWN

SEQ ID NO: 2061468 - protein, 21 aa, Staphylococcus
DFNRRYLSEFTGTSGALIITP

SEQ ID NO: 2061469 - protein, 22 aa, Staphylococcus
DFNSLSLFKLLALESQHAGLSW

SEQ ID NO: 2061470 - protein, 19 aa, Staphylococcus
DFNVHFDNWFSETSLYENG

SEQ ID NO: 2061471 - protein, 23 aa, Staphylococcus
DFPEHLMHFINLSTPRPIVYTED

SEQ ID NO: 2061472 - protein, 29 aa, Staphylococcus
DFPNQINNVLAFPGIFRGALDTESTHINE

SEQ ID NO: 2061473 - protein, 29 aa, Staphylococcus
DFPNQINNVLAFPGIFRGALEVEATHINE

SEQ ID NO: 2061474 - protein, 20 aa, Staphylococcus
DFQEVIWLKKDIYNYDDVLN

SEQ ID NO: 2061475 - protein, 17 aa, Staphylococcus
DFQVNFGKSFKYLPNYL

SEQ ID NO: 2061476 - protein, 17 aa, Staphylococcus
DFQVNIPERWSIAQLYQ

SEQ ID NO: 2061477 - protein, 30 aa, Staphylococcus
DFRFNDLIIHQLMYSPQYMAYLNTIYNLSL

SEQ ID NO: 2061478 - protein, 25 aa, Staphylococcus
DFRIGRVIVVKAYRKNKLGYQLMNT

SEQ ID NO: 2061479 - protein, 17 aa, Staphylococcus
DFRLVEPEAFYHTLQHF

SEQ ID NO: 2061480 - protein, 19 aa, Staphylococcus
DFRNIDQNQLFLISGKTGS

SEQ ID NO: 2061481 - protein, 26 aa, Staphylococcus
DFSIGILSEIKLLGNEILIINITDKA

SEQ ID NO: 2061482 - protein, 21 aa, Staphylococcus
DFSKYLASVTPYEIFTYGIDH

SEQ ID NO: 2061483 - protein, 22 aa, Staphylococcus
DFSKYLETVTPYEILTYGIDNE

SEQ ID NO: 2061484 - protein, 18 aa, Staphylococcus
DFSLYDHVLDTSLLFNII

SEQ ID NO: 2061485 - protein, 18 aa, Staphylococcus
DFSYEAYVDFLYEYRQHI

SEQ ID NO: 2061486 - protein, 21 aa, Staphylococcus
DFTDYVYLSQILAGIVMRYSV

SEQ ID NO: 2061487 - protein, 23 aa, Staphylococcus
DFTGFLAATLLRGVHFIQVPTTI

SEQ ID NO: 2061488 - protein, 18 aa, Staphylococcus
DFTHLLDRMKPSLPATFA

SEQ ID NO: 2061489 - protein, 18 aa, Staphylococcus
DFTHWRNIMGIEPISDEA

SEQ ID NO: 2061490 - protein, 25 aa, Staphylococcus
DFTNKYFQSIFKALTDYYSENDYYS

SEQ ID NO: 2061491 - protein, 19 aa, Staphylococcus
DFTQIKNDQLFLISGKTGS

SEQ ID NO: 2061492 - protein, 24 aa, Staphylococcus
DFTQLKNNELFLISGKTGSGKSML

SEQ ID NO: 2061493 - protein, 24 aa, Staphylococcus
DFTVAIPNYTSLSPMLEQLNRSFA

SEQ ID NO: 2061494 - protein, 19 aa, Staphylococcus
DFTYYFATSEQTPSSVGLG

SEQ ID NO: 2061495 - protein, 23 aa, Staphylococcus
DFVHLETDVLFKYVATIINKNSN

SEQ ID NO: 2061496 - protein, 20 aa, Staphylococcus
DFVILGHYQLIDLLLTTKEQ

SEQ ID NO: 2061497 - protein, 19 aa, Staphylococcus
DFVLGAMPWCLYNTVDGEE

SEQ ID NO: 2061498 - protein, 19 aa, Staphylococcus
DFVYDRIKVVIATNAFGMG

SEQ ID NO: 2061499 - protein, 19 aa, Staphylococcus
DFYFSELTKYLKQHNCLYV

SEQ ID NO: 2061500 - protein, 20 aa, Staphylococcus
DFYSYVRTFSEYYAPYDKRA

SEQ ID NO: 2061501 - protein, 23 aa, Staphylococcus
DFYTMPFATINEMQYFFDDKAIE

SEQ ID NO: 2061502 - protein, 23 aa, Staphylococcus
DGAKQFIDYLNEKDIPHLFVTNN

SEQ ID NO: 2061503 - protein, 17 aa, Staphylococcus
DGASMMLVMTEEKAKEL

SEQ ID NO: 2061504 - protein, 25 aa, Staphylococcus
DGAWSKVRKLLTNITPHYSGTTFIE

SEQ ID NO: 2061505 - protein, 30 aa, Staphylococcus
DGDAFAKFFKLMLNQGINLAPSKFEAWFLT

SEQ ID NO: 2061506 - protein, 22 aa, Staphylococcus
DGDAVIFFNFRPDRAAQLSEIF

SEQ ID NO: 2061507 - protein, 27 aa, Staphylococcus
DGDDIYYDLNISFPQAALGDEVKIPTL

SEQ ID NO: 2061508 - protein, 26 aa, Staphylococcus
DGDDIYYNLNISFPQAALGDEIKVPT

SEQ ID NO: 2061509 - protein, 23 aa, Staphylococcus
DGDDWLPEDALEKLYTLLKTNKT

SEQ ID NO: 2061510 - protein, 18 aa, Staphylococcus
DGDPWFVVGKNLDDNILY

SEQ ID NO: 2061511 - protein, 23 aa, Staphylococcus
DGEFQFDAAIVPKVAAKKAPDAK

SEQ ID NO: 2061512 - protein, 23 aa, Staphylococcus
DGEKLLQYALKRESIEQELWQNL

SEQ ID NO: 2061513 - protein, 25 aa, Staphylococcus
DGERTLLFGPFANIGPKFLKNGSNL

SEQ ID NO: 2061514 - protein, 25 aa, Staphylococcus
DGERTLLFGPFASIGPKFLKQGSNL

SEQ ID NO: 2061515 - protein, 25 aa, Staphylococcus
DGETLYLNIFRPNKEGRFPVVMSAD

SEQ ID NO: 2061516 - protein, 18 aa, Staphylococcus
DGFELKGLNRAKETYKFA

SEQ ID NO: 2061517 - protein, 18 aa, Staphylococcus
DGFELKGLNRARETYKFA

SEQ ID NO: 2061518 - protein, 18 aa, Staphylococcus
DGFETLLEKKPVAYFTLF

SEQ ID NO: 2061519 - protein, 23 aa, Staphylococcus
DGFINFCHEYLLFADKKPNIVHD

SEQ ID NO: 2061520 - protein, 21 aa, Staphylococcus
DGFITKFNRLIERRLLNHFRK

SEQ ID NO: 2061521 - protein, 23 aa, Staphylococcus
DGFITKFNRLIERRLLNRYKRKG

SEQ ID NO: 2061522 - protein, 20 aa, Staphylococcus
DGFKVERVNDLFYATFTKYN

SEQ ID NO: 2061523 - protein, 23 aa, Staphylococcus
DGFLLNFNDWAPNLYHFLKVSKF

SEQ ID NO: 2061524 - protein, 23 aa, Staphylococcus
DGFLLNFNDWAPNLYHFLKVTKF

SEQ ID NO: 2061525 - protein, 25 aa, Staphylococcus
DGFLLNFNDWAPNLYHFLKVYKIKR

SEQ ID NO: 2061526 - protein, 25 aa, Staphylococcus
DGFLLNFNDWAPNLYHFLNLKQFKR

SEQ ID NO: 2061527 - protein, 25 aa, Staphylococcus
DGFLLNFNNWAPNLYHFLKVSTFKR

SEQ ID NO: 2061528 - protein, 18 aa, Staphylococcus
DGFMLMSPTYPNAFEKFI

SEQ ID NO: 2061529 - protein, 22 aa, Staphylococcus
DGFNLMPPTLPGSLEDFVDLIV

SEQ ID NO: 2061530 - protein, 20 aa, Staphylococcus
DGFYWCRQIRHESNVPILFL

SEQ ID NO: 2061531 - protein, 26 aa, Staphylococcus
DGGHNWKSWKPLLGDILKYFLDEELP

SEQ ID NO: 2061532 - protein, 23 aa, Staphylococcus
DGGIPGYIILSLVPNNYTLSRVK

SEQ ID NO: 2061533 - protein, 21 aa, Staphylococcus
DGGKFSGIVPISQLSTHHIDS

SEQ ID NO: 2061534 - protein, 26 aa, Staphylococcus
DGGVDDLISLFLLLQMDNIELVGVST

SEQ ID NO: 2061535 - protein, 24 aa, Staphylococcus
DGHPPKLPMLKRGYRYDIHLNITA

SEQ ID NO: 2061536 - protein, 25 aa, Staphylococcus
DGHTTALLLFVKRCKLLADKGELPH

SEQ ID NO: 2061537 - protein, 17 aa, Staphylococcus
DGHYYLITKFGSTTFTD

SEQ ID NO: 2061538 - protein, 26 aa, Staphylococcus
DGIAYLKEHPSHFIDPVLILHGKEDG

SEQ ID NO: 2061539 - protein, 24 aa, Staphylococcus
DGIEFVEFLISPNKGEPLKSLNKV

SEQ ID NO: 2061540 - protein, 23 aa, Staphylococcus
DGIGRYLNDFFSLNIPYNNETKV

SEQ ID NO: 2061541 - protein, 18 aa, Staphylococcus
DGIGRYLNNFFKLNIPYK

SEQ ID NO: 2061542 - protein, 18 aa, Staphylococcus
DGIHTFRNGLNIDAYNVS

SEQ ID NO: 2061543 - protein, 30 aa, Staphylococcus
DGIKAFYTHGHLYNVNRSRMQLAEQAKSLG

SEQ ID NO: 2061544 - protein, 20 aa, Staphylococcus
DGINKFKTVIGDDSFIGCNT

SEQ ID NO: 2061545 - protein, 30 aa, Staphylococcus
DGIPNTFVPARNLLFLSFAGALAYQIKAKH

SEQ ID NO: 2061546 - protein, 19 aa, Staphylococcus
DGIYIDIYCALKHGVNISK

SEQ ID NO: 2061547 - protein, 23 aa, Staphylococcus
DGIYIDVYCALKHGINISKTANQ

SEQ ID NO: 2061548 - protein, 21 aa, Staphylococcus
DGKGLIITGSLYFISEVKSKT

SEQ ID NO: 2061549 - protein, 17 aa, Staphylococcus
DGKIIMFGGGGYNIWTV

SEQ ID NO: 2061550 - protein, 26 aa, Staphylococcus
DGKKSLLFGPFAGFSPKFLKTGTNMD

SEQ ID NO: 2061551 - protein, 23 aa, Staphylococcus
DGKNIWFGVREFGMGAAVNGMAA

SEQ ID NO: 2061552 - protein, 24 aa, Staphylococcus
DGKNKFKTIIGKDSFIGCNTNLVA

SEQ ID NO: 2061553 - protein, 17 aa, Staphylococcus
DGKPILVHTVEKFLLTS

SEQ ID NO: 2061554 - protein, 17 aa, Staphylococcus
DGKPKKVWVSARALKSG

SEQ ID NO: 2061555 - protein, 17 aa, Staphylococcus
DGKSYIDLLSSASSQNV

SEQ ID NO: 2061556 - protein, 23 aa, Staphylococcus
DGKTLTINLRKDAKWSNGDPVTA

SEQ ID NO: 2061557 - protein, 23 aa, Staphylococcus
DGLDTYLRDLALTGATGIIVADP

SEQ ID NO: 2061558 - protein, 19 aa, Staphylococcus
DGLELFHPERMASRILGMG

SEQ ID NO: 2061559 - protein, 38 aa, Staphylococcus
DGLENAFDFPGFVPAYIRPLFCEGKGPFRFAALSGNPK

SEQ ID NO: 2061560 - protein, 30 aa, Staphylococcus
DGLFVITGHYRNGILLSPVIGRDIANWLIS

SEQ ID NO: 2061561 - protein, 20 aa, Staphylococcus
DGLILGPRMQISVNALTITG

SEQ ID NO: 2061562 - protein, 20 aa, Staphylococcus
DGLKNLFKIVSASLVKYYYR

SEQ ID NO: 2061563 - protein, 20 aa, Staphylococcus
DGLKNLFKIVSASLVQYYYR

SEQ ID NO: 2061564 - protein, 24 aa, Staphylococcus
DGLKPVQRRILYAMYSSGNTFDKN

SEQ ID NO: 2061565 - protein, 24 aa, Staphylococcus
DGLKPVQRRILYAMYSSGNTYDKN

SEQ ID NO: 2061566 - protein, 23 aa, Staphylococcus
DGLKSECILLFSERDRGLHEYFI

SEQ ID NO: 2061567 - protein, 17 aa, Staphylococcus
DGLLDPVIGRDTEIQKT

SEQ ID NO: 2061568 - protein, 17 aa, Staphylococcus
DGLLFETYYDLEELTNI

SEQ ID NO: 2061569 - protein, 22 aa, Staphylococcus
DGLLVPFVRDCDKKNFAEIEDE

SEQ ID NO: 2061570 - protein, 21 aa, Staphylococcus
DGLLVPFVRDCDKKNFAEIEQ

SEQ ID NO: 2061571 - protein, 22 aa, Staphylococcus
DGLLVPFVRDCDKKNFAELERA

SEQ ID NO: 2061572 - protein, 28 aa, Staphylococcus
DGLNVPNEPIIPFIIGDGIGPDIWKAAS

SEQ ID NO: 2061573 - protein, 25 aa, Staphylococcus
DGLVAPIYKFTLKHPQYIDYNKVRV

SEQ ID NO: 2061574 - protein, 19 aa, Staphylococcus
DGLVSYQDSIQFFQEIGSV

SEQ ID NO: 2061575 - protein, 17 aa, Staphylococcus
DGLYNFISALRVAADND

SEQ ID NO: 2061576 - protein, 23 aa, Staphylococcus
DGMAFLSGVVSRKKQVVPQITEI

SEQ ID NO: 2061577 - protein, 25 aa, Staphylococcus
DGMDKLIDAVKPFAKQKLIFLCGMA

SEQ ID NO: 2061578 - protein, 21 aa, Staphylococcus
DGMLVKRPLAIAGDNITLGFK

SEQ ID NO: 2061579 - protein, 26 aa, Staphylococcus
DGMTDYAVTPLKWKDTFIAHNHFISC

SEQ ID NO: 2061580 - protein, 24 aa, Staphylococcus
DGMYDLIKEPLRFLEVRIPVRMDD

SEQ ID NO: 2061581 - protein, 26 aa, Staphylococcus
DGNAALRICENIKYYFHIISKKPESF

SEQ ID NO: 2061582 - protein, 24 aa, Staphylococcus
DGNKLKAFQAQYSKGFKPYMEASQ

SEQ ID NO: 2061583 - protein, 24 aa, Staphylococcus
DGNKTPYDLWFPNAKENIILFCPV

SEQ ID NO: 2061584 - protein, 32 aa, Staphylococcus
DGNKYDEQTTPRGYAWQLEKALDAVSHDDFQK

SEQ ID NO: 2061585 - protein, 33 aa, Staphylococcus
DGNKYNEQTTPRGYAWQLEKALDTVSRDEFQKY

SEQ ID NO: 2061586 - protein, 30 aa, Staphylococcus
DGNLIEYVDKVYIMLNKPAGYISATEDEEQ

SEQ ID NO: 2061587 - protein, 17 aa, Staphylococcus
DGNLLVCPMCGHEWSET

SEQ ID NO: 2061588 - protein, 26 aa, Staphylococcus
DGNRFKFYEFSLFLYEEYHGCYIDNR

SEQ ID NO: 2061589 - protein, 20 aa, Staphylococcus
DGNRYIDYLQAYGPIITGHA

SEQ ID NO: 2061590 - protein, 27 aa, Staphylococcus
DGPAIEATIIGPTLTFLEDDTIVITGA

SEQ ID NO: 2061591 - protein, 31 aa, Staphylococcus
DGPAIEYTVIGPKVQFLKENTFAFIGGTSNA

SEQ ID NO: 2061592 - protein, 27 aa, Staphylococcus
DGPERFWPADLVILSIGFIGTEITIPQ

SEQ ID NO: 2061593 - protein, 26 aa, Staphylococcus
DGPGIRYILFTQGCLLRCLYCHNPDT

SEQ ID NO: 2061594 - protein, 26 aa, Staphylococcus
DGPGLRYIIFTQGCLLRCLYCHNPDT

SEQ ID NO: 2061595 - protein, 26 aa, Staphylococcus
DGPGLRYILFTQGCLLRCLYCHNPDT

SEQ ID NO: 2061596 - protein, 18 aa, Staphylococcus
DGPKLPEVPALKPTQKQA

SEQ ID NO: 2061597 - protein, 26 aa, Staphylococcus
DGPVGYLAATALHYIYGIEKENLIVF

SEQ ID NO: 2061598 - protein, 25 aa, Staphylococcus
DGQIFLESDLFFSGVRPAINAGFSV

SEQ ID NO: 2061599 - protein, 25 aa, Staphylococcus
DGQTHFVTELYVETIKFMSPKSKND

SEQ ID NO: 2061600 - protein, 25 aa, Staphylococcus
DGQVLVYHDLLNYAVEHRAKFVKQF

SEQ ID NO: 2061601 - protein, 21 aa, Staphylococcus
DGQYLVGKFPPGIKYDFEKVF

SEQ ID NO: 2061602 - protein, 23 aa, Staphylococcus
DGQYRGMATWKYDKARGRLVGTI

SEQ ID NO: 2061603 - protein, 24 aa, Staphylococcus
DGRTWITREPAIVYFHAEYWFNVI

SEQ ID NO: 2061604 - protein, 22 aa, Staphylococcus
DGRTWITREPAIVYFHSEFWFN

SEQ ID NO: 2061605 - protein, 24 aa, Staphylococcus
DGRTWITREPAIVYFHSEYWFNVI

SEQ ID NO: 2061606 - protein, 19 aa, Staphylococcus
DGRYLLYQPNDGGLAQIGP

SEQ ID NO: 2061607 - protein, 18 aa, Staphylococcus
DGRYLLYQPNDGGYAQIG

SEQ ID NO: 2061608 - protein, 27 aa, Staphylococcus
DGSIKNFRVTKIFGYFGLKREEIEEAQ

SEQ ID NO: 2061609 - protein, 21 aa, Staphylococcus
DGSIVGTSSLRRGAQILAKYP

SEQ ID NO: 2061610 - protein, 22 aa, Staphylococcus
DGSIYPVLLRLDKKGYVHTTMR

SEQ ID NO: 2061611 - protein, 24 aa, Staphylococcus
DGSNYLKDDILKFALYDGSNHVVI

SEQ ID NO: 2061612 - protein, 25 aa, Staphylococcus
DGSNYLKDKILKFGLYAQNQYIVIS

SEQ ID NO: 2061613 - protein, 18 aa, Staphylococcus
DGSQLSFKGLPTPNIFTG

SEQ ID NO: 2061614 - protein, 23 aa, Staphylococcus
DGSQLSFKGLPTPNIFTGCGNFH

SEQ ID NO: 2061615 - protein, 23 aa, Staphylococcus
DGSQLSFMGLPTPNIFTGCDNFH

SEQ ID NO: 2061616 - protein, 18 aa, Staphylococcus
DGSQLSYMGLPTPNIFTG

SEQ ID NO: 2061617 - protein, 23 aa, Staphylococcus
DGSRGKLISQTFIEDGQDGKTPS

SEQ ID NO: 2061618 - protein, 22 aa, Staphylococcus
DGSRRFLDRVWRLFINEDDSLS

SEQ ID NO: 2061619 - protein, 25 aa, Staphylococcus
DGSTAYMFVAYLGVDPITRKQKRTT

SEQ ID NO: 2061620 - protein, 25 aa, Staphylococcus
DGTIGDFPFSYFMSYVAGAGISLIR

SEQ ID NO: 2061621 - protein, 26 aa, Staphylococcus
DGTIIYFDRSWMKIGLQLVDDFMEKY

SEQ ID NO: 2061622 - protein, 21 aa, Staphylococcus
DGTKYLELLQDYQINVLCCTP

SEQ ID NO: 2061623 - protein, 34 aa, Staphylococcus
DGTLIEFDKSWKKIGLRLVDQFLETFPVAHKETA

SEQ ID NO: 2061624 - protein, 26 aa, Staphylococcus
DGTNYLQDTILKFGFYDGVDHVVIDS

SEQ ID NO: 2061625 - protein, 22 aa, Staphylococcus
DGTRGKLISETFIADGEKGRDG

SEQ ID NO: 2061626 - protein, 23 aa, Staphylococcus
DGTRGKLISETFIADGQKGKNGQ

SEQ ID NO: 2061627 - protein, 17 aa, Staphylococcus
DGTRHIAFHENGKYAYV

SEQ ID NO: 2061628 - protein, 28 aa, Staphylococcus
DGTVKNFRVTKIFGFFGLKREEIEEAQA

SEQ ID NO: 2061629 - protein, 21 aa, Staphylococcus
DGVKFDYLFSAIGGGGLISGI

SEQ ID NO: 2061630 - protein, 25 aa, Staphylococcus
DGVKLVDFWATWCGPCKMIAPVLEE

SEQ ID NO: 2061631 - protein, 18 aa, Staphylococcus
DGVPQLILAGQTNSSLLG

SEQ ID NO: 2061632 - protein, 24 aa, Staphylococcus
DGVRILFVAATAPFTPFYRALDWV

SEQ ID NO: 2061633 - protein, 27 aa, Staphylococcus
DGVSLTIFDLHQHSFDIHLIPETRRST

SEQ ID NO: 2061634 - protein, 25 aa, Staphylococcus
DGVSLTIFDLRHDSFDIHLIPETRR

SEQ ID NO: 2061635 - protein, 27 aa, Staphylococcus
DGWYSLHLFYAIDWATFRLVPEEERET

SEQ ID NO: 2061636 - protein, 28 aa, Staphylococcus
DGWYSLHLFYAIDWTTFRLVPEDDRHAM

SEQ ID NO: 2061637 - protein, 27 aa, Staphylococcus
DGWYSLHLFYAMDWTTFRLVPEDEREA

SEQ ID NO: 2061638 - protein, 26 aa, Staphylococcus
DGWYSLHLFYAVDWATFRLVPEDERE

SEQ ID NO: 2061639 - protein, 27 aa, Staphylococcus
DGWYSLHLFYAVDWATFRLVPEDEREA

SEQ ID NO: 2061640 - protein, 27 aa, Staphylococcus
DGWYSLHLFYAVDWPTLRLVPDEDRIQ

SEQ ID NO: 2061641 - protein, 26 aa, Staphylococcus
DGWYSLHLLYAIDWSSLRLVPTEERQ

SEQ ID NO: 2061642 - protein, 20 aa, Staphylococcus
DGYGAILRKLIKHDINVIAL

SEQ ID NO: 2061643 - protein, 25 aa, Staphylococcus
DGYGKLIHMLIQNDIQLIALHTNLD

SEQ ID NO: 2061644 - protein, 20 aa, Staphylococcus
DGYQLLKYIDLSVTNVIVVT

SEQ ID NO: 2061645 - protein, 22 aa, Staphylococcus
DHAYLPIYAIKNHLCQFAVAGE

SEQ ID NO: 2061646 - protein, 21 aa, Staphylococcus
DHAYLPIYAIQNKICNSAIAG

SEQ ID NO: 2061647 - protein, 23 aa, Staphylococcus
DHDLAILMIVGEGMNQVVGTASK

SEQ ID NO: 2061648 - protein, 24 aa, Staphylococcus
DHDLAILMIVGEGMNRVIGTASKI

SEQ ID NO: 2061649 - protein, 21 aa, Staphylococcus
DHDLAILMIVGEGMTQSVGTA

SEQ ID NO: 2061650 - protein, 26 aa, Staphylococcus
DHEFKTKILPTLTPLGIDAYHPFPKL

SEQ ID NO: 2061651 - protein, 19 aa, Staphylococcus
DHEIIKTWKKAYQDIADVF

SEQ ID NO: 2061652 - protein, 18 aa, Staphylococcus
DHESLLTGIVYQDKETPS

SEQ ID NO: 2061653 - protein, 36 aa, Staphylococcus
DHFAIRFLFNEVCHKLHLPWVYGAAVGGKGSIYAID

SEQ ID NO: 2061654 - protein, 17 aa, Staphylococcus
DHFKFLYDRVNGRATAK

SEQ ID NO: 2061655 - protein, 21 aa, Staphylococcus
DHFKIRYLINESCNKQNIPWI

SEQ ID NO: 2061656 - protein, 20 aa, Staphylococcus
DHFQTFLSNQLPGHLLLAEE

SEQ ID NO: 2061657 - protein, 21 aa, Staphylococcus
DHGLTGLEFACGIPGSIGGAV

SEQ ID NO: 2061658 - protein, 28 aa, Staphylococcus
DHGVHVILTDTFALNKPAQGLFEKFGFT

SEQ ID NO: 2061659 - protein, 31 aa, Staphylococcus
DHHHYPLTHYIFMNELKINLLDFRKQMDYLE

SEQ ID NO: 2061660 - protein, 30 aa, Staphylococcus
DHHKLAMVLVQFPPWFDCTAQNIKYILYVR

SEQ ID NO: 2061661 - protein, 24 aa, Staphylococcus
DHHSRRGLLKMVGRRRHLLNYLRD

SEQ ID NO: 2061662 - protein, 24 aa, Staphylococcus
DHHSRRGLLKMVGRRRHLLNYLRS

SEQ ID NO: 2061663 - protein, 27 aa, Staphylococcus
DHIIKAFDIYLKKGYSSKLLVYGKDKE

SEQ ID NO: 2061664 - protein, 25 aa, Staphylococcus
DHIKGLGVIARRYGLPVYANEKTWK

SEQ ID NO: 2061665 - protein, 31 aa, Staphylococcus
DHIKGLGVLARKYGLPIYANENTWKAIEKKD

SEQ ID NO: 2061666 - protein, 17 aa, Staphylococcus
DHILDTSLLFNIIPERF

SEQ ID NO: 2061667 - protein, 33 aa, Staphylococcus
DHISSYGLILEPKTQFYNMYKKGKLKIPNEDIG

SEQ ID NO: 2061668 - protein, 33 aa, Staphylococcus
DHISSYGLILEPKTQFYNMYRKGHLKLPNEDLG

SEQ ID NO: 2061669 - protein, 17 aa, Staphylococcus
DHKRFHNNIKDQSINLK

SEQ ID NO: 2061670 - protein, 23 aa, Staphylococcus
DHKVKVIAWYDNEWGYSNRVVEV

SEQ ID NO: 2061671 - protein, 17 aa, Staphylococcus
DHLFLMFGVMHEGKDKA

SEQ ID NO: 2061672 - protein, 27 aa, Staphylococcus
DHLIKAYHRFLSYGYGTRLDVFGADED

SEQ ID NO: 2061673 - protein, 22 aa, Staphylococcus
DHLNMDYFKMKPVGLIGNSGGI

SEQ ID NO: 2061674 - protein, 24 aa, Staphylococcus
DHLPQLQSLIKQRYQMRSKPMIVR

SEQ ID NO: 2061675 - protein, 18 aa, Staphylococcus
DHMKSIMTMLDAKDINDL

SEQ ID NO: 2061676 - protein, 19 aa, Staphylococcus
DHNFTWAAPIMSRPVKNMT

SEQ ID NO: 2061677 - protein, 18 aa, Staphylococcus
DHPELLPQAQYQVELPAK

SEQ ID NO: 2061678 - protein, 23 aa, Staphylococcus
DHPFAFDNDLLIKNLKDLKNGQS

SEQ ID NO: 2061679 - protein, 24 aa, Staphylococcus
DHPILDAFRILDHVSVPKGAVRPS

SEQ ID NO: 2061680 - protein, 18 aa, Staphylococcus
DHPITLTTQPLLTQLENE

SEQ ID NO: 2061681 - protein, 17 aa, Staphylococcus
DHREFTLILYVNDIVGM

SEQ ID NO: 2061682 - protein, 23 aa, Staphylococcus
DHTHLFNTLHLFDKNGFKTTFGL

SEQ ID NO: 2061683 - protein, 25 aa, Staphylococcus
DHTREYIPVLMFSPKIDAYHELSGD

SEQ ID NO: 2061684 - protein, 24 aa, Staphylococcus
DHTREYIPVLMFSPKIDKYHELSG

SEQ ID NO: 2061685 - protein, 24 aa, Staphylococcus
DHTREYIPVLMFSPKIKQYHELPG

SEQ ID NO: 2061686 - protein, 24 aa, Staphylococcus
DHTREYIPVLMFSPKINQYHELSQ

SEQ ID NO: 2061687 - protein, 24 aa, Staphylococcus
DHTREYIPVLMFSPKMTDYHELTI

SEQ ID NO: 2061688 - protein, 24 aa, Staphylococcus
DHVKDLYVLINKLNLKKAHLLGHD

SEQ ID NO: 2061689 - protein, 29 aa, Staphylococcus
DHVKQISRIPLSLTFDHQILDGAGAADFL

SEQ ID NO: 2061690 - protein, 17 aa, Staphylococcus
DHVLDTSLLFNIIPERF

SEQ ID NO: 2061691 - protein, 24 aa, Staphylococcus
DHVLELFIKGYLSDYHLYINQTFY

SEQ ID NO: 2061692 - protein, 21 aa, Staphylococcus
DHVLTGLEFACGIPGSVGGAV

SEQ ID NO: 2061693 - protein, 17 aa, Staphylococcus
DHWLGYCTNELIQIAPE

SEQ ID NO: 2061694 - protein, 22 aa, Staphylococcus
DHYFIYPKERKSEVSKLPFIEF

SEQ ID NO: 2061695 - protein, 19 aa, Staphylococcus
DHYGLWTFKKVWGTYLSEK

SEQ ID NO: 2061696 - protein, 23 aa, Staphylococcus
DIADMHRFVMSKDTFSPSEVTAI

SEQ ID NO: 2061697 - protein, 22 aa, Staphylococcus
DIAGLRIMCQFVDDIDVVVNIL

SEQ ID NO: 2061698 - protein, 23 aa, Staphylococcus
DIAGLRLMCQFVDDIDIVVNLLR

SEQ ID NO: 2061699 - protein, 22 aa, Staphylococcus
DIAGLRMMCQFVDDIDIVVNIL

SEQ ID NO: 2061700 - protein, 22 aa, Staphylococcus
DIAGLRMMCQFVDDIDVVVKML

SEQ ID NO: 2061701 - protein, 20 aa, Staphylococcus
DIAILDIEIPGMTGLEVLSQ

SEQ ID NO: 2061702 - protein, 18 aa, Staphylococcus
DIAKILYSTRAGVAYMAT

SEQ ID NO: 2061703 - protein, 20 aa, Staphylococcus
DIALEFRKEFHKDVVIDLVG

SEQ ID NO: 2061704 - protein, 27 aa, Staphylococcus
DIAMEFRKEFHKDFVIDLVGYRRYGHN

SEQ ID NO: 2061705 - protein, 20 aa, Staphylococcus
DIANYCDIFYIGGTKIGALC

SEQ ID NO: 2061706 - protein, 17 aa, Staphylococcus
DIAPLFGLNKRQGKQLL

SEQ ID NO: 2061707 - protein, 25 aa, Staphylococcus
DIARFVDKLQLFSLLANVGDSKSLV

SEQ ID NO: 2061708 - protein, 24 aa, Staphylococcus
DIAVSVFTGWLAYSTFDHDWVMQQ

SEQ ID NO: 2061709 - protein, 26 aa, Staphylococcus
DIAYAQYLATRHIYPDASIGIINIDS

SEQ ID NO: 2061710 - protein, 18 aa, Staphylococcus
DIAYVINLFKKPVSKDCN

SEQ ID NO: 2061711 - protein, 27 aa, Staphylococcus
DICIDNGIMGIPSFLVYRNGELLGSYI

SEQ ID NO: 2061712 - protein, 17 aa, Staphylococcus
DIDAWIKNDLSWKTIKR

SEQ ID NO: 2061713 - protein, 23 aa, Staphylococcus
DIDDLYQEVLIKLYLVIDRYDTQ

SEQ ID NO: 2061714 - protein, 23 aa, Staphylococcus
DIDDYLKLLALDGTLVNVGAPAE

SEQ ID NO: 2061715 - protein, 27 aa, Staphylococcus
DIDFADYFDFITNLDCLIYASGTALYG

SEQ ID NO: 2061716 - protein, 22 aa, Staphylococcus
DIDFARYMIPSLTTVAQPMEDI

SEQ ID NO: 2061717 - protein, 22 aa, Staphylococcus
DIDHYLNYLDALAYPIQIIKEL

SEQ ID NO: 2061718 - protein, 21 aa, Staphylococcus
DIDIAAYRKNLLAQKLSILKQ

SEQ ID NO: 2061719 - protein, 25 aa, Staphylococcus
DIDIDEDFLLVKREIFSSGKSICKV

SEQ ID NO: 2061720 - protein, 24 aa, Staphylococcus
DIDIDEDFLLVKREIFSSGKSICR

SEQ ID NO: 2061721 - protein, 24 aa, Staphylococcus
DIDIDEDFLLVKREIFSTGKSMCR

SEQ ID NO: 2061722 - protein, 26 aa, Staphylococcus
DIDIDELFDLFIFKHDRLKAKMKEAF

SEQ ID NO: 2061723 - protein, 26 aa, Staphylococcus
DIDIDELFDMFIFKNDRLKAKMKEAF

SEQ ID NO: 2061724 - protein, 22 aa, Staphylococcus
DIDIMKFPYFDNAGNGIFERPI

SEQ ID NO: 2061725 - protein, 26 aa, Staphylococcus
DIDKAHRFKTLLATPLIPTKPEMYIL

SEQ ID NO: 2061726 - protein, 18 aa, Staphylococcus
DIDLFIKANIVLSKDIYG

SEQ ID NO: 2061727 - protein, 20 aa, Staphylococcus
DIDPALIPFIMEKTGKTADE

SEQ ID NO: 2061728 - protein, 24 aa, Staphylococcus
DIDPSLIEQVIFGNVLQSGIGQNS

SEQ ID NO: 2061729 - protein, 20 aa, Staphylococcus
DIDQLIPYCLHLTGKPVIES

SEQ ID NO: 2061730 - protein, 25 aa, Staphylococcus
DIDTVIFIPSIIHPSIKRIPEVENL

SEQ ID NO: 2061731 - protein, 25 aa, Staphylococcus
DIDYSDFMKLFEKYDLYFWKQHDEG

SEQ ID NO: 2061732 - protein, 27 aa, Staphylococcus
DIEAKRKFINETQYFYQNIKQYQIAYD

SEQ ID NO: 2061733 - protein, 24 aa, Staphylococcus
DIEDEAIFKILIAKLKKQVSVLEV

SEQ ID NO: 2061734 - protein, 31 aa, Staphylococcus
DIEDQTLQELPFISGFIGTCSFDLVRHEFPI

SEQ ID NO: 2061735 - protein, 23 aa, Staphylococcus
DIEEAFVVKQILQHLATKHGIDF

SEQ ID NO: 2061736 - protein, 25 aa, Staphylococcus
DIEEDFNFMLQGYRKGVITEERLND

SEQ ID NO: 2061737 - protein, 24 aa, Staphylococcus
DIEIDEDFLLVKREIFSTGKSICR

SEQ ID NO: 2061738 - protein, 18 aa, Staphylococcus
DIELAYEAGLLSRNEENF

SEQ ID NO: 2061739 - protein, 24 aa, Staphylococcus
DIELYHTSRFMTFTGYTIGGSEIS

SEQ ID NO: 2061740 - protein, 18 aa, Staphylococcus
DIEMPLKEQFWGGKMGAF

SEQ ID NO: 2061741 - protein, 24 aa, Staphylococcus
DIENCIQDFYKNYYNQWLSRFKNT

SEQ ID NO: 2061742 - protein, 25 aa, Staphylococcus
DIENKVGLFIKTLPILFSRDEDKTI

SEQ ID NO: 2061743 - protein, 27 aa, Staphylococcus
DIEPKAQIQLFKQFKAIADKKKTVSDR

SEQ ID NO: 2061744 - protein, 22 aa, Staphylococcus
DIERFIEVLAAKAKKYKYTLMM

SEQ ID NO: 2061745 - protein, 21 aa, Staphylococcus
DIETYVFTEVALRNKGITILP

SEQ ID NO: 2061746 - protein, 29 aa, Staphylococcus
DIEVMRKWIPLMMQGRFDDGLMAASKIDE

SEQ ID NO: 2061747 - protein, 18 aa, Staphylococcus
DIEVSIMDFDRDEWATPN

SEQ ID NO: 2061748 - protein, 19 aa, Staphylococcus
DIEYFLYKGIETKLNIIVQ

SEQ ID NO: 2061749 - protein, 26 aa, Staphylococcus
DIEYSDFMKLYKKYDLYFWKQHDEGI

SEQ ID NO: 2061750 - protein, 17 aa, Staphylococcus
DIFALLLGNEGEGVNKA

SEQ ID NO: 2061751 - protein, 18 aa, Staphylococcus
DIFFSERQLKNLEKDSFE

SEQ ID NO: 2061752 - protein, 17 aa, Staphylococcus
DIFISVEKDIYTEMLWD

SEQ ID NO: 2061753 - protein, 17 aa, Staphylococcus
DIFLAFKTDKSDLLNCI

SEQ ID NO: 2061754 - protein, 17 aa, Staphylococcus
DIFTLEDKADFIQMSIK

SEQ ID NO: 2061755 - protein, 22 aa, Staphylococcus
DIGGPTMLRAAAKNFKHVITVV

SEQ ID NO: 2061756 - protein, 20 aa, Staphylococcus
DIGIKYLTLYAFSTENWTRP

SEQ ID NO: 2061757 - protein, 25 aa, Staphylococcus
DIGKALGFPAHMSRLTRTSSGGFNI

SEQ ID NO: 2061758 - protein, 24 aa, Staphylococcus
DIGKFDAIVGRRVLMYLPGAYEAL

SEQ ID NO: 2061759 - protein, 18 aa, Staphylococcus
DIGKKLGYPAHMSRLTRV

SEQ ID NO: 2061760 - protein, 22 aa, Staphylococcus
DIGMIFQHFNLLNSKTVFKNVA

SEQ ID NO: 2061761 - protein, 20 aa, Staphylococcus
DIGMIFQHFNLLNSKTVYKN

SEQ ID NO: 2061762 - protein, 19 aa, Staphylococcus
DIGMLLYNYVPQSEWSEWL

SEQ ID NO: 2061763 - protein, 21 aa, Staphylococcus
DIGMQLINYLLALLEETEFEI

SEQ ID NO: 2061764 - protein, 19 aa, Staphylococcus
DIGNIIALKQRAKKRNIKL

SEQ ID NO: 2061765 - protein, 24 aa, Staphylococcus
DIGYTRAKYGYDCQTMAVLTAIDE

SEQ ID NO: 2061766 - protein, 23 aa, Staphylococcus
DIHHHIIPEIYLKALNDSGIDKA

SEQ ID NO: 2061767 - protein, 24 aa, Staphylococcus
DIHHHIIPPLYKKSLKKIGITMSG

SEQ ID NO: 2061768 - protein, 24 aa, Staphylococcus
DIHLTGTYTMPCARTLVPVEVPLD

SEQ ID NO: 2061769 - protein, 19 aa, Staphylococcus
DIHNHIRGLSPWPVGYTTM

SEQ ID NO: 2061770 - protein, 24 aa, Staphylococcus
DIHTGQWLVLRDIANFQPTTLVKI

SEQ ID NO: 2061771 - protein, 26 aa, Staphylococcus
DIIAKILELGLYPTLKEILKYRGIDS

SEQ ID NO: 2061772 - protein, 24 aa, Staphylococcus
DIIALLDFIYIDQAAFIGHEMAAM

SEQ ID NO: 2061773 - protein, 18 aa, Staphylococcus
DIIHKLNLTLEYFNGMSH

SEQ ID NO: 2061774 - protein, 18 aa, Staphylococcus
DIIHNKFILDATYLGKYS

SEQ ID NO: 2061775 - protein, 17 aa, Staphylococcus
DIIILNKMDLVTQVELE

SEQ ID NO: 2061776 - protein, 23 aa, Staphylococcus
DIIKNHVPFVYAVKNEEALKYLR

SEQ ID NO: 2061777 - protein, 18 aa, Staphylococcus
DIINYIYEQLSFSFKDDA

SEQ ID NO: 2061778 - protein, 19 aa, Staphylococcus
DIIPFAMSPKDLKLIEAIP

SEQ ID NO: 2061779 - protein, 19 aa, Staphylococcus
DIIVQPPGKKLQHLSLLSG

SEQ ID NO: 2061780 - protein, 52 aa, Staphylococcus; identical to SEQ ID NO: 1823174

SEQ ID NO: 2061781 - protein, 24 aa, Staphylococcus
DIKANANRIGVWIGSGIGGMETFE

SEQ ID NO: 2061782 - protein, 24 aa, Staphylococcus
DIKDIHDFVMSKDSFSPSEITAIA

SEQ ID NO: 2061783 - protein, 21 aa, Staphylococcus
DIKGLKIALPSEYLGEGVSDE

SEQ ID NO: 2061784 - protein, 19 aa, Staphylococcus
DIKHRMIRNLCLSIIDEQQ

SEQ ID NO: 2061785 - protein, 29 aa, Staphylococcus
DIKISQLTHLFNLEPFLQKRIYECSKGTQ

SEQ ID NO: 2061786 - protein, 19 aa, Staphylococcus
DIKIVDYPLQTGLVAEVGQ

SEQ ID NO: 2061787 - protein, 25 aa, Staphylococcus
DIKKNIDYWLKRFAITENRHKRIDA

SEQ ID NO: 2061788 - protein, 29 aa, Staphylococcus
DIKLDKRKMDLPQGIHTLGYTNVPVKLDK

SEQ ID NO: 2061789 - protein, 35 aa, Staphylococcus
DIKLNNYFLKYAQKPIYLKLNNKFYIISYHNQKLS

SEQ ID NO: 2061790 - protein, 19 aa, Staphylococcus
DIKNIHYLHHAYPLTLMEH

SEQ ID NO: 2061791 - protein, 20 aa, Staphylococcus
DIKSILKDLYQKGIGKLLVE

SEQ ID NO: 2061792 - protein, 27 aa, Staphylococcus
DIKSKPPILLSPIISIILFSTQSISST

SEQ ID NO: 2061793 - protein, 17 aa, Staphylococcus
DIKTSTRFYASAGGLYP

SEQ ID NO: 2061794 - protein, 26 aa, Staphylococcus
DIKTTDLLIRLYEKVINNIDYQHKKH

SEQ ID NO: 2061795 - protein, 24 aa, Staphylococcus
DIKTTDLLIRLYEKVTSGLDYQDK

SEQ ID NO: 2061796 - protein, 25 aa, Staphylococcus
DIKTTDLLLRLYEKSVAGLDYQNKK

SEQ ID NO: 2061797 - protein, 25 aa, Staphylococcus
DIKVHDFLINNIFPKYGDVLTTKAW

SEQ ID NO: 2061798 - protein, 18 aa, Staphylococcus
DIKVLVLTSYVDDEHVIS

SEQ ID NO: 2061799 - protein, 29 aa, Staphylococcus
DIKVQDVMFLLLYALKDLGAQLNMDPVTE

SEQ ID NO: 2061800 - protein, 19 aa, Staphylococcus
DILEKKLITFFNAVKESNF

SEQ ID NO: 2061801 - protein, 18 aa, Staphylococcus
DILGDFKAPMGCRSFLPA

SEQ ID NO: 2061802 - protein, 20 aa, Staphylococcus
DILIEDIPVMIGSTPITFDA

SEQ ID NO: 2061803 - protein, 21 aa, Staphylococcus
DILKALFPCGSITGAPKLNTM

SEQ ID NO: 2061804 - protein, 25 aa, Staphylococcus
DILKQTKLIYLTYPNNPTGSTVTQE

SEQ ID NO: 2061805 - protein, 19 aa, Staphylococcus
DILLQVLLHASIGKKEGYF

SEQ ID NO: 2061806 - protein, 20 aa, Staphylococcus
DILNDIRAYRDLKLKAFEAH

SEQ ID NO: 2061807 - protein, 22 aa, Staphylococcus
DILNEEGIIILVIYHGHDEGKI

SEQ ID NO: 2061808 - protein, 17 aa, Staphylococcus
DILNHMFQYLPDFFQNE

SEQ ID NO: 2061809 - protein, 20 aa, Staphylococcus
DILPLITSANIACGFHAGDA

SEQ ID NO: 2061810 - protein, 18 aa, Staphylococcus
DILPQESAKWRYIENKLD

SEQ ID NO: 2061811 - protein, 18 aa, Staphylococcus
DILPTFEYVDFNHLDEAV

SEQ ID NO: 2061812 - protein, 21 aa, Staphylococcus
DILREMKYYQNAWTNRYDIWF

SEQ ID NO: 2061813 - protein, 20 aa, Staphylococcus
DILRRVMLENKKAVQWEIMY

SEQ ID NO: 2061814 - protein, 19 aa, Staphylococcus
DILTIGQYLQPSRKHLKVE

SEQ ID NO: 2061815 - protein, 21 aa, Staphylococcus
DILTIGQYLQPSRKHLKVEKY

SEQ ID NO: 2061816 - protein, 18 aa, Staphylococcus
DILTQQILDKFKSLTFIS

SEQ ID NO: 2061817 - protein, 18 aa, Staphylococcus
DIMRFIESSLYLQIAQAD

SEQ ID NO: 2061818 - protein, 22 aa, Staphylococcus
DIMRSEFQRYVSNNYTIVVLVE

SEQ ID NO: 2061819 - protein, 22 aa, Staphylococcus
DINDFYSQLLEYAYPTDKTEVY

SEQ ID NO: 2061820 - protein, 18 aa, Staphylococcus
DINEPFMYKLVDIVAEIM

SEQ ID NO: 2061821 - protein, 20 aa, Staphylococcus
DINEPFMYQLVDAVADIMEP

SEQ ID NO: 2061822 - protein, 24 aa, Staphylococcus
DINEQILDLLVKRGKLAQKIGEEK

SEQ ID NO: 2061823 - protein, 19 aa, Staphylococcus
DINGKLPTGVYAKDIILYL

SEQ ID NO: 2061824 - protein, 18 aa, Staphylococcus
DINKSHWFYKATEKNIYL

SEQ ID NO: 2061825 - protein, 24 aa, Staphylococcus
DINPNVLSHYWGGDKLNIRQDLEQ

SEQ ID NO: 2061826 - protein, 24 aa, Staphylococcus
DINRGTFYLHFEDKYLLLDEMENE

SEQ ID NO: 2061827 - protein, 24 aa, Staphylococcus
DINRGTFYLHYEDKYILLSDIEDE

SEQ ID NO: 2061828 - protein, 24 aa, Staphylococcus
DINRGTFYLHYKDKYMLLTDMEDE

SEQ ID NO: 2061829 - protein, 43 aa, Staphylococcus
DINYFVTYGNFVFSIDYYLNNKLLPSSLLLNANRKVKFPFSFT

SEQ ID NO: 2061830 - protein, 27 aa, Staphylococcus
DIPDCHCVILLRPTESLSLFIQQTMRA

SEQ ID NO: 2061831 - protein, 17 aa, Staphylococcus
DIPFCIYNRTAVCKGRG

SEQ ID NO: 2061832 - protein, 24 aa, Staphylococcus
DIPLQSHLIIMKTLSKAFALAGLR

SEQ ID NO: 2061833 - protein, 21 aa, Staphylococcus
DIPLSADIFRKYGIDFCCGGN

SEQ ID NO: 2061834 - protein, 17 aa, Staphylococcus
DIPLYLGRTLSNVKGTW

SEQ ID NO: 2061835 - protein, 25 aa, Staphylococcus
DIPREKLFITTKIWNDFQGYESTKE

SEQ ID NO: 2061836 - protein, 20 aa, Staphylococcus
DIPSIRPIARLGYYDYTVVD

SEQ ID NO: 2061837 - protein, 22 aa, Staphylococcus
DIPTFYIVNVGGGYLDGDRYTM

SEQ ID NO: 2061838 - protein, 21 aa, Staphylococcus
DIPYELWVINKRVKNKDGKYK

SEQ ID NO: 2061839 - protein, 17 aa, Staphylococcus
DIPYVDYMSDLISIVEH

SEQ ID NO: 2061840 - protein, 19 aa, Staphylococcus
DIQALGGNFLKPVVITNAN

SEQ ID NO: 2061841 - protein, 22 aa, Staphylococcus
DIQEPFMYKLVDIVADIMEPYY

SEQ ID NO: 2061842 - protein, 25 aa, Staphylococcus
DIQQRIDYWLERFAITENRKKRIQS

SEQ ID NO: 2061843 - protein, 23 aa, Staphylococcus
DIQQRQLTYAPCTELSMGMSNDY

SEQ ID NO: 2061844 - protein, 27 aa, Staphylococcus
DIQRGPLIRFLIVKLENGYKIIMENHH

SEQ ID NO: 2061845 - protein, 24 aa, Staphylococcus
DIQSRYLIYLYARGQNEWMKFLGI

SEQ ID NO: 2061846 - protein, 29 aa, Staphylococcus
DIQTTIESRYPLVEKIPISTLVQGTQAKQ

SEQ ID NO: 2061847 - protein, 21 aa, Staphylococcus
DIQVLAPMYKGSAGIKKLNMV

SEQ ID NO: 2061848 - protein, 22 aa, Staphylococcus
DIQVLAPMYRGSAGIKRLNKVL

SEQ ID NO: 2061849 - protein, 24 aa, Staphylococcus
DIRAAIFFGGFYNMNTVKKTEFPR

SEQ ID NO: 2061850 - protein, 27 aa, Staphylococcus
DIRDEDTWMLFGTLPIYPCINDENDQH

SEQ ID NO: 2061851 - protein, 27 aa, Staphylococcus
DIRDKNTWMLFGTLPIYPCINDENDQV

SEQ ID NO: 2061852 - protein, 17 aa, Staphylococcus
DIRFLKGNALKPLIKEN

SEQ ID NO: 2061853 - protein, 17 aa, Staphylococcus
DIRHFYTNDVRFLSQFK

SEQ ID NO: 2061854 - protein, 24 aa, Staphylococcus
DIRNERFILLKPNMALRHLTDQIL

SEQ ID NO: 2061855 - protein, 32 aa, Staphylococcus
DIRTALRMILPRKWSLEQLVAYFFKWLNDTRG

SEQ ID NO: 2061856 - protein, 25 aa, Staphylococcus
DIRVNIIYEIPLSEVVFDFFDQLKS

SEQ ID NO: 2061857 - protein, 17 aa, Staphylococcus
DIRYFYTNDVRFLDQFK

SEQ ID NO: 2061858 - protein, 21 aa, Staphylococcus
DISIIITQLIMRYPMNAVVVR

SEQ ID NO: 2061859 - protein, 20 aa, Staphylococcus
DISLPKYYNNRELSWLDFNY

SEQ ID NO: 2061860 - protein, 19 aa, Staphylococcus
DISLVKSGCKIIKKAVGED

SEQ ID NO: 2061861 - protein, 19 aa, Staphylococcus
DISLWKTDALRTIAEDLDL

SEQ ID NO: 2061862 - protein, 28 aa, Staphylococcus
DISNYEDYLVCRPLLNIYKKDIINYQEK

SEQ ID NO: 2061863 - protein, 24 aa, Staphylococcus
DISNYVLLEYGQPLHMFDQDHIGS

SEQ ID NO: 2061864 - protein, 23 aa, Staphylococcus
DISNYVLLEYGQPLHMFDQDQIG

SEQ ID NO: 2061865 - protein, 24 aa, Staphylococcus
DISNYVLLEYGQPLHMFDQNHMGS

SEQ ID NO: 2061866 - protein, 23 aa, Staphylococcus
DISNYVLLEYGQPLHMFDQNQIG

SEQ ID NO: 2061867 - protein, 23 aa, Staphylococcus
DISRMTFYAYYVDKLDLLDQMEN

SEQ ID NO: 2061868 - protein, 31 aa, Staphylococcus
DISSPYYRDLAFVTYMGITPLDTMLSAFGKR

SEQ ID NO: 2061869 - protein, 26 aa, Staphylococcus
DITFADYFYQWYEVNKLPHVSESTKR

SEQ ID NO: 2061870 - protein, 24 aa, Staphylococcus
DITSAVALEFSFVDALVALDIDVK

SEQ ID NO: 2061871 - protein, 29 aa, Staphylococcus
DITSIHDLMHYLFEIIDPYSLNKQGVDKG

SEQ ID NO: 2061872 - protein, 18 aa, Staphylococcus
DITTIKFMDSTPAENIGI

SEQ ID NO: 2061873 - protein, 24 aa, Staphylococcus
DITVISVFVNPLQFGPNEDFDAYP

SEQ ID NO: 2061874 - protein, 26 aa, Staphylococcus
DITVTQLMKYIKGPDFPTGGIIQGVD

SEQ ID NO: 2061875 - protein, 25 aa, Staphylococcus
DITVVSIFVNPLQFGPNEDFDAYPR

SEQ ID NO: 2061876 - protein, 17 aa, Staphylococcus
DIVAENPDLIIVGGGIA

SEQ ID NO: 2061877 - protein, 22 aa, Staphylococcus
DIVATYDIPRFNKSPYDGFAIR

SEQ ID NO: 2061878 - protein, 23 aa, Staphylococcus
DIVIGDLPIGYYPLDERSHEMQL

SEQ ID NO: 2061879 - protein, 23 aa, Staphylococcus
DIVIGDLPIGYYPVDDRSKEMKL

SEQ ID NO: 2061880 - protein, 18 aa, Staphylococcus
DIVLPKLENFGEDDIILL

SEQ ID NO: 2061881 - protein, 25 aa, Staphylococcus
DIVSIGARPINLLNSLRFGELDEIQ

SEQ ID NO: 2061882 - protein, 26 aa, Staphylococcus
DIVSIGARPINLLNSLRFGELSNKQN

SEQ ID NO: 2061883 - protein, 25 aa, Staphylococcus
DIVSIGARPINLLNSLRFGELTEKQ

SEQ ID NO: 2061884 - protein, 17 aa, Staphylococcus
DIVVLSNRKAEQQKKFV

SEQ ID NO: 2061885 - protein, 20 aa, Staphylococcus
DIVVRSYYQFTADNRIYFDA

SEQ ID NO: 2061886 - protein, 23 aa, Staphylococcus
DIYDFYALGFGEPYPISGSHGLG

SEQ ID NO: 2061887 - protein, 26 aa, Staphylococcus
DIYKLEGHIFIFGGQSLFEEMIDKVD

SEQ ID NO: 2061888 - protein, 23 aa, Staphylococcus
DIYLIKSLYKSTFWKIVKEDAAY

SEQ ID NO: 2061889 - protein, 20 aa, Staphylococcus
DIYLYGSFMETYRGHGTDVA

SEQ ID NO: 2061890 - protein, 26 aa, Staphylococcus
DIYNLEGHVFIFGGQTLFEVMIDKVD

SEQ ID NO: 2061891 - protein, 22 aa, Staphylococcus
DIYSGIEMDILPDGSLDYDDEI

SEQ ID NO: 2061892 - protein, 28 aa, Staphylococcus
DIYYNLNVSFPQAALGDEIKIPTLNSNV

SEQ ID NO: 2061893 - protein, 17 aa, Staphylococcus
DKADLIYISQKGKFDAV

SEQ ID NO: 2061894 - protein, 21 aa, Staphylococcus
DKADLIYISQKGKFDAVIEDV

SEQ ID NO: 2061895 - protein, 21 aa, Staphylococcus
DKAPEIGLATVYRTLELLAEI

SEQ ID NO: 2061896 - protein, 28 aa, Staphylococcus
DKARLRDITELFLDSGLGKEAFSIISQG

SEQ ID NO: 2061897 - protein, 23 aa, Staphylococcus
DKAVITVPAYFNDAERQATKDAG

SEQ ID NO: 2061898 - protein, 18 aa, Staphylococcus
DKAYGEVLGAFIVGPHAT

SEQ ID NO: 2061899 - protein, 24 aa, Staphylococcus
DKAYYIKPYFSNQLFKVQLNEELL

SEQ ID NO: 2061900 - protein, 25 aa, Staphylococcus
DKCLDKNIPIILVSRSFNGIVGPIY

SEQ ID NO: 2061901 - protein, 26 aa, Staphylococcus
DKDAIQIVPLIIKYASELKNEGRMLK

SEQ ID NO: 2061902 - protein, 25 aa, Staphylococcus
DKDAIQIVPLIIKYTSILKNEGKTL

SEQ ID NO: 2061903 - protein, 27 aa, Staphylococcus
DKDAIQMVPLLVKYKNLLDKNGITFKE

SEQ ID NO: 2061904 - protein, 27 aa, Staphylococcus
DKDALQIVPLIIKFKNLLYENNITLKD

SEQ ID NO: 2061905 - protein, 27 aa, Staphylococcus
DKDDQPILYSFNYFKSSLVKFKTVKNS

SEQ ID NO: 2061906 - protein, 23 aa, Staphylococcus
DKDFTVINIKKYLMNRQIGFTRR

SEQ ID NO: 2061907 - protein, 24 aa, Staphylococcus
DKDFTVINIKKYLMNRQIGFTVKI

SEQ ID NO: 2061908 - protein, 33 aa, Staphylococcus
DKDFTVINIKKYLMNRQVGFTRKILGVLEDYNI

SEQ ID NO: 2061909 - protein, 27 aa, Staphylococcus
DKDFVIHTPLMWLDKKATWALSDDLGV

SEQ ID NO: 2061910 - protein, 27 aa, Staphylococcus
DKDFVIHTPLMWLNKAQTWALSDELGV

SEQ ID NO: 2061911 - protein, 18 aa, Staphylococcus
DKDKLYVPVIKHADEKSI

SEQ ID NO: 2061912 - protein, 23 aa, Staphylococcus
DKDLEVVNYWIYSPKPQDVDFAS

SEQ ID NO: 2061913 - protein, 24 aa, Staphylococcus
DKDLYILGVSDRISRLFDITGLKD

SEQ ID NO: 2061914 - protein, 26 aa, Staphylococcus
DKDPDFMQGYYYIQQLYLQQKDYKSA

SEQ ID NO: 2061915 - protein, 26 aa, Staphylococcus
DKDSEHYGLWAFKRVWGTYLSEKIGE

SEQ ID NO: 2061916 - protein, 26 aa, Staphylococcus
DKDSILRVILPQYVESLIYGTILDAK

SEQ ID NO: 2061917 - protein, 26 aa, Staphylococcus
DKDVKLPVIFWMHGGGFIAGDKQYKN

SEQ ID NO: 2061918 - protein, 18 aa, Staphylococcus
DKDYFDTLPLSNQKSEDY

SEQ ID NO: 2061919 - protein, 25 aa, Staphylococcus
DKEAILSVILPQYVESLIYGTILDA

SEQ ID NO: 2061920 - protein, 18 aa, Staphylococcus
DKEALSLNYLPSIKLSDT

SEQ ID NO: 2061921 - protein, 23 aa, Staphylococcus
DKEFLDFQTIQYLYNSDFIGYGL

SEQ ID NO: 2061922 - protein, 25 aa, Staphylococcus
DKEIFKSLMFYWSDKDNRRINNLKE

SEQ ID NO: 2061923 - protein, 20 aa, Staphylococcus
DKEIGLFLTEDGRIFAVNNV

SEQ ID NO: 2061924 - protein, 23 aa, Staphylococcus
DKEIIPIYNFVREKEFPTQHENQ

SEQ ID NO: 2061925 - protein, 23 aa, Staphylococcus
DKELFVEGAYLYYLGSFIDSDSS

SEQ ID NO: 2061926 - protein, 23 aa, Staphylococcus
DKELILKAIIRYVTSVLFSFNQT

SEQ ID NO: 2061927 - protein, 67 aa, Staphylococcus
DKELPYLDLPEEMNPFLGYRAIRLCLAQPDIFRPQLRALLRASVYGKLNIMFPMVATIKEFRDAKAM

SEQ ID NO: 2061928 - protein, 37 aa, Staphylococcus
DKELPYLDLPEEMNPFLGYRAIRLCLDQPEIFRPQLR

SEQ ID NO: 2061929 - protein, 37 aa, Staphylococcus; identical to SEQ ID NO: 1825911

SEQ ID NO: 2061930 - protein, 37 aa, Staphylococcus
DKELPYLNLPEEMNPFLGYRAIRLCLDQPDIFRPQLR

SEQ ID NO: 2061931 - protein, 24 aa, Staphylococcus
DKELYILGVSDRISRLFDITGLKD

SEQ ID NO: 2061932 - protein, 24 aa, Staphylococcus
DKELYILGVTDRISRLFDITGLKD

SEQ ID NO: 2061933 - protein, 27 aa, Staphylococcus
DKERIKLLHEWIGGKMPLIGIGSIFTP

SEQ ID NO: 2061934 - protein, 24 aa, Staphylococcus
DKESLFREIYRVLKNSGKAVISDI

SEQ ID NO: 2061935 - protein, 25 aa, Staphylococcus
DKEVSIYPYFPYDENKKFEMFKMEI

SEQ ID NO: 2061936 - protein, 22 aa, Staphylococcus
DKFIAIFAGYNDDMQRFLESNE

SEQ ID NO: 2061937 - protein, 27 aa, Staphylococcus
DKFKTTMITFKFMAPLEYETITARSLL

SEQ ID NO: 2061938 - protein, 28 aa, Staphylococcus
DKFLNIYKEFYLSLSKFSNLFYTNRQSY

SEQ ID NO: 2061939 - protein, 20 aa, Staphylococcus
DKFNALTFISGTLTFNHSFD

SEQ ID NO: 2061940 - protein, 21 aa, Staphylococcus
DKFVHIKPYKRTRTYNNLVNL

SEQ ID NO: 2061941 - protein, 20 aa, Staphylococcus
DKFYEHHRWIAGHLDEEYYE

SEQ ID NO: 2061942 - protein, 24 aa, Staphylococcus
DKFYNDHFVIQYFSGLIGGKGRRA

SEQ ID NO: 2061943 - protein, 33 aa, Staphylococcus
DKGFTVLNIKKYLMNRQVGFTRKILAVLEDYGI

SEQ ID NO: 2061944 - protein, 23 aa, Staphylococcus
DKGHFEPIFILAKNNKAKKDSSP

SEQ ID NO: 2061945 - protein, 23 aa, Staphylococcus
DKGKFNMIFQFEHLGLWNTGDVK

SEQ ID NO: 2061946 - protein, 25 aa, Staphylococcus
DKGLDGSRRFLDRVWRLIVKEDGSL

SEQ ID NO: 2061947 - protein, 18 aa, Staphylococcus
DKGLLDIAILIEPIAMEK

SEQ ID NO: 2061948 - protein, 21 aa, Staphylococcus
DKGLTHFKLGISVSKKLGNAV

SEQ ID NO: 2061949 - protein, 22 aa, Staphylococcus
DKGTWIIYSKMIIEPKGRNMES

SEQ ID NO: 2061950 - protein, 27 aa, Staphylococcus
DKGWHDLKIVPYAPFEISPAAQGLHYG

SEQ ID NO: 2061951 - protein, 25 aa, Staphylococcus
DKGWHDLKIVPYAPLEVSPAAQGLH

SEQ ID NO: 2061952 - protein, 26 aa, Staphylococcus
DKGWHDMKIVPYAPFEISPAAQGLHY

SEQ ID NO: 2061953 - protein, 23 aa, Staphylococcus
DKGYTDIIVIALSSGISGSYQSA

SEQ ID NO: 2061954 - protein, 17 aa, Staphylococcus
DKHAKIYAFIPGTELRG

SEQ ID NO: 2061955 - protein, 19 aa, Staphylococcus
DKHALSHYDNWLLQWIEQR

SEQ ID NO: 2061956 - protein, 20 aa, Staphylococcus
DKHDIVVTAWMPLMRNRGLL

SEQ ID NO: 2061957 - protein, 25 aa, Staphylococcus
DKHLADMDIVISAPFYSAYMTKERI

SEQ ID NO: 2061958 - protein, 24 aa, Staphylococcus
DKHLEVIHKINVPVIIVGQTHEQL

SEQ ID NO: 2061959 - protein, 25 aa, Staphylococcus
DKHMMHITISYPLSDDRLLTQLFTA

SEQ ID NO: 2061960 - protein, 32 aa, Staphylococcus
DKHTTLTYQFPFNDEWFVYWGGDNELFNYHYP

SEQ ID NO: 2061961 - protein, 20 aa, Staphylococcus
DKIFDAVLMTIKAVIREERI

SEQ ID NO: 2061962 - protein, 20 aa, Staphylococcus
DKIFEIDGDLPLYPGHGPST

SEQ ID NO: 2061963 - protein, 32 aa, Staphylococcus
DKIFKKLNQINKPLKAILLTHAHFDHIGALDD

SEQ ID NO: 2061964 - protein, 25 aa, Staphylococcus
DKIIGYLGMWIVIDQAQITTVAIKK

SEQ ID NO: 2061965 - protein, 19 aa, Staphylococcus
DKILICGDLFISDAQHLHI

SEQ ID NO: 2061966 - protein, 20 aa, Staphylococcus
DKILIGGGMAYTFLKAQGKE

SEQ ID NO: 2061967 - protein, 35 aa, Staphylococcus
DKIMVVANLPYYITTPILLNLMSKSLPIDGYVVMM

SEQ ID NO: 2061968 - protein, 21 aa, Staphylococcus
DKINFIGIRLDSGDIAYLSKE

SEQ ID NO: 2061969 - protein, 22 aa, Staphylococcus
DKINFIGIRLDSGDIAYLSKEA

SEQ ID NO: 2061970 - protein, 21 aa, Staphylococcus
DKINFIGIRLDSGDIAYLSKK

SEQ ID NO: 2061971 - protein, 21 aa, Staphylococcus
DKISKLLFESTKRRPMIIPVI

SEQ ID NO: 2061972 - protein, 30 aa, Staphylococcus
DKIVIKPLSLMYMHYDYWLTYEYKKEVSTI

SEQ ID NO: 2061973 - protein, 29 aa, Staphylococcus
DKKEGIHYKNLLGTYLHGPILPKNHELTD

SEQ ID NO: 2061974 - protein, 25 aa, Staphylococcus
DKKEKPYIMPVWSMKGRALKVRDQD

SEQ ID NO: 2061975 - protein, 24 aa, Staphylococcus
DKKHALYLYDRNGFRSILGNIYER

SEQ ID NO: 2061976 - protein, 23 aa, Staphylococcus
DKKIITYAPTWRDDEFIKKGQYL

SEQ ID NO: 2061977 - protein, 19 aa, Staphylococcus
DKKKFVLGSVSHKVAKRAT

SEQ ID NO: 2061978 - protein, 23 aa, Staphylococcus
DKKLFIQDLEKFYDKIFSLTYRE

SEQ ID NO: 2061979 - protein, 22 aa, Staphylococcus
DKKLLLETKITEVLSRLSIEPS

SEQ ID NO: 2061980 - protein, 27 aa, Staphylococcus
DKKQELNDALYYFNVPAEVQNVTEGPS

SEQ ID NO: 2061981 - protein, 26 aa, Staphylococcus
DKKRIAIQYSLPKWLVDHWVTHYGLE

SEQ ID NO: 2061982 - protein, 23 aa, Staphylococcus
DKKVIMYAPTWRDDEFVSKGKYL

SEQ ID NO: 2061983 - protein, 22 aa, Staphylococcus
DKKVRGRRLGEDYNKGGIEDGF

SEQ ID NO: 2061984 - protein, 27 aa, Staphylococcus
DKLAMVLVQFPPWFDCKTQNINYIRYV

SEQ ID NO: 2061985 - protein, 25 aa, Staphylococcus
DKLCRTTGFDGWAPLFFRGREVSGK

SEQ ID NO: 2061986 - protein, 22 aa, Staphylococcus
DKLEYPVFVKPANLGSSVGISK

SEQ ID NO: 2061987 - protein, 21 aa, Staphylococcus
DKLFELEGDLPLFPGHGPYTT

SEQ ID NO: 2061988 - protein, 19 aa, Staphylococcus
DKLFIYRRNYQATSWLVVA

SEQ ID NO: 2061989 - protein, 32 aa, Staphylococcus
DKLGGKMHVYPEKIIWDIGGLAPKPCFEVIQD

SEQ ID NO: 2061990 - protein, 28 aa, Staphylococcus
DKLGGKMQIYPEKIIWDIGGVAPKPCYQ

SEQ ID NO: 2061991 - protein, 31 aa, Staphylococcus
DKLGGKMQLYPEKIIWDIGGIGPKPCYQIIE

SEQ ID NO: 2061992 - protein, 18 aa, Staphylococcus
DKLILSGFDEMLVQAVIS

SEQ ID NO: 2061993 - protein, 26 aa, Staphylococcus
DKLKQLVDYGWLDKTNYQTLLSNPVI

SEQ ID NO: 2061994 - protein, 29 aa, Staphylococcus
DKLNKKIKATPLYFLQHGIVFLKPRDNSN

SEQ ID NO: 2061995 - protein, 24 aa, Staphylococcus
DKLNKQLPILLISGKEDPFGDYGK

SEQ ID NO: 2061996 - protein, 22 aa, Staphylococcus
DKLSFLAWMNNINHYPNIIYNI

SEQ ID NO: 2061997 - protein, 25 aa, Staphylococcus
DKLSRTQGFDGWAPLFFRGREVSGK

SEQ ID NO: 2061998 - protein, 29 aa, Staphylococcus
DKLVMKQLFAHRGLPQLPYVSFLRSEYEK

SEQ ID NO: 2061999 - protein, 30 aa, Staphylococcus
DKLVMKQLFAHRGLPQLPYVSFLRSEYHKY

SEQ ID NO: 2062000 - protein, 24 aa, Staphylococcus
DKLVTNELYYKVWNGLYHEIHNEP

SEQ ID NO: 2062001 - protein, 24 aa, Staphylococcus
DKMDQFELQLLLDGPHDANNAILE

SEQ ID NO: 2062002 - protein, 21 aa, Staphylococcus
DKMFDYFIKMILEIAHNKNVL

SEQ ID NO: 2062003 - protein, 20 aa, Staphylococcus
DKMKSWYERFGFGKKTDGMF

SEQ ID NO: 2062004 - protein, 23 aa, Staphylococcus
DKMKSWYERFGFGKSTNGMFDGE

SEQ ID NO: 2062005 - protein, 18 aa, Staphylococcus
DKMKSWYERFGFGKTTGG

SEQ ID NO: 2062006 - protein, 31 aa, Staphylococcus
DKMPDKLCLYYHIGQCLGPCVYPVDLEKYAE

SEQ ID NO: 2062007 - protein, 25 aa, Staphylococcus
DKMPDKLCLYYHIGQCMGPCVYDVD

SEQ ID NO: 2062008 - protein, 26 aa, Staphylococcus
DKMPNKLCLYYHIGQCLGPCVYDVDQ

SEQ ID NO: 2062009 - protein, 18 aa, Staphylococcus
DKMYRRFSILTTISQNQP

SEQ ID NO: 2062010 - protein, 29 aa, Staphylococcus
DKNDFYHSDIYLQLFKFYSEILGNNKSTT

SEQ ID NO: 2062011 - protein, 23 aa, Staphylococcus
DKNDLLFEPFPLEHSQNAFKDIN

SEQ ID NO: 2062012 - protein, 25 aa, Staphylococcus
DKNFTYHYMHLINEIYIDEALVTYD

SEQ ID NO: 2062013 - protein, 27 aa, Staphylococcus
DKNFVIHTPLMWLDKKETWALSDQLGV

SEQ ID NO: 2062014 - protein, 20 aa, Staphylococcus
DKNLACHLGWFNTTVDENFR

SEQ ID NO: 2062015 - protein, 35 aa, Staphylococcus
DKNMPGCMIGIARLNLPAVFVYGGTILPGKLDGKD

SEQ ID NO: 2062016 - protein, 24 aa, Staphylococcus
DKNNPLLEKLNFISIFSSNLDEFF

SEQ ID NO: 2062017 - protein, 24 aa, Staphylococcus
DKNNPLLEQLNFISIFSSNLDEFF

SEQ ID NO: 2062018 - protein, 27 aa, Staphylococcus
DKNQIMLAIPDIFWSIELDLNMDSNDV

SEQ ID NO: 2062019 - protein, 24 aa, Staphylococcus
DKNRNEFFHYFNPGDFKPPLNVYF

SEQ ID NO: 2062020 - protein, 22 aa, Staphylococcus
DKNTSRIYAKFGKEIYVAAKSG

SEQ ID NO: 2062021 - protein, 25 aa, Staphylococcus
DKNVDFLYYAFEKVSKYMKRIAGKT

SEQ ID NO: 2062022 - protein, 18 aa, Staphylococcus
DKNVIWEHHQWNKGVFIE

SEQ ID NO: 2062023 - protein, 18 aa, Staphylococcus
DKPFLDQVFTTETIEGVF

SEQ ID NO: 2062024 - protein, 18 aa, Staphylococcus
DKPIIFYTPDYEEYETSR

SEQ ID NO: 2062025 - protein, 17 aa, Staphylococcus
DKPLTLIGPTGLQQFIE

SEQ ID NO: 2062026 - protein, 17 aa, Staphylococcus
DKPLVCVGILKGSVMFM

SEQ ID NO: 2062027 - protein, 26 aa, Staphylococcus
DKPMAVFNINNFFIPLQTMLDEMIDA

SEQ ID NO: 2062028 - protein, 20 aa, Staphylococcus
DKQAMMLVPEIALTPQMVLR

SEQ ID NO: 2062029 - protein, 31 aa, Staphylococcus
DKQEGIHYKNLLGTYLHGPILPKNHELTDYL

SEQ ID NO: 2062030 - protein, 23 aa, Staphylococcus
DKQIILMTHIVTHSKFVVPTPHR

SEQ ID NO: 2062031 - protein, 17 aa, Staphylococcus
DKQNILKGILPDNDIFL

SEQ ID NO: 2062032 - protein, 22 aa, Staphylococcus
DKQSIYSLRFDEMQQWLVEQGQ

SEQ ID NO: 2062033 - protein, 24 aa, Staphylococcus
DKQTHFITELVVETIKFISNPNSN

SEQ ID NO: 2062034 - protein, 18 aa, Staphylococcus
DKRAFDEQTFRTDMSQFG

SEQ ID NO: 2062035 - protein, 25 aa, Staphylococcus
DKREKLLSFKYILIDEFQDFTSDML

SEQ ID NO: 2062036 - protein, 20 aa, Staphylococcus
DKRILISHLGMAGGFFVVDK

SEQ ID NO: 2062037 - protein, 22 aa, Staphylococcus
DKRKYVIISINKKTVNKKPTIS

SEQ ID NO: 2062038 - protein, 34 aa, Staphylococcus
DKRVSPDLFIKRLNFYDFLLLCSDGLTDYVRNEE

SEQ ID NO: 2062039 - protein, 25 aa, Staphylococcus
DKSEALILLLPYMYKEQEKAKKWFQ

SEQ ID NO: 2062040 - protein, 23 aa, Staphylococcus
DKSSSLLEDLLGRKPQDIVEILN

SEQ ID NO: 2062041 - protein, 29 aa, Staphylococcus
DKSWEKIGIRLVDKLLDTFPVHDKEVAHR

SEQ ID NO: 2062042 - protein, 21 aa, Staphylococcus
DKSYIRRMVDLGYTTIFTSVQ

SEQ ID NO: 2062043 - protein, 21 aa, Staphylococcus
DKTEKFYFFSDIEAIIFDHYR

SEQ ID NO: 2062044 - protein, 17 aa, Staphylococcus
DKTGIYCTIGIGSNLLL

SEQ ID NO: 2062045 - protein, 21 aa, Staphylococcus
DKTKVILLNYPTNPTGVILSR

SEQ ID NO: 2062046 - protein, 18 aa, Staphylococcus
DKTLERKAVWDKWMDQDM

SEQ ID NO: 2062047 - protein, 26 aa, Staphylococcus
DKTLPWLIVERGFEIPSFNFAIESEE

SEQ ID NO: 2062048 - protein, 32 aa, Staphylococcus
DKTNQLLNAFHLWLIRIFYANQPKSYPSIDTA

SEQ ID NO: 2062049 - protein, 28 aa, Staphylococcus
DKTPNLEVLKFLYFKMNKLGADIVKLAV

SEQ ID NO: 2062050 - protein, 18 aa, Staphylococcus
DKTPNPVHYWIAELENKG

SEQ ID NO: 2062051 - protein, 31 aa, Staphylococcus
DKVCARLKQSRTVFIFGFGASYVAARDLFQK

SEQ ID NO: 2062052 - protein, 22 aa, Staphylococcus
DKVFLNIFKHWNSDQFFNLIQS

SEQ ID NO: 2062053 - protein, 29 aa, Staphylococcus
DKVHYLIGTMIETPRACLIADQLAQHCDF

SEQ ID NO: 2062054 - protein, 18 aa, Staphylococcus
DKVKLLHSYGVNRISMGV

SEQ ID NO: 2062055 - protein, 19 aa, Staphylococcus
DKVLFIEPMTMMNLSGEAV

SEQ ID NO: 2062056 - protein, 21 aa, Staphylococcus
DKVLQFFVRYGGEFQLKQGFS

SEQ ID NO: 2062057 - protein, 20 aa, Staphylococcus
DKVYGVNVKGVLWGIQAAHA

SEQ ID NO: 2062058 - protein, 21 aa, Staphylococcus
DKYAHKISRYIMGANQYLKDL

SEQ ID NO: 2062059 - protein, 34 aa, Staphylococcus
DKYKDNPGLFKRLIASTFFLKMNEKQQPEFKNKD

SEQ ID NO: 2062060 - protein, 21 aa, Staphylococcus
DKYQYVSFIPVNGEVIVSLSG

SEQ ID NO: 2062061 - protein, 18 aa, Staphylococcus
DKYYQVPYYGQVSAGNFE

SEQ ID NO: 2062062 - protein, 29 aa, Staphylococcus
DLADFYCKEAPFYTLGPLTTDIAQLMTTS

SEQ ID NO: 2062063 - protein, 18 aa, Staphylococcus
DLAFTILDNAGAICRIER

SEQ ID NO: 2062064 - protein, 22 aa, Staphylococcus
DLAFVTYMGMSPYQIMLNSFGK

SEQ ID NO: 2062065 - protein, 18 aa, Staphylococcus
DLAKRAGASIILLIVNIL

SEQ ID NO: 2062066 - protein, 19 aa, Staphylococcus
DLAPYVGASLDRMAEDTKV

SEQ ID NO: 2062067 - protein, 18 aa, Staphylococcus
DLAQDLSNRLIQMRKRRG

SEQ ID NO: 2062068 - protein, 18 aa, Staphylococcus
DLAQDLSNRLVNMRKRRG

SEQ ID NO: 2062069 - protein, 17 aa, Staphylococcus
DLAREYGTRIIGLRDGE

SEQ ID NO: 2062070 - protein, 24 aa, Staphylococcus
DLAREYGTRIIGLRDGQLVFDGPV

SEQ ID NO: 2062071 - protein, 17 aa, Staphylococcus
DLARIDTEHFPWQQFRK

SEQ ID NO: 2062072 - protein, 25 aa, Staphylococcus
DLARKLLALCHDYAVPFIVNDDVAL

SEQ ID NO: 2062073 - protein, 20 aa, Staphylococcus
DLAVFDFIDGQMRLVELQDG

SEQ ID NO: 2062074 - protein, 23 aa, Staphylococcus
DLAWLIEMMLPRMQSHQVLSEDF

SEQ ID NO: 2062075 - protein, 18 aa, Staphylococcus
DLCLDVLVLPDGSYELVD

SEQ ID NO: 2062076 - protein, 23 aa, Staphylococcus
DLCVKYDIMGIPSFLVFKDGDML

SEQ ID NO: 2062077 - protein, 27 aa, Staphylococcus
DLDEFYYLPHALFDNPYYKKLSADSII

SEQ ID NO: 2062078 - protein, 21 aa, Staphylococcus
DLDFDFINWLVTGVKDHEAVL

SEQ ID NO: 2062079 - protein, 20 aa, Staphylococcus
DLDFDFINWLVTGVKDHEPV

SEQ ID NO: 2062080 - protein, 18 aa, Staphylococcus
DLDIKYIKSIFYPEKVTI

SEQ ID NO: 2062081 - protein, 21 aa, Staphylococcus
DLDIRAHYGINIIAIKRDKDV

SEQ ID NO: 2062082 - protein, 22 aa, Staphylococcus
DLDIRAQFGINIIAIKRGREII

SEQ ID NO: 2062083 - protein, 25 aa, Staphylococcus
DLDIRAQYGINIIAIKRGKQFIVSP

SEQ ID NO: 2062084 - protein, 21 aa, Staphylococcus
DLDITELYQNYLDAHDLNGTS

SEQ ID NO: 2062085 - protein, 19 aa, Staphylococcus
DLDLILLNFANPDMVGHSG

SEQ ID NO: 2062086 - protein, 23 aa, Staphylococcus
DLDMLYHMIDIINDTLVSIRFSV

SEQ ID NO: 2062087 - protein, 22 aa, Staphylococcus
DLDPVFMWHLAHAFGQEERDKE

SEQ ID NO: 2062088 - protein, 25 aa, Staphylococcus
DLDQEHFLVLLLNSKNIVIKQSWIF

SEQ ID NO: 2062089 - protein, 18 aa, Staphylococcus
DLDQYYHKVMLLSGTLHS

SEQ ID NO: 2062090 - protein, 23 aa, Staphylococcus
DLDRKIIIVSAPGKRHKNDVKTT

SEQ ID NO: 2062091 - protein, 25 aa, Staphylococcus
DLDVDFIFKARKPMGKAFKKALKYM

SEQ ID NO: 2062092 - protein, 20 aa, Staphylococcus
DLDVDFIFKARKPVGKAFKK

SEQ ID NO: 2062093 - protein, 20 aa, Staphylococcus
DLDYIISTRHPLHVQQQLLN

SEQ ID NO: 2062094 - protein, 18 aa, Staphylococcus
DLDYTIIRPGWLTDKNEN

SEQ ID NO: 2062095 - protein, 18 aa, Staphylococcus
DLEDLRIVLWKGHCSVHE

SEQ ID NO: 2062096 - protein, 23 aa, Staphylococcus
DLEEDFHFMLKGYQDGVITDDRL

SEQ ID NO: 2062097 - protein, 24 aa, Staphylococcus
DLEGTLSWLKNAINSLIAAIEKIA

SEQ ID NO: 2062098 - protein, 28 aa, Staphylococcus
DLEKGLYRKRMLSYGGLLKQKHKILNLD

SEQ ID NO: 2062099 - protein, 32 aa, Staphylococcus
DLEKQNVNLLPRRAFYIPYQLGEKDYDFKTRY

SEQ ID NO: 2062100 - protein, 18 aa, Staphylococcus
DLELFTNNQLVGAGLPLW

SEQ ID NO: 2062101 - protein, 17 aa, Staphylococcus
DLELPLARILSKMEEIG

SEQ ID NO: 2062102 - protein, 23 aa, Staphylococcus
DLEMLYHMIDIINDTLVSIRFSV

SEQ ID NO: 2062103 - protein, 24 aa, Staphylococcus
DLEMPNMIIFLDADLEVLKQRIAQ

SEQ ID NO: 2062104 - protein, 25 aa, Staphylococcus
DLEMTFFFEMVLGEETDFYQKLLND

SEQ ID NO: 2062105 - protein, 25 aa, Staphylococcus
DLEMTLFFELIFGEETEFYQTLLNE

SEQ ID NO: 2062106 - protein, 24 aa, Staphylococcus
DLEMTLFFELVFGEETDFYQMLLN

SEQ ID NO: 2062107 - protein, 25 aa, Staphylococcus
DLEMTLFYEMLFGEETDFYQSLLNE

SEQ ID NO: 2062108 - protein, 21 aa, Staphylococcus
DLEPMVLFVNPKDAGKLRASA

SEQ ID NO: 2062109 - protein, 18 aa, Staphylococcus
DLERLLEIKSLIEKGFNL

SEQ ID NO: 2062110 - protein, 19 aa, Staphylococcus
DLERQWLNLPLEEDIRELG

SEQ ID NO: 2062111 - protein, 22 aa, Staphylococcus
DLERYRQLFAPGSKPADWPQIE

SEQ ID NO: 2062112 - protein, 19 aa, Staphylococcus
DLESLKLAFEKYGDDIAGV

SEQ ID NO: 2062113 - protein, 18 aa, Staphylococcus
DLEWIVGIMLPRMKEHHI

SEQ ID NO: 2062114 - protein, 18 aa, Staphylococcus
DLFANYHVTAMFNTFIDM

SEQ ID NO: 2062115 - protein, 23 aa, Staphylococcus
DLFDDVCRFMLNEGHISTSLVQR

SEQ ID NO: 2062116 - protein, 19 aa, Staphylococcus
DLFELDGQHVLLFSPQGMD

SEQ ID NO: 2062117 - protein, 22 aa, Staphylococcus
DLFIKKFIEIYLNKSSVEMDDS

SEQ ID NO: 2062118 - protein, 17 aa, Staphylococcus
DLFITSKLWLDHYGKDN

SEQ ID NO: 2062119 - protein, 20 aa, Staphylococcus
DLFITSKLWNDYQGYDNTIE

SEQ ID NO: 2062120 - protein, 20 aa, Staphylococcus
DLFITSKLWNDYQGYDSTIQ

SEQ ID NO: 2062121 - protein, 25 aa, Staphylococcus
DLFKCAETIFIYGYGASFVVATDLY

SEQ ID NO: 2062122 - protein, 17 aa, Staphylococcus
DLFKQWFHPEGASTEVF

SEQ ID NO: 2062123 - protein, 30 aa, Staphylococcus
DLFYNTEISTYIWIITKNKSPKRQGKVQLI

SEQ ID NO: 2062124 - protein, 24 aa, Staphylococcus
DLGAPFEVLKQIKDNGRLPVVNFA

SEQ ID NO: 2062125 - protein, 21 aa, Staphylococcus
DLGDRVNIINAFALLNEQGVT

SEQ ID NO: 2062126 - protein, 18 aa, Staphylococcus
DLGHFRGAVRPNITRFRD

SEQ ID NO: 2062127 - protein, 23 aa, Staphylococcus
DLGIDVIWLSPMYQSPNDDNGYD

SEQ ID NO: 2062128 - protein, 19 aa, Staphylococcus
DLGIELQSLLFFMKNYSNN

SEQ ID NO: 2062129 - protein, 18 aa, Staphylococcus
DLGIELQSLLFFMNNLRN

SEQ ID NO: 2062130 - protein, 22 aa, Staphylococcus
DLGIKYLTLYAFSTENWSRPEN

SEQ ID NO: 2062131 - protein, 17 aa, Staphylococcus
DLGIRAIMFFGVPNDKD

SEQ ID NO: 2062132 - protein, 26 aa, Staphylococcus
DLGLEAAFKSYFKQFENNYGMQIVYQ

SEQ ID NO: 2062133 - protein, 25 aa, Staphylococcus
DLGLTFLEIIILEQLKYLNKEKIDA

SEQ ID NO: 2062134 - protein, 34 aa, Staphylococcus
DLGNGLFATYLYPKRMFWIKGQSFAINIDPFDMN

SEQ ID NO: 2062135 - protein, 23 aa, Staphylococcus
DLGRINELRIGEALFRGIDTTTN

SEQ ID NO: 2062136 - protein, 17 aa, Staphylococcus
DLGVELVIDEALREARK

SEQ ID NO: 2062137 - protein, 22 aa, Staphylococcus
DLGVKTAQWLRKTPLLKNREQE

SEQ ID NO: 2062138 - protein, 31 aa, Staphylococcus
DLHDVCVVVTRYFGGIKLGGGGLIRAYSGAV

SEQ ID NO: 2062139 - protein, 23 aa, Staphylococcus
DLHLYHQGDLFMDPGFVIGHEPM

SEQ ID NO: 2062140 - protein, 23 aa, Staphylococcus
DLIDFNIRKLRLSNISAFEHDAT

SEQ ID NO: 2062141 - protein, 23 aa, Staphylococcus
DLIDMVVVNLYPFKETVANPNVT

SEQ ID NO: 2062142 - protein, 23 aa, Staphylococcus
DLIEDSIFQFLKYKPEYVKQNRD

SEQ ID NO: 2062143 - protein, 25 aa, Staphylococcus
DLIELKIPIAYFYIEDNDFFNCFFD

SEQ ID NO: 2062144 - protein, 18 aa, Staphylococcus
DLIELRKVIVHWCELLLT

SEQ ID NO: 2062145 - protein, 20 aa, Staphylococcus
DLIFQKDGKYYFVDYKTDAF

SEQ ID NO: 2062146 - protein, 20 aa, Staphylococcus
DLIKTYLVEKNFDVLDVTEG

SEQ ID NO: 2062147 - protein, 22 aa, Staphylococcus
DLINVQYILDLLNQIDLSDTEQ

SEQ ID NO: 2062148 - protein, 24 aa, Staphylococcus
DLIPNQFVLIATGSTPKSLPFIEF

SEQ ID NO: 2062149 - protein, 29 aa, Staphylococcus
DLIVDYCRERGFLVLTYDNGYIIHDSNHE

SEQ ID NO: 2062150 - protein, 23 aa, Staphylococcus
DLKAFYQIIEPHVDVLLAGKSEA

SEQ ID NO: 2062151 - protein, 27 aa, Staphylococcus
DLKAIQHWLTQYQLELAYIKNKGFMIT

SEQ ID NO: 2062152 - protein, 22 aa, Staphylococcus
DLKDRYKFIGGISPLAKITDEQ

SEQ ID NO: 2062153 - protein, 18 aa, Staphylococcus
DLKEIYKWMDLGRKVDER

SEQ ID NO: 2062154 - protein, 26 aa, Staphylococcus
DLKEKVDPYLRPLYDGLNTVLGREQT

SEQ ID NO: 2062155 - protein, 27 aa, Staphylococcus
DLKEKVDPYLRPLYDGLNTVLGREQTA

SEQ ID NO: 2062156 - protein, 27 aa, Staphylococcus
DLKEKVDPYLRPLYDGLNTVLGREQTE

SEQ ID NO: 2062157 - protein, 20 aa, Staphylococcus
DLKEQMLQQIPLARFGQDTD

SEQ ID NO: 2062158 - protein, 18 aa, Staphylococcus
DLKGQKAVLYFYPRDNTP

SEQ ID NO: 2062159 - protein, 26 aa, Staphylococcus
DLKGSWSVVCFYPADFSFVCPTELED

SEQ ID NO: 2062160 - protein, 17 aa, Staphylococcus
DLKIGIVVSRFNDFITG

SEQ ID NO: 2062161 - protein, 18 aa, Staphylococcus
DLKQLRNAGKVPAVVYGY

SEQ ID NO: 2062162 - protein, 17 aa, Staphylococcus
DLKRLNLSLEEIKYIVN

SEQ ID NO: 2062163 - protein, 20 aa, Staphylococcus
DLKRPIEGFFSIAGFKEDAQ

SEQ ID NO: 2062164 - protein, 21 aa, Staphylococcus
DLKRTYVFELNYDAIMRVSVG

SEQ ID NO: 2062165 - protein, 17 aa, Staphylococcus
DLKTLRNTGKVPAIVYG

SEQ ID NO: 2062166 - protein, 21 aa, Staphylococcus
DLKTRDLMLLRYGYTVNETRE

SEQ ID NO: 2062167 - protein, 17 aa, Staphylococcus
DLKVAIVVSRFNDFITG

SEQ ID NO: 2062168 - protein, 32 aa, Staphylococcus
DLKVKYPTYKLCRDLLHLLDHSSQFEEIYGKV

SEQ ID NO: 2062169 - protein, 27 aa, Staphylococcus
DLLDADTKFFINPTGRFVIGGPQGDAG

SEQ ID NO: 2062170 - protein, 30 aa, Staphylococcus
DLLDELIAREDIWLTPHIAFYTDAAVKNLI

SEQ ID NO: 2062171 - protein, 21 aa, Staphylococcus
DLLDGLYDQNKRYFDDVTLYI

SEQ ID NO: 2062172 - protein, 26 aa, Staphylococcus
DLLFGTIDTWLVWKLSGGEAHITDYS

SEQ ID NO: 2062173 - protein, 30 aa, Staphylococcus
DLLKENGSLLKLKFITHSYPHDWRTKKPVI

SEQ ID NO: 2062174 - protein, 21 aa, Staphylococcus
DLLKRLCKMNEKFDTTIIMVT

SEQ ID NO: 2062175 - protein, 17 aa, Staphylococcus
DLLLKIKEERNLTIVII

SEQ ID NO: 2062176 - protein, 17 aa, Staphylococcus
DLLLKIREQQNLTIVLI

SEQ ID NO: 2062177 - protein, 19 aa, Staphylococcus
DLLNLIHKYKHMHPQDIVQ

SEQ ID NO: 2062178 - protein, 17 aa, Staphylococcus
DLLNMKVKYLKTSEIGN

SEQ ID NO: 2062179 - protein, 19 aa, Staphylococcus
DLLNVYPDLTAFGKIVGGG

SEQ ID NO: 2062180 - protein, 18 aa, Staphylococcus
DLLPVPANWLNRPEDREK

SEQ ID NO: 2062181 - protein, 18 aa, Staphylococcus
DLLRRLKAMNERFDSTIL

SEQ ID NO: 2062182 - protein, 20 aa, Staphylococcus
DLLTIFLNRYVDMIQRGQYA

SEQ ID NO: 2062183 - protein, 25 aa, Staphylococcus
DLLVEALLHEHVDFIFGYPGGAVLP

SEQ ID NO: 2062184 - protein, 20 aa, Staphylococcus
DLLVEYDGELPFWDKSSPEA

SEQ ID NO: 2062185 - protein, 17 aa, Staphylococcus
DLMAAILLFHKVKVDGH

SEQ ID NO: 2062186 - protein, 28 aa, Staphylococcus
DLMEKYPAFIGAFVWEWCDHAVTAGMQH

SEQ ID NO: 2062187 - protein, 23 aa, Staphylococcus
DLMGYTPWGIIDIVSFTTGEMKK

SEQ ID NO: 2062188 - protein, 20 aa, Staphylococcus
DLMIYYIKSLNGLGQYYQAV

SEQ ID NO: 2062189 - protein, 24 aa, Staphylococcus
DLMKIANDIRWLASGPRAGLAEIA

SEQ ID NO: 2062190 - protein, 24 aa, Staphylococcus
DLMKIANDIRWLASGPRAGLAEIS

SEQ ID NO: 2062191 - protein, 22 aa, Staphylococcus
DLMKIANDVRWLASGPRAGLAE

SEQ ID NO: 2062192 - protein, 18 aa, Staphylococcus
DLMLVQTNRHFGKTIVLN

SEQ ID NO: 2062193 - protein, 23 aa, Staphylococcus
DLMNAWLSPYRRALNLENPVINL

SEQ ID NO: 2062194 - protein, 21 aa, Staphylococcus
DLMNGHLTLPVLFEMRKNETF

SEQ ID NO: 2062195 - protein, 19 aa, Staphylococcus
DLMPYLIKEKVWDAHLEMR

SEQ ID NO: 2062196 - protein, 23 aa, Staphylococcus
DLMQLLKINDGTFRNWKKAGMPI

SEQ ID NO: 2062197 - protein, 21 aa, Staphylococcus
DLNDMIAALPKQLTKRKILNP

SEQ ID NO: 2062198 - protein, 23 aa, Staphylococcus
DLNDVIQLIRLLHDKYPSAYIHM

SEQ ID NO: 2062199 - protein, 17 aa, Staphylococcus
DLNENKFYFMEMNTRIQ

SEQ ID NO: 2062200 - protein, 17 aa, Staphylococcus
DLNEPAFQLSMSKAIIT

SEQ ID NO: 2062201 - protein, 24 aa, Staphylococcus
DLNIKYIKPVTYPEKVRIKTWVER

SEQ ID NO: 2062202 - protein, 18 aa, Staphylococcus
DLNIKYKKSIFYPEKVTI

SEQ ID NO: 2062203 - protein, 17 aa, Staphylococcus
DLNITAVGFIRDGNFNI

SEQ ID NO: 2062204 - protein, 23 aa, Staphylococcus
DLNKVFHIQGEYILWQCSQHCHA

SEQ ID NO: 2062205 - protein, 24 aa, Staphylococcus
DLNMPLELYVQLVYSVQNEMVYKP

SEQ ID NO: 2062206 - protein, 20 aa, Staphylococcus
DLNMVYMQEARYLNAEDADT

SEQ ID NO: 2062207 - protein, 21 aa, Staphylococcus
DLNNPLFLWTNSGVLLSEEDN

SEQ ID NO: 2062208 - protein, 20 aa, Staphylococcus
DLNRTYVFELNYHTIMEVAV

SEQ ID NO: 2062209 - protein, 19 aa, Staphylococcus
DLNSKLYHYWALGHIHERQ

SEQ ID NO: 2062210 - protein, 28 aa, Staphylococcus
DLNVFVDWSFILEFIKYANGFVRVSRFP

SEQ ID NO: 2062211 - protein, 17 aa, Staphylococcus
DLNYDGGQMYLGDYQYY

SEQ ID NO: 2062212 - protein, 28 aa, Staphylococcus
DLPDLDYSKIYLFNPNLDKITTFRDELI

SEQ ID NO: 2062213 - protein, 21 aa, Staphylococcus
DLPEYAFPLFGMAVGEPAEDE

SEQ ID NO: 2062214 - protein, 17 aa, Staphylococcus
DLPGYMGADYHKLPISK

SEQ ID NO: 2062215 - protein, 19 aa, Staphylococcus
DLPILADPLSQLRKYNHPN

SEQ ID NO: 2062216 - protein, 20 aa, Staphylococcus
DLPITMIGLDLARQSLLTHD

SEQ ID NO: 2062217 - protein, 17 aa, Staphylococcus
DLPKIKELWPQAGDYLL

SEQ ID NO: 2062218 - protein, 18 aa, Staphylococcus
DLPVLLISGKEDPFGDYS

SEQ ID NO: 2062219 - protein, 25 aa, Staphylococcus
DLQDLPFISGFIGSCSFDLARHEFP

SEQ ID NO: 2062220 - protein, 19 aa, Staphylococcus
DLQIKYRKSIFYPEKVTIK

SEQ ID NO: 2062221 - protein, 25 aa, Staphylococcus
DLQISLKRQHYVLWRMKVEGEISDK

SEQ ID NO: 2062222 - protein, 21 aa, Staphylococcus
DLQLSRQIAIQTAPQIRMIQN

SEQ ID NO: 2062223 - protein, 21 aa, Staphylococcus
DLQLSRQIALQTAPQIRMIQN

SEQ ID NO: 2062224 - protein, 20 aa, Staphylococcus
DLQLSRQISLQTAPQIRMIQ

SEQ ID NO: 2062225 - protein, 19 aa, Staphylococcus
DLQNVIKPYDALVSILKHE

SEQ ID NO: 2062226 - protein, 19 aa, Staphylococcus
DLQPFNPESYVYGLFADMI

SEQ ID NO: 2062227 - protein, 25 aa, Staphylococcus
DLQQEHFYVLLLNSKNIVIKQQCVF

SEQ ID NO: 2062228 - protein, 17 aa, Staphylococcus
DLQRCKPIFETLPGWTE

SEQ ID NO: 2062229 - protein, 26 aa, Staphylococcus
DLRDIAEELVIIEKPIRAVADDSSID

SEQ ID NO: 2062230 - protein, 21 aa, Staphylococcus
DLRKLLADHFVMTTLTTVVKQ

SEQ ID NO: 2062231 - protein, 24 aa, Staphylococcus
DLRKPLILNQKYGLGIDYFDLEQN

SEQ ID NO: 2062232 - protein, 20 aa, Staphylococcus
DLRQLLKDNFAMTTLTTVVK

SEQ ID NO: 2062233 - protein, 19 aa, Staphylococcus
DLRQLLKDNFVMTTLTTVV

SEQ ID NO: 2062234 - protein, 18 aa, Staphylococcus
DLSELFVRSFDDLTFKII

SEQ ID NO: 2062235 - protein, 22 aa, Staphylococcus
DLSHRKLFPSLFHLFQQNNLDE

SEQ ID NO: 2062236 - protein, 22 aa, Staphylococcus
DLSHRKLFPSLFHLYQQENLNE

SEQ ID NO: 2062237 - protein, 27 aa, Staphylococcus
DLSNPFNVPDFLEDLLLDGHLKELRRY

SEQ ID NO: 2062238 - protein, 26 aa, Staphylococcus
DLSNQYIPQRLLPDKAIDVLDITSAH

SEQ ID NO: 2062239 - protein, 24 aa, Staphylococcus
DLSNRLYHDFLRENNEREKLRAEL

SEQ ID NO: 2062240 - protein, 30 aa, Staphylococcus
DLSRRFINRDLFKYIPFDGSIITITELQEL

SEQ ID NO: 2062241 - protein, 25 aa, Staphylococcus
DLTCPITFGNIKFYTMPYATVSEVA

SEQ ID NO: 2062242 - protein, 22 aa, Staphylococcus
DLTEKFKGFDKVIFSVGSGGST

SEQ ID NO: 2062243 - protein, 27 aa, Staphylococcus
DLTEKRMILEKILPILSERERQIIQCT

SEQ ID NO: 2062244 - protein, 20 aa, Staphylococcus
DLTIYGILHDGTKELVFENG

SEQ ID NO: 2062245 - protein, 21 aa, Staphylococcus
DLTIYGILQDGSKELVFENGN

SEQ ID NO: 2062246 - protein, 17 aa, Staphylococcus
DLTIYLDISAEIGRQRI

SEQ ID NO: 2062247 - protein, 17 aa, Staphylococcus
DLTKEEIYLIGSHLDKE

SEQ ID NO: 2062248 - protein, 17 aa, Staphylococcus
DLTKYLVSQLMLSNEER

SEQ ID NO: 2062249 - protein, 17 aa, Staphylococcus
DLTLLARNKSKLPDYDS

SEQ ID NO: 2062250 - protein, 24 aa, Staphylococcus
DLTQEHFVVLLLNSKNIVIKEETI

SEQ ID NO: 2062251 - protein, 18 aa, Staphylococcus
DLTTIKGIGLYKAVILKA

SEQ ID NO: 2062252 - protein, 21 aa, Staphylococcus
DLTYKQLVNHLYPLKTKWDIH

SEQ ID NO: 2062253 - protein, 19 aa, Staphylococcus
DLTYSGKFIKDGTWRTEEV

SEQ ID NO: 2062254 - protein, 24 aa, Staphylococcus
DLVCHIIALLRYGGGISYQLIATG

SEQ ID NO: 2062255 - protein, 18 aa, Staphylococcus
DLVDFDWLDGFDIECRNE

SEQ ID NO: 2062256 - protein, 18 aa, Staphylococcus
DLVDFEWIDGFDIECRNE

SEQ ID NO: 2062257 - protein, 18 aa, Staphylococcus
DLVEFDWIEGFDIECRNE

SEQ ID NO: 2062258 - protein, 28 aa, Staphylococcus
DLVGNNTPVFFFRDPKLFASLNHAIKRD

SEQ ID NO: 2062259 - protein, 28 aa, Staphylococcus
DLVGNNTPVFFFRDPKLFASLNHAVKRD

SEQ ID NO: 2062260 - protein, 30 aa, Staphylococcus; identical to SEQ ID NO: 1819056

SEQ ID NO: 2062261 - protein, 28 aa, Staphylococcus
DLVGNNTPVFFFRDSKLFVSLNRAVKRD

SEQ ID NO: 2062262 - protein, 27 aa, Staphylococcus
DLVHSKYLYYFLIDQKTVNYLQNIAES

SEQ ID NO: 2062263 - protein, 23 aa, Staphylococcus
DLVKLQLLVAMGEPLPFTQDDIT

SEQ ID NO: 2062264 - protein, 21 aa, Staphylococcus
DLVLTNALIIDYDKIVKADIG

SEQ ID NO: 2062265 - protein, 17 aa, Staphylococcus
DLVRVINLSLRAKYLFK

SEQ ID NO: 2062266 - protein, 19 aa, Staphylococcus
DLVSLFLLLQMDNINLIGV

SEQ ID NO: 2062267 - protein, 25 aa, Staphylococcus
DLYDDYLYEVSTDSEFLFIKVKGKN

SEQ ID NO: 2062268 - protein, 19 aa, Staphylococcus
DLYDKIFNTYFKNEKPFSQ

SEQ ID NO: 2062269 - protein, 18 aa, Staphylococcus
DLYFNPNSPHKAGLQAEQ

SEQ ID NO: 2062270 - protein, 25 aa, Staphylococcus
DLYGGTFRLFDFYEQQYGIHFKYVD

SEQ ID NO: 2062271 - protein, 24 aa, Staphylococcus
DLYGGTFRLFDFYEQQYGVKFKYV

SEQ ID NO: 2062272 - protein, 24 aa, Staphylococcus
DLYGRVLPYIQYLVVLHYLNYILE

SEQ ID NO: 2062273 - protein, 20 aa, Staphylococcus
DLYIRYGNMTTPMLYEDIRN

SEQ ID NO: 2062274 - protein, 19 aa, Staphylococcus
DLYQLRLHKKRGEGIQLHG

SEQ ID NO: 2062275 - protein, 22 aa, Staphylococcus
DLYSALLIKGVSSQLKYGLQHD

SEQ ID NO: 2062276 - protein, 24 aa, Staphylococcus
DMAGKVCIQLLGKAPRELKIKFSG

SEQ ID NO: 2062277 - protein, 17 aa, Staphylococcus
DMAIHCILHITPSINFD

SEQ ID NO: 2062278 - protein, 26 aa, Staphylococcus
DMAPDEIYTLVAYQLGALSAFSRIHD

SEQ ID NO: 2062279 - protein, 20 aa, Staphylococcus
DMDDIFIPPTKINRAMDGDT

SEQ ID NO: 2062280 - protein, 23 aa, Staphylococcus
DMDFKGEPFEPMPKLLAVSEQVT

SEQ ID NO: 2062281 - protein, 23 aa, Staphylococcus
DMDFRGEPFEPMPKLLAVSEQVT

SEQ ID NO: 2062282 - protein, 24 aa, Staphylococcus
DMDKVFADIFKTWNSDRFFEVIQR

SEQ ID NO: 2062283 - protein, 18 aa, Staphylococcus
DMEFQLIEPINTLFKDEV

SEQ ID NO: 2062284 - protein, 17 aa, Staphylococcus
DMELGQISAVYLNDLAQ

SEQ ID NO: 2062285 - protein, 26 aa, Staphylococcus
DMELIAKRHPVDVCFIPIGDNFTMGI

SEQ ID NO: 2062286 - protein, 26 aa, Staphylococcus
DMETTQWLEDYLNYFKGAIVIISHDR

SEQ ID NO: 2062287 - protein, 17 aa, Staphylococcus
DMEVWMAFRNDIHEYGQ

SEQ ID NO: 2062288 - protein, 19 aa, Staphylococcus
DMEVWMAFRNDIHEYGQST

SEQ ID NO: 2062289 - protein, 28 aa, Staphylococcus
DMFMNGPSTELLRRALNMSYYQGQKQAL

SEQ ID NO: 2062290 - protein, 25 aa, Staphylococcus
DMHITGTYTMPCARTLVPVEVPLDV

SEQ ID NO: 2062291 - protein, 25 aa, Staphylococcus
DMINKRYWECPIGCYEWEDLAEYFG

SEQ ID NO: 2062292 - protein, 26 aa, Staphylococcus
DMKLIADRHPVDVCFIPIGDNFTMGI

SEQ ID NO: 2062293 - protein, 26 aa, Staphylococcus
DMKLIAQRHPVDVCFIPIGDNYTMGI

SEQ ID NO: 2062294 - protein, 18 aa, Staphylococcus
DMKSGLAALAISLIEIKK

SEQ ID NO: 2062295 - protein, 28 aa, Staphylococcus
DMKSQLNEALYNHYTQCNTLSKTGSIKG

SEQ ID NO: 2062296 - protein, 22 aa, Staphylococcus
DMLHQLFKHYKGDDFEKGINVY

SEQ ID NO: 2062297 - protein, 17 aa, Staphylococcus
DMLKNNANHYGVALKTL

SEQ ID NO: 2062298 - protein, 21 aa, Staphylococcus
DMLQQIIFYRELDVSIEEIKN

SEQ ID NO: 2062299 - protein, 17 aa, Staphylococcus
DMLTQDIYFKMMQDFIG

SEQ ID NO: 2062300 - protein, 29 aa, Staphylococcus
DMLTTDNGLTRLIFMVPARGMIGYTTEFM

SEQ ID NO: 2062301 - protein, 25 aa, Staphylococcus
DMLVTDIFNIIYDSPTPLAVTDENN

SEQ ID NO: 2062302 - protein, 25 aa, Staphylococcus
DMLWRTYQGINRLKYVFGLNVKVMP

SEQ ID NO: 2062303 - protein, 17 aa, Staphylococcus
DMMIVKPALSYLDIVRD

SEQ ID NO: 2062304 - protein, 21 aa, Staphylococcus
DMMRVEGIIILVIYHGHDEGK

SEQ ID NO: 2062305 - protein, 18 aa, Staphylococcus
DMNDDCEFIVAIRSMLIK

SEQ ID NO: 2062306 - protein, 19 aa, Staphylococcus
DMNDDCEFIVAIRSMLIKK

SEQ ID NO: 2062307 - protein, 27 aa, Staphylococcus
DMNNPHAHVLLTQRPFNSDGTWGKKTK

SEQ ID NO: 2062308 - protein, 34 aa, Staphylococcus
DMNRPTGLWFGEVVHFADVLYKNGYKVHYISPEG

SEQ ID NO: 2062309 - protein, 22 aa, Staphylococcus
DMPFIEFQADPIYMNQIKEWYG

SEQ ID NO: 2062310 - protein, 17 aa, Staphylococcus
DMPYLRSPCVHHVHPDP

SEQ ID NO: 2062311 - protein, 25 aa, Staphylococcus
DMQIKLPKPFFFEEGKRAVLLLHGF

SEQ ID NO: 2062312 - protein, 28 aa, Staphylococcus
DMQNGKIRIWRLKIFERDNFTCDICKKR

SEQ ID NO: 2062313 - protein, 23 aa, Staphylococcus
DMQQFIYILGEFHKLYPNVTYNL

SEQ ID NO: 2062314 - protein, 22 aa, Staphylococcus
DMRVIQVPNWYLSYYRRFPEKL

SEQ ID NO: 2062315 - protein, 27 aa, Staphylococcus
DMSKEEILILLNLWEKGSMTLKEMDEF

SEQ ID NO: 2062316 - protein, 29 aa, Staphylococcus
DMSRQHHRFLFFINKLPGITIKQLLKTLE

SEQ ID NO: 2062317 - protein, 21 aa, Staphylococcus
DMTPGQIRYFFPNHSELLNAV

SEQ ID NO: 2062318 - protein, 26 aa, Staphylococcus
DMTYEQWNKVINLNLNGVFLVAQAVG

SEQ ID NO: 2062319 - protein, 24 aa, Staphylococcus
DMWIDPIIKKYDEYKWYSVNRDEL

SEQ ID NO: 2062320 - protein, 23 aa, Staphylococcus
DMWIDPIQEKYNDYGWFTVNRDE

SEQ ID NO: 2062321 - protein, 17 aa, Staphylococcus
DMYEPYMSLIKQLFPNA

SEQ ID NO: 2062322 - protein, 20 aa, Staphylococcus
DMYLKYIDIYKDVAVKYLAE

SEQ ID NO: 2062323 - protein, 22 aa, Staphylococcus
DNAFELTIAVLLSAQCTDILVN

SEQ ID NO: 2062324 - protein, 39 aa, Staphylococcus
DNAGYYNIPIMSYGIKYASSFFGPFRDAADSAPSFGDRK

SEQ ID NO: 2062325 - protein, 21 aa, Staphylococcus
DNAKEILLKGLEKLEYRGYDS

SEQ ID NO: 2062326 - protein, 23 aa, Staphylococcus
DNAKELLLKGLEKLEYRGYDSAG

SEQ ID NO: 2062327 - protein, 18 aa, Staphylococcus
DNAKYLKDSLEKLGFNTG

SEQ ID NO: 2062328 - protein, 24 aa, Staphylococcus
DNAQGEYYLPDAVALILHNHGIAE

SEQ ID NO: 2062329 - protein, 27 aa, Staphylococcus
DNAQGEYYLPDVISLILAENGVAEVYH

SEQ ID NO: 2062330 - protein, 18 aa, Staphylococcus
DNARTILDWASKQTYIAL

SEQ ID NO: 2062331 - protein, 17 aa, Staphylococcus
DNASSLVLFIMICTGCR

SEQ ID NO: 2062332 - protein, 25 aa, Staphylococcus
DNATSIYFLITLLQTVTPVVDQQVY

SEQ ID NO: 2062333 - protein, 17 aa, Staphylococcus
DNAYHEPLLILSDLYRN

SEQ ID NO: 2062334 - protein, 22 aa, Staphylococcus
DNAYHEPLLILSDLYRSEEDYE

SEQ ID NO: 2062335 - protein, 25 aa, Staphylococcus
DNCRAQLIDLPFTATAKELGTALMK

SEQ ID NO: 2062336 - protein, 18 aa, Staphylococcus
DNDAYIKKEWLYSGYNNI

SEQ ID NO: 2062337 - protein, 26 aa, Staphylococcus
DNDEYYWLTHSFIRREFLETTHLEPP

SEQ ID NO: 2062338 - protein, 22 aa, Staphylococcus
DNDFEDWYNWLKENEVNILEGR

SEQ ID NO: 2062339 - protein, 25 aa, Staphylococcus
DNDHRILISHLGMAGGFFVVDDLEE

SEQ ID NO: 2062340 - protein, 18 aa, Staphylococcus
DNDILGIPSFLVYKNGKL

SEQ ID NO: 2062341 - protein, 23 aa, Staphylococcus
DNDKPIPTIAFYSRGVISNIEKA

SEQ ID NO: 2062342 - protein, 26 aa, Staphylococcus
DNDKYLWDVVHWLKDGNWKVNCRNKD

SEQ ID NO: 2062343 - protein, 23 aa, Staphylococcus
DNDLELLPVINKIDLPAAEPERV

SEQ ID NO: 2062344 - protein, 17 aa, Staphylococcus
DNDLFFIISLSGEATQL

SEQ ID NO: 2062345 - protein, 25 aa, Staphylococcus
DNDNDKMIWLLENINHSGPTIIYVS

SEQ ID NO: 2062346 - protein, 23 aa, Staphylococcus
DNDQSLLDWARKQTYIALGNMMT

SEQ ID NO: 2062347 - protein, 22 aa, Staphylococcus
DNDRSMFAFGHYTVAMKNARPE

SEQ ID NO: 2062348 - protein, 24 aa, Staphylococcus
DNDSRTHFPLLTKILDAHDQLSVQ

SEQ ID NO: 2062349 - protein, 28 aa, Staphylococcus
DNDTELQNLLLDPYFKDIVTNYQDALRD

SEQ ID NO: 2062350 - protein, 32 aa, Staphylococcus
DNEDTFKVLQLSSLIVATPYRNQGIGKALVQA

SEQ ID NO: 2062351 - protein, 30 aa, Staphylococcus
DNEEKTFYFPYRLIIRFNPTPSLNIEVDLK

SEQ ID NO: 2062352 - protein, 27 aa, Staphylococcus
DNEEKYLRLYAEFENYKRRIQNENKIN

SEQ ID NO: 2062353 - protein, 23 aa, Staphylococcus
DNEHPLYTLLKREKPGLFGSQIK

SEQ ID NO: 2062354 - protein, 19 aa, Staphylococcus
DNEILSKLIQRLSPRDIRI

SEQ ID NO: 2062355 - protein, 27 aa, Staphylococcus
DNELSDYLPLMLQFLHVAQWHDDPRAE

SEQ ID NO: 2062356 - protein, 28 aa, Staphylococcus
DNELSDYLPLMLQFLHVASWHNDPRAEG

SEQ ID NO: 2062357 - protein, 27 aa, Staphylococcus
DNELSDYLPLMLQFLHVASWQNDPRAE

SEQ ID NO: 2062358 - protein, 35 aa, Staphylococcus
DNEQFFATILKYVRLGVLFPLSYYDGEWFENDTVQ

SEQ ID NO: 2062359 - protein, 17 aa, Staphylococcus
DNEVLALKRIRIGDLQL

SEQ ID NO: 2062360 - protein, 25 aa, Staphylococcus
DNEVMGIPSLLIFENGQKQAHLHSA

SEQ ID NO: 2062361 - protein, 25 aa, Staphylococcus
DNEVRIQWRVADIKIPNNEIKNISQ

SEQ ID NO: 2062362 - protein, 26 aa, Staphylococcus
DNFIIYKGVRIINIDDLVLPGEHNLE

SEQ ID NO: 2062363 - protein, 24 aa, Staphylococcus
DNFKRIRIGIGRPTNGMSVPDYVL

SEQ ID NO: 2062364 - protein, 25 aa, Staphylococcus
DNGDSRFYLSLQDELMVRFGSERLQ

SEQ ID NO: 2062365 - protein, 25 aa, Staphylococcus
DNGIIWPKTVTPFDLHLITVNPKKE

SEQ ID NO: 2062366 - protein, 22 aa, Staphylococcus
DNGLIVPFVRDCDKKNFAEIES

SEQ ID NO: 2062367 - protein, 23 aa, Staphylococcus
DNGNYILDVVLNEGINAAGMHEF

SEQ ID NO: 2062368 - protein, 25 aa, Staphylococcus
DNHEKIELFKKLEFKQLLADIDNKA

SEQ ID NO: 2062369 - protein, 18 aa, Staphylococcus
DNHHDITILAIHGGGIEP

SEQ ID NO: 2062370 - protein, 26 aa, Staphylococcus
DNHIKILIPLFKENIFYDSGVKAIKN

SEQ ID NO: 2062371 - protein, 18 aa, Staphylococcus
DNHRDVFSILFKIGKASM

SEQ ID NO: 2062372 - protein, 22 aa, Staphylococcus
DNHSAEWAAFIRALEYARELNV

SEQ ID NO: 2062373 - protein, 27 aa, Staphylococcus
DNHYTDYRLFLDKKQIDYPLMNELINQ

SEQ ID NO: 2062374 - protein, 18 aa, Staphylococcus
DNIAVKCIFFNQPYLKKK

SEQ ID NO: 2062375 - protein, 27 aa, Staphylococcus
DNIAYQYATLRNILYAKGYTTEMLINY

SEQ ID NO: 2062376 - protein, 20 aa, Staphylococcus
DNIDTLLYAIADKLEEVKDI

SEQ ID NO: 2062377 - protein, 24 aa, Staphylococcus
DNIHDIIDSAWRWHNQHPNGYQED

SEQ ID NO: 2062378 - protein, 18 aa, Staphylococcus
DNIKLYQQAFSHSSFIND

SEQ ID NO: 2062379 - protein, 31 aa, Staphylococcus
DNILASQLLTRYLIDLGHKTFLFLAEMGDYE

SEQ ID NO: 2062380 - protein, 23 aa, Staphylococcus
DNILDLVGLLHTYGKKVKDFSFG

SEQ ID NO: 2062381 - protein, 19 aa, Staphylococcus
DNILKYFNISQPTLSHHMK

SEQ ID NO: 2062382 - protein, 17 aa, Staphylococcus
DNILTVFVLAKNEEDVR

SEQ ID NO: 2062383 - protein, 25 aa, Staphylococcus
DNIQKAIAEMKLAVGLLVEKKLSHM

SEQ ID NO: 2062384 - protein, 31 aa, Staphylococcus
DNIRQYGHLLADIYPINPPKRTHLPKLTIED

SEQ ID NO: 2062385 - protein, 17 aa, Staphylococcus
DNIYWERIQLFIEGHVE

SEQ ID NO: 2062386 - protein, 23 aa, Staphylococcus
DNKAELVNFAIKSVDKASQSNLI

SEQ ID NO: 2062387 - protein, 31 aa, Staphylococcus
DNKAQYSFINLLKYMFKSEAYRYLAIGQIEN

SEQ ID NO: 2062388 - protein, 24 aa, Staphylococcus
DNKDKIELFQKLEFKQLLNDIDSS

SEQ ID NO: 2062389 - protein, 22 aa, Staphylococcus
DNKELLHMLLTRDIDVAFMDLS

SEQ ID NO: 2062390 - protein, 23 aa, Staphylococcus
DNKGVEDLYYSLSSTMTVISIDG

SEQ ID NO: 2062391 - protein, 17 aa, Staphylococcus
DNKILRQSDLVVTLCSD

SEQ ID NO: 2062392 - protein, 26 aa, Staphylococcus
DNKKERRLLFWVVMNIIRGQRHYDNH

SEQ ID NO: 2062393 - protein, 28 aa, Staphylococcus
DNKPQMEQLKWKNLTLDISKYQMFYKDT

SEQ ID NO: 2062394 - protein, 27 aa, Staphylococcus
DNKSQISFLNLLKHMFGEHPYRHLATG

SEQ ID NO: 2062395 - protein, 22 aa, Staphylococcus
DNKTLGRFQLTDIPAAPRGVPQ

SEQ ID NO: 2062396 - protein, 21 aa, Staphylococcus
DNKTSFVYDVDFSSFGAPTST

SEQ ID NO: 2062397 - protein, 29 aa, Staphylococcus
DNKVFQGEALLFLLGLTNSMAGFEKLVPD

SEQ ID NO: 2062398 - protein, 23 aa, Staphylococcus
DNKVKVIAWYDNEWGYSNRVVDV

SEQ ID NO: 2062399 - protein, 24 aa, Staphylococcus
DNLAGFLRLNFNDERFGLTDNEHS

SEQ ID NO: 2062400 - protein, 25 aa, Staphylococcus
DNLKLTTQFYPTQSIKFEEATIETS

SEQ ID NO: 2062401 - protein, 24 aa, Staphylococcus
DNLKSLMLEFLRFAGYNTPININK

SEQ ID NO: 2062402 - protein, 25 aa, Staphylococcus
DNLKSRGMILYINRNTRKTNGYFEI

SEQ ID NO: 2062403 - protein, 23 aa, Staphylococcus
DNLKVLLKTFADAIAQRGKVELN

SEQ ID NO: 2062404 - protein, 27 aa, Staphylococcus
DNLLDEDTKFFINPTGRFVIGGPQGDA

SEQ ID NO: 2062405 - protein, 22 aa, Staphylococcus
DNLRNRIIISSRLFAPIHKKDI

SEQ ID NO: 2062406 - protein, 27 aa, Staphylococcus
DNLYDFLIKVMKIYKTPLGSAVIEILI

SEQ ID NO: 2062407 - protein, 19 aa, Staphylococcus
DNMDFYRVILTLERRSKIE

SEQ ID NO: 2062408 - protein, 18 aa, Staphylococcus
DNNHYRLYGIFLLNQLNG

SEQ ID NO: 2062409 - protein, 28 aa, Staphylococcus
DNNIHLMNLKELFLVSLQERAIPFELNG

SEQ ID NO: 2062410 - protein, 21 aa, Staphylococcus
DNNIIYVYADELLHQVSPTIK

SEQ ID NO: 2062411 - protein, 24 aa, Staphylococcus
DNNKGLNYFIAVIKNWIADDVDTK

SEQ ID NO: 2062412 - protein, 28 aa, Staphylococcus
DNNPELENLLLDPYFKNIVTDYQDALRD

SEQ ID NO: 2062413 - protein, 17 aa, Staphylococcus
DNNPLLEKLNFISIFSS

SEQ ID NO: 2062414 - protein, 24 aa, Staphylococcus
DNNPNNYIFVIYKGKRKGMPYTQH

SEQ ID NO: 2062415 - protein, 22 aa, Staphylococcus
DNNPYKLVYDIKGIGFNKADTL

SEQ ID NO: 2062416 - protein, 28 aa, Staphylococcus
DNNSELQNLLLDPYFKNIVTEYQDALRD

SEQ ID NO: 2062417 - protein, 23 aa, Staphylococcus
DNNTLQFLLDLYEDEITKDAYGK

SEQ ID NO: 2062418 - protein, 17 aa, Staphylococcus
DNNYKHIPTIEKAILSG

SEQ ID NO: 2062419 - protein, 24 aa, Staphylococcus
DNNYLFEAVYGAGIARIYKLNKDT

SEQ ID NO: 2062420 - protein, 32 aa, Staphylococcus
DNPDRLEFIIREGLKRFDTLVLTGGLGPTKDD

SEQ ID NO: 2062421 - protein, 22 aa, Staphylococcus
DNPDYGPFINYVNDVFIQEGEL

SEQ ID NO: 2062422 - protein, 24 aa, Staphylococcus
DNPERLEYIIRQGLKRFDMIVLTG

SEQ ID NO: 2062423 - protein, 24 aa, Staphylococcus
DNPFDLTKVWFKDEYPLIEVGEFE

SEQ ID NO: 2062424 - protein, 28 aa, Staphylococcus
DNPFDPPMFARVFRKHLEGGIIKSIRQI

SEQ ID NO: 2062425 - protein, 23 aa, Staphylococcus
DNPFELAIAVLLSAQCTDNLVNK

SEQ ID NO: 2062426 - protein, 24 aa, Staphylococcus
DNPGLLRRPIILDDKRLQVGYNED

SEQ ID NO: 2062427 - protein, 22 aa, Staphylococcus
DNPIYYAQYAHARICSILRQAK

SEQ ID NO: 2062428 - protein, 18 aa, Staphylococcus
DNPKRDWYIWADPKDDGS

SEQ ID NO: 2062429 - protein, 23 aa, Staphylococcus
DNQHALKFYIKNGFKAYSESQKD

SEQ ID NO: 2062430 - protein, 21 aa, Staphylococcus
DNQHPLFRYLTSQAKGMLSEK

SEQ ID NO: 2062431 - protein, 21 aa, Staphylococcus
DNQLCFLLYVSSKEIIKKYTT

SEQ ID NO: 2062432 - protein, 25 aa, Staphylococcus
DNQTVYVKTPWGSLIELQTIPNGYY

SEQ ID NO: 2062433 - protein, 27 aa, Staphylococcus
DNQVKNQLLIIPTWRDWLINSEQLIES

SEQ ID NO: 2062434 - protein, 29 aa, Staphylococcus
DNRIVQALPTIKYIIEQGGKLVLFSHLGK

SEQ ID NO: 2062435 - protein, 25 aa, Staphylococcus
DNRIVQALPTIKYIIEQGGKVVLFS

SEQ ID NO: 2062436 - protein, 29 aa, Staphylococcus
DNRIVQALPTIKYILEQGGKLVLFSHLGK

SEQ ID NO: 2062437 - protein, 18 aa, Staphylococcus
DNRSMFKRMFITFKNHKS

SEQ ID NO: 2062438 - protein, 19 aa, Staphylococcus
DNRYGCLIGIELLELLKNT

SEQ ID NO: 2062439 - protein, 32 aa, Staphylococcus
DNSRSQQLYTTPLFLNVFGMTNLDELPTTEEE

SEQ ID NO: 2062440 - protein, 28 aa, Staphylococcus
DNSSSKAYLWKQLVQRLKTLQLNQKNYI

SEQ ID NO: 2062441 - protein, 24 aa, Staphylococcus
DNTIDYLKTILNKKTTKESTKFDE

SEQ ID NO: 2062442 - protein, 27 aa, Staphylococcus
DNTIEQNSLIAVRYWQTAIREQEDTDI

SEQ ID NO: 2062443 - protein, 23 aa, Staphylococcus
DNTIESVLLINAAWLAGIEAAMI

SEQ ID NO: 2062444 - protein, 36 aa, Staphylococcus
DNTISYAYRGVRYKGCINVFIEKNYLNNIKTEAVYN

SEQ ID NO: 2062445 - protein, 24 aa, Staphylococcus
DNTKLIYIETPSNPLFKITDIRGA

SEQ ID NO: 2062446 - protein, 25 aa, Staphylococcus
DNTNKIELFKKLEFKQLLADIDEEA

SEQ ID NO: 2062447 - protein, 40 aa, Staphylococcus
DNTPEYILKHCESLLTEFGVWHPYAWDYAPIRTDLTPQTS

SEQ ID NO: 2062448 - protein, 23 aa, Staphylococcus
DNTPNLLAVLKEVGVVDSGGKGL

SEQ ID NO: 2062449 - protein, 24 aa, Staphylococcus
DNTPNLLAVLKEVGVVDSGGKGLL

SEQ ID NO: 2062450 - protein, 24 aa, Staphylococcus
DNTPNLLPVLKEVGVVDSGGKGLL

SEQ ID NO: 2062451 - protein, 23 aa, Staphylococcus
DNTPYKVIGISMSHLGLVSRVAQ

SEQ ID NO: 2062452 - protein, 31 aa, Staphylococcus
DNVDATIIRLAIDGLWLSEIFGLDAIDEKTR

SEQ ID NO: 2062453 - protein, 20 aa, Staphylococcus
DNVHLESDVLFKYVENILNQ

SEQ ID NO: 2062454 - protein, 18 aa, Staphylococcus
DNVLRYPANDFVREFIGQ

SEQ ID NO: 2062455 - protein, 24 aa, Staphylococcus
DNVNYFGTMLVYTGKAAGLVSGAA

SEQ ID NO: 2062456 - protein, 17 aa, Staphylococcus
DNVVFLRKWQDLGVRYG

SEQ ID NO: 2062457 - protein, 17 aa, Staphylococcus
DNVYWITYLYEEEIYTR

SEQ ID NO: 2062458 - protein, 20 aa, Staphylococcus
DNWSNLMYQIAQAIVESTSQ

SEQ ID NO: 2062459 - protein, 23 aa, Staphylococcus
DNYIKIWEFYATLADNNYDMVLN

SEQ ID NO: 2062460 - protein, 17 aa, Staphylococcus
DNYKPLNIRYAYNKNMT

SEQ ID NO: 2062461 - protein, 18 aa, Staphylococcus
DPAKIGRFWFSSSSERWE

SEQ ID NO: 2062462 - protein, 18 aa, Staphylococcus
DPATLSVGYFQRLKKEID

SEQ ID NO: 2062463 - protein, 24 aa, Staphylococcus
DPDPLPMELIFKRLDEIPNLRTLS

SEQ ID NO: 2062464 - protein, 24 aa, Staphylococcus
DPDPLPMNLIYQRLDEIPNLRTMS

SEQ ID NO: 2062465 - protein, 30 aa, Staphylococcus
DPDYYKWTQWIFIQLYNKGLAYVDEVAVNW

SEQ ID NO: 2062466 - protein, 20 aa, Staphylococcus
DPEFKQLISYCLLENQSGEI

SEQ ID NO: 2062467 - protein, 20 aa, Staphylococcus
DPEHFTINPEWLIELDKCAN

SEQ ID NO: 2062468 - protein, 20 aa, Staphylococcus
DPEPLPMDIIYRRLDEIPHL

SEQ ID NO: 2062469 - protein, 19 aa, Staphylococcus
DPEVSGVLPICIGSATRVS

SEQ ID NO: 2062470 - protein, 20 aa, Staphylococcus
DPFNVFQPDKLSVTQLEVLN

SEQ ID NO: 2062471 - protein, 22 aa, Staphylococcus
DPFNVVYLVSKGKMYAHVLIKD

SEQ ID NO: 2062472 - protein, 24 aa, Staphylococcus
DPGFWVPNDYVVVKVALRGSAKSK

SEQ ID NO: 2062473 - protein, 24 aa, Staphylococcus
DPGFWVPNDYVVVKVALRGSAKSV

SEQ ID NO: 2062474 - protein, 22 aa, Staphylococcus
DPGFWVPQDYVVVKLALRGSSK

SEQ ID NO: 2062475 - protein, 21 aa, Staphylococcus
DPGVDILSIIYQHGIEIEFPD

SEQ ID NO: 2062476 - protein, 20 aa, Staphylococcus
DPGVYHLYFSRQDENKEMVI

SEQ ID NO: 2062477 - protein, 26 aa, Staphylococcus
DPINNTLITSWFWSHRPEHIEKAGLK

SEQ ID NO: 2062478 - protein, 24 aa, Staphylococcus
DPINNTLITSWFWSHRPKDIESAG

SEQ ID NO: 2062479 - protein, 36 aa, Staphylococcus
DPIYLKYHDEVWGQPLYDSLKLFKLLALESQHAGLS

SEQ ID NO: 2062480 - protein, 18 aa, Staphylococcus
DPIYMNQIKEWYGRNLGR

SEQ ID NO: 2062481 - protein, 22 aa, Staphylococcus
DPKHPYTWGLLSSMPDLTTGTE

SEQ ID NO: 2062482 - protein, 22 aa, Staphylococcus
DPKHPYTWGLLSSMPDLTTSND

SEQ ID NO: 2062483 - protein, 23 aa, Staphylococcus
DPKLRQHVWQQLKDLTRKGQSVV

SEQ ID NO: 2062484 - protein, 20 aa, Staphylococcus
DPKRVIVEHNKTLIKQEDYD

SEQ ID NO: 2062485 - protein, 18 aa, Staphylococcus
DPKTQFIYVMDTFDFYHY

SEQ ID NO: 2062486 - protein, 17 aa, Staphylococcus
DPKVLAPLFEAFDVKPE

SEQ ID NO: 2062487 - protein, 20 aa, Staphylococcus
DPKYLIGRVIARPYVGEPGN

SEQ ID NO: 2062488 - protein, 18 aa, Staphylococcus
DPLLKFDLDYIKENAKSV

SEQ ID NO: 2062489 - protein, 17 aa, Staphylococcus
DPMCLYNSGDYIKFYAI

SEQ ID NO: 2062490 - protein, 20 aa, Staphylococcus
DPMFIALFNRHGSLLPIMHL

SEQ ID NO: 2062491 - protein, 20 aa, Staphylococcus
DPMKFLPEDGSLKLTAGWTG

SEQ ID NO: 2062492 - protein, 20 aa, Staphylococcus
DPMKFLPEDGSLQLTSGWTG

SEQ ID NO: 2062493 - protein, 47 aa, Staphylococcus
DPNGLIYFNGNYYISHQWFPLGPVHGLKYWYTYTSKDLIHFNAVGPT

SEQ ID NO: 2062494 - protein, 39 aa, Staphylococcus
DPNGLIYYDGYYYISHQWFPLGAVHGLKYWFNYKSDDLV

SEQ ID NO: 2062495 - protein, 24 aa, Staphylococcus
DPNGRLSFMIVKKHKVLTLEKVIE

SEQ ID NO: 2062496 - protein, 25 aa, Staphylococcus
DPNKTVHWILKQPLIHFHYPKAIHE

SEQ ID NO: 2062497 - protein, 34 aa, Staphylococcus
DPNNPAFIDSRKPLAAQFKFRGKQVIAIANHWNS

SEQ ID NO: 2062498 - protein, 22 aa, Staphylococcus
DPNQVHLPGIYVDYIFEGENFE

SEQ ID NO: 2062499 - protein, 18 aa, Staphylococcus
DPNVRLPLWDNEEDCRNA

SEQ ID NO: 2062500 - protein, 28 aa, Staphylococcus
DPPDNAVTFYDFLYGRKAPNLEGARFSV

SEQ ID NO: 2062501 - protein, 20 aa, Staphylococcus
DPQFWIGGLKQNGVYKAYDN

SEQ ID NO: 2062502 - protein, 24 aa, Staphylococcus
DPQKIVRWRAAMFIFDEGGEAQLP

SEQ ID NO: 2062503 - protein, 25 aa, Staphylococcus
DPQKIVRWRAAMFLFDEGGPEQLPS

SEQ ID NO: 2062504 - protein, 25 aa, Staphylococcus
DPQKIVRWRAAMFLFEEGGKAQLAS

SEQ ID NO: 2062505 - protein, 17 aa, Staphylococcus
DPRVALLSFSTKGSAKS

SEQ ID NO: 2062506 - protein, 17 aa, Staphylococcus
DPRVAMLSFSTKGSAKS

SEQ ID NO: 2062507 - protein, 18 aa, Staphylococcus
DPRVAMLSFSTKGSAKSD

SEQ ID NO: 2062508 - protein, 18 aa, Staphylococcus
DPSHPEYIVTRRGVGYFL

SEQ ID NO: 2062509 - protein, 24 aa, Staphylococcus
DPSIKKVIFLVDRKDLDSQTLAEF

SEQ ID NO: 2062510 - protein, 24 aa, Staphylococcus
DPTAKYIIDPLKKQLEALEYIGLS

SEQ ID NO: 2062511 - protein, 23 aa, Staphylococcus
DPVVYLEHMKLYRSFREEVPEEE

SEQ ID NO: 2062512 - protein, 22 aa, Staphylococcus
DPVYWKKLFKRYENWINNFNAC

SEQ ID NO: 2062513 - protein, 21 aa, Staphylococcus
DPYHGHVWIMDPIDGTANLVK

SEQ ID NO: 2062514 - protein, 17 aa, Staphylococcus
DPYRGVISSIRIIDGVV

SEQ ID NO: 2062515 - protein, 20 aa, Staphylococcus
DQALERYPDKLIVTQGALGA

SEQ ID NO: 2062516 - protein, 31 aa, Staphylococcus
DQANCLVHPLFIDPYHLIYPSEKYNKKDVMK

SEQ ID NO: 2062517 - protein, 24 aa, Staphylococcus
DQDKSYDLYYDGQKFYQLTTDMFQ

SEQ ID NO: 2062518 - protein, 23 aa, Staphylococcus
DQDQKVLVFDLGGGTFDVSILEL

SEQ ID NO: 2062519 - protein, 19 aa, Staphylococcus
DQDVYDPRKYLGPAREAIK

SEQ ID NO: 2062520 - protein, 22 aa, Staphylococcus
DQDVYDPRKYLGPAREAIKETV

SEQ ID NO: 2062521 - protein, 23 aa, Staphylococcus
DQEAAKNFWIEKLNFVEVSDVSN

SEQ ID NO: 2062522 - protein, 25 aa, Staphylococcus
DQEAATHLPYIYLSAGVSAELFQET

SEQ ID NO: 2062523 - protein, 25 aa, Staphylococcus
DQEFDFDFDILDPTKLWPEDEIPVK

SEQ ID NO: 2062524 - protein, 19 aa, Staphylococcus
DQEKAFVTSGIRLGTPAVT

SEQ ID NO: 2062525 - protein, 26 aa, Staphylococcus
DQENKLFQIIYYPKHKSRRVFNTEKE

SEQ ID NO: 2062526 - protein, 20 aa, Staphylococcus
DQEWIPVHKSWRLNERHYGK

SEQ ID NO: 2062527 - protein, 30 aa, Staphylococcus
DQFDEPLFVKIGMELFYQAGPDLIKSIKSR

SEQ ID NO: 2062528 - protein, 20 aa, Staphylococcus
DQFMRQLFNIKIGFQGGELA

SEQ ID NO: 2062529 - protein, 30 aa, Staphylococcus
DQFNEPLFVKIGMELFYQTGPQLIASIKDR

SEQ ID NO: 2062530 - protein, 21 aa, Staphylococcus
DQFNILNRRLIEKYTTHQLAM

SEQ ID NO: 2062531 - protein, 22 aa, Staphylococcus
DQFNKFLYERDIDGYYLIVQQE

SEQ ID NO: 2062532 - protein, 21 aa, Staphylococcus
DQFNKFLYERDMDGYYLIVQE

SEQ ID NO: 2062533 - protein, 18 aa, Staphylococcus
DQGVLNISLIFKGQTETT

SEQ ID NO: 2062534 - protein, 26 aa, Staphylococcus
DQGWHDLKIVPYGPIEISPAAQGIHY

SEQ ID NO: 2062535 - protein, 29 aa, Staphylococcus
DQHDIKVTAWMPLMRGRGLFEDPVIEKLA

SEQ ID NO: 2062536 - protein, 19 aa, Staphylococcus
DQHIKGFKALGAKIDESSP

SEQ ID NO: 2062537 - protein, 26 aa, Staphylococcus
DQHILIQLLILLEKAKYYYFMDIAHL

SEQ ID NO: 2062538 - protein, 24 aa, Staphylococcus
DQHVREYIVLKLQSKPNRLHQVSK

SEQ ID NO: 2062539 - protein, 31 aa, Staphylococcus
DQIHTGRYYIQRFLARSFGFDVDDIKNMSEV

SEQ ID NO: 2062540 - protein, 32 aa, Staphylococcus
DQIHTGRYYIQRFLARSFGFDVDDIKVMSEVK

SEQ ID NO: 2062541 - protein, 22 aa, Staphylococcus
DQIIPMIDYFKDKQIEIRFIEF

SEQ ID NO: 2062542 - protein, 29 aa, Staphylococcus
DQILTYSTIYDLPILADPLSQLRKNNHPN

SEQ ID NO: 2062543 - protein, 33 aa, Staphylococcus
DQIPRLNVLDLQRLIRVIPKPVIAMVRGYAIGG

SEQ ID NO: 2062544 - protein, 32 aa, Staphylococcus
DQIPRLNVLDLQRLIRVIPKPVVAMVKGYAIG

SEQ ID NO: 2062545 - protein, 27 aa, Staphylococcus
DQIPRLNVLDLQRLIRVIPKPVVAMVR

SEQ ID NO: 2062546 - protein, 26 aa, Staphylococcus
DQKKMYKFFLLVASYIKRREAFYKAT

SEQ ID NO: 2062547 - protein, 21 aa, Staphylococcus
DQKLKLFMYQERQKQTQAQAE

SEQ ID NO: 2062548 - protein, 22 aa, Staphylococcus
DQKVIDWLWETQDKTFFDSKED

SEQ ID NO: 2062549 - protein, 21 aa, Staphylococcus
DQKVIDWLWETQDKTFFDSKQ

SEQ ID NO: 2062550 - protein, 17 aa, Staphylococcus
DQLDERFFRCHNSFVVN

SEQ ID NO: 2062551 - protein, 24 aa, Staphylococcus
DQLDTEDLIPLFDSSLEDYRNFID

SEQ ID NO: 2062552 - protein, 18 aa, Staphylococcus
DQLEDWNYAIKFAKSIDS

SEQ ID NO: 2062553 - protein, 25 aa, Staphylococcus
DQLEQPIKLEPMSTFPVIRDLQVDR

SEQ ID NO: 2062554 - protein, 20 aa, Staphylococcus
DQLETILYRVLSGRSTRSSL

SEQ ID NO: 2062555 - protein, 24 aa, Staphylococcus
DQLKEVVIAYEPIWAIGTGKSSTS

SEQ ID NO: 2062556 - protein, 27 aa, Staphylococcus
DQLVAKAIEPILPQLNRVIEQTITRFR

SEQ ID NO: 2062557 - protein, 26 aa, Staphylococcus
DQMAEFERMILLRSIDTHWTDHIDTM

SEQ ID NO: 2062558 - protein, 23 aa, Staphylococcus
DQMDGKLFGIPMGIKDNIITEGV

SEQ ID NO: 2062559 - protein, 23 aa, Staphylococcus
DQMDGKLFGIPMGIKDNIITKDV

SEQ ID NO: 2062560 - protein, 23 aa, Staphylococcus
DQMEGKLFGIPMGIKDNIITEGL

SEQ ID NO: 2062561 - protein, 23 aa, Staphylococcus
DQMEGKLFGIPMGIKDNIITEGV

SEQ ID NO: 2062562 - protein, 23 aa, Staphylococcus
DQMEGKLFGIPMGIKDNIITKDL

SEQ ID NO: 2062563 - protein, 20 aa, Staphylococcus
DQMKSQIPLGRFGEDTDIAN

SEQ ID NO: 2062564 - protein, 26 aa, Staphylococcus
DQMMRMLHPFMPFVTEEIWQSLPHEG

SEQ ID NO: 2062565 - protein, 26 aa, Staphylococcus
DQMNEFERMILLRSIDSHWTDHIDTM

SEQ ID NO: 2062566 - protein, 26 aa, Staphylococcus
DQMPEFERMILLRSIDTHWTDHIDTM

SEQ ID NO: 2062567 - protein, 26 aa, Staphylococcus
DQMSEFERMILLRSIDSHWTDHIDTM

SEQ ID NO: 2062568 - protein, 23 aa, Staphylococcus
DQNDPIPEMYYLDVASPGAERPL

SEQ ID NO: 2062569 - protein, 22 aa, Staphylococcus
DQNMLRKAMIQLIEFHDDLKVI

SEQ ID NO: 2062570 - protein, 21 aa, Staphylococcus
DQPYDAWFNIVQTFSKRESND

SEQ ID NO: 2062571 - protein, 24 aa, Staphylococcus
DQQQKIIYIIQHLSYRNGQNNHVD

SEQ ID NO: 2062572 - protein, 25 aa, Staphylococcus
DQQTHFVTELYVETIKFMSSKGKTH

SEQ ID NO: 2062573 - protein, 22 aa, Staphylococcus
DQRIFKSAMFYWSDKNNQRINN

SEQ ID NO: 2062574 - protein, 27 aa, Staphylococcus
DQSIQKLEFYLYHIELLKQKQAINLND

SEQ ID NO: 2062575 - protein, 22 aa, Staphylococcus
DQSKTYYLYCQAGKRSQQASQM

SEQ ID NO: 2062576 - protein, 23 aa, Staphylococcus
DQSRRKVAQLLGAKPHEVIFTSG

SEQ ID NO: 2062577 - protein, 27 aa, Staphylococcus
DQSVFHLHFHFLPRYKDDIDGFGYKWI

SEQ ID NO: 2062578 - protein, 27 aa, Staphylococcus
DQSVFHLHFHFLPRYKDDIDGFGYQWE

SEQ ID NO: 2062579 - protein, 26 aa, Staphylococcus
DQSVFHLHFHLLPRYKDDVDGFGYHW

SEQ ID NO: 2062580 - protein, 23 aa, Staphylococcus
DQTALNLRPFLEEKGHELVVLKN

SEQ ID NO: 2062581 - protein, 25 aa, Staphylococcus
DQTRGWFYSLLVISTILKGKSSYKR

SEQ ID NO: 2062582 - protein, 24 aa, Staphylococcus
DQTTAILTGNFLLALGLEQLSEVN

SEQ ID NO: 2062583 - protein, 27 aa, Staphylococcus
DQTTAILTGNFLLALGLQHLSEIKDAR

SEQ ID NO: 2062584 - protein, 25 aa, Staphylococcus
DQTVNFNHLIDKLGLIDLSDIRVKG

SEQ ID NO: 2062585 - protein, 29 aa, Staphylococcus
DQVAYPNLMFHFLPIAVRYDGQKAPVAHG

SEQ ID NO: 2062586 - protein, 22 aa, Staphylococcus
DQVHQRLYLEQTLLVERIKTYF

SEQ ID NO: 2062587 - protein, 22 aa, Staphylococcus
DQVIIDYLVSEFKKENGVDLSQ

SEQ ID NO: 2062588 - protein, 24 aa, Staphylococcus
DQVKRISLELGGNAPVIVLNDADL

SEQ ID NO: 2062589 - protein, 24 aa, Staphylococcus
DQVNWVGFYLIEDNELILGPFQGH

SEQ ID NO: 2062590 - protein, 17 aa, Staphylococcus
DQYCKHEFVLSGTKQKQ

SEQ ID NO: 2062591 - protein, 26 aa, Staphylococcus
DQYGYVPQYNFIFSHKPIIEIENVMR

SEQ ID NO: 2062592 - protein, 27 aa, Staphylococcus
DQYLNRSLMLVTALNPHIGYEKAASIA

SEQ ID NO: 2062593 - protein, 19 aa, Staphylococcus
DQYMLRKAMVQLIEFNDQM

SEQ ID NO: 2062594 - protein, 21 aa, Staphylococcus
DRAGDQIVLPVDCKVAKEFSN

SEQ ID NO: 2062595 - protein, 21 aa, Staphylococcus
DRANQLFRWGVDGIFTDVAQH

SEQ ID NO: 2062596 - protein, 26 aa, Staphylococcus
DRAPYAICLMLALEQHGIPFVYLDSK

SEQ ID NO: 2062597 - protein, 28 aa, Staphylococcus
DRARLKDIIDLFLDSGLGKEAFSIISQG

SEQ ID NO: 2062598 - protein, 28 aa, Staphylococcus
DRARLKDIIELFLDSGLGKEAFSIISQG

SEQ ID NO: 2062599 - protein, 24 aa, Staphylococcus
DRAYYIKPYFTNQIFKIQLNEQLL

SEQ ID NO: 2062600 - protein, 23 aa, Staphylococcus
DRDEALILFPFAGGGANIYRHWS

SEQ ID NO: 2062601 - protein, 25 aa, Staphylococcus
DRDFVIHTPLMWLDKAQTWELADDL

SEQ ID NO: 2062602 - protein, 17 aa, Staphylococcus
DREGEAIAWHLSKILEL

SEQ ID NO: 2062603 - protein, 18 aa, Staphylococcus
DRELAHDTIYLALRSRQG

SEQ ID NO: 2062604 - protein, 22 aa, Staphylococcus
DRETLEILFGYDGKLDESFLKQ

SEQ ID NO: 2062605 - protein, 24 aa, Staphylococcus
DRFGVHLRLEYYKESELKDIIIRT

SEQ ID NO: 2062606 - protein, 29 aa, Staphylococcus
DRFPKLQQLGLKWYAVPIISSMDLKIGGI

SEQ ID NO: 2062607 - protein, 23 aa, Staphylococcus
DRGALILVENGIEPVFSVGDFDS

SEQ ID NO: 2062608 - protein, 25 aa, Staphylococcus
DRGESRFYLSLQDELMVRFGSERLQ

SEQ ID NO: 2062609 - protein, 17 aa, Staphylococcus
DRGFRETSFKYFSDALR

SEQ ID NO: 2062610 - protein, 19 aa, Staphylococcus
DRHEPLTLLAALAPVTKNI

SEQ ID NO: 2062611 - protein, 25 aa, Staphylococcus
DRHKSIFEDLNSIAPTVLVKSFDAD

SEQ ID NO: 2062612 - protein, 23 aa, Staphylococcus
DRHLPPHIFSKLSTESWGGIDRG

SEQ ID NO: 2062613 - protein, 18 aa, Staphylococcus
DRHPVDVCFVPIGDNFTM

SEQ ID NO: 2062614 - protein, 24 aa, Staphylococcus
DRHVKLRMFICWGAQFALNYRYGI

SEQ ID NO: 2062615 - protein, 22 aa, Staphylococcus
DRIAIFLDRGIKNIALMIALAK

SEQ ID NO: 2062616 - protein, 22 aa, Staphylococcus
DRIAVMHFGKIVELGPADDIYN

SEQ ID NO: 2062617 - protein, 19 aa, Staphylococcus
DRIAVMYFGKIVELGPSEE

SEQ ID NO: 2062618 - protein, 20 aa, Staphylococcus
DRIDFRKLVKHLAQNLKTRI

SEQ ID NO: 2062619 - protein, 20 aa, Staphylococcus
DRIHQPFQSIATFIDFPITK

SEQ ID NO: 2062620 - protein, 35 aa, Staphylococcus
DRIIKPLSYLYENNLRRKGLLKAAALLLKYDDMND

SEQ ID NO: 2062621 - protein, 22 aa, Staphylococcus
DRIKEVVPIWKKEIWEDGAEWI

SEQ ID NO: 2062622 - protein, 17 aa, Staphylococcus
DRILIPQNKWDEKPKKN

SEQ ID NO: 2062623 - protein, 28 aa, Staphylococcus
DRIMRMLHPFMPFVTEKIWQSLPHEGET

SEQ ID NO: 2062624 - protein, 19 aa, Staphylococcus
DRIPHEIIQLLKQNLTKAE

SEQ ID NO: 2062625 - protein, 19 aa, Staphylococcus
DRIQLAKPVLTLTQLDKIK

SEQ ID NO: 2062626 - protein, 19 aa, Staphylococcus
DRIRRLLKLYLERESFEIH

SEQ ID NO: 2062627 - protein, 27 aa, Staphylococcus
DRKEGIHYKNLLGSYLHGPVLPKNHEM

SEQ ID NO: 2062628 - protein, 28 aa, Staphylococcus
DRKEGIHYKNLLGTYLHGPILPKNHEVT

SEQ ID NO: 2062629 - protein, 24 aa, Staphylococcus
DRKEIPFDELVLFSSARSAGQTIE

SEQ ID NO: 2062630 - protein, 24 aa, Staphylococcus
DRKGIPFDELVLFSSARSAGKKID

SEQ ID NO: 2062631 - protein, 23 aa, Staphylococcus
DRKGIVFDELVLFSSARSAGEQI

SEQ ID NO: 2062632 - protein, 23 aa, Staphylococcus
DRKKFDALLAERSLNYQDFCDNI

SEQ ID NO: 2062633 - protein, 24 aa, Staphylococcus
DRKNIPFDELVLFSSARSAGKEVE

SEQ ID NO: 2062634 - protein, 25 aa, Staphylococcus
DRKNIPFDELVLFSSPRSAGTKVEF

SEQ ID NO: 2062635 - protein, 19 aa, Staphylococcus
DRLEGYNSLQWPVAEDGTD

SEQ ID NO: 2062636 - protein, 19 aa, Staphylococcus
DRLEKRIYDLQLSRQIAIQ

SEQ ID NO: 2062637 - protein, 19 aa, Staphylococcus
DRLIAFLKEAAERYGFDLS

SEQ ID NO: 2062638 - protein, 24 aa, Staphylococcus
DRLICDWLKIVDDILPRLIQEMHT

SEQ ID NO: 2062639 - protein, 19 aa, Staphylococcus
DRLIGFVELDHLYSSALKE

SEQ ID NO: 2062640 - protein, 22 aa, Staphylococcus
DRMPYHGLKPEFYALAAGTKSD

SEQ ID NO: 2062641 - protein, 26 aa, Staphylococcus
DRMTAIFPKLVFSIKKGTNFSPDDPN

SEQ ID NO: 2062642 - protein, 17 aa, Staphylococcus
DRNDQIIYVGKAKKLRN

SEQ ID NO: 2062643 - protein, 24 aa, Staphylococcus
DRNFNIEFIAKLEGAHLEYEKQSD

SEQ ID NO: 2062644 - protein, 20 aa, Staphylococcus
DRNIILMTHVVTHPQFVVPT

SEQ ID NO: 2062645 - protein, 20 aa, Staphylococcus
DRNYNIEFITKLEGAHLDYE

SEQ ID NO: 2062646 - protein, 24 aa, Staphylococcus
DRPRARCWMIKASKMKWIFKFEIA

SEQ ID NO: 2062647 - protein, 25 aa, Staphylococcus
DRQLVKVAAWYDNEMSYTAQLVRTL

SEQ ID NO: 2062648 - protein, 22 aa, Staphylococcus
DRSNHYILIDPLVSPQPETYAS

SEQ ID NO: 2062649 - protein, 33 aa, Staphylococcus
DRTLDIIKRHRLLELFLIEILQYNWEEVHQEAE

SEQ ID NO: 2062650 - protein, 23 aa, Staphylococcus
DRVHFDFETLYQLLSNHFVSSEI

SEQ ID NO: 2062651 - protein, 34 aa, Staphylococcus
DRVKLALLASFKNKSLLKFFSHETEWLRGKELDN

SEQ ID NO: 2062652 - protein, 25 aa, Staphylococcus
DRVKLAMMASFKNKTLLKFYNNETG

SEQ ID NO: 2062653 - protein, 17 aa, Staphylococcus
DRVLIIDDFLANGDASL

SEQ ID NO: 2062654 - protein, 19 aa, Staphylococcus
DRVVVLVNPTLQLIKKIIN

SEQ ID NO: 2062655 - protein, 28 aa, Staphylococcus
DRVYGNHLWSGYPTGIIYSRPGAMMASP

SEQ ID NO: 2062656 - protein, 21 aa, Staphylococcus
DRVYRSLGILQNSRIISMEEA

SEQ ID NO: 2062657 - protein, 19 aa, Staphylococcus
DRYEAMKEFPMFDNIEYTE

SEQ ID NO: 2062658 - protein, 18 aa, Staphylococcus
DRYEAMRNFPMFDNIEYT

SEQ ID NO: 2062659 - protein, 17 aa, Staphylococcus
DRYFLNEVSSRIIELDR

SEQ ID NO: 2062660 - protein, 46 aa, Staphylococcus
DRYRVMIVHPWQYKHVIAKFFESWVSENWLLPTPLTIEAKATESFK

SEQ ID NO: 2062661 - protein, 23 aa, Staphylococcus
DSARLQYLISREFDVAPASVNAS

SEQ ID NO: 2062662 - protein, 17 aa, Staphylococcus
DSAYLIDLLENFVVERG

SEQ ID NO: 2062663 - protein, 17 aa, Staphylococcus
DSCFLFKARFKTMQDVE

SEQ ID NO: 2062664 - protein, 24 aa, Staphylococcus
DSCKKIKYMFPKAHAAAYVLMAMR

SEQ ID NO: 2062665 - protein, 19 aa, Staphylococcus
DSCPVAVKALLKQAGYNDD

SEQ ID NO: 2062666 - protein, 36 aa, Staphylococcus
DSDNFSFAYLLDDGSSYSYLIFVQETWSMLHNNRDK

SEQ ID NO: 2062667 - protein, 25 aa, Staphylococcus
DSDNKMLQRIYGTAFFDKKDLKAHL

SEQ ID NO: 2062668 - protein, 23 aa, Staphylococcus
DSDSIFYYYQALIQLRKQYEIIV

SEQ ID NO: 2062669 - protein, 35 aa, Staphylococcus
DSEAQAWHKFLSGLPYIKVLDSYIFVHAGIDVRVP

SEQ ID NO: 2062670 - protein, 22 aa, Staphylococcus
DSEDFLDLLNNLADKKGLVVNV

SEQ ID NO: 2062671 - protein, 26 aa, Staphylococcus
DSEEAVLQMDLLGHDFFIFNDRETDG

SEQ ID NO: 2062672 - protein, 26 aa, Staphylococcus
DSEEAVLQMDLLGHDFFIFTDRETDG

SEQ ID NO: 2062673 - protein, 26 aa, Staphylococcus
DSEEAVLQMDLLGHDFYIFTDRETDG

SEQ ID NO: 2062674 - protein, 26 aa, Staphylococcus
DSEEAVLQMELLGHDFYIFTDRETDG

SEQ ID NO: 2062675 - protein, 26 aa, Staphylococcus
DSEEAVLQMNLLGHDFFIFTDRETDG

SEQ ID NO: 2062676 - protein, 27 aa, Staphylococcus
DSEEAVLQMNLLGHDFFIFTDRETDGT

SEQ ID NO: 2062677 - protein, 32 aa, Staphylococcus
DSEIKRPLRKGAKPFNVMMTPSDKRRMQRANK

SEQ ID NO: 2062678 - protein, 25 aa, Staphylococcus
DSEIPEHFIHFINLATPRPIVYTED

SEQ ID NO: 2062679 - protein, 20 aa, Staphylococcus
DSELILVGLANTLLISEAEK

SEQ ID NO: 2062680 - protein, 24 aa, Staphylococcus
DSEMYRYLYLLSEKEDIFIEPSAA

SEQ ID NO: 2062681 - protein, 22 aa, Staphylococcus
DSEVYDPRKYLGPAREAIKATV

SEQ ID NO: 2062682 - protein, 18 aa, Staphylococcus
DSEWMAWYLKQMAEMQAK

SEQ ID NO: 2062683 - protein, 24 aa, Staphylococcus
DSEYQLGLLISRKKYWYKSPNFEE

SEQ ID NO: 2062684 - protein, 24 aa, Staphylococcus
DSFEYNVELQFIKEKEKEIDSYKE

SEQ ID NO: 2062685 - protein, 30 aa, Staphylococcus
DSFSTLYEWAINKRNFFSTTFMSLYNSFIN

SEQ ID NO: 2062686 - protein, 25 aa, Staphylococcus
DSFVNPFMKEVWKYDIDVAKAAAKA

SEQ ID NO: 2062687 - protein, 19 aa, Staphylococcus
DSGFYPLGSCTMKYNPKIN

SEQ ID NO: 2062688 - protein, 17 aa, Staphylococcus
DSGGAERLLGYGDMLYL

SEQ ID NO: 2062689 - protein, 18 aa, Staphylococcus
DSGRGYRRVVPSPMPINI

SEQ ID NO: 2062690 - protein, 24 aa, Staphylococcus
DSGYAVFNGLRRVIQFIEKFHFTE

SEQ ID NO: 2062691 - protein, 20 aa, Staphylococcus
DSHDYAHCPNFVKGHIPELY

SEQ ID NO: 2062692 - protein, 25 aa, Staphylococcus
DSHLYHVTQLLLDYVYHTQKRDLSH

SEQ ID NO: 2062693 - protein, 26 aa, Staphylococcus
DSHNEWVNMLGVVPVIRALRDKAMDI

SEQ ID NO: 2062694 - protein, 24 aa, Staphylococcus
DSHNTFNLIKLFQQRIKQGQTIIM

SEQ ID NO: 2062695 - protein, 17 aa, Staphylococcus
DSHYRLYGIFLLNQLNG

SEQ ID NO: 2062696 - protein, 30 aa, Staphylococcus
DSIEIPISLLPYLFFKFADHGKRLYEDSGV

SEQ ID NO: 2062697 - protein, 31 aa, Staphylococcus
DSIEVPLDLLPYLFFQFAKYGKRLYDDNSVD

SEQ ID NO: 2062698 - protein, 17 aa, Staphylococcus
DSIFYRVEHPNDILEWV

SEQ ID NO: 2062699 - protein, 18 aa, Staphylococcus
DSIGLILGFLVERFMQDK

SEQ ID NO: 2062700 - protein, 18 aa, Staphylococcus
DSIGLILGYLVERFTEGK

SEQ ID NO: 2062701 - protein, 41 aa, Staphylococcus
DSIGMALDKYLYMSIKEIKGYAWEFLYYSPELETLPKDESN

SEQ ID NO: 2062702 - protein, 21 aa, Staphylococcus
DSIGYPFIVKTRFGGYDGKGQ

SEQ ID NO: 2062703 - protein, 29 aa, Staphylococcus
DSIHLDELFILGLIYLYPNAYNMAQLKYV

SEQ ID NO: 2062704 - protein, 20 aa, Staphylococcus
DSIHVANFYFTITDSGMTGP

SEQ ID NO: 2062705 - protein, 24 aa, Staphylococcus
DSIKKLNLELGGNAPVLVTQHADL

SEQ ID NO: 2062706 - protein, 20 aa, Staphylococcus
DSIMRRGLVSYNMDGLLISH

SEQ ID NO: 2062707 - protein, 18 aa, Staphylococcus
DSIPVNFLHPIQGTKFGS

SEQ ID NO: 2062708 - protein, 22 aa, Staphylococcus
DSITFDYLFAAIGGGGLISGIS

SEQ ID NO: 2062709 - protein, 24 aa, Staphylococcus
DSITPSFYYDFKGSLSICDVGAGA

SEQ ID NO: 2062710 - protein, 19 aa, Staphylococcus
DSITPSFYYDFNQPLTICD

SEQ ID NO: 2062711 - protein, 22 aa, Staphylococcus
DSIYKYPTHQTFFSSSDKLSIG

SEQ ID NO: 2062712 - protein, 24 aa, Staphylococcus
DSKDKYFFTILDNVQQKPLGILAL

SEQ ID NO: 2062713 - protein, 20 aa, Staphylococcus
DSKIQSLYWQHGEYANQIEP

SEQ ID NO: 2062714 - protein, 32 aa, Staphylococcus
DSKKPVILYGHMSPFMVVGMIAGIKAGCGYVP

SEQ ID NO: 2062715 - protein, 23 aa, Staphylococcus
DSKLKQLYKYAHKLGLEVLVEVH

SEQ ID NO: 2062716 - protein, 17 aa, Staphylococcus
DSKLRKLELKSYQIDFV

SEQ ID NO: 2062717 - protein, 18 aa, Staphylococcus
DSKNILPIRLDGATKEFF

SEQ ID NO: 2062718 - protein, 23 aa, Staphylococcus
DSKPDWEIFQLIANKLGADWDYS

SEQ ID NO: 2062719 - protein, 22 aa, Staphylococcus
DSKPDWEIFQLIAQRMGADWNY

SEQ ID NO: 2062720 - protein, 32 aa, Staphylococcus
DSKPDWVIFQMIAKEFGFDWNYNYPGDIMDEI

SEQ ID NO: 2062721 - protein, 21 aa, Staphylococcus
DSKQLLVMLHGFISDSTTYDS

SEQ ID NO: 2062722 - protein, 24 aa, Staphylococcus
DSKSSGFDWFKRKSNKKDVYEDEP

SEQ ID NO: 2062723 - protein, 19 aa, Staphylococcus
DSKSYITPFQLNEPMNGHI

SEQ ID NO: 2062724 - protein, 17 aa, Staphylococcus
DSKWKIGVIPSFSLTNK

SEQ ID NO: 2062725 - protein, 24 aa, Staphylococcus
DSKWNDGYLNRNFIFTNHKGNPMQ

SEQ ID NO: 2062726 - protein, 29 aa, Staphylococcus
DSKYPFKELPFYEIGWRLIPEVWGNGLAT

SEQ ID NO: 2062727 - protein, 23 aa, Staphylococcus
DSLHAYFKPEILNRMDDIVLFKP

SEQ ID NO: 2062728 - protein, 17 aa, Staphylococcus
DSLIERVMYYLNHSTNK

SEQ ID NO: 2062729 - protein, 17 aa, Staphylococcus
DSLIKVVKAVKWNIIRD

SEQ ID NO: 2062730 - protein, 22 aa, Staphylococcus
DSLKMLISYPGYSGYDIQKWFE

SEQ ID NO: 2062731 - protein, 20 aa, Staphylococcus
DSLKVFPGLVAYVGQTYEEA

SEQ ID NO: 2062732 - protein, 27 aa, Staphylococcus
DSLLYPNYVVSPYYDSLVAKVIVKGSD

SEQ ID NO: 2062733 - protein, 17 aa, Staphylococcus
DSLPLVVFTGQVATPGI

SEQ ID NO: 2062734 - protein, 20 aa, Staphylococcus
DSLPLVVFTGQVATPGIGKD

SEQ ID NO: 2062735 - protein, 20 aa, Staphylococcus
DSLPTLIDKAIDNDIKLIAC

SEQ ID NO: 2062736 - protein, 17 aa, Staphylococcus
DSLVELDYYRHGGILQL

SEQ ID NO: 2062737 - protein, 26 aa, Staphylococcus
DSMQNYKPIFWENPNFRKPASLTFTL

SEQ ID NO: 2062738 - protein, 18 aa, Staphylococcus
DSMSLFHNLLSQSSRTYK

SEQ ID NO: 2062739 - protein, 23 aa, Staphylococcus
DSMTLLHSLLNQYRDTYKTLTCV

SEQ ID NO: 2062740 - protein, 29 aa, Staphylococcus
DSNIDYTLLHLTWLYDDPSNTSYELVPTP

SEQ ID NO: 2062741 - protein, 22 aa, Staphylococcus
DSNWQYPPFQLTEKEGWLYGRG

SEQ ID NO: 2062742 - protein, 27 aa, Staphylococcus
DSNWTYPPFELTQLDDWLYGRGVSDMK

SEQ ID NO: 2062743 - protein, 24 aa, Staphylococcus
DSPEFVNESPFEKAWMVKVELDDE

SEQ ID NO: 2062744 - protein, 23 aa, Staphylococcus
DSPEFVNESPYEKAWMVKVEISD

SEQ ID NO: 2062745 - protein, 24 aa, Staphylococcus
DSPEFVNESPYEKAWMVKVEISDQ

SEQ ID NO: 2062746 - protein, 25 aa, Staphylococcus
DSPEFVNESPYEKAWMVKVELNDES

SEQ ID NO: 2062747 - protein, 25 aa, Staphylococcus
DSPEFVNESPYEKAWMVKVKLNDES

SEQ ID NO: 2062748 - protein, 21 aa, Staphylococcus
DSPFYGIFVGAKLAARMALLN

SEQ ID NO: 2062749 - protein, 24 aa, Staphylococcus
DSPYRDYYFFRPSEDGPPTNWESK

SEQ ID NO: 2062750 - protein, 26 aa, Staphylococcus
DSQWQSAYQYLRTLIFNETELEEQYK

SEQ ID NO: 2062751 - protein, 30 aa, Staphylococcus
DSQYPLLNQLIILPALLHKTTLTYEGIKQG

SEQ ID NO: 2062752 - protein, 26 aa, Staphylococcus
DSRAIKKDMLFIPFKGENVDGHRFVE

SEQ ID NO: 2062753 - protein, 27 aa, Staphylococcus
DSRAIKTNMLFIPFKGENVDGHCFVSQ

SEQ ID NO: 2062754 - protein, 27 aa, Staphylococcus
DSRAVQPQMLFIPFKGEHVDGHRFVKQ

SEQ ID NO: 2062755 - protein, 26 aa, Staphylococcus
DSRKIEKDMLFIPFKGENVDGHRFVA

SEQ ID NO: 2062756 - protein, 19 aa, Staphylococcus
DSRLYMEELAKEKGMTIVH

SEQ ID NO: 2062757 - protein, 27 aa, Staphylococcus
DSRRQAILTELFGYTLENVAINSPFDT

SEQ ID NO: 2062758 - protein, 25 aa, Staphylococcus
DSRSHQLYTTELFLNVFGIEHLDDL

SEQ ID NO: 2062759 - protein, 23 aa, Staphylococcus
DSRTWITREPAIVYFHSEFWFNV

SEQ ID NO: 2062760 - protein, 20 aa, Staphylococcus
DSRYPLVEKISISTLVQGIN

SEQ ID NO: 2062761 - protein, 17 aa, Staphylococcus
DSRYVLNELGREPLKLQ

SEQ ID NO: 2062762 - protein, 23 aa, Staphylococcus
DSSDRYLLYLYDWRVIESESSID

SEQ ID NO: 2062763 - protein, 21 aa, Staphylococcus
DSSFTLEDFLDQLDQVKNLGP

SEQ ID NO: 2062764 - protein, 22 aa, Staphylococcus
DSSKWQTPPFKLTEDSEGHLHG

SEQ ID NO: 2062765 - protein, 24 aa, Staphylococcus
DSSLKKILRKLVVANLITSNASKD

SEQ ID NO: 2062766 - protein, 22 aa, Staphylococcus
DSSPIIQTWKNAYREIAQVFID

SEQ ID NO: 2062767 - protein, 24 aa, Staphylococcus
DSTAKIDIFKKLEFKQLLDQVDVE

SEQ ID NO: 2062768 - protein, 19 aa, Staphylococcus
DSTDYLYGKAPNAYIKEVF

SEQ ID NO: 2062769 - protein, 20 aa, Staphylococcus
DSTFKQLISYCLLENEKGEI

SEQ ID NO: 2062770 - protein, 31 aa, Staphylococcus
DSTGHIINLYLPFVDVETMLTLLDLSNIYVS

SEQ ID NO: 2062771 - protein, 33 aa, Staphylococcus
DSTGIMNLDFQPKKLVIVGGGYIALEFASMFAN

SEQ ID NO: 2062772 - protein, 23 aa, Staphylococcus
DSTGYFIEPTIFSGLKSADRIMQ

SEQ ID NO: 2062773 - protein, 18 aa, Staphylococcus
DSTGYFIHPTIISGLTSS

SEQ ID NO: 2062774 - protein, 24 aa, Staphylococcus
DSTKGNYYLLTKFGKQTYSDFDFS

SEQ ID NO: 2062775 - protein, 26 aa, Staphylococcus
DSTKIIIVTTFKRPGYFEKAVANDVD

SEQ ID NO: 2062776 - protein, 23 aa, Staphylococcus
DSTQAIQVFKIGEGGLGGELHLY

SEQ ID NO: 2062777 - protein, 24 aa, Staphylococcus
DSTYPYISFIPLNDEVSLSLEGFK

SEQ ID NO: 2062778 - protein, 29 aa, Staphylococcus
DSVFSIIETPSELPYLLAHGERFLTQTVE

SEQ ID NO: 2062779 - protein, 30 aa, Staphylococcus
DSVFTPMKLRERVWRRLATDLKSDKLHDIK

SEQ ID NO: 2062780 - protein, 18 aa, Staphylococcus
DSVILLEQIRTLDKNRLK

SEQ ID NO: 2062781 - protein, 32 aa, Staphylococcus
DSVLLSTKFKLPKWMFKPFKNHSLKKHREISY

SEQ ID NO: 2062782 - protein, 24 aa, Staphylococcus
DSVMPGFDFYFIPSILNSNDVTYH

SEQ ID NO: 2062783 - protein, 29 aa, Staphylococcus
DSVMTPMKLRQRVWRRLATDLKSNKLHEI

SEQ ID NO: 2062784 - protein, 23 aa, Staphylococcus
DSVTSKWFDFYSTEMRPLIEVFD

SEQ ID NO: 2062785 - protein, 25 aa, Staphylococcus
DSYDFPRVWLDKNSYDFSFSGLKSA

SEQ ID NO: 2062786 - protein, 17 aa, Staphylococcus
DSYIFVHAGIDVRVPID

SEQ ID NO: 2062787 - protein, 26 aa, Staphylococcus
DSYKDLFSYFIKGIRMSNPESEILLN

SEQ ID NO: 2062788 - protein, 19 aa, Staphylococcus
DSYSQLLEFAYPSDKTEVY

SEQ ID NO: 2062789 - protein, 17 aa, Staphylococcus
DSYSQMLEFAYPTDKTE

SEQ ID NO: 2062790 - protein, 17 aa, Staphylococcus
DTAKLRYTQAEKALIEK

SEQ ID NO: 2062791 - protein, 24 aa, Staphylococcus
DTAKNFINIILKNMLQHISDNITF

SEQ ID NO: 2062792 - protein, 24 aa, Staphylococcus
DTALNQLAFFIRQNCHSWDLDEPV

SEQ ID NO: 2062793 - protein, 23 aa, Staphylococcus
DTAPAFFEGTPGYEEQMFGEQQS

SEQ ID NO: 2062794 - protein, 23 aa, Staphylococcus
DTAPAFFEGTPGYEEQMFGMQQS

SEQ ID NO: 2062795 - protein, 20 aa, Staphylococcus
DTAPAFFQGTPGYEEQMFGE

SEQ ID NO: 2062796 - protein, 25 aa, Staphylococcus
DTAYKAVMKPVEGTILTVAKDAAKG

SEQ ID NO: 2062797 - protein, 22 aa, Staphylococcus
DTAYKAVMKPVEGTILTVARES

SEQ ID NO: 2062798 - protein, 24 aa, Staphylococcus
DTDADIRILRRLIRDTKERGRSME

SEQ ID NO: 2062799 - protein, 18 aa, Staphylococcus
DTDRGLLVPVVKNADRKS

SEQ ID NO: 2062800 - protein, 23 aa, Staphylococcus
DTDRGLLVPVVKNADRKSMFAIS

SEQ ID NO: 2062801 - protein, 23 aa, Staphylococcus
DTDRSLKIFPGLVTYVGKTHEEA

SEQ ID NO: 2062802 - protein, 22 aa, Staphylococcus
DTDTIIAILPLNIDGFNIISWS

SEQ ID NO: 2062803 - protein, 17 aa, Staphylococcus
DTDTLIEVTDRLYQRIE

SEQ ID NO: 2062804 - protein, 20 aa, Staphylococcus
DTDYILLDEPLNNLDMKHSV

SEQ ID NO: 2062805 - protein, 23 aa, Staphylococcus
DTEDFLLNDLPYKSVKKWDKAEK

SEQ ID NO: 2062806 - protein, 26 aa, Staphylococcus
DTEKHWPADLILLAIGFIGTENTVPN

SEQ ID NO: 2062807 - protein, 21 aa, Staphylococcus
DTELFISWIDKGEGLIANDVD

SEQ ID NO: 2062808 - protein, 23 aa, Staphylococcus
DTELIAIPGTPPDLLHPPKGDAF

SEQ ID NO: 2062809 - protein, 23 aa, Staphylococcus
DTERGLLVPVVKNADRKSIFQIS

SEQ ID NO: 2062810 - protein, 25 aa, Staphylococcus
DTERYCLYRKFYPNSQVVKFEDFFT

SEQ ID NO: 2062811 - protein, 26 aa, Staphylococcus
DTEVNIVWSPPWGKDMMSRYAKIALG

SEQ ID NO: 2062812 - protein, 20 aa, Staphylococcus
DTEYILLDEPLNNLDMKHSV

SEQ ID NO: 2062813 - protein, 20 aa, Staphylococcus
DTEYILLDEPLNNLDMKYSV

SEQ ID NO: 2062814 - protein, 22 aa, Staphylococcus
DTFARVHKAIPSKLILLGDGPE

SEQ ID NO: 2062815 - protein, 24 aa, Staphylococcus
DTFDWLQALLKRKYPDINFEYTYI

SEQ ID NO: 2062816 - protein, 23 aa, Staphylococcus
DTFDWLQPLLKRKFPHHHFEFTY

SEQ ID NO: 2062817 - protein, 18 aa, Staphylococcus
DTFEILRKRFRGTYGKMK

SEQ ID NO: 2062818 - protein, 27 aa, Staphylococcus
DTFETNIFGMFFLSQAAVPYLSDNDTI

SEQ ID NO: 2062819 - protein, 23 aa, Staphylococcus
DTFPFELLKERITQIILPEAQKI

SEQ ID NO: 2062820 - protein, 28 aa, Staphylococcus
DTGACLSPLNAFLLLQGLETLSLRMERH

SEQ ID NO: 2062821 - protein, 20 aa, Staphylococcus
DTGFYPLGSCTMKYNPKVNE

SEQ ID NO: 2062822 - protein, 22 aa, Staphylococcus
DTGFYRFRIQGIFARWPNNPNI

SEQ ID NO: 2062823 - protein, 25 aa, Staphylococcus
DTGRNYLKYLKNKFPERQFITNINK

SEQ ID NO: 2062824 - protein, 17 aa, Staphylococcus
DTGVDPLPLMKEAVEIA

SEQ ID NO: 2062825 - protein, 24 aa, Staphylococcus
DTHILFVAATAPFTPFYRALDWVV

SEQ ID NO: 2062826 - protein, 32 aa, Staphylococcus
DTHMMHVTISYPLPDNRLLTQLFTALDEGSVN

SEQ ID NO: 2062827 - protein, 30 aa, Staphylococcus
DTHMMHVTISYPLPDNRLLTQLFTELEEGS

SEQ ID NO: 2062828 - protein, 20 aa, Staphylococcus
DTHYLLGSALGPDPFPTIVR

SEQ ID NO: 2062829 - protein, 21 aa, Staphylococcus
DTHYLLGSALGPDPFPTIVRD

SEQ ID NO: 2062830 - protein, 27 aa, Staphylococcus
DTIENRPMMYLALSYDHRIIDGKEAVG

SEQ ID NO: 2062831 - protein, 28 aa, Staphylococcus
DTIENRPMMYLALSYDHRIIDGKEAVGF

SEQ ID NO: 2062832 - protein, 18 aa, Staphylococcus
DTIKDDEVLVRMLNRLNI

SEQ ID NO: 2062833 - protein, 17 aa, Staphylococcus
DTIKDIVAENPDLIIVG

SEQ ID NO: 2062834 - protein, 23 aa, Staphylococcus
DTIKIGGTVLSGFGPRIVRINNF

SEQ ID NO: 2062835 - protein, 18 aa, Staphylococcus
DTIKYGLDKGFNLTLHAG

SEQ ID NO: 2062836 - protein, 22 aa, Staphylococcus
DTIMYKIHLMKECLKRDVKLIS

SEQ ID NO: 2062837 - protein, 23 aa, Staphylococcus
DTINVSYIMDLVRKIDLTDKAEQ

SEQ ID NO: 2062838 - protein, 25 aa, Staphylococcus
DTIQRGGTFLFSARCPEFKEEEVRK

SEQ ID NO: 2062839 - protein, 25 aa, Staphylococcus
DTIQRGGTFLFSARCPQFKEEDVRK

SEQ ID NO: 2062840 - protein, 22 aa, Staphylococcus
DTKAIIVYTLVKPEMRKYMEAE

SEQ ID NO: 2062841 - protein, 28 aa, Staphylococcus
DTKDLIRLRYWECPIGCYEWEDIANYFG

SEQ ID NO: 2062842 - protein, 42 aa, Staphylococcus
DTKKDAIIYACDLILKGELDGHFPLVVWQTGSGTQSNMNVNE

SEQ ID NO: 2062843 - protein, 17 aa, Staphylococcus
DTKKYLFKYVSIDEVKN

SEQ ID NO: 2062844 - protein, 26 aa, Staphylococcus
DTKTTDLLIRLYEKVLNGLDYQNKKK

SEQ ID NO: 2062845 - protein, 30 aa, Staphylococcus
DTLEPLFDDALPYYDNFIYEVSLFLEQESV

SEQ ID NO: 2062846 - protein, 20 aa, Staphylococcus
DTLEPVYKEIIRLIYREEIP

SEQ ID NO: 2062847 - protein, 23 aa, Staphylococcus
DTLERVIPYWNDAIAPELLTGKT

SEQ ID NO: 2062848 - protein, 23 aa, Staphylococcus
DTLFLLGETLYNYGLTPQGLEVF

SEQ ID NO: 2062849 - protein, 17 aa, Staphylococcus
DTLKIVEALKQAGIKLV

SEQ ID NO: 2062850 - protein, 22 aa, Staphylococcus
DTLKPPGILYDSIGWTKSVEKI

SEQ ID NO: 2062851 - protein, 21 aa, Staphylococcus
DTLKQLYYLSKNLKYDLHDII

SEQ ID NO: 2062852 - protein, 19 aa, Staphylococcus
DTLKYRILNGQKLLKKDFT

SEQ ID NO: 2062853 - protein, 28 aa, Staphylococcus
DTLLKYIKPKIHYYLPPHYGIARLQTTQ

SEQ ID NO: 2062854 - protein, 17 aa, Staphylococcus
DTLLNIKSTGRMVGIIS

SEQ ID NO: 2062855 - protein, 21 aa, Staphylococcus
DTLNRAPYSSIYFLLTHDNIS

SEQ ID NO: 2062856 - protein, 23 aa, Staphylococcus
DTLSQNFLYRQGYNSKFINKKYL

SEQ ID NO: 2062857 - protein, 20 aa, Staphylococcus
DTLSVKFLTSDIASLHGMTV

SEQ ID NO: 2062858 - protein, 18 aa, Staphylococcus
DTLVKLKTSGRMVGIISH

SEQ ID NO: 2062859 - protein, 17 aa, Staphylococcus
DTLVNLKSTGRMVGIIS

SEQ ID NO: 2062860 - protein, 31 aa, Staphylococcus
DTLVYKMFHDPSIELRYFENGYIKTKVGYIH

SEQ ID NO: 2062861 - protein, 27 aa, Staphylococcus
DTMKRARTIFLFGYGASLVIVTDLFQK

SEQ ID NO: 2062862 - protein, 17 aa, Staphylococcus
DTMRKRLNIKSPGRLPA

SEQ ID NO: 2062863 - protein, 22 aa, Staphylococcus
DTNAIIVYTLVKPEIKKYMLAK

SEQ ID NO: 2062864 - protein, 26 aa, Staphylococcus
DTNKAQYTLIKLLANKFKNLCVVGDS

SEQ ID NO: 2062865 - protein, 26 aa, Staphylococcus
DTNRAQYTLVQLLAKKFKNLCVVGDS

SEQ ID NO: 2062866 - protein, 23 aa, Staphylococcus
DTNYHATLLLQVHDELIFELPKS

SEQ ID NO: 2062867 - protein, 21 aa, Staphylococcus
DTPIIMIGPGTGVAPFRACMQ

SEQ ID NO: 2062868 - protein, 26 aa, Staphylococcus
DTPKHLDTDLFFRNIKKLDDAKIDAV

SEQ ID NO: 2062869 - protein, 17 aa, Staphylococcus
DTPLGYLANYILNDCEF

SEQ ID NO: 2062870 - protein, 22 aa, Staphylococcus
DTPVTMLMHLSKPIKTIKEWSK

SEQ ID NO: 2062871 - protein, 21 aa, Staphylococcus
DTQERYPKKSAYWYKALAESK

SEQ ID NO: 2062872 - protein, 23 aa, Staphylococcus
DTQISVVWYNNLDSRSFKSFSQP

SEQ ID NO: 2062873 - protein, 24 aa, Staphylococcus
DTQKQLYYLSKNLKYDLYNILFEM

SEQ ID NO: 2062874 - protein, 26 aa, Staphylococcus
DTQTQQYYFHLFSKKQPDLNWHNPEV

SEQ ID NO: 2062875 - protein, 19 aa, Staphylococcus
DTRFLSEEFAHEIAAILAE

SEQ ID NO: 2062876 - protein, 17 aa, Staphylococcus
DTRFYYHQLNEITQLED

SEQ ID NO: 2062877 - protein, 19 aa, Staphylococcus
DTRILKLTDAIPNDTISVR

SEQ ID NO: 2062878 - protein, 31 aa, Staphylococcus
DTRLLVNDFAYKYNIPWIYGGVVQSTYIEAA

SEQ ID NO: 2062879 - protein, 17 aa, Staphylococcus
DTRLNDGLTYLLSALTY

SEQ ID NO: 2062880 - protein, 32 aa, Staphylococcus
DTRYIDGKRTILFGPFAGFSPKFLKTGSNMDL

SEQ ID NO: 2062881 - protein, 25 aa, Staphylococcus
DTSELIGYFCLKIVIIKFEINVSKN

SEQ ID NO: 2062882 - protein, 23 aa, Staphylococcus
DTSFFTTLFQEALDYRQYFFNID

SEQ ID NO: 2062883 - protein, 21 aa, Staphylococcus
DTSLPGMQILIDFTSESAQRT

SEQ ID NO: 2062884 - protein, 23 aa, Staphylococcus
DTTDRVFLFSPFYTKEVAQDIQQ

SEQ ID NO: 2062885 - protein, 31 aa, Staphylococcus
DTTGHILNLYFPFIDVETMLTLLDLANISVS

SEQ ID NO: 2062886 - protein, 26 aa, Staphylococcus
DTTIDDILYTFYLSKFDNKFVKNLTI

SEQ ID NO: 2062887 - protein, 25 aa, Staphylococcus
DTTKHFIEILADVDVKLMLVSGTGR

SEQ ID NO: 2062888 - protein, 19 aa, Staphylococcus
DTTPKRFIREFRNVNVDEY

SEQ ID NO: 2062889 - protein, 25 aa, Staphylococcus
DTTQSLIHLPFDYIFFTGSERVGRI

SEQ ID NO: 2062890 - protein, 27 aa, Staphylococcus
DTTTAIGRLFVTLVGAMAEWERETIRE

SEQ ID NO: 2062891 - protein, 26 aa, Staphylococcus
DTTTEPMVLPARFPNLLINGSTGISA

SEQ ID NO: 2062892 - protein, 18 aa, Staphylococcus
DTTTLVLAPLVAAVGVPV

SEQ ID NO: 2062893 - protein, 23 aa, Staphylococcus
DTVDIWNGFIDKGIVPCGLGARD

SEQ ID NO: 2062894 - protein, 30 aa, Staphylococcus
DTVHEYFNGLYIITPFQRIDYSLELAAYSK

SEQ ID NO: 2062895 - protein, 25 aa, Staphylococcus
DTVLFVSPVYWYSVSASMKAFIDHW

SEQ ID NO: 2062896 - protein, 32 aa, Staphylococcus
DTVLSLSFQAYLTKFKQALIELFELAETPQAV

SEQ ID NO: 2062897 - protein, 25 aa, Staphylococcus
DTVQKNIIFIIKHLSYRNGRNNDVT

SEQ ID NO: 2062898 - protein, 21 aa, Staphylococcus
DTVVIPTTSIPKGIAALFQYD

SEQ ID NO: 2062899 - protein, 19 aa, Staphylococcus
DTVVLNEFRFHVADALINQ

SEQ ID NO: 2062900 - protein, 23 aa, Staphylococcus
DTVYRNLHLFKDLGIIESTELEG

SEQ ID NO: 2062901 - protein, 18 aa, Staphylococcus
DTWVAFAPNKRGYKMLPH

SEQ ID NO: 2062902 - protein, 26 aa, Staphylococcus
DTYGDWIVIGYTPVKLFDPSKEDFTL

SEQ ID NO: 2062903 - protein, 17 aa, Staphylococcus
DTYLEENYWYTAEPASD

SEQ ID NO: 2062904 - protein, 18 aa, Staphylococcus
DTYLTKFPGIGKKTARQI

SEQ ID NO: 2062905 - protein, 19 aa, Staphylococcus
DTYLTKFPGIGKKTARQIV

SEQ ID NO: 2062906 - protein, 31 aa, Staphylococcus
DTYNDWLVIGYTPLKLFFPNQEDFTLFKLGD

SEQ ID NO: 2062907 - protein, 31 aa, Staphylococcus
DTYNDWLVIGYTPLQLFYPDQADFTLIKLGD

SEQ ID NO: 2062908 - protein, 25 aa, Staphylococcus
DTYNDWLVIGYTPTQLFFPNKDDFS

SEQ ID NO: 2062909 - protein, 19 aa, Staphylococcus
DTYNYILNIAKVGMTEREL

SEQ ID NO: 2062910 - protein, 24 aa, Staphylococcus
DTYQFPRVWLEKESYDFSFSGLKS

SEQ ID NO: 2062911 - protein, 24 aa, Staphylococcus
DTYRFGHYLVVIHPTIPKQQLPLL

SEQ ID NO: 2062912 - protein, 25 aa, Staphylococcus
DVAEGETFTFDKVLFVGGDSVKVGA

SEQ ID NO: 2062913 - protein, 33 aa, Staphylococcus
DVAIDFSNPNLLFPLLEEEFQLPLVIATTGEKE

SEQ ID NO: 2062914 - protein, 18 aa, Staphylococcus
DVAILDIEIPGMTGLEIL

SEQ ID NO: 2062915 - protein, 23 aa, Staphylococcus
DVAITIAYLIKHYNQRVLCIDTD

SEQ ID NO: 2062916 - protein, 26 aa, Staphylococcus
DVALKEDVDFMLIVGDLFDSENRTLR

SEQ ID NO: 2062917 - protein, 24 aa, Staphylococcus
DVARMILHIIDQLDGIPFTERAIK

SEQ ID NO: 2062918 - protein, 21 aa, Staphylococcus
DVARMILHTIDQLNGIFFTEK

SEQ ID NO: 2062919 - protein, 17 aa, Staphylococcus
DVCFIPIGDNFTMGIDD

SEQ ID NO: 2062920 - protein, 18 aa, Staphylococcus
DVCFIPIGDNFTMGIDDA

SEQ ID NO: 2062921 - protein, 17 aa, Staphylococcus
DVCFIPIGDNFTMGIED

SEQ ID NO: 2062922 - protein, 23 aa, Staphylococcus
DVDDDLYITNRPSDNFPDVKYST

SEQ ID NO: 2062923 - protein, 24 aa, Staphylococcus
DVDELFDMFIFKNERLKSKMKAAF

SEQ ID NO: 2062924 - protein, 29 aa, Staphylococcus
DVDFKAEPPWFKISPTHFVKSWLLDERAP

SEQ ID NO: 2062925 - protein, 24 aa, Staphylococcus
DVDIDDLFDMFIFKNERLKDKMKQ

SEQ ID NO: 2062926 - protein, 25 aa, Staphylococcus
DVDKFNAFFAWYNSGAKLLTKPNQQ

SEQ ID NO: 2062927 - protein, 20 aa, Staphylococcus
DVDMFVPHQANIRIMESARE

SEQ ID NO: 2062928 - protein, 24 aa, Staphylococcus
DVDPLNDVLILVESLTLVDVDALN

SEQ ID NO: 2062929 - protein, 17 aa, Staphylococcus
DVDRKIIIVSAPGKRHS

SEQ ID NO: 2062930 - protein, 20 aa, Staphylococcus
DVDRLLVVTFTNLSAREMKH

SEQ ID NO: 2062931 - protein, 18 aa, Staphylococcus
DVDYIAASFVRRPSDVLD

SEQ ID NO: 2062932 - protein, 29 aa, Staphylococcus
DVDYPNLMFHFLPIAVRYDGTKAPAAHGY

SEQ ID NO: 2062933 - protein, 18 aa, Staphylococcus
DVEDATTEFLLAQSKKIK

SEQ ID NO: 2062934 - protein, 28 aa, Staphylococcus
DVEDLRYQFLQKYWNTLPQKGNINIYFR

SEQ ID NO: 2062935 - protein, 23 aa, Staphylococcus
DVEGPFPRMTYNEAMSRYGSDKP

SEQ ID NO: 2062936 - protein, 24 aa, Staphylococcus
DVEGPFYYQSINDSIFYRVEHPND

SEQ ID NO: 2062937 - protein, 26 aa, Staphylococcus
DVEGVFVQIGLLPNTEWLEGAIDTND

SEQ ID NO: 2062938 - protein, 25 aa, Staphylococcus
DVEHPLLKMPNVVIVPHIGSASEYT

SEQ ID NO: 2062939 - protein, 20 aa, Staphylococcus
DVEIYRDGYIYEQKFNKGGL

SEQ ID NO: 2062940 - protein, 24 aa, Staphylococcus
DVEKHQFLINKILTRYADVTTVEA

SEQ ID NO: 2062941 - protein, 24 aa, Staphylococcus
DVEKNHHYLWRFAKKMPKSGHIEI

SEQ ID NO: 2062942 - protein, 24 aa, Staphylococcus
DVELKHHYLWRFAKDMPRSGHIEL

SEQ ID NO: 2062943 - protein, 22 aa, Staphylococcus
DVELKHHYLWRFAKEMPRTGHI

SEQ ID NO: 2062944 - protein, 21 aa, Staphylococcus
DVEMLQDLVLAATNEAMNKAD

SEQ ID NO: 2062945 - protein, 21 aa, Staphylococcus
DVEMREHFWTMIGKLKKENVS

SEQ ID NO: 2062946 - protein, 25 aa, Staphylococcus
DVEPTSIISILVAAADALSAARPGA

SEQ ID NO: 2062947 - protein, 18 aa, Staphylococcus
DVETLLEFGSPKAIIPKK

SEQ ID NO: 2062948 - protein, 22 aa, Staphylococcus
DVETLYMMTSTNYSFISSSVVK

SEQ ID NO: 2062949 - protein, 19 aa, Staphylococcus
DVEVFLLSRVFSYVNHTNI

SEQ ID NO: 2062950 - protein, 17 aa, Staphylococcus
DVEVHLLARVFSLINHK

SEQ ID NO: 2062951 - protein, 17 aa, Staphylococcus
DVFIPGSLVDYIYVAGD

SEQ ID NO: 2062952 - protein, 24 aa, Staphylococcus
DVFKKLLAHPTIASKRYLYEQYDQ

SEQ ID NO: 2062953 - protein, 24 aa, Staphylococcus
DVFKKLLKHPTIASKHYLYEQYDQ

SEQ ID NO: 2062954 - protein, 17 aa, Staphylococcus
DVFLGFDCASSEFYENG

SEQ ID NO: 2062955 - protein, 21 aa, Staphylococcus
DVFNPSTYPPLSYTFDHIIIK

SEQ ID NO: 2062956 - protein, 37 aa, Staphylococcus
DVFSENLRHLLLQPPMRGKQILGIDPAFRTGCKLAVI

SEQ ID NO: 2062957 - protein, 29 aa, Staphylococcus
DVFSENLRNLLLQPPMKGKQILGVDPAFR

SEQ ID NO: 2062958 - protein, 24 aa, Staphylococcus
DVFSKLLKHPTIASKRYLYEQYDQ

SEQ ID NO: 2062959 - protein, 29 aa, Staphylococcus
DVGQHQMWAAQFYPFKSHSQWVTSGGLGT

SEQ ID NO: 2062960 - protein, 26 aa, Staphylococcus
DVGQHQMWVAQFYPFKNHGQLVTSGG

SEQ ID NO: 2062961 - protein, 24 aa, Staphylococcus
DVHALCHYILLLYNTKDKAYPNYL

SEQ ID NO: 2062962 - protein, 17 aa, Staphylococcus
DVHLGIATSLEEGLMVP

SEQ ID NO: 2062963 - protein, 31 aa, Staphylococcus
DVHNVCVVVTRYFGGIKLGGGGLIRAYSGAV

SEQ ID NO: 2062964 - protein, 18 aa, Staphylococcus
DVHQPDLAIVFGRTKRRV

SEQ ID NO: 2062965 - protein, 19 aa, Staphylococcus
DVHRYHYVFDFDSTRILKD

SEQ ID NO: 2062966 - protein, 24 aa, Staphylococcus
DVIGKTVILPIVGRELPILADEYV

SEQ ID NO: 2062967 - protein, 31 aa, Staphylococcus
DVIHAPQFDYVFPYMLQFIANLPVVAHNAAF

SEQ ID NO: 2062968 - protein, 18 aa, Staphylococcus
DVIMVLLPDEIQGNVYKN

SEQ ID NO: 2062969 - protein, 18 aa, Staphylococcus
DVIMVLLPDEIQGQVYKE

SEQ ID NO: 2062970 - protein, 23 aa, Staphylococcus
DVINKLNFYVSLGGPVTFKNAKQ

SEQ ID NO: 2062971 - protein, 24 aa, Staphylococcus
DVINNYPFPNTFKVLRVSGADIKA

SEQ ID NO: 2062972 - protein, 24 aa, Staphylococcus
DVIQQMGFKPLIAKDLKTIDHTIY

SEQ ID NO: 2062973 - protein, 20 aa, Staphylococcus
DVIRLIPGLENVEIVRYGVM

SEQ ID NO: 2062974 - protein, 26 aa, Staphylococcus
DVIVEPFYEWVIEKDAWFGPELDHIK

SEQ ID NO: 2062975 - protein, 18 aa, Staphylococcus
DVIVFNLSSGISGSYQSA

SEQ ID NO: 2062976 - protein, 17 aa, Staphylococcus
DVKEAYDIFDQKKIILL

SEQ ID NO: 2062977 - protein, 30 aa, Staphylococcus
DVKELMDFLYIRHAFFIGQELGASIAADFA

SEQ ID NO: 2062978 - protein, 26 aa, Staphylococcus
DVKERPFLMLYYKDMLKQICQSWFIV

SEQ ID NO: 2062979 - protein, 23 aa, Staphylococcus
DVKKFKYKDFENEIELDFTEGNS

SEQ ID NO: 2062980 - protein, 23 aa, Staphylococcus
DVKKRFESYGWNHILVKDGNDLD

SEQ ID NO: 2062981 - protein, 24 aa, Staphylococcus
DVKKRFESYGWNHILVKDGNNLNQ

SEQ ID NO: 2062982 - protein, 18 aa, Staphylococcus
DVKLIFYSAKHLSSLEGI

SEQ ID NO: 2062983 - protein, 17 aa, Staphylococcus
DVKLNDYLTFYQKEMNF

SEQ ID NO: 2062984 - protein, 26 aa, Staphylococcus
DVKLRLKGYPAIIFQHEIDHLNGIMF

SEQ ID NO: 2062985 - protein, 27 aa, Staphylococcus
DVKTDMPYVVLYTFNQPKNWKSDANIY

SEQ ID NO: 2062986 - protein, 17 aa, Staphylococcus
DVLALVESLTLVDVLVD

SEQ ID NO: 2062987 - protein, 20 aa, Staphylococcus
DVLFLNLHGKPLSRQGIWKL

SEQ ID NO: 2062988 - protein, 18 aa, Staphylococcus
DVLKAIELPIDAIGFIHF

SEQ ID NO: 2062989 - protein, 17 aa, Staphylococcus
DVLLLTATPINNSLLDF

SEQ ID NO: 2062990 - protein, 27 aa, Staphylococcus
DVLNKERHLAALSFLTFVALDDNGKPV

SEQ ID NO: 2062991 - protein, 26 aa, Staphylococcus
DVLNKERHLAALSFLTFVALDENGKP

SEQ ID NO: 2062992 - protein, 18 aa, Staphylococcus
DVLNYIEEIIKMTHIQLI

SEQ ID NO: 2062993 - protein, 20 aa, Staphylococcus
DVLPEYEKFLNDFKKRSKGE

SEQ ID NO: 2062994 - protein, 19 aa, Staphylococcus
DVLPNYEKFLKEFKKKSKN

SEQ ID NO: 2062995 - protein, 23 aa, Staphylococcus
DVLRKQREIIYGERNSIIDSDES

SEQ ID NO: 2062996 - protein, 28 aa, Staphylococcus
DVLTEKFHLDILPLTYVNSTAAIKKFVG

SEQ ID NO: 2062997 - protein, 17 aa, Staphylococcus
DVLVCTVVGFPLGASTT

SEQ ID NO: 2062998 - protein, 17 aa, Staphylococcus
DVLVKPEIRMPKVGGRV

SEQ ID NO: 2062999 - protein, 21 aa, Staphylococcus
DVLYHLFVLLNACGVSISEVK

SEQ ID NO: 2063000 - protein, 18 aa, Staphylococcus
DVLYSIVPVNYFTYRHMS

SEQ ID NO: 2063001 - protein, 25 aa, Staphylococcus
DVMAHLTMEFFTKGLVPITSLSFGY

SEQ ID NO: 2063002 - protein, 26 aa, Staphylococcus
DVMAHLTMEFFTKGLVPITSLSFGYE

SEQ ID NO: 2063003 - protein, 26 aa, Staphylococcus
DVMAHLTMEFFTKGLVPITSLSFGYS

SEQ ID NO: 2063004 - protein, 26 aa, Staphylococcus
DVMAHLTMEFFTKGLVPITSLSLGYD

SEQ ID NO: 2063005 - protein, 18 aa, Staphylococcus
DVMGIPSILVFKNGEKLA

SEQ ID NO: 2063006 - protein, 17 aa, Staphylococcus
DVMGIPSLLIFKNGEKL

SEQ ID NO: 2063007 - protein, 18 aa, Staphylococcus
DVMGIPSLLVFKNGEKLA

SEQ ID NO: 2063008 - protein, 25 aa, Staphylococcus
DVMISGLGFITIGPGAKVVVHVPKS

SEQ ID NO: 2063009 - protein, 22 aa, Staphylococcus
DVMKPYAVAKHFSDLYIENSNL

SEQ ID NO: 2063010 - protein, 21 aa, Staphylococcus
DVMRRWFMTSNRSNKSIDLIP

SEQ ID NO: 2063011 - protein, 22 aa, Staphylococcus
DVNDWWACVQEAYQFLKKEGYE

SEQ ID NO: 2063012 - protein, 23 aa, Staphylococcus
DVNEALPGFIFLDTKQDYPNYND

SEQ ID NO: 2063013 - protein, 17 aa, Staphylococcus
DVNGTVIGFFTPELFHG

SEQ ID NO: 2063014 - protein, 23 aa, Staphylococcus
DVNHNNWLLSDRDELFLIDWEGA

SEQ ID NO: 2063015 - protein, 30 aa, Staphylococcus
DVNIKGVLYGIGAVLPYMRKQKSGHIINLA

SEQ ID NO: 2063016 - protein, 22 aa, Staphylococcus
DVNLDPILGREKGKYRPCVVLS

SEQ ID NO: 2063017 - protein, 23 aa, Staphylococcus
DVNRGTFYLHYEDKYMLLSDMED

SEQ ID NO: 2063018 - protein, 26 aa, Staphylococcus
DVNSDAILNFLYKNTDLQISYNFNMV

SEQ ID NO: 2063019 - protein, 18 aa, Staphylococcus
DVNYLANFKPQSGETLYL

SEQ ID NO: 2063020 - protein, 21 aa, Staphylococcus
DVPAFAICHGPQILIDTDDLK

SEQ ID NO: 2063021 - protein, 25 aa, Staphylococcus
DVPDVDIILTIPPYELKTEDSRNVL

SEQ ID NO: 2063022 - protein, 19 aa, Staphylococcus
DVPFCIYSKTAICTGHGEK

SEQ ID NO: 2063023 - protein, 24 aa, Staphylococcus
DVPKALRILKDFLKPEGIFCFQES

SEQ ID NO: 2063024 - protein, 18 aa, Staphylococcus
DVPKQRHNLYKEKDEFHI

SEQ ID NO: 2063025 - protein, 18 aa, Staphylococcus
DVPKSLEIRYYESFAKTH

SEQ ID NO: 2063026 - protein, 19 aa, Staphylococcus
DVPLTANQFKYFASVLTTD

SEQ ID NO: 2063027 - protein, 17 aa, Staphylococcus
DVPLVKAIAASSAFQGA

SEQ ID NO: 2063028 - protein, 26 aa, Staphylococcus
DVPRGLPVIPEAYTPKLKRVNRKPII

SEQ ID NO: 2063029 - protein, 27 aa, Staphylococcus
DVPSEYFMVKFLWDQLLEQPQGDVVYS

SEQ ID NO: 2063030 - protein, 22 aa, Staphylococcus
DVPTFAICHGPLLLVDTDDLKG

SEQ ID NO: 2063031 - protein, 21 aa, Staphylococcus
DVPTFAICHGPQVLIDTDDLN

SEQ ID NO: 2063032 - protein, 18 aa, Staphylococcus
DVPVYYYGFSNKDDVYAD

SEQ ID NO: 2063033 - protein, 21 aa, Staphylococcus
DVQELWDHRKKFKEIAAEQGT

SEQ ID NO: 2063034 - protein, 25 aa, Staphylococcus
DVQGIKIHLLHLLKGTPMVKQYDKG

SEQ ID NO: 2063035 - protein, 26 aa, Staphylococcus
DVQGIKIHLLHLLKGTPMVKQYDKGM

SEQ ID NO: 2063036 - protein, 25 aa, Staphylococcus
DVQGLKIHLLHLLKGTPMVKQYEKG

SEQ ID NO: 2063037 - protein, 34 aa, Staphylococcus
DVQYGHFFDIPFDQPFDYIVTSFAFHHVKPEEKS

SEQ ID NO: 2063038 - protein, 22 aa, Staphylococcus
DVRAVLGRFLFVQDDVKKVIND

SEQ ID NO: 2063039 - protein, 26 aa, Staphylococcus
DVREAVFKMMNWWFEKGIDGFRVDAI

SEQ ID NO: 2063040 - protein, 17 aa, Staphylococcus
DVRHPLLYHLLLKLVTT

SEQ ID NO: 2063041 - protein, 17 aa, Staphylococcus
DVRQLGRFLQKKGYTSY

SEQ ID NO: 2063042 - protein, 17 aa, Staphylococcus
DVRQLGRYLQKKGYTSY

SEQ ID NO: 2063043 - protein, 22 aa, Staphylococcus
DVSFDTLLVATGRQPNTQVAKD

SEQ ID NO: 2063044 - protein, 23 aa, Staphylococcus
DVSKRLLAHILGVELPNPSIIDE

SEQ ID NO: 2063045 - protein, 18 aa, Staphylococcus
DVSLPYLKVPELKDILKE

SEQ ID NO: 2063046 - protein, 33 aa, Staphylococcus
DVSTHKPRFAGSKPFNVVMTPSDKKRMMDSKNN

SEQ ID NO: 2063047 - protein, 21 aa, Staphylococcus
DVSTIIMNIKELALKIYSEED

SEQ ID NO: 2063048 - protein, 22 aa, Staphylococcus
DVTEIFIKNLKHFLNYGNLIEN

SEQ ID NO: 2063049 - protein, 25 aa, Staphylococcus
DVTGKWSWLAPPLSPTLTSNYHHGY

SEQ ID NO: 2063050 - protein, 24 aa, Staphylococcus
DVTGPFDLVIILTKAMRSEEMLRD

SEQ ID NO: 2063051 - protein, 18 aa, Staphylococcus
DVTIALDYAMNRFTNIID

SEQ ID NO: 2063052 - protein, 25 aa, Staphylococcus
DVTIISIFVNPLQFGPNEDLDSYPR

SEQ ID NO: 2063053 - protein, 23 aa, Staphylococcus
DVTKLPFIEFQADPIYINQIKQW

SEQ ID NO: 2063054 - protein, 23 aa, Staphylococcus
DVTLPSRKIAIGAKHPLTRTIEE

SEQ ID NO: 2063055 - protein, 26 aa, Staphylococcus
DVTQQLLLLRDYLVKQDLPFIVEIVP

SEQ ID NO: 2063056 - protein, 24 aa, Staphylococcus
DVTSTPILRPLISLDKEDIIKKAK

SEQ ID NO: 2063057 - protein, 22 aa, Staphylococcus
DVTSTPILRPLVSLDKEDIVKK

SEQ ID NO: 2063058 - protein, 26 aa, Staphylococcus
DVTTAILTGNFLLALGLKQLSKIEDH

SEQ ID NO: 2063059 - protein, 22 aa, Staphylococcus
DVTTSKPFFLEFMAKDVSKGNA

SEQ ID NO: 2063060 - protein, 20 aa, Staphylococcus
DVTVLINGLPLVQIELKRSG

SEQ ID NO: 2063061 - protein, 23 aa, Staphylococcus
DVTYELLTVLNFDINDLGTDKLK

SEQ ID NO: 2063062 - protein, 18 aa, Staphylococcus
DVVDIWDGLLENENLVPA

SEQ ID NO: 2063063 - protein, 17 aa, Staphylococcus
DVVFKLRKILKMKKIGH

SEQ ID NO: 2063064 - protein, 28 aa, Staphylococcus
DVVHNIFDLALMTLLFDDVVVDGHVAYD

SEQ ID NO: 2063065 - protein, 24 aa, Staphylococcus
DVVIGDFPIGYYPLDGRSKEMKLG

SEQ ID NO: 2063066 - protein, 23 aa, Staphylococcus
DVVIGDFPIGYYPVDERSKDMVL

SEQ ID NO: 2063067 - protein, 22 aa, Staphylococcus
DVVIGDFPIGYYPVDERSKEMK

SEQ ID NO: 2063068 - protein, 19 aa, Staphylococcus
DVVLAHHYSLMGQKLIIDT

SEQ ID NO: 2063069 - protein, 30 aa, Staphylococcus
DVVNDWPYEALVKIFYRYGEEKFSKQIARR

SEQ ID NO: 2063070 - protein, 25 aa, Staphylococcus
DVVPAPLMEFIFDTTRTVIYMSQNN

SEQ ID NO: 2063071 - protein, 19 aa, Staphylococcus
DVVRLLEKIATYMELKGEN

SEQ ID NO: 2063072 - protein, 20 aa, Staphylococcus
DVVRRYFEYKGYDVNYVSNF

SEQ ID NO: 2063073 - protein, 23 aa, Staphylococcus
DVVRRYFEYKGYTVDYVSNFTDV

SEQ ID NO: 2063074 - protein, 19 aa, Staphylococcus
DVYDDCEFIVAIRSMLIKG

SEQ ID NO: 2063075 - protein, 25 aa, Staphylococcus
DVYDFPRVWLEKDSYDFSFSGLKSA

SEQ ID NO: 2063076 - protein, 24 aa, Staphylococcus
DVYEPFLIQKGFIERTPRGRKATA

SEQ ID NO: 2063077 - protein, 25 aa, Staphylococcus
DVYEPFLIQKGFIERTPRGRKATAF

SEQ ID NO: 2063078 - protein, 25 aa, Staphylococcus
DVYEPFLIQKGFIERTPRGRKATPF

SEQ ID NO: 2063079 - protein, 25 aa, Staphylococcus
DVYEPFLIQKGFIERTPRGRKATPY

SEQ ID NO: 2063080 - protein, 23 aa, Staphylococcus
DVYGDSIIYSCSFGAEGMILIDL

SEQ ID NO: 2063081 - protein, 21 aa, Staphylococcus
DVYIRYLRNKLKPFGKDKCIE

SEQ ID NO: 2063082 - protein, 28 aa, Staphylococcus
DVYLKHFFDSITPSFYYDFDGELCICDV

SEQ ID NO: 2063083 - protein, 20 aa, Staphylococcus
DVYMKTLMELFPEELIDIKN

SEQ ID NO: 2063084 - protein, 19 aa, Staphylococcus
DVYNDCEFIVAIRSMLVKQ

SEQ ID NO: 2063085 - protein, 17 aa, Staphylococcus
DVYQCRFLTVATGYYGH

SEQ ID NO: 2063086 - protein, 19 aa, Staphylococcus
DWAKLRGLIASEDIVETLA

SEQ ID NO: 2063087 - protein, 27 aa, Staphylococcus
DWALNQGKVILFLPDQHLGRNTAYDLG

SEQ ID NO: 2063088 - protein, 28 aa, Staphylococcus
DWANEWKNYFHPFRASKRFTIVPSWEDY

SEQ ID NO: 2063089 - protein, 26 aa, Staphylococcus
DWEKDLAMIFIVINKQSKKVSSRAGM

SEQ ID NO: 2063090 - protein, 21 aa, Staphylococcus
DWEKLPLFYTQYELDKDKKSA

SEQ ID NO: 2063091 - protein, 19 aa, Staphylococcus
DWEVLLKPAKRIKVGNKLS

SEQ ID NO: 2063092 - protein, 19 aa, Staphylococcus
DWEVLLKPAKRIKVGNQLN

SEQ ID NO: 2063093 - protein, 20 aa, Staphylococcus
DWEVLLKPAKRIKVGNRLSF

SEQ ID NO: 2063094 - protein, 17 aa, Staphylococcus
DWEYLKRDIDILEGAFQ

SEQ ID NO: 2063095 - protein, 18 aa, Staphylococcus
DWEYYQNKDFMTRLGHTV

SEQ ID NO: 2063096 - protein, 17 aa, Staphylococcus
DWFEKMSVFVELADDYQ

SEQ ID NO: 2063097 - protein, 17 aa, Staphylococcus
DWFFDKMKHLGFKHEGF

SEQ ID NO: 2063098 - protein, 20 aa, Staphylococcus
DWIIAYDVYFKSMIGIEVSE

SEQ ID NO: 2063099 - protein, 33 aa, Staphylococcus
DWKEKLRMLKSFPTPTFDDIPLLDAALNEEKVP

SEQ ID NO: 2063100 - protein, 19 aa, Staphylococcus
DWKIITKNRNSSVSILAIH

SEQ ID NO: 2063101 - protein, 18 aa, Staphylococcus
DWKYYQDKDFMTRLGSTL

SEQ ID NO: 2063102 - protein, 17 aa, Staphylococcus
DWLEQIPNNIVRAKGIV

SEQ ID NO: 2063103 - protein, 20 aa, Staphylococcus
DWQCPLTVRAPFGGGVHGGL

SEQ ID NO: 2063104 - protein, 33 aa, Staphylococcus
DWQGQSYFFPSKVAFITFYLQQIQVDLSEIIIN

SEQ ID NO: 2063105 - protein, 26 aa, Staphylococcus
DWRTKKPVIFRATPQWFASISKVRQD

SEQ ID NO: 2063106 - protein, 19 aa, Staphylococcus
DWSKFTNSIFYTQSYDFGD

SEQ ID NO: 2063107 - protein, 20 aa, Staphylococcus
DWSLQRLLKTDRIILRMATF

SEQ ID NO: 2063108 - protein, 17 aa, Staphylococcus
DWVVKLPDNMTLEEAMI

SEQ ID NO: 2063109 - protein, 20 aa, Staphylococcus
DYACILLDLMLPEMDGIEVA

SEQ ID NO: 2063110 - protein, 21 aa, Staphylococcus
DYAEFYRNLPYVGTLKPEVYQ

SEQ ID NO: 2063111 - protein, 21 aa, Staphylococcus
DYAFLVLNMNKVYLYVDIKNE

SEQ ID NO: 2063112 - protein, 25 aa, Staphylococcus
DYAGKTEIAFIGDSWIQGGEFRGGD

SEQ ID NO: 2063113 - protein, 29 aa, Staphylococcus
DYAIDFSGYSMFWANLILASHAKRKFIFL

SEQ ID NO: 2063114 - protein, 23 aa, Staphylococcus
DYANFINPNYKLVNSRFIKNAHS

SEQ ID NO: 2063115 - protein, 26 aa, Staphylococcus
DYCREKGFLTLTYQDGQIIFDTEHEY

SEQ ID NO: 2063116 - protein, 21 aa, Staphylococcus
DYDAFATPFILLDGEPMYQVD

SEQ ID NO: 2063117 - protein, 24 aa, Staphylococcus
DYDAFATPFILLNDEPMYQVDMDK

SEQ ID NO: 2063118 - protein, 25 aa, Staphylococcus
DYDAFATPFILLNNEPMYSVDMDKI

SEQ ID NO: 2063119 - protein, 24 aa, Staphylococcus
DYDAFSTPFILIDDHPMYQVDLDK

SEQ ID NO: 2063120 - protein, 22 aa, Staphylococcus
DYDEFIAFLNRTTSGNYDLVEG

SEQ ID NO: 2063121 - protein, 23 aa, Staphylococcus
DYDIRMSLIFINEKIRLIEYTFI

SEQ ID NO: 2063122 - protein, 17 aa, Staphylococcus
DYDKYIVCLLSQGKQHL

SEQ ID NO: 2063123 - protein, 17 aa, Staphylococcus
DYDNAIVNFFKENKEPL

SEQ ID NO: 2063124 - protein, 20 aa, Staphylococcus
DYEENYFKHLSPRQKAYIEN

SEQ ID NO: 2063125 - protein, 19 aa, Staphylococcus
DYEGWWLFSDWTDKIIEQY

SEQ ID NO: 2063126 - protein, 23 aa, Staphylococcus
DYEIIDEIGQIKIIFTTTIKEME

SEQ ID NO: 2063127 - protein, 23 aa, Staphylococcus
DYEKLYLTYLVQGLHLNKLDFIH

SEQ ID NO: 2063128 - protein, 24 aa, Staphylococcus
DYEKLYLTYLVQGLHLNKLDFIHK

SEQ ID NO: 2063129 - protein, 23 aa, Staphylococcus
DYELFTRFNTYYIQSRIALIESD

SEQ ID NO: 2063130 - protein, 17 aa, Staphylococcus
DYELLAFNSGQRYNMVP

SEQ ID NO: 2063131 - protein, 22 aa, Staphylococcus
DYELNYLIYKTSLLPINTVIKD

SEQ ID NO: 2063132 - protein, 17 aa, Staphylococcus
DYELYSTGGTKGALEDA

SEQ ID NO: 2063133 - protein, 24 aa, Staphylococcus
DYENLLFYFAYKTFINTADEIIEK

SEQ ID NO: 2063134 - protein, 17 aa, Staphylococcus
DYESFFKRFDDLEFDHA

SEQ ID NO: 2063135 - protein, 28 aa, Staphylococcus
DYFKDLGIDVIWLSPMYKSPNDDNGYDI

SEQ ID NO: 2063136 - protein, 22 aa, Staphylococcus
DYFKKEAIHFAWEFLTSENWMG

SEQ ID NO: 2063137 - protein, 17 aa, Staphylococcus
DYFLSTLKHWNGAFTFN

SEQ ID NO: 2063138 - protein, 27 aa, Staphylococcus
DYFNLNGYDMLLFCPQGIDAEGDQFRN

SEQ ID NO: 2063139 - protein, 17 aa, Staphylococcus
DYFNRDRFILSAGHGSA

SEQ ID NO: 2063140 - protein, 18 aa, Staphylococcus
DYFPATNVMRVLYPGRES

SEQ ID NO: 2063141 - protein, 24 aa, Staphylococcus
DYGQKIDILFILGGDGTVNEMVNG

SEQ ID NO: 2063142 - protein, 21 aa, Staphylococcus
DYIDFLYESRQLIKEKALTST

SEQ ID NO: 2063143 - protein, 21 aa, Staphylococcus
DYIDNSVRYGFKRIFTNLLSV

SEQ ID NO: 2063144 - protein, 18 aa, Staphylococcus
DYIFCTFNTDLYYEKMID

SEQ ID NO: 2063145 - protein, 24 aa, Staphylococcus
DYIGQFKTGYFSPLANLARLTEEV

SEQ ID NO: 2063146 - protein, 20 aa, Staphylococcus
DYIHLEYFGFELDGLGKRII

SEQ ID NO: 2063147 - protein, 20 aa, Staphylococcus
DYIHQLFKQLRLKRDEIKNL

SEQ ID NO: 2063148 - protein, 21 aa, Staphylococcus
DYIKPFSFLPMRKGMLSRVDA

SEQ ID NO: 2063149 - protein, 24 aa, Staphylococcus
DYIKQYPERFVGFATLPINEPEAA

SEQ ID NO: 2063150 - protein, 22 aa, Staphylococcus
DYIKTLLLQLLQQDSKDHKDQQ

SEQ ID NO: 2063151 - protein, 18 aa, Staphylococcus
DYILEYRQLSKLQSTYVE

SEQ ID NO: 2063152 - protein, 19 aa, Staphylococcus
DYILEYRQLSKLQSTYVEG

SEQ ID NO: 2063153 - protein, 23 aa, Staphylococcus
DYISQFKAGYFSPLANLARLTEE

SEQ ID NO: 2063154 - protein, 24 aa, Staphylococcus
DYISQFKAGYFSPLANLARLTEEV

SEQ ID NO: 2063155 - protein, 26 aa, Staphylococcus
DYIVADAIGPLPYTLQKTTEQLYNPN

SEQ ID NO: 2063156 - protein, 19 aa, Staphylococcus
DYIVNSYPVWFPKAEAEEI

SEQ ID NO: 2063157 - protein, 19 aa, Staphylococcus
DYIVNSYPVWFPKAEAQEI

SEQ ID NO: 2063158 - protein, 24 aa, Staphylococcus
DYIVNSYPVWLPKADVEDIIKDMI

SEQ ID NO: 2063159 - protein, 19 aa, Staphylococcus
DYIYEKYPIKYSIMGHVHF

SEQ ID NO: 2063160 - protein, 20 aa, Staphylococcus
DYKICVLLDMHIGHLKSVMA

SEQ ID NO: 2063161 - protein, 18 aa, Staphylococcus
DYKQIELKIIYSKTPIKT

SEQ ID NO: 2063162 - protein, 23 aa, Staphylococcus
DYKRVHFFLMMYDESDNLVATNE

SEQ ID NO: 2063163 - protein, 20 aa, Staphylococcus
DYKSKYFTIYDQVKPLKNDK

SEQ ID NO: 2063164 - protein, 21 aa, Staphylococcus
DYKWMHPCYTINNKNVVLIHG

SEQ ID NO: 2063165 - protein, 20 aa, Staphylococcus
DYLDKGFTGYIIRRGHTEAD

SEQ ID NO: 2063166 - protein, 28 aa, Staphylococcus
DYLDKLGIDVIWLNPIYESPNDDNGYDI

SEQ ID NO: 2063167 - protein, 19 aa, Staphylococcus
DYLDSLLIHRPSPLMNPDE

SEQ ID NO: 2063168 - protein, 18 aa, Staphylococcus
DYLGFTHDQLILSGLSMG

SEQ ID NO: 2063169 - protein, 17 aa, Staphylococcus
DYLIDAINYMFPDVHVT

SEQ ID NO: 2063170 - protein, 20 aa, Staphylococcus
DYLIDAINYMFPTVDVKDED

SEQ ID NO: 2063171 - protein, 20 aa, Staphylococcus
DYLIFVQETWSMLHENRGKK

SEQ ID NO: 2063172 - protein, 19 aa, Staphylococcus
DYLKDLGIDVIWLSPMYQS

SEQ ID NO: 2063173 - protein, 21 aa, Staphylococcus
DYLNLDKPVILYTYDLDEYAN

SEQ ID NO: 2063174 - protein, 31 aa, Staphylococcus
DYLNVKPQVLIFMLKVFNELNFIHDNNGIIT

SEQ ID NO: 2063175 - protein, 33 aa, Staphylococcus
DYLPIGVSVVISPWNFAYAIMAGTTVAPVVTGN

SEQ ID NO: 2063176 - protein, 29 aa, Staphylococcus
DYLSNFEIREIRIIKSVLLKGKKSFNNTH

SEQ ID NO: 2063177 - protein, 26 aa, Staphylococcus
DYLTKYADIPYVIDPVMLAKSGDSLM

SEQ ID NO: 2063178 - protein, 23 aa, Staphylococcus
DYLTQIHQRFYLEQTLITERIKK

SEQ ID NO: 2063179 - protein, 32 aa, Staphylococcus
DYLTTDTFFNLQSLPKRLAVIGGGVIATELAS

SEQ ID NO: 2063180 - protein, 43 aa, Staphylococcus
DYMIEKLEIYLFDYASWDVPRGEFFIWLKLNGNVNIKKLFSDL

SEQ ID NO: 2063181 - protein, 18 aa, Staphylococcus
DYNAEIKTILSKLGIHDT

SEQ ID NO: 2063182 - protein, 17 aa, Staphylococcus
DYNGLTIVISEKDLWYF

SEQ ID NO: 2063183 - protein, 18 aa, Staphylococcus
DYNIEFITKLEGAHLEYE

SEQ ID NO: 2063184 - protein, 29 aa, Staphylococcus
DYNNQSLVRFFFKSLTDYLKKRNCLYVLV

SEQ ID NO: 2063185 - protein, 17 aa, Staphylococcus
DYNTNVIPVFWIAGEDH

SEQ ID NO: 2063186 - protein, 19 aa, Staphylococcus
DYPLPTIGIEPGRSIVGEA

SEQ ID NO: 2063187 - protein, 29 aa, Staphylococcus
DYPNQINNVLAFPGIFRGALDTEATHINE

SEQ ID NO: 2063188 - protein, 17 aa, Staphylococcus
DYPVALAAPTGRAAKRL

SEQ ID NO: 2063189 - protein, 27 aa, Staphylococcus
DYQEMKPLYEWLGLSASLGFVDIPNYE

SEQ ID NO: 2063190 - protein, 17 aa, Staphylococcus
DYQPILVQVNQFKQIRT

SEQ ID NO: 2063191 - protein, 21 aa, Staphylococcus
DYRCLIPRPETEEVLMHFIER

SEQ ID NO: 2063192 - protein, 35 aa, Staphylococcus
DYRMKGIAFDLLEYALNYAFTHFDLRKVYFKIRNK

SEQ ID NO: 2063193 - protein, 19 aa, Staphylococcus
DYRVKPPFFIQWDENEQKR

SEQ ID NO: 2063194 - protein, 25 aa, Staphylococcus
DYSKALHEPSWMTDSRKKALKLTET

SEQ ID NO: 2063195 - protein, 26 aa, Staphylococcus
DYSKEELDLFLYQEPMKLKNPPEEWR

SEQ ID NO: 2063196 - protein, 37 aa, Staphylococcus
DYSKKIVLARRRLIKFDKKISIPYILTRALKNEKNSY

SEQ ID NO: 2063197 - protein, 23 aa, Staphylococcus
DYSKYFEHVYQPPSLKEARKRGK

SEQ ID NO: 2063198 - protein, 27 aa, Staphylococcus
DYSNIELVHYFFKSLTNFLKQRNCLYV

SEQ ID NO: 2063199 - protein, 28 aa, Staphylococcus
DYSNIKLVHFFFKSLTEYLKKQNCLFVL

SEQ ID NO: 2063200 - protein, 17 aa, Staphylococcus
DYSNIVYHFKNAKFFVP

SEQ ID NO: 2063201 - protein, 19 aa, Staphylococcus
DYSPMSVIASLLPTGTVSG

SEQ ID NO: 2063202 - protein, 22 aa, Staphylococcus
DYSQRYPVYQLIDKFYNDHYVI

SEQ ID NO: 2063203 - protein, 25 aa, Staphylococcus
DYSSFINYHIFFETLLRKYNERKEN

SEQ ID NO: 2063204 - protein, 25 aa, Staphylococcus
DYSSFISYHIFFETLLRKYNERKEA

SEQ ID NO: 2063205 - protein, 25 aa, Staphylococcus
DYSSFISYHIFFETLLRKYNERKEK

SEQ ID NO: 2063206 - protein, 25 aa, Staphylococcus
DYSSFISYHIFFETLLRKYNERQEK

SEQ ID NO: 2063207 - protein, 25 aa, Staphylococcus
DYSSIFFDFLVTDKPIIFYTPDYEE

SEQ ID NO: 2063208 - protein, 25 aa, Staphylococcus
DYSSIFFDFLVTDKPIIFYTTNHDE

SEQ ID NO: 2063209 - protein, 24 aa, Staphylococcus
DYSSIFFDFLVTDNPIIFYSPDYE

SEQ ID NO: 2063210 - protein, 35 aa, Staphylococcus
DYSSVMFDYAYLKRPMLFFAYDLEKYLYSERGTYL

SEQ ID NO: 2063211 - protein, 24 aa, Staphylococcus
DYSTNIAMVLTKIAKRNPRDIAQA

SEQ ID NO: 2063212 - protein, 24 aa, Staphylococcus
DYSTNIAMVLTKLAKRNPREIAQA

SEQ ID NO: 2063213 - protein, 18 aa, Staphylococcus
DYSYFFNGVKHILKAKEN

SEQ ID NO: 2063214 - protein, 34 aa, Staphylococcus
DYTDFDQIIKKDGYWWCRFKFDNKGEYFYVALCR

SEQ ID NO: 2063215 - protein, 27 aa, Staphylococcus
DYTKDELELFLYQEPMTLKNPPKEWRK

SEQ ID NO: 2063216 - protein, 26 aa, Staphylococcus
DYTKRPDIVLFINGLPIVVIELKNST

SEQ ID NO: 2063217 - protein, 21 aa, Staphylococcus
DYTLVSLLHKGGEESGISIAD

SEQ ID NO: 2063218 - protein, 20 aa, Staphylococcus
DYTLVSLLTKGGEDANVSIE

SEQ ID NO: 2063219 - protein, 20 aa, Staphylococcus
DYTQIYNKFVTLGPLLENGK

SEQ ID NO: 2063220 - protein, 24 aa, Staphylococcus
DYTVLRGFNPFYIEHGAFSGAIGA

SEQ ID NO: 2063221 - protein, 24 aa, Staphylococcus
DYVAIELLKLIKDKPDAILGLATG

SEQ ID NO: 2063222 - protein, 20 aa, Staphylococcus
DYVFYGHIFPTPSHPHDAPR

SEQ ID NO: 2063223 - protein, 17 aa, Staphylococcus
DYVLPKKGVYAVSLAIG

SEQ ID NO: 2063224 - protein, 19 aa, Staphylococcus
DYVSQGHQFLLLAKEDWHE

SEQ ID NO: 2063225 - protein, 30 aa, Staphylococcus
DYVVTGSGFLYNMVRVLVAFLIEVGKGKRH

SEQ ID NO: 2063226 - protein, 17 aa, Staphylococcus
DYWMGATPMGRPGEPEE

SEQ ID NO: 2063227 - protein, 18 aa, Staphylococcus
DYWMGATPMGRPGEPHEL

SEQ ID NO: 2063228 - protein, 24 aa, Staphylococcus
DYYSISDLILYIEDKDIREAIIQL

SEQ ID NO: 2063229 - protein, 20 aa, Staphylococcus
DYYSYVRTFSEYYAPYENRA

SEQ ID NO: 2063230 - protein, 24 aa, Staphylococcus
EAADIVFNAHIPITMVGLDVARGA

SEQ ID NO: 2063231 - protein, 23 aa, Staphylococcus
EAADLKFHLAIAKAAQNSMLFDL

SEQ ID NO: 2063232 - protein, 20 aa, Staphylococcus
EAAEALPINVGFTGKGQAVN

SEQ ID NO: 2063233 - protein, 20 aa, Staphylococcus
EAAELLELFQWKTPEEVVQK

SEQ ID NO: 2063234 - protein, 26 aa, Staphylococcus
EAAEQFSMFLFQNNIPNNLLIAQNAA

SEQ ID NO: 2063235 - protein, 24 aa, Staphylococcus
EAAGFSFVFVADGLYIHEKSIPHF

SEQ ID NO: 2063236 - protein, 26 aa, Staphylococcus
EAAGVYGLIIPDLPFELGEQLKERFK

SEQ ID NO: 2063237 - protein, 20 aa, Staphylococcus
EAAIKGLRQHNKHTRIIAVT

SEQ ID NO: 2063238 - protein, 25 aa, Staphylococcus
EAAKLGFKRVILPKTNIGGWTFPDN

SEQ ID NO: 2063239 - protein, 21 aa, Staphylococcus
EAALALLRLYQRDKNELWLKT

SEQ ID NO: 2063240 - protein, 23 aa, Staphylococcus
EAAPKMLPMFSDELVNHAVNYLE

SEQ ID NO: 2063241 - protein, 24 aa, Staphylococcus
EAAPKMLPMFSDELVNYAVKYLED

SEQ ID NO: 2063242 - protein, 23 aa, Staphylococcus
EAAQHMYLVYQNPELQFITNSVY

SEQ ID NO: 2063243 - protein, 25 aa, Staphylococcus
EAAREYDLHFFTPSSIGAFGSSTPK

SEQ ID NO: 2063244 - protein, 23 aa, Staphylococcus
EAATNLPYIYLSAGVSAELFQET

SEQ ID NO: 2063245 - protein, 24 aa, Staphylococcus
EACEYRRHFLSYHPDYAIMTNIDY

SEQ ID NO: 2063246 - protein, 25 aa, Staphylococcus
EACKATIQSFLPKANIIKISDEEIE

SEQ ID NO: 2063247 - protein, 25 aa, Staphylococcus
EACNTWRLVYQRLQAIEKATYRHVH

SEQ ID NO: 2063248 - protein, 24 aa, Staphylococcus
EACQTWRLVYHRLMNLERETHEHV

SEQ ID NO: 2063249 - protein, 24 aa, Staphylococcus
EADASLAMLLYRDDYYNHDEVDIS

SEQ ID NO: 2063250 - protein, 24 aa, Staphylococcus
EADDLYIFGIFDKAHQHIGMLNIK

SEQ ID NO: 2063251 - protein, 29 aa, Staphylococcus
EADEDKVHFNYFKDYFLTDGGVKNWEQIS

SEQ ID NO: 2063252 - protein, 21 aa, Staphylococcus
EADEFYFDNPFRFGATVGRYG

SEQ ID NO: 2063253 - protein, 21 aa, Staphylococcus
EADEFYQENPFYFGASVGRYG

SEQ ID NO: 2063254 - protein, 24 aa, Staphylococcus
EADFINCVVFRKQAENVNNYLFKG

SEQ ID NO: 2063255 - protein, 25 aa, Staphylococcus
EADFINCVVFRRQAENVNNYLNKGS

SEQ ID NO: 2063256 - protein, 24 aa, Staphylococcus
EADFINCVVFRRQAENVNNYLSKG

SEQ ID NO: 2063257 - protein, 25 aa, Staphylococcus
EADFINCVVFRRQAENVNNYLSKGS

SEQ ID NO: 2063258 - protein, 24 aa, Staphylococcus
EADFINVVVFRRQAENVNNYLFKG

SEQ ID NO: 2063259 - protein, 28 aa, Staphylococcus
EADFKRWGINLVLLGDKLAIHAAATVYC

SEQ ID NO: 2063260 - protein, 21 aa, Staphylococcus
EADILFIGFISSKGAIQEGAE

SEQ ID NO: 2063261 - protein, 21 aa, Staphylococcus
EADILYIGFISSKGAIQEGTS

SEQ ID NO: 2063262 - protein, 23 aa, Staphylococcus
EADILYIGFISTKGAIQEGKARL

SEQ ID NO: 2063263 - protein, 22 aa, Staphylococcus
EADISFEEFLGQAAISSSETVE

SEQ ID NO: 2063264 - protein, 17 aa, Staphylococcus
EADKPPFQKTLRQYTVV

SEQ ID NO: 2063265 - protein, 32 aa, Staphylococcus
EADKYVFVSPMWNLSFPPVLKAYIDAISIAGK

SEQ ID NO: 2063266 - protein, 32 aa, Staphylococcus
EADKYVFVSPMWNLSFPPVLKAYIDAITVAGK

SEQ ID NO: 2063267 - protein, 23 aa, Staphylococcus
EADLLIDLGLIEDVDYIAARLDE

SEQ ID NO: 2063268 - protein, 27 aa, Staphylococcus
EADMIQKYPNRFGGFATLPLPEVDASI

SEQ ID NO: 2063269 - protein, 33 aa, Staphylococcus
EADQDLFIDLIFSPIYFNILIKPNVLNETYIKK

SEQ ID NO: 2063270 - protein, 19 aa, Staphylococcus
EADRLRFDFSHFGPMTQEE

SEQ ID NO: 2063271 - protein, 20 aa, Staphylococcus
EADRLRFDFSHFGPMTQEEL

SEQ ID NO: 2063272 - protein, 23 aa, Staphylococcus
EADTVLFAVGVNPATDWLDGKVE

SEQ ID NO: 2063273 - protein, 23 aa, Staphylococcus
EADTVLFAVGVTPATEWLDGKIE

SEQ ID NO: 2063274 - protein, 21 aa, Staphylococcus
EAEAIKLFSNTYLAMRVSFFN

SEQ ID NO: 2063275 - protein, 24 aa, Staphylococcus
EAEDVTLPLKPIIRVATEQDLEKH

SEQ ID NO: 2063276 - protein, 23 aa, Staphylococcus
EAEEFMIPRVKQMLTRFYAENIE

SEQ ID NO: 2063277 - protein, 17 aa, Staphylococcus
EAEIEKLVWATHWGADT

SEQ ID NO: 2063278 - protein, 27 aa, Staphylococcus
EAEILESLRPILLQYAKERTEGEHFGD

SEQ ID NO: 2063279 - protein, 24 aa, Staphylococcus
EAEKISDFLSLIGGYQALLKFEDV

SEQ ID NO: 2063280 - protein, 24 aa, Staphylococcus
EAEKISEFLSLIGGYQALLKFEDV

SEQ ID NO: 2063281 - protein, 29 aa, Staphylococcus
EAEQYIRDGKWKSWGPYLLAGKDVHGSKV

SEQ ID NO: 2063282 - protein, 25 aa, Staphylococcus
EAERHIIKYHKAFFSHFDRLHRKIF

SEQ ID NO: 2063283 - protein, 37 aa, Staphylococcus
EAETVVIPTKWIPQGIGALFQYLPDASLEDNKNTMTE

SEQ ID NO: 2063284 - protein, 19 aa, Staphylococcus
EAFAEFSAAIKLGRYQEPR

SEQ ID NO: 2063285 - protein, 20 aa, Staphylococcus
EAFEIGFKKGLDINFKPLEL

SEQ ID NO: 2063286 - protein, 17 aa, Staphylococcus
EAFGYYFDAYGQVVHKV

SEQ ID NO: 2063287 - protein, 22 aa, Staphylococcus
EAFKDRILIPQNDLDRTPKKNK

SEQ ID NO: 2063288 - protein, 21 aa, Staphylococcus
EAFKSNIMIKQLFVIEPERTD

SEQ ID NO: 2063289 - protein, 22 aa, Staphylococcus
EAFVGALYLDQGLGAVWHFAEK

SEQ ID NO: 2063290 - protein, 25 aa, Staphylococcus
EAGADAIKFLLYYDVDEPDEINQKK

SEQ ID NO: 2063291 - protein, 18 aa, Staphylococcus
EAGDYITSLLTYKNIRSN

SEQ ID NO: 2063292 - protein, 26 aa, Staphylococcus
EAGETVYFILKETPFYAVSGGQVADK

SEQ ID NO: 2063293 - protein, 18 aa, Staphylococcus
EAGGLLMYGIPNMKLDKD

SEQ ID NO: 2063294 - protein, 28 aa, Staphylococcus
EAGIDVFRIFDSLNWLDQMKVANEAVQE

SEQ ID NO: 2063295 - protein, 25 aa, Staphylococcus
EAGIDVFRIFDSLNWVDQMKVANEA

SEQ ID NO: 2063296 - protein, 21 aa, Staphylococcus
EAGYMPVKRFEKPVYRENKDG

SEQ ID NO: 2063297 - protein, 24 aa, Staphylococcus
EAHDIKILDLPLDTGLVAEIGQGD

SEQ ID NO: 2063298 - protein, 19 aa, Staphylococcus
EAHFIKQLIKMMNLHISNQ

SEQ ID NO: 2063299 - protein, 21 aa, Staphylococcus
EAHHIPVQWATTPGGGTDAGS

SEQ ID NO: 2063300 - protein, 18 aa, Staphylococcus
EAHITFLKEMVLDESFKV

SEQ ID NO: 2063301 - protein, 21 aa, Staphylococcus
EAHLLYQAFLKSKDQYDDVMR

SEQ ID NO: 2063302 - protein, 24 aa, Staphylococcus
EAHQKPHIMPVWSIKNRAEKVRNQ

SEQ ID NO: 2063303 - protein, 28 aa, Staphylococcus
EAHSTLRQSLIPHLIDAVAYNVARKNSD

SEQ ID NO: 2063304 - protein, 34 aa, Staphylococcus
EAIALIKHLAPTDTKIYEIYLYENLINNRFNELE

SEQ ID NO: 2063305 - protein, 18 aa, Staphylococcus
EAIAPYLFKEHLHGFFLE

SEQ ID NO: 2063306 - protein, 18 aa, Staphylococcus
EAIARFDSLVELDYYRHG

SEQ ID NO: 2063307 - protein, 37 aa, Staphylococcus
EAIEMIKGILGKSPFFGICLGHQLFALSQGATSFKMK

SEQ ID NO: 2063308 - protein, 17 aa, Staphylococcus
EAIGVAGLVTPWNFPTN

SEQ ID NO: 2063309 - protein, 18 aa, Staphylococcus
EAIGVAGLVTPWNFPTNQ

SEQ ID NO: 2063310 - protein, 26 aa, Staphylococcus
EAIHNYNIIRPPFNVGRLSEYAAVAA

SEQ ID NO: 2063311 - protein, 22 aa, Staphylococcus
EAIIFDHYRSYFSHKLVIKCMQ

SEQ ID NO: 2063312 - protein, 18 aa, Staphylococcus
EAIKAYLSIAPKNTILIT

SEQ ID NO: 2063313 - protein, 23 aa, Staphylococcus
EAIKAYLSIAPKNTVLITDEGAA

SEQ ID NO: 2063314 - protein, 19 aa, Staphylococcus
EAIKIANDTKYGLAGYVIG

SEQ ID NO: 2063315 - protein, 18 aa, Staphylococcus
EAIKRMEKRYKGPIAFEY

SEQ ID NO: 2063316 - protein, 27 aa, Staphylococcus
EAILEELGLPYRRVILCTGDIGFSASK

SEQ ID NO: 2063317 - protein, 20 aa, Staphylococcus
EAILHYCEPDYIAGLSILGG

SEQ ID NO: 2063318 - protein, 21 aa, Staphylococcus
EAILQKIWELSGKTSERLTQL

SEQ ID NO: 2063319 - protein, 33 aa, Staphylococcus
EAINNNVYKWAYVNSILVSWYQEGINSVEDIEA

SEQ ID NO: 2063320 - protein, 24 aa, Staphylococcus
EAIQIVIEEMKASHYGVAGVRKSD

SEQ ID NO: 2063321 - protein, 20 aa, Staphylococcus
EAIQQYPFVLYDRNFYHHNF

SEQ ID NO: 2063322 - protein, 22 aa, Staphylococcus
EAITFPELVGIQDMGAAGLTSS

SEQ ID NO: 2063323 - protein, 17 aa, Staphylococcus
EAIVNFYQRQYNVTLDK

SEQ ID NO: 2063324 - protein, 21 aa, Staphylococcus
EAIVTLQLYRLTNTDIVALEK

SEQ ID NO: 2063325 - protein, 21 aa, Staphylococcus
EAIVYLGVKKLYQKDGVGQTL

SEQ ID NO: 2063326 - protein, 20 aa, Staphylococcus
EAKAHWDLIEELGMANFDRA

SEQ ID NO: 2063327 - protein, 23 aa, Staphylococcus
EAKAKLRPLIRFNTSQNDTSSAM

SEQ ID NO: 2063328 - protein, 24 aa, Staphylococcus
EAKAKPLEKLLSKELDMPVKVSVS

SEQ ID NO: 2063329 - protein, 26 aa, Staphylococcus
EAKDFANIFFMTMNYYSIERSMQTAK

SEQ ID NO: 2063330 - protein, 24 aa, Staphylococcus
EAKEYWLCWVTTERGENGPYYAGV

SEQ ID NO: 2063331 - protein, 20 aa, Staphylococcus
EAKIPFYTLSNYNELIDVAK

SEQ ID NO: 2063332 - protein, 22 aa, Staphylococcus
EAKIQIGEKLTRGLGAGANPEI

SEQ ID NO: 2063333 - protein, 21 aa, Staphylococcus
EAKLSAPYWDKGVRSVRVYWE

SEQ ID NO: 2063334 - protein, 22 aa, Staphylococcus
EAKQPIQFKWKKDAVVGVMLAS

SEQ ID NO: 2063335 - protein, 17 aa, Staphylococcus
EAKTGAGFIVALTGAIM

SEQ ID NO: 2063336 - protein, 24 aa, Staphylococcus
EALARKIPMIFLDPAPGQELENAH

SEQ ID NO: 2063337 - protein, 21 aa, Staphylococcus
EALEPLTYLLIGGEVLNAKWV

SEQ ID NO: 2063338 - protein, 20 aa, Staphylococcus
EALFPYIQYALITQSSEDLA

SEQ ID NO: 2063339 - protein, 25 aa, Staphylococcus
EALGKKMPVFFSANMSYGVHALTKI

SEQ ID NO: 2063340 - protein, 20 aa, Staphylococcus
EALIDFIPNRTNIEIKDVTQ

SEQ ID NO: 2063341 - protein, 20 aa, Staphylococcus
EALIDFMPTVTDTALKDVEQ

SEQ ID NO: 2063342 - protein, 19 aa, Staphylococcus
EALIKTVAIIGGAGIGFET

SEQ ID NO: 2063343 - protein, 18 aa, Staphylococcus
EALILVGAFDHFGKNRAT

SEQ ID NO: 2063344 - protein, 24 aa, Staphylococcus
EALKPFYEDILGFTVMNETYTSIQ

SEQ ID NO: 2063345 - protein, 22 aa, Staphylococcus
EALKYYEEVFGATNIKRLEVGE

SEQ ID NO: 2063346 - protein, 18 aa, Staphylococcus
EALLFAASRREHLVEKVL

SEQ ID NO: 2063347 - protein, 22 aa, Staphylococcus
EALMFKGIPYQIKLTTTSDESR

SEQ ID NO: 2063348 - protein, 20 aa, Staphylococcus
EALTPMLDLAQDLSQRLIQM

SEQ ID NO: 2063349 - protein, 30 aa, Staphylococcus
EALTSYFEITKLTKPLLQNAAAYFDNEALE

SEQ ID NO: 2063350 - protein, 20 aa, Staphylococcus
EALTYYMKRFEAFGIKHDGI

SEQ ID NO: 2063351 - protein, 24 aa, Staphylococcus
EALVNEKFILLKPNLLLRQQVDEI

SEQ ID NO: 2063352 - protein, 24 aa, Staphylococcus
EAMEALIRFSKMEGIIPAIESAHA

SEQ ID NO: 2063353 - protein, 25 aa, Staphylococcus
EAMEALVRFTKIEGIIPAIESAHAL

SEQ ID NO: 2063354 - protein, 20 aa, Staphylococcus
EAMKHFYQDILGLNVVNESL

SEQ ID NO: 2063355 - protein, 17 aa, Staphylococcus
EAMVRFDSLVELDYYRH

SEQ ID NO: 2063356 - protein, 18 aa, Staphylococcus
EAMVRMAQDFSYRYPLVD

SEQ ID NO: 2063357 - protein, 19 aa, Staphylococcus
EANDEMLIQLLEKLNLLES

SEQ ID NO: 2063358 - protein, 20 aa, Staphylococcus
EANDLLQLMISTMEDRLNEH

SEQ ID NO: 2063359 - protein, 25 aa, Staphylococcus
EANKDNLIYYKKSACLLEEIGNHYR

SEQ ID NO: 2063360 - protein, 18 aa, Staphylococcus
EANKLILYLIVELSHFEN

SEQ ID NO: 2063361 - protein, 18 aa, Staphylococcus
EANKYFQSFFTKLLSSIT

SEQ ID NO: 2063362 - protein, 24 aa, Staphylococcus
EANLPPEWFEAAGAPTVEYESFAE

SEQ ID NO: 2063363 - protein, 30 aa, Staphylococcus
EANVIRYARYLNELSDETQFIVITHRKGTM

SEQ ID NO: 2063364 - protein, 19 aa, Staphylococcus
EANVKYLALDLGEDNIRVN

SEQ ID NO: 2063365 - protein, 21 aa, Staphylococcus
EANVKYLALDLGQDNIRVNAI

SEQ ID NO: 2063366 - protein, 23 aa, Staphylococcus
EANVLTFAVRRMNLYDKNLPNPL

SEQ ID NO: 2063367 - protein, 24 aa, Staphylococcus
EAPGVGMRFIQINDIKLAIINLQG

SEQ ID NO: 2063368 - protein, 23 aa, Staphylococcus
EAPGVGMRFIQVNDIKVAIINLQ

SEQ ID NO: 2063369 - protein, 23 aa, Staphylococcus
EAPISLAFYRRSIGGAATELHQY

SEQ ID NO: 2063370 - protein, 21 aa, Staphylococcus
EAPITHMALAGFSASRALSTN

SEQ ID NO: 2063371 - protein, 22 aa, Staphylococcus
EAPKARIFKQMKNGMFLRMSVI

SEQ ID NO: 2063372 - protein, 22 aa, Staphylococcus
EAPKARIFKQMTNGMYLRMSVI

SEQ ID NO: 2063373 - protein, 35 aa, Staphylococcus
EAPLIQAQLLETVLLNIINFHTLIATKASRIRQIA

SEQ ID NO: 2063374 - protein, 25 aa, Staphylococcus
EAPLKALIFDSEYDPYRGVISSIRV

SEQ ID NO: 2063375 - protein, 26 aa, Staphylococcus
EAPLKALIFDSEYDPYRGVISSIRVI

SEQ ID NO: 2063376 - protein, 17 aa, Staphylococcus
EAPNHVMNYYDPKDKTL

SEQ ID NO: 2063377 - protein, 23 aa, Staphylococcus
EAPPWFKVSPTHYVKSWLLDERA

SEQ ID NO: 2063378 - protein, 24 aa, Staphylococcus
EAPPWFQVSPTHFVKSWLLDERSP

SEQ ID NO: 2063379 - protein, 25 aa, Staphylococcus
EAPQKLLIELKYPKLYPNIEIELLN

SEQ ID NO: 2063380 - protein, 26 aa, Staphylococcus
EAQAEAIVMLQLYRLTNTDIVALENE

SEQ ID NO: 2063381 - protein, 26 aa, Staphylococcus
EAQAEAIVMLQLYRLTNTDIVALEQE

SEQ ID NO: 2063382 - protein, 17 aa, Staphylococcus
EAQGQPILLFYNFKHDR

SEQ ID NO: 2063383 - protein, 20 aa, Staphylococcus
EAQHPFLDRISLVINGNHVT

SEQ ID NO: 2063384 - protein, 28 aa, Staphylococcus
EAQLFSTQLLFQYLFSQGRLQDARKYIL

SEQ ID NO: 2063385 - protein, 28 aa, Staphylococcus
EAQLSNKIGGYFLKKLNLNMINSNDELY

SEQ ID NO: 2063386 - protein, 34 aa, Staphylococcus
EAQPPSEDFAFYAKTLPSTFIYSGAAPQDGKAYP

SEQ ID NO: 2063387 - protein, 27 aa, Staphylococcus
EAQRGTIIFDPNVRLPLWKNAADCKKA

SEQ ID NO: 2063388 - protein, 33 aa, Staphylococcus
EARAHQLVIKYSSAWSFLVPEILQLDQSTIEQF

SEQ ID NO: 2063389 - protein, 17 aa, Staphylococcus
EARDIFMKGYFDSNRKI

SEQ ID NO: 2063390 - protein, 23 aa, Staphylococcus
EAREQLLIAIANYNAVIADEVVC

SEQ ID NO: 2063391 - protein, 24 aa, Staphylococcus
EARGFIIGCPVAYSMGIGFAPVRK

SEQ ID NO: 2063392 - protein, 21 aa, Staphylococcus
EARHFGFVLPDDKRIMQDIFI

SEQ ID NO: 2063393 - protein, 20 aa, Staphylococcus
EARLHRLRPILPNGTVTVGN

SEQ ID NO: 2063394 - protein, 24 aa, Staphylococcus
EARNITFGLFRLSVGLETADELIS

SEQ ID NO: 2063395 - protein, 23 aa, Staphylococcus
EARPYRLLRVGSFLLSKEGYKIF

SEQ ID NO: 2063396 - protein, 24 aa, Staphylococcus
EARSIRIDLPPFTLVGATTRAGSL

SEQ ID NO: 2063397 - protein, 26 aa, Staphylococcus
EARVEDIFFNVFEVLQDLGLTKVNGG

SEQ ID NO: 2063398 - protein, 21 aa, Staphylococcus
EARWPGTITTIVHRIGPLQIS

SEQ ID NO: 2063399 - protein, 17 aa, Staphylococcus
EARYVFNQPYEGGKMVV

SEQ ID NO: 2063400 - protein, 23 aa, Staphylococcus
EASKTVLDVQSPLAGKIVERNTK

SEQ ID NO: 2063401 - protein, 24 aa, Staphylococcus
EASKTVLDVQTPLAGTIVARNTKA

SEQ ID NO: 2063402 - protein, 20 aa, Staphylococcus
EASPFLNMTINNFTFNMKIA

SEQ ID NO: 2063403 - protein, 18 aa, Staphylococcus
EASRKLNFKARKTMMIAQ

SEQ ID NO: 2063404 - protein, 29 aa, Staphylococcus
EASSTLIFIYPLYWFNVTPILKSFIDQTF

SEQ ID NO: 2063405 - protein, 20 aa, Staphylococcus
EATAPYSLYIRGAKYRFEPI

SEQ ID NO: 2063406 - protein, 17 aa, Staphylococcus
EATAYIFIKMVQQMKEL

SEQ ID NO: 2063407 - protein, 22 aa, Staphylococcus
EATAYIFIKMVQQMKELGVANH

SEQ ID NO: 2063408 - protein, 20 aa, Staphylococcus
EATIFLMNAVYDFETVRENE

SEQ ID NO: 2063409 - protein, 20 aa, Staphylococcus
EATLAPYFKAIEETAFVNQE

SEQ ID NO: 2063410 - protein, 21 aa, Staphylococcus
EATLQPFFRDIEERAFCNQAK

SEQ ID NO: 2063411 - protein, 34 aa, Staphylococcus
EATLTARLIDRPIRPLFPKGYKHDVQIMNIVLSA

SEQ ID NO: 2063412 - protein, 35 aa, Staphylococcus
EATLTARLIDRPIRPLFPKGYKYDVQIMNTVLSAD

SEQ ID NO: 2063413 - protein, 34 aa, Staphylococcus
EATLTARLIDRPIRPLFPKGYRHDVQIINMVLSA

SEQ ID NO: 2063414 - protein, 35 aa, Staphylococcus; identical to SEQ ID NO: 1819073

SEQ ID NO: 2063415 - protein, 21 aa, Staphylococcus
EAVDFYLAKGVIDRVAQKLNL

SEQ ID NO: 2063416 - protein, 25 aa, Staphylococcus
EAVDRACYLLERYATGTVLKDRVAA

SEQ ID NO: 2063417 - protein, 17 aa, Staphylococcus
EAVDRACYLLQELASGE

SEQ ID NO: 2063418 - protein, 20 aa, Staphylococcus
EAVLALLRLYQKDENELWLK

SEQ ID NO: 2063419 - protein, 26 aa, Staphylococcus
EAVQSLLRVLAFYTGRDKSQMESIFL

SEQ ID NO: 2063420 - protein, 18 aa, Staphylococcus
EAVRDNFDLRPAGIIKML

SEQ ID NO: 2063421 - protein, 20 aa, Staphylococcus
EAVRIFYCLQKNNCCFIPVS

SEQ ID NO: 2063422 - protein, 24 aa, Staphylococcus
EAVRRNPYSVILLDEIEKAHSDVF

SEQ ID NO: 2063423 - protein, 20 aa, Staphylococcus
EAVVLYYLKKWIDEDDEILS

SEQ ID NO: 2063424 - protein, 27 aa, Staphylococcus
EAVYHNFGYIFPYQLYIENHPVQWQLQ

SEQ ID NO: 2063425 - protein, 17 aa, Staphylococcus
EAWEAMIDVNIKGTLYT

SEQ ID NO: 2063426 - protein, 25 aa, Staphylococcus
EAYAKAKYWISNARLPLYLNKKENQ

SEQ ID NO: 2063427 - protein, 24 aa, Staphylococcus
EAYDLGIRAIMFFGVPNAKDEVGS

SEQ ID NO: 2063428 - protein, 20 aa, Staphylococcus
EAYEMGVSKAFKPIMENTLK

SEQ ID NO: 2063429 - protein, 30 aa, Staphylococcus
EAYFQLDIMTYFYKIVKWLMQYMKQQPTEL

SEQ ID NO: 2063430 - protein, 18 aa, Staphylococcus
EAYHLWHNDIGLEESRII

SEQ ID NO: 2063431 - protein, 17 aa, Staphylococcus
EAYKIWNEKIGLEESRI

SEQ ID NO: 2063432 - protein, 22 aa, Staphylococcus
EAYKQNMFALLGKPGYEDKKAD

SEQ ID NO: 2063433 - protein, 18 aa, Staphylococcus
EAYPFKRGIYSGGVGYIN

SEQ ID NO: 2063434 - protein, 30 aa, Staphylococcus
EAYTQNMRVKPYKLYLLGKDDVLSFKETNK

SEQ ID NO: 2063435 - protein, 18 aa, Staphylococcus
EAYYLNRNTDILTGQRRL

SEQ ID NO: 2063436 - protein, 19 aa, Staphylococcus
ECDFFSFGTNDLTQLTFGF

SEQ ID NO: 2063437 - protein, 26 aa, Staphylococcus
ECIKEFTFPVIIKPMDFGGSDGVYLA

SEQ ID NO: 2063438 - protein, 17 aa, Staphylococcus
ECILLFSERDKGLHEYF

SEQ ID NO: 2063439 - protein, 26 aa, Staphylococcus
ECLPFAFPHIILDFAGWQFQMENIKQ

SEQ ID NO: 2063440 - protein, 17 aa, Staphylococcus
ECVAEDIPFFLEVLSYD

SEQ ID NO: 2063441 - protein, 26 aa, Staphylococcus
ECVAEDIPFFLEVLSYDDKIADNKSA

SEQ ID NO: 2063442 - protein, 17 aa, Staphylococcus
ECVPTFGVSRDIVIGLI

SEQ ID NO: 2063443 - protein, 17 aa, Staphylococcus
ECYGIVGMASRHQVRDG

SEQ ID NO: 2063444 - protein, 25 aa, Staphylococcus
EDAKRKVAIALRNRYRRSLLGEETK

SEQ ID NO: 2063445 - protein, 30 aa, Staphylococcus
EDALIKIVKALKWNILKDGKVLYNLEILFL

SEQ ID NO: 2063446 - protein, 22 aa, Staphylococcus
EDALRIIRGLRFQSQFGFHLEE

SEQ ID NO: 2063447 - protein, 21 aa, Staphylococcus
EDALRILRGLRFQSQLNFKIE

SEQ ID NO: 2063448 - protein, 23 aa, Staphylococcus
EDAPFDLLLLADPSMKLILEYLQ

SEQ ID NO: 2063449 - protein, 26 aa, Staphylococcus
EDAPIYPGTIFYRWYDFEQDCKPWGV

SEQ ID NO: 2063450 - protein, 22 aa, Staphylococcus
EDAQLLYGFINEEEKDMFLSLI

SEQ ID NO: 2063451 - protein, 22 aa, Staphylococcus
EDAVLFLGKQNWVSQFYQISDL

SEQ ID NO: 2063452 - protein, 23 aa, Staphylococcus
EDCLRTLNIFKLLGVDITIKDDN

SEQ ID NO: 2063453 - protein, 26 aa, Staphylococcus
EDCLRTMKIFELLGVNFDIKDDKVFV

SEQ ID NO: 2063454 - protein, 25 aa, Staphylococcus
EDCRNAILTFIPKAHVIKVSDEELE

SEQ ID NO: 2063455 - protein, 40 aa, Staphylococcus
EDDGKYRVYPYFPFEKSKSFEFFYVELDPGATLDSEPHLS

SEQ ID NO: 2063456 - protein, 23 aa, Staphylococcus
EDDHPIIQTWKKAYQEIADVFIQ

SEQ ID NO: 2063457 - protein, 22 aa, Staphylococcus
EDDIDIAHILSLTLTKMHIKTT

SEQ ID NO: 2063458 - protein, 21 aa, Staphylococcus
EDDIDIAHILSLTLTKMTVHT

SEQ ID NO: 2063459 - protein, 23 aa, Staphylococcus
EDDISFLLVQRNRPESFYAAEIA

SEQ ID NO: 2063460 - protein, 24 aa, Staphylococcus
EDDKSYFRRYALTGSGISPRPIPG

SEQ ID NO: 2063461 - protein, 24 aa, Staphylococcus
EDDKYPFETLLNKITKINLPCPLS

SEQ ID NO: 2063462 - protein, 25 aa, Staphylococcus
EDDLDPRFMWNLAYALGAEERDKEA

SEQ ID NO: 2063463 - protein, 23 aa, Staphylococcus
EDDLKYALKLYQATQANALKVEG

SEQ ID NO: 2063464 - protein, 25 aa, Staphylococcus
EDDNKATIRRGPNIKLPSIELLEAP

SEQ ID NO: 2063465 - protein, 26 aa, Staphylococcus
EDDNLDYQPFINYINDVFLQEGELKE

SEQ ID NO: 2063466 - protein, 34 aa, Staphylococcus
EDDPFILNGLIEMLPIGAPFDYYIYFTAITHSDR

SEQ ID NO: 2063467 - protein, 17 aa, Staphylococcus
EDDTWGSVPYLYYVANK

SEQ ID NO: 2063468 - protein, 24 aa, Staphylococcus
EDEEMEDIFIPPTKINRAMDGDTV

SEQ ID NO: 2063469 - protein, 20 aa, Staphylococcus
EDEFERFYSAFDSELSEYKA

SEQ ID NO: 2063470 - protein, 23 aa, Staphylococcus
EDEGKFNMIFQFEHLGLWSTGDQ

SEQ ID NO: 2063471 - protein, 17 aa, Staphylococcus
EDELGVALFDRKGRHIY

SEQ ID NO: 2063472 - protein, 25 aa, Staphylococcus
EDERKGLNGYRKTDLDLEIERELQE

SEQ ID NO: 2063473 - protein, 20 aa, Staphylococcus
EDFDFYHYFGDIEKEAILKL

SEQ ID NO: 2063474 - protein, 21 aa, Staphylococcus
EDFEKFMYQLMNFEKTFLKKY

SEQ ID NO: 2063475 - protein, 24 aa, Staphylococcus
EDFELSLLRIDYPEKFVSIQHQHV

SEQ ID NO: 2063476 - protein, 24 aa, Staphylococcus
EDFKEGFYFIVRIKTDNNRATDEF

SEQ ID NO: 2063477 - protein, 29 aa, Staphylococcus
EDFKKMGYFVNILPLYIQDSIYDKGYTWL

SEQ ID NO: 2063478 - protein, 20 aa, Staphylococcus
EDFLNLLNELSDRKGIIVNV

SEQ ID NO: 2063479 - protein, 19 aa, Staphylococcus
EDFLSPCKLAKMISRYMII

SEQ ID NO: 2063480 - protein, 20 aa, Staphylococcus
EDFNINIPERWSIAQLFQSA

SEQ ID NO: 2063481 - protein, 17 aa, Staphylococcus
EDFQFFKQINQAHWEAF

SEQ ID NO: 2063482 - protein, 21 aa, Staphylococcus
EDFRKELMIKVFAHTNEYDHA

SEQ ID NO: 2063483 - protein, 21 aa, Staphylococcus
EDFTKANPFSRFIRAKATLSA

SEQ ID NO: 2063484 - protein, 24 aa, Staphylococcus
EDFTNKYFKSIFNILHDYFSEHDN

SEQ ID NO: 2063485 - protein, 19 aa, Staphylococcus
EDGFFAVVFIPTAENHAYQ

SEQ ID NO: 2063486 - protein, 21 aa, Staphylococcus
EDGIPIYLGMPMGVIIEAEGK

SEQ ID NO: 2063487 - protein, 22 aa, Staphylococcus
EDGIPIYLGMPMGVIIETEGKT

SEQ ID NO: 2063488 - protein, 20 aa, Staphylococcus
EDGIPVYLGMPMGVVIEAEG

SEQ ID NO: 2063489 - protein, 23 aa, Staphylococcus
EDGKHYLFHLKKNVKFNDGSDFD

SEQ ID NO: 2063490 - protein, 17 aa, Staphylococcus
EDGLMVPVITQADTKSV

SEQ ID NO: 2063491 - protein, 22 aa, Staphylococcus
EDGLPEYELSFTTPVISTHTGK

SEQ ID NO: 2063492 - protein, 23 aa, Staphylococcus
EDGRLAIDLIGGFHFNAIEGEYC

SEQ ID NO: 2063493 - protein, 17 aa, Staphylococcus
EDGVLVVILPKNVTEED

SEQ ID NO: 2063494 - protein, 18 aa, Staphylococcus
EDGYFWFQGRVDDVIMTA

SEQ ID NO: 2063495 - protein, 18 aa, Staphylococcus
EDGYTDVIVVFLSSGISG

SEQ ID NO: 2063496 - protein, 19 aa, Staphylococcus
EDHFFGRVGLFRNQVGDEL

SEQ ID NO: 2063497 - protein, 26 aa, Staphylococcus
EDHREEIMIIFAGYTNEMITFKNSNP

SEQ ID NO: 2063498 - protein, 19 aa, Staphylococcus
EDIALIYNAFERQIAGRYI

SEQ ID NO: 2063499 - protein, 24 aa, Staphylococcus
EDIASHFYITDFDFPKALSKEEIA

SEQ ID NO: 2063500 - protein, 25 aa, Staphylococcus
EDIDQFSIFLLWDSLDACPQGKLVL

SEQ ID NO: 2063501 - protein, 19 aa, Staphylococcus
EDIELFKEIADKVKKTNSY

SEQ ID NO: 2063502 - protein, 17 aa, Staphylococcus
EDIFNNKGSKFDKQMYK

SEQ ID NO: 2063503 - protein, 20 aa, Staphylococcus
EDIGALALTLIMKKIQNQGS

SEQ ID NO: 2063504 - protein, 30 aa, Staphylococcus
EDIGYFCVDNLPPILLPKFVELMEQGNPSL

SEQ ID NO: 2063505 - protein, 30 aa, Staphylococcus
EDIGYFCVDNLPPILLPKFVELMGQGNPSL

SEQ ID NO: 2063506 - protein, 17 aa, Staphylococcus
EDIIARDIIVIARQPAK

SEQ ID NO: 2063507 - protein, 18 aa, Staphylococcus
EDIKIAILPIGYADGYLR

SEQ ID NO: 2063508 - protein, 17 aa, Staphylococcus
EDILLINQFIQSVEKKT

SEQ ID NO: 2063509 - protein, 25 aa, Staphylococcus
EDILLKKYHLPTIDILKVGHHGSRT

SEQ ID NO: 2063510 - protein, 22 aa, Staphylococcus
EDILVQLDRLYNYPELRVSVDT

SEQ ID NO: 2063511 - protein, 18 aa, Staphylococcus
EDIMAVPAVFLDGQEFGN

SEQ ID NO: 2063512 - protein, 21 aa, Staphylococcus
EDINILPIVEEFRESQAEAND

SEQ ID NO: 2063513 - protein, 26 aa, Staphylococcus
EDINRLATRLIFIKNGEVLLQIAKKE

SEQ ID NO: 2063514 - protein, 27 aa, Staphylococcus
EDIPGELIMKILAFDSDLGKIDLVGQE

SEQ ID NO: 2063515 - protein, 26 aa, Staphylococcus
EDIPGELIMKVLAFNPDLEKIERIGQ

SEQ ID NO: 2063516 - protein, 18 aa, Staphylococcus
EDIRHFYTNDVRFLDQFK

SEQ ID NO: 2063517 - protein, 18 aa, Staphylococcus
EDISFDIYKGETLGLVGE

SEQ ID NO: 2063518 - protein, 22 aa, Staphylococcus
EDITQLAFYERGELVDADALEM

SEQ ID NO: 2063519 - protein, 23 aa, Staphylococcus
EDIVAMTSLYRPGPMEEIPTYIT

SEQ ID NO: 2063520 - protein, 21 aa, Staphylococcus
EDIYDYIKIPFNKELLKMYGS

SEQ ID NO: 2063521 - protein, 21 aa, Staphylococcus
EDKAWANALFEPATPPGDVGV

SEQ ID NO: 2063522 - protein, 25 aa, Staphylococcus
EDKEPFIQINYYIDTPNFTLRDHKS

SEQ ID NO: 2063523 - protein, 24 aa, Staphylococcus
EDKGKFNMIFQFEHLGLWSTGDSQ

SEQ ID NO: 2063524 - protein, 29 aa, Staphylococcus
EDKGPGTFMTLLLDALYQVTYDDYSNQSD

SEQ ID NO: 2063525 - protein, 17 aa, Staphylococcus
EDKHILMTMLHQFKVRD

SEQ ID NO: 2063526 - protein, 17 aa, Staphylococcus
EDKILFFNASFGHNEPK

SEQ ID NO: 2063527 - protein, 27 aa, Staphylococcus
EDKIRQEFQFLDYAPIAFVSAKEKQRL

SEQ ID NO: 2063528 - protein, 24 aa, Staphylococcus
EDKKVIMYAPTWRDDEFVKKGQYL

SEQ ID NO: 2063529 - protein, 24 aa, Staphylococcus
EDKKVRGRRLGEDYNKGGIEDGFE

SEQ ID NO: 2063530 - protein, 23 aa, Staphylococcus
EDKNILYAPDYIVNSGGVINTAD

SEQ ID NO: 2063531 - protein, 23 aa, Staphylococcus
EDKQFIFLTLTTPNVTVEHLEDE

SEQ ID NO: 2063532 - protein, 17 aa, Staphylococcus
EDKQKIIYLTPSEPLKY

SEQ ID NO: 2063533 - protein, 24 aa, Staphylococcus
EDKRQEELLKSFKLNGLINSDPEV

SEQ ID NO: 2063534 - protein, 22 aa, Staphylococcus
EDKRVLIEERLRAIGSGLAEVF

SEQ ID NO: 2063535 - protein, 20 aa, Staphylococcus
EDKYQYYFNKIALTEDEFID

SEQ ID NO: 2063536 - protein, 33 aa, Staphylococcus
EDLAWLSHMTQAFPNRLYLSIDAYRRQVKINGW

SEQ ID NO: 2063537 - protein, 24 aa, Staphylococcus
EDLDLTIEYLFKTYPDILTMVQDK

SEQ ID NO: 2063538 - protein, 24 aa, Staphylococcus
EDLDPVFMWHLAYAYGHEERDKEA

SEQ ID NO: 2063539 - protein, 25 aa, Staphylococcus
EDLEMPNMIIFLDADLDVLKARIAK

SEQ ID NO: 2063540 - protein, 26 aa, Staphylococcus
EDLESPNMIIFLDADLDVLKRRIAKR

SEQ ID NO: 2063541 - protein, 26 aa, Staphylococcus
EDLEWPYNTEFFYSPYLIQAMKAHYV

SEQ ID NO: 2063542 - protein, 26 aa, Staphylococcus
EDLGYTDFNLGPEPEFFLFKLDEKGE

SEQ ID NO: 2063543 - protein, 28 aa, Staphylococcus
EDLHAQKILPDIVLLDLVMPEMNGIEVT

SEQ ID NO: 2063544 - protein, 23 aa, Staphylococcus
EDLIKDLRRLGLRVYFNIENALV

SEQ ID NO: 2063545 - protein, 17 aa, Staphylococcus
EDLIYPIFVVERDDVKE

SEQ ID NO: 2063546 - protein, 20 aa, Staphylococcus
EDLIYPIFVVERDNVKEEIK

SEQ ID NO: 2063547 - protein, 24 aa, Staphylococcus
EDLKPFILLVVDKGEGLKAAEDLL

SEQ ID NO: 2063548 - protein, 20 aa, Staphylococcus
EDLNHKLYHYWALGHIHQRQ

SEQ ID NO: 2063549 - protein, 22 aa, Staphylococcus
EDLNNKLYHYWALGHIHERQQL

SEQ ID NO: 2063550 - protein, 19 aa, Staphylococcus
EDLPIYHALLLQGIDKKLE

SEQ ID NO: 2063551 - protein, 18 aa, Staphylococcus
EDLRQFMQNYKGVKINSP

SEQ ID NO: 2063552 - protein, 26 aa, Staphylococcus
EDLTNHIFKIIYNGPLRIMVQHQYKA

SEQ ID NO: 2063553 - protein, 18 aa, Staphylococcus
EDLTPIVPAIMPVVYKHC

SEQ ID NO: 2063554 - protein, 20 aa, Staphylococcus
EDLTQVAFYERGELLDAASI

SEQ ID NO: 2063555 - protein, 28 aa, Staphylococcus
EDLVKEYLYVILIKTFQYWSANKDSIDV

SEQ ID NO: 2063556 - protein, 19 aa, Staphylococcus
EDLWKKLIELWDEQTVLIV

SEQ ID NO: 2063557 - protein, 26 aa, Staphylococcus
EDMEDYLLDLEWLSFQFVDDDFVESI

SEQ ID NO: 2063558 - protein, 25 aa, Staphylococcus
EDMERFLYEHPQVARIIIEKGLMAS

SEQ ID NO: 2063559 - protein, 23 aa, Staphylococcus
EDMFEIIAGERRFRALQSLHKPQ

SEQ ID NO: 2063560 - protein, 26 aa, Staphylococcus
EDMGFTDFNLGPEPEFFLFKLDEKGE

SEQ ID NO: 2063561 - protein, 20 aa, Staphylococcus
EDMIEHIIKYTPSAFNSQST

SEQ ID NO: 2063562 - protein, 30 aa, Staphylococcus
EDMKPFIKKLEDLNLPYDIVFTVGSATTEI

SEQ ID NO: 2063563 - protein, 28 aa, Staphylococcus
EDNIEEKIWYKLLVNLGINSITALGHNT

SEQ ID NO: 2063564 - protein, 17 aa, Staphylococcus
EDNIYVAKLHSVGLSDF

SEQ ID NO: 2063565 - protein, 18 aa, Staphylococcus
EDNKKEIYFKLTAAGQKI

SEQ ID NO: 2063566 - protein, 24 aa, Staphylococcus
EDNKKKLKKLFKYDKKEALAFTKE

SEQ ID NO: 2063567 - protein, 18 aa, Staphylococcus
EDNMRQLLTFKDNQFYLS

SEQ ID NO: 2063568 - protein, 17 aa, Staphylococcus
EDNPTLGDVFGDKLKDF

SEQ ID NO: 2063569 - protein, 33 aa, Staphylococcus
EDNQDLFIDIIFSPIYFNILIKPQSLTEAYIEK

SEQ ID NO: 2063570 - protein, 23 aa, Staphylococcus
EDNQVLHFFVRYGGEFQLKQGFS

SEQ ID NO: 2063571 - protein, 24 aa, Staphylococcus
EDNWFLMQVYSVVNTITILGYEND

SEQ ID NO: 2063572 - protein, 24 aa, Staphylococcus
EDQERTKLYKGWKKAVEATQIFKL

SEQ ID NO: 2063573 - protein, 26 aa, Staphylococcus
EDQIYHLNGRLKLQLLDDVKSIYNSQ

SEQ ID NO: 2063574 - protein, 22 aa, Staphylococcus
EDQLLPLGLPRLSQYLKFNLKA

SEQ ID NO: 2063575 - protein, 29 aa, Staphylococcus
EDQLQEVVIAYEPIWAIGTGKSATSEDAN

SEQ ID NO: 2063576 - protein, 23 aa, Staphylococcus
EDQPRYIYCGTLGILMPDDKMIF

SEQ ID NO: 2063577 - protein, 32 aa, Staphylococcus
EDQQDIFIDLIFSPIYFNILIKPETLTDEYIH

SEQ ID NO: 2063578 - protein, 17 aa, Staphylococcus
EDQYFIAVSKGKKQNCA

SEQ ID NO: 2063579 - protein, 21 aa, Staphylococcus
EDRIRRLLKLYLERESFEIHE

SEQ ID NO: 2063580 - protein, 20 aa, Staphylococcus
EDRIRRLLKLYLERESFNIH

SEQ ID NO: 2063581 - protein, 17 aa, Staphylococcus
EDRLNDYAYIPRTKEIS

SEQ ID NO: 2063582 - protein, 26 aa, Staphylococcus
EDRMPKIVIVIDELADLMMMAPQEVE

SEQ ID NO: 2063583 - protein, 23 aa, Staphylococcus
EDSHPIIQTWKKAYQEIADVFIQ

SEQ ID NO: 2063584 - protein, 18 aa, Staphylococcus
EDTAYIRQLFKQLRVKRD

SEQ ID NO: 2063585 - protein, 23 aa, Staphylococcus
EDTDLFRLALESRSLFPQLCQDL

SEQ ID NO: 2063586 - protein, 27 aa, Staphylococcus
EDTEQITLPHLFADILIYSSERNVMLI

SEQ ID NO: 2063587 - protein, 17 aa, Staphylococcus
EDTIAILKGLRDRYEAH

SEQ ID NO: 2063588 - protein, 23 aa, Staphylococcus
EDTIKALHFATDKASLLKARRTY

SEQ ID NO: 2063589 - protein, 23 aa, Staphylococcus
EDTLMHQAVQLLLDYIHHTQKRN

SEQ ID NO: 2063590 - protein, 29 aa, Staphylococcus
EDTLVKVVKALKWNIIKDGKLLYNLEIMF

SEQ ID NO: 2063591 - protein, 18 aa, Staphylococcus
EDTREIEFGDVVFRKGDK

SEQ ID NO: 2063592 - protein, 28 aa, Staphylococcus
EDTRSLTLPHLFSEILIYSNERHVMLVD

SEQ ID NO: 2063593 - protein, 23 aa, Staphylococcus
EDTTFVVINSTCGCAAGLARPAA

SEQ ID NO: 2063594 - protein, 23 aa, Staphylococcus
EDTVVERLFSFNIAKTLIDSIDA

SEQ ID NO: 2063595 - protein, 23 aa, Staphylococcus
EDVALLAELCSVSLFPINQLDEI

SEQ ID NO: 2063596 - protein, 24 aa, Staphylococcus
EDVALLAELCSVSLFPINQLKEIT

SEQ ID NO: 2063597 - protein, 23 aa, Staphylococcus
EDVENILLRLIQAADFDIDKAEK

SEQ ID NO: 2063598 - protein, 17 aa, Staphylococcus
EDVFIPPTKINRALDGD

SEQ ID NO: 2063599 - protein, 27 aa, Staphylococcus
EDVFNKKMLVFGLTASPNYIMNIRTER

SEQ ID NO: 2063600 - protein, 25 aa, Staphylococcus
EDVIDYFIEYLFQGYDIRNTFTFRI

SEQ ID NO: 2063601 - protein, 25 aa, Staphylococcus
EDVIQPYYHFAIDIPYNHFYDMKEH

SEQ ID NO: 2063602 - protein, 26 aa, Staphylococcus
EDVKGRFEAYGWKHILVKDGNDLDAI

SEQ ID NO: 2063603 - protein, 25 aa, Staphylococcus
EDVRNEFQFLDYAQIAFVSAKESLR

SEQ ID NO: 2063604 - protein, 17 aa, Staphylococcus
EDVVKAIYNCQTPIISA

SEQ ID NO: 2063605 - protein, 24 aa, Staphylococcus
EDVVTFFINQLFVGYEVLNTFAFR

SEQ ID NO: 2063606 - protein, 18 aa, Staphylococcus
EDVYVFDHYKDELYIIST

SEQ ID NO: 2063607 - protein, 17 aa, Staphylococcus
EDWDAMIDTNLKGTLYA

SEQ ID NO: 2063608 - protein, 18 aa, Staphylococcus
EDWLRKTLQQINRELYHY

SEQ ID NO: 2063609 - protein, 20 aa, Staphylococcus
EDYDFYHYFGDIDKDSILKL

SEQ ID NO: 2063610 - protein, 20 aa, Staphylococcus
EDYDIIYYAGGHGTIWDFKD

SEQ ID NO: 2063611 - protein, 18 aa, Staphylococcus
EDYFRLGIPFSTRNNSED

SEQ ID NO: 2063612 - protein, 23 aa, Staphylococcus
EDYLEIQRIYFYKTYQGGGRGQK

SEQ ID NO: 2063613 - protein, 18 aa, Staphylococcus
EDYQWMRDMITGETPPNN

SEQ ID NO: 2063614 - protein, 25 aa, Staphylococcus
EDYTPLLQPITLPNGVQLNNRFVLS

SEQ ID NO: 2063615 - protein, 28 aa, Staphylococcus
EEADQKLIYYNHSLKVFLDNKATYYNEG

SEQ ID NO: 2063616 - protein, 18 aa, Staphylococcus
EEAFALYEDFFKAKQHKI

SEQ ID NO: 2063617 - protein, 18 aa, Staphylococcus
EEAGKFVHHSLGEGTFDD

SEQ ID NO: 2063618 - protein, 34 aa, Staphylococcus
EEAGVTFAGIPLGHEFNSLVLAILQVSGRAPKEK

SEQ ID NO: 2063619 - protein, 21 aa, Staphylococcus
EEAIVLLKQGYDAYDKLMVYY

SEQ ID NO: 2063620 - protein, 25 aa, Staphylococcus
EEAKEYWLCWVTTERGENGPYYAGV

SEQ ID NO: 2063621 - protein, 25 aa, Staphylococcus
EEAKEYWLCWVTTERSESGPYYAGV

SEQ ID NO: 2063622 - protein, 33 aa, Staphylococcus
EEALTTHFEITKLTKPLLINAASFFENEEFNEK

SEQ ID NO: 2063623 - protein, 24 aa, Staphylococcus
EEAPGVGMRFIQINEIKLAIINLQ

SEQ ID NO: 2063624 - protein, 28 aa, Staphylococcus
EEARSIRIDLPPFTLIGATTRAGSLTAP

SEQ ID NO: 2063625 - protein, 27 aa, Staphylococcus
EEASFKMAALILNKYHLPINRETVRLH

SEQ ID NO: 2063626 - protein, 20 aa, Staphylococcus
EEDAAILEWFDAIGRRRGLL

SEQ ID NO: 2063627 - protein, 25 aa, Staphylococcus
EEDLDPVFMWHLAYALGQEERDKEA

SEQ ID NO: 2063628 - protein, 25 aa, Staphylococcus
EEDLDPVFMWHLAYAYGQEERDKEA

SEQ ID NO: 2063629 - protein, 17 aa, Staphylococcus
EEDLKEIYKWMDLGRKV

SEQ ID NO: 2063630 - protein, 17 aa, Staphylococcus
EEDLLVYGVGYIGNQSF

SEQ ID NO: 2063631 - protein, 24 aa, Staphylococcus
EEDMFEIIAGERRFRALQSLSKTH

SEQ ID NO: 2063632 - protein, 33 aa, Staphylococcus
EEDQDLFIDLIFSPIYFNILIKPETLDEAYIEK

SEQ ID NO: 2063633 - protein, 28 aa, Staphylococcus
EEDQDLMIDLVFSPIYFNILIKPQELDE

SEQ ID NO: 2063634 - protein, 29 aa, Staphylococcus
EEDQQELFQYLWLQYLRTDMGRINFVTLI

SEQ ID NO: 2063635 - protein, 33 aa, Staphylococcus
EEDTGITFAGIPLGHEFNSLVLAILQVSGRAPK

SEQ ID NO: 2063636 - protein, 17 aa, Staphylococcus
EEDWIIAYDVYFKSMIG

SEQ ID NO: 2063637 - protein, 19 aa, Staphylococcus
EEDYEAIIALLSYVDEDDL

SEQ ID NO: 2063638 - protein, 28 aa, Staphylococcus
EEECSNLLRQFFRDLRAKKVKRNASPYK

SEQ ID NO: 2063639 - protein, 18 aa, Staphylococcus
EEEDMDDIFIPPTKINRA

SEQ ID NO: 2063640 - protein, 31 aa, Staphylococcus
EEEFQYFKEGLILFTYLHLANEEKLTRALLE

SEQ ID NO: 2063641 - protein, 18 aa, Staphylococcus
EEEFYTFIGQFYDLNQHI

SEQ ID NO: 2063642 - protein, 25 aa, Staphylococcus
EEEFYTFIGQFYRLNQHLLPKEVHV

SEQ ID NO: 2063643 - protein, 25 aa, Staphylococcus
EEEFYTFIGQFYSLNQHILPKEVHV

SEQ ID NO: 2063644 - protein, 23 aa, Staphylococcus
EEEGKFNMIFQFEHLGLWSTGDS

SEQ ID NO: 2063645 - protein, 18 aa, Staphylococcus
EEEKAHITIFPKIENQEG

SEQ ID NO: 2063646 - protein, 22 aa, Staphylococcus
EEELDRVLPVVKALSHLDVQLS

SEQ ID NO: 2063647 - protein, 26 aa, Staphylococcus
EEEYILILRPHIIISNALHLDASLDE

SEQ ID NO: 2063648 - protein, 31 aa, Staphylococcus
EEEYKYFKEGLILFTYLHLANEEKLTQALVD

SEQ ID NO: 2063649 - protein, 31 aa, Staphylococcus
EEEYKYFREGLILFTYLHLANEEKLTQALVD

SEQ ID NO: 2063650 - protein, 39 aa, Staphylococcus
EEFDDIMNELKRFFRPEFLNRFNGIVEFTHLDKHALQDI

SEQ ID NO: 2063651 - protein, 21 aa, Staphylococcus
EEFDTCPLLLTQPSLDRWTPK

SEQ ID NO: 2063652 - protein, 21 aa, Staphylococcus
EEFFEMYSWAQIGIHQKPIAI

SEQ ID NO: 2063653 - protein, 22 aa, Staphylococcus
EEFFRALIINARLTTHIDLLRG

SEQ ID NO: 2063654 - protein, 20 aa, Staphylococcus
EEFGFATAPLVVLGCVMMRV

SEQ ID NO: 2063655 - protein, 25 aa, Staphylococcus
EEFILFHDDFYLKDQIIENCKRIGF

SEQ ID NO: 2063656 - protein, 22 aa, Staphylococcus
EEFIRPLPHISFVRGKNNVQFL

SEQ ID NO: 2063657 - protein, 17 aa, Staphylococcus
EEFKTYLPVNEATPSLT

SEQ ID NO: 2063658 - protein, 28 aa, Staphylococcus
EEFLEKIRQALYMSKICSYAQGFAQMRK

SEQ ID NO: 2063659 - protein, 19 aa, Staphylococcus
EEGIIFIGPELKHLDMFGD

SEQ ID NO: 2063660 - protein, 18 aa, Staphylococcus
EEGLNYYYPLKYDGYDKY

SEQ ID NO: 2063661 - protein, 19 aa, Staphylococcus
EEGLSILNGFISQAKEGNQ

SEQ ID NO: 2063662 - protein, 20 aa, Staphylococcus
EEGNFPKWKMYIQVMTEEQA

SEQ ID NO: 2063663 - protein, 18 aa, Staphylococcus
EEGTTYKIYFGFASRQTY

SEQ ID NO: 2063664 - protein, 17 aa, Staphylococcus
EEGVDDIFIPPTKINRA

SEQ ID NO: 2063665 - protein, 17 aa, Staphylococcus
EEGYTDVICVFLSSGIS

SEQ ID NO: 2063666 - protein, 18 aa, Staphylococcus
EEHGAISAPIHDENFPGQ

SEQ ID NO: 2063667 - protein, 25 aa, Staphylococcus
EEHKARIDSIRKVSKKLGKTIGILL

SEQ ID NO: 2063668 - protein, 31 aa, Staphylococcus
EEHNIHVLLTDTFALNKPAQGLFEKFGFIKV

SEQ ID NO: 2063669 - protein, 23 aa, Staphylococcus
EEIALALYVRKDHYGIETKLKLE

SEQ ID NO: 2063670 - protein, 18 aa, Staphylococcus
EEICETIKPLDNESLLAF

SEQ ID NO: 2063671 - protein, 18 aa, Staphylococcus
EEIDFFIAKGVVDRVAEK

SEQ ID NO: 2063672 - protein, 24 aa, Staphylococcus
EEIDSIVERLLSRLLKENQEQSLI

SEQ ID NO: 2063673 - protein, 23 aa, Staphylococcus
EEIDYAPFINFVEDVFLHEGEVK

SEQ ID NO: 2063674 - protein, 25 aa, Staphylococcus
EEIEWQNFWKTFASQWLKDLNINEE

SEQ ID NO: 2063675 - protein, 33 aa, Staphylococcus
EEIEWQNYWKTFAEKWLLDLGIKNDSIRLRDHD

SEQ ID NO: 2063676 - protein, 27 aa, Staphylococcus
EEIEWQNYWKTFASQWLKDLNLSEEAT

SEQ ID NO: 2063677 - protein, 25 aa, Staphylococcus
EEIGDDHIIIPLSAVSRDNIDQLLY

SEQ ID NO: 2063678 - protein, 23 aa, Staphylococcus
EEIGGIYCSSYLTDHGYLGDFVI

SEQ ID NO: 2063679 - protein, 26 aa, Staphylococcus
EEIHQVGDVILFIDELHTLIGAGGAE

SEQ ID NO: 2063680 - protein, 22 aa, Staphylococcus
EEIKWMITEYTKGNIPDYQMSS

SEQ ID NO: 2063681 - protein, 19 aa, Staphylococcus
EEILNIKELILLDLKKTSL

SEQ ID NO: 2063682 - protein, 22 aa, Staphylococcus
EEILQKIWELSGKTAERLSKLQ

SEQ ID NO: 2063683 - protein, 38 aa, Staphylococcus; identical to SEQ ID NO: 1683849

SEQ ID NO: 2063684 - protein, 28 aa, Staphylococcus
EEIPGEIIMKILAFNPDLEKLTKIEQLL

SEQ ID NO: 2063685 - protein, 26 aa, Staphylococcus
EEIRLLFFQDFARPLYYEHSTLKFYL

SEQ ID NO: 2063686 - protein, 24 aa, Staphylococcus
EEIRNTVRILSRKTKNNPVLIGEP

SEQ ID NO: 2063687 - protein, 26 aa, Staphylococcus
EEISNHLYFTEFDFPKALTKDELSEQ

SEQ ID NO: 2063688 - protein, 23 aa, Staphylococcus
EEIYNHFDVNWIAPAMREDGSEF

SEQ ID NO: 2063689 - protein, 23 aa, Staphylococcus
EEKAKALGVKPIAILDSFGTSGV

SEQ ID NO: 2063690 - protein, 23 aa, Staphylococcus
EEKGILYAPDYIVNSGGVINTAD

SEQ ID NO: 2063691 - protein, 25 aa, Staphylococcus
EEKKKNLKFIKKAKFIFLSPEFILN

SEQ ID NO: 2063692 - protein, 20 aa, Staphylococcus
EEKLLLIEKGRYNSRHFIDE

SEQ ID NO: 2063693 - protein, 30 aa, Staphylococcus
EEKNYLDAVIGLPANIFYGTSIPTCVLVFK

SEQ ID NO: 2063694 - protein, 24 aa, Staphylococcus
EEKRCPTCHMTLKDIAHVGKFGCA

SEQ ID NO: 2063695 - protein, 24 aa, Staphylococcus
EEKRCPTCHMTLKDIAHVGKFGCS

SEQ ID NO: 2063696 - protein, 24 aa, Staphylococcus
EEKRIVIYIDPNGRLSFMIVKKHK

SEQ ID NO: 2063697 - protein, 17 aa, Staphylococcus
EEKTGITIMYMVKKLDA

SEQ ID NO: 2063698 - protein, 25 aa, Staphylococcus
EEKTNYLNILIEKQKFEEAAVIRDE

SEQ ID NO: 2063699 - protein, 23 aa, Staphylococcus
EEKYDLFVLVVTDIINSDSKILV

SEQ ID NO: 2063700 - protein, 19 aa, Staphylococcus
EELAIPHAAFKDIVKMMDY

SEQ ID NO: 2063701 - protein, 28 aa, Staphylococcus
EELEKEKDFLQVLVKEDNSQLPTDQNIS

SEQ ID NO: 2063702 - protein, 25 aa, Staphylococcus
EELEKLRLLTHVQYFYNYNNENALN

SEQ ID NO: 2063703 - protein, 28 aa, Staphylococcus
EELEPEDLYQILRKLPPREYSISSSYQS

SEQ ID NO: 2063704 - protein, 25 aa, Staphylococcus
EELERYKKEILNDNYLVVATKDTTS

SEQ ID NO: 2063705 - protein, 19 aa, Staphylococcus
EELEVISHSSFDYIKDLKA

SEQ ID NO: 2063706 - protein, 22 aa, Staphylococcus
EELFARIRAILRRQPQKDVIDI

SEQ ID NO: 2063707 - protein, 26 aa, Staphylococcus
EELGFTDFNLGPEPEFFLFKLDEKGE

SEQ ID NO: 2063708 - protein, 24 aa, Staphylococcus
EELGLNRFMLHIPVGSMPHERIMK

SEQ ID NO: 2063709 - protein, 31 aa, Staphylococcus
EELGLSGNTWLFFGEQYFTTDFLYQTEWQAW

SEQ ID NO: 2063710 - protein, 30 aa, Staphylococcus
EELIGDFYKPINKVKYWLFTTLDRIRSKVK

SEQ ID NO: 2063711 - protein, 23 aa, Staphylococcus
EELIQPILKEKFENLGLAVKEDH

SEQ ID NO: 2063712 - protein, 25 aa, Staphylococcus
EELKAQMLEQIPLAKFGEDSDIANT

SEQ ID NO: 2063713 - protein, 25 aa, Staphylococcus
EELKQRYDFILIDTPPVNTVTDAQL

SEQ ID NO: 2063714 - protein, 24 aa, Staphylococcus
EELLARIRAILRRQPQKNVIDING

SEQ ID NO: 2063715 - protein, 22 aa, Staphylococcus
EELLTIYEWPEKLLNKELKKLV

SEQ ID NO: 2063716 - protein, 22 aa, Staphylococcus
EELLTIYEWPEKLMTKELKKLA

SEQ ID NO: 2063717 - protein, 25 aa, Staphylococcus
EELMSGYLIAYPEYIRRSELHKRAL

SEQ ID NO: 2063718 - protein, 26 aa, Staphylococcus
EELQTDLLGHLPLEQPSWNPKDFAPS

SEQ ID NO: 2063719 - protein, 20 aa, Staphylococcus
EELRLLARSVFVLDESNKIV

SEQ ID NO: 2063720 - protein, 22 aa, Staphylococcus
EELRLLNMFKQRQIAGVIMGAL

SEQ ID NO: 2063721 - protein, 24 aa, Staphylococcus
EELRTEIQKMREDRQMLGQMMTQV

SEQ ID NO: 2063722 - protein, 21 aa, Staphylococcus
EELSHYWGTVRQYYSDFESDI

SEQ ID NO: 2063723 - protein, 24 aa, Staphylococcus
EELSSIMLTYRLKSATGLLSAKTY

SEQ ID NO: 2063724 - protein, 20 aa, Staphylococcus
EELVIIEKPMRAFSENSDQM

SEQ ID NO: 2063725 - protein, 24 aa, Staphylococcus
EEMAELYEFLGLSVGLNLNSKTTT

SEQ ID NO: 2063726 - protein, 25 aa, Staphylococcus
EEMAELYEFLGLTVGLNLNSKSTEE

SEQ ID NO: 2063727 - protein, 25 aa, Staphylococcus
EEMAELYEFLGLTVGLNLNSKSTNE

SEQ ID NO: 2063728 - protein, 23 aa, Staphylococcus
EEMAELYNFLGLSVGLNLNSLST

SEQ ID NO: 2063729 - protein, 34 aa, Staphylococcus
EEMKPFLTRDQHRLYKLIWERFVASQMAPAILDT

SEQ ID NO: 2063730 - protein, 35 aa, Staphylococcus
EEMRFVDSWLVTTKFKLPKWLYNKMQNRALNKHRN

SEQ ID NO: 2063731 - protein, 23 aa, Staphylococcus
EEMRLMYVALTRAKEQLFLVGRV

SEQ ID NO: 2063732 - protein, 50 aa, Staphylococcus
EENAPVIWRGPMLGKMLTNFFTEVKWGDLDYLLLDLPPGTGDVALDVHSM

SEQ ID NO: 2063733 - protein, 49 aa, Staphylococcus
EENAPVIWRGPMLGKMLTNFFTEVKWGELDYLILDLPPGTGDVALDVHT

SEQ ID NO: 2063734 - protein, 50 aa, Staphylococcus; identical to SEQ ID NO: 1826427

SEQ ID NO: 2063735 - protein, 29 aa, Staphylococcus
EENAPVIWRGPMLGKMLTNFFVEVKWGEL

SEQ ID NO: 2063736 - protein, 50 aa, Staphylococcus
EENAPVIWRGPMLGKMLTNFFVEVKWGELDYLLLDLPPGTGDVALDVHSM

SEQ ID NO: 2063737 - protein, 50 aa, Staphylococcus
EENAPVIWRGPMLGKMLTNFFVEVRWGDLDYLILDLPPGTGDIALDVHTM

SEQ ID NO: 2063738 - protein, 24 aa, Staphylococcus
EENAQVRVLPYAAITVRQAGKEHV

SEQ ID NO: 2063739 - protein, 30 aa, Staphylococcus
EENDVYFLNGPLDLTFLFGLVDHLSNKLKY

SEQ ID NO: 2063740 - protein, 24 aa, Staphylococcus
EENEKLAHFILDKNIELSEEIMSD

SEQ ID NO: 2063741 - protein, 25 aa, Staphylococcus
EENIAYQYATIRNVLYNKGYTTEML

SEQ ID NO: 2063742 - protein, 17 aa, Staphylococcus
EENIDVFDFELSADQMK

SEQ ID NO: 2063743 - protein, 20 aa, Staphylococcus
EENIKAIKYAQSQGITVVIA

SEQ ID NO: 2063744 - protein, 32 aa, Staphylococcus
EENIPFEPMKGGIFLWLKTPPNFDGESFVDYL

SEQ ID NO: 2063745 - protein, 24 aa, Staphylococcus
EENIPYVDYMSGLLSIIEERTHQS

SEQ ID NO: 2063746 - protein, 22 aa, Staphylococcus
EENIWINMHYISDIKPLKNRKS

SEQ ID NO: 2063747 - protein, 25 aa, Staphylococcus
EENKVLQFYVRYGGEFQLKQGFSPA

SEQ ID NO: 2063748 - protein, 17 aa, Staphylococcus
EENPHLYMIGNDAIGLG

SEQ ID NO: 2063749 - protein, 23 aa, Staphylococcus
EENPYIEIIKFDYQVGTGGYGVG

SEQ ID NO: 2063750 - protein, 26 aa, Staphylococcus
EENSYREFFLLCFLSISNKVSNRRKT

SEQ ID NO: 2063751 - protein, 30 aa, Staphylococcus
EEPEPIYGKTYLPRKFKIGIAVPPSNDIDV

SEQ ID NO: 2063752 - protein, 30 aa, Staphylococcus
EEPKNQGAWSFVYPYLKELTTDKYDLSYHG

SEQ ID NO: 2063753 - protein, 24 aa, Staphylococcus
EEPLDINEFKQIILKTIFGENEVE

SEQ ID NO: 2063754 - protein, 23 aa, Staphylococcus
EEPLTFPLMALIVSGGHTELVYM

SEQ ID NO: 2063755 - protein, 22 aa, Staphylococcus
EEQFDLWKHADLGDIVGVEGVM

SEQ ID NO: 2063756 - protein, 24 aa, Staphylococcus
EEQKAIILYALIQSKIPIKQYSLA

SEQ ID NO: 2063757 - protein, 25 aa, Staphylococcus
EEQKRFMHHYNFPNYSVGETGPVRS

SEQ ID NO: 2063758 - protein, 18 aa, Staphylococcus
EEQKVIILYALIQAKHAI

SEQ ID NO: 2063759 - protein, 23 aa, Staphylococcus
EEQKVIILYALIQSDTPIKQYGL

SEQ ID NO: 2063760 - protein, 28 aa, Staphylococcus
EEQLALINQLLPMLTPEQQHWLSGYLLN

SEQ ID NO: 2063761 - protein, 28 aa, Staphylococcus
EEQLKEVVIAYEPIWAIGTGKSATSDDA

SEQ ID NO: 2063762 - protein, 25 aa, Staphylococcus
EEQLYNLIIEKIRHAFKDRILIPKN

SEQ ID NO: 2063763 - protein, 24 aa, Staphylococcus
EEQTLFFGGLARIDYVSGGKRSLV

SEQ ID NO: 2063764 - protein, 25 aa, Staphylococcus
EEQWKAMELGWKVVPSVKSNAIILS

SEQ ID NO: 2063765 - protein, 21 aa, Staphylococcus
EERFKGFYSPSPGSVYPILQM

SEQ ID NO: 2063766 - protein, 17 aa, Staphylococcus
EERGYHLSKTEYRGREA

SEQ ID NO: 2063767 - protein, 25 aa, Staphylococcus
EERLKLIHQWVDGRIPVIGIGSVFS

SEQ ID NO: 2063768 - protein, 17 aa, Staphylococcus
EERLKLSAAYVRDFYQT

SEQ ID NO: 2063769 - protein, 19 aa, Staphylococcus
EERTKIQILAPLVSHRKGS

SEQ ID NO: 2063770 - protein, 18 aa, Staphylococcus
EERVKLLRKIGDKILEQK

SEQ ID NO: 2063771 - protein, 23 aa, Staphylococcus
EERYHYMIARKYHFMGYSQMKTL

SEQ ID NO: 2063772 - protein, 22 aa, Staphylococcus
EESENIMAVPAIFLDGEEFGNG

SEQ ID NO: 2063773 - protein, 23 aa, Staphylococcus
EESENIMAVPAVFLDGEEFGNGR

SEQ ID NO: 2063774 - protein, 27 aa, Staphylococcus
EESFKEWLRLFLSEQLTYADGLAIRLV

SEQ ID NO: 2063775 - protein, 25 aa, Staphylococcus
EESFQQFIYFIGEHKKVFKHLLTSS

SEQ ID NO: 2063776 - protein, 25 aa, Staphylococcus
EESFQQWLVLFLNEQLTYADGLTMR

SEQ ID NO: 2063777 - protein, 17 aa, Staphylococcus
EESGHWDHYHENMYFTK

SEQ ID NO: 2063778 - protein, 18 aa, Staphylococcus
EESHQDVILLYAAKNTKY

SEQ ID NO: 2063779 - protein, 22 aa, Staphylococcus
EESKDIMAVPAVFLDGEEFGNG

SEQ ID NO: 2063780 - protein, 24 aa, Staphylococcus
EESKKLFDEFRETQLKFQQMQMQG

SEQ ID NO: 2063781 - protein, 29 aa, Staphylococcus
EESVGFVMDLNFLGTFIPSQVFATDMLDK

SEQ ID NO: 2063782 - protein, 24 aa, Staphylococcus
EETAKWRYIENKLAQLMKLYNYQE

SEQ ID NO: 2063783 - protein, 27 aa, Staphylococcus
EETARQCAIVWGVNPVVKEGRKNTDAL

SEQ ID NO: 2063784 - protein, 23 aa, Staphylococcus
EETDFYQMLLNESLIDETFGYQF

SEQ ID NO: 2063785 - protein, 26 aa, Staphylococcus
EETFKKLLIHPTIASKHYLYEQYDQQ

SEQ ID NO: 2063786 - protein, 27 aa, Staphylococcus
EETLIQPTFVYGHPIEISPLAKKNAED

SEQ ID NO: 2063787 - protein, 28 aa, Staphylococcus
EETLIQPTFVYGHPIEISPLAKKNPEDP

SEQ ID NO: 2063788 - protein, 24 aa, Staphylococcus
EETPFAAIILAEIFDKVGVPKGVF

SEQ ID NO: 2063789 - protein, 28 aa, Staphylococcus
EETQQFKALRRFFKIYIRGIKGASQLRH

SEQ ID NO: 2063790 - protein, 24 aa, Staphylococcus
EETQTLIHLPFDYMFFTGSEKVGQ

SEQ ID NO: 2063791 - protein, 23 aa, Staphylococcus
EETRTKLYKGWKKAVEATQVFKL

SEQ ID NO: 2063792 - protein, 30 aa, Staphylococcus
EETSELHDLAFLLLVYPLSEIEGALDSAYY

SEQ ID NO: 2063793 - protein, 38 aa, Staphylococcus
EETTTLYDIPAGRIPLTVKTLSILHFVTPNGGKLKIHY

SEQ ID NO: 2063794 - protein, 30 aa, Staphylococcus
EETYFPDCDDYILLWKLEVLEKYQGRGYAK

SEQ ID NO: 2063795 - protein, 25 aa, Staphylococcus
EEVADIVVMTLIKEDWQFDETLLRE

SEQ ID NO: 2063796 - protein, 20 aa, Staphylococcus
EEVDFVLIVGDLFDSENRTL

SEQ ID NO: 2063797 - protein, 22 aa, Staphylococcus
EEVFRAWTKPSLFKQWFMTTEE

SEQ ID NO: 2063798 - protein, 23 aa, Staphylococcus
EEVGIKNLIYPVNIDRFQTAGRF

SEQ ID NO: 2063799 - protein, 33 aa, Staphylococcus
EEVKALNEFAINGLYPDLTIYLDVSAEVGRERI

SEQ ID NO: 2063800 - protein, 33 aa, Staphylococcus
EEVKTLNEFAINGLYPDLTIYLDVSAEVGHQRI

SEQ ID NO: 2063801 - protein, 23 aa, Staphylococcus
EEVMLLRHMILAHHGKLEFGSPK

SEQ ID NO: 2063802 - protein, 23 aa, Staphylococcus
EEVPLEWLKRYDKNLIIIFKDID

SEQ ID NO: 2063803 - protein, 25 aa, Staphylococcus
EEVPPPLMEFIFDTTRTIIYMSQKN

SEQ ID NO: 2063804 - protein, 34 aa, Staphylococcus
EEVRAINEFAINGLYPDLTIYLDITAETGRERIE

SEQ ID NO: 2063805 - protein, 31 aa, Staphylococcus
EEVRKLNDFAINGLYPDLTIYLDISAEIGRQ

SEQ ID NO: 2063806 - protein, 24 aa, Staphylococcus
EEVVTRLLDIELSIGRTGVVTPTA

SEQ ID NO: 2063807 - protein, 18 aa, Staphylococcus
EEYASFIRKQWAKLGLGL

SEQ ID NO: 2063808 - protein, 19 aa, Staphylococcus
EEYASFIRQQWAKLGLGLD

SEQ ID NO: 2063809 - protein, 25 aa, Staphylococcus
EEYASFIRQQWAKLGLGLDYSRERF

SEQ ID NO: 2063810 - protein, 21 aa, Staphylococcus
EEYFPLPEHLTSTHNSDIFIL

SEQ ID NO: 2063811 - protein, 17 aa, Staphylococcus
EEYKKAIDKTMFPGIQG

SEQ ID NO: 2063812 - protein, 26 aa, Staphylococcus
EEYKKQIDKTIFPGIQSGPLEHVIAA

SEQ ID NO: 2063813 - protein, 18 aa, Staphylococcus
EEYQLVINLIKEHPTLIF

SEQ ID NO: 2063814 - protein, 22 aa, Staphylococcus
EEYSKTFFYAFNNLPENERKAV

SEQ ID NO: 2063815 - protein, 18 aa, Staphylococcus
EEYYPIETIVYGIKNIKQ

SEQ ID NO: 2063816 - protein, 18 aa, Staphylococcus
EFAALAYKHKKPIIFNKA

SEQ ID NO: 2063817 - protein, 28 aa, Staphylococcus
EFADDIILLLDYLYIDQAAFIGHEMGAT

SEQ ID NO: 2063818 - protein, 28 aa, Staphylococcus
EFADDIILLLDYLYIEQAAFIGHELGAN

SEQ ID NO: 2063819 - protein, 22 aa, Staphylococcus
EFAHIITQILTSKGIKVYLADV

SEQ ID NO: 2063820 - protein, 21 aa, Staphylococcus
EFARALKIPQIAVSLGGIQTI

SEQ ID NO: 2063821 - protein, 18 aa, Staphylococcus
EFARWHGRYWKSSDDDVN

SEQ ID NO: 2063822 - protein, 18 aa, Staphylococcus
EFCKQSMERYLASFKPKL

SEQ ID NO: 2063823 - protein, 18 aa, Staphylococcus
EFCTKIAWIEGGKLKEFG

SEQ ID NO: 2063824 - protein, 19 aa, Staphylococcus
EFCTKIAWIEGGKLKEYGD

SEQ ID NO: 2063825 - protein, 25 aa, Staphylococcus
EFDDNLLDKLYSFIANDLYDGQFTA

SEQ ID NO: 2063826 - protein, 18 aa, Staphylococcus
EFDIIRDQLLLIGGLSKS

SEQ ID NO: 2063827 - protein, 24 aa, Staphylococcus
EFDKKQLILYEGKDGKKKGIKLDK

SEQ ID NO: 2063828 - protein, 26 aa, Staphylococcus
EFDLGHFRGAIRPDITRFRDLPDWIR

SEQ ID NO: 2063829 - protein, 26 aa, Staphylococcus
EFDLGHFRGAIRPDITRFRDLPNWIR

SEQ ID NO: 2063830 - protein, 21 aa, Staphylococcus
EFDLGHFRGAVRPDITRFRDL

SEQ ID NO: 2063831 - protein, 23 aa, Staphylococcus
EFDVITIFCDSLNYLPDIEDVNK

SEQ ID NO: 2063832 - protein, 20 aa, Staphylococcus
EFEAPLVEFFYKNDDLNDPL

SEQ ID NO: 2063833 - protein, 24 aa, Staphylococcus
EFEDKKIQVFKIGDGGLGGEIHLY

SEQ ID NO: 2063834 - protein, 17 aa, Staphylococcus
EFEFGSVKYVQAFHSSS

SEQ ID NO: 2063835 - protein, 27 aa, Staphylococcus
EFEFKLRNQYFKIQRQGAFIKEGNKNK

SEQ ID NO: 2063836 - protein, 21 aa, Staphylococcus
EFEIYSKLFKSWSGTIHTSMY

SEQ ID NO: 2063837 - protein, 18 aa, Staphylococcus
EFENILIQLDRLGNYAEL

SEQ ID NO: 2063838 - protein, 27 aa, Staphylococcus
EFENMYEWLSNFKLYKVPKTFITKNPK

SEQ ID NO: 2063839 - protein, 24 aa, Staphylococcus
EFESYYERIFQPEFYQLPQSYINS

SEQ ID NO: 2063840 - protein, 19 aa, Staphylococcus
EFETEFGVYLRKVRGWATL

SEQ ID NO: 2063841 - protein, 18 aa, Staphylococcus
EFFGTMKPFILKPKADDS

SEQ ID NO: 2063842 - protein, 19 aa, Staphylococcus
EFFGTMKPFILKPKADDSV

SEQ ID NO: 2063843 - protein, 18 aa, Staphylococcus
EFFGTMKPFILKPKEDDS

SEQ ID NO: 2063844 - protein, 19 aa, Staphylococcus
EFFKKVFVGYTDSLKNSDE

SEQ ID NO: 2063845 - protein, 20 aa, Staphylococcus
EFFRGLVINARLTTHIDLIR

SEQ ID NO: 2063846 - protein, 17 aa, Staphylococcus
EFFWERYTQEIKKSITV

SEQ ID NO: 2063847 - protein, 27 aa, Staphylococcus
EFGLEGNRLFYLAMAPNFFGVVTDYLK

SEQ ID NO: 2063848 - protein, 18 aa, Staphylococcus
EFGRQFIDQIPTINPVKT

SEQ ID NO: 2063849 - protein, 24 aa, Staphylococcus
EFGSPKAIIPKKLAHEVGADLIMS

SEQ ID NO: 2063850 - protein, 25 aa, Staphylococcus
EFGSPKAIIPKKLANELGVDLIMCG

SEQ ID NO: 2063851 - protein, 24 aa, Staphylococcus
EFGSPKAIIPKKLASELGVDLIMC

SEQ ID NO: 2063852 - protein, 20 aa, Staphylococcus
EFHPYFTQEKLRKYLEAQNI

SEQ ID NO: 2063853 - protein, 17 aa, Staphylococcus
EFIAFDMGALGDGQASD

SEQ ID NO: 2063854 - protein, 26 aa, Staphylococcus
EFIAKNTLLNLIRKYKHMHPQDIVQI

SEQ ID NO: 2063855 - protein, 18 aa, Staphylococcus
EFINHVLPILEQKGYYTQ

SEQ ID NO: 2063856 - protein, 17 aa, Staphylococcus
EFINLYEELAGDDVEII

SEQ ID NO: 2063857 - protein, 26 aa, Staphylococcus
EFIQIDTTNILFILGGAFDGIDEVIK

SEQ ID NO: 2063858 - protein, 32 aa, Staphylococcus
EFKFGLSFLTRSVALSRFPWLSANIEYIKTKE

SEQ ID NO: 2063859 - protein, 30 aa, Staphylococcus
EFKFNIYEYEFKSEPKHLILKTHAYVGYSV

SEQ ID NO: 2063860 - protein, 18 aa, Staphylococcus
EFKFYKKAQFIPTEDRES

SEQ ID NO: 2063861 - protein, 19 aa, Staphylococcus
EFKHAALLYDFGYKYLETV

SEQ ID NO: 2063862 - protein, 18 aa, Staphylococcus
EFKKQLIELYKVADTPEA

SEQ ID NO: 2063863 - protein, 19 aa, Staphylococcus
EFKMLCMGFKKKEIKRLMP

SEQ ID NO: 2063864 - protein, 22 aa, Staphylococcus
EFKMLCMGFKRKEIKQLMPQVI

SEQ ID NO: 2063865 - protein, 18 aa, Staphylococcus
EFKNKHLRLAISKAINKK

SEQ ID NO: 2063866 - protein, 20 aa, Staphylococcus
EFKPYYLTKALQKLKDLNLL

SEQ ID NO: 2063867 - protein, 19 aa, Staphylococcus
EFKPYYLTKALQKLKELKL

SEQ ID NO: 2063868 - protein, 20 aa, Staphylococcus
EFKPYYLTKALQKLKELNLL

SEQ ID NO: 2063869 - protein, 20 aa, Staphylococcus
EFLARTLSQSEFRFLDADNK

SEQ ID NO: 2063870 - protein, 29 aa, Staphylococcus
EFLDEPLDIDRFKEIILKTIFGEATQVEE

SEQ ID NO: 2063871 - protein, 18 aa, Staphylococcus
EFLSQDELKWYTRSPRKI

SEQ ID NO: 2063872 - protein, 28 aa, Staphylococcus
EFNLNGNRLFYLAMAPKFFGVISDYLKS

SEQ ID NO: 2063873 - protein, 25 aa, Staphylococcus
EFNSMNQRILLPSSQLARPKLAHQL

SEQ ID NO: 2063874 - protein, 17 aa, Staphylococcus
EFPIVFIMGMEESIFPH

SEQ ID NO: 2063875 - protein, 18 aa, Staphylococcus
EFPQYTRPREYKGMSVPD

SEQ ID NO: 2063876 - protein, 21 aa, Staphylococcus
EFPRIQLFMRSYTGTSHWESE

SEQ ID NO: 2063877 - protein, 18 aa, Staphylococcus
EFQRLRRIKQLGTLYLAF

SEQ ID NO: 2063878 - protein, 17 aa, Staphylococcus
EFQTLICELTNMDVANS

SEQ ID NO: 2063879 - protein, 19 aa, Staphylococcus
EFQVFLQTHLEGHQLFAEE

SEQ ID NO: 2063880 - protein, 24 aa, Staphylococcus
EFQYCNFNHHYLHDVALQNVVYDK

SEQ ID NO: 2063881 - protein, 18 aa, Staphylococcus
EFRMGNMKETLFNQITKE

SEQ ID NO: 2063882 - protein, 19 aa, Staphylococcus
EFRYFGKPIPALQSLDSQD

SEQ ID NO: 2063883 - protein, 18 aa, Staphylococcus
EFSDLIDFAITLKDYKQK

SEQ ID NO: 2063884 - protein, 18 aa, Staphylococcus
EFSDSYVYSLLREEYEKL

SEQ ID NO: 2063885 - protein, 19 aa, Staphylococcus
EFSEEKLALAKKIIISQRQ

SEQ ID NO: 2063886 - protein, 30 aa, Staphylococcus
EFTHKYPEQLGFFATLPLPLVKESIETIDT

SEQ ID NO: 2063887 - protein, 21 aa, Staphylococcus
EFVAYFMKKLHLTEQDIVIID

SEQ ID NO: 2063888 - protein, 18 aa, Staphylococcus
EFVNSLERPRKILLMVKA

SEQ ID NO: 2063889 - protein, 18 aa, Staphylococcus
EFVQLLTIKLWELSRKYN

SEQ ID NO: 2063890 - protein, 34 aa, Staphylococcus
EFYALPQSPQIFKQLLMISGFDKYYQIVKCFRDE

SEQ ID NO: 2063891 - protein, 29 aa, Staphylococcus
EFYEMELSNLYIYKLAVISNMRLQSLSSC

SEQ ID NO: 2063892 - protein, 20 aa, Staphylococcus
EFYFLPSYMAPLKEHQDFLD

SEQ ID NO: 2063893 - protein, 18 aa, Staphylococcus
EFYQFWLNQDDRDVIKYL

SEQ ID NO: 2063894 - protein, 23 aa, Staphylococcus
EFYQLLLIQLWHLTHHYQPSQSS

SEQ ID NO: 2063895 - protein, 31 aa, Staphylococcus
EFYQPKPGTDLVWLSAVTKYIIDHHLHDIEF

SEQ ID NO: 2063896 - protein, 17 aa, Staphylococcus
EFYTFIGQFYSLNQHIL

SEQ ID NO: 2063897 - protein, 23 aa, Staphylococcus
EFYTFIGQFYSLNQHILPKEVHV

SEQ ID NO: 2063898 - protein, 18 aa, Staphylococcus
EFYYFIEKTFLDYYVKNH

SEQ ID NO: 2063899 - protein, 24 aa, Staphylococcus
EGAALAMSILDHVRNLGALVMATT

SEQ ID NO: 2063900 - protein, 25 aa, Staphylococcus
EGAARYMGGFYTVVKMVEGLMHDKE

SEQ ID NO: 2063901 - protein, 25 aa, Staphylococcus
EGAARYMSGFYTVVKMVEGLIHDLN

SEQ ID NO: 2063902 - protein, 26 aa, Staphylococcus
EGAARYMSGFYTVVKMVEGLLHDLKI

SEQ ID NO: 2063903 - protein, 30 aa, Staphylococcus
EGADVRLEFYRLYLLMVHLVKFGEMYAGSV

SEQ ID NO: 2063904 - protein, 23 aa, Staphylococcus
EGAFYIFPSIKRFTNNDFDFCVN

SEQ ID NO: 2063905 - protein, 20 aa, Staphylococcus
EGAFYIFPSIQRFTENDFDF

SEQ ID NO: 2063906 - protein, 21 aa, Staphylococcus
EGAIILKFFLTLDKDEQLKRF

SEQ ID NO: 2063907 - protein, 20 aa, Staphylococcus
EGAIILKFFLTLDKEEQLKR

SEQ ID NO: 2063908 - protein, 23 aa, Staphylococcus
EGAKNAVLPILTASLLASEGKSK

SEQ ID NO: 2063909 - protein, 17 aa, Staphylococcus
EGAKNAVLPVLTASLLA

SEQ ID NO: 2063910 - protein, 17 aa, Staphylococcus
EGAKRVFNMTPYKVQVM

SEQ ID NO: 2063911 - protein, 28 aa, Staphylococcus
EGALLYTHNVIQAALPYLKQQQAASIIN

SEQ ID NO: 2063912 - protein, 20 aa, Staphylococcus
EGALRFYDFLNTQSFKVGDK

SEQ ID NO: 2063913 - protein, 32 aa, Staphylococcus
EGANIDIGYLPGKLKWLVADLLTKQGLQVVNK

SEQ ID NO: 2063914 - protein, 26 aa, Staphylococcus
EGANLAKVFYYFKEAHPYFDQNVVVI

SEQ ID NO: 2063915 - protein, 26 aa, Staphylococcus
EGANTTFFMLTLTPFKNIKFETFALS

SEQ ID NO: 2063916 - protein, 19 aa, Staphylococcus
EGAQKYLSYLKSTIDINLD

SEQ ID NO: 2063917 - protein, 24 aa, Staphylococcus
EGAYDLLIIMSHVGVFFDEKLCQE

SEQ ID NO: 2063918 - protein, 18 aa, Staphylococcus
EGCMPFEVMAERGRKTLL

SEQ ID NO: 2063919 - protein, 29 aa, Staphylococcus
EGCNNFCTFCIIPWARGLMRSRDPKKVVE

SEQ ID NO: 2063920 - protein, 26 aa, Staphylococcus
EGDESFRILKEQPKVIWLDCDIEILY

SEQ ID NO: 2063921 - protein, 31 aa, Staphylococcus
EGDKSLTYWREAHIAFFKPYYESLEIDFNET

SEQ ID NO: 2063922 - protein, 32 aa, Staphylococcus
EGDQLSRTKGFDGWAPLFFRGREVSGKVLGIV

SEQ ID NO: 2063923 - protein, 19 aa, Staphylococcus
EGDRLRFDFSHFGPVTEEE

SEQ ID NO: 2063924 - protein, 22 aa, Staphylococcus
EGDSFTFDKVLFVGGDAVKVGA

SEQ ID NO: 2063925 - protein, 23 aa, Staphylococcus
EGDSFTFDKVLFVGGDSVKVGAP

SEQ ID NO: 2063926 - protein, 19 aa, Staphylococcus
EGDSLIPPFIAVPGLGENV

SEQ ID NO: 2063927 - protein, 26 aa, Staphylococcus
EGDSRLNLFLGGIDRYGLEFEYLPQS

SEQ ID NO: 2063928 - protein, 21 aa, Staphylococcus
EGDTLIPPFISVPGLGENVAK

SEQ ID NO: 2063929 - protein, 17 aa, Staphylococcus
EGDVEIEYTFRLSPFGS

SEQ ID NO: 2063930 - protein, 20 aa, Staphylococcus
EGDYAVGLFFSNEKIQGTKH

SEQ ID NO: 2063931 - protein, 20 aa, Staphylococcus
EGEAIAWHLANILNLEDSTE

SEQ ID NO: 2063932 - protein, 20 aa, Staphylococcus
EGEAIAWHLSKILELEESKE

SEQ ID NO: 2063933 - protein, 38 aa, Staphylococcus
EGEEHAFDFPGFVPAYIRPLFCEGKGPFRFAALSGDPK

SEQ ID NO: 2063934 - protein, 26 aa, Staphylococcus
EGEHYFTIVPLLLFSGRHYLEDIPTI

SEQ ID NO: 2063935 - protein, 17 aa, Staphylococcus
EGEIIGVELPKTVELEV

SEQ ID NO: 2063936 - protein, 26 aa, Staphylococcus
EGEILSISQFTLYADVRKGNRPGFTQ

SEQ ID NO: 2063937 - protein, 19 aa, Staphylococcus
EGELDRYPLAKFKRSNTGT

SEQ ID NO: 2063938 - protein, 25 aa, Staphylococcus
EGELKQRIYFMYGGKWQRVRFEFNN

SEQ ID NO: 2063939 - protein, 27 aa, Staphylococcus
EGELLFGDTVAVFGAGPIGLLTVIAAK

SEQ ID NO: 2063940 - protein, 24 aa, Staphylococcus
EGELPEERLFRKYAHKIRNWNEDK

SEQ ID NO: 2063941 - protein, 24 aa, Staphylococcus
EGELPEERLFRKYSHKIRNWDDEK

SEQ ID NO: 2063942 - protein, 22 aa, Staphylococcus
EGELSIVEPLDNGAFKILAEIN

SEQ ID NO: 2063943 - protein, 26 aa, Staphylococcus
EGERKLAALSFLTFVALDQSGKPTQV

SEQ ID NO: 2063944 - protein, 33 aa, Staphylococcus
EGFDYIVTGSGFLYNMVRVLVAFLIEVGKGKRS

SEQ ID NO: 2063945 - protein, 32 aa, Staphylococcus
EGFDYIVTGSGFLYNMVRVLVAFLVEVGKGKR

SEQ ID NO: 2063946 - protein, 33 aa, Staphylococcus
EGFEAYFLMNQLGAPFLLISDPRIQGGAFYLGS

SEQ ID NO: 2063947 - protein, 31 aa, Staphylococcus
EGFEGYFMMNKMNAPFILIGDPRLEGGSFYL

SEQ ID NO: 2063948 - protein, 26 aa, Staphylococcus
EGFFEEMGKLQYFTNPLLYEGREGAK

SEQ ID NO: 2063949 - protein, 32 aa, Staphylococcus
EGFGKEVKRRILLGTFALSSGYYDAYYKKSQK

SEQ ID NO: 2063950 - protein, 19 aa, Staphylococcus
EGFKNLGFDTYFAVPRSKE

SEQ ID NO: 2063951 - protein, 19 aa, Staphylococcus
EGFKNLGFETYFAVPRSKE

SEQ ID NO: 2063952 - protein, 21 aa, Staphylococcus
EGFRLYVDQLLKQTSRQNKNK

SEQ ID NO: 2063953 - protein, 17 aa, Staphylococcus
EGFYRLHHSYKKKVIMA

SEQ ID NO: 2063954 - protein, 22 aa, Staphylococcus
EGGGWNAIFWCNHDQPRVVTRF

SEQ ID NO: 2063955 - protein, 25 aa, Staphylococcus
EGGHMWKSWKPLLGDLLKYFLSDNI

SEQ ID NO: 2063956 - protein, 26 aa, Staphylococcus
EGGHNWKSWKPLLSDILKYYLSDELI

SEQ ID NO: 2063957 - protein, 21 aa, Staphylococcus
EGGHSWKSWKPLLGDILEYFL

SEQ ID NO: 2063958 - protein, 28 aa, Staphylococcus
EGHAVVKIDRYPIFIPNALIDETIEYKV

SEQ ID NO: 2063959 - protein, 29 aa, Staphylococcus
EGHGVIKIDRYPIFVPNALIGEVIKYKII

SEQ ID NO: 2063960 - protein, 25 aa, Staphylococcus
EGHGVIKLDRYPIFVPNVLIDEEVE

SEQ ID NO: 2063961 - protein, 28 aa, Staphylococcus
EGHGVVKIDRYPVFIPQALTGEEIEYKL

SEQ ID NO: 2063962 - protein, 25 aa, Staphylococcus
EGHKKFVETPFKYQPKRAQDGKRIT

SEQ ID NO: 2063963 - protein, 23 aa, Staphylococcus
EGHKNYVAHPFQYQPKRAKQGGN

SEQ ID NO: 2063964 - protein, 20 aa, Staphylococcus
EGHNRLLDYKMLVTGGDSAI

SEQ ID NO: 2063965 - protein, 24 aa, Staphylococcus
EGHSMDGFLIKGTQAKILAELKRV

SEQ ID NO: 2063966 - protein, 24 aa, Staphylococcus
EGHSYSHFLLIEQAITAMKASGYA

SEQ ID NO: 2063967 - protein, 25 aa, Staphylococcus
EGHSYSHYLLIEQAINALKGAGYAF

SEQ ID NO: 2063968 - protein, 25 aa, Staphylococcus
EGHTPLIHCANISEMLDIDLYVKYE

SEQ ID NO: 2063969 - protein, 17 aa, Staphylococcus
EGHVPRPFALKDTLLEI

SEQ ID NO: 2063970 - protein, 20 aa, Staphylococcus
EGIAILWITHSDDQSMRHFQ

SEQ ID NO: 2063971 - protein, 23 aa, Staphylococcus
EGIAQIQIMYDPGLILIGGGISA

SEQ ID NO: 2063972 - protein, 22 aa, Staphylococcus
EGIAQLQIIYDPELILIGGGIS

SEQ ID NO: 2063973 - protein, 19 aa, Staphylococcus
EGIECDVIFFATPSNVSKH

SEQ ID NO: 2063974 - protein, 27 aa, Staphylococcus
EGIFKKPIITPVLPYKNFYPAEDYHQD

SEQ ID NO: 2063975 - protein, 27 aa, Staphylococcus
EGIFKKPVITPILPYKNFYPAEDYHQD

SEQ ID NO: 2063976 - protein, 17 aa, Staphylococcus
EGIFNSLHEVSGLGLDL

SEQ ID NO: 2063977 - protein, 22 aa, Staphylococcus
EGIGLYRTEFLYMGRDEMPTED

SEQ ID NO: 2063978 - protein, 27 aa, Staphylococcus
EGIGSEKWPSFLPKALVSDIIKVSDDA

SEQ ID NO: 2063979 - protein, 25 aa, Staphylococcus
EGIKLIKRTFKEWKIPIIFVTHSNF

SEQ ID NO: 2063980 - protein, 29 aa, Staphylococcus
EGIKLYDAFTILYLLDPKSYEIKEADVQI

SEQ ID NO: 2063981 - protein, 18 aa, Staphylococcus
EGIQQWFPQLSFEDRQVG

SEQ ID NO: 2063982 - protein, 18 aa, Staphylococcus
EGITLPMLKARKAIIDMN

SEQ ID NO: 2063983 - protein, 27 aa, Staphylococcus
EGIVKQFSHCELIPQLKLIESTKSGGE

SEQ ID NO: 2063984 - protein, 20 aa, Staphylococcus
EGKDSFIKKIFKRAKASANE

SEQ ID NO: 2063985 - protein, 26 aa, Staphylococcus
EGKDTLRPLIRFNTRQNDSSAAMVVI

SEQ ID NO: 2063986 - protein, 38 aa, Staphylococcus
EGKDTTTLYTIPAGRIPLIVRTKSILHFVNENGGKLKI

SEQ ID NO: 2063987 - protein, 24 aa, Staphylococcus
EGKHPIRIILSKRGQIDYSKQIFH

SEQ ID NO: 2063988 - protein, 22 aa, Staphylococcus
EGKHTPIISQDLWDKVQARKKQ

SEQ ID NO: 2063989 - protein, 21 aa, Staphylococcus
EGKLFLEYLENNEQPDIVLLD

SEQ ID NO: 2063990 - protein, 22 aa, Staphylococcus
EGKMKVTLNKTGNWLDSLKFLT

SEQ ID NO: 2063991 - protein, 22 aa, Staphylococcus
EGKNILPGFIDIHIHGGYGEDA

SEQ ID NO: 2063992 - protein, 23 aa, Staphylococcus
EGKNIWFGVREFAMGAAVNGMAA

SEQ ID NO: 2063993 - protein, 25 aa, Staphylococcus
EGKRILVDRVWPRGISKAHAQLDEW

SEQ ID NO: 2063994 - protein, 17 aa, Staphylococcus
EGKTIDAFLAGVGTGGT

SEQ ID NO: 2063995 - protein, 33 aa, Staphylococcus
EGKTIIIAEHRLHYLMDVVDRFIILAQGTMRKQ

SEQ ID NO: 2063996 - protein, 23 aa, Staphylococcus
EGKTVIPVERYGVKVISMAFFVE

SEQ ID NO: 2063997 - protein, 24 aa, Staphylococcus
EGKYTGDYLADKGIVPFLKVDKGL

SEQ ID NO: 2063998 - protein, 17 aa, Staphylococcus
EGKYVLIRLRSGEVRMV

SEQ ID NO: 2063999 - protein, 25 aa, Staphylococcus
EGLDTGYFARPTIFINVKNDMTIAQ

SEQ ID NO: 2064000 - protein, 18 aa, Staphylococcus
EGLDYKASKFPYAANGRA

SEQ ID NO: 2064001 - protein, 18 aa, Staphylococcus
EGLDYKASKFPYAGNGRA

SEQ ID NO: 2064002 - protein, 26 aa, Staphylococcus
EGLEELSHYWATVRPYYADFESDIKS

SEQ ID NO: 2064003 - protein, 17 aa, Staphylococcus
EGLIFKDSITIGVEPTL

SEQ ID NO: 2064004 - protein, 38 aa, Staphylococcus
EGLKNLFKIVSASLVKYYYRTPRIPRSLLNEYREGILV

SEQ ID NO: 2064005 - protein, 20 aa, Staphylococcus
EGLKRFDTLVFTGGLGPTKD

SEQ ID NO: 2064006 - protein, 23 aa, Staphylococcus
EGLKYHIQQWDKYKNKVLFTGVY

SEQ ID NO: 2064007 - protein, 18 aa, Staphylococcus
EGLNFAGVQKLPFICVIE

SEQ ID NO: 2064008 - protein, 23 aa, Staphylococcus
EGLPGICIIGDIINYSLPQNKAK

SEQ ID NO: 2064009 - protein, 23 aa, Staphylococcus
EGLQKFYDLLKSFQMTHEKPLNK

SEQ ID NO: 2064010 - protein, 19 aa, Staphylococcus
EGLRLNQFYKELMLSTGKI

SEQ ID NO: 2064011 - protein, 18 aa, Staphylococcus
EGLRLQNRKLRRPDLTFA

SEQ ID NO: 2064012 - protein, 18 aa, Staphylococcus
EGLRLQNRQLRRPDLTYA

SEQ ID NO: 2064013 - protein, 17 aa, Staphylococcus
EGLRLQQRQLRRPDLTF

SEQ ID NO: 2064014 - protein, 17 aa, Staphylococcus
EGLTKLMNSYGLNAKHL

SEQ ID NO: 2064015 - protein, 18 aa, Staphylococcus
EGLVFDRDHNLFLCEVFG

SEQ ID NO: 2064016 - protein, 17 aa, Staphylococcus
EGLYLEKIYLDPEALKN

SEQ ID NO: 2064017 - protein, 18 aa, Staphylococcus
EGMFVKEKLPFVNQDALK

SEQ ID NO: 2064018 - protein, 18 aa, Staphylococcus
EGMIPVAKELKLDHYQSY

SEQ ID NO: 2064019 - protein, 20 aa, Staphylococcus
EGMLPTAKKLKFDTYQSYVI

SEQ ID NO: 2064020 - protein, 41 aa, Staphylococcus
EGMMLCEFLKVKPEILKFMLKVFNELNFIYNKDGLIKINSH

SEQ ID NO: 2064021 - protein, 18 aa, Staphylococcus
EGMRRLELYLKEHYPNVL

SEQ ID NO: 2064022 - protein, 24 aa, Staphylococcus
EGNEWYTPCYNDDFLRGCMRQSLI

SEQ ID NO: 2064023 - protein, 35 aa, Staphylococcus
EGNFHEGLNFASILNLPVIFVCENNQFAEGTTHDY

SEQ ID NO: 2064024 - protein, 25 aa, Staphylococcus
EGNHPIPTIAFYSPNCLPIIARALE

SEQ ID NO: 2064025 - protein, 32 aa, Staphylococcus
EGNIIKLVKDKLTYPVFVKPANLGSSVGISKC

SEQ ID NO: 2064026 - protein, 23 aa, Staphylococcus
EGNLFLDAMLGAHIHIIEPTSSR

SEQ ID NO: 2064027 - protein, 17 aa, Staphylococcus
EGNLFLLDVFEGNIFKV

SEQ ID NO: 2064028 - protein, 24 aa, Staphylococcus
EGNRPIGSFLFVGPTGVGKTELAK

SEQ ID NO: 2064029 - protein, 25 aa, Staphylococcus
EGNSYSHYLLIEQAITALKQSGFAF

SEQ ID NO: 2064030 - protein, 20 aa, Staphylococcus
EGNYAVGLFFSKEKVKDSIH

SEQ ID NO: 2064031 - protein, 20 aa, Staphylococcus
EGNYKYCFFSSKGNGQFKPT

SEQ ID NO: 2064032 - protein, 18 aa, Staphylococcus
EGPAIGFLAEYDSLPGLG

SEQ ID NO: 2064033 - protein, 17 aa, Staphylococcus
EGPIIWVDDTLQALQDL

SEQ ID NO: 2064034 - protein, 25 aa, Staphylococcus
EGQKGIFVIFNNKQPIFVGQVGGYM

SEQ ID NO: 2064035 - protein, 23 aa, Staphylococcus
EGQSLYIRPFVFATEAGLGVHPA

SEQ ID NO: 2064036 - protein, 24 aa, Staphylococcus
EGQSLYIRPYVFATEGILGVRPSY

SEQ ID NO: 2064037 - protein, 26 aa, Staphylococcus
EGQTHFVTELYVETIKFMSPKTKHNE

SEQ ID NO: 2064038 - protein, 24 aa, Staphylococcus
EGQTLFFGGLSRIDYVSGGKRPLV

SEQ ID NO: 2064039 - protein, 18 aa, Staphylococcus
EGQWQSWGPYLLSGKDVH

SEQ ID NO: 2064040 - protein, 25 aa, Staphylococcus
EGRECQFIAVKLPYGKQKDADEVED

SEQ ID NO: 2064041 - protein, 17 aa, Staphylococcus
EGRFTEYMNLDPFYEKL

SEQ ID NO: 2064042 - protein, 36 aa, Staphylococcus
EGRGEKIKFLDKPPSAWVVLAKPNLGISSPDIFKEL

SEQ ID NO: 2064043 - protein, 22 aa, Staphylococcus
EGRGLICAPLDTSIAKRLELNA

SEQ ID NO: 2064044 - protein, 20 aa, Staphylococcus
EGRHFGFVIPDDKRIMQDIF

SEQ ID NO: 2064045 - protein, 17 aa, Staphylococcus
EGRIPFIKKMQDKGLFA

SEQ ID NO: 2064046 - protein, 17 aa, Staphylococcus
EGRLPVVNFAAGGVATP

SEQ ID NO: 2064047 - protein, 22 aa, Staphylococcus
EGRRIFVTEVVADSVQFLEPKN

SEQ ID NO: 2064048 - protein, 19 aa, Staphylococcus
EGRVIGRKTMFVRTAGCDY

SEQ ID NO: 2064049 - protein, 27 aa, Staphylococcus
EGSDFTTGWIFFIDDFGHHELVSSVNL

SEQ ID NO: 2064050 - protein, 22 aa, Staphylococcus
EGSFINAIKRIVGNKQIILVGN

SEQ ID NO: 2064051 - protein, 22 aa, Staphylococcus
EGSFINALKRIVGNKKIILAAN

SEQ ID NO: 2064052 - protein, 22 aa, Staphylococcus
EGSFINALKRIVGNKKIILVAN

SEQ ID NO: 2064053 - protein, 25 aa, Staphylococcus
EGSKDPHIWLDPVLNKKMVKAIKDD

SEQ ID NO: 2064054 - protein, 22 aa, Staphylococcus
EGSKLTIDLYNKDDYLLLRIQD

SEQ ID NO: 2064055 - protein, 28 aa, Staphylococcus
EGSKRVFNMIPYRVQVMGGIAIHKGDIA

SEQ ID NO: 2064056 - protein, 31 aa, Staphylococcus
EGSKSVYVKAPFNALIELQSIPNGYYYPNDS

SEQ ID NO: 2064057 - protein, 25 aa, Staphylococcus
EGTDFDVLPLIYKLPHENQMRMYEL

SEQ ID NO: 2064058 - protein, 35 aa, Staphylococcus
EGTFHEGLNFASILNLPVIFVCENNQFAEGTTHDY

SEQ ID NO: 2064059 - protein, 27 aa, Staphylococcus
EGTGDLTVAFLLAKLSWHERHHLEHIK

SEQ ID NO: 2064060 - protein, 25 aa, Staphylococcus
EGTIEQWLISVGDYVDEYEPLCEVI

SEQ ID NO: 2064061 - protein, 21 aa, Staphylococcus
EGTIVGFNIFEFSRYNKISGN

SEQ ID NO: 2064062 - protein, 32 aa, Staphylococcus
EGTKAIIIDKYGIAPFILANKQKNIIAATVSD

SEQ ID NO: 2064063 - protein, 25 aa, Staphylococcus
EGTMPQTRFVLKKALEQNLKPVVVV

SEQ ID NO: 2064064 - protein, 18 aa, Staphylococcus
EGTQLWFEFFENNRSFFM

SEQ ID NO: 2064065 - protein, 21 aa, Staphylococcus
EGTTLVVCGDTPLITADTLNA

SEQ ID NO: 2064066 - protein, 28 aa, Staphylococcus
EGTVVRLAAFGAFVEVAPGVQGLVHISE

SEQ ID NO: 2064067 - protein, 25 aa, Staphylococcus
EGVDALLFETYYDLDELKRIVTWTK

SEQ ID NO: 2064068 - protein, 24 aa, Staphylococcus
EGVDALLFETYYDLDELKSIVVAT

SEQ ID NO: 2064069 - protein, 19 aa, Staphylococcus
EGVDMRLHRVIYNVIEEIE

SEQ ID NO: 2064070 - protein, 19 aa, Staphylococcus
EGVFFHERKALSHFEKRYA

SEQ ID NO: 2064071 - protein, 23 aa, Staphylococcus
EGVIQHFDIIATGNLAVKHPLFE

SEQ ID NO: 2064072 - protein, 25 aa, Staphylococcus
EGVKGSLKRLGLDHLDLYQLHGGTI

SEQ ID NO: 2064073 - protein, 20 aa, Staphylococcus
EGVMHACGHDIHMASILAVA

SEQ ID NO: 2064074 - protein, 24 aa, Staphylococcus
EGVNQFIFFSIMSVFGLDGEVGKQ

SEQ ID NO: 2064075 - protein, 23 aa, Staphylococcus
EGVRYYITPSIKDPNYLDIIIDI

SEQ ID NO: 2064076 - protein, 18 aa, Staphylococcus
EGVSLFDLLEIVESITLE

SEQ ID NO: 2064077 - protein, 18 aa, Staphylococcus
EGVYLKHFYDSITAAFYI

SEQ ID NO: 2064078 - protein, 17 aa, Staphylococcus
EGWAHCLTIPRVLTIEN

SEQ ID NO: 2064079 - protein, 18 aa, Staphylococcus
EGWAHCLTIPRVLTVENG

SEQ ID NO: 2064080 - protein, 17 aa, Staphylococcus
EGWAHCLTLPRVLTVEQ

SEQ ID NO: 2064081 - protein, 25 aa, Staphylococcus
EGWGNIPMTLGFTYSSNTLMMHLQD

SEQ ID NO: 2064082 - protein, 17 aa, Staphylococcus
EGWWLFSDWPERVIETL

SEQ ID NO: 2064083 - protein, 18 aa, Staphylococcus
EGYAIYEGILKDLPQVMK

SEQ ID NO: 2064084 - protein, 22 aa, Staphylococcus
EGYDIQRWFEDHNIFVELVDEH

SEQ ID NO: 2064085 - protein, 25 aa, Staphylococcus
EGYDPQYGARPLIRAIQKTVEDNLS

SEQ ID NO: 2064086 - protein, 20 aa, Staphylococcus
EGYIRMLGYKNLTTCRREYL

SEQ ID NO: 2064087 - protein, 17 aa, Staphylococcus
EGYIYFKDSPISDYPVY

SEQ ID NO: 2064088 - protein, 17 aa, Staphylococcus
EGYRLGSDDLSIGEIVF

SEQ ID NO: 2064089 - protein, 31 aa, Staphylococcus
EGYRPVMEIQFLGFVFEVFDSVAGQIARTRF

SEQ ID NO: 2064090 - protein, 24 aa, Staphylococcus
EHAFPYIKYQLLTQRTSTLKTIYT

SEQ ID NO: 2064091 - protein, 23 aa, Staphylococcus
EHCDFFSFGTNDLTQLAYGFSRD

SEQ ID NO: 2064092 - protein, 22 aa, Staphylococcus
EHDEILVYERLSGGGEARLHGQ

SEQ ID NO: 2064093 - protein, 26 aa, Staphylococcus
EHDESLFNYFKQLFAQVTNPPIDAYR

SEQ ID NO: 2064094 - protein, 49 aa, Staphylococcus
EHDIKFHEVLIYATQHRYLLSSWNNLKPLMLCLILLSMRKRMREEPEDF

SEQ ID NO: 2064095 - protein, 19 aa, Staphylococcus
EHDIPYVDYMSDLISIIEK

SEQ ID NO: 2064096 - protein, 24 aa, Staphylococcus
EHDLAILMIVGEGMHRIVGTANTI

SEQ ID NO: 2064097 - protein, 22 aa, Staphylococcus
EHDLAILMIVGEGMNKAIGTAN

SEQ ID NO: 2064098 - protein, 28 aa, Staphylococcus
EHETLQHYLFPIEYGLKSLQHVVIDDDT

SEQ ID NO: 2064099 - protein, 33 aa, Staphylococcus
EHFAGTIIFVSHDRYFINQLANKVFDLDHDGGK

SEQ ID NO: 2064100 - protein, 24 aa, Staphylococcus
EHFDRLEVPFIYRVHEQPKSERLR

SEQ ID NO: 2064101 - protein, 22 aa, Staphylococcus
EHFERFLYENPSVGRIIVEKGI

SEQ ID NO: 2064102 - protein, 17 aa, Staphylococcus
EHFFAKHNDLDMIKDKS

SEQ ID NO: 2064103 - protein, 18 aa, Staphylococcus
EHFFARNDDLDIIKDRSD

SEQ ID NO: 2064104 - protein, 18 aa, Staphylococcus
EHFFARNDDLDIIRDRSE

SEQ ID NO: 2064105 - protein, 17 aa, Staphylococcus
EHFFARNDDLDVIRDRS

SEQ ID NO: 2064106 - protein, 18 aa, Staphylococcus
EHFGTLDIMINNAGFEKP

SEQ ID NO: 2064107 - protein, 17 aa, Staphylococcus
EHFKFLYKKVAGRATAK

SEQ ID NO: 2064108 - protein, 25 aa, Staphylococcus
EHFNKLEVPFIYRVHEQPKSERLRQ

SEQ ID NO: 2064109 - protein, 21 aa, Staphylococcus
EHFSKMEVPFIYRVHEQPKSD

SEQ ID NO: 2064110 - protein, 17 aa, Staphylococcus
EHGFDYHIPYQFEAPRL

SEQ ID NO: 2064111 - protein, 23 aa, Staphylococcus
EHGGMIIYLPQEGRGIGLMNKLR

SEQ ID NO: 2064112 - protein, 26 aa, Staphylococcus
EHGGVQWFNLIKQFTLKNFAKQQRSF

SEQ ID NO: 2064113 - protein, 24 aa, Staphylococcus
EHHDVDYCIVINFSSRFASVTSEE

SEQ ID NO: 2064114 - protein, 26 aa, Staphylococcus
EHHHELYIYHPYFNSGILPNVKETDL

SEQ ID NO: 2064115 - protein, 18 aa, Staphylococcus
EHHIAPQIELITADDIDN

SEQ ID NO: 2064116 - protein, 30 aa, Staphylococcus
EHHIHVILTDTFALNKPAQGLFEKFGFQKV

SEQ ID NO: 2064117 - protein, 18 aa, Staphylococcus
EHHRKDYAVSDPVTVLAA

SEQ ID NO: 2064118 - protein, 23 aa, Staphylococcus
EHHRPDYAVSDPVTVLAAAASRT

SEQ ID NO: 2064119 - protein, 23 aa, Staphylococcus
EHHRPDYAVSDPVTVLAAAATST

SEQ ID NO: 2064120 - protein, 17 aa, Staphylococcus
EHHVKVAELLLERAKRL

SEQ ID NO: 2064121 - protein, 21 aa, Staphylococcus
EHHYKNFIYTPVGFVCEHLEV

SEQ ID NO: 2064122 - protein, 25 aa, Staphylococcus
EHIKRIKERIGDIQWGDNLIITGTD

SEQ ID NO: 2064123 - protein, 23 aa, Staphylococcus
EHILEWLRIASEYKLPTFLMGVG

SEQ ID NO: 2064124 - protein, 28 aa, Staphylococcus
EHIPVVDMVKVKRYLQGRKTRLVGPNCP

SEQ ID NO: 2064125 - protein, 23 aa, Staphylococcus
EHIRYVAHLVDERLKMLASKSAG

SEQ ID NO: 2064126 - protein, 18 aa, Staphylococcus
EHITFLKKLTSNVTLMFD

SEQ ID NO: 2064127 - protein, 17 aa, Staphylococcus
EHKARIDTIRKVAKKLG

SEQ ID NO: 2064128 - protein, 23 aa, Staphylococcus
EHKDWQILYNERVAKSLITAVHG

SEQ ID NO: 2064129 - protein, 30 aa, Staphylococcus
EHLKFAHDFNPLYFKKLWLEAWEETHERKL

SEQ ID NO: 2064130 - protein, 25 aa, Staphylococcus
EHLKKMELLIREETNWLADHASNYY

SEQ ID NO: 2064131 - protein, 25 aa, Staphylococcus
EHLNLPPIFSEVLIYCTERNVMAVE

SEQ ID NO: 2064132 - protein, 28 aa, Staphylococcus
EHLNPQYYEFLNTLPREFTLDLLGQSVL

SEQ ID NO: 2064133 - protein, 30 aa, Staphylococcus
EHLRFAKRFNPLYFKKIWLEAWEETHKREL

SEQ ID NO: 2064134 - protein, 23 aa, Staphylococcus
EHLTITPYKLYLIQAGDTLTFNE

SEQ ID NO: 2064135 - protein, 26 aa, Staphylococcus
EHMFFGAERLVEMRRFILASNYDERV

SEQ ID NO: 2064136 - protein, 26 aa, Staphylococcus
EHMFFGAERLVEMRRFILASSYDERV

SEQ ID NO: 2064137 - protein, 24 aa, Staphylococcus
EHMFFGAERLVEMRRFILSSSRED

SEQ ID NO: 2064138 - protein, 26 aa, Staphylococcus
EHMFFGAERLVEMRRFILSSSYEQRV

SEQ ID NO: 2064139 - protein, 21 aa, Staphylococcus
EHMLFYFAYKTFIKTADEIIE

SEQ ID NO: 2064140 - protein, 21 aa, Staphylococcus
EHMLFYFAYKTFITTADEIIE

SEQ ID NO: 2064141 - protein, 21 aa, Staphylococcus
EHMLFYFAYKTFVTTADDIIE

SEQ ID NO: 2064142 - protein, 21 aa, Staphylococcus
EHMLFYFAYKTFVTTADEIIE

SEQ ID NO: 2064143 - protein, 19 aa, Staphylococcus
EHMNAWLKPYRRAFNIEEP

SEQ ID NO: 2064144 - protein, 17 aa, Staphylococcus
EHMSLDYDPIRGKWNNQ

SEQ ID NO: 2064145 - protein, 28 aa, Staphylococcus
EHNKLAMVLVQFPPWFDCNAQNINYILY

SEQ ID NO: 2064146 - protein, 39 aa, Staphylococcus; identical to SEQ ID NO: 1826533

SEQ ID NO: 2064147 - protein, 26 aa, Staphylococcus
EHNLTMMTYADWIIDIGPFAGEKGGQ

SEQ ID NO: 2064148 - protein, 34 aa, Staphylococcus
EHNNILAAIKLDVFRNFYLIKHKDKYLDVNLKAI

SEQ ID NO: 2064149 - protein, 39 aa, Staphylococcus
EHNQYFYKPIGTGVTIPPWNFPFAIMVGTTLAPVVAGNT

SEQ ID NO: 2064150 - protein, 32 aa, Staphylococcus
EHNRLFLFVSEGLLKGYLYLQIDTLSSLAEIR

SEQ ID NO: 2064151 - protein, 39 aa, Staphylococcus
EHNRYFYKPIGTGVTIPPWNFPFAIMAGTTLAPVIAGNT

SEQ ID NO: 2064152 - protein, 27 aa, Staphylococcus
EHNSLYVEIYPFNISFEDPFTKIQLWI

SEQ ID NO: 2064153 - protein, 17 aa, Staphylococcus
EHPKLYDNKTGLYNLKL

SEQ ID NO: 2064154 - protein, 25 aa, Staphylococcus
EHPSNQLLILLHGFISDSQTYMNHI

SEQ ID NO: 2064155 - protein, 20 aa, Staphylococcus
EHQHPLFRFLTDAQQGMFNE

SEQ ID NO: 2064156 - protein, 18 aa, Staphylococcus
EHQIHVVPLNLTIDGKSY

SEQ ID NO: 2064157 - protein, 24 aa, Staphylococcus
EHQKPHIMPVWSIKNRASKVRDED

SEQ ID NO: 2064158 - protein, 19 aa, Staphylococcus
EHRAPGVFGAVWTNDEINA

SEQ ID NO: 2064159 - protein, 17 aa, Staphylococcus
EHRFQILVKYKREPELI

SEQ ID NO: 2064160 - protein, 18 aa, Staphylococcus
EHRGLGYGKLLMNSIEEL

SEQ ID NO: 2064161 - protein, 33 aa, Staphylococcus
EHRLTALHTALINGGIFVYVPKNVVVENPIQYV

SEQ ID NO: 2064162 - protein, 26 aa, Staphylococcus
EHRLTALHTALLNGGVFVYVPKNVVV

SEQ ID NO: 2064163 - protein, 24 aa, Staphylococcus
EHSDDYITFILSNENKQFAFKKYG

SEQ ID NO: 2064164 - protein, 27 aa, Staphylococcus
EHSETLPVIIWFYGGGFLNGHGSAELY

SEQ ID NO: 2064165 - protein, 17 aa, Staphylococcus
EHSIIPDRIEAGTLLIA

SEQ ID NO: 2064166 - protein, 17 aa, Staphylococcus
EHSRYDLMLIQTDRHYG

SEQ ID NO: 2064167 - protein, 28 aa, Staphylococcus
EHTDKPFYKHLISFITSAPVFAMVVEGE

SEQ ID NO: 2064168 - protein, 28 aa, Staphylococcus
EHTLDLEGIFVQIGLLPNTEWLNNYVEL

SEQ ID NO: 2064169 - protein, 23 aa, Staphylococcus
EHTNQILKFKKKGFHYISESGIH

SEQ ID NO: 2064170 - protein, 21 aa, Staphylococcus
EHTSFIRKLTSNVTLLFDGDF

SEQ ID NO: 2064171 - protein, 27 aa, Staphylococcus
EHVEIHIERLLKYSPELVYQAWTDADL

SEQ ID NO: 2064172 - protein, 23 aa, Staphylococcus
EHVELIEVPIKPSDRLRARDMLG

SEQ ID NO: 2064173 - protein, 25 aa, Staphylococcus
EHVLPLGNVIFYKTPEHFDIMLQAD

SEQ ID NO: 2064174 - protein, 20 aa, Staphylococcus
EHVLSALRPVWYKDEALLHE

SEQ ID NO: 2064175 - protein, 24 aa, Staphylococcus
EHVMKLLMHVDQVSYVRFASVYKE

SEQ ID NO: 2064176 - protein, 18 aa, Staphylococcus
EHVMRVVKMALFIAEQEG

SEQ ID NO: 2064177 - protein, 26 aa, Staphylococcus
EHVTSDQLIFFNIAAAMASIRFINVL

SEQ ID NO: 2064178 - protein, 18 aa, Staphylococcus
EHWFNYTYQLTMTSDIKL

SEQ ID NO: 2064179 - protein, 21 aa, Staphylococcus
EHYGPYYILTPGMAMPHARPE

SEQ ID NO: 2064180 - protein, 21 aa, Staphylococcus
EIAKKIAILPQTPEVADGLTV

SEQ ID NO: 2064181 - protein, 24 aa, Staphylococcus
EIALLPEYGLNVKIVLINNGTLGM

SEQ ID NO: 2064182 - protein, 17 aa, Staphylococcus
EIAMYFKNPSRILGSFF

SEQ ID NO: 2064183 - protein, 18 aa, Staphylococcus
EIANDYVFAMIGYHPDYN

SEQ ID NO: 2064184 - protein, 24 aa, Staphylococcus
EIANVQPFLFKHSKGDLGLAHNGN

SEQ ID NO: 2064185 - protein, 24 aa, Staphylococcus
EIASQFYLADFDFPKALTKEEIAD

SEQ ID NO: 2064186 - protein, 18 aa, Staphylococcus
EIAVLLYTGIKELKYSEV

SEQ ID NO: 2064187 - protein, 19 aa, Staphylococcus
EICIPIRHFIKLEKHFFNS

SEQ ID NO: 2064188 - protein, 17 aa, Staphylococcus
EICRKIREVKSTPIIII

SEQ ID NO: 2064189 - protein, 25 aa, Staphylococcus
EIDAEYFPLNLFRKYAKEAFEDNEL

SEQ ID NO: 2064190 - protein, 24 aa, Staphylococcus
EIDDQIYYLNDRLKLQLLDDVKSV

SEQ ID NO: 2064191 - protein, 24 aa, Staphylococcus
EIDFRIIEPAAYYHTLQHFTGSKD

SEQ ID NO: 2064192 - protein, 32 aa, Staphylococcus
EIDIAGPGFINFYLDNQYLTQIIPEAINKGDQ

SEQ ID NO: 2064193 - protein, 22 aa, Staphylococcus
EIDIERLLKYSPETIYEAWTKE

SEQ ID NO: 2064194 - protein, 18 aa, Staphylococcus
EIDKVMTVTLLSSLASVS

SEQ ID NO: 2064195 - protein, 27 aa, Staphylococcus
EIDNLVWYFSELFKSELKLAIGPIERG

SEQ ID NO: 2064196 - protein, 29 aa, Staphylococcus
EIDPDVLRFFMISVHYRSPINYNLELVGA

SEQ ID NO: 2064197 - protein, 29 aa, Staphylococcus
EIDPDVLRFFMISVHYRSPINYNLELVNA

SEQ ID NO: 2064198 - protein, 29 aa, Staphylococcus
EIDPDVLRFFMISVHYRSPINYNLELVSA

SEQ ID NO: 2064199 - protein, 29 aa, Staphylococcus
EIDPDVLRFFMISVHYRSPINYNMELVSA

SEQ ID NO: 2064200 - protein, 20 aa, Staphylococcus
EIDVTLYYDLSQRHGLLTII

SEQ ID NO: 2064201 - protein, 19 aa, Staphylococcus
EIDYPEKFVTLQHQHVLGT

SEQ ID NO: 2064202 - protein, 22 aa, Staphylococcus
EIEAIFKAFARSLKIALSDDGS

SEQ ID NO: 2064203 - protein, 23 aa, Staphylococcus
EIEAPYKIIYHDYFANEKGQINP

SEQ ID NO: 2064204 - protein, 17 aa, Staphylococcus
EIEARWPGTITTIVHRI

SEQ ID NO: 2064205 - protein, 29 aa, Staphylococcus
EIEDIPGELIMKVLAFNPDLEKINAIGAE

SEQ ID NO: 2064206 - protein, 24 aa, Staphylococcus
EIEEIYPLFPLQEEMLYSSVGDYS

SEQ ID NO: 2064207 - protein, 19 aa, Staphylococcus
EIEFVCAFIFYAELSLEEW

SEQ ID NO: 2064208 - protein, 18 aa, Staphylococcus
EIEKEIMSFYAKYANHEG

SEQ ID NO: 2064209 - protein, 17 aa, Staphylococcus
EIEKNPIAHILLGYDDT

SEQ ID NO: 2064210 - protein, 24 aa, Staphylococcus
EIENSYLIYRYINGLNLHKEERYI

SEQ ID NO: 2064211 - protein, 30 aa, Staphylococcus
EIEPMYGKKYLPRKFKIGIALPPSNDIDVY

SEQ ID NO: 2064212 - protein, 24 aa, Staphylococcus
EIERKTFYLHYLDKYDLLDAIVQK

SEQ ID NO: 2064213 - protein, 20 aa, Staphylococcus
EIERPMDRLLCGDVGYGKTE

SEQ ID NO: 2064214 - protein, 18 aa, Staphylococcus
EIERYMRLVNLEGKLKDI

SEQ ID NO: 2064215 - protein, 25 aa, Staphylococcus
EIETYPMNWPVGMGQNFFGIIDRES

SEQ ID NO: 2064216 - protein, 23 aa, Staphylococcus
EIEVTLELKLLADVGLVGFPSVG

SEQ ID NO: 2064217 - protein, 32 aa, Staphylococcus
EIEYDVALFSYNKLLEIFFSVIDPSDEGGQFQ

SEQ ID NO: 2064218 - protein, 26 aa, Staphylococcus
EIEYGPRIQPIIIKSQALMQGFIVAN

SEQ ID NO: 2064219 - protein, 18 aa, Staphylococcus
EIEYTFRLSPFGSTEYPD

SEQ ID NO: 2064220 - protein, 20 aa, Staphylococcus
EIFDEFLHPANLPDGRWPSQ

SEQ ID NO: 2064221 - protein, 19 aa, Staphylococcus
EIFFKDKEYKLPIGTPAMA

SEQ ID NO: 2064222 - protein, 19 aa, Staphylococcus
EIFHNLKSILSKRGLETAV

SEQ ID NO: 2064223 - protein, 19 aa, Staphylococcus
EIFLVVTGSNKREVIEKLY

SEQ ID NO: 2064224 - protein, 18 aa, Staphylococcus
EIFLVVTGSNKREVVEKL

SEQ ID NO: 2064225 - protein, 18 aa, Staphylococcus
EIFPYAPPQGIETLRDLW

SEQ ID NO: 2064226 - protein, 18 aa, Staphylococcus
EIFRSMGVPVPEGRVAFT

SEQ ID NO: 2064227 - protein, 27 aa, Staphylococcus
EIGADAIMLITPYYNKTSQRGLVAHFT

SEQ ID NO: 2064228 - protein, 24 aa, Staphylococcus
EIGAPYEVLKSIKDNGRLPVVNFA

SEQ ID NO: 2064229 - protein, 30 aa, Staphylococcus
EIGDEYVILLRMHYLIANALDLHGYDDFAI

SEQ ID NO: 2064230 - protein, 26 aa, Staphylococcus
EIGEEYSFFIYPNRSGELFATQNMPD

SEQ ID NO: 2064231 - protein, 24 aa, Staphylococcus
EIGHFRADFDQRFKCNCGKSGCIE

SEQ ID NO: 2064232 - protein, 19 aa, Staphylococcus
EIGLSLLEKDKVDFAKELL

SEQ ID NO: 2064233 - protein, 18 aa, Staphylococcus
EIGPFIEAYLRTQMDNRE

SEQ ID NO: 2064234 - protein, 23 aa, Staphylococcus
EIGTLMHTVMQHLPFREQRLTET

SEQ ID NO: 2064235 - protein, 20 aa, Staphylococcus
EIGYLLYRSEDQLTFEQRAS

SEQ ID NO: 2064236 - protein, 29 aa, Staphylococcus
EIHDMTKIDYFFLNKFLNIIHIEHELKAH

SEQ ID NO: 2064237 - protein, 21 aa, Staphylococcus
EIHEFVMSKDSFSPSEVTAIA

SEQ ID NO: 2064238 - protein, 25 aa, Staphylococcus
EIHGANHYLIHQFVSPYYNRRNDEW

SEQ ID NO: 2064239 - protein, 26 aa, Staphylococcus
EIHGANHYLIHQFVSPYYNRRNDEWS

SEQ ID NO: 2064240 - protein, 28 aa, Staphylococcus
EIHKMTKIDFFFLNKFQNIINIEHELKE

SEQ ID NO: 2064241 - protein, 19 aa, Staphylococcus
EIHNFVMSKDSFSPSEVTA

SEQ ID NO: 2064242 - protein, 26 aa, Staphylococcus
EIHNKQFDYLLKRYLLNIERENDISM

SEQ ID NO: 2064243 - protein, 28 aa, Staphylococcus
EIHNMTQIDYFFLNKFQNIINIEHELKN

SEQ ID NO: 2064244 - protein, 21 aa, Staphylococcus
EIHVFLKRNLPSYAVPNFIKY

SEQ ID NO: 2064245 - protein, 31 aa, Staphylococcus
EIIEDYFMYDSWLAIYIIDQTFNYPKEFIVA

SEQ ID NO: 2064246 - protein, 19 aa, Staphylococcus
EIIEFLNKILSFNQYFEAP

SEQ ID NO: 2064247 - protein, 20 aa, Staphylococcus
EIIELLIKYYGQYVTIYEIA

SEQ ID NO: 2064248 - protein, 19 aa, Staphylococcus
EIIFDIISYFNDASIINEN

SEQ ID NO: 2064249 - protein, 18 aa, Staphylococcus
EIIFIDGPVIKAMKQGHI

SEQ ID NO: 2064250 - protein, 19 aa, Staphylococcus
EIIGILWHQGESDSLNQRY

SEQ ID NO: 2064251 - protein, 19 aa, Staphylococcus
EIIHLIHTLQETIVKLADD

SEQ ID NO: 2064252 - protein, 21 aa, Staphylococcus
EIIHRLSKVYGIKSISPVLKT

SEQ ID NO: 2064253 - protein, 21 aa, Staphylococcus
EIIHRLTKVYGIKSISPVIKT

SEQ ID NO: 2064254 - protein, 17 aa, Staphylococcus
EIIKNASAGYWFDKKFS

SEQ ID NO: 2064255 - protein, 17 aa, Staphylococcus
EIILEQLMHNDKAMIEA

SEQ ID NO: 2064256 - protein, 26 aa, Staphylococcus
EIINRMDDIVLFKPLTISDMSSIVDK

SEQ ID NO: 2064257 - protein, 26 aa, Staphylococcus
EIIPSYRAILIYFDNKRIEGNELLEN

SEQ ID NO: 2064258 - protein, 17 aa, Staphylococcus
EIIQLLKQNLTKAEIVE

SEQ ID NO: 2064259 - protein, 17 aa, Staphylococcus
EIIQPHPALLEAIGEGA

SEQ ID NO: 2064260 - protein, 26 aa, Staphylococcus
EIITHLSFYVGWPKAWSAFNIAKDIY

SEQ ID NO: 2064261 - protein, 27 aa, Staphylococcus
EIITTMMFVYFGQIHPVDFVVVEAGLG

SEQ ID NO: 2064262 - protein, 20 aa, Staphylococcus
EIIVTRRLYRSGDSAYYLNN

SEQ ID NO: 2064263 - protein, 23 aa, Staphylococcus
EIKDHFKILVTYRTISQGGKGQL

SEQ ID NO: 2064264 - protein, 17 aa, Staphylococcus
EIKDIILELPQVSIDHL

SEQ ID NO: 2064265 - protein, 31 aa, Staphylococcus
EIKGVAQLLFKRIPKLPFTLCYVSRGFVVDY

SEQ ID NO: 2064266 - protein, 17 aa, Staphylococcus
EIKIPEFINPEVKFSMI

SEQ ID NO: 2064267 - protein, 24 aa, Staphylococcus
EIKKIPPGIRYITKATGLPTDVSS

SEQ ID NO: 2064268 - protein, 17 aa, Staphylococcus
EIKLKAFEAHKSQTGPF

SEQ ID NO: 2064269 - protein, 19 aa, Staphylococcus
EIKLLFLEGLYQKMGYEGS

SEQ ID NO: 2064270 - protein, 24 aa, Staphylococcus
EIKLMNNIKLLGLAFNFMCFKSKA

SEQ ID NO: 2064271 - protein, 22 aa, Staphylococcus
EIKQFITRLNYFKSKAIASQRS

SEQ ID NO: 2064272 - protein, 20 aa, Staphylococcus
EIKQWFPKQVTPYNIKLVEN

SEQ ID NO: 2064273 - protein, 20 aa, Staphylococcus
EIKRVIAHLPNFESDTDTFV

SEQ ID NO: 2064274 - protein, 24 aa, Staphylococcus
EIKSLKFNSTLYSLGYPWQHNDNT

SEQ ID NO: 2064275 - protein, 20 aa, Staphylococcus
EIKSLNLLAEQLIEIVKIVS

SEQ ID NO: 2064276 - protein, 25 aa, Staphylococcus
EIKVEPLMYKPYFTAKLQSIDNATE

SEQ ID NO: 2064277 - protein, 22 aa, Staphylococcus
EIKYIVNLFNKPTSKECNIQST

SEQ ID NO: 2064278 - protein, 18 aa, Staphylococcus
EILCPFHYFGVTDYSLNG

SEQ ID NO: 2064279 - protein, 17 aa, Staphylococcus
EILDAVRRAFLADMLIF

SEQ ID NO: 2064280 - protein, 25 aa, Staphylococcus
EILDLPEYTFPLFGMAIGEPAENEN

SEQ ID NO: 2064281 - protein, 23 aa, Staphylococcus
EILEALRQLYYIEKFASIDDIGN

SEQ ID NO: 2064282 - protein, 24 aa, Staphylococcus
EILEKSFELVFVKWVPREQNKEAN

SEQ ID NO: 2064283 - protein, 21 aa, Staphylococcus
EILESLRPLLMSYGKERLEGE

SEQ ID NO: 2064284 - protein, 17 aa, Staphylococcus
EILGAFIVGPHATDLIG

SEQ ID NO: 2064285 - protein, 23 aa, Staphylococcus
EILGKYRFMLSGGQLERVYIASV

SEQ ID NO: 2064286 - protein, 21 aa, Staphylococcus
EILHVLKRFKAMLIQKNETVE

SEQ ID NO: 2064287 - protein, 19 aa, Staphylococcus
EILINLGYHLLMQNSAITL

SEQ ID NO: 2064288 - protein, 30 aa, Staphylococcus
EILIPGPTYAGYIPLIQTLGGKPVFIDTSA

SEQ ID NO: 2064289 - protein, 30 aa, Staphylococcus
EILIPGPVYAGYIPLIETLGGIPIYMDTTQ

SEQ ID NO: 2064290 - protein, 28 aa, Staphylococcus
EILKKLSNYLLPYEMPNYVFKVERFPIT

SEQ ID NO: 2064291 - protein, 25 aa, Staphylococcus
EILKPAVMMNLLGKDLDLLEDEFGE

SEQ ID NO: 2064292 - protein, 25 aa, Staphylococcus
EILKPAVMMNLLGKDLDLLEDKFGD

SEQ ID NO: 2064293 - protein, 25 aa, Staphylococcus
EILKPAVMMNLLGRDLDLLEDKFGD

SEQ ID NO: 2064294 - protein, 19 aa, Staphylococcus
EILKQWFMTTPRTNKTFEA

SEQ ID NO: 2064295 - protein, 18 aa, Staphylococcus
EILLLDESLSALDLKLRT

SEQ ID NO: 2064296 - protein, 18 aa, Staphylococcus
EILLYFRTNPCLENIPVT

SEQ ID NO: 2064297 - protein, 17 aa, Staphylococcus
EILMSLDAFPKLNQEEL

SEQ ID NO: 2064298 - protein, 24 aa, Staphylococcus
EILNRMDDIVLFKPLSVNDMSMIV

SEQ ID NO: 2064299 - protein, 25 aa, Staphylococcus
EILNTLDCFSEHLGLMFQIKDDLLD

SEQ ID NO: 2064300 - protein, 18 aa, Staphylococcus
EILPNTKEFKTFCNMLEH

SEQ ID NO: 2064301 - protein, 28 aa, Staphylococcus
EILQIDSYNLWWYGGIEGKTISVNIAEK

SEQ ID NO: 2064302 - protein, 19 aa, Staphylococcus
EILQKIWELSNKTAERLAK

SEQ ID NO: 2064303 - protein, 18 aa, Staphylococcus
EILRKHLIDKYSIGIIAL

SEQ ID NO: 2064304 - protein, 25 aa, Staphylococcus
EILRKPDWLKIKLNTNENYIGLKKM

SEQ ID NO: 2064305 - protein, 18 aa, Staphylococcus
EILTKLKSLGLNSNWDML

SEQ ID NO: 2064306 - protein, 18 aa, Staphylococcus
EILVDLLSLNDVDSLIES

SEQ ID NO: 2064307 - protein, 17 aa, Staphylococcus
EILVRKKMKLKKNNIYI

SEQ ID NO: 2064308 - protein, 18 aa, Staphylococcus
EILYDNEIGFYRGSNHLG

SEQ ID NO: 2064309 - protein, 22 aa, Staphylococcus
EIMEKLFGYKLENVGISIPFDT

SEQ ID NO: 2064310 - protein, 18 aa, Staphylococcus
EIMIADCGLPIPNGVKKI

SEQ ID NO: 2064311 - protein, 18 aa, Staphylococcus
EIMPIYDAAMKYKEDGTG

SEQ ID NO: 2064312 - protein, 27 aa, Staphylococcus
EIMSLKHIKVIGLAFNFMSFKSEAPSD

SEQ ID NO: 2064313 - protein, 28 aa, Staphylococcus
EINAPSWLHHLLRIYQLAPRFIEKHFTF

SEQ ID NO: 2064314 - protein, 19 aa, Staphylococcus
EINELLSEKIYIQNPPCDT

SEQ ID NO: 2064315 - protein, 17 aa, Staphylococcus
EINFFIEGYTKGDIPDY

SEQ ID NO: 2064316 - protein, 19 aa, Staphylococcus
EINGNRRKLNAAYKKFEKL

SEQ ID NO: 2064317 - protein, 24 aa, Staphylococcus
EINHGHGVLYIYGNYAGDLMNFEM

SEQ ID NO: 2064318 - protein, 27 aa, Staphylococcus
EINICIEEILTLPFFSDKKVVVIKNAY

SEQ ID NO: 2064319 - protein, 22 aa, Staphylococcus
EINKALVEMLDSINLRLVDFKI

SEQ ID NO: 2064320 - protein, 23 aa, Staphylococcus
EINKLNLEYAPCTELSMGMSNDY

SEQ ID NO: 2064321 - protein, 22 aa, Staphylococcus
EINLPVIGIVKRDYTNSSVFIT

SEQ ID NO: 2064322 - protein, 39 aa, Staphylococcus
EINNNLMIPLKIEIPYYAGLSFRTLMPKFPSTLPHIKLS

SEQ ID NO: 2064323 - protein, 24 aa, Staphylococcus
EINQLCIKLALNFNTNASFKIDVK

SEQ ID NO: 2064324 - protein, 18 aa, Staphylococcus
EINQNIFLVLVCPHGPLK

SEQ ID NO: 2064325 - protein, 26 aa, Staphylococcus
EINSKYFNISFYLTTHSIPEAYGVVV

SEQ ID NO: 2064326 - protein, 19 aa, Staphylococcus
EINYIITVDLFNEGIDIPE

SEQ ID NO: 2064327 - protein, 30 aa, Staphylococcus; identical to SEQ ID NO: 1826586

SEQ ID NO: 2064328 - protein, 25 aa, Staphylococcus
EIPGAISFAPFNLVLRFGLDSQDVE

SEQ ID NO: 2064329 - protein, 17 aa, Staphylococcus
EIPNFKFGDRVIDSTGA

SEQ ID NO: 2064330 - protein, 18 aa, Staphylococcus
EIPSLINKKILQFSMNDL

SEQ ID NO: 2064331 - protein, 17 aa, Staphylococcus
EIPSTLPVFEDVTSGSL

SEQ ID NO: 2064332 - protein, 17 aa, Staphylococcus
EIPSYINSIRTWHNIRS

SEQ ID NO: 2064333 - protein, 17 aa, Staphylococcus
EIQFADFILPAVNQIIS

SEQ ID NO: 2064334 - protein, 19 aa, Staphylococcus
EIQFQYGLVLCHLEMFEQA

SEQ ID NO: 2064335 - protein, 23 aa, Staphylococcus
EIQFQYGLVLCQLEMFEQAINQL

SEQ ID NO: 2064336 - protein, 18 aa, Staphylococcus
EIQIETLYISVDPYMRGR

SEQ ID NO: 2064337 - protein, 26 aa, Staphylococcus
EIQLKTLYISVDPYMRGRMSQGDSYV

SEQ ID NO: 2064338 - protein, 25 aa, Staphylococcus
EIQNLLIPLTFHFSTDELMIINQHK

SEQ ID NO: 2064339 - protein, 27 aa, Staphylococcus
EIQPKTMMSKFVPGLFLCGEVLDIHGY

SEQ ID NO: 2064340 - protein, 31 aa, Staphylococcus
EIQSKYVLMTYYNIINHYGELAFLNACEQAG

SEQ ID NO: 2064341 - protein, 29 aa, Staphylococcus
EIRDNVAYIFVIHEFYADWLNSNYKDVIQ

SEQ ID NO: 2064342 - protein, 19 aa, Staphylococcus
EIRHSNMLAWLFNPNEVHG

SEQ ID NO: 2064343 - protein, 24 aa, Staphylococcus
EIRLDAVYIFEKIIQGSGGLPVGT

SEQ ID NO: 2064344 - protein, 23 aa, Staphylococcus
EIRLKDGLLFRKMQIITDGGILK

SEQ ID NO: 2064345 - protein, 28 aa, Staphylococcus
EIRRTKINMVFQNFGLFPKRTVLENTEY

SEQ ID NO: 2064346 - protein, 17 aa, Staphylococcus
EIRYIIFNINEDNLLKP

SEQ ID NO: 2064347 - protein, 25 aa, Staphylococcus
EISDFTALIYYPEDKLKLVKSSFDA

SEQ ID NO: 2064348 - protein, 17 aa, Staphylococcus
EISGWRYMLDKCEELLA

SEQ ID NO: 2064349 - protein, 18 aa, Staphylococcus
EISGWRYMLDKCEELLSE

SEQ ID NO: 2064350 - protein, 24 aa, Staphylococcus
EISIYPFLCYLDKELIAIGYLDNF

SEQ ID NO: 2064351 - protein, 27 aa, Staphylococcus
EISSGIFAFDNKILFEKLEQVKNDNAQ

SEQ ID NO: 2064352 - protein, 27 aa, Staphylococcus
EISTPIKIILIDIPSNNYPLLKKHIEK

SEQ ID NO: 2064353 - protein, 20 aa, Staphylococcus
EISWMYDLELLQETSSKAYI

SEQ ID NO: 2064354 - protein, 22 aa, Staphylococcus
EITHSLPQIDYFVAGIGSGGTF

SEQ ID NO: 2064355 - protein, 18 aa, Staphylococcus
EITKDPKYLIGRVIARPY

SEQ ID NO: 2064356 - protein, 26 aa, Staphylococcus
EITLNEFYVLYFLKKSEGHSLSISEL

SEQ ID NO: 2064357 - protein, 23 aa, Staphylococcus
EITPLYIRYQGFTFNLVYHYKQK

SEQ ID NO: 2064358 - protein, 19 aa, Staphylococcus
EITSYFYNRMFNQHPELKN

SEQ ID NO: 2064359 - protein, 19 aa, Staphylococcus
EIVDILKDYPKAHLHVDAV

SEQ ID NO: 2064360 - protein, 19 aa, Staphylococcus
EIVELFAFISFTNCQQQFG

SEQ ID NO: 2064361 - protein, 19 aa, Staphylococcus
EIVFIDGPVIRAMKEGHIL

SEQ ID NO: 2064362 - protein, 18 aa, Staphylococcus
EIVFKINGPLPFLQLVYF

SEQ ID NO: 2064363 - protein, 33 aa, Staphylococcus
EIVGVAQLLFKKVPKLPYTLCYISRGFVTDYSN

SEQ ID NO: 2064364 - protein, 23 aa, Staphylococcus
EIVKLIHRAMFETNIFDYSKEDL

SEQ ID NO: 2064365 - protein, 28 aa, Staphylococcus
EIVKSMIFKIDGEFIMFLIRGHHELNDV

SEQ ID NO: 2064366 - protein, 21 aa, Staphylococcus
EIVKTMIFKVDGEFIMVLVRG

SEQ ID NO: 2064367 - protein, 20 aa, Staphylococcus
EIVLNFLSVLFDNNFLKNKL

SEQ ID NO: 2064368 - protein, 17 aa, Staphylococcus
EIVPIWKKEIWEDGAEW

SEQ ID NO: 2064369 - protein, 17 aa, Staphylococcus
EIVPIWKKEIWEDGSEW

SEQ ID NO: 2064370 - protein, 17 aa, Staphylococcus
EIVPIYNFVREKEFPTK

SEQ ID NO: 2064371 - protein, 22 aa, Staphylococcus
EIVRRYCFDKAFLGMNGIDLKH

SEQ ID NO: 2064372 - protein, 21 aa, Staphylococcus
EIVRYLGYFQTSSPSYLVMAS

SEQ ID NO: 2064373 - protein, 19 aa, Staphylococcus
EIVTKCGIVLPSSPEQDIH

SEQ ID NO: 2064374 - protein, 19 aa, Staphylococcus
EIVTLLMKYQGQFITIYEI

SEQ ID NO: 2064375 - protein, 26 aa, Staphylococcus
EIWEQVNVFMLPKDYLRYCLTNQINM

SEQ ID NO: 2064376 - protein, 17 aa, Staphylococcus
EIYCDINDTVDIWNGLL

SEQ ID NO: 2064377 - protein, 21 aa, Staphylococcus
EIYDYIKHIVQTKGYPPSVRE

SEQ ID NO: 2064378 - protein, 22 aa, Staphylococcus
EIYDYIKHVVQIKGYPPSVREI

SEQ ID NO: 2064379 - protein, 19 aa, Staphylococcus
EIYERAPFTPTEYGDPSML

SEQ ID NO: 2064380 - protein, 18 aa, Staphylococcus
EIYFKLTAAGQKIYHTHE

SEQ ID NO: 2064381 - protein, 21 aa, Staphylococcus
EIYFRGKDYKLPIGTPAMATG

SEQ ID NO: 2064382 - protein, 18 aa, Staphylococcus
EIYHRLIEAGKSANIPVI

SEQ ID NO: 2064383 - protein, 18 aa, Staphylococcus
EIYIFGIFRKADGIHVGN

SEQ ID NO: 2064384 - protein, 24 aa, Staphylococcus
EIYKPYIEGFIKMLAPIAPHISEE

SEQ ID NO: 2064385 - protein, 18 aa, Staphylococcus
EIYKSHMFYWSDKNNKRI

SEQ ID NO: 2064386 - protein, 17 aa, Staphylococcus
EIYKWMDLGRKVDERLW

SEQ ID NO: 2064387 - protein, 19 aa, Staphylococcus
EIYNHPLHPYTQSLLSAVP

SEQ ID NO: 2064388 - protein, 22 aa, Staphylococcus
EIYNHPMHPYTQSLLSAVPQPD

SEQ ID NO: 2064389 - protein, 25 aa, Staphylococcus
EIYNTYRRRFGITFPIHSKTIVNGD

SEQ ID NO: 2064390 - protein, 19 aa, Staphylococcus
EIYQLMNELTDRGVSIIMV

SEQ ID NO: 2064391 - protein, 27 aa, Staphylococcus
EKAHELHPDLILMDLLMEDMDGVEATQ

SEQ ID NO: 2064392 - protein, 27 aa, Staphylococcus
EKAHELKPDLILMDLLMDDMDGVEATE

SEQ ID NO: 2064393 - protein, 27 aa, Staphylococcus
EKAHELKPDLILMDLLMDDMDGVEATT

SEQ ID NO: 2064394 - protein, 27 aa, Staphylococcus
EKAHTLNPDLILMDLLMNDMDGVEATT

SEQ ID NO: 2064395 - protein, 22 aa, Staphylococcus
EKAIATKILPASTFYKAEEYHQ

SEQ ID NO: 2064396 - protein, 18 aa, Staphylococcus
EKAIINRLNLFKENKYPS

SEQ ID NO: 2064397 - protein, 22 aa, Staphylococcus
EKAILLLHSFTGTVRDVKLLAT

SEQ ID NO: 2064398 - protein, 18 aa, Staphylococcus
EKAKPNLQIINVARGGII

SEQ ID NO: 2064399 - protein, 23 aa, Staphylococcus
EKAKTFISLSIKYTPEIGKGRGP

SEQ ID NO: 2064400 - protein, 22 aa, Staphylococcus
EKALFTYYYNHVLPNGSVVFND

SEQ ID NO: 2064401 - protein, 17 aa, Staphylococcus
EKALKNIVAYQADQQRG

SEQ ID NO: 2064402 - protein, 17 aa, Staphylococcus
EKALPEYTLLSHLHPSI

SEQ ID NO: 2064403 - protein, 24 aa, Staphylococcus
EKALPKHYTWIEKLKFAKELGFDF

SEQ ID NO: 2064404 - protein, 17 aa, Staphylococcus
EKALPYVDYMSELISIV

SEQ ID NO: 2064405 - protein, 23 aa, Staphylococcus
EKALQKRINLFHMRNGVTIIDPD

SEQ ID NO: 2064406 - protein, 18 aa, Staphylococcus
EKARRLAFQTEDMKRQSK

SEQ ID NO: 2064407 - protein, 24 aa, Staphylococcus
EKATGYFYQICKRNHYVKEDAIAK

SEQ ID NO: 2064408 - protein, 30 aa, Staphylococcus
EKCLYSTYLSYLPEDKFSYPLKMNVDNRGS

SEQ ID NO: 2064409 - protein, 28 aa, Staphylococcus
EKCNAYHILMKLMLKFDFVYDGDKLTDR

SEQ ID NO: 2064410 - protein, 19 aa, Staphylococcus
EKDDLYQEVLIKLYLALKR

SEQ ID NO: 2064411 - protein, 24 aa, Staphylococcus
EKDFDLLINWINSPELLVKWAGTD

SEQ ID NO: 2064412 - protein, 20 aa, Staphylococcus
EKDFGPFYRYDPNQCILCGR

SEQ ID NO: 2064413 - protein, 17 aa, Staphylococcus
EKDFQEVIWLKKDIYNY

SEQ ID NO: 2064414 - protein, 42 aa, Staphylococcus
EKDGRQAIQFLKQRNLGRATFLPLNVIKPRHIASDIKEIARQ

SEQ ID NO: 2064415 - protein, 25 aa, Staphylococcus
EKDLDAIVVLSDYNRRYLSGFTGTS

SEQ ID NO: 2064416 - protein, 26 aa, Staphylococcus
EKDLDLMFAVNLKGPIWFSQSVAEHF

SEQ ID NO: 2064417 - protein, 23 aa, Staphylococcus
EKDLWIHVKLDTGMGRLGMKTAE

SEQ ID NO: 2064418 - protein, 22 aa, Staphylococcus
EKDLWLHVKIDTGMGRLGVKSA

SEQ ID NO: 2064419 - protein, 24 aa, Staphylococcus
EKDPKLAPFQGYVLQNFDLNENGF

SEQ ID NO: 2064420 - protein, 25 aa, Staphylococcus
EKDPKLMPFQGYVLQNFQLKDDDAF

SEQ ID NO: 2064421 - protein, 26 aa, Staphylococcus
EKDPTIDIFFQMNGQLRIWNDLDNEA

SEQ ID NO: 2064422 - protein, 22 aa, Staphylococcus
EKDRERLYKGWKKAVEATQVFK

SEQ ID NO: 2064423 - protein, 19 aa, Staphylococcus
EKDYDFIKLIQLPENTGSP

SEQ ID NO: 2064424 - protein, 17 aa, Staphylococcus
EKEDLARKLLALCHDYA

SEQ ID NO: 2064425 - protein, 24 aa, Staphylococcus
EKEGFHILAIKDMAGLLKPKAAYE

SEQ ID NO: 2064426 - protein, 24 aa, Staphylococcus
EKEGKFNMIFQFEHLGLWSTGDSK

SEQ ID NO: 2064427 - protein, 17 aa, Staphylococcus
EKEIFSMYYDYAEPIKK

SEQ ID NO: 2064428 - protein, 24 aa, Staphylococcus
EKEKDFLQVIVKEDNEQLPADQGA

SEQ ID NO: 2064429 - protein, 24 aa, Staphylococcus
EKELGALYVPFDTLLEHSDFIICT

SEQ ID NO: 2064430 - protein, 22 aa, Staphylococcus
EKELGYRLKLISGGNSSMLPQL

SEQ ID NO: 2064431 - protein, 19 aa, Staphylococcus
EKELVIYTSLIVREDAQLL

SEQ ID NO: 2064432 - protein, 20 aa, Staphylococcus
EKEMIWSHMFEWIQKQVLKK

SEQ ID NO: 2064433 - protein, 25 aa, Staphylococcus
EKENDFLQIVVKEDNEKLPSDQNFA

SEQ ID NO: 2064434 - protein, 29 aa, Staphylococcus
EKEPIYGNTYLPRKFKIGIAVPPSNDIDV

SEQ ID NO: 2064435 - protein, 33 aa, Staphylococcus
EKERCIPYYIFNEYWFLFYHDEEYFALKFDLDK

SEQ ID NO: 2064436 - protein, 23 aa, Staphylococcus
EKERFLELLQNKKTYDRISHILE

SEQ ID NO: 2064437 - protein, 17 aa, Staphylococcus
EKERPMDRLLCGDVGYG

SEQ ID NO: 2064438 - protein, 18 aa, Staphylococcus
EKFFKILKDIHYNGPFLI

SEQ ID NO: 2064439 - protein, 20 aa, Staphylococcus
EKFILALGLNHVRVRYHQNI

SEQ ID NO: 2064440 - protein, 18 aa, Staphylococcus
EKFISEYLKTLNVTQSAI

SEQ ID NO: 2064441 - protein, 19 aa, Staphylococcus
EKFISEYLKTLNVTQSAIK

SEQ ID NO: 2064442 - protein, 28 aa, Staphylococcus
EKFKQMIDIMLVGTFLMTKHVLPIMKAQ

SEQ ID NO: 2064443 - protein, 25 aa, Staphylococcus
EKFKRPIFTFIDTKGAYPGKAAEER

SEQ ID NO: 2064444 - protein, 20 aa, Staphylococcus
EKFKTLFQMIEQTFARPLSP

SEQ ID NO: 2064445 - protein, 28 aa, Staphylococcus
EKFKTTMITFKFMAPLDYETITARSLLS

SEQ ID NO: 2064446 - protein, 20 aa, Staphylococcus
EKFLEHAWSWKEEYASFIRQ

SEQ ID NO: 2064447 - protein, 25 aa, Staphylococcus
EKFNRPIFSFIDTKGAYPGKAAEER

SEQ ID NO: 2064448 - protein, 18 aa, Staphylococcus
EKFVAEYLKTLNVTQSTI

SEQ ID NO: 2064449 - protein, 18 aa, Staphylococcus
EKGDKGTWIIYSKMIIEP

SEQ ID NO: 2064450 - protein, 40 aa, Staphylococcus
EKGDRVFIFMPRTPELYFALFGILKIGAIVGPLFEAFMEK

SEQ ID NO: 2064451 - protein, 22 aa, Staphylococcus
EKGLDGSRRFLDRVWRLLINED

SEQ ID NO: 2064452 - protein, 23 aa, Staphylococcus
EKGLYRKRMLSYGGLLKQKHKIL

SEQ ID NO: 2064453 - protein, 17 aa, Staphylococcus
EKGNEVLPITFIEGNIA

SEQ ID NO: 2064454 - protein, 23 aa, Staphylococcus
EKGVKTIVFDRGGYLYHGRVKAL

SEQ ID NO: 2064455 - protein, 18 aa, Staphylococcus
EKGVWNYTLFIQNGRVKD

SEQ ID NO: 2064456 - protein, 21 aa, Staphylococcus
EKGYQLYFDSPTNQQFFVLSE

SEQ ID NO: 2064457 - protein, 29 aa, Staphylococcus
EKHDIITQQLLDLVIAYMMEMQKTDYDGA

SEQ ID NO: 2064458 - protein, 22 aa, Staphylococcus
EKHFKLRIEQFLIYKDISNKEV

SEQ ID NO: 2064459 - protein, 19 aa, Staphylococcus
EKHLELIMKWAVQELEKNF

SEQ ID NO: 2064460 - protein, 25 aa, Staphylococcus
EKHNLKMITIEELVHYRRTHEQHMH

SEQ ID NO: 2064461 - protein, 24 aa, Staphylococcus
EKIADYLVYLKHGEILLTGECDAL

SEQ ID NO: 2064462 - protein, 28 aa, Staphylococcus
EKIAIQKLIKILFNITRRFKNEKLEFLI

SEQ ID NO: 2064463 - protein, 18 aa, Staphylococcus
EKIALIHPDTPKHHLKVC

SEQ ID NO: 2064464 - protein, 23 aa, Staphylococcus
EKIGFIYSELYLNDKWTVKKCEQ

SEQ ID NO: 2064465 - protein, 27 aa, Staphylococcus
EKIKKMQYAPYIIFATAHDTFAVKAFE

SEQ ID NO: 2064466 - protein, 23 aa, Staphylococcus
EKINDVMMLYGKNIQSLKDSVDE

SEQ ID NO: 2064467 - protein, 36 aa, Staphylococcus
EKIQSSILTSIPLWKNQMAIALTLMRQKNAVTAQRA

SEQ ID NO: 2064468 - protein, 37 aa, Staphylococcus
EKIQSSILTSIPLWKNQMAIALTLMRQRQAMSAQRAV

SEQ ID NO: 2064469 - protein, 30 aa, Staphylococcus; identical to SEQ ID NO: 1826621

SEQ ID NO: 2064470 - protein, 21 aa, Staphylococcus
EKIRIYLESRTKDFSVGGLFN

SEQ ID NO: 2064471 - protein, 21 aa, Staphylococcus
EKIRKWFKRYLSESRHIRIDK

SEQ ID NO: 2064472 - protein, 24 aa, Staphylococcus
EKIRLRWAQLVNTDYNLLVLDEPT

SEQ ID NO: 2064473 - protein, 22 aa, Staphylococcus
EKISDFLSLIGGYQALLKFEDV

SEQ ID NO: 2064474 - protein, 26 aa, Staphylococcus
EKISKQIFDLILKFADYGFPRAHAVS

SEQ ID NO: 2064475 - protein, 28 aa, Staphylococcus
EKISSTIVYLPEFIRSLKGGFKDGSFES

SEQ ID NO: 2064476 - protein, 17 aa, Staphylococcus
EKIVDVIPPPDGDPEAP

SEQ ID NO: 2064477 - protein, 18 aa, Staphylococcus
EKIYKDLLREGVDFMTMG

SEQ ID NO: 2064478 - protein, 17 aa, Staphylococcus
EKIYKQLLRDGVDFITM

SEQ ID NO: 2064479 - protein, 22 aa, Staphylococcus
EKIYKQLLREGVDFMTMGNHTY

SEQ ID NO: 2064480 - protein, 34 aa, Staphylococcus
EKKAFVEAFRLVSKLVLRLKAFDEFDFTKANIGM

SEQ ID NO: 2064481 - protein, 22 aa, Staphylococcus
EKKDFQNWVARPSHVEEHKAMH

SEQ ID NO: 2064482 - protein, 21 aa, Staphylococcus
EKKFKQYDVYAYLLDERHKTV

SEQ ID NO: 2064483 - protein, 27 aa, Staphylococcus
EKKHELNDALYYFNVPAEVKNVTEGPS

SEQ ID NO: 2064484 - protein, 21 aa, Staphylococcus
EKKLWLHAKIDSGMGRLGMKD

SEQ ID NO: 2064485 - protein, 28 aa, Staphylococcus
EKKQELNDAFYYFNVPAEVKNVTEGPSV

SEQ ID NO: 2064486 - protein, 27 aa, Staphylococcus
EKKQELNDAFYYFNVPAEVQNVTEGPS

SEQ ID NO: 2064487 - protein, 23 aa, Staphylococcus
EKKWQCFWLDNQTFKTSDNLGQK

SEQ ID NO: 2064488 - protein, 19 aa, Staphylococcus
EKLAIATLAVRNGATFIST

SEQ ID NO: 2064489 - protein, 31 aa, Staphylococcus
EKLEIIPLNIERYFYLLTHTNKYIDQNMELL

SEQ ID NO: 2064490 - protein, 18 aa, Staphylococcus
EKLFKLKDLMHTQTAKHI

SEQ ID NO: 2064491 - protein, 22 aa, Staphylococcus
EKLGLLKIDFLGLKNLSIIHQI

SEQ ID NO: 2064492 - protein, 19 aa, Staphylococcus
EKLGYARYWVAEHHQVPSV

SEQ ID NO: 2064493 - protein, 23 aa, Staphylococcus
EKLKNEYIISPKEAKNIFGKYVF

SEQ ID NO: 2064494 - protein, 25 aa, Staphylococcus
EKLLCHTYDLVFLDINLMDENGIDL

SEQ ID NO: 2064495 - protein, 21 aa, Staphylococcus
EKLLNFSKLNHKFSYLVNEND

SEQ ID NO: 2064496 - protein, 23 aa, Staphylococcus
EKLPIWIADYVLSTYGTGAVMAV

SEQ ID NO: 2064497 - protein, 24 aa, Staphylococcus
EKLSYLIKELKFESAIYDLVSSYS

SEQ ID NO: 2064498 - protein, 22 aa, Staphylococcus
EKLTLTEYYYRMWAREYERLDQ

SEQ ID NO: 2064499 - protein, 26 aa, Staphylococcus
EKLVDQKMIYIPTKNEQYVSTNNNQQ

SEQ ID NO: 2064500 - protein, 21 aa, Staphylococcus
EKLYVNIFRPNKEGQFPVVMS

SEQ ID NO: 2064501 - protein, 20 aa, Staphylococcus
EKMIELVKPLGHIATIVVFK

SEQ ID NO: 2064502 - protein, 26 aa, Staphylococcus
EKMVEGRLRKYLQEICAVDQNFVKNP

SEQ ID NO: 2064503 - protein, 21 aa, Staphylococcus
EKMYRRFSILATISQNEPVGR

SEQ ID NO: 2064504 - protein, 29 aa, Staphylococcus
EKNEFINTMGWFTNIYPMKIELNDDIKIS

SEQ ID NO: 2064505 - protein, 21 aa, Staphylococcus
EKNEILVYKRLSGGGESRLHG

SEQ ID NO: 2064506 - protein, 24 aa, Staphylococcus
EKNFPSLLQWTESLWQFIPSSTNK

SEQ ID NO: 2064507 - protein, 19 aa, Staphylococcus
EKNFQQEAFYIMATRNGMI

SEQ ID NO: 2064508 - protein, 17 aa, Staphylococcus
EKNTLLERFKYAQSINV

SEQ ID NO: 2064509 - protein, 19 aa, Staphylococcus
EKPIPMCGVPYHSANSYIE

SEQ ID NO: 2064510 - protein, 19 aa, Staphylococcus
EKPRKILLMIKAGSPTDNM

SEQ ID NO: 2064511 - protein, 23 aa, Staphylococcus
EKQCPTCHMTLKDIAHVGKFGCA

SEQ ID NO: 2064512 - protein, 24 aa, Staphylococcus
EKQERLTIIQGKLKQLETDIERYT

SEQ ID NO: 2064513 - protein, 18 aa, Staphylococcus
EKQFFVIENLAKSMTKEA

SEQ ID NO: 2064514 - protein, 18 aa, Staphylococcus
EKQFFVIENLAKTMSKEA

SEQ ID NO: 2064515 - protein, 25 aa, Staphylococcus
EKQFLYQDEPYSYALPLLVVNRDNN

SEQ ID NO: 2064516 - protein, 25 aa, Staphylococcus
EKQFLYQDVPYSYALPMFAVNKKNN

SEQ ID NO: 2064517 - protein, 24 aa, Staphylococcus
EKQFTHYPQLYSRLGFAHQYRPLG

SEQ ID NO: 2064518 - protein, 24 aa, Staphylococcus
EKQIKVLARGPVFKGLLTSNSNEA

SEQ ID NO: 2064519 - protein, 24 aa, Staphylococcus
EKQKLRYLYGMTERQFRNTFEIAG

SEQ ID NO: 2064520 - protein, 25 aa, Staphylococcus
EKQNNYILSFIQSASMYALSYCDVS

SEQ ID NO: 2064521 - protein, 22 aa, Staphylococcus
EKQNYLDFVDYYIDFLTSFTDE

SEQ ID NO: 2064522 - protein, 23 aa, Staphylococcus
EKQRDLLNLLKQELEELGLQTDI

SEQ ID NO: 2064523 - protein, 17 aa, Staphylococcus
EKQRNYMELFYLRDYSL

SEQ ID NO: 2064524 - protein, 23 aa, Staphylococcus
EKQSKLKRFFKRTKASINEVFSR

SEQ ID NO: 2064525 - protein, 32 aa, Staphylococcus
EKQTFSNLLQFVQKFPHYFAGSNADLPIVGGS

SEQ ID NO: 2064526 - protein, 24 aa, Staphylococcus
EKQTHFVTELYVETIKFMSPKLNN

SEQ ID NO: 2064527 - protein, 24 aa, Staphylococcus
EKQTSFFNEYFFSQPVSGPEISFN

SEQ ID NO: 2064528 - protein, 22 aa, Staphylococcus
EKQVELFKQFKSIADKKKNVSD

SEQ ID NO: 2064529 - protein, 22 aa, Staphylococcus
EKRLFEQAAYVYYLGRFIDSDS

SEQ ID NO: 2064530 - protein, 23 aa, Staphylococcus
EKRLNYAGFYRIHHQYKKKVMMV

SEQ ID NO: 2064531 - protein, 18 aa, Staphylococcus
EKRLNYEGFYRLHHSYKK

SEQ ID NO: 2064532 - protein, 23 aa, Staphylococcus
EKRQAILKELLGYEAKQLSISSP

SEQ ID NO: 2064533 - protein, 28 aa, Staphylococcus
EKRQEKLLNGMWQFPMFESPNGIQKLEN

SEQ ID NO: 2064534 - protein, 27 aa, Staphylococcus
EKRQEKLLNGMWQFPMRKASVADNLLT

SEQ ID NO: 2064535 - protein, 24 aa, Staphylococcus
EKRRHANRLKKIPLRININGIRGK

SEQ ID NO: 2064536 - protein, 22 aa, Staphylococcus
EKRTYTFTNIWNNSVYYHGNVP

SEQ ID NO: 2064537 - protein, 26 aa, Staphylococcus
EKRVFYALIAGYKPLEIARILKLQRK

SEQ ID NO: 2064538 - protein, 17 aa, Staphylococcus
EKRYATRSQLRDFNVEE

SEQ ID NO: 2064539 - protein, 19 aa, Staphylococcus
EKSFSHIALPDNAYLSCYP

SEQ ID NO: 2064540 - protein, 17 aa, Staphylococcus
EKSILLGTSTFFEGFDF

SEQ ID NO: 2064541 - protein, 26 aa, Staphylococcus
EKSLALYQSFLEFMNRFDIKIATTFG

SEQ ID NO: 2064542 - protein, 22 aa, Staphylococcus
EKSNYLPSYRYAQISYEDDDLA

SEQ ID NO: 2064543 - protein, 24 aa, Staphylococcus
EKSQAFDFIIEGDSLIPPFIAVPG

SEQ ID NO: 2064544 - protein, 33 aa, Staphylococcus
EKSQAFDFIIEGDTLIPPFIAVPGLGENVAKRI

SEQ ID NO: 2064545 - protein, 24 aa, Staphylococcus
EKSQAFDFIIEGDTLIPPFISVPG

SEQ ID NO: 2064546 - protein, 24 aa, Staphylococcus
EKSQAFEFIIEGDTLIPPFISVPG

SEQ ID NO: 2064547 - protein, 22 aa, Staphylococcus
EKSQNKFIFEEIVEWLENELNK

SEQ ID NO: 2064548 - protein, 20 aa, Staphylococcus
EKSVLSYKPTNQGPGVIFSI

SEQ ID NO: 2064549 - protein, 26 aa, Staphylococcus
EKTELPIEGMLLLSPLLEFKRNNKTR

SEQ ID NO: 2064550 - protein, 26 aa, Staphylococcus
EKTFDGKAFYIIATRNGMIKKSNQSL

SEQ ID NO: 2064551 - protein, 19 aa, Staphylococcus
EKTFVCEKTFNILKQSPYK

SEQ ID NO: 2064552 - protein, 26 aa, Staphylococcus
EKTGNPHTIFEHCLPAFHNAETKIGK

SEQ ID NO: 2064553 - protein, 24 aa, Staphylococcus
EKTKVGPFAQLRPGSNLGADVKVG

SEQ ID NO: 2064554 - protein, 17 aa, Staphylococcus
EKTLERKAVWDKWMEQD

SEQ ID NO: 2064555 - protein, 17 aa, Staphylococcus
EKTLGFKSVFKFRNDKN

SEQ ID NO: 2064556 - protein, 25 aa, Staphylococcus
EKTLLSAKRWIRYIHEIEEPDFLIV

SEQ ID NO: 2064557 - protein, 31 aa, Staphylococcus
EKTLQLIDMLNPYLCIIFCNSRENANELADS

SEQ ID NO: 2064558 - protein, 35 aa, Staphylococcus
EKTPSQLFQFFMSYTIAKFDVSLATLLGVHQGLGH

SEQ ID NO: 2064559 - protein, 24 aa, Staphylococcus
EKTQFIVITHRKGTMEAADRLYGI

SEQ ID NO: 2064560 - protein, 21 aa, Staphylococcus
EKVATPFPRISYDDAIEFLKE

SEQ ID NO: 2064561 - protein, 24 aa, Staphylococcus
EKVATPFPRITYDDAIDYLKEQGF

SEQ ID NO: 2064562 - protein, 23 aa, Staphylococcus
EKVDAPIVEGSFTAAVKLSVGGS

SEQ ID NO: 2064563 - protein, 23 aa, Staphylococcus
EKVDQFELQLLLDGPHDANNAIL

SEQ ID NO: 2064564 - protein, 26 aa, Staphylococcus
EKVDTSLLMIHAQDHLMTALSEKSLI

SEQ ID NO: 2064565 - protein, 23 aa, Staphylococcus
EKVKQFDRFIFKLEINKNNKTRM

SEQ ID NO: 2064566 - protein, 29 aa, Staphylococcus
EKVKVALCQLILSPFNLLILDEPTNSLDI

SEQ ID NO: 2064567 - protein, 22 aa, Staphylococcus
EKVMIRLHDLGFGPKLASSIYQ

SEQ ID NO: 2064568 - protein, 29 aa, Staphylococcus
EKVQIAGPGFINFYLDNAYLTEVISEAID

SEQ ID NO: 2064569 - protein, 20 aa, Staphylococcus
EKVQLIGFGNFEVRERAARK

SEQ ID NO: 2064570 - protein, 22 aa, Staphylococcus
EKVQLIGFGNFEVRERAARKGR

SEQ ID NO: 2064571 - protein, 24 aa, Staphylococcus
EKVRENIFLPLLEKNHVSLTFKNE

SEQ ID NO: 2064572 - protein, 24 aa, Staphylococcus
EKVSAPFPRISYDDAIKFLKEEGF

SEQ ID NO: 2064573 - protein, 21 aa, Staphylococcus
EKVTLLFTGPLTDLAKAIKYD

SEQ ID NO: 2064574 - protein, 22 aa, Staphylococcus
EKVYTNLKPWDRVQLARLQERP

SEQ ID NO: 2064575 - protein, 17 aa, Staphylococcus
EKWNIIRPPFNVTRISE

SEQ ID NO: 2064576 - protein, 22 aa, Staphylococcus
EKYDLFVLVVTDIINSDSKILV

SEQ ID NO: 2064577 - protein, 23 aa, Staphylococcus
EKYDSYFIGDWYVSGDSAYKDED

SEQ ID NO: 2064578 - protein, 23 aa, Staphylococcus
EKYDSYFIGDWYVSGDSAYQDED

SEQ ID NO: 2064579 - protein, 26 aa, Staphylococcus
EKYEWLRMHFPFLDPQNFVFCGRKNI

SEQ ID NO: 2064580 - protein, 25 aa, Staphylococcus
EKYGAFVELFPGKDALLHISQISKD

SEQ ID NO: 2064581 - protein, 25 aa, Staphylococcus
EKYGAFVELFPGKDALLHISQISKE

SEQ ID NO: 2064582 - protein, 25 aa, Staphylococcus
EKYGAFVELFPGKDALLHISQISTE

SEQ ID NO: 2064583 - protein, 23 aa, Staphylococcus
EKYGAFVELFPGKDALVHISQIA

SEQ ID NO: 2064584 - protein, 24 aa, Staphylococcus
EKYGLFLDMVLGKTVSTLTAFSEL

SEQ ID NO: 2064585 - protein, 25 aa, Staphylococcus
EKYGTFVELFPGKDALLHISQIANQ

SEQ ID NO: 2064586 - protein, 21 aa, Staphylococcus
EKYIRLYLQLSYALFQFKDEF

SEQ ID NO: 2064587 - protein, 22 aa, Staphylococcus
EKYLQDAHEFCPYSKATRGNID

SEQ ID NO: 2064588 - protein, 23 aa, Staphylococcus
EKYLQDAHEFCPYSKATRGNIEV

SEQ ID NO: 2064589 - protein, 28 aa, Staphylococcus
EKYTGPDFPMLFKAFKDMGMVSNEVNIQ

SEQ ID NO: 2064590 - protein, 20 aa, Staphylococcus
EKYVDYWKAYDFNSGYFMAL

SEQ ID NO: 2064591 - protein, 17 aa, Staphylococcus
EKYYFPGGKIDEGETQL

SEQ ID NO: 2064592 - protein, 33 aa, Staphylococcus
ELADDYQILIVLPLWHFNDRYPFETLLHRIKTI

SEQ ID NO: 2064593 - protein, 28 aa, Staphylococcus
ELADDYQVLLILPLWHEQDKYPFDELIE

SEQ ID NO: 2064594 - protein, 25 aa, Staphylococcus
ELADYRLRIFTPNNELPFAGHPTVG

SEQ ID NO: 2064595 - protein, 24 aa, Staphylococcus
ELAEQLVTFIPHSLLTLDNVKYNE

SEQ ID NO: 2064596 - protein, 21 aa, Staphylococcus
ELAFPIMIGDHVWIGAGAIVL

SEQ ID NO: 2064597 - protein, 18 aa, Staphylococcus
ELAGLQNIFKTAASKRIA

SEQ ID NO: 2064598 - protein, 21 aa, Staphylococcus
ELAHQYLWRFARDMPRTGHIE

SEQ ID NO: 2064599 - protein, 18 aa, Staphylococcus
ELAKNYDIPLYLGRTLSN

SEQ ID NO: 2064600 - protein, 20 aa, Staphylococcus
ELALALYVRKDHYGNETRLK

SEQ ID NO: 2064601 - protein, 19 aa, Staphylococcus
ELALPITIGNNIWIGGNVV

SEQ ID NO: 2064602 - protein, 25 aa, Staphylococcus
ELANNYNIPLYLGRTLSNVKGTWIM

SEQ ID NO: 2064603 - protein, 24 aa, Staphylococcus
ELAPSYVFLASYADSSYITGQVIH

SEQ ID NO: 2064604 - protein, 22 aa, Staphylococcus
ELARKIRYRTRIVTLEGDIVNP

SEQ ID NO: 2064605 - protein, 21 aa, Staphylococcus
ELASYLKGYVGRETPLTYAKS

SEQ ID NO: 2064606 - protein, 18 aa, Staphylococcus
ELCGVRISIFSVGPDREQ

SEQ ID NO: 2064607 - protein, 19 aa, Staphylococcus
ELCRFIEINKLHKPRKVII

SEQ ID NO: 2064608 - protein, 19 aa, Staphylococcus
ELCYIIWQELEVDMVKGIE

SEQ ID NO: 2064609 - protein, 20 aa, Staphylococcus
ELDAALWGARAAYIGGFDST

SEQ ID NO: 2064610 - protein, 24 aa, Staphylococcus
ELDAYYIAYQMAPLARILEPQKYI

SEQ ID NO: 2064611 - protein, 24 aa, Staphylococcus
ELDGQGVILFCPQGIEADGNKYRN

SEQ ID NO: 2064612 - protein, 17 aa, Staphylococcus
ELDILTERVGQIAKGAA

SEQ ID NO: 2064613 - protein, 17 aa, Staphylococcus
ELDKILEFAEMVRKSRD

SEQ ID NO: 2064614 - protein, 17 aa, Staphylococcus
ELDLFYEDGDVTPFAMS

SEQ ID NO: 2064615 - protein, 23 aa, Staphylococcus
ELDLVQRYLIRPIHYDTTDDLHD

SEQ ID NO: 2064616 - protein, 19 aa, Staphylococcus
ELDSLWQLRNLFTDSTDFT

SEQ ID NO: 2064617 - protein, 21 aa, Staphylococcus
ELDSLWQLRNMFRDTTDFTER

SEQ ID NO: 2064618 - protein, 19 aa, Staphylococcus
ELDTFLYTEPTKLKNPPAN

SEQ ID NO: 2064619 - protein, 19 aa, Staphylococcus
ELDTLWQLRNLFTDSMDFT

SEQ ID NO: 2064620 - protein, 17 aa, Staphylococcus
ELDWKYYQDKDFMTRLG

SEQ ID NO: 2064621 - protein, 23 aa, Staphylococcus
ELECPSIISQVKFYHVPEGIDIE

SEQ ID NO: 2064622 - protein, 22 aa, Staphylococcus
ELEEGPNKTLFKKLIKKMGSRN

SEQ ID NO: 2064623 - protein, 24 aa, Staphylococcus
ELEEILPHYFIRISKSEILNIRNI

SEQ ID NO: 2064624 - protein, 25 aa, Staphylococcus
ELEIPKPYIVFVTLLNTKGKQSLGD

SEQ ID NO: 2064625 - protein, 21 aa, Staphylococcus
ELEISPASSWFKKLIKRMESR

SEQ ID NO: 2064626 - protein, 18 aa, Staphylococcus
ELEKALFQLEKHSYRLDG

SEQ ID NO: 2064627 - protein, 27 aa, Staphylococcus
ELEKEKDFLQVIVKDEDSQLPTDQNVA

SEQ ID NO: 2064628 - protein, 21 aa, Staphylococcus
ELEKLFKQFNTDAFYGIAEHA

SEQ ID NO: 2064629 - protein, 20 aa, Staphylococcus
ELEKLILFLGDRSTINKQDV

SEQ ID NO: 2064630 - protein, 23 aa, Staphylococcus
ELELSFGLKFLRIIDKVMAMESE

SEQ ID NO: 2064631 - protein, 17 aa, Staphylococcus
ELENHFFGRVGLFRNQV

SEQ ID NO: 2064632 - protein, 21 aa, Staphylococcus
ELENHFFGRVGLFRNQVGDEL

SEQ ID NO: 2064633 - protein, 27 aa, Staphylococcus
ELEQEKDFLQVLVKEDNSKLPTNQNIP

SEQ ID NO: 2064634 - protein, 20 aa, Staphylococcus
ELEQHWAVMKHSPGMPPGAN

SEQ ID NO: 2064635 - protein, 26 aa, Staphylococcus
ELEREGFHILAIKDMAGLLKPKAANE

SEQ ID NO: 2064636 - protein, 26 aa, Staphylococcus
ELEREGFHILAIKDMAGLLKPKAAYE

SEQ ID NO: 2064637 - protein, 26 aa, Staphylococcus
ELEREGFHILAIKDMAGLLKPRAAYE

SEQ ID NO: 2064638 - protein, 20 aa, Staphylococcus
ELETQLFGELPLEQPTWNPK

SEQ ID NO: 2064639 - protein, 25 aa, Staphylococcus
ELEVAKYLQKWFDKYGIESELDEVS

SEQ ID NO: 2064640 - protein, 17 aa, Staphylococcus
ELFAGKDALLHISQISK

SEQ ID NO: 2064641 - protein, 17 aa, Staphylococcus
ELFARIRAVLRRQPHKD

SEQ ID NO: 2064642 - protein, 20 aa, Staphylococcus
ELFDAVLMTIKYIMREADIA

SEQ ID NO: 2064643 - protein, 23 aa, Staphylococcus
ELFEAMVMTPYFPKPDVLIYLDC

SEQ ID NO: 2064644 - protein, 18 aa, Staphylococcus
ELFELDCDILIPAAIENQ

SEQ ID NO: 2064645 - protein, 18 aa, Staphylococcus
ELFEQFKALWNIRDDRYS

SEQ ID NO: 2064646 - protein, 18 aa, Staphylococcus
ELFHYLFNEYYNIDLSYL

SEQ ID NO: 2064647 - protein, 25 aa, Staphylococcus
ELFKQFRHMLEPLIAHHKLAMVLVQ

SEQ ID NO: 2064648 - protein, 24 aa, Staphylococcus
ELFNAMVMTPYFPKPDVLIYLECD

SEQ ID NO: 2064649 - protein, 18 aa, Staphylococcus
ELFSHMYREMAKEGIFLP

SEQ ID NO: 2064650 - protein, 17 aa, Staphylococcus
ELFTSMGVTHIISGGQT

SEQ ID NO: 2064651 - protein, 18 aa, Staphylococcus
ELFVTTKVWIENVNYEDT

SEQ ID NO: 2064652 - protein, 25 aa, Staphylococcus
ELGAPYEVLKQIKDHGRLPVVNFAA

SEQ ID NO: 2064653 - protein, 28 aa, Staphylococcus
ELGDDYVILLRMHYLISNALDLTGYENF

SEQ ID NO: 2064654 - protein, 24 aa, Staphylococcus
ELGFEGHTWLFFGEQHFTTDFLYQ

SEQ ID NO: 2064655 - protein, 19 aa, Staphylococcus
ELGFFGEYGGRYVPETLMP

SEQ ID NO: 2064656 - protein, 18 aa, Staphylococcus
ELGFKGNTWLFFGDQHFT

SEQ ID NO: 2064657 - protein, 18 aa, Staphylococcus
ELGFKGNTWLFFGEQHFT

SEQ ID NO: 2064658 - protein, 17 aa, Staphylococcus
ELGFRYYVNQLLEQTSH

SEQ ID NO: 2064659 - protein, 25 aa, Staphylococcus
ELGITILINLHFVDLAREYGTRIIG

SEQ ID NO: 2064660 - protein, 17 aa, Staphylococcus
ELGIVWKQGKRLSYAAN

SEQ ID NO: 2064661 - protein, 25 aa, Staphylococcus
ELGKEYLIAIIIQTFEYWAQYKDKV

SEQ ID NO: 2064662 - protein, 28 aa, Staphylococcus
ELGLQGNRLFYLAMAPQFFGVISDFLKS

SEQ ID NO: 2064663 - protein, 26 aa, Staphylococcus
ELGTWTYLGEMLVSIPFPPDDPLIDS

SEQ ID NO: 2064664 - protein, 19 aa, Staphylococcus
ELGYLLTLSNQGIDVRHAD

SEQ ID NO: 2064665 - protein, 20 aa, Staphylococcus
ELHDKLWDNARYLKDGLAKL

SEQ ID NO: 2064666 - protein, 20 aa, Staphylococcus
ELHPSVIISFYPQFAVHPDH

SEQ ID NO: 2064667 - protein, 17 aa, Staphylococcus
ELHQKYLDTFREGFKQQ

SEQ ID NO: 2064668 - protein, 21 aa, Staphylococcus
ELIASFSRALASDLRAGQSKE

SEQ ID NO: 2064669 - protein, 22 aa, Staphylococcus
ELIASFSRALASDLRYSQSKEE

SEQ ID NO: 2064670 - protein, 17 aa, Staphylococcus
ELIATAPSVIYECILKD

SEQ ID NO: 2064671 - protein, 17 aa, Staphylococcus
ELIATAPSVIYQCILKD

SEQ ID NO: 2064672 - protein, 17 aa, Staphylococcus
ELIATAPSVIYQCIMKD

SEQ ID NO: 2064673 - protein, 17 aa, Staphylococcus
ELIATAPSVIYQCLMKD

SEQ ID NO: 2064674 - protein, 17 aa, Staphylococcus
ELICDRAVFLRDGTFVQ

SEQ ID NO: 2064675 - protein, 17 aa, Staphylococcus
ELIERFPNNIVGRTILP

SEQ ID NO: 2064676 - protein, 18 aa, Staphylococcus
ELIFRIKAVLRRYQINAE

SEQ ID NO: 2064677 - protein, 19 aa, Staphylococcus
ELIFRIKAVLRRYQINAEN

SEQ ID NO: 2064678 - protein, 17 aa, Staphylococcus
ELIGAIPVLIKKNGNID

SEQ ID NO: 2064679 - protein, 21 aa, Staphylococcus
ELIGDFYKPIKKSKYWLFNTL

SEQ ID NO: 2064680 - protein, 28 aa, Staphylococcus
ELIGDFYKPINKVKYWLFNTLNTIRKNV

SEQ ID NO: 2064681 - protein, 29 aa, Staphylococcus
ELIGDFYKPINKVKYWLFTTLDRIRRKVK

SEQ ID NO: 2064682 - protein, 21 aa, Staphylococcus
ELIKGFYDISLPSGKSPHGKK

SEQ ID NO: 2064683 - protein, 18 aa, Staphylococcus
ELIKKYWPKRLGQAPEHM

SEQ ID NO: 2064684 - protein, 17 aa, Staphylococcus
ELIKPVLSIVDYVLVMT

SEQ ID NO: 2064685 - protein, 17 aa, Staphylococcus
ELIPYMKHVRVMVVFGE

SEQ ID NO: 2064686 - protein, 21 aa, Staphylococcus
ELIQFTEWYNNYFVTKRISML

SEQ ID NO: 2064687 - protein, 21 aa, Staphylococcus
ELIQIYQARIRVFVVEQKCIY

SEQ ID NO: 2064688 - protein, 19 aa, Staphylococcus
ELIQYFYDIVNNGPATIIR

SEQ ID NO: 2064689 - protein, 19 aa, Staphylococcus
ELIRPASKITLWDIYKAVE

SEQ ID NO: 2064690 - protein, 21 aa, Staphylococcus
ELIRRLKRGIFAKQKVVVFKP

SEQ ID NO: 2064691 - protein, 20 aa, Staphylococcus
ELIRRLRRGIYAKQKVIVFK

SEQ ID NO: 2064692 - protein, 27 aa, Staphylococcus
ELKDKTYIGLLDRLHPTPALGGYPKEK

SEQ ID NO: 2064693 - protein, 25 aa, Staphylococcus
ELKDLPFISGFIGSCSFDLVRHEFP

SEQ ID NO: 2064694 - protein, 17 aa, Staphylococcus
ELKDPDVPIRLIGVTVG

SEQ ID NO: 2064695 - protein, 25 aa, Staphylococcus
ELKDTKYVLMTYYNIILHYGEEQFI

SEQ ID NO: 2064696 - protein, 17 aa, Staphylococcus
ELKEIVTMMVKKLTDRL

SEQ ID NO: 2064697 - protein, 17 aa, Staphylococcus
ELKEIYRLILKIQNKQF

SEQ ID NO: 2064698 - protein, 25 aa, Staphylococcus
ELKEKLFEYMTLNPRVYSHFKEYAT

SEQ ID NO: 2064699 - protein, 19 aa, Staphylococcus
ELKFPVFVKPNSGSASLNI

SEQ ID NO: 2064700 - protein, 18 aa, Staphylococcus
ELKHFIPREHIEGRDIQD

SEQ ID NO: 2064701 - protein, 25 aa, Staphylococcus
ELKIPTPNNTLLKHLVHQLELKFAQ

SEQ ID NO: 2064702 - protein, 23 aa, Staphylococcus
ELKKILIQLINQGFPKDKMIIHS

SEQ ID NO: 2064703 - protein, 21 aa, Staphylococcus
ELKPTPKWSISRYKGLGEMDA

SEQ ID NO: 2064704 - protein, 22 aa, Staphylococcus
ELKQLNNWCVWKFEKRNGKRTK

SEQ ID NO: 2064705 - protein, 26 aa, Staphylococcus
ELKQSKFVFDHKLMSWIEQRGLDIHR

SEQ ID NO: 2064706 - protein, 27 aa, Staphylococcus
ELKSDQLIILTAVDYIYINFGKDNQEQ

SEQ ID NO: 2064707 - protein, 17 aa, Staphylococcus
ELKSRIATQYPYKAWLA

SEQ ID NO: 2064708 - protein, 30 aa, Staphylococcus; identical to SEQ ID NO: 1821449

SEQ ID NO: 2064709 - protein, 31 aa, Staphylococcus
ELKSRLPEYMIPRKFVWMDHLPLTSNGKLDR

SEQ ID NO: 2064710 - protein, 30 aa, Staphylococcus
ELKSRLPEYMIPRKFVWMEQLPLTSNGKLD

SEQ ID NO: 2064711 - protein, 17 aa, Staphylococcus
ELKSYDFGLWKDSTFEG

SEQ ID NO: 2064712 - protein, 22 aa, Staphylococcus
ELKTDSKMFSPAPAHFGAKPNS

SEQ ID NO: 2064713 - protein, 23 aa, Staphylococcus
ELKVLFNVFTDRDLELYKEAFND

SEQ ID NO: 2064714 - protein, 17 aa, Staphylococcus
ELKVNLLDFRKTMDYLE

SEQ ID NO: 2064715 - protein, 18 aa, Staphylococcus
ELLAFNSGQRYNMVPDHA

SEQ ID NO: 2064716 - protein, 18 aa, Staphylococcus
ELLAILINTGRKGHSSIE

SEQ ID NO: 2064717 - protein, 18 aa, Staphylococcus
ELLAILINTGRKGYSSLD

SEQ ID NO: 2064718 - protein, 23 aa, Staphylococcus
ELLARIRAILRRQPKKDTINING

SEQ ID NO: 2064719 - protein, 17 aa, Staphylococcus
ELLCQYYYEKFGVDTRS

SEQ ID NO: 2064720 - protein, 18 aa, Staphylococcus
ELLEKYYVIYKGHIEGDD

SEQ ID NO: 2064721 - protein, 18 aa, Staphylococcus
ELLELISHKYDFQYQIEH

SEQ ID NO: 2064722 - protein, 20 aa, Staphylococcus
ELLFEFVTPKESYQAKEELP

SEQ ID NO: 2064723 - protein, 21 aa, Staphylococcus
ELLFRIKAVLRRYQINAESEL

SEQ ID NO: 2064724 - protein, 21 aa, Staphylococcus
ELLKKIKQPKTLYGDYVVPFG

SEQ ID NO: 2064725 - protein, 17 aa, Staphylococcus
ELLKSTIPIINLYEWLS

SEQ ID NO: 2064726 - protein, 23 aa, Staphylococcus
ELLMMRRNIGMIFQHFNLVKRST

SEQ ID NO: 2064727 - protein, 28 aa, Staphylococcus
ELLNVPNEPIIPFIIGDGIGPDIWKAAS

SEQ ID NO: 2064728 - protein, 19 aa, Staphylococcus
ELLSFAIKQVDKAAQSNLI

SEQ ID NO: 2064729 - protein, 33 aa, Staphylococcus
ELLTDFAHIPGKEQWFFPPRPHTHHVKWLDNNH

SEQ ID NO: 2064730 - protein, 24 aa, Staphylococcus
ELLTNQFVLIATGSRPTELPFLPF

SEQ ID NO: 2064731 - protein, 18 aa, Staphylococcus
ELLVRKKMKLKKNNIYIC

SEQ ID NO: 2064732 - protein, 24 aa, Staphylococcus
ELMDGYLKAYPKYIRQSEKHRRAL

SEQ ID NO: 2064733 - protein, 23 aa, Staphylococcus
ELMGYTPWGIIDIVSFTTGEMKK

SEQ ID NO: 2064734 - protein, 22 aa, Staphylococcus
ELMQDYYHYALKKTVEGEAALN

SEQ ID NO: 2064735 - protein, 24 aa, Staphylococcus
ELNDYLTEYVGRATPLTFAQSYTQ

SEQ ID NO: 2064736 - protein, 19 aa, Staphylococcus
ELNHRLRNIGGHIGYGVAR

SEQ ID NO: 2064737 - protein, 19 aa, Staphylococcus
ELNIAFTPNLPKSLKESVE

SEQ ID NO: 2064738 - protein, 25 aa, Staphylococcus
ELNKNYFDDISLYILAAQQKKEAIQ

SEQ ID NO: 2064739 - protein, 21 aa, Staphylococcus
ELNKQILILNKLKKIHDLSKN

SEQ ID NO: 2064740 - protein, 21 aa, Staphylococcus
ELNNLLENYLITSIYSGGDDL

SEQ ID NO: 2064741 - protein, 21 aa, Staphylococcus
ELNPTPKWSIARYKGLGEMNA

SEQ ID NO: 2064742 - protein, 20 aa, Staphylococcus
ELNQLLLYKEEKHTGYVGFT

SEQ ID NO: 2064743 - protein, 25 aa, Staphylococcus
ELPDSKLPMQVSIAILEGLNQRVVE

SEQ ID NO: 2064744 - protein, 28 aa, Staphylococcus
ELPELEEQLKFLLIPKDPNDEKDVIVEI

SEQ ID NO: 2064745 - protein, 25 aa, Staphylococcus
ELPFDKRFRFKSFILQRSEGNVMIY

SEQ ID NO: 2064746 - protein, 18 aa, Staphylococcus
ELPHNYFLQHAADYTSIL

SEQ ID NO: 2064747 - protein, 17 aa, Staphylococcus
ELPIIALLCTQATGTSI

SEQ ID NO: 2064748 - protein, 27 aa, Staphylococcus
ELPISAGFFIINPFEVVYYAGGTANKY

SEQ ID NO: 2064749 - protein, 18 aa, Staphylococcus
ELPLIIRNDYLSHGGMKK

SEQ ID NO: 2064750 - protein, 34 aa, Staphylococcus
ELPNLIEIQTKSYDWFLEEGLLEMFRDISPIEDF

SEQ ID NO: 2064751 - protein, 18 aa, Staphylococcus
ELPNYISCHYSNIDEIIL

SEQ ID NO: 2064752 - protein, 19 aa, Staphylococcus
ELPYMQLVVITERELFKTK

SEQ ID NO: 2064753 - protein, 17 aa, Staphylococcus
ELPYMQLVVVTERELFK

SEQ ID NO: 2064754 - protein, 20 aa, Staphylococcus
ELPYQQWLETFKIDDRFDRI

SEQ ID NO: 2064755 - protein, 17 aa, Staphylococcus
ELQAFFLQNGVTSGIIN

SEQ ID NO: 2064756 - protein, 23 aa, Staphylococcus
ELQDMLGYFIKYVGSSSYDAPAV

SEQ ID NO: 2064757 - protein, 18 aa, Staphylococcus
ELQESIDHQLGHLAEMVV

SEQ ID NO: 2064758 - protein, 20 aa, Staphylococcus
ELQGRFPIRVELDSLSVDDF

SEQ ID NO: 2064759 - protein, 19 aa, Staphylococcus
ELQGRFPIRVELDSLSVED

SEQ ID NO: 2064760 - protein, 18 aa, Staphylococcus
ELQGRFPIRVELESLSVD

SEQ ID NO: 2064761 - protein, 19 aa, Staphylococcus
ELQGRFPIRVELESLSVED

SEQ ID NO: 2064762 - protein, 27 aa, Staphylococcus
ELQNGLRLFVIPKPGFQKTFVTYTTQF

SEQ ID NO: 2064763 - protein, 19 aa, Staphylococcus
ELQPKTGAGFIVALTGAIM

SEQ ID NO: 2064764 - protein, 17 aa, Staphylococcus
ELQSRLGITFIFVTHDQ

SEQ ID NO: 2064765 - protein, 19 aa, Staphylococcus
ELQSRLGITFIFVTHDQEE

SEQ ID NO: 2064766 - protein, 32 aa, Staphylococcus
ELQTFLYRFESSLPWWLYMGTQALIHDIVMAG

SEQ ID NO: 2064767 - protein, 25 aa, Staphylococcus
ELQTKTVIIELLYIPTFSSSRTRQT

SEQ ID NO: 2064768 - protein, 18 aa, Staphylococcus
ELQTVPNGFYYPKDSEAK

SEQ ID NO: 2064769 - protein, 21 aa, Staphylococcus
ELRAFLSKRLARYQIPSKLLK

SEQ ID NO: 2064770 - protein, 17 aa, Staphylococcus
ELRGQKNNVANFRIAVQ

SEQ ID NO: 2064771 - protein, 26 aa, Staphylococcus
ELRKKGVVGKFIEFFGPGVADLPLAD

SEQ ID NO: 2064772 - protein, 22 aa, Staphylococcus
ELRKRIKLVAEQNYEQIRALEA

SEQ ID NO: 2064773 - protein, 18 aa, Staphylococcus
ELRLLARSVFVLDKNNKV

SEQ ID NO: 2064774 - protein, 26 aa, Staphylococcus
ELRLNDIGFIFQASHLVPYLTVEEQL

SEQ ID NO: 2064775 - protein, 27 aa, Staphylococcus
ELRNSEGITWTFLSPAAEFDPEGVRTG

SEQ ID NO: 2064776 - protein, 20 aa, Staphylococcus
ELRPLIFRKIGYITSNQFDI

SEQ ID NO: 2064777 - protein, 35 aa, Staphylococcus
ELRQKMGMVFQNFNLFPHKKVIDNIMLAPKMLLKG

SEQ ID NO: 2064778 - protein, 45 aa, Staphylococcus
ELRQKMGMVFQNFNLFPHKTVLENVILAPKLLKNVDLKKLEIEGK

SEQ ID NO: 2064779 - protein, 23 aa, Staphylococcus
ELRQNMGMVFQSFNLFPHKTVLE

SEQ ID NO: 2064780 - protein, 25 aa, Staphylococcus
ELRQRYKLELLDYTIKTLHLPKDKQ

SEQ ID NO: 2064781 - protein, 43 aa, Staphylococcus
ELSAVQKSMYLLWSVNPEDTVYNIPFLWRLSSELNVEQLKRAL

SEQ ID NO: 2064782 - protein, 22 aa, Staphylococcus
ELSEYLLYLDKHREAMETYVER

SEQ ID NO: 2064783 - protein, 24 aa, Staphylococcus
ELSHNMPVFFSANMSYGVHALTKI

SEQ ID NO: 2064784 - protein, 22 aa, Staphylococcus
ELSIFTVPVDLIYFNGKEMHRQ

SEQ ID NO: 2064785 - protein, 35 aa, Staphylococcus
ELSIKNNWFDDNGDIFFIFTNEKLKAILNCHDGKL

SEQ ID NO: 2064786 - protein, 18 aa, Staphylococcus
ELSKGYFFQPTIIAVENN

SEQ ID NO: 2064787 - protein, 23 aa, Staphylococcus
ELSKKYDLPVWNKPALCSLASRI

SEQ ID NO: 2064788 - protein, 23 aa, Staphylococcus
ELSKVFHYFKEAHPYFDQNVVVI

SEQ ID NO: 2064789 - protein, 18 aa, Staphylococcus
ELSLLNLLGSGISNITIV

SEQ ID NO: 2064790 - protein, 20 aa, Staphylococcus
ELSLRPHFLKQYIGQASIKS

SEQ ID NO: 2064791 - protein, 17 aa, Staphylococcus
ELSPKLIPNHLFKEIIS

SEQ ID NO: 2064792 - protein, 24 aa, Staphylococcus
ELSQAHLEILNRLYAPLIGTHAIG

SEQ ID NO: 2064793 - protein, 23 aa, Staphylococcus
ELSQKMPVFFSANMSYGIHVLTK

SEQ ID NO: 2064794 - protein, 25 aa, Staphylococcus
ELSRIMLALKTIFVKARGQTAILFD

SEQ ID NO: 2064795 - protein, 24 aa, Staphylococcus
ELSRLYVYAHHKGLKSLYYTRNKL

SEQ ID NO: 2064796 - protein, 29 aa, Staphylococcus
ELSVKAKTFTLLSKALRPLPDKFHGLQDI

SEQ ID NO: 2064797 - protein, 31 aa, Staphylococcus
ELSWHLGLIWRRDAYLNFVTREWIQFIRDLR

SEQ ID NO: 2064798 - protein, 33 aa, Staphylococcus
ELTAIGLDLPFSMKINQRLGFDSSLVTYEGLVK

SEQ ID NO: 2064799 - protein, 18 aa, Staphylococcus
ELTCLNPVQLRRVVANLS

SEQ ID NO: 2064800 - protein, 36 aa, Staphylococcus
ELTDGMELTWMRQPHYYMGLYSYTYSAGLTIGTVVS

SEQ ID NO: 2064801 - protein, 18 aa, Staphylococcus
ELTDIVKPGGLLYFHVHE

SEQ ID NO: 2064802 - protein, 26 aa, Staphylococcus
ELTDLPYAVNLFVPSDKLYIPEKVEH

SEQ ID NO: 2064803 - protein, 18 aa, Staphylococcus
ELTHHIYKIVYNGPLRIM

SEQ ID NO: 2064804 - protein, 23 aa, Staphylococcus
ELTHYLKSILQPDDKVLIKGSRG

SEQ ID NO: 2064805 - protein, 27 aa, Staphylococcus
ELTINIDKVIQWLNQIEFESLSLTGGQ

SEQ ID NO: 2064806 - protein, 26 aa, Staphylococcus
ELTPELAFKLGRYGGYVLAHNKGEKH

SEQ ID NO: 2064807 - protein, 26 aa, Staphylococcus
ELTPELAFKLGRYGGYVLAHNKGEKN

SEQ ID NO: 2064808 - protein, 32 aa, Staphylococcus
ELTRLLDDISEFDLVLVYKLDRLTRSVRDLLD

SEQ ID NO: 2064809 - protein, 28 aa, Staphylococcus
ELTVPEPIYPLWHRAMNSSARASDAEQE

SEQ ID NO: 2064810 - protein, 20 aa, Staphylococcus
ELVDVANAVLFLASDEARFI

SEQ ID NO: 2064811 - protein, 18 aa, Staphylococcus
ELVERFMTKLRSHKTYRD

SEQ ID NO: 2064812 - protein, 18 aa, Staphylococcus
ELVLIRKAGDRKDANKVM

SEQ ID NO: 2064813 - protein, 20 aa, Staphylococcus
ELVLLRILGQKVDAEKVMLV

SEQ ID NO: 2064814 - protein, 23 aa, Staphylococcus
ELVQVIGSMIVLYKESQENKDIV

SEQ ID NO: 2064815 - protein, 22 aa, Staphylococcus
ELVSVLKRFKAMLLQKNETVEA

SEQ ID NO: 2064816 - protein, 53 aa, Staphylococcus
ELVYGTIKRKFTLDYYLRPFVQTKIKGWVRQLLWMSIYQYVYLDKVPNHAIIN

SEQ ID NO: 2064817 - protein, 28 aa, Staphylococcus
ELWKKAATFLLPKDYLRYCLTGEIYTEY

SEQ ID NO: 2064818 - protein, 26 aa, Staphylococcus
ELWRHTLIEVGIGRPGFLRFQAQIMP

SEQ ID NO: 2064819 - protein, 19 aa, Staphylococcus
ELYDLRLMLESFAFSRLRS

SEQ ID NO: 2064820 - protein, 21 aa, Staphylococcus
ELYINQLYDKPSRLYDALLSC

SEQ ID NO: 2064821 - protein, 17 aa, Staphylococcus
ELYLRFLDGEKLTKSTI

SEQ ID NO: 2064822 - protein, 17 aa, Staphylococcus
ELYLRLKKYVQNKRLII

SEQ ID NO: 2064823 - protein, 19 aa, Staphylococcus
ELYLSVLGMPGQTAYHGLI

SEQ ID NO: 2064824 - protein, 21 aa, Staphylococcus
ELYNFFDVETIIRVGSCGALQ

SEQ ID NO: 2064825 - protein, 17 aa, Staphylococcus
ELYNIKITTPYDLKVAN

SEQ ID NO: 2064826 - protein, 18 aa, Staphylococcus
ELYTINRFKVKALQKNNG

SEQ ID NO: 2064827 - protein, 18 aa, Staphylococcus
ELYYLPKPLIKIESNSEG

SEQ ID NO: 2064828 - protein, 26 aa, Staphylococcus
EMAGIPQEKIWLDPGIGFAKTRDEEN

SEQ ID NO: 2064829 - protein, 26 aa, Staphylococcus
EMAGIPQHKVWLDPGIGFAKTREEEK

SEQ ID NO: 2064830 - protein, 22 aa, Staphylococcus
EMALELFKPFIMKELVQREIAT

SEQ ID NO: 2064831 - protein, 18 aa, Staphylococcus
EMASYLLELYDSDKTIGL

SEQ ID NO: 2064832 - protein, 19 aa, Staphylococcus
EMATTLESILDFAKQNDSA

SEQ ID NO: 2064833 - protein, 26 aa, Staphylococcus
EMCNRLKKVFGIYSISPVLKIEKTVE

SEQ ID NO: 2064834 - protein, 17 aa, Staphylococcus
EMDYIRQIEDVNGRRMN

SEQ ID NO: 2064835 - protein, 25 aa, Staphylococcus
EMEDEFLLKLIRRNISKFKTSSNPS

SEQ ID NO: 2064836 - protein, 27 aa, Staphylococcus
EMEDRIYRSLGLLRYSRLMSVEEAAMR

SEQ ID NO: 2064837 - protein, 20 aa, Staphylococcus
EMEFLLNLSEDLKRAKYAGI

SEQ ID NO: 2064838 - protein, 19 aa, Staphylococcus
EMEFLLNLSEDLKRAKYSG

SEQ ID NO: 2064839 - protein, 22 aa, Staphylococcus
EMELELMDIPMAISPLHDKDKS

SEQ ID NO: 2064840 - protein, 18 aa, Staphylococcus
EMERAWLDMTLDDDIRAY

SEQ ID NO: 2064841 - protein, 24 aa, Staphylococcus
EMERRYKLFAQYHVRNITAFNKKA

SEQ ID NO: 2064842 - protein, 18 aa, Staphylococcus
EMFDRSWYGRVLVERVEG

SEQ ID NO: 2064843 - protein, 19 aa, Staphylococcus
EMFDRSWYGRVLVERVEGF

SEQ ID NO: 2064844 - protein, 17 aa, Staphylococcus
EMFLQTHYPSHQLFAEE

SEQ ID NO: 2064845 - protein, 23 aa, Staphylococcus
EMGAMALFGEKYGDIVRVVNMAP

SEQ ID NO: 2064846 - protein, 28 aa, Staphylococcus
EMGDRYIRTIFSFLGVPKYKLIAVEGHN

SEQ ID NO: 2064847 - protein, 19 aa, Staphylococcus
EMGKPILYSLNYIKSSLVK

SEQ ID NO: 2064848 - protein, 22 aa, Staphylococcus
EMGKPILYSLNYVKSSLVKFKL

SEQ ID NO: 2064849 - protein, 24 aa, Staphylococcus
EMGLPYEEAIGEAAFYGPKLDVQV

SEQ ID NO: 2064850 - protein, 26 aa, Staphylococcus
EMGNMYKLLIGTVTPRPIAFVTSQDE

SEQ ID NO: 2064851 - protein, 25 aa, Staphylococcus
EMGYTQKSPRWAIAYKFPAEEVVSK

SEQ ID NO: 2064852 - protein, 25 aa, Staphylococcus
EMGYTQKSPRWAIAYKFPAEEVVTR

SEQ ID NO: 2064853 - protein, 24 aa, Staphylococcus
EMHEFLIHLTGVLETGYFLDMTDQ

SEQ ID NO: 2064854 - protein, 18 aa, Staphylococcus
EMIEARAYRLLRVGSFLL

SEQ ID NO: 2064855 - protein, 34 aa, Staphylococcus
EMIKGILGKIPFFGICLGHQLFALSQGATSFKMK

SEQ ID NO: 2064856 - protein, 29 aa, Staphylococcus
EMIKGILGKIPFFGICLGHQLFALSQGGT

SEQ ID NO: 2064857 - protein, 19 aa, Staphylococcus
EMILTLRKEIGDFPIVAIG

SEQ ID NO: 2064858 - protein, 27 aa, Staphylococcus
EMITKLRAHVNHFPIVAIGGINVENTR

SEQ ID NO: 2064859 - protein, 20 aa, Staphylococcus
EMITLDFGAYYKGYSSDITR

SEQ ID NO: 2064860 - protein, 21 aa, Staphylococcus
EMIVMGFIEPFTKELPMEYAV

SEQ ID NO: 2064861 - protein, 33 aa, Staphylococcus
EMKAYLTRDQHRLYKLIWERFVASQMAPAILDT

SEQ ID NO: 2064862 - protein, 26 aa, Staphylococcus
EMKDNQCLVVLPLSKALSESALEQIR

SEQ ID NO: 2064863 - protein, 33 aa, Staphylococcus
EMKEFLTRDQYRLYKLIWDRFVASQMAPAVLDT

SEQ ID NO: 2064864 - protein, 18 aa, Staphylococcus
EMKFLEDLNFIEKTHTSS

SEQ ID NO: 2064865 - protein, 33 aa, Staphylococcus
EMKNFLTRDQHRLYKLIWERFVASQMAPAILDT

SEQ ID NO: 2064866 - protein, 20 aa, Staphylococcus
EMKYSHTPYYQAFKENQKQL

SEQ ID NO: 2064867 - protein, 21 aa, Staphylococcus
EMLDEFHFLGEDKAYDIVVKN

SEQ ID NO: 2064868 - protein, 17 aa, Staphylococcus
EMLDIDLYVKYEGANPT

SEQ ID NO: 2064869 - protein, 19 aa, Staphylococcus
EMLDVGRYFAKLEVTMYCQ

SEQ ID NO: 2064870 - protein, 24 aa, Staphylococcus
EMLTEREMEILLLIAKGYSNQEIA

SEQ ID NO: 2064871 - protein, 17 aa, Staphylococcus
EMMDFLKIVNYDNGLNI

SEQ ID NO: 2064872 - protein, 22 aa, Staphylococcus
EMMDVIHFFNKIENYYESSVKG

SEQ ID NO: 2064873 - protein, 22 aa, Staphylococcus
EMMKNFKEWIKENSYWRYVETN

SEQ ID NO: 2064874 - protein, 24 aa, Staphylococcus
EMMNMGFIDDMKFIMDKIPAEQRQ

SEQ ID NO: 2064875 - protein, 25 aa, Staphylococcus
EMMQLIQEYLVKYPEIPYVIDPVML

SEQ ID NO: 2064876 - protein, 24 aa, Staphylococcus
EMNLQIQYLDLKPYLLYKIKDCSK

SEQ ID NO: 2064877 - protein, 21 aa, Staphylococcus
EMNLVPLRRFTSTEVDLFFTL

SEQ ID NO: 2064878 - protein, 26 aa, Staphylococcus
EMPPIPLNLFLHARIPLTKDIYATSV

SEQ ID NO: 2064879 - protein, 20 aa, Staphylococcus
EMPVFWGCGVTPQSVALDAK

SEQ ID NO: 2064880 - protein, 27 aa, Staphylococcus
EMPWRETTNPYYIWLSEVMLQQTQVNT

SEQ ID NO: 2064881 - protein, 31 aa, Staphylococcus
EMQFRKLGKYPPYYYLINFTIAHKNMKKVME

SEQ ID NO: 2064882 - protein, 24 aa, Staphylococcus
EMQVKSIMKHYLSPISDAIVEDNL

SEQ ID NO: 2064883 - protein, 19 aa, Staphylococcus
EMQYELRALQSRLGITFIF

SEQ ID NO: 2064884 - protein, 25 aa, Staphylococcus
EMREKIRVYLESRVKTFKVGGLFNK

SEQ ID NO: 2064885 - protein, 32 aa, Staphylococcus
EMRLTEIGFIFQASHLVPYLTVLEQLTIVGRE

SEQ ID NO: 2064886 - protein, 24 aa, Staphylococcus
EMTHKLPTLQFTEPTLIALTGSNF

SEQ ID NO: 2064887 - protein, 24 aa, Staphylococcus
EMTHKMATIRFTEPALIALTGGNF

SEQ ID NO: 2064888 - protein, 24 aa, Staphylococcus
EMTHKMPTIRFTEPTLIALAGGNF

SEQ ID NO: 2064889 - protein, 19 aa, Staphylococcus
EMTLPELIEWAWKNEVSDK

SEQ ID NO: 2064890 - protein, 24 aa, Staphylococcus
EMTNTLLKTKRFSKMFFSCNGIKD

SEQ ID NO: 2064891 - protein, 23 aa, Staphylococcus
EMTNTLLKTKRFSKMFFSCNGVK

SEQ ID NO: 2064892 - protein, 24 aa, Staphylococcus
EMTPFAAIILAEIFDKVGVPKGVF

SEQ ID NO: 2064893 - protein, 24 aa, Staphylococcus
EMVHESLLNALKNNGLEKIETEGQ

SEQ ID NO: 2064894 - protein, 17 aa, Staphylococcus
EMVLRPMNCPHHMMIYN

SEQ ID NO: 2064895 - protein, 20 aa, Staphylococcus
EMVNYWIQFGVDGFRFDVIN

SEQ ID NO: 2064896 - protein, 26 aa, Staphylococcus
EMVYKPTDFLIRRTGMLYFDIEDVKK

SEQ ID NO: 2064897 - protein, 28 aa, Staphylococcus
EMVYRPTDFFIRRTGKLYFKIDDVLNYK

SEQ ID NO: 2064898 - protein, 20 aa, Staphylococcus
EMWDKPLLEKFAEDIKNGAL

SEQ ID NO: 2064899 - protein, 25 aa, Staphylococcus
EMYDNMLWDGFQPFKLTNIENVASD

SEQ ID NO: 2064900 - protein, 20 aa, Staphylococcus
EMYQYLMKTLNQTDFKQYEI

SEQ ID NO: 2064901 - protein, 19 aa, Staphylococcus
EMYQYLMNVLGETSFKQYE

SEQ ID NO: 2064902 - protein, 31 aa, Staphylococcus
ENAAEIDNLIWYLSEIFKSELKLALGPIQRG

SEQ ID NO: 2064903 - protein, 21 aa, Staphylococcus
ENAMVQDLDDLKTLGKEMEQI

SEQ ID NO: 2064904 - protein, 49 aa, Staphylococcus
ENAPVIWRGPMLGKMLTNFFTDVKWGELDYLLLDLPPGTGDVALDVHTM

SEQ ID NO: 2064905 - protein, 17 aa, Staphylococcus
ENAQYLKDGLAKLGFNT

SEQ ID NO: 2064906 - protein, 23 aa, Staphylococcus
ENARYYRSFLKELSRIKSKLTPF

SEQ ID NO: 2064907 - protein, 21 aa, Staphylococcus
ENASCHIALGSAYGFNVEGGT

SEQ ID NO: 2064908 - protein, 20 aa, Staphylococcus
ENASCHLAIGSAYGFNVEGG

SEQ ID NO: 2064909 - protein, 23 aa, Staphylococcus
ENASKFVQYLLSNDTTNLSETKA

SEQ ID NO: 2064910 - protein, 24 aa, Staphylococcus
ENAVLFPGNILKSNAFVKLLNIEG

SEQ ID NO: 2064911 - protein, 24 aa, Staphylococcus
ENCKAQLIDLPLTATAKELGTALM

SEQ ID NO: 2064912 - protein, 23 aa, Staphylococcus
ENCKRIGFYPKTVANISQISFIA

SEQ ID NO: 2064913 - protein, 24 aa, Staphylococcus
ENCQAQLIDLPFTSTAKELGTALM

SEQ ID NO: 2064914 - protein, 18 aa, Staphylococcus
ENCSFLVFFGYNFNSSFL

SEQ ID NO: 2064915 - protein, 24 aa, Staphylococcus
ENDDMEDIFIPPTKINRALDGDTV

SEQ ID NO: 2064916 - protein, 25 aa, Staphylococcus
ENDDQLMWQLIHSKNKYVFTNQTRS

SEQ ID NO: 2064917 - protein, 24 aa, Staphylococcus
ENDEFLLAGFNYEGQLAAALEIST

SEQ ID NO: 2064918 - protein, 25 aa, Staphylococcus
ENDEIFEFYGLKVLVDKYDKPVLDG

SEQ ID NO: 2064919 - protein, 23 aa, Staphylococcus
ENDELFYPLVTMDDMLVADGFIQ

SEQ ID NO: 2064920 - protein, 25 aa, Staphylococcus
ENDEVLEYFGLKVLVDKYDAPVLNG

SEQ ID NO: 2064921 - protein, 26 aa, Staphylococcus
ENDHYFTPHYNEDFLLGCMRQSLIDE

SEQ ID NO: 2064922 - protein, 24 aa, Staphylococcus
ENDIGKLLGLKRKLRPVHNIRKLS

SEQ ID NO: 2064923 - protein, 22 aa, Staphylococcus
ENDKRAFLLKQQYPELIVGMST

SEQ ID NO: 2064924 - protein, 24 aa, Staphylococcus
ENDSGVYILSKRQLETEKSYEYLQ

SEQ ID NO: 2064925 - protein, 24 aa, Staphylococcus
ENDVPDWYLDSCRKIKYMFPKAHA

SEQ ID NO: 2064926 - protein, 25 aa, Staphylococcus
ENDVPDWYLDSCRKIKYMFPKAHAA

SEQ ID NO: 2064927 - protein, 25 aa, Staphylococcus
ENDYCRGVLLWQMNDCWPTISWSGV

SEQ ID NO: 2064928 - protein, 27 aa, Staphylococcus
ENEAQYTLFLYDWRVFESEASITYFGD

SEQ ID NO: 2064929 - protein, 25 aa, Staphylococcus
ENEEAFYRALGRYINTLNGRYYTAE

SEQ ID NO: 2064930 - protein, 24 aa, Staphylococcus
ENEEFEDIFIPPTKINRALDGDTV

SEQ ID NO: 2064931 - protein, 27 aa, Staphylococcus
ENEEKYLRLYAEFENYKRRIQKENETN

SEQ ID NO: 2064932 - protein, 28 aa, Staphylococcus
ENEEKYLRLYAEFENYKRRIQKENQTMK

SEQ ID NO: 2064933 - protein, 28 aa, Staphylococcus
ENEEKYLRLYAEFENYKRRIRNENETNK

SEQ ID NO: 2064934 - protein, 27 aa, Staphylococcus
ENEILQTLRPLLIQYGKEKLPNEHFGD

SEQ ID NO: 2064935 - protein, 25 aa, Staphylococcus
ENEKALWLHLKLDTGMGRLGMKDVE

SEQ ID NO: 2064936 - protein, 22 aa, Staphylococcus
ENEKLIDFISEKNIELSKEVMS

SEQ ID NO: 2064937 - protein, 27 aa, Staphylococcus
ENEKTAKILLLIYLEIMPLLSEWYEED

SEQ ID NO: 2064938 - protein, 17 aa, Staphylococcus
ENELPSNMIWFNLDNRD

SEQ ID NO: 2064939 - protein, 20 aa, Staphylococcus
ENELSGRVRILFQASEELGH

SEQ ID NO: 2064940 - protein, 36 aa, Staphylococcus
ENELTIKQLLDALNLWLIRINYLKQPKVYPSIETAQ

SEQ ID NO: 2064941 - protein, 29 aa, Staphylococcus
ENEPRQFKPLRRFFKIYVRGIRGASELRH

SEQ ID NO: 2064942 - protein, 27 aa, Staphylococcus
ENEPVPSKLFLISPLLDATLSNKMITE

SEQ ID NO: 2064943 - protein, 22 aa, Staphylococcus
ENERIKIRYLKCPCKIKHDEER

SEQ ID NO: 2064944 - protein, 26 aa, Staphylococcus
ENERKAVWAIYAVCRIIDDSIDVYED

SEQ ID NO: 2064945 - protein, 25 aa, Staphylococcus
ENERKAVWAIYAVCRMIDDSIDEYE

SEQ ID NO: 2064946 - protein, 22 aa, Staphylococcus
ENEVLELKRLKIANLALDENLK

SEQ ID NO: 2064947 - protein, 25 aa, Staphylococcus
ENEWKNYFHPFRASETFTIVPSWET

SEQ ID NO: 2064948 - protein, 29 aa, Staphylococcus
ENEYLNEAWFDLFKELGFKLGVLEFYLIE

SEQ ID NO: 2064949 - protein, 22 aa, Staphylococcus
ENEYPDFIPLGKPNPFCYIATL

SEQ ID NO: 2064950 - protein, 17 aa, Staphylococcus
ENEYWNHFEKGIYVDKI

SEQ ID NO: 2064951 - protein, 18 aa, Staphylococcus
ENFAISIGIYNDGKPYAG

SEQ ID NO: 2064952 - protein, 20 aa, Staphylococcus
ENFDLGDIFHRVLKFISEKV

SEQ ID NO: 2064953 - protein, 31 aa, Staphylococcus
ENFDLIVDYCRKNNLFILTYEDGHIVYEGEH

SEQ ID NO: 2064954 - protein, 22 aa, Staphylococcus
ENFEMVNLFLDNIFYFQQNVED

SEQ ID NO: 2064955 - protein, 25 aa, Staphylococcus
ENFGVVMEGMRLLARSVFVLDQDNK

SEQ ID NO: 2064956 - protein, 26 aa, Staphylococcus
ENGGTQMFFFYQSLVERERRLTTLEY

SEQ ID NO: 2064957 - protein, 20 aa, Staphylococcus
ENGIPVYLGMPMGVVIEAEG

SEQ ID NO: 2064958 - protein, 31 aa, Staphylococcus
ENGKRNFPSIRTLFLLLVGFKNSKLSNQTRS

SEQ ID NO: 2064959 - protein, 38 aa, Staphylococcus
ENGKSYLDTFLEPTRLYVKPVLAVKEQVKLYAMTHITG

SEQ ID NO: 2064960 - protein, 24 aa, Staphylococcus
ENGPLHLELTLTRSKFEELADSLI

SEQ ID NO: 2064961 - protein, 24 aa, Staphylococcus
ENGRLALDLIGGFHFNAIEGEYCE

SEQ ID NO: 2064962 - protein, 29 aa, Staphylococcus
ENGSLILENIYFQHFYNVFEKGPIYNENG

SEQ ID NO: 2064963 - protein, 28 aa, Staphylococcus
ENGSPKPRLPFELIFHKNVYNSNKAHQK

SEQ ID NO: 2064964 - protein, 27 aa, Staphylococcus
ENGVLAGYPLIDVKARLFDGSYHDVDS

SEQ ID NO: 2064965 - protein, 25 aa, Staphylococcus
ENGYRSLHIVVSIPVFLADAVEVTP

SEQ ID NO: 2064966 - protein, 25 aa, Staphylococcus
ENGYRSLHIVVSIPVFLADRVEVTP

SEQ ID NO: 2064967 - protein, 26 aa, Staphylococcus
ENGYRSLHIVVSIPVFLADSVEIIPV

SEQ ID NO: 2064968 - protein, 19 aa, Staphylococcus
ENHFFGRVGLFRNQVGDQL

SEQ ID NO: 2064969 - protein, 19 aa, Staphylococcus
ENHLAFGTYAQNLMLLLYE

SEQ ID NO: 2064970 - protein, 20 aa, Staphylococcus
ENHMAFGAFAQNLMLLLHEA

SEQ ID NO: 2064971 - protein, 24 aa, Staphylococcus
ENHRKLFIAIAKDVRVILVKLADR

SEQ ID NO: 2064972 - protein, 25 aa, Staphylococcus
ENHVHPLMFLSEQDGFRIINEVQDA

SEQ ID NO: 2064973 - protein, 24 aa, Staphylococcus
ENHVHPLMFPSEQAGFRVINEVQD

SEQ ID NO: 2064974 - protein, 19 aa, Staphylococcus
ENIAMWIWDEFEQHLPGEH

SEQ ID NO: 2064975 - protein, 24 aa, Staphylococcus
ENIDFLREGGLGLFLIESLMDEVK

SEQ ID NO: 2064976 - protein, 27 aa, Staphylococcus
ENIDFLREGGLGLFLIESLMDEVKVYK

SEQ ID NO: 2064977 - protein, 29 aa, Staphylococcus
ENIDFLREGGLGLFLIESLMDEVTVYKES

SEQ ID NO: 2064978 - protein, 22 aa, Staphylococcus
ENIELNIPFIANHEINIVGIFR

SEQ ID NO: 2064979 - protein, 26 aa, Staphylococcus
ENIEWLIKEGYSLLTLPVAYGGEGAT

SEQ ID NO: 2064980 - protein, 26 aa, Staphylococcus
ENIFAIGDIVPGLPLAHKASYEAKVA

SEQ ID NO: 2064981 - protein, 18 aa, Staphylococcus
ENIKGSIVGFFTPELFHG

SEQ ID NO: 2064982 - protein, 29 aa, Staphylococcus
ENIKGTIIGFYTPELFHGIGSAGFHIHFA

SEQ ID NO: 2064983 - protein, 25 aa, Staphylococcus
ENIKQRFEAYGWNHILVKDGNDLEE

SEQ ID NO: 2064984 - protein, 24 aa, Staphylococcus
ENIKTDFHHYAFKPAQHNTEIVQA

SEQ ID NO: 2064985 - protein, 22 aa, Staphylococcus
ENIKTFFMAQTTDNLFIVTANP

SEQ ID NO: 2064986 - protein, 17 aa, Staphylococcus
ENILDVMVEPFFEWVIE

SEQ ID NO: 2064987 - protein, 30 aa, Staphylococcus
ENIMVINIYDWLSNFRLLTGSYYSSNTYIN

SEQ ID NO: 2064988 - protein, 23 aa, Staphylococcus
ENINFDYLFAAIGGGGLISGIST

SEQ ID NO: 2064989 - protein, 25 aa, Staphylococcus
ENINKTFGLIYSQRVLLTLINKGMV

SEQ ID NO: 2064990 - protein, 22 aa, Staphylococcus
ENIRLKYRYLDLRRPELAQTFK

SEQ ID NO: 2064991 - protein, 20 aa, Staphylococcus
ENIWINMHFIVDIKPLKHRK

SEQ ID NO: 2064992 - protein, 18 aa, Staphylococcus
ENKDVIIKAIRLMKVLDD

SEQ ID NO: 2064993 - protein, 26 aa, Staphylococcus
ENKELVHYFFNELAKYVKKHNALYLR

SEQ ID NO: 2064994 - protein, 27 aa, Staphylococcus
ENKELVHYFFRELKAYVKQYNALYMRV

SEQ ID NO: 2064995 - protein, 26 aa, Staphylococcus
ENKEMVITFFNWPNEHRGRVGSGQVG

SEQ ID NO: 2064996 - protein, 23 aa, Staphylococcus
ENKGKLILQVLSIDESGKLDVSV

SEQ ID NO: 2064997 - protein, 34 aa, Staphylococcus
ENKMQGLPNQPIKLYYNGPMFRYERKQKGRYRQF

SEQ ID NO: 2064998 - protein, 24 aa, Staphylococcus
ENKPMALIGIIELLKNAKNRKLQL

SEQ ID NO: 2064999 - protein, 23 aa, Staphylococcus
ENKVKVIAWYDNEWGYSNRVVEV

SEQ ID NO: 2065000 - protein, 22 aa, Staphylococcus
ENKVLQFYVRYGGEFQLKQGFS

SEQ ID NO: 2065001 - protein, 21 aa, Staphylococcus
ENKVSILIGHLTIKGGKTSDS

SEQ ID NO: 2065002 - protein, 23 aa, Staphylococcus
ENLDFYRDVLGLQLIKQTVNFDD

SEQ ID NO: 2065003 - protein, 24 aa, Staphylococcus
ENLHQFLFDFIFNIDEKYIRLYLQ

SEQ ID NO: 2065004 - protein, 25 aa, Staphylococcus
ENLNIPYDYILLATGFKSSILQQPM

SEQ ID NO: 2065005 - protein, 24 aa, Staphylococcus
ENLPIEEAILIEPYACSLHAVQRA

SEQ ID NO: 2065006 - protein, 20 aa, Staphylococcus
ENLTLPHTIQFYISNNEEIG

SEQ ID NO: 2065007 - protein, 23 aa, Staphylococcus
ENLVPDYLGGLLFDDIPYLEVAQ

SEQ ID NO: 2065008 - protein, 21 aa, Staphylococcus
ENMGLSYPDLIAKLINLAKER

SEQ ID NO: 2065009 - protein, 21 aa, Staphylococcus
ENMLNQLLDGGWPQPIVEAYG

SEQ ID NO: 2065010 - protein, 17 aa, Staphylococcus
ENMLRNALIIEDTGNNN

SEQ ID NO: 2065011 - protein, 19 aa, Staphylococcus
ENMWINMHYVHEIKPLKNR

SEQ ID NO: 2065012 - protein, 23 aa, Staphylococcus
ENNEFLLAGFNYEGQLAATLEIS

SEQ ID NO: 2065013 - protein, 24 aa, Staphylococcus
ENNFIIYHIQTDLGLIIKVKTDAS

SEQ ID NO: 2065014 - protein, 20 aa, Staphylococcus
ENNHIKIRYLPCPCKIKHDE

SEQ ID NO: 2065015 - protein, 18 aa, Staphylococcus
ENNHSDSDVFFRKTRRQH

SEQ ID NO: 2065016 - protein, 32 aa, Staphylococcus
ENNILKLVNDKLSYPVFVKPANLGSSVGISKC

SEQ ID NO: 2065017 - protein, 25 aa, Staphylococcus
ENNKTVYIRAPWGSLIELQTVPNGF

SEQ ID NO: 2065018 - protein, 24 aa, Staphylococcus
ENNLKIIPSCPFAKKVIEETPEFQ

SEQ ID NO: 2065019 - protein, 21 aa, Staphylococcus
ENNPYQLVYDIKGIGFNKADT

SEQ ID NO: 2065020 - protein, 20 aa, Staphylococcus
ENPFGYGRILRDSEGRLVSI

SEQ ID NO: 2065021 - protein, 19 aa, Staphylococcus
ENPIPMCGVPYHSANSYIE

SEQ ID NO: 2065022 - protein, 17 aa, Staphylococcus
ENPWERLERLREAIPNV

SEQ ID NO: 2065023 - protein, 35 aa, Staphylococcus
ENPWERLERLRKAIPNILFQILLRASNAVGYKNYA

SEQ ID NO: 2065024 - protein, 17 aa, Staphylococcus
ENPWERLERLRKAIPNV

SEQ ID NO: 2065025 - protein, 18 aa, Staphylococcus
ENPYFVSFIGDAPKDDPE

SEQ ID NO: 2065026 - protein, 21 aa, Staphylococcus
ENQHPLFRYLTDAAKGMLSEK

SEQ ID NO: 2065027 - protein, 19 aa, Staphylococcus
ENQLSALFLVLNESQSYST

SEQ ID NO: 2065028 - protein, 17 aa, Staphylococcus
ENQMYIQTWHGTPLKRL

SEQ ID NO: 2065029 - protein, 17 aa, Staphylococcus
ENQSAVILFKSLGFIIE

SEQ ID NO: 2065030 - protein, 24 aa, Staphylococcus
ENQTLFFGGLARIDYVSGGKRPLV

SEQ ID NO: 2065031 - protein, 23 aa, Staphylococcus
ENRDIPLLLYMLQKLLSELKKCN

SEQ ID NO: 2065032 - protein, 28 aa, Staphylococcus
ENRGNIPYTVFIDPPLSRVGLTAAEAEA

SEQ ID NO: 2065033 - protein, 27 aa, Staphylococcus
ENRGQIPYTVFIDPPLSRVGLTAAQAE

SEQ ID NO: 2065034 - protein, 23 aa, Staphylococcus
ENRIIMFGGGGYNLWRVVPRAWS

SEQ ID NO: 2065035 - protein, 20 aa, Staphylococcus
ENRIVQFYTDLNTDGRFLNV

SEQ ID NO: 2065036 - protein, 18 aa, Staphylococcus
ENRKIKAMPSVRKYAREK

SEQ ID NO: 2065037 - protein, 17 aa, Staphylococcus
ENRLHSIKAVMALTLGG

SEQ ID NO: 2065038 - protein, 19 aa, Staphylococcus
ENRLMQYLLSVDNISMVHN

SEQ ID NO: 2065039 - protein, 26 aa, Staphylococcus
ENRTLRAEIFLKEQFKRLEKEQIFVY

SEQ ID NO: 2065040 - protein, 30 aa, Staphylococcus
ENRYLTEDIAYGLVLWSSLGREIGVDTPNI

SEQ ID NO: 2065041 - protein, 31 aa, Staphylococcus
ENSDDILLSQYLFELLYALQKTFPKKFTYTE

SEQ ID NO: 2065042 - protein, 27 aa, Staphylococcus
ENSDLDYTIFRPAWLTNYDEIDYEVTQ

SEQ ID NO: 2065043 - protein, 33 aa, Staphylococcus
ENSDSEAFAKFFKLMLNQGINLAPSKFEAWFLT

SEQ ID NO: 2065044 - protein, 22 aa, Staphylococcus
ENSFLVFATKKGIVKRSALSNF

SEQ ID NO: 2065045 - protein, 23 aa, Staphylococcus
ENSQFLLKMKTDMPNVVVFTFND

SEQ ID NO: 2065046 - protein, 22 aa, Staphylococcus
ENTKALLFNLLDSPVKFTQHIG

SEQ ID NO: 2065047 - protein, 23 aa, Staphylococcus
ENTLLQFINDYNVSLIAIGNGTA

SEQ ID NO: 2065048 - protein, 23 aa, Staphylococcus
ENTPNLLPVLKEVGVVDSGGKGL

SEQ ID NO: 2065049 - protein, 25 aa, Staphylococcus
ENTQSRFEAYGWNYILVKDGNDLEE

SEQ ID NO: 2065050 - protein, 21 aa, Staphylococcus
ENTRKFVKAVCHLGKDIFGDK

SEQ ID NO: 2065051 - protein, 26 aa, Staphylococcus
ENTSSIDLLAIFKTNSISFSDIFNSD

SEQ ID NO: 2065052 - protein, 23 aa, Staphylococcus
ENVGYKFERWLDLAFYQYDLKAD

SEQ ID NO: 2065053 - protein, 25 aa, Staphylococcus
ENVIFIGLLCKDGQWHAVIFDIGRG

SEQ ID NO: 2065054 - protein, 18 aa, Staphylococcus
ENVINKSRFIAHIKPVES

SEQ ID NO: 2065055 - protein, 25 aa, Staphylococcus
ENVKGLYLYGSFGTGKSFILGAIAN

SEQ ID NO: 2065056 - protein, 19 aa, Staphylococcus
ENVLTSRKLSRHIEDKFAN

SEQ ID NO: 2065057 - protein, 26 aa, Staphylococcus
ENVPEPPMITIPLFGNPGIEDTVGDN

SEQ ID NO: 2065058 - protein, 20 aa, Staphylococcus
ENVRSNCGLGFKSFWESSTG

SEQ ID NO: 2065059 - protein, 22 aa, Staphylococcus
ENVTMELGGLAPLIVHEDADIE

SEQ ID NO: 2065060 - protein, 19 aa, Staphylococcus
ENWLRTTLKAINRELYEMS

SEQ ID NO: 2065061 - protein, 18 aa, Staphylococcus
ENYDTLLLGIEMSRDILY

SEQ ID NO: 2065062 - protein, 22 aa, Staphylococcus
ENYDVIYFAGGHGTIWDFKDNE

SEQ ID NO: 2065063 - protein, 18 aa, Staphylococcus
ENYEALLVYYKNSFDNPV

SEQ ID NO: 2065064 - protein, 17 aa, Staphylococcus
ENYFYSVIFVPTSEDHA

SEQ ID NO: 2065065 - protein, 17 aa, Staphylococcus
ENYIRRLERLETLSEGY

SEQ ID NO: 2065066 - protein, 27 aa, Staphylococcus
ENYKPSPDGILYILNKYNLHRNQTVYI

SEQ ID NO: 2065067 - protein, 24 aa, Staphylococcus
ENYNDLIIVVSEDDLWYFEDHEVL

SEQ ID NO: 2065068 - protein, 24 aa, Staphylococcus
ENYNDLILVVSEEDLWYFEDNEVL

SEQ ID NO: 2065069 - protein, 22 aa, Staphylococcus
ENYQIPVIYSTHPRSWKKIEER

SEQ ID NO: 2065070 - protein, 22 aa, Staphylococcus
ENYQNSMYPLLTSLSNAFGMKN

SEQ ID NO: 2065071 - protein, 23 aa, Staphylococcus
EPAKIFGLVHKGSIAVGKDADFV

SEQ ID NO: 2065072 - protein, 17 aa, Staphylococcus
EPAVDLGIIIATASSFK

SEQ ID NO: 2065073 - protein, 21 aa, Staphylococcus
EPAWGLFSGVFGKGDNINKVM

SEQ ID NO: 2065074 - protein, 23 aa, Staphylococcus
EPAYSFMIRVRLPGGTATPEQWI

SEQ ID NO: 2065075 - protein, 25 aa, Staphylococcus
EPDDTWEERIKLLEPYRVTKELIEK

SEQ ID NO: 2065076 - protein, 24 aa, Staphylococcus
EPDEVWEKRIKLLEPYRVTKEMME

SEQ ID NO: 2065077 - protein, 25 aa, Staphylococcus
EPDEVWKERIALLEPYRVDQAMIEK

SEQ ID NO: 2065078 - protein, 24 aa, Staphylococcus
EPDIKKVIFLVDRKDLDGQTLGEF

SEQ ID NO: 2065079 - protein, 24 aa, Staphylococcus
EPDIYLLGKSLGGGLYPISAVLAN

SEQ ID NO: 2065080 - protein, 24 aa, Staphylococcus
EPDKFKLTVLVDMFGRETPVEVEF

SEQ ID NO: 2065081 - protein, 22 aa, Staphylococcus
EPDSFVAFRSDWSKRWPNVEQF

SEQ ID NO: 2065082 - protein, 20 aa, Staphylococcus
EPEFFLFKLDDKGEPTLELN

SEQ ID NO: 2065083 - protein, 18 aa, Staphylococcus
EPEFFLFKLDEKGEPTLE

SEQ ID NO: 2065084 - protein, 20 aa, Staphylococcus
EPEFFLFKLDEKGEPTLELN

SEQ ID NO: 2065085 - protein, 22 aa, Staphylococcus
EPELIHALQYLDDYYHEAYIKD

SEQ ID NO: 2065086 - protein, 25 aa, Staphylococcus
EPGDKLKVYLKKNPNFKFPFDETTP

SEQ ID NO: 2065087 - protein, 26 aa, Staphylococcus
EPGETVYFILKETPFYAVSGGQVADK

SEQ ID NO: 2065088 - protein, 17 aa, Staphylococcus
EPGFFRRLKVMPHAQDV

SEQ ID NO: 2065089 - protein, 18 aa, Staphylococcus
EPGGLLMYGIPNMKLDKN

SEQ ID NO: 2065090 - protein, 23 aa, Staphylococcus
EPGGLLMYGIPNMKLDKTVVRRR

SEQ ID NO: 2065091 - protein, 19 aa, Staphylococcus
EPGSTFKSYGLAAAIQEGK

SEQ ID NO: 2065092 - protein, 18 aa, Staphylococcus
EPGSTFKTYGLAAAIQEG

SEQ ID NO: 2065093 - protein, 19 aa, Staphylococcus
EPGTNLLEFIRSRDTFVPA

SEQ ID NO: 2065094 - protein, 22 aa, Staphylococcus
EPGYKSVLIAVDRFVTATIEEA

SEQ ID NO: 2065095 - protein, 19 aa, Staphylococcus
EPHAQNLFRKLIKKMGSRE

SEQ ID NO: 2065096 - protein, 32 aa, Staphylococcus
EPIGDNGFGYDPIFYVPSLNKTMAQLSDSEKA

SEQ ID NO: 2065097 - protein, 21 aa, Staphylococcus
EPIMTKRRFSAFTGSGLEVFL

SEQ ID NO: 2065098 - protein, 18 aa, Staphylococcus
EPISRLLNALSVDVNPIP

SEQ ID NO: 2065099 - protein, 18 aa, Staphylococcus
EPITLSNGITLANRFVLS

SEQ ID NO: 2065100 - protein, 21 aa, Staphylococcus
EPKIHDFLPPDYGVARLQTTQ

SEQ ID NO: 2065101 - protein, 24 aa, Staphylococcus
EPKLNRNVLLDRFKYAQSINVNAH

SEQ ID NO: 2065102 - protein, 27 aa, Staphylococcus
EPKLNRNVLLERFQFAQQLNVPAHPVI

SEQ ID NO: 2065103 - protein, 17 aa, Staphylococcus
EPKNLLEHLATLIAKRI

SEQ ID NO: 2065104 - protein, 22 aa, Staphylococcus
EPKQWKYAMNSALPEDIYVNSV

SEQ ID NO: 2065105 - protein, 17 aa, Staphylococcus
EPKVAMLSFSTKGSAKS

SEQ ID NO: 2065106 - protein, 22 aa, Staphylococcus
EPLDVIDFHNFANKAYLILTDS

SEQ ID NO: 2065107 - protein, 25 aa, Staphylococcus
EPLDVLDFHNFAKQAYIILTDSGGI

SEQ ID NO: 2065108 - protein, 19 aa, Staphylococcus
EPLDVVDFHNFANKAYLIL

SEQ ID NO: 2065109 - protein, 27 aa, Staphylococcus
EPLEFEQWLAILLIKNNNLPSLKQLKI

SEQ ID NO: 2065110 - protein, 21 aa, Staphylococcus
EPLILIGFMGTGKSTLGEYIA

SEQ ID NO: 2065111 - protein, 24 aa, Staphylococcus
EPLKALIFDSEYDPYRGVISSIRV

SEQ ID NO: 2065112 - protein, 17 aa, Staphylococcus
EPLLKQIHLKIEKGSFH

SEQ ID NO: 2065113 - protein, 17 aa, Staphylococcus
EPLNLNLEDYRVMIVHP

SEQ ID NO: 2065114 - protein, 21 aa, Staphylococcus
EPLNRLFNESPVFSQIPGPNK

SEQ ID NO: 2065115 - protein, 22 aa, Staphylococcus
EPLNRLFNTSPVFSKIPGPNHV

SEQ ID NO: 2065116 - protein, 23 aa, Staphylococcus
EPLSVWHDMSFFIKQDSTHYTRF

SEQ ID NO: 2065117 - protein, 20 aa, Staphylococcus
EPLYMDHPQLFIYRRNYKND

SEQ ID NO: 2065118 - protein, 29 aa, Staphylococcus
EPNDPIIHYALAELLYYDGQYLRATSEYE

SEQ ID NO: 2065119 - protein, 26 aa, Staphylococcus
EPNFDFFNYAGIHRPVKIYTTPHTFI

SEQ ID NO: 2065120 - protein, 20 aa, Staphylococcus
EPNLLLTMCYADCVPIYFYS

SEQ ID NO: 2065121 - protein, 24 aa, Staphylococcus
EPNSVWHYMTFFEKQNDGSYRRFD

SEQ ID NO: 2065122 - protein, 20 aa, Staphylococcus
EPPCIYYYKCGGCQLQHMTY

SEQ ID NO: 2065123 - protein, 20 aa, Staphylococcus
EPPMLMISVGKQDGALKDTN

SEQ ID NO: 2065124 - protein, 21 aa, Staphylococcus
EPQDYFRLLVDSLEKYPVEFE

SEQ ID NO: 2065125 - protein, 30 aa, Staphylococcus
EPQNQGAWSFVYPYLSDLASDKYELQYSGR

SEQ ID NO: 2065126 - protein, 34 aa, Staphylococcus
EPQPPSEDFAFYAKTLPSTFIYSGAKPRKGKAYP

SEQ ID NO: 2065127 - protein, 35 aa, Staphylococcus
EPQPPSEDFAYYAQALPSTFLYSGAAPQQGHAYPH

SEQ ID NO: 2065128 - protein, 21 aa, Staphylococcus
EPQYLFGHLVKKIEKQAFEME

SEQ ID NO: 2065129 - protein, 21 aa, Staphylococcus
EPRDVANLVSFLASDDSDYIT

SEQ ID NO: 2065130 - protein, 21 aa, Staphylococcus
EPSEFLSEPYVIIGLNVIVAD

SEQ ID NO: 2065131 - protein, 32 aa, Staphylococcus
EPTDAQWEAMLLGWKVIPSVKSNAIILSNNKQ

SEQ ID NO: 2065132 - protein, 18 aa, Staphylococcus
EPTDLAIYIPKDGQINAN

SEQ ID NO: 2065133 - protein, 18 aa, Staphylococcus
EPTFFEFGDKFNSLVQIK

SEQ ID NO: 2065134 - protein, 25 aa, Staphylococcus
EPVIMDIALDILKLDKADVAMVGDL

SEQ ID NO: 2065135 - protein, 25 aa, Staphylococcus
EPVIMDIALDILKLDKSDVAMVGDL

SEQ ID NO: 2065136 - protein, 20 aa, Staphylococcus
EPVNLLEHLAERIAKRINSH

SEQ ID NO: 2065137 - protein, 23 aa, Staphylococcus
EPVTLLFTGPLTDLAKALKIEPS

SEQ ID NO: 2065138 - protein, 19 aa, Staphylococcus
EPVVDEMLVYLLKQANKAE

SEQ ID NO: 2065139 - protein, 34 aa, Staphylococcus
EPYGTILIIGPFNYPVQLLFEPLIGAIAAGNNAI

SEQ ID NO: 2065140 - protein, 34 aa, Staphylococcus
EPYGTVLIIGPFNYPFQLLIEPLIGAIAAGNTVI

SEQ ID NO: 2065141 - protein, 34 aa, Staphylococcus
EPYGTVLIIGPFNYPVQLLFEPLIGAIAAGNTAI

SEQ ID NO: 2065142 - protein, 33 aa, Staphylococcus
EPYGTVLIIGPFNYPVQLVFEPLIGAIAAGNTA

SEQ ID NO: 2065143 - protein, 26 aa, Staphylococcus
EPYIKNHELFYKLIDLVTEIAHKHNA

SEQ ID NO: 2065144 - protein, 31 aa, Staphylococcus
EPYKVFTSFYKKWRPYLMKRTVYNYDIKDLA

SEQ ID NO: 2065145 - protein, 17 aa, Staphylococcus
EPYLAARMLSSLHQISH

SEQ ID NO: 2065146 - protein, 21 aa, Staphylococcus
EPYLSTQWFVKMKPLAQRALD

SEQ ID NO: 2065147 - protein, 22 aa, Staphylococcus
EPYLSTQWFVKMKPLAQRALDN

SEQ ID NO: 2065148 - protein, 22 aa, Staphylococcus
EPYLSTQWFVKMKPLAQRSLDN

SEQ ID NO: 2065149 - protein, 24 aa, Staphylococcus
EPYNDINMWDYKALPNVFGGDSVK

SEQ ID NO: 2065150 - protein, 23 aa, Staphylococcus
EPYQGHLWIMDPIDGTANLVKQQ

SEQ ID NO: 2065151 - protein, 17 aa, Staphylococcus
EQAFLKEYKLRGLVNSD

SEQ ID NO: 2065152 - protein, 21 aa, Staphylococcus
EQAIIALRKSGVRITPQRQAI

SEQ ID NO: 2065153 - protein, 25 aa, Staphylococcus
EQAKAQNLFARWRKEETLYKEDEKE

SEQ ID NO: 2065154 - protein, 25 aa, Staphylococcus
EQAKAQNLFARWRKEETLYSEDEKK

SEQ ID NO: 2065155 - protein, 33 aa, Staphylococcus
EQAKEQFGFLLDAFKYGAPPHGGIALGLDRLVM

SEQ ID NO: 2065156 - protein, 26 aa, Staphylococcus
EQAKLRKIYLEEFRKGFKQQIEHTKV

SEQ ID NO: 2065157 - protein, 18 aa, Staphylococcus
EQAKVMLMPFYSLTNEDD

SEQ ID NO: 2065158 - protein, 19 aa, Staphylococcus
EQALLEIYERLRPGEPPTV

SEQ ID NO: 2065159 - protein, 20 aa, Staphylococcus
EQALTLVKKKSILSSGASIV

SEQ ID NO: 2065160 - protein, 33 aa, Staphylococcus
EQAQEQFGFLLDAFKYGAPPHGGIALGLDRFVM

SEQ ID NO: 2065161 - protein, 29 aa, Staphylococcus
EQAQMLNERLLNMIGVHTVSIDIERNKIN

SEQ ID NO: 2065162 - protein, 33 aa, Staphylococcus
EQARDQFGFLLDAFKYGAPPHGGIALGLDRLVM

SEQ ID NO: 2065163 - protein, 33 aa, Staphylococcus
EQAREQFGFLLDAFKYGAPPHGGIALGLDRLVM

SEQ ID NO: 2065164 - protein, 18 aa, Staphylococcus
EQAVLCGGIHKLIQSGFE

SEQ ID NO: 2065165 - protein, 19 aa, Staphylococcus
EQAVLCGGIHKLIQSGFET

SEQ ID NO: 2065166 - protein, 21 aa, Staphylococcus
EQAVLCGGIHKLIQSGFETLV

SEQ ID NO: 2065167 - protein, 24 aa, Staphylococcus
EQCRAQLIELPFTSTAKELGTALM

SEQ ID NO: 2065168 - protein, 25 aa, Staphylococcus
EQDDIKKVIFLVDRKDLDSQTEEEF

SEQ ID NO: 2065169 - protein, 30 aa, Staphylococcus
EQDEDVLDTWFSSALWPFSTLGWPNESADD

SEQ ID NO: 2065170 - protein, 31 aa, Staphylococcus
EQDGRHAIQYLKQRNLGRATFLPLNVIQPRR

SEQ ID NO: 2065171 - protein, 28 aa, Staphylococcus
EQDIQRIEHMLRYALIIEDNGDNNVIQI

SEQ ID NO: 2065172 - protein, 23 aa, Staphylococcus
EQDKETIYVAKNKSPLLVGVGEG

SEQ ID NO: 2065173 - protein, 24 aa, Staphylococcus
EQDLPNLQRLGLGNIAPLPVVEEV

SEQ ID NO: 2065174 - protein, 18 aa, Staphylococcus
EQDLVECIVTLPGQLFYS

SEQ ID NO: 2065175 - protein, 23 aa, Staphylococcus
EQDQPILYSLNYIKSSLVKFKIN

SEQ ID NO: 2065176 - protein, 29 aa, Staphylococcus
EQDVYLLNGPLDLTFIFGLVDHLSHKLKY

SEQ ID NO: 2065177 - protein, 27 aa, Staphylococcus
EQDYQELFKLMFYTGLRIGEAMALVWT

SEQ ID NO: 2065178 - protein, 22 aa, Staphylococcus
EQDYYLFGHSMGTKIVYELALK

SEQ ID NO: 2065179 - protein, 17 aa, Staphylococcus
EQEAVLRMLYNNLDPEV

SEQ ID NO: 2065180 - protein, 28 aa, Staphylococcus
EQEEKYLRLYAEFENYKRRIQNENQTLK

SEQ ID NO: 2065181 - protein, 18 aa, Staphylococcus
EQEFEEFVEQLIYFKKLF

SEQ ID NO: 2065182 - protein, 18 aa, Staphylococcus
EQEKANITIFPKIENQEG

SEQ ID NO: 2065183 - protein, 20 aa, Staphylococcus
EQELTAPFNKKFLGNIIAEV

SEQ ID NO: 2065184 - protein, 27 aa, Staphylococcus
EQERVKFWIIKLLELHTLKKAYKTEAN

SEQ ID NO: 2065185 - protein, 19 aa, Staphylococcus
EQEYPQYLLEDVMESISPK

SEQ ID NO: 2065186 - protein, 18 aa, Staphylococcus
EQFDAIILCTGAQKARDL

SEQ ID NO: 2065187 - protein, 31 aa, Staphylococcus
EQFDQVIGVNLGGVFWGIQAALEQFNKLGHG

SEQ ID NO: 2065188 - protein, 28 aa, Staphylococcus
EQFDSDLPYKLIAKLLNDFNKRVDNISS

SEQ ID NO: 2065189 - protein, 26 aa, Staphylococcus
EQFQFQTFMLNALSKAYYAHGWVMQI

SEQ ID NO: 2065190 - protein, 17 aa, Staphylococcus
EQFREMSFGLAEMGFKG

SEQ ID NO: 2065191 - protein, 17 aa, Staphylococcus
EQFRQLEPLNDLLDLLE

SEQ ID NO: 2065192 - protein, 27 aa, Staphylococcus
EQGGRLVIPEFINPTIKFAMISSIDIA

SEQ ID NO: 2065193 - protein, 19 aa, Staphylococcus
EQGLFDAIFFADNQSFPAS

SEQ ID NO: 2065194 - protein, 24 aa, Staphylococcus
EQGLKHHILDMSLLSQLTPNALTQ

SEQ ID NO: 2065195 - protein, 23 aa, Staphylococcus
EQHDFEMDFPYELTPDQAKSIEE

SEQ ID NO: 2065196 - protein, 20 aa, Staphylococcus
EQHELRQEYLKMIRGQVVST

SEQ ID NO: 2065197 - protein, 20 aa, Staphylococcus
EQHFQAMYIMLNAVKYPYPD

SEQ ID NO: 2065198 - protein, 28 aa, Staphylococcus
EQHIDLIDLVVVNLYPFQKTVENPDVTE

SEQ ID NO: 2065199 - protein, 27 aa, Staphylococcus
EQHIDLIDMVVVNLYPFQKTVAKPDVT

SEQ ID NO: 2065200 - protein, 27 aa, Staphylococcus
EQHIDLIDMVVVNLYPFQKTVENPDVT

SEQ ID NO: 2065201 - protein, 27 aa, Staphylococcus
EQHIDLIDMVVVNLYPFQQTVANPDVT

SEQ ID NO: 2065202 - protein, 23 aa, Staphylococcus
EQHIQIIEKINVPVIIVGQEHAQ

SEQ ID NO: 2065203 - protein, 24 aa, Staphylococcus
EQHKLHQHLIEMTGVSAVQVDMDS

SEQ ID NO: 2065204 - protein, 18 aa, Staphylococcus
EQHLLSLLSAEGVQWIVL

SEQ ID NO: 2065205 - protein, 23 aa, Staphylococcus
EQIDQFELQLLLDGPHDANNAIL

SEQ ID NO: 2065206 - protein, 20 aa, Staphylococcus
EQIFKLNDYKEKLIIPGFFG

SEQ ID NO: 2065207 - protein, 17 aa, Staphylococcus
EQIIKFNEDLRTMSKQG

SEQ ID NO: 2065208 - protein, 18 aa, Staphylococcus
EQIIRPTGLLDPKIDVRP

SEQ ID NO: 2065209 - protein, 26 aa, Staphylococcus
EQIKPHPYIIDIPKKVFADLEIKPNT

SEQ ID NO: 2065210 - protein, 26 aa, Staphylococcus
EQITGKLIHYLWTDVNKASFSEVSLF

SEQ ID NO: 2065211 - protein, 17 aa, Staphylococcus
EQKAIILYALIQSKHAV

SEQ ID NO: 2065212 - protein, 26 aa, Staphylococcus
EQKEDALDFTLWKKAKPGEISWESPF

SEQ ID NO: 2065213 - protein, 25 aa, Staphylococcus
EQKGIAFLLIRFKTLDEVYLLPYVP

SEQ ID NO: 2065214 - protein, 36 aa, Staphylococcus
EQKLIQLLHSEEVEWIILAGYMRLVGPDLLNAYEGK

SEQ ID NO: 2065215 - protein, 32 aa, Staphylococcus
EQKLTLENYVLIYYLERILTQANQRLAIMTGQ

SEQ ID NO: 2065216 - protein, 17 aa, Staphylococcus
EQKNVLNLFSYTGAFSV

SEQ ID NO: 2065217 - protein, 21 aa, Staphylococcus
EQKRLTVGLVLNKQKKLYIFD

SEQ ID NO: 2065218 - protein, 17 aa, Staphylococcus
EQKVIILYALIQSKHAV

SEQ ID NO: 2065219 - protein, 19 aa, Staphylococcus
EQLGYQRYWIAEHHQVLSV

SEQ ID NO: 2065220 - protein, 26 aa, Staphylococcus
EQLKGSDVLVCTVIGFPLGASTTETK

SEQ ID NO: 2065221 - protein, 19 aa, Staphylococcus
EQLLKEVWHYEFYGDLRTV

SEQ ID NO: 2065222 - protein, 20 aa, Staphylococcus
EQLLKEVWHYEFYGDLRTVD

SEQ ID NO: 2065223 - protein, 18 aa, Staphylococcus
EQLLYLLENLNKTYAHLT

SEQ ID NO: 2065224 - protein, 24 aa, Staphylococcus
EQLNGRVRFLFQPAEELGYGAKVM

SEQ ID NO: 2065225 - protein, 23 aa, Staphylococcus
EQLPIWIADYVLSTYGTGAVMAV

SEQ ID NO: 2065226 - protein, 27 aa, Staphylococcus
EQLQEKLFPIEYGLKGLPSIEIYNEDI

SEQ ID NO: 2065227 - protein, 24 aa, Staphylococcus
EQLRQKMGMVFQNFNLFPHKKVKE

SEQ ID NO: 2065228 - protein, 24 aa, Staphylococcus
EQLSLELQILFWNMVKERDNQPHT

SEQ ID NO: 2065229 - protein, 17 aa, Staphylococcus
EQLVFDLAKTGVGVMWI

SEQ ID NO: 2065230 - protein, 33 aa, Staphylococcus
EQLYIQSHPIYWQLQLLYLLVKTPQNLNEFNEK

SEQ ID NO: 2065231 - protein, 20 aa, Staphylococcus
EQMELEFFCKPGEEIEWQNF

SEQ ID NO: 2065232 - protein, 20 aa, Staphylococcus
EQMELEFFCKPGEEIEWQNY

SEQ ID NO: 2065233 - protein, 27 aa, Staphylococcus
EQMIFNKPVITPVKPYKNFYPAEGYHQ

SEQ ID NO: 2065234 - protein, 25 aa, Staphylococcus
EQMIQSHLKSQFESLGLLVQEDNAS

SEQ ID NO: 2065235 - protein, 23 aa, Staphylococcus
EQMNHEYFAAHAYMAMAAYCDKE

SEQ ID NO: 2065236 - protein, 22 aa, Staphylococcus
EQMNHEYFAAHAYMAMASYCDS

SEQ ID NO: 2065237 - protein, 25 aa, Staphylococcus
EQMQKIIIFITHDLNEALRIGDRIA

SEQ ID NO: 2065238 - protein, 26 aa, Staphylococcus
EQNARTLAFIYHSKIRVIAPDNLLQK

SEQ ID NO: 2065239 - protein, 23 aa, Staphylococcus
EQNDLLLDILTPKQSYADKDEFS

SEQ ID NO: 2065240 - protein, 29 aa, Staphylococcus
EQNIAYQYATIRNILYSKGYTTEMLINYE

SEQ ID NO: 2065241 - protein, 23 aa, Staphylococcus
EQNNPILYSLNYMKSSLVKFRIT

SEQ ID NO: 2065242 - protein, 18 aa, Staphylococcus
EQNQVFQIALIGYTNAGK

SEQ ID NO: 2065243 - protein, 25 aa, Staphylococcus
EQNVAPLELALSSGATFVAQGFSSD

SEQ ID NO: 2065244 - protein, 24 aa, Staphylococcus
EQNVAPLELALSSGATFVGQGFSS

SEQ ID NO: 2065245 - protein, 19 aa, Staphylococcus
EQNVFLLTEYIQKGKKDKA

SEQ ID NO: 2065246 - protein, 24 aa, Staphylococcus
EQPDGLFYIIADANIKELAMNTSE

SEQ ID NO: 2065247 - protein, 23 aa, Staphylococcus
EQPDIILLDLGLPDIDGLSLIQQ

SEQ ID NO: 2065248 - protein, 22 aa, Staphylococcus
EQPEQLLQYYPFELSGGMAQRV

SEQ ID NO: 2065249 - protein, 17 aa, Staphylococcus
EQPERGKIYDRNGKILA

SEQ ID NO: 2065250 - protein, 23 aa, Staphylococcus
EQPERGKIYDRNGKVLAEDVERF

SEQ ID NO: 2065251 - protein, 23 aa, Staphylococcus
EQPERGKIYDRNGKVLAEDVERY

SEQ ID NO: 2065252 - protein, 23 aa, Staphylococcus
EQPLTFPLMALIVSGGHTELVYM

SEQ ID NO: 2065253 - protein, 23 aa, Staphylococcus
EQPTKIQLWLPIQQETYHVDSED

SEQ ID NO: 2065254 - protein, 22 aa, Staphylococcus
EQQALRQDYLAMIRGQVLHTFS

SEQ ID NO: 2065255 - protein, 22 aa, Staphylococcus
EQQAYYLPKLQSHELRTCFALT

SEQ ID NO: 2065256 - protein, 17 aa, Staphylococcus
EQQGFKVEFADYLPGDE

SEQ ID NO: 2065257 - protein, 21 aa, Staphylococcus
EQQHWLSGYLLNPATTSVSDN

SEQ ID NO: 2065258 - protein, 26 aa, Staphylococcus
EQQKGYYVAVYIAYEAAPYFNKHMCV

SEQ ID NO: 2065259 - protein, 33 aa, Staphylococcus
EQQLKPFGLTYSQYLVLLALWEEDNRTLHEIGR

SEQ ID NO: 2065260 - protein, 33 aa, Staphylococcus
EQQLKPFGLTYSQYLVLLALWEHDNQPLHEVGK

SEQ ID NO: 2065261 - protein, 36 aa, Staphylococcus
EQQLLKHLSDEGVQWIVLAGYMRLVGQDLLQAFEGR

SEQ ID NO: 2065262 - protein, 23 aa, Staphylococcus
EQQQHILHIIKHISYRHGQNNEV

SEQ ID NO: 2065263 - protein, 24 aa, Staphylococcus
EQQRRAIWAIYAVCRIVDDSIDVH

SEQ ID NO: 2065264 - protein, 19 aa, Staphylococcus
EQQTEVPSWLPMLLRVTNK

SEQ ID NO: 2065265 - protein, 25 aa, Staphylococcus
EQQVKVLARGPVFKGLLTSNSVDAL

SEQ ID NO: 2065266 - protein, 19 aa, Staphylococcus
EQQWLILQISGYKQYEIAQ

SEQ ID NO: 2065267 - protein, 25 aa, Staphylococcus
EQRIPKIVIVIDELADLMMIAPQEV

SEQ ID NO: 2065268 - protein, 27 aa, Staphylococcus
EQRISNFLIWQISYSEFIFDQKLWPDF

SEQ ID NO: 2065269 - protein, 24 aa, Staphylococcus
EQRISNFLIWQSSYSEFIFNEKLW

SEQ ID NO: 2065270 - protein, 26 aa, Staphylococcus
EQRISNFLIWQVSYSEFIFNEKLWPD

SEQ ID NO: 2065271 - protein, 23 aa, Staphylococcus
EQRKKIFAMCRDIELHWGEPVES

SEQ ID NO: 2065272 - protein, 23 aa, Staphylococcus
EQRKMMLESIRYVDLVIPENDWG

SEQ ID NO: 2065273 - protein, 18 aa, Staphylococcus
EQRKRYHKLYASGLMQED

SEQ ID NO: 2065274 - protein, 26 aa, Staphylococcus
EQRLPKIVIVIDELADLMMMAPQEVE

SEQ ID NO: 2065275 - protein, 24 aa, Staphylococcus
EQRLSNFLIWQASYSEFIFNEKLW

SEQ ID NO: 2065276 - protein, 25 aa, Staphylococcus
EQRMPKIVIVIDELADLMMMAPQEV

SEQ ID NO: 2065277 - protein, 26 aa, Staphylococcus
EQRMPKIVIVIDELADLMMMAPQEVE

SEQ ID NO: 2065278 - protein, 28 aa, Staphylococcus
EQRQERLLNGMWQFPMFEAPNTLEQLEN

SEQ ID NO: 2065279 - protein, 20 aa, Staphylococcus
EQRQPIHFKWKDEAVVGVML

SEQ ID NO: 2065280 - protein, 23 aa, Staphylococcus
EQRRAEFLAGRFACKEAFSKALG

SEQ ID NO: 2065281 - protein, 24 aa, Staphylococcus
EQRVEDIFFEVFDVLQELGLTKVN

SEQ ID NO: 2065282 - protein, 29 aa, Staphylococcus
EQRVLVKRAFIGSFLFGGNFDSPKFKLKQ

SEQ ID NO: 2065283 - protein, 23 aa, Staphylococcus
EQSFIDFKFHELILRGEIMNVVI

SEQ ID NO: 2065284 - protein, 21 aa, Staphylococcus
EQSIYDVLTALELDPKRVIVE

SEQ ID NO: 2065285 - protein, 28 aa, Staphylococcus
EQSKLRKAYLESFRKNFKQQIESTRVID

SEQ ID NO: 2065286 - protein, 23 aa, Staphylococcus
EQSKPFYNYLNKYQQAFKEQEHI

SEQ ID NO: 2065287 - protein, 23 aa, Staphylococcus
EQSMYNYMESAYYRALEQQAGIL

SEQ ID NO: 2065288 - protein, 28 aa, Staphylococcus
EQSRAEWLMLDLFEWSRTDYLMHMYDEM

SEQ ID NO: 2065289 - protein, 28 aa, Staphylococcus
EQSRAEWLMLDLFGWSRTDYLIHMYDDM

SEQ ID NO: 2065290 - protein, 28 aa, Staphylococcus
EQSRAEWLMLDLFHWTRTDYLMHMYDEM

SEQ ID NO: 2065291 - protein, 23 aa, Staphylococcus
EQSRQFIFKNIDTNAIKATMDDG

SEQ ID NO: 2065292 - protein, 18 aa, Staphylococcus
EQSTDKVILLFTGPLTDL

SEQ ID NO: 2065293 - protein, 18 aa, Staphylococcus
EQSVIEGHPLHPGAKLRK

SEQ ID NO: 2065294 - protein, 17 aa, Staphylococcus
EQTEVRLVLSFLRTVDN

SEQ ID NO: 2065295 - protein, 40 aa, Staphylococcus
EQTEVRLVLSFLRTVDNPLQDIYLVGLMRSVIYQFTEDEL

SEQ ID NO: 2065296 - protein, 27 aa, Staphylococcus
EQTITRFRDGGRLIYIGAGTSGRLGVL

SEQ ID NO: 2065297 - protein, 26 aa, Staphylococcus
EQTQQLIFTELWTRMIFEEINLYLNQ

SEQ ID NO: 2065298 - protein, 37 aa, Staphylococcus
EQTSWQLLYLNQPHADLKPPFFIQWSKSEEEREEALK

SEQ ID NO: 2065299 - protein, 24 aa, Staphylococcus
EQTYNGLWFSPLTDSLKQFIDSTQ

SEQ ID NO: 2065300 - protein, 24 aa, Staphylococcus
EQTYNGLWFSPLTDSLKTFIDSTQ

SEQ ID NO: 2065301 - protein, 28 aa, Staphylococcus
EQVEIHIERLFKYSPELVYSAWTDINLL

SEQ ID NO: 2065302 - protein, 23 aa, Staphylococcus
EQVNYDKLFLSPGGKPVTPPVEG

SEQ ID NO: 2065303 - protein, 26 aa, Staphylococcus
EQVQQGNLFLLLAKENWHEGVLGIVA

SEQ ID NO: 2065304 - protein, 25 aa, Staphylococcus
EQVVNLFHRKGPFEDIPIQPTLGME

SEQ ID NO: 2065305 - protein, 22 aa, Staphylococcus
EQVVNLFHRKGQFTDTVINDTI

SEQ ID NO: 2065306 - protein, 21 aa, Staphylococcus
EQWHIKIAYDKFIIMAKYQQQ

SEQ ID NO: 2065307 - protein, 19 aa, Staphylococcus
EQYAIFFVGNVFHTMGAFS

SEQ ID NO: 2065308 - protein, 22 aa, Staphylococcus
EQYKWMHPCYTLNNKNVVLIHG

SEQ ID NO: 2065309 - protein, 20 aa, Staphylococcus
EQYLPHFFYEEEMSALFETV

SEQ ID NO: 2065310 - protein, 24 aa, Staphylococcus
EQYQTLPFDFLSDVVYQWERFARR

SEQ ID NO: 2065311 - protein, 17 aa, Staphylococcus
EQYRQLETTYLCSVIGI

SEQ ID NO: 2065312 - protein, 29 aa, Staphylococcus
EQYTKIYHSLYGLPTVALRFFNVYGPRQN

SEQ ID NO: 2065313 - protein, 21 aa, Staphylococcus
ERAAQEGCQFAFYGHTHVAKY

SEQ ID NO: 2065314 - protein, 25 aa, Staphylococcus
ERADKLYKWFSLINEHKDELAELIT

SEQ ID NO: 2065315 - protein, 18 aa, Staphylococcus
ERAFGPALLDIWNLDDIK

SEQ ID NO: 2065316 - protein, 19 aa, Staphylococcus
ERAFGPVLLDIWNLDDMKE

SEQ ID NO: 2065317 - protein, 26 aa, Staphylococcus
ERAFSYQLLIFAFKETAHNSVWIDDS

SEQ ID NO: 2065318 - protein, 25 aa, Staphylococcus
ERAGDKIVLPVDAKVAREFSNEAQF

SEQ ID NO: 2065319 - protein, 26 aa, Staphylococcus
ERAGVYGLIIPDLPFELGQQLKEQAH

SEQ ID NO: 2065320 - protein, 25 aa, Staphylococcus
ERAHRLIRKGAMLEKYFECEHLSPD

SEQ ID NO: 2065321 - protein, 18 aa, Staphylococcus
ERAIRIQAKIASLVTAFA

SEQ ID NO: 2065322 - protein, 22 aa, Staphylococcus
ERASFSSILFLLKADDISHFHR

SEQ ID NO: 2065323 - protein, 18 aa, Staphylococcus
ERDDVLPFCLHISGKPIV

SEQ ID NO: 2065324 - protein, 25 aa, Staphylococcus
ERDEPIMDEMLLYLLKQANRAEEAG

SEQ ID NO: 2065325 - protein, 21 aa, Staphylococcus
ERDFAFYRKPSADMLLKTEDL

SEQ ID NO: 2065326 - protein, 19 aa, Staphylococcus
ERDIAGYYLVVQEQRNLSN

SEQ ID NO: 2065327 - protein, 18 aa, Staphylococcus
ERDIFFHHPYESFEPIVD

SEQ ID NO: 2065328 - protein, 22 aa, Staphylococcus
ERDYIRNTKPSGYRSYHVIIEY

SEQ ID NO: 2065329 - protein, 20 aa, Staphylococcus
EREALALKYLPSLKFSHQDQ

SEQ ID NO: 2065330 - protein, 22 aa, Staphylococcus
EREDLGLLVDFLAELFKEEGHK

SEQ ID NO: 2065331 - protein, 24 aa, Staphylococcus
EREHLELYFTSLSHKTIVYKGWLR

SEQ ID NO: 2065332 - protein, 18 aa, Staphylococcus
EREISFVELVPYTEKLIS

SEQ ID NO: 2065333 - protein, 23 aa, Staphylococcus
EREKLGLKYLPSLKLSDYEKEES

SEQ ID NO: 2065334 - protein, 32 aa, Staphylococcus
EREKLSFGVINILLQFVMLKNEMKLPKSYIFE

SEQ ID NO: 2065335 - protein, 32 aa, Staphylococcus
EREKLSFGVINILLQFVMLKNEMKLPKTYILE

SEQ ID NO: 2065336 - protein, 26 aa, Staphylococcus
ERELGFLALHGFLHLLGYDHMNEADE

SEQ ID NO: 2065337 - protein, 25 aa, Staphylococcus
ERELGFLALHGFLHLLGYDHMNEQD

SEQ ID NO: 2065338 - protein, 27 aa, Staphylococcus
ERELGFLALHGFLHLLGYDHMTDEDEK

SEQ ID NO: 2065339 - protein, 22 aa, Staphylococcus
ERETLSLTYLPSIKLSDMSKGE

SEQ ID NO: 2065340 - protein, 26 aa, Staphylococcus
ERFDNQYFLSLLSRIDIHLIAFDEAH

SEQ ID NO: 2065341 - protein, 26 aa, Staphylococcus
ERFENQYFLSQLRKVNIRLVAFDEAH

SEQ ID NO: 2065342 - protein, 21 aa, Staphylococcus
ERFERIFQQLKTQQIKFIAAS

SEQ ID NO: 2065343 - protein, 25 aa, Staphylococcus
ERFKEVFQIFSDVLGIPLKGKQQDE

SEQ ID NO: 2065344 - protein, 18 aa, Staphylococcus
ERFVRITNFPFYYRGEVY

SEQ ID NO: 2065345 - protein, 17 aa, Staphylococcus
ERGFIQIKLDVKKGKIE

SEQ ID NO: 2065346 - protein, 18 aa, Staphylococcus
ERGITFDLLRLSVGLEDP

SEQ ID NO: 2065347 - protein, 23 aa, Staphylococcus
ERGITFGLFRLSVGLEQPEELID

SEQ ID NO: 2065348 - protein, 24 aa, Staphylococcus
ERGITFGLFRLSVGLEQPQELIAD

SEQ ID NO: 2065349 - protein, 22 aa, Staphylococcus
ERGKALVERLKTLIPRQQFEVP

SEQ ID NO: 2065350 - protein, 24 aa, Staphylococcus
ERGRKTLLFGPMKPVGLEDPKTGK

SEQ ID NO: 2065351 - protein, 23 aa, Staphylococcus
ERGVEITSFFYNRMFTQHPELKN

SEQ ID NO: 2065352 - protein, 29 aa, Staphylococcus
ERHEYNLYGLLHRKIFYVNNSSIRHSDEL

SEQ ID NO: 2065353 - protein, 20 aa, Staphylococcus
ERHLAALSFLTFVALDENGK

SEQ ID NO: 2065354 - protein, 26 aa, Staphylococcus
ERIDDVVTSFVWFNDDYFTHEPNHVL

SEQ ID NO: 2065355 - protein, 25 aa, Staphylococcus
ERIFINHDCYFMDGGKIFIGDDVFI

SEQ ID NO: 2065356 - protein, 19 aa, Staphylococcus
ERIKTLSTPYFLKGENFRN

SEQ ID NO: 2065357 - protein, 18 aa, Staphylococcus
ERILADEEVLLQLVRDEL

SEQ ID NO: 2065358 - protein, 17 aa, Staphylococcus
ERIQFYNRTYDKALKFS

SEQ ID NO: 2065359 - protein, 23 aa, Staphylococcus
ERKKIYTNLKPWDRVQIARLQER

SEQ ID NO: 2065360 - protein, 23 aa, Staphylococcus
ERKKRLKPWLYDGTPQAVKPSEW

SEQ ID NO: 2065361 - protein, 23 aa, Staphylococcus
ERKNLFIEALKKHLSIYGSWNDP

SEQ ID NO: 2065362 - protein, 24 aa, Staphylococcus
ERKQLEPFILNLLDFESSKSDKLQ

SEQ ID NO: 2065363 - protein, 17 aa, Staphylococcus
ERKWYVIDAEGQTLGRL

SEQ ID NO: 2065364 - protein, 18 aa, Staphylococcus
ERLDKTLNFPKTCPHGGV

SEQ ID NO: 2065365 - protein, 30 aa, Staphylococcus
ERLEKLRTAIPNVLFQMLLRASNAVGYKNY

SEQ ID NO: 2065366 - protein, 30 aa, Staphylococcus
ERLERLREAIPNVLFQMLLRASNAVGYKNY

SEQ ID NO: 2065367 - protein, 29 aa, Staphylococcus
ERLERLRKAIPNVLFQMLLRASNAVGYKN

SEQ ID NO: 2065368 - protein, 21 aa, Staphylococcus
ERLFALLIQADGEPVLFCPKM

SEQ ID NO: 2065369 - protein, 25 aa, Staphylococcus
ERLGFPEARIPLSQAVIELCLSPKS

SEQ ID NO: 2065370 - protein, 20 aa, Staphylococcus
ERLGFPEARIPLSQAVIELS

SEQ ID NO: 2065371 - protein, 23 aa, Staphylococcus
ERLKGVFAWGFRIKSSEPEEGLP

SEQ ID NO: 2065372 - protein, 18 aa, Staphylococcus
ERLKLQLFDEVRTVFNAQ

SEQ ID NO: 2065373 - protein, 17 aa, Staphylococcus
ERLLRRSHNQRFLIVFS

SEQ ID NO: 2065374 - protein, 17 aa, Staphylococcus
ERLMRRSHNQRFLIVFS

SEQ ID NO: 2065375 - protein, 28 aa, Staphylococcus
ERLNDSGVLVCTVIGFPLGATTTATKIF

SEQ ID NO: 2065376 - protein, 22 aa, Staphylococcus
ERLNYGSPWFQLSNLHIKTSLE

SEQ ID NO: 2065377 - protein, 30 aa, Staphylococcus
ERLPVDELILYIYKIVYNGPLRLLSEHRHH

SEQ ID NO: 2065378 - protein, 17 aa, Staphylococcus
ERLQESAFLLKDLKITL

SEQ ID NO: 2065379 - protein, 18 aa, Staphylococcus
ERLRFDFSHFGPMTNEEI

SEQ ID NO: 2065380 - protein, 21 aa, Staphylococcus
ERLRLKTLFPYIREASENHKK

SEQ ID NO: 2065381 - protein, 24 aa, Staphylococcus
ERLRNYKTIFPDLSYFEIKLIIVG

SEQ ID NO: 2065382 - protein, 20 aa, Staphylococcus
ERLSKAKAFTLDILKSMKAY

SEQ ID NO: 2065383 - protein, 29 aa, Staphylococcus
ERLVVAHPFHPVYILPLVEIVPGAQTSEA

SEQ ID NO: 2065384 - protein, 19 aa, Staphylococcus
ERLYYLDLDSKYVSSLKLI

SEQ ID NO: 2065385 - protein, 21 aa, Staphylococcus
ERMAQLPILTDLYQEIHQKCD

SEQ ID NO: 2065386 - protein, 26 aa, Staphylococcus
ERMPINSLNLLTKQLLKIVEIITQQS
